United States Patent 8,461,315 (MICRORNAS AND USES THEREOF) - sequence listing, part 4

SEQ ID NO: 79696 - RNA, 64 nt, Homo Sapiens
uguguggauaagccaucauuuguuuauucauccauguguuaauggguuuccagucucggcucuu

SEQ ID NO: 79697 - RNA, 61 nt, Homo Sapiens
ggaaagagacuuugguguagagaaggcucuguguguuaacugaugggagagacuguuuguu

SEQ ID NO: 79698 - RNA, 64 nt, Homo Sapiens
cugcaaauaaugaguuugaaaagaaacaaugaaauguguuaaaaauuugaccauauuagauaaa

SEQ ID NO: 79699 - RNA, 64 nt, Homo Sapiens
caaauugugugaagcgagguuuguugagcugcauuguguuaaacgggcauaaacauguucauuc

SEQ ID NO: 79700 - RNA, 64 nt, Homo Sapiens
cacuuauuaugguauaacucccuauguacuuuucuguguuaacugggucucugugauuucccca

SEQ ID NO: 79701 - RNA, 64 nt, Homo Sapiens
guauuacagcaauauucaaagaaagaaccacagauguguuaaccauuuaagcagaucaucugcc

SEQ ID NO: 79702 - RNA, 64 nt, Homo Sapiens
cccuuuagaauggcuugucccaucagcagaugaauguguuaagcacaaagcaucuuccuuaaag

SEQ ID NO: 79703 - RNA, 64 nt, Homo Sapiens
aacacugaucugaucauuuguguaaccuuucauguguguuaagaucuuaucugaaaauuucauc

SEQ ID NO: 79704 - RNA, 64 nt, Homo Sapiens
uaguacugaauggaguauuucacugaugcagauuuguguuaagaggauuuugccaguuucuuuu

SEQ ID NO: 79705 - RNA, 64 nt, Homo Sapiens
acaauauuguuccuguccauucacccagccaaauuguguuaaagaggaaagccccacaaacuaa

SEQ ID NO: 79706 - RNA, 64 nt, Homo Sapiens
ggaaagagguguuccucauuaucuaauauuucaauguguuaagaguuuaauuuuuuuguuauca

SEQ ID NO: 79707 - RNA, 64 nt, Homo Sapiens
cauuuuagaaacaucuuagccguaaguuagguccuguguuaaacuguuuagugcucuguuuuua

SEQ ID NO: 79708 - RNA, 64 nt, Homo Sapiens
gauacaguuuggcuguguccccaccaaauugaauuguguuaauaguucccauaaucccuacgug

SEQ ID NO: 79709 - RNA, 64 nt, Homo Sapiens
aagaagcuuagugaggagcaguaguuguuauagguguguuaacguuugugcucaggcuacuaaa

SEQ ID NO: 79710 - RNA, 64 nt, Homo Sapiens
aaggggaaaaaaaaauaaccccauuggcuugugcuguguuaagagggucugaaugucuagcugg

SEQ ID NO: 79711 - RNA, 64 nt, Homo Sapiens
auuuaguuuuaagacaguaaacacacauucccuuuguguuaauauuaacagaauggcagacuaa

SEQ ID NO: 79712 - RNA, 64 nt, Homo Sapiens
gauuauaggacugucuuugaaauacagugcaaaauguguuaaggauuaggugugaaaauaggaa

SEQ ID NO: 79713 - RNA, 64 nt, Homo Sapiens
aaagugcguuuucuguuuucauuuaauucaguuuuguguuaaggguggaacaaagcucuguucu

SEQ ID NO: 79714 - RNA, 64 nt, Homo Sapiens
ccaauaugcgaaaaaaggguacauuuuaauuuaauguguuaaaaacacaaugucccuaccgugu

SEQ ID NO: 79715 - RNA, 64 nt, Homo Sapiens
guucuagcuuuagauuuuggauuuucaccagucauguguuaauuuacauuagauaguaaagaau

SEQ ID NO: 79716 - RNA, 64 nt, Homo Sapiens
cagguuguucauaauauuaaaaaucuuacguaguuguguuaaacugaaccaguucauuauaccu

SEQ ID NO: 79717 - RNA, 64 nt, Homo Sapiens
aacuacagaauacuaaauaaagaccauuuaaguguguguuaaaccccuuucccuucccccaaua

SEQ ID NO: 79718 - RNA, 64 nt, Homo Sapiens
cuuguacuaguguuguaacuaagcaaauguuaaauguguuaagacuuucgcauugcuuuucaac

SEQ ID NO: 79719 - RNA, 64 nt, Homo Sapiens
gcugggauuacaggugugccaccgcgcccggccaagaugggaguauuuuuauggccauuuuaca

SEQ ID NO: 79720 - RNA, 64 nt, Homo Sapiens
ggccaagaugggaguauuuuuauggccauuuuacagaugggagaacagucucagcacaauugag

SEQ ID NO: 79721 - RNA, 64 nt, Homo Sapiens
gugguccugaacuggggccggguggggaagagugagaugggauaacauagccccugcuuggagg

SEQ ID NO: 79722 - RNA, 64 nt, Homo Sapiens
auugaucgaucgcuugagccuacuuaggaggcugagaugggaggcacacaccuguagucccagc

SEQ ID NO: 79723 - RNA, 64 nt, Homo Sapiens
cuuugacaaacaaauuauuuaaauaaaguuggggagaugggaauuuucugaaaaccaaugcgac

SEQ ID NO: 79724 - RNA, 64 nt, Homo Sapiens
aauaauagagagcuauggagucaaggcauguuuaagaugggagguagagcaugccaauauugau

SEQ ID NO: 79725 - RNA, 64 nt, Homo Sapiens
auugauggcaacagucaagauggugugaugagagagaugggaggggcacaaagaggaggacccc

SEQ ID NO: 79726 - RNA, 64 nt, Homo Sapiens
agguagccgaggacagugagaggaugucaggaugagaugggacccacaagauggaaggcaggug

SEQ ID NO: 79727 - RNA, 64 nt, Homo Sapiens
aaugaccaucugggguaugggcugggcaugucauagaugggaugggcucucccuccaggcugcu

SEQ ID NO: 79728 - RNA, 64 nt, Homo Sapiens
auuuuucuuuucucucugucgaaccgaguuaucaagaugggagguagcuuccuaaggggggagg

SEQ ID NO: 79729 - RNA, 64 nt, Homo Sapiens
cacaugccuguggccccagccacucugaacgcugagaugggaaggucacuugagcccaggaccc

SEQ ID NO: 79730 - RNA, 64 nt, Homo Sapiens
gguuaauuguuuuuuuuuaauuuaucuuuuguagagaugggaucucacuauguugcucaggcug

SEQ ID NO: 79731 - RNA, 64 nt, Homo Sapiens
caggaucaaggaauuaggguggucuacuugaggcagaugggauaguagcugggaacuguucccu

SEQ ID NO: 79732 - RNA, 64 nt, Homo Sapiens
guguuuuuaagcaucccuugggcuuuggauuuggagaugggaagagcaucuccaggcaaugagu

SEQ ID NO: 79733 - RNA, 64 nt, Homo Sapiens
gcucacuuggucugagcucagcugaaugcagggaagaugggacagagugacauuucuccucugu

SEQ ID NO: 79734 - RNA, 64 nt, Homo Sapiens
caucuugaaaacucguggaaagggaaaggggaggagaugggacuuugaccacacacagugaugc

SEQ ID NO: 79735 - RNA, 64 nt, Homo Sapiens
aucacuugaaccugggaggcuacucgggaggcugagaugggagaugcgugccuguagucccagc

SEQ ID NO: 79736 - RNA, 64 nt, Homo Sapiens
gaauagugcagcuccauagaaucagaaauaauugagaugggaaaagagagaguguuuugguuac

SEQ ID NO: 79737 - RNA, 64 nt, Homo Sapiens
gcggcagagaaagaagaaagaccuagaagguuguagaugggaaaucaggaaugauuugaacuga

SEQ ID NO: 79738 - RNA, 64 nt, Homo Sapiens
gccauggcucucugagccugaggauggaaaugggagaugggagcuguuuugucagugucuuggg

SEQ ID NO: 79739 - RNA, 64 nt, Homo Sapiens
uuaaaccacuucuuauuaccugccagaugggaugagaugggaugaaccagugccaaauucugaa

SEQ ID NO: 79740 - RNA, 64 nt, Homo Sapiens
agaugggauguuaaaccacuaaauucugaaugccagaugggaugauauuucaauaaccagugcc

SEQ ID NO: 79741 - RNA, 64 nt, Homo Sapiens
uguaaaagaucaaguaugcuauacuaauugguggagaugggaaccauauaguggaaaucugcca

SEQ ID NO: 79742 - RNA, 64 nt, Homo Sapiens
cugugguacagauagacauggacgucacagucuaagaugggaaaacagccagcccuugccagcu

SEQ ID NO: 79743 - RNA, 64 nt, Homo Sapiens
cuucagguaggacaucaagguacuggagaauaacagaugggaugaggagauaaacaggguacug

SEQ ID NO: 79744 - RNA, 64 nt, Homo Sapiens
auuagugucuagaaauacucuauauuugaauauuagaugggaaaaccuuguggaaucuguuucc

SEQ ID NO: 79745 - RNA, 64 nt, Homo Sapiens
ucaccguauuagccaggauguggauuuuuaguagagaugggauucaccacacccggcuaauuuu

SEQ ID NO: 79746 - RNA, 64 nt, Homo Sapiens
ggcuuucucagugucagcacgagugacaggcaccagaugggauggaguggaguucucuguucua

SEQ ID NO: 79747 - RNA, 64 nt, Homo Sapiens
gacccucaagaaaaugacggagaacaucccagacagaugggacucaagcaggaugggugcuaua

SEQ ID NO: 79748 - RNA, 64 nt, Homo Sapiens
ccucucugguccucagcuuccuccaucauggaggagaugggaucauggauuuucugggcauaag

SEQ ID NO: 79749 - RNA, 64 nt, Homo Sapiens
aaacccagcuccucacuucccgcagaugcgguagagaugggaggugggguggcaguuggcacag

SEQ ID NO: 79750 - RNA, 64 nt, Homo Sapiens
uagugaaggggugacucccucaggguaucacuggagaugggaguaaguaggcuucagugcauac

SEQ ID NO: 79751 - RNA, 64 nt, Homo Sapiens
aagauuuuuguaaaaagcuacaaaaaacugcaguuugaucaaauuuggguauaugcaguaugcu

SEQ ID NO: 79752 - RNA, 64 nt, Homo Sapiens
acacaaggagaacccaauuuuguuucaacaauuuuugaucaauguauaugaagcucuugauagg

SEQ ID NO: 79753 - RNA, 64 nt, Homo Sapiens
cagaaauguacauacuacaucaucuacagaaaucuugaucaauaaccuagaaacuagguuaucu

SEQ ID NO: 79754 - RNA, 64 nt, Homo Sapiens
gaucaauaaccuagaaacuagguuaucuagguuauugaucaagauuucuguagaugaugcagug

SEQ ID NO: 79755 - RNA, 64 nt, Homo Sapiens
aacuaaaagccauauguggaauauugacauguguaagaagcacuuucagaauguuguccuuuuu

SEQ ID NO: 79756 - RNA, 64 nt, Homo Sapiens
auuugcguugcauaaauagccaugugaauuccacaagaagcaccagggaaaguuuagagauuug

SEQ ID NO: 79757 - RNA, 64 nt, Homo Sapiens
aacuuaguagaacugaaccaauguugggaaaaaaaagaagcauugacaagacugagagaguuac

SEQ ID NO: 79758 - RNA, 64 nt, Homo Sapiens
aguguaauuuuccuuuucccuauuugaugguacaaagaagcagaucacaugccauucaccagau

SEQ ID NO: 79759 - RNA, 64 nt, Homo Sapiens
gucauucuccagaaggaacuauagaagaccuugcaagaagcagagguauaauccaaccaucaaa

SEQ ID NO: 79760 - RNA, 64 nt, Homo Sapiens
caugcccaguauucccacucagcagccucagcagaagaagcagcuuuccuucuguaucacucca

SEQ ID NO: 79761 - RNA, 64 nt, Homo Sapiens
ccuuaauaucccacucaagguugaagaagaaaugaagaagcaugaaaguaauaaugugggauua

SEQ ID NO: 79762 - RNA, 64 nt, Homo Sapiens
ccagcuagaaaauuuuauggcuaucgaagaaaugaagaagcacggaaguacucaugucggauuc

SEQ ID NO: 79763 - RNA, 64 nt, Homo Sapiens
agauuguaauuugguuuauuuauuugaaaaugagaagaagcagcaacagugugaaucuuuauag

SEQ ID NO: 79764 - RNA, 64 nt, Homo Sapiens
agcagaaaccccugauaaacaagaaaaaaugaggaagaagcaaagacacuucuuacauuguggc

SEQ ID NO: 79765 - RNA, 64 nt, Homo Sapiens
aguggaaaccccugauaagcaagagaaaaugaggaagaagcaaaggcacuucuuacauggcagc

SEQ ID NO: 79766 - RNA, 64 nt, Homo Sapiens
ggucgugccaaagagguccaccaagauaacaaagaagaagcaauucuuucuugggccugcaccu

SEQ ID NO: 79767 - RNA, 64 nt, Homo Sapiens
ccaugggaaguguuuacacuaaccugggagacggaagaagcacgaccuuggcaucguugugccu

SEQ ID NO: 79768 - RNA, 64 nt, Homo Sapiens
ggguuuaaagaaauggucugcauaaccugaaugaaagaagcaaaugacuauucucugaagacaa

SEQ ID NO: 79769 - RNA, 64 nt, Homo Sapiens
agaugcugugguggaugagguuggaguucgaaagaagaagcaagcgcuggccuggccuugaaag

SEQ ID NO: 79770 - RNA, 64 nt, Homo Sapiens
gaaauaggaauccggcagaagaccuucauuaauuaagaagcaaacaaaaagagagcaacccaac

SEQ ID NO: 79771 - RNA, 64 nt, Homo Sapiens
cuuccaaacaaugugaauuuaaaaggucacacaaaagaagcaaucgggcuccgccaccacaaaa

SEQ ID NO: 79772 - RNA, 64 nt, Homo Sapiens
ugcuacauaauuauccaggaagggaauaagguacaagaagcauuuuguaaguugaagcaaaucg

SEQ ID NO: 79773 - RNA, 64 nt, Homo Sapiens
guggacuggccucaaagcaagcauucagaagaaaaagaagcaaccucaguaauuuagaaaucau

SEQ ID NO: 79774 - RNA, 64 nt, Homo Sapiens
ucuauuuuauacaucauuuccauuuuaaaucuccaagaagcaccaccuuugauacgcuaaugug

SEQ ID NO: 79775 - RNA, 64 nt, Homo Sapiens
cuguaauguuuuaugaacuguguagacuuugauaaagaagcauagagcucauguucuucugaua

SEQ ID NO: 79776 - RNA, 64 nt, Homo Sapiens
gcucuucuucauuucccagcguggcccugguuggaagaagcagcugucacagcugcuguagaca

SEQ ID NO: 79777 - RNA, 64 nt, Homo Sapiens
uuuaagaacauaauucuuuuguugcuguuuguuuaagaagcaccuuaguuuguuuaagaagcac

SEQ ID NO: 79778 - RNA, 64 nt, Homo Sapiens
uugcuguuuguuuaagaagcaccuuaguuuguuuaagaagcaccuuauauaguauaauauauau

SEQ ID NO: 79779 - RNA, 64 nt, Homo Sapiens
cagccuucucucccccauaagggcauuuuucuacaagaagcagucgugaggacaguugaauuug

SEQ ID NO: 79780 - RNA, 64 nt, Homo Sapiens
acagacuaguuuugaguaaacccggaagaagaggaagaagcagauggcucugacccccucucau

SEQ ID NO: 79781 - RNA, 64 nt, Homo Sapiens
uaagaagacagaaaaguguuuagacuugaucucaaagaagcagauaaggaagaagccucccaua

SEQ ID NO: 79782 - RNA, 64 nt, Homo Sapiens
ucuuaccaugaggugauuucgugaacugagccaaaagaagcaacccaaaugaaguuguucucag

SEQ ID NO: 79783 - RNA, 64 nt, Homo Sapiens
accccuacuugcugaagacaauguggaauacaagaagaagcaggauggaaacugugggacacag

SEQ ID NO: 79784 - RNA, 64 nt, Homo Sapiens
aacaauaucagcggauucggaaucuucgggauccaagaagcagaaaauggauuuccaccugaca

SEQ ID NO: 79785 - RNA, 64 nt, Homo Sapiens
acuucuuacauggcggcagcaagagaaaaugagaaagaagcaaaaguggaaaccccuaauaaac

SEQ ID NO: 79786 - RNA, 64 nt, Homo Sapiens
acuucguacauggugguggcaagagaaaaugaagaagaagcaaaaguggaaaccccugauaaac

SEQ ID NO: 79787 - RNA, 64 nt, Homo Sapiens
ccucuuucauguauuaaaauagcaaaacuuuuugaagaagcacccuaccuaauuaugugaaaga

SEQ ID NO: 79788 - RNA, 64 nt, Homo Sapiens
acuuuuugaagaagcaccccaccuaauuaugugaaagaagcaaauaucuaaccuacagaaaucu

SEQ ID NO: 79789 - RNA, 64 nt, Homo Sapiens
auugauguugucuuuaccagaaagguagacaaaaaagaagcagcagcagcucuuaaagugaggg

SEQ ID NO: 79790 - RNA, 64 nt, Homo Sapiens
auaacagguacuuugaaggcaagacauaggguugaagaagcacagccagccucugaaaucauag

SEQ ID NO: 79791 - RNA, 64 nt, Homo Sapiens
ggcaaucuugagucuauuauuauuuuggguagugaagaagcaaugcugcugcgcuagacuugga

SEQ ID NO: 79792 - RNA, 64 nt, Homo Sapiens
cccauuggugaggauauuauuccugagggguguuaagaagcaguuuaaccucagaauucauaau

SEQ ID NO: 79793 - RNA, 64 nt, Homo Sapiens
aaaauaugacuuauaaccaguaauguguuaugcaaagaagcaauuguccggcauccaaaaaaac

SEQ ID NO: 79794 - RNA, 64 nt, Homo Sapiens
ggaaagcagcaggcugaacaacugaggccaggaaaagaagcacuuugacuuaguacugacuugc

SEQ ID NO: 79795 - RNA, 64 nt, Homo Sapiens
aauuaauugaaggcagcaaaaggcacaguaggucaagaagcaggucucgaucccggaccagaag

SEQ ID NO: 79796 - RNA, 64 nt, Homo Sapiens
cccguucccguagucgcaaaucuuacagccggucaagaagcaggagcaggagccggagccggag

SEQ ID NO: 79797 - RNA, 64 nt, Homo Sapiens
uagaccaccugucccaggcuaucugaagugggagaagaagcaggagggcacacuggcagagggu

SEQ ID NO: 79798 - RNA, 64 nt, Homo Sapiens
agggguaugccuggcagguguuaugcugcuauugaagaagcauuuuagcagcugcaggcaagca

SEQ ID NO: 79799 - RNA, 64 nt, Homo Sapiens
cuucaaccagaagagugcgcugcaggugcacaugaagaagcacacgggggagcggcccuacaag

SEQ ID NO: 79800 - RNA, 64 nt, Homo Sapiens
aguaugucagauuuuccuucauguuucugguuauaagaagcauagcuuacaaagcaagcguaag

SEQ ID NO: 79801 - RNA, 64 nt, Homo Sapiens
gcaagcaacgguggcccuguccaccccagcaaauaagaagcauaucuguagcuuaaggccacga

SEQ ID NO: 79802 - RNA, 64 nt, Homo Sapiens
ggagaucacacaacauuuauucuucuuacagguaaagaagcagauuuuagaugaaaagaucuac

SEQ ID NO: 79803 - RNA, 64 nt, Homo Sapiens
gaugaguuggagaggaggcugcugcagaugaaagaagaagcaacaauggccaacgaagcacugg

SEQ ID NO: 79804 - RNA, 64 nt, Homo Sapiens
guaacaguguaguacucaguaacagugaaguacucaguaauacaguacaguauucaguaaggca

SEQ ID NO: 79805 - RNA, 64 nt, Homo Sapiens
uacaguacaguauucaguaaggcagugaaguacucaguaauacaauacaguacucaguuaggca

SEQ ID NO: 79806 - RNA, 64 nt, Homo Sapiens
ggcagugcaguacucaguaacacagugcaguacucaguaauacaguacaguacucaguaaggca

SEQ ID NO: 79807 - RNA, 64 nt, Homo Sapiens
uuuucuuucacuggccugaguuaggacaugcuaucaguaauagucccaguuccauccaacuuuc

SEQ ID NO: 79808 - RNA, 64 nt, Homo Sapiens
uguggucauuugguuccucuuucuuauuauaacucaguaauaccacugauuaauugguuacucc

SEQ ID NO: 79809 - RNA, 64 nt, Homo Sapiens
agauugcugcauaauuuaaaaacaagaucugggacaguaauaaagaugacagagaucuucauua

SEQ ID NO: 79810 - RNA, 64 nt, Homo Sapiens
aauuuaaaggaaaaauaggugccuccuuuauaaacaguaauagcuacguuugggaaggaggaaa

SEQ ID NO: 79811 - RNA, 64 nt, Homo Sapiens
auuuguaaaauuuaguaguucauauuuaguauaucaguaauauagaagacaucuuuauagucaa

SEQ ID NO: 79812 - RNA, 64 nt, Homo Sapiens
aaugagaagaaaugauucauaaauuuugaacuaacaguaauaacuucuugaaaauccaauaaaa

SEQ ID NO: 79813 - RNA, 64 nt, Homo Sapiens
cuugaaaaaaaauuuuuugauaugacuacucuaacaguaauaacuauaaaucucacuuuaaaua

SEQ ID NO: 79814 - RNA, 64 nt, Homo Sapiens
caaaaaaaauuguguaguauuuaccagcaccauucaguaauacagccuuaaccauaccuccuug

SEQ ID NO: 79815 - RNA, 64 nt, Homo Sapiens
ccuuuaaggcagacaagggcuaagauuuccuuagcaguaauaaugacauacacugaauugaaaa

SEQ ID NO: 79816 - RNA, 64 nt, Homo Sapiens
cuggagguacuacggucuauuucucaaccuuaggcaguaauagacaucacaaacugccaugguu

SEQ ID NO: 79817 - RNA, 64 nt, Homo Sapiens
aauaccugcauuucuaauuuuuuaagcauguagccaguaauaauuugaaguuuuuuuucuaugc

SEQ ID NO: 79818 - RNA, 64 nt, Homo Sapiens
ucuuagagaugguuaaaaauuucauauggucccucaguaauauuuuuuuuaccacugauaguau

SEQ ID NO: 79819 - RNA, 64 nt, Homo Sapiens
ccucacuuccaucagaaucuugcagcagugguuucaguaauaauaguaggcuuuaaagaaacag

SEQ ID NO: 79820 - RNA, 64 nt, Homo Sapiens
auuugccauuuuuauuagaaugaugcgaucugcucaguaauauagguguuuacacaaccaaauu

SEQ ID NO: 79821 - RNA, 64 nt, Homo Sapiens
aguggguauuaugcaacauccuggaaauauuauacaguaauagggaaugauuuguaaauagcua

SEQ ID NO: 79822 - RNA, 64 nt, Homo Sapiens
uaaaauuuauacaaaguuucgauuuuaguauuuacaguaauaaacuuuaagguguuuucaaugu

SEQ ID NO: 79823 - RNA, 64 nt, Homo Sapiens
uuuaauauucuguuuuauaccaguguccguuugccaguaauaaaacauuucaaaggaaauaaau

SEQ ID NO: 79824 - RNA, 64 nt, Homo Sapiens
aagcaucauguaaagaaaucgauaaggauguaaugauuuagauauaccaugauuuucuuugaaa

SEQ ID NO: 79825 - RNA, 64 nt, Homo Sapiens
augagcccugaggaguuauuuguaauguccucuagauuuagauucucuuagaaaaaaaaaauuc

SEQ ID NO: 79826 - RNA, 64 nt, Homo Sapiens
uaucuaaaauucagagcauagacuguaccauugugauuuagaccuagacuaaaguuucacauca

SEQ ID NO: 79827 - RNA, 64 nt, Homo Sapiens
gugguucaauuccccuguugugaguucauacuaugauuuagaaauuaccaaguaucugaagaga

SEQ ID NO: 79828 - RNA, 64 nt, Homo Sapiens
acgcuccuuuguaggguuuuaaacuuuucuaauagauuuagauucacuuuuggucuuggcuugu

SEQ ID NO: 79829 - RNA, 64 nt, Homo Sapiens
uuugaggaaugaugugauguguagagaauagaaagauuuagauauaugccugugacaggaauag

SEQ ID NO: 79830 - RNA, 64 nt, Homo Sapiens
acauagcugaccuuuuaugacugucaggugaguugauuuagacaucugauauauauuguguaac

SEQ ID NO: 79831 - RNA, 64 nt, Homo Sapiens
aucaaauguguuugguuuugaugaccucgauauggauuuagauuucccuuauggucagugauug

SEQ ID NO: 79832 - RNA, 64 nt, Homo Sapiens
ucauugaguauauugcuucaacuagugaaugugagauuuagagcuucagcuucacuugcagauc

SEQ ID NO: 79833 - RNA, 64 nt, Homo Sapiens
uggaauggccuuggaugucuugagggauaagugugauuuagaaagauccagucacugacuugau

SEQ ID NO: 79834 - RNA, 64 nt, Homo Sapiens
acucuucaagucaccuaaagcuauuaugcaggaggauuuagaagucacauucauaaaacccaag

SEQ ID NO: 79835 - RNA, 64 nt, Homo Sapiens
uaauuuuuuuuuaaguaggaccaaaggaaaacaagauuuagauagucugacuuugcuuuugaac

SEQ ID NO: 79836 - RNA, 64 nt, Homo Sapiens
uuucagugugaaaugguaaacauccaauugacaggauuuagauuuugcuuaguuuuucugcuuu

SEQ ID NO: 79837 - RNA, 64 nt, Homo Sapiens
auauauauaaauauauauugaaacugaauguacugauuuagaaaugaagaaaaaaacaaguuaa

SEQ ID NO: 79838 - RNA, 64 nt, Homo Sapiens
aaguugauuguaaccauagguaguaacaucuuaugauuuagaguuuuuccuucuugaagacuag

SEQ ID NO: 79839 - RNA, 64 nt, Homo Sapiens
gacaagacauuguguguauuagagacuccugaaugauuuagacaacuucaaaauacagaagaaa

SEQ ID NO: 79840 - RNA, 64 nt, Homo Sapiens
aucaaauaguaaaguuguuguaaaaauaaaaguggauuuagaaagauccaguucuugaaaacac

SEQ ID NO: 79841 - RNA, 64 nt, Homo Sapiens
aagaagcugcagaagaaaugaagaaagugaugaugauuuagauuuugauauugauuuagaagac

SEQ ID NO: 79842 - RNA, 64 nt, Homo Sapiens
ugaagaaagugaugaugauuuagauuuugauauugauuuagaagacacaggaggagaccaucaa

SEQ ID NO: 79843 - RNA, 64 nt, Homo Sapiens
gagggagagucugaccuggagggguggagaaucagauuuagaggagccuggcugucucuagcga

SEQ ID NO: 79844 - RNA, 64 nt, Homo Sapiens
uuggugcuggggcaaggccagugagagagaaaaugauuuagaucagacucuccaccugaguuca

SEQ ID NO: 79845 - RNA, 64 nt, Homo Sapiens
gaaggacauugccuuuugagauuaaauauugucugauuuagagagcauggaggugggcagagua

SEQ ID NO: 79846 - RNA, 64 nt, Homo Sapiens
auuuaauucuugguauuauaaguugcaaccauuugauuuagaauguaugcagcucucauguuug

SEQ ID NO: 79847 - RNA, 64 nt, Homo Sapiens
ggcaaauuuaggagcuuguucccauugccaaauggauuuagaaauucccuugugagugccuggu

SEQ ID NO: 79848 - RNA, 64 nt, Homo Sapiens
caaaguuuacaaccuuauuccaugcugucuuucagauuuagaaaagaucuaauuucugucucag

SEQ ID NO: 79849 - RNA, 64 nt, Homo Sapiens
aaggaacaccugaugaagaaaaacagucaauauggauuuagaaaaagguugaauugaaaaaaaa

SEQ ID NO: 79850 - RNA, 64 nt, Homo Sapiens
aagacaagagcaucagacaaguuaugaagauacagauuuagacacaagcauaaaaggaaaaaga

SEQ ID NO: 79851 - RNA, 64 nt, Homo Sapiens
gucuggcauggcaauuaaucacuaaugaauuaugcgaaagcaacauauuugauaaccguugcag

SEQ ID NO: 79852 - RNA, 64 nt, Homo Sapiens
aggcuccugcuuaaaguccacacguuauuauggccgaaagcaaccuggugcuucggccuggaua

SEQ ID NO: 79853 - RNA, 59 nt, Homo Sapiens
guggucaaagcguuccauaguucccuccacgaaagcauucagaaacccuacaaccaaaa

SEQ ID NO: 79854 - RNA, 64 nt, Homo Sapiens
uacugcaccguacaugccagcguacccauugcaccgaaagcaggcccuuagggcaggaagggac

SEQ ID NO: 79855 - RNA, 64 nt, Homo Sapiens
gaauuuugcuucaaagaacucuuuguagucaagacgaaagcacuagcuggaguuauuggaacca

SEQ ID NO: 79856 - RNA, 64 nt, Homo Sapiens
aauucacuuuccuuuuuccuuuuaaugucucuuucgaaagcauucauauugcccagaaaucuac

SEQ ID NO: 79857 - RNA, 64 nt, Homo Sapiens
ugggaguggggagggaaagucucagcaugcaguccgaaagcaugaaugaggcugguucugcacu

SEQ ID NO: 79858 - RNA, 59 nt, Homo Sapiens
uugggagugagaagccuuaagagaagcagcgaaagcagaucugagugucugacccagga

SEQ ID NO: 79859 - RNA, 64 nt, Homo Sapiens
gugagacuccaucucuauauaaaaacaaaaaccacgaaagcacacacaaaauaaaucaguggga

SEQ ID NO: 79860 - RNA, 64 nt, Homo Sapiens
aaaagugucucccuguggaaaggcauaacugugacgaaagcaacuuuuauaggcaaagcagcgc

SEQ ID NO: 79861 - RNA, 64 nt, Homo Sapiens
cgagugaauuaggauuucaaugaagaggucauaacgaaagcaaguguauauuuuggaggacggg

SEQ ID NO: 79862 - RNA, 64 nt, Homo Sapiens
gaaaugagaagcuaucaguaacagcuacucucaucgaaagcacuuuauuauuuuacggagcugc

SEQ ID NO: 79863 - RNA, 64 nt, Homo Sapiens
uggagcauuuuaaagccccauacacagaaguauacgaaagcacacaaaacacuccaaguuucag

SEQ ID NO: 79864 - RNA, 64 nt, Homo Sapiens
agggaaaaaagacaaaaagcauaaggcuccaaaacgaaagcaagcauuucacuggcagccucca

SEQ ID NO: 79865 - RNA, 64 nt, Homo Sapiens
ccuugugugccacugguguucuuuccacuuuauacgaaagcaaguagccaugcuuugguugugu

SEQ ID NO: 79866 - RNA, 64 nt, Homo Sapiens
uggcuuaauugccuaucagacgcauuuucccagacgaaagcaauguuggguuggggaagacagu

SEQ ID NO: 79867 - RNA, 64 nt, Homo Sapiens
aggggaggcugugggacuucaccacguggacaaacgaaagcacaggcuacucagacuuggccac

SEQ ID NO: 79868 - RNA, 55 nt, Homo Sapiens
gcgagggacaguucaacugaaacuucgaaagcaucauuauuugcagagacaggac

SEQ ID NO: 79869 - RNA, 64 nt, Homo Sapiens
ggaaaacgaagauggagagagcacuuccccguaacgaaagcaaagugguaagcacagggugaga

SEQ ID NO: 79870 - RNA, 64 nt, Homo Sapiens
caaaauauaaauaauaguguuuauaacuaaaagucgaaagcacaaaaaaaagucaaagacaaca

SEQ ID NO: 79871 - RNA, 64 nt, Homo Sapiens
cuuuugccaaugaucuuuaacccuuuugcagauacgaaagcaaggagccuguggaaaggcagag

SEQ ID NO: 79872 - RNA, 64 nt, Homo Sapiens
aaaaauuguucauuaaucuuuuucuccauuggcccgaaagcaguucuuucuuaaugccugaaau

SEQ ID NO: 79873 - RNA, 64 nt, Homo Sapiens
uuggcuugguagcucugggaacuggaugcuuugccgaaagcagcauucccagacuggcuugacc

SEQ ID NO: 79874 - RNA, 64 nt, Homo Sapiens
ggcagugucaccgcaaagggaggaaacucaaagccgaaagcaaaauuccaggccugauucuggc

SEQ ID NO: 79875 - RNA, 64 nt, Homo Sapiens
ucuguugcugcugcugaacucagcuguuguagcacgaaagcagccagguaauuacuagaugaag

SEQ ID NO: 79876 - RNA, 64 nt, Homo Sapiens
agccaugacagauggcuuuuuggcuaggacuguucgaaagcaggcgagguaaauggacagugga

SEQ ID NO: 79877 - RNA, 64 nt, Homo Sapiens
cuuaaaaggcccaagcacugaaaauggaaccuggcgaaagcagaggaggagaaugaagaaagau

SEQ ID NO: 79878 - RNA, 64 nt, Homo Sapiens
guaagcacuucugagcucuuuagcauugaagugucgaaagcaacucacacgggaagaucauuuc

SEQ ID NO: 79879 - RNA, 64 nt, Homo Sapiens
uacuuaaaugaagcauauucuuuuuaaaucagcucgaaagcaugaaaccauaauucaacuuuuc

SEQ ID NO: 79880 - RNA, 64 nt, Homo Sapiens
ccagccugcagcacaccccacagccaaguagaggcgaaagcaguggcucauccuaccuguuagg

SEQ ID NO: 79881 - RNA, 64 nt, Homo Sapiens
uccaagggcaagacuuggugcccagcuggaaggacgaaagcacacuuugugaccgccauccuca

SEQ ID NO: 79882 - RNA, 64 nt, Homo Sapiens
uucacaaugaagcuuccagaaaaaaacaaaaaaacgaaagcaucagugccucaugacugaaaac

SEQ ID NO: 79883 - RNA, 64 nt, Homo Sapiens
guuugggaaagucagcaaaagaaagaaugcauuucgaaagcaaacagaagaaaaaaguauauuc

SEQ ID NO: 79884 - RNA, 64 nt, Homo Sapiens
cccugugcccccagccucagcccaacuucuuacccgaaagcaucacugccuuggccccucccuc

SEQ ID NO: 79885 - RNA, 64 nt, Homo Sapiens
ccaggagauuauuaagggguccagaaagcauguccgaaagcagucucuccacaccccuccuguu

SEQ ID NO: 79886 - RNA, 64 nt, Homo Sapiens
gauccagugggguccggacacugggccccgcaggcgaaagcacguuccagccaccaggaggcca

SEQ ID NO: 79887 - RNA, 64 nt, Homo Sapiens
cacuguuaggccuuuauuuuauuuuauuuuccaucgaaagcauuggaggcccagugcaauggcu

SEQ ID NO: 79888 - RNA, 64 nt, Homo Sapiens
uaacuggccaguuuugauugaauucaaaagugaacgaaagcauuuauauccuauauucuguuaa

SEQ ID NO: 79889 - RNA, 64 nt, Homo Sapiens
gggacugcugggagaggagguuuggggaggggggcgaaagcaacucugggcgggcccaguggag

SEQ ID NO: 79890 - RNA, 64 nt, Homo Sapiens
gacgacagaggguccuaggcuggaauguuccuuucgaaagcaaugcuucuaucaaauacuagua

SEQ ID NO: 79891 - RNA, 64 nt, Homo Sapiens
gacggccaaccgccaugugauguaagccuccauacgaaagcacuguugcagauagaagaagagg

SEQ ID NO: 79892 - RNA, 64 nt, Homo Sapiens
uuuuuucauacauuuaguaugaaaacuugaacagcgaaagcagagcauguuauuuauauaacug

SEQ ID NO: 79893 - RNA, 64 nt, Homo Sapiens
cgguugugugcggcagcaguuucggcagccaacucgaaagcaggggaucauuucagacccgcac

SEQ ID NO: 79894 - RNA, 64 nt, Homo Sapiens
acaggaaaccugccgccugcuaugagaaggaaggcgaaagcaugugaacucuagcacuggugua

SEQ ID NO: 79895 - RNA, 64 nt, Homo Sapiens
uaaacuaagaaaaagguaagaacugucucaaaaacgaaagcacaccacccaagacacaguaccc

SEQ ID NO: 79896 - RNA, 64 nt, Homo Sapiens
gccagcugcccguuuccuccuagacagccugguccgaaagcauucacagaauucaggaaacugc

SEQ ID NO: 79897 - RNA, 64 nt, Homo Sapiens
gauuucaugacaaagaucccaaaaauaauuguaacgaaagcaaaaauugacaaaugggacauga

SEQ ID NO: 79898 - RNA, 64 nt, Homo Sapiens
ugcugcuacaauacggcuaaucuuucauugggaccgaaagcaaaggucaguacagaaacaaguu

SEQ ID NO: 79899 - RNA, 64 nt, Homo Sapiens
cucugacugccagauagugccucccgauacccagcgaaagcaccuuuccuuucuuuguccccca

SEQ ID NO: 79900 - RNA, 64 nt, Homo Sapiens
gaagcccuaagcuuauccccguucuuccucccaacgaaagcauguggagauaugaggacccccu

SEQ ID NO: 79901 - RNA, 64 nt, Homo Sapiens
caaggauauauaaggcacugcauucuggaagacacgaaagcaagcucuguccccuugauccugg

SEQ ID NO: 79902 - RNA, 64 nt, Homo Sapiens
auaacuguaacguucuuugaguagaaaaaaaugucgaaagcauucuugaaaaagcaucacagaa

SEQ ID NO: 79903 - RNA, 64 nt, Homo Sapiens
aaauuucucaagacccucuuaccagcagauucugcgaaagcaccgcccacuucacaucuccccu

SEQ ID NO: 79904 - RNA, 64 nt, Homo Sapiens
ucuuuuaaauuaagccacuguucuaggauucauucgaaagcacacuguguaaagacagauuauu

SEQ ID NO: 79905 - RNA, 64 nt, Homo Sapiens
ugucucgccuuuagaacgugugaugauucccaaccgaaagcagccggcgugagcggagggagug

SEQ ID NO: 79906 - RNA, 64 nt, Homo Sapiens
cuugggcuaggugacaaguucuuggacuuugccccgaaagcacauccauaaaagacaaaaucug

SEQ ID NO: 79907 - RNA, 64 nt, Homo Sapiens
ucccagcugugcucuggacaggcauguucucugaggacacuaaccacgcuggaccuugaacugg

SEQ ID NO: 79908 - RNA, 64 nt, Homo Sapiens
gaugcaccagcccuuagcagggaaacagcuaaugggacacuaauggggcggugagaggggaaca

SEQ ID NO: 79909 - RNA, 64 nt, Homo Sapiens
cuuggagaagccaccugcacuacaccugcaaggcugucaacagugcggggaugacgaugccaag

SEQ ID NO: 79910 - RNA, 64 nt, Homo Sapiens
acgggcaccaggaucaagcugagaacaucaugugugucaacaagugcaccuggaccucaagccg

SEQ ID NO: 79911 - RNA, 64 nt, Homo Sapiens
cgggccucgggccugacccguccacacagggccgugucaacagcagcgacucaagggacgugug

SEQ ID NO: 79912 - RNA, 64 nt, Homo Sapiens
acguguguacauauguaaaugagaaauagagacgugucaacagaugcauucauuucucuuggaa

SEQ ID NO: 79913 - RNA, 64 nt, Homo Sapiens
aagacacaggaagaaugggcgaagauuagagguuugucaacacauuugucaacacaaagacaug

SEQ ID NO: 79914 - RNA, 64 nt, Homo Sapiens
aagacauggaagauuagagguggaagguuagguuugucaacacagguuugucaacaaaaagaca

SEQ ID NO: 79915 - RNA, 64 nt, Homo Sapiens
aagacauggaagguuagguugaagguuagagguuugucaacaaauuugucaacacaaagacaug

SEQ ID NO: 79916 - RNA, 64 nt, Homo Sapiens
aagacauggaagguuagaggcccauggagagguuugucaacacaggauagggucagaugcacca

SEQ ID NO: 79917 - RNA, 64 nt, Homo Sapiens
guaguuuagaaaauggcccguuagguuuuaacgaugucaacagucacuugggggcacuggccuc

SEQ ID NO: 79918 - RNA, 64 nt, Homo Sapiens
uuuguguacauauuuggcaugaagaaaacccuuuugucaacaauauaguuaaaucuugauuuua

SEQ ID NO: 79919 - RNA, 64 nt, Homo Sapiens
cucaaauaucucacugucaaaaaugucacaaguaaagcaucaucauuuaaguguaauucauuuc

SEQ ID NO: 79920 - RNA, 64 nt, Homo Sapiens
uaaagaaauccuaacauuuauaaugauuuagauaaagcaucauguucuuugaaagauaaggaug

SEQ ID NO: 79921 - RNA, 64 nt, Homo Sapiens
aaauucauaccugagaaaaagcucaucccuuauuaagcaucagagaggaaggccuucagucagg

SEQ ID NO: 79922 - RNA, 64 nt, Homo Sapiens
aacacauacuagagagaggcucucuuccuuuacuaagcaucaaguggaaaaaucuucaguugua

SEQ ID NO: 79923 - RNA, 64 nt, Homo Sapiens
caucacauuucaggccccaagcaaucucugugcaaagcaucagaaagaccugcuucccagcccc

SEQ ID NO: 79924 - RNA, 64 nt, Homo Sapiens
cauccuaugcauguaagcauuauuucccaaaccaaagcaucauucaucuccauuuauuucuuuu

SEQ ID NO: 79925 - RNA, 64 nt, Homo Sapiens
ggaauugaauggguuugcuagaaugugauauuugaagcaucacauaaaaaugaugggacaauaa

SEQ ID NO: 79926 - RNA, 64 nt, Homo Sapiens
cuuauuaaccuauuuauuauuuauguauuuauuuaagcaucaaauauuugugcaagaauuugga

SEQ ID NO: 79927 - RNA, 64 nt, Homo Sapiens
ugcaccuaugugggaacuuuuuugauaacucuuaaagcaucauuugcauuauuuuuuaaaaagu

SEQ ID NO: 79928 - RNA, 64 nt, Homo Sapiens
agccaauuugauagguguuucugcuuuggaagagaagcaucauggucggccauaaacagcuauc

SEQ ID NO: 79929 - RNA, 64 nt, Homo Sapiens
uaaauuuuaaaggaauggagugaacauagccuuuaagcaucauugcugacaacuugcacaaugu

SEQ ID NO: 79930 - RNA, 64 nt, Homo Sapiens
auuucaugccacauaaauuauuauuacuauauuaaagcaucaacaaaaaggacugaauuaguuu

SEQ ID NO: 79931 - RNA, 64 nt, Homo Sapiens
auuugugauguuaauacaggcuucuuguuuuaggaagcaucaccuauacucugaagccuuuaaa

SEQ ID NO: 79932 - RNA, 64 nt, Homo Sapiens
cuaaaaugugaagcuuuaggaccaaauuguuagaaagcaucaggaugaccaguuaucucgagua

SEQ ID NO: 79933 - RNA, 64 nt, Homo Sapiens
guuaaaaagaaacauaguguugcccuuuuucuuaaagcaucagugaaauuauggaaaauuacuu

SEQ ID NO: 79934 - RNA, 64 nt, Homo Sapiens
ugcccuccccacuucccccgauucagagacuuagaagcaucagaguugauaaauuagauugaaa

SEQ ID NO: 79935 - RNA, 64 nt, Homo Sapiens
cucagccacaaaacucugucaggcauugaaugacaagcaucaguagcugagugcacuccuggug

SEQ ID NO: 79936 - RNA, 64 nt, Homo Sapiens
aauucaauauuugcauuuaaacgugucuuaaaggaagcaucaagcuucauuaacuugacagagu

SEQ ID NO: 79937 - RNA, 64 nt, Homo Sapiens
cucucaaacaguugccccaggcuguguccguaucaagcaucaguagaaaauggaaucccugaca

SEQ ID NO: 79938 - RNA, 64 nt, Homo Sapiens
cugguauuaauguuagagaauggcagacaaggcgaagcaucagaucuccuguguaucuuugaag

SEQ ID NO: 79939 - RNA, 64 nt, Homo Sapiens
cugguaucaauauuagacaauggcagauaaggugaagcaucagaucuccuguguaucuuugaag

SEQ ID NO: 79940 - RNA, 64 nt, Homo Sapiens
ggcauggagagcaagagaagguauguacugccugaggucacaugacagugaccaaguggagaca

SEQ ID NO: 79941 - RNA, 64 nt, Homo Sapiens
gcccugcacuauggcuggaggacacauuugguagaggucacacugcagcucccagugccccagu

SEQ ID NO: 79942 - RNA, 64 nt, Homo Sapiens
aagagccagagugggaagucaggccucucugggaaggucacaaggccugggguuguucacacca

SEQ ID NO: 79943 - RNA, 64 nt, Homo Sapiens
acgccaugcugugccugggguccacagagccgggaggucacacauguacauccuggaagcugcc

SEQ ID NO: 79944 - RNA, 64 nt, Homo Sapiens
aguguucaccuguuucaucuuucugagauguagcaggucacagacaaagcuuccuaugagaagc

SEQ ID NO: 79945 - RNA, 64 nt, Homo Sapiens
gugacugaaagcugauuucuuaaaggcucccauuaggucacagcuuuuuccucagagacacccc

SEQ ID NO: 79946 - RNA, 64 nt, Homo Sapiens
gccgaacauuuucagaaaucgcagguguuacccaaggucacaagggaaacugaggcucagagca

SEQ ID NO: 79947 - RNA, 64 nt, Homo Sapiens
ggguuaaguuuguaugaccaaauuugagcuuucuaggucacauuugugaagaguccagugguag

SEQ ID NO: 79948 - RNA, 64 nt, Homo Sapiens
ccaaaaaccuuuacuguuucgcagcacuauacaugaaauauaaauacuuuguaagguuggaaca

SEQ ID NO: 79949 - RNA, 64 nt, Homo Sapiens
ugugaacaguguguaccagugcauuuccaaacuugaaauauaggguauugcugcuugcaaauau

SEQ ID NO: 79950 - RNA, 64 nt, Homo Sapiens
ugacacacacauucacauauuauguuauaaacgugaaauauauuauuguaugcauauaugugua

SEQ ID NO: 79951 - RNA, 64 nt, Homo Sapiens
guaaugauuguccuuagacuuaacuggauaucuugaaauauacauaauucaaggauugaaaaau

SEQ ID NO: 79952 - RNA, 64 nt, Homo Sapiens
uaauucucucauauuuaaaaaaagaaacuagauggaaauauaugacaaaaguuuugcuggcacg

SEQ ID NO: 79953 - RNA, 64 nt, Homo Sapiens
gccuucaucauaauuuguucccucaguaauaggagaaauauaaauacaguaaguuuagauuauu

SEQ ID NO: 79954 - RNA, 64 nt, Homo Sapiens
aucaucagaucagcaugugcuauacucccugcaagaaauauacugacaugaacaggcaguucuu

SEQ ID NO: 79955 - RNA, 64 nt, Homo Sapiens
acccuaauggaauaauuauuaaugaaagauuuuugaaauauaaaaaauaaauuaggcccaaucc

SEQ ID NO: 79956 - RNA, 64 nt, Homo Sapiens
ucucauuuuaaaauuggacaguauuaaugaaggggaaauauacaauuuauuucuauugaguggu

SEQ ID NO: 79957 - RNA, 64 nt, Homo Sapiens
cauguggaacaccaaacaggaaagaacuaugucugaaauauaaaaaauaaaaauaaaaaaacaa

SEQ ID NO: 79958 - RNA, 64 nt, Homo Sapiens
aauguucuuuucaaucccaucuagauaauuuauagaaauauaacccuaauuggacaugugguac

SEQ ID NO: 79959 - RNA, 64 nt, Homo Sapiens
aacuguauuuccugucaccuauucacuagugcaggaaauauacuugcuccaaauaagucaguau

SEQ ID NO: 79960 - RNA, 64 nt, Homo Sapiens
acauauaucuguguauauaaauccacaugcacaugaaauauauauauauauauaauuugugugu

SEQ ID NO: 79961 - RNA, 64 nt, Homo Sapiens
aguaaacccuaaguaaagucaaaauggagaaggggaaauauacagauggcuaguugcauaaaau

SEQ ID NO: 79962 - RNA, 64 nt, Homo Sapiens
ucuugucauuaauauuauuuuguauuuuuauguggaaauauauaauuuuaugacacuaauugcu

SEQ ID NO: 79963 - RNA, 64 nt, Homo Sapiens
uuuaaauuugcuaguggauuuugucuaaugugcagaaauauauaugucuaaugugcagaaauau

SEQ ID NO: 79964 - RNA, 64 nt, Homo Sapiens
ucuaaugugcagaaauauauaugucuaaugugcagaaauauauauguguguauguguguauaua

SEQ ID NO: 79965 - RNA, 64 nt, Homo Sapiens
aaaauauaugauuuuuaugucaaucaagacaaaugaaauauauauguauguguauauauauaca

SEQ ID NO: 79966 - RNA, 64 nt, Homo Sapiens
auauauguauguguauauauauacauguauguaugaaauauauauaugugcgugugugugugua

SEQ ID NO: 79967 - RNA, 64 nt, Homo Sapiens
ucaaaauauguguguacguguuuauacaucuucugaaauauauuauauuuguauguaaauuaua

SEQ ID NO: 79968 - RNA, 64 nt, Homo Sapiens
gauuauauuuguauguaaauuaaauauauauuuugaaauauauaagauuauuugaaaaucauuc

SEQ ID NO: 79969 - RNA, 64 nt, Homo Sapiens
agcuaaaaaaauacucugggucaacagaaauauagaaauauaguuuaguucaauuuaagccuau

SEQ ID NO: 79970 - RNA, 64 nt, Homo Sapiens
aauauaguagcuaaaaaaauaagccuauucaacagaaauauagaagccuacauuaguucaauuu

SEQ ID NO: 79971 - RNA, 64 nt, Homo Sapiens
cugaugaggcauuucuuacuagaaucccauaagugaaauauaauauuuuucaaaguugauauca

SEQ ID NO: 79972 - RNA, 64 nt, Homo Sapiens
guucuaguuucccggcauugauaguucccuauuugaaauauaauguuucucuuguaagugauau

SEQ ID NO: 79973 - RNA, 64 nt, Homo Sapiens
aaaaauaauaaacuaaaaccauuauacauuuucagaaauauauucauuaucagacagucuugau

SEQ ID NO: 79974 - RNA, 64 nt, Homo Sapiens
aagagucaucaacuuggaaaccauauggaaaaaggaaauauacguacuuuaaaagccaaggugc

SEQ ID NO: 79975 - RNA, 64 nt, Homo Sapiens
uaauuuugucaauuauaccucauguuguacaacugaaauauaaaaccaaaacauguugaacauc

SEQ ID NO: 79976 - RNA, 64 nt, Homo Sapiens
gacaguauguauggugugguccuugcccaaguaugaaauauaggaaaaaagucaacuccccucc

SEQ ID NO: 79977 - RNA, 64 nt, Homo Sapiens
uaccucuuccguuggaaagaauuuuucauauguggaaauauaccuugauuuauggcuguuccug

SEQ ID NO: 79978 - RNA, 64 nt, Homo Sapiens
augaaaauuaagauuauuguuccuguuaguagcagaaauauauuaaaaggcagcauuugaauac

SEQ ID NO: 79979 - RNA, 64 nt, Homo Sapiens
caauagagauauaucuauuuucaauucaacuacagaaauauauuuuauuggccgggugcggugg

SEQ ID NO: 79980 - RNA, 64 nt, Homo Sapiens
gagacuccgucucaaaaacaaaaaaaaaagaaaagaaauauauuuuauucauucacauuagguc

SEQ ID NO: 79981 - RNA, 64 nt, Homo Sapiens
ugugauuuuaaaauuuugcucauaauauauaaaagaaauauaucuuccuuacuagaaauauauu

SEQ ID NO: 79982 - RNA, 64 nt, Homo Sapiens
cauaauauauaaaagaaauauauauuccuuacuagaaauauauucaguuucugaagacuaguua

SEQ ID NO: 79983 - RNA, 64 nt, Homo Sapiens
auauuaaaauuaugcucauuagggaaauauauuugaaauauaaaugccacuguuuuuaucaaga

SEQ ID NO: 79984 - RNA, 64 nt, Homo Sapiens
ugaaauauaaaauauuaaaauuuuaucaagaagggaaauauauugguuagaaaaaugccacugu

SEQ ID NO: 79985 - RNA, 64 nt, Homo Sapiens
auagaaaagcuuuguuccuagaagauuaagauaagaaauauaagagaccuucauuuaagaggca

SEQ ID NO: 79986 - RNA, 64 nt, Homo Sapiens
caagagauuaugauucuguauuuuaauaacauuggaaauauauuaucuuguaugauuuuuuauu

SEQ ID NO: 79987 - RNA, 64 nt, Homo Sapiens
acuugugauaagcugcugcuccuauauuuuuuaagaaauauaauaaagcacuuagggcagggga

SEQ ID NO: 79988 - RNA, 64 nt, Homo Sapiens
gccuuauuaagaacacuacuacaguucugaaggggaaauauaacaucuaugguuauauauuuua

SEQ ID NO: 79989 - RNA, 64 nt, Homo Sapiens
uaaucucaucuguuuaccuagaagauagguuaaggaaauauauuauuauuccuguuugaugugg

SEQ ID NO: 79990 - RNA, 64 nt, Homo Sapiens
aaaguuaacaaagggguacacaguauggucuuuggaaauauaauaaaacaucaacuaacuugga

SEQ ID NO: 79991 - RNA, 64 nt, Homo Sapiens
cauggauuuauaauggcauuguucccgucuuuuugaaauauagauuaauguaucuugcuuuugu

SEQ ID NO: 79992 - RNA, 64 nt, Homo Sapiens
caugucuauguguauauagacacaaacacacacagaaauauauuaguguuugagguuauauaug

SEQ ID NO: 79993 - RNA, 64 nt, Homo Sapiens
auaaauauuaauaauacaacuucagcaacauauagaaauauacuuaaagaaaggaugauuuauu

SEQ ID NO: 79994 - RNA, 64 nt, Homo Sapiens
cguacuaaugaacaaacuugugguuuccucauuugaaauauauccagaaaaaaaguggaagguu

SEQ ID NO: 79995 - RNA, 64 nt, Homo Sapiens
cacagaaaaucauuuauauuugagaaaaauuguagaaauauagacugugaaaaagacgucaaua

SEQ ID NO: 79996 - RNA, 64 nt, Homo Sapiens
aaauuugucuauguaaauaccagaauuuauaguagaaauauaugaggaagcgacacuucgaaua

SEQ ID NO: 79997 - RNA, 64 nt, Homo Sapiens
auacauccuauagaaacucacaaauaaugcauaagaaauauauauauaauauauguauguaugu

SEQ ID NO: 79998 - RNA, 64 nt, Homo Sapiens
gaaacauagcaagaccccaucucuuaaaaaaaaagaaauauauagacauauaucugcauugaaa

SEQ ID NO: 79999 - RNA, 64 nt, Homo Sapiens
auuguuuugcaaauuucuauuuuucacauucuuggaaauauauccugccuuaaauuuccucugu

SEQ ID NO: 80000 - RNA, 64 nt, Homo Sapiens
auuuguuagucuguaucuggccagaaaauuuaaggaaauauauuauucaggucaguaguauagc

SEQ ID NO: 80001 - RNA, 64 nt, Homo Sapiens
acucagauaccagugcuggggagggaggccugacuucagcaacagcugugggugggcuggaggc

SEQ ID NO: 80002 - RNA, 64 nt, Homo Sapiens
acccgcaaucugcuccagauucaagcaguaauauuucagcaagaggagguggucaugggaagcc

SEQ ID NO: 80003 - RNA, 64 nt, Homo Sapiens
gcuacaugacuaugucuaaagugcaaagcacaguuucagcaauggacauucccuaccuuuaaua

SEQ ID NO: 80004 - RNA, 64 nt, Homo Sapiens
cugugccucuugauagagaauugcauguuuacuguucagcaaaucuuuaagagcaauggcacaa

SEQ ID NO: 80005 - RNA, 64 nt, Homo Sapiens
gaagccaaacaccggcauuuuauguacuuuguccuucagcaagaaagguguggaagcaugauau

SEQ ID NO: 80006 - RNA, 64 nt, Homo Sapiens
aguuaacacaacguaacacuuaaaagcauacauuuucagcaaccaguggcacauauuugaagug

SEQ ID NO: 80007 - RNA, 64 nt, Homo Sapiens
auacacaauaguauuaucguauaucuuuaauucauucagcaagugccugcucuagucucaucuc

SEQ ID NO: 80008 - RNA, 64 nt, Homo Sapiens
aaaccuuauacaaacucguaugaggaggccuuuguucagcaaaggacugcauaaauguaauaac

SEQ ID NO: 80009 - RNA, 64 nt, Homo Sapiens
gucaauauugcuaucagcauuuugggcaaagccauucagcaaguaucuaggaaguuccaaacuu

SEQ ID NO: 80010 - RNA, 64 nt, Homo Sapiens
guuccaaacuugcuuucauauuuuuggcuaucuuuucagcaaugccccacucuacuguuagcag

SEQ ID NO: 80011 - RNA, 64 nt, Homo Sapiens
accuuaaaucagugaugugcugcauucggcucccuucagcaaauuucagggguuuucugggacc

SEQ ID NO: 80012 - RNA, 64 nt, Homo Sapiens
aaggggaaccagggcaaaucuuauguaaagauuuuucagcaacuugucccaauuuguguguauu

SEQ ID NO: 80013 - RNA, 64 nt, Homo Sapiens
uuucucaucauugggguuagcgggugcagacaaauucagcaauaguaugcagaucagccccuca

SEQ ID NO: 80014 - RNA, 64 nt, Homo Sapiens
auuugguauguaucugaauuaauucucacuaaaauucagcaaaggacuugauagccccuccccg

SEQ ID NO: 80015 - RNA, 64 nt, Homo Sapiens
cugauauucacuuuauuuuuauauucuaggaauuuucagcaauauucauuuaaaguuuuaucca

SEQ ID NO: 80016 - RNA, 64 nt, Homo Sapiens
cuaauauucucauuuuuaaaguauucuaggaauuuucagcaauaguuauuuaaaguuuuaucca

SEQ ID NO: 80017 - RNA, 64 nt, Homo Sapiens; identical to SEQ ID NO: 58312

SEQ ID NO: 80018 - RNA, 64 nt, Homo Sapiens; identical to SEQ ID NO: 58313

SEQ ID NO: 80019 - RNA, 64 nt, Homo Sapiens; identical to SEQ ID NO: 58314

SEQ ID NO: 80020 - RNA, 64 nt, Homo Sapiens; identical to SEQ ID NO: 58315

SEQ ID NO: 80021 - RNA, 64 nt, Homo Sapiens; identical to SEQ ID NO: 58316

SEQ ID NO: 80022 - RNA, 64 nt, Homo Sapiens; identical to SEQ ID NO: 58317

SEQ ID NO: 80023 - RNA, 64 nt, Homo Sapiens; identical to SEQ ID NO: 58318

SEQ ID NO: 80024 - RNA, 64 nt, Homo Sapiens; identical to SEQ ID NO: 58319

SEQ ID NO: 80025 - RNA, 64 nt, Homo Sapiens; identical to SEQ ID NO: 58320

SEQ ID NO: 80026 - RNA, 64 nt, Homo Sapiens; identical to SEQ ID NO: 58321

SEQ ID NO: 80027 - RNA, 64 nt, Homo Sapiens; identical to SEQ ID NO: 58322

SEQ ID NO: 80028 - RNA, 64 nt, Homo Sapiens; identical to SEQ ID NO: 58323

SEQ ID NO: 80029 - RNA, 64 nt, Homo Sapiens; identical to SEQ ID NO: 58324

SEQ ID NO: 80030 - RNA, 64 nt, Homo Sapiens; identical to SEQ ID NO: 58325

SEQ ID NO: 80031 - RNA, 64 nt, Homo Sapiens; identical to SEQ ID NO: 58326

SEQ ID NO: 80032 - RNA, 64 nt, Homo Sapiens; identical to SEQ ID NO: 58327

SEQ ID NO: 80033 - RNA, 64 nt, Homo Sapiens; identical to SEQ ID NO: 58328

SEQ ID NO: 80034 - RNA, 64 nt, Homo Sapiens; identical to SEQ ID NO: 58329

SEQ ID NO: 80035 - RNA, 64 nt, Homo Sapiens; identical to SEQ ID NO: 58330

SEQ ID NO: 80036 - RNA, 64 nt, Homo Sapiens; identical to SEQ ID NO: 58331

SEQ ID NO: 80037 - RNA, 64 nt, Homo Sapiens; identical to SEQ ID NO: 58332

SEQ ID NO: 80038 - RNA, 64 nt, Homo Sapiens; identical to SEQ ID NO: 58333

SEQ ID NO: 80039 - RNA, 64 nt, Homo Sapiens; identical to SEQ ID NO: 58334

SEQ ID NO: 80040 - RNA, 64 nt, Homo Sapiens; identical to SEQ ID NO: 58335

SEQ ID NO: 80041 - RNA, 64 nt, Homo Sapiens; identical to SEQ ID NO: 58336

SEQ ID NO: 80042 - RNA, 64 nt, Homo Sapiens; identical to SEQ ID NO: 58337

SEQ ID NO: 80043 - RNA, 64 nt, Homo Sapiens; identical to SEQ ID NO: 58338

SEQ ID NO: 80044 - RNA, 64 nt, Homo Sapiens; identical to SEQ ID NO: 58339

SEQ ID NO: 80045 - RNA, 64 nt, Homo Sapiens; identical to SEQ ID NO: 58340

SEQ ID NO: 80046 - RNA, 64 nt, Homo Sapiens; identical to SEQ ID NO: 58341

SEQ ID NO: 80047 - RNA, 64 nt, Homo Sapiens; identical to SEQ ID NO: 58342

SEQ ID NO: 80048 - RNA, 64 nt, Homo Sapiens; identical to SEQ ID NO: 58343

SEQ ID NO: 80049 - RNA, 64 nt, Homo Sapiens; identical to SEQ ID NO: 58344

SEQ ID NO: 80050 - RNA, 64 nt, Homo Sapiens; identical to SEQ ID NO: 58345

SEQ ID NO: 80051 - RNA, 64 nt, Homo Sapiens; identical to SEQ ID NO: 58346

SEQ ID NO: 80052 - RNA, 64 nt, Homo Sapiens; identical to SEQ ID NO: 58347

SEQ ID NO: 80053 - RNA, 64 nt, Homo Sapiens; identical to SEQ ID NO: 58348

SEQ ID NO: 80054 - RNA, 64 nt, Homo Sapiens; identical to SEQ ID NO: 58349

SEQ ID NO: 80055 - RNA, 64 nt, Homo Sapiens; identical to SEQ ID NO: 58350

SEQ ID NO: 80056 - RNA, 64 nt, Homo Sapiens; identical to SEQ ID NO: 58351

SEQ ID NO: 80057 - RNA, 64 nt, Homo Sapiens; identical to SEQ ID NO: 58352

SEQ ID NO: 80058 - RNA, 64 nt, Homo Sapiens; identical to SEQ ID NO: 58353

SEQ ID NO: 80059 - RNA, 64 nt, Homo Sapiens; identical to SEQ ID NO: 58354

SEQ ID NO: 80060 - RNA, 64 nt, Homo Sapiens; identical to SEQ ID NO: 58355

SEQ ID NO: 80061 - RNA, 64 nt, Homo Sapiens; identical to SEQ ID NO: 58356

SEQ ID NO: 80062 - RNA, 64 nt, Homo Sapiens; identical to SEQ ID NO: 58357

SEQ ID NO: 80063 - RNA, 64 nt, Homo Sapiens; identical to SEQ ID NO: 58358

SEQ ID NO: 80064 - RNA, 64 nt, Homo Sapiens; identical to SEQ ID NO: 58359

SEQ ID NO: 80065 - RNA, 64 nt, Homo Sapiens; identical to SEQ ID NO: 58360

SEQ ID NO: 80066 - RNA, 64 nt, Homo Sapiens; identical to SEQ ID NO: 58361

SEQ ID NO: 80067 - RNA, 64 nt, Homo Sapiens; identical to SEQ ID NO: 58362

SEQ ID NO: 80068 - RNA, 64 nt, Homo Sapiens; identical to SEQ ID NO: 58363

SEQ ID NO: 80069 - RNA, 64 nt, Homo Sapiens; identical to SEQ ID NO: 58364

SEQ ID NO: 80070 - RNA, 64 nt, Homo Sapiens; identical to SEQ ID NO: 58365

SEQ ID NO: 80071 - RNA, 64 nt, Homo Sapiens; identical to SEQ ID NO: 58366

SEQ ID NO: 80072 - RNA, 64 nt, Homo Sapiens; identical to SEQ ID NO: 58367

SEQ ID NO: 80073 - RNA, 64 nt, Homo Sapiens; identical to SEQ ID NO: 58368

SEQ ID NO: 80074 - RNA, 64 nt, Homo Sapiens; identical to SEQ ID NO: 58369

SEQ ID NO: 80075 - RNA, 64 nt, Homo Sapiens; identical to SEQ ID NO: 58370

SEQ ID NO: 80076 - RNA, 64 nt, Homo Sapiens; identical to SEQ ID NO: 58371

SEQ ID NO: 80077 - RNA, 64 nt, Homo Sapiens; identical to SEQ ID NO: 58372

SEQ ID NO: 80078 - RNA, 64 nt, Homo Sapiens; identical to SEQ ID NO: 58373

SEQ ID NO: 80079 - RNA, 64 nt, Homo Sapiens; identical to SEQ ID NO: 58374

SEQ ID NO: 80080 - RNA, 64 nt, Homo Sapiens; identical to SEQ ID NO: 58375

SEQ ID NO: 80081 - RNA, 64 nt, Homo Sapiens; identical to SEQ ID NO: 58376

SEQ ID NO: 80082 - RNA, 64 nt, Homo Sapiens; identical to SEQ ID NO: 58377

SEQ ID NO: 80083 - RNA, 64 nt, Homo Sapiens; identical to SEQ ID NO: 58378

SEQ ID NO: 80084 - RNA, 64 nt, Homo Sapiens; identical to SEQ ID NO: 58379

SEQ ID NO: 80085 - RNA, 64 nt, Homo Sapiens; identical to SEQ ID NO: 58380

SEQ ID NO: 80086 - RNA, 64 nt, Homo Sapiens; identical to SEQ ID NO: 58381

SEQ ID NO: 80087 - RNA, 64 nt, Homo Sapiens; identical to SEQ ID NO: 58382

SEQ ID NO: 80088 - RNA, 64 nt, Homo Sapiens; identical to SEQ ID NO: 58383

SEQ ID NO: 80089 - RNA, 64 nt, Homo Sapiens; identical to SEQ ID NO: 58384

SEQ ID NO: 80090 - RNA, 64 nt, Homo Sapiens; identical to SEQ ID NO: 58385

SEQ ID NO: 80091 - RNA, 64 nt, Homo Sapiens; identical to SEQ ID NO: 58386

SEQ ID NO: 80092 - RNA, 64 nt, Homo Sapiens; identical to SEQ ID NO: 58387

SEQ ID NO: 80093 - RNA, 64 nt, Homo Sapiens; identical to SEQ ID NO: 58388

SEQ ID NO: 80094 - RNA, 64 nt, Homo Sapiens; identical to SEQ ID NO: 58389

SEQ ID NO: 80095 - RNA, 64 nt, Homo Sapiens; identical to SEQ ID NO: 58390

SEQ ID NO: 80096 - RNA, 64 nt, Homo Sapiens; identical to SEQ ID NO: 58391

SEQ ID NO: 80097 - RNA, 64 nt, Homo Sapiens; identical to SEQ ID NO: 58392

SEQ ID NO: 80098 - RNA, 64 nt, Homo Sapiens; identical to SEQ ID NO: 58393

SEQ ID NO: 80099 - RNA, 64 nt, Homo Sapiens; identical to SEQ ID NO: 58394

SEQ ID NO: 80100 - RNA, 64 nt, Homo Sapiens; identical to SEQ ID NO: 58395

SEQ ID NO: 80101 - RNA, 64 nt, Homo Sapiens; identical to SEQ ID NO: 58396

SEQ ID NO: 80102 - RNA, 64 nt, Homo Sapiens; identical to SEQ ID NO: 58397

SEQ ID NO: 80103 - RNA, 64 nt, Homo Sapiens; identical to SEQ ID NO: 58398

SEQ ID NO: 80104 - RNA, 64 nt, Homo Sapiens; identical to SEQ ID NO: 58399

SEQ ID NO: 80105 - RNA, 64 nt, Homo Sapiens; identical to SEQ ID NO: 58400

SEQ ID NO: 80106 - RNA, 64 nt, Homo Sapiens; identical to SEQ ID NO: 58401

SEQ ID NO: 80107 - RNA, 64 nt, Homo Sapiens; identical to SEQ ID NO: 58402

SEQ ID NO: 80108 - RNA, 64 nt, Homo Sapiens; identical to SEQ ID NO: 58403

SEQ ID NO: 80109 - RNA, 64 nt, Homo Sapiens; identical to SEQ ID NO: 58404

SEQ ID NO: 80110 - RNA, 64 nt, Homo Sapiens; identical to SEQ ID NO: 58405

SEQ ID NO: 80111 - RNA, 64 nt, Homo Sapiens; identical to SEQ ID NO: 58406

SEQ ID NO: 80112 - RNA, 64 nt, Homo Sapiens; identical to SEQ ID NO: 58407

SEQ ID NO: 80113 - RNA, 64 nt, Homo Sapiens; identical to SEQ ID NO: 58408

SEQ ID NO: 80114 - RNA, 64 nt, Homo Sapiens; identical to SEQ ID NO: 58409

SEQ ID NO: 80115 - RNA, 64 nt, Homo Sapiens; identical to SEQ ID NO: 58410

SEQ ID NO: 80116 - RNA, 64 nt, Homo Sapiens; identical to SEQ ID NO: 58411

SEQ ID NO: 80117 - RNA, 64 nt, Homo Sapiens; identical to SEQ ID NO: 58412

SEQ ID NO: 80118 - RNA, 64 nt, Homo Sapiens; identical to SEQ ID NO: 58413

SEQ ID NO: 80119 - RNA, 64 nt, Homo Sapiens; identical to SEQ ID NO: 58414

SEQ ID NO: 80120 - RNA, 64 nt, Homo Sapiens; identical to SEQ ID NO: 58415

SEQ ID NO: 80121 - RNA, 64 nt, Homo Sapiens; identical to SEQ ID NO: 58416

SEQ ID NO: 80122 - RNA, 64 nt, Homo Sapiens; identical to SEQ ID NO: 58417

SEQ ID NO: 80123 - RNA, 64 nt, Homo Sapiens; identical to SEQ ID NO: 58418

SEQ ID NO: 80124 - RNA, 64 nt, Homo Sapiens; identical to SEQ ID NO: 58419

SEQ ID NO: 80125 - RNA, 64 nt, Homo Sapiens; identical to SEQ ID NO: 58420

SEQ ID NO: 80126 - RNA, 64 nt, Homo Sapiens; identical to SEQ ID NO: 58421

SEQ ID NO: 80127 - RNA, 64 nt, Homo Sapiens; identical to SEQ ID NO: 58422

SEQ ID NO: 80128 - RNA, 64 nt, Homo Sapiens; identical to SEQ ID NO: 58423

SEQ ID NO: 80129 - RNA, 64 nt, Homo Sapiens; identical to SEQ ID NO: 58424

SEQ ID NO: 80130 - RNA, 64 nt, Homo Sapiens; identical to SEQ ID NO: 58425

SEQ ID NO: 80131 - RNA, 64 nt, Homo Sapiens; identical to SEQ ID NO: 58426

SEQ ID NO: 80132 - RNA, 64 nt, Homo Sapiens; identical to SEQ ID NO: 58427

SEQ ID NO: 80133 - RNA, 64 nt, Homo Sapiens; identical to SEQ ID NO: 58428

SEQ ID NO: 80134 - RNA, 64 nt, Homo Sapiens; identical to SEQ ID NO: 58429

SEQ ID NO: 80135 - RNA, 64 nt, Homo Sapiens; identical to SEQ ID NO: 58430

SEQ ID NO: 80136 - RNA, 64 nt, Homo Sapiens; identical to SEQ ID NO: 58431

SEQ ID NO: 80137 - RNA, 64 nt, Homo Sapiens; identical to SEQ ID NO: 58432

SEQ ID NO: 80138 - RNA, 64 nt, Homo Sapiens; identical to SEQ ID NO: 58433

SEQ ID NO: 80139 - RNA, 64 nt, Homo Sapiens; identical to SEQ ID NO: 58434

SEQ ID NO: 80140 - RNA, 64 nt, Homo Sapiens; identical to SEQ ID NO: 58435

SEQ ID NO: 80141 - RNA, 50 nt, Homo Sapiens; identical to SEQ ID NO: 58436

SEQ ID NO: 80142 - RNA, 64 nt, Homo Sapiens; identical to SEQ ID NO: 58437

SEQ ID NO: 80143 - RNA, 64 nt, Homo Sapiens; identical to SEQ ID NO: 58438

SEQ ID NO: 80144 - RNA, 64 nt, Homo Sapiens; identical to SEQ ID NO: 58439

SEQ ID NO: 80145 - RNA, 64 nt, Homo Sapiens; identical to SEQ ID NO: 58440

SEQ ID NO: 80146 - RNA, 64 nt, Homo Sapiens; identical to SEQ ID NO: 58441

SEQ ID NO: 80147 - RNA, 64 nt, Homo Sapiens; identical to SEQ ID NO: 58442

SEQ ID NO: 80148 - RNA, 64 nt, Homo Sapiens; identical to SEQ ID NO: 58443

SEQ ID NO: 80149 - RNA, 64 nt, Homo Sapiens; identical to SEQ ID NO: 58444

SEQ ID NO: 80150 - RNA, 64 nt, Homo Sapiens; identical to SEQ ID NO: 58445

SEQ ID NO: 80151 - RNA, 64 nt, Homo Sapiens; identical to SEQ ID NO: 58446

SEQ ID NO: 80152 - RNA, 64 nt, Homo Sapiens; identical to SEQ ID NO: 58447

SEQ ID NO: 80153 - RNA, 64 nt, Homo Sapiens; identical to SEQ ID NO: 58448

SEQ ID NO: 80154 - RNA, 64 nt, Homo Sapiens; identical to SEQ ID NO: 58449

SEQ ID NO: 80155 - RNA, 64 nt, Homo Sapiens; identical to SEQ ID NO: 58450

SEQ ID NO: 80156 - RNA, 64 nt, Homo Sapiens; identical to SEQ ID NO: 58451

SEQ ID NO: 80157 - RNA, 64 nt, Homo Sapiens; identical to SEQ ID NO: 58452

SEQ ID NO: 80158 - RNA, 64 nt, Homo Sapiens; identical to SEQ ID NO: 58453

SEQ ID NO: 80159 - RNA, 64 nt, Homo Sapiens; identical to SEQ ID NO: 58454

SEQ ID NO: 80160 - RNA, 64 nt, Homo Sapiens; identical to SEQ ID NO: 58455

SEQ ID NO: 80161 - RNA, 64 nt, Homo Sapiens; identical to SEQ ID NO: 58456

SEQ ID NO: 80162 - RNA, 64 nt, Homo Sapiens; identical to SEQ ID NO: 58457

SEQ ID NO: 80163 - RNA, 64 nt, Homo Sapiens; identical to SEQ ID NO: 58458

SEQ ID NO: 80164 - RNA, 64 nt, Homo Sapiens; identical to SEQ ID NO: 58459

SEQ ID NO: 80165 - RNA, 64 nt, Homo Sapiens; identical to SEQ ID NO: 58460

SEQ ID NO: 80166 - RNA, 64 nt, Homo Sapiens; identical to SEQ ID NO: 58461

SEQ ID NO: 80167 - RNA, 64 nt, Homo Sapiens; identical to SEQ ID NO: 58462

SEQ ID NO: 80168 - RNA, 64 nt, Homo Sapiens; identical to SEQ ID NO: 58463

SEQ ID NO: 80169 - RNA, 64 nt, Homo Sapiens; identical to SEQ ID NO: 58464

SEQ ID NO: 80170 - RNA, 64 nt, Homo Sapiens; identical to SEQ ID NO: 58465

SEQ ID NO: 80171 - RNA, 64 nt, Homo Sapiens; identical to SEQ ID NO: 58466

SEQ ID NO: 80172 - RNA, 64 nt, Homo Sapiens; identical to SEQ ID NO: 58467

SEQ ID NO: 80173 - RNA, 64 nt, Homo Sapiens
uguuuugugguggaguaucugaguuuucacccguaggaccgaaggaauauagaugagcguagcu

SEQ ID NO: 80174 - RNA, 64 nt, Homo Sapiens
acaggggccggacauuggggcugagagcacccagaggaccgaggcgaugcgggcagcugggggg

SEQ ID NO: 80175 - RNA, 64 nt, Homo Sapiens
cagagagcauagaccaagucaucuggaauggucuacaugccaugcggaaguccaccgaaggguu

SEQ ID NO: 80176 - RNA, 64 nt, Homo Sapiens
gguucacuucacggauguucaguggauaucggucacaugccagguccccagcuacgcauucaag

SEQ ID NO: 80177 - RNA, 64 nt, Homo Sapiens
uagcuagaugaaaaucuuugcacucacagagcuuacaugccagugagugaagaucgaugauaaa

SEQ ID NO: 80178 - RNA, 64 nt, Homo Sapiens
acuaaaaauacaaaaauuggcuggguguggugucacaugccaguaaccccagcuacuagggagg

SEQ ID NO: 80179 - RNA, 64 nt, Homo Sapiens
gccuuccugggcugagcacacgggaccgggucugacaugccagucguauccugggccccacugc

SEQ ID NO: 80180 - RNA, 64 nt, Homo Sapiens
aggaugcaggauuucuacaccuagagaacauuccacaugccaagucuguggggaauaaggauac

SEQ ID NO: 80181 - RNA, 64 nt, Homo Sapiens
guugacaguaauaggaauaacaggauagaaaugaacaugccaugcaaauaauauaauauuaugc

SEQ ID NO: 80182 - RNA, 50 nt, Homo Sapiens
gcgguccuccaggcagggaaacaugccacgaugaccccaacgagguauag

SEQ ID NO: 80183 - RNA, 64 nt, Homo Sapiens
gcuugucugacugcaaguuuuuuaaagaaaagaggaacuggagaaacgacuuccauugaugugg

SEQ ID NO: 80184 - RNA, 64 nt, Homo Sapiens
ugcucccagaauguccugugaugcaugauucuaagaacuggaagaaccuggugguuccauuugc

SEQ ID NO: 80185 - RNA, 64 nt, Homo Sapiens
cacgugaaguccuguguguggucgggaccaaagagaacuggaucagguaguuguuuacauauga

SEQ ID NO: 80186 - RNA, 64 nt, Homo Sapiens
accuuacaaguauaugaguaggggccagucuuuugaacuggacaaaugauuggcaacuucuaca

SEQ ID NO: 80187 - RNA, 64 nt, Homo Sapiens
gugguguucacaagaaaaucgaugaccucagaaugaacuggauucaagaagacuacuggaacug

SEQ ID NO: 80188 - RNA, 64 nt, Homo Sapiens
accucagaaugaacuggauucaagaagacuacuggaacuggauggaggaaaaugguguuuuccu

SEQ ID NO: 80189 - RNA, 64 nt, Homo Sapiens
cuagcccuggcggaggugcaggcccugucagcuggaacuggacagaccuugguuuguuuacaug

SEQ ID NO: 80190 - RNA, 64 nt, Homo Sapiens
ugagcgggauucagcaaugguggaauggaagacagaacuggaagagaaagaaggaaaagaugag

SEQ ID NO: 80191 - RNA, 64 nt, Homo Sapiens
gggccagccugaggacccccgccuaccaccucgagaacuggaagccaaccucuaaccuccugac

SEQ ID NO: 80192 - RNA, 64 nt, Homo Sapiens
gcuucaccagugcccaagucucuauggagaaugagaacuggaagccacugcuaccgucuaccca

SEQ ID NO: 80193 - RNA, 64 nt, Homo Sapiens
uguccaauaaacgcuuauuucucuaaacuuuggagaacuggaucauagcuaccaaguuaaccug

SEQ ID NO: 80194 - RNA, 64 nt, Homo Sapiens
uuauaggcauuaaagacaagauuuuuccuccucugaacuggauugcaggacuugccugauaaau

SEQ ID NO: 80195 - RNA, 64 nt, Homo Sapiens
ucuuugccuccuacuugcucagucucugucacaagaacuggaucuccauccccuugaugcucug

SEQ ID NO: 80196 - RNA, 64 nt, Homo Sapiens
uagagaauguaacugaccaaagucacacugccaggaacuggaagcacuaggauuugacagcaua

SEQ ID NO: 80197 - RNA, 64 nt, Homo Sapiens
augcguaagagacccagaacagagccuccagggggaacuggaggggcaggaaggauccuccccu

SEQ ID NO: 80198 - RNA, 64 nt, Homo Sapiens
caauugcagagugcacuaaaagagucucuggagggaacuggauaggcaggaaggacccuccccu

SEQ ID NO: 80199 - RNA, 64 nt, Homo Sapiens
uguacagccagcagggcccaggcagccaccaagcccaccccaggucaugccagcggcagaggac

SEQ ID NO: 80200 - RNA, 64 nt, Homo Sapiens
aacacgaucugggggggggauccugucuuccuccccaccccaccccacucuuacccaauuucug

SEQ ID NO: 80201 - RNA, 64 nt, Homo Sapiens
gaucugggggggggauccugucuuccuccccaccccaccccacucuuacccaauuucugggcuc

SEQ ID NO: 80202 - RNA, 64 nt, Homo Sapiens
ugggugccuggccuccagugucccaccuccuucaccaccccacuuggcuccuuugccaucuuga

SEQ ID NO: 80203 - RNA, 64 nt, Homo Sapiens
guuauuucuguaaagaugguuauuuaacccuccuccaccccaucacgguggcccugagggcuga

SEQ ID NO: 80204 - RNA, 64 nt, Homo Sapiens
cagguuucaagucuggguucugguguccacucacccaccccaccccccaaaaucagacaaaugc

SEQ ID NO: 80205 - RNA, 64 nt, Homo Sapiens
aaggaccagguccuguuccucuuucuccccgacuccaccccagcucccugugaagagagaguua

SEQ ID NO: 80206 - RNA, 64 nt, Homo Sapiens
caaccucuaugcuuucuucuuucuagcaagccccccaccccaauaaauuuuuuuaaauggaagc

SEQ ID NO: 80207 - RNA, 64 nt, Homo Sapiens
cacgcccccuaccuuucccacccucaacccccucccaccccaucgggagggcaucucccugcuc

SEQ ID NO: 80208 - RNA, 64 nt, Homo Sapiens
uguaguuaauuucagugccuucuuccaccacuccccaccccagccacucaucccucuuuuucuu

SEQ ID NO: 80209 - RNA, 64 nt, Homo Sapiens
caccacugaguccacucggacugggccugcaggcccaccccagcugccccuuccuccuucaugc

SEQ ID NO: 80210 - RNA, 64 nt, Homo Sapiens
cccacugcccuccagggccacacagggaccacauccaccccagcgugauccaggaaagaugucc

SEQ ID NO: 80211 - RNA, 64 nt, Homo Sapiens
ccuggcugaccugcuguggauacacagacccugcccaccccauccaggccucaccucccagggc

SEQ ID NO: 80212 - RNA, 64 nt, Homo Sapiens
uguauauaacccagccccuguucucugcaucuguccaccccaugaguuguauuuagcuuugagu

SEQ ID NO: 80213 - RNA, 64 nt, Homo Sapiens
accccggggucucuggggaaggaggaaccacugcccaccccaccggaccaaggugugugugucu

SEQ ID NO: 80214 - RNA, 64 nt, Homo Sapiens
ccaaccauacacacauacaaguccacacacacucccaccccagccaaaaauauauaaaaaacaa

SEQ ID NO: 80215 - RNA, 64 nt, Homo Sapiens
aucaacaacccccaaccaccaucuaccacuacggccaccccaaaggaccccgacgccaacagac

SEQ ID NO: 80216 - RNA, 64 nt, Homo Sapiens
gugucguuuuguuuuuaaagcaugaccugcuuccccaccccacgccugccagcugccacagcug

SEQ ID NO: 80217 - RNA, 64 nt, Homo Sapiens
ucuucuuuccauuuauuucggccuccacagcaccccaccccauauggggaggguggcuggcccg

SEQ ID NO: 80218 - RNA, 64 nt, Homo Sapiens
uccccaccaccaccucugugaugccccuucucucccaccccaucagggaggcccuuuucugauc

SEQ ID NO: 80219 - RNA, 64 nt, Homo Sapiens
cuuuuccuuucaucugaacauggauccaccagucccaccccagcugagcccaacagguccacga

SEQ ID NO: 80220 - RNA, 64 nt, Homo Sapiens
acgccacucauuucaucucagccagcgccucccuccaccccaggcacccccagccccgacucca

SEQ ID NO: 80221 - RNA, 64 nt, Homo Sapiens
aauggaaaaucgucuaacuggagaagggcgguauccaccccacauucggaucccaggguccuga

SEQ ID NO: 80222 - RNA, 64 nt, Homo Sapiens
agaaaggcacaauguggagccuggggugucucccccaccccaggaccgucagguuuaccagugu

SEQ ID NO: 80223 - RNA, 64 nt, Homo Sapiens
ugagcagggccccucccccagcuccauuccgcucccaccccagccggcugcguuccucucucca

SEQ ID NO: 80224 - RNA, 64 nt, Homo Sapiens
ccauuuauucagcuacaucaucccucuauuaaccccaccccaucaggcacgugugcaaaccucu

SEQ ID NO: 80225 - RNA, 64 nt, Homo Sapiens
ugccuuuggagguuaaggcuggaagcuguucuccccaccccagguucuuuccuguuguagggga

SEQ ID NO: 80226 - RNA, 64 nt, Homo Sapiens
uguacuggaagggacccuggcugcacagcucagcccaccccaucccuggucgcuuugauucuuc

SEQ ID NO: 80227 - RNA, 64 nt, Homo Sapiens
gauugcccgugaagacuuugcccaucccagacucccaccccaggagguauccuucauuauccac

SEQ ID NO: 80228 - RNA, 64 nt, Homo Sapiens
ccagacucccaccccagggaguauccuucauuauccaccccaucccccacuucugcaaccccag

SEQ ID NO: 80229 - RNA, 64 nt, Homo Sapiens
ucugcaaccccagguauccuugccccagggauucccaccccacuccccaccuccuguggacuga

SEQ ID NO: 80230 - RNA, 64 nt, Homo Sapiens
gucgagguuccccuaccccucuggcaggagcaacccaccccaugggccuugccccuaguacccc

SEQ ID NO: 80231 - RNA, 64 nt, Homo Sapiens
agcccugaccucauuugggcugccccccgucccuccaccccagauccuucccccgccgccacug

SEQ ID NO: 80232 - RNA, 52 nt, Homo Sapiens
acagcuaccuggugagcugaugccaccccagcaucugucuuuucacccacgg

SEQ ID NO: 80233 - RNA, 64 nt, Homo Sapiens
aaggacaccuuugcagggauucuuguccugcuggccaccccacccacaccugucccuggccagc

SEQ ID NO: 80234 - RNA, 64 nt, Homo Sapiens
cccugagguaccuuuccacccagacccuccuuccccaccccauaagcccugagacucccgccuu

SEQ ID NO: 80235 - RNA, 64 nt, Homo Sapiens
cugccccgcgucuucagcuguuucgcauccaccgccaccccacugagagcugcuccuuuggggg

SEQ ID NO: 80236 - RNA, 64 nt, Homo Sapiens
auucucaaccaggaggugauuuugcccccugacuccaccccagggacauucaaaaaugucuggu

SEQ ID NO: 80237 - RNA, 64 nt, Homo Sapiens
augcacagcacaaccuacaacagcaaagaaucauccaccccaaaauaucaguagugccgagauu

SEQ ID NO: 80238 - RNA, 64 nt, Homo Sapiens
cguccugccauccccccccgccguccugccuuccccaccccacccuuaggucccagguaguugc

SEQ ID NO: 80239 - RNA, 64 nt, Homo Sapiens
uugcaauguaagggccucagcuuccuuggagaagccaccccagguuuccagacauagauguuga

SEQ ID NO: 80240 - RNA, 64 nt, Homo Sapiens
aaucaggcccauccaucccaugccucccuccuccccaccccacuccaacaguuccucuuucccg

SEQ ID NO: 80241 - RNA, 64 nt, Homo Sapiens
uauaagcgcuucucuucgcauagucacguagcucccaccccacccucuuccugugucucacgca

SEQ ID NO: 80242 - RNA, 64 nt, Homo Sapiens
uuacuauugacagucaccccguaagguucacaaaccaccccauugaacagaugaggaacugagg

SEQ ID NO: 80243 - RNA, 64 nt, Homo Sapiens
cagugagaggagugguguguaccccuaaauccucccaccccagcacugcccaucuguaaaaucu

SEQ ID NO: 80244 - RNA, 64 nt, Homo Sapiens
aaccccagguagggacgccccuuguuccucacccccaccccacuuagguccugggcccccacug

SEQ ID NO: 80245 - RNA, 64 nt, Homo Sapiens
ccccuaucagggggacagcuggugggcaaagcagccaccccacagccuuguggcuagaguacag

SEQ ID NO: 80246 - RNA, 64 nt, Homo Sapiens
cauucuggaaagcucucccaggaggaagcauuccccaccccaccuugccucuguccugcgcugg

SEQ ID NO: 80247 - RNA, 64 nt, Homo Sapiens
cauucuccuguggcccucuaguccaccccccgccccaccccagccccuggcaaccacugaucug

SEQ ID NO: 80248 - RNA, 64 nt, Homo Sapiens
agcacggcacacaguucagccuccccaccccaccccaccccaggccacgacagccaggacugcc

SEQ ID NO: 80249 - RNA, 64 nt, Homo Sapiens
ccaggagcacggcacacagucugcccuccccaccccaccccaccacagcccacgacagccagga

SEQ ID NO: 80250 - RNA, 64 nt, Homo Sapiens
ccaccccaggagcacggcaccaggacugcccuccccaccccaccccccgacagcccacgacagc

SEQ ID NO: 80251 - RNA, 64 nt, Homo Sapiens
acaaaguugccacagguuuuacuguagcccauuuccaccccacccccaacuucauuucccccuc

SEQ ID NO: 80252 - RNA, 64 nt, Homo Sapiens
uugucccugaugucuugggguuccccaucucacuccaccccacuucuucuauaccuucuucucc

SEQ ID NO: 80253 - RNA, 64 nt, Homo Sapiens
agcuuccggcucccucuucuccccccucuacccgccaccccaccccaccccacccccgcccacu

SEQ ID NO: 80254 - RNA, 64 nt, Homo Sapiens
ccggcucccucuucuccccccucuacccgccaccccaccccaccccacccccgcccacucguug

SEQ ID NO: 80255 - RNA, 64 nt, Homo Sapiens
ucccucuucuccccccucuacccgccaccccaccccaccccacccccgcccacucguugccuga

SEQ ID NO: 80256 - RNA, 64 nt, Homo Sapiens
aggggaggacuccuggguggacagccuuugacguccaccccacgcugaugcagaagcucccaga

SEQ ID NO: 80257 - RNA, 64 nt, Homo Sapiens
gucacugcauggccucugcccauccugcaccuguccaccccaccccaacacccuggaagccacu

SEQ ID NO: 80258 - RNA, 64 nt, Homo Sapiens
ugcauggccucugcccauccugcaccuguccaccccaccccaacacccuggaagccacugucaa

SEQ ID NO: 80259 - RNA, 64 nt, Homo Sapiens
ggggagggaggggcccuggaggccacauccugccccaccccacccccacucccacggacacuaa

SEQ ID NO: 80260 - RNA, 64 nt, Homo Sapiens
uggaucuggggcuguuccccccccuccguuuuuuccaccccacaguuccuccugggaucuggcc

SEQ ID NO: 80261 - RNA, 64 nt, Homo Sapiens
uguucccuucccaccuccaaccuagcccuacugcccaccccaccccaacccaccccaugcccag

SEQ ID NO: 80262 - RNA, 64 nt, Homo Sapiens
ccuucccaccuccaaccuagcccuacugcccaccccaccccaacccaccccaugcccagugguc

SEQ ID NO: 80263 - RNA, 64 nt, Homo Sapiens
uccaaccuagcccuacugcccaccccaccccaacccaccccaugcccaguggucucaguagaua

SEQ ID NO: 80264 - RNA, 64 nt, Homo Sapiens
cagcggcagccacuagaccgcgcccggcagccacccaccccacgugccaacuuccccuccccgu

SEQ ID NO: 80265 - RNA, 64 nt, Homo Sapiens
auguuugcugugcuucccgccguggagggcagagccaccccacaucaggaucggacgugcuacc

SEQ ID NO: 80266 - RNA, 64 nt, Homo Sapiens
gguuuacccccccggccugggcaucugaccucccccaccccagugugauuuaacauccaggaac

SEQ ID NO: 80267 - RNA, 64 nt, Homo Sapiens
cagcccagccguguguggugucagguuccucuccccaccccagcuucaagcagaggccucgggg

SEQ ID NO: 80268 - RNA, 64 nt, Homo Sapiens
uacagcuguguuuuuuaaagccaccucucugucuccaccccaugggcccacacccagguggggg

SEQ ID NO: 80269 - RNA, 64 nt, Homo Sapiens
ccgcuuccacaugagcuaaagcccucccgcgcccccaccccagaccccgagccaccccaggaaa

SEQ ID NO: 80270 - RNA, 64 nt, Homo Sapiens
aaagcccucccgcgcccccaccccagaccccgagccaccccaggaaaagcacaaggacugccgc

SEQ ID NO: 80271 - RNA, 64 nt, Homo Sapiens
ucaacagaauauacauucuuaucuacagaacgcuccaccccaaaaccaagcggaccuaggagac

SEQ ID NO: 80272 - RNA, 64 nt, Homo Sapiens
ugggacuuccauggcuucugccuuacaccacuagccaccccacgugcccauccgagaccucugu

SEQ ID NO: 80273 - RNA, 64 nt, Homo Sapiens
aguaugcuuguccugaagagagguuuggcuauccccaccccaccccaccccacccuguuccuuu

SEQ ID NO: 80274 - RNA, 64 nt, Homo Sapiens
gcuuguccugaagagagguuuggcuauccccaccccaccccaccccacccuguuccuuuuuuau

SEQ ID NO: 80275 - RNA, 64 nt, Homo Sapiens
uccugaagagagguuuggcuauccccaccccaccccaccccacccuguuccuuuuuuaucagga

SEQ ID NO: 80276 - RNA, 64 nt, Homo Sapiens
ugccuucaggucuucuucaccaaaauaagcacccccaccccaucaagccccuucuccacuguag

SEQ ID NO: 80277 - RNA, 64 nt, Homo Sapiens
uacacagcagaauaguacaagggccaguuuaccaccaccccaagcaguugaaagcuccgaguuu

SEQ ID NO: 80278 - RNA, 64 nt, Homo Sapiens
cugcccccacccucacccacugucugccaccagcccaccccacccccucaccaaugcaucuauc

SEQ ID NO: 80279 - RNA, 64 nt, Homo Sapiens
gaagccaugaacucccaagcccaggggcuuggccccaccccagccgaguggggggaucacaaag

SEQ ID NO: 80280 - RNA, 64 nt, Homo Sapiens
ugcauucccagcucuacccuuucuccugcuuuaaccaccccaucugcuggccuugccacacucu

SEQ ID NO: 80281 - RNA, 64 nt, Homo Sapiens
cuggccuugccacacucuuugggcccuggagcagccaccccaugaagaaggaggcuaugcucag

SEQ ID NO: 80282 - RNA, 64 nt, Homo Sapiens
gcucuuuccuuccccuccucggucaucuguagggccaccccacauggcugccuuggugcagcag

SEQ ID NO: 80283 - RNA, 64 nt, Homo Sapiens
cugggaaggagagcuugcuuuccauccaucauaaccaccccagcguccuccagcugucugacua

SEQ ID NO: 80284 - RNA, 64 nt, Homo Sapiens
cucagcgucucugccccuaaucuucuccauccuuccaccccaccaccgcuccaccccaccacug

SEQ ID NO: 80285 - RNA, 64 nt, Homo Sapiens
acugucuucuccauccuuccuaucccccaccgcuccaccccaccgcauuccuccacccacccuc

SEQ ID NO: 80286 - RNA, 64 nt, Homo Sapiens
uaaccuccucaguucccuaggggcucuccccaccccaccccagacuagaaucuucaaucaaccu

SEQ ID NO: 80287 - RNA, 64 nt, Homo Sapiens
ccagauaaccuccucaguucaaccugggcucuccccaccccaccauucacuagaaucuucaauc

SEQ ID NO: 80288 - RNA, 64 nt, Homo Sapiens
cucaccacccaaaggguggugggcacugcugugaccaccccagcugcagagucagugcccuggg

SEQ ID NO: 80289 - RNA, 64 nt, Homo Sapiens
guggguccugggaccucuaaugugggcaugucguccaccccaggacgagccaucagggacagac

SEQ ID NO: 80290 - RNA, 64 nt, Homo Sapiens
cuugaaggaugggccugcugcacgucucccuccuccaccccauaccacacuggggggucugagc

SEQ ID NO: 80291 - RNA, 64 nt, Homo Sapiens
cucggucacccuccugguucugcccugucccauuccaccccaccccagggggaacaguagcuuc

SEQ ID NO: 80292 - RNA, 64 nt, Homo Sapiens
ucacccuccugguucugcccugucccauuccaccccaccccagggggaacaguagcuucaccuu

SEQ ID NO: 80293 - RNA, 64 nt, Homo Sapiens
cuggggcccagauugugagggggcuccucagcucccaccccaggccacugugggacuuucuggu

SEQ ID NO: 80294 - RNA, 64 nt, Homo Sapiens
cagcugggcagggccggugugcccagcacccgcuccaccccagcugcaggacccccaggccuga

SEQ ID NO: 80295 - RNA, 64 nt, Homo Sapiens
ugccaagcccugggccagcacuccaggguacccuccaccccagcacuguucuggguggcuggau

SEQ ID NO: 80296 - RNA, 64 nt, Homo Sapiens
acaagccgacacacagggaggacagagcaaacacccaccccagaggccugaaggggagcucuga

SEQ ID NO: 80297 - RNA, 64 nt, Homo Sapiens
acaauaccucgaauuuccaauccccggagucccuccaccccauauugagccccgccccuuucuu

SEQ ID NO: 80298 - RNA, 64 nt, Homo Sapiens
ccccggcaugaggccuuuccccgggcagcucucaccaccccaggagaccuccguccucugcuuu

SEQ ID NO: 80299 - RNA, 64 nt, Homo Sapiens
ucccuaauagcuaggauuacagguguguggccucccaccccaccccacccuucacaccuggcug

SEQ ID NO: 80300 - RNA, 64 nt, Homo Sapiens
aauagcuaggauuacagguguguggccucccaccccaccccacccuucacaccuggcugauuuu

SEQ ID NO: 80301 - RNA, 64 nt, Homo Sapiens
ucucacucuccccaguccucaggcagcagcuuuuccaccccaggaaucucuguuccuucucugu

SEQ ID NO: 80302 - RNA, 64 nt, Homo Sapiens
agcccagcauggaugugucucaggcaccucauccccaccccaccucaccccaacaaacuccucu

SEQ ID NO: 80303 - RNA, 64 nt, Homo Sapiens
uguaggcuacauccugauaccuauaaguucacccccaccccacagcugcuggagagaaauccca

SEQ ID NO: 80304 - RNA, 64 nt, Homo Sapiens
aucucuguauauacuuucccagcccugucugucuccaccccauccccucuugucucugagaacc

SEQ ID NO: 80305 - RNA, 64 nt, Homo Sapiens
accccauccccucuugucucugagaaccauucucccaccccaaguuccaccuucuauguuucua

SEQ ID NO: 80306 - RNA, 64 nt, Homo Sapiens
cuacuucccucacccacuuuggccuccguucaccccaccccaccccaccucuccccaccuuacc

SEQ ID NO: 80307 - RNA, 64 nt, Homo Sapiens
ucccucacccacuuuggccuccguucaccccaccccaccccaccucuccccaccuuacccccgc

SEQ ID NO: 80308 - RNA, 64 nt, Homo Sapiens
ggggcucugcucccggucuugggcccugggaaccccaccccaccccaccccacaggcguuguaa

SEQ ID NO: 80309 - RNA, 64 nt, Homo Sapiens
ucugcucccggucuugggcccugggaaccccaccccaccccaccccacaggcguuguaaccuug

SEQ ID NO: 80310 - RNA, 64 nt, Homo Sapiens
ucccggucuugggcccugggaaccccaccccaccccaccccacaggcguuguaaccuugaaucu

SEQ ID NO: 80311 - RNA, 64 nt, Homo Sapiens
uugccucucuccugugggccugcuccucagcucuccaccccagguaugugaguccuugugcucc

SEQ ID NO: 80312 - RNA, 64 nt, Homo Sapiens
caggugucccuccuaugcacuccugggcacuuccccaccccagcaccugcauccccagcacugg

SEQ ID NO: 80313 - RNA, 64 nt, Homo Sapiens
aagccuuggcaaccucauuuuggggucuuucccaccaccccacuccuugacuuuaguguagugg

SEQ ID NO: 80314 - RNA, 64 nt, Homo Sapiens
gacucaggacucaggucuccugacccagccccagccaccccauguuugaugacauauuacccgc

SEQ ID NO: 80315 - RNA, 64 nt, Homo Sapiens
gggcccaaccaugggcucagauucccggacccuuccaccccacuacuuagcuucccucucccuc

SEQ ID NO: 80316 - RNA, 64 nt, Homo Sapiens
ccucugguccaucccucccugauuagccgguugcccaccccagccccugcuuuuauuuauuuug

SEQ ID NO: 80317 - RNA, 64 nt, Homo Sapiens
guuggugagaugccaaguuucccgcccagcuugcccaccccauaggauggugucucccagcuuc

SEQ ID NO: 80318 - RNA, 64 nt, Homo Sapiens
cagggcucccuguccagaaucaucauaccugcacccaccccagccccucuuuccugccccuccc

SEQ ID NO: 80319 - RNA, 64 nt, Homo Sapiens
cuugucacuuuccuacccugauggucacacuagcccaccccaagcuccgacauugagguuuuca

SEQ ID NO: 80320 - RNA, 64 nt, Homo Sapiens
agguuuucaucucugcagggagagguuccaauguccaccccacccccagguacccgccucuucc

SEQ ID NO: 80321 - RNA, 64 nt, Homo Sapiens
gcauccacccagccugaggcucaagcugcccuuaccaccccaucccccacgcaggaccaacuac

SEQ ID NO: 80322 - RNA, 64 nt, Homo Sapiens
ucccaaaccacuuacuucccuguucaccucugccccaccccagcccagaggaguuugagccacc

SEQ ID NO: 80323 - RNA, 64 nt, Homo Sapiens
gcucaccccgggguggcccuggaggccccugaccccaccccacccacagagcacgagggccccg

SEQ ID NO: 80324 - RNA, 64 nt, Homo Sapiens
caucaucagaggacgccccgugcgcugucaccuuccaccccacaaggccaaccuuuuucugugg

SEQ ID NO: 80325 - RNA, 51 nt, Homo Sapiens
gaaccgaccaccucccaugacccaccccagcccccugaacccccuucaugg

SEQ ID NO: 80326 - RNA, 64 nt, Homo Sapiens
agucaccacuagggggugauggagaggaagggggccaccccagggccauuaacaaccaguacuc

SEQ ID NO: 80327 - RNA, 64 nt, Homo Sapiens
ggacacuccgucugcuccaaugacugagcagcauccaccccaccccaucuuugcugccagcucu

SEQ ID NO: 80328 - RNA, 64 nt, Homo Sapiens
cuccgucugcuccaaugacugagcagcauccaccccaccccaucuuugcugccagcucucagga

SEQ ID NO: 80329 - RNA, 64 nt, Homo Sapiens
uguaccucuguguaucuguacagccucgcuccugccaccccacccuugcguucugcauuaggua

SEQ ID NO: 80330 - RNA, 64 nt, Homo Sapiens
ccccgggcacugcacagccugucugggggccagaccaccccauuguccauccuuguuguccgug

SEQ ID NO: 80331 - RNA, 62 nt, Homo Sapiens
uccgcaucaacaaaaccugaggccccuuccucccaccccaucucucuccuguggaugcuccu

SEQ ID NO: 80332 - RNA, 64 nt, Homo Sapiens
gaaugucccugacccugccugaucccucccucacccaccccaaagguauuuuugauaacagagc

SEQ ID NO: 80333 - RNA, 64 nt, Homo Sapiens
gugacugagccagggccugcauuuuugguuuuccccaccccacacauucucaaccauaguccuu

SEQ ID NO: 80334 - RNA, 64 nt, Homo Sapiens
ccuggacuuaauaccagccggauaccucuggcccccaccccauuacuguaccucuggagucacu

SEQ ID NO: 80335 - RNA, 54 nt, Homo Sapiens
uuuugcagaggcugccguaguaauccaccccaacggccggaggagccgccggag

SEQ ID NO: 80336 - RNA, 64 nt, Homo Sapiens
gcucccggaaccggacggcacagggcguucuugcccaccccaggggccaggcuugcggaggggg

SEQ ID NO: 80337 - RNA, 64 nt, Homo Sapiens
acgacguggcacacauuccacgugggugcugccgccaccccagucggucguggcgugcagcugg

SEQ ID NO: 80338 - RNA, 64 nt, Homo Sapiens
cccuuuggccucuguuuguccccuuuccaguccuccaccccaccccuggagcccagccugggag

SEQ ID NO: 80339 - RNA, 64 nt, Homo Sapiens
ugucugagaagugaggagccccuccgcccggcagccaccccaucugggaagugaggagcgucua

SEQ ID NO: 80340 - RNA, 64 nt, Homo Sapiens
cuacugggaagugaggagccccucugccuggccaccaccccaucugggaggugugcccagcagc

SEQ ID NO: 80341 - RNA, 64 nt, Homo Sapiens
gucuuugccuggugucuuccuuucccguguccgcccaccccagcgucuguugguacuuaccugu

SEQ ID NO: 80342 - RNA, 64 nt, Homo Sapiens
cccaacaccagucagcccuauacccuaacucacuccaccccauuuucuccggcugccuggccgg

SEQ ID NO: 80343 - RNA, 64 nt, Homo Sapiens
ggguauuuuguuuuuguucucaccugcugcccccccaccccaccaccccagggauaaauuggau

SEQ ID NO: 80344 - RNA, 64 nt, Homo Sapiens
uguuuuuguucucaccugcugcccccccaccccaccaccccagggauaaauuggauauaaacac

SEQ ID NO: 80345 - RNA, 64 nt, Homo Sapiens
guacauccauguguggcucugcuccaccccugugccaccccagagcccugggggguggucucca

SEQ ID NO: 80346 - RNA, 64 nt, Homo Sapiens
cggugucuccacggugcucucgcccugcccauggccaccccagacucugaucuccaggaacccc

SEQ ID NO: 80347 - RNA, 64 nt, Homo Sapiens
cuacucuccagacgcccugaccuucaucuccaccccaccccaccugccauuucuccccucucuu

SEQ ID NO: 80348 - RNA, 64 nt, Homo Sapiens
ccacccuacucuccagacgccucuuccuucaucuccaccccaccacuccugccauuucuccccu

SEQ ID NO: 80349 - RNA, 64 nt, Homo Sapiens
aagggcaagagcuguggaaaauaaccccaccuccccaccccaaaguaaucauucacauguaaaa

SEQ ID NO: 80350 - RNA, 64 nt, Homo Sapiens
cccaccuucacccucuuccucuacccaacuacccccaccccaauaugacuaaggacugagcccc

SEQ ID NO: 80351 - RNA, 64 nt, Homo Sapiens
cacuucugcacuugcgguuccggaccagccuggcccaccccacccuaucagacuaagccagcac

SEQ ID NO: 80352 - RNA, 59 nt, Homo Sapiens
gcagccagggagagcccaggggcucagccccaccccaggcagacucugacuccaacuga

SEQ ID NO: 80353 - RNA, 64 nt, Homo Sapiens
gcacccacucugcuuugacucagggcugacacguccaccccagucagccuggaggccgggugcu

SEQ ID NO: 80354 - RNA, 64 nt, Homo Sapiens
gugaccggcugcuuuucccuacgucugacccucuccaccccauaccccaguaagccacugccac

SEQ ID NO: 80355 - RNA, 64 nt, Homo Sapiens
ugcuccccucccuccucuguaccugagcuccccaccaccccagccugcuggcacauuuccccag

SEQ ID NO: 80356 - RNA, 64 nt, Homo Sapiens
uccugcccuggaaaucuggaagccccucccugccccaccccagcgggagacggucuugccucuc

SEQ ID NO: 80357 - RNA, 64 nt, Homo Sapiens
augaccuuugacccuacggcucuucucccugcccccaccccacuaccgggagcucuuggcugca

SEQ ID NO: 80358 - RNA, 64 nt, Homo Sapiens
cccgccaugcaacgggauugauccccaccccaccccaccccaccccaccggaggucacuccacc

SEQ ID NO: 80359 - RNA, 64 nt, Homo Sapiens
ccacccccgccaugcaacggccaccauccccaccccaccccaccgccugccaccggaggucacu

SEQ ID NO: 80360 - RNA, 64 nt, Homo Sapiens
ccaccccacccccgccaugcucacuccaccauccccaccccacccccccgccugccaccggagg

SEQ ID NO: 80361 - RNA, 64 nt, Homo Sapiens
agaaucaggaucucuuucucauucaaggggggaaccaccccaggucagcgcugcgccugcugug

SEQ ID NO: 80362 - RNA, 64 nt, Homo Sapiens
auuccuuuccuuugaaugauagcugugauucaccccaccccauuuucuuguuucugguccaucc

SEQ ID NO: 80363 - RNA, 64 nt, Homo Sapiens
ucuuuucuucauuucuuuccagaacaacucuuucccaccccaacaccacugccaccaccccucu

SEQ ID NO: 80364 - RNA, 64 nt, Homo Sapiens
uagcaggugcaacaaaaacaagaaacaaaugugcccaccccacuuuccgcuuaacugaaaagcu

SEQ ID NO: 80365 - RNA, 64 nt, Homo Sapiens
uacagaugaggggaggggccgcagugcgcagaacccaccccaccccccagugcagacuucgggg

SEQ ID NO: 80366 - RNA, 64 nt, Homo Sapiens
cccaccccaccccccagugcagacuucggggucuccaccccaggccagcagcgcccacugggcu

SEQ ID NO: 80367 - RNA, 64 nt, Homo Sapiens
ccgaccaggagggggagagcagccuccacuuaccccaccccacccuugggcuaaaagcccccag

SEQ ID NO: 80368 - RNA, 64 nt, Homo Sapiens
ccgaggggcaccccagccccgccucugcucccccccaccccacccacccucggggcgccccccu

SEQ ID NO: 80369 - RNA, 64 nt, Homo Sapiens
gggggcuguugccccucccuccaucuccccacacccaccccaccccacagcagggcuccuggcc

SEQ ID NO: 80370 - RNA, 64 nt, Homo Sapiens
cuguugccccucccuccaucuccccacacccaccccaccccacagcagggcuccuggcccccac

SEQ ID NO: 80371 - RNA, 64 nt, Homo Sapiens
agucaccccuccucuccccccgccuccuggccugccaccccaccccagcguuuaccccaaagca

SEQ ID NO: 80372 - RNA, 64 nt, Homo Sapiens
ccccuccucuccccccgccuccuggccugccaccccaccccagcguuuaccccaaagcacaaug

SEQ ID NO: 80373 - RNA, 64 nt, Homo Sapiens
cuuacugagucccucugggcagcagcucccuucuccaccccaccccagcacccgucccaaaugu

SEQ ID NO: 80374 - RNA, 64 nt, Homo Sapiens
ugagucccucugggcagcagcucccuucuccaccccaccccagcacccgucccaaauguggccu

SEQ ID NO: 80375 - RNA, 64 nt, Homo Sapiens
uccgaaagaagcuaaaccuugcacaucccaacacccaccccagggagaguucccgugugugccu

SEQ ID NO: 80376 - RNA, 64 nt, Homo Sapiens
aucacugaguuuauccaccgccauccaccucuauccaccccauaaggucccuacagcaaguggg

SEQ ID NO: 80377 - RNA, 64 nt, Homo Sapiens
auguccccauuacaccagagggacaccccccaccccaccccaccgcugcucaggagccagcaca

SEQ ID NO: 80378 - RNA, 64 nt, Homo Sapiens
ccaccauguccccauuacacgcacaggacaccccccaccccaccaggaugcugcucaggagcca

SEQ ID NO: 80379 - RNA, 64 nt, Homo Sapiens
caccccucuuuuuacucaaacaccgccccucuccccaccccaggcaccuccagggccuuagaac

SEQ ID NO: 80380 - RNA, 64 nt, Homo Sapiens
ucuccuggccacugagacacccuccccccgucgcccaccccacggccuccaacccugccugcgg

SEQ ID NO: 80381 - RNA, 64 nt, Homo Sapiens
gcuggguuucggggcuugguuccccuuccccccaccaccccaucgggccccggcccucccuggc

SEQ ID NO: 80382 - RNA, 64 nt, Homo Sapiens
uuccuccaggccaagucaugggacuacuuguuucccaccccagguucuggccucugagguuggg

SEQ ID NO: 80383 - RNA, 64 nt, Homo Sapiens
ggcagcguccaggugcggggccgcccacccgcccccaccccaccugcuuuguccgucuauccac

SEQ ID NO: 80384 - RNA, 64 nt, Homo Sapiens
cagcggccccaucggaacugccucgcaccgcuccccaccccacuaggccggagccccugggagc

SEQ ID NO: 80385 - RNA, 64 nt, Homo Sapiens
cccugccccagacgcucccuccaggcaggaggucccaccccagagcccauagcaucccacaggc

SEQ ID NO: 80386 - RNA, 64 nt, Homo Sapiens
cugggcuguucacucucucgccauccuccugcccccaccccagggugcccggggaucccccgcc

SEQ ID NO: 80387 - RNA, 64 nt, Homo Sapiens
acuauugugcgauucgugaggugccgugcgacccccaccccaugggagaccacgcuucuccucc

SEQ ID NO: 80388 - RNA, 64 nt, Homo Sapiens
gggcaggcaggcaggcccccgccccguccucccaccaccccagggccccagcgucuucucccca

SEQ ID NO: 80389 - RNA, 64 nt, Homo Sapiens
cauccccguauuucccccucgagccgcuggggagccaccccauuucucguaauagaaaaguggg

SEQ ID NO: 80390 - RNA, 64 nt, Homo Sapiens
cuccaggguuagggggagcaaucuaauuucacccccaccccaccagggccccagaguuccuugc

SEQ ID NO: 80391 - RNA, 64 nt, Homo Sapiens
caucugaaccauuccugucuccuccccccaccuuccaccccaacaagcuuccucugacgguuac

SEQ ID NO: 80392 - RNA, 53 nt, Homo Sapiens
cccccggccaagccuggacucucccaccccaagggcugcugccugcgcccuga

SEQ ID NO: 80393 - RNA, 64 nt, Homo Sapiens
uacagggugagcucagccugggggucuccccaccccaccccauugccaacaccaccacccccag

SEQ ID NO: 80394 - RNA, 64 nt, Homo Sapiens
ccauuuacagggugagcucacccagggggucuccccaccccaccccggagccaacaccaccacc

SEQ ID NO: 80395 - RNA, 64 nt, Homo Sapiens
uugaaaaacaguugucuggcagacccccagugcaccaccccauauuuaacauugugagccagcu

SEQ ID NO: 80396 - RNA, 64 nt, Homo Sapiens
uacagcaagggacuccccagaagggcucagcuucccaccccacgagcaagaaggcuggugaggg

SEQ ID NO: 80397 - RNA, 64 nt, Homo Sapiens
cucugaaaugugaaaagccucgccccaccccaccccaccccaccccaaagccaggggcccaccc

SEQ ID NO: 80398 - RNA, 64 nt, Homo Sapiens
ccacccucugaaaugugaaacaccccgccccaccccaccccaccgcagcccaaagccaggggcc

SEQ ID NO: 80399 - RNA, 64 nt, Homo Sapiens
ccaccccacccucugaaauggggcccaccccgccccaccccaccggagggcagcccaaagccag

SEQ ID NO: 80400 - RNA, 64 nt, Homo Sapiens
uucuaauuugcuguaggcugauaauauccgccccccaccccaguccaaggguauuacuggugga

SEQ ID NO: 80401 - RNA, 64 nt, Homo Sapiens
aucaucaggcaccuuuccccucccuaaugagauuccaccccaaugaguggggguucucgccaau

SEQ ID NO: 80402 - RNA, 64 nt, Homo Sapiens
uccccaccaacuucucugccccagggacccgaggccaccccagccugguguggacccaucggcg

SEQ ID NO: 80403 - RNA, 64 nt, Homo Sapiens
agcccucaggcccucccugccaaacuggagaaccccaccccaaggcaugccacguccgcagccc

SEQ ID NO: 80404 - RNA, 64 nt, Homo Sapiens
uuggucccagggcggggcagggaauucuaaguguccaccccagggaggcaaggggcugcuuucc

SEQ ID NO: 80405 - RNA, 64 nt, Homo Sapiens
uauuauggaucccuugggcugugggccuucccauccaccccaccacaacugcccagguagcugg

SEQ ID NO: 80406 - RNA, 64 nt, Homo Sapiens
gcuuuugucugaugcucugggauucuggccagacccaccccagggcacauguccugcgggggcg

SEQ ID NO: 80407 - RNA, 64 nt, Homo Sapiens
ccagccuuucgcgucaccuggaggccacaucuucccaccccaccugccagccccugucucuccu

SEQ ID NO: 80408 - RNA, 64 nt, Homo Sapiens
ccacagggacaagaggggcccccucgccccagccccaccccacauggagcucagggggaagcag

SEQ ID NO: 80409 - RNA, 64 nt, Homo Sapiens
cgcugcuagcgcaccccugcaguccagcgugcauccaccccacgcacgccccgugcuguguucc

SEQ ID NO: 80410 - RNA, 64 nt, Homo Sapiens
cccccaccucccacccugacauuccagcugccugccaccccagaacuacucucuucaccccuuu

SEQ ID NO: 80411 - RNA, 64 nt, Homo Sapiens
aagugcggggaggagguuauacaucuuggcauccccaccccagguuccuuuaugcaacacccaa

SEQ ID NO: 80412 - RNA, 64 nt, Homo Sapiens
uggcaccacagcugcaucuuaaagaugagaaaagccaccccaucaaaaaaauaauaauaaucuu

SEQ ID NO: 80413 - RNA, 64 nt, Homo Sapiens
uucuguuacacuguauaguaguccuauggcacccccaccccaucccuuucgugccacucccguc

SEQ ID NO: 80414 - RNA, 64 nt, Homo Sapiens
ccccaucccuuucgugccacucccguccccacccccaccccaguguguauaagcuggcauuucg

SEQ ID NO: 80415 - RNA, 64 nt, Homo Sapiens
aaugggggaaugacacaucccccccaaccuacccccaccccaaaagcagcuccaacagaauggc

SEQ ID NO: 80416 - RNA, 64 nt, Homo Sapiens
ucacuccaccucaaagucauuugacugcccccauccaccccaccacccuaaucuuccaccaccu

SEQ ID NO: 80417 - RNA, 64 nt, Homo Sapiens
ccuccuauccaccccucccccacacucacccaucccaccccacccccccagucaccauugucac

SEQ ID NO: 80418 - RNA, 64 nt, Homo Sapiens
agcccucucuucccccaccucgccacccuaccucccaccccagcccaaggaccgggcccugccc

SEQ ID NO: 80419 - RNA, 64 nt, Homo Sapiens
cuggagaguuuagucauaaugagauguggacuugugcuuauaaaagcaccuguucugaggaggu

SEQ ID NO: 80420 - RNA, 64 nt, Homo Sapiens
gcuuccaaauacaacuccaggaacgucucagaugugcuuauaaaacaaauauuuugauucuaga

SEQ ID NO: 80421 - RNA, 64 nt, Homo Sapiens
cacaacaucuauuuuaccaaaauauaaagggagaugcuuauagcuuaaaagcuucuaaaugucu

SEQ ID NO: 80422 - RNA, 64 nt, Homo Sapiens
uggaacaacuacacagccuaguccuguaauaaggugcuuauaaaccuuauagguucauguaacu

SEQ ID NO: 80423 - RNA, 64 nt, Homo Sapiens
uguaaaugaaaucacauuuacugucaagaaaagcugcuuauaaaaggcaauuuaaucaaaauuc

SEQ ID NO: 80424 - RNA, 64 nt, Homo Sapiens
guuucuucccauguucccauaaacaaacucaaauugcuuauaaagagauagcuaacugcccaua

SEQ ID NO: 80425 - RNA, 64 nt, Homo Sapiens
auuguauaauuguuaauaaugaaaaauaaagaugugcuuauaucuaaauauuaaguguuuaaau

SEQ ID NO: 80426 - RNA, 64 nt, Homo Sapiens
agacuugauggacaaacaccaagcgucauggauaugcuuauacaacauuuuacaagaaguaugu

SEQ ID NO: 80427 - RNA, 64 nt, Homo Sapiens
guagaaaccauauuuugguuaacagcaagaaaaaugcuuauaauguaguacaauuaaaaacaac

SEQ ID NO: 80428 - RNA, 64 nt, Homo Sapiens
cuaauaucuguuauuuaauugaaaucugcuugugugcuuauaagaauuuacugaguucucacuu

SEQ ID NO: 80429 - RNA, 64 nt, Homo Sapiens
auuaucugauaaugauuauuuaaauauuccuaucugcuuauaaaauggcugcuauaauaauaau

SEQ ID NO: 80430 - RNA, 64 nt, Homo Sapiens
auagauaauuuaacaaaaguacaggauuagaacaugcuuauaccuauaaauaagaacaaaauuu

SEQ ID NO: 80431 - RNA, 64 nt, Homo Sapiens
uuuuaaaaaaguaauuuccucugcuuuuuuuggcugcuuauaguuuuuaucugcauuuuacugu

SEQ ID NO: 80432 - RNA, 64 nt, Homo Sapiens
ggagggagagugguguguuuuguuuuuuuuguugugcuuauaugagaggcuuggacugcuucug

SEQ ID NO: 80433 - RNA, 64 nt, Homo Sapiens
aguagagacaagaucuccguauguuauacaggcuggccucaagugauccucuuaccuuggccuc

SEQ ID NO: 80434 - RNA, 64 nt, Homo Sapiens
aacaccgggauuauaggcgugagcccccgugccuggccucaaauuuuauuuuagcucgacccua

SEQ ID NO: 80435 - RNA, 64 nt, Homo Sapiens
aguacguguucaguaugcucguuauuaugaaaaaggccucaaggagagagcuggcuugagagua

SEQ ID NO: 80436 - RNA, 64 nt, Homo Sapiens
cugccagggaauaaaaccaggggucccugugccaggccucaauaccugcagcauacaguaagau

SEQ ID NO: 80437 - RNA, 64 nt, Homo Sapiens
cuugcuauguugcccagguuggucuugaacuccuggccucaagagauccccccaaccuuggccu

SEQ ID NO: 80438 - RNA, 64 nt, Homo Sapiens
agugcugggauuacaggcaugagccaccgcgccuggccucaaguaaguuuuuauaccaugauag

SEQ ID NO: 80439 - RNA, 64 nt, Homo Sapiens
ugugcauguaagccuuuguucccuggaggagaagggccucaaacugccauaugggcucacagca

SEQ ID NO: 80440 - RNA, 64 nt, Homo Sapiens
cugacuuggucccacuuggacaaacuucuggcuaggccucaaaaaaacaugucgcaaaaugaac

SEQ ID NO: 80441 - RNA, 64 nt, Homo Sapiens
aacccuccugccucagucuuggucuugaacuccuggccucaagccuugcuauguugcccaggcu

SEQ ID NO: 80442 - RNA, 64 nt, Homo Sapiens
gauccaccuaccuuagucucggucucaaacuccuggccucaaguuucaccguguuggccaggcu

SEQ ID NO: 80443 - RNA, 64 nt, Homo Sapiens
gagcacaacaaaaccugauucuggucuucuuuaccaauauaaucauaauguaaauaauaauuug

SEQ ID NO: 80444 - RNA, 64 nt, Homo Sapiens
uuucuauuaccuugcuaccaaacaguuuagauagcaauauaauagcaaaaaagcaaauauggua

SEQ ID NO: 80445 - RNA, 64 nt, Homo Sapiens
cacuuguuuuauucacagagguaaagugucuuuucaauauaaccagcaauuuagguggcaucua

SEQ ID NO: 80446 - RNA, 64 nt, Homo Sapiens
guagucuaguagguaacuuuguggcaaaaauuuucaauauaauacauucugaaacaauaguugc

SEQ ID NO: 80447 - RNA, 64 nt, Homo Sapiens
gaugcuaucuccuaauuacuaacucaucuucuuucaauauaauucccuuggcuauaagcaucua

SEQ ID NO: 80448 - RNA, 64 nt, Homo Sapiens
uuuuauucauagauguuuuuaacuaugguugccucaauauaaccaaccuagaucauuuucuacc

SEQ ID NO: 80449 - RNA, 64 nt, Homo Sapiens
aaaccaaaaaccauuuugaucucccugugguuaucaauauaacgcacaaucacaaguguaugag

SEQ ID NO: 80450 - RNA, 64 nt, Homo Sapiens
uuaaagaggaaaggcgauggugaugucuguaguacaauauaaaccauaauugugauuuaccuua

SEQ ID NO: 80451 - RNA, 64 nt, Homo Sapiens
gucacucauagcauuucuauauuugaaaguagcccaauauaaaacuuuugauucuaaaauuaaa

SEQ ID NO: 80452 - RNA, 64 nt, Homo Sapiens
ugaaggaaacaguuaauaccauuuuuuaaggaaacaauauaaccacaaagcacaguuugaacaa

SEQ ID NO: 80453 - RNA, 64 nt, Homo Sapiens
aaaacaaaacaaaaaacuccccuuccucacugcccaauauaaaaggcaaauguguacauggcag

SEQ ID NO: 80454 - RNA, 64 nt, Homo Sapiens
ucuuccucuuuuuuuuuuaauuggguaggacacccaauauaaaaacagucaauauuugacaaug

SEQ ID NO: 80455 - RNA, 64 nt, Homo Sapiens
uuucuauauugaauaaacaauguaacauagauaacaauauaaauaaaagugguaugaccagugc

SEQ ID NO: 80456 - RNA, 64 nt, Homo Sapiens
aaggaaaauaaaucaaugaauguaaagagaauaucaauauaaauccauauugcuauaguacuuc

SEQ ID NO: 80457 - RNA, 64 nt, Homo Sapiens
uugcauuugccaaaauuuacagaugugugaacuucaauauaaagagucucauucuuuaagauac

SEQ ID NO: 80458 - RNA, 64 nt, Homo Sapiens
cuugaaccccuaaaauuaucagacuuccuuuuuccaauauaaagaaaaaaaguaaguuuucaga

SEQ ID NO: 80459 - RNA, 64 nt, Homo Sapiens
guugcuuucuuugccugguccucaguuugcccaucaauauaauggguggauuggaugauuuuuu

SEQ ID NO: 80460 - RNA, 64 nt, Homo Sapiens
uauuguaaacaaaacacagcgcauuggcuugaagcaauauaauaauauaauguaugaacuuuuu

SEQ ID NO: 80461 - RNA, 64 nt, Homo Sapiens
uauucuaaacacaaugaaauuaguggcauuuaaacaauauaauaaaaaaaaaauuacacugugg

SEQ ID NO: 80462 - RNA, 64 nt, Homo Sapiens
cuaaaccuugacaguuggagugugaucaauauaacaauauaaucggccaagaaauuaaagcaca

SEQ ID NO: 80463 - RNA, 64 nt, Homo Sapiens
auauaauccuaaaccuugacaaagcacaugugaucaauauaacauuccuucuggccaagaaauu

SEQ ID NO: 80464 - RNA, 64 nt, Homo Sapiens
gguguccuuauaagaagggguaugggccccgaugcaauauaauuaauuaaaaugagcucacuga

SEQ ID NO: 80465 - RNA, 64 nt, Homo Sapiens
gacauccucaucaucacggguggacuuaggaaaacaauauaaagcagagucuggggugggagug

SEQ ID NO: 80466 - RNA, 64 nt, Homo Sapiens
ucucauaagcacuauagaauaacaauauaaaagccaauauaaaugggcacagacaaccuuauca

SEQ ID NO: 80467 - RNA, 64 nt, Homo Sapiens
gccaauauaaauucucauaaacaaccuuaucaaacaauauaaaauggaagucuggggggcacag

SEQ ID NO: 80468 - RNA, 64 nt, Homo Sapiens
uaauagcaaguauuuacugagggcauauuuaggucaauauaaaaaauauaacugauugaugaaa

SEQ ID NO: 80469 - RNA, 64 nt, Homo Sapiens
aguuguuccuuucauaguuuuucugaugcaauuucaauauaaaauauaacuuugcuacccugga

SEQ ID NO: 80470 - RNA, 64 nt, Homo Sapiens
cauuauuuucagaaccacauuuuaaaccuuuggguaaucagauuuccaacuuaugccuuccaga

SEQ ID NO: 80471 - RNA, 64 nt, Homo Sapiens
uauuguuauguaucacuugcuaaaaauauuguuuuaaucagagauaaccucuuuaaaaaaauuu

SEQ ID NO: 80472 - RNA, 64 nt, Homo Sapiens
cccucauuguguuucuaccgucagauuacugcuuuaaucagaaagaauuuggaggcuggaguaa

SEQ ID NO: 80473 - RNA, 64 nt, Homo Sapiens
acugcuuuaaucagaaacccuuuggaggcuggaguaaucagauuaacgaaugaaaauaacugaa

SEQ ID NO: 80474 - RNA, 64 nt, Homo Sapiens
cccaacuuuacugagaauuacuuuauucugauauuaaucagauuagaguggcuuuuauaaauag

SEQ ID NO: 80475 - RNA, 64 nt, Homo Sapiens
ucagcuuguucacuguuagaccacuugcaaaugauaaucagaagcuaacuuugaauccauccag

SEQ ID NO: 80476 - RNA, 64 nt, Homo Sapiens
cuaaaguaaaguuccuuuccuaaaaauaaaaaaguaaucagaaguaauaauaauaaaguaaaaa

SEQ ID NO: 80477 - RNA, 64 nt, Homo Sapiens
cuaagcugggugcaguggcuagauacugaggucauaaucagaagauuccucaguaucuauucca

SEQ ID NO: 80478 - RNA, 64 nt, Homo Sapiens
gccccagaggggccgguaauaaucacgugagggauaaucagauuccugcguauucagcaucuuc

SEQ ID NO: 80479 - RNA, 64 nt, Homo Sapiens
auccucagauuuaaauaaguacuuuuuuuuuuuuuaaucagaagaacauuguuguuugauuaua

SEQ ID NO: 80480 - RNA, 64 nt, Homo Sapiens
agggagaaagugguauuuauuaauauaauguguauaaucagagugccucuuauacauacuuuau

SEQ ID NO: 80481 - RNA, 64 nt, Homo Sapiens
auguuuuacaaauuugaaacuuucauaauuguauuaaucagaaaacaagcacauugccauucuu

SEQ ID NO: 80482 - RNA, 64 nt, Homo Sapiens
aagauugaccauugcuccuuuuuucaaacuuuuguaaucagauuucagaagagugaggcuucuu

SEQ ID NO: 80483 - RNA, 64 nt, Homo Sapiens
aacaguugaaucauugcuguuaaugugaaugauguaaucagacuuuagaggauauacuugguga

SEQ ID NO: 80484 - RNA, 64 nt, Homo Sapiens
auauauauauagaaagauguucuaagaagaaagaaacagagauaugacauauaugaaagguuua

SEQ ID NO: 80485 - RNA, 64 nt, Homo Sapiens
agaaggccaagagccagcuucuugaaaaaucugaaacagagaacaaaaacaagaaccacaaaaa

SEQ ID NO: 80486 - RNA, 64 nt, Homo Sapiens
ugauaaggaucagaacagcaaagccaacagucaaaacagagauggcugaacacuggcaacaaca

SEQ ID NO: 80487 - RNA, 64 nt, Homo Sapiens
gauaacucuccucgggucucgauacacugaaguuaacagagacaugcaucuggggaacuagagg

SEQ ID NO: 80488 - RNA, 64 nt, Homo Sapiens
aacaauaaauuuuaugaacugaacuaauauauguaacagagaaauaaaaacugaaggcagaaug

SEQ ID NO: 80489 - RNA, 64 nt, Homo Sapiens
cuguauuuaaucuacuuugaagaauuaccccuaaaacagagaccuuagaauaacaagaacacca

SEQ ID NO: 80490 - RNA, 64 nt, Homo Sapiens
ugcuaaacacugggcuucaucacccagggauaaaaacagagaucauugucuuggaccuccugca

SEQ ID NO: 80491 - RNA, 64 nt, Homo Sapiens
caucaagccagcuucauucacucacuuuacuuagaacagagauauaagggccugggaugcauuu

SEQ ID NO: 80492 - RNA, 64 nt, Homo Sapiens
ggaagagaggaagaacgagaaggcaaguuggaugaacagagaaguuuaaaugguuuucuuuuug

SEQ ID NO: 80493 - RNA, 64 nt, Homo Sapiens
caaaaagcuaaaaagacaccucgaaaauggcaacaacagagaugucucuagcaagggcucaacu

SEQ ID NO: 80494 - RNA, 64 nt, Homo Sapiens
cuguagaaaaauauuccagcaagauaauccguagaacagagagacuaguugaacacugguuuac

SEQ ID NO: 80495 - RNA, 64 nt, Homo Sapiens
uccaaacuacagguaaaaacugcaguuacauucuaacagagaaggccuuuaaaagggcugguaa

SEQ ID NO: 80496 - RNA, 64 nt, Homo Sapiens
ucuuggugguagcuauuugggauugaaauguuacaacagagauuauuauuucagagggaauggc

SEQ ID NO: 80497 - RNA, 64 nt, Homo Sapiens
aggagagaagccgagagacacuggagaggaaggcaacagagacaaagcauuucuaaagcaccga

SEQ ID NO: 80498 - RNA, 64 nt, Homo Sapiens
uuuacuuuuuuauuauaauuuugauauuaaaaagaacagagauggggucuugcuuuguugccca

SEQ ID NO: 80499 - RNA, 64 nt, Homo Sapiens
cacaaaucagcaucauaagggaauguagccuuccaacagagaugaugcuguucguauguuaauc

SEQ ID NO: 80500 - RNA, 64 nt, Homo Sapiens
ccccaucucuuuuaaauaaaagaccaaucugggcaacagagagacacuugagcucaggaguucu

SEQ ID NO: 80501 - RNA, 64 nt, Homo Sapiens
gggaugugugccugggagagagucuucuuccagaaacagagaagcgauuucccacuccuuucuu

SEQ ID NO: 80502 - RNA, 64 nt, Homo Sapiens
caccuccaagcucagacagggcccaggcuuggggaacagagagagcagguguacacccaaccaa

SEQ ID NO: 80503 - RNA, 64 nt, Homo Sapiens
agguugugacaggugcagguagacaacgcccauaaacagagaugguccugaacucuggagagau

SEQ ID NO: 80504 - RNA, 64 nt, Homo Sapiens
uguguguguguguaugagagagagagagagagacaacagagacagagagaggcagagaggcaua

SEQ ID NO: 80505 - RNA, 64 nt, Homo Sapiens
agagaggcauagagagacagagagagagacaagaaacagagauagacagaaaauguucggggug

SEQ ID NO: 80506 - RNA, 64 nt, Homo Sapiens
cacgcuaugcugccagaauuugcucaggcuggggaacagagaggagaucaagaagagugguuug

SEQ ID NO: 80507 - RNA, 64 nt, Homo Sapiens
caaaguaucugaacaagaauuacaaaucucuggcaacagagaggucccucuucccuuacccccu

SEQ ID NO: 80508 - RNA, 64 nt, Homo Sapiens
cacgaggcccggcucccuggggcagcugcuugagaacagagacugcuaccccauccugcccaug

SEQ ID NO: 80509 - RNA, 64 nt, Homo Sapiens
uaggguugcccgcuguggccugcuuccagggagcaacagagaggccaccaagcagaggcccgug

SEQ ID NO: 80510 - RNA, 64 nt, Homo Sapiens
gaaacuaaacacauacguaacuugccuuguaaucaacagagagacaucaucuuaauguuuggag

SEQ ID NO: 80511 - RNA, 64 nt, Homo Sapiens
uagauuguuuccugauuuaaauuggaaagcuucaaacagagaauagcauuugguugagaggguu

SEQ ID NO: 80512 - RNA, 64 nt, Homo Sapiens
acgguguccagagcuggcccggcaucuccugaagaacagagagccugaggucuuggcugagguu

SEQ ID NO: 80513 - RNA, 64 nt, Homo Sapiens
acgagccugaauacagcagacaugucuuaccaaaaacagagagaccaugauggaagaagcugag

SEQ ID NO: 80514 - RNA, 64 nt, Homo Sapiens
uugccaaccauauuggaucuguuucuuccagcagaacagagacaagccuuucuccuguuuaugg

SEQ ID NO: 80515 - RNA, 64 nt, Homo Sapiens
gucaaucuaguuccagagggaacuuccuccuuaaaacagagaagucaacaagggucucauaucu

SEQ ID NO: 80516 - RNA, 64 nt, Homo Sapiens
aaaugucucaaaugucucguuaagaaaguccaguaacagagaagaggauaguguuugauauauc

SEQ ID NO: 80517 - RNA, 64 nt, Homo Sapiens
cuguagcuuaaaacauguuuacauuucuaaauuuaacagagaugugauaacucuuccauguuuc

SEQ ID NO: 80518 - RNA, 64 nt, Homo Sapiens
agauucuauuagcuacugucagcucaugauagcaaacagagacucaguuaccucauugcuuacc

SEQ ID NO: 80519 - RNA, 64 nt, Homo Sapiens
ugguugaugucagacccagauagaaacacacaggaacagagaaaaaagauaggagauagcucug

SEQ ID NO: 80520 - RNA, 64 nt, Homo Sapiens
gauuugcuauggcaggucgucaagagaacugugucauuccaaacucaccaagguggcuuauaga

SEQ ID NO: 80521 - RNA, 64 nt, Homo Sapiens
auccaaauguuccccagaaauucugauaucaaaacauuccaauaacuuuuuuuuuucaggcgca

SEQ ID NO: 80522 - RNA, 64 nt, Homo Sapiens
ugugacaggccaagucuuacagugccauggcccacauuccaacuuaccauguacuuagugacuu

SEQ ID NO: 80523 - RNA, 64 nt, Homo Sapiens
uugaguacugugaaggauuauuugucuaacaguucauuccaaucagaccagguaggagcuuucc

SEQ ID NO: 80524 - RNA, 64 nt, Homo Sapiens
uuucuaguccauaccacaguguuucuucaugagucauuccaagugcuucaugugucauuccaag

SEQ ID NO: 80525 - RNA, 64 nt, Homo Sapiens
uuucuucaugagucauuccacaugcuucaugugucauuccaaggccucagaaugacuuuccuau

SEQ ID NO: 80526 - RNA, 64 nt, Homo Sapiens
aaagcaccuuuaaaaaaaauacauuuuaaaaaaacauuccaagccaauuggaagacaucauugg

SEQ ID NO: 80527 - RNA, 64 nt, Homo Sapiens
gcuaccuagaaaucuuuuccauuccucuuucauacauuccaacccacuggaagucuuuagaggu

SEQ ID NO: 80528 - RNA, 64 nt, Homo Sapiens
aguugccaguggcacauuacaccaguacagagcacauuccaaaggagacauuggaccaguuaau

SEQ ID NO: 80529 - RNA, 64 nt, Homo Sapiens
ugucauucacaucucacaaaaucuugacaucuuacauuccaauacauuaucaagcaagcacaag

SEQ ID NO: 80530 - RNA, 64 nt, Homo Sapiens
uucaguauuuaauguaauuaucuauuuuagcacucauuccaaaauuaaugaccaaaucacauua

SEQ ID NO: 80531 - RNA, 64 nt, Homo Sapiens
caguauauugguuccaauuauaaguucuggggagcauuccaaagacacuuuaaaaaccgccuug

SEQ ID NO: 80532 - RNA, 64 nt, Homo Sapiens
ccaaacugcaacugagccacaucggacugcaaaucauuccaaggagcgauuugcugaaggaaaa

SEQ ID NO: 80533 - RNA, 64 nt, Homo Sapiens
gcaguuuauuuuuagacccguuggcucuuacacccauuccaaauuguacuuugauuguaauagg

SEQ ID NO: 80534 - RNA, 64 nt, Homo Sapiens
gaggcuagugagaaagaaaagcuccucucugcuccauuccaaaggccaucuuguggucaguuuc

SEQ ID NO: 80535 - RNA, 64 nt, Homo Sapiens
ccuucagccacuugaagaagaaauagaaggcgcucauuccaauauagucuuuauuucccauuca

SEQ ID NO: 80536 - RNA, 64 nt, Homo Sapiens
ccugucuaaagucaaucauccgagauggguuuuccauuccaaagaaaggcaauaugguuccuuc

SEQ ID NO: 80537 - RNA, 64 nt, Homo Sapiens
uguugucuaggccuuccccuugugaaucuggguucauuccaauacggcaaguaagaguuggaaa

SEQ ID NO: 80538 - RNA, 64 nt, Homo Sapiens
guccugguacagcagggucuugcuguaacucagacauuccaaggguaugggaagccauauucac

SEQ ID NO: 80539 - RNA, 64 nt, Homo Sapiens
ccccccgccccccaccuuugggaucagccuccgccauuccaagucaacacucuucuugagcaga

SEQ ID NO: 80540 - RNA, 64 nt, Homo Sapiens
aauguuuuuugcauucaaaggacauccacaucuguuggaagacuuuuaagugaguuuuuguucu

SEQ ID NO: 80541 - RNA, 64 nt, Homo Sapiens
aacuaauucugugagaguugagcucauuuucuaguuggaagaaugugauauuuguuguguuggu

SEQ ID NO: 80542 - RNA, 64 nt, Homo Sapiens
guggugcgguaaccugcguggcuccugauagcguuuggaagaacgcgggggagacugaagagca

SEQ ID NO: 80543 - RNA, 64 nt, Homo Sapiens
acgcaucuggaggggacuggaggaaacccccuuguuggaagagauuccaagagaagcacgguuu

SEQ ID NO: 80544 - RNA, 64 nt, Homo Sapiens
gauccuaaggaugugacacugggagaguggccaguuggaagaagcacugcuaaaaugauucaca

SEQ ID NO: 80545 - RNA, 64 nt, Homo Sapiens
cuuugaaaauauuguuacaauagaacuaggggacuuggaagaugucauuugguggcaaaguuca

SEQ ID NO: 80546 - RNA, 64 nt, Homo Sapiens
agccugucauccuuggucuuuguaucuuccauauuuggaagaaaaaaaucuucuccagauuuuu

SEQ ID NO: 80547 - RNA, 64 nt, Homo Sapiens
agaacuguaaguguuuuuucauauguacuuuucauuggaagauucccaacaagaauuuggaugg

SEQ ID NO: 80548 - RNA, 64 nt, Homo Sapiens
cccuccagaagcauacuggaaagugccacccuucuuggaagacccauggccauucaugacccuu

SEQ ID NO: 80549 - RNA, 64 nt, Homo Sapiens
cccccagaugcccaggcucaucuucccuggccccuuggaagagggccagaacuggggggcugag

SEQ ID NO: 80550 - RNA, 64 nt, Homo Sapiens
gcauuugugguacaauaugcagcuuauauuucccuuggaagagaucuauaacuugacguuggug

SEQ ID NO: 80551 - RNA, 64 nt, Homo Sapiens
auguuuugaguauaugugacuacagauaaaaugguuggaagaaacaccaaagaugcuucugaaa

SEQ ID NO: 80552 - RNA, 64 nt, Homo Sapiens
aagaggcaugacagcuaacagggacgggcuuucuuuggaagaugaugaaauuguggaaugaugg

SEQ ID NO: 80553 - RNA, 64 nt, Homo Sapiens
ugugaauauacuagaaaccaaugaauuaaaaacuuuggaagaugaauuuuauggucugugaauu

SEQ ID NO: 80554 - RNA, 64 nt, Homo Sapiens
uacccuccuuggaguugcaaguauucuuucaagguuggaagagggauuuugaagagguaucucu

SEQ ID NO: 80555 - RNA, 64 nt, Homo Sapiens
uuuuuccauaagggacaugagcauuuuacuaggcuuggaagagcugacaugaugagcauuauug

SEQ ID NO: 80556 - RNA, 64 nt, Homo Sapiens
cauagaaucccagucaccuuuauauaucauauuauuggaagagauucaucuucauaaucuccag

SEQ ID NO: 80557 - RNA, 64 nt, Homo Sapiens
uagaaucacaauuaccuuuauauaucauauguuauuggaagagauuccucaguaaucuccaauc

SEQ ID NO: 80558 - RNA, 64 nt, Homo Sapiens
ucaccaaagauuauuacaaauuuaccagaauucauuggaagaaauuuuguucugcauugacuca

SEQ ID NO: 80559 - RNA, 64 nt, Homo Sapiens
agaaagugcuggcucacuuucauuuuaucuguaauuggaagaacaucucuauagaucgucagcu

SEQ ID NO: 80560 - RNA, 64 nt, Homo Sapiens
uugagauuaugaugaaaaccuacauauuccauguuuggaagacccuuggaagaggaaaauugga

SEQ ID NO: 80561 - RNA, 64 nt, Homo Sapiens
augaaaaccuacauauuccauguuuggaagacccuuggaagaggaaaauuggauucccuuaaac

SEQ ID NO: 80562 - RNA, 64 nt, Homo Sapiens
uuucaugaguccagggaagaggguccuccaggucuuggaagacagaggggagcugcuuuagagg

SEQ ID NO: 80563 - RNA, 64 nt, Homo Sapiens
accaucuuguggccaccucagacaucacuucucuuuggaagacuccauuaaauauuucucugug

SEQ ID NO: 80564 - RNA, 64 nt, Homo Sapiens
aauuuaauuuuagcuuuaaaauauuggauuggcuuuggaagaauuauauuagguagaauacaca

SEQ ID NO: 80565 - RNA, 64 nt, Homo Sapiens
acauaagacuaaacaugagaaaaacgcuaacuuauuggaagaaaaucggagaaacguugguguc

SEQ ID NO: 80566 - RNA, 64 nt, Homo Sapiens
auauaaguagauguuaagguucacuguguuggauuuggaagaaaguagguagccuucucugugg

SEQ ID NO: 80567 - RNA, 64 nt, Homo Sapiens
gaaaggaaacacacucuuucguuguguaguugcauuggaagagacucuacaauguuaagggguu

SEQ ID NO: 80568 - RNA, 64 nt, Homo Sapiens
aaaaaaguuccuuccuaaaauaauuucucuacaauuggaagauuggaagauucagcuaguuagg

SEQ ID NO: 80569 - RNA, 64 nt, Homo Sapiens
uccuuccuaaaauaauuucucuacaauuggaagauuggaagauucagcuaguuaggagcccacc

SEQ ID NO: 80570 - RNA, 64 nt, Homo Sapiens
gaauuucaaaaauggcuaggagcuuggugaauaauuggaagaaacacuaauugucacaccugga

SEQ ID NO: 80571 - RNA, 64 nt, Homo Sapiens
cauugguuauaaauucaaagggaaggcaaagacauuggaagaggucauuuauauuaaagaauuu

SEQ ID NO: 80572 - RNA, 64 nt, Homo Sapiens
uuccuccugcuuauauuguuucuuuuuaagcuucuuggaagaauacucaauuuaaaaauccaaa

SEQ ID NO: 80573 - RNA, 64 nt, Homo Sapiens
ggaaagcuguuuccuccuggcuccaccucacccuuuggaagaaaagcaggaugugucacuaaug

SEQ ID NO: 80574 - RNA, 64 nt, Homo Sapiens
cuggacacuaacaauucuacuuggaagaccuugcuuggaagagcaauauuuuugagauaucccu

SEQ ID NO: 80575 - RNA, 64 nt, Homo Sapiens
uugcuuggaagagccuggacuuugagauaucccuuuggaagacccuucaacucuaaggaauauu

SEQ ID NO: 80576 - RNA, 64 nt, Homo Sapiens
aaccaggacagccaagugaaaauuuaaaaacaaauuggaagaaugagaaaggggaaucucccaa

SEQ ID NO: 80577 - RNA, 64 nt, Homo Sapiens
uugccccuuagccauccccagguugcaacugccuuuggaagauuucaccccaggcccagaagua

SEQ ID NO: 80578 - RNA, 64 nt, Homo Sapiens
uguaauacaguuuauaccaguguaugcucuagacuuggaagauguaguauguuugauguggauu

SEQ ID NO: 80579 - RNA, 64 nt, Homo Sapiens
gugcuuaaaugguaauguacuccacuucuuccuauuggaagauuaacauuauuuaccaagaagg

SEQ ID NO: 80580 - RNA, 64 nt, Homo Sapiens
aaaagagugaggcugaaaguuaaggauaauccauuuggaagaagcucuuuaaagguaaaagguu

SEQ ID NO: 80581 - RNA, 64 nt, Homo Sapiens
uuuuaaaggccacauaggccugggaaucucaggauuggaagagaccccuuuuuauccagaguug

SEQ ID NO: 80582 - RNA, 64 nt, Homo Sapiens
gccaggagagcaggaacagaacagagaaaugcccuuggaagaaguggaguugguggaugggugg

SEQ ID NO: 80583 - RNA, 64 nt, Homo Sapiens
gugugugagggagcugaguaggccagguaggcgauuggaagagugagcaggacacagaggggag

SEQ ID NO: 80584 - RNA, 64 nt, Homo Sapiens
uaaaagaugaauaaacugggugauauuuucaauuuuggaagaacuucuccuuagcaguaggacu

SEQ ID NO: 80585 - RNA, 64 nt, Homo Sapiens
uaagaagcagugauacucccguauaucugcugccuuggaagacaugccucgugcagauucugag

SEQ ID NO: 80586 - RNA, 64 nt, Homo Sapiens
ucagaaccaagcugacugugucugcauucucagcuuggaagacccuuuauugaugagguggaua

SEQ ID NO: 80587 - RNA, 64 nt, Homo Sapiens
agguuccggugaggacaagcgacagucgggauuguuggaagaacuugaacauacaaagugggca

SEQ ID NO: 80588 - RNA, 64 nt, Homo Sapiens
auaaucaagaagagcaaagcaaagaggaacgggcuuggaagaaaauugguuucagaugaugaag

SEQ ID NO: 80589 - RNA, 64 nt, Homo Sapiens
ugacugcaaauacaaacacccacagugcagugaauuggaagacuuucugcuagcuuguuuucuu

SEQ ID NO: 80590 - RNA, 64 nt, Homo Sapiens
cuaaauuagcgaauguuuuuuuuuuuucuucugguuggaagaacuuugugggagacuuggcuuu

SEQ ID NO: 80591 - RNA, 64 nt, Homo Sapiens
ccgcauggguucgaggugagugggaauugcacucuuggaagaucuccuugagcaaguggagcug

SEQ ID NO: 80592 - RNA, 64 nt, Homo Sapiens
uauugggaaggaaucauuguuccaggcauccaucuuggaagaaaggaccagcuuugagcuccau

SEQ ID NO: 80593 - RNA, 64 nt, Homo Sapiens
aucucuuaaauacacguaggugggccagagaacauuggaagaaucaagagagauuagaauaucu

SEQ ID NO: 80594 - RNA, 64 nt, Homo Sapiens
uuuucccauauacaaucuuccuuccuuagguaauuuggaagaaaacuaugacccauuuaauuuc

SEQ ID NO: 80595 - RNA, 64 nt, Homo Sapiens
aaguuacuacuuacaggugauaacuugcauacuauuggaagauaaacuugucaaacuugucaag

SEQ ID NO: 80596 - RNA, 64 nt, Homo Sapiens
uggauuguccggaagacaugagacuuggagcuucuuggaagacaggaagacuugauuuacugga

SEQ ID NO: 80597 - RNA, 64 nt, Homo Sapiens
uggauuuccuggaagacgugagaccuugaaauuauuggaagacagaagaucuguauuugaugga

SEQ ID NO: 80598 - RNA, 64 nt, Homo Sapiens
gucugauguuccugccaaauuucagucucaucuaaccuuccaauccuaagaguuuucucaccug

SEQ ID NO: 80599 - RNA, 64 nt, Homo Sapiens
cacuggccugaugccccgccaccccuuuggccacaccuuccaggcagcagagcagcagcuagag

SEQ ID NO: 80600 - RNA, 64 nt, Homo Sapiens
uaugggucuuagucuuaaggguaacagagugaauaccuuccaaauaaaaagcuaaauauuccuc

SEQ ID NO: 80601 - RNA, 64 nt, Homo Sapiens
gaauaacuuuaguaaguuagcugccagcauuagaaccuuccaggaagaauuuuaacuaguaugc

SEQ ID NO: 80602 - RNA, 64 nt, Homo Sapiens
uuacauugcugcugcuagagaggguggggauugcaccuuccaaaucuguuucuguaccaauauu

SEQ ID NO: 80603 - RNA, 64 nt, Homo Sapiens
uguggcuugucuugccaauagacuccaggcuuauaccuuccauuuccaucguauucuccaguuu

SEQ ID NO: 80604 - RNA, 64 nt, Homo Sapiens
gugccaggcagggcuggccuguccccaccccaccaccuuccaggcucccccaagccaggccccu

SEQ ID NO: 80605 - RNA, 64 nt, Homo Sapiens
accagcgugugcgcagggcccugccuggcccucaaccuuccaugccacagggacacugcucugc

SEQ ID NO: 80606 - RNA, 64 nt, Homo Sapiens
aaaagugccgggaccaaauguuaauaauaauaaaaccuuccaaagagacuccaucucaauaaaa

SEQ ID NO: 80607 - RNA, 64 nt, Homo Sapiens
accaggcgcgguggcuaaaaagcaguaauuaauaaccuuccaagauaucuauuaaauaaauuga

SEQ ID NO: 80608 - RNA, 64 nt, Homo Sapiens
cgccuucgcccuggggauccgugagccagcccccaccuuccagggccccgcggaagaccgccca

SEQ ID NO: 80609 - RNA, 64 nt, Homo Sapiens
cauuccgucucaucgugcgucccaaugcuuguagaccuuccauuuuuccuccaccccuccaucc

SEQ ID NO: 80610 - RNA, 64 nt, Homo Sapiens
uaagauuucuuccagggaaucuccccaccacggaaccuuccaucugcaucagacaaugccauuu

SEQ ID NO: 80611 - RNA, 64 nt, Homo Sapiens
gccguggucucaaggagucaccggaaaccauggcaccuuccagagauguggcuccuagugcaaa

SEQ ID NO: 80612 - RNA, 64 nt, Homo Sapiens
aaggguagccuggcuuuucuggcguguccaggagaccuuccacaggcuguggguggggaaggaa

SEQ ID NO: 80613 - RNA, 64 nt, Homo Sapiens
gaaaagcagaaguucaugggcauuccacauccccaccuuccaagggcccuagacccucccccac

SEQ ID NO: 80614 - RNA, 64 nt, Homo Sapiens
gucaggcagggaaguuauagcacaggugccccucaccuuccacauucucuggggauugcugggu

SEQ ID NO: 80615 - RNA, 64 nt, Homo Sapiens
ggauaaaauaguucagaguuaggaccuuuccuuuaccuuccaauaguucuuccucccacaaugu

SEQ ID NO: 80616 - RNA, 64 nt, Homo Sapiens
acguugcuggggagagaaaagcaguauagacuccaccuuccaggauguccauuucggggagagg

SEQ ID NO: 80617 - RNA, 64 nt, Homo Sapiens
cucuccucguccccacccacccccacauuugcacaccuuccacagggucaggauggaguagcug

SEQ ID NO: 80618 - RNA, 64 nt, Homo Sapiens
uuaaaagcuuccuccuccauucucuuugaaaugaagaauauaguacuaaaauuaggacauguuu

SEQ ID NO: 80619 - RNA, 64 nt, Homo Sapiens
uuuaacugaaugaagccauacaggaauauuuugcagaauauaggaguuguacuuaaguguguaa

SEQ ID NO: 80620 - RNA, 64 nt, Homo Sapiens
uacuauauuuauacuguauauauaauacugacugagaauauaauacuguauuugagaauauaaa

SEQ ID NO: 80621 - RNA, 64 nt, Homo Sapiens
uauaauacugacugagaauauaauacuguauuugagaauauaaaaaacuuuuuucagggaagaa

SEQ ID NO: 80622 - RNA, 64 nt, Homo Sapiens
aaaguacuuuauaacucacauuacagauuuaaugagaauauauccacuuacuuauagaggugau

SEQ ID NO: 80623 - RNA, 64 nt, Homo Sapiens
aauauguguguauaaaauaacuuaguaauauauuagaauauacaugguaauucauuaaaauugc

SEQ ID NO: 80624 - RNA, 64 nt, Homo Sapiens
gaauugagugucuaugaaaaccauauuccagacaagaauauagucuaagguaaauguucucaua

SEQ ID NO: 80625 - RNA, 64 nt, Homo Sapiens
cuccacaauaaauuuuaaugagcacuacaaauuuagaauauauaaaaauaucaguaaccuauga

SEQ ID NO: 80626 - RNA, 64 nt, Homo Sapiens
aaauguuauuacugaggaaagaaaauacauuauuagaauauaaaagaacaaaagaggauuagua

SEQ ID NO: 80627 - RNA, 64 nt, Homo Sapiens
gccaaauauuaagaagcucauuuuugauggaaaaagaauauauuuguuuuaggugccuggauau

SEQ ID NO: 80628 - RNA, 64 nt, Homo Sapiens
auuauauauaagguggccacccagcauuuaugguagaauauauaaaaucauaauuugaagaagg

SEQ ID NO: 80629 - RNA, 64 nt, Homo Sapiens
uccuuauucagaauuucuaacaccuuaucuauguagaauauauuuuagaaagcugaguguuuca

SEQ ID NO: 80630 - RNA, 64 nt, Homo Sapiens
ugcagcuauugacuuuguaagaaagcuuuguagcagaauauauuuuauagagauauuucuuaca

SEQ ID NO: 80631 - RNA, 64 nt, Homo Sapiens
ugaucacaaaaagggagaaauaagaaacgugauaagaauauagaaugcagaagaauggcuaaaa

SEQ ID NO: 80632 - RNA, 64 nt, Homo Sapiens
gcuccauuuuauuuuauaguaacauuuuauuucuagaauauaugauuuaaaugauuuuaauuuu

SEQ ID NO: 80633 - RNA, 64 nt, Homo Sapiens
uucuuggugaauuuuuguaucucaaaggccuugaagaauauauuacagucaaagauugugucac

SEQ ID NO: 80634 - RNA, 64 nt, Homo Sapiens
ugucaaauaaaaucaugaucaaagaauuuaagaaagaauauauuagacuuuuuaaaauguacau

SEQ ID NO: 80635 - RNA, 64 nt, Homo Sapiens
aaaagggaauuuaggauccauccuaagugccaccagaauauauaaagcaccuauagacuugaac

SEQ ID NO: 80636 - RNA, 64 nt, Homo Sapiens
aagagaauuaaaaucguagcuuguacagaucaagagaauauacugggcagaaugaaguauguuu

SEQ ID NO: 80637 - RNA, 64 nt, Homo Sapiens
uuaaaaauaaaggauuuuggaacucuggagaguaagaauauaguauagaguuugccucaacaca

SEQ ID NO: 80638 - RNA, 64 nt, Homo Sapiens
auuugggcauucucugcugauaauuaauucuuucagaauauaaauguaaaaaauaaagcaagug

SEQ ID NO: 80639 - RNA, 64 nt, Homo Sapiens
agagaacugugauuuaaaagauauuuaaaaauauagaauauauuaacauuuaauuguguucauc

SEQ ID NO: 80640 - RNA, 64 nt, Homo Sapiens
cacucaagcuacuggcacaugucauucauuuuucagaauauaacgaaagaauaacagaaaaugu

SEQ ID NO: 80641 - RNA, 64 nt, Homo Sapiens
auuugaucuucuaaucugugccuggaucaaauuaagaauauaaauaugaaauguuacuucguuc

SEQ ID NO: 80642 - RNA, 64 nt, Homo Sapiens
gaacuguacaguuacuuugaaauuauucucaggaagaauauaauuuaguuuguugggggauaua

SEQ ID NO: 80643 - RNA, 64 nt, Homo Sapiens
agcuauauuuugaagacuugaucccacuuuacaaagaauauaaaccuucaguugcaauaugcua

SEQ ID NO: 80644 - RNA, 64 nt, Homo Sapiens
cccugacccacacaaagguucuggagauuacuggagaauauauauaaauauauauauguacgua

SEQ ID NO: 80645 - RNA, 64 nt, Homo Sapiens
ggauuacaggcaugagccacugcacccggcccugagaauauauuuauuaaagccaccucuucac

SEQ ID NO: 80646 - RNA, 64 nt, Homo Sapiens
guuaggauauagcuaugccuuuaugguuaagauuagaauauaugauccauaaaaauuuaaagug

SEQ ID NO: 80647 - RNA, 64 nt, Homo Sapiens
uugguaguuguaacugcuaauaaaaccagugacuagaauauaagggagguaaaaaggacaagau

SEQ ID NO: 80648 - RNA, 64 nt, Homo Sapiens
uuggaagcccuuaacuaaacaauacucuaugaauagaauauacugggaaaaauaauguuggaga

SEQ ID NO: 80649 - RNA, 56 nt, Homo Sapiens
aaauguguagggaggcuuuuugaaacagaauauaugaucaaaauuuguacugguga

SEQ ID NO: 80650 - RNA, 64 nt, Homo Sapiens
ggggaaugggaagaagcaguuuacuuuagacuaaagaauauauuggggggccggguguaguggc

SEQ ID NO: 80651 - RNA, 64 nt, Homo Sapiens
agagcgagacuccaucucaaaaaaaaaaaaaaaaagaauauauugacggaagaauagagaggag

SEQ ID NO: 80652 - RNA, 64 nt, Homo Sapiens
ugacagagaugugcauguggguauuguuaggaaaugucaucaaacuccacccaccuggcuucau

SEQ ID NO: 80653 - RNA, 64 nt, Homo Sapiens
cuuucacacaaugcccaacuuacugucuucuucaugucaucaaaaucugcacagucacuggccc

SEQ ID NO: 80654 - RNA, 64 nt, Homo Sapiens
ugacagagaugugcauguggguauuguuaggagaugucaucaagcuccacccuccuggccucau

SEQ ID NO: 80655 - RNA, 64 nt, Homo Sapiens
cuuucauacaauggccaacuuauuguauuccucaugucaucaaaaccugcgcagucauuggccc

SEQ ID NO: 80656 - RNA, 64 nt, Homo Sapiens
acuccaaagucaucuugccagucccgguguucaaugucaucaauggcaguucucaugcugucac

SEQ ID NO: 80657 - RNA, 64 nt, Homo Sapiens
ccauuggagcggagguuuaccacagccugaagaaugucaucaaggagaaauaugggaaagaugc

SEQ ID NO: 80658 - RNA, 64 nt, Homo Sapiens
acagauaugcaacuaaaauaaggcuggaggcauuugucaucacugugcagccuugcagaggaca

SEQ ID NO: 80659 - RNA, 64 nt, Homo Sapiens
cugguggggcuacugcagugaugcauuucucaauugucaucagcagaguuccugcuuugggugg

SEQ ID NO: 80660 - RNA, 64 nt, Homo Sapiens
guacccaagugaugucacuaccccuuaggcugucugucaucacuuuuagucuucugagguccag

SEQ ID NO: 80661 - RNA, 64 nt, Homo Sapiens
ugaccuugaccaccacaauaauuccauuccuaggugucaucagaaaggaggauuaggaaugagu

SEQ ID NO: 80662 - RNA, 64 nt, Homo Sapiens
auuuuuuauguuccaauaauguuuuguacaucauugucaucaauaucuacagaagcucuuugac

SEQ ID NO: 80663 - RNA, 64 nt, Homo Sapiens
ggggucuccugaauaaauagaguauuaguccuuaugucaucauuguucaaaauuggagauguac

SEQ ID NO: 80664 - RNA, 64 nt, Homo Sapiens
cuaucacauagauuucaguuuuuagaaggguuucugucaucauggaagagguggucugggacua

SEQ ID NO: 80665 - RNA, 64 nt, Homo Sapiens
accuggguugacaccuuccuacuuauccacuagaugucaucagaggugcuguuccgugguucug

SEQ ID NO: 80666 - RNA, 64 nt, Homo Sapiens
gacacuuacacauacuugaacacugagcaccaugugucaucacaguccugggugacagggcgcu

SEQ ID NO: 80667 - RNA, 64 nt, Homo Sapiens
uugucccauucaagccaccggcccacagacagguugucaucagcccagucuugaccgggaugag

SEQ ID NO: 80668 - RNA, 64 nt, Homo Sapiens
guuucaccaccucccucuuccagacugcacucucugucaucaguccccuccuuucuaacagaaa

SEQ ID NO: 80669 - RNA, 64 nt, Homo Sapiens
auccuuccuucucuuucccccuaagucuuuugagugucaucauguacuggugguuucucgguuc

SEQ ID NO: 80670 - RNA, 64 nt, Homo Sapiens
cuccaucaaggaaaaaugaucuguuaaaugaagcugucaucagggaaugcugagcugcaaugac

SEQ ID NO: 80671 - RNA, 64 nt, Homo Sapiens
gccuucaaagaaagaccagaagccaaguguacucugucaucacuuaauaaugcuugaagcuuuu

SEQ ID NO: 80672 - RNA, 64 nt, Homo Sapiens
caggcaggagccaaacaauguauugacaccccagugucaucaguauugucaucacaauguuaua

SEQ ID NO: 80673 - RNA, 64 nt, Homo Sapiens
auguuauauauugacaccccggugaaaguccaauugucaucacaguaguucuggaauauugccg

SEQ ID NO: 80674 - RNA, 64 nt, Homo Sapiens
agggccaaaacuagagugauacuaaugcuucaguagaauacagcacaaaaaauuaugggaugua

SEQ ID NO: 80675 - RNA, 64 nt, Homo Sapiens
ccauccuggaaaguugggaugcauucaguuagauagaauacacaaauuauuuuaaaagaacuca

SEQ ID NO: 80676 - RNA, 64 nt, Homo Sapiens
uuugaacaucauaguuguaugaacauaauggcucagaauacauauuucccagauauuuauguuu

SEQ ID NO: 80677 - RNA, 64 nt, Homo Sapiens
augauucaaaauuauauagaaaguauuaucugauagaauacaaguugaaauaagauuuuguucc

SEQ ID NO: 80678 - RNA, 64 nt, Homo Sapiens
uugugauuuagauguauccauccuuuuucuauuaagaauacaaaugcugggcugggcacagugg

SEQ ID NO: 80679 - RNA, 64 nt, Homo Sapiens
ccuggaugacagagcgagacuccgccucaaaaaaagaauacaaaugcuccaacauuauuuuuua

SEQ ID NO: 80680 - RNA, 64 nt, Homo Sapiens
ggacucuacuauugaugcagaucagagaguucuuagaauacagaauaccgaugacaaugauaag

SEQ ID NO: 80681 - RNA, 64 nt, Homo Sapiens
uuucagucagagcucaagucuuagucgacauaaaagaauacacacuagagaaaaaccuuacaaa

SEQ ID NO: 80682 - RNA, 64 nt, Homo Sapiens
gaugaauugggguaaauaagucacugaacguaucagaauacaugccccaaugauccuggcuuuu

SEQ ID NO: 80683 - RNA, 64 nt, Homo Sapiens
ucucuggccacagcugaugagcugacagacuguuagaauacaguuccuaacuugauuagcuuga

SEQ ID NO: 80684 - RNA, 64 nt, Homo Sapiens
auucuuaggcugaaauuuguguaauugccaacucagaauacaucuuacucucucauuguuuuaa

SEQ ID NO: 80685 - RNA, 64 nt, Homo Sapiens
gcacuacauucuuuuaucuuacaucaccccauuaagaauacaaaccagguucgcugaucuauca

SEQ ID NO: 80686 - RNA, 64 nt, Homo Sapiens
uuaguuuuuaaaauauuccguggucaaaauucuuccucacuauaauugguauuuacuuuuacca

SEQ ID NO: 80687 - RNA, 64 nt, Homo Sapiens
gguucaccauuaccaguggaaugaagucaauucuccucacuauaacugggugugguaguuuaag

SEQ ID NO: 80688 - RNA, 64 nt, Homo Sapiens
agggucccccagcugggugggcuggaauggaacuccucacuagcugcuggggcuccgcccaccc

SEQ ID NO: 80689 - RNA, 64 nt, Homo Sapiens
cagaagacagagcuauuucagaggcucugugugcccucacuagauaguuuuucuucuggguuca

SEQ ID NO: 80690 - RNA, 64 nt, Homo Sapiens
uucuuagggauggaaguauucuaauuuagaacugccucacuaaauuugcucucucccgcuuugu

SEQ ID NO: 80691 - RNA, 64 nt, Homo Sapiens
uccacuucacuccucauuugugguuucucagucuccucacuauaugucugugugguuaauguuc

SEQ ID NO: 80692 - RNA, 64 nt, Homo Sapiens
guugaagccuguuccagagaagggguuuugaugcccucacuagucccuccuuacccaccagaac

SEQ ID NO: 80693 - RNA, 64 nt, Homo Sapiens
uuuuguauuauuuuuguagaugugugccaccaugccucacuaauaauauagcugagacuacaag

SEQ ID NO: 80694 - RNA, 64 nt, Homo Sapiens
uuguacaugugggaauuacauaauuauuuguuuuccucacuacaauucagccuuacagcauaac

SEQ ID NO: 80695 - RNA, 50 nt, Homo Sapiens
ccggcugcccuuucugggcaccucacuaucccugggcgggcaggaaauaa

SEQ ID NO: 80696 - RNA, 64 nt, Homo Sapiens
uggaaccuucccaggugggcgauagcaucgucgaccucacuacuuuccuccucugacgagugaa

SEQ ID NO: 80697 - RNA, 64 nt, Homo Sapiens
aaagaaccccucugucuucacauaugccuacagcccucacuaacuccugcucuguuuggugggc

SEQ ID NO: 80698 - RNA, 64 nt, Homo Sapiens
aaaugagugaaagcuugauuccaugggauucuaaccucacuaccggauuuuggaaaauuguucc

SEQ ID NO: 80699 - RNA, 64 nt, Homo Sapiens
gggaagucuucucaaguuucaugcucaucuuaaaccucacuagacugcacgggcuuuaggguaa

SEQ ID NO: 80700 - RNA, 64 nt, Homo Sapiens
gaugcauuuuuaauaagcaacuaauuuugaaugcccucacuauuaauacaucuuguacccagcg

SEQ ID NO: 80701 - RNA, 64 nt, Homo Sapiens
gauaaauauaaauuggaguuaggaauuucaugaaccucacuaugaccaaaauuaauuuuuugau

SEQ ID NO: 80702 - RNA, 64 nt, Homo Sapiens
guacuuuguaagucguuugcgagaaugcagaccaccucacuaaacuguaaacgguaaagagauu

SEQ ID NO: 80703 - RNA, 64 nt, Homo Sapiens
cauuucauaugaucacacugcauuauuaaagaguccucacuaaaaugcacaaagaauuaauuag

SEQ ID NO: 80704 - RNA, 64 nt, Homo Sapiens
caaaaccaaucaugccuuccuccaaaucucauguccucacuauuaucauucuaccccuggcccc

SEQ ID NO: 80705 - RNA, 64 nt, Homo Sapiens
ccaccccacaugguugacucuccucauacaccuuccucacuaccucgucagggcccaguuuguu

SEQ ID NO: 80706 - RNA, 64 nt, Homo Sapiens
uuaccacccugugcagguaagccuuuucuaugcgccucacuagcugcggcgaugccacgggccu

SEQ ID NO: 80707 - RNA, 64 nt, Homo Sapiens
agagacugggcgaagcaaacagcccggcugugccccucacuaucccacgccugcccacuuugcu

SEQ ID NO: 80708 - RNA, 64 nt, Homo Sapiens
ccuuggcuauucugugcauauuguucuucagagaccucacuacccacaugcugaucuauugggg

SEQ ID NO: 80709 - RNA, 64 nt, Homo Sapiens
cugaugguuccccaucucucucccucuccucagaccucacuauucucucagacacaacaguauu

SEQ ID NO: 80710 - RNA, 64 nt, Homo Sapiens
uuccuauccuaaauccucuuccagucuguccaucccucacuaccaugauagucuacauucugau

SEQ ID NO: 80711 - RNA, 64 nt, Homo Sapiens
guagccuggcagccuacaucuccccucagccucuccucacuauggccccagugccuugaggccc

SEQ ID NO: 80712 - RNA, 64 nt, Homo Sapiens
ucuccccugagggagucccugggccuagccauccccucacuauucccgacccaaagggugacuu

SEQ ID NO: 80713 - RNA, 64 nt, Homo Sapiens
cccauggagaggucacagaugcuuugugccuacaccucacuaagguuagggcugccagccuagg

SEQ ID NO: 80714 - RNA, 64 nt, Homo Sapiens
ggcuugguuuggucuacugggacaacaaacugccccucacuacuucugacuggcuacugcuaag

SEQ ID NO: 80715 - RNA, 64 nt, Homo Sapiens
cuguaagguuauccaaguaggaucucuguuugaaccucacuaucaucagccauguucaggaaau

SEQ ID NO: 80716 - RNA, 53 nt, Homo Sapiens
gaguuagagagguaccggcaaaaccucacuaaggauuuaggaagagagauuga

SEQ ID NO: 80717 - RNA, 64 nt, Homo Sapiens
cugcuucacaaaccuugcuccauggcuuuagcuaccucacuauguaaagccuuuagagccagcc

SEQ ID NO: 80718 - RNA, 64 nt, Homo Sapiens
ucaacggaccaaauaaacaaauuuaagaacucagccucacuagauuuuaacuugggggugaaag

SEQ ID NO: 80719 - RNA, 64 nt, Homo Sapiens
aaaaaaacaaaauaaauaaaauuagacuuccuucccucacuauauaucuuuaugcagucagaau

SEQ ID NO: 80720 - RNA, 64 nt, Homo Sapiens
auggcuggguacaaucaagugauauuuuguagcaccucacuaucugaaaggccaugaguuuuca

SEQ ID NO: 80721 - RNA, 64 nt, Homo Sapiens
gaagucucaguuuucaguacaguacaucauuccuccucacuaggagcacuuugauguaaaccag

SEQ ID NO: 80722 - RNA, 64 nt, Homo Sapiens
cuuuuuuuuuuuaguccaaauauuuauugguuuuccucacuaaugcauuucuuucucuccccau

SEQ ID NO: 80723 - RNA, 64 nt, Homo Sapiens
uuuuuguugcuguuguucagacuuauuucuaaauccucacuauuaaaacaccuaagugacuacc

SEQ ID NO: 80724 - RNA, 64 nt, Homo Sapiens
acuguauucucuacuucuaaucccuguucuccugccucacuauucuaccccuggcuauccuaau

SEQ ID NO: 80725 - RNA, 64 nt, Homo Sapiens
accuaacaugcuggugaauauuuucaacuuuuucccucacuaauugguacuuuuaaaaacauaa

SEQ ID NO: 80726 - RNA, 64 nt, Homo Sapiens
aaaccggcauuugcugcuaaaggauacccagaacccucacuacuguaacauacaacgguucagc

SEQ ID NO: 80727 - RNA, 52 nt, Homo Sapiens
ucgccgacacucaccuguagcaccucacuaaccauucgacugagcacacuuu

SEQ ID NO: 80728 - RNA, 64 nt, Homo Sapiens
ucugcuauauuuucaugacuuuuccauguaucuaccucacuauucaaguauuagggguaauaua

SEQ ID NO: 80729 - RNA, 64 nt, Homo Sapiens
ugcacccuguuugcucgcagucccguucgcccguccucacuagcacagagccucugcccggccc

SEQ ID NO: 80730 - RNA, 64 nt, Homo Sapiens
ggaucuucauguuguuaauaggaaaaacacccucccucacuacagagucuuuugcaaugacuug

SEQ ID NO: 80731 - RNA, 64 nt, Homo Sapiens
ggggggccuccuguagcaagacugggaggaaaugccucacuacaugggacacaguuggaaagcc

SEQ ID NO: 80732 - RNA, 64 nt, Homo Sapiens
ucacuuuugaaaaguucuuaguauuaagcugaauccucacuaaucacuuccucauuugauacag

SEQ ID NO: 80733 - RNA, 64 nt, Homo Sapiens
cuucugguucaugccuuugagggcauccugcgagccucacuagccuacacuguacgauucacua

SEQ ID NO: 80734 - RNA, 64 nt, Homo Sapiens
uugcaaaugccgacccuguggaggccagggagugccucacuauuccucaguggcccagugggca

SEQ ID NO: 80735 - RNA, 64 nt, Homo Sapiens
cacccacuccagcccucugccccaguuuucuccuccucacuagucuguggcuuuaguaguuccu

SEQ ID NO: 80736 - RNA, 64 nt, Homo Sapiens
cacccacuacagaccucagccccaguuuucuccuccucacuaggcuguguuuuuaguaguuccu

SEQ ID NO: 80737 - RNA, 64 nt, Homo Sapiens
uaauauggauucugacucuuaagugcuuccgcccccucacuaccuccuuuaauacaaauucaau

SEQ ID NO: 80738 - RNA, 64 nt, Homo Sapiens
cacccaacugcuucaggguacuucguagacucugccucacuacaugucgaaagaguuauuugag

SEQ ID NO: 80739 - RNA, 64 nt, Homo Sapiens
uagggagcccugggccagggcucccaagagggcuccucacuauccaacaucagcucugugccac

SEQ ID NO: 80740 - RNA, 64 nt, Homo Sapiens
cacuacaaauuuggaacuuuuaaaaaaagauguaccucacuaccaugggaaauggcccuucauu

SEQ ID NO: 80741 - RNA, 64 nt, Homo Sapiens
gaauuucucaguguugguaaguuucuuuaccuacccucacuauauauuauucucguuuuaaaac

SEQ ID NO: 80742 - RNA, 64 nt, Homo Sapiens
aauaauguggcaauacuuuaaaccaauccucaaaccucacuaaacauaagauaauacugaaaac

SEQ ID NO: 80743 - RNA, 64 nt, Homo Sapiens
ugcaguaucauacuuguuuauauuacauuguaugccucacuauucauuaaaaaucaagaaaguu

SEQ ID NO: 80744 - RNA, 64 nt, Homo Sapiens
uggaguucgugccaauccugacaucucgagguuuccucacuagacaacucucuuucgcaggcuc

SEQ ID NO: 80745 - RNA, 64 nt, Homo Sapiens
aaggacaucagggagccaacaagacuccuaauagccucacuacauucauccagugccuauucug

SEQ ID NO: 80746 - RNA, 64 nt, Homo Sapiens
gagagugugaacuguguggcaagagagccucacaccucacuaggugcagagagcccaggccuua

SEQ ID NO: 80747 - RNA, 64 nt, Homo Sapiens
caucuuuucuguaaacuucuuccccuaguuccauccucacuaguaaaaaauaaauacuuuuuaa

SEQ ID NO: 80748 - RNA, 64 nt, Homo Sapiens
caccagugauacagaaaugacacugugcaagacaccucacuaguuuccuaucauucacccauuu

SEQ ID NO: 80749 - RNA, 64 nt, Homo Sapiens
cuauuuugaagauuuuuaagagcacugucaugagccucacuaagggcuacauuuccauggggcc

SEQ ID NO: 80750 - RNA, 64 nt, Homo Sapiens
cuauauaaaaaucauuggcaagacagaggacccuccucacuaccaucucugauaauggagagag

SEQ ID NO: 80751 - RNA, 64 nt, Homo Sapiens
cauuaaaaaucaagaaaguuuauuacauugugugccucacuauuugcaguaucauacuuguuua

SEQ ID NO: 80752 - RNA, 64 nt, Homo Sapiens
cuuggaccaugccagauucucuguccaaaagcgcccucacuauuuguggguguucuuuccugcc

SEQ ID NO: 80753 - RNA, 64 nt, Homo Sapiens
aacuaaccuuuagguaaaaaucuaaauauguagaccucacuaauuaucugcuacugaauaacuc

SEQ ID NO: 80754 - RNA, 64 nt, Homo Sapiens
cccaggagauauucacuguauagcauguuuauucccucacuaccauuuucuccaucauccugau

SEQ ID NO: 80755 - RNA, 64 nt, Homo Sapiens
ugccaugcauacaugcugcgagcuggccagauuuccucacuaccccuugguaaaggaaccaguc

SEQ ID NO: 80756 - RNA, 64 nt, Homo Sapiens
caugcuuuauguggguuaucuuuugcccuauauaccucacuagcugugcauccgccugaaagug

SEQ ID NO: 80757 - RNA, 64 nt, Homo Sapiens
ugcauuuuuagauuccuuuuaguucuaauugaggccucacuagaugcucuucaguucuguguau

SEQ ID NO: 80758 - RNA, 64 nt, Homo Sapiens
ugugguuuuuuaaaaaagcaauaauuaacucagaccucacuaaaaaucauuuuuguuuuuauau

SEQ ID NO: 80759 - RNA, 64 nt, Homo Sapiens
cagaggagcuccaaaccugccugcagaccgugauccucacuagaacggggaggccaacccuucu

SEQ ID NO: 80760 - RNA, 64 nt, Homo Sapiens
aauggguuguuaaaggcaauacuacacuaaauccccucacuaugucuuggauggugacauugaa

SEQ ID NO: 80761 - RNA, 64 nt, Homo Sapiens
aaucuuuguuguuguuguugcccucaaaugaauuccucacuauuaccaggccuagcacccaagg

SEQ ID NO: 80762 - RNA, 64 nt, Homo Sapiens
cacugcugcuuauaaauucaucuuuugguugaauccucacuaugcuauuugguaccuaaaaaua

SEQ ID NO: 80763 - RNA, 64 nt, Homo Sapiens
aguuaugaagguggguuagaaacuagugccuaucccucacuaaguugccagauggauuuaacag

SEQ ID NO: 80764 - RNA, 64 nt, Homo Sapiens
uaagaaaauuuuccuuuucuaaccuauuaaaauaccucacuaucauuucaaaagguuaaaugag

SEQ ID NO: 80765 - RNA, 64 nt, Homo Sapiens
cucuucacauguaacuucugaucauggcugacuuccucacuaucugugaccuucacauagaugg

SEQ ID NO: 80766 - RNA, 64 nt, Homo Sapiens
cucaccaggccaugggacuuguugccccucuccuccucacuauugugacagcagaccuggcugu

SEQ ID NO: 80767 - RNA, 64 nt, Homo Sapiens
uuucucacggcgugucaccccaccagggcgcaagccucacuauuacuugaacuuuccaaaaccu

SEQ ID NO: 80768 - RNA, 64 nt, Homo Sapiens
uccgauugucccuuggggguuaccccucagcccaccucacuauggugcuggguagaggggauac

SEQ ID NO: 80769 - RNA, 64 nt, Homo Sapiens
ucacuuacugugcggguuugacucagucccuuccccucacuaggucccaguuucuccauuugua

SEQ ID NO: 80770 - RNA, 64 nt, Homo Sapiens
ugcaaguaagcaucuuacaacuggcucuuccuccccucacuaagaagacccaaaccucugcaua

SEQ ID NO: 80771 - RNA, 64 nt, Homo Sapiens
gggcuugggcccugcacagauauuuccauuucuuccucacuaugacacugagcaagaucuuguc

SEQ ID NO: 80772 - RNA, 64 nt, Homo Sapiens
ucguugagccccaaaccacugcucaggguccauuccucacuauaagaugaagccauaucugccu

SEQ ID NO: 80773 - RNA, 64 nt, Homo Sapiens
cuuggauucuagguggacauuacagaguugaauuccucacuacccccucccgcugucauuuguu

SEQ ID NO: 80774 - RNA, 64 nt, Homo Sapiens
uugugagggaauauccauucccucacucuacucuccucacuaucggaaauucauuuugauucag

SEQ ID NO: 80775 - RNA, 59 nt, Homo Sapiens
uccccauggugauagccugaaagagcuuuccucacuagaaaccaaaugguguaaauauu

SEQ ID NO: 80776 - RNA, 64 nt, Homo Sapiens
augucaggagccaggucuagacuaaggucccagcccucacuaggaguaaaggucuuucagaacc

SEQ ID NO: 80777 - RNA, 64 nt, Homo Sapiens
uucaagaguagacauucuuaaguaauaccuuuaaccucacuagcagcugaagcaaagaaggaaa

SEQ ID NO: 80778 - RNA, 64 nt, Homo Sapiens
aaggaaacuucaguugaucugacucuccacuccuccucacuaaaugugaacugcuuucaagucu

SEQ ID NO: 80779 - RNA, 64 nt, Homo Sapiens
gggugcugcccugcguggcuacgggccucuccucccucacuacuucaggaagcagccuuagcac

SEQ ID NO: 80780 - RNA, 64 nt, Homo Sapiens
acaucugugaugacugguugggacaacaauacuaccucacuacuaaacaucagucccgaggagg

SEQ ID NO: 80781 - RNA, 64 nt, Homo Sapiens
ucucccccuacgcucugccaggaauucuuucagaccucacuagcacaagcccgguugcuccuug

SEQ ID NO: 80782 - RNA, 64 nt, Homo Sapiens
cccaaacccccaauagcuagugacagccacuuggccucacuaccagaagaaggguggagucaga

SEQ ID NO: 80783 - RNA, 64 nt, Homo Sapiens
ccccaccauuucccaaggaguuuugcuuuguagcccucacuacuggccaccugaccucacaccu

SEQ ID NO: 80784 - RNA, 64 nt, Homo Sapiens
cccagccaguccugagccucccgccaaaucccagccucacuaggugggacccccuucccagugu

SEQ ID NO: 80785 - RNA, 64 nt, Homo Sapiens
uucgagaucucucacggguuuuuaauggucuuguccucacuaacccggagcggugaguuugauu

SEQ ID NO: 80786 - RNA, 64 nt, Homo Sapiens
ucuagagugagaaucuggcuaguagguuuggcccccucacuaucggacuaaugcaugugguaug

SEQ ID NO: 80787 - RNA, 64 nt, Homo Sapiens
aacauugcugucaaguguagacaaacaucacagcccucacuaauaaccaaaaugggaacauuaa

SEQ ID NO: 80788 - RNA, 64 nt, Homo Sapiens
uccucgagggaccaaaucuccaacuuuuuuuuccccucacuagcaccuggaaugaugcuuugua

SEQ ID NO: 80789 - RNA, 64 nt, Homo Sapiens
cccuuuccccaucauggggcagaugcccaccagcccucacuaucuacugcuugaccauccucug

SEQ ID NO: 80790 - RNA, 64 nt, Homo Sapiens
agagccuugacaaggcacuggucaacccaggaggccucacuacaggggcuuaugagucucaccg

SEQ ID NO: 80791 - RNA, 64 nt, Homo Sapiens
ggaaaaguaguaugaugaacaaacauaacuguagccucacuaauucucuguaaucgcacauuua

SEQ ID NO: 80792 - RNA, 64 nt, Homo Sapiens
gggaaggaaaggaagcugggucugggcugugcucccucacuaaaaggggaguuccgcgcugggg

SEQ ID NO: 80793 - RNA, 64 nt, Homo Sapiens
guaugcuggccagcacccucggcaccagaugcaaccucacuauggggccucaguucaaccuggu

SEQ ID NO: 80794 - RNA, 64 nt, Homo Sapiens
cuaugaaacagcaugcuaaaugugaaaugucaacccucacuaaacuuugccgguucagagcauc

SEQ ID NO: 80795 - RNA, 64 nt, Homo Sapiens
agaaaaugcuguuaccuuuaucucagcacguguuccucacuagaauguccaugaauucuucuuu

SEQ ID NO: 80796 - RNA, 64 nt, Homo Sapiens
gucauaacacaugagcauaucauguacccuccuuccucacuacaucagaucuaaucaauuaguc

SEQ ID NO: 80797 - RNA, 64 nt, Homo Sapiens
gcugagcaccuucucugagugcuucccagaaccuccucacuaggugcauugagcaggcccaccu

SEQ ID NO: 80798 - RNA, 64 nt, Homo Sapiens
guuggcgucugaagcugggcgccugucacugaggccucacuaugguuuggaggggaggaugagu

SEQ ID NO: 80799 - RNA, 64 nt, Homo Sapiens
ccagaagcguccugugacucugggagaggugacaccucacuaaggggccgaccccauggaguaa

SEQ ID NO: 80800 - RNA, 64 nt, Homo Sapiens
aacagaaggcucgcacucuugucuucuggucacaccucacuauguccccucagcuccuaucucu

SEQ ID NO: 80801 - RNA, 64 nt, Homo Sapiens
uuaaaaaauuaaucugggccagaauuucaaacggccucacuaggcuucugguugaugccuguga

SEQ ID NO: 80802 - RNA, 64 nt, Homo Sapiens
cauccagcccucucagcguggggcuguggcugguccucacuauuccccagucucccgcuguggg

SEQ ID NO: 80803 - RNA, 64 nt, Homo Sapiens
auguaaacuccaugaaggcauugauauuuucuacccucacuagagucuacauguauuuauauuc

SEQ ID NO: 80804 - RNA, 64 nt, Homo Sapiens
gguggggucgcuuagucccccaaacagcuuguggccucacuaaaguauagugaccaauagaugc

SEQ ID NO: 80805 - RNA, 64 nt, Homo Sapiens
uggguuaccaucuucaggcagugggguauuuauuccucacuagcuucucuguggacugggcaag

SEQ ID NO: 80806 - RNA, 64 nt, Homo Sapiens
ugacuuccauuguguuuuaucaucucacuaaugaccucacuaucguagcucucugcuaaaaugg

SEQ ID NO: 80807 - RNA, 64 nt, Homo Sapiens
aaacugccaugaugccucagaaugcaauuaaauaccucacuauuuuugcaauguuuuuuauaaa

SEQ ID NO: 80808 - RNA, 64 nt, Homo Sapiens
acaggaccccaaaugccucuucccucuggucaugccucacuaucucuaggagcuccauccugug

SEQ ID NO: 80809 - RNA, 64 nt, Homo Sapiens
accaugcuuggcuaauuuuuuugcagaaacgaggccucacuauauuguccaggcugaguggcuc

SEQ ID NO: 80810 - RNA, 64 nt, Homo Sapiens
cuuaucuuacaacucccccaccgcccacucuccaccucacuagcuccccaaucccugacccuuu

SEQ ID NO: 80811 - RNA, 64 nt, Homo Sapiens
uucuggaggcaguugggagcuauccuuguuuaugccucacuauuggcagaaaagaccccauuua

SEQ ID NO: 80812 - RNA, 64 nt, Homo Sapiens
ugccuuguauucuaguuauuuguguauuugucucccucacuagauuauacgcuccuugugggca

SEQ ID NO: 80813 - RNA, 64 nt, Homo Sapiens
uugccuaggcuggaaauaggucguggagacggggccucacuaugcagcuaauauuuuuuuauuu

SEQ ID NO: 80814 - RNA, 64 nt, Homo Sapiens
cugguacugaaaguguaauuguuugccagugguuccucacuacauccagaagacauuuccaaca

SEQ ID NO: 80815 - RNA, 64 nt, Homo Sapiens
uuguuauccaguggcaugccuguacacacugcccccucacuaucaaaugcccauguccacagcu

SEQ ID NO: 80816 - RNA, 64 nt, Homo Sapiens
auacucagcuuccccugaugggaaccccagcccaccucacuaucuccccuguggugaguaccgu

SEQ ID NO: 80817 - RNA, 64 nt, Homo Sapiens
cuaccccacccgcuccuugacuugggaggcuuccccucacuaucucugcuugcucuuguccuag

SEQ ID NO: 80818 - RNA, 64 nt, Homo Sapiens
aggacuggugguggagucucccucaccggggaacccucacuagcugcacccccaccaaccuuac

SEQ ID NO: 80819 - RNA, 64 nt, Homo Sapiens
ugcaugagaaaucuaucuuagaagagagaaguccccucacuagcaggagaagguggaaaugggu

SEQ ID NO: 80820 - RNA, 64 nt, Homo Sapiens
cgagcccacccagcaucccgcgggugcucugaggccucacuacucccgcccgcacagcucccgg

SEQ ID NO: 80821 - RNA, 64 nt, Homo Sapiens
cucuaacucccugugucugcaguguaccguggggccucacuagccaugaugccuuaacaugugg

SEQ ID NO: 80822 - RNA, 64 nt, Homo Sapiens
uuuccugucuucucuuuaguaugaucccucaaaaccucacuaacuggaaggaugauuuugucuc

SEQ ID NO: 80823 - RNA, 64 nt, Homo Sapiens
ccuuugcaauggagaucaucaggcagggaauagaccucacuagcuggugaacaaugacgaauug

SEQ ID NO: 80824 - RNA, 64 nt, Homo Sapiens
gccaucagcagcgguagguacuggcuugggcugaccucacuaauugaagucugcaaggagguug

SEQ ID NO: 80825 - RNA, 64 nt, Homo Sapiens
uccugacaccaccagaauaaacuugccgaguuuaccucacuagggccggacccguggcuccuua

SEQ ID NO: 80826 - RNA, 64 nt, Homo Sapiens
aaacaggagaugcuggauuucaaucccagcagggccucacuaguugagguauugaauuugaaca

SEQ ID NO: 80827 - RNA, 64 nt, Homo Sapiens
aguuugagaccagccugggcaauauagcaagaccccucacuacaaaaauaaaacaucaaaaaca

SEQ ID NO: 80828 - RNA, 64 nt, Homo Sapiens
gaucuuuaaugggcccaaggccaacaggcauaugccucacuacugccuggagaagggagagauu

SEQ ID NO: 80829 - RNA, 64 nt, Homo Sapiens
ugcccauccgucugucugucgcccuucucccggcccucacuaagccccggcacuucuagugguc

SEQ ID NO: 80830 - RNA, 64 nt, Homo Sapiens
ucccugcccagcuguaaggaccgggggucucccuccucacuaccgccagacaccccgguggaag

SEQ ID NO: 80831 - RNA, 64 nt, Homo Sapiens
cucuguauauaaaaucugccccaaucauaucaugccucacuaccgaauccccucauuacaagau

SEQ ID NO: 80832 - RNA, 64 nt, Homo Sapiens
ccccgccccuccggccuccccacaccccccuugcccucacuaccuguaucucaccggcgugugu

SEQ ID NO: 80833 - RNA, 64 nt, Homo Sapiens
cugacauucauuuucauuguuuuacuuuugucuuccucacuaguguaaacaaaaauuucaacca

SEQ ID NO: 80834 - RNA, 64 nt, Homo Sapiens
gggcgcaggagggugagcgugauuugucccagguccucacuaccguaacgaagacacagacugc

SEQ ID NO: 80835 - RNA, 64 nt, Homo Sapiens
uguacuuuuguaaugacugugaaauacacuuuucccucacuacgacugcuucuuuauuugcuga

SEQ ID NO: 80836 - RNA, 64 nt, Homo Sapiens
caucguuuuaugaaaagguaccgcugugugcauuccucacuagaacucauccgacccccgaccc

SEQ ID NO: 80837 - RNA, 64 nt, Homo Sapiens
aauggggggagaaaggaguaccuguuuuacuuuaccucacuaacaaagugagauuuuacuaaga

SEQ ID NO: 80838 - RNA, 64 nt, Homo Sapiens
uguuggccugugggccgcccacaacauauccuucccucacuaccugugugaccaagguuggcuu

SEQ ID NO: 80839 - RNA, 64 nt, Homo Sapiens
gccccacaacaaggccagggaugguggggacaggccucacuagucuugaggcccagccuaggau

SEQ ID NO: 80840 - RNA, 64 nt, Homo Sapiens; identical to SEQ ID NO: 80839

SEQ ID NO: 80841 - RNA, 64 nt, Homo Sapiens
auuuaucacuuuuuuccuucggagggaaguggcaccucacuagcgcgguuagagccuggaagaa

SEQ ID NO: 80842 - RNA, 64 nt, Homo Sapiens
ggccccaaguucaacucaacaucgccuggggccuccucacuaggacucaccaggccgugcuccc

SEQ ID NO: 80843 - RNA, 64 nt, Homo Sapiens
gagaccuuggacaaggaucccccagccaagcugcccucacuacaguuuuuauuuaucucuuugg

SEQ ID NO: 80844 - RNA, 64 nt, Homo Sapiens
uucuuugaauauguauuuuuaauacuuuuuuauaccucacuaugaaaaacacaaaaaaagaaag

SEQ ID NO: 80845 - RNA, 64 nt, Homo Sapiens
ggcaagggcaggaugaggcuccaguggcuccaggccucacuaguucaggccucuuguccucucc

SEQ ID NO: 80846 - RNA, 64 nt, Homo Sapiens
aguguguuuucuucuguguaaaguacaugagcugccucacuaagcauucccaacucauugaaug

SEQ ID NO: 80847 - RNA, 64 nt, Homo Sapiens
guccacccuugacugcucuuggcuuggucucuacccucacuaccucaguucucaauaacuuagu

SEQ ID NO: 80848 - RNA, 64 nt, Homo Sapiens
uuuucauuuucauuauuucaaggaauagaguuuuccucacuaccacuuguaauuagagauugac

SEQ ID NO: 80849 - RNA, 64 nt, Homo Sapiens
ugugaccuucacauagauggaucauggcugacuuccucacuaaccucuucacguguaacuucug

SEQ ID NO: 80850 - RNA, 64 nt, Homo Sapiens
aacugccuaaaaaugucuuguuuguuuuaugagcccucacuagaaggcugaguuugacauguug

SEQ ID NO: 80851 - RNA, 64 nt, Homo Sapiens
ccauugaagacgcaucaccuagacaugaacaacaccucacuaccauucaucaaaaauaagccau

SEQ ID NO: 80852 - RNA, 64 nt, Homo Sapiens
gaauuuaaaggugcaccuguccaugagaauuuuuccucacuagagacaacuucuauaauuaaau

SEQ ID NO: 80853 - RNA, 64 nt, Homo Sapiens
caaacugaaacucuaugcaacugagcuaguuagcccucacuagccuaauaaaaugaaacuaggg

SEQ ID NO: 80854 - RNA, 64 nt, Homo Sapiens
aguaggaaaguaacaccuaccuuagccuuguucuccucacuagcugugugaccuuacuucaccu

SEQ ID NO: 80855 - RNA, 64 nt, Homo Sapiens
aauggcgaugauuacaauaacaaauuggacaaauccucacuacccuagucaaacauggagaaac

SEQ ID NO: 80856 - RNA, 64 nt, Homo Sapiens
aauauuagaauggccgaccauggcagugaccaggccucacuacaggccugguuggauucugguc

SEQ ID NO: 80857 - RNA, 64 nt, Homo Sapiens
ggucagugugugcugggggaccugguaaccuuacucaaaagaagcuugaagggguauaccuuac

SEQ ID NO: 80858 - RNA, 64 nt, Homo Sapiens
gcugggcaccacucccagcacacggaaggucuugucaaaagaguacuuaaggaaggaucagcau

SEQ ID NO: 80859 - RNA, 64 nt, Homo Sapiens
uuacaacuguuaaaaaaccucaaaauaguucucuucaaaagaagagagauuccaagcaacccau

SEQ ID NO: 80860 - RNA, 64 nt, Homo Sapiens
agauuuauaaucaugauacucuucggugguaguuucaaaagacacuacuaauacgcaggaagcg

SEQ ID NO: 80861 - RNA, 64 nt, Homo Sapiens
uuuaucaggcagauguacaggauaaugguauaaaucaaaagagagaugggaugguaucuaaaaa

SEQ ID NO: 80862 - RNA, 64 nt, Homo Sapiens
uuuuuccagaguuucacaggcauuuuuggauccuucaaaagaagagguauauaacaguucuuuu

SEQ ID NO: 80863 - RNA, 64 nt, Homo Sapiens
caaaaagugggugaaggacaugaacagacacuucucaaaagaagacauuuaugcagccaaaaaa

SEQ ID NO: 80864 - RNA, 64 nt, Homo Sapiens
auuggaaaaaauugaauauauugcaaauuguuguucaaaagauaagggaaacuguaaauauauu

SEQ ID NO: 80865 - RNA, 64 nt, Homo Sapiens
uuaagaaaauuuuccaaaaagcaagauaauuuaaucaaaagaaaauuugucuaauaaaacagag

SEQ ID NO: 80866 - RNA, 64 nt, Homo Sapiens
uuuuuauuguugaauguacaucuaccccagccccucaaaagaaaaacuguuuacauagaaauuc

SEQ ID NO: 80867 - RNA, 64 nt, Homo Sapiens
uuuguuuuguaccuuaaauuguucgauuacgucaucaaaagagaugaaagguauguagaacagg

SEQ ID NO: 80868 - RNA, 64 nt, Homo Sapiens
acuuuaucauacaggaaacuuaaaacaagaggugucaaaagacccaaauuaggugcauuuuacu

SEQ ID NO: 80869 - RNA, 64 nt, Homo Sapiens
gugauagaaacagcuuuuugaaguaaugaaaaccucaaaagaucauguugauucuuaauuuuug

SEQ ID NO: 80870 - RNA, 64 nt, Homo Sapiens
gugaaauaguuuuuauugaaagucaagugacauuucaaaagaaguucuauaacaauuauguuuc

SEQ ID NO: 80871 - RNA, 64 nt, Homo Sapiens
uuuuugccacaucugcaaugauuauuguuuaauuucaaaagaauccucaggcucuacaaucuag

SEQ ID NO: 80872 - RNA, 64 nt, Homo Sapiens
uuauuuugcuucuauuuauagccucugucaaaagucaaaagacuauaaaugcuuugcaaaaaug

SEQ ID NO: 80873 - RNA, 64 nt, Homo Sapiens
ggagaagguugacuuuuugcacuucuguauauagucaaaagagagaaaccuguauaauaguaag

SEQ ID NO: 80874 - RNA, 64 nt, Homo Sapiens
ugugcauauauuuauucuguucacacacaaagauucaaaagaaacacuuuuaauguuuucucuc

SEQ ID NO: 80875 - RNA, 64 nt, Homo Sapiens
aggaaaauaaaagaaauauagugcuuuuuuuuuuucaaaagaaaagagagaagaaaauauauua

SEQ ID NO: 80876 - RNA, 64 nt, Homo Sapiens
uugcucuugcuuguaaauccuaaucuuagaguuaucaaaagaagaaaaaacugaagguacuuua

SEQ ID NO: 80877 - RNA, 64 nt, Homo Sapiens
cuucuccaugaugugacuuccggagauaaaggauucaaaagauaaagacaaaguacgcucagag

SEQ ID NO: 80878 - RNA, 64 nt, Homo Sapiens
agaaaagagaugacuaagucaagugucugccuuaucaaaagagcaaaaaugccucugguuuugu

SEQ ID NO: 80879 - RNA, 64 nt, Homo Sapiens
uucccugucucucuuccccaggcaauuacuggccucaaaagaggaacagaggugcugcgaggug

SEQ ID NO: 80880 - RNA, 64 nt, Homo Sapiens
uguagcuuuagaaguggcccucuauagaaagaagucaaaagaugaggccccuucuagaaucuag

SEQ ID NO: 80881 - RNA, 64 nt, Homo Sapiens
ucauuuuagaauaacaaguaaacugaaauuuuaaucaaaagagggcauacuguaauguuuuaug

SEQ ID NO: 80882 - RNA, 64 nt, Homo Sapiens
augcuagguuaugucaauuucuccaugggcaaagucaaaagauaguaaauuuaacuccaaguuu

SEQ ID NO: 80883 - RNA, 59 nt, Homo Sapiens
caucuaauuugagcugaguggcuuuguagucaaaagacucccauauguuaagaaaauga

SEQ ID NO: 80884 - RNA, 64 nt, Homo Sapiens
ugacuucugcacuaauccagugaaggaggcugugucaaaagaagggcucagaagcccucuuuuc

SEQ ID NO: 80885 - RNA, 64 nt, Homo Sapiens
aaagaaacuucagaaagcuagaauugcuuaucaaucaaaagacuuucucaaucuauuuuggcca

SEQ ID NO: 80886 - RNA, 64 nt, Homo Sapiens
uuuuucaauguuauuuuagcaugaccucaacuuuucaaaagacuucaauggugccuugaaaucu

SEQ ID NO: 80887 - RNA, 64 nt, Homo Sapiens
cccccuuuuuuuacagaggauaaguuauugcauuucaaaagaccguaaagcuuuuuuuugcaug

SEQ ID NO: 80888 - RNA, 64 nt, Homo Sapiens
uuuaauuuugauccugcccucuccagcugcuccuucaaaagauacaucaaaagauagaaacucu

SEQ ID NO: 80889 - RNA, 64 nt, Homo Sapiens
ccugcccucuccagcugcuccuucaaaagauacaucaaaagauagaaacucugggcugggcaca

SEQ ID NO: 80890 - RNA, 64 nt, Homo Sapiens
aaaacuccagaaacgcacagaugagucauuuuuuucaaaagauguaacaauaugaagggcucuu

SEQ ID NO: 80891 - RNA, 64 nt, Homo Sapiens
aauuaaaaucauguaaccauaagguugcuuauuaucaaaagaauuuuucuugaauagauaucac

SEQ ID NO: 80892 - RNA, 64 nt, Homo Sapiens
uaucuccuaugaacagauugcuuauaauaaaagaucaaaagauaaucuuaaucuauauucuacc

SEQ ID NO: 80893 - RNA, 64 nt, Homo Sapiens
gugauucuauuuuuuaaagaccacugugguugauucaaaagaaagaaaagaaaaacacgucuca

SEQ ID NO: 80894 - RNA, 64 nt, Homo Sapiens
uguuggagcuuuuuauuaaaugaguauaucuuagucaaaagaaugaacacuuggaggcaauuaa

SEQ ID NO: 80895 - RNA, 64 nt, Homo Sapiens
gcuguaagaaaaaauguaagucucuauucuuuucucaaaagauuuuuuucuaccugguaaacau

SEQ ID NO: 80896 - RNA, 64 nt, Homo Sapiens
agugguuccauuucuagauuugagauggcaccugucaaaagagcggacuuuccagugaugccac

SEQ ID NO: 80897 - RNA, 64 nt, Homo Sapiens
auuuugugacgugaaaauuuugguugaaaaauaaucaaaagaacaauguucuuacguuuuccau

SEQ ID NO: 80898 - RNA, 64 nt, Homo Sapiens
ucauguguguaaauaauucauuucugggcuaauuucaaaagaaucccaauauugcuguauagaa

SEQ ID NO: 80899 - RNA, 64 nt, Homo Sapiens
uuucaauucacuugaaugagaaacguguuuaguaucaaaagagcccaagaagacacugguguga

SEQ ID NO: 80900 - RNA, 64 nt, Homo Sapiens
ccugaaaugauaaaucaggggcagauuuggcaguucaaaagacucugaggauuuuaucaagaaa

SEQ ID NO: 80901 - RNA, 64 nt, Homo Sapiens
ucugucuacauugaauugggcagcggauacaaccucaaaagacgugagaacucugaggacaaag

SEQ ID NO: 80902 - RNA, 64 nt, Homo Sapiens
gucucugauaaaacagaauuuaaaccaacaaagaucaaaagagacaaggccauuauauaauggu

SEQ ID NO: 80903 - RNA, 64 nt, Homo Sapiens
caaaaagucggcaaaggacaugaacagacacuucucaaaagaagacauuuaugcagccaaaaaa

SEQ ID NO: 80904 - RNA, 64 nt, Homo Sapiens
gauuuaccagggauguagauuaaggugaugugauucaaaagaugccauucauagagagcccuag

SEQ ID NO: 80905 - RNA, 64 nt, Homo Sapiens
guugcucccugugacaaaauuuuauaagcaaauuucaaaagacauguuguaaauuaggaggcuc

SEQ ID NO: 80906 - RNA, 64 nt, Homo Sapiens
ccuuuaggaccaauuaaaaccccaaacuguuggggugguacauuagaauucuguuugccuaacu

SEQ ID NO: 80907 - RNA, 64 nt, Homo Sapiens
auugcuuauugugacuuugggcacucuauaauuugugguacaguuaaaaagaagcaaaucauuu

SEQ ID NO: 80908 - RNA, 60 nt, Homo Sapiens
aauugcuuauguuuauucccugucagcggaguggagaaugucauucaucaauaaaccaaa

SEQ ID NO: 80909 - RNA, 60 nt, Homo Sapiens
uaaagaucuggcaacuuuucaggauuauuuguggagaacucuaagguuaagaucaggaaa

SEQ ID NO: 80910 - RNA, 60 nt, Homo Sapiens
uugcggaccgugguacccaguuuuaggaauguggagaaaggaauucuguugauuccguug

SEQ ID NO: 80911 - RNA, 60 nt, Homo Sapiens
uacagguagguuggucuuugaaguccacuaguggagaaugucaagacaagauacuuauua

SEQ ID NO: 80912 - RNA, 60 nt, Homo Sapiens
aaauucauacuggggagaaaccccacaaauguggagaaugcggaaaagccuuuaacuggu

SEQ ID NO: 80913 - RNA, 60 nt, Homo Sapiens
caacucuuauuacacauaagauaauucacaguggagaaaaacccuacaaaugugaagaau

SEQ ID NO: 80914 - RNA, 60 nt, Homo Sapiens
uucaaucugucaaauuuguuuuauucucaaguggagaacuucucccacauaauauauaua

SEQ ID NO: 80915 - RNA, 60 nt, Homo Sapiens
ggacaacuuaucuucacuaagcugaaucagguggagaaaguaaucuccuugcaaucaugu

SEQ ID NO: 80916 - RNA, 60 nt, Homo Sapiens
ucaaaccgagcagggcuguguaucaaccacguggagaaaauagcagcaacugaagacaau

SEQ ID NO: 80917 - RNA, 60 nt, Homo Sapiens
gugcccugcuuugcaaacauuuggggaaauguggagaagagagucucccucugauugguu

SEQ ID NO: 80918 - RNA, 60 nt, Homo Sapiens
ucacuuucucuucuugcguguggggcagguguggagaagggcuuuaaggaggccaauuug

SEQ ID NO: 80919 - RNA, 60 nt, Homo Sapiens
uuaagccaugggugggucuaacuggcuuuuguggagaaauuagcacaccccaacuuuaau

SEQ ID NO: 80920 - RNA, 60 nt, Homo Sapiens
aucaggaaggcauuuucaaucauucaaaauguggagaauuuaauggcuaaaucuuuaaaa

SEQ ID NO: 80921 - RNA, 60 nt, Homo Sapiens
gccguaccccacccucagcaccccuuccauguggagaaaggagugaaaccuuuagggcag

SEQ ID NO: 80922 - RNA, 60 nt, Homo Sapiens
ggcacugagcccccccaacacugugcccugguggagaaagcacugaccugucaugccccc

SEQ ID NO: 80923 - RNA, 60 nt, Homo Sapiens
cauuaggcagauaggccacaggaagaagguguggagaacccaccugaaccagauugagac

SEQ ID NO: 80924 - RNA, 60 nt, Homo Sapiens
uggauuccagaauguuucaugguaagcacuguggagaaccuacaugucagguucuggagu

SEQ ID NO: 80925 - RNA, 60 nt, Homo Sapiens
ucuuuuuuuagggagaagggcuuuucuuuaguggagaaauggaacucgccccccuacccc

SEQ ID NO: 80926 - RNA, 60 nt, Homo Sapiens
aagccuuccuccauggcccaucacucggcuguggagaacaaagaccaaugugaagacacu

SEQ ID NO: 80927 - RNA, 60 nt, Homo Sapiens
aaauuccuguguugugugccaagguauaaaguggagaaguuagaugagugcaaggagcuc

SEQ ID NO: 80928 - RNA, 60 nt, Homo Sapiens
agcagccaacacguuuagcagacacugcgcguggagaagggcuuaucugcaguacacucu

SEQ ID NO: 80929 - RNA, 60 nt, Homo Sapiens
cgucacgggucuuucaucccaaaacaaugaguggagaaguuccuggaguagguccacgug

SEQ ID NO: 80930 - RNA, 60 nt, Homo Sapiens
aucuagccagauuggagauaaguagucauuguggagaaacgcuucggugaaaguaaagac

SEQ ID NO: 80931 - RNA, 60 nt, Homo Sapiens
gcagggguacuuccgccuugccguuagcuuguggagaacgugcuucuuauuccuggcagg

SEQ ID NO: 80932 - RNA, 60 nt, Homo Sapiens
cgaagccuuagagggugacauagcuagaaaguggagaagcucacuguucacugugcaaag

SEQ ID NO: 80933 - RNA, 64 nt, Homo Sapiens
cacacacacacacacacacacacauacacagacaaaaacacaaaaacucugaggggaucuggug

SEQ ID NO: 80934 - RNA, 64 nt, Homo Sapiens
aggauuaaaacuaaccgugaccacuacuccaaacaaaacacaauaugccuaggggcacggauga

SEQ ID NO: 80935 - RNA, 64 nt, Homo Sapiens
ucuauuuucucuacggcuuaggcuaugugagggcaaaacacaaaucccuuugcuaaaaagaacc

SEQ ID NO: 80936 - RNA, 64 nt, Homo Sapiens
cagugaaauuaucuugagucuacacauuauuuuuaaaacacaaaaauuguucggcuggaacuga

SEQ ID NO: 80937 - RNA, 64 nt, Homo Sapiens
cauuacuguagugcugagguuauugaaguuauacaaaacacaucucagucucuguuucuuggaa

SEQ ID NO: 80938 - RNA, 64 nt, Homo Sapiens
guugaauauugaacucuaacaguuuucuacauacaaaacacagugucaugaagguuauucauaa

SEQ ID NO: 80939 - RNA, 64 nt, Homo Sapiens
uagaaaacaaaaugauccaacuuuguuuuuggucaaaacacacaccuguuguuagagaaccuau

SEQ ID NO: 80940 - RNA, 64 nt, Homo Sapiens
gaaucaucaauaaaaacucaaucacacucuguuaaaaacacauauuaauauguuuaauucaccu

SEQ ID NO: 80941 - RNA, 64 nt, Homo Sapiens
uucucagugucauccauugcaacaccugcuacucaaaacacaacuccagcaacauacuauagaa

SEQ ID NO: 80942 - RNA, 64 nt, Homo Sapiens
uagaaugaugaauuaaaaaacaucaccacuuauuaaaacacacaauggauuccuauaaugggag

SEQ ID NO: 80943 - RNA, 64 nt, Homo Sapiens
uaauuaaaaaagaaaaauucauauaaucguguuuaaaacacaaaugaagucaguauuugccuuu

SEQ ID NO: 80944 - RNA, 64 nt, Homo Sapiens
uccauuuguugacauguagacuguuuacaaaaaaaaaacacaugguuaaauguuaaauuuuaau

SEQ ID NO: 80945 - RNA, 64 nt, Homo Sapiens
cacugggcauggaccccucaaagcaggcacacccaaaacacaagucuguggcuagaaccugaug

SEQ ID NO: 80946 - RNA, 64 nt, Homo Sapiens
ggugccugugcuauaaaugaguuucuucacaugaaaaacacagccagcccaagaugacuuaucu

SEQ ID NO: 80947 - RNA, 64 nt, Homo Sapiens
cgaggagcguauacaguugacaagaaaaugguacaaaacacaacgaauuacacaacguuuuccu

SEQ ID NO: 80948 - RNA, 64 nt, Homo Sapiens
uugaagaagaaaagaaagaacugcucugagccuuaaaacacagauguuugauauuucuuaaugu

SEQ ID NO: 80949 - RNA, 64 nt, Homo Sapiens
gauuaguauuuuccacgucacuguuuauuuuuuuaaaacacaaauucuaaagcuacaacaaaua

SEQ ID NO: 80950 - RNA, 64 nt, Homo Sapiens
ccugagacuuucagugcacuguauauagaagucuaaaacacaccuaagagaaaaagaucgaauu

SEQ ID NO: 80951 - RNA, 64 nt, Homo Sapiens
cuuucauuuuucucuuccugggauucauuuuuucaaaacacaaugcuggaaaaaaaagauuugu

SEQ ID NO: 80952 - RNA, 64 nt, Homo Sapiens
uagaauuccugcacaugaucaaacagauccuccuaaaacacaccuuuugaaauguugaacauaa

SEQ ID NO: 80953 - RNA, 64 nt, Homo Sapiens
ccugagagggauggaccagaauuuuaugcauuuaaaaacacaguauuuuaguccuauuuguauu

SEQ ID NO: 80954 - RNA, 64 nt, Homo Sapiens
cuuaaggggauagacuagacuuuugugcauuuaaaaaacacaauuuucagcccuauuuguauua

SEQ ID NO: 80955 - RNA, 63 nt, Homo Sapiens
uuucugguuacuaugaauaaaaaauaaaaagcauaaaacacaauaauugcaucuucauuagga

SEQ ID NO: 80956 - RNA, 64 nt, Homo Sapiens
uagaaugauuuaaauaggaugucuuuuuauuuuuaaaacacaagaacuuucuaaaacuaaaaga

SEQ ID NO: 80957 - RNA, 64 nt, Homo Sapiens
auuaaaauaaaguugcugguuuuuaaaaauauauaaaacacaaaaucguaaaacugacaaaaua

SEQ ID NO: 80958 - RNA, 64 nt, Homo Sapiens
ccuuggaacagagcuauuacucugggcaaaaauuaaaacacauugcaaagcuuauuuucuuuua

SEQ ID NO: 80959 - RNA, 64 nt, Homo Sapiens
gaacaguagugaccccuggcagcaauucauuaccaaaacacagacaaaccaaagguaaccagcu

SEQ ID NO: 80960 - RNA, 64 nt, Homo Sapiens
uuggccugugauggaaaggaaggcuucuaauuagaaaacacagcaacagaagaccuauaccccg

SEQ ID NO: 80961 - RNA, 64 nt, Homo Sapiens
uguucuucacaagugcuuugugccccuuuaauuaaaaacacaugaaaugaauaacaaaacaaga

SEQ ID NO: 80962 - RNA, 64 nt, Homo Sapiens
uuacugcaccucuuguuagacucugugcauuaauaaaacacaccuagagucuguugucauuuca

SEQ ID NO: 80963 - RNA, 64 nt, Homo Sapiens
caccacacacacacacacacaauuuaguuugcuuaaaacacacagugacuaugcuuaaguguuu

SEQ ID NO: 80964 - RNA, 64 nt, Homo Sapiens
gguuuugagaggugaugcaacaguucauccccacaaaacacauucccugcacccuucugacuga

SEQ ID NO: 80965 - RNA, 64 nt, Homo Sapiens
ugguuuggagcaauaggaacaacacuaagaugggaaaacacacauugacuggauccacuaaacc

SEQ ID NO: 80966 - RNA, 64 nt, Homo Sapiens
ccaccuuuuggcuuacuucgcauguggacucagaaaaacacacauaauaucacuauuuacaacu

SEQ ID NO: 80967 - RNA, 64 nt, Homo Sapiens
aacuuccauaagauacugcuaaugcaccaguauuaaaacacaucgacguaaguagcucauuuag

SEQ ID NO: 80968 - RNA, 64 nt, Homo Sapiens
cagccugggcgacagagcaggacucucucucaaaaaaacacaaaaaaacaaaaacaaaaaacca

SEQ ID NO: 80969 - RNA, 64 nt, Homo Sapiens
uuagccaggcguggugguacccccaucucuacuaaaaacacaaagccugaccaacauggagaaa

SEQ ID NO: 80970 - RNA, 64 nt, Homo Sapiens
cuuauuguuccugaucucuuguguaaaagugcgcaaaacacaucauauggucauccucuaauga

SEQ ID NO: 80971 - RNA, 64 nt, Homo Sapiens
ucuaucagcugacuuuucaggguauccuuaaaaaaaaacacacacgaaaaacaaaaguuugcuu

SEQ ID NO: 80972 - RNA, 64 nt, Homo Sapiens
gguugauccugcuguguugaaggcugugguuaauaaaacacaaguaugauaaacaggaccuagc

SEQ ID NO: 80973 - RNA, 64 nt, Homo Sapiens
guaggacucuguaaucuuuugauuaguuucugagaaaacacaaugaagcacuucacuuuuuuuu

SEQ ID NO: 80974 - RNA, 64 nt, Homo Sapiens
gcacuucacuuuuuuuuauucaaagccauuuaauaaaacacaguuggucagcccagugcaaagc

SEQ ID NO: 80975 - RNA, 64 nt, Homo Sapiens
guuaaaaaagaaacaaaugaaggcaguaguuuucaaaacacauacggcgauuuucgggcugaga

SEQ ID NO: 80976 - RNA, 64 nt, Homo Sapiens
aagggggauugggcggaaaggcaacacagccacuaaaacacaaagugacaaaccauuuccaaca

SEQ ID NO: 80977 - RNA, 64 nt, Homo Sapiens
agcugcaugucuaaaauuacacaaaaacaaaaaaaaaacacaaauuuucaaaaaaaaaaaaaaa

SEQ ID NO: 80978 - RNA, 64 nt, Homo Sapiens
ugaaguucaaauuucaggaauuugacaaaaguuuaaaacacauaaacauaucuuucaugacuau

SEQ ID NO: 80979 - RNA, 64 nt, Homo Sapiens
ggccauuuuauucaaaugcuugcuauacaaucugaaaacacacuggcaggugcuccucuccuug

SEQ ID NO: 80980 - RNA, 64 nt, Homo Sapiens
uucagaauauuugcaauaagagucuggauuuuaaaaaacacaugcauacacacaauuaagagcu

SEQ ID NO: 80981 - RNA, 64 nt, Homo Sapiens
uuuaaggaaucauaaucauuuguauuuauacuuaaaaacacacaauguuaaaaaaaauaaagca

SEQ ID NO: 80982 - RNA, 64 nt, Homo Sapiens
uguagcaaaagaguauuuauacaucccaccaaucaaaacacagcuuuauuaccucaugcgaacu

SEQ ID NO: 80983 - RNA, 64 nt, Homo Sapiens
cuacauugcauaugggcauaagcugugguucuugaaaacacaucguuuccauucccaaauaugu

SEQ ID NO: 80984 - RNA, 64 nt, Homo Sapiens
cucucccccaaaggguguccuuaaaggggauuaaaaaacacagcuugguccauuuuacacuuuu

SEQ ID NO: 80985 - RNA, 64 nt, Homo Sapiens
gaucagaagccuucagauaguuugaggcucaaaaaaaacacaaagccucuguucuuucaacucc

SEQ ID NO: 80986 - RNA, 64 nt, Homo Sapiens
aggacaguucuguguugaaaacaggugagcccugaaaacacaaaaacaguucaauaaugaggaa

SEQ ID NO: 80987 - RNA, 64 nt, Homo Sapiens
auuuuaauacagauugaaaggaacuauuuugaagaaaacacaacaaaaaaucaaaaggcacugu

SEQ ID NO: 80988 - RNA, 64 nt, Homo Sapiens
uuguguuuauggcauuuaguugaaaacuugcugaaaaacacaacaacagggaaaacagcuagcu

SEQ ID NO: 80989 - RNA, 64 nt, Homo Sapiens
guucccucuguauagccucugggacaagaaaaagaaaacacaagaauguauacacuggaagauu

SEQ ID NO: 80990 - RNA, 64 nt, Homo Sapiens
gcuauagaugaagguagagggcugucagcccugaaaaacacacaggucagacauuuaaaaggca

SEQ ID NO: 80991 - RNA, 64 nt, Homo Sapiens
aagucaaacaaauguuuuaaagauaagagggggaaaaacacauaccugggggucaaguauuuua

SEQ ID NO: 80992 - RNA, 64 nt, Homo Sapiens
uccuuggcacuggcuagucucaaccgcaacaacaaaaacacaaagccacuggguauacugcuga

SEQ ID NO: 80993 - RNA, 64 nt, Homo Sapiens
gaaaaccccuuuuaucauuuguggaaucuuacggaaaacacagauauguaacuauucuaaucca

SEQ ID NO: 80994 - RNA, 64 nt, Homo Sapiens
uuagcaaauucguuugcguauuaugucauuuguaaaaacacauaccccuuucucuagagcaguu

SEQ ID NO: 80995 - RNA, 64 nt, Homo Sapiens
aggucaauguuuuucaagaucugaucaaaacuuaaaaacacacuuaaguggcuugauuaaaugg

SEQ ID NO: 80996 - RNA, 64 nt, Homo Sapiens
auccuagcuugggauucccauuuuggaacaaaagaaaacacaaaagggagaagguggcauaacu

SEQ ID NO: 80997 - RNA, 64 nt, Homo Sapiens
uuaaucugauucacaggauuauguuuaaucgccaaaaacacacuggccaguguaccauaauaug

SEQ ID NO: 80998 - RNA, 64 nt, Homo Sapiens
cagcacuguucaucuggccaaacaacugugguuaaaaacacauguaaaaugcuuuuuaacagcu

SEQ ID NO: 80999 - RNA, 64 nt, Homo Sapiens
ccacacacacgcgcuuuuccccaaaaacaaaaacaaaacacacauucauaaugcagcaguuucu

SEQ ID NO: 81000 - RNA, 64 nt, Homo Sapiens
gucaggcuuccagcacauucugcacaugggccgcaaaacacacauuccaaaagaggucaccaga

SEQ ID NO: 81001 - RNA, 64 nt, Homo Sapiens
aguuugccccuuuuggaaugaucucugaauauauaaaacacacacacaaagagcaauaguuugc

SEQ ID NO: 81002 - RNA, 64 nt, Homo Sapiens
aguuugccccuuuuggaacgaccccugaauauauaaaacacacacacaccccgcgcacucucac

SEQ ID NO: 81003 - RNA, 64 nt, Homo Sapiens
acuuuauacucacuuaaaaucaagaaucccaucuaaaacacauagguaccuuaucugaaacucu

SEQ ID NO: 81004 - RNA, 64 nt, Homo Sapiens
uggaaaaaaugaucauggcuuuaaaaaaaaaacaaaaacacacacacaugaacucagauuugca

SEQ ID NO: 81005 - RNA, 64 nt, Homo Sapiens
gcccaggcugcagucuccacaccaaacagucaacaaaacacaaacccugaaggaaaaccuuuuc

SEQ ID NO: 81006 - RNA, 64 nt, Homo Sapiens
caacuuugucagguucacguccuauaacgguuaaaaaacacacacacacauacacaaaccguuu

SEQ ID NO: 81007 - RNA, 64 nt, Homo Sapiens
uggaauacgaugcagcccacuuugugacagucagaaaacacaccgaauuaccaagacgucugcu

SEQ ID NO: 81008 - RNA, 64 nt, Homo Sapiens
uucaaauuauuugaauuaccuugugccuaucuauaaaacacacucuuuuauuguggcugaauuu

SEQ ID NO: 81009 - RNA, 64 nt, Homo Sapiens
cuaaauacuagagauaacuuacaaaaaaacacaaaaaacacauuuucuuaaaaucaaaaacaaa

SEQ ID NO: 81010 - RNA, 64 nt, Homo Sapiens
aaacacauucuaaauacuagaaaaacaaaacaaaaaaacacaaaaagaauuccuucuuaaaauc

SEQ ID NO: 81011 - RNA, 64 nt, Homo Sapiens
uccugcaccaacaccaauacgcuguuaacacuagaaaacacacuuauuuccaggucacagaauu

SEQ ID NO: 81012 - RNA, 64 nt, Homo Sapiens
aaaugaauuuauuauaucuagggaaggagugggcaaaacacauaaagggagggggggauuuaaa

SEQ ID NO: 81013 - RNA, 64 nt, Homo Sapiens
aaauaaaaaaccccuacaaagcagaaaaagaaaaaaaacacaaacccuagaaacccaauucuaa

SEQ ID NO: 81014 - RNA, 64 nt, Homo Sapiens
ggggagaucaugccuaaaagccggaaaaggaguaaaaacacauuacauaccucuguccuagaag

SEQ ID NO: 81015 - RNA, 64 nt, Homo Sapiens
ucuuuauguguauagcauguaggccuauaaaugaaaaacacaauuguuuuggaaguaugcaugc

SEQ ID NO: 81016 - RNA, 64 nt, Homo Sapiens
ucuuauuaguuuaccacuuguuguuguucauauaaaaacacacucuggaugggaaagugcaguc

SEQ ID NO: 81017 - RNA, 64 nt, Homo Sapiens
gaugggugccuguggguguuuuuagacaccagagaaaacacagucucugcuagagagcacuccc

SEQ ID NO: 81018 - RNA, 64 nt, Homo Sapiens
augauguacacuuugugcuuggcauuaaaagaaaaaaacacacauccuggaagucuguaaguug

SEQ ID NO: 81019 - RNA, 64 nt, Homo Sapiens
guugguguggaauggucauuaauauaacuugccaaaaacacacauuugccuaacaggaaucuga

SEQ ID NO: 81020 - RNA, 64 nt, Homo Sapiens
cuacaaugaggcagcaucagaaaacacuagagugaaaacacauguaaacacagaguguagagug

SEQ ID NO: 81021 - RNA, 64 nt, Homo Sapiens
uaauaccgucagagugcugugauucgucauuugcaaaacacacaugauuauucagcauacuguu

SEQ ID NO: 81022 - RNA, 64 nt, Homo Sapiens
uaauuuaucuccuguguuucuucugacauuuggaaaaacacauuaacuccugggaaccucgaua

SEQ ID NO: 81023 - RNA, 64 nt, Homo Sapiens
guuugggaaugagaggaugagugagugaggcuugaaaacacaccacauugaaaauccugccaca

SEQ ID NO: 81024 - RNA, 64 nt, Homo Sapiens
aagagauguaaaaaaaaaaaaaaaaaaaaaaaaaaaaacacacacacagaggaaagacgcucuu

SEQ ID NO: 81025 - RNA, 64 nt, Homo Sapiens
aaaguuugugcgcauguuuuucauuauaacaaugaaaacacaaaaguggagaagcuguacaacg

SEQ ID NO: 81026 - RNA, 64 nt, Homo Sapiens
auaagacacccaauuuuucaugggaguugacaccaaaacacagcuggauuccaucaggaaagcu

SEQ ID NO: 81027 - RNA, 64 nt, Homo Sapiens
uuagagaagaacauaaaugaccugauggagcugaaaaacacagcaugagaacuucgugaagcau

SEQ ID NO: 81028 - RNA, 64 nt, Homo Sapiens
uggaauuuauccacuucuuuugguuccccaguccaaaacacagucauuucaccuggacuauuuc

SEQ ID NO: 81029 - RNA, 64 nt, Homo Sapiens
uuuauauucucacauaucugaccguaucuggcccaaaacacaaaugggauuacaggccugagcc

SEQ ID NO: 81030 - RNA, 64 nt, Homo Sapiens
auuuuuuuuuuuuuuuuuuuaaucaaugagguuaaaaacacagguagaaauuaauuuaauuuua

SEQ ID NO: 81031 - RNA, 64 nt, Homo Sapiens
acucagcccagccaggccccggacuucuuuuucuaaaacacaaaccacccccaagacugggagg

SEQ ID NO: 81032 - RNA, 64 nt, Homo Sapiens
gaagagauuuaaaaaaaaaaagcaacaaaaaaagaaaacacacacaaacagaagaggaaaaaaa

SEQ ID NO: 81033 - RNA, 64 nt, Homo Sapiens
cagaagaggaaaaaaaagcaaaaaaagcgacaaaaaaacacaaagaacaaaaaagaaaaaaauc

SEQ ID NO: 81034 - RNA, 64 nt, Homo Sapiens
aaaagacaaaaaaaaaaaaagaacuugaaaaaaaaaaacacaaaaauuuuuacuggggauucuu

SEQ ID NO: 81035 - RNA, 64 nt, Homo Sapiens
auaauacaguggaucugaauuuauuauugcuuauaaaacacauuugauggaauaggaguacugg

SEQ ID NO: 81036 - RNA, 64 nt, Homo Sapiens
auaaugguuaaaaaugaaaccagcuguggauuucaaaacacaguguauucuagaucaucuaaga

SEQ ID NO: 81037 - RNA, 64 nt, Homo Sapiens
auuuuauuccuuuaacugccaugguuauuuuuauaaaacacaucuauguuucucuuauuaaaag

SEQ ID NO: 81038 - RNA, 64 nt, Homo Sapiens
caccaguguuucuugagccauuucagauguauguaaaacacaaaauaugccaaauauauauugc

SEQ ID NO: 81039 - RNA, 64 nt, Homo Sapiens
ugaauuuucuauaaaaucacuauccaaaugcuagaaaacacacaaaaaaaaaaaccuauuuuau

SEQ ID NO: 81040 - RNA, 64 nt, Homo Sapiens
ucuucuuucagcuugucuuauuguuuuaccucccaaaacacagucaucgauaguauuuaauaau

SEQ ID NO: 81041 - RNA, 64 nt, Homo Sapiens
aagaaaauuuaccaaaaaaauuucuuuugucuaaaaaacacauguuuuuuauaaacuggugauu

SEQ ID NO: 81042 - RNA, 64 nt, Homo Sapiens
guaauauguuggguuuauuuuguuguuauuuugaaaaacacauuucaaguuuuuauuuuguugu

SEQ ID NO: 81043 - RNA, 64 nt, Homo Sapiens
ugauuagggugaggcacaaagaguuucuugaucauccagagaacauugacagacaauuaugaau

SEQ ID NO: 81044 - RNA, 64 nt, Homo Sapiens
uguguuuuguucugaucaagggguagggaaccuuuccagagaagucccauuaguaagaaaugac

SEQ ID NO: 81045 - RNA, 64 nt, Homo Sapiens
gcaauuaauuuuauuaacugauuucuggucuaucuccagagauaaaauaccauuccuucacaac

SEQ ID NO: 81046 - RNA, 64 nt, Homo Sapiens
cgagccacaccuuuggaaguaaugauuuggccauuccagagauucuggggcuaaaguuuguuuu

SEQ ID NO: 81047 - RNA, 64 nt, Homo Sapiens
gccccucacuuuacagaugaggaaauggaggugguccagagagggucugggauucccaagguca

SEQ ID NO: 81048 - RNA, 64 nt, Homo Sapiens
ugacuggaggggcaggagaugguccaaguguccauccagagaugagacucuuagaaucaaagug

SEQ ID NO: 81049 - RNA, 64 nt, Homo Sapiens
auuuauagccagccaucuaucaccucuagaagguuccagagacagugaaacugcaagaugcucu

SEQ ID NO: 81050 - RNA, 64 nt, Homo Sapiens
uuaaaucacuugagguaugaaguuuauccuguuuuccagagauaaacauaaguugaucuuccca

SEQ ID NO: 81051 - RNA, 64 nt, Homo Sapiens
ugauggcauucacuucacacagucgucuauguuauccagagauuuuuauuucauuuuacauuuu

SEQ ID NO: 81052 - RNA, 64 nt, Homo Sapiens
auuguuuaacaguauguguggugaugucauuaucuccagagaggcuucaagaaauccuuuggaa

SEQ ID NO: 81053 - RNA, 64 nt, Homo Sapiens
ugggugccuggguugagagacucuucucacugccuccagagaggaccauucccauuuucucagc

SEQ ID NO: 81054 - RNA, 64 nt, Homo Sapiens
ggaccuugacucuuccacacggccacugcccugcuccagagaguccucaucugaccccacccug

SEQ ID NO: 81055 - RNA, 64 nt, Homo Sapiens
cuguagcacugcuuuuuugaggccaguagcaacauccagagaucauucuuccauacuuuacucc

SEQ ID NO: 81056 - RNA, 64 nt, Homo Sapiens
gcuuuuccuacgaucugcauuauguaaucacagguccagagagcuuuauggaagcgggagagga

SEQ ID NO: 81057 - RNA, 64 nt, Homo Sapiens
cuaaauuuguccagagcuuucuuuuuccuagaaauccagagagcaaagucagagccuggcaccu

SEQ ID NO: 81058 - RNA, 64 nt, Homo Sapiens
gugguucuucagaaucaccuagaugccuccacccuccagagauccugaguccaggagucugaag

SEQ ID NO: 81059 - RNA, 64 nt, Homo Sapiens
ccuuaguggccagagacugacuucaagguuuuauuccagagacuccagagacuuaagcuaagua

SEQ ID NO: 81060 - RNA, 64 nt, Homo Sapiens
ccagagacugacuucaagguuuuauuccagagacuccagagacuuaagcuaaguauuuuuucau

SEQ ID NO: 81061 - RNA, 64 nt, Homo Sapiens
gaggccaggaggcagugaggcaaagauacuuuuuuccagagacauuguuagucccaacucuggc

SEQ ID NO: 81062 - RNA, 64 nt, Homo Sapiens
aaaccucagacuuugugcacugcaaaaugcccaguccagagacaggagggcaucuguacuccug

SEQ ID NO: 81063 - RNA, 64 nt, Homo Sapiens
caaagauugaacacugcguaggagagggagaugauccagagacauguggcagcaggcauggcuu

SEQ ID NO: 81064 - RNA, 64 nt, Homo Sapiens
ggcagccuauugguguuauguuuauguaacauaguccagagaacugacaugcaggucaaaaguc

SEQ ID NO: 81065 - RNA, 64 nt, Homo Sapiens
cuuauguauuuuaacaguuggguucuguggaguguccagagaccuuggguuagguauauccauc

SEQ ID NO: 81066 - RNA, 64 nt, Homo Sapiens
acaacuuguugguaguuaggcacccaugaaugucuccagagacauccugagaggcaagauuccu

SEQ ID NO: 81067 - RNA, 64 nt, Homo Sapiens
acacuuuuucaaaaugcucaccaaaauuauuguguccagagagugggcauuugauggcaauagg

SEQ ID NO: 81068 - RNA, 64 nt, Homo Sapiens
ggacaaacucuuaacuuuuacaauuuuauuccauuccagagaauucucggguuaagggaaguga

SEQ ID NO: 81069 - RNA, 64 nt, Homo Sapiens
gcgcucugcucauguccguacaucgcagugauccuccagagacaugugcuggucuaaauuaauc

SEQ ID NO: 81070 - RNA, 64 nt, Homo Sapiens
gcgccccuccugguucccugcugccccaccguccuccagagaauccgagaaugaggagcccucc

SEQ ID NO: 81071 - RNA, 64 nt, Homo Sapiens
gggcuucccugucccggaggcuccccuuuaccccuccagagaaggauguccagagacuaggccu

SEQ ID NO: 81072 - RNA, 64 nt, Homo Sapiens
aggccucuccccuuuaccccuagccugggggauguccagagacuagugaauggcccuuccuuag

SEQ ID NO: 81073 - RNA, 64 nt, Homo Sapiens
aguccugggagagcgggcggccagagagcgggcauccagagaggguucccauuucccagguucu

SEQ ID NO: 81074 - RNA, 64 nt, Homo Sapiens
gggcauccagagaggagucccauuucccagguucuccagagagcuccacugagccucugguucc

SEQ ID NO: 81075 - RNA, 64 nt, Homo Sapiens
aagccacauauaaaaaggcauugagggcucacuguccagagaauugcuuuuguaaaugcuccac

SEQ ID NO: 81076 - RNA, 64 nt, Homo Sapiens
uguucauuccaaaucuguuaagcauuuccaaacauccagagaaugguuucacuguugagggugc

SEQ ID NO: 81077 - RNA, 64 nt, Homo Sapiens
gugccaugaucagggauauggaacaggaggguccuccagagaauggggcacggccccuacccga

SEQ ID NO: 81078 - RNA, 64 nt, Homo Sapiens
acauggacacccccagcucuuacaggaacugagguccagagaggaucuggccaacgggccuuuu

SEQ ID NO: 81079 - RNA, 64 nt, Homo Sapiens
uuuuaaaauaauagaagaaaaucaguuugcuuucuccagagaaaucagcgugaauuaauuuuua

SEQ ID NO: 81080 - RNA, 64 nt, Homo Sapiens
agguguuuuuuucggggagcuuugguagcaaggguccagagauggcagcugggguucccugcuu

SEQ ID NO: 81081 - RNA, 64 nt, Homo Sapiens
cacggccgggcccccuggcgacaacuuccaucauuccagagaaaagccacuuuaaaaacagcug

SEQ ID NO: 81082 - RNA, 64 nt, Homo Sapiens
uuccuuguaauuaagucacaggcaggacccaguuuccagagagcaggcggggccgcccaguggg

SEQ ID NO: 81083 - RNA, 64 nt, Homo Sapiens
cagcuaaagucaccugccuguucaccugacuguuuccagagaccuuucuagagacccagcuuua

SEQ ID NO: 81084 - RNA, 64 nt, Homo Sapiens
cagcuacaguucccuggcugguuucucaguuauuuccagagaccagcagcuccuuggacagacu

SEQ ID NO: 81085 - RNA, 64 nt, Homo Sapiens
cccaucgaacugaaggaucaaaggucauuccagauccagagauccucaacggggacaacuccag

SEQ ID NO: 81086 - RNA, 64 nt, Homo Sapiens
cacuccgcucuggaacucacuggcagagaugcauuccagagaugugagagaacaguguugcugc

SEQ ID NO: 81087 - RNA, 64 nt, Homo Sapiens
ugucagcccuuaucaggcauauugugagugaaguuccagagaugaguagacccuguguacacag

SEQ ID NO: 81088 - RNA, 64 nt, Homo Sapiens
ugaaggagaaccugguggcauugccccagagcucuccagagaugagccuccccuauccccaccc

SEQ ID NO: 81089 - RNA, 64 nt, Homo Sapiens
gcuuauguauaaguaaaggggcaggugcuugggcuccagagagacccuagguacugccuucuaa

SEQ ID NO: 81090 - RNA, 64 nt, Homo Sapiens
agaaacugaggaguagcugagaggaagaugaagagaagcugagaagaagcugaggauccucaca

SEQ ID NO: 81091 - RNA, 64 nt, Homo Sapiens
aguagcugagaggaagaugaagagaagcugagaagaagcugaggauccucacaggagcagacag

SEQ ID NO: 81092 - RNA, 64 nt, Homo Sapiens
gaaacagggcagugacaaguggagggggugucuggaagcugagcaggcccgacagagagaugaa

SEQ ID NO: 81093 - RNA, 64 nt, Homo Sapiens
ccacuggggaaugcucccagcugugcuguggagagaagcugauguuuugguguauugucagcca

SEQ ID NO: 81094 - RNA, 64 nt, Homo Sapiens
cacccuccucuuggaauuacaagcccugggguuugaagcugacuuuauagcugcaaguguaucu

SEQ ID NO: 81095 - RNA, 64 nt, Homo Sapiens
auucuucccaucuggccagcgccaagcugaagcugaagcugaaguuuauuuucaaaugaaugag

SEQ ID NO: 81096 - RNA, 64 nt, Homo Sapiens
cugaagauucuucccaucugaaugaggccaagcugaagcugaagaaacauuuuauuuucaaaug

SEQ ID NO: 81097 - RNA, 64 nt, Homo Sapiens
cauuuggggaccacagaggcuguggucagagagggaagcugaggcccauggccacauccucaug

SEQ ID NO: 81098 - RNA, 64 nt, Homo Sapiens
ggcaaugggcuacccucauuucacacguugugaugaagcugaggcugcugccaggcccggcaug

SEQ ID NO: 81099 - RNA, 64 nt, Homo Sapiens
ugggaggaucucgagccugcucccagcuauuugggaagcugagggugguguuucgcgucuguag

SEQ ID NO: 81100 - RNA, 64 nt, Homo Sapiens
ugcuaaaugaauaucccugcggagaggagggucugaagcugagccaccuguguaaaaggaugug

SEQ ID NO: 81101 - RNA, 64 nt, Homo Sapiens
auaauuuucaagggaucuucauggguugugacuggaagcugaccuuagucuugcgucucauccu

SEQ ID NO: 81102 - RNA, 64 nt, Homo Sapiens
aggugauuuucagauuucuuguucuauggaagaggaagcugagcucagggagauaugagcucca

SEQ ID NO: 81103 - RNA, 64 nt, Homo Sapiens
uagugcuuacauuugcucaaaaagcauguuguaugaagcugacugccaccaugcuaaagcagau

SEQ ID NO: 81104 - RNA, 64 nt, Homo Sapiens
aaggaauucagacuuaaaugccuaccucugugcugaagcugacagacaguauuaacucuuauca

SEQ ID NO: 81105 - RNA, 64 nt, Homo Sapiens
aaggcagacauuuccaaguuuguugaaauaauacgaagcugacuagcuuacgugaaugauguug

SEQ ID NO: 81106 - RNA, 64 nt, Homo Sapiens
aggccagaaugaggaagcccugaagagcuuaaaagaagcugaaaacuuaaugcaggaagaacau

SEQ ID NO: 81107 - RNA, 64 nt, Homo Sapiens
ucuccuugcccugaagcuucaggaugaaggacaggaagcugaaggagaaaaguacauugaagaa

SEQ ID NO: 81108 - RNA, 64 nt, Homo Sapiens
gacuggaaggacuucuugcuaggcucaugcgggagaagcugacgaccugcaggaccaagugcag

SEQ ID NO: 81109 - RNA, 64 nt, Homo Sapiens
cggcagcucugcgccaucuacuccaggcaugugggaagcugaagccucucucgugcucaggcug

SEQ ID NO: 81110 - RNA, 64 nt, Homo Sapiens
gaagggccggagcccggggcuccaugcuggagaagaagcugaagcccagcugauggauggcuuc

SEQ ID NO: 81111 - RNA, 64 nt, Homo Sapiens
auuacuuggguauucucugaaugcaauggacauggaagcugaaaccagguccagagaaccuggc

SEQ ID NO: 81112 - RNA, 64 nt, Homo Sapiens
uuggaggcauccaaaauaagcguguacugugccugaagcugaagcaggccuuacugccccuacu

SEQ ID NO: 81113 - RNA, 64 nt, Homo Sapiens
gccuagagccagaugccuaugcguuguuccauaagaagcugaccgagggugugcugaugcggga

SEQ ID NO: 81114 - RNA, 64 nt, Homo Sapiens
aggaucccccugcuuaccaggcccgcuuguuacagaagcugacagaagagguacccuugggaca

SEQ ID NO: 81115 - RNA, 64 nt, Homo Sapiens
agaauuuugagggugggagagaagaaaagggaaagaagcugaaaauguaaaaccacaccaggga

SEQ ID NO: 81116 - RNA, 64 nt, Homo Sapiens
ccuuuauaugacuuucucugaguugggcaaagaagaagcugacacaccguauguuguuagaguc

SEQ ID NO: 81117 - RNA, 64 nt, Homo Sapiens
ugaugucagugucugggcucaugacuuguaaauggaagcugaugugaacagguaauuaauauua

SEQ ID NO: 81118 - RNA, 64 nt, Homo Sapiens
guuuaagauguauauuuagaaugacaucaucuaagaagcugauuuugcuaaacuccuguucccu

SEQ ID NO: 81119 - RNA, 64 nt, Homo Sapiens
cauagugucaugugcucaguuccuaguaucagaagaagcugauauacucaugagaaguggaagc

SEQ ID NO: 81120 - RNA, 64 nt, Homo Sapiens
guugagggagguggaggaagcaagugaugguggggaagcugaaugaccagaaggaguaaugaga

SEQ ID NO: 81121 - RNA, 64 nt, Homo Sapiens
caacaggauuugucugcagcuaaauauccgagaggaagcugaugggugguaaacuaugggaugg

SEQ ID NO: 81122 - RNA, 64 nt, Homo Sapiens
cucauuuuagguuccuuccaggcacauuagccuugaagcugaagcuuuacguggagggagaaca

SEQ ID NO: 81123 - RNA, 64 nt, Homo Sapiens
gcccaaggcaccagaagguuuguuucaguuugcugaagcugauuuguaaugauuggcacucuuc

SEQ ID NO: 81124 - RNA, 64 nt, Homo Sapiens
uagcucuccugaaccuccuccuuccccaagcugagaagcugagagcuggaggacaauauccagg

SEQ ID NO: 81125 - RNA, 64 nt, Homo Sapiens
cuuaggcuccacagcugggaacaaguggggcugggaagcugacuucgugcucuucaccaccaca

SEQ ID NO: 81126 - RNA, 64 nt, Homo Sapiens
uggaccugcuacuggagaagaccaaggagcugcagaagcugauugaagcugacaucuccaagag

SEQ ID NO: 81127 - RNA, 64 nt, Homo Sapiens
acuggagaagaccaaggagcugcagaagcugauugaagcugacaucuccaagagguacagcggg

SEQ ID NO: 81128 - RNA, 64 nt, Homo Sapiens
ugaggaagggucugacaggcaggcagaggggaaagaagcugauaagcccagcagaagcugagcc

SEQ ID NO: 81129 - RNA, 64 nt, Homo Sapiens
caggcagaggggaaagaagcggagaagcccagcagaagcugagcgagagaggaaaggagggagg

SEQ ID NO: 81130 - RNA, 64 nt, Homo Sapiens
ccuucagaucagccacaccuuuuccaggaguucugaagcugacagcacuacaaaggagacgggg

SEQ ID NO: 81131 - RNA, 64 nt, Homo Sapiens
gugguggcacaugccuguaaucccagcuacucgggaagcugaggcaggagaauugcuugaacca

SEQ ID NO: 81132 - RNA, 64 nt, Homo Sapiens
cccggggaggggagcgacccauuuuacagaugaggaagcugaaggagaagaggccaaagcccuc

SEQ ID NO: 81133 - RNA, 64 nt, Homo Sapiens
aucucccgaguccugggcagccaaaaaagaaaaggaagcugagcagcuagaguucacaggagag

SEQ ID NO: 81134 - RNA, 64 nt, Homo Sapiens
ggggagacccuaugucaaaacacugcacuucagccuuggagacagcagugagccgugauggcgc

SEQ ID NO: 81135 - RNA, 64 nt, Homo Sapiens
cuccuggccuccccuccugucuccuuggccuccucuuggagagugcgcccagggcgcauggggc

SEQ ID NO: 81136 - RNA, 64 nt, Homo Sapiens
cauaaggaaauugcugucuuucaugcguguccugcuuggagagcugcuucugguuacuaggguc

SEQ ID NO: 81137 - RNA, 64 nt, Homo Sapiens
uacugguguccgucucccagggggaagugcaguccuuggagaugagggaauggggugggagucg

SEQ ID NO: 81138 - RNA, 64 nt, Homo Sapiens
agcgcugucuguggugugauuuccugaauaaagccuuggagacccugucaaacagaugcaaacc

SEQ ID NO: 81139 - RNA, 64 nt, Homo Sapiens
acugaacuguuacaaaccccucuccccaugggaccuuggagaaacucuuccuguucugcacccc

SEQ ID NO: 81140 - RNA, 64 nt, Homo Sapiens
gcacuccagccugggcaacagagcaagacccugucuuggagaaaccagaauuuuggaagagcaa

SEQ ID NO: 81141 - RNA, 64 nt, Homo Sapiens
uacuuuuaaaacugguggcaccacucauuugggacuuggagacugcuuuuauccagaaccuguu

SEQ ID NO: 81142 - RNA, 64 nt, Homo Sapiens
cucacuuuauucuuguauggcuuugguaggcauacuuggagaacauaucccacauuaggaauug

SEQ ID NO: 81143 - RNA, 64 nt, Homo Sapiens
agccugagaguuugagggcuuuaauccuuuaaaacuuggagaagcuggcugggcgcgguggcuc

SEQ ID NO: 81144 - RNA, 64 nt, Homo Sapiens
uauguaauuuugucuuuggagucaaaauaacauacuuggagaagguguuuguuuuuaucaaaau

SEQ ID NO: 81145 - RNA, 64 nt, Homo Sapiens
cugcauuaucuuaaaaggcaaauucuguagcauacuuggagaaauuuucuagagguuggcuuuc

SEQ ID NO: 81146 - RNA, 64 nt, Homo Sapiens
agcccuaccugauacccugugucaaugaguguaccuuggagagcuauccacucaggccccagug

SEQ ID NO: 81147 - RNA, 64 nt, Homo Sapiens
uaggcuugguuuugaugcuagagaggaaaaaggacuuggagagagagaaggaauggcuggucca

SEQ ID NO: 81148 - RNA, 64 nt, Homo Sapiens
ccucccuccgagaugccagaaguuuuuccacagccuuggagaggggcuuugacugagggcuggg

SEQ ID NO: 81149 - RNA, 64 nt, Homo Sapiens
ggccacccaggaccaggucuguguggggaugugccuuggagaccaaggcaauaguccuuuccac

SEQ ID NO: 81150 - RNA, 64 nt, Homo Sapiens
aguccuguaaaugaaugcucugggcuagauacagcuuggagaaccugcuggccuuguuagacag

SEQ ID NO: 81151 - RNA, 64 nt, Homo Sapiens
ccccucccaccugcccccugcguaggcacccagacuuggagagacccgucugcuguuaauacuu

SEQ ID NO: 81152 - RNA, 64 nt, Homo Sapiens
guccaagaacaaaugccagccacguccuccgccacuuggagagaugagaacccaguggggucac

SEQ ID NO: 81153 - RNA, 64 nt, Homo Sapiens
gcaggcaucuguggggaaucccagccugcagguucuuggagaagcaggugaaccuaaggaugaa

SEQ ID NO: 81154 - RNA, 64 nt, Homo Sapiens
ucacugugggcuagggugguacuuggagagggagcuuggagaaccacggccaagggccacggga

SEQ ID NO: 81155 - RNA, 64 nt, Homo Sapiens
gagcuuggagaacucacuguaagggccacgggaacuuggagaggcgauggucagggccacggcc

SEQ ID NO: 81156 - RNA, 64 nt, Homo Sapiens
uguucccccagggggcucugcuccugcggauacucuuggagaguugagauggggugccgcccac

SEQ ID NO: 81157 - RNA, 64 nt, Homo Sapiens
aguuuuaggaccagcauuacuugugaaagauguccuuggagaugucauuucuuagauggagaag

SEQ ID NO: 81158 - RNA, 64 nt, Homo Sapiens
agaaccaaguccuuggauauuagaaccaagucuacuuggagaaagcuguaucuacucuguggag

SEQ ID NO: 81159 - RNA, 64 nt, Homo Sapiens
aaagaugccaagcugcuucucccaggguuuuguacuuggagaggcacuggaacaggguugaaaa

SEQ ID NO: 81160 - RNA, 64 nt, Homo Sapiens
cagagaaagguuuuagacuccaguuuaccuuucucuuggagaaacucaaugcuaaucccaccuu

SEQ ID NO: 81161 - RNA, 64 nt, Homo Sapiens
gcaugaggacaacuauucagcaugguuuuagcuucuuggagaugauuccaacuuaacuauuuug

SEQ ID NO: 81162 - RNA, 64 nt, Homo Sapiens
gugaagccagcugggcuccugagucugguggggacuuggagaaccuuuaugucuagcuaaggga

SEQ ID NO: 81163 - RNA, 64 nt, Homo Sapiens
auccacacucuguaucuggcuacucugguggggacuuggagaaccuuuguguccacacucugua

SEQ ID NO: 81164 - RNA, 64 nt, Homo Sapiens
ggcaugugugggguguguguauguguucuggucacuuggagaagguacaccuggcaucuguggc

SEQ ID NO: 81165 - RNA, 64 nt, Homo Sapiens
ggugugugugggaugcguguguguguccuagucacuuggagaagggugugggcgcgucuguggu

SEQ ID NO: 81166 - RNA, 64 nt, Homo Sapiens
gugacgagacuuuugaaaaaauggugaacacacucuuggagagguaccccaggcugcacagcau

SEQ ID NO: 81167 - RNA, 64 nt, Homo Sapiens
accuuguauugugauauuaacuggcaaagauccucuuggagaaaccuuucccagguacaguuuc

SEQ ID NO: 81168 - RNA, 64 nt, Homo Sapiens
ccaucuuguggggccaggaccauggccgaagccccuuggagagagaggcugccucagccagugg

SEQ ID NO: 81169 - RNA, 64 nt, Homo Sapiens
uuacuccuccugcuccucaccccuguagggaaaccuuggagaggagaguggcaggugggcugcc

SEQ ID NO: 81170 - RNA, 64 nt, Homo Sapiens
guaagaacuuaacaauaaaggcaauagguauuuucuuggagaaucuuccaucuugcugugauuu

SEQ ID NO: 81171 - RNA, 64 nt, Homo Sapiens
ucuuuuuguuuccuuuuggucuuccaucgggugacuuggagauuuauacugccuuuagguuucu

SEQ ID NO: 81172 - RNA, 64 nt, Homo Sapiens
caggggcgcauggagaggccagccgggggcgcagcuuggagauccccgggggcgcagcuuggag

SEQ ID NO: 81173 - RNA, 64 nt, Homo Sapiens
cgggggcgcagcuuggagauucccgggggcgcagcuuggagagcgcaggagaguguguucugag

SEQ ID NO: 81174 - RNA, 64 nt, Homo Sapiens
gcaagcaacaauucuguagccucaaguaagaccaccugugaacuugaucauuaucuggcccaaa

SEQ ID NO: 81175 - RNA, 64 nt, Homo Sapiens
ugcugggauuacaggcaugagccagcaugccuggccugugaacgcagaauucuuauaagguguu

SEQ ID NO: 81176 - RNA, 64 nt, Homo Sapiens
gcccucagucuagggaucuggccacagacucccuccugugaaccaacacagacacccaagcaga

SEQ ID NO: 81177 - RNA, 64 nt, Homo Sapiens
aguuaaugauuaucauuuacuuggaaagauuuuaccugugaagugaaauucuuucauugggggu

SEQ ID NO: 81178 - RNA, 64 nt, Homo Sapiens
agaucucugccaucucuggcugagauacugcuguccugugaaguguuucccaugaccuuuuucu

SEQ ID NO: 81179 - RNA, 64 nt, Homo Sapiens
cucauagggcuguugugaggauuaggaugaaauaccugugaaagugccuaggcagugccagcca

SEQ ID NO: 81180 - RNA, 64 nt, Homo Sapiens
uugggaucugccuuuuucauccagagcucugaugccugugaacacugaaagagaaagccuaaug

SEQ ID NO: 81181 - RNA, 64 nt, Homo Sapiens
caggaguucaaggcuauagugugcuaugaucaugccugugaauagccacugcacuugagccucu

SEQ ID NO: 81182 - RNA, 64 nt, Homo Sapiens
auuuguuccugccccaccuuaacugagcgauuaaccugugaacuuccuucuccuggcucagaag

SEQ ID NO: 81183 - RNA, 64 nt, Homo Sapiens
gcuaguauuccagagcugcuauuagaagcugcuuccugugaagaucaaaucuuccugaguaauu

SEQ ID NO: 81184 - RNA, 64 nt, Homo Sapiens
ucacaaaggauggucuuggccauaugcuagggccccugugaaaauaaguaguuuugagaaguuu

SEQ ID NO: 81185 - RNA, 64 nt, Homo Sapiens
cuucuuccauuacaccuucuuuauauuuuaaaggccugugaauauacuuauaaccugcauauca

SEQ ID NO: 81186 - RNA, 64 nt, Homo Sapiens
uuccauguuucaacaacuauugaaauaugaaaugccugugaacucuuaaagcuucaugagcagc

SEQ ID NO: 81187 - RNA, 64 nt, Homo Sapiens
ugguggugucggguguugguggguagaguuaguuccugugaacaaugcacugggaaggguggag

SEQ ID NO: 81188 - RNA, 64 nt, Homo Sapiens
cuguuccucuuucuccccgacuccaccccagcucccugugaagagagaguuaauauauuuguuu

SEQ ID NO: 81189 - RNA, 64 nt, Homo Sapiens
gugggcccagcccggcccgcgucucgaaggggcaccugugaacucaaaaggcucuuuucagagc

SEQ ID NO: 81190 - RNA, 64 nt, Homo Sapiens
accccggugccugugacaccucuaagcucuggcaccugugaagcccuuuaaacacccuuaagcc

SEQ ID NO: 81191 - RNA, 64 nt, Homo Sapiens
ggggcauuguuuuuucacugcuuucucaacaguuccugugaauaaaugaaacauuucggagcuc

SEQ ID NO: 81192 - RNA, 64 nt, Homo Sapiens
agagaugauaccucuuacaaacuuuaccucauagccugugaagcagguuggcauguggauuaca

SEQ ID NO: 81193 - RNA, 64 nt, Homo Sapiens
gggacccuuaggauggggcucccagcuccuuucuccugugaauggaggcagagaccuccaauaa

SEQ ID NO: 81194 - RNA, 64 nt, Homo Sapiens
ggaccaagaagucuggcuccugcuuuucuacaugccugugaaggagacuuuucaugaaacugaa

SEQ ID NO: 81195 - RNA, 64 nt, Homo Sapiens
cuuccuuuguugcacaaauagaguuuggaaaaagccugugaaaggugucuucuuugacuuaaug

SEQ ID NO: 81196 - RNA, 64 nt, Homo Sapiens
ucaguggaaaguaucugccagccacagcaugaggccugugaaggcugacugagaaauccucugc

SEQ ID NO: 81197 - RNA, 64 nt, Homo Sapiens
uuuugaauguacugguaaugccuaauguggucugccugugaaucuccccauguagaauuugccc

SEQ ID NO: 81198 - RNA, 64 nt, Homo Sapiens
uugccaguacuucaucuucaagauuuacccuuuuccugugaaguucagaguuacugaagaugcu

SEQ ID NO: 81199 - RNA, 64 nt, Homo Sapiens
ccuuggcagcgacguggcuccauuuuuagaaaugccugugaagagucugcagucaaggauucuu

SEQ ID NO: 81200 - RNA, 64 nt, Homo Sapiens
gcgugagcccauaauggauagugcucaauucaugccugugaaugccuguuuucccacauacuag

SEQ ID NO: 81201 - RNA, 64 nt, Homo Sapiens
aacugugucucuuuuuugacguucaaaccuccagccugugaaucuuuauaaaugucuuacucaa

SEQ ID NO: 81202 - RNA, 64 nt, Homo Sapiens
aggugggacaaguauaaggguuaucuucauuaucccugugaaguuuucuagccuugaauucauu

SEQ ID NO: 81203 - RNA, 64 nt, Homo Sapiens
cugucccgugggaauccugaugccugaacuggacccugugaaaugcccuguugguggagaccag

SEQ ID NO: 81204 - RNA, 64 nt, Homo Sapiens
aaccacgucuuggucacuguccaauuaugugcauccugugaauauucaugccauaugcagauau

SEQ ID NO: 81205 - RNA, 64 nt, Homo Sapiens
ucccugguccagggauccucaaucauguuugguuccugugaaaguuuuuuuuuuuuuuuucaug

SEQ ID NO: 81206 - RNA, 64 nt, Homo Sapiens
agcaaagaugguugaagauuuaaagcaucaaaugccugugaaacucagcauuccacaucagauu

SEQ ID NO: 81207 - RNA, 64 nt, Homo Sapiens
ggugccuuccaccgugauugcucacucuugccgcccugugaagauuccccuacuggcucucauu

SEQ ID NO: 81208 - RNA, 64 nt, Homo Sapiens
cugugacuccuaauaggccauucagaaauuguuuccugugaauuguggcagcaggcaccugguc

SEQ ID NO: 81209 - RNA, 64 nt, Homo Sapiens
cugggugaggauaacacaagaugggacuggagucccugugaagaggagagagcagguguguuaa

SEQ ID NO: 81210 - RNA, 64 nt, Homo Sapiens
ucugugcauaugucccagccuagacuaacagauuccugugaagugcuaagcauuucuaaagcau

SEQ ID NO: 81211 - RNA, 64 nt, Homo Sapiens
uaaaauuuucaauguuuuuuuuuuaugcaaauccccugugaaaacagaacaaaaauaauguucu

SEQ ID NO: 81212 - RNA, 64 nt, Homo Sapiens
uccaaauuuuguaccuuguuacuucugugcuguuccugugaaucauuauuauuaauauuguuaa

SEQ ID NO: 81213 - RNA, 64 nt, Homo Sapiens
auuggcagugcuugugccugcccuuaccccuguaccugugaagguguccaggaugucacauguu

SEQ ID NO: 81214 - RNA, 64 nt, Homo Sapiens
ugugaaauaguguaaauauguggcucucuauauaccugugaauacagaguucacuccuuccucc

SEQ ID NO: 81215 - RNA, 64 nt, Homo Sapiens
uacagauacugauucagugggaucaccugaggauccugugaaaacacacuuucaugugcuugug

SEQ ID NO: 81216 - RNA, 64 nt, Homo Sapiens
gaaggacccaagccaauaugcuguuucccuguguccugugaaugccaggcagcccagagaagau

SEQ ID NO: 81217 - RNA, 64 nt, Homo Sapiens
cguaacuacuguugggaguguggcguuuuccuccccugugaaaaaugcaagaacccuguuguac

SEQ ID NO: 81218 - RNA, 64 nt, Homo Sapiens
aaccccuccuggcugugacagcugaccucacuguccugugaaguggggucccugugcugauccu

SEQ ID NO: 81219 - RNA, 64 nt, Homo Sapiens
agggcuaaugaugaggguuggcccacuuccaggaccugugaauaacucaugcuggagaggagcc

SEQ ID NO: 81220 - RNA, 64 nt, Homo Sapiens
agagaccaaaguucugacuuucacuagaguggcuccugugaagcccucucuucccccaacauac

SEQ ID NO: 81221 - RNA, 64 nt, Homo Sapiens
gacacagagaacaggugggugcacggggugucauccugugaaggcccagaaaaggcggugcuca

SEQ ID NO: 81222 - RNA, 64 nt, Homo Sapiens
ccuaggggcugggggccacuaauuuccaaagcagccugugaagucuuuggugcuaggagcugac

SEQ ID NO: 81223 - RNA, 64 nt, Homo Sapiens
cuggggaguucugcguugaguggacggacuuauuccugugaagcggcauaauuugucuccauug

SEQ ID NO: 81224 - RNA, 64 nt, Homo Sapiens
acccccaucacucaccuuugucugcaucccugggccugugaaugaugacagcaccugacauucu

SEQ ID NO: 81225 - RNA, 64 nt, Homo Sapiens
uugcgcaguaguuugguuugacuuguuugugcauccugugaaaaauaacggugcuugugucacu

SEQ ID NO: 81226 - RNA, 64 nt, Homo Sapiens
agcccuccugucccuuccccccagucaguauuacccugugaagccccuucccuccuuuauuauu

SEQ ID NO: 81227 - RNA, 64 nt, Homo Sapiens
auucaagauacugaaaaauagagcugggacugagccugugaaugacaggaaugaucuauuacca

SEQ ID NO: 81228 - RNA, 64 nt, Homo Sapiens
ggauuuuuuugugaguuaacaauuuccuugaaauccugugaaauagauuugcacagacaccuug

SEQ ID NO: 81229 - RNA, 64 nt, Homo Sapiens
agcucucuuuaaaccagcuaagccauuccagucuccugugaagccaaaagggaccaggaaccgu

SEQ ID NO: 81230 - RNA, 64 nt, Homo Sapiens
guacugcugcagcuuuaaguaccuuaaagcuucuccugugaacuucuuagggaaauguuagguu

SEQ ID NO: 81231 - RNA, 64 nt, Homo Sapiens
ucuucaaauguaccagaaccugagccaacgccucccugugaaacuguugcugaucuguaguaca

SEQ ID NO: 81232 - RNA, 64 nt, Homo Sapiens
gcucuaggcuucuccugcugaguccuggucuuggccugugaaugugccucguucaucccuggug

SEQ ID NO: 81233 - RNA, 64 nt, Homo Sapiens
uugaaguuuucugcucuacuuuccuuggcagcagccugugaacuacucaaaagaguccccuugg

SEQ ID NO: 81234 - RNA, 64 nt, Homo Sapiens
aucuuuccagagguccaugguggaagacgauaacccugugaaauacuuuauaaaaugucuuaau

SEQ ID NO: 81235 - RNA, 64 nt, Homo Sapiens
ccuugcugcucccuacugacucuagcuuacuuccccugugaagaaacagguguucucggcugag

SEQ ID NO: 81236 - RNA, 64 nt, Homo Sapiens
agaaauuuucucagagcaaacuuucuauuuuuuaccugugaaauaacagugacuuuuuaaaaug

SEQ ID NO: 81237 - RNA, 64 nt, Homo Sapiens
agaauguuuuaaagugaauuguuguaaugaaguuccugugaacaucauuaugguuuuguacaaa

SEQ ID NO: 81238 - RNA, 64 nt, Homo Sapiens
ugguagggauguuaauaauuuuaguggaacaaagccugugaaaugauuguacauaguguuaauu

SEQ ID NO: 81239 - RNA, 64 nt, Homo Sapiens
uccaucaugcaaaaaaaaagcuccugcugaaacuccugugaaagaaagacuuuuuauuguguuu

SEQ ID NO: 81240 - RNA, 64 nt, Homo Sapiens
aaguguggaaucaaaugagcacauaagcugugucccugugaaaagagguuuguagccuuucagg

SEQ ID NO: 81241 - RNA, 64 nt, Homo Sapiens
gugcaaaaccgagggcuccaguaacaccuucuaaccugugaauuggcagaaaaggguagcggua

SEQ ID NO: 81242 - RNA, 64 nt, Homo Sapiens
uucuguuaauuuguaaaagcacauuagugcuuuaccugugaaauuccccgccccccugcacaca

SEQ ID NO: 81243 - RNA, 64 nt, Homo Sapiens
ccacugccuucgcuucuugcuaauauaaaguaguccugugaauguuuccaaauguaauaaacuu

SEQ ID NO: 81244 - RNA, 64 nt, Homo Sapiens
uuaaaaagcuaucccauaucuaaaaucuuccuguccugugaauuaauuggggcuugaaaguaua

SEQ ID NO: 81245 - RNA, 64 nt, Homo Sapiens
guuacuacagccuuaauauugaacuuagccuuuaccugugaagucuaaaagcuuucauguccca

SEQ ID NO: 81246 - RNA, 64 nt, Homo Sapiens
uggguaaugugggagagccuauaccugagaaaaaccugugaauguauuaagcaucagaaaauuc

SEQ ID NO: 81247 - RNA, 64 nt, Homo Sapiens
ggccaguucuucuauauucauccaaagcaaguuuccugugaaucucacccauugacucaccuua

SEQ ID NO: 81248 - RNA, 64 nt, Homo Sapiens
uguuaauuaaagauaguuaaccaacacauuuuuuccugugaauuccaacugaucaucugagaaa

SEQ ID NO: 81249 - RNA, 64 nt, Homo Sapiens
auugagaacuuuuuggagucuuuucuagauuaucccugugaauagaaagcaaaacuaauauuua

SEQ ID NO: 81250 - RNA, 64 nt, Homo Sapiens
ugauuuauuuguguuaauaauauauuguuuacagccugugaaagaaauagagcuucauuuuuga

SEQ ID NO: 81251 - RNA, 64 nt, Homo Sapiens
uuuuuaucuuuggacuacuaacuuuggcaagaauccugugaagaauauauauuauuauauuugu

SEQ ID NO: 81252 - RNA, 64 nt, Homo Sapiens
gauaacuuucaucaauuaggaccaucacugcaggccugugaacacaaaucucagaacauuccuc

SEQ ID NO: 81253 - RNA, 64 nt, Homo Sapiens
aguucaaagccaaguuuauauuuccauugguuuaccugugaaaucuuuaaguguaacuggcagu

SEQ ID NO: 81254 - RNA, 64 nt, Homo Sapiens
gcagccugaggaaguuuugcgcuguauuccaaggccugugaaugucauuuguccaugugcaaac

SEQ ID NO: 81255 - RNA, 64 nt, Homo Sapiens
cauggggacgugcugaacccugucacuuucgguaccugugaaugauguuuacaauguaugugua

SEQ ID NO: 81256 - RNA, 64 nt, Homo Sapiens
uucuuuuucaauucagcaaacgggggaaauaauuccugugaauauauuugauauaagacaccuu

SEQ ID NO: 81257 - RNA, 64 nt, Homo Sapiens
accugagguaugcauuucccacugggggaucgcaccugugaauuguucaggcugccccgccucc

SEQ ID NO: 81258 - RNA, 64 nt, Homo Sapiens
gaaagucacccccacauaccaacucaacuuuuuuccugugaacacauaaauauauuuuuauaga

SEQ ID NO: 81259 - RNA, 64 nt, Homo Sapiens
accagcccauuucuccacacugguacaguagucaccugugaaaaaaaaauuggaacuuacuaau

SEQ ID NO: 81260 - RNA, 64 nt, Homo Sapiens
accggaucugcugaagcaucuguccagcugguauccugugaaaguuuguuauuuucugaguaga

SEQ ID NO: 81261 - RNA, 64 nt, Homo Sapiens
cuugguuuauuguugggggugcucucagaaggaaccugugaaagccuuuaucagucauuuauug

SEQ ID NO: 81262 - RNA, 64 nt, Homo Sapiens
ccauccccuguucacuuucucuagcccaucauuaccugugaacugcaguggggcagucauggca

SEQ ID NO: 81263 - RNA, 64 nt, Homo Sapiens
accaugggggaggcucccaaccuguggaagugguccugugaaaaggagacagaaacaaguaaga

SEQ ID NO: 81264 - RNA, 64 nt, Homo Sapiens
uugguugccauggugaccagggaccacguugcugccugugaaugcugagugagcgaguaaggga

SEQ ID NO: 81265 - RNA, 64 nt, Homo Sapiens
uuugguuuuuuguguguuuuccccuucaucucuaccugugaaagugaaauucuauuguaaaugg

SEQ ID NO: 81266 - RNA, 64 nt, Homo Sapiens
ggaaugaaaaagcgagcagauacuguuggucuagccugugaagcaauuaaucgaauguuucaga

SEQ ID NO: 81267 - RNA, 64 nt, Homo Sapiens
uacccaggaccacucuguaccaucuuuguaacuuccugugaauuuauaauaauuucaaaauaaa

SEQ ID NO: 81268 - RNA, 64 nt, Homo Sapiens
gaaaucuuuuccaucuccauccuaacaugcacaaccugugaagagaauuguuucuauaguaacu

SEQ ID NO: 81269 - RNA, 64 nt, Homo Sapiens
gccuucaaaacucagcuguuccagccggugccaaccugugaacuucccaccauaucccagaauc

SEQ ID NO: 81270 - RNA, 64 nt, Homo Sapiens
uuaacuggccuccacucaaugggaaacugacucgccugugaaagacacagugggagagcugaaa

SEQ ID NO: 81271 - RNA, 64 nt, Homo Sapiens
gcccgugccccuagcaggagcccuggugcuacccccugugaagagccaagcagcagggcacgcc

SEQ ID NO: 81272 - RNA, 64 nt, Homo Sapiens
ggaaacaaauauaacuguaaaugaaucuugguauccugugaaacagaauaauucguaauuuaag

SEQ ID NO: 81273 - RNA, 64 nt, Homo Sapiens
cuuacuuugccccuagucuggugggguuuuucccccugugaaaaguuacuuuaggggguuuuug

SEQ ID NO: 81274 - RNA, 64 nt, Homo Sapiens
guacaguauuuacaguauuguucuccaacaaguaccugugaacaucugaauacaaacauuucac

SEQ ID NO: 81275 - RNA, 64 nt, Homo Sapiens
aacuauuuugacugaaauguacuuagugguuucaccugugaaauuaaaagguaggaaguaagcu

SEQ ID NO: 81276 - RNA, 64 nt, Homo Sapiens
cucaggcugugacgcccucaugcacuggccaugcccugugaaucauguuggagacugagcuggg

SEQ ID NO: 81277 - RNA, 64 nt, Homo Sapiens
ugaaaagggggugggaugggaaauuucugugaaaccugugaagcauuuuuaaacagguggugag

SEQ ID NO: 81278 - RNA, 64 nt, Homo Sapiens
gucuuccuuguucuagccaggaacuguucaguggccugugaacuggccugagcagagcaugugg

SEQ ID NO: 81279 - RNA, 64 nt, Homo Sapiens
guaagaccaagaaaaaacaagaagagaauuuuucccugugaaaaaaacuucaaauuagccucau

SEQ ID NO: 81280 - RNA, 64 nt, Homo Sapiens
gcuuuaccuuguuuacaguuccuugaacuuugaaccugugaaauaauuuaaagacguuuacuuc

SEQ ID NO: 81281 - RNA, 64 nt, Homo Sapiens
cauuaucugucccaaacaguuguuugaaccuuauccugugaaagaugacauaguaaguuauauu

SEQ ID NO: 81282 - RNA, 51 nt, Homo Sapiens
gaauuucucuucaaucaaaguccugugaauuaaugcuuuagcaagauguaa

SEQ ID NO: 81283 - RNA, 64 nt, Homo Sapiens
uuaacuugaacucauuccuggauguuuccauucuccugugaauuugugaagugacugaccuuaa

SEQ ID NO: 81284 - RNA, 64 nt, Homo Sapiens
caaauaaaaugauuaaaguuucacaauauuuucaccugugaaccauugugguguaaaugaacuu

SEQ ID NO: 81285 - RNA, 64 nt, Homo Sapiens
acugcuacaaucaaggccacagaaccaguccugcccugugaauuggggagcucuuuccuguguc

SEQ ID NO: 81286 - RNA, 64 nt, Homo Sapiens
uucauucuucuugcucuuucaaguuucuaguaguccugugaagaccucauaccuugcugggaag

SEQ ID NO: 81287 - RNA, 64 nt, Homo Sapiens
gagaaacuguacaaaugugaagaauauggcaaagccugugaaugguccacaaaccugaaugagc

SEQ ID NO: 81288 - RNA, 64 nt, Homo Sapiens
agguccccuccucuccuagcuucccgccucugccccugugaacacccaucugcaguauccccug

SEQ ID NO: 81289 - RNA, 64 nt, Homo Sapiens
cuaccuuaacuguuuuuaacauggauccucugugccugugaauuuacuugcaugcuuguacuug

SEQ ID NO: 81290 - RNA, 64 nt, Homo Sapiens
gcgaagcuuuauaucuguuccuaaaacaguuaauccugugaaauaaauauugaacauaauccag

SEQ ID NO: 81291 - RNA, 64 nt, Homo Sapiens
uaaaaaacuagcauauguaaagguauucguuaauccugugaaugguagcuuuugcacagaacuu

SEQ ID NO: 81292 - RNA, 64 nt, Homo Sapiens
aaaacuugugugcauuauaaccuaagcugugcaaccugugaagccaagagugaacugauguuuc

SEQ ID NO: 81293 - RNA, 64 nt, Homo Sapiens
ugaacagauuuucagugggauuuucuggagagagccugugaaacgcaaauugguacauaugcau

SEQ ID NO: 81294 - RNA, 64 nt, Homo Sapiens
ugacuuaaccagcuuaacauguguucucuaaaauccugugaacaaaggguuaauuuucgugugu

SEQ ID NO: 81295 - RNA, 64 nt, Homo Sapiens
gagugcucugauguaaaacuacuuuuuuuuuuugccugugaauuacgguuucauuuaaaaagua

SEQ ID NO: 81296 - RNA, 64 nt, Homo Sapiens
uuuugcucaucuuuuuuaugacagcaagcagcagccugugaagaaauuaauauaauuaaaagca

SEQ ID NO: 81297 - RNA, 64 nt, Homo Sapiens
gcuguuuuucucacaugugauauauguuucuuuuccugugaaaaaauucuauuuuauauauaua

SEQ ID NO: 81298 - RNA, 64 nt, Homo Sapiens
uaccaugaccccauggauggauaaagaaaucuuuccugugaagauaaaucagcaaaauauugua

SEQ ID NO: 81299 - RNA, 64 nt, Homo Sapiens
gcaaacuugcuuaugauugaguugaauuaaaaugccugugaacuuguuuccuuugugacucaag

SEQ ID NO: 81300 - RNA, 64 nt, Homo Sapiens
cugcacucagagggaggaguuaugcaaggggaaaccugugaaagcuuucaaaagacaccugccu

SEQ ID NO: 81301 - RNA, 64 nt, Homo Sapiens
cugaugcccaugugcccugaacugggaacaggauccugugaaagacaacaaacagugcagccug

SEQ ID NO: 81302 - RNA, 64 nt, Homo Sapiens
uagguguggucccauaggagcagccuuagcauccccugugaacuuaucaaaaaugcaaauucuc

SEQ ID NO: 81303 - RNA, 64 nt, Homo Sapiens
aggagauacaacagaggagauaaucuccaggaugccugugaagaaagaucccuggaucccagga

SEQ ID NO: 81304 - RNA, 64 nt, Homo Sapiens
aaguaaaucuugaacagguucacuaagcacccacccugugaaaaguauuauggaaaucacugcu

SEQ ID NO: 81305 - RNA, 64 nt, Homo Sapiens
aacucucuaaguacauccaccuguguaauaggaaccugugaauuguacuggaugauuaauacaa

SEQ ID NO: 81306 - RNA, 64 nt, Homo Sapiens
ccaggagacggggugaagcuauuccccacacucuccugugaacacuggagucuugcaagaccca

SEQ ID NO: 81307 - RNA, 64 nt, Homo Sapiens
uugaauguaauuccauuauauuuccuuuuguacaccugugaaaaaguggaguaguguuuuuuua

SEQ ID NO: 81308 - RNA, 64 nt, Homo Sapiens
cccggugacagggugcucacuggcaccccaucuuccugugaauaacucaaauaauuagaaaaug

SEQ ID NO: 81309 - RNA, 64 nt, Homo Sapiens
agugggcggcaguguuccuggcaugaccaggauuccugugaaagcaggagcagcagcaagccgu

SEQ ID NO: 81310 - RNA, 64 nt, Homo Sapiens
cucccccagccuugaggugcccugcccggcggggccugugaauaugcaaugggagucccaggcu

SEQ ID NO: 81311 - RNA, 64 nt, Homo Sapiens
ucguggccuccuucccccacucccuaucccuucaccugugaaaugccuuugcuuugcauauugu

SEQ ID NO: 81312 - RNA, 64 nt, Homo Sapiens
uagucacuuuaggaguugggacagagucgagcacccugugaaagucucccuugaguucaggugc

SEQ ID NO: 81313 - RNA, 64 nt, Homo Sapiens
caggaguuccagccugaaguaugcugugaucaugccugugaauaaccacugcacuccagccagg

SEQ ID NO: 81314 - RNA, 64 nt, Homo Sapiens
gccaggcagcugcaguuagcgugggagccgucagccugugaacuggacuggaguguaaugcucg

SEQ ID NO: 81315 - RNA, 64 nt, Homo Sapiens
aaaacaaauucaagaaugcauaaaaucauauuuaccugugaaucuauguuugcgaauggcuuuu

SEQ ID NO: 81316 - RNA, 64 nt, Homo Sapiens
uaggcuuauaguuccuuaacuuugcaacuuucuuccugugaaaaaccaccucuucuuaucaaaa

SEQ ID NO: 81317 - RNA, 64 nt, Homo Sapiens
auuguuaggaggugaacuucauucuuggagggauccugugaaguuugcuacaucagcacugggc

SEQ ID NO: 81318 - RNA, 64 nt, Homo Sapiens
aagaucccuggaucccaggauaaucuccaggaugccugugaagaaggagauacaacagaggaga

SEQ ID NO: 81319 - RNA, 64 nt, Homo Sapiens
gucccacacuuugaagcaaauugaccauucucacccugugaaacuaggcauuuggucucacuac

SEQ ID NO: 81320 - RNA, 64 nt, Homo Sapiens
acuuccaacaaaauuaaugauuaguauuuuaggaccugugaauauagugugacauuccaaucau

SEQ ID NO: 81321 - RNA, 64 nt, Homo Sapiens
acaaaguguacugucucaaacugaugcaaguuauccugugaaucgagcuuucauuaaauugcgu

SEQ ID NO: 81322 - RNA, 64 nt, Homo Sapiens
uaacaucuuauugagauuugucagcuccacauuuccugugaaaccauacucaucauuucuuugu

SEQ ID NO: 81323 - RNA, 64 nt, Homo Sapiens
cugucuccugaaacccugaaauccauguucacauccugugaacuuuuuuggcuuuuguaaugga

SEQ ID NO: 81324 - RNA, 64 nt, Homo Sapiens
ucuucacuguugaaaauuauaguuuaacacaaguccugugaauuaucccuaaugugugccauag

SEQ ID NO: 81325 - RNA, 64 nt, Homo Sapiens
uguuaaggcacucucauuuggaugauuggaaaaaccugugaagucacuuuaucuuuaguaucau

SEQ ID NO: 81326 - RNA, 64 nt, Homo Sapiens
ugccuuguggguggcuuggcgcucgugauugcuuccugugaacgccucccaaggacgagcccag

SEQ ID NO: 81327 - RNA, 64 nt, Homo Sapiens
uaucauaggucuaaaaauauuuguuuacuaaauaccugugaagaaauaccauuaaaaaacuauu

SEQ ID NO: 81328 - RNA, 64 nt, Homo Sapiens
ggagagaagaaugagccuacgcugaagauggcauccugugaaguccuucaccucacugaaaaca

SEQ ID NO: 81329 - RNA, 64 nt, Homo Sapiens
uuacuugcauuuauccggcauuauuucaacaccuccugugaagaaaguacuuuucuggcauagc

SEQ ID NO: 81330 - RNA, 64 nt, Homo Sapiens
ucuguuucuuccuguuggguggcaauuaauuaauccugugaagguuacauugcugcugcuagag

SEQ ID NO: 81331 - RNA, 64 nt, Homo Sapiens
acaggaaaacccaccuauggaauaggugccuaucccugugaagaugaaccucuggcccuuccag

SEQ ID NO: 81332 - RNA, 64 nt, Homo Sapiens
cagggcuggaagaagcggcacccgggggcgcucaccugugaagccaucugcgccaagccuugcc

SEQ ID NO: 81333 - RNA, 64 nt, Homo Sapiens
ucuguuuaguugagaggcugugauuuuacucuugccugugaaccucaugcaugaaagcagcaca

SEQ ID NO: 81334 - RNA, 64 nt, Homo Sapiens
cauauguuuuaucuuuaaaauuauucuuauuuuaccugugaauauauacaacagaacuuuuuaa

SEQ ID NO: 81335 - RNA, 64 nt, Homo Sapiens
aagaacaaaguuuacuucaacuaaaauguuucuuccugugaagacauaugguaucauuuuaauu

SEQ ID NO: 81336 - RNA, 64 nt, Homo Sapiens
aucaaauauauucuauuuaaucuucuaauuucuuccugugaauauccaaagaugugauuacuuu

SEQ ID NO: 81337 - RNA, 64 nt, Homo Sapiens
cccaguccuggcuucuuugugggcuccucucauuccugugaaccucaucccuuuucagaauaua

SEQ ID NO: 81338 - RNA, 64 nt, Homo Sapiens
gggcugaggcaggaaaugggcucagauuuccucaccugugaaauaaugaagucccucacugagc

SEQ ID NO: 81339 - RNA, 64 nt, Homo Sapiens
ucauuucagcacuggagaccagauacagaaccauccugugaaaagggcucccuggcuacuggga

SEQ ID NO: 81340 - RNA, 64 nt, Homo Sapiens
guggugaugcaucuaacaccgucauucaggagguccugugaaguagguacacagcacaucugca

SEQ ID NO: 81341 - RNA, 64 nt, Homo Sapiens
uaauuuaauuugaaacugcuaaacaaaaagcaagccugugaauaugacaggacaaagcaaaaac

SEQ ID NO: 81342 - RNA, 64 nt, Homo Sapiens
ggggaccacccuccuaaucugccucucaucaccgccugugaaaugaugcuggcucaggcucaga

SEQ ID NO: 81343 - RNA, 64 nt, Homo Sapiens
uaugaggcuugauaauauuaaauaaguauauaauccugugaaaaauuucuagaaacaaacaucu

SEQ ID NO: 81344 - RNA, 64 nt, Homo Sapiens
uauuuuagguaagcuucuguguaaagcuaaaaauccugugaauacaauacuauccuuuacaggc

SEQ ID NO: 81345 - RNA, 64 nt, Homo Sapiens
gcucacugcuugggcccccuugauuucuaagacaccugugaagggucccacaaggccaggcaca

SEQ ID NO: 81346 - RNA, 64 nt, Homo Sapiens
gaaaaaccuuacaaaugugaagcaucugauaaauccugugaagcgucugauaaauccuguaguc

SEQ ID NO: 81347 - RNA, 64 nt, Homo Sapiens
gacuucuacaggacuucuacgugugugauaaaagccugugaaucgugagucccugaaauauggu

SEQ ID NO: 81348 - RNA, 64 nt, Homo Sapiens
uauucuuucuguaaagucaaacaggauuccauccccugugaaauaacacaaaauuucacucucu

SEQ ID NO: 81349 - RNA, 64 nt, Homo Sapiens
ccccaaccucacggaccaagaggaucccuggcugccugugaauggcccacauuugaguggugcu

SEQ ID NO: 81350 - RNA, 64 nt, Homo Sapiens
uugauacgagcuggccagucggagcccgcgggagccugugaaugucggaugccgcuguccuggg

SEQ ID NO: 81351 - RNA, 64 nt, Homo Sapiens
cagcacaucaucuaaaucccgcuguaauccauaaccugugaagaugcaguaauugcuuuaugcg

SEQ ID NO: 81352 - RNA, 64 nt, Homo Sapiens
uaucuucucucaauuggaauucuuguccaaacugccugugaauacuuucaugugacuggaguca

SEQ ID NO: 81353 - RNA, 64 nt, Homo Sapiens
cagccuuaucuccaccuguuagccauuuuugucuccugugaauacaggugaaucucuuccuuua

SEQ ID NO: 81354 - RNA, 64 nt, Homo Sapiens
acugacaaugucuucuaccuggggcucuguugaaccugugaaauuuucugauguacaagccccu

SEQ ID NO: 81355 - RNA, 64 nt, Homo Sapiens
cccgaaaccugcuguuauaauagcugcugcaauuccugugaauacauuuaaaucaguuauggug

SEQ ID NO: 81356 - RNA, 64 nt, Homo Sapiens
cuagguggcccuaugucuuccagagcugcuccuuccugugaaucggagccagccauguaagaau

SEQ ID NO: 81357 - RNA, 64 nt, Homo Sapiens
ucugaccaccguuucgcuuucgugagggugggacccugugaaggaguacguagaccagugucgu

SEQ ID NO: 81358 - RNA, 64 nt, Homo Sapiens
caugggcagguagugcccuccugggcuggcuggaccugugaagcgacaccagcacuucugcuug

SEQ ID NO: 81359 - RNA, 64 nt, Homo Sapiens
gagggaaaggaaaagccccuggaaaugcgugugaccugugaagugguguauugucacaguagcu

SEQ ID NO: 81360 - RNA, 64 nt, Homo Sapiens
aauaucuucuacugccaaacuucuggcaaauuuaccugugaauuucaaaauguuauaaaaucuc

SEQ ID NO: 81361 - RNA, 64 nt, Homo Sapiens
ccaacaaccgcugacuccaggauugcauaagcccccugugaaaucggugcuguacugcauaccc

SEQ ID NO: 81362 - RNA, 64 nt, Homo Sapiens
uguaguuccucauugaacaugugauaaucuaauaccugugaaaacugacuaaucagcugccaau

SEQ ID NO: 81363 - RNA, 64 nt, Homo Sapiens
aauuugaauuuugucguguuuggguuuguucauuccugugaaugaugguacaguuaggugagau

SEQ ID NO: 81364 - RNA, 64 nt, Homo Sapiens
agacuuguauuuuuuauugucucugaacuuuaauccugugaaaaugcucaaaguuuuggcgaga

SEQ ID NO: 81365 - RNA, 64 nt, Homo Sapiens
caaaacuuguuucuuaaaaaugcgguuaauaaugccugugaacuaaaaaaaugggaagcccucc

SEQ ID NO: 81366 - RNA, 64 nt, Homo Sapiens
uugaguggaaaaguguuucuuuaguuuggaaagaccugugaaguauccuagucagggaaagaac

SEQ ID NO: 81367 - RNA, 64 nt, Homo Sapiens
uuauaccauuguuuuuucccucaaguauuuuuucccugugaagaagauuauuuaucugcuuuua

SEQ ID NO: 81368 - RNA, 64 nt, Homo Sapiens
gcacaaaucuugggucuuggggacuaacccaaugccugugaagcagucagcccuuauggccaau

SEQ ID NO: 81369 - RNA, 64 nt, Homo Sapiens
gucugacaaaggcagaaugcuaacccaguugcacccugugaagucuccgcuuugccugcaaaag

SEQ ID NO: 81370 - RNA, 64 nt, Homo Sapiens
ggauggcacccgaggcauuaccaacggccgacugccugugaagucgacuacuauaaaaagacaa

SEQ ID NO: 81371 - RNA, 64 nt, Homo Sapiens
agagugcacaagcaccucucuccugaguucauccccugugaaucuuuuuguaugucuuuugaga

SEQ ID NO: 81372 - RNA, 64 nt, Homo Sapiens
auguacagagaugcaggucuauacugguaaucauccugugaaaagcacacucaggcuaucugag

SEQ ID NO: 81373 - RNA, 64 nt, Homo Sapiens
aaggaccugcaaacgcuucacuacacgguucaaaccugugaagauuaugugucugccacauuaa

SEQ ID NO: 81374 - RNA, 64 nt, Homo Sapiens
gcugcccuguuuaguaaauagaccggucuugagaccugugaacugcugcaaaacaucacaaagu

SEQ ID NO: 81375 - RNA, 64 nt, Homo Sapiens
ugugcaaaacauugaagguauuuuuuuucccucuccugugaaucgguuauucuuggaaguagca

SEQ ID NO: 81376 - RNA, 64 nt, Homo Sapiens
cccuggaaaccucaugaggcgggaagcccuggagccugugaagacaaggcuggcacaggcuuug

SEQ ID NO: 81377 - RNA, 64 nt, Homo Sapiens
gaaaggagagaggauaagaagggaaaguucacaaccugugaacagggacuugagcacgagacac

SEQ ID NO: 81378 - RNA, 64 nt, Homo Sapiens
aaggauucuuaucacauaaugugcaggccaugugccugugaacuugaaguuugcgcaaaaugug

SEQ ID NO: 81379 - RNA, 64 nt, Homo Sapiens
uucuaucaggggugcauucuggccaaggggugggccugugaaucaauccugggcaaucagacac

SEQ ID NO: 81380 - RNA, 64 nt, Homo Sapiens
uggaggcugcccuaccugggaaggcaccccagcaccugugaaggacauuuacugcucauccuca

SEQ ID NO: 81381 - RNA, 64 nt, Homo Sapiens
gugagaaggagccacaaguuguggcugagaguucccugugaacuugaguaguucauagagugcu

SEQ ID NO: 81382 - RNA, 64 nt, Homo Sapiens
uuggagcuggaagaaucugcucuccgguggcugcccugugaacagagggcucccggucagcuuc

SEQ ID NO: 81383 - RNA, 64 nt, Homo Sapiens
agccaagggcccacguccucaccacaaagggacuccugugaaacugcugccaaaaagauaccaa

SEQ ID NO: 81384 - RNA, 64 nt, Homo Sapiens
cccccccucuaugggaaggauauaauuaguguucccugugaauuuauccccgugguucaucuga

SEQ ID NO: 81385 - RNA, 64 nt, Homo Sapiens
caguucuuggcacaaagacauaauucugaacuccccugugaaugagaugaugaggucuuugaag

SEQ ID NO: 81386 - RNA, 64 nt, Homo Sapiens
uauauuuuuuaaaaauaucuggaucgcuuguaccccugugaaaaaacauaguggguauaaucau

SEQ ID NO: 81387 - RNA, 64 nt, Homo Sapiens
uugcccuaguuacuaccauuagauuggugguaggccugugaaauauauaauuccuggacuggug

SEQ ID NO: 81388 - RNA, 64 nt, Homo Sapiens
ucaguuguguguguggcuccggaggauaugagguccugugaaaugaugugggaaagagcccauu

SEQ ID NO: 81389 - RNA, 64 nt, Homo Sapiens
cuucauuuccagaauacugaccaaacauccuuggccugugaaguauuguugcaauggcuaaauc

SEQ ID NO: 81390 - RNA, 64 nt, Homo Sapiens
ccugugaggaucugaagagugaugggagagagccccugugaaagcccucggagagagguggugg

SEQ ID NO: 81391 - RNA, 64 nt, Homo Sapiens
gccacugcacucuagucuggugcgcuagacggcgccugugaauaccaggaguuuaagguuguag

SEQ ID NO: 81392 - RNA, 64 nt, Homo Sapiens
auaggaugugaggugagcauacugaugaaaaagcccugugaaagacuguuaccagacagaggca

SEQ ID NO: 81393 - RNA, 64 nt, Homo Sapiens
ugguaauagagcaaccauagccuuaacuuacagaccugugaaauaaagggcauuuugaccuaau

SEQ ID NO: 81394 - RNA, 64 nt, Homo Sapiens
gagguagacaguuucaaacaucacaguuugaaugccugugaaugacaagucagugggaaagagc

SEQ ID NO: 81395 - RNA, 64 nt, Homo Sapiens
ucuauuuacauguaugucaacucauuacuuuuuuccugugaacaguauugaaaaaccccaacgg

SEQ ID NO: 81396 - RNA, 64 nt, Homo Sapiens
aggggaaaauuuugggaugggggacucaggaggaccugugaagcauguaguuaucuagaucugg

SEQ ID NO: 81397 - RNA, 64 nt, Homo Sapiens
uggugaccucauucagucgguuaagagccugagcccugugaaguuaaacaccugcucaugguca

SEQ ID NO: 81398 - RNA, 64 nt, Homo Sapiens
agcugcagugaaggcugugggaagggugucagauccugugaagaauggcaaaacagccugaccu

SEQ ID NO: 81399 - RNA, 64 nt, Homo Sapiens
guaaugguuuccaucuccgauuuccucaucagggccugugaauacccaggugccuguaucuuug

SEQ ID NO: 81400 - RNA, 64 nt, Homo Sapiens
gcccuacuggccuucccccaccacagcagcccugccugugaagcucuuguuucugacauuucac

SEQ ID NO: 81401 - RNA, 64 nt, Homo Sapiens
cugucuguugugugugugccucaagcccuguuuuccugugaagauacuuugaguggcagccauu

SEQ ID NO: 81402 - RNA, 64 nt, Homo Sapiens
uuauguuguauuacaauguauguagaaauaguaaccugugaacuaugcuuuuccauaacuuuuu

SEQ ID NO: 81403 - RNA, 64 nt, Homo Sapiens
auguauuuucuucauugcagguccaccuaaucauccugugaaagugguuucucuauggaaagcu

SEQ ID NO: 81404 - RNA, 64 nt, Homo Sapiens
gacuuaagccugguuucucaguuacugagagaggccugugaacaguucuagcuaugaucaugaa

SEQ ID NO: 81405 - RNA, 64 nt, Homo Sapiens
ggcagacggguucagccugcagaacuggaggcgaccugugaaacccacccgggcaccccaacag

SEQ ID NO: 81406 - RNA, 64 nt, Homo Sapiens
cgcccugccggaggacacuguaguuuuugagaagccugugaagaccauccacuggaacgggucc

SEQ ID NO: 81407 - RNA, 64 nt, Homo Sapiens
cacaaagcuggaggcugggcaaaugcauugggagccugugaaagcagaccacccacuucugcug

SEQ ID NO: 81408 - RNA, 64 nt, Homo Sapiens
ccccgaaacuguaugugaaaggauuuuuuaaaaaccugugaaccaagugcaugaguucuuuacu

SEQ ID NO: 81409 - RNA, 64 nt, Homo Sapiens
cacgggcugggucauaaggacaccaaugaugaggccugugaagcgauagggaagaaggccugcu

SEQ ID NO: 81410 - RNA, 64 nt, Homo Sapiens
aaaguucucaggccaaggucgucaagggaagcuuccugugaaccaagcuuugcacucaaguauu

SEQ ID NO: 81411 - RNA, 64 nt, Homo Sapiens
ggccucuuaccuuuauguauaaacuuaauuaauaccugugaaaaguuggauggcgguuauuuuu

SEQ ID NO: 81412 - RNA, 64 nt, Homo Sapiens
gcgucuguguccuugcugccuucauccccuggggccugugaauaaagcugcagaacccccuuca

SEQ ID NO: 81413 - RNA, 64 nt, Homo Sapiens
acagacuacuguugggucccugauuccaggcuggccugugaaggauugccccagguguccccuu

SEQ ID NO: 81414 - RNA, 64 nt, Homo Sapiens
accacauuugaaauuguuuucccuuucauuuuacccugugaaagcaucucuccuagagccuugc

SEQ ID NO: 81415 - RNA, 64 nt, Homo Sapiens
gccucuuuuaugguuuaauggccaccuguucucuccugugaaaggcuuugcaaagucacauuaa

SEQ ID NO: 81416 - RNA, 64 nt, Homo Sapiens
uacuguaggaauccuauuuauauuauuuuucaguccugugaaugcugugaaaagauuuauuccu

SEQ ID NO: 81417 - RNA, 64 nt, Homo Sapiens
auacugggacuucagaagugcaauguauuuuucuccugugaaaccugaaucuacaaguuuuccu

SEQ ID NO: 81418 - RNA, 64 nt, Homo Sapiens
aaggugaauggccugcucucccuggcccuaucagccugugaacuucacuuaggccccaagcuga

SEQ ID NO: 81419 - RNA, 64 nt, Homo Sapiens
uggcugccuucuuuccaucaacucccaacuucuuccugugaaguuuaauugucucaacgccucc

SEQ ID NO: 81420 - RNA, 64 nt, Homo Sapiens
auguuuauauuguauuguucuaaauaauggguagccugugaaauaagaucuugccacccaugua

SEQ ID NO: 81421 - RNA, 64 nt, Homo Sapiens
ugaaacaguuuugucuugcaguggaaagagacuuccugugaauguuucucaacugguuucuacu

SEQ ID NO: 81422 - RNA, 64 nt, Homo Sapiens
ugacuucuuucacaaguacuaucuguuccccuguccugugaauggaagcaaagugcuggauugu

SEQ ID NO: 81423 - RNA, 64 nt, Homo Sapiens
aauuuucuuuguguucugaauucucagacuugguccugugaaauacaggcacaaaauguaucug

SEQ ID NO: 81424 - RNA, 64 nt, Homo Sapiens
guguggaugcagagagagugugacagaggaucugccugugaaccaccugggauuagucaagucc

SEQ ID NO: 81425 - RNA, 64 nt, Homo Sapiens
uuauuuuuagaagcuaaagaaaguaauuaugcuuccugugaauugucuuuuacuggcaucuuug

SEQ ID NO: 81426 - RNA, 64 nt, Homo Sapiens
aaagaguuugcucacguaaacgcccgugcugggcccugugaagccagcauguucaccacugguc

SEQ ID NO: 81427 - RNA, 64 nt, Homo Sapiens
aacaucagcuuacagaugauuaacagauaguucaccugugaacgcugacucuuccugguaggug

SEQ ID NO: 81428 - RNA, 64 nt, Homo Sapiens
ugguuuuugcacauuauuuguuuauaaauugccaccugugaaaagacuuuucuaucauuuccau

SEQ ID NO: 81429 - RNA, 64 nt, Homo Sapiens
uucuuuacaguuuuccaagaucuauuuuuuuuaaccugugaaauaauucuuuuuuuuugcuuac

SEQ ID NO: 81430 - RNA, 64 nt, Homo Sapiens
ugggcugugccagggcuucugaagugugauuuggccugugaacugcgugaagcagugugggccu

SEQ ID NO: 81431 - RNA, 64 nt, Homo Sapiens
ggcuaguugaucauuuuucccuuuuguucuauagccugugaaauaggaaagaugcccaauugua

SEQ ID NO: 81432 - RNA, 64 nt, Homo Sapiens
accuaggggucuuguuaagucaaaccuugaugugccugugaaucugaguuaaagcagugcuucu

SEQ ID NO: 81433 - RNA, 64 nt, Homo Sapiens
ugcuggaaauacaaauccuccaucaucagcauuaccugugaacugaguggagguuuucaaagug

SEQ ID NO: 81434 - RNA, 64 nt, Homo Sapiens
ccaaaguaaacuuuauguaccucuccagaucaucccugugaaugaacauguauaacaaaaagcu

SEQ ID NO: 81435 - RNA, 64 nt, Homo Sapiens
auucuuaggcagaucugcccguggaaggcauuguccugugaaaugagcaaguaacauuaacuca

SEQ ID NO: 81436 - RNA, 64 nt, Homo Sapiens
caucaguuuccuguaccaaaugcuuugcaaguuuccugugaaaaacgcucuuccucuucauaac

SEQ ID NO: 81437 - RNA, 64 nt, Homo Sapiens
uacaaccaaaaggcacacaacaggaaccugggggccugugaaacuuuauucaucauggguacca

SEQ ID NO: 81438 - RNA, 64 nt, Homo Sapiens
gugagugcggcaaucccucauccucuuagaagcaccugugaaugggaauugagccaacuguuau

SEQ ID NO: 81439 - RNA, 64 nt, Homo Sapiens
gaaucaaagauucagcccuacaaggauauguuuuccugugaaauuaucuaagagguagguuuag

SEQ ID NO: 81440 - RNA, 64 nt, Homo Sapiens
uuacaugugauuauuuuaaaauuugauuaugaaaccugugaagugugcucuuccaugauguuga

SEQ ID NO: 81441 - RNA, 64 nt, Homo Sapiens
augugaaugcuuuuguaguaaccaucuuguaguaccugugaaaucuauaacucagaaaugguca

SEQ ID NO: 81442 - RNA, 64 nt, Homo Sapiens
gcucuccauuaucaccuuuauacaaaauguacauccugugaauucuguuccagauuucacaccu

SEQ ID NO: 81443 - RNA, 64 nt, Homo Sapiens
cggaaagcagaagggauuuaggacuacgucuccuccugugaagaauucccuugcguauucucuc

SEQ ID NO: 81444 - RNA, 64 nt, Homo Sapiens
acccccacauaacaugcauuugcaugggcccgaaccugugaaauguuacguuugugcuucauuu

SEQ ID NO: 81445 - RNA, 64 nt, Homo Sapiens
cugcguggauguuuccuuaaccucagcugacuucccugugaaugucuaaugcuaguucagggcc

SEQ ID NO: 81446 - RNA, 64 nt, Homo Sapiens
gagguccugagcacugccaggagggacaaaggagccugugaacccaggacaagcauggucccac

SEQ ID NO: 81447 - RNA, 64 nt, Homo Sapiens
cuuauagaguagaacauucacagcaaagaagaauccugugaauguccaaaagccuuccagaagu

SEQ ID NO: 81448 - RNA, 64 nt, Homo Sapiens
cagaggcuuuugcauugucuuuaauauaauagggccugugaaaagguacaguuguaagucagag

SEQ ID NO: 81449 - RNA, 64 nt, Homo Sapiens
auuccacauagagaaaagaaacacauauuuuaauccugugaaaguaauaagaagcacuuaauuu

SEQ ID NO: 81450 - RNA, 64 nt, Homo Sapiens
uggugucugucauucagggccaguuucgauuuugccugugaauauccaugauucaaaaucuaag

SEQ ID NO: 81451 - RNA, 64 nt, Homo Sapiens
agaaacugaauaccuaagauuugaacuagcaaugccugugaaaauauucccagaguuuugguuu

SEQ ID NO: 81452 - RNA, 64 nt, Homo Sapiens
accuugaaauauaacacuccguccuacuguaaccccugugaaaagccugauugggguggggacu

SEQ ID NO: 81453 - RNA, 64 nt, Homo Sapiens
auaugacaguccagcaucgagagcuuccucucuuccugugaaggguaaccccaacugaaaugag

SEQ ID NO: 81454 - RNA, 64 nt, Homo Sapiens
cuguuaacagcuuacauaggggguuaucccuaccccugugaacuauuugggagcuggagaacag

SEQ ID NO: 81455 - RNA, 64 nt, Homo Sapiens
cagaggagauggacuggucuuggaguugggcagcccugugaagcgucacaucaaccgccagaag

SEQ ID NO: 81456 - RNA, 64 nt, Homo Sapiens
aaacauagaauauccucuuacaacagaguaguaaccugugaaacuaugggccagccuggauaua

SEQ ID NO: 81457 - RNA, 64 nt, Homo Sapiens
acagguggcuuuucauggauccugaagcgcagccccugugaauacuucugcauuugguugguuu

SEQ ID NO: 81458 - RNA, 64 nt, Homo Sapiens
gcaucaagguccucuccgcucacgggcccagagcccugugaaaucaugguggacgcguucugcu

SEQ ID NO: 81459 - RNA, 64 nt, Homo Sapiens
cacugaaccuucugagccccggagccucugcuccccugugaaccccugucugaguaagcccuca

SEQ ID NO: 81460 - RNA, 64 nt, Homo Sapiens
gggcugggagaguggaguucccguagggcauaggccugugaaguaacacuggggcagauaugua

SEQ ID NO: 81461 - RNA, 64 nt, Homo Sapiens
gggcuuuaaggaggccaauuugcugcgcgggugaccugugaaaggucacagucauuuuuguagu

SEQ ID NO: 81462 - RNA, 64 nt, Homo Sapiens
caacuggaaucuuaaaaaagaucuuguuugucucccugugaaaauuccaagaauuuuauaguac

SEQ ID NO: 81463 - RNA, 64 nt, Homo Sapiens
cauaagaaaaucuuaguaacauuccgccugcuuaccugugaagacaguuuugagaauaggaaag

SEQ ID NO: 81464 - RNA, 64 nt, Homo Sapiens
auuggacauuuauagauaauauuaccgucauuggccugugaagcugagguguuugcauguggcc

SEQ ID NO: 81465 - RNA, 64 nt, Homo Sapiens
caauacuaucuacaauuuuuugucauucacauacccugugaagaccaaaagacuuuuuugaauc

SEQ ID NO: 81466 - RNA, 64 nt, Homo Sapiens
cgcaggaucauuucagaccccgcgggcgagcaggccugugaauuaguggccaagcgcgcaaggg

SEQ ID NO: 81467 - RNA, 64 nt, Homo Sapiens
gccaugaagggccaggaugcccagaugcuuggccccugugaagugcugucuggagcagcaggau

SEQ ID NO: 81468 - RNA, 64 nt, Homo Sapiens
caccuuacuguucaccucaucaaaucaguucugcccugugaaaagauccagccuucccugccgu

SEQ ID NO: 81469 - RNA, 64 nt, Homo Sapiens; identical to SEQ ID NO: 81468

SEQ ID NO: 81470 - RNA, 64 nt, Homo Sapiens
cacuggcaacauauuugaaauaagugaauauuguccugugaaaagaauagcaggacuuuuagau

SEQ ID NO: 81471 - RNA, 64 nt, Homo Sapiens
gcaugguguagaugcccugauaaagaacaucuguccugugaaagacucaaugagcuguuauguu

SEQ ID NO: 81472 - RNA, 64 nt, Homo Sapiens
cauggcugaaacuugagggugacuaaaaguaaugccugugaaacaugauaucuaucugggaugg

SEQ ID NO: 81473 - RNA, 64 nt, Homo Sapiens
guuuuucacuuuugaugaaagggacaugggcacuccugugaacaagugaugcauagggaaacag

SEQ ID NO: 81474 - RNA, 64 nt, Homo Sapiens
cuaauuauuuuaaauguguuaagcaccucaauguccugugaacauuaauaacacuuuauuuaua

SEQ ID NO: 81475 - RNA, 64 nt, Homo Sapiens
uagugagugccccaucacuguguuugaauggcugccugugaaggcagcagcugaaacucuucaa

SEQ ID NO: 81476 - RNA, 64 nt, Homo Sapiens
ucuuauuguacacaaguucucgcccagccucaucccugugaauuauuacaggcgugagacacug

SEQ ID NO: 81477 - RNA, 64 nt, Homo Sapiens
cacagggccugcuagugggcgccagggcuucaucccugugaagggccucccaggcauucucagu

SEQ ID NO: 81478 - RNA, 64 nt, Homo Sapiens
ucagcauggcuuaugugcacguguaaauggagucccugugaaugacagcauguuucuuacauag

SEQ ID NO: 81479 - RNA, 64 nt, Homo Sapiens
ucuccaaucuccauuacauagggacuguacagagccugugaagauguaugaaugguaucuuuua

SEQ ID NO: 81480 - RNA, 64 nt, Homo Sapiens
auuuauccagaugcaugucaucucaaggacaaagccugugaaaguacaagugagaugguugcau

SEQ ID NO: 81481 - RNA, 64 nt, Homo Sapiens
ggaucccagcuagacuuagaacuuggacuuuuccccugugaagggggcugccaggacaucucag

SEQ ID NO: 81482 - RNA, 64 nt, Homo Sapiens
uauugaaaugcagaucccagagucaguaaaucugccugugaaguaugauagucugcauuuguaa

SEQ ID NO: 81483 - RNA, 64 nt, Homo Sapiens
uucggagaaugagccaggucagucacugggaggaccugugaaagaaaguuggucacugagugcc

SEQ ID NO: 81484 - RNA, 64 nt, Homo Sapiens
gggccagaguauuggucuccucucagccccugauccugugaaguaaggaugugggggaagaccu

SEQ ID NO: 81485 - RNA, 64 nt, Homo Sapiens
ucuggucuuuucuuuucauuguauuuuaagcuuaccugugaauagcccaauaaacaugacacac

SEQ ID NO: 81486 - RNA, 64 nt, Homo Sapiens
caguacuaggcagaacagcccccgaucugcauagccugugaaagcccacggggacaucaguaac

SEQ ID NO: 81487 - RNA, 64 nt, Homo Sapiens
cuuaucaccuuuauuagauaaaucaugaagugucccugugaaauugaagugaaacuaucucugu

SEQ ID NO: 81488 - RNA, 64 nt, Homo Sapiens
uacacuguaggacacaagcucuucuucccucccuccugugaaguuggccuugggguucagguuc

SEQ ID NO: 81489 - RNA, 64 nt, Homo Sapiens
uuaggacccuucccacagccaaccaggaagggggccugugaagguucagcaaaaaaaaaaccuu

SEQ ID NO: 81490 - RNA, 64 nt, Homo Sapiens
caggauacugcagcuuuauuaagggccaggaguuccugugaaacuccuuuuugaauguucgugg

SEQ ID NO: 81491 - RNA, 64 nt, Homo Sapiens
cgagaggggacucgcggccgcgauggcaaggcauccugugaauucaugcgcugcgaguggcggg

SEQ ID NO: 81492 - RNA, 64 nt, Homo Sapiens
gcucccuuucccuccccuuuuuuuuuucuuuguuccugugaaauguuaaucuccgugaguucuu

SEQ ID NO: 81493 - RNA, 64 nt, Homo Sapiens
auggagcuacuacuguaaugcgugaacuaacaaaccugugaacuguaaauaggccccuggaagc

SEQ ID NO: 81494 - RNA, 64 nt, Homo Sapiens
gcacuguccugacugcuccccaccagcacgcugaccugugaaccccagccucaccaucaccccc

SEQ ID NO: 81495 - RNA, 64 nt, Homo Sapiens
auuucaaacggccucacuaggcuucugguugaugccugugaacugaacucugacaacagacuuc

SEQ ID NO: 81496 - RNA, 64 nt, Homo Sapiens
uauaccaccuugacccauuugcuacauuccuuuuccugugaaauaugugagugauaauuaaaca

SEQ ID NO: 81497 - RNA, 64 nt, Homo Sapiens
ccucugcauuuucccaucacauagaagacuuugaccugugaagcugccaucuguuaauacuaaa

SEQ ID NO: 81498 - RNA, 64 nt, Homo Sapiens
guugagugcugugcuuggggcgccauguacuuguccugugaagagaaaaaagcucguccauguc

SEQ ID NO: 81499 - RNA, 64 nt, Homo Sapiens
ccacuccacucgcacgugaucccacucccaccauccugugaaccccuaugagcccacgcccggc

SEQ ID NO: 81500 - RNA, 64 nt, Homo Sapiens
uuuuucuaauuuucuucacuuagaguauuauauuccugugaaaaaaacaugccuuucuauuuau

SEQ ID NO: 81501 - RNA, 64 nt, Homo Sapiens
agaaaaucagagggaaguuuaagggagugaacuaccugugaaguucugcagugccagcugacuu

SEQ ID NO: 81502 - RNA, 64 nt, Homo Sapiens
cagccccacgcgcgcaccagggaguaaugcaacgccugugaagcggaggcgggucaaggcaaaa

SEQ ID NO: 81503 - RNA, 64 nt, Homo Sapiens
gaggcaguuucccucacguuuucugacccuguuaccugugaaauguguuggcugccaacagaac

SEQ ID NO: 81504 - RNA, 64 nt, Homo Sapiens
cccaagccaggaguucuaugacaguucgacuaacccugugaacacuaacuguugcguggaguuc

SEQ ID NO: 81505 - RNA, 64 nt, Homo Sapiens
guccuuaguuugggucauaucguuaacauugaaaccugugaaaugcacaaacccucacaauacg

SEQ ID NO: 81506 - RNA, 64 nt, Homo Sapiens
gaagcagcaugcacuuuggagcucugaacucugaccugugaauaacaucccggguggcucuggg

SEQ ID NO: 81507 - RNA, 64 nt, Homo Sapiens
ugcggaacagccaacauagaguacuugcucucguccugugaauuuucuuucaugagggagucaa

SEQ ID NO: 81508 - RNA, 64 nt, Homo Sapiens
auuauuacacugucuuuuugccaucaaaaugaggccugugaaauacaagguucccuucugcacc

SEQ ID NO: 81509 - RNA, 64 nt, Homo Sapiens
uaagggccaguuuacuugucugccucuuugaccaccugugaacucuguuggguguacucugcua

SEQ ID NO: 81510 - RNA, 64 nt, Homo Sapiens
cauuagggcacaaccuguuggauaguuuuagcuuccugugaacauuuguaaccacugcuucagu

SEQ ID NO: 81511 - RNA, 64 nt, Homo Sapiens
auuacugauauuucauuauaauuaguucaccuucccugugaaacaagagaauuguaaaauguug

SEQ ID NO: 81512 - RNA, 64 nt, Homo Sapiens
cuuugaaccaccugcaucccagcccuucaggaagccugugaaaaacgugauuccugggccccac

SEQ ID NO: 81513 - RNA, 64 nt, Homo Sapiens
ugaagcugacaucuccaagagguacagcgggcgcccugugaaccugaugggaaccucucuguga

SEQ ID NO: 81514 - RNA, 64 nt, Homo Sapiens
ccgagccacugcaaagcacagcugauccuggcccccugugaagaaguguucuggucaaaacuaa

SEQ ID NO: 81515 - RNA, 64 nt, Homo Sapiens
guauucaaaaacauaacucauuacagaaagaaacccugugaagguuugauaugauuuuaauuca

SEQ ID NO: 81516 - RNA, 64 nt, Homo Sapiens
uauuuugaaccuaaaaagcauaggugaucauuauccugugaaaaucuucauaggagagcaacug

SEQ ID NO: 81517 - RNA, 64 nt, Homo Sapiens
cuucagaggacuuuggccuuaaagcacuuauaucccugugaauauucuggcaaauaagauucua

SEQ ID NO: 81518 - RNA, 64 nt, Homo Sapiens
gaaucaugcaaggccaauugcuugauaugauccaccugugaacuugccuuuauuaaccagcauu

SEQ ID NO: 81519 - RNA, 64 nt, Homo Sapiens
augacacugcaguuaaauuguaaauguaggaaggccugugaaaccacagcugugugacgauuuc

SEQ ID NO: 81520 - RNA, 64 nt, Homo Sapiens
accaaccugaagacaccguuacuugggagcaccgccugugaaauacaaaugggaaaaccagacu

SEQ ID NO: 81521 - RNA, 64 nt, Homo Sapiens
acguguucuucugucagggccaaaacucaaaucuccugugaaauacguauugauaauccaaucu

SEQ ID NO: 81522 - RNA, 64 nt, Homo Sapiens
aauauggauuuccucauuucaguuccuucugcagccugugaaucuccacaaaguguuaccaguu

SEQ ID NO: 81523 - RNA, 64 nt, Homo Sapiens
auguuagaaguccaggcagagacaauaaaacauuccugugaaaggcacuuuucauuccacuuua

SEQ ID NO: 81524 - RNA, 64 nt, Homo Sapiens
ucaccccacccccccaccccccaucacacgugcuccugugaacuuuccaugguuaugucuacgg

SEQ ID NO: 81525 - RNA, 64 nt, Homo Sapiens
uccuuguuuuugaaaguuagcauaauuuuagaugccugugaaauaguacugcacuuacauaaag

SEQ ID NO: 81526 - RNA, 64 nt, Homo Sapiens
gaugcaguaguaggcacuguugauucaaauuuauccugugaaacuggcuuuauagaguuaacaa

SEQ ID NO: 81527 - RNA, 64 nt, Homo Sapiens
gguucucaaauuccuauguagcuguuucccucuuccugugaaguuauacauaaauaaauauugg

SEQ ID NO: 81528 - RNA, 64 nt, Homo Sapiens
caggaaugcacaguugacuucuuugaacguagcgccugugaacucaucgguuguuuggcagcag

SEQ ID NO: 81529 - RNA, 64 nt, Homo Sapiens
gauccuuccauuccaucuagacuguggacaccucccugugaagaagccauauugucaccucagc

SEQ ID NO: 81530 - RNA, 64 nt, Homo Sapiens
uacauuucaaaaaauguuauaugacuaccuauagccugugaaaaaauuguggccaucuuugcaa

SEQ ID NO: 81531 - RNA, 64 nt, Homo Sapiens
ccaccucguuugcuuuuuguauauaguuugucauccugugaaaaugcuuuuuuucaguuuugaa

SEQ ID NO: 81532 - RNA, 64 nt, Homo Sapiens
gggaucagccccuccugaguggccagccuuucccccugugaaagcaaaauagcuuggaccccuu

SEQ ID NO: 81533 - RNA, 64 nt, Homo Sapiens
agcuuccccacugccucugugugccccuuugcguccugugaaggccauugagaaaugcccagug

SEQ ID NO: 81534 - RNA, 64 nt, Homo Sapiens
aguuaccaacccugccugagccucaguuuccuccccugugaaaugagaacacgggguaacugcg

SEQ ID NO: 81535 - RNA, 64 nt, Homo Sapiens
cgauuucauaaaaggacacacacuggagagaaacccugugaauguaagaaauguagaaaagcau

SEQ ID NO: 81536 - RNA, 64 nt, Homo Sapiens
gaggugacuuuuguaacuuuuguucugugugugaccugugaaccacuaggaugugaucugcccu

SEQ ID NO: 81537 - RNA, 64 nt, Homo Sapiens
ggaaggauacagaccaaacucuugauaguggucaccugugaagaguggagaagggaaaauaaug

SEQ ID NO: 81538 - RNA, 64 nt, Homo Sapiens
cuguuccuucaagcaagcuggccugggccaugugccugugaaaggcaggcucuggccccuuucc

SEQ ID NO: 81539 - RNA, 64 nt, Homo Sapiens
acuaggcagcagagaauucauacuggagagaagcccugugaauguuaacaaauguggaaaagcu

SEQ ID NO: 81540 - RNA, 64 nt, Homo Sapiens
aggcagggccagaucacccaggugaaagagaaagccugugaaauaaccaggagcccggaggaag

SEQ ID NO: 81541 - RNA, 64 nt, Homo Sapiens
ucucagaaggcuucagugacacuaagggagaaaaccugugaaggggauucaugugacagcucac

SEQ ID NO: 81542 - RNA, 64 nt, Homo Sapiens
ccuaccagagagaaaccuuuuauuccucaccccaccugugaacuuaugugggaaagaauuucug

SEQ ID NO: 81543 - RNA, 64 nt, Homo Sapiens
uaagcacuugguaaagccuucauuggagauagacccugugaaugucagauacuuguacgaaaca

SEQ ID NO: 81544 - RNA, 64 nt, Homo Sapiens
gaaaugagggcuuuaguuucucccacccuucuacccugugaaggcacuuccagacucuccccuc

SEQ ID NO: 81545 - RNA, 64 nt, Homo Sapiens
ccccagugcccccguggggcagaugcucccucccccugugaaccuuuacaaaauauauauaugg

SEQ ID NO: 81546 - RNA, 64 nt, Homo Sapiens
cuuuuuauggcagguaaucagaaacagaauugucccugugaaaucugauaauuuauacuaacua

SEQ ID NO: 81547 - RNA, 64 nt, Homo Sapiens
auuuguccagccuucauguuggucucauguuaugccugugaaggccuuuuucugggacauuguu

SEQ ID NO: 81548 - RNA, 64 nt, Homo Sapiens
agaagaagauggugccuggguccagagucuguccccugugaagaucuccucucuccccagaaca

SEQ ID NO: 81549 - RNA, 64 nt, Homo Sapiens
aaggcagaguuuuacuguaauuuucuacuccugcccugugaauuacuguauuuuacauaauuga

SEQ ID NO: 81550 - RNA, 64 nt, Homo Sapiens
acccugcagggcccuuaugggaccagguuugaugccugugaagagggagacuuguucuagagag

SEQ ID NO: 81551 - RNA, 64 nt, Homo Sapiens
uacuauguaugacagaagcuaucagaguucaaauccugugaauagaguuuaagcauuaacagac

SEQ ID NO: 81552 - RNA, 64 nt, Homo Sapiens
caucugagugggagguggugacgcaauucuuuauccugugaacuuguagcguguggaccggucc

SEQ ID NO: 81553 - RNA, 64 nt, Homo Sapiens
cagugaauguaaggaucccucuuuggagagaagcccugugaauaaacuaacacaugagcaguca

SEQ ID NO: 81554 - RNA, 64 nt, Homo Sapiens
aacaaugaagucguuccucuaggugaauaaauuaccugugaaugucguugcaggagggcaaacu

SEQ ID NO: 81555 - RNA, 64 nt, Homo Sapiens
cauucagaacaugauuggaacaccacagagagaaccugugaaugaugugcaaacauggggguga

SEQ ID NO: 81556 - RNA, 64 nt, Homo Sapiens
accaucuccccccgccgggcuacgaugacauguaccugugaaggccucaagaauguaacauccc

SEQ ID NO: 81557 - RNA, 64 nt, Homo Sapiens
guucugagcccccuuuucuggacaccaacuguguccugugaauguaucgcuacugugagcuguu

SEQ ID NO: 81558 - RNA, 60 nt, Homo Sapiens
augacaucuuggauugcuagaagagaaggaccugugaaacuacugaggccagcugguauu

SEQ ID NO: 81559 - RNA, 64 nt, Homo Sapiens
caggaguuuaaagcugcagugcccugugguugcaccugugaauaacugcacuccagccugggca

SEQ ID NO: 81560 - RNA, 64 nt, Homo Sapiens
guaaugaaaguucagugacaaacuagauagugaaccugugaaagucauuauuuacauuugcuuu

SEQ ID NO: 81561 - RNA, 64 nt, Homo Sapiens
agccggggcugccagcgcauccagccagcccagcccugugaaagauggagcugacuugcugcag

SEQ ID NO: 81562 - RNA, 64 nt, Homo Sapiens
ggcacauuccuuuccuuuagcuuagccgcgggucccugugaaccagcuguauuuuacccuugag

SEQ ID NO: 81563 - RNA, 64 nt, Homo Sapiens
guggauucugccuccaucucguucuauguggaaaccugugaagaaugacaaagacauaugugau

SEQ ID NO: 81564 - RNA, 64 nt, Homo Sapiens
ccaggaggugguguuggcugcuugggugagugaaccugugaagcggucgugguugugcuggccu

SEQ ID NO: 81565 - RNA, 64 nt, Homo Sapiens
ggcuugucuccucccccaucaucuccugugaugcccugugaaauaggccuggggccggcgagaa

SEQ ID NO: 81566 - RNA, 64 nt, Homo Sapiens
uauuaaacuugucagaauuucuuugucauucaagccugugaauaaaaacccuguauggcacuua

SEQ ID NO: 81567 - RNA, 64 nt, Homo Sapiens
auauuguggacacauuaucuuauguuuugaaauaccugugaauuguuggcauugagcagcugaa

SEQ ID NO: 81568 - RNA, 64 nt, Homo Sapiens
aacucaacuugagcucuugaacuccuccugugggccugugaauguauucauucauuccacaacu

SEQ ID NO: 81569 - RNA, 64 nt, Homo Sapiens
caggaguuugaggcugcagugcacuaugcuugcaccugugaauagccacugcacuccaucuugg

SEQ ID NO: 81570 - RNA, 64 nt, Homo Sapiens
ugacacgcagcgcguuggugucuccguguuugucccugugaaaacauguaacgucugccuuaga

SEQ ID NO: 81571 - RNA, 64 nt, Homo Sapiens
aaaaauugacgauugcccugcauuucuaccaaguccugugaauaaagagaugggagauuugauu

SEQ ID NO: 81572 - RNA, 64 nt, Homo Sapiens
gugcugucauaugaaauaaacauucuguacauauccugugaaacuaaagucagugguacacaga

SEQ ID NO: 81573 - RNA, 64 nt, Homo Sapiens
auauguuguaggaaaagcuggauguauuaaccuaccugugaaucguauggcagugggagacuaa

SEQ ID NO: 81574 - RNA, 64 nt, Homo Sapiens
gaagauuaaaaacucgacacucauugggucagcaccugugaaagccaaucacacaugauuggcc

SEQ ID NO: 81575 - RNA, 64 nt, Homo Sapiens
gacugugacuguugcccuuagccagccagaugcgccugugaaccaaagcuucgugcacaugugu

SEQ ID NO: 81576 - RNA, 64 nt, Homo Sapiens
cuaagccuuaccaugagucagaguguuaagggggccugugaaccagucguuugguggaggaggg

SEQ ID NO: 81577 - RNA, 64 nt, Homo Sapiens
ucucagagacucgcagcauagccauacaccucagccugugaaaugaacgauccggacccucacc

SEQ ID NO: 81578 - RNA, 64 nt, Homo Sapiens
uucccagaaccccguuggggcagauguuacugaaccugugaaucagacgccaggagugagggcu

SEQ ID NO: 81579 - RNA, 64 nt, Homo Sapiens
cccgcgccugagacuggcuggaaaugcucugacuccugugaaggcacagccagcguuguggccu

SEQ ID NO: 81580 - RNA, 64 nt, Homo Sapiens
augaagccuuuuuccuggucccagcagcaucugcccugugaaguuuguuuucucccacugccuc

SEQ ID NO: 81581 - RNA, 64 nt, Homo Sapiens
uggaccugcugggcaggaucccagggugaaccugccugugaacucugaagucacuaguccagcu

SEQ ID NO: 81582 - RNA, 64 nt, Homo Sapiens
gggacaucugaggacauccgcagauucuugucagccugugaacuaggcccugccucugucaccu

SEQ ID NO: 81583 - RNA, 64 nt, Homo Sapiens
ccccagcagccuccuacagagcaggaagaggcgcccugugaacccugaguguugcaggcccagc

SEQ ID NO: 81584 - RNA, 64 nt, Homo Sapiens
ugugguucaagugugcacugggaggaggcugaggccugugaagccaaacaauaugcuccugccu

SEQ ID NO: 81585 - RNA, 64 nt, Homo Sapiens
gggucuaagaauagcacugaccucaguucgcucaccugugaaauuugauguaaccuuuuaaagg

SEQ ID NO: 81586 - RNA, 64 nt, Homo Sapiens
ggggcugauaccaccuaccuccucaguuugcccaccugugaaauagcuauugcauuucauucug

SEQ ID NO: 81587 - RNA, 64 nt, Homo Sapiens
cuggccccacugccugccggcucagcccugggugccugugaagcuugcccccugccaucucgca

SEQ ID NO: 81588 - RNA, 64 nt, Homo Sapiens
uugggggcauaugaucaccagggcacacagugugccugugaaaauuuggcaccuacauuuguau

SEQ ID NO: 81589 - RNA, 64 nt, Homo Sapiens
ucuucacaauuugugucucguuguucagaacaacccugugaaguaguuuuggcaaugucugugu

SEQ ID NO: 81590 - RNA, 64 nt, Homo Sapiens
cgcagcguuaaugcgcauugcgugcgaaugaaccccugugaacgguugacuagaugaguaaucu

SEQ ID NO: 81591 - RNA, 64 nt, Homo Sapiens
gccaugcaccaccucagaucuccaaacugaugucccugugaacaccugcacuaugagaagguuu

SEQ ID NO: 81592 - RNA, 64 nt, Homo Sapiens
aaguacacauaaguuauuuccuaggauuuuucccccugugaacaggcauguuguauuauauaac

SEQ ID NO: 81593 - RNA, 64 nt, Homo Sapiens
acagcuucgugucuaguaugagcucaguacuugcccugugaaaaucccagaagcccccgcuguc

SEQ ID NO: 81594 - RNA, 64 nt, Homo Sapiens
gucacagaguaauggcauuaauccccauaauaauccugugaaggugauauucucaucccaucuu

SEQ ID NO: 81595 - RNA, 64 nt, Homo Sapiens
gcaaaaaaaaaaaaaaaguugagugcucugcaggccugugaagggugccaccugagggagccgc

SEQ ID NO: 81596 - RNA, 64 nt, Homo Sapiens
gugagaaguacacauuucuggaucaacuucugacccugugaaaugguguuuuccaguauuacaa

SEQ ID NO: 81597 - RNA, 64 nt, Homo Sapiens
uucuucacuacauuuaauagauaguuccuuuagaccugugaaaucuacuuuauccuuccuuuua

SEQ ID NO: 81598 - RNA, 64 nt, Homo Sapiens
aguaggccacucuuuaagugauucccagcccaucccugugaaggauagggcuggagggcuaugg

SEQ ID NO: 81599 - RNA, 64 nt, Homo Sapiens
uaagaggugucaacaaacugcacuugagcaguugccugugaaugcacaacuguauuucccaaua

SEQ ID NO: 81600 - RNA, 64 nt, Homo Sapiens
agaaaguugcuuggcuggagcauuuaggguccccccugugaauuuuuuuucuuuaauuuuagga

SEQ ID NO: 81601 - RNA, 64 nt, Homo Sapiens
ucuuaaaguuuagaggcuaaaaaugguuuauagcccugugaaguuccacaaaugaugcaggugc

SEQ ID NO: 81602 - RNA, 64 nt, Homo Sapiens
ucagacauagauuucauaguauuuuucugagaauccugugaaggaacgcugucucuuugcaaag

SEQ ID NO: 81603 - RNA, 64 nt, Homo Sapiens
ucugaacacaagcauuucacuucuccaagaaguaccugugaacaguacaauauuucaguauuga

SEQ ID NO: 81604 - RNA, 64 nt, Homo Sapiens; identical to SEQ ID NO: 81603

SEQ ID NO: 81605 - RNA, 64 nt, Homo Sapiens
ccagguuuaucuuugucuuaucuaccaguuuauuccugugaacuucagauugaaccauucauug

SEQ ID NO: 81606 - RNA, 64 nt, Homo Sapiens; identical to SEQ ID NO: 76027

SEQ ID NO: 81607 - RNA, 64 nt, Homo Sapiens; identical to SEQ ID NO: 76028

SEQ ID NO: 81608 - RNA, 64 nt, Homo Sapiens; identical to SEQ ID NO: 76029

SEQ ID NO: 81609 - RNA, 64 nt, Homo Sapiens; identical to SEQ ID NO: 76030

SEQ ID NO: 81610 - RNA, 64 nt, Homo Sapiens; identical to SEQ ID NO: 76031

SEQ ID NO: 81611 - RNA, 64 nt, Homo Sapiens; identical to SEQ ID NO: 76032

SEQ ID NO: 81612 - RNA, 64 nt, Homo Sapiens; identical to SEQ ID NO: 76033

SEQ ID NO: 81613 - RNA, 64 nt, Homo Sapiens; identical to SEQ ID NO: 76034

SEQ ID NO: 81614 - RNA, 64 nt, Homo Sapiens; identical to SEQ ID NO: 76035

SEQ ID NO: 81615 - RNA, 64 nt, Homo Sapiens; identical to SEQ ID NO: 76036

SEQ ID NO: 81616 - RNA, 64 nt, Homo Sapiens; identical to SEQ ID NO: 76037

SEQ ID NO: 81617 - RNA, 64 nt, Homo Sapiens; identical to SEQ ID NO: 76038

SEQ ID NO: 81618 - RNA, 64 nt, Homo Sapiens; identical to SEQ ID NO: 76039

SEQ ID NO: 81619 - RNA, 64 nt, Homo Sapiens; identical to SEQ ID NO: 76040

SEQ ID NO: 81620 - RNA, 64 nt, Homo Sapiens; identical to SEQ ID NO: 76041

SEQ ID NO: 81621 - RNA, 64 nt, Homo Sapiens; identical to SEQ ID NO: 76042

SEQ ID NO: 81622 - RNA, 64 nt, Homo Sapiens; identical to SEQ ID NO: 76043

SEQ ID NO: 81623 - RNA, 64 nt, Homo Sapiens; identical to SEQ ID NO: 76044

SEQ ID NO: 81624 - RNA, 64 nt, Homo Sapiens; identical to SEQ ID NO: 76045

SEQ ID NO: 81625 - RNA, 64 nt, Homo Sapiens; identical to SEQ ID NO: 76046

SEQ ID NO: 81626 - RNA, 64 nt, Homo Sapiens; identical to SEQ ID NO: 76047

SEQ ID NO: 81627 - RNA, 64 nt, Homo Sapiens; identical to SEQ ID NO: 76048

SEQ ID NO: 81628 - RNA, 64 nt, Homo Sapiens; identical to SEQ ID NO: 76049

SEQ ID NO: 81629 - RNA, 64 nt, Homo Sapiens; identical to SEQ ID NO: 76050

SEQ ID NO: 81630 - RNA, 64 nt, Homo Sapiens; identical to SEQ ID NO: 76051

SEQ ID NO: 81631 - RNA, 64 nt, Homo Sapiens; identical to SEQ ID NO: 76052

SEQ ID NO: 81632 - RNA, 64 nt, Homo Sapiens; identical to SEQ ID NO: 76053

SEQ ID NO: 81633 - RNA, 64 nt, Homo Sapiens; identical to SEQ ID NO: 76054

SEQ ID NO: 81634 - RNA, 64 nt, Homo Sapiens; identical to SEQ ID NO: 76055

SEQ ID NO: 81635 - RNA, 64 nt, Homo Sapiens; identical to SEQ ID NO: 76056

SEQ ID NO: 81636 - RNA, 64 nt, Homo Sapiens; identical to SEQ ID NO: 76057

SEQ ID NO: 81637 - RNA, 64 nt, Homo Sapiens; identical to SEQ ID NO: 76058

SEQ ID NO: 81638 - RNA, 52 nt, Homo Sapiens; identical to SEQ ID NO: 76059

SEQ ID NO: 81639 - RNA, 64 nt, Homo Sapiens; identical to SEQ ID NO: 76060

SEQ ID NO: 81640 - RNA, 64 nt, Homo Sapiens; identical to SEQ ID NO: 76061

SEQ ID NO: 81641 - RNA, 64 nt, Homo Sapiens; identical to SEQ ID NO: 76062

SEQ ID NO: 81642 - RNA, 64 nt, Homo Sapiens; identical to SEQ ID NO: 76062

SEQ ID NO: 81643 - RNA, 64 nt, Homo Sapiens; identical to SEQ ID NO: 76064

SEQ ID NO: 81644 - RNA, 64 nt, Homo Sapiens; identical to SEQ ID NO: 76065

SEQ ID NO: 81645 - RNA, 64 nt, Homo Sapiens; identical to SEQ ID NO: 76066

SEQ ID NO: 81646 - RNA, 64 nt, Homo Sapiens; identical to SEQ ID NO: 76067

SEQ ID NO: 81647 - RNA, 64 nt, Homo Sapiens; identical to SEQ ID NO: 76068

SEQ ID NO: 81648 - RNA, 64 nt, Homo Sapiens; identical to SEQ ID NO: 76069

SEQ ID NO: 81649 - RNA, 64 nt, Homo Sapiens; identical to SEQ ID NO: 76070

SEQ ID NO: 81650 - RNA, 64 nt, Homo Sapiens; identical to SEQ ID NO: 76071

SEQ ID NO: 81651 - RNA, 64 nt, Homo Sapiens; identical to SEQ ID NO: 76072

SEQ ID NO: 81652 - RNA, 64 nt, Homo Sapiens; identical to SEQ ID NO: 76073

SEQ ID NO: 81653 - RNA, 64 nt, Homo Sapiens; identical to SEQ ID NO: 76074

SEQ ID NO: 81654 - RNA, 64 nt, Homo Sapiens; identical to SEQ ID NO: 76075

SEQ ID NO: 81655 - RNA, 64 nt, Homo Sapiens; identical to SEQ ID NO: 76076

SEQ ID NO: 81656 - RNA, 64 nt, Homo Sapiens; identical to SEQ ID NO: 76077

SEQ ID NO: 81657 - RNA, 64 nt, Homo Sapiens; identical to SEQ ID NO: 76078

SEQ ID NO: 81658 - RNA, 64 nt, Homo Sapiens; identical to SEQ ID NO: 76079

SEQ ID NO: 81659 - RNA, 64 nt, Homo Sapiens; identical to SEQ ID NO: 76080

SEQ ID NO: 81660 - RNA, 64 nt, Homo Sapiens; identical to SEQ ID NO: 76081

SEQ ID NO: 81661 - RNA, 64 nt, Homo Sapiens; identical to SEQ ID NO: 76082

SEQ ID NO: 81662 - RNA, 64 nt, Homo Sapiens; identical to SEQ ID NO: 76083

SEQ ID NO: 81663 - RNA, 64 nt, Homo Sapiens; identical to SEQ ID NO: 76084

SEQ ID NO: 81664 - RNA, 64 nt, Homo Sapiens; identical to SEQ ID NO: 76085

SEQ ID NO: 81665 - RNA, 64 nt, Homo Sapiens; identical to SEQ ID NO: 76086

SEQ ID NO: 81666 - RNA, 64 nt, Homo Sapiens; identical to SEQ ID NO: 76087

SEQ ID NO: 81667 - RNA, 64 nt, Homo Sapiens; identical to SEQ ID NO: 76088

SEQ ID NO: 81668 - RNA, 64 nt, Homo Sapiens; identical to SEQ ID NO: 76089

SEQ ID NO: 81669 - RNA, 64 nt, Homo Sapiens; identical to SEQ ID NO: 76090

SEQ ID NO: 81670 - RNA, 64 nt, Homo Sapiens; identical to SEQ ID NO: 76090

SEQ ID NO: 81671 - RNA, 64 nt, Homo Sapiens
acuccuaaaggaagggccaaacuagagauuuucaaucauagacuuugugacagcauuuggggaa

SEQ ID NO: 81672 - RNA, 64 nt, Homo Sapiens
gaagagagagagagagcauguauacccguauguuaucauagagcacgauucuccaguggaugga

SEQ ID NO: 81673 - RNA, 64 nt, Homo Sapiens
aauggagaaaacauuuaaaauuaucaguguucagaucauagauuauucagauauuuaauaucuu

SEQ ID NO: 81674 - RNA, 64 nt, Homo Sapiens
uuaaggaaagcgguguaggugugacggaagccugaucauagacauauggacuuccagugaagua

SEQ ID NO: 81675 - RNA, 64 nt, Homo Sapiens
ucauacugcagagaaacuuuaacccuugcacgucaucauagaauaagguuuuuaaucaaaaaac

SEQ ID NO: 81676 - RNA, 64 nt, Homo Sapiens
ucauaguggagagaaaccuuaaaccuuguauaccaucauagacuaagaccuucagucagauguc

SEQ ID NO: 81677 - RNA, 64 nt, Homo Sapiens
aguuccuuagagaaucuguuuugauucugggcugaguuauuacaguuaugguaugaccagugag

SEQ ID NO: 81678 - RNA, 64 nt, Homo Sapiens
auuuuuuaacuuagauuucucacuaaguuuccugaguuauuaguaagauugcucccuaaaugua

SEQ ID NO: 81679 - RNA, 64 nt, Homo Sapiens
aacauuucuccccucacucccuugcuggugucauaguuauuagaaucagcagccucuuaacuaa

SEQ ID NO: 81680 - RNA, 64 nt, Homo Sapiens
aauguuucaagccauuauugcugaaugguucuuuaguuauuaaccuagacccaaaucaaagacc

SEQ ID NO: 81681 - RNA, 64 nt, Homo Sapiens
caggaucuuuaauacaauauagaaauuguguaauaguuauuauaaauguuaauacacaacuuuc

SEQ ID NO: 81682 - RNA, 64 nt, Homo Sapiens
uuuaacugauuauuucuuuugcucuuuuaacuuaaguuauuaaaguuuaaaaguucguaaguac

SEQ ID NO: 81683 - RNA, 64 nt, Homo Sapiens
ggauaaauaaauuauugaucuuuuuuaaggcagcaguuauuaaauugguaauagaagaugcugc

SEQ ID NO: 81684 - RNA, 64 nt, Homo Sapiens
caugauaaaacauuuugagaagggguaagcagugaguuauuacccacaauuuaaagcaaauuuu

SEQ ID NO: 81685 - RNA, 64 nt, Homo Sapiens
aauaaauaugucucuuuauuuaccaaaaaaagagaguuauuacagcauuguuaaagauaguuau

SEQ ID NO: 81686 - RNA, 64 nt, Homo Sapiens
aaaaaaagagaguuauuacagcauuguuaaagauaguuauuaccauggguaaaaauaaauaaua

SEQ ID NO: 81687 - RNA, 64 nt, Homo Sapiens
acuuuggccuguauuaaagcaguagagcagcaucaguuauuauaguccagaaaaagugugcauc

SEQ ID NO: 81688 - RNA, 64 nt, Homo Sapiens
acuuauaaaaggagucaaaguuucaaagcaagauaguuauuaagcaaaaggaaaaaugguaaug

SEQ ID NO: 81689 - RNA, 64 nt, Homo Sapiens
ugagucucccauggaugacuuuuuaccuagucccaguuauuaccaaucuguuuggcccaugacc

SEQ ID NO: 81690 - RNA, 64 nt, Homo Sapiens
uauauuuacuauauaacacaccacuuguuuauucaguuauuaaacauugauuaaaaaaagaaaa

SEQ ID NO: 81691 - RNA, 64 nt, Homo Sapiens
aguccuuuuaugaaaaaguuacugauugcuucucaguuauuaggaaaacaguuguuucacaauu

SEQ ID NO: 81692 - RNA, 64 nt, Homo Sapiens
auacaaugcaugaaucauaauggauucuuuuauaaguuauuaauuuuuaugguuuaaucagucu

SEQ ID NO: 81693 - RNA, 64 nt, Homo Sapiens
auuuacuucacuguguaauuaguuacaaccacucaguuauuaagagacguaacgcuucaaacuu

SEQ ID NO: 81694 - RNA, 64 nt, Homo Sapiens
accaagucuguguucuguuuaaucuguccauacaaguuauuacugagaaaguguuuaugccaua

SEQ ID NO: 81695 - RNA, 64 nt, Homo Sapiens
aucacaaaaccaccugguugaauauaauagauugaguuauuaacuguauuuucuuucacuuuau

SEQ ID NO: 81696 - RNA, 64 nt, Homo Sapiens
auggauauuugucaacagauuuaaagaaaaccacaguuauuaauuaaagaaaauuaauuaugug

SEQ ID NO: 81697 - RNA, 64 nt, Homo Sapiens
uuuagcuguuuugugguaauugcuuuuuaaaggaaguuauuaauaucauaaguuauuauuaaua

SEQ ID NO: 81698 - RNA, 64 nt, Homo Sapiens
uaauugcuuuuuaaaggaaguuauuaauaucauaaguuauuauuaauauuuugaacacaggugg

SEQ ID NO: 81699 - RNA, 64 nt, Homo Sapiens
auguuuguguugguuuuuuaagaagucuaaaugaaguuauuaauaccugaagcuuuaaguuaag

SEQ ID NO: 81700 - RNA, 64 nt, Homo Sapiens
uaauuugguuuuauuaagagucuacucucaauccaguuauuagagauguacugaguuugauuug

SEQ ID NO: 81701 - RNA, 64 nt, Homo Sapiens
uucagcauggacuguucauuugaaaccuuuuucuaguuauuagcguuuuaacaguuacaagcuu

SEQ ID NO: 81702 - RNA, 64 nt, Homo Sapiens
aaguugaacaauccuagccauugacaaucgugauaguuauuauuuucccauuugcugucuuuuu

SEQ ID NO: 81703 - RNA, 64 nt, Homo Sapiens
acccugaggcuuuaagugguuucuauuucuucuuaguuauuaugugccaccuucuuaguuauua

SEQ ID NO: 81704 - RNA, 64 nt, Homo Sapiens
cuauuucuucuuaguuauuaugugccaccuucuuaguuauuaugugccaccuccccuaugagug

SEQ ID NO: 81705 - RNA, 64 nt, Homo Sapiens
uugaguuacaaacaauccaguuacaaucuuuuuaaguuauuauuauuauuauuauuuuuuuuuu

SEQ ID NO: 81706 - RNA, 64 nt, Homo Sapiens
ugggauuauaggugugagccacugcgccuggcuaaguuauuauuauuuuuuugagacagucucc

SEQ ID NO: 81707 - RNA, 64 nt, Homo Sapiens
ugaagcagucugaauguucuuugaaaauaacuggaguuauuagcauacccuaguacaucuuaca

SEQ ID NO: 81708 - RNA, 64 nt, Homo Sapiens
gaaaaaauugauacuggaaaagauuguugugcauaguuauuagucauuuguaaccuugcuuaag

SEQ ID NO: 81709 - RNA, 64 nt, Homo Sapiens
auugauaccucugauaauauuagaaaaagauuauaguuauuaauccaacuguucuauauuucuu

SEQ ID NO: 81710 - RNA, 64 nt, Homo Sapiens
aaugauuuugauuggguugcuaagagggaguaauaguuauuacuagaauaaugguucuuacugc

SEQ ID NO: 81711 - RNA, 64 nt, Homo Sapiens
uacacaucagccaucaacuauuuaaauugcucacaguuauuacaaucucacauuuuuauaccug

SEQ ID NO: 81712 - RNA, 64 nt, Homo Sapiens
auuguuguccgguuuacuuuaaaacaaaaccaaaaguuauuaaaucuaaagauagaguaaaaag

SEQ ID NO: 81713 - RNA, 64 nt, Homo Sapiens
ugauauguaaacauaauucuuccuacaaagauguuugucagauaaagauggaugugcuuugcau

SEQ ID NO: 81714 - RNA, 64 nt, Homo Sapiens
uuuuuucagaaauaugugguggaagguuuguauauugucagauauuggagaguaaaaacugaau

SEQ ID NO: 81715 - RNA, 64 nt, Homo Sapiens
gcacugaacaauuaagaaauugggcuggggaaacuugucagaaaagaauagcuaagagauaaau

SEQ ID NO: 81716 - RNA, 64 nt, Homo Sapiens
acaggacuaaguagcagagauccccguaugaugauugucagaagcacuguaaggcagaugaucg

SEQ ID NO: 81717 - RNA, 64 nt, Homo Sapiens
aaagggagacuguugcucaaccaucaggaaacaguugucagaagacaucauugguucuguguuu

SEQ ID NO: 81718 - RNA, 64 nt, Homo Sapiens
cagaaagucgcauaggguuuuuuaaugcagaauuuugucagaagacaauggcgcugcauguuuu

SEQ ID NO: 81719 - RNA, 64 nt, Homo Sapiens
gaaagggcagugagacaagaccucauccuaccucccugaccagcucuggcuucugcuccugccc

SEQ ID NO: 81720 - RNA, 64 nt, Homo Sapiens
aguggaucaccugaggucagaaguuugagaccagccugaccaacauggugaaaugaaaccccau

SEQ ID NO: 81721 - RNA, 64 nt, Homo Sapiens
gaugaggcuucuuccuggauggggcagagcuucuccugaccagggcaaggccccuuccacgggg

SEQ ID NO: 81722 - RNA, 64 nt, Homo Sapiens
ccaccccuuccucagccugggguuugaccacccaccugaccaggggcccuaccuggggaaagcc

SEQ ID NO: 81723 - RNA, 64 nt, Homo Sapiens
auuuaaggacucuaagccagcaguugggaaaacaccugaccaccagggccuaagguccacugga

SEQ ID NO: 81724 - RNA, 64 nt, Homo Sapiens
cuugaacccagaaggaggacggggacccaugaauccugaccacuggggaaggggcuugugggga

SEQ ID NO: 81725 - RNA, 64 nt, Homo Sapiens
aaauccuaagcucuugaggccauucaccugccaaccugaccauacugcuuucaaaagucuuuuc

SEQ ID NO: 81726 - RNA, 64 nt, Homo Sapiens
gcagaucaccugagaucgggaguuugagaccaagccugaccaauauggagaaacccugucucua

SEQ ID NO: 81727 - RNA, 64 nt, Homo Sapiens
gggagcgggagggcagagguccuggguacccaggccugaccagaggcaggugugugacuggguu

SEQ ID NO: 81728 - RNA, 64 nt, Homo Sapiens
agacucaccucccaagaacgucuuuucuugccucccugaccagccuggccuccgucuucuaucu

SEQ ID NO: 81729 - RNA, 64 nt, Homo Sapiens
cagagacaugcagagauugguagaaucccagcccccugaccacuuagggacugaccagcagcuu

SEQ ID NO: 81730 - RNA, 64 nt, Homo Sapiens
ucccccucccuccccuugcccccaacagcuggacccugaccagcgaauucccucacucgucucc

SEQ ID NO: 81731 - RNA, 64 nt, Homo Sapiens
gagcggcggccggagggcgggcggugagguccauccugaccaaggagcuggcggaagccccacg

SEQ ID NO: 81732 - RNA, 64 nt, Homo Sapiens
aggccaacugggcgcccgucaccaggcguuccucccugaccacaccagccccaaggcuuugaca

SEQ ID NO: 81733 - RNA, 64 nt, Homo Sapiens
ucaguggaggaggcagugggggcagcagcagccuccugaccaaugcccgcucuuggggagugag

SEQ ID NO: 81734 - RNA, 64 nt, Homo Sapiens
cggguggaucacaaggucaagaguucgagaccagccugaccaacguggugaaaccccgucucua

SEQ ID NO: 81735 - RNA, 64 nt, Homo Sapiens
gcccuggcgggggccaugggggugaugaaugacccuccaacagccccacauggguuguuucugu

SEQ ID NO: 81736 - RNA, 64 nt, Homo Sapiens
acggcacugcuucaggacgcgcuugcugaaacgacuccaacagcuaguucacagcccagcuuug

SEQ ID NO: 81737 - RNA, 64 nt, Homo Sapiens
aacccuagcugccaaccugcacuggaccgaaagccuccaacacauuguuguaggacugcaagac

SEQ ID NO: 81738 - RNA, 64 nt, Homo Sapiens
uugaaacaagucacuuuaccagagacccacuuugcuccaacaaccccucaggccgagauccgug

SEQ ID NO: 81739 - RNA, 64 nt, Homo Sapiens
ggcugcaguucuagugauaaaucaagcaauuucccuccaacaagcugccaggucucaaaaauuc

SEQ ID NO: 81740 - RNA, 64 nt, Homo Sapiens
gaccuuugcaauauauuuuauagauauaaaaggucuccaacaaaugcuagaauuuuuuauagcu

SEQ ID NO: 81741 - RNA, 64 nt, Homo Sapiens
aggagcugaacauuaauaugugcaaagauuggcucuccaacaagaaggaaagcagggaggaagg

SEQ ID NO: 81742 - RNA, 64 nt, Homo Sapiens
cgcuggaaggcugcgagaggacucuaguaugagucuccaacauuuggaacguuuccugggcugu

SEQ ID NO: 81743 - RNA, 64 nt, Homo Sapiens
agggcacuggacuuaguuaguaucaggagcacugagcucacagacugacuugggcuccuacugg

SEQ ID NO: 81744 - RNA, 64 nt, Homo Sapiens
uauagcuagauaaauauuguuagucuuagacaauagcucacauuuuuugagaagcaugcccucc

SEQ ID NO: 81745 - RNA, 64 nt, Homo Sapiens
uccggacaggcgcugcugccccgaguggcaggccagcucacacucugcugcacaacagcucggc

SEQ ID NO: 81746 - RNA, 64 nt, Homo Sapiens
cucagacucugucccugguaaggagugacaaggaagcucacagcugggcgagugcauuuugaau

SEQ ID NO: 81747 - RNA, 64 nt, Homo Sapiens
gugcauguguguguuuuagugaaucugcucucccagcucacacacuccccugccucccauggcu

SEQ ID NO: 81748 - RNA, 64 nt, Homo Sapiens
ccuccucccugacuccucucugcccaugcaaauuagcucacaucuuuccuccugcugcaaucca

SEQ ID NO: 81749 - RNA, 64 nt, Homo Sapiens
aagggagaaaaccugugaaggggauucaugugacagcucacacuagccuucagugcuaucagca

SEQ ID NO: 81750 - RNA, 64 nt, Homo Sapiens
ggauauauaaguuauuuguuagauaguuugagagagcucacacuucauugaucuuucaucccua

SEQ ID NO: 81751 - RNA, 64 nt, Homo Sapiens
ugacaggcucaggguucucaaggcagagcuuuugagcucacaggcuuugagcucacagguugcc

SEQ ID NO: 81752 - RNA, 64 nt, Homo Sapiens
uugccaggcagagcuuuugacuggcagagcuuugagcucacaggaagaaacugcccaugguugc

SEQ ID NO: 81753 - RNA, 64 nt, Homo Sapiens
gaaaaguagaaaaaugucacguuuccauaucuccugcuggaaaucagaaaauauaauaaaauug

SEQ ID NO: 81754 - RNA, 64 nt, Homo Sapiens
ucauugaaucaauggaucuguugaagaacucagcugcuggaaaccaugcaaaauguuuugaauu

SEQ ID NO: 81755 - RNA, 64 nt, Homo Sapiens
cucagaaacugcagcagccacgcacacagaagccugcuggaagacaggucucucuccguccaca

SEQ ID NO: 81756 - RNA, 64 nt, Homo Sapiens
uaauuuuacauaagaucugccuuccacacuucccugcuggaaggcauucucagagcuuuauguc

SEQ ID NO: 81757 - RNA, 64 nt, Homo Sapiens
acaggcaugagccaccgcgcucggccucccaaagugcuggaauugaccuugugauccacccacc

SEQ ID NO: 81758 - RNA, 64 nt, Homo Sapiens
gagguagacacaggugugggaggcaucagcucccugcuggaacuaguagugcugccccugugac

SEQ ID NO: 81759 - RNA, 64 nt, Homo Sapiens
ucagcugugcuccagacuaggagccuccuuauauugcuggaaacuucuuauaaaagaaacuuuc

SEQ ID NO: 81760 - RNA, 64 nt, Homo Sapiens
cuugcuagcaggcauucuuaccaaccaaccaccuugcuggaaccacucaagacugacuuacaga

SEQ ID NO: 81761 - RNA, 61 nt, Homo Sapiens
acgacccguuacccaccuagaggaagcgcgaugcuggaacacaucccugccuccgggaagu

SEQ ID NO: 81762 - RNA, 64 nt, Homo Sapiens
aggcccuugaguaacugaccacauuuggagguuuugcuggaaaugccugaccucucagucuggc

SEQ ID NO: 81763 - RNA, 64 nt, Homo Sapiens
ccucaggugaucugcccaccucggcuucccaaagugcuggaauuacaggccugagccaccccac

SEQ ID NO: 81764 - RNA, 64 nt, Homo Sapiens
gccuuuaguaccaagguucucaacacugacuacaugcuggaaugacugugaagcuuuuaaaaaa

SEQ ID NO: 81765 - RNA, 64 nt, Homo Sapiens
gggaugauugccacauacauggaacaccugggagugcuggaaauguacugugaucgaagugaca

SEQ ID NO: 81766 - RNA, 64 nt, Homo Sapiens
uccaaacgugcauacaguagcaauccaucagauaugcuggaagaacacacacacgaauccacag

SEQ ID NO: 81767 - RNA, 64 nt, Homo Sapiens
uuucuaaaagacagugaugagcuugucuuuauguugcuggaacaacaguguuuucauuuacucu

SEQ ID NO: 81768 - RNA, 64 nt, Homo Sapiens
uaaauuuacacuuaaaguugcuuugguauuuauuugcuggaagcccaauagaagccaaauccag

SEQ ID NO: 81769 - RNA, 64 nt, Homo Sapiens
uccaaaugaccaguuccaguaaaauaauuucccaugcuggaaaugguacuuacaaggcacauau

SEQ ID NO: 81770 - RNA, 56 nt, Homo Sapiens
aagccaaaggaauugaguaagacaacugcuggaagaugucuuaaaucaagcuuuca

SEQ ID NO: 81771 - RNA, 64 nt, Homo Sapiens
gcucaaaugauccuccugccuuggccucccaaagugcuggaauuacaggcaugagccaccacac

SEQ ID NO: 81772 - RNA, 64 nt, Homo Sapiens
guaccugccagcaggagcaugauggggacuuccaugcuggaauugcucccugauuaaaaugaga

SEQ ID NO: 81773 - RNA, 64 nt, Homo Sapiens
ucugcacacgcuagcucuccuucgccuucugccaugcuggaaguagccugaggcccucaccaga

SEQ ID NO: 81774 - RNA, 64 nt, Homo Sapiens
uaugauagaguuuauaaaacaguccuguguaaacugcuggaaguucuuccacagucaggucaau

SEQ ID NO: 81775 - RNA, 64 nt, Homo Sapiens
aagcccuuuaaaaagcugccuuccucuaccacuuugcuggaaagcuucacaauugucacagaca

SEQ ID NO: 81776 - RNA, 64 nt, Homo Sapiens
cgagugaguugcccauuaauugugaugacuaaaaugcuggaaagaggguuccugugauuaauuu

SEQ ID NO: 81777 - RNA, 64 nt, Homo Sapiens
cuuugaaccauuucaagucuccauggaacacauaugcuggaaauauugaauuagcauaauuggg

SEQ ID NO: 81778 - RNA, 64 nt, Homo Sapiens
cuggagugcccagggagagguacucccagggaccugcuggaagggcagcccugggcucugucuc

SEQ ID NO: 81779 - RNA, 64 nt, Homo Sapiens
ggugugggaagguucaggauggauaucuuuggguugcuggaaaaccagaagguggcuugggggu

SEQ ID NO: 81780 - RNA, 64 nt, Homo Sapiens
aauugugcuuagacaccucacaggcuuuccaauaugcuggaaguuuucacaagagaugagggag

SEQ ID NO: 81781 - RNA, 64 nt, Homo Sapiens
acacuccugcagaagcuguacaugaucuucagagugcuggaaacaaagagagccuauucucaca

SEQ ID NO: 81782 - RNA, 64 nt, Homo Sapiens
ggagccaaggggaggcugccaggaaggccuguccugcuggaacuugccccaggcuuccuuucag

SEQ ID NO: 81783 - RNA, 64 nt, Homo Sapiens
auggagaauggaaacaggccgaguuguagauuuaugcuggaagaaaucagguugugcugccagu

SEQ ID NO: 81784 - RNA, 64 nt, Homo Sapiens
uuccuaacauuugacaaacuagcucuguaucagaugcuggaauauucagugucuugucaaaucu

SEQ ID NO: 81785 - RNA, 64 nt, Homo Sapiens
aaguagaggugacucucucucuuugaaauugaguugcuggaaugaggacccauauguuaucaaa

SEQ ID NO: 81786 - RNA, 64 nt, Homo Sapiens
cugaggggacugacucuggcaucucugccgaggcugcuggaaucgacuggggcaucuucccgga

SEQ ID NO: 81787 - RNA, 64 nt, Homo Sapiens
uggggagacgaugcuguugcuuugcagaucacagugcuggaagcaggaacccaggguaagugca

SEQ ID NO: 81788 - RNA, 64 nt, Homo Sapiens
gggacacuucccugggccucaacaaggaucaggcugcuggaaacacagucacuugggagcugcu

SEQ ID NO: 81789 - RNA, 64 nt, Homo Sapiens
ggccuagaccgcgugauaaaacuggguugagggaugcuggaaccaguuacgacugaagucagug

SEQ ID NO: 81790 - RNA, 64 nt, Homo Sapiens
aagguuauuuuuggagccacagcuggugguguggugcuggaaggaccgugaagugaauucucug

SEQ ID NO: 81791 - RNA, 64 nt, Homo Sapiens
gcuagugaugagcuucacccuccagggacagugcugcuggaaagggcucccacugcuucugguc

SEQ ID NO: 81792 - RNA, 64 nt, Homo Sapiens
gucaccaguccucuugggguuuuguaccaucugaugcuggaaguuuugauuagugauauuuucu

SEQ ID NO: 81793 - RNA, 64 nt, Homo Sapiens
caucgcaagaugaacaguuguuaauaaaagcuguugcuggaaacuugcuuuaggaacagcucaa

SEQ ID NO: 81794 - RNA, 64 nt, Homo Sapiens
uugaagagagugacuggagugguaaagauggaaaugcuggaaaugauacuggcgcucacgcugc

SEQ ID NO: 81795 - RNA, 64 nt, Homo Sapiens
acaauagccacacccacaccugagcuguucucagugcuggaacuugaccauccuggaacacccu

SEQ ID NO: 81796 - RNA, 64 nt, Homo Sapiens
gcacaacccaaccucgcuuagggacccccagagaugcuggaaucgcuaggaggguuggcuccag

SEQ ID NO: 81797 - RNA, 64 nt, Homo Sapiens
ggcuugcaggguguauaccugcgcauugggaacuugcuggaaccccugaugcauuuuccuugag

SEQ ID NO: 81798 - RNA, 64 nt, Homo Sapiens
ccucugauucaaaacuuauuagaacaguagcuucugcuggaauuugcaaucacugaagucauag

SEQ ID NO: 81799 - RNA, 64 nt, Homo Sapiens
uuauuuuguuugcugucugucuccccugccccacugcuggaacagaggcuccaagaaaacaggg

SEQ ID NO: 81800 - RNA, 64 nt, Homo Sapiens
uuuuauuucacuuguguuuugucuuaaacccuacugcuggaaacaauuuuauguaauaagcaau

SEQ ID NO: 81801 - RNA, 64 nt, Homo Sapiens
cuugauuuacuggaagacuuuggaagacuggauuugcuggaagagguggaagaccaguaauugc

SEQ ID NO: 81802 - RNA, 64 nt, Homo Sapiens
cuggauuugcuggaagacuuggaagaccaguaauugcuggaagacuggaagaucuggauuuggu

SEQ ID NO: 81803 - RNA, 64 nt, Homo Sapiens
auuaaaucugguuaaugccugccuguacuuaccugccaaaaacauaguugguaacucugccaga

SEQ ID NO: 81804 - RNA, 64 nt, Homo Sapiens
caaugugagcuucucacagguuuguggacuggaggccaaaaagucuuaucaaaugaaguauuau

SEQ ID NO: 81805 - RNA, 64 nt, Homo Sapiens
augcaauuugaaaacuacaggcuuaggacucugugccaaaaaucucuauuuuaaaugaaaauau

SEQ ID NO: 81806 - RNA, 64 nt, Homo Sapiens
ugauucaagaaaugugauguagauuuuugagaaugccaaaaaucagguuucagaaaagcuacag

SEQ ID NO: 81807 - RNA, 64 nt, Homo Sapiens
ggaccaggaugaagagggaucaaagagauaauuagccaaaaacccaguagccuagaagauacaa

SEQ ID NO: 81808 - RNA, 64 nt, Homo Sapiens
guugagaaugaguaccacucucaccauugguauagccaaaaaagcuuggaagugaccaaggcua

SEQ ID NO: 81809 - RNA, 64 nt, Homo Sapiens
gaauuccuucuaguuuuucuugagaaacuguugugccaaaaauauuguaaugcacaggcaacug

SEQ ID NO: 81810 - RNA, 64 nt, Homo Sapiens
agaugaccagauuugaucucagaaaugucagauggccaaaaacagaaaucuuguuacuagaaca

SEQ ID NO: 81811 - RNA, 64 nt, Homo Sapiens
aaagaaaaccuuucuucaccaaaucuugguugaugccaaaaaaaaauacaugcuaagagaagua

SEQ ID NO: 81812 - RNA, 64 nt, Homo Sapiens
uacuauuucacaacagccugacaacauuucuauagccaaaaauagcuaaauaccucaaucaguc

SEQ ID NO: 81813 - RNA, 64 nt, Homo Sapiens
aucauuuuucaaagaaaauuauucucaucucaaugccaaaaagauaguuucuacacaucaccug

SEQ ID NO: 81814 - RNA, 64 nt, Homo Sapiens
aauagaaagaucuauguuuauaaaccagcacuuggccaaaaacaaaauuguaaaggaaauuuaa

SEQ ID NO: 81815 - RNA, 64 nt, Homo Sapiens
gaaagugaccaugaaaaauaauguaucacucacugccaaaaauaugcugccaauaguggauaac

SEQ ID NO: 81816 - RNA, 64 nt, Homo Sapiens
aaggugccgauuucaugcaucuuagacugaucaagccaaaaaaggaaggagccagccaggacuc

SEQ ID NO: 81817 - RNA, 64 nt, Homo Sapiens
aaaaaccuauuuuauuauccugccaaaaacaacagccaaaaaaacagcuugucuuaagaauggu

SEQ ID NO: 81818 - RNA, 64 nt, Homo Sapiens
acagccaaaaaaaaaaaaccucuuaagaaugguugccaaaaacaacaguucuucuuucagcuug

SEQ ID NO: 81819 - RNA, 64 nt, Homo Sapiens
gguaaauacaccauaccauaauaucugcuuggagaaccacaaugcacauuagcauauuagucug

SEQ ID NO: 81820 - RNA, 64 nt, Homo Sapiens
auuuugaaguauuugggcaggugagucauguuuuaaccacaagccauaacucaucuguugucuu

SEQ ID NO: 81821 - RNA, 64 nt, Homo Sapiens
uuuuaguaaacuggacauguuauuccacuacaaaaaccacaaguuaucuggccuuuuagaucuu

SEQ ID NO: 81822 - RNA, 64 nt, Homo Sapiens
uuggaaacaguuccugucugaaaacucuucugagaaccacaaaccuuguguauggauucggcau

SEQ ID NO: 81823 - RNA, 64 nt, Homo Sapiens
aaaaaggcugguguucaccagccaaacaaaacugaaccacaaaaugaccccaguggaaaacaaa

SEQ ID NO: 81824 - RNA, 64 nt, Homo Sapiens
aauucgaaugggguagaaacuauagcaaaugcagaaccacaaacuugcuggaagaaacuaaaaa

SEQ ID NO: 81825 - RNA, 64 nt, Homo Sapiens
uuuaucaaaacaagaugaaacacagaaaaguugaaaccacaacaaaaugaauucuauuaaagaa

SEQ ID NO: 81826 - RNA, 64 nt, Homo Sapiens
acuggaaauggagaaguuauugcagacagucaugaaccacaaaucacugugauuaaaauuuucu

SEQ ID NO: 81827 - RNA, 64 nt, Homo Sapiens
gcgugucugggugugccugucacuguguguaauaaaccacaaguauuuccguguagauggagau

SEQ ID NO: 81828 - RNA, 64 nt, Homo Sapiens
agcugccucugcaguuggaccagccuccaaacucaaccacaaccgcuguugcuccuggccucau

SEQ ID NO: 81829 - RNA, 64 nt, Homo Sapiens
acgcagccacagcuauaaccacaaucacguucacaaccacaaccaccacgguccccaccacgac

SEQ ID NO: 81830 - RNA, 64 nt, Homo Sapiens
cacggcuaugaucaugacaaccaugacaggaugcaaccacaacaccuugaugucugugaucaaa

SEQ ID NO: 81831 - RNA, 64 nt, Homo Sapiens
ugggacagggugaauaaagcagggaauauuuuagaaccacaagagaucagcaguggcaggaccc

SEQ ID NO: 81832 - RNA, 63 nt, Homo Sapiens
gcaaaccacauaaucucucuagguccauuuuccuaaccacaagauaaagauguuacauuguca

SEQ ID NO: 81833 - RNA, 64 nt, Homo Sapiens
gcuuccucuccugucaauuccaggcucuuuccauaaccacaagccugaggcugcagccuuuuau

SEQ ID NO: 81834 - RNA, 64 nt, Homo Sapiens
cuaacuuugucgcuaguccuaaggagaaaccuuuaaccacaaaguuuuuaucauugaagacaau

SEQ ID NO: 81835 - RNA, 64 nt, Homo Sapiens
auauauuuauagauuguguucacagcaaucauuuaaccacaaauaaaauaucccuugaugauac

SEQ ID NO: 81836 - RNA, 64 nt, Homo Sapiens
gcaagcaggaaaaaaaaauugggaccucaguugcaaccacaaggaacugaauucugccaaaaau

SEQ ID NO: 81837 - RNA, 64 nt, Homo Sapiens
ccuggauccuggggcccccacacuggauccugacaaccacaauguggaugucaacaaaccucac

SEQ ID NO: 81838 - RNA, 64 nt, Homo Sapiens
uucaagauuauccacaccccaagucugcuacccuaaccacaagaaucccuuacuucagcaacuc

SEQ ID NO: 81839 - RNA, 64 nt, Homo Sapiens
aggcucucugugaaacuacagaccccaccugagcaaccacaaaucauuucugcaagcaauguau

SEQ ID NO: 81840 - RNA, 64 nt, Homo Sapiens
agacaaacaagaaaaaaagcugaguuuaaacaaaaaccacaaacaagaaaaauguauauagcug

SEQ ID NO: 81841 - RNA, 64 nt, Homo Sapiens
gauccccggggaggcaggucccaggagcagacccugcccccagcccccacagacacaccccaau

SEQ ID NO: 81842 - RNA, 64 nt, Homo Sapiens
cguuuccugggguuucuuugcccaugggguucucugcccccacccccggcccuuuguuugacuu

SEQ ID NO: 81843 - RNA, 64 nt, Homo Sapiens
uagaggcuagcuucugcuuuucugcccuggcugcugcccccaccccggggacccugugacaugg

SEQ ID NO: 81844 - RNA, 64 nt, Homo Sapiens
uuccucugccugccccgcccccaguccccaccccugcccccagccccggggugaguccauucuc

SEQ ID NO: 81845 - RNA, 64 nt, Homo Sapiens
uucccagucccacaggccacauucacuccugcccugcccccaccccucacuggccuccaguggg

SEQ ID NO: 81846 - RNA, 64 nt, Homo Sapiens
cgcagccugucagagcucugcaugggacacccucugcccccagcugcuggcaggggcuggcacc

SEQ ID NO: 81847 - RNA, 64 nt, Homo Sapiens
uccccaggccuccagccucuuuagccuugugcccugcccccaucgguggaggaaggugcugagc

SEQ ID NO: 81848 - RNA, 64 nt, Homo Sapiens
ccucggacccaccaaacugcagccccucagcccuugcccccauccuguagccauggcucaggca

SEQ ID NO: 81849 - RNA, 64 nt, Homo Sapiens
gacucuugguuucgucucccugggaaaugccugcugcccccaauccuuccaucagccuuaaccc

SEQ ID NO: 81850 - RNA, 64 nt, Homo Sapiens
cagcuggcugugccagggcagccugcccaccccgugcccccagccccacgccagcgagcaggcu

SEQ ID NO: 81851 - RNA, 64 nt, Homo Sapiens
cuauaagcagggcuaauugucagcgggucacagcugcccccacuagcccccucccaggaguggu

SEQ ID NO: 81852 - RNA, 61 nt, Homo Sapiens
agccugcccccgacucuaccguggcccugccugcccccagcgggaccuguugauuaauuga

SEQ ID NO: 81853 - RNA, 64 nt, Homo Sapiens
ugcagccuugguguucguucccccagcccaccccugcccccauuagugcagacugucuaaaugc

SEQ ID NO: 81854 - RNA, 51 nt, Homo Sapiens
ccaccccugcccccauuugcaugcccccagcccccagugcagacugucuaa

SEQ ID NO: 81855 - RNA, 64 nt, Homo Sapiens
gggacuggggaggcgcagccuagacccaauugcuugcccccaugaggcuagcacuaauaggaaa

SEQ ID NO: 81856 - RNA, 64 nt, Homo Sapiens
uuuauuuaaaacaaaacaacacaaaaaaacaaugugcccccagaugucagaaugaggcgacuag

SEQ ID NO: 81857 - RNA, 64 nt, Homo Sapiens
ggcugggggugucagcauucccagcuuuccaagcugcccccaggcggcagagucugaggguccc

SEQ ID NO: 81858 - RNA, 64 nt, Homo Sapiens
gcugccacacccagcucaggccugggccagccccugcccccagcccacugagggggugggcuua

SEQ ID NO: 81859 - RNA, 64 nt, Homo Sapiens
cauauuuggggaggauggacuguccacucucuucugcccccagcgacccacccgucugugaaug

SEQ ID NO: 81860 - RNA, 64 nt, Homo Sapiens
ccgcauguggcuucauuauaaacuuggagguaaaugcccccaggggagaggggaggugucacac

SEQ ID NO: 81861 - RNA, 64 nt, Homo Sapiens
ccccgcugggacuggaugugcuggcacugaggggugcccccagaccuugcagggcagacagugc

SEQ ID NO: 81862 - RNA, 64 nt, Homo Sapiens
aguaagcagcucuuggacccccccucagcaugggugcccccagagcccagcucugccucgcagc

SEQ ID NO: 81863 - RNA, 64 nt, Homo Sapiens
augauuuuggaaagauauaauacugaaauguagaugcccccaacgccaauucaccuaauuuuua

SEQ ID NO: 81864 - RNA, 64 nt, Homo Sapiens
aaggcugcacccuccuugauagaacgauuuucagugcccccagcgagaacaggaggcucacaaa

SEQ ID NO: 81865 - RNA, 64 nt, Homo Sapiens
gguccccagggcauuuucauggcaaguaccccucugcccccacuccagcagugcuucccaaagu

SEQ ID NO: 81866 - RNA, 64 nt, Homo Sapiens
uuaaagcaguaguccacaaaguauucugcucaugugcccccaaaaguauuuugaaaaaucaugu

SEQ ID NO: 81867 - RNA, 64 nt, Homo Sapiens
aucuggaccccagagccagcccccccaaccccugugcccccaucucucccacccagaucaacau

SEQ ID NO: 81868 - RNA, 64 nt, Homo Sapiens
cucacccacgcuucugcucaagcccaccccacccugcccccaccgcaucuaucugucugccacc

SEQ ID NO: 81869 - RNA, 64 nt, Homo Sapiens
gaaaggcagcuucacccaguuuucuggacucucaugcccccaucuccgaccugggagacuucag

SEQ ID NO: 81870 - RNA, 64 nt, Homo Sapiens
ucucucucugucccggcagcccaggauggccuggugcccccaccugcugcagcaggagccccaa

SEQ ID NO: 81871 - RNA, 64 nt, Homo Sapiens
cucagggucugaagcagcugcugucucccuccucugcccccauccccuggcucuccccugggca

SEQ ID NO: 81872 - RNA, 64 nt, Homo Sapiens
cuugggaagccugaggcgggccucugccucucccugcccccagcacaauuggcagagaugaggc

SEQ ID NO: 81873 - RNA, 64 nt, Homo Sapiens
acacauggaagaauguuuaucggcugggcugcagugcccccacccucaccuucuccuggugcau

SEQ ID NO: 81874 - RNA, 64 nt, Homo Sapiens
auuuauugugagaauggcuacacuucuuuaggaaugcccccacuuacaaccagguggguggaac

SEQ ID NO: 81875 - RNA, 64 nt, Homo Sapiens
gcaucaguccuugaagagcaggaaaggaaggagcugcccccagacaccugccaccugagaagau

SEQ ID NO: 81876 - RNA, 64 nt, Homo Sapiens
accaauuacugcuccaguuagccagagacauuuaugcccccagcuuccuucugucucuuuagcu

SEQ ID NO: 81877 - RNA, 64 nt, Homo Sapiens
gcaaugguaacugcaccugggcagcuccucccugugcccccagccucagcccaacuucuuaccc

SEQ ID NO: 81878 - RNA, 64 nt, Homo Sapiens
gaaagcaucacugccuuggccccucccucccggcugcccccaucaccucuacugucuccucccu

SEQ ID NO: 81879 - RNA, 64 nt, Homo Sapiens
accuuggccaggcaggaugaaccugcagugacccugcccccaugcuuggggaguacagggaagu

SEQ ID NO: 81880 - RNA, 64 nt, Homo Sapiens
agcgcagucugggguauuucccuugcuccuguacugcccccagcgaaggccugagugcaagcac

SEQ ID NO: 81881 - RNA, 64 nt, Homo Sapiens
cgugggggcacuacuaagaaggggcauuuuugguugcccccaugaggugacugagauuguaggg

SEQ ID NO: 81882 - RNA, 64 nt, Homo Sapiens
gugguucauuucccagcccuccuccaucacgcccugcccccaggcucccccccccccaccgugc

SEQ ID NO: 81883 - RNA, 64 nt, Homo Sapiens
uuguguuuuagggugaaacuuaaaaaaaaaauucugcccccaccuagaucauauuuaaagaucu

SEQ ID NO: 81884 - RNA, 64 nt, Homo Sapiens
cuccuccccucuucucuuuugcccccucccuuccugcccccagucuggguuacucuucgcuucu

SEQ ID NO: 81885 - RNA, 64 nt, Homo Sapiens
acauuaccagguuauaaaacauaacucacaccccugcccccaccccaugcccccacccuccccu

SEQ ID NO: 81886 - RNA, 64 nt, Homo Sapiens
auaaaacauaacucacaccccugcccccaccccaugcccccacccuccccucacacacaaauug

SEQ ID NO: 81887 - RNA, 64 nt, Homo Sapiens
cggguuguucccagccugagggaucugagcucugugcccccagcgcugggguccuacccagccu

SEQ ID NO: 81888 - RNA, 64 nt, Homo Sapiens
cagcucccagcagcuucuccagaacuggaugggcugcccccagcccucccaguaggcaguaguc

SEQ ID NO: 81889 - RNA, 64 nt, Homo Sapiens
cggaaaccccaccuuuggagcucuuccccagcauugcccccaccugaggcccagggccugagcu

SEQ ID NO: 81890 - RNA, 64 nt, Homo Sapiens
cccacccgccccucucccggccccucuucgcccuugcccccauccuggcuccccuacuaacguc

SEQ ID NO: 81891 - RNA, 64 nt, Homo Sapiens
agcgucuggcuccccuacuaggccccugcccugcugcccccaacgcccccaacuccccgggccc

SEQ ID NO: 81892 - RNA, 64 nt, Homo Sapiens
uccccgggcccggccccugcgacccgcuacugccugcccccaaccccuccccugcagcgacucg

SEQ ID NO: 81893 - RNA, 64 nt, Homo Sapiens
gcuaauuuuuuguauuuuuuggauuacaggugccugcccccaugcucagccucccacguggcug

SEQ ID NO: 81894 - RNA, 64 nt, Homo Sapiens
cuguaugaaaacaucuccgauggauggcuucauuugcccccagauauuuauggcacgauuccuu

SEQ ID NO: 81895 - RNA, 64 nt, Homo Sapiens
gaggauggaacucagaaugaaacugcaacccaccugcccccagcccugccccucgcccugaugc

SEQ ID NO: 81896 - RNA, 64 nt, Homo Sapiens
cgaagcuggagaggggcgugcugcggggcccugaugcccccacccaccucgguccagcgcggcc

SEQ ID NO: 81897 - RNA, 64 nt, Homo Sapiens
ggaggcccaccucaaggagugcgagcacaucaaaugcccccacuccaaguacgggugagugggg

SEQ ID NO: 81898 - RNA, 64 nt, Homo Sapiens
ugcuggccuccagucccaucucccccaacacaugugcccccaaaaagugagccaggcaccucug

SEQ ID NO: 81899 - RNA, 64 nt, Homo Sapiens
agccccgguucccccaacauguucccguucacucugcccccacccccaaaggcucagccucuaa

SEQ ID NO: 81900 - RNA, 64 nt, Homo Sapiens
uuaauggcucaguccccuucaccccauuuccaagugcccccaggacuccugggcccugcuuccc

SEQ ID NO: 81901 - RNA, 64 nt, Homo Sapiens
cagccuaaaauaaagagcucugacugucacaugcugcccccaccagcccaagggucagcccucu

SEQ ID NO: 81902 - RNA, 64 nt, Homo Sapiens
agaagcuggagugcauagguugguccuggagagcugcccccagaggcccaggagcucggacugc

SEQ ID NO: 81903 - RNA, 64 nt, Homo Sapiens
ccuuucuaccgaccaugugaccccgcaccagcccugcccccaccugcccucccgggcaguacug

SEQ ID NO: 81904 - RNA, 64 nt, Homo Sapiens
ccccacugugaaggggcuggccaggggcccgagcugcccccacccccggccucagccaccagca

SEQ ID NO: 81905 - RNA, 64 nt, Homo Sapiens
uggcacccaccgucucggcccugaaccacgaggcugcccccauccagccacggagggaggcacc

SEQ ID NO: 81906 - RNA, 64 nt, Homo Sapiens
uugccacagcucaacucgggggcgccuggagggaugcccccaggcagccaccaguggaccuagc

SEQ ID NO: 81907 - RNA, 64 nt, Homo Sapiens
auuuuucuuugccgguuugccccugccuuccacaugcccccacccaggggacuccgcagcgggc

SEQ ID NO: 81908 - RNA, 64 nt, Homo Sapiens
gcacacacagacccaccggguccccgcccccaccugcccccaaucgagcccuugcuccuuagga

SEQ ID NO: 81909 - RNA, 64 nt, Homo Sapiens
cccugccuccucuaucccccccgcuugcuuccccugcccccaacccucagcuucccaucucugc

SEQ ID NO: 81910 - RNA, 64 nt, Homo Sapiens
cugcgccucagcuucccaucuagggcugggacugugcccccacacugggggcugggcugggggu

SEQ ID NO: 81911 - RNA, 64 nt, Homo Sapiens
acagcucuaugacucuguucuuggaacaggugugugcccccaccggaacagggcuggggcuggg

SEQ ID NO: 81912 - RNA, 64 nt, Homo Sapiens
ucguugguguggcucugcguggaaaggccaggccugcccccaucauagacuauacacauggggu

SEQ ID NO: 81913 - RNA, 64 nt, Homo Sapiens
ucuaagugcaauacuuggcccgccggcuucccgcugcccccaucgcgcucacgcaauaaccggc

SEQ ID NO: 81914 - RNA, 64 nt, Homo Sapiens
ccgugaugaauguacugacgagccgaggcagcagugcccccaccguggccccccacgccccauu

SEQ ID NO: 81915 - RNA, 64 nt, Homo Sapiens
aauggagucugggggagggggaaccccggggacaugcccccacccgggaggggccgguaacccc

SEQ ID NO: 81916 - RNA, 64 nt, Homo Sapiens
agacccucauuugccacccagaccaaugugagccugcccccagcccccucucauuggaaguggc

SEQ ID NO: 81917 - RNA, 64 nt, Homo Sapiens
agccagccguaauggggacucuccaggcaccgccugcccccagcguggggguggccacuccugg

SEQ ID NO: 81918 - RNA, 64 nt, Homo Sapiens
ccgccaugcaugauggguaaagcaauacugccgcugcccccacccugcuucugcugccuguuug

SEQ ID NO: 81919 - RNA, 64 nt, Homo Sapiens
ccuguacagcgacugucuccgaaccuucuggaccugcccccacuguggccugcaugcgccccuc

SEQ ID NO: 81920 - RNA, 64 nt, Homo Sapiens
cacgccccuggagcgcaucgcccaugagaacaccugcccccaggccccacaggaugggccccca

SEQ ID NO: 81921 - RNA, 64 nt, Homo Sapiens
ucuuuucuuuccuuccuuccuucuuuuuuguuuuugcccccaauucugcccauacccauuucuu

SEQ ID NO: 81922 - RNA, 64 nt, Homo Sapiens
uucuuucuuuccuuccuuccuucuuuuuuguuuuugcccccaguucuguccacaccccuucccu

SEQ ID NO: 81923 - RNA, 64 nt, Homo Sapiens
cccacccucgaccacccccgagaaugcagagaugugcccccaccguuucuuuuuucggcuaaaa

SEQ ID NO: 81924 - RNA, 64 nt, Homo Sapiens
ccaggcugggcuguucacucccgccccauccuccugcccccaccggggggugcccggggauccc

SEQ ID NO: 81925 - RNA, 64 nt, Homo Sapiens
cuccggccgguucccccggugaugagccccagggugcccccagguccaggcucuaggacugcgc

SEQ ID NO: 81926 - RNA, 64 nt, Homo Sapiens
cccagccgccgcccugcuccgacccgcgcccccgugcccccaggcugcugcccucgcugccccu

SEQ ID NO: 81927 - RNA, 64 nt, Homo Sapiens
uccugucuuuucuccuugccuguaaccggggccuugcccccaccaagcaacuguuuaaacccuu

SEQ ID NO: 81928 - RNA, 64 nt, Homo Sapiens
cccgccuccaguuuuccgcucuuccacuuuccugugcccccacccucugcucuccaucaaauca

SEQ ID NO: 81929 - RNA, 64 nt, Homo Sapiens
ccugcagguaggcuuagcccgaugcucaaggcccugcccccagccaguugguccugcagaacug

SEQ ID NO: 81930 - RNA, 64 nt, Homo Sapiens
gcugccccccacgggcauccccucgggucagcccugcccccagaagcgggccaagcagaggagc

SEQ ID NO: 81931 - RNA, 64 nt, Homo Sapiens
caccaccugccuggagaggacggccuccuguuccugcccccaccgccagacgccagggccugcc

SEQ ID NO: 81932 - RNA, 64 nt, Homo Sapiens
cuucaggcugccagaugcuccuuguggugcccgcugcccccaacgcacugaggauucuugcccc

SEQ ID NO: 81933 - RNA, 64 nt, Homo Sapiens
cugcagaaauaccuggugcuuuccaggacaagacugcccccagguggaguugcuggccaaagaa

SEQ ID NO: 81934 - RNA, 64 nt, Homo Sapiens
uggccucccugagaugaaccacagauccaggaccugcccccaacuugggcuucagguaccuaaa

SEQ ID NO: 81935 - RNA, 64 nt, Homo Sapiens
cuguuugggaagacguggaggaaaaggugacuucugcccccaccgcucuuacccccacuguagu

SEQ ID NO: 81936 - RNA, 64 nt, Homo Sapiens
ccgcucuuacccccacuguaguggccuuuggagaugcccccaccucccccccaccaacucucgc

SEQ ID NO: 81937 - RNA, 64 nt, Homo Sapiens
aguagucucugugaggccuuuuucaccugcugcuugcccccaauaaagagucaagugaccauca

SEQ ID NO: 81938 - RNA, 64 nt, Homo Sapiens
gcaccuccauguggacuuagagugggaugagugaugcccccacaucugcuccugcgaggcuaug

SEQ ID NO: 81939 - RNA, 64 nt, Homo Sapiens
acuggcagcauucccagacccauaacuggccagcugcccccauaccagcugggcuggaagguuc

SEQ ID NO: 81940 - RNA, 64 nt, Homo Sapiens
ccccauccccagcuagcccauacucccuucuuccugcccccacaugccuuagugugccucccaa

SEQ ID NO: 81941 - RNA, 64 nt, Homo Sapiens
ccucaggugaucugcccgccucggccucccaacgugcccccaguuuuauaaacagcagauagca

SEQ ID NO: 81942 - RNA, 64 nt, Homo Sapiens
uugaaaugaccuaaccaaaaacauucaaggguucugcccccagauuucgggagauccacguucc

SEQ ID NO: 81943 - RNA, 64 nt, Homo Sapiens
ugggaaaacugaggccuggagguaggaagggacuugcccccaaggccgcacacugaguuaacag

SEQ ID NO: 81944 - RNA, 64 nt, Homo Sapiens
gguggguagcuaauuaacuaucagguguugaggcugcccccaguggacaucaccuuuggcucug

SEQ ID NO: 81945 - RNA, 64 nt, Homo Sapiens
uuuagaguaaaaagccaaauugauuucugcaaugaacccaaacuaauuggauauggaaggacug

SEQ ID NO: 81946 - RNA, 64 nt, Homo Sapiens
acuacucauuuaucauuguagaagagaaggaaguaacccaaaguucuauuuggaagagagggag

SEQ ID NO: 81947 - RNA, 64 nt, Homo Sapiens
uaauacuaauguaacagcagaugaaaauugauaaaacccaaaagagagucaucuaaauuuguag

SEQ ID NO: 81948 - RNA, 64 nt, Homo Sapiens
cguguuuauuuugagucaugagauaaucaauuuuaacccaaagucauuggauuauuuauaugaa

SEQ ID NO: 81949 - RNA, 64 nt, Homo Sapiens
aaaugauuaaaguucugauguauuuucaccugugaacccaaauaguguaaaugaacuuucacaa

SEQ ID NO: 81950 - RNA, 64 nt, Homo Sapiens
ucuaugaacuaaugaauagacaaaagcugaauacaacccaaauggcagaauuauucauaauggc

SEQ ID NO: 81951 - RNA, 64 nt, Homo Sapiens
aaaccugaguggacagguucgggaccuggaaaagaacccaaagaucaguuaaguuguucuguuu

SEQ ID NO: 81952 - RNA, 64 nt, Homo Sapiens
uagaccugcuguuaaugaucgaaacuuaaaugauaacccaaaggaggaucacaaugucacagau

SEQ ID NO: 81953 - RNA, 64 nt, Homo Sapiens
ucauuauuuucauccaaaagaucaaauauucuaaaacccaaagugaggaacccaaaggcaguaa

SEQ ID NO: 81954 - RNA, 64 nt, Homo Sapiens
caguaaaucaaauauucuaaacaggcagcagaggaacccaaaggcugaauauuuagcaagagaa

SEQ ID NO: 81955 - RNA, 64 nt, Homo Sapiens
ucucugcauguacacauuacagcgaaaaaaaugaaacccaaaacacauguaaagaaaauaaguc

SEQ ID NO: 81956 - RNA, 64 nt, Homo Sapiens
ccuaguuaauugagggaugggguagaaaagacaaaacccaaacauuuuguacauaguagcauua

SEQ ID NO: 81957 - RNA, 64 nt, Homo Sapiens
aauaagacuuuaacugcaguuccaaagcuucucuaacccaaaaauuacaguaccaaaugauuga

SEQ ID NO: 81958 - RNA, 64 nt, Homo Sapiens
uuggucugcauuuguuagaaguuuaacuccuaacaacccaaagaccuauuuaacaauuggugca

SEQ ID NO: 81959 - RNA, 64 nt, Homo Sapiens
caaugauuucaaaauacuugaaaaauaaaauuuuaacccaaaugaauaacuaagaaauauaaaa

SEQ ID NO: 81960 - RNA, 64 nt, Homo Sapiens
uuaauguauaaaauuucuaggaauuaaaagcuuaaacccaaaaauuguucauccauauauaaga

SEQ ID NO: 81961 - RNA, 64 nt, Homo Sapiens
auguuuauaaaauaggacgcugcuauaaugugagaacccaaaucgaggcuaggaauagugaucc

SEQ ID NO: 81962 - RNA, 64 nt, Homo Sapiens
uaaaugucauagucaagauugaucuuaauguaacaacccaaaaagugcccggcccagauagguu

SEQ ID NO: 81963 - RNA, 64 nt, Homo Sapiens; identical to SEQ ID NO: 68551

SEQ ID NO: 81964 - RNA, 64 nt, Homo Sapiens; identical to SEQ ID NO: 68552

SEQ ID NO: 81965 - RNA, 64 nt, Homo Sapiens; identical to SEQ ID NO: 68553

SEQ ID NO: 81966 - RNA, 64 nt, Homo Sapiens; identical to SEQ ID NO: 68554

SEQ ID NO: 81967 - RNA, 64 nt, Homo Sapiens; identical to SEQ ID NO: 68555

SEQ ID NO: 81968 - RNA, 64 nt, Homo Sapiens; identical to SEQ ID NO: 68556

SEQ ID NO: 81969 - RNA, 64 nt, Homo Sapiens; identical to SEQ ID NO: 68557

SEQ ID NO: 81970 - RNA, 64 nt, Homo Sapiens; identical to SEQ ID NO: 68558

SEQ ID NO: 81971 - RNA, 62 nt, Homo Sapiens
uucccaguaaagauaccaugcuaauaaguggcacagcuaauauaauuugccuaaggucacag

SEQ ID NO: 81972 - RNA, 62 nt, Homo Sapiens
aguggcacagcuaauauuccuugccuaaggucacagcuaauaggccagauaagugaaguaau

SEQ ID NO: 81973 - RNA, 62 nt, Homo Sapiens
cagcucuuuagauucccugucuguguauguacacagcuaacauugaccuuuucucagauaau

SEQ ID NO: 81974 - RNA, 62 nt, Homo Sapiens
uauuuuuuaaaaugcauugccauuuuuaauuuacagcuaaaaugccaaggguacauuauggc

SEQ ID NO: 81975 - RNA, 62 nt, Homo Sapiens
uucucuagaaugagcacaaaacaaaucgaauaacagcuaaacaaaucgaauaacagcuaaac

SEQ ID NO: 81976 - RNA, 62 nt, Homo Sapiens
acaaaucgaauaacagcuaaacaaaucgaauaacagcuaaacgaaucgaauaacagcuuuug

SEQ ID NO: 81977 - RNA, 62 nt, Homo Sapiens
ugcuuuaugccaaacauguuuauuuuuaucacacagcuaaagucuguaguuaaguugcugcu

SEQ ID NO: 81978 - RNA, 62 nt, Homo Sapiens
acaaggcaggaaaagggauggaauugauggugacagcuaagucugucuuuuuucuuaggaaa

SEQ ID NO: 81979 - RNA, 62 nt, Homo Sapiens
uauugcuaauaccaaaaaugaaagaggccaucacagcuaauccuauggucaccaaaaggauu

SEQ ID NO: 81980 - RNA, 62 nt, Homo Sapiens
aaguugguaaagaacauacuacaaaaaacccuacagcuaacauuauccuugauguuuccaac

SEQ ID NO: 81981 - RNA, 62 nt, Homo Sapiens
gcaggacaugcugaagccaaagccaauaacacacagcuaacacacagcucccauaaccgcug

SEQ ID NO: 81982 - RNA, 62 nt, Homo Sapiens
aggcaaugccauccucaaacacugcaggcaucacagcuaacaauugugaagucgucuuaacu

SEQ ID NO: 81983 - RNA, 62 nt, Homo Sapiens
ugugagugcaucucuucuuuccuuuagucuucacagcuaacucuggagagcuucaaaacuag

SEQ ID NO: 81984 - RNA, 62 nt, Homo Sapiens
ggaugaguugccccgggcugcaaauuaagaguacagcuaagugcggggguggcgguggaggg

SEQ ID NO: 81985 - RNA, 62 nt, Homo Sapiens
aguacuaacugauuuagagguauagauucaugacagcuaauuucuucagugauuccuuuuac

SEQ ID NO: 81986 - RNA, 62 nt, Homo Sapiens
uaucagaaugaaagcaagguuugacuggauugacagcuaaagagacuuaacaacaaccggua

SEQ ID NO: 81987 - RNA, 64 nt, Homo Sapiens
aaggcagcaucccucugacaggggggcaguugugaggccacagagugccuugacacaaagauua

SEQ ID NO: 81988 - RNA, 64 nt, Homo Sapiens
gcuaguuugggugaaguucacuccagcaagucucaggccacaauggggugguuugguuugguuu

SEQ ID NO: 81989 - RNA, 64 nt, Homo Sapiens
accaauuuucucgauuuaaagguauuugcugccaaggccacaucaaugagguaaaggcuuucug

SEQ ID NO: 81990 - RNA, 64 nt, Homo Sapiens
ccacugcccccgaggccagaccuggggaggaccgaggccacacgcacagcgcccuccagaguua

SEQ ID NO: 81991 - RNA, 64 nt, Homo Sapiens
acaugaugggcuguucuauaccuggguuaaacugaggccacaggugcaguuuguuuuaacaaau

SEQ ID NO: 81992 - RNA, 64 nt, Homo Sapiens
aggauguuauuuuaugaagaagucucugaucuauaggccacaucgacccagauagaaaauauaa

SEQ ID NO: 81993 - RNA, 64 nt, Homo Sapiens
aacucagccucgcaagagguggcagaggcacaggaggccacaguccuuccuggggcauuccagg

SEQ ID NO: 81994 - RNA, 64 nt, Homo Sapiens
uuuccaucuccccagcgggggcucccugggugaaaggccacaguauuuuggguugguaggcaaa

SEQ ID NO: 81995 - RNA, 64 nt, Homo Sapiens
gauuauucuucagacagugagcagucaaguguucaggccacacagucagcccaggaaaaagaga

SEQ ID NO: 81996 - RNA, 64 nt, Homo Sapiens
gacucccauccauccucugacaaggaagaaggugaggccacauccgauucugaaucagagguua

SEQ ID NO: 81997 - RNA, 64 nt, Homo Sapiens
aagucccuacgccucccugcagcugugauagagcaggccacacaagaucuguaauucucccagg

SEQ ID NO: 81998 - RNA, 64 nt, Homo Sapiens
aggacaggccgggacaggcccccagcccugccccaggccacagcgagcagggacuggaggcacc

SEQ ID NO: 81999 - RNA, 64 nt, Homo Sapiens
ggccccacccccacaguuccacgccccccccccaaggccacacccucccucccuagagcagcag

SEQ ID NO: 82000 - RNA, 64 nt, Homo Sapiens
cugcucugggcugcagcuuccagcacugaaucagaggccacacagcccaaagauuagcuucaug

SEQ ID NO: 82001 - RNA, 64 nt, Homo Sapiens
uugugcccgcucuuggggcugcccugugguacccaggccacacggccccugucccucucuucug

SEQ ID NO: 82002 - RNA, 64 nt, Homo Sapiens
gcccaguguguccaaccagccuuucaugucccacaggccacagauugcugucccuggguccccu

SEQ ID NO: 82003 - RNA, 64 nt, Homo Sapiens
auaguuuaaugaaucauuacauuuauaauaacaaaggccacaauuuaauuaauugguaagauau

SEQ ID NO: 82004 - RNA, 64 nt, Homo Sapiens
cuauaugcgaaauuguuaauuuuaaaauaaccucaggccacagacuuguaguaaucauuugaag

SEQ ID NO: 82005 - RNA, 64 nt, Homo Sapiens
uccacaccugccaugggaugcagagagcauuucaaggccacagcacagcacacacauacacaca

SEQ ID NO: 82006 - RNA, 64 nt, Homo Sapiens
ugauuaugaagucacccuguuuacuuuauuuuacaggccacaauugaaaugaaaauacugugua

SEQ ID NO: 82007 - RNA, 64 nt, Homo Sapiens
gaggcccgggucagagcccugggggugagccugaaggccacagagaaagaaccuugcccaaacu

SEQ ID NO: 82008 - RNA, 64 nt, Homo Sapiens
aggcacacaaacgaggaaugaggggcuucacgagaggccacagggccuggcuggccacgcuguc

SEQ ID NO: 82009 - RNA, 58 nt, Homo Sapiens
ccuacuacccaucugggugacccggggcaggccacagaggccaggccagggcuggaag

SEQ ID NO: 82010 - RNA, 64 nt, Homo Sapiens
gcuaagacaggacgauugugguccucccacacuaaggccacagcccauccgcgugcuguguguc

SEQ ID NO: 82011 - RNA, 64 nt, Homo Sapiens
aggaacugccccacuggccacuguccauggaaucaggccacagcggggagugagaugaguggug

SEQ ID NO: 82012 - RNA, 64 nt, Homo Sapiens
aaagacaguuaaagcaaagacuuugaagacuuugaggccacagacugagaacaccaagucuccc

SEQ ID NO: 82013 - RNA, 64 nt, Homo Sapiens
aggccucucuuugugggaaucuugggccucuagaaggccacaguaucugggccaaccagggguc

SEQ ID NO: 82014 - RNA, 64 nt, Homo Sapiens
agaggccccccauccucacauuacgauguucccuaggccacaagcagucuggaccagugugacc

SEQ ID NO: 82015 - RNA, 64 nt, Homo Sapiens
guggacuuugagcugaacaugcccacuggcccccaggccacaugggaccuggaggagccuaccu

SEQ ID NO: 82016 - RNA, 64 nt, Homo Sapiens
agagcuggggggcagagguaaagcccugcaggggaggccacaggguccaucccgucuucaggau

SEQ ID NO: 82017 - RNA, 63 nt, Homo Sapiens
gagaggcaaaaauucuaaagagcccacuggaguugcaaggaaugaaaacuggaucaagauucu

SEQ ID NO: 82018 - RNA, 63 nt, Homo Sapiens
uuucuuuuaaauucugaacuaagacauucuuucugcaaggaaaaauuaagaggggccaagagg

SEQ ID NO: 82019 - RNA, 63 nt, Homo Sapiens
aaaauaacugugccccaagaagugcuccagauuugcaaggaauagccccaagagaauaccaag

SEQ ID NO: 82020 - RNA, 63 nt, Homo Sapiens
agacaagcaggcuguucccuggaaaaaaucuaaugcaaggagggcuaguucacagcaaauuca

SEQ ID NO: 82021 - RNA, 63 nt, Homo Sapiens
ccagguuccccucuggugucaugucaggcauuuugcaaggaaaagccacuuggggaaagaugg

SEQ ID NO: 82022 - RNA, 62 nt, Homo Sapiens
uuuccauuggcccucgggugagcugaggguuuuugcaaggaaguugugguggccaagugugg

SEQ ID NO: 82023 - RNA, 63 nt, Homo Sapiens
uaauuuuuaaguugaauccccaaacuuugaaagugcaaggauuacucauuuugaauugaguuu

SEQ ID NO: 82024 - RNA, 63 nt, Homo Sapiens
uccugccuucagacugaagaagagcugcucugcugcaaggauuuuuuauuuuugugaaauucu

SEQ ID NO: 82025 - RNA, 63 nt, Homo Sapiens
cuuuccgcccucccuuggauaagcugacugaguugcaaggaccaauaagcaauaagaggcucu

SEQ ID NO: 82026 - RNA, 63 nt, Homo Sapiens
ucuguuccaaaggcugggaacugcuggugcuggugcaaggacugucugcuuuucagggauucu

SEQ ID NO: 82027 - RNA, 63 nt, Homo Sapiens
gaagcaggguggggcguaaccucaccugggaagugcaaggagucggggaucucccuccccuag

SEQ ID NO: 82028 - RNA, 63 nt, Homo Sapiens
uccucugagcuaaaggagcauguucuaacccaaugcaaggaagcuaagaaccuugaaaaaagg

SEQ ID NO: 82029 - RNA, 63 nt, Homo Sapiens
uaaugagaagcccaggaaauuguuuggggaagaugcaaggaaguaccucauagaugugggcuc

SEQ ID NO: 82030 - RNA, 63 nt, Homo Sapiens
cuguagcauggcaaaucugcgccuuccccagccugcaaggagcccagcccaaugccccagcug

SEQ ID NO: 82031 - RNA, 64 nt, Homo Sapiens
cagugucuuaaggagacugguaggaggaggcauggaaaccaaaaggccguguguuuagaagccu

SEQ ID NO: 82032 - RNA, 64 nt, Homo Sapiens
aaacaaaugcuuguugauagccuuuuucuaucaagaaaccaaggagcuaauuauuaauaacaau

SEQ ID NO: 82033 - RNA, 64 nt, Homo Sapiens
uuccuggaaucaaggaauccugagucugggcaaugaaaccaaagccaggaguugacgcauccug

SEQ ID NO: 82034 - RNA, 64 nt, Homo Sapiens
uucuuggcaguauuccaugggauguuaagcaaaggaaaccaaaggaaucguuucaaauggacuc

SEQ ID NO: 82035 - RNA, 64 nt, Homo Sapiens
uuuuucaggaugcuguauuuugccucguaggguagaaaccaauaaaaugugaacguuuucuaac

SEQ ID NO: 82036 - RNA, 64 nt, Homo Sapiens
uaagaacugaaugacagugagcaguuaaucugcugaaaccaaaggauacauucuucagcauuug

SEQ ID NO: 82037 - RNA, 64 nt, Homo Sapiens
aauguuucuuaaaaguuuuugagaaaaaaaggaagaaaccaacucauucagaaggcucggauuc

SEQ ID NO: 82038 - RNA, 64 nt, Homo Sapiens
guccaggaguccaaguagaucucgaaguaaaucugaaaccaaaucaagacacagaacaaggucu

SEQ ID NO: 82039 - RNA, 64 nt, Homo Sapiens
auggaugcuguuuuuauuggaauugggagauaaugaaaccaaucugguggugucaccacuacuu

SEQ ID NO: 82040 - RNA, 64 nt, Homo Sapiens
uuuaaaauguuggucuagguuuuaacauauuuaagaaaccaauauuauguucuguuaaugggaa

SEQ ID NO: 82041 - RNA, 64 nt, Homo Sapiens
ucuguuucuuggugguuauguauacuauauugcagaaaccaauacuggauugauuguggacuuu

SEQ ID NO: 82042 - RNA, 64 nt, Homo Sapiens
cccucaugguaguauuuccuauaacuagaagguggaaaccaaaaaacuuucuaacagaacuucc

SEQ ID NO: 82043 - RNA, 64 nt, Homo Sapiens
ucuaaacucguccccagaggaggacuugaaugaggaaaccaacacuuugagaaaccaaaguccu

SEQ ID NO: 82044 - RNA, 64 nt, Homo Sapiens
gaggaggacuugaaugaggaaaccaacacuuugagaaaccaaaguccuuuuucccaaagguucu

SEQ ID NO: 82045 - RNA, 64 nt, Homo Sapiens
acuaguuugaaaucguuuauaccauacccaucuagaaaccaagaaagcuaaagaagacuaugau

SEQ ID NO: 82046 - RNA, 64 nt, Homo Sapiens
cuaaauaauuacaccaacuuggucucauuacaaugaaaccaaucaauccaagugacugugaaaa

SEQ ID NO: 82047 - RNA, 64 nt, Homo Sapiens
ucuuuuugaaucucucaaacggcaacauuccucagaaaccaaagcuuuauuucaaaucucuucc

SEQ ID NO: 82048 - RNA, 64 nt, Homo Sapiens
aucucuguugcuaacacacagagcucaccuguuugaaaccaagcuuucaaacauguugaagcuc

SEQ ID NO: 82049 - RNA, 64 nt, Homo Sapiens
uuuggggaauuuuggccaggagacccugaaacaugaaaccaaacaggcuuugauauuuuuuuuu

SEQ ID NO: 82050 - RNA, 64 nt, Homo Sapiens
cuguggcuuugagaaguuaacuuuuguggaauaugaaaccaaaggaagaauuuccauguagaua

SEQ ID NO: 82051 - RNA, 64 nt, Homo Sapiens
caugggaauuacauaaggauaaugaggcccaacugaaaccaaguuucagucugccuuaccuuua

SEQ ID NO: 82052 - RNA, 64 nt, Homo Sapiens
aagucagcauguaagcgucaaccaagcaucuauagaaaccaagaauuuuaguuuuauuuuugaa

SEQ ID NO: 82053 - RNA, 64 nt, Homo Sapiens
aucuauagaaaccaagaaaguuaguuuuauuuuugaaaccaagcgauuuggaauuuuuguuauu

SEQ ID NO: 82054 - RNA, 64 nt, Homo Sapiens
acuuggccucacuaccagaagaaggguggagucagaaaccaaagugaccuccagagcuguccuc

SEQ ID NO: 82055 - RNA, 64 nt, Homo Sapiens
gagcaaauauuguucuucccauuuuacagauucagaaaccaaggcuaagggacuggucuaaagu

SEQ ID NO: 82056 - RNA, 64 nt, Homo Sapiens
gccuucaaugaaacaagccuuauaaauugccauggaaaccaagugaaaccaaaccaccaucuuu

SEQ ID NO: 82057 - RNA, 64 nt, Homo Sapiens
caccaucuuuuauaaauugcucuguuccaaugaagaaaccaaacugaacacccaaacuacguca

SEQ ID NO: 82058 - RNA, 64 nt, Homo Sapiens
gguccuugugaugguauuacuuuuuacaaagaaugaaaccaaauggacucagcccucucccaca

SEQ ID NO: 82059 - RNA, 64 nt, Homo Sapiens
guuguccccauugucuacccacacaaauccucaggaaaccaaccaccgcccagguggcccugag

SEQ ID NO: 82060 - RNA, 64 nt, Homo Sapiens
auugaaauaagcucuuugcaggcguccaauccuagaaaccaauggucuccagaacucucacaca

SEQ ID NO: 82061 - RNA, 64 nt, Homo Sapiens
aauuccucuuauucuuaaauaucuaaagggaaaggaaaccaacuuuaauuucagaacuucucuu

SEQ ID NO: 82062 - RNA, 64 nt, Homo Sapiens
agacuuaauaaaagcuuaggauuaauuagaagaagcaaucuaguuaaauuucccauuuguauuu

SEQ ID NO: 82063 - RNA, 64 nt, Homo Sapiens
auauucuucuuugauaguguaaacaaauaauaaagcaaucuagguccuuuagguuugaaaggca

SEQ ID NO: 82064 - RNA, 64 nt, Homo Sapiens
uuuuuuuuuuuuuuaaguuuggcagaaacuuugagcaaucuagguuuaccauuccuacaaaaga

SEQ ID NO: 82065 - RNA, 64 nt, Homo Sapiens
agcgccaaaauucgcuaugucagaaauuuucagagcaaucuaaaggcugcuauggucaacucuu

SEQ ID NO: 82066 - RNA, 64 nt, Homo Sapiens
aaacuguauuuuggaagauaaaauuucuuuuguagcaaucuaggaaugauuuaaauuucuuauc

SEQ ID NO: 82067 - RNA, 64 nt, Homo Sapiens
gcuuucauaccaaaugucacucuacaugaaaauugcaaucuaaaagaugugauaugaagcuacu

SEQ ID NO: 82068 - RNA, 64 nt, Homo Sapiens
aaugguaggccauucugaacuuucuggcacauaagcaaucuaaauuuuuuuauugacuguauau

SEQ ID NO: 82069 - RNA, 64 nt, Homo Sapiens
auaugcauguuaacaacauuaaaaacagcaaacagcaaucuaaguacagaaaagcuuuuugugu

SEQ ID NO: 82070 - RNA, 64 nt, Homo Sapiens
uguccuacagucccugaucuuucauggcugagcugcaaucuaacacuuuacuguaccuuuauaa

SEQ ID NO: 82071 - RNA, 64 nt, Homo Sapiens
aacaacagccacaaaagagaaaaucaagaguguugcaaucuauaacaguaauauugauucauuc

SEQ ID NO: 82072 - RNA, 64 nt, Homo Sapiens
aaguauuccauuuagauuugauagauaugcuuaagcaaucuauaaaucauuuucaauguuauaa

SEQ ID NO: 82073 - RNA, 64 nt, Homo Sapiens
aagacugucuuuaccagaaucugugugaaauaaggcaaucuagucuccuugaaaaaaaaaucuc

SEQ ID NO: 82074 - RNA, 64 nt, Homo Sapiens
caaacaccuuucccauaaagacacuaaauagcuagcaaucuaugugggggcucuguuuuccugc

SEQ ID NO: 82075 - RNA, 64 nt, Homo Sapiens
uuauaugaacuuuuuugguuuagugugaauaugagcaaucuauuaaaaacaacguauuccuuug

SEQ ID NO: 82076 - RNA, 64 nt, Homo Sapiens
uuucccccuuuuuaaguuaguaucuuuaggugaugcaaucuaugacaugcaaauuagagcaugc

SEQ ID NO: 82077 - RNA, 64 nt, Homo Sapiens
gcaugugggccaaauccagcuguagcauggguuggcaaucuacacaggcuuuuaagguauauuu

SEQ ID NO: 82078 - RNA, 64 nt, Homo Sapiens
auaguacuccagaucucuuuugagcauuaaagcugcaaucuacuugacuggauguuuaauggga

SEQ ID NO: 82079 - RNA, 64 nt, Homo Sapiens
acaacaguauuugacccauuagcgauccauaguugcaaucuaaauaacacuguacccuugauac

SEQ ID NO: 82080 - RNA, 64 nt, Homo Sapiens
caggggucuggucucuuugaauggugcgaguauggcaaucuaaggugagggaggcagguuugga

SEQ ID NO: 82081 - RNA, 64 nt, Homo Sapiens
gaugcaauaaauaugaugacuucuguuucaaaaugcaaucuaaagcuguggugcacuauuaauu

SEQ ID NO: 82082 - RNA, 64 nt, Homo Sapiens
cuaaagaaaaaagaaaagcaaggaggaggguugagcaaucuagagcauggaguuuguuaagugc

SEQ ID NO: 82083 - RNA, 64 nt, Homo Sapiens
gcuuucuuaagccucauuaagaaaaaaacugaaagcaaucuauccuugugugccacugguguuc

SEQ ID NO: 82084 - RNA, 64 nt, Homo Sapiens
guuuagccuuuuuaaaaaugagagagcaaauacagcaaucuagaagcacuuuguuaaucuccag

SEQ ID NO: 82085 - RNA, 64 nt, Homo Sapiens
aucuuugagugcuuggcuuuaaagagaacccagagcaaucuagacuguuagaaagaaacuaaca

SEQ ID NO: 82086 - RNA, 64 nt, Homo Sapiens
uuguggcuugaaggacugcagagcacaccgaagggcaaucuaaauaauaugaaccaacaaucug

SEQ ID NO: 82087 - RNA, 64 nt, Homo Sapiens
ggagucauuuuuuaagugacgaugguaaucugaggcaaucuaagggcagcuuuuucaaaguguu

SEQ ID NO: 82088 - RNA, 64 nt, Homo Sapiens
uugcaggauacauagccccaaagauggucuaggagcaaucuaagcuguguuacuccaaaggaca

SEQ ID NO: 82089 - RNA, 64 nt, Homo Sapiens
acuagccccuauauuuuaauguaagaguuacucugcaaucuaagcaaagcacccaacaauggua

SEQ ID NO: 82090 - RNA, 64 nt, Homo Sapiens
guuccauuccaaucauauccuggcaguuuuuucugcaaucuauucagagccauuuuuguuaaag

SEQ ID NO: 82091 - RNA, 64 nt, Homo Sapiens
uacucauuuugcuuucaauccagucaaaauauuugcaaucuaucgaagggaggaaaaauaauua

SEQ ID NO: 82092 - RNA, 64 nt, Homo Sapiens
gauguccucuaggaauuuuuuuucuaguaauuuugcaaucuaccuaauaaguaccuaaauacgc

SEQ ID NO: 82093 - RNA, 64 nt, Homo Sapiens
uaguguauuaaaaguuaaguauaauuauuuuaaugcaaucuaauacaaucagauuacucaguug

SEQ ID NO: 82094 - RNA, 64 nt, Homo Sapiens
uuuggucuaggcuucauuuugauaugacugaauugcaaucuauauuuuuaaaaagaaaaaucaa

SEQ ID NO: 82095 - RNA, 64 nt, Homo Sapiens
uauaauuuuuuaauuaaugucacaaagcucuagugcaaucuaguugaaugcagaugccugugcc

SEQ ID NO: 82096 - RNA, 64 nt, Homo Sapiens
uuacauagugcuuacauuguauuagguguuauaagcaaucuagagaugauuuagcaaguauaca

SEQ ID NO: 82097 - RNA, 64 nt, Homo Sapiens
gggucaacugacauccauuguuuuuaauacauuagcaaucuauucauugcaacacccuaaauug

SEQ ID NO: 82098 - RNA, 64 nt, Homo Sapiens
uuaccagcgcuggauccuuuggcaaaggccuucagcaaucuauacuguugccugguggaaagaa

SEQ ID NO: 82099 - RNA, 64 nt, Homo Sapiens
auagguuaauguagauaggauguuuugugaaaaagcaaucuauuguguccaaauaaaaaaacaa

SEQ ID NO: 82100 - RNA, 64 nt, Homo Sapiens
auuuuauauuuauaaugugcaucaacaugugaaagcaaucuaggucacuagcacagaggaaguu

SEQ ID NO: 82101 - RNA, 64 nt, Homo Sapiens
aguauauggccguuuuuuaucaugucuuaaaaaugcaaucuaaugguaauucuaugcaaguuug

SEQ ID NO: 82102 - RNA, 64 nt, Homo Sapiens
ucucacaaauaacaggggugaauguuucucucuagcaaucuaggcaggugcugguguuucaucu

SEQ ID NO: 82103 - RNA, 64 nt, Homo Sapiens
guacaauaucuaaaaagaaagugacaugaaggaagcaaucuacaacuuccuuccgcuuagcgag

SEQ ID NO: 82104 - RNA, 64 nt, Homo Sapiens
uaauaaucuccuaccuaaaaagauaaaauuaauugcaaucuaccauaucuuaaguauaggaaau

SEQ ID NO: 82105 - RNA, 64 nt, Homo Sapiens
acuauuuagagaaccguuguuaauuuuaaaacuagcaaucuauaaagugcaccaggucaacuug

SEQ ID NO: 82106 - RNA, 64 nt, Homo Sapiens
aauuguauguauaaucuguauuugaaaucauuuugcaaucuauggaaauagaguagcaauugcu

SEQ ID NO: 82107 - RNA, 64 nt, Homo Sapiens
uuauauauauugacaaaagauuguguauaucuuugcaaucuauuggaguguaaugcuuauuuuu

SEQ ID NO: 82108 - RNA, 64 nt, Homo Sapiens
cucaaaaaauucagaaacaugggccauaauguaugcaaucuacuauaaaguauuuugagguaaa

SEQ ID NO: 82109 - RNA, 64 nt, Homo Sapiens
guaauuuccauauccuagauccaacucaaaauuagcaaucuaaauauucaaauucucacgccuu

SEQ ID NO: 82110 - RNA, 64 nt, Homo Sapiens
aaaaaaaguuuuguugaaagcgcuauugaauauugcaaucuauauaguguauuggauggcuucu

SEQ ID NO: 82111 - RNA, 64 nt, Homo Sapiens
gacaugcuaccagacauggggaaccauuagaggugcaaucuacauugggcaucuggucauucaa

SEQ ID NO: 82112 - RNA, 64 nt, Homo Sapiens
uuauauagagccuucagaaacuacagaugauauagcaaucuaccgcuuuuauaaaaagugguag

SEQ ID NO: 82113 - RNA, 64 nt, Homo Sapiens
aaaaauuaauuucagcuucauuucguauuucgaagcaaucuagacuguugugaugaguguaugu

SEQ ID NO: 82114 - RNA, 64 nt, Homo Sapiens
ggccuuguccagaggcucaccuggcuggccaguggcaaucuacuugggggagccccacagcuuu

SEQ ID NO: 82115 - RNA, 64 nt, Homo Sapiens
cugaacugaccuugaaucuuaaauucauuugcuugcaaucuaauuuuccauaagcuuggugaca

SEQ ID NO: 82116 - RNA, 64 nt, Homo Sapiens
uguauuguacacgaaaggugaaaauauacugaaugcaaucuagacauugugaagaaugcaguuu

SEQ ID NO: 82117 - RNA, 64 nt, Homo Sapiens
guagauuaucucaggcauugaagcugcccgacuugcaaucuaaucacugucugaauuaaacaaa

SEQ ID NO: 82118 - RNA, 64 nt, Homo Sapiens
aacacuggaaacgcuggguuuuucagauagcaaagcaaucuauauuuuaaauacuaacuggguc

SEQ ID NO: 82119 - RNA, 54 nt, Homo Sapiens
ucuugcaguauaugcucaucuuuggcaaucuauuacguaaccugggcucuguga

SEQ ID NO: 82120 - RNA, 64 nt, Homo Sapiens
uacuguuuaucaaucuaucaugucuuccucucuagcaaucuauucauccaauuaucuacccacc

SEQ ID NO: 82121 - RNA, 64 nt, Homo Sapiens
guaaacuuguaaaaauagagauuugacagacauagcaaucuagucaauguguaaggggucaaaa

SEQ ID NO: 82122 - RNA, 64 nt, Homo Sapiens
ucuucccuguaaaaugcagauuacagguauuaaagcaaucuagugguauacccgccccuugccu

SEQ ID NO: 82123 - RNA, 64 nt, Homo Sapiens
ggagggaggguggcuuugcuguuguugggacauggcaaucuagaccgguagcagcgcucgcuga

SEQ ID NO: 82124 - RNA, 64 nt, Homo Sapiens
acucaccuugcucugccaucguuaaagugaaaaggcaaucuaugagggcccaggccaggagacu

SEQ ID NO: 82125 - RNA, 64 nt, Homo Sapiens
ugccaaagagauagggacgcauaugcuuuuuaaagcaaucuaaaaauaauaauaaguauagcga

SEQ ID NO: 82126 - RNA, 64 nt, Homo Sapiens
gcuauauaaaauguuaaagucugaugcugugaaagcaaucuagugcuauauuucuaccuccuca

SEQ ID NO: 82127 - RNA, 64 nt, Homo Sapiens
ucuaguaugaaauccacacaguggucaucacugugcaaucuacacaccugcuuuuccacgcacu

SEQ ID NO: 82128 - RNA, 64 nt, Homo Sapiens
aaacuacaccaagccuaagauaggacagagaacggcaaucuacacgaauccaaguuucaugugg

SEQ ID NO: 82129 - RNA, 64 nt, Homo Sapiens
ugaaaaaauaucuuaacgacauggggcaaaaagugcaaucuaaaugguagccuuuacuaaugug

SEQ ID NO: 82130 - RNA, 64 nt, Homo Sapiens
guuuaugcaacuuaaaauguguacaaacugcagugcaaucuacuguuggugaaugucaguguau

SEQ ID NO: 82131 - RNA, 64 nt, Homo Sapiens
aggcuggagugcaguggcaggaucucggcucacugcaaucuagguggaggucuuuuuaaauaac

SEQ ID NO: 82132 - RNA, 64 nt, Homo Sapiens
guuggugaaugucaguguauguacaaacugcagugcaaucuacuguuuaugcaacuuaaaaugu

SEQ ID NO: 82133 - RNA, 64 nt, Homo Sapiens
guuugugaaugucuguauuauuacacacuguggugcaaucuacuguuuaugcaacuuaaaaugu

SEQ ID NO: 82134 - RNA, 64 nt, Homo Sapiens
aagagacuuauucuguauuucugaugacuuaagggcaaucuaccccuguugaggaaggauugag

SEQ ID NO: 82135 - RNA, 64 nt, Homo Sapiens
agugguucacguucuaguguuuuuccugaaaugugcaaucuacuguauaguauugccacauaau

SEQ ID NO: 82136 - RNA, 64 nt, Homo Sapiens
uuugcacuucuacuaagcuugauagggcaggagugcaaucuacaauuauuuuaaagugaauuuc

SEQ ID NO: 82137 - RNA, 64 nt, Homo Sapiens
uuaaccgcacaugcacacacacacgcuuucuuaugcaaucuauguuugcacuugugcuuucagu

SEQ ID NO: 82138 - RNA, 64 nt, Homo Sapiens
uccaguuuuuccaagugauacucccaguucuagagcaaucuacagcuguuuaugugaggugccc

SEQ ID NO: 82139 - RNA, 64 nt, Homo Sapiens
uacaguuaucgcagauauucuagcuucauuguaagcaaucuaggaaauaagcccugcugcuuuc

SEQ ID NO: 82140 - RNA, 64 nt, Homo Sapiens
ggaaauguagcacuuacguauuuugaugccaggugcaaucuacuacccuaagaugaagcugagc

SEQ ID NO: 82141 - RNA, 64 nt, Homo Sapiens
cauuuuacauucccaccagcagugcacaaggauugcaaucuauauacauccucaccaacauugu

SEQ ID NO: 82142 - RNA, 64 nt, Homo Sapiens
auuccaggaaucuuccccaaaucccagauccucugcaaucuaccugcaccccugacccacccag

SEQ ID NO: 82143 - RNA, 64 nt, Homo Sapiens
acaaggucaguaaugcugcaggaaaagcaaaauugcaaucuacguaucuaugguacuaaggaag

SEQ ID NO: 82144 - RNA, 64 nt, Homo Sapiens
cuauauuggcuaaauugaaaccuggaauuguggggcaaucuauuaauagcugccuuaaagucag

SEQ ID NO: 82145 - RNA, 64 nt, Homo Sapiens
uuauagaaagcaagauguacuauaacauagaauugcaaucuauaauauuuguguguucacuaaa

SEQ ID NO: 82146 - RNA, 64 nt, Homo Sapiens
auaaugcuaacagaaagaagagaaccguucguuugcaaucuacagcuaguagagacuuugagga

SEQ ID NO: 82147 - RNA, 64 nt, Homo Sapiens
augucuuuaucaagggucagaucacaucaguuuggcaaucuaaguuuuaguucuuacaguggua

SEQ ID NO: 82148 - RNA, 64 nt, Homo Sapiens
uugaucagucucucagugggaaagacaggauugugcaaucuaagggggccuuuuucugucucau

SEQ ID NO: 82149 - RNA, 64 nt, Homo Sapiens
aaaagucagucagggugaaaauaacaaguaagaugcaaucuagccucuuuagacuacucuuuga

SEQ ID NO: 82150 - RNA, 64 nt, Homo Sapiens
gcagggugggauggggaagaccaggagcagagucgagccucacagaagccagcgcgggucucug

SEQ ID NO: 82151 - RNA, 64 nt, Homo Sapiens
ggguaacagccccaguucaucccaaccccucucagagccucaagagggguagcucggcugccgg

SEQ ID NO: 82152 - RNA, 64 nt, Homo Sapiens
ccucuggaacgugcagucauccaccugauuacaagagccucauucagaagcaguagacaaugaa

SEQ ID NO: 82153 - RNA, 64 nt, Homo Sapiens
ccuagucucaauggaagaagcggcauuucaguaagagccucaggcuaaggaguuagagagguac

SEQ ID NO: 82154 - RNA, 64 nt, Homo Sapiens
gcagccccaccccacccugccccuuguccucucagagccucagcuucugggggagacaugcucu

SEQ ID NO: 82155 - RNA, 64 nt, Homo Sapiens
ggcuucugcagcuuuggcugcacgucacccuccugagccucaccuuuccugccgucccuccugu

SEQ ID NO: 82156 - RNA, 64 nt, Homo Sapiens
acggacagcguuguucacccagagccuuacuugggagccucacugaacgccugcucugguugaa

SEQ ID NO: 82157 - RNA, 64 nt, Homo Sapiens
cccugcccgauccaccguccugaggcagaguguugagccucauaccuguaccagguccccggcc

SEQ ID NO: 82158 - RNA, 64 nt, Homo Sapiens
auuagcacaggaguagcagcagcaggacaggcaagagccucacaagugggacucugggccucug

SEQ ID NO: 82159 - RNA, 64 nt, Homo Sapiens
cuagaugcugccccaaggaguugcugcaguucuggagccucaucuggcugggaucuccaagggg

SEQ ID NO: 82160 - RNA, 64 nt, Homo Sapiens
cugcagcucccaucuccagcuauuccuaggcaaagagccucauggcuaaggcagccucaaagcc

SEQ ID NO: 82161 - RNA, 64 nt, Homo Sapiens
gggcuuuagccaagccaccuacugccaggaauuggagccucaguucccuccugugucaaguagc

SEQ ID NO: 82162 - RNA, 64 nt, Homo Sapiens
aaucuguuugauuggauauuuggcacagccccuggagccucagaugcccuccugggcccugggc

SEQ ID NO: 82163 - RNA, 64 nt, Homo Sapiens
cagccucagagaucucccuucaccagggcuccaggagccucaucccucacuccuccgugagcac

SEQ ID NO: 82164 - RNA, 64 nt, Homo Sapiens
guagaguagaaagguacugguacacugagcuucugagccucauugccuccuggggauggggugg

SEQ ID NO: 82165 - RNA, 64 nt, Homo Sapiens
cuaucagucaguagagagagaagaagccuguucugagccucacccucagccucucugagcuugg

SEQ ID NO: 82166 - RNA, 64 nt, Homo Sapiens
augacucccauccucuccucaucuccccuuugacgagccucaaacugcucagcucaucaaagag

SEQ ID NO: 82167 - RNA, 64 nt, Homo Sapiens
uggucaaaagucagcugccagcccugcggaaccagagccucaggcugggauggggaggccuccc

SEQ ID NO: 82168 - RNA, 64 nt, Homo Sapiens
uaccuauguccugagcccugacacucccacaccugagccucagauuccaauagcucacucccua

SEQ ID NO: 82169 - RNA, 64 nt, Homo Sapiens
ucccuagagccugacgccggggccccugaccccugagccucagauuccaauaccucacucccca

SEQ ID NO: 82170 - RNA, 64 nt, Homo Sapiens
aaaggaaaaagagugaugagaagagaauggagagaauuugaauaaaaggugggaaaggagagca

SEQ ID NO: 82171 - RNA, 64 nt, Homo Sapiens
uaggcuuaacauaaagccgaagaagguaccuagaaauuugaaacuucccuaaaaagcuccuaau

SEQ ID NO: 82172 - RNA, 64 nt, Homo Sapiens
ccuuaaaaaguugauuuccuugaagcaguuugaaaauuugaauugagucuuaacuuuaggaaau

SEQ ID NO: 82173 - RNA, 64 nt, Homo Sapiens
ucagacucuuuuaaggguauuuuaaaaauuaguaaauuugaaugaacuaaagauauaucucuac

SEQ ID NO: 82174 - RNA, 64 nt, Homo Sapiens
uauacauguauguauauacacuuuauauguauauaauuugaauauaucuugaaucuacaaauau

SEQ ID NO: 82175 - RNA, 64 nt, Homo Sapiens
agucaugcuuuccuagaauuagcauggaaaauccaauuugaauaacaucuguaaaacuaaauau

SEQ ID NO: 82176 - RNA, 64 nt, Homo Sapiens
uggaacaggaaacuagagugcaggaugauuguuuaauuugaagaaaaaaguuuucuagaauaag

SEQ ID NO: 82177 - RNA, 64 nt, Homo Sapiens
auaaaaccagaggaaaugcauuaaguauuuucuuaauuugaauaaagcuguuaccaaaaaauuu

SEQ ID NO: 82178 - RNA, 64 nt, Homo Sapiens
cuuuaaagggaagaagggacuuuaacauccuaugaauuugaaacauccuaugaauuugaaaguu

SEQ ID NO: 82179 - RNA, 64 nt, Homo Sapiens
acuuuaacauccuaugaauuugaaacauccuaugaauuugaaaguuuccuaaguguuguuuuca

SEQ ID NO: 82180 - RNA, 64 nt, Homo Sapiens
cuauuuuauuaagauggaaauuucuuuuuaggcuaauuugaaauccaacugaagcuuuuuaacc

SEQ ID NO: 82181 - RNA, 64 nt, Homo Sapiens
gaaauccaacugaagcuuuuuaaccaauauuuuaaauuugaaccacuagaguuuuuuaugaugc

SEQ ID NO: 82182 - RNA, 64 nt, Homo Sapiens
ucuucuguugugugcuuuucaaacacuguaaauaaauuugaaauuugaauaacuuuccacagua

SEQ ID NO: 82183 - RNA, 62 nt, Homo Sapiens
uugugugcuuuucaaacacuguaaauaaauuugaaauuugaauaacuuuccacaguauaacu

SEQ ID NO: 82184 - RNA, 64 nt, Homo Sapiens
acauuuauauaucuacaaaaauauggagaagaguaauuugaaagccuacuuucugaagaaaaug

SEQ ID NO: 82185 - RNA, 64 nt, Homo Sapiens
uaguuugaugaauaauuuaaagaaaaacaccuaaaauuugaaaaaugauuguaggaucaaaaaa

SEQ ID NO: 82186 - RNA, 64 nt, Homo Sapiens
ccuugcuguuacaaauuggaauacgaauugucuuaauuugaaaacgugcagcaauugcuacucu

SEQ ID NO: 82187 - RNA, 64 nt, Homo Sapiens
gaguuuuuuuccccccauaaucguaagagcuuugaauuugaagugugacaagaugagagcagaa

SEQ ID NO: 82188 - RNA, 64 nt, Homo Sapiens
aaaucuugauuacuaauuacuauuuguuaauuugaauuugaagaauuauuuagauuaacaaaca

SEQ ID NO: 82189 - RNA, 64 nt, Homo Sapiens
ugaagaaaaucuugauuacucaaacauauuuguuaauuugaauuauguauauuauuuagauuaa

SEQ ID NO: 82190 - RNA, 64 nt, Homo Sapiens
auuuaugucagucuuagauaauuuaaggaagaauaauuugaaaggaauuuauaugaaugucuau

SEQ ID NO: 82191 - RNA, 64 nt, Homo Sapiens
caaaaccguggaauccuaacugaguuccuaaaugaauuugaagguuugaaaagccacagagucu

SEQ ID NO: 82192 - RNA, 64 nt, Homo Sapiens
uaaaaugcuaugggcaacacaaucaugcaauuauaauuugaaaauauuuccuuuaaagacagag

SEQ ID NO: 82193 - RNA, 64 nt, Homo Sapiens
cauugucuuugugguagcauuaucuuagacauuaaauuugaaguaacauauauccuguaguaac

SEQ ID NO: 82194 - RNA, 64 nt, Homo Sapiens
gaaacaguaaacuguaacuaaacacuucaacaugaauuugaaaauaaauaauuguggauauaaa

SEQ ID NO: 82195 - RNA, 64 nt, Homo Sapiens
uauaugagaagagaacugacugaacuugggaaauaauuugaacaaaaagauaaaucuucacaga

SEQ ID NO: 82196 - RNA, 64 nt, Homo Sapiens
uuguauguuuuauuuuuuaaggaugugugccuucaauuugaaaaaaacuugccaguaccaacug

SEQ ID NO: 82197 - RNA, 64 nt, Homo Sapiens
uuauguugaggacaugacauauggacaguaaaugaauuugaacugaucuggaugcuuaaguguc

SEQ ID NO: 82198 - RNA, 64 nt, Homo Sapiens
cuguaucacuuaauuuuuaccuuauuuuggcucuaauuugaauaagcugaguaaaaccaccaaa

SEQ ID NO: 82199 - RNA, 64 nt, Homo Sapiens
auauguaccauguuguuacauguaaacaaacuucaauuugaagugcagcuauuaugugguaucc

SEQ ID NO: 82200 - RNA, 64 nt, Homo Sapiens
aggccagcauuuaugguagauuuuccaaaaucauaauuugaagaaucccucuguauggguuaga

SEQ ID NO: 82201 - RNA, 64 nt, Homo Sapiens
uaaauuuaucauuuaguuauaaacguauucaaacaauuugaauauuguacucugaaaguuuugg

SEQ ID NO: 82202 - RNA, 64 nt, Homo Sapiens
caguggacauugggauuguugcuugaaaaauuaaaauuugaauauuuucucucucauuugcauc

SEQ ID NO: 82203 - RNA, 64 nt, Homo Sapiens
uuuuuucuuuuggagggacaagaugaaaauauauaauuugaauugauuaaaauuggucguuacu

SEQ ID NO: 82204 - RNA, 64 nt, Homo Sapiens
cuuuuaaagaucaucucuucagagcugcaugguaaauuugaauuuccccauuguucucuagagc

SEQ ID NO: 82205 - RNA, 64 nt, Homo Sapiens
uauuacuauauggaaaugaauugcucugugcugaaauuugaagaccagauaaugaaacugaaaa

SEQ ID NO: 82206 - RNA, 64 nt, Homo Sapiens
auggucuugcauuuuaaaagcuuaugggaaacucaauuugaaaugauuagaaaaugucaaguau

SEQ ID NO: 82207 - RNA, 64 nt, Homo Sapiens
uaagugauagcucacuuguauggugcccauuaugaauuugaaguaacccaaaucaaagauaauu

SEQ ID NO: 82208 - RNA, 64 nt, Homo Sapiens
gugcaacuccuguguaaagucuguuuugcagcagaauuugaauuuuauagugaggcacaucuca

SEQ ID NO: 82209 - RNA, 64 nt, Homo Sapiens
cccaauuuuaaucugaaaauuuaucauguuuuauaauuugaauuaaaguuuugucccccccccc

SEQ ID NO: 82210 - RNA, 64 nt, Homo Sapiens
auacauuuuauaauuucuuuuggaauguaaaucaaauuugaauaaaaaucuuacacgugaaauu

SEQ ID NO: 82211 - RNA, 64 nt, Homo Sapiens
guauaucuauaugaucuugauauuguuuuauaauaauuugaagucuaaaagacugcauuuuuaa

SEQ ID NO: 82212 - RNA, 64 nt, Homo Sapiens
ucaaaccuaagcauauuugaauaugaucucccauaauuugaaauugaaaucguauuguguggcu

SEQ ID NO: 82213 - RNA, 64 nt, Homo Sapiens
auaaaugaacucaaucuaaauuaaaaaagaaagaaauuugaaaaaacuuucucuuugccauuuc

SEQ ID NO: 82214 - RNA, 64 nt, Homo Sapiens
caguuucauuaacuccuucccccgcucccccaaaaauuugaauuuuuuuuucaacacucuuaca

SEQ ID NO: 82215 - RNA, 64 nt, Homo Sapiens
gccuguacugcaauuuuauaccagugaaaugccaaauuugaaagaucuugguuguuguauugua

SEQ ID NO: 82216 - RNA, 64 nt, Homo Sapiens
uuaugucgggacauacccuauuguguuauuguacaauuugaaaacauggccuuaacaaaguugu

SEQ ID NO: 82217 - RNA, 64 nt, Homo Sapiens
ugauuuaauugagccaaauuugggucagaacacaaauuugaagaugacuuuucaguauaugaug

SEQ ID NO: 82218 - RNA, 64 nt, Homo Sapiens
uucuuuguugagucacaaaucuugagccagucagaauuugaaccuaagauuuuugacugcuggu

SEQ ID NO: 82219 - RNA, 64 nt, Homo Sapiens
uucuuuaacagauugcagcacaucccuguaauuuaauuugaagauguuugaguuaaaaaccaaa

SEQ ID NO: 82220 - RNA, 64 nt, Homo Sapiens
ugaaacauuaauuuuugaggucuugaaguucuuuaauuugaaauauacuauauucuuugaaaau

SEQ ID NO: 82221 - RNA, 64 nt, Homo Sapiens
uguauuuugaccaaauaaugacaacuucuuuagaaauuugaauggcuuggugaggaaaguaguu

SEQ ID NO: 82222 - RNA, 64 nt, Homo Sapiens
guuugucuuuucuuucagaaacaucucuuagccuaauuugaaauagcacaaucacaauucaaaa

SEQ ID NO: 82223 - RNA, 64 nt, Homo Sapiens
agccgaaguaugaacaguccauuuuguuucuuaaaauuugaagucgugucugucauagcauuuu

SEQ ID NO: 82224 - RNA, 64 nt, Homo Sapiens
ccuacauuaccuucaggagacuguucuaccuuuuaauuugaaaacaaggaaauuaaauuuuaac

SEQ ID NO: 82225 - RNA, 64 nt, Homo Sapiens
uuuugagggguggggaaaaaaaacacuaagugauaauuugaaaaaggcauauugcuuccagauu

SEQ ID NO: 82226 - RNA, 64 nt, Homo Sapiens
ucuguguauuggauuguugucuugauuuggucuaaauuugaauauauaugaguuacuugaauau

SEQ ID NO: 82227 - RNA, 64 nt, Homo Sapiens
cuagaauuucuaaaauggaauuuaaugccaucacaauuugaaaaacuuuuuuuuuuuuuuuacu

SEQ ID NO: 82228 - RNA, 64 nt, Homo Sapiens
cuuagcuauauuauuauaagcuacauuugcccugaauuugaacacucaacaucacuagauuuaa

SEQ ID NO: 82229 - RNA, 64 nt, Homo Sapiens
aagggggcgguuucccccauauccagugagagauaauuugaaucucccacauuuuauaggaggg

SEQ ID NO: 82230 - RNA, 64 nt, Homo Sapiens
uccauauaaguuuuuaucuguuuaaacuucaugcaauuugaaauaaugugaaacuucaugaagu

SEQ ID NO: 82231 - RNA, 64 nt, Homo Sapiens
caaguacagaaauuauagagacuacagcuaaauaaauuugaacauuaaauauaauuuuaccacu

SEQ ID NO: 82232 - RNA, 64 nt, Homo Sapiens
caauagugcacaacuuagguuauuuuugcuuccgaauuugaaugaaaaacuuaaugccauggau

SEQ ID NO: 82233 - RNA, 64 nt, Homo Sapiens
aggaaagauagagggaaggaaguucacucacuugaauuugaauugcuucucauucucaucagac

SEQ ID NO: 82234 - RNA, 64 nt, Homo Sapiens
aaaauaauauguuuaaaaauguaaauguuuuacaaauuugaaacuuucauaauuguauuaauca

SEQ ID NO: 82235 - RNA, 64 nt, Homo Sapiens
cuugaggcacagaguuauaaaguaacauaucuggaauuugaaaucagaucuguuuagggcuaau

SEQ ID NO: 82236 - RNA, 64 nt, Homo Sapiens
agcuauuauuaagaaaaacaguugagagaggaagaauuugaagagggcucaagauuuugagucc

SEQ ID NO: 82237 - RNA, 64 nt, Homo Sapiens
aaacagaauucuaaaaugugaguucaauucaauaaauuugaauuucuguaggaagaaucaaauc

SEQ ID NO: 82238 - RNA, 64 nt, Homo Sapiens
aaaucagcucuaaaaccaaagcugauuuuuagaaaauuugaaaauguaaaucagcccuauccau

SEQ ID NO: 82239 - RNA, 64 nt, Homo Sapiens
aggugauuucuuauauguagaugcucgauuuuggaauuugaaauaguagaugcaccucuuuacc

SEQ ID NO: 82240 - RNA, 64 nt, Homo Sapiens
uuuuuauauccaucaagggaaggaugaaauguugaauuugaagacuaauucaguaagaaguccu

SEQ ID NO: 82241 - RNA, 64 nt, Homo Sapiens
uguaaaucagcccuauccaugcugauuuuuagaaaauuugaaaaaaaucagcucuaaaaccaaa

SEQ ID NO: 82242 - RNA, 64 nt, Homo Sapiens
ucuguaggaagaaucaaaucaguucaauucaauaaauuugaauuaaacagaauucuaaaaugug

SEQ ID NO: 82243 - RNA, 64 nt, Homo Sapiens
ugccguguagaauuuuuuuuagauauccauuguaaauuugaaacaaagaccgaucuguguaaaa

SEQ ID NO: 82244 - RNA, 64 nt, Homo Sapiens
cugcuagagugcagcauuugugacacguauuugaaauuugaaauuuccuucugcacuguauaaa

SEQ ID NO: 82245 - RNA, 64 nt, Homo Sapiens
gagccaaccuggccaaucagauuguuuugucaauaauuugaaauuugaacuggagagauccaga

SEQ ID NO: 82246 - RNA, 64 nt, Homo Sapiens
ccuggccaaucagauuguuuugucaauaauuugaaauuugaacuggagagauccagaaccuugg

SEQ ID NO: 82247 - RNA, 64 nt, Homo Sapiens
auuauguucuuuuucccccuuuauggucuuaacuaauuugaauccuucaagaaggauuuuucca

SEQ ID NO: 82248 - RNA, 64 nt, Homo Sapiens
cggauugaaugaauguaaauagaaauuaaaugcaaauuugaaugaacauaaauagaagugauuu

SEQ ID NO: 82249 - RNA, 64 nt, Homo Sapiens
uuuauuuauaugacguuuguaaauuccaguaguuaauuugaacauuaccuuauuuaucuguaug

SEQ ID NO: 82250 - RNA, 64 nt, Homo Sapiens
gggccaaaacaaaguugguggagauacucuugauaauuugaauagaaacaaaaucauggaucaa

SEQ ID NO: 82251 - RNA, 64 nt, Homo Sapiens
uguuaauuagaauguuguugaaacagcuuuaaauaauuugaacuuggacgcaaaugacagauaa

SEQ ID NO: 82252 - RNA, 64 nt, Homo Sapiens
caacuuaauuuaagccaccuuccuaaccaaauuuaauuugaauuguuuucaguccauuaaaaaa

SEQ ID NO: 82253 - RNA, 64 nt, Homo Sapiens
uuaauguaaugagauaccuuuguucauuuuuuuaaauuugaaauauacuuuaccugauccacuu

SEQ ID NO: 82254 - RNA, 64 nt, Homo Sapiens
caucugauuggcugguaccgagagcuguggguaaaauuugaaaauuguauuuagaauaagaaau

SEQ ID NO: 82255 - RNA, 64 nt, Homo Sapiens
uuuuccuuuacccaggaaaucaccagugcccaggaauuugaacaaaggcuuggaugagaugggg

SEQ ID NO: 82256 - RNA, 64 nt, Homo Sapiens
ccuuccuaaagaaacccagcaauuuggauguccaaauuugaacuagagcaccagcuuugugcau

SEQ ID NO: 82257 - RNA, 64 nt, Homo Sapiens
uuuagagcaaguauagcucuuaccuuuauuacugaauuugaaucuucuuuuauuucuaggcugu

SEQ ID NO: 82258 - RNA, 64 nt, Homo Sapiens
uucucccuuuagcaauuuucauuuuauuucucauaauuugaacagagacaguucucauacauga

SEQ ID NO: 82259 - RNA, 64 nt, Homo Sapiens
aaugagaaaaaaugcauuguuacuuccugcagugaauuugaauauuuuuuaaucuuuuaguguu

SEQ ID NO: 82260 - RNA, 64 nt, Homo Sapiens
uagggugauuuuaaagaacauagagaauguucccaauuugaauuagaaugcuguucugauuuac

SEQ ID NO: 82261 - RNA, 64 nt, Homo Sapiens
aauuaaaagcuuggagagauaguuuccugaauagaauuugaagcagucugaauguucuuugaaa

SEQ ID NO: 82262 - RNA, 64 nt, Homo Sapiens
gaccuucaaaccauuuguaaacuaaccccugggaaauuugaaauuaccugauaacuuaagacuc

SEQ ID NO: 82263 - RNA, 64 nt, Homo Sapiens
acaauguaaaaccuguucuggguccucaaauuggaauuugaacaaaucaguacacugugaccaa

SEQ ID NO: 82264 - RNA, 64 nt, Homo Sapiens
aauuccaucaaauacuugcuauugaaagcuucaaaauuugaaagaaaauaagucaccguguugg

SEQ ID NO: 82265 - RNA, 64 nt, Homo Sapiens; identical to SEQ ID NO: 74019

SEQ ID NO: 82266 - RNA, 64 nt, Homo Sapiens; identical to SEQ ID NO: 74020

SEQ ID NO: 82267 - RNA, 64 nt, Homo Sapiens; identical to SEQ ID NO: 74021

SEQ ID NO: 82268 - RNA, 64 nt, Homo Sapiens; identical to SEQ ID NO: 74022

SEQ ID NO: 82269 - RNA, 64 nt, Homo Sapiens; identical to SEQ ID NO: 74023

SEQ ID NO: 82270 - RNA, 64 nt, Homo Sapiens; identical to SEQ ID NO: 74024

SEQ ID NO: 82271 - RNA, 64 nt, Homo Sapiens; identical to SEQ ID NO: 74025

SEQ ID NO: 82272 - RNA, 64 nt, Homo Sapiens; identical to SEQ ID NO: 74026

SEQ ID NO: 82273 - RNA, 64 nt, Homo Sapiens; identical to SEQ ID NO: 74027

SEQ ID NO: 82274 - RNA, 64 nt, Homo Sapiens; identical to SEQ ID NO: 74028

SEQ ID NO: 82275 - RNA, 64 nt, Homo Sapiens; identical to SEQ ID NO: 74029

SEQ ID NO: 82276 - RNA, 64 nt, Homo Sapiens; identical to SEQ ID NO: 74030

SEQ ID NO: 82277 - RNA, 64 nt, Homo Sapiens; identical to SEQ ID NO: 74031

SEQ ID NO: 82278 - RNA, 64 nt, Homo Sapiens; identical to SEQ ID NO: 74032

SEQ ID NO: 82279 - RNA, 64 nt, Homo Sapiens; identical to SEQ ID NO: 74033

SEQ ID NO: 82280 - RNA, 64 nt, Homo Sapiens; identical to SEQ ID NO: 74034

SEQ ID NO: 82281 - RNA, 64 nt, Homo Sapiens; identical to SEQ ID NO: 74035

SEQ ID NO: 82282 - RNA, 64 nt, Homo Sapiens; identical to SEQ ID NO: 74036

SEQ ID NO: 82283 - RNA, 64 nt, Homo Sapiens; identical to SEQ ID NO: 74037

SEQ ID NO: 82284 - RNA, 64 nt, Homo Sapiens; identical to SEQ ID NO: 74038

SEQ ID NO: 82285 - RNA, 64 nt, Homo Sapiens; identical to SEQ ID NO: 74039

SEQ ID NO: 82286 - RNA, 64 nt, Homo Sapiens; identical to SEQ ID NO: 74040

SEQ ID NO: 82287 - RNA, 64 nt, Homo Sapiens; identical to SEQ ID NO: 74041

SEQ ID NO: 82288 - RNA, 64 nt, Homo Sapiens; identical to SEQ ID NO: 74042

SEQ ID NO: 82289 - RNA, 64 nt, Homo Sapiens; identical to SEQ ID NO: 74043

SEQ ID NO: 82290 - RNA, 64 nt, Homo Sapiens; identical to SEQ ID NO: 74044

SEQ ID NO: 82291 - RNA, 64 nt, Homo Sapiens; identical to SEQ ID NO: 74045

SEQ ID NO: 82292 - RNA, 64 nt, Homo Sapiens; identical to SEQ ID NO: 74046

SEQ ID NO: 82293 - RNA, 64 nt, Homo Sapiens; identical to SEQ ID NO: 74047

SEQ ID NO: 82294 - RNA, 64 nt, Homo Sapiens; identical to SEQ ID NO: 74048

SEQ ID NO: 82295 - RNA, 64 nt, Homo Sapiens; identical to SEQ ID NO: 74049

SEQ ID NO: 82296 - RNA, 64 nt, Homo Sapiens; identical to SEQ ID NO: 74050

SEQ ID NO: 82297 - RNA, 64 nt, Homo Sapiens; identical to SEQ ID NO: 74051

SEQ ID NO: 82298 - RNA, 64 nt, Homo Sapiens; identical to SEQ ID NO: 74052

SEQ ID NO: 82299 - RNA, 64 nt, Homo Sapiens; identical to SEQ ID NO: 74053

SEQ ID NO: 82300 - RNA, 64 nt, Homo Sapiens; identical to SEQ ID NO: 74054

SEQ ID NO: 82301 - RNA, 64 nt, Homo Sapiens; identical to SEQ ID NO: 74055

SEQ ID NO: 82302 - RNA, 64 nt, Homo Sapiens; identical to SEQ ID NO: 74056

SEQ ID NO: 82303 - RNA, 64 nt, Homo Sapiens; identical to SEQ ID NO: 74057

SEQ ID NO: 82304 - RNA, 64 nt, Homo Sapiens; identical to SEQ ID NO: 74058

SEQ ID NO: 82305 - RNA, 64 nt, Homo Sapiens; identical to SEQ ID NO: 74059

SEQ ID NO: 82306 - RNA, 64 nt, Homo Sapiens; identical to SEQ ID NO: 74060

SEQ ID NO: 82307 - RNA, 64 nt, Homo Sapiens; identical to SEQ ID NO: 74061

SEQ ID NO: 82308 - RNA, 62 nt, Homo Sapiens
aauacauccuuucacucagcagagauggccauauuaaacacguuuugcuauguuaaaagugg

SEQ ID NO: 82309 - RNA, 62 nt, Homo Sapiens
gaauacaaauuucaguucugcaaaagugaaacauuaaacauugccaacgcaaauguauguac

SEQ ID NO: 82310 - RNA, 62 nt, Homo Sapiens
acuuuaaguaagucaacuguacaugaaacagcauuaaacaucaugguuguacaacucugaau

SEQ ID NO: 82311 - RNA, 62 nt, Homo Sapiens
aaauuaccauaggauucagcguuucucaaaggauuaaacauaguuuggaaaacaguuuggca

SEQ ID NO: 82312 - RNA, 62 nt, Homo Sapiens
acauuagcauugugguuuuacauuauaaugucauuaaacauggucccuaauuuaacccagcu

SEQ ID NO: 82313 - RNA, 62 nt, Homo Sapiens
aagcuguugaaauauugauguuaaggcccaacauuaaacacacacuaaaauuaaucuggaau

SEQ ID NO: 82314 - RNA, 62 nt, Homo Sapiens
uuauacauuuaaagucuuguuuggagguuuuaauuaaacauuuaaucuuaaagagaaaaucu

SEQ ID NO: 82315 - RNA, 62 nt, Homo Sapiens
uugagaaugcaacacuauaauauauauucauaauuaaacacauaagaacugccuccacuguu

SEQ ID NO: 82316 - RNA, 62 nt, Homo Sapiens
ggauuauuaagcaaccuuaaagcaauaaguucauuaaacagaagguaauaggaagaacagua

SEQ ID NO: 82317 - RNA, 62 nt, Homo Sapiens
ugucucaaagcaucaaauaauacaucuuuaucauuaaacaugaauuuaaugucuaggauaau

SEQ ID NO: 82318 - RNA, 62 nt, Homo Sapiens
caagagaagucuuuaaaaagccugcauuguguauuaaacaccagguaauaugugcaaaaccg

SEQ ID NO: 82319 - RNA, 62 nt, Homo Sapiens
auauccuaccaggcuuuccaucugaauaguaaauuaaacaguuguuaucaaaaugauuuuaa

SEQ ID NO: 82320 - RNA, 62 nt, Homo Sapiens
uuuccaauucauuaaauugaucaguguuuuauauuaaacauacaaguaauguuuugaggaua

SEQ ID NO: 82321 - RNA, 62 nt, Homo Sapiens
ucagaacuuucuaauguuaugcauuauauaugauuaaacacugaauucaugugauaauggug

SEQ ID NO: 82322 - RNA, 62 nt, Homo Sapiens
acuuuuacuagggcugaaaauggcaucuuagaauuaaacaaaguuaagguuguucacuauga

SEQ ID NO: 82323 - RNA, 62 nt, Homo Sapiens
ugaacaucacaaaacaauuuguuggcauaagaauuaaacauagcugucuucaucagaaaaca

SEQ ID NO: 82324 - RNA, 62 nt, Homo Sapiens
cauuccccagaccauucagaaucacacagcguauuaaacacugacagaaucuucaucuagau

SEQ ID NO: 82325 - RNA, 62 nt, Homo Sapiens
gacauuuucuagacaaucgcaccuuuggguauauuaaacagcugguaucauaacaaagaauc

SEQ ID NO: 82326 - RNA, 62 nt, Homo Sapiens
uuucaguucuuguguuuuggaguccuagucauauuaaacaugagagauacucuuaauuucag

SEQ ID NO: 82327 - RNA, 62 nt, Homo Sapiens
aguggucuuaagguuagcaaauaauugucuguauuaaacauggcguuauuuaaguaguccug

SEQ ID NO: 82328 - RNA, 62 nt, Homo Sapiens
aaucauuuuugucaaccacuacaagccugaagauuaaacaguauagaaaugauuuagauuaa

SEQ ID NO: 82329 - RNA, 62 nt, Homo Sapiens
ccugaagauuaaacaguaaugaaaugauuuagauuaaacaagagcucuuuuuaaagaaaaua

SEQ ID NO: 82330 - RNA, 62 nt, Homo Sapiens
cuauauggaacaaacauuccaaauacauuuuaauuaaacaaucuguaacagaaucaagaaac

SEQ ID NO: 82331 - RNA, 62 nt, Homo Sapiens
cuguaacagaaucaagaaacaaacaaauuuuaauuaaacaauauguauauaacagaaucaag

SEQ ID NO: 82332 - RNA, 62 nt, Homo Sapiens
uuggucugguuuauaucauuaaguuguacuauauuaaacaacaaacaaaugacaggguuguu

SEQ ID NO: 82333 - RNA, 62 nt, Homo Sapiens
cuugcuaucauuuaccauggccaggcaauggcauuaaacauuaaauuuuccuuuuaaaaaau

SEQ ID NO: 82334 - RNA, 62 nt, Homo Sapiens
gugacuauccccauguaagagggcacuuggcaauuaaacaugcuacacagcauggcaucacu

SEQ ID NO: 82335 - RNA, 62 nt, Homo Sapiens
acacagcauggcaucacuuuuuuuuauaacucauuaaacacaguaaaauuuuaaucauuuuu

SEQ ID NO: 82336 - RNA, 60 nt, Homo Sapiens
gucuugaucucuuugugacuaaaaaaguaacuauuaaacaaaugugacuggauuucccuc

SEQ ID NO: 82337 - RNA, 62 nt, Homo Sapiens
guguaugcaaauuguuauggaaacucugcagcauuaaacaacuuuaccuauguaaguguuca

SEQ ID NO: 82338 - RNA, 62 nt, Homo Sapiens
aaaagcaagauuuuuaaaacucauaacaucugauuaaacagaauaagggcaaagggagagaa

SEQ ID NO: 82339 - RNA, 62 nt, Homo Sapiens
caauuguuuguuuaacaucuaguugcagagucauuaaacaauacacccaggguggaaaccac

SEQ ID NO: 82340 - RNA, 62 nt, Homo Sapiens
uuuacauauuuuucauuuuagcuaagaaaaaaauuaaacauauauuuuuagaaagauuuuuu

SEQ ID NO: 82341 - RNA, 62 nt, Homo Sapiens
aaaacccaacaacacacuuugcuaggauaucaauuaaacacauaccauaauacucuauucag

SEQ ID NO: 82342 - RNA, 62 nt, Homo Sapiens
ugguagagucaucauaaaacuuaagacuuuaaauuaaacauuuuauaauuaaaaauaagaaa

SEQ ID NO: 82343 - RNA, 62 nt, Homo Sapiens
aaauacuauaaaaccccugaauaaccaaaaagauuaaacaaaggacuguucuauuuuuuuca

SEQ ID NO: 82344 - RNA, 62 nt, Homo Sapiens
ggguaaauuauuaaauguguauucauuacucaauuaaacauucuaaaguuuauauuaaauga

SEQ ID NO: 82345 - RNA, 62 nt, Homo Sapiens
uaugaaauuaaaguaaauuaauuguuuuuaacauuaaacaaaaaagaguauauuuuaaauau

SEQ ID NO: 82346 - RNA, 62 nt, Homo Sapiens
aauugaaaugaaaagcuuacuagcuuuaaaguauuaaacaaugguuuuaucuuuguuuaaac

SEQ ID NO: 82347 - RNA, 62 nt, Homo Sapiens
uuacagucuaaaggaaacaaccaguuauacguauuaaacagugugguucggaugugaaauaa

SEQ ID NO: 82348 - RNA, 62 nt, Homo Sapiens
uuuuagucauuuauacaaagauguggaagugaauuaaacaagaauuuuguuuccuccauaaa

SEQ ID NO: 82349 - RNA, 62 nt, Homo Sapiens
acguuauccaauugcaggucuuuuagaggccuauuaaacaugcuacugauguagccacaacu

SEQ ID NO: 82350 - RNA, 62 nt, Homo Sapiens
aucuuggaccuuggucaguugugcuauucauuauuaaacacuaaaacuuuggcgguucuugc

SEQ ID NO: 82351 - RNA, 62 nt, Homo Sapiens
cuguuuggauaaaaguugaugugugauuuuuuauuaaacaaauaguaaacccuucaauuaua

SEQ ID NO: 82352 - RNA, 62 nt, Homo Sapiens
aagauuagacuacacaaaagcuuccuuccaguauuaaacaaaaagaauuaaacauaacuaug

SEQ ID NO: 82353 - RNA, 62 nt, Homo Sapiens
caaaagcuuccuuccaguauuaaacaaaaagaauuaaacauaacuaugaaaaaacuuugcua

SEQ ID NO: 82354 - RNA, 64 nt, Homo Sapiens
gccacaaggacugagguuggguaggugugggguuccagaggacagcaggacacucucgcauacu

SEQ ID NO: 82355 - RNA, 64 nt, Homo Sapiens
agguuucaggggccuccuuuguugucaucagaacccagaggaauucuucuccuaaaaaauacgu

SEQ ID NO: 82356 - RNA, 64 nt, Homo Sapiens
ucuuccaccuuucuguucaaggcuguuugucuacccagaggaaggaggcacugcugaauggcua

SEQ ID NO: 82357 - RNA, 64 nt, Homo Sapiens
caguucuggguuaucuccucucauacaucaagccccagaggaggcggcaagaggaacagccaca

SEQ ID NO: 82358 - RNA, 64 nt, Homo Sapiens
cggcuugggauccucugggcagacggugcgaagcccagaggaggacuaaggaugucaguguacg

SEQ ID NO: 82359 - RNA, 64 nt, Homo Sapiens
guggauaccucaguguccacgccaugggcugcugccagaggaccccgcagggagccaggcuggg

SEQ ID NO: 82360 - RNA, 64 nt, Homo Sapiens
ggggaguaucugugggcaaccucucacaggaaguccagaggaagguggguucugccgaacccuc

SEQ ID NO: 82361 - RNA, 64 nt, Homo Sapiens
ucuauugcaucucucaccugagcugcaaaccuggccagaggaguagagugagcuuggccaagcc

SEQ ID NO: 82362 - RNA, 64 nt, Homo Sapiens
gcucuuucagaagacccaggaagggcagcuccagccagaggaccuuccuggcuaugcaggugca

SEQ ID NO: 82363 - RNA, 64 nt, Homo Sapiens
ucucuuuccuuugugccacugagucguucccuggccagaggacauaaauggugcugguaggagg

SEQ ID NO: 82364 - RNA, 64 nt, Homo Sapiens
cuuccuccuaacugucaggguggggagcugguucccagaggauugucuacccugaaguccauca

SEQ ID NO: 82365 - RNA, 64 nt, Homo Sapiens
aacaaaaaaucugugagggucugacuugcucaaaccagaggaggaaacagaaaccccugcacau

SEQ ID NO: 82366 - RNA, 64 nt, Homo Sapiens
gggcgucauucacccacuaccccuagugcuagucccagaggaugcugcggagggggcagccuca

SEQ ID NO: 82367 - RNA, 64 nt, Homo Sapiens
acugucuaggaggacugggcagggugggggcaacccagaggacccauggcuagcagggaagggc

SEQ ID NO: 82368 - RNA, 64 nt, Homo Sapiens
gggccagaggcucguugacucucuguaucaggacccagaggaagucagaggcccucgcugccag

SEQ ID NO: 82369 - RNA, 64 nt, Homo Sapiens
gcugccccaucagugcuccccaccaggguugaccccagaggauugcccaagggaauucggugug

SEQ ID NO: 82370 - RNA, 64 nt, Homo Sapiens
cuuagcucuuagucucuuugguaggaguuuuguuccagaggagcucucccccuuggauuugaac

SEQ ID NO: 82371 - RNA, 64 nt, Homo Sapiens
caggucaggggcacacauggcuuaagugacaaagccagaggagaagacaacccugacagcauca

SEQ ID NO: 82372 - RNA, 64 nt, Homo Sapiens
ccugaacguggguggagcgucuuguagaugggagccagaggaaagcaccauuucacacacacuc

SEQ ID NO: 82373 - RNA, 64 nt, Homo Sapiens
gggaggcaccccacccuccccccgagggacgcccccagaggacccccccggagguggcagcagc

SEQ ID NO: 82374 - RNA, 64 nt, Homo Sapiens
cacaggggagacgccccaguguccuccucauucaccagaggacaggggcuuuagccggaaguca

SEQ ID NO: 82375 - RNA, 64 nt, Homo Sapiens
cacacaggggagaagccuuagaccuccucagucaccagaggacaagggcuuuagccggaaguca

SEQ ID NO: 82376 - RNA, 64 nt, Homo Sapiens
cgguccgggggcugggggcucuauggcagucagaccagaggaaggcuuccuggggccacagggc

SEQ ID NO: 82377 - RNA, 64 nt, Homo Sapiens
cagaagcccccgaguccuuuaagaguccacaggcccagaggaaguccugagggccgggaagccg

SEQ ID NO: 82378 - RNA, 64 nt, Homo Sapiens
auuccucgggacccacagucucaccacgucuccuccagaggacggcagaggguacagguggugg

SEQ ID NO: 82379 - RNA, 64 nt, Homo Sapiens
cuaaauguuuacuuaagaaacacccuguuuacagccagaggagaaacacccaacacugagugga

SEQ ID NO: 82380 - RNA, 64 nt, Homo Sapiens
aaaauuaucuccccugcaaaucaccaccuuuccuccagaggaggacugucucccugccugucaa

SEQ ID NO: 82381 - RNA, 64 nt, Homo Sapiens
gcaugagggguggggcuuugguaaauagaggugaccagaggagaacaggaaggggcaugugagc

SEQ ID NO: 82382 - RNA, 64 nt, Homo Sapiens
auuuuccugccuuggcagagccauccauccaugaccagaggauuucccacuuaugugagugacc

SEQ ID NO: 82383 - RNA, 64 nt, Homo Sapiens
uucuccagaguucaccuuuccgugucgucuccacccagaggaagaagcucuuggcuuggagucc

SEQ ID NO: 82384 - RNA, 64 nt, Homo Sapiens
acaagagccagaggcccgucccccacccccgccgccagaggaguccagaggaugccaccuccgc

SEQ ID NO: 82385 - RNA, 64 nt, Homo Sapiens
ccaccuccgcccccacccccaguccacgcccucaccagaggauguccaggggucuguuauuagc

SEQ ID NO: 82386 - RNA, 64 nt, Homo Sapiens
agagccaaaaacuuguuucaaaaagugcagaaagccagaggacugaugaacuugaagauuacau

SEQ ID NO: 82387 - RNA, 64 nt, Homo Sapiens
agauccaaagacuuguuucacaaaguacagaaagccagaggacugaugaacuugaagauuacau

SEQ ID NO: 82388 - RNA, 64 nt, Homo Sapiens
agaggccaagacuuguuucacaaugugcagaaagccagaggacuaaugagugugcagauuacau

SEQ ID NO: 82389 - RNA, 63 nt, Homo Sapiens
ucauuuccuuaaguuuugaucuccgucuuccugaugaagcaggcagagcucagaggaucuugg

SEQ ID NO: 82390 - RNA, 63 nt, Homo Sapiens
ugcuuccugccagcacgugccugaagguuucacaugaagcaugggaagcgcacccugucguuc

SEQ ID NO: 82391 - RNA, 63 nt, Homo Sapiens
uagccuaaaaaaaucuuaauuauuucauggaucaugaagcaaggaugaauaauaucaugucuu

SEQ ID NO: 82392 - RNA, 63 nt, Homo Sapiens
ugucuuuaaagauauaaaaauuaggaugccuuuaugaagcacugauuauaccaaaaaaaaaag

SEQ ID NO: 82393 - RNA, 63 nt, Homo Sapiens
guuucuuuucuucacucaaauuuugacauggaaaugaagcaggugauuaaaucaaccaccuau

SEQ ID NO: 82394 - RNA, 63 nt, Homo Sapiens
auuuugguaaccaggccauuaccaaacuacugaaugaagcaguacauacacccaaacacuuac

SEQ ID NO: 82395 - RNA, 63 nt, Homo Sapiens
aaaacuucuucucugggcuaccuaucuuccuucaugaagcaggugcucaggacccggaagaau

SEQ ID NO: 82396 - RNA, 63 nt, Homo Sapiens
cugguuaaguguuuacuaccauuaaagcgaggcaugaagcaaagagcugagugaguccucugc

SEQ ID NO: 82397 - RNA, 63 nt, Homo Sapiens
cuccuaguccuggagugacugggcucuucacucaugaagcagaagguucaucuuugaaaucua

SEQ ID NO: 82398 - RNA, 63 nt, Homo Sapiens
gugugaauggacaauguugacccaggccuugcuaugaagcaguauaagucaaaggaaaaugag

SEQ ID NO: 82399 - RNA, 63 nt, Homo Sapiens
aaaggaugcagagcugugcaaauuguuccucaaaugaagcaguguggaguguauuggggauuu

SEQ ID NO: 82400 - RNA, 63 nt, Homo Sapiens
ugaggugauuuugaaucuuguccauauaggaaaaugaagcacagaauuacucagucuuccaua

SEQ ID NO: 82401 - RNA, 63 nt, Homo Sapiens
aaaacauuuaacauaaugguugugaaauguaacaugaagcaaacuaacuuuuuuuuuuuuaac

SEQ ID NO: 82402 - RNA, 63 nt, Homo Sapiens
gaacagacuagaaguauuugugggaggagugacaugaagcaugaguuaucugauuuuuuuugu

SEQ ID NO: 82403 - RNA, 63 nt, Homo Sapiens
aaguuggaccaagggaagucggggacguaaaaaaugaagcaaaacaaugccagggugucuccc

SEQ ID NO: 82404 - RNA, 63 nt, Homo Sapiens
uggacuugguacaaaaugucggugugguccuagaugaagcauuggggugggggagggagaggg

SEQ ID NO: 82405 - RNA, 63 nt, Homo Sapiens
guggauguuacuuaaagagaaaagcauaagagcaugaagcauaucugggaauaucuuuugccu

SEQ ID NO: 82406 - RNA, 63 nt, Homo Sapiens
aauuuguuuuucugaugaauaguguucaguaaaaugaagcagucuuaagagugacuaauaauu

SEQ ID NO: 82407 - RNA, 63 nt, Homo Sapiens
cagugacugcuggauagucucccagucugaucaaugaagcauucgauuaguuuuugauuuuuu

SEQ ID NO: 82408 - RNA, 63 nt, Homo Sapiens
aauuugaugacacugucuaucaaaaaagagcaaaugaagcagaugcaaauguuagugagaagu

SEQ ID NO: 82409 - RNA, 63 nt, Homo Sapiens
uuuauuuuugaaacaaacaugaugaagaaauuuaugaagcagaucauaauggaaaaaaagacu

SEQ ID NO: 82410 - RNA, 63 nt, Homo Sapiens
agaaacgugagaaggaggguccagaaccgccgaaugaagcaaaacccaagugaagaucugguu

SEQ ID NO: 82411 - RNA, 63 nt, Homo Sapiens
acaggaauuugguuuucuuuuucccaggagagaaugaagcaaaaacccuuccuuguaucuguc

SEQ ID NO: 82412 - RNA, 63 nt, Homo Sapiens
gaauuccaggaaacccaagaggaagaggagagcaugaagcaaaaacuaccuuagcugcauagu

SEQ ID NO: 82413 - RNA, 63 nt, Homo Sapiens
auaauauuguucccauauauaaagucauagaagaugaagcacuaaagugauauguauuccaaa

SEQ ID NO: 82414 - RNA, 63 nt, Homo Sapiens
caaugcucuaaucacaauauauuuguuuaggucaugaagcaaaaccuagacuucaaagccagu

SEQ ID NO: 82415 - RNA, 63 nt, Homo Sapiens
cacacacacacacacacacauuugauuagaaaaaugaagcagacagcuuacaucaguuguuug

SEQ ID NO: 82416 - RNA, 63 nt, Homo Sapiens
uuugcacuggaaccauugcugacauuugucuucaugaagcagaauugaauuucauauuugaga

SEQ ID NO: 82417 - RNA, 63 nt, Homo Sapiens
uggguaccagcugguguagcgacaucuuauccuaugaagcauauugcugaguggugccugaaa

SEQ ID NO: 82418 - RNA, 63 nt, Homo Sapiens
aguaaccuuacucugagguuuuacggucugauaaugaagcacuugcaugaguauaguaaguca

SEQ ID NO: 82419 - RNA, 63 nt, Homo Sapiens
auacuucauuuaauagcucguuaccaagugugaaugaagcaauaugucauaauagaguagcca

SEQ ID NO: 82420 - RNA, 63 nt, Homo Sapiens
gaaggcucaucaggugaucauuaccuagcauccaugaagcaccugaaauuauuugcaaaaugu

SEQ ID NO: 82421 - RNA, 63 nt, Homo Sapiens
auaaugcuugaagcuuuucauauaacaaaaggaaugaagcagccccgccucgcaguguggaag

SEQ ID NO: 82422 - RNA, 63 nt, Homo Sapiens
cuucaaaaguucagucuagucuggaaaacaaacaugaagcaaagaaggcacaacaccauaugg

SEQ ID NO: 82423 - RNA, 63 nt, Homo Sapiens
cucaaagagauucgaaugacgguaaguguucucaugaagcaggaggcccuugucgugggaugg

SEQ ID NO: 82424 - RNA, 63 nt, Homo Sapiens
acguacgcaagaggacauggauccaaaaugaugaugaagcaucucccauggggaggugauggu

SEQ ID NO: 82425 - RNA, 63 nt, Homo Sapiens
gacaugcauguguguguguguguguaugugcauaugaagcacaugaagcaauaauuuuuaaau

SEQ ID NO: 82426 - RNA, 63 nt, Homo Sapiens
aauuuuuaaauuguguaugucauuaggguaaagaugaagcaauuaaaugugauuccuuuaugg

SEQ ID NO: 82427 - RNA, 63 nt, Homo Sapiens
ugaagaaagacucuauaggcuuuuacacagcacaugaagcaguaauccagaaagaaggaaaug

SEQ ID NO: 82428 - RNA, 63 nt, Homo Sapiens
uaugugaaauauuaugaucugaacuuagcacacaugaagcaacauuucuuugcuacacagagg

SEQ ID NO: 82429 - RNA, 64 nt, Homo Sapiens
cccucuucagucccaguagacucugcucccuagcccugagcaggaggcugggagcagcucuguu

SEQ ID NO: 82430 - RNA, 64 nt, Homo Sapiens
cuggaaacuaaacugguuagaaugaaccuggcucccugagcaucccuggauccuucaaauaggc

SEQ ID NO: 82431 - RNA, 64 nt, Homo Sapiens
guugcagugagccaaucucaccauugcacuucagccugagcaacacgagcaaaacuccgucuca

SEQ ID NO: 82432 - RNA, 64 nt, Homo Sapiens
agacagccuaacagcagaggcaacuuaaauaacuccugagcaguuggcacuagaacagaauacu

SEQ ID NO: 82433 - RNA, 64 nt, Homo Sapiens
uauagcaauacacuguaauaucagaaaugguuggccugagcaaccuaguaagaccucgucucua

SEQ ID NO: 82434 - RNA, 64 nt, Homo Sapiens
uuaguacuaaagagcacagcugcucaaaguaaagccugagcaguguucucaguaauguauuuga

SEQ ID NO: 82435 - RNA, 64 nt, Homo Sapiens
ggacauggaugccaagcggaggccugcguggccuccugagcagcagcugaccgcccgucucaug

SEQ ID NO: 82436 - RNA, 64 nt, Homo Sapiens
ggccagggacgccgugcggaggccuacguggcugccugagcagcagcugaccgcccgucucacu

SEQ ID NO: 82437 - RNA, 64 nt, Homo Sapiens
agaagagccuccgcccggcccaccagaaaccggcccugagcacgagccaagcgcaucgggagca

SEQ ID NO: 82438 - RNA, 64 nt, Homo Sapiens
gcagaagccccagggcggagaaggacucccccuaccugagcagacugcggccacagcuccgugg

SEQ ID NO: 82439 - RNA, 64 nt, Homo Sapiens
agcggagacgccuuuuaucucuggaugccacagaccugagcagcauugggcuggcuguccgcug

SEQ ID NO: 82440 - RNA, 64 nt, Homo Sapiens
cggcaggugccucuguguggagcuagggucaagcccugagcagcuucacuuccccugcgccuuu

SEQ ID NO: 82441 - RNA, 64 nt, Homo Sapiens
gaagcagaaaaggagguucccacagaccucuguuccugagcagauugcuccccgacaggugggg

SEQ ID NO: 82442 - RNA, 64 nt, Homo Sapiens
ccacacgggcagucacagagacccgggccgcaucccugagcaagaucuaccaguauccugaccg

SEQ ID NO: 82443 - RNA, 64 nt, Homo Sapiens
ggcccauuccccucgcacagccgagcuuuuacucccugagcacgggccgcuccgcuccccugcu

SEQ ID NO: 82444 - RNA, 64 nt, Homo Sapiens
ggcagcaauuccaucaagccaagccuccugugguccugagcaugaaggggccaggggaccuccu

SEQ ID NO: 82445 - RNA, 64 nt, Homo Sapiens
cgaaaugcuugcucaggcucagagggaccucaccccugagcaggucaggacucagaacagucug

SEQ ID NO: 82446 - RNA, 64 nt, Homo Sapiens
cauauuucaaaccacaauauccagcaaaaugucuccugagcacccagaacuccauaccaucggc

SEQ ID NO: 82447 - RNA, 64 nt, Homo Sapiens
cccagcauccagacuggaaaccuacccauuuuccccugagcauccucuagaugcugccccaagg

SEQ ID NO: 82448 - RNA, 64 nt, Homo Sapiens
uccaaggggccuccuggauucaguccccacuggcccugagcacgacagcccuucuuacccuccc

SEQ ID NO: 82449 - RNA, 64 nt, Homo Sapiens
uccuaaaaagauuugcuguuagacaaaggcaaaaccugagcagugauuuuaaaaugaaguguca

SEQ ID NO: 82450 - RNA, 64 nt, Homo Sapiens
cucugugcauuaggaagaccuccugaugucacagccugagcauaaagguaaauaucuguuuucu

SEQ ID NO: 82451 - RNA, 64 nt, Homo Sapiens
aagagcgaaacuccaucucaccauugcaccccagccugagcaacugcagugagccaagacagca

SEQ ID NO: 82452 - RNA, 64 nt, Homo Sapiens
auagugaggaucccaucucugaguucaagaccggccugagcaacggagaauggcuugagcccag

SEQ ID NO: 82453 - RNA, 64 nt, Homo Sapiens
gcucuguaggcagugcgggccggcgcccacccguccugagcauagagugcccgacagcugagac

SEQ ID NO: 82454 - RNA, 64 nt, Homo Sapiens
acucggcgccagcagccucuccgcaccguccccuccugagcagcuggagucuccagcccacccu

SEQ ID NO: 82455 - RNA, 64 nt, Homo Sapiens
acaaugaugaacacacguuuuuuuucccaauugcccugagcaguaucugaaugccuuuuauuua

SEQ ID NO: 82456 - RNA, 64 nt, Homo Sapiens
auagauuugaagugcaagcccaauuacuuccaugccugagcaggccagacagacuuucacacca

SEQ ID NO: 82457 - RNA, 64 nt, Homo Sapiens
gguguaguauaaauaauaauaauggcuaauauuuccugagcaucuacuaaaugcaaggaauugu

SEQ ID NO: 82458 - RNA, 64 nt, Homo Sapiens
cucugugguggaacgaccccaccucgaggagcuuccugagcagguggcagaagaugcgguaaga

SEQ ID NO: 82459 - RNA, 64 nt, Homo Sapiens
cugggccuaaacacagcagccuccucucuuccugccugagcaccgcagcgggagccagcagggg

SEQ ID NO: 82460 - RNA, 64 nt, Homo Sapiens
ggaagcuucaggaagcucagccucagccuucaggccugagcaagugcagggcggagcuaccagc

SEQ ID NO: 82461 - RNA, 64 nt, Homo Sapiens
ugacaaucuaaccugccaucagugagaaggcuuuccugagcaagcagggaccauggcccgagaa

SEQ ID NO: 82462 - RNA, 64 nt, Homo Sapiens
uccuguacaugaaccaggucggauacuaaugauuccugagcaccccagagggaggaaguugaaa

SEQ ID NO: 82463 - RNA, 64 nt, Homo Sapiens
gcuggggcucuggccccaggugagguccccagcuccugagcacuucugaggggguggguuccac

SEQ ID NO: 82464 - RNA, 64 nt, Homo Sapiens
cuguggcuguuccuggacacugugcuguccccguccugagcaacuaugcccccgccccaguagg

SEQ ID NO: 82465 - RNA, 61 nt, Homo Sapiens
auccccuuggccacagagccauugugauaugaggagauacuggcucuucuggaaaagagag

SEQ ID NO: 82466 - RNA, 61 nt, Homo Sapiens
agagaggcuuuucuucaucgagagcuaccagaggagauauuaucuguccucuguguggcac

SEQ ID NO: 82467 - RNA, 61 nt, Homo Sapiens
agugaaccaagaagaggaugacauuagauccaggagauacaacagaggagauaaucuccag

SEQ ID NO: 82468 - RNA, 61 nt, Homo Sapiens
aggaugacauuagauccaggagauacaacagaggagauaaucuccaggaugccugugaaga

SEQ ID NO: 82469 - RNA, 61 nt, Homo Sapiens
cuccaggaugccugugaagaagauacaacagaggagauaauaggaugacauuagauccagg

SEQ ID NO: 82470 - RNA, 61 nt, Homo Sapiens
acagaggagauaaucuccagacauuagauccaggagauacaagugaaccaagaagaggaug

SEQ ID NO: 82471 - RNA, 61 nt, Homo Sapiens
gauggggacguuugacuuggugggaggugucaggagauaggaguugguuaagaugauagau

SEQ ID NO: 82472 - RNA, 61 nt, Homo Sapiens
cauucacaggggcccugcaaccucacgagaaaggagauaguggaagagucaggacagguug

SEQ ID NO: 82473 - RNA, 61 nt, Homo Sapiens
caucuucuaaagauuuuuuuacugacucauuaggagauaggauggacuuuucccaccauuc

SEQ ID NO: 82474 - RNA, 61 nt, Homo Sapiens
gaguagaaugaugguuaccaaaucaaacuuaaggagauagaugggagcuaaaaauuacaau

SEQ ID NO: 82475 - RNA, 61 nt, Homo Sapiens
caguggagccucugcccuucaucaggccuguaggagauacuauguccuagguaauaccacu

SEQ ID NO: 82476 - RNA, 61 nt, Homo Sapiens
caggguacuguacuggagaacuugucuaugaaggagauaaaacuaacccuuaauuaucuua

SEQ ID NO: 82477 - RNA, 61 nt, Homo Sapiens
aaacaccuaccuugcaguagacaucuguaaaaggagauaauaccucugagccuaaguuucc

SEQ ID NO: 82478 - RNA, 61 nt, Homo Sapiens
guggguucaugaaugacuaucccuccuaguaaggagauacaugaaucagacaugaucucua

SEQ ID NO: 82479 - RNA, 64 nt, Homo Sapiens
ugaaggccgcuucucguuggguaccguggggggugaacccuagccccagcuuugggaggauguu

SEQ ID NO: 82480 - RNA, 64 nt, Homo Sapiens
ggaaauugauuggaauagaaacuuaaaggaaauggaacccuaacuauucucccaucaaaucaua

SEQ ID NO: 82481 - RNA, 64 nt, Homo Sapiens
aggggaauccccuuauuucuguuuugcauaugaggaacccuagagcagccaggugaggcucucu

SEQ ID NO: 82482 - RNA, 64 nt, Homo Sapiens
auuucauuugcauguuaguccacagaguugcccagaacccuaaauuuauucauaagagaaaaua

SEQ ID NO: 82483 - RNA, 64 nt, Homo Sapiens
ggacuuuuauggcucuaucuuuuccuucagugaagaacccuauuuaaaacugggucaucauuug

SEQ ID NO: 82484 - RNA, 64 nt, Homo Sapiens
ugcagaggugacccucggacccgcugccguucgcgaacccuagcagaggacucagccaccgccg

SEQ ID NO: 82485 - RNA, 64 nt, Homo Sapiens
uaucuuugaaaaauguaaauaguuuauuuauagagaacccuaccucugagguugacucaaaggu

SEQ ID NO: 82486 - RNA, 64 nt, Homo Sapiens
ccccuuaguuuguuuccuuuuauuuuauagagcagaacccuagucuuuuaaacaguuuagagug

SEQ ID NO: 82487 - RNA, 64 nt, Homo Sapiens
ccagggacuggagcaggaaagccagccucuucuagaacccuagcggccucauguaaacguggca

SEQ ID NO: 82488 - RNA, 64 nt, Homo Sapiens
cucccacgaggauccucaguauccugaggucccagaacccuauuuuucugguucuugugauugu

SEQ ID NO: 82489 - RNA, 64 nt, Homo Sapiens
auggucguugaaggcgccugaggugcuuucaucagaacccuaaagccugcaccuuagaagccga

SEQ ID NO: 82490 - RNA, 64 nt, Homo Sapiens
ccauugugguuucugccacucaggccauuucugugaacccuacuuaggaauagggucuguuuca

SEQ ID NO: 82491 - RNA, 64 nt, Homo Sapiens
guugacuugaaaauaaauagggagguauugagaggaacccuacuuaaguuuuccauauguacaa

SEQ ID NO: 82492 - RNA, 64 nt, Homo Sapiens
agucagaugaacccaacagucagaugagagaaaugaacccuacuugcuaucucuaucuuagaaa

SEQ ID NO: 82493 - RNA, 64 nt, Homo Sapiens
uaaucuucaauaguuuuaccuaccccagucuuuggaacccuaaauaauaaaaauaaacauguuu

SEQ ID NO: 82494 - RNA, 64 nt, Homo Sapiens
ggguggggccuccagagcuuugcagggaacccuggaacccuaggaacaaggagccuuuguucca

SEQ ID NO: 82495 - RNA, 64 nt, Homo Sapiens
ugcuagguccuugcuuauauggcaaccacugcuagaacccuaaaagaaccaaaaaucugccaca

SEQ ID NO: 82496 - RNA, 63 nt, Homo Sapiens
uggaaucauauucuagccgcauuaugcaggggagaacccuacacacauuccccuaagaccuaa

SEQ ID NO: 82497 - RNA, 64 nt, Homo Sapiens
gcuauagaacuugggggcuaguuucaacugaugggaacccuauaaauagcgaaaaagcaaaucu

SEQ ID NO: 82498 - RNA, 64 nt, Homo Sapiens
auggugauacuuguuuauaauucuuaugcugcaggaacccuagagacaaaaugagaugaccauu

SEQ ID NO: 82499 - RNA, 64 nt, Homo Sapiens
aauuagaaaaucaagcuuugaauagaaguagugugaacccuagagaauuugagauuuuuguaau

SEQ ID NO: 82500 - RNA, 64 nt, Homo Sapiens
uuauaaugguacguuacugaauguauuuuuaauggaacccuauuacacaaauacaacugccagu

SEQ ID NO: 82501 - RNA, 64 nt, Homo Sapiens
gacacugucaugaacugugucccccucuucaacugaacccuaaaacccucuuuuuaaaaguuua

SEQ ID NO: 82502 - RNA, 64 nt, Homo Sapiens
uuugaguagcagaccuaacaaauauuugaggucagaacccuaccauguuaaaacaaacaaaaac

SEQ ID NO: 82503 - RNA, 64 nt, Homo Sapiens
cucacuaugucacccagguucgucucaaacuccugaacccuaguaauucuccuaucucagccuc

SEQ ID NO: 82504 - RNA, 64 nt, Homo Sapiens
cauucggaacaauguuuuucacuuggaggauggugaacccuacugugagacugguaagaucagg

SEQ ID NO: 82505 - RNA, 64 nt, Homo Sapiens
uuuacugcagcacuauucacuuaaagagacauuugaacccuaugggaaaaaggaaaucuguaua

SEQ ID NO: 82506 - RNA, 64 nt, Homo Sapiens
ucuucaaccaugagguaaaagagccaaguucaaagaacccuagcacaaauuugcuuugggauuu

SEQ ID NO: 82507 - RNA, 64 nt, Homo Sapiens
agccgcaggcacccucucacucaauuuccacucagaacccuauaaacaccagugggaagggcaa

SEQ ID NO: 82508 - RNA, 64 nt, Homo Sapiens
uuccacagaaugaaauuuugggggaggagggugggaacccuaaugaaaugggagggaguaguuu

SEQ ID NO: 82509 - RNA, 64 nt, Homo Sapiens
ugaauugcagggcugugauuaugccgaauuuaaugaacccuauucccagcccaguuaagaggag

SEQ ID NO: 82510 - RNA, 64 nt, Homo Sapiens
ccaauuuagcauaucuagacuaccuauuugaaaggaacccuaucaacugucuuauguacguuac

SEQ ID NO: 82511 - RNA, 64 nt, Homo Sapiens
ucucggccccggcuuucuuccaagaguugaccaggaacccuaaagcauccagaguagacugcgc

SEQ ID NO: 82512 - RNA, 64 nt, Homo Sapiens
ugccauuggucacaauaggucaagggcuuguucugaacccuaguuagcuucauucagagaaaga

SEQ ID NO: 82513 - RNA, 57 nt, Homo Sapiens
cucauuucagacgaaaguaggcgguacgaacccuaauggaggcaguuuugaggaggu

SEQ ID NO: 82514 - RNA, 64 nt, Homo Sapiens
ucugucacccauaauaaagccuaucgcuauuuaagaacccuaaaagcgcuucuucuagccacug

SEQ ID NO: 82515 - RNA, 64 nt, Homo Sapiens
guucaggaagauuuuaaucuaauccugaacauuagaacccuaauuucauaaggacucuuaaaau

SEQ ID NO: 82516 - RNA, 64 nt, Homo Sapiens
gccagcuauagauuugggguguaccaccaagagugaacccuaauuguccaaacccacaggaggu

SEQ ID NO: 82517 - RNA, 64 nt, Homo Sapiens
ucucaggcuuccugaccuaccuuauaaacacauugaacccuagagggucaugaaaaucacagaa

SEQ ID NO: 82518 - RNA, 64 nt, Homo Sapiens
aggccacugugggugaagcgccucaguuacacaggaacccuaaagcaaaucugccaccgugggg

SEQ ID NO: 82519 - RNA, 64 nt, Homo Sapiens
uauuucuguuaauuuuguuauauguuuuuugugugaacccuaaagguuaaaccuuagcccugug

SEQ ID NO: 82520 - RNA, 64 nt, Homo Sapiens
cuugguuugcuacccuuagucucccaucagggaagaacccuauacggaagaucagaugcaauug

SEQ ID NO: 82521 - RNA, 64 nt, Homo Sapiens
auuugucagggauuuagcccaugacguguuucuugaacccuacuuucuggaaguggaguugacu

SEQ ID NO: 82522 - RNA, 64 nt, Homo Sapiens
uuuucuauaaaaaaacaaacuauguguaaauguagaacccuaauuguaauucauuuucucaggc

SEQ ID NO: 82523 - RNA, 64 nt, Homo Sapiens
guggggaaugaggaauuuuauauaauugcagcuagaacccuacaccugcuaaaaggcaauguaa

SEQ ID NO: 82524 - RNA, 64 nt, Homo Sapiens
ccauaaaguguaguuaccauauaaaggcuagucagaacccuauaugaaaacaaacuuaugggua

SEQ ID NO: 82525 - RNA, 64 nt, Homo Sapiens
ggcugccagacugaugggcgccccagcuuuccaggaacccuacuaugagacacacaccuacccu

SEQ ID NO: 82526 - RNA, 64 nt, Homo Sapiens
agcacaggucgacuacauaauggaguccauuggcgaacccuauugcaauuugguccaacuauau

SEQ ID NO: 82527 - RNA, 64 nt, Homo Sapiens
ccuguguccuuucuuauggacucgcaggauuuuagaacccuaaugcacccuggaggguagcugg

SEQ ID NO: 82528 - RNA, 64 nt, Homo Sapiens
aggagaauacagucuccaucggcuuuugaccuaagaacccuagcgacgggagggacccgagccu

SEQ ID NO: 82529 - RNA, 64 nt, Homo Sapiens
uccacaggauaauagguuuuaaguaugcuccugggaacccuaguccuucaccagcauuucccaa

SEQ ID NO: 82530 - RNA, 64 nt, Homo Sapiens
ugugucagaaucuccaucccuaaagguauauugugaacccuagcucauuuguaacuuuaggaug

SEQ ID NO: 82531 - RNA, 64 nt, Homo Sapiens
gccaccugaccagaagucuuuguuauauggaugggaacccuaacuuagggcuugggcaggggaa

SEQ ID NO: 82532 - RNA, 64 nt, Homo Sapiens
gccaccugaccagaagucuuuguuauauggaugggaacccuaacuuagggccugggcaggggaa

SEQ ID NO: 82533 - RNA, 64 nt, Homo Sapiens
gcuuucuuagcuugaacugauaacuaugcauuaugaacccuaagucaauauauuuuuggugguu

SEQ ID NO: 82534 - RNA, 64 nt, Homo Sapiens
gccuuccugaauuggcaguggucagagcacaccugaacccuauccugggcuggugaugagcaga

SEQ ID NO: 82535 - RNA, 64 nt, Homo Sapiens
uggagggauacaauucuugguucagugggaaacagaacccuaaaacauccauuugauucaaggu

SEQ ID NO: 82536 - RNA, 64 nt, Homo Sapiens
agaagagagggaaguaagcuucuguucagcaccugaacccuagaaaaagagccaguuugcuacg

SEQ ID NO: 82537 - RNA, 64 nt, Homo Sapiens
ugcuuauuguuaagugaaaauaaaagacauauaggaacccuaaaagaauuagacaucaagucau

SEQ ID NO: 82538 - RNA, 64 nt, Homo Sapiens
ugucauugcaagaaauaaaaucucaaaucacacugaacccuaaagucagcaacagcacuaaaaa

SEQ ID NO: 82539 - RNA, 64 nt, Homo Sapiens
ucagcucccacuaaugaaacagugauaaagaacugaacccuaaaaggggccugccuaagauugc

SEQ ID NO: 82540 - RNA, 64 nt, Homo Sapiens
uuuuguagaggaacuuaaucagacacaugggacagaacccuacuguauuuuguaaaugugucag

SEQ ID NO: 82541 - RNA, 64 nt, Homo Sapiens
auuuggcagggaagacaccuggguuuuuaauucagaacccuauuuauauacuguuaaaauuuga

SEQ ID NO: 82542 - RNA, 64 nt, Homo Sapiens
ugggugucaucuccuccgaccaggaaggggcugugaacccuaagcaagguuccuggaacugaca

SEQ ID NO: 82543 - RNA, 64 nt, Homo Sapiens
aagucaaaagagcuggggcccuaaucaaacaccagaacccuaucuggguggagacaagcucagu

SEQ ID NO: 82544 - RNA, 64 nt, Homo Sapiens
aagaccccacuggagucucugggacuccuuccuugaacccuaauuuggucucucccagcucugg

SEQ ID NO: 82545 - RNA, 64 nt, Homo Sapiens
cucaucuuucaucugggaagaguguuuauagagugaacccuauuuucccccgucaaccaaaauc

SEQ ID NO: 82546 - RNA, 64 nt, Homo Sapiens
gggagggaagguccuacagggaaggggccuuacagaacccuaaagaauggacucugaggacuga

SEQ ID NO: 82547 - RNA, 64 nt, Homo Sapiens
auuucuugaaguuaauggaaauuuccaagaacaagaacccuaguuguuuuaggaagcugagaug

SEQ ID NO: 82548 - RNA, 64 nt, Homo Sapiens
cugacguaauuuuuucccugacgucuuuaaaauugaacccuaucaugaaaugauaauuucuucc

SEQ ID NO: 82549 - RNA, 64 nt, Homo Sapiens
aucaugaugacuuuaccuccauucccucuacccagaacccuaaauuauucuguuauuggaucug

SEQ ID NO: 82550 - RNA, 64 nt, Homo Sapiens
ucuucugcccuaggugagaacccuugcacuagaggaacccuacaccccaacccuggggggaaug

SEQ ID NO: 82551 - RNA, 64 nt, Homo Sapiens
caguggaaggagaauuuaaugguaugaauagacagaacccuauccaguaggauuuuucaaaccu

SEQ ID NO: 82552 - RNA, 64 nt, Homo Sapiens
ggcggaguuugcagugagcccaggagaaucgcuugaacccuagaagccuuucaggaggcugaga

SEQ ID NO: 82553 - RNA, 64 nt, Homo Sapiens
gccaggauguucuguuuaaugucugggaguucccgaacccuagacagauggauguugacuuggu

SEQ ID NO: 82554 - RNA, 64 nt, Homo Sapiens
uuucuucuucccaucaccaguggcagcaacaagagaacccuacuuauacauguucauaugcaua

SEQ ID NO: 82555 - RNA, 64 nt, Homo Sapiens
augauuaacugcuauucguggugggggugggggggaacccuaugauuuacuaugcagaugaaga

SEQ ID NO: 82556 - RNA, 64 nt, Homo Sapiens
uuuagaaaaagacugguagaaauuggagugaaaggaacccuacagauuagcccaguucucucuu

SEQ ID NO: 82557 - RNA, 64 nt, Homo Sapiens
uagugccccaagcugcacuauuuauuuguauauugaacccuagcagaacucugugucagccacu

SEQ ID NO: 82558 - RNA, 64 nt, Homo Sapiens
aauauauccuguguaccucauuguuaacagcaacgaacccuagaggugcuacuucuucuucuuu

SEQ ID NO: 82559 - RNA, 64 nt, Homo Sapiens
aagaauuccucucccaucaucaggcauauaucaagaacccuaugguuaucauaaauggaacuug

SEQ ID NO: 82560 - RNA, 64 nt, Homo Sapiens
gcaguaaaauaaaaaaccuguugagauuuacguggaacccuaaauuuuuaaccucaaaauggug

SEQ ID NO: 82561 - RNA, 64 nt, Homo Sapiens
uaaccaggucaucagggacccauuguucucuucagaacccuaucugggagagaaggcgaaccac

SEQ ID NO: 82562 - RNA, 64 nt, Homo Sapiens
ccacaggaaaaaaaauuacuuuguaugcuuguuugaacccuauggguucguuuuauuaauaaaa

SEQ ID NO: 82563 - RNA, 64 nt, Homo Sapiens
ggcaaccuacccauucaggaaggucagggcuuuggaacccuaaaaaguuggcccgaugacuuaa

SEQ ID NO: 82564 - RNA, 64 nt, Homo Sapiens
gcuuacugugguauuuggaauguauguaucuucugaacccuacaucaaguugaaaagguuuguu

SEQ ID NO: 82565 - RNA, 64 nt, Homo Sapiens
auacuuuagugaacguggacuccagacucucugugaacccuaugagagcgcgucugggcccggc

SEQ ID NO: 82566 - RNA, 64 nt, Homo Sapiens
aaacauaagacacaggggcuguugcuuuugaacagaacccuauauuacucuccugggaucugag

SEQ ID NO: 82567 - RNA, 64 nt, Homo Sapiens
gccccaucauauuaacugucuguuaacuuucugagaacccuagugguauguaguuaggaauguc

SEQ ID NO: 82568 - RNA, 64 nt, Homo Sapiens
gagaacggggagcugccaggcacacuugggucaggaacccuaauaaucagauaccugcugucac

SEQ ID NO: 82569 - RNA, 64 nt, Homo Sapiens
uacaguugaccaagcugcuuuagccugcucucuagaacccuacucccauuugauccuaaccuuu

SEQ ID NO: 82570 - RNA, 59 nt, Homo Sapiens
gcaguaaacugaagacaagacagagccaggaacccuacucggaacacaugagcauguaa

SEQ ID NO: 82571 - RNA, 64 nt, Homo Sapiens
gugccccaaaucaaauugaauagccuucagaauagaacccuagagaaugucuuauaaggauugu

SEQ ID NO: 82572 - RNA, 64 nt, Homo Sapiens
auuuaguuauucuaaaauagaaaauuuuagacaugaacccuacuaccuacucccaccccaaggg

SEQ ID NO: 82573 - RNA, 64 nt, Homo Sapiens
ucuuacuaaacauaagaacauucauacugaagaggaacccuaugagugugaagaauauggcaaa

SEQ ID NO: 82574 - RNA, 64 nt, Homo Sapiens
ccauuggaaggaaugcucuaccucacagaacucugaacccuacagaaauaugggccugcugcca

SEQ ID NO: 82575 - RNA, 64 nt, Homo Sapiens
ggaggcccagggcuggugagucuagaaugcucuggaacccuacaccuagugaugugugucuauu

SEQ ID NO: 82576 - RNA, 64 nt, Homo Sapiens
gccccgcuuucccuccaaggggccccccaucucugaacccuagauucugaccuuugauccgcua

SEQ ID NO: 82577 - RNA, 64 nt, Homo Sapiens
gcgagagugacgaugauuggggaagggccugcacgaacccuacagccccgcgggccgggcucca

SEQ ID NO: 82578 - RNA, 52 nt, Homo Sapiens
gcugcaaugaauacagcaaggagaacccuauuaccaaaggguccauacauga

SEQ ID NO: 82579 - RNA, 64 nt, Homo Sapiens
agguuuacauuugcaccuuagccucaauagcuacgaacccuagagaagcagcuagcuggagcuc

SEQ ID NO: 82580 - RNA, 64 nt, Homo Sapiens
gaaagcaauaacuuugucucguuccuguugggcugaacccuaaggugagugugcaguacagugu

SEQ ID NO: 82581 - RNA, 64 nt, Homo Sapiens
uguccauuucugcacacacguuacugaugcuccugaacccuaugaccaugaucucaauagucag

SEQ ID NO: 82582 - RNA, 64 nt, Homo Sapiens
cccugccuccagccuuccugaguuucucucuccugaacccuacucucuccuuuuugcuuccuca

SEQ ID NO: 82583 - RNA, 64 nt, Homo Sapiens
gguaaagcuaugauuuuaggcgaguuacccaccagaacccuaauuguuauggagcuucaagaau

SEQ ID NO: 82584 - RNA, 64 nt, Homo Sapiens
gccuuugguccuaagaauggcaggaggccgaucagaacccuagccucccucagaagcacguugg

SEQ ID NO: 82585 - RNA, 64 nt, Homo Sapiens
gucccgacccgcgggcgaggugugcgcgaacccugaacccuacgcgccgccggcaguggaccgc

SEQ ID NO: 82586 - RNA, 64 nt, Homo Sapiens
uuuccuaauaugccuuuacugauccguuugcugugaacccuauguuauuuccaugugucaagug

SEQ ID NO: 82587 - RNA, 64 nt, Homo Sapiens
acucacugcucacccucuucugugagcaggaaaagaacccuacugacaugcaugguuuaacuuc

SEQ ID NO: 82588 - RNA, 64 nt, Homo Sapiens
acaaaaaacuaagucugcucagugaaaugcuguagaacccuaaauaagugguagaagaguguca

SEQ ID NO: 82589 - RNA, 64 nt, Homo Sapiens
caguucugugagaaagcagcaugaucuguugaaugaacccuagaaaaugccagaccacguuucu

SEQ ID NO: 82590 - RNA, 64 nt, Homo Sapiens
aagcaaagcugauacagaagacuguuccaaagcugaacccuagauuaaccuccugcuucucuag

SEQ ID NO: 82591 - RNA, 64 nt, Homo Sapiens
uaauagacuucucggagucuuuaauuauuucucuggcaaugauuauucaucauucacccuugau

SEQ ID NO: 82592 - RNA, 64 nt, Homo Sapiens
ccaccacaguauucuaauuucuuguaacugaugaggcaaugauguuuauaauacucacuugacc

SEQ ID NO: 82593 - RNA, 64 nt, Homo Sapiens
ucccgccauugggccaucuucccaaaguuauccaggcaaugaaucauaggaacaaugccauucc

SEQ ID NO: 82594 - RNA, 64 nt, Homo Sapiens
cagccacuaaggcucagauuguuaaagcucucaaggcaaugacucgaaguuugcaguauggaga

SEQ ID NO: 82595 - RNA, 64 nt, Homo Sapiens
cugagguucuccuagugcaggaacguugaauauuggcaaugauuccugguuccagaaagggcug

SEQ ID NO: 82596 - RNA, 64 nt, Homo Sapiens
guugauuuuggugugacuuguguaaaugguucauggcaaugacguuggguugcuuccuaggccu

SEQ ID NO: 82597 - RNA, 64 nt, Homo Sapiens
ugggacuacuuggucgaauuauuuguagacuaaaggcaaugaugaaucaaguauaaucccugag

SEQ ID NO: 82598 - RNA, 64 nt, Homo Sapiens
aacaagcagaauuccaggagguaacacgguuaaaggcaaugagauuuacuuuuggacuggguuu

SEQ ID NO: 82599 - RNA, 64 nt, Homo Sapiens
uggcaguuuguguagacaaucuuacugagcaaaaggcaaugaaaagucuugguucccacacugc

SEQ ID NO: 82600 - RNA, 64 nt, Homo Sapiens
cuccauucauuucagugcugccuggaggaaacucggcaaugauuucuuucaguugugaaguucc

SEQ ID NO: 82601 - RNA, 64 nt, Homo Sapiens
acugaguaacuuuuaaguggaaaccaaguuuagauuuggggagugguaaaggaaucagcuuuuu

SEQ ID NO: 82602 - RNA, 64 nt, Homo Sapiens
agugcucuggccucaucauuccugcaaagcuugcuuuggggaguuggauaaugugaaaauuuua

SEQ ID NO: 82603 - RNA, 64 nt, Homo Sapiens
uaaugcugcagaacugcaaccuuuuguaccuuucuuuggggaauggggugggggugggagagga

SEQ ID NO: 82604 - RNA, 64 nt, Homo Sapiens
cuucauauacagucuacuucguguucugucacccuuuggggaggggaguucuccugggacagug

SEQ ID NO: 82605 - RNA, 64 nt, Homo Sapiens
uugcucaucucucccuucuguuuuaugugauuuguuuggggagaaagcuaaaaaaaccugaaac

SEQ ID NO: 82606 - RNA, 64 nt, Homo Sapiens
uacuggggauggggacauuccugcccauaaaggauuuggggaaagaagauuaauccuaaaauac

SEQ ID NO: 82607 - RNA, 64 nt, Homo Sapiens
acuauagggaauauuguauaauuuaugaauuuucuuuggggaucuuauuacugccauuaaucag

SEQ ID NO: 82608 - RNA, 64 nt, Homo Sapiens
aaggacccaucaaugaugguaaaugagacacagguuuggggaccaagauacgguuggaaaggaa

SEQ ID NO: 82609 - RNA, 64 nt, Homo Sapiens
aaagugacuugacauguccacucugaaagaucguuuuggggacaauuuauaauuucuaguauuu

SEQ ID NO: 82610 - RNA, 64 nt, Homo Sapiens
aggauuagucaguuuuaagcgaaauuuaagguaauuuggggaaaaggugauucuguggugccau

SEQ ID NO: 82611 - RNA, 64 nt, Homo Sapiens
ggcugggagugacaguagccuuccacacuauuuauuuggggaugauacuacuacacuauuacac

SEQ ID NO: 82612 - RNA, 64 nt, Homo Sapiens
agggagagagagacucaucugagccccacaaaacuuuggggacacuagagggaaacaaaaggga

SEQ ID NO: 82613 - RNA, 64 nt, Homo Sapiens
acuuuccugucauuucuaacgccucucccacugcuuuggggagcuggaugugagagaccacauu

SEQ ID NO: 82614 - RNA, 64 nt, Homo Sapiens
gguuguuauaaaaugcaauuguuaauguguuugguuuggggacugguaaaaugcagaagacagu

SEQ ID NO: 82615 - RNA, 64 nt, Homo Sapiens
guuaaaacaaauuacuauaguggcacuaaaugcauuuggggauguauuuuuuccauuuugacau

SEQ ID NO: 82616 - RNA, 64 nt, Homo Sapiens
gacuuaauugaaucacauuuugggaccagauguauuuggggauagaauucuuuaaauguauggg

SEQ ID NO: 82617 - RNA, 64 nt, Homo Sapiens
uaaaacgauaccagacauuugucacagugucuuauuuggggaaaguuugcuaauauacauuuug

SEQ ID NO: 82618 - RNA, 64 nt, Homo Sapiens
agagggaaugguguuugaugguaaacacaggguguuuggggaucaaggagccuagauucucucc

SEQ ID NO: 82619 - RNA, 64 nt, Homo Sapiens
caucugcauuuucuaaaaaauuccaugcagguguuuuggggagagguauuuuuuaagcaaugaa

SEQ ID NO: 82620 - RNA, 64 nt, Homo Sapiens
auuaaggguguuagucuugguaagacuugaauuuuuuggggacuucacugccuucuugggauac

SEQ ID NO: 82621 - RNA, 64 nt, Homo Sapiens
uaauuuccacggacggcugcaguggcuguguugguuuggggaacugucagucaggcagggaggg

SEQ ID NO: 82622 - RNA, 64 nt, Homo Sapiens
aaauuaugugugugugugcuaagaauguggcuauuuuggggagauguauugaaucaucaaauaa

SEQ ID NO: 82623 - RNA, 64 nt, Homo Sapiens
ucugagccuagcucagaaaauaaccuauuccuuuuuuggggaaacauucagauccagccauuac

SEQ ID NO: 82624 - RNA, 64 nt, Homo Sapiens
cauugagucauuauccuugcuaugaugaugguguuuuggggaugagagggugcuauccauuucu

SEQ ID NO: 82625 - RNA, 64 nt, Homo Sapiens
agaagccuuuccuguagccuucuguaggaauucuuuuggggaagugaggaagccagguccacgg

SEQ ID NO: 82626 - RNA, 64 nt, Homo Sapiens
ggugguuuagagauaauccaaaaucaggguuugguuuggggaagaaaauccucccccuuccucc

SEQ ID NO: 82627 - RNA, 64 nt, Homo Sapiens
aaaaaaaaaaaaaaaguuuuuaugugcacuuaaauuuggggacaauuuuauguaucuguguuaa

SEQ ID NO: 82628 - RNA, 64 nt, Homo Sapiens
uucucccuaccccacaaaucuuuugguacuaccauuuggggaagccaagcaaggauaguaaauu

SEQ ID NO: 82629 - RNA, 64 nt, Homo Sapiens
uaugcaucguucuacacagguuuaaaacaacuuuuuuggggauuuagggcuauuauaggaauag

SEQ ID NO: 82630 - RNA, 64 nt, Homo Sapiens
uuuuaaagaugacauaaauaaguuuaaauaucaauuuggggaguaagguuuaauauugccaucg

SEQ ID NO: 82631 - RNA, 64 nt, Homo Sapiens
aauaacuuggguguuuaggagucuuuucacauuuuuuggggauaugaacuagauguucaagaac

SEQ ID NO: 82632 - RNA, 64 nt, Homo Sapiens
uuuuuugcccaugugucuuugguaagacaguaguuuuggggaacuuaccucccuucucaaauuc

SEQ ID NO: 82633 - RNA, 64 nt, Homo Sapiens
uuaugcuggaaagagcuccuuggugcuggcaguguuuggggacaguaguacuggcuccaccccu

SEQ ID NO: 82634 - RNA, 64 nt, Homo Sapiens
cguccaucuuuuuaagggauguucugcugauaguuuuggggauagaaaauugaaacacagaguu

SEQ ID NO: 82635 - RNA, 64 nt, Homo Sapiens
augaaguuuugauuuauuugcaauauaugacuaauuuggggaaacuuugaaaagagaauauuua

SEQ ID NO: 82636 - RNA, 64 nt, Homo Sapiens
uuuugauaauauaaauauauugccccuuccccaauuuggggacugggggguccagacuaccuga

SEQ ID NO: 82637 - RNA, 64 nt, Homo Sapiens
ucagccuuccuuccagucuggcugagagcugcgcuuuggggacucuuggcugagcuucuacagg

SEQ ID NO: 82638 - RNA, 64 nt, Homo Sapiens
uauauaguuuuuaccuuuuauguagcacauaaacuuuggggaagggagggcaggguggggcuga

SEQ ID NO: 82639 - RNA, 64 nt, Homo Sapiens
agauaaauauuugacuugcaugaagagaagcaauuuuggggaaggguuugaauuguuuucuuua

SEQ ID NO: 82640 - RNA, 64 nt, Homo Sapiens
auaagguugaguauuuauuagaugggaagggaaauuuggggauuauuuauccuccuggggacag

SEQ ID NO: 82641 - RNA, 64 nt, Homo Sapiens
gaaauuuggggauuauuuauccuccuggggacaguuuggggaggauuauuuauuguauuuauau

SEQ ID NO: 82642 - RNA, 64 nt, Homo Sapiens
gagcaaaccccaaaccaguauauuuuaguauuuguuuggggaggggaacaagccaauaaagaug

SEQ ID NO: 82643 - RNA, 64 nt, Homo Sapiens
uacuggauuuuguaaucuaggauaaaucacuuuuuuuggggacuuugauuuugcuccauuacgu

SEQ ID NO: 82644 - RNA, 64 nt, Homo Sapiens
caaaggggauugcuacaccauauagaaacuuguauuuggggauuuuuuuauuucaaaaaaaaug

SEQ ID NO: 82645 - RNA, 64 nt, Homo Sapiens
ugggguggccugcagugacagcugaggguaccuuuuuggggagagauuaggcuacauaaaaugg

SEQ ID NO: 82646 - RNA, 64 nt, Homo Sapiens
uaugccaccuuuuaaaccaauggaaauugcuauauuuggggaugucauacauuugauauugcuu

SEQ ID NO: 82647 - RNA, 64 nt, Homo Sapiens
auaaguuugguaaacuuuagucccauuauauacuuuuggggacaguguuauaaaucagaauuuu

SEQ ID NO: 82648 - RNA, 64 nt, Homo Sapiens
aagauuaaaaaaacaacaacaacaacuuauuuaguuuggggaggggaagcauuuuuaagugugu

SEQ ID NO: 82649 - RNA, 64 nt, Homo Sapiens
gcagagacucuauagcugucucuuagggcaguauuuuggggaaguggggcuugaagaagcagcc

SEQ ID NO: 82650 - RNA, 64 nt, Homo Sapiens
gucuggaaaguugggauuuggaaagaacguucccuuuggggauacaagcagaaaacaagagaaa

SEQ ID NO: 82651 - RNA, 64 nt, Homo Sapiens
gcuggcagugugcggagcugggcucucaugucucuuuggggagacccugccucuuccgguugga

SEQ ID NO: 82652 - RNA, 64 nt, Homo Sapiens
ggcaucaguuguagcccacaaacauggcuagggcuuuggggauuuggcauuuuucuggugguuu

SEQ ID NO: 82653 - RNA, 64 nt, Homo Sapiens
acaucaacuucuuucucuccguuccugaaggaacuuuggggaaucaucuucauccguaguuacg

SEQ ID NO: 82654 - RNA, 64 nt, Homo Sapiens
cagggacucucgucugugggacgggauccaagaguuuggggauuagggguauuagggcuuuuca

SEQ ID NO: 82655 - RNA, 64 nt, Homo Sapiens
ggacacgaugaagcaccggcuccauaagacaccuuuuggggaagugguugugcauauuuuauuu

SEQ ID NO: 82656 - RNA, 64 nt, Homo Sapiens
ucauggguguuuuugucaacugcuuguuaauugauuuggggauguuugccccgaaugagagguu

SEQ ID NO: 82657 - RNA, 64 nt, Homo Sapiens
ucuguuuccucuugaucucaaagcacaauguggauuuggggaccaaaggucagggacacauccc

SEQ ID NO: 82658 - RNA, 64 nt, Homo Sapiens
uuauauuuuccauaucugugggcuuuguucuacauuuggggagcuuuuuauauuguuuauuuca

SEQ ID NO: 82659 - RNA, 64 nt, Homo Sapiens
gaagauacaaaggcacaagaaugauacaauggauuuuggggacuuaggggaaaggaugcagggg

SEQ ID NO: 82660 - RNA, 64 nt, Homo Sapiens
ggggagaguggauggacuagcugaugaccuugaauuuggggaguaucuccaggccaccagaacc

SEQ ID NO: 82661 - RNA, 64 nt, Homo Sapiens
acuguggcucuaccugccccgccccacugguaccuuuggggaagccccaggugugaagaccccu

SEQ ID NO: 82662 - RNA, 64 nt, Homo Sapiens
aacuuccaucuggucugaccgcaaacaguguuuauuuggggacagggguugggaugggggugug

SEQ ID NO: 82663 - RNA, 64 nt, Homo Sapiens
uggagugguccccagaagcauccaagaaaagauauuuggggacguagccuaacauuuuaccaac

SEQ ID NO: 82664 - RNA, 64 nt, Homo Sapiens
cagguaccccagggcagcaguggagcugaccggcuuuggggagggggcaucucccugccacagg

SEQ ID NO: 82665 - RNA, 64 nt, Homo Sapiens
aagauacuugacccagcacaaaguggggaugauguuuggggaacauggugaaaugacaggcaag

SEQ ID NO: 82666 - RNA, 64 nt, Homo Sapiens
ggaauuuuguaucauauuuuaaaaugugguuuucuuuggggacuaaaguggaugauggagaaau

SEQ ID NO: 82667 - RNA, 64 nt, Homo Sapiens
auucagucuguaccagacauagggcagaaaagucuuuggggauguccagagacaacuuaggaug

SEQ ID NO: 82668 - RNA, 64 nt, Homo Sapiens
acuacccccucccugccaucuuuucuucugcuacuuuggggaguugauggccaggaaagaagcc

SEQ ID NO: 82669 - RNA, 64 nt, Homo Sapiens
cauguccaguccucuucuucccucugcuggaaccuuuggggacacucaaggguacaguuugaca

SEQ ID NO: 82670 - RNA, 64 nt, Homo Sapiens
ccaguuauccccgaaauuucuauguauuauauuuuuuggggaagugaggugugcccaguuuuuu

SEQ ID NO: 82671 - RNA, 64 nt, Homo Sapiens
gaggugugcccaguuuuuuaaucuaacaacuacuuuuggggacuugcccacaucucugggauuu

SEQ ID NO: 82672 - RNA, 64 nt, Homo Sapiens
cagugcucgggaucccgggcccagcuuuugccuuuuuggggaugcuuggugagacagauuugcc

SEQ ID NO: 82673 - RNA, 64 nt, Homo Sapiens
agcucugaaggggucuccuaguuccagauuuuaauuuggggaacagaucuggguucuuuuuaac

SEQ ID NO: 82674 - RNA, 64 nt, Homo Sapiens
gggcauuuugguagguaaagcaacagcaaucaucuuuggggaauggaaagguacccuaaucguu

SEQ ID NO: 82675 - RNA, 64 nt, Homo Sapiens
gcaaauauauauauauauacuuguaguuuuuaaauuuggggaauuguggaaaaaaaucuccaaa

SEQ ID NO: 82676 - RNA, 64 nt, Homo Sapiens
gggugggcugggguggauggugaucuuuuagugcuuuggggaugucuagugugaagccaaauag

SEQ ID NO: 82677 - RNA, 64 nt, Homo Sapiens
ugaaauaugugguugguaggguguuuucuguuguuuuggggaagcagagagauaaggaacaaaa

SEQ ID NO: 82678 - RNA, 63 nt, Homo Sapiens
uauuucugaugaauaugaaauaaaacaugccucccacagaauccgucagcccgaguucugaau

SEQ ID NO: 82679 - RNA, 63 nt, Homo Sapiens
gugaguugauuaaaucucuuaagcauguaaagcccacagaaccugaggccuccccagaagcag

SEQ ID NO: 82680 - RNA, 63 nt, Homo Sapiens
caagugacgacaaagauucuguuucaaauauagccacagaaauaaaggagggaccaauaucug

SEQ ID NO: 82681 - RNA, 63 nt, Homo Sapiens
caagugacgagaaagauucuguuucaaauauagccacagaaauaaagaagggacaacaaucug

SEQ ID NO: 82682 - RNA, 63 nt, Homo Sapiens
caacugacgaggaagacucuguuucgaauauagccacagaaauaaaggauggagaaaaaucug

SEQ ID NO: 82683 - RNA, 63 nt, Homo Sapiens
caacugaugagaaagauucuguuucgaacauagccacagaaauaaaggauggagaaaaaucug

SEQ ID NO: 82684 - RNA, 63 nt, Homo Sapiens
cccuaaacgccgccucgucaagaaagggcagcgccacagaagcucuaguaacuuaagugagag

SEQ ID NO: 82685 - RNA, 63 nt, Homo Sapiens
gaauaaauuauacaccacugacugagucuugaaccacagaaggggauccuuuuggggcuggag

SEQ ID NO: 82686 - RNA, 63 nt, Homo Sapiens
aaaaaaaaaaaaaucagaaaacccccaccuaauccacagaaaguaaugucuuuccccuccccu

SEQ ID NO: 82687 - RNA, 63 nt, Homo Sapiens
uucaggucacgcagcccuguacuguauccagcaccacagaaaccucaguguuuuuccucugcu

SEQ ID NO: 82688 - RNA, 63 nt, Homo Sapiens
aauucaguguauccguuauuuuaaugcacuacaccacagaaauguuaaguuggucaagggcuu

SEQ ID NO: 82689 - RNA, 63 nt, Homo Sapiens
aaacccuucccuccaggaggcccccgcugacucccacagaaacccaccuaccauaagaugucu

SEQ ID NO: 82690 - RNA, 63 nt, Homo Sapiens
uggcagugagaccagcccacccaccaccacccaccacagaaaagcacaaaccucugggaaaga

SEQ ID NO: 82691 - RNA, 63 nt, Homo Sapiens
aaacacacccaccagugcagccugaaguaacucccacagaaaccaucaucgucuuuguacauc

SEQ ID NO: 82692 - RNA, 63 nt, Homo Sapiens
caagacagcugaaggagaaugaaacacacacauccacagaaacagagaggcguagguggcccu

SEQ ID NO: 82693 - RNA, 63 nt, Homo Sapiens
cccacccacccugcaccccucgcccuccccccaccacagaaucuaagaccuuucagcuucgag

SEQ ID NO: 82694 - RNA, 63 nt, Homo Sapiens
ucaguugaaauuuuuuucacuugaacugaugagccacagaacuaaaaaaaugccaugaaacau

SEQ ID NO: 82695 - RNA, 63 nt, Homo Sapiens
caguaaguuuacauuucaauaguggggaaaaucccacagaaaucaaauuuuccaauuugaacc

SEQ ID NO: 82696 - RNA, 63 nt, Homo Sapiens
uaaucggguacuaccagucuugaaauuuugccaccacagaaagaaagauguuuuuaaaagcuu

SEQ ID NO: 82697 - RNA, 63 nt, Homo Sapiens
uagucuccauuucauagaugaaaauagugaagcccacagaaaauaaguagcuccuccacaggu

SEQ ID NO: 82698 - RNA, 63 nt, Homo Sapiens
caccagucuuucugggaacuuaugcacucagccccacagaaccagggaccacccuccccacag

SEQ ID NO: 82699 - RNA, 63 nt, Homo Sapiens
ccucuucgggcagccccccucucugccucccuuccacagaagcccauucccucccagccuccg

SEQ ID NO: 82700 - RNA, 63 nt, Homo Sapiens
cuuucaccauuuuauauacaaaggggaccagugccacagaaggguacccgaagaaaugagaag

SEQ ID NO: 82701 - RNA, 63 nt, Homo Sapiens
uauacauccagauggccugaaguuacugaagauccacagaagugaaaauagccuuaacugaug

SEQ ID NO: 82702 - RNA, 63 nt, Homo Sapiens
gcaagaagcucucuuaagaagugaagaaauuggccacagaagauacuucaaagugucaggaga

SEQ ID NO: 82703 - RNA, 63 nt, Homo Sapiens
uuugcagagcugggcaguugcuccaccuucucuccacagaaugagaggcacugcccaucucuu

SEQ ID NO: 82704 - RNA, 64 nt, Homo Sapiens
gaaaagccauagcccggcagccccuaccaugagggagacagagaaacagaacugguggugcugg

SEQ ID NO: 82705 - RNA, 64 nt, Homo Sapiens
caaaguugucccaacagaggaggccagugaggcagagacagagcucucccacucucagacccuc

SEQ ID NO: 82706 - RNA, 64 nt, Homo Sapiens
agaccagcggagugggagggagacgcaguagacagagacagaccgagagaggaauggagagaca

SEQ ID NO: 82707 - RNA, 64 nt, Homo Sapiens
gcaguagacagagacagaccgagagaggaauggagagacagagggggcgcgcgcacaggagccu

SEQ ID NO: 82708 - RNA, 64 nt, Homo Sapiens
cucgcuauugucaccagggcuuuuguuuuguuuggagacagaguccacgcccggcuaauuuuug

SEQ ID NO: 82709 - RNA, 64 nt, Homo Sapiens
cucgcucugucgcccaggcuucuuuuuuuuuuuugagacagaauuuuuuuuuucuuucuuucuu

SEQ ID NO: 82710 - RNA, 64 nt, Homo Sapiens
uagccucacucagcccagggauagccaguguugggagacagaguugccucagguucccaggggc

SEQ ID NO: 82711 - RNA, 64 nt, Homo Sapiens
ggacccggaagaaucaucuaccucccagcuuugugagacagaaccaaguaaaaggaaacaugcu

SEQ ID NO: 82712 - RNA, 64 nt, Homo Sapiens
cucacucuguugcccaggcucuuuuuuuuuuuuugagacagagucaggucuagagaaaugauac

SEQ ID NO: 82713 - RNA, 64 nt, Homo Sapiens
cuugcucugucgccgaggcuuguuuguuuguuuugagacagaguguagugggguuuuuugguuu

SEQ ID NO: 82714 - RNA, 64 nt, Homo Sapiens
ugguauucucaacagcaaaggggugaaaaaucuagagacagaggaggccuggcaggggugauaa

SEQ ID NO: 82715 - RNA, 64 nt, Homo Sapiens
cuuggaguggcacaaguugggggaaagcgcacuugagacagagguaaugauggggacgaaguga

SEQ ID NO: 82716 - RNA, 64 nt, Homo Sapiens
uugaaucccuaaaugcaccugucuuucacuuuuugagacagacugaauauaucuaaaauuucca

SEQ ID NO: 82717 - RNA, 64 nt, Homo Sapiens
uuuguauaauuuugaacacuauaauagcaauucagagacagacauuguuaaagguuugauguau

SEQ ID NO: 82718 - RNA, 64 nt, Homo Sapiens
uucagugacgaaggugcguuuuucgugccgaaaugagacagaaaugauacaggguugguucuca

SEQ ID NO: 82719 - RNA, 64 nt, Homo Sapiens
cucacucugucacccaggcuuuuauuuuuuuuuugagacagaguauguaaguaaucuuuuauuu

SEQ ID NO: 82720 - RNA, 64 nt, Homo Sapiens
aagacaaaagguccagucucacaaagucaguuuggagacagaaauuacagcaguuucaaaaaug

SEQ ID NO: 82721 - RNA, 64 nt, Homo Sapiens
acuccuuguuauccuuguuuccuuagcuugguaugagacagaucggauccaguuucccaugcac

SEQ ID NO: 82722 - RNA, 64 nt, Homo Sapiens
aaaaaugcaucuggcuacuuuuucauguauguaugagacagaaacuaauccuuacuauccuauu

SEQ ID NO: 82723 - RNA, 64 nt, Homo Sapiens
uaagccucccuaagagacugcucuuagcacaccugagacagauuuugaccaccuugggcuggca

SEQ ID NO: 82724 - RNA, 64 nt, Homo Sapiens
aauguugaauaagagcacgauuccagucuaggcagagacagaagcgagagagauuggcuuuuua

SEQ ID NO: 82725 - RNA, 64 nt, Homo Sapiens
agguugacuuaauuuauuuauuuuuugaaaagaagagacagaaaauaccuuauuaucugcaggg

SEQ ID NO: 82726 - RNA, 64 nt, Homo Sapiens
agaagccuuccccugcaaggugcccaccugcccggagacagagggagcagcugaggccucucuc

SEQ ID NO: 82727 - RNA, 64 nt, Homo Sapiens
gacaguagaugagaauagaaaauuaagagcuaaggagacagaaauuuaaauggcacuauguagu

SEQ ID NO: 82728 - RNA, 64 nt, Homo Sapiens
guauuuuguuguaugacagacaggaaucauucaugagacagaauuaggcguuguggugaauaug

SEQ ID NO: 82729 - RNA, 64 nt, Homo Sapiens
ucgggaaaggaucaucgccguugaaaugaaaagagagacagagagaaaaaaaaaaagagaaccc

SEQ ID NO: 82730 - RNA, 64 nt, Homo Sapiens
ugaaaccaaacagcauccugccaugagcuucccagagacagaagagacuggagcaaagucggaa

SEQ ID NO: 82731 - RNA, 64 nt, Homo Sapiens
cucacucugucccccaggcuuuuuuuuuuuuuuugagacagagugguucaagcgauuccuuuuu

SEQ ID NO: 82732 - RNA, 64 nt, Homo Sapiens
cucacucugucacccagacuucuuuuauuuuuuugagacagagucuacccuuuuuuuuuuuuaa

SEQ ID NO: 82733 - RNA, 64 nt, Homo Sapiens
aaaagacaaacagaaauagacacacacaccagcagagacagaaacagcaauagccaggacuccu

SEQ ID NO: 82734 - RNA, 64 nt, Homo Sapiens
gagacugcucuaccaauagaucuuuguuuguuuugagacagaaucuugaucuguuacccaggcu

SEQ ID NO: 82735 - RNA, 64 nt, Homo Sapiens
gacaaaaagacagagagauguagagacagugauagagacagaggaacaaaaagagcagcaguga

SEQ ID NO: 82736 - RNA, 64 nt, Homo Sapiens
gagcagcagugagaaggcaaagagagaggcagaagagacagacgaggcagagacaaaacacuga

SEQ ID NO: 82737 - RNA, 64 nt, Homo Sapiens
uguguguguaugagagagagagagagagacaacagagacagagagaggcagagaggcauagaga

SEQ ID NO: 82738 - RNA, 64 nt, Homo Sapiens
acaacagagacagagagaggcagagaggcauagagagacagagagagagacaagaaacagagau

SEQ ID NO: 82739 - RNA, 64 nt, Homo Sapiens
aggcacugugcuaggugcugggaauaccacugaugagacagacaaggucccuacucuuguggag

SEQ ID NO: 82740 - RNA, 64 nt, Homo Sapiens
gucccuacucuuguggaguuuacuucugguggaggagacagaugauaaguaaacaaauaaauaa

SEQ ID NO: 82741 - RNA, 64 nt, Homo Sapiens
aggagggcaugggagggagggagagguggggagggagacagagacagaaacagagagagacaga

SEQ ID NO: 82742 - RNA, 64 nt, Homo Sapiens
gcaugggagggagggagagguggggagggagacagagacagaaacagagagagacagagacaga

SEQ ID NO: 82743 - RNA, 64 nt, Homo Sapiens
gagguggggagggagacagagacagaaacagagagagacagagacagagagagacugagggaga

SEQ ID NO: 82744 - RNA, 64 nt, Homo Sapiens
gggagggagacagagacagaaacagagagagacagagacagagagagacugagggagagacucu

SEQ ID NO: 82745 - RNA, 64 nt, Homo Sapiens
ggaauaguuaaaugcauuuguuuguuuguuuuuugagacagaguuucacucuuguugcccaggc

SEQ ID NO: 82746 - RNA, 64 nt, Homo Sapiens
ccagccaucaaugcauuuuuuuuauuuuuuuuuugagacagaguuucgcacuucuugcccaggc

SEQ ID NO: 82747 - RNA, 64 nt, Homo Sapiens
ccauauaauucaccuucuuuuuuuuuuuuugucugagacagaaucucagucugucacccagguu

SEQ ID NO: 82748 - RNA, 64 nt, Homo Sapiens
caccagaauuaauuuuauuauucuuauuauuuuugagacagagucuuacucuguugccaggcug

SEQ ID NO: 82749 - RNA, 64 nt, Homo Sapiens
caccgcgcccagccuuuuuguuuuuuuuuuuuuugagacagagucuuccucugucuccuaagcu

SEQ ID NO: 82750 - RNA, 64 nt, Homo Sapiens
uccccugccuggaacuggcugugaagacccaggagagacagagaugcgaaccacccaaaacacg

SEQ ID NO: 82751 - RNA, 64 nt, Homo Sapiens
acccaaaacacgcacacccugccccuggugcccugagacagacacacagccucacgcccccagg

SEQ ID NO: 82752 - RNA, 64 nt, Homo Sapiens
cuguggcaggaggacgcaucccaaucgggagggagagacagagacagagccgauggggccagag

SEQ ID NO: 82753 - RNA, 64 nt, Homo Sapiens
caggaggacgcaucccaaucgggagggagagacagagacagagccgauggggccagagcaggca

SEQ ID NO: 82754 - RNA, 64 nt, Homo Sapiens
aauaagcauuagagaccugcaagagagagagacagagacagagacgcugguagacuuuuguuaa

SEQ ID NO: 82755 - RNA, 64 nt, Homo Sapiens
cagagaaauaagcauuagaguguuaaaagagagagagacagagaugaggccgcugguagacuuu

SEQ ID NO: 82756 - RNA, 64 nt, Homo Sapiens
agcucagcagugacuggggagcuggucugccucagagacagaguagggggugggagcagagccu

SEQ ID NO: 82757 - RNA, 64 nt, Homo Sapiens
aacacuaccuuucucauugguuucuaagucaguagagacagaucuguuuuaagcaguugggggu

SEQ ID NO: 82758 - RNA, 64 nt, Homo Sapiens
gaacgaaucgauguaagauuccuccuuuagggcagagacagaccacugacaaauacacagauag

SEQ ID NO: 82759 - RNA, 64 nt, Homo Sapiens
aauauuuaaagccaaacaaauccaucuuuucugagagacagaaacuaaaaaauucagaguuaau

SEQ ID NO: 82760 - RNA, 64 nt, Homo Sapiens
uccggagugagaagcuuugcccuccuaagagagagagacagagagacagagagagagaaagaga

SEQ ID NO: 82761 - RNA, 64 nt, Homo Sapiens
gagaagcuuugcccuccuaagagagagagacagagagacagagagagagaaagagagagugugu

SEQ ID NO: 82762 - RNA, 64 nt, Homo Sapiens
gguagaugcaugacuugugugugaugagagaauggagacagagucccuggcuccucuacuguuu

SEQ ID NO: 82763 - RNA, 64 nt, Homo Sapiens
auuggggaaacggggugaacuucagguggaugaggagacagaauagagugauaggaagcgucug

SEQ ID NO: 82764 - RNA, 64 nt, Homo Sapiens
uucacucuuguugcccaggcuuuuuuuuuucugugagacagaguuuucuuugauuuuauucuuu

SEQ ID NO: 82765 - RNA, 64 nt, Homo Sapiens
uucacucuucucacccaggcuuauucuuuuuuuugagacagaauggcccuuguuuucuuugauu

SEQ ID NO: 82766 - RNA, 64 nt, Homo Sapiens
gggagagagggacagagagagggagagaggcagagagacagagagagagggagagaggcagaga

SEQ ID NO: 82767 - RNA, 64 nt, Homo Sapiens
ggaagagaggcagagagggagacagagggagagagagacagagggagacagagagggagagaga

SEQ ID NO: 82768 - RNA, 64 nt, Homo Sapiens
gagagagagacagaggggaacagagagggagagagagacagaggagggagagaaacagaggaga

SEQ ID NO: 82769 - RNA, 64 nt, Homo Sapiens
gggagagagagacagagggaggagagaaacagaggagacagagagagacagaggaggcagagag

SEQ ID NO: 82770 - RNA, 64 nt, Homo Sapiens
aggcagagagggagagaaacgauaugaggagagagagacagaggagguggggagaggggagaga

SEQ ID NO: 82771 - RNA, 64 nt, Homo Sapiens
ccaccaugcccagcuaauuuuuguauuuuuaguagagacagaguuucaccauauuagccuggcu

SEQ ID NO: 82772 - RNA, 64 nt, Homo Sapiens
gcagacagcugcugggggaaauccugggguccuugagacagaggcaggacccucguguucccag

SEQ ID NO: 82773 - RNA, 64 nt, Homo Sapiens
acuaagaagcuugaaucuacuuuuuuuuuuuuuugagacagagucuggcucugucacccaggcu

SEQ ID NO: 82774 - RNA, 64 nt, Homo Sapiens
uuuauuuuauuuauuuuuauuuuuauuuuuauuugagacagagucucacucuguugcccaggcu

SEQ ID NO: 82775 - RNA, 64 nt, Homo Sapiens
acaaaaucuagaugcaacagcuuuuuacaauccagagacagaaacgggcgggccgccagagcag

SEQ ID NO: 82776 - RNA, 64 nt, Homo Sapiens
gaggcaguggcuggugggccucuggugggagagggagacagauggagggaacccugggcagggc

SEQ ID NO: 82777 - RNA, 64 nt, Homo Sapiens
uuugcuauguuggccaggcuuuguauuuuuaguagagacagaguaccacagcccagcuaauuuu

SEQ ID NO: 82778 - RNA, 64 nt, Homo Sapiens
uuccuggcaauguaccauacauucagcuuauucugagacagacaccaaaaagaaaaugagggua

SEQ ID NO: 82779 - RNA, 64 nt, Homo Sapiens
aacagagucucagggaaagagacacccagaguuggagacagaacagacccagagggcagcguca

SEQ ID NO: 82780 - RNA, 64 nt, Homo Sapiens
ccaagagcaggggauagaagaaauccagaguggggagacagagagacgcagaagagaggaacag

SEQ ID NO: 82781 - RNA, 64 nt, Homo Sapiens
cccaaagggagagaaacagagguggaaacccagagagacagagagagacccagaaaaaggaaga

SEQ ID NO: 82782 - RNA, 64 nt, Homo Sapiens
cugguucuguuucccaggcuuuuuuuuuuuuuuugagacagagugagagagguuucuuucuuuc

SEQ ID NO: 82783 - RNA, 64 nt, Homo Sapiens
cuuggaccugggugccuggcaucguuugaggagggagacagaugugggcaucagugcagcugau

SEQ ID NO: 82784 - RNA, 64 nt, Homo Sapiens
agauccuguguguuucucugauggcuaccuuuaggagacagagacugccuccaucucugccucc

SEQ ID NO: 82785 - RNA, 64 nt, Homo Sapiens
aagucuuuuggggagagaaugacauuuuuuuuuugagacagaguuuugcucuuguugcccaggc

SEQ ID NO: 82786 - RNA, 64 nt, Homo Sapiens
ucugccccuugugaaggcccauuccuggcacuuagagacagaaagaacucagcaaucuuucguu

SEQ ID NO: 82787 - RNA, 64 nt, Homo Sapiens
uccuagguuuugagauuuagagcaaugcauucuggagacagaaccagcagaacagccauuuuuc

SEQ ID NO: 82788 - RNA, 64 nt, Homo Sapiens
aacugcuguauucaugaaucuugagaguguuccugagacagaauuaauggucauuugggaaaac

SEQ ID NO: 82789 - RNA, 64 nt, Homo Sapiens
cagacuggagugaugcggcccaggaggacacguggagacagagggaggagacacagacacagag

SEQ ID NO: 82790 - RNA, 64 nt, Homo Sapiens
aggagacacagacacagagcagguguccuuccaagagacagaagagcacccuaaaugccaugac

SEQ ID NO: 82791 - RNA, 64 nt, Homo Sapiens
ugguggcggguagacaagggaugccugggcugacugggcagaggaaccucuagcucugacuguc

SEQ ID NO: 82792 - RNA, 64 nt, Homo Sapiens
ucagucucaacaggagccagucuucuggagccucugggcagaacccuccaucagaguggaaauc

SEQ ID NO: 82793 - RNA, 64 nt, Homo Sapiens
gaagacuucaucccucugggccaucccauaugccugggcagaaggagcucauggugagggauac

SEQ ID NO: 82794 - RNA, 64 nt, Homo Sapiens
aaagcaaaggagauuggaagucaggccugggggcugggcagagggcacagcugggguggggacc

SEQ ID NO: 82795 - RNA, 64 nt, Homo Sapiens
uuuuuucuugguaaagccaugcaccacagacuucugggcagagcugagagacaaugguccugac

SEQ ID NO: 82796 - RNA, 64 nt, Homo Sapiens
gccauggguaaccucauuguaacuaucaucagaaugggcagagaugaucuugaagugucacaua

SEQ ID NO: 82797 - RNA, 64 nt, Homo Sapiens
aagauggcgugcacaggacacagcgugggcggccugggcagaagggcggcuggcuguccuggag

SEQ ID NO: 82798 - RNA, 64 nt, Homo Sapiens
aaggggaaaaccacuugagucuugugguguguggugggcagacaccacaggguggcaucaccug

SEQ ID NO: 82799 - RNA, 64 nt, Homo Sapiens
uaucuucauuaagaguuuuugauguuuuguuuauugggcagacacaguauaugauaguucugcu

SEQ ID NO: 82800 - RNA, 64 nt, Homo Sapiens
auuaaacuuauuuuguugccaucugggacugguuugggcagaauuaucuugguuauuaaacagu

SEQ ID NO: 82801 - RNA, 64 nt, Homo Sapiens
acuugaggucaggaguucgcuugggaggccaaggugggcagaucacaccuauaaucccagcaau

SEQ ID NO: 82802 - RNA, 64 nt, Homo Sapiens
ggcuuacaccuauaaucccaauuaacuuuuuggcugggcagaguauauuuugauuaagauuucu

SEQ ID NO: 82803 - RNA, 64 nt, Homo Sapiens
gagcacaaacuuucugggccuccauccuaggaccugggcagacccacauggccugggcucugaa

SEQ ID NO: 82804 - RNA, 64 nt, Homo Sapiens
gacgguggguucugcaucagcaaacgcugaggagugggcagauuuucuuugucuuuugcuugca

SEQ ID NO: 82805 - RNA, 64 nt, Homo Sapiens
cagaagcugauuuaacagcaacccugggcuugucugggcagagauuugucucuuguuaaaccag

SEQ ID NO: 82806 - RNA, 64 nt, Homo Sapiens
aguuugucaaagucucagccgcucuuuuuuaaggugggcagauuacaaauuacaguaaaaaugu

SEQ ID NO: 82807 - RNA, 64 nt, Homo Sapiens
cagauauagaucaauaccuguagaaagaagcuauugggcagaaauuuuucuacugaaaacaauu

SEQ ID NO: 82808 - RNA, 64 nt, Homo Sapiens
agaggcccagagggagagagggagucccagccucugggcagaccuugagagcaagguagaggaa

SEQ ID NO: 82809 - RNA, 64 nt, Homo Sapiens
uggaguucucauccagggcuacccacaggagaggugggcagagcaggcuccaggaaguugaggg

SEQ ID NO: 82810 - RNA, 64 nt, Homo Sapiens
gaugcagugggugcggggggugaggcaggcacccugggcagagacuguggcgcggggcauccua

SEQ ID NO: 82811 - RNA, 61 nt, Homo Sapiens
gacucuguggcgcggggcauggcgggcgcccugggcagagauggacgaggaccagcuguga

SEQ ID NO: 82812 - RNA, 64 nt, Homo Sapiens
gaagacccggccaggaccuugcuggaggaggguuugggcagagcgugggaggaggccugcacag

SEQ ID NO: 82813 - RNA, 64 nt, Homo Sapiens
gugaccucucuaggugugucauuacuaaggcaggugggcagacaagaugaguuuuaggaccagc

SEQ ID NO: 82814 - RNA, 64 nt, Homo Sapiens
aucuuagcagaugggaggaacugcugagagaagaugggcagaaagcuggagccccuggaguugg

SEQ ID NO: 82815 - RNA, 64 nt, Homo Sapiens
uguguuugugacugauuacuggcugugucuugggugggcagaaacucgaacuugcuauguaauu

SEQ ID NO: 82816 - RNA, 64 nt, Homo Sapiens
uggcagggugcugguucacuggugguagcuacacugggcagaguaauaagugaauggaagcagu

SEQ ID NO: 82817 - RNA, 64 nt, Homo Sapiens
cacagggcagugcaggggacggacaggcacaggcugggcagaggagggacugaggggaacccug

SEQ ID NO: 82818 - RNA, 64 nt, Homo Sapiens
cuggacauuugaggagccguggggugaugcaugaugggcagauguggaugggcucugcauguaa

SEQ ID NO: 82819 - RNA, 64 nt, Homo Sapiens
uggugaggccagggauggcauccugaguccuuguugggcagaaugugauguugggagugggauc

SEQ ID NO: 82820 - RNA, 64 nt, Homo Sapiens
gggucuccuucagucucccugguccccugacaccugggcagauguagggugguguggaggggcu

SEQ ID NO: 82821 - RNA, 64 nt, Homo Sapiens
agcagauacaugucagugcacugacucagagcccugggcagaucugggggcagcuccucuucuu

SEQ ID NO: 82822 - RNA, 64 nt, Homo Sapiens
agcagaggucuucucugcacuguccuugucaaggugggcagaagauuucauucuaggcucacac

SEQ ID NO: 82823 - RNA, 64 nt, Homo Sapiens
cugggguccuguccugcaggaugcugcauaggaaugggcagagauguccuggaugggaacaugg

SEQ ID NO: 82824 - RNA, 64 nt, Homo Sapiens
cucagaccagugaggggugauucagagguggggaugggcagagagggcuggccacucugccuca

SEQ ID NO: 82825 - RNA, 64 nt, Homo Sapiens
ucccuuccugaaggccaaaauugggagaguuccaugggcagauugaaacaguuuguuaaucuga

SEQ ID NO: 82826 - RNA, 64 nt, Homo Sapiens
aacuuauuuuccacauuaaaggugacagaagagaugggcagagcucugugagccuuuucauuuc

SEQ ID NO: 82827 - RNA, 64 nt, Homo Sapiens
cucagggucagggaaugagccaggcacgggggcaugggcagagagggccacggggcagggccca

SEQ ID NO: 82828 - RNA, 64 nt, Homo Sapiens
aagggaggggaaacuccaucaggaagugcuccccugggcagaggcgcccacugggugcuguggg

SEQ ID NO: 82829 - RNA, 64 nt, Homo Sapiens
ugaaggaagcaggggcugaggaacacuuagagggugggcagaagcggggguucccagucugcuu

SEQ ID NO: 82830 - RNA, 64 nt, Homo Sapiens
gaaagcugcgaauucucuuguccaaauaguggauugggcagacuggccuggaggaaaugcuaga

SEQ ID NO: 82831 - RNA, 64 nt, Homo Sapiens
cugguguggaguccagggcugcuaggaaaaggaaugggcagacacagguguaugccaauguuuc

SEQ ID NO: 82832 - RNA, 64 nt, Homo Sapiens
gcauggcccaaggccccaaguauaucaaggcacuugggcagaacaugccaaggaaucaaauguc

SEQ ID NO: 82833 - RNA, 64 nt, Homo Sapiens
accugagaucaaguauuugauugggaggccaaggugggcagaucaugccuguaaucccagcacu

SEQ ID NO: 82834 - RNA, 64 nt, Homo Sapiens
ggugaaaccaccuucucuacacucaagaccagccugggcagaauugggucacgugggccccggu

SEQ ID NO: 82835 - RNA, 64 nt, Homo Sapiens
gugccaucccaaauacuugggcagcagcucagcaugggcagacaugggggcuguggauucuucc

SEQ ID NO: 82836 - RNA, 64 nt, Homo Sapiens
cuugguguggccguguccugagccucagugaggcugggcagauggucucggagccuccaugggg

SEQ ID NO: 82837 - RNA, 64 nt, Homo Sapiens
cccuaagacagauuggcuuucuaaugaguuuaagugggcagaaguguaggguucaguguguccu

SEQ ID NO: 82838 - RNA, 64 nt, Homo Sapiens
cagguacuugggacauggaaacucguuggauggcugggcagauguaagccuguccaugcaguca

SEQ ID NO: 82839 - RNA, 64 nt, Homo Sapiens
ggcugugguuugggggagaauuugccagcccauuugggcagagacaggggccuuugggugcugu

SEQ ID NO: 82840 - RNA, 64 nt, Homo Sapiens
ucccacaugccaggggccuugcucugccccagcuugggcagaucccccuuccugggcacacgcu

SEQ ID NO: 82841 - RNA, 64 nt, Homo Sapiens
ggcagaggggcuuccaggccguccugccccaucuuagagucaaaacaucccacugagagcgggg

SEQ ID NO: 82842 - RNA, 64 nt, Homo Sapiens
ggauauuuauuuauaggccuuucauuuuuccuuuuagagucaaaaaugaaaauuguuuuucuac

SEQ ID NO: 82843 - RNA, 64 nt, Homo Sapiens
uagggcucagaguggugguuucugacuacauuucuagagucagagcuugaucaccacaacucaa

SEQ ID NO: 82844 - RNA, 64 nt, Homo Sapiens
gauagcuugucccaugagcacagaagagccucaguagagucaaguccugcugcagcugccccac

SEQ ID NO: 82845 - RNA, 64 nt, Homo Sapiens
caucacuuaaugacagagaugauaaaggagcaaauagagucacgccuuacaauguaauguuaga

SEQ ID NO: 82846 - RNA, 64 nt, Homo Sapiens
acagguggacuuugcuuugaguagcuuuuuguucuagagucagacuuauuuauuuccucuauuu

SEQ ID NO: 82847 - RNA, 64 nt, Homo Sapiens
augguuuuaaugcaaagcgccuuuuuugagcagguagagucacgcauccggcaggcggggcgag

SEQ ID NO: 82848 - RNA, 64 nt, Homo Sapiens
uuagcugacacagauggucaccuccauuaccaaguagagucaggaugaacuaugugugacuguu

SEQ ID NO: 82849 - RNA, 64 nt, Homo Sapiens
cuccaucucaaagaaaccagcucagccugggcaguagagucaguggcaaaaucgugccacugcc

SEQ ID NO: 82850 - RNA, 64 nt, Homo Sapiens
ccagcauugacuugaguuuggcauuaauugacacuagagucaguugaguauagcaaaccaucaa

SEQ ID NO: 82851 - RNA, 64 nt, Homo Sapiens
aagagcauggaugcauuucaaauguuagauauugcuacuauaaucaaaugauuucauauugauc

SEQ ID NO: 82852 - RNA, 64 nt, Homo Sapiens
gaccucgcacuuucuguucuaaauauauuuauuccuacuauacaguaaaauacaucagacaaca

SEQ ID NO: 82853 - RNA, 64 nt, Homo Sapiens
auauuuaaguuggauguacuuguuuuagguacaucuacuauacuuauucucucaaaccugggua

SEQ ID NO: 82854 - RNA, 64 nt, Homo Sapiens
aaaaggaauucaaaucugaguaaauaacagccuccuacuauaggaauuagauucuucuauaaaa

SEQ ID NO: 82855 - RNA, 64 nt, Homo Sapiens
uuauguauauuaauuaaaacauaaauuauaugaacuacuauacauccuauagaaaaugccauua

SEQ ID NO: 82856 - RNA, 64 nt, Homo Sapiens
cuugagucaucccgacguugaccgugugaagcaacuacuauaaauggcauccaagucuuggaaa

SEQ ID NO: 82857 - RNA, 64 nt, Homo Sapiens
uuuuaauguguuugauagcuuugacgaggguucucuuuguuacuuucaggggagggcauccuau

SEQ ID NO: 82858 - RNA, 64 nt, Homo Sapiens
agcccccuucuuggucccaugugaugucauccugcuuuguuaucuucuuauaacuuuauccugc

SEQ ID NO: 82859 - RNA, 64 nt, Homo Sapiens
ggccccuuacuggugguuuuacagggggauccuacuuuguuacacauguuggguuuccugauaa

SEQ ID NO: 82860 - RNA, 64 nt, Homo Sapiens
uccccauuuaaauuccuacaacuaagucucccugcuuuguuaauaguccaacaguuggguugug

SEQ ID NO: 82861 - RNA, 64 nt, Homo Sapiens
augaauauugauaacuaaacuucauuucaguuuacuuuguuaugccuuaauauucugugucuuu

SEQ ID NO: 82862 - RNA, 64 nt, Homo Sapiens
acauauaagaaaaaagucucuccccaagggcagccuuuguuacuuuuaaauauuuucuguuauu

SEQ ID NO: 82863 - RNA, 64 nt, Homo Sapiens
uaaaugcauuauauaaacucauaaauguuacauucuuuguuacuuccuaauuacuugguggcua

SEQ ID NO: 82864 - RNA, 64 nt, Homo Sapiens
auauauuuucuaccauuccagguuuuauggauuucuuuguuauaaaaauaaaaguuagauaaug

SEQ ID NO: 82865 - RNA, 64 nt, Homo Sapiens
ugccucaggauauuucuuuugcugcuuguguuugcuuuguuaauauuaaugcguuggaaagaaa

SEQ ID NO: 82866 - RNA, 64 nt, Homo Sapiens
ugacuuuauagguuaugauugucuuuagucuucccuuuguuauaggauuuacugauaaugauca

SEQ ID NO: 82867 - RNA, 64 nt, Homo Sapiens
aacaucuucagggcgggaaaggggccacuucuggcuuuguuagcaauaacugaccuucaguuua

SEQ ID NO: 82868 - RNA, 64 nt, Homo Sapiens
uuuccuuuuuucaauguacauaguucaacucuuucuuuguuacauuuaaacuauauccauggau

SEQ ID NO: 82869 - RNA, 64 nt, Homo Sapiens
uuugaaaaccaacaccaucacagcuuguuuuggacuuuguuacacuguuauuuucagcaugaaa

SEQ ID NO: 82870 - RNA, 64 nt, Homo Sapiens
ucauagaauagcauguuguagauacaaucagcugcuuuguuaccuuaaaacuaggcauuuguaa

SEQ ID NO: 82871 - RNA, 64 nt, Homo Sapiens
ugugaccuugacuggcuuuaaguugcugaagaugcuuuguuaaacugcacacuucaggcacugu

SEQ ID NO: 82872 - RNA, 64 nt, Homo Sapiens
ucuggauuacuuugcaguaauaaccuccugcuuccuuuguuacccuuuuggugcaggcagccgu

SEQ ID NO: 82873 - RNA, 64 nt, Homo Sapiens
uccagucagauaauggcauuuuaaaggaaauggucuuuguuaauuaaauauuauuaauagcuua

SEQ ID NO: 82874 - RNA, 64 nt, Homo Sapiens
aacuccuauuuuucaggggcguguggcuuuaugucuuuguuauaagucuuuguuaugaugauug

SEQ ID NO: 82875 - RNA, 64 nt, Homo Sapiens
augauugguguggcuuuauguccacaggcauagucuuuguuaugaagaaauguuacauguguac

SEQ ID NO: 82876 - RNA, 64 nt, Homo Sapiens
auuauggugucacuuagauuaaaccuauuuuaugcuuuguuaaauugacucuuucaaaugcaaa

SEQ ID NO: 82877 - RNA, 64 nt, Homo Sapiens
uaaauguuucagaauucaauacucaacuguuucucuuuguuaucuuguuagaugagggaggaaa

SEQ ID NO: 82878 - RNA, 64 nt, Homo Sapiens
ugagggaggaaaacucaacuagaguuaauuuugacuuuguuagaauuuuguaauuguuaaaaau

SEQ ID NO: 82879 - RNA, 64 nt, Homo Sapiens
gacauguugacaggcagcaugguauguuuuuagccuuuguuacaguuuuagcaacauugauguc

SEQ ID NO: 82880 - RNA, 64 nt, Homo Sapiens
gaaggauccagcuaggcccgugugguuagaucagcuuuguuacugaauuaccuaaaaccagacc

SEQ ID NO: 82881 - RNA, 64 nt, Homo Sapiens
ccagauagugucagcuuauuugaagauuaauuuucuuuguuaacuuaaaauaacuauuuuaacc

SEQ ID NO: 82882 - RNA, 64 nt, Homo Sapiens
guuggccauuauuugauuuuuguacgaaaaaaagcuuuguuauagaaaucagcauacuauuuuu

SEQ ID NO: 82883 - RNA, 64 nt, Homo Sapiens
ucuacaucuuagauaaaugccuuuauugcaacuacuuuguuauucuuauuaaauauuucauaca

SEQ ID NO: 82884 - RNA, 64 nt, Homo Sapiens
aguaguaguauagaauaaaagaaguugaaauuaucuuuguuagcauaucuagguuuuuaaaacu

SEQ ID NO: 82885 - RNA, 64 nt, Homo Sapiens
ggguaaagcuuugucuaaaggcuggacagauuugcuuuguuauacucucagaauuugguuuaaa

SEQ ID NO: 82886 - RNA, 64 nt, Homo Sapiens
cacaaugcaucauuccuuuguuguugauaaugggcuuuguuagcacuuuuuaaaacaaacaaac

SEQ ID NO: 82887 - RNA, 64 nt, Homo Sapiens
agucauuacaccaaguccauuuagagauaaugggcuuuguuagcacuuucaaaaaaaaaaaaag

SEQ ID NO: 82888 - RNA, 64 nt, Homo Sapiens
accauuuccguaauucuuauuccauauuagaaaacuuuguuaggccaaagacaaauaguaggca

SEQ ID NO: 82889 - RNA, 64 nt, Homo Sapiens
aguuuuauuuucuaaaguacugagcagugauauucuuuguuaauuuggaccauuuuccugcauu

SEQ ID NO: 82890 - RNA, 64 nt, Homo Sapiens
gaacugaccagcuuauauuucccaguauucccacucuccaaaagcagcagaagaagcagccaug

SEQ ID NO: 82891 - RNA, 64 nt, Homo Sapiens
gaguguuggaaaauguucuuccauguagacacacucuccaaauggucagaguuguggcucucag

SEQ ID NO: 82892 - RNA, 64 nt, Homo Sapiens
uucacugguacucugccacuauaauuagguauuuucuccaaauguaacuuggguuaggaagaaa

SEQ ID NO: 82893 - RNA, 64 nt, Homo Sapiens
cuacaguacaaagcccuaagcuggaugucucucuucuccaaauggcagauaaguagcaguucaa

SEQ ID NO: 82894 - RNA, 64 nt, Homo Sapiens
gaaagagaaacuugagaaggagagugagacccugucuccaaagaugcacuccagccugggcaac

SEQ ID NO: 82895 - RNA, 64 nt, Homo Sapiens
aaauugcauggacuucuuaauugcuuuugggucuucuccaaaguauaagaaagaaucaaauauc

SEQ ID NO: 82896 - RNA, 64 nt, Homo Sapiens
ugcaugacaucacuagucuuguuuuucuauggcaucuccaaaaccuuauuaauauuaagagaca

SEQ ID NO: 82897 - RNA, 64 nt, Homo Sapiens
agagcaaguuaaauaauauaagcauuuggcccaaucuccaaauugugguucaagccaaacuggc

SEQ ID NO: 82898 - RNA, 64 nt, Homo Sapiens
ccaggcuguugauaccucagagccuucucuuuacucuccaaagugaaagggaagcccccgucuc

SEQ ID NO: 82899 - RNA, 64 nt, Homo Sapiens
gagugcagaaauguggcuuuugccccacuuugcaucuccaaaauuacaacgguuggccgauccc

SEQ ID NO: 82900 - RNA, 64 nt, Homo Sapiens
gaagcugagcuuucuuuauucaaccucauucccuucuccaaauaagccacuuguguaguugggc

SEQ ID NO: 82901 - RNA, 64 nt, Homo Sapiens
uguccccaggaccuaugcucccugcucacccccuucuccaaagcccaagcgucccgcugcucau

SEQ ID NO: 82902 - RNA, 64 nt, Homo Sapiens
uuggugccuuggaaaguagagagcaacagacacaucuccaaaugggcaaggagucucuagcaug

SEQ ID NO: 82903 - RNA, 64 nt, Homo Sapiens
ccacugcauuccaaccugggugaugaagugagacucuccaaaaaaaaaaaagaaauuauuaauc

SEQ ID NO: 82904 - RNA, 64 nt, Homo Sapiens
ccaacuuaggcucuuuauuaauugguuaagguuuucuccaaaaagggcauuucaacaaugggaa

SEQ ID NO: 82905 - RNA, 64 nt, Homo Sapiens
aucuuuuuccauguugugcagaucaguuucacuaucuccaaagcauuugcaucaugaccuuaua

SEQ ID NO: 82906 - RNA, 64 nt, Homo Sapiens
uuuguagucauguaaaacuuaagugcuucaugccucuccaaaugugguuauucuaauaaaugga

SEQ ID NO: 82907 - RNA, 64 nt, Homo Sapiens
ugcacuccagccugggugacagagugagacucugucuccaaaaaaaaacuuugcuuguauauua

SEQ ID NO: 82908 - RNA, 64 nt, Homo Sapiens
ucuacauauuauucaugaagcauaauguugcauuucuccaaauuuuaugccugaaaggguagug

SEQ ID NO: 82909 - RNA, 64 nt, Homo Sapiens
gcugggguaggaaugguugugaugccugcuugggucuccaaaugaaccacgggcuguuuaggag

SEQ ID NO: 82910 - RNA, 64 nt, Homo Sapiens
cuuggaguuuucuucugaggcuuucuccuuuccuucuccaaaggcugacacaggcugacacauu

SEQ ID NO: 82911 - RNA, 64 nt, Homo Sapiens
uccagagacauuacgagagcgccauuucuucccaucuccaaaaaaaugaggaugcuguuacuug

SEQ ID NO: 82912 - RNA, 64 nt, Homo Sapiens
ggcauuugcaugccuaucucagaguagcugaaaaucuccaaaugucugaaaugggauaauggcc

SEQ ID NO: 82913 - RNA, 64 nt, Homo Sapiens
aauccucacuaugcuauuugguaccuaaaaauauucuccaaacccuugcugccaguuccucuuu

SEQ ID NO: 82914 - RNA, 64 nt, Homo Sapiens
uguguucuaaccagaaagaaaggauuuguauuacucuccaaaucuacuguacugucagcuucac

SEQ ID NO: 82915 - RNA, 64 nt, Homo Sapiens
gaccuagggauccugagagggagagacugcaauuucuccaaagcuugccacuuuccagccuguu

SEQ ID NO: 82916 - RNA, 64 nt, Homo Sapiens
cuacuuccuccuagcaaccaacuuuaccucuucuucuccaaaggaucuuuguuccucugagcca

SEQ ID NO: 82917 - RNA, 64 nt, Homo Sapiens
aaaaaaaaaaaaaaaagaauagagcaagacuccgucuccaaaaaugcacuccagccugggcaac

SEQ ID NO: 82918 - RNA, 64 nt, Homo Sapiens
ugguugcugaugacaucaccgcucccugggucugucuccaaaaaugcacuggcccccaagguca

SEQ ID NO: 82919 - RNA, 64 nt, Homo Sapiens
auuucaugucuuacugaaacauuuugccagacuuucuccaaaugaaaccugaaucaauuuuucu

SEQ ID NO: 82920 - RNA, 64 nt, Homo Sapiens
auacuuggcuuggaaauuuaacacaguccuuuugucuccaaagcccuucuucuuuccaccacaa

SEQ ID NO: 82921 - RNA, 64 nt, Homo Sapiens
acaccaauuaauuuaauguauaauggauucgaacucuccaaacuuugauaggauccauaucuaa

SEQ ID NO: 82922 - RNA, 64 nt, Homo Sapiens
caugccauaauaauauaaguacuauaauaaccugucuccaaaaccugcauacuuaccuaugugg

SEQ ID NO: 82923 - RNA, 64 nt, Homo Sapiens
aauuauugauuuuuaaauuaugggagcaaauccaucuccaaacaugauacucuugggccaauga

SEQ ID NO: 82924 - RNA, 64 nt, Homo Sapiens
ugcacuccagccugggcgacagugcaagacucugucuccaaaaaaaaaaaaagaaaaaagaaaa

SEQ ID NO: 82925 - RNA, 64 nt, Homo Sapiens
cgcuaugcuacuggauuuguauaaauacugauauucuccaaaccuagugguguagggagcaaga

SEQ ID NO: 82926 - RNA, 64 nt, Homo Sapiens
gauccuggucuagcugaaucuucagagugggaggucuccaaaaagauauuaccuuauugggcuu

SEQ ID NO: 82927 - RNA, 64 nt, Homo Sapiens
agagcccguuacuaucagucggcaacuucaugguucuccaaagagccaagucugaagaaucaga

SEQ ID NO: 82928 - RNA, 64 nt, Homo Sapiens
cauuuauuacuggcuugaccaaaauaugcgaaguucuccaaaccagcucggagucaaucccagg

SEQ ID NO: 82929 - RNA, 64 nt, Homo Sapiens
caucuucccugaagcccccaaucuggccccccccuccccagacuuccuccccaaaacaccccag

SEQ ID NO: 82930 - RNA, 64 nt, Homo Sapiens
uggccuggcuggagccaggaacaggagggacacuuccccagaauccgcauguuuccccagugau

SEQ ID NO: 82931 - RNA, 64 nt, Homo Sapiens
uaacauuaccuaaaaggcacuaacaugcucagguuccccagaaagaggcguaagaagggccucu

SEQ ID NO: 82932 - RNA, 64 nt, Homo Sapiens
gagcuucaaggcucacaauggaagcacugucauuuccccagaaaagcuguguucccuaugcuga

SEQ ID NO: 82933 - RNA, 64 nt, Homo Sapiens
acccccugccaucaggggggucucuccucucuccuccccagagcaauuuuccaaaacagccugu

SEQ ID NO: 82934 - RNA, 64 nt, Homo Sapiens
ccagagggagaggcccaccccgccggguccucccuccccagacccucugagcacgggcucuucc

SEQ ID NO: 82935 - RNA, 64 nt, Homo Sapiens
ccugccccucuaaugaaugagacccuaaauagguuccccagagugucagaggauguggccaccu

SEQ ID NO: 82936 - RNA, 64 nt, Homo Sapiens
ucaagaacgcagcucagcuucaucucccaccacguccccagauccaccaccugccuugugacca

SEQ ID NO: 82937 - RNA, 64 nt, Homo Sapiens
aagucucuaucgcucuuccccucuccucggccacuccccagauaccagaccugaggcaauucac

SEQ ID NO: 82938 - RNA, 64 nt, Homo Sapiens
ucagaaggcuaacuugagagguuuggggccuuguuccccagaggguccccagggacucugcagu

SEQ ID NO: 82939 - RNA, 64 nt, Homo Sapiens
ccucuaagcacuuuacacauauuagcucauucaguccccagacagacgggaugaaguagguauu

SEQ ID NO: 82940 - RNA, 64 nt, Homo Sapiens
ugcuuuuuaccuuuugcuguuugcuguggcagauuccccagauaaccaaggaaaaggggccacc

SEQ ID NO: 82941 - RNA, 64 nt, Homo Sapiens
ggcagucaucauggcaguuucgauauucagagucuccccagaccagaaaucagugccaagcaug

SEQ ID NO: 82942 - RNA, 64 nt, Homo Sapiens
caacagaaaucagugccaagcugagcagggacgcuccccagaacgacugguucagcuagcucuc

SEQ ID NO: 82943 - RNA, 64 nt, Homo Sapiens
uacauucuccucuggggcucuaccucuccacacuuccccagaagggaaaagggcacccuggauu

SEQ ID NO: 82944 - RNA, 64 nt, Homo Sapiens
gaaaucacuccuuggugggcagcauccugaggcuuccccagaaccaggccucugcucuggcccu

SEQ ID NO: 82945 - RNA, 64 nt, Homo Sapiens
gggagcauccagaacugcuaccuuccuagauguuuccccagaccgcuggcugagauucccucac

SEQ ID NO: 82946 - RNA, 64 nt, Homo Sapiens
gcacgggguucgcgcaccaggugucuuuuuccaguccccagaagcagagagcacagccccugcu

SEQ ID NO: 82947 - RNA, 64 nt, Homo Sapiens
cccuguggagcagaacgggaaccaccugcagagguccccagacccaaagcaggacgggagacaa

SEQ ID NO: 82948 - RNA, 64 nt, Homo Sapiens
cugugggugagccaggccaacauuggugucccuguccccagagggaggagcaggcaggagagag

SEQ ID NO: 82949 - RNA, 64 nt, Homo Sapiens
acagacgcuggaugcccuccuaccgccagacaccuccccagaggccuuggaccuccuuaggcga

SEQ ID NO: 82950 - RNA, 64 nt, Homo Sapiens
cuucaccuggcccucuguuccugccccagccccuuccccagaccccucuccagucuccugcacc

SEQ ID NO: 82951 - RNA, 64 nt, Homo Sapiens
ggcacucagugagccuccugaugggggcaucucuuccccagagaagcucacaugggacugggau

SEQ ID NO: 82952 - RNA, 64 nt, Homo Sapiens
caagcuuuugcuugauccagggaauguuuuucccuccccagaaucguuggccggcggcuacucu

SEQ ID NO: 82953 - RNA, 64 nt, Homo Sapiens
ugggaagcaguuagggagauagcgacccggaguuuccccagaagcggggugggagggugugcau

SEQ ID NO: 82954 - RNA, 64 nt, Homo Sapiens
cagccccguucggcucagaccgacccccacuccauccccagaccugcagcacaagugcgcgggc

SEQ ID NO: 82955 - RNA, 64 nt, Homo Sapiens
cacagacccucaugcacucucuuacgugccauucuccccagacuuuuuuuguacuuaauguaug

SEQ ID NO: 82956 - RNA, 64 nt, Homo Sapiens
ggagaggagggcccuguccggcauguguggguauuccccagaagcauuugccuccugcugagcc

SEQ ID NO: 82957 - RNA, 64 nt, Homo Sapiens
ggaaggagggagccgggagccuggugggaagccuuccccagagagauggcuuuaggggcuuuau

SEQ ID NO: 82958 - RNA, 64 nt, Homo Sapiens
cccugagcccucccagggaccaccacuuccgagguccccagaccacaacugggcccuggaccag

SEQ ID NO: 82959 - RNA, 64 nt, Homo Sapiens
cuggaggaacaacugggccccagauguccccccauccccagaggcgaacaggagccccccucca

SEQ ID NO: 82960 - RNA, 64 nt, Homo Sapiens
ucacuuaugcuagucuaagauuggaguucggcccuccccagacugagauauucuuucuucugcc

SEQ ID NO: 82961 - RNA, 64 nt, Homo Sapiens
cuguaccugccuguaacucucagaagcaucaugguccccagaccgguaugacauucaaagcuac

SEQ ID NO: 82962 - RNA, 64 nt, Homo Sapiens
aucucccaggaggaaguggaggggacaucgcuguuccccagaaacccacucuauccucacccug

SEQ ID NO: 82963 - RNA, 64 nt, Homo Sapiens
accgggaacagggauuugcccuucacaauucuacuccccagauccucuccccuggacacaggag

SEQ ID NO: 82964 - RNA, 64 nt, Homo Sapiens
gcgccacuuuguauauuucaggacugggaccuacuccccagaugccaccugagaggagcuucug

SEQ ID NO: 82965 - RNA, 64 nt, Homo Sapiens
guggagcugugcucccuugagugcacuugagcacuccccagaccagaucacuuuuuggacacac

SEQ ID NO: 82966 - RNA, 64 nt, Homo Sapiens
caggcugaagaggaaaggcauccccagaacaggauccccagaagagccagucucuggcuguggc

SEQ ID NO: 82967 - RNA, 64 nt, Homo Sapiens
aggauccccagaagcaggcuucucuggcuguggcuccccagaacaaggagagcccaggagccag

SEQ ID NO: 82968 - RNA, 64 nt, Homo Sapiens
acagcucagcaucacacugauccagcgugcugguuccccagagcccccagccccacuaucagug

SEQ ID NO: 82969 - RNA, 64 nt, Homo Sapiens
agcaggccccgagccccuuccuggcuaccacucuuccccagagcagacaugugccccuuugcug

SEQ ID NO: 82970 - RNA, 64 nt, Homo Sapiens
ugugccccuuugcugcuggcgaagugguucucaguccccagacaaccaaagaagguguguaagu

SEQ ID NO: 82971 - RNA, 64 nt, Homo Sapiens
caagagaccagggaugcaggguuaggcagacagguccccagaguccucacccugcuccccagac

SEQ ID NO: 82972 - RNA, 64 nt, Homo Sapiens
uuaggcagacagguccccagaguccucacccugcuccccagacaguagacacagugcccguccu

SEQ ID NO: 82973 - RNA, 64 nt, Homo Sapiens
cuguggaauagggggaguucaugcaccccuuuuuuccccagaggggcuggacucagguuaguuu

SEQ ID NO: 82974 - RNA, 64 nt, Homo Sapiens
ucuaagaaggugauucccccugcccuugcccccuuccccagaacaaaacauguugaucaugugc

SEQ ID NO: 82975 - RNA, 64 nt, Homo Sapiens
aagccauaaggggcaggggccaccccacggcaucuccccagaaguacaggccucaggaggaggu

SEQ ID NO: 82976 - RNA, 64 nt, Homo Sapiens
caggaggagguggaacugauguaggggguggcacuccccagagacugcccucacgaggggacug

SEQ ID NO: 82977 - RNA, 64 nt, Homo Sapiens
uaccucaccuacuaggaccuauccccucccaucuuccccagaccccaccccacccuccaccuca

SEQ ID NO: 82978 - RNA, 64 nt, Homo Sapiens
aggucagcgucucgagaggcggcaggcaccaccguccccagagcaagugugaaauugagcaaua

SEQ ID NO: 82979 - RNA, 64 nt, Homo Sapiens
cccacgcccgacgcagacccccaccucuggaggguccccagagagccaggccaucagcccaccu

SEQ ID NO: 82980 - RNA, 64 nt, Homo Sapiens
gugguuuauccagaaaccaaguuuuauuauccuguccccagaggccuucuuaaaaauauuacau

SEQ ID NO: 82981 - RNA, 64 nt, Homo Sapiens
cacauacacgugucugcaggccacaccgugcauguccccagaccugccgccuggcuucuggagu

SEQ ID NO: 82982 - RNA, 64 nt, Homo Sapiens
gagcauccugaaggagccacugcagccgucacuguccccagagccuguggagauagagccuguu

SEQ ID NO: 82983 - RNA, 64 nt, Homo Sapiens
cuccaccgucaggggggagugguucugucauguaacacgacaugacccgacuaaaguuuccgug

SEQ ID NO: 82984 - RNA, 64 nt, Homo Sapiens
gucacagacauccugcaccugucauuucucccacacacgacaaaauucccacauccugagaaag

SEQ ID NO: 82985 - RNA, 64 nt, Homo Sapiens
caggccuggacccagagacgucccccaucgugggacacgacacacccagaccgcgugccccacc

SEQ ID NO: 82986 - RNA, 64 nt, Homo Sapiens
acccugucccucgguggccuccccaggccccuggacacgacaguucuccucaggcaggugggcu

SEQ ID NO: 82987 - RNA, 64 nt, Homo Sapiens
ucugaauguguggcccucuagucagcccgaauugacacgacaacgagggaucgugcacgguagc

SEQ ID NO: 82988 - RNA, 64 nt, Homo Sapiens
ucaccucacuugcucagcuucugggacaauucagacacgacagcccacccacccacacacaaca

SEQ ID NO: 82989 - RNA, 64 nt, Homo Sapiens
auuccacugccagugacccacugccuccggccguacacgacagugccuugacccaacagccauc

SEQ ID NO: 82990 - RNA, 64 nt, Homo Sapiens
cagucugaagagcucuauacugcuagccucugcaacacgacacccagggugacaucaggaaugg

SEQ ID NO: 82991 - RNA, 64 nt, Homo Sapiens
gugcaccacccuaagcggcuaggcugacagggccacacgacauagcugaaauuuguucuguagg

SEQ ID NO: 82992 - RNA, 64 nt, Homo Sapiens
ggcagcuucacaagccaucugccaugcgacucccacacgacacgaaaucacuuuucucgcagaa

SEQ ID NO: 82993 - RNA, 64 nt, Homo Sapiens
agcuggaaaaucucucuuaggagguaccugggccacacgacaugagguggaaguuacagaagag

SEQ ID NO: 82994 - RNA, 64 nt, Homo Sapiens
uuuagcuaagaaauaaauacaucucaucuaacacacacgacaaagagaagcugugcgugccccg

SEQ ID NO: 82995 - RNA, 64 nt, Homo Sapiens
ggcgaaauccugccccgucuugcucgcuaguggaacacgacagaucuaaggaggaccccuagac

SEQ ID NO: 82996 - RNA, 64 nt, Homo Sapiens
gagagcagcugccgccucccgacaccuucagaaaacacgacaccuuuuguugccuucuuuggcc

SEQ ID NO: 82997 - RNA, 64 nt, Homo Sapiens
accaaaccccacagaacagagggcaccaggcaucacacgacaucuuucccucccaucucugcca

SEQ ID NO: 82998 - RNA, 64 nt, Homo Sapiens
aggcaggagugagccucaggggaaggaggcaccgacacgacaccgggguuuuagcugcagccuu

SEQ ID NO: 82999 - RNA, 64 nt, Homo Sapiens
cagauaacccugguuggccacagaagcuauuaauacacgacagcauguggggaaggacuuaugg

SEQ ID NO: 83000 - RNA, 64 nt, Homo Sapiens
aaaccagaguggugccucugaugccagaauuaggacacgacaugaugcaaugugagaggauggc

SEQ ID NO: 83001 - RNA, 64 nt, Homo Sapiens
ucaauaaagcuauccagaaaaauguaugcuuuguacacgacacuuaaucauuuuaagugcauga

SEQ ID NO: 83002 - RNA, 64 nt, Homo Sapiens
cacuuauggcucuuuuucaaccaaggaagaaaauacacgacaacuacaaacugcucucaaguua

SEQ ID NO: 83003 - RNA, 64 nt, Homo Sapiens
acacacaguggauuccaguggaggccaguaggagacacgacagcuugguuuugcugagaucgaa

SEQ ID NO: 83004 - RNA, 64 nt, Homo Sapiens
ccucuucccucaggaggcccguguggggcaccccacacgacaccaccugcuggugcugaguccu

SEQ ID NO: 83005 - RNA, 64 nt, Homo Sapiens
ccacauugacacacacacacacacacacacacacacacgacaugcuccuuucuguggcacaugc

SEQ ID NO: 83006 - RNA, 64 nt, Homo Sapiens
aaucuccccuggggaggaaguuguccaaguuuacacacgacacuuggagagaggacccagugac

SEQ ID NO: 83007 - RNA, 64 nt, Homo Sapiens
ccacaagcucccucaugcuuccugucccccgcuuacacgacaacgggccagaccacaggaagga

SEQ ID NO: 83008 - RNA, 64 nt, Homo Sapiens
uccuguugccccaccugugguugcuguggacugcacacgacagcagauucgcuguccccucguu

SEQ ID NO: 83009 - RNA, 64 nt, Homo Sapiens
gaagacgaugggcagaggagugacagccgcagacacacgacagccggcagcaacuggaauggca

SEQ ID NO: 83010 - RNA, 64 nt, Homo Sapiens
cucaggcaagcccggccucuaagagugaaaugcuacacgacaacauugaaccccgaaacucagg

SEQ ID NO: 83011 - RNA, 64 nt, Homo Sapiens
gacaguucagacacccuuggggauggcacuccacacacgacagagaugcaggggccagggaagc

SEQ ID NO: 83012 - RNA, 64 nt, Homo Sapiens
uuuucuccuguguaccaagguauugcuuuuauuuacacgacagcgacucaaaaggcacucgauu

SEQ ID NO: 83013 - RNA, 64 nt, Homo Sapiens
agagacaaucgauauaauguggccagccaaagacacacgacaaaauacacuacgaguugaucuc

SEQ ID NO: 83014 - RNA, 64 nt, Homo Sapiens
ggguuuucugcuuuguuuuuauuuaagaaaauaaacacgacauauuuaaagaagguucuuucac

SEQ ID NO: 83015 - RNA, 64 nt, Homo Sapiens
aacaggggggcccuuguaauuggggucuuucagaacacgacagaaccagacccuguaugacaag

SEQ ID NO: 83016 - RNA, 64 nt, Homo Sapiens
caugggaaugauaguugggaagaaaacuauuugcacacgacagauuucuagauacuuuuugcug

SEQ ID NO: 83017 - RNA, 64 nt, Homo Sapiens
cucucaugccucagcugggacccaccguguagacacacgacaugcaagaguugcagcggcugcu

SEQ ID NO: 83018 - RNA, 64 nt, Homo Sapiens
aaaucacuugagguaugaaguuuauccuguuuuccagagauaaacauaaguugaucuucccaaa

SEQ ID NO: 83019 - RNA, 64 nt, Homo Sapiens
ucaagccagcuucauucacucacuuuacuuagaacagagauauaagggccugggaugcauuuau

SEQ ID NO: 83020 - RNA, 64 nt, Homo Sapiens
gggggaaaugccagaugaaacuagacaaugccaccagagauagucuuuugaggcauucacugcc

SEQ ID NO: 83021 - RNA, 64 nt, Homo Sapiens
uaugaaaaccaguggcuucccccuggugauuacccagagauaucgugauaacuacuuagcacug

SEQ ID NO: 83022 - RNA, 64 nt, Homo Sapiens
aagacauucugcaaagauaucauaugaaaauaaccagagauacauucuacuuguaagauccuau

SEQ ID NO: 83023 - RNA, 64 nt, Homo Sapiens
acucuuugaugaaugcauaacauuucaaaaaacucagagauauuacaagcuucuauugcuaaaa

SEQ ID NO: 83024 - RNA, 64 nt, Homo Sapiens
aggauaaauuaguuuuaguuaaugcuaauuuuugcagagauauaaaguuucguuggauguucaa

SEQ ID NO: 83025 - RNA, 64 nt, Homo Sapiens
uugggugguaaugaucaucugaaauccugagcaacagagauaauauuuggcuauuuuuauaacu

SEQ ID NO: 83026 - RNA, 64 nt, Homo Sapiens
cuucauggaaguggccacuacguggggaucccuucagagauaucugagaccucucuggggauca

SEQ ID NO: 83027 - RNA, 64 nt, Homo Sapiens
ccaccagagaggagagggaaccagauaugcagaucagagauagaggaaguggaaccagagagcu

SEQ ID NO: 83028 - RNA, 64 nt, Homo Sapiens
ugcacugugcucucccacaaguccagcugcaacccagagauaguggaaacugaaauuaggaagg

SEQ ID NO: 83029 - RNA, 64 nt, Homo Sapiens
gaagcauggggaaaauauuugcacucuaaacauacagagauagagguggggcuugugguacuua

SEQ ID NO: 83030 - RNA, 64 nt, Homo Sapiens
gcaacuguuuugauccauuucuuacacacacugccagagauacucuaggcauguaaagcacaaa

SEQ ID NO: 83031 - RNA, 64 nt, Homo Sapiens
guguguuuauuguuccuaagaauuuggcacaagucagagauaauugccuauacuaagaaucuau

SEQ ID NO: 83032 - RNA, 64 nt, Homo Sapiens
gaaacagacuuaucauuauugauuugagguuucccagagauauaguucacaguuaauuguugcg

SEQ ID NO: 83033 - RNA, 64 nt, Homo Sapiens
uggaugcacacacacacacgccaaugcacacacacagagauaugcacacacacggaugcacaca

SEQ ID NO: 83034 - RNA, 64 nt, Homo Sapiens
ugcacacacacggaugcacacacagauggucacacagagauacgcaaacacaccgaugcacacg

SEQ ID NO: 83035 - RNA, 64 nt, Homo Sapiens
ccaaugcacgcacacaucagugcacacggaugcacagagauaugcacacaccgaugugcgcaca

SEQ ID NO: 83036 - RNA, 64 nt, Homo Sapiens
uuagaaacuuagugggaaaaguaggaugguauuuuuauguaaagccuugacccaauguuuaaaa

SEQ ID NO: 83037 - RNA, 64 nt, Homo Sapiens
ucugauuuauugagauugaauuaugccaccacguuuauguaaaaaugaagguggcaccguggug

SEQ ID NO: 83038 - RNA, 64 nt, Homo Sapiens
guguuuuguuuaucaugauuauagaauaaggaauuuauguaaauauacuuaguccuauuucuag

SEQ ID NO: 83039 - RNA, 64 nt, Homo Sapiens
auuauuuuauugucuagcuccaguuaucuguauuuuauguaauguaauugacaggauggcugcu

SEQ ID NO: 83040 - RNA, 64 nt, Homo Sapiens
aaagcugaacuguaaaucuuuauuuuuuaaaugguuauguaagcggaagcacgcuggugcuaag

SEQ ID NO: 83041 - RNA, 64 nt, Homo Sapiens
caguguuuggaacaggagaauugggcagguaaaauuauguaaugaauauuuguaaauggucugu

SEQ ID NO: 83042 - RNA, 64 nt, Homo Sapiens
aagugccaaaauaguuaucaucuaaauaaacacauuauguaaggucugucauuaauaagguauu

SEQ ID NO: 83043 - RNA, 64 nt, Homo Sapiens
cuuguggaacuuugauaaauaacugaauuaaaaauuauguaauauuccguagucuaagauaacu

SEQ ID NO: 83044 - RNA, 64 nt, Homo Sapiens
gauaagucuggaaauaaaugaauguguauuuaacuuauguaaaaauguuucagugccucagaca

SEQ ID NO: 83045 - RNA, 64 nt, Homo Sapiens
aauccaaagaaaugauuguauaccucucugaauauuauguaaaccaguauaucuucuuuggggu

SEQ ID NO: 83046 - RNA, 64 nt, Homo Sapiens
gauaacauuucaaacccugaaggacagugacuuauuauguaaguucaauuuuguaaguucauua

SEQ ID NO: 83047 - RNA, 64 nt, Homo Sapiens
ugacuuauuauguaaguucaauuuuguaaguucauuauguaagauccuuuuuuuuuucauaaua

SEQ ID NO: 83048 - RNA, 64 nt, Homo Sapiens
augaaauuaaugagauauauauugaaauaaagaauuauguaaaagccauucuuuaaaauauuua

SEQ ID NO: 83049 - RNA, 64 nt, Homo Sapiens
ccauucuuuaaaauauuuauagcauaaauauauguuauguaaaguguguauauagaauuaguuu

SEQ ID NO: 83050 - RNA, 64 nt, Homo Sapiens
gcagaagccuuuuuuuuaagaugaaggaaauauuuuauguaaagagcaacucagcaggacacag

SEQ ID NO: 83051 - RNA, 64 nt, Homo Sapiens
cagcauuugacuuuuauuuaaaaggcggcacuacuuauguaaaucugagcugugggauauuucu

SEQ ID NO: 83052 - RNA, 64 nt, Homo Sapiens
gaugacuaauuggcaauuugauaguaguuacauuuuauguaacacuugauauaauaacccaaau

SEQ ID NO: 83053 - RNA, 64 nt, Homo Sapiens
uucugugguuuauugauccaaaaguacauauuuguuauguaaacuuauacuauguaaacuugaa

SEQ ID NO: 83054 - RNA, 64 nt, Homo Sapiens
acaguaacaugcaaacacuuccaaucaugucucuuuauguaaagugggcagcugcagguuucuc

SEQ ID NO: 83055 - RNA, 64 nt, Homo Sapiens
cccugugaguuguauuuaucauuuucagugacacuuauguaaggaaaauaacucuauguuguuu

SEQ ID NO: 83056 - RNA, 64 nt, Homo Sapiens
gaccugaagaauuacuaucucuguuucuuggugguuauguaaaauauauugcagaaaccaauau

SEQ ID NO: 83057 - RNA, 64 nt, Homo Sapiens
gugggccuugccccugucugcagaaauugugcuauuauguaacuaugcugauguucaacaguug

SEQ ID NO: 83058 - RNA, 64 nt, Homo Sapiens
uuuuguuuaauaggaaauauauaauaauagcauuuuauguaauaaaauaugggcaacgauuauc

SEQ ID NO: 83059 - RNA, 64 nt, Homo Sapiens
auuuuaauugagcauuuauauggauaaucauacauuauguaagcccauauguauuuacauccag

SEQ ID NO: 83060 - RNA, 64 nt, Homo Sapiens
uggggcuuuuauguagcacuaaacuuuucaaaauuuauguaaugcuguaacuguuuaagccaau

SEQ ID NO: 83061 - RNA, 64 nt, Homo Sapiens
uuguaauacuuuccuauauuguuucaucuucuuuuuauguaaauaauaacuuguuuuuucucau

SEQ ID NO: 83062 - RNA, 64 nt, Homo Sapiens
auguaaagaaaauaagucaguggacucuguuccuuuauguaaacuauauugucuuaaaaguaug

SEQ ID NO: 83063 - RNA, 64 nt, Homo Sapiens
uuuuguacauaguagcauuaagaacacugucccuuuauguaaauauaguaucuuaauaaaaaug

SEQ ID NO: 83064 - RNA, 64 nt, Homo Sapiens
aauuuguaaaaguuucuuaauuauuaacuuucuuuuauguaaguuugcaaauuugugacugucc

SEQ ID NO: 83065 - RNA, 64 nt, Homo Sapiens
acuugcaucacaguggccgaacacaguuucuuauuuauguaaauugucuugaccauugacuaug

SEQ ID NO: 83066 - RNA, 64 nt, Homo Sapiens
aagaauaugaaacauagauaaaacaucuuugaaauuauguaaauuauguaaauuaucaggcaaa

SEQ ID NO: 83067 - RNA, 64 nt, Homo Sapiens
aaacauagauaaaacaucuuugaaauuauguaaauuauguaaauuaucaggcaaauuugcauua

SEQ ID NO: 83068 - RNA, 64 nt, Homo Sapiens
ugauuggaaauguaauggauaugaaaaugcuugguuauguaaaguuuacaauagugugacaacg

SEQ ID NO: 83069 - RNA, 64 nt, Homo Sapiens
uuaugcugcaauagcuuuuguagaucuuuuaguauuauguaaauguuuugccgaggauuuuggu

SEQ ID NO: 83070 - RNA, 64 nt, Homo Sapiens
gagaaaauauuuuagaauuuaauguuucuuauauuuauguaaacuuaugacucuucauuuauau

SEQ ID NO: 83071 - RNA, 64 nt, Homo Sapiens
gugcagugcagcucuaauaaaggccuuauuuuucuuauguaaaucaucuuuuuacauuuguuug

SEQ ID NO: 83072 - RNA, 64 nt, Homo Sapiens
cuguuuuucuauuaaucuuuugucaacuuccugauuauguaacaaaguauguacagucuacuuu

SEQ ID NO: 83073 - RNA, 64 nt, Homo Sapiens
cacuucauuguuuuaaaggaucgaucaagcuacuuuauguaaauuacgauuccacugaaacucu

SEQ ID NO: 83074 - RNA, 64 nt, Homo Sapiens
acaauuuguacuuuuuucuugacaaaguguguaauuauguaaauaagaagaaaaagaagucaaa

SEQ ID NO: 83075 - RNA, 64 nt, Homo Sapiens
cuguuuuacaguaucaaaauucuuuuugcauuuauuauguaaaauaaaaauuuagaaaauguua

SEQ ID NO: 83076 - RNA, 64 nt, Homo Sapiens
ugguuucauuuuauucuaccuguauaaccugccauuauguaauuuggaaagagauucuuuaaaa

SEQ ID NO: 83077 - RNA, 64 nt, Homo Sapiens
cugauguauaugguuaucuggguuauaucuauuuuuauguaaacucuauuuuguuuuuggcaag

SEQ ID NO: 83078 - RNA, 64 nt, Homo Sapiens
uucuuuaaaguuuacaaaaaaaaaccuuauguuuuuauguaaucagucauuacacuagggagaa

SEQ ID NO: 83079 - RNA, 64 nt, Homo Sapiens
uuuagaacgacauguuaauauauguaagcuguauuuauguaauaaacaauguuugauacucuag

SEQ ID NO: 83080 - RNA, 64 nt, Homo Sapiens
auaaauauucuagguuagucuguugaaaugauaauuauguaaagaguuuaacguauauuaaacc

SEQ ID NO: 83081 - RNA, 64 nt, Homo Sapiens
gacuugaguauacuuggauuacaaauaugucauuuuauguaaggcggaugugcguugguuauau

SEQ ID NO: 83082 - RNA, 64 nt, Homo Sapiens
uuauuugaagaaaauguuuuuuuuucuaagcaauuuauguaauuugaaauuauugauuuuggca

SEQ ID NO: 83083 - RNA, 64 nt, Homo Sapiens
guuccuuuaauguuguaauuaguuaaacaaaagguuauguaacucagaaacagaaccagagaga

SEQ ID NO: 83084 - RNA, 64 nt, Homo Sapiens
uaguccucugcuguuuacuuguugagagagaugguuauguaaguaaaagaaaaauaauugaaau

SEQ ID NO: 83085 - RNA, 64 nt, Homo Sapiens
uuuucuuuuuaauuuaagaugagcuauuuggagcuuauguaauaauggcauaaagccaacuaga

SEQ ID NO: 83086 - RNA, 64 nt, Homo Sapiens
aguagguuaccauuuugaggcaguuggauauaaauuauguaaauauguaugauuaugauuuuua

SEQ ID NO: 83087 - RNA, 64 nt, Homo Sapiens
gauaccaaauuagggaaguuggauaaugcaaaaauuauguaauauuuagauguauaaugaaaaa

SEQ ID NO: 83088 - RNA, 64 nt, Homo Sapiens
augauuuuaacaacuuuuuagaguugcauucuuauuauguaaggaacuauuuaagaguuuaaaa

SEQ ID NO: 83089 - RNA, 64 nt, Homo Sapiens
uauuauuuuaaauguuauuuuaaauuauauuguuuuauguaauauauuuuauguaauauugugu

SEQ ID NO: 83090 - RNA, 64 nt, Homo Sapiens
uuguguuaaauuauauuguuuauaauauuauauuuuauguaauacuuguauuauaaucuuuuaa

SEQ ID NO: 83091 - RNA, 64 nt, Homo Sapiens
acacagcuaauuuacucuuguaacuaaauucuauuuauguaacauagaguaguagcucuauuuc

SEQ ID NO: 83092 - RNA, 64 nt, Homo Sapiens
auugcuuauucaaguaguuuuauugagcuauguuuuauguaaguagccauuuucucaucugaua

SEQ ID NO: 83093 - RNA, 64 nt, Homo Sapiens
cugcagcaaugauauuucagucugugaacuucuauuauguaaagaaucucuaguguacaaaggg

SEQ ID NO: 83094 - RNA, 64 nt, Homo Sapiens
gauuaaguuguugaguaguuuuguaaucaagauuuuauguaacauuuguaaagggaaaauuagc

SEQ ID NO: 83095 - RNA, 64 nt, Homo Sapiens
uauauuuauggggccauugcuuaaagauuauaaauuauguaaauacauuaauaaauucuaaguu

SEQ ID NO: 83096 - RNA, 64 nt, Homo Sapiens
aaaauaacucaaucaauauaucaauauaauuuauuuauguaagacagcuguuaaauccuaaaaa

SEQ ID NO: 83097 - RNA, 64 nt, Homo Sapiens
guuaaaaugagcaucucaaauuugggauuauaaauuauguaaauuuuucauugucuuuuauaca

SEQ ID NO: 83098 - RNA, 64 nt, Homo Sapiens
uaacuacaauucacuguugugagaauauuccucgucacagcaaaaacacuuuccuuucuacuga

SEQ ID NO: 83099 - RNA, 64 nt, Homo Sapiens
cacuuuccuuucuacugacaaccaguccuccacaucacagcauuuagacauauggguaaaaugu

SEQ ID NO: 83100 - RNA, 64 nt, Homo Sapiens
agugcacaucagcacuauggagucucugcccaggucacagcacacacaacagaugcugggaccc

SEQ ID NO: 83101 - RNA, 64 nt, Homo Sapiens
acccuuuccucucauugucccaggccccugccucucacagcagcucaagggaccucccucaugc

SEQ ID NO: 83102 - RNA, 64 nt, Homo Sapiens
gaaacugaggcccagggaggagaguaacugaaggucacagcacggucacagcagagguggccga

SEQ ID NO: 83103 - RNA, 64 nt, Homo Sapiens
ccagggaggagaguaacugaaggucacagcacggucacagcagagguggccgaacccagcccuc

SEQ ID NO: 83104 - RNA, 64 nt, Homo Sapiens
acauucuauuguucaucauaaaaaguccuuguccucacagcagucaacagugaacaauaaagau

SEQ ID NO: 83105 - RNA, 64 nt, Homo Sapiens
aaaucauauuacaaguacguguuuuguacuagugucacagcauacuaugcauuagaguugaugu

SEQ ID NO: 83106 - RNA, 64 nt, Homo Sapiens
acacugagggaauauuucccuggcuuuaacaguuucacagcaggagugaguuucauaggauggg

SEQ ID NO: 83107 - RNA, 64 nt, Homo Sapiens
cacgcuagacagcauagucccugccaugaggaagucacagcagaaacagccacaguguggggcu

SEQ ID NO: 83108 - RNA, 64 nt, Homo Sapiens
auccaaaucucuguggcuucaugcuuguauaugcucacagcagggcacaaaauccaagagaagg

SEQ ID NO: 83109 - RNA, 64 nt, Homo Sapiens
gucugauauucuugacaaucaucagcaacaaagaucacagcacuuuccagaagcauggagcuuc

SEQ ID NO: 83110 - RNA, 64 nt, Homo Sapiens
ugugagucugggcgccuuagaauaaaggagcucuucacagcaccggaaccgauuccaucacccc

SEQ ID NO: 83111 - RNA, 64 nt, Homo Sapiens
aaaccagcucuuuggaaccgaagcugcgaucccuucacagcagugaaccagagcuugaaauuca

SEQ ID NO: 83112 - RNA, 64 nt, Homo Sapiens
cacaacccccuauauuauuuugguugucuauuucucacagcauauuuucaguuuuuuguccauu

SEQ ID NO: 83113 - RNA, 64 nt, Homo Sapiens
uguggguauaccuaccccaaaauuguuuucucauucacagcauuagcauauucagcaaauccau

SEQ ID NO: 83114 - RNA, 64 nt, Homo Sapiens
agagggauggggucccugagccaggccccacccaucacagcauucccagguccugguacccagc

SEQ ID NO: 83115 - RNA, 64 nt, Homo Sapiens
gcuuugcucuuugguccucaggccaccagaccccucacagcauggcccuuggcucuuccugcac

SEQ ID NO: 83116 - RNA, 64 nt, Homo Sapiens
agccuucacagaggacgucccgugccagauucucucacagcagaucgggagacaggauguugac

SEQ ID NO: 83117 - RNA, 64 nt, Homo Sapiens
gaaggguccugcuguggucaucuuggugacucggucacagcagcuacuggccaagaucagacgu

SEQ ID NO: 83118 - RNA, 64 nt, Homo Sapiens
gcugucugccaaaagaaacugccuacagacaucaucacagcagccuccucacuuggguacuaca

SEQ ID NO: 83119 - RNA, 64 nt, Homo Sapiens
uuuuuaucccauaucccaaauucuuaugagccacucacagcaggcagcauauguugaaauaagu

SEQ ID NO: 83120 - RNA, 64 nt, Homo Sapiens
cugggacagcuguuaccuuugcaguguugccgaaucacagcaguuaccuuugcaguguugccga

SEQ ID NO: 83121 - RNA, 64 nt, Homo Sapiens
gaaucacagcaguuaccuuugcaguguugccgaaucacagcaguucuguuggagaaacgcuugg

SEQ ID NO: 83122 - RNA, 62 nt, Homo Sapiens
gucccagguccaggaaauccaauguuggugaaggcagccacucucuugcuuguccccaaauc

SEQ ID NO: 83123 - RNA, 62 nt, Homo Sapiens
gguggggugggcucucccuuaggcuugggcaaggcagccaccugcccuugcucucccuuagu

SEQ ID NO: 83124 - RNA, 62 nt, Homo Sapiens
aagcaggcugaaaggcagaguggggggugccuggcagccaugugccaguaccugccuggggg

SEQ ID NO: 83125 - RNA, 62 nt, Homo Sapiens
ccaguaccugccuggggguggucccucaggcuggcagccaugugccaacuguggaaacuuca

SEQ ID NO: 83126 - RNA, 62 nt, Homo Sapiens
aggccuggauggaggccuaggguuacuucaagggcagccagcgggcuccccaaccugaguug

SEQ ID NO: 83127 - RNA, 57 nt, Homo Sapiens
auucuggcccagggcgccucggcugguggcagccagggcaugcucaaggacuccuag

SEQ ID NO: 83128 - RNA, 62 nt, Homo Sapiens
gcagaauuguuugugggcaaugggauuaauugggcagccaucaaaggaggaucagaaugcuu

SEQ ID NO: 83129 - RNA, 62 nt, Homo Sapiens
cugcagcuucaaacgcucaccgccgacacgauggcagccaaagugccugaauucuuucuuuu

SEQ ID NO: 83130 - RNA, 62 nt, Homo Sapiens
cuauggccccagugccuugaggcccaggccagggcagccaguggcucuagcucagggaaagc

SEQ ID NO: 83131 - RNA, 62 nt, Homo Sapiens
agccaugaggaccuggccuucugcccgacccaggcagccauucaaguugagcaauggccacu

SEQ ID NO: 83132 - RNA, 62 nt, Homo Sapiens
ggggaggcggccucuccccugcuguggacacuggcagccaaugcccccucuccccuucccug

SEQ ID NO: 83133 - RNA, 62 nt, Homo Sapiens
ggccaggccguuguauccauagaugcuuccugggcagccacuacuagagccccaaccacagc

SEQ ID NO: 83134 - RNA, 62 nt, Homo Sapiens
gaagacugugcucgcuggguguuucagacacuggcagccaauggccuaggcgaggguuccag

SEQ ID NO: 83135 - RNA, 62 nt, Homo Sapiens
gcuuccuggaggcgaugcaggcagccccucccggcagccagguguccucccaucuccugugg

SEQ ID NO: 83136 - RNA, 59 nt, Homo Sapiens
acuccagcggcagccacuagaccgcgcccggcagccacccaccccacgugccaacuucc

SEQ ID NO: 83137 - RNA, 62 nt, Homo Sapiens
ccucgaggcucgaugccugugccaaggccaggggcagccagagggcagcuggauggccacgu

SEQ ID NO: 83138 - RNA, 62 nt, Homo Sapiens
cggggagggcuaccuccuccgaugcaguauucggcagccagccgugggugucacguguccca

SEQ ID NO: 83139 - RNA, 62 nt, Homo Sapiens
ggggcgugaugcagugugcagaggcagagggaggcagccagcagugugcgucuguacgggaa

SEQ ID NO: 83140 - RNA, 62 nt, Homo Sapiens
ggacaggaagagucugugaucaagccucagaaggcagccagauucuucaucauggaaagcca

SEQ ID NO: 83141 - RNA, 62 nt, Homo Sapiens
ggcauucaguuugugggcaugccugucacaguggcagccacauguucguaggaugaugugca

SEQ ID NO: 83142 - RNA, 62 nt, Homo Sapiens
aucugggccuuggccuggagaucuggggagcaggcagccagcgaggcagcccaggaagucuc

SEQ ID NO: 83143 - RNA, 62 nt, Homo Sapiens
gcccugagccagggucuccacccccuuucacaggcagccagugugggccugggcuccuggac

SEQ ID NO: 83144 - RNA, 62 nt, Homo Sapiens
aacccacaccaugaagacaggacaguucuguuggcagccaagcuuccuucuuaauaaaggcu

SEQ ID NO: 83145 - RNA, 62 nt, Homo Sapiens
caccuggucccuugugcugauuuucucucucaggcagccagcacucuuuccacugugacuua

SEQ ID NO: 83146 - RNA, 62 nt, Homo Sapiens
ggugggcccugagcccucaggcacuucccccaggcagccagucuuuccacaccagacuggca

SEQ ID NO: 83147 - RNA, 62 nt, Homo Sapiens
guccccagagcugcuugugguggaguguguugggcagccaguacugaugaagucaccuggcc

SEQ ID NO: 83148 - RNA, 62 nt, Homo Sapiens
uguggcguugugaggccaccggccucucauguggcagccacauacagacuggcacugggcag

SEQ ID NO: 83149 - RNA, 62 nt, Homo Sapiens
gcacuuuaaccccugcauaguguuugcccucaggcagccaaagggaaaaaccccugcucacu

SEQ ID NO: 83150 - RNA, 62 nt, Homo Sapiens
cuggcucaggaggguugggucccugggaggccggcagccaggccacagaauccacacgugga

SEQ ID NO: 83151 - RNA, 62 nt, Homo Sapiens
acacguggaccauugugggucccugggaggccggcagccaggccacggaauccacacgugga

SEQ ID NO: 83152 - RNA, 62 nt, Homo Sapiens
cugcauucccacccagcgcgguggcugugccgggcagccaucuggccgccuggggagccugu

SEQ ID NO: 83153 - RNA, 62 nt, Homo Sapiens
cagaggaggggcucuaccagcucccacagccuggcagccaucgggucucgugcugcccuucc

SEQ ID NO: 83154 - RNA, 62 nt, Homo Sapiens
augugcuugggcccaccaggcccccacuccagggcagccaugcuguagcagccaccccccug

SEQ ID NO: 83155 - RNA, 62 nt, Homo Sapiens
ccaaagacacuggugugcauuaggugcccaacggcagccaaacggggugggaccagagguca

SEQ ID NO: 83156 - RNA, 64 nt, Homo Sapiens
ucuuguucuguguucaaucaacuuagucugacgccacgcgcauccuggccugcaucucucuaag

SEQ ID NO: 83157 - RNA, 64 nt, Homo Sapiens
cgccaauuaagagauggaccgggcugagccuugucacgcgcacugguggcucccuguggagcca

SEQ ID NO: 83158 - RNA, 64 nt, Homo Sapiens
ccuacccugugggcacucagcugguggggcuguccgggaagacaucguucuuccacacccuguc

SEQ ID NO: 83159 - RNA, 64 nt, Homo Sapiens
cucugcaagggggacaggcaccggcuucacguggcgggaagacccgucggcauccaggccugug

SEQ ID NO: 83160 - RNA, 64 nt, Homo Sapiens
ucuucucauuucagagcaugggcauguguuucaucgggaagaggaauuuugaacauuuccuucu

SEQ ID NO: 83161 - RNA, 64 nt, Homo Sapiens
cuguguucuacaagggggacgagugccugggcagcgggaagauccugcggcuggggccgucugc

SEQ ID NO: 83162 - RNA, 64 nt, Homo Sapiens; identical to SEQ ID NO: 58312

SEQ ID NO: 83163 - RNA, 64 nt, Homo Sapiens; identical to SEQ ID NO: 58313

SEQ ID NO: 83164 - RNA, 64 nt, Homo Sapiens; identical to SEQ ID NO: 58314

SEQ ID NO: 83165 - RNA, 64 nt, Homo Sapiens; identical to SEQ ID NO: 58315

SEQ ID NO: 83166 - RNA, 64 nt, Homo Sapiens; identical to SEQ ID NO: 58316

SEQ ID NO: 83167 - RNA, 64 nt, Homo Sapiens; identical to SEQ ID NO: 58317

SEQ ID NO: 83168 - RNA, 64 nt, Homo Sapiens; identical to SEQ ID NO: 58318

SEQ ID NO: 83169 - RNA, 64 nt, Homo Sapiens; identical to SEQ ID NO: 58319

SEQ ID NO: 83170 - RNA, 64 nt, Homo Sapiens; identical to SEQ ID NO: 58320

SEQ ID NO: 83171 - RNA, 64 nt, Homo Sapiens; identical to SEQ ID NO: 58321

SEQ ID NO: 83172 - RNA, 64 nt, Homo Sapiens; identical to SEQ ID NO: 58322

SEQ ID NO: 83173 - RNA, 64 nt, Homo Sapiens; identical to SEQ ID NO: 58323

SEQ ID NO: 83174 - RNA, 64 nt, Homo Sapiens; identical to SEQ ID NO: 58324

SEQ ID NO: 83175 - RNA, 64 nt, Homo Sapiens; identical to SEQ ID NO: 58325

SEQ ID NO: 83176 - RNA, 64 nt, Homo Sapiens; identical to SEQ ID NO: 58326

SEQ ID NO: 83177 - RNA, 64 nt, Homo Sapiens; identical to SEQ ID NO: 58327

SEQ ID NO: 83178 - RNA, 64 nt, Homo Sapiens; identical to SEQ ID NO: 58328

SEQ ID NO: 83179 - RNA, 64 nt, Homo Sapiens; identical to SEQ ID NO: 58329

SEQ ID NO: 83180 - RNA, 64 nt, Homo Sapiens; identical to SEQ ID NO: 58330

SEQ ID NO: 83181 - RNA, 64 nt, Homo Sapiens; identical to SEQ ID NO: 58331

SEQ ID NO: 83182 - RNA, 64 nt, Homo Sapiens; identical to SEQ ID NO: 58332

SEQ ID NO: 83183 - RNA, 64 nt, Homo Sapiens; identical to SEQ ID NO: 58333

SEQ ID NO: 83184 - RNA, 64 nt, Homo Sapiens; identical to SEQ ID NO: 58334

SEQ ID NO: 83185 - RNA, 64 nt, Homo Sapiens; identical to SEQ ID NO: 58335

SEQ ID NO: 83186 - RNA, 64 nt, Homo Sapiens; identical to SEQ ID NO: 58336

SEQ ID NO: 83187 - RNA, 64 nt, Homo Sapiens; identical to SEQ ID NO: 58337

SEQ ID NO: 83188 - RNA, 64 nt, Homo Sapiens; identical to SEQ ID NO: 58338

SEQ ID NO: 83189 - RNA, 64 nt, Homo Sapiens; identical to SEQ ID NO: 58339

SEQ ID NO: 83190 - RNA, 64 nt, Homo Sapiens; identical to SEQ ID NO: 58340

SEQ ID NO: 83191 - RNA, 64 nt, Homo Sapiens; identical to SEQ ID NO: 58341

SEQ ID NO: 83192 - RNA, 64 nt, Homo Sapiens; identical to SEQ ID NO: 58342

SEQ ID NO: 83193 - RNA, 64 nt, Homo Sapiens; identical to SEQ ID NO: 58343

SEQ ID NO: 83194 - RNA, 64 nt, Homo Sapiens; identical to SEQ ID NO: 58344

SEQ ID NO: 83195 - RNA, 64 nt, Homo Sapiens; identical to SEQ ID NO: 58345

SEQ ID NO: 83196 - RNA, 64 nt, Homo Sapiens; identical to SEQ ID NO: 58346

SEQ ID NO: 83197 - RNA, 64 nt, Homo Sapiens; identical to SEQ ID NO: 58347

SEQ ID NO: 83198 - RNA, 64 nt, Homo Sapiens; identical to SEQ ID NO: 58348

SEQ ID NO: 83199 - RNA, 64 nt, Homo Sapiens; identical to SEQ ID NO: 58349

SEQ ID NO: 83200 - RNA, 64 nt, Homo Sapiens; identical to SEQ ID NO: 58350

SEQ ID NO: 83201 - RNA, 64 nt, Homo Sapiens; identical to SEQ ID NO: 58351

SEQ ID NO: 83202 - RNA, 64 nt, Homo Sapiens; identical to SEQ ID NO: 58352

SEQ ID NO: 83203 - RNA, 64 nt, Homo Sapiens; identical to SEQ ID NO: 58353

SEQ ID NO: 83204 - RNA, 64 nt, Homo Sapiens; identical to SEQ ID NO: 58354

SEQ ID NO: 83205 - RNA, 64 nt, Homo Sapiens; identical to SEQ ID NO: 58355

SEQ ID NO: 83206 - RNA, 64 nt, Homo Sapiens; identical to SEQ ID NO: 58356

SEQ ID NO: 83207 - RNA, 64 nt, Homo Sapiens; identical to SEQ ID NO: 58357

SEQ ID NO: 83208 - RNA, 64 nt, Homo Sapiens; identical to SEQ ID NO: 58358

SEQ ID NO: 83209 - RNA, 64 nt, Homo Sapiens; identical to SEQ ID NO: 58359

SEQ ID NO: 83210 - RNA, 64 nt, Homo Sapiens; identical to SEQ ID NO: 58360

SEQ ID NO: 83211 - RNA, 64 nt, Homo Sapiens; identical to SEQ ID NO: 58361

SEQ ID NO: 83212 - RNA, 64 nt, Homo Sapiens; identical to SEQ ID NO: 58362

SEQ ID NO: 83213 - RNA, 64 nt, Homo Sapiens; identical to SEQ ID NO: 58363

SEQ ID NO: 83214 - RNA, 64 nt, Homo Sapiens; identical to SEQ ID NO: 58364

SEQ ID NO: 83215 - RNA, 64 nt, Homo Sapiens; identical to SEQ ID NO: 58365

SEQ ID NO: 83216 - RNA, 64 nt, Homo Sapiens; identical to SEQ ID NO: 58366

SEQ ID NO: 83217 - RNA, 64 nt, Homo Sapiens; identical to SEQ ID NO: 58367

SEQ ID NO: 83218 - RNA, 64 nt, Homo Sapiens; identical to SEQ ID NO: 58368

SEQ ID NO: 83219 - RNA, 64 nt, Homo Sapiens; identical to SEQ ID NO: 58369

SEQ ID NO: 83220 - RNA, 64 nt, Homo Sapiens; identical to SEQ ID NO: 58370

SEQ ID NO: 83221 - RNA, 64 nt, Homo Sapiens; identical to SEQ ID NO: 58371

SEQ ID NO: 83222 - RNA, 64 nt, Homo Sapiens; identical to SEQ ID NO: 58372

SEQ ID NO: 83223 - RNA, 64 nt, Homo Sapiens; identical to SEQ ID NO: 58373

SEQ ID NO: 83224 - RNA, 64 nt, Homo Sapiens; identical to SEQ ID NO: 58374

SEQ ID NO: 83225 - RNA, 64 nt, Homo Sapiens; identical to SEQ ID NO: 58375

SEQ ID NO: 83226 - RNA, 64 nt, Homo Sapiens; identical to SEQ ID NO: 58376

SEQ ID NO: 83227 - RNA, 64 nt, Homo Sapiens; identical to SEQ ID NO: 58377

SEQ ID NO: 83228 - RNA, 64 nt, Homo Sapiens; identical to SEQ ID NO: 58378

SEQ ID NO: 83229 - RNA, 64 nt, Homo Sapiens; identical to SEQ ID NO: 58379

SEQ ID NO: 83230 - RNA, 64 nt, Homo Sapiens; identical to SEQ ID NO: 58380

SEQ ID NO: 83231 - RNA, 64 nt, Homo Sapiens; identical to SEQ ID NO: 58381

SEQ ID NO: 83232 - RNA, 64 nt, Homo Sapiens; identical to SEQ ID NO: 58382

SEQ ID NO: 83233 - RNA, 64 nt, Homo Sapiens; identical to SEQ ID NO: 58383

SEQ ID NO: 83234 - RNA, 64 nt, Homo Sapiens; identical to SEQ ID NO: 58384

SEQ ID NO: 83235 - RNA, 64 nt, Homo Sapiens; identical to SEQ ID NO: 58385

SEQ ID NO: 83236 - RNA, 64 nt, Homo Sapiens; identical to SEQ ID NO: 58386

SEQ ID NO: 83237 - RNA, 64 nt, Homo Sapiens; identical to SEQ ID NO: 58387

SEQ ID NO: 83238 - RNA, 64 nt, Homo Sapiens; identical to SEQ ID NO: 58388

SEQ ID NO: 83239 - RNA, 64 nt, Homo Sapiens; identical to SEQ ID NO: 58389

SEQ ID NO: 83240 - RNA, 64 nt, Homo Sapiens; identical to SEQ ID NO: 58390

SEQ ID NO: 83241 - RNA, 64 nt, Homo Sapiens; identical to SEQ ID NO: 58391

SEQ ID NO: 83242 - RNA, 64 nt, Homo Sapiens; identical to SEQ ID NO: 58392

SEQ ID NO: 83243 - RNA, 64 nt, Homo Sapiens; identical to SEQ ID NO: 58393

SEQ ID NO: 83244 - RNA, 64 nt, Homo Sapiens; identical to SEQ ID NO: 58394

SEQ ID NO: 83245 - RNA, 64 nt, Homo Sapiens; identical to SEQ ID NO: 58395

SEQ ID NO: 83246 - RNA, 64 nt, Homo Sapiens; identical to SEQ ID NO: 58396

SEQ ID NO: 83247 - RNA, 64 nt, Homo Sapiens; identical to SEQ ID NO: 58397

SEQ ID NO: 83248 - RNA, 64 nt, Homo Sapiens; identical to SEQ ID NO: 58398

SEQ ID NO: 83249 - RNA, 64 nt, Homo Sapiens; identical to SEQ ID NO: 58399

SEQ ID NO: 83250 - RNA, 64 nt, Homo Sapiens; identical to SEQ ID NO: 58400

SEQ ID NO: 83251 - RNA, 64 nt, Homo Sapiens; identical to SEQ ID NO: 58401

SEQ ID NO: 83252 - RNA, 64 nt, Homo Sapiens; identical to SEQ ID NO: 58402

SEQ ID NO: 83253 - RNA, 64 nt, Homo Sapiens; identical to SEQ ID NO: 58403

SEQ ID NO: 83254 - RNA, 64 nt, Homo Sapiens; identical to SEQ ID NO: 58404

SEQ ID NO: 83255 - RNA, 64 nt, Homo Sapiens; identical to SEQ ID NO: 58405

SEQ ID NO: 83256 - RNA, 64 nt, Homo Sapiens; identical to SEQ ID NO: 58406

SEQ ID NO: 83257 - RNA, 64 nt, Homo Sapiens; identical to SEQ ID NO: 58407

SEQ ID NO: 83258 - RNA, 64 nt, Homo Sapiens; identical to SEQ ID NO: 58408

SEQ ID NO: 83259 - RNA, 64 nt, Homo Sapiens; identical to SEQ ID NO: 58409

SEQ ID NO: 83260 - RNA, 64 nt, Homo Sapiens; identical to SEQ ID NO: 58410

SEQ ID NO: 83261 - RNA, 64 nt, Homo Sapiens; identical to SEQ ID NO: 58411

SEQ ID NO: 83262 - RNA, 64 nt, Homo Sapiens; identical to SEQ ID NO: 58412

SEQ ID NO: 83263 - RNA, 64 nt, Homo Sapiens; identical to SEQ ID NO: 58413

SEQ ID NO: 83264 - RNA, 64 nt, Homo Sapiens; identical to SEQ ID NO: 58414

SEQ ID NO: 83265 - RNA, 64 nt, Homo Sapiens; identical to SEQ ID NO: 58415

SEQ ID NO: 83266 - RNA, 64 nt, Homo Sapiens; identical to SEQ ID NO: 58416

SEQ ID NO: 83267 - RNA, 64 nt, Homo Sapiens; identical to SEQ ID NO: 58417

SEQ ID NO: 83268 - RNA, 64 nt, Homo Sapiens; identical to SEQ ID NO: 58418

SEQ ID NO: 83269 - RNA, 64 nt, Homo Sapiens; identical to SEQ ID NO: 58419

SEQ ID NO: 83270 - RNA, 64 nt, Homo Sapiens; identical to SEQ ID NO: 58420

SEQ ID NO: 83271 - RNA, 64 nt, Homo Sapiens; identical to SEQ ID NO: 58421

SEQ ID NO: 83272 - RNA, 64 nt, Homo Sapiens; identical to SEQ ID NO: 58422

SEQ ID NO: 83273 - RNA, 64 nt, Homo Sapiens; identical to SEQ ID NO: 58423

SEQ ID NO: 83274 - RNA, 64 nt, Homo Sapiens; identical to SEQ ID NO: 58424

SEQ ID NO: 83275 - RNA, 64 nt, Homo Sapiens; identical to SEQ ID NO: 58425

SEQ ID NO: 83276 - RNA, 64 nt, Homo Sapiens; identical to SEQ ID NO: 58426

SEQ ID NO: 83277 - RNA, 64 nt, Homo Sapiens; identical to SEQ ID NO: 58427

SEQ ID NO: 83278 - RNA, 64 nt, Homo Sapiens; identical to SEQ ID NO: 58428

SEQ ID NO: 83279 - RNA, 64 nt, Homo Sapiens; identical to SEQ ID NO: 58429

SEQ ID NO: 83280 - RNA, 64 nt, Homo Sapiens; identical to SEQ ID NO: 58430

SEQ ID NO: 83281 - RNA, 64 nt, Homo Sapiens; identical to SEQ ID NO: 58431

SEQ ID NO: 83282 - RNA, 64 nt, Homo Sapiens; identical to SEQ ID NO: 58432

SEQ ID NO: 83283 - RNA, 64 nt, Homo Sapiens; identical to SEQ ID NO: 58433

SEQ ID NO: 83284 - RNA, 64 nt, Homo Sapiens; identical to SEQ ID NO: 58434

SEQ ID NO: 83285 - RNA, 64 nt, Homo Sapiens; identical to SEQ ID NO: 58435

SEQ ID NO: 83286 - RNA, 50 nt, Homo Sapiens; identical to SEQ ID NO: 58436

SEQ ID NO: 83287 - RNA, 64 nt, Homo Sapiens; identical to SEQ ID NO: 58437

SEQ ID NO: 83288 - RNA, 64 nt, Homo Sapiens; identical to SEQ ID NO: 58438

SEQ ID NO: 83289 - RNA, 64 nt, Homo Sapiens; identical to SEQ ID NO: 58439

SEQ ID NO: 83290 - RNA, 64 nt, Homo Sapiens; identical to SEQ ID NO: 58440

SEQ ID NO: 83291 - RNA, 64 nt, Homo Sapiens; identical to SEQ ID NO: 58441

SEQ ID NO: 83292 - RNA, 64 nt, Homo Sapiens; identical to SEQ ID NO: 58442

SEQ ID NO: 83293 - RNA, 64 nt, Homo Sapiens; identical to SEQ ID NO: 58443

SEQ ID NO: 83294 - RNA, 64 nt, Homo Sapiens; identical to SEQ ID NO: 58444

SEQ ID NO: 83295 - RNA, 64 nt, Homo Sapiens; identical to SEQ ID NO: 58445

SEQ ID NO: 83296 - RNA, 64 nt, Homo Sapiens; identical to SEQ ID NO: 58446

SEQ ID NO: 83297 - RNA, 64 nt, Homo Sapiens; identical to SEQ ID NO: 58447

SEQ ID NO: 83298 - RNA, 64 nt, Homo Sapiens; identical to SEQ ID NO: 58448

SEQ ID NO: 83299 - RNA, 64 nt, Homo Sapiens; identical to SEQ ID NO: 58449

SEQ ID NO: 83300 - RNA, 64 nt, Homo Sapiens; identical to SEQ ID NO: 58450

SEQ ID NO: 83301 - RNA, 64 nt, Homo Sapiens; identical to SEQ ID NO: 58451

SEQ ID NO: 83302 - RNA, 64 nt, Homo Sapiens; identical to SEQ ID NO: 58452

SEQ ID NO: 83303 - RNA, 64 nt, Homo Sapiens; identical to SEQ ID NO: 58453

SEQ ID NO: 83304 - RNA, 64 nt, Homo Sapiens; identical to SEQ ID NO: 58454

SEQ ID NO: 83305 - RNA, 64 nt, Homo Sapiens; identical to SEQ ID NO: 58455

SEQ ID NO: 83306 - RNA, 64 nt, Homo Sapiens; identical to SEQ ID NO: 58456

SEQ ID NO: 83307 - RNA, 64 nt, Homo Sapiens; identical to SEQ ID NO: 58457

SEQ ID NO: 83308 - RNA, 64 nt, Homo Sapiens; identical to SEQ ID NO: 58458

SEQ ID NO: 83309 - RNA, 64 nt, Homo Sapiens; identical to SEQ ID NO: 58459

SEQ ID NO: 83310 - RNA, 64 nt, Homo Sapiens; identical to SEQ ID NO: 58460

SEQ ID NO: 83311 - RNA, 64 nt, Homo Sapiens; identical to SEQ ID NO: 58461

SEQ ID NO: 83312 - RNA, 64 nt, Homo Sapiens; identical to SEQ ID NO: 58462

SEQ ID NO: 83313 - RNA, 64 nt, Homo Sapiens; identical to SEQ ID NO: 58463

SEQ ID NO: 83314 - RNA, 64 nt, Homo Sapiens; identical to SEQ ID NO: 58464

SEQ ID NO: 83315 - RNA, 64 nt, Homo Sapiens; identical to SEQ ID NO: 58465

SEQ ID NO: 83316 - RNA, 64 nt, Homo Sapiens; identical to SEQ ID NO: 58466

SEQ ID NO: 83317 - RNA, 64 nt, Homo Sapiens; identical to SEQ ID NO: 58467

SEQ ID NO: 83318 - RNA, 64 nt, Homo Sapiens
gacauuaacugcgugccuggcccuaugagggcggcggcgggacagggugagcggagagacagaa

SEQ ID NO: 83319 - RNA, 64 nt, Homo Sapiens
uuguaugaaaggggccacugugugucuuccuccccggcgggagccccacaugugugcacuguag

SEQ ID NO: 83320 - RNA, 52 nt, Homo Sapiens
ugcgggcgcgcggcccgacgcccggcgggaccgccucuggcggcccugguga

SEQ ID NO: 83321 - RNA, 64 nt, Homo Sapiens
cucauugccaugguacucaaguggguaggggaugcggcgggaucgugaggcccugucacagccu

SEQ ID NO: 83322 - RNA, 64 nt, Homo Sapiens
gaggacggugcggggccgcagggggcgcggggcgcggcgggacccaggcuacgagcgggaggga

SEQ ID NO: 83323 - RNA, 64 nt, Homo Sapiens
ccgcccugcgcuggacugguucaagcuuccgccucggcgggaacgcuguacauagucagguccg

SEQ ID NO: 83324 - RNA, 64 nt, Homo Sapiens
ggcccugcccucacuuuuaccaaagguucucccucggcgggagggcaucuguguuggaggugau

SEQ ID NO: 83325 - RNA, 64 nt, Homo Sapiens
cgugggagguguagcuccuaaacccccaccgcgucggcgggaagggagucaucaguaugagggg

SEQ ID NO: 83326 - RNA, 64 nt, Homo Sapiens
ugggggaacaaggggucuucccaacagggugcuucggcgggaggccagcaaggacacgcucucc

SEQ ID NO: 83327 - RNA, 54 nt, Homo Sapiens
gcgucuaccgagcccagugaggcgcggcgggagggcgcggggcggggagcgagc

SEQ ID NO: 83328 - RNA, 64 nt, Homo Sapiens
gagcuucggcugggccacgggaggcgcggagaggcggcgggaaaggguggggcuggacggggac

SEQ ID NO: 83329 - RNA, 64 nt, Homo Sapiens
agauggugaggcugucaguguauggggcagcuuccggcgggauguugaacuggucauuaaugug

SEQ ID NO: 83330 - RNA, 64 nt, Homo Sapiens
ggcgcaguggcugcaggcuggccgcggcucuuggcggcgggagaccggcguuucuguuaccccg

SEQ ID NO: 83331 - RNA, 64 nt, Homo Sapiens
ggccgcggugccgggccgggaggaggagggagagcggcgggagggcgggcgggcccggcugcca

SEQ ID NO: 83332 - RNA, 64 nt, Homo Sapiens
cgccacauccucacgcucgguggagggacgcgugcggcgggacggugccuacggguacuugcag

SEQ ID NO: 83333 - RNA, 64 nt, Homo Sapiens
cccauguccuccgcuccgcccagaccugugaccccggcgggacccagcaagcaggaucgcugcu

SEQ ID NO: 83334 - RNA, 64 nt, Homo Sapiens
cccacgguucggggcuucugcugccugucggacgcggcgggaggucggucaucuagccccaccc

SEQ ID NO: 83335 - RNA, 64 nt, Homo Sapiens
agagcuguguggccuggcaagcaagccugggagccggcgggaggucugccaggcugucccgugc

SEQ ID NO: 83336 - RNA, 64 nt, Homo Sapiens
gcgaggagauccuccugcagaggcguggcgcagccggcgggaccgaucaaccagguggcauugg

SEQ ID NO: 83337 - RNA, 64 nt, Homo Sapiens
gggugcugccucuuccuccaaggguccagcagcccggcgggaacugcugugcagucagaggccc

SEQ ID NO: 83338 - RNA, 64 nt, Homo Sapiens
gcuggcagacaaggugaagaggcugaugcggccccggcgggaggggggccccccuggggggcug

SEQ ID NO: 83339 - RNA, 64 nt, Homo Sapiens
ggcgagguggcuggacagcaccagcagcgcaucccggcgggaacccagaaaaggcuucuuacac

SEQ ID NO: 83340 - RNA, 64 nt, Homo Sapiens
gauacccucaccccuccacuaccaagccagcccccggcgggaucaagggcucagggcaccagca

SEQ ID NO: 83341 - RNA, 64 nt, Homo Sapiens
accagccccgacagcaccucauguaugugguggccggcgggaagacacccucuguaauuuuaag

SEQ ID NO: 83342 - RNA, 64 nt, Homo Sapiens
gagacggaggaagcggcagaaggcggacgcgugccggcgggaggagccacgcgugagcacaccu

SEQ ID NO: 83343 - RNA, 59 nt, Homo Sapiens
uccucaacaaccccagauaguggcggccccggcgggaggggcgggugggaggccgcggc

SEQ ID NO: 83344 - RNA, 64 nt, Homo Sapiens
ccagagcaagcucagcgaggaccucauggaguuccggcgggacgcauccauguuaaaugugagc

SEQ ID NO: 83345 - RNA, 64 nt, Homo Sapiens
auccauucuagagccagucucugccucccagacgcggcgggagccaagcuccuccaaccacaag

SEQ ID NO: 83346 - RNA, 64 nt, Homo Sapiens
ggccucccucccccacgacuggggccccuacggccggcgggaucgccgcaccgagugcacuuua

SEQ ID NO: 83347 - RNA, 64 nt, Homo Sapiens
aggagaccaugccgggcgcgagccucacuggccccggcgggaugggcgggggcaaagcccccag

SEQ ID NO: 83348 - RNA, 64 nt, Homo Sapiens
ccaggguuagacacaaggaccugaagugacaugacggcgggacaggggaaaugugacuuucuaa

SEQ ID NO: 83349 - RNA, 59 nt, Homo Sapiens
uggucacgaagaacuuguaaggccaacugcggcgggaggcccugaagaugcaguccccc

SEQ ID NO: 83350 - RNA, 64 nt, Homo Sapiens
cggcaacguagccugggcucacugugcuggggcacggcgggauccuccacagagaggaggggac

SEQ ID NO: 83351 - RNA, 64 nt, Homo Sapiens
gugaggaagggggaggcagccuggggcaaggugucggcgggacggaccuggccuugccaagggc

SEQ ID NO: 83352 - RNA, 64 nt, Homo Sapiens
aagggcucugagcccaggggaggcaggggccacacggcgggaggaggcgucuacauucgcugag

SEQ ID NO: 83353 - RNA, 64 nt, Homo Sapiens
acaugccugggucucacccugcugggcagcaggucggcgggaccagccccgggggauccgggcu

SEQ ID NO: 83354 - RNA, 64 nt, Homo Sapiens
caagucgcugagccauugaggaucgcgacgcagucggcgggacccucauggaagcaucgcccuc

SEQ ID NO: 83355 - RNA, 64 nt, Homo Sapiens
ccgccccugggcccgucugcgccggaggcugcggcggcgggagccacggaccagaccagccaca

SEQ ID NO: 83356 - RNA, 64 nt, Homo Sapiens
gaagcggcgaagcagccggagucgggagcgggcccggcgggagcgggagcgcaaggaggagcug

SEQ ID NO: 83357 - RNA, 64 nt, Homo Sapiens
gagccgcuacgaggccuuccugaguccggaguaccggcgggaggagguagggccauagugaccc

SEQ ID NO: 83358 - RNA, 64 nt, Homo Sapiens
cccagggaccaccccucaggacggcacuuacaaccggcgggaccugcuccugccgccuuccuuc

SEQ ID NO: 83359 - RNA, 64 nt, Homo Sapiens
ggagggagggagaguggaggcccacccuuaaaggcggcgggaggccuugggcugggggaggggg

SEQ ID NO: 83360 - RNA, 64 nt, Homo Sapiens
cccgcugcucggcggaucccagcugcgguggcgacggcgggaaggcgcuuuccgcuguuccuca

SEQ ID NO: 83361 - RNA, 64 nt, Homo Sapiens
gucaauggaggcagggguucgugggcuggguccccggcgggacuugcuucuccccugggcugcu

SEQ ID NO: 83362 - RNA, 64 nt, Homo Sapiens
gacccgaggccaccccagccugguguggacccaucggcgggagagagugccacgccuccacagc

SEQ ID NO: 83363 - RNA, 64 nt, Homo Sapiens
aaugauuuuauucauuuuuauguuuucuuuugggcggcgggauggagucucugucacccaggcu

SEQ ID NO: 83364 - RNA, 64 nt, Homo Sapiens
cuucuucauccaaaauugcauuggcaauuccccagacagguauaaugcuuuaaugauaacugcu

SEQ ID NO: 83365 - RNA, 64 nt, Homo Sapiens
agguaacagcaucgcuaaucuauauuuuggaaaagacagguaacagaguaagcaguacaaagug

SEQ ID NO: 83366 - RNA, 64 nt, Homo Sapiens
agauuuugauuuuguuucaaugucuacccacccucccuucuagcuuauaaacaaggcugguggc

SEQ ID NO: 83367 - RNA, 64 nt, Homo Sapiens
agauucuuauuuuguuugaacgucuacccacccucccuucuagcgccugugacggggcgggugg

SEQ ID NO: 83368 - RNA, 64 nt, Homo Sapiens
caguguccuagucccucccuuuuaguguaauuaccccuucuaaauuucagcgaaggucagugua

SEQ ID NO: 83369 - RNA, 64 nt, Homo Sapiens
uuucagcgaaggucaguguacuguagccaccugucccuucuauuaaagggguaagagcuggcuu

SEQ ID NO: 83370 - RNA, 64 nt, Homo Sapiens
uuccauugcuuuggccuucaguaaaaagcagccucccuucuaggucagggaaccaugccauuga

SEQ ID NO: 83371 - RNA, 64 nt, Homo Sapiens
guugcagcuaaaaaucagucucugaagucucucucccuucuagagguuaggacuuggugaacau

SEQ ID NO: 83372 - RNA, 64 nt, Homo Sapiens
aucucuagcaaccuccugggccccaugcccccaccccuucuagaaccugcauucccagggccuu

SEQ ID NO: 83373 - RNA, 64 nt, Homo Sapiens
ccaaaccauaaaugugauuauaguuaacacaugacccuucuagcgucccagccaguguuuuucc

SEQ ID NO: 83374 - RNA, 64 nt, Homo Sapiens
aagcaacugaacggaugcgugcgagcugaggacagggcgggaggagggggcacacaugccccag

SEQ ID NO: 83375 - RNA, 64 nt, Homo Sapiens
caaacaauaccugcucauuuacacugaggauucagggcgggagacaggagccuugggguccugu

SEQ ID NO: 83376 - RNA, 64 nt, Homo Sapiens
ggcauccuugucccccucacccacccagagcuaggggcgggaacagcccaccuuuugguuggca

SEQ ID NO: 83377 - RNA, 64 nt, Homo Sapiens
gggagguggaugguucuuauucuguggagaagaagggcgggaagaacuuccuuucaggaggaag

SEQ ID NO: 83378 - RNA, 64 nt, Homo Sapiens
ggccagggaucacccccgccccgagacccacgccgggcgggacccucucgggagccacagacgc

SEQ ID NO: 83379 - RNA, 64 nt, Homo Sapiens
gggacucucgggagccacagcgagaccccaccgagggcgggagggcugcgccgcguccgaacgu

SEQ ID NO: 83380 - RNA, 64 nt, Homo Sapiens
cucgccagaguccccagccguggccccgcugcugcgcccacacucaguugcccagcagagcucu

SEQ ID NO: 83381 - RNA, 64 nt, Homo Sapiens
cuucuagcaccuccugacagucacccuuggacagcgcccacaccgcuuccaggccacccaucug

SEQ ID NO: 83382 - RNA, 64 nt, Homo Sapiens
acaccaacgccgcauaggacugcccacaugggaccgcccacauaggaccgcccacauaggaccg

SEQ ID NO: 83383 - RNA, 64 nt, Homo Sapiens
uaggacugcccacaugggaccgcccacauaggaccgcccacauaggaccgcccacaugggaccg

SEQ ID NO: 83384 - RNA, 64 nt, Homo Sapiens
ugggaccgcccacauaggaccgcccacauaggaccgcccacaugggaccgcccacaugggaccg

SEQ ID NO: 83385 - RNA, 64 nt, Homo Sapiens
uaggaccgcccacauaggaccgcccacaugggaccgcccacaugggaccgcccacaugggaccg

SEQ ID NO: 83386 - RNA, 64 nt, Homo Sapiens
uaggaccgcccacaugggaccgcccacaugggaccgcccacaugggaccgcccacauagaaccg

SEQ ID NO: 83387 - RNA, 64 nt, Homo Sapiens
ugggaccgcccacaugggaccgcccacaugggaccgcccacauagaaccguccuccagugguga

SEQ ID NO: 83388 - RNA, 64 nt, Homo Sapiens
agcaugcccuucucaccccuguuugaguccagugcgcccacagcuuuguagcuucuaaugugag

SEQ ID NO: 83389 - RNA, 64 nt, Homo Sapiens
gagcuggcugcugugcccacgaccacguggacuccgcccacacauccccagggaagagaaugag

SEQ ID NO: 83390 - RNA, 64 nt, Homo Sapiens; identical to SEQ ID NO: 52852

SEQ ID NO: 83391 - RNA, 64 nt, Homo Sapiens; identical to SEQ ID NO: 52853

SEQ ID NO: 83392 - RNA, 64 nt, Homo Sapiens; identical to SEQ ID NO: 52854

SEQ ID NO: 83393 - RNA, 64 nt, Homo Sapiens; identical to SEQ ID NO: 52855

SEQ ID NO: 83394 - RNA, 64 nt, Homo Sapiens; identical to SEQ ID NO: 52856

SEQ ID NO: 83395 - RNA, 64 nt, Homo Sapiens; identical to SEQ ID NO: 52857

SEQ ID NO: 83396 - RNA, 64 nt, Homo Sapiens; identical to SEQ ID NO: 52858

SEQ ID NO: 83397 - RNA, 64 nt, Homo Sapiens; identical to SEQ ID NO: 52859

SEQ ID NO: 83398 - RNA, 60 nt, Homo Sapiens; identical to SEQ ID NO: 52860

SEQ ID NO: 83399 - RNA, 64 nt, Homo Sapiens; identical to SEQ ID NO: 52861

SEQ ID NO: 83400 - RNA, 64 nt, Homo Sapiens; identical to SEQ ID NO: 52862

SEQ ID NO: 83401 - RNA, 64 nt, Homo Sapiens; identical to SEQ ID NO: 52863

SEQ ID NO: 83402 - RNA, 62 nt, Homo Sapiens
ucuuugugaaaaauuaaaaauaaacuauuugccuucuggagcauuucagaguggggaaguga

SEQ ID NO: 83403 - RNA, 62 nt, Homo Sapiens
gacaaccgugacaucagcagcuaacgugggaucuucuggacagucuggauuucucuugggau

SEQ ID NO: 83404 - RNA, 62 nt, Homo Sapiens
acugauuccacaugcuauauagagaaagcugccuucuggagguauuauacacccccagaaag

SEQ ID NO: 83405 - RNA, 62 nt, Homo Sapiens
aggccugggcuaagaggagccucaguuccagccuucuggacaauaccuugccagaucccucu

SEQ ID NO: 83406 - RNA, 62 nt, Homo Sapiens
acccagcugggacuccaaaacucaaccaucaccuucuggaauaucacccuggaggaugaagg

SEQ ID NO: 83407 - RNA, 62 nt, Homo Sapiens
ugcucugccacugcccgcccagcccccauggucuucuggaaggucccucggucagggauuga

SEQ ID NO: 83408 - RNA, 62 nt, Homo Sapiens
auugccaaugcuacaguaauaaaugaaugucacuucuggauauagcuaggugacauauacau

SEQ ID NO: 83409 - RNA, 62 nt, Homo Sapiens
cccaucuuaaaaacaacgaaagaaggcauggacuucuggaugcccauccacuggguguaaac

SEQ ID NO: 83410 - RNA, 62 nt, Homo Sapiens
cuggaguuuuagugaaaggauuuauugagcagcuucuggaauauaaugugcauguccaaaau

SEQ ID NO: 83411 - RNA, 62 nt, Homo Sapiens
uggcagaugaauaauuuucacucauuuauugucuucuggaaaccauuuaacuuuuacuguuu

SEQ ID NO: 83412 - RNA, 62 nt, Homo Sapiens
gguggcagugggcuacucccuggguagcugggcuucuggaagucuacuuguucuccagcuuc

SEQ ID NO: 83413 - RNA, 62 nt, Homo Sapiens
uuugaaacacaaaacacaaguuuuuguuuuugcuucuggaacgagccgcuguacccgaacuu

SEQ ID NO: 83414 - RNA, 62 nt, Homo Sapiens
uuuauuuacucuuucuuuuuaggagagcaaagcuucuggaacguacaaacgcugcuuggaua

SEQ ID NO: 83415 - RNA, 62 nt, Homo Sapiens
gcugccagcucugccuugagcauggcugcugccuucuggacagggccaaccacguuuguuau

SEQ ID NO: 83416 - RNA, 62 nt, Homo Sapiens
gcgugguuuuuugcuaagagccagaggcaggucuucuggaguucucaggggggcccugugac

SEQ ID NO: 83417 - RNA, 62 nt, Homo Sapiens
cccguguuucucagacuuuaaagccaccagggcuucuggaacaccugucauagaagcaauaa

SEQ ID NO: 83418 - RNA, 62 nt, Homo Sapiens
gucuaaaaucaaagugucagcagaguugguuccuucuggaggcucuaaggaagaauccauaa

SEQ ID NO: 83419 - RNA, 62 nt, Homo Sapiens
uguggcugugugcaauucuuggaguucuuuggcuucuggacaaaucuuguccaaguauugca

SEQ ID NO: 83420 - RNA, 62 nt, Homo Sapiens
agccugcaggguccugggccauguggguggugcuucuggaugugagucucuuauuuaucugc

SEQ ID NO: 83421 - RNA, 62 nt, Homo Sapiens
cugggaaaccgggccagcguggggcucccugccuucuggacuccugaaggucguggauggau

SEQ ID NO: 83422 - RNA, 62 nt, Homo Sapiens
agacugaucauaaaccaaugcugguauugcaccuucuggaacuaugggcuugagaaaacccc

SEQ ID NO: 83423 - RNA, 62 nt, Homo Sapiens
aaauagaagcaggaaagggagacaaagacuggcuucuggacuuccucccugauccccacccu

SEQ ID NO: 83424 - RNA, 62 nt, Homo Sapiens
cuugguacccacauugccucgaggccugaguccuucuggacuuccaucucgacccuggggcu

SEQ ID NO: 83425 - RNA, 62 nt, Homo Sapiens
auauuuuucagacuccucaaccaagacuuuaucuucuggaaagaagcuggggcaucgaugac

SEQ ID NO: 83426 - RNA, 62 nt, Homo Sapiens
cauagagguugggcuggaggccuguccacuggcuucuggagcugaaggucugcgucacggug

SEQ ID NO: 83427 - RNA, 62 nt, Homo Sapiens
ucagaggcucugacacugucugguuuccaaugcuucuggagacuuccugccuaggccucauc

SEQ ID NO: 83428 - RNA, 62 nt, Homo Sapiens
ugcuaagccacccuccguuugacagggcuggacuucuggagcugauggcugccccuucccca

SEQ ID NO: 83429 - RNA, 62 nt, Homo Sapiens
gaggauucccccaacucccccagcccucaccucuucuggauaggaguucccuggagccuggc

SEQ ID NO: 83430 - RNA, 62 nt, Homo Sapiens
agaacuuuccagggauccagaaaaugguacagcuucuggagcuggggugagggaucacugcc

SEQ ID NO: 83431 - RNA, 62 nt, Homo Sapiens
agcuugugguguuccugaaggaggccuggcaucuucuggagagccagcaguacguggcuuca

SEQ ID NO: 83432 - RNA, 62 nt, Homo Sapiens
aaauaaacuguauuugcaaauccaacauugagcuucuggacuacgcugacuccacugcugaa

SEQ ID NO: 83433 - RNA, 62 nt, Homo Sapiens
uggcccacuccucacccccuugcuccccuggucuucuggaguuugugacauugauuugaaau

SEQ ID NO: 83434 - RNA, 62 nt, Homo Sapiens
acuguuagcucugcuaacagucaggacuauuccuucuggacucugugccuuugccugcacag

SEQ ID NO: 83435 - RNA, 62 nt, Homo Sapiens
ggcuuguuuguuguuuucaccagagugagcuccuucuggacauacugccuggcagccugccu

SEQ ID NO: 83436 - RNA, 62 nt, Homo Sapiens
cauuguccagagcugcuuccaauguaauguggcuucuggaauuuauguauuauacuuaguca

SEQ ID NO: 83437 - RNA, 62 nt, Homo Sapiens
gguuagaagugagggaguuuccguguuugucucuucuggaauaucaguagcuuaagaaaaaa

SEQ ID NO: 83438 - RNA, 64 nt, Homo Sapiens
ggauccaugauucugcuuugguccaauugcuuccucucugcagaggaacaacccuaaaaccaga

SEQ ID NO: 83439 - RNA, 64 nt, Homo Sapiens
cuggagaagguugcuucauuggcccugggacuucucucugcaggaggagagaacgcugccucuc

SEQ ID NO: 83440 - RNA, 64 nt, Homo Sapiens
uguccaccccauguguauauuuuagcuuugaguuucucugcaucucuuucauccuucaguugua

SEQ ID NO: 83441 - RNA, 64 nt, Homo Sapiens
uggagauucguggagaaccuaccucuuccugaagucucugcauuugccagggcgugcuccaggc

SEQ ID NO: 83442 - RNA, 64 nt, Homo Sapiens
ccaaccuggccaaggccccucuccugccuguuuuucucugcaucggaugcuauagauugacacc

SEQ ID NO: 83443 - RNA, 64 nt, Homo Sapiens
ccuaggggaaaacugcaggucucugcacuguuucucucugcagauccuugacuguggcauugca

SEQ ID NO: 83444 - RNA, 64 nt, Homo Sapiens
aggggaccuuugauugucuuuccagagaugcugcucucugcagggcaccaccuucaaggcacag

SEQ ID NO: 83445 - RNA, 64 nt, Homo Sapiens
aauagcaaaucuuacagaagguccugugugacccucucugcaucuguccccaggaccuaugcuc

SEQ ID NO: 83446 - RNA, 64 nt, Homo Sapiens
uuugaaugugaaagcuuauaguuaauguugggauucucugcacuuuuuuguggaaccauuguuu

SEQ ID NO: 83447 - RNA, 64 nt, Homo Sapiens
uguuacaauucaguuauuucagcacuugaaauaaucucugcauguuuucuaauagguauuuaga

SEQ ID NO: 83448 - RNA, 64 nt, Homo Sapiens
cucccagggguccugaggguuucagcaccaggguucucugcagccacacaaucagcccggcucg

SEQ ID NO: 83449 - RNA, 64 nt, Homo Sapiens
uccucacaacccgagauagguacuguuaccauccucucugcagacgaggaaaccgaggaccagg

SEQ ID NO: 83450 - RNA, 64 nt, Homo Sapiens
acuuugaggacauuuaugaugccggauucuuaauucucugcaacuauuaauuucuucccccaaa

SEQ ID NO: 83451 - RNA, 64 nt, Homo Sapiens
uuuucccaaguacccugagaucaaaagcaaaacaucucugcaguccccauccagcgagagaguu

SEQ ID NO: 83452 - RNA, 51 nt, Homo Sapiens
accuuaugucauuugaguaagucucugcaggacguggcaugacuucagagg

SEQ ID NO: 83453 - RNA, 64 nt, Homo Sapiens
aaaacaaacuccuaguccuuuagaaauaacagauucucugcacaaaaccacccauucauucauu

SEQ ID NO: 83454 - RNA, 64 nt, Homo Sapiens
ggcuuccuccugcgccugguugauucagcccaccucucugcaucccgcuucccgcgucucuucu

SEQ ID NO: 83455 - RNA, 64 nt, Homo Sapiens
gcccaccucucugcaucccgcuucccgcgucucuucucugcacuccugccgaccuucccaccug

SEQ ID NO: 83456 - RNA, 64 nt, Homo Sapiens
aggagaggaggccgcacucucccugucucucccgucucugcacccagcuccucucugcaugcug

SEQ ID NO: 83457 - RNA, 64 nt, Homo Sapiens
ucucccugucucucccgucucugcacccagcuccucucugcaugcugagggcuaaauugggauc

SEQ ID NO: 83458 - RNA, 64 nt, Homo Sapiens
cuccuccacuggcuucucugucagagcuagcugcucucugcagcagugagggguuuuuuuaacc

SEQ ID NO: 83459 - RNA, 64 nt, Homo Sapiens
agaauguccguccucuguugugggcuccucugccucucugcagcucaagagucaccccagcugc

SEQ ID NO: 83460 - RNA, 64 nt, Homo Sapiens
aacgccaauaaacauguugcaagacuuguguaagucucugcaucuaauuuuucucuuaaaaaag

SEQ ID NO: 83461 - RNA, 64 nt, Homo Sapiens
ugcuagcucagacaccaaagguauucagagggccucucugcagcgggauagcaaaauauacugu

SEQ ID NO: 83462 - RNA, 64 nt, Homo Sapiens
uggcuggagaaagggugugcucugcaccaaccacucucugcagagcagaagagcagaggucuuc

SEQ ID NO: 83463 - RNA, 64 nt, Homo Sapiens
aaccacucucugcagauggcaagagcagaggucuucucugcaccguccuugucaaggugggcag

SEQ ID NO: 83464 - RNA, 64 nt, Homo Sapiens
gcaaaggguguaagggacucuaacggacucugcuucucugcaguaagcugcacugcaaagggag

SEQ ID NO: 83465 - RNA, 64 nt, Homo Sapiens
uugcugaggcccaggaggggggaauggaagauuuucucugcagugagaggcaguuccuaccuug

SEQ ID NO: 83466 - RNA, 64 nt, Homo Sapiens
aggucuuuucuuggcguuccugccaggcucucccucucugcaccugucucauagccucgaauau

SEQ ID NO: 83467 - RNA, 64 nt, Homo Sapiens
ugcucauucauauuccugccuuucuuccaucagcucucugcaaagaugauuuugcuuuucccua

SEQ ID NO: 83468 - RNA, 64 nt, Homo Sapiens
uagcccaccccaagcuccgacauugagguuuucaucucugcagggagagguuccaauguccacc

SEQ ID NO: 83469 - RNA, 64 nt, Homo Sapiens
cacuccagcccaaaaccgugaggaaggugauauaucucugcauuuucccuuguuguugcuugaa

SEQ ID NO: 83470 - RNA, 64 nt, Homo Sapiens
cugcaacuuccuaagcugccccugccccagcuccucucugcaacccagcccucuccugagcucu

SEQ ID NO: 83471 - RNA, 64 nt, Homo Sapiens
ccucccaccgcggccccugccuggccaccuggccucucugcaccagggugacaagggguccucg

SEQ ID NO: 83472 - RNA, 64 nt, Homo Sapiens
uccccuagccgccaccccacguuucuguaccgggucucugcaguguuaaacggacguguaaaua

SEQ ID NO: 83473 - RNA, 64 nt, Homo Sapiens
ucgucccagccugggacaggcccccuuuccccucucucugcaggccaggagggccuccuuccug

SEQ ID NO: 83474 - RNA, 64 nt, Homo Sapiens
cuggucucccccucuucucugcccuccacccccgucucugcacugagauacauaagaaacaagg

SEQ ID NO: 83475 - RNA, 64 nt, Homo Sapiens
augaccaugggaccaccaagcucuaggucauccaucucugcauccaaauaguagggaaacgugg

SEQ ID NO: 83476 - RNA, 64 nt, Homo Sapiens
gauggcuuuugcugcucuguucucccucuacauuucucugcagaacucgcguuagaaacacaga

SEQ ID NO: 83477 - RNA, 64 nt, Homo Sapiens
ugugcacuugcugucugcggagccagugugccauucucugcacaugggcagccagccugagcug

SEQ ID NO: 83478 - RNA, 64 nt, Homo Sapiens
cacaaguccacaccuggccuuggcugcugcccgcucucugcagcguggauuuccuuugcccauu

SEQ ID NO: 83479 - RNA, 64 nt, Homo Sapiens
acuguauccacacgagccaaacagaguggaucuuucucugcaguaccaugcugcucaaaucuuc

SEQ ID NO: 83480 - RNA, 64 nt, Homo Sapiens
cacugaccaugcugcucaaacuaucaugccucauucucugcauuuaguuuggagauuacagguc

SEQ ID NO: 83481 - RNA, 64 nt, Homo Sapiens
ugccugagcgccgccucugugcccaggucccauuucucugcagcacuggccccuuggugcacac

SEQ ID NO: 83482 - RNA, 64 nt, Homo Sapiens
guggugggagggccucccuggcuugggagaccgcucucugcaagggagggggagagaagcagag

SEQ ID NO: 83483 - RNA, 64 nt, Homo Sapiens
ucccucagucuccagccugggcugccgagggcuaucucugcagaaugaguugugaucauuguca

SEQ ID NO: 83484 - RNA, 64 nt, Homo Sapiens
gugucugcauggguagcaggcugcaggaguggggucucugcacagccugggauggggcuugggg

SEQ ID NO: 83485 - RNA, 64 nt, Homo Sapiens
cccuuuucccuuauggcucugaggccaucggcugucucugcauuucauuggcuguggaggagag

SEQ ID NO: 83486 - RNA, 64 nt, Homo Sapiens
ucuuuacacuacuuuuucuuccccuuccucuugcucucugcacaccccauucuuaaacuccucc

SEQ ID NO: 83487 - RNA, 64 nt, Homo Sapiens
uuuauuagggugcuguuuguuauugagagcccaaucucugcaugaauaacagaaagguggacau

SEQ ID NO: 83488 - RNA, 64 nt, Homo Sapiens; identical to SEQ ID NO: 80183

SEQ ID NO: 83489 - RNA, 64 nt, Homo Sapiens; identical to SEQ ID NO: 80184

SEQ ID NO: 83490 - RNA, 64 nt, Homo Sapiens; identical to SEQ ID NO: 80185

SEQ ID NO: 83491 - RNA, 64 nt, Homo Sapiens; identical to SEQ ID NO: 80186

SEQ ID NO: 83492 - RNA, 64 nt, Homo Sapiens; identical to SEQ ID NO: 80187

SEQ ID NO: 83493 - RNA, 64 nt, Homo Sapiens; identical to SEQ ID NO: 80188

SEQ ID NO: 83494 - RNA, 64 nt, Homo Sapiens; identical to SEQ ID NO: 80189

SEQ ID NO: 83495 - RNA, 64 nt, Homo Sapiens; identical to SEQ ID NO: 80190

SEQ ID NO: 83496 - RNA, 64 nt, Homo Sapiens; identical to SEQ ID NO: 80191

SEQ ID NO: 83497 - RNA, 64 nt, Homo Sapiens; identical to SEQ ID NO: 80192

SEQ ID NO: 83498 - RNA, 64 nt, Homo Sapiens; identical to SEQ ID NO: 80193

SEQ ID NO: 83499 - RNA, 64 nt, Homo Sapiens; identical to SEQ ID NO: 80194

SEQ ID NO: 83500 - RNA, 64 nt, Homo Sapiens; identical to SEQ ID NO: 80195

SEQ ID NO: 83501 - RNA, 64 nt, Homo Sapiens; identical to SEQ ID NO: 80196

SEQ ID NO: 83502 - RNA, 64 nt, Homo Sapiens; identical to SEQ ID NO: 80197

SEQ ID NO: 83503 - RNA, 64 nt, Homo Sapiens; identical to SEQ ID NO: 80198

SEQ ID NO: 83504 - RNA, 64 nt, Homo Sapiens
cuuaaacaucuuucugugaauuacacauuuuaugugccagaagcaugacauugucacacagaaa

SEQ ID NO: 83505 - RNA, 64 nt, Homo Sapiens
aaaguuaccagaauuuauaaguuguggcuuuuaaugccagaagaauuaaaauauuagaauuugu

SEQ ID NO: 83506 - RNA, 64 nt, Homo Sapiens
aauuuuaagaggacucaccaucucagauugguaaugccagaaaaauauauugauaaaaagugac

SEQ ID NO: 83507 - RNA, 64 nt, Homo Sapiens
acuuccauaacuaacucaccauggaaauaagagaugccagaacucagaaguaauggauaacaga

SEQ ID NO: 83508 - RNA, 64 nt, Homo Sapiens
cuggaaacagaggaaccgguuuuagaugccagucugccagaaaucugcuucuaacaugaaggcc

SEQ ID NO: 83509 - RNA, 64 nt, Homo Sapiens
cagaguuugggcacacacugcccucccuccgagaugccagaaguuuuuccacagccuuggagag

SEQ ID NO: 83510 - RNA, 64 nt, Homo Sapiens
uucuagcugacuucugcacaagcuagugaggaccugccagaauuguugccugagcgugccaggc

SEQ ID NO: 83511 - RNA, 64 nt, Homo Sapiens
ccaugguguguguguccagaggugugugugaggcugccagaacaagugcugggucugucacaga

SEQ ID NO: 83512 - RNA, 64 nt, Homo Sapiens
uaagaugauaagaaagugcuccugagaaggcucuugccagaagccugaugugaguguguggcac

SEQ ID NO: 83513 - RNA, 64 nt, Homo Sapiens
gucccacuagggaauuugguugaacaaguagggcugccagaaauaccugacccccguaagcugc

SEQ ID NO: 83514 - RNA, 64 nt, Homo Sapiens
auugcuguuuucccuccauaucaaguuaaguaggugccagaaccguugggugaauuuaauggaa

SEQ ID NO: 83515 - RNA, 64 nt, Homo Sapiens
ucgaacaagugcaauuaacaucucuccuggcuucugccagaaaaagagaagcacgcuguccccg

SEQ ID NO: 83516 - RNA, 64 nt, Homo Sapiens
ggccuuucccagaugcugcagaaucuuccaguucugccagaauugacgccucuccccuggucug

SEQ ID NO: 83517 - RNA, 64 nt, Homo Sapiens
cuguggguuucuuucuagcuagggagguggccauugccagaagccccaccaucucccggacccc

SEQ ID NO: 83518 - RNA, 64 nt, Homo Sapiens
ggguuuucgggacuugcccccaggguccccucugugccagaaauuuagccauggguccuuucug

SEQ ID NO: 83519 - RNA, 64 nt, Homo Sapiens
uggaaaguagcuuacccuagaaaacagcugcaaaugccagaaagaugaucccuaaaaauguuga

SEQ ID NO: 83520 - RNA, 64 nt, Homo Sapiens
cugagaguguguacaaguuuuaguauacaugccaugccagaagauaguguaugcaagaagucuu

SEQ ID NO: 83521 - RNA, 64 nt, Homo Sapiens
aacacagaccugcugaaucagcuucuuucugagcugccagaaguacagaaguuggagccuccac

SEQ ID NO: 83522 - RNA, 64 nt, Homo Sapiens
ucaugagucucagguccagguggagucuguagguugccagaacucaaaagucugaaaaacaucc

SEQ ID NO: 83523 - RNA, 64 nt, Homo Sapiens; identical to SEQ ID NO: 21333

SEQ ID NO: 83524 - RNA, 64 nt, Homo Sapiens; identical to SEQ ID NO: 21334

SEQ ID NO: 83525 - RNA, 64 nt, Homo Sapiens
uggggaggcuugggaaauuauugcuuaggcucgcaaacaagaagaucaaugaaacucuugaguc

SEQ ID NO: 83526 - RNA, 64 nt, Homo Sapiens
cacaaaaacuugaaaaaucuucuaguuggcauaaaaacaagaacaguaaaccccaccauuaccu

SEQ ID NO: 83527 - RNA, 64 nt, Homo Sapiens
ccuaugaaaaauuucuucuuuggccugugcuacuaaacaagaagaagacgacgacaaaggccuu

SEQ ID NO: 83528 - RNA, 64 nt, Homo Sapiens
gcuuggucagcuacaaucuuuguugauguacgcaaaacaagacagaauauuggaagcagcauag

SEQ ID NO: 83529 - RNA, 64 nt, Homo Sapiens
guuacucaaaaacauugacucugcaucaagaaagaaacaagaaagcaauaaaacaagaaauaau

SEQ ID NO: 83530 - RNA, 64 nt, Homo Sapiens
gacucugcaucaagaaagaaacaagaaagcaauaaaacaagaaauaauucaugcucacauuuuu

SEQ ID NO: 83531 - RNA, 64 nt, Homo Sapiens
uuguagaauauugcaaaaauaccuacugugugccaaacaagauuugcaacaugcauucuugauu

SEQ ID NO: 83532 - RNA, 64 nt, Homo Sapiens
gcuacaagcucuaaaugguagccaagucauggugaaacaagaaacugcuuugccuuuucucugg

SEQ ID NO: 83533 - RNA, 64 nt, Homo Sapiens
acgacgacaaccacaaaaaaaaaaaaaaaaaaaaaaacaagaugauuuguuaaaaaaaaacaaa

SEQ ID NO: 83534 - RNA, 64 nt, Homo Sapiens
agaugugauuuguuaaaaaacugugucugcagaaaaacaagacccucguucccuccccuggugc

SEQ ID NO: 83535 - RNA, 64 nt, Homo Sapiens
uuaggccugaaccaaaaaacaacaaacaaacaaaaaacaagaaugaaaaacagaaauaaaagaa

SEQ ID NO: 83536 - RNA, 64 nt, Homo Sapiens
aucuggaacauuacuuauuugaggucagagaacaaaacaagaaccuggccagguguugauuacc

SEQ ID NO: 83537 - RNA, 64 nt, Homo Sapiens
aguuuggugcuuuaaauuaagucuguuuacuaugaaacaagagucauuuuuagaggauuuuaac

SEQ ID NO: 83538 - RNA, 64 nt, Homo Sapiens
acuaucaucacaugccuccccaaccccaagucaaaaacaagaggaaugguacuacaaacauggc

SEQ ID NO: 83539 - RNA, 64 nt, Homo Sapiens
cuauaaauaccauuuugagugagaaaguacuuuuaaacaagaaagaaauuguacauuaugacua

SEQ ID NO: 83540 - RNA, 64 nt, Homo Sapiens
ugaagagauauuuguauuuuucaaauguuaaguaaaacaagaugugccaauaucauagguaaau

SEQ ID NO: 83541 - RNA, 64 nt, Homo Sapiens
gaaauggcuuuucuuacccaaaaaauacacaugaaaacaagaaagccuuauucaccuuuuuaau

SEQ ID NO: 83542 - RNA, 64 nt, Homo Sapiens
aguaaacaggaaaccuacuucccucccuucugggaaacaagaagcuccuguccucccccgcacc

SEQ ID NO: 83543 - RNA, 64 nt, Homo Sapiens
gagcuucuucccuaagccauaaacugucucaccuaaacaagauagaccucaauaaaagacauaa

SEQ ID NO: 83544 - RNA, 64 nt, Homo Sapiens
aacaugaaaaugcuggugagcugagguagaaaaaaaacaagaaaaaaauuuuaaaaauagcguu

SEQ ID NO: 83545 - RNA, 64 nt, Homo Sapiens
uccauucccacaaauuuuaguaucaaagagaaagaaacaagauuuccuuacacauuugucauac

SEQ ID NO: 83546 - RNA, 64 nt, Homo Sapiens
aguggacuuuguuguuauuuuaucuauuauagcaaaacaagaaauauuuuuuauuaccagagca

SEQ ID NO: 83547 - RNA, 64 nt, Homo Sapiens
aaaaauacccuuuucuuuuccugggcauuuuacaaaacaagaaauuuguaauaaucgagaaugc

SEQ ID NO: 83548 - RNA, 64 nt, Homo Sapiens
aguacauucuuuagaaacuauuuuuaaaaaaguaaaacaagaaauuuuuuugaaaugaaaagac

SEQ ID NO: 83549 - RNA, 64 nt, Homo Sapiens
uugcagcauauucuucucuuauuaaauggcuucuaaacaagaaaaagcuuuuguuugcauuuaa

SEQ ID NO: 83550 - RNA, 64 nt, Homo Sapiens
acacuauuuuuguagcaugaauguacauuuaguuaaacaagauaucauggaauuggaaaaaaag

SEQ ID NO: 83551 - RNA, 64 nt, Homo Sapiens
cugauaaugguuugugugagagagagauggugugaaacaagauucuuuucauaacugccugaaa

SEQ ID NO: 83552 - RNA, 64 nt, Homo Sapiens
gugcagugucaguuucaaaucaaauuaucuaagaaaacaagaaaacaaaggcagcagacuauug

SEQ ID NO: 83553 - RNA, 64 nt, Homo Sapiens
aacaaguuagaauaggaaauaguaaaauaaauccaaacaagaguguaauauugguuagggaaac

SEQ ID NO: 83554 - RNA, 64 nt, Homo Sapiens
cucuccauugcaguuuguagaacuaagccauuugaaacaagauuuacauuuagacaaaacccca

SEQ ID NO: 83555 - RNA, 64 nt, Homo Sapiens
ucuucuguccgccuuacauaaauauucaguuccaaaacaagauacuuguagggaugagguuagg

SEQ ID NO: 83556 - RNA, 64 nt, Homo Sapiens
gccucccucucuuccgggagccuucccacgacaaaaacaagacuucuuuuucuccacccaaacc

SEQ ID NO: 83557 - RNA, 64 nt, Homo Sapiens
ccaagugggcugguauucucacgccaauaauaaaaaacaagaaagccacguauaguccuagcug

SEQ ID NO: 83558 - RNA, 64 nt, Homo Sapiens
auuuuuaugaaagaaaaggaaaaaguuuauuaccaaacaagaguauuucucuuacuguagaaga

SEQ ID NO: 83559 - RNA, 64 nt, Homo Sapiens
auaaaaagcacuguugaggcuaagccauuuuauaaaacaagaaguaauacaugccucucucagg

SEQ ID NO: 83560 - RNA, 64 nt, Homo Sapiens
guuacaaagauuuuuuaaaauccauuuuauuccuaaacaagauaugcgucagacaaaccugccu

SEQ ID NO: 83561 - RNA, 64 nt, Homo Sapiens
aaacaucaaauuugcgaugauucugcuaaaacugaaacaagaagcucaaucaaggcaauguaaa

SEQ ID NO: 83562 - RNA, 64 nt, Homo Sapiens
auaccaucauccuaauaacagaagaucuugcaaagaaucacagagcuuaaugggucaagaaguu

SEQ ID NO: 83563 - RNA, 64 nt, Homo Sapiens
aaguuaguaguauugaguggauacaaugaauggggaaucacauguguagagccccaacuuagau

SEQ ID NO: 83564 - RNA, 64 nt, Homo Sapiens
cauacccuacccucaccugaccuguccccuucccgaaucacacaagcuaucaccgggaacccuc

SEQ ID NO: 83565 - RNA, 64 nt, Homo Sapiens
cccgaagguccugccuucacgccugaggggauuugaaucacagcuuggccucccaggacaucug

SEQ ID NO: 83566 - RNA, 64 nt, Homo Sapiens
uacaugucgcuccggucagaaccagguaacacgggaaucacaggcagacaccaagguuuaugcc

SEQ ID NO: 83567 - RNA, 64 nt, Homo Sapiens
uuaaagcuaaaaaugaaccuuuggauuaaaacgggaaucacaucgagcuauuuaaugacacacc

SEQ ID NO: 83568 - RNA, 64 nt, Homo Sapiens
cagauaaaucaugcccguuccccucugccuggcagaaucacagucucacauacugucuuguacu

SEQ ID NO: 83569 - RNA, 64 nt, Homo Sapiens
aaauaccaaauaaugaauugguauaccauauccggaaucacacauguuaucuuaaacccagcca

SEQ ID NO: 83570 - RNA, 64 nt, Homo Sapiens
gaagaucugcgagguugucuccaaggugaaggaugaaucacagaggaugcuaaaggagauaaag

SEQ ID NO: 83571 - RNA, 64 nt, Homo Sapiens
auuugaugacaauauccuuagacaaucgauauuugaaucacaauugauaugguacagucauuuu

SEQ ID NO: 83572 - RNA, 64 nt, Homo Sapiens
gacaguuucugacaggcgcaccauauucuuccccgaaucacacauggaaugcuacuaagauacu

SEQ ID NO: 83573 - RNA, 64 nt, Homo Sapiens
cuguuuaucaagccauaauguggaaucagaauuggaaucacauugaucugggagagucucacuu

SEQ ID NO: 83574 - RNA, 64 nt, Homo Sapiens
ccaagccaugcuggugggccuggucugaauucuggaaucacaaaaacugugugagauugugaag

SEQ ID NO: 83575 - RNA, 64 nt, Homo Sapiens
gcacagaaacacuaugaaugcaaaaacaugagaggaaucacacuucaguuaccacuguacugcu

SEQ ID NO: 83576 - RNA, 64 nt, Homo Sapiens
guacagaaacgcuaugaaugcgagcacaugaaaggaaucacacuucauuuaccgccauucugcu

SEQ ID NO: 83577 - RNA, 64 nt, Homo Sapiens
ccccugggacagcuguuaccuuugcaguguugccgaaucacagcaguuaccuuugcaguguugc

SEQ ID NO: 83578 - RNA, 64 nt, Homo Sapiens
gccgaaucacagcaguuaccuuugcaguguugccgaaucacagcaguucuguuggagaaacgcu

SEQ ID NO: 83579 - RNA, 65 nt, Homo Sapiens
auccuugucaaaaugagauuccagguccugagagcugcuuugaggcaguuccaggaguacuuacu

SEQ ID NO: 83580 - RNA, 65 nt, Homo Sapiens
caaugauggcaccuacuuuugggaaucuguagcugugcuuugagaauugccaucggucauguguu

SEQ ID NO: 83581 - RNA, 65 nt, Homo Sapiens
ugaauaagcuuuguuacaaaugcuuuucucaguugugcuuugaagguuugggcuuugucuggauu

SEQ ID NO: 83582 - RNA, 65 nt, Homo Sapiens
cugauauguguguuucagagacuggaaggcugauuugcuuugaggcugaaccagucuuaccugag

SEQ ID NO: 83583 - RNA, 65 nt, Homo Sapiens
ucugcaggucgucagcuuguucuggaaacucuuuaugcuuugacaucgaguacaaaaauaaucaa

SEQ ID NO: 83584 - RNA, 65 nt, Homo Sapiens
aguacaaaaauaaucaaagaagcaauggcaaagggugcuuugaucuauuuacuggauauguucug

SEQ ID NO: 83585 - RNA, 65 nt, Homo Sapiens
cuuuccgauugcucauuaaucuguggaguacaaaaugcuuugagucguuugugugaagaaaugaa

SEQ ID NO: 83586 - RNA, 56 nt, Homo Sapiens
aggaagccauuauggauggacuaaggugcuuugaaguggaggugcgaguuuuauag

SEQ ID NO: 83587 - RNA, 65 nt, Homo Sapiens
uugcuuucucaacauuauuguuuuucauugaucuaugcuuugaguauuuauguccauuucucaau

SEQ ID NO: 83588 - RNA, 65 nt, Homo Sapiens
cuacaucaaacggaauggaacuacagcacuaaauaugcuuugaugaaauccaucagaaucucaga

SEQ ID NO: 83589 - RNA, 65 nt, Homo Sapiens
ccaaauuagaaacacauuccaagugggaaccagugugcuuugaaacaaugucaugaaagugguaa

SEQ ID NO: 83590 - RNA, 65 nt, Homo Sapiens
ggguccauggcgaguguaucggcgagaaggaggagugcuuugagcaucucuacaauacccggcgg

SEQ ID NO: 83591 - RNA, 65 nt, Homo Sapiens
uuuaguuugccugcaguuuccuaggcauuucauuaugcuuugaacaguuuaacaaaugacuguau

SEQ ID NO: 83592 - RNA, 65 nt, Homo Sapiens
cauagcuacaauuuguuuuuccuccuuaauuuaauugcuuugaagagggcccaaagaauuggaau

SEQ ID NO: 83593 - RNA, 65 nt, Homo Sapiens
uggcagggucccuguucugaucaggggaccgguccugcuuugagagccugcuuggcagugggaca

SEQ ID NO: 83594 - RNA, 65 nt, Homo Sapiens
uuuugugccugcuuuuugcugccccugacguuaugugcuuugaggguuugccucugaaauucaug

SEQ ID NO: 83595 - RNA, 65 nt, Homo Sapiens
guaaguucccacacugcuggaccuguggcaaagagugcuuugaauaagucagcuagggauucuug

SEQ ID NO: 83596 - RNA, 65 nt, Homo Sapiens
gguuuuggaaggagaggucuuuaauagcuuugaaaugcuuugagaucauuggucaaauugcauuu

SEQ ID NO: 83597 - RNA, 65 nt, Homo Sapiens
gcaaaugaaaaaaauguuaacauuugguagacaugugcuuugacauagcgugagcagcacauuac

SEQ ID NO: 83598 - RNA, 65 nt, Homo Sapiens
uucuaaaaguuaugguuagaugcuauucuguggguugcuuugauaauucuuacuaacacagauua

SEQ ID NO: 83599 - RNA, 65 nt, Homo Sapiens
aacaagaucuaugccuuaguguuguuuuuguugucugcuuugauguaaaagcaagaguauuugga

SEQ ID NO: 83600 - RNA, 65 nt, Homo Sapiens
ugaaaauauauauuuaucuuuaacuguguuauuucugcuuugagagaugcuagcugcuuggacau

SEQ ID NO: 83601 - RNA, 65 nt, Homo Sapiens
agcugcauuaagguguucagaagauauaacccaggugcuuugagauaaauaugaguaauuucucu

SEQ ID NO: 83602 - RNA, 65 nt, Homo Sapiens
aaacauuucuuaaaacagugccuccauugaguacgugcuuugagauuuauaucuaacuuuccuuc

SEQ ID NO: 83603 - RNA, 65 nt, Homo Sapiens
uuugaaguugggguaguagucuuguagaguuguacugcuuugauuaaaacuugaaaaguuuauug

SEQ ID NO: 83604 - RNA, 65 nt, Homo Sapiens
uccucauagacuuauauuuuauaaucagaauauguugcuuugaaaaagccucuaauggacugacc

SEQ ID NO: 83605 - RNA, 65 nt, Homo Sapiens
gaaauguuaaugguuaauguucccaaaccagagaaugcuuugaaaauguaucauucaguguaaau

SEQ ID NO: 83606 - RNA, 65 nt, Homo Sapiens
uuuggaauuacaggugugagccaccaugccuggccugcuuugacauauuuuauaguguguuaauu

SEQ ID NO: 83607 - RNA, 65 nt, Homo Sapiens
uuuagaugggaauugcagaagcugcaucaaaaguaugcuuugagguauauauagugaaacagagc

SEQ ID NO: 83608 - RNA, 65 nt, Homo Sapiens
cugcuucguuccaccccgggccccuugucagggcuugcuuugaccaggcuaagggggacagccuu

SEQ ID NO: 83609 - RNA, 65 nt, Homo Sapiens
ggcgggguccgcauguacguucauuuccauaaacgugcuuugagacgcgggccaccccacccugu

SEQ ID NO: 83610 - RNA, 65 nt, Homo Sapiens
gugagagcaaaaugcauguaaucaacauggcuacuugcuuugaggcucaccagaauuauuuuuaa

SEQ ID NO: 83611 - RNA, 65 nt, Homo Sapiens
ggucacuuuucacauccuugacuuuuuagaugugcugcuuugauauauaggacauugauuugauu

SEQ ID NO: 83612 - RNA, 64 nt, Homo Sapiens
gguuaacuaauauauccaugugcagauagaauuuggcccagagauggauaccaauauucuauuu

SEQ ID NO: 83613 - RNA, 64 nt, Homo Sapiens
agaggagacagacacacacucuaagcaaucacugggcccagagguugccugucaccccagucac

SEQ ID NO: 83614 - RNA, 64 nt, Homo Sapiens
cacaaugggguccuucuguaccuuaucagccuguggcccagagaagccaaucauguuaacucuu

SEQ ID NO: 83615 - RNA, 64 nt, Homo Sapiens
gucccccuugaccccagggcacggaugggaccugggcccagacacuaguaccaacacagggaaa

SEQ ID NO: 83616 - RNA, 64 nt, Homo Sapiens
aagucagggucaacucccaggccucagaugcaggggcccagaacaccugcucucaccugagccc

SEQ ID NO: 83617 - RNA, 64 nt, Homo Sapiens
gaacaccugcucucaccugaaccccaggugaaggggcccagaacaccugcucucaccugagccc

SEQ ID NO: 83618 - RNA, 64 nt, Homo Sapiens
cucuuggacuuuuggaugccuggccuuaggcuguggcccagaagcuggaaguuugggaaaggcc

SEQ ID NO: 83619 - RNA, 64 nt, Homo Sapiens
agagggggugaugaccccuccccaagccccucagggcccagaccuuccugcucuccagcagggg

SEQ ID NO: 83620 - RNA, 64 nt, Homo Sapiens
ggcagggcccagcccugcuuccuggaguggauguggcccagagaaggaggcugggggaucacca

SEQ ID NO: 83621 - RNA, 64 nt, Homo Sapiens
caaaacuuggcagcugugccagaaaccaaagccaggcccagauguagggggagggcacgagagc

SEQ ID NO: 83622 - RNA, 64 nt, Homo Sapiens
cucgcacuugcugugugcgagagcccugcgucagggcccagagccgccgauuccgggagcuugg

SEQ ID NO: 83623 - RNA, 64 nt, Homo Sapiens
cacggucccucaggucaggagucuagaaacaccaggcccagacaaagugacuguaggggggacc

SEQ ID NO: 83624 - RNA, 64 nt, Homo Sapiens
gaaagcaggagccccucuggugcuccuagaggguggcccagaggagcugugccagggcguggag

SEQ ID NO: 83625 - RNA, 64 nt, Homo Sapiens
ccagggggccgcaggggucucuccacccugcaggggcccagacugccugcaggucaggcacagg

SEQ ID NO: 83626 - RNA, 64 nt, Homo Sapiens
ucaggacacuuggcuuuggggggaaggaaacugaggcccagagaggggcaaccacuggccaagg

SEQ ID NO: 83627 - RNA, 64 nt, Homo Sapiens
uggcuaagagccuggccuccagccccagcaguguggcccagagcaggggccgacugccaaagua

SEQ ID NO: 83628 - RNA, 64 nt, Homo Sapiens
cuugcaagcaacaucugcucuguuccucagguggggcccagagcccuuccccgagacugcugau

SEQ ID NO: 83629 - RNA, 64 nt, Homo Sapiens
aaugaggaugaagucacuauccuagaggcugcuuggcccagaagagccaggcacagagcugcag

SEQ ID NO: 83630 - RNA, 64 nt, Homo Sapiens
gcugcccuuuggguaggugcugggcuccugggagggcccagaugauggggugaggcaugucuuu

SEQ ID NO: 83631 - RNA, 64 nt, Homo Sapiens
ggcccugcuucucugcuccccugggugaugggugggcccagaagguggcagucccacaccuugu

SEQ ID NO: 83632 - RNA, 64 nt, Homo Sapiens
gcccgcauaguuccucaccagcuggagcugcugaggcccagaaggccugccaggccaggagugg

SEQ ID NO: 83633 - RNA, 60 nt, Homo Sapiens
cagaugggugggugggugggcuucacugggggcccagaggggggcuccugccucuucuga

SEQ ID NO: 83634 - RNA, 64 nt, Homo Sapiens
accucaaccauggcaagaaccagagguccaaagaggcccagacccagguccuugugcucagucc

SEQ ID NO: 83635 - RNA, 64 nt, Homo Sapiens
acccagguccuugugcucaguccugcgcaaaccaggcccagacccugcaagcauuuguugaugc

SEQ ID NO: 83636 - RNA, 64 nt, Homo Sapiens
aguggacgacccagccuccccauaccgggccucuggcccagaccuaagcccugcccacaaagac

SEQ ID NO: 83637 - RNA, 64 nt, Homo Sapiens
ccugaaggcucuaagccuggaacacccugggguuggcccagaaggaggcacaucagucccaaaa

SEQ ID NO: 83638 - RNA, 64 nt, Homo Sapiens
caacagaugauauugagugucggguggggaaggaggcccagacucugcuucggccaugauuugu

SEQ ID NO: 83639 - RNA, 64 nt, Homo Sapiens
acuguucacucugugucuuuugaagugccuugaaggcccagaugaaauuuuaaagggagggggu

SEQ ID NO: 83640 - RNA, 64 nt, Homo Sapiens
gagccagaggcagcagccucuacccgguggccuuggcccagaagugcacugccagcgccugucu

SEQ ID NO: 83641 - RNA, 64 nt, Homo Sapiens
uggacuggagagugaggaggaaccaguagcuacaggcccagagauuaggagcgccuggaagcag

SEQ ID NO: 83642 - RNA, 64 nt, Homo Sapiens
uggcagggccguccaucagcgcugaccuuccgggggcccagagcuucccagcccugagucaagc

SEQ ID NO: 83643 - RNA, 64 nt, Homo Sapiens
gcgggccugccccaacccccagcauucccgggugggcccagaccccaucaccaagacuggccac

SEQ ID NO: 83644 - RNA, 64 nt, Homo Sapiens
cggcgccuggguggcuugccgcccacacuucaggggcccagacuuacacccugacugucccacc

SEQ ID NO: 83645 - RNA, 64 nt, Homo Sapiens
cucacccagagguuucacccuccuucaucucacgggcccagagcccugucucacucaccccacc

SEQ ID NO: 83646 - RNA, 64 nt, Homo Sapiens
ggagcgagaagccaaggccagguucuggguguagggcccagagaagcagaacagcccagagccc

SEQ ID NO: 83647 - RNA, 64 nt, Homo Sapiens
cagccugaccaacgaugagccugucugucccuuuggcccagacccguggagacaguauuucuuu

SEQ ID NO: 83648 - RNA, 64 nt, Homo Sapiens
agccaguacagacuccagacaaggagaggccuugggcccagaugucccccacuggauucccuac

SEQ ID NO: 83649 - RNA, 64 nt, Homo Sapiens
cccauccucagugcccaaugcuguggccccaccaggcccagagccugguuggccauucucaugc

SEQ ID NO: 83650 - RNA, 64 nt, Homo Sapiens
gacccgggccaggaggcccggggcgcugagcucaggcccagaacuggcugauuucagggauacc

SEQ ID NO: 83651 - RNA, 54 nt, Homo Sapiens
uccaaaaggauguucuauaaaaauggcccagaguauuuucaacaaagcgugcuu

SEQ ID NO: 83652 - RNA, 64 nt, Homo Sapiens
auggcugcaggguggaccagcugccuggcauucaggcccagaugccugcagggcuggggcucuc

SEQ ID NO: 83653 - RNA, 64 nt, Homo Sapiens
agguguauucccguuuuacagauaaggaaacugaggcccagagagcugaaguacugcacccagc

SEQ ID NO: 83654 - RNA, 64 nt, Homo Sapiens
gaauuaaacuaaaauacaaguaaagcuagacaaaggcccagaaaucauacuguaaggaaauguu

SEQ ID NO: 83655 - RNA, 64 nt, Homo Sapiens
uugccaaggcucugaccucacagaagaugcccagggcccagaagccaucagaauuaucagugga

SEQ ID NO: 83656 - RNA, 64 nt, Homo Sapiens
auccuggaaagguggcagagccuccacugagccaggcccagagcuccuugcagugccuucuucc

SEQ ID NO: 83657 - RNA, 64 nt, Homo Sapiens
uaaaauggugauaaaaaccgacagguuguucaaaggcccagaucagcuaaagcauguauauaag

SEQ ID NO: 83658 - RNA, 59 nt, Homo Sapiens
agcccggggagaaccucuaggcacaggcgggcccagaccggcuucucggcuuggauccu

SEQ ID NO: 83659 - RNA, 64 nt, Homo Sapiens
gcucugggccgggccuggggcuccgaaauuccaaggcccagacuugcgggggguggggggguau

SEQ ID NO: 83660 - RNA, 64 nt, Homo Sapiens
gcccaaaaaggacaaaaaugggcuggccuggaauggcccagaccccagccuccccuccucccuc

SEQ ID NO: 83661 - RNA, 64 nt, Homo Sapiens
ugcuuguggcugugcaggcugaggucuggagccaggcccagagcuggcuucaggguggggccuu

SEQ ID NO: 83662 - RNA, 64 nt, Homo Sapiens
caggaagugacucacacaaggguugggaaacugaggcccagaaaaagcuguagcccaucugaga

SEQ ID NO: 83663 - RNA, 64 nt, Homo Sapiens
cccccacuugaagaggagcuagccagcucccaggggcccagagcgcagcuuugcaaggauccgg

SEQ ID NO: 83664 - RNA, 64 nt, Homo Sapiens
ggucugaggagacagcugaccuguuggcugaaaaggcccagaucaccgaggaggaggcaaaacu

SEQ ID NO: 83665 - RNA, 64 nt, Homo Sapiens
aggcccagaucaccgaggaggaggcaaaacuucuggcccagaaggccgcagaggcugagcagga

SEQ ID NO: 83666 - RNA, 64 nt, Homo Sapiens
aagcccuguggcuccacaggugcugcuucucacuggcccagacucugagcuccaccggcccagu

SEQ ID NO: 83667 - RNA, 64 nt, Homo Sapiens
cuggccagaguucaggaacggggaccccagacugggcccagagggucaaagccagaacugagag

SEQ ID NO: 83668 - RNA, 64 nt, Homo Sapiens
guggcgguccccaugguggccuugaaguggagugggcccagagugagcccaaggggccacugcc

SEQ ID NO: 83669 - RNA, 64 nt, Homo Sapiens; identical to SEQ ID NO: 58132

SEQ ID NO: 83670 - RNA, 64 nt, Homo Sapiens; identical to SEQ ID NO: 58133

SEQ ID NO: 83671 - RNA, 64 nt, Homo Sapiens; identical to SEQ ID NO: 58134

SEQ ID NO: 83672 - RNA, 64 nt, Homo Sapiens; identical to SEQ ID NO: 58135

SEQ ID NO: 83673 - RNA, 64 nt, Homo Sapiens; identical to SEQ ID NO: 58136

SEQ ID NO: 83674 - RNA, 64 nt, Homo Sapiens; identical to SEQ ID NO: 58137

SEQ ID NO: 83675 - RNA, 64 nt, Homo Sapiens; identical to SEQ ID NO: 58138

SEQ ID NO: 83676 - RNA, 64 nt, Homo Sapiens; identical to SEQ ID NO: 58139

SEQ ID NO: 83677 - RNA, 64 nt, Homo Sapiens; identical to SEQ ID NO: 58140

SEQ ID NO: 83678 - RNA, 64 nt, Homo Sapiens
ugucuuuuacuaggacuguaaacuuuugugauaaaauucaaauaagauuuuauuucuugguaau

SEQ ID NO: 83679 - RNA, 64 nt, Homo Sapiens
ccaauuucuugcauuaauuugaauuuaagcauuuaauucaaagagaggggagcauccauuauug

SEQ ID NO: 83680 - RNA, 64 nt, Homo Sapiens
aaauucauuuaaacaguugagcuguauaauuguuaauucaaauggaauguaggaccucugagug

SEQ ID NO: 83681 - RNA, 64 nt, Homo Sapiens
aacccaucaacuggaugccaccuccaaaccauuuaauucaaaugaauuuaaaaaaucacguuag

SEQ ID NO: 83682 - RNA, 64 nt, Homo Sapiens
ggccaacuguauuuaggauaauuucaucacuuuuaauucaaaccagaauaugugaauaagcaga

SEQ ID NO: 83683 - RNA, 64 nt, Homo Sapiens
aauaaaauauaaaaaugaaaaugaagauacgugaaauucaaaugucacaacuugccuauuauuu

SEQ ID NO: 83684 - RNA, 64 nt, Homo Sapiens
ugaaaauaaaaaaugauggccuaauuuacuuugaaauucaaaggauucuguuauuuacauaucu

SEQ ID NO: 83685 - RNA, 64 nt, Homo Sapiens
aagcccuuuagaauuagaguagcuuuauaaagggaauucaaagguuaagcucuucuuugcacaa

SEQ ID NO: 83686 - RNA, 64 nt, Homo Sapiens
cuuuuuuuuacaauguguuuuguuuuuagauaucaauucaaauuugaaauaucaauucaaauuc

SEQ ID NO: 83687 - RNA, 64 nt, Homo Sapiens
cuguuuuuagauaucaauuccaagaugaaauaucaauucaaauugccucuagggcuuuaaaagu

SEQ ID NO: 83688 - RNA, 64 nt, Homo Sapiens
uaauuguggauauaaaagaacaccagagaucagaaauucaaaaacucagaauaaaaaugaaaaa

SEQ ID NO: 83689 - RNA, 64 nt, Homo Sapiens
aaagauaagacaguggcauagaguuaauauuuaaaauucaaauauuaaaacucaaauaaacccc

SEQ ID NO: 83690 - RNA, 64 nt, Homo Sapiens
uauuagcucuacuacuugaaaacacuaaaaauacaauucaaauuaguuacauuuuuuucuuuuu

SEQ ID NO: 83691 - RNA, 64 nt, Homo Sapiens
auuagccaggugugguggcacaucuccacaaaaaaauucaaaaauggacaucaugacgaaaccc

SEQ ID NO: 83692 - RNA, 64 nt, Homo Sapiens
gaauaagaaaggauuaaacaguuacaagccuccaaauucaaauaaaauuaaaucacaguucaga

SEQ ID NO: 83693 - RNA, 64 nt, Homo Sapiens
cggucucaccgaugcaguuuucauggacauagaaaauucaaauagaauauauaauauugaauuu

SEQ ID NO: 83694 - RNA, 64 nt, Homo Sapiens
acuccuaggaauguauuuugcuucaggauuuuuaaauucaaauaaggauggcagugcccauuuu

SEQ ID NO: 83695 - RNA, 64 nt, Homo Sapiens
cuuuaguaauuuguauguaaugucaaauaaaaggaauucaaaucugaguaaauaacagccuccu

SEQ ID NO: 83696 - RNA, 64 nt, Homo Sapiens
uuuaaauauuuaagaggagaguagauauaaacauaauucaaauaaaucaauaucuccuacauua

SEQ ID NO: 83697 - RNA, 64 nt, Homo Sapiens
uacagaaacacacacagauaugugauagcauacaaauucaaacauacaaacauaugcccauucc

SEQ ID NO: 83698 - RNA, 64 nt, Homo Sapiens
cauauaugucaagaccacaaagauaagggaguucaauucaaaacuggcuuaaucucuuagacuu

SEQ ID NO: 83699 - RNA, 64 nt, Homo Sapiens
auguugcauuaauuguauaaaccugugugcuaauaauucaaacaggauucuguggauucuuuaa

SEQ ID NO: 83700 - RNA, 64 nt, Homo Sapiens
gagugagauguaaauccugucauuccugaaccaaaauucaaaguacuagccuuaaugaguuucc

SEQ ID NO: 83701 - RNA, 64 nt, Homo Sapiens
gaggcgcuagaucaaggucacagaggacaaaguuaauucaaaaaaccuuaauuccaggaaagca

SEQ ID NO: 83702 - RNA, 64 nt, Homo Sapiens
uaauuguucucuaggaaaagagaacuuuuuucaaaauucaaaauacuuuuuaaggauggcacag

SEQ ID NO: 83703 - RNA, 64 nt, Homo Sapiens
agguuuuagguggcauaguggcuuaacuggacugaauucaaauauucuuucaacuucaucucaa

SEQ ID NO: 83704 - RNA, 64 nt, Homo Sapiens
cugaaaagaaucagcauuuauauggaauucuuuuaauucaaacgacuguuaucuaucugcugua

SEQ ID NO: 83705 - RNA, 64 nt, Homo Sapiens
ugaaguaauguuuuaguaaguauaaacaagggucaauucaaauuacaaaucccauuaaauaaau

SEQ ID NO: 83706 - RNA, 64 nt, Homo Sapiens
uuaacuaguucucgaacuuuacuaugcauaagaaaauucaaacuggagagaaacucuacaaaug

SEQ ID NO: 83707 - RNA, 64 nt, Homo Sapiens
cauaagauaauuuauacuggagcaaaaccuuggaaauucaaagaaugugguaaaacuuacaauc

SEQ ID NO: 83708 - RNA, 64 nt, Homo Sapiens
cacacuauguuaaaauuacuuuuuucccuuagauaauucaaauuucuccacuugcuugagauua

SEQ ID NO: 83709 - RNA, 64 nt, Homo Sapiens
cauuuggaggauuuucuucuuuguaauguaaagaaauucaaaguuaucaaaguuccuuaaaugu

SEQ ID NO: 83710 - RNA, 64 nt, Homo Sapiens
auuuguacugagggaaacagagguguucaauaaaaauucaaauaagauauuuuaaauauuugga

SEQ ID NO: 83711 - RNA, 64 nt, Homo Sapiens
gauaacugcaaagacacuggcucauguacuagagaauucaaaggaucucuuuacacaauuggag

SEQ ID NO: 83712 - RNA, 64 nt, Homo Sapiens
ugaguuuucuuauuauagugaacagaaacaucacaauucaaaaguaacguauuguccuuccguu

SEQ ID NO: 83713 - RNA, 64 nt, Homo Sapiens
aaaguuauuacacuaaaaguucaaauuuuuucauaauucaaacaauggucuagagggaaaugau

SEQ ID NO: 83714 - RNA, 64 nt, Homo Sapiens
uaaauaaucuuuucuagcuuaauauuuuaauucuaauucaaacaacucugagguuuugguuuca

SEQ ID NO: 83715 - RNA, 64 nt, Homo Sapiens
aacuauucuugaaaugguauugaaaaauaccguuaauucaaauugacagagauugauaaaaaga

SEQ ID NO: 83716 - RNA, 64 nt, Homo Sapiens
gccuuugaaauucaguguguauuaaacacaucucaauucaaaccaucaccauauuucaagucuu

SEQ ID NO: 83717 - RNA, 64 nt, Homo Sapiens
uguuuacuuucugucaagauauuuacccgugucaaauucaaacuacaguacuguguaauuaugu

SEQ ID NO: 83718 - RNA, 64 nt, Homo Sapiens
auguuguaacugaaagcacuguuuuagagaaggaaauucaaaaauggacaccucugcugugaau

SEQ ID NO: 83719 - RNA, 64 nt, Homo Sapiens
augucacccaagcucuguucgugguaagguugcaaauucaaaacuuuaugauguucaucacagu

SEQ ID NO: 83720 - RNA, 64 nt, Homo Sapiens
acuauuugagaaacccucaacuguuauguccuaaaauucaaaucaauaaaguuaccauguuaca

SEQ ID NO: 83721 - RNA, 64 nt, Homo Sapiens
augccucugccccuuuaauacugaaaaucugaguaauucaaagcaggguuuugucaaauguuuu

SEQ ID NO: 83722 - RNA, 64 nt, Homo Sapiens
guuccauuuucucucuuguaaaaaacaucuuuaaaauucaaacauccauauguuacugaaucug

SEQ ID NO: 83723 - RNA, 64 nt, Homo Sapiens
aagagaaaaagaaaaacagcgucuacuuuaaaaaaauucaaauguuaaauaaagaaagugugag

SEQ ID NO: 83724 - RNA, 64 nt, Homo Sapiens
cuuuacuccuuaaaaaagaaaggaaagaucucuaaauucaaagcuagauuguaaauaggcauuc

SEQ ID NO: 83725 - RNA, 64 nt, Homo Sapiens
cuccuuuuuucggaauugaaacauuuuaauuucaaauucaaauagaacauuuaaaaugauuuca

SEQ ID NO: 83726 - RNA, 64 nt, Homo Sapiens
gcaauucguauuggagagaaaauucauaccuuguaauucaaaagguggcaacaccuuuggucaa

SEQ ID NO: 83727 - RNA, 64 nt, Homo Sapiens
ggagagaaaccuuacaaauggcaaaacauauuagaauucaaacuuugaauauaauucauaccug

SEQ ID NO: 83728 - RNA, 64 nt, Homo Sapiens
cugcagguggagcuggagcaagaauaccaagacaaauucaaaagacugccccucgagauuuugg

SEQ ID NO: 83729 - RNA, 64 nt, Homo Sapiens
uguaugugagauuuuuguuuucuuuccaauagcaaauucaaagcaagcaacuugcaggcuccau

SEQ ID NO: 83730 - RNA, 64 nt, Homo Sapiens
uuggcuuaauuccaaucauuguuaaaguaaaaacaauucaaagaaucaccuaauuaauuucagu

SEQ ID NO: 83731 - RNA, 64 nt, Homo Sapiens
aacccaaguuuauuauaucauuaaccuuaucauaaauucaaaccuaaguugcuggacccuggug

SEQ ID NO: 83732 - RNA, 64 nt, Homo Sapiens
uuugauuuuuauuuuuuacaaucagaauguuaauguaagguacauauaaucuuauucuguaguc

SEQ ID NO: 83733 - RNA, 64 nt, Homo Sapiens
ugaauggucaaacaccaguccuguuucuguuucuguaagguacacaaaaggcaugucuuaggaa

SEQ ID NO: 83734 - RNA, 64 nt, Homo Sapiens
gcgucugucuuuguauuucuagggacagugauggaugacucagaagugauguuggguugugggc

SEQ ID NO: 83735 - RNA, 64 nt, Homo Sapiens
cugaggagucuccagggaugaguguuguguggacaugacucaccguugaaaagaaacccaaagg

SEQ ID NO: 83736 - RNA, 64 nt, Homo Sapiens
auuacaaccucuucuucucuaggaauaauuugagaugacucaauuccaacauaaaaauuauaau

SEQ ID NO: 83737 - RNA, 64 nt, Homo Sapiens
agguauuuaagaauugacgaaucucuuuacuguaaugacucaaacccuuuuccauuuuggauuu

SEQ ID NO: 83738 - RNA, 64 nt, Homo Sapiens
cuggcagugcucaccccaggcuucccugacggggaugacucagcacuaccccucaacagagaug

SEQ ID NO: 83739 - RNA, 64 nt, Homo Sapiens
aacagggaugacuccgcacugccccucaacagggaugacucagcagagaugacucagcacuguc

SEQ ID NO: 83740 - RNA, 64 nt, Homo Sapiens
cgcacugccccucaacagggaugacucagcagagaugacucagcacugucccuuagcagggaug

SEQ ID NO: 83741 - RNA, 64 nt, Homo Sapiens
agcacugucccuuagcagggaugacacagcaaggaugacucagcacugccccucagcaaggaug

SEQ ID NO: 83742 - RNA, 64 nt, Homo Sapiens
agcaaggaugacucagcacugccccucagcaaggaugacucagcacugccgcucaacagacaug

SEQ ID NO: 83743 - RNA, 64 nt, Homo Sapiens
agcaaggaugacucagcacugccgcucaacagacaugacucagggauggcuuaguacugccccu

SEQ ID NO: 83744 - RNA, 64 nt, Homo Sapiens
cucagggauggcuuaguacugccccucagcagggaugacucagcaccgccucucaacagggaug

SEQ ID NO: 83745 - RNA, 64 nt, Homo Sapiens
agcagggaugacucagcaccgccucucaacagggaugacucagcagggaugacucagcaccgcc

SEQ ID NO: 83746 - RNA, 64 nt, Homo Sapiens
agcaccgccucucaacagggaugacucagcagggaugacucagcaccgccccucaacaggcaug

SEQ ID NO: 83747 - RNA, 64 nt, Homo Sapiens
agcaccgccccucaacaggcaugacucugcagagaugacucagcacugucccuuagcagggaug

SEQ ID NO: 83748 - RNA, 64 nt, Homo Sapiens; identical to SEQ ID NO: 83741

SEQ ID NO: 83749 - RNA, 64 nt, Homo Sapiens
agcaaggaugacucagcacugccccucagcaaggaugacucagcacugccgcucaacagggaug

SEQ ID NO: 83750 - RNA, 64 nt, Homo Sapiens
agcaaggaugacucagcacugccgcucaacagggaugacucagggauggcuuaguacugccccu

SEQ ID NO: 83751 - RNA, 64 nt, Homo Sapiens
cucagggauggcuuaguacugccccucaacagggaugacucagcagggaugacucagcaccgcc

SEQ ID NO: 83752 - RNA, 64 nt, Homo Sapiens
aguacugccccucaacagggaugacucagcagggaugacucagcaccgccccucaacaggcaug

SEQ ID NO: 83753 - RNA, 64 nt, Homo Sapiens
ugcagagaugacuuaguacugccccucagcagggaugacucaguacugccccucagcagggaug

SEQ ID NO: 83754 - RNA, 64 nt, Homo Sapiens
agcagggaugacucaguacugccccucagcagggaugacucagcacugccccucaacagggaug

SEQ ID NO: 83755 - RNA, 64 nt, Homo Sapiens
agcagggaugacucagcacugccccucaacagggaugacucagcagggaugacucagcacuguc

SEQ ID NO: 83756 - RNA, 64 nt, Homo Sapiens
agcacugccccucaacagggaugacucagcagggaugacucagcacugucccuuagcagugaug

SEQ ID NO: 83757 - RNA, 64 nt, Homo Sapiens
agcacugucccuuagcagugaugacacagcaaggaugacucagcacugccccucagcaaggaug

SEQ ID NO: 83758 - RNA, 64 nt, Homo Sapiens; identical to SEQ ID NO: 83742

SEQ ID NO: 83759 - RNA, 64 nt, Homo Sapiens; identical to SEQ ID NO: 83743

SEQ ID NO: 83760 - RNA, 64 nt, Homo Sapiens
cucagggauggcuuaguacugccccucagcagggaugacucagcaccgccccucaacagggaug

SEQ ID NO: 83761 - RNA, 64 nt, Homo Sapiens
agcagggaugacucagcaccgccccucaacagggaugacucagcacugccccucaacagggaug

SEQ ID NO: 83762 - RNA, 64 nt, Homo Sapiens
aacagggaugacucagcacugccccucaacagggaugacucagcagggaugacucagcaguguc

SEQ ID NO: 83763 - RNA, 64 nt, Homo Sapiens
agcacugccccucaacagggaugacucagcagggaugacucagcagugucccuuagcagcgaug

SEQ ID NO: 83764 - RNA, 64 nt, Homo Sapiens
agcagugucccuuagcagcgaugacacagcaaggaugacucagcacugccccucaccaaggaug

SEQ ID NO: 83765 - RNA, 64 nt, Homo Sapiens
agcaaggaugacucagcacugccccucaccaaggaugacucagcacugccgcucaacagacaug

SEQ ID NO: 83766 - RNA, 64 nt, Homo Sapiens
accaaggaugacucagcacugccgcucaacagacaugacucagggauggcuuaguacugccccu

SEQ ID NO: 83767 - RNA, 64 nt, Homo Sapiens
cucagggauggcuuaguacugccccucagcagggaugacucagcagggaugacucagcaccacc

SEQ ID NO: 83768 - RNA, 64 nt, Homo Sapiens
aguacugccccucagcagggaugacucagcagggaugacucagcaccaccccucaacagggaug

SEQ ID NO: 83769 - RNA, 64 nt, Homo Sapiens
agcagggaugacucagcaccaccccucaacagggaugacucagcagggaugacucagcacugcc

SEQ ID NO: 83770 - RNA, 64 nt, Homo Sapiens
agcaccaccccucaacagggaugacucagcagggaugacucagcacugccccucaacagggaug

SEQ ID NO: 83771 - RNA, 64 nt, Homo Sapiens
ucagcacugccccucaacagggaugacugcagggaugacucagcacugccccucagcagggaug

SEQ ID NO: 83772 - RNA, 64 nt, Homo Sapiens
ugcagggaugacucagcacugccccucagcagggaugacucagcacugccccucagcagggaug

SEQ ID NO: 83773 - RNA, 64 nt, Homo Sapiens
agcagggaugacucagcacugccccucagcagggaugacucagcagggaugacucagcaccgcc

SEQ ID NO: 83774 - RNA, 64 nt, Homo Sapiens
agcacugccccucagcagggaugacucagcagggaugacucagcaccgccccucaacaggcaug

SEQ ID NO: 83775 - RNA, 64 nt, Homo Sapiens
agcaccgccccucaacaggcaugacucugcagagaugacucagcacugccccucagcagggaug

SEQ ID NO: 83776 - RNA, 64 nt, Homo Sapiens
agcacugccccucagcagggauggcucagcagggaugacucagcauugccccucaacagggaug

SEQ ID NO: 83777 - RNA, 64 nt, Homo Sapiens
agcagggaugacucagcauugccccucaacagggaugacucagcagacucagcagggaugacuc

SEQ ID NO: 83778 - RNA, 64 nt, Homo Sapiens
ccucaacagggaugacucagcagacucagcagggaugacucagcacugccccucaacagacaug

SEQ ID NO: 83779 - RNA, 64 nt, Homo Sapiens
agcagggaugacucagcacugccccucaacagacaugacucagcagggaugacucagcaccgcc

SEQ ID NO: 83780 - RNA, 64 nt, Homo Sapiens
agcacugccccucaacagacaugacucagcagggaugacucagcaccgccccucagcaaggaug

SEQ ID NO: 83781 - RNA, 64 nt, Homo Sapiens
agcagggaugacucagcaccgccccucagcaaggaugacucagcagggaugauucagcagagau

SEQ ID NO: 83782 - RNA, 64 nt, Homo Sapiens
ggugggauggggaagaccaggagcagagucgagccucacagaagccagcgcgggucucugcuca

SEQ ID NO: 83783 - RNA, 64 nt, Homo Sapiens
acagaucccagcuuauggccuugacccagccguccucacagaugccgggugacccucuagcucu

SEQ ID NO: 83784 - RNA, 64 nt, Homo Sapiens
cuaccccuuuccauuuuggauucucggcugaguucucacagaagcauuuuccccauguggcucu

SEQ ID NO: 83785 - RNA, 64 nt, Homo Sapiens
ggagaaguuuuguggugccgcuggugacaaggaacucacagaaagguuucuuagcuggugaaga

SEQ ID NO: 83786 - RNA, 64 nt, Homo Sapiens
agaucugggggaggcaggaagcuccucagauuuucucacagacccuucccaauuccaucaccac

SEQ ID NO: 83787 - RNA, 64 nt, Homo Sapiens
agaguaggaagagagaaaugguagccugcugcuucucacagacaccucacauccucacuuggga

SEQ ID NO: 83788 - RNA, 64 nt, Homo Sapiens
cuggccucuuggcaccugccagagucucuccagccucacagaugguaacucccacuccuaauca

SEQ ID NO: 83789 - RNA, 64 nt, Homo Sapiens
cuuccaccagagcaggggcugcagcgccuguccccucacagacuaguaacaccagggccagcag

SEQ ID NO: 83790 - RNA, 64 nt, Homo Sapiens
ugcagugcacaugcaggccuuuuuaucuauauuucucacagauguucauuuuuaaguuuggaau

SEQ ID NO: 83791 - RNA, 64 nt, Homo Sapiens
cauaaucauggcuaaauauuuggcugccaaggcacucacagaauaagaggaaucaaguucugag

SEQ ID NO: 83792 - RNA, 64 nt, Homo Sapiens
uuuaucacaaugcccacugugacagaacaagacacucacagauuagugauacguuuuauuuuua

SEQ ID NO: 83793 - RNA, 64 nt, Homo Sapiens
gugaugcuuucauauugaccucaccccauacuaccucacagauguguugugaggauuaauaaaa

SEQ ID NO: 83794 - RNA, 64 nt, Homo Sapiens
cggaugcacccgucuuuagaaccaaaaauauucucucacagauuucauuccuguuuuuauauau

SEQ ID NO: 83795 - RNA, 64 nt, Homo Sapiens
auccauccacgcgugcagagcugccagcagggagcucacagaaggggagggagcaccaggccag

SEQ ID NO: 83796 - RNA, 64 nt, Homo Sapiens
uuccuguggcuucuccagccacccaaccccaugccucacagagcaaacaagcaacauccucaaa

SEQ ID NO: 83797 - RNA, 64 nt, Homo Sapiens
gagagcucugagcaggugaggcccuuaccugacccucacagaaauuguucucucucuggucacu

SEQ ID NO: 83798 - RNA, 64 nt, Homo Sapiens
cuaugaguacuacuuuuguuaaaugugaaaaacccucacagaaagucaucgaggcaaaaagagg

SEQ ID NO: 83799 - RNA, 64 nt, Homo Sapiens
ugaacagcuaauaaagauuuauuuauuguaauaccucacagacguuguaccauauccaugcaca

SEQ ID NO: 83800 - RNA, 64 nt, Homo Sapiens
accacuucccauauaagauguaccaauccucuuucucacagagaucccagcaucugugccucca

SEQ ID NO: 83801 - RNA, 64 nt, Homo Sapiens
cagagacugacaauuguguccauuaugucuguugcucacagaugucccuaggaugccaaagugg

SEQ ID NO: 83802 - RNA, 64 nt, Homo Sapiens
cucuccaugcccugggucacuuccuuuuuugggucucacagaccccuccaggggcugacaccua

SEQ ID NO: 83803 - RNA, 64 nt, Homo Sapiens
cugaugagagcucaaaccucuagucugggaugagcucacagagcccucaugaguuaagauccau

SEQ ID NO: 83804 - RNA, 64 nt, Homo Sapiens
guaggaucccaguaaauauggaaccagcccaugccucacagacaauagaaaagacuuaaaugga

SEQ ID NO: 83805 - RNA, 64 nt, Homo Sapiens
agcugaucuguaagucacuccacuggaugggaaacucacagaugcucagugucugggccagucu

SEQ ID NO: 83806 - RNA, 64 nt, Homo Sapiens
aggauggcagauggugcagcucucacagagguggcucacagagacuugggcugaauuuagacuc

SEQ ID NO: 83807 - RNA, 64 nt, Homo Sapiens
uggcucacagagaaggauggugaauuuagacucucucacagagguugauccugauuucuugggc

SEQ ID NO: 83808 - RNA, 64 nt, Homo Sapiens
cugcaccccaaguccaggucgggcucagcucuggcucacagacuggagacaaugcagaugccag

SEQ ID NO: 83809 - RNA, 64 nt, Homo Sapiens
ggucuucggcauugguucccuuugcuccaccccacucacagagacacagggcauccaacugaga

SEQ ID NO: 83810 - RNA, 64 nt, Homo Sapiens
ggcaugaagcacugaucaggguuccuggaacagacucacagauucuaaggcucucucuccucua

SEQ ID NO: 83811 - RNA, 64 nt, Homo Sapiens
uggggaguugguggcaacuuugccccuaaaacuucucacagagcauuugauaauuuaaaccccc

SEQ ID NO: 83812 - RNA, 64 nt, Homo Sapiens
aguaaguuaaagucugguggguuuuuuuucccuccucacagauaaaugaaaaguaaguauucua

SEQ ID NO: 83813 - RNA, 64 nt, Homo Sapiens
acugauucaaaugcuaaucucuuccagaaacagccucacagacacacccagacaucugguagau

SEQ ID NO: 83814 - RNA, 64 nt, Homo Sapiens
ugggugcccaagcucagaaggcucuucugacuacugggcaaagaguguagaucagagcagcagu

SEQ ID NO: 83815 - RNA, 64 nt, Homo Sapiens
uuaauccagaauaacuagcaccagggacuaugaaugggcaaaacugaauuauaagaggcugaua

SEQ ID NO: 83816 - RNA, 64 nt, Homo Sapiens
cggaucacuugaggccaggaauuugaaaccagccugggcaaaacccugucucuacuaaaaauau

SEQ ID NO: 83817 - RNA, 64 nt, Homo Sapiens
ggcagaugggcacaggugcuggugaugccucuccugggcaaaacgccccauuuguggcacuuuc

SEQ ID NO: 83818 - RNA, 64 nt, Homo Sapiens
augccuguaaucccaguacuuugggaggcugaggugggcaaaucaccugaggucaggaguucca

SEQ ID NO: 83819 - RNA, 64 nt, Homo Sapiens
gaaaacaucggggaaucucuccaggacauuggagugggcaaagauuucuuguguaauaccugac

SEQ ID NO: 83820 - RNA, 64 nt, Homo Sapiens
uauaguuagauauacuuucucuuaggaaaaauaaugggcaaaaauuuuuguugcaacuuuucau

SEQ ID NO: 83821 - RNA, 64 nt, Homo Sapiens
gaaaguugcagauccacaaaacuaacaggauaauugggcaaauaaauuacauauaaacacacac

SEQ ID NO: 83822 - RNA, 64 nt, Homo Sapiens
ggucccacuggggacugugaguaggauugagagcugggcaaacaagucucucggcuccuuuaau

SEQ ID NO: 83823 - RNA, 64 nt, Homo Sapiens
ggagauguagcuaacugguguguucaaucacugaugggcaaagguccucugcccuagagcuguu

SEQ ID NO: 83824 - RNA, 64 nt, Homo Sapiens
gaagguccucagccaugccccuucagggucacucugggcaaagagugauugugaugcuauuuau

SEQ ID NO: 83825 - RNA, 64 nt, Homo Sapiens
uggagaacccuccuaaauccacaaagaggccuugugggcaaaccuuaggaugaauggucccuac

SEQ ID NO: 83826 - RNA, 64 nt, Homo Sapiens
ugucccgagcugccauguuucgugggggaggccgugggcaaaggccaccucugcucgagagguc

SEQ ID NO: 83827 - RNA, 64 nt, Homo Sapiens
ggugaaaccaugucucuacaauuugaggccugccugggcaaaaucaaauugcuugaccucagga

SEQ ID NO: 83828 - RNA, 64 nt, Homo Sapiens
gcuugaccucaggaauuugacccagcacuuagggugggcaaauucaguggcucacgccuguaau

SEQ ID NO: 83829 - RNA, 64 nt, Homo Sapiens
cugucuaguggcagcuuuuccccuggaacaggggucccuggaguucacaggcuuauccccagga

SEQ ID NO: 83830 - RNA, 64 nt, Homo Sapiens
uaaacugguuagaaugaaccuggcucccugagcaucccuggauccuucaaauaggcccugagau

SEQ ID NO: 83831 - RNA, 64 nt, Homo Sapiens
aaugucucuguuuucuuuuccuuuugaaaaagagucccuggaaaagaaagaauaaguggauucu

SEQ ID NO: 83832 - RNA, 64 nt, Homo Sapiens
augcucuuuguaugccuuaugcagcgcugaucugucccuggaguucccagguucccagcucccc

SEQ ID NO: 83833 - RNA, 64 nt, Homo Sapiens
aauagaaugcaauucauucaggggcauccagggcucccuggaugaagacauccucaagaaaaca

SEQ ID NO: 83834 - RNA, 64 nt, Homo Sapiens
ccguuccacccucacccuuuccugcuggcccaccucccuggacccuccuugccucucccuaugg

SEQ ID NO: 83835 - RNA, 64 nt, Homo Sapiens
aaguauuuuucccacauuuucugaacucccucucucccuggaauuuauaauuugaccacagcau

SEQ ID NO: 83836 - RNA, 64 nt, Homo Sapiens
ccugaaauggguggaauagcgguuggugucuuacucccuggaagcacuaaaagcaguauuuuaa

SEQ ID NO: 83837 - RNA, 64 nt, Homo Sapiens
ccaagagccugauaacugagcaggguggauccugucccuggagcugcugcacccauuaauucuc

SEQ ID NO: 83838 - RNA, 64 nt, Homo Sapiens
cagggucacagccuacuaauuccucaaacuucucucccuggacuaggagaaaggcuaaagaaug

SEQ ID NO: 83839 - RNA, 64 nt, Homo Sapiens
gccaaguuaggauggcaucacucuguggcagcucucccuggacuugcccugccuggaacagggu

SEQ ID NO: 83840 - RNA, 64 nt, Homo Sapiens
ucaguucucuuugagucugacugacuguggccagucccuggacugguagcugcuggaggccuuc

SEQ ID NO: 83841 - RNA, 64 nt, Homo Sapiens
cugguagcugcuggaggccuucuuguuucuccagucccuggaagcugagcucuauguguauuug

SEQ ID NO: 83842 - RNA, 64 nt, Homo Sapiens
cauuucaaauucaucuucuaaaacuuguuagaaaucccuggaggaccaagaaguaacacuuuuu

SEQ ID NO: 83843 - RNA, 64 nt, Homo Sapiens
ugaggccuuucccuugccauugcugccuauccugucccuggauccaaauucuagguacacuggc

SEQ ID NO: 83844 - RNA, 64 nt, Homo Sapiens
ggccuuaaaaagauacacaaagaugggcugugggucccuggaaagggggagaguugcccuuuac

SEQ ID NO: 83845 - RNA, 64 nt, Homo Sapiens
ugcaccucuuugacuaggucccaggauccccuugucccuggaguagggacuaacuauagcacaa

SEQ ID NO: 83846 - RNA, 64 nt, Homo Sapiens
gugggugagcuuagccacucuuacccaugcucuuucccuggaaucccuggagaccuguccaaga

SEQ ID NO: 83847 - RNA, 64 nt, Homo Sapiens
cuuagccacucuuacccaugcucuuucccuggaaucccuggagaccuguccaagaugauuucca

SEQ ID NO: 83848 - RNA, 64 nt, Homo Sapiens
augccaaaugguuguggagaaaguggccggagccucccuggaguggagcagcccugaagccugu

SEQ ID NO: 83849 - RNA, 64 nt, Homo Sapiens
gguggggugggaaccucaguuucccccaaagucuucccuggaugcuggcuucagguugaagucc

SEQ ID NO: 83850 - RNA, 64 nt, Homo Sapiens
accucuguccugucugggccacuccagcacccugucccuggagcccaccgcuccaccuggcuuc

SEQ ID NO: 83851 - RNA, 64 nt, Homo Sapiens
cuuaacugccucacccugagcuggcccauuuuauucccuggaccaggcccuggcgguccuuggc

SEQ ID NO: 83852 - RNA, 64 nt, Homo Sapiens
ggggaggacacccgacugugcacacuuccaggccucccuggagagguguccacuccauccuucc

SEQ ID NO: 83853 - RNA, 64 nt, Homo Sapiens
ucagaauaggagcagagagaagcccagacuuccuucccuggaguguagaccugugugugggacc

SEQ ID NO: 83854 - RNA, 64 nt, Homo Sapiens
uuaagcauuuuaaaaucuauucucucccccuuucucccuggaugauucaggaagcugacauugu

SEQ ID NO: 83855 - RNA, 64 nt, Homo Sapiens
ugggcccccuucuccauaugccuccaaaaacaugucccuggagaguagccugcucccacacugu

SEQ ID NO: 83856 - RNA, 64 nt, Homo Sapiens
gugggucagaggugccaguaguauaauauucgucucccuggaguuauguugaaggcagaguuuu

SEQ ID NO: 83857 - RNA, 64 nt, Homo Sapiens
gcaggaaaacaggauuuuuuuuuuuuuaucuuguucccuggaggauccagggaugaggauagag

SEQ ID NO: 83858 - RNA, 64 nt, Homo Sapiens
ucucgcugggcuggguccuggauuccagggcuauucccuggaggacagucucaguuaugggaua

SEQ ID NO: 83859 - RNA, 64 nt, Homo Sapiens
cuuagccaugagcuggcucaggcaucccuucccuucccuggagcugcccugccuuucucaagua

SEQ ID NO: 83860 - RNA, 64 nt, Homo Sapiens
gaauugggggugggggucuucuaccuaggacucuucccuggagucaugggcugccugggaccca

SEQ ID NO: 83861 - RNA, 64 nt, Homo Sapiens
ccagaucuuucucuucccugaacguuuucuucuuucccuggacaggcagccuccuuugugugua

SEQ ID NO: 83862 - RNA, 64 nt, Homo Sapiens
aacccaagugccucaccucgaaaggaggcccuguucccuggagucagggugaacugcaaagcuu

SEQ ID NO: 83863 - RNA, 64 nt, Homo Sapiens
ggugggaaccugaacuaggacuucaguccuguggucccuggacuggcccucugcagggcccagu

SEQ ID NO: 83864 - RNA, 64 nt, Homo Sapiens
uuuuuaagcaguacgugccuucccuccuuugggcucccuggagguugaaaaaaacaggacccuu

SEQ ID NO: 83865 - RNA, 64 nt, Homo Sapiens
ggaccugaagcuccagugugugccuuuggccucuucccuggacuugggugaccagucuccgucu

SEQ ID NO: 83866 - RNA, 64 nt, Homo Sapiens
cugggccaccacucugaggaggguaggaggggccucccuggauugaaccgggacagaaacacgg

SEQ ID NO: 83867 - RNA, 64 nt, Homo Sapiens
gucugugaaaaacugaaaauccccuggugggcacucccuggagcccaagcagcuccccuagggg

SEQ ID NO: 83868 - RNA, 64 nt, Homo Sapiens
aaaugucagcgaccugggcuuggaacacagugacucccuggaguagucgggcagcccagauggc

SEQ ID NO: 83869 - RNA, 64 nt, Homo Sapiens
accaccgagcuucaaugaggaccccagccccacuucccuggaacugccgaggacucuguuuggc

SEQ ID NO: 83870 - RNA, 64 nt, Homo Sapiens
ugugguggcaguacuguggcccaccaguguaaucucccuggauuaaggcauucuuaaaaacuua

SEQ ID NO: 83871 - RNA, 64 nt, Homo Sapiens
uuucacaaauuaggccacggcccuaaauaggaauucccuggauugugggcaagugggcggaagu

SEQ ID NO: 83872 - RNA, 64 nt, Homo Sapiens
cacaggggcuaucgaggagaagccuucuaccccaucccuggaucccugcucugggagcauugcu

SEQ ID NO: 83873 - RNA, 64 nt, Homo Sapiens
aagaagaccucagggcuaccaaggaaagacggcuucccuggacauaacagugaaguaaggccca

SEQ ID NO: 83874 - RNA, 64 nt, Homo Sapiens
cccuaaccucggcagggcuucuguccuguggaguucccuggacaccuuggucuggcucuugugc

SEQ ID NO: 83875 - RNA, 64 nt, Homo Sapiens
acccccaccucaugcaucccaaggcucuacugggucccuggaccuaacccugcuuucauccugg

SEQ ID NO: 83876 - RNA, 64 nt, Homo Sapiens
cugagacugggugccagcuuacuccuacacgcuaucccuggagcaacaggcuccgaggaaaauc

SEQ ID NO: 83877 - RNA, 64 nt, Homo Sapiens
ucuucuacacggaagacgagaccugcucacgcucucccuggacccgccaaugaggaucugcugc

SEQ ID NO: 83878 - RNA, 64 nt, Homo Sapiens
gugugcaugcaggggugagguauuuucacugcccucccuggagagucccuuguaaguuuggcuc

SEQ ID NO: 83879 - RNA, 64 nt, Homo Sapiens
uggugccuggcaccccugaaccaugaucugagccucccuggagaagguauuuuauaugucugcu

SEQ ID NO: 83880 - RNA, 64 nt, Homo Sapiens
ucaacccuccuguuguuuggaugccuaugagaagucccuggacuagggaauacccaagccccug

SEQ ID NO: 83881 - RNA, 64 nt, Homo Sapiens
agggagaggcuggcccgugucuggagccugacccucccuggaacuagggaagaaagagcugcag

SEQ ID NO: 83882 - RNA, 64 nt, Homo Sapiens
ggcucaguacuugccaccugcuggccugucugacccuccgcacucaccugccgggacccucccu

SEQ ID NO: 83883 - RNA, 64 nt, Homo Sapiens
ccgggccuccugggcgccccggggcugccggugcccuccgcaggcggcggccgcgagcggggcg

SEQ ID NO: 83884 - RNA, 64 nt, Homo Sapiens
ccggguucaagagauucugcucagcucacugcaaccuccgcaucuggaguguaguggcacaauc

SEQ ID NO: 83885 - RNA, 64 nt, Homo Sapiens
ccugacauuucucuccaccucugcugggcaucacccuccgcacccugguggggcacccagcacu

SEQ ID NO: 83886 - RNA, 64 nt, Homo Sapiens
agggaagcucuuuucuccugcacugccugccuccccuccgcagcggaugcuaggggggcuugcc

SEQ ID NO: 83887 - RNA, 64 nt, Homo Sapiens
cccucagccacaagcgggugaauguaguucucauccuccgcauguugcuaugccccagauccuu

SEQ ID NO: 83888 - RNA, 64 nt, Homo Sapiens
ccgucagcuggaaaaggccuacuagguccccuucccuccgcaucgucagcugaaucccgauagu

SEQ ID NO: 83889 - RNA, 64 nt, Homo Sapiens
augagcucuccugcagacaauagcaaauaugcagccuccgcaagcaaucauuuauucguucauu

SEQ ID NO: 83890 - RNA, 64 nt, Homo Sapiens
gagcagcuccagcugccugggugaaaaguucugcccuccgcaggcagggagggguuggcuuggg

SEQ ID NO: 83891 - RNA, 64 nt, Homo Sapiens
uauugcugugcuccccaccacccccauggcagucccuccgcagccccagucccuggccacgccc

SEQ ID NO: 83892 - RNA, 64 nt, Homo Sapiens
accagccucagcuggcgcagcggggcccuucuucccuccgcauccccuucagggagcaggagcc

SEQ ID NO: 83893 - RNA, 64 nt, Homo Sapiens
cacucuaacccucggagacccccuaagccccguuccuccgcagacccaggcccuccggaagggg

SEQ ID NO: 83894 - RNA, 64 nt, Homo Sapiens
uuacccucccuuucucuuucccauccaccugugcccuccgcauccaugcuuggcccccucgucc

SEQ ID NO: 83895 - RNA, 64 nt, Homo Sapiens
uggacugcaaugacgcgaucuugguucacugcaaccuccgcauccgggguucaagccauucucc

SEQ ID NO: 83896 - RNA, 64 nt, Homo Sapiens
gccuccccguccaggccuucugcuuucaucauccccuccgcacagggucuucuccccucaccca

SEQ ID NO: 83897 - RNA, 64 nt, Homo Sapiens
ugaccgcugcccagguggggccgcugagaggcugccuccgcaccguuacugugaauguucccca

SEQ ID NO: 83898 - RNA, 64 nt, Homo Sapiens
ccucucuucaccgccugcgccugaguucgcggguccuccgcaggccgccugggaaccggagccu

SEQ ID NO: 83899 - RNA, 64 nt, Homo Sapiens
cagauucauggagaccagucgucaccccugaacgccuccgcaggagucacuuaugacgaaauaa

SEQ ID NO: 83900 - RNA, 64 nt, Homo Sapiens
ggagcggccuccagccuuauuuaauuuuacggucccuccgcaggcgagaugacauauauagagu

SEQ ID NO: 83901 - RNA, 64 nt, Homo Sapiens
ccaacgcaguucauguacaagauguguugccccuccuccgcaugugggagggguccccaacaug

SEQ ID NO: 83902 - RNA, 64 nt, Homo Sapiens
uuucucucaaccacaucugccuccacacacagcuccuccgcagggaaggagaagcugcucugua

SEQ ID NO: 83903 - RNA, 64 nt, Homo Sapiens
uuccguuuccuaccuguuugcuuccccccccaguccuccgcaugagcuguugcccuccaggggc

SEQ ID NO: 83904 - RNA, 64 nt, Homo Sapiens
ucuggccaccuggagagcucgagugccaccaguaccuccgcaccccgggccucuggacuucuug

SEQ ID NO: 83905 - RNA, 64 nt, Homo Sapiens
guugacugccaaaauagcauccccaacgugcagcccuccgcaucuaucagcagguugccccgga

SEQ ID NO: 83906 - RNA, 64 nt, Homo Sapiens
uuuauuuuaauaaaaggcaauguaugcgacuccaccuccgcauguuauaaccuauuaccuauuu

SEQ ID NO: 83907 - RNA, 63 nt, Homo Sapiens
agaaacugagcaaggccugagcgcugcccugcaccuccgcagaccugcugugaugacuugcca

SEQ ID NO: 83908 - RNA, 64 nt, Homo Sapiens
cauccuuugugaagcuggaacacuggcuggagacccuccgcaugcaccuggccggccaccugcc

SEQ ID NO: 83909 - RNA, 64 nt, Homo Sapiens
cagcuccguccucaggaugucagcacgcggugcaccuccgcagcauguggccccgcucgaggca

SEQ ID NO: 83910 - RNA, 64 nt, Homo Sapiens
uccccucacuucugaaggucccauccccugcugcccuccgcaggcccagggcugggcacucccu

SEQ ID NO: 83911 - RNA, 64 nt, Homo Sapiens
ccauugccccugagcucccagagucaccccuccaccuccgcagccagugaaguguguugugccu

SEQ ID NO: 83912 - RNA, 64 nt, Homo Sapiens
cagugggccaagcaguccugguaccugagcgccuccuccgcagagcugcagcagcaguggcugg

SEQ ID NO: 83913 - RNA, 64 nt, Homo Sapiens
caaauugcugcugaccuuacgccuguauauuaagccuccgcaggaugccggacaauggugaaga

SEQ ID NO: 83914 - RNA, 64 nt, Homo Sapiens
cugccggcgguggccugggauuggcugugaggucccuccgcaucacccagcucacgucccccaa

SEQ ID NO: 83915 - RNA, 64 nt, Homo Sapiens
accuuccacccuggggccugugucagccgccggcccuccgcacccuggaagcacacggccucug

SEQ ID NO: 83916 - RNA, 64 nt, Homo Sapiens
ugacugucccaacggcaugcaaaagguccugccgccuccgcauccggccggggcacuguggucc

SEQ ID NO: 83917 - RNA, 64 nt, Homo Sapiens
cucaccccaccaucacuuacgcccucucaucagaccuccgcacccccuaaacaagucugcugcu

SEQ ID NO: 83918 - RNA, 64 nt, Homo Sapiens
cacccccguccgccauccugcaggaguccacccaccuccgcaucuccaguguccaagcugcggc

SEQ ID NO: 83919 - RNA, 64 nt, Homo Sapiens
cccaucccugcggggcggucguggacagcccaccccuccgcagcggccuccagcgcccugcccu

SEQ ID NO: 83920 - RNA, 64 nt, Homo Sapiens
cucuccacaccucaaaacuccugccccauaacguccuccgcauccacuuuccagcucagcagcc

SEQ ID NO: 83921 - RNA, 64 nt, Homo Sapiens
auagcacagucgauuucguuucgcagcugucuccccuccgcagcagauaccucgguccagaucu

SEQ ID NO: 83922 - RNA, 64 nt, Homo Sapiens
uuugaaaguagagcuagcugccacuuucacguggccuccgcagugucuccaccuacaccccugu

SEQ ID NO: 83923 - RNA, 64 nt, Homo Sapiens
gucucggcagagcccuuuguaguacccuggacccccuccgcagagaggggaccccuccaccccc

SEQ ID NO: 83924 - RNA, 58 nt, Homo Sapiens
ucacacaccugccugcccacgggauaugccuccgcaacucaaugaguacuucugcuga

SEQ ID NO: 83925 - RNA, 64 nt, Homo Sapiens
ggaaagcucuuuacccagaaaaacuacaguugauccuccgcaaacagguaaugaaucguaacca

SEQ ID NO: 83926 - RNA, 64 nt, Homo Sapiens
gagagcaaggaagagaaauuccaugggugacuuuccuccgcagaaagcaaaguuuggggagggc

SEQ ID NO: 83927 - RNA, 64 nt, Homo Sapiens
gcccaccucuucccgcacccagcaugcagcucugccuccgcagccucagugcgcuuuccugcgc

SEQ ID NO: 83928 - RNA, 64 nt, Homo Sapiens
ucaucuuucucuuuucaaucuuugaaugccucucccuccgcaucagaugcuguaacuagcauuu

SEQ ID NO: 83929 - RNA, 64 nt, Homo Sapiens
ccccucccuccccacggccccagggugugcccuuccuccgcaugcugggacugaggggcucagg

SEQ ID NO: 83930 - RNA, 64 nt, Homo Sapiens
ccuggccuggcuuccugguaaggaguuucagccgccuccgcaggaacccccaaagugcagauuc

SEQ ID NO: 83931 - RNA, 64 nt, Homo Sapiens
caagaagccugcaggagaaagccaagggcaguucccuccgcagaacaccccaugcgugcugaga

SEQ ID NO: 83932 - RNA, 64 nt, Homo Sapiens
cccagagccaagagggugcugcucaguugcagggccuccgcagcuggacagagagugggggagg

SEQ ID NO: 83933 - RNA, 64 nt, Homo Sapiens
cucuacgaaauucaguaggagagaagauccugucccuccgcaguugcucccugggcucccuggg

SEQ ID NO: 83934 - RNA, 64 nt, Homo Sapiens
gagaaagcuuauuauggaaagucacugguccuccccuccgcacaggaaagguacccaguagaua

SEQ ID NO: 83935 - RNA, 64 nt, Homo Sapiens
caccccggggaggcgcccaccccggacccccaccccuccgcacugugaaagacuaacuccugca

SEQ ID NO: 83936 - RNA, 64 nt, Homo Sapiens
acuaaccugcccugccucuccauacaaacaugucccuccgcacaccucugcuguagcuuuaaug

SEQ ID NO: 83937 - RNA, 64 nt, Homo Sapiens
ccgccuugggcccucccugcgacagccggacccgccuccgcaucggguugcgaugcccucugca

SEQ ID NO: 83938 - RNA, 64 nt, Homo Sapiens
cugcuucccagcuucacaauaaacggcugcgucuccuccgcacaccuguggugccugccaccca

SEQ ID NO: 83939 - RNA, 64 nt, Homo Sapiens
guuacccaguguguauauaaaacaucugaaacccccuccgcacugcuuugaugaacagaugaca

SEQ ID NO: 83940 - RNA, 64 nt, Homo Sapiens
aagcccaccuggcccuguggcaccaccgccacgcccuccgcagacccucucccagaaccgcugc

SEQ ID NO: 83941 - RNA, 64 nt, Homo Sapiens
uggcucuguuccuucugggagcuguucccgggagccuccgcaagcaucuuuagaaaucugaucu

SEQ ID NO: 83942 - RNA, 64 nt, Homo Sapiens
ccucaggaagcuguggaggcuggauuccaggcucccuccgcagacugacuuuccucugugucug

SEQ ID NO: 83943 - RNA, 64 nt, Homo Sapiens
gggugagguggcaguggcagacuucgcacagucuccuccgcacaggcugcugcuggcugugaag

SEQ ID NO: 83944 - RNA, 64 nt, Homo Sapiens
ugcuucauuuugacccuuggccaaggaguccuggccuccgcagauccccugacuguguccgaug

SEQ ID NO: 83945 - RNA, 64 nt, Homo Sapiens
guccccuccugagcagcacuagucuccagcccacccuccgcaccugacucaggaccagcucugg

SEQ ID NO: 83946 - RNA, 64 nt, Homo Sapiens
caggaaaugcugucggagagcgcgcauucuauuuccuccgcagggaaugccagauagaaaguug

SEQ ID NO: 83947 - RNA, 50 nt, Homo Sapiens
aggcccagggcaugcgguagccuccgcagaggcugggggccuccacccag

SEQ ID NO: 83948 - RNA, 64 nt, Homo Sapiens
ggacaugccuuacacuggcguccucuccugagucccuccgcacucuccaucagcaaccucacac

SEQ ID NO: 83949 - RNA, 64 nt, Homo Sapiens
ccagauuccagcgauucuccuaggcucacugcaaccuccgcaucuagagugcaguggcgccauc

SEQ ID NO: 83950 - RNA, 64 nt, Homo Sapiens
ccgccccaugccccaguccugccucucuccaggcccuccgcaccguccagccccgggacccaug

SEQ ID NO: 83951 - RNA, 64 nt, Homo Sapiens
caggacaucccaaccccuggugggggcuguggccccuccgcaggccgcugcgaggggcccccca

SEQ ID NO: 83952 - RNA, 64 nt, Homo Sapiens
ugagguuccugccccuuccuccccugccucccagccuccgcagaaccucucagugccucaccuc

SEQ ID NO: 83953 - RNA, 64 nt, Homo Sapiens
agguuggugggggguccagucuggggugggagcuccuccgcagagucucuucugggcgucugag

SEQ ID NO: 83954 - RNA, 64 nt, Homo Sapiens
ggugccugggcccagccccgugccccuccgucugccuccgcacggcuggcagagggcaggcugc

SEQ ID NO: 83955 - RNA, 64 nt, Homo Sapiens
ccugucugugcauccugaaccacucuuugcugggccuccgcaagggccucucuugggucugugu

SEQ ID NO: 83956 - RNA, 64 nt, Homo Sapiens
uggggccacgaccucccuggccguggccacccguccuccgcagcaggccccugcugucccccca

SEQ ID NO: 83957 - RNA, 64 nt, Homo Sapiens
agagagaugcugcucuggccagcucaggugaccuccuccgcagaccgacauucccaguccugug

SEQ ID NO: 83958 - RNA, 64 nt, Homo Sapiens
acccgacuuaccaggacgcaauggaaccaccucaccuccgcagccugcuuccucaguuuccaaa

SEQ ID NO: 83959 - RNA, 64 nt, Homo Sapiens
acacauuauucaagagaccaccugacaugcaucuccuccgcaggaauacauucguccucucuua

SEQ ID NO: 83960 - RNA, 64 nt, Homo Sapiens
gcucccaccacgcggcgcuucaguacggcuggauccuccgcaggcgagcggaaggcccccagga

SEQ ID NO: 83961 - RNA, 64 nt, Homo Sapiens
cccgcacugaacacacccgcccucaaccccgcacccuccgcacucaccucccccucgccgcucg

SEQ ID NO: 83962 - RNA, 64 nt, Homo Sapiens
acaggaggggaaggcaacauacacaccccggacuccuccgcauccuccuccugcuuccuccgcu

SEQ ID NO: 83963 - RNA, 64 nt, Homo Sapiens
caugucuccagauuccaggugcagguucuuagcaccuccgcagccgcucucucuugaguccauc

SEQ ID NO: 83964 - RNA, 64 nt, Homo Sapiens
ggggagacacaccuacugcuuccucagaugggccccuccgcagccccuucccuugcucggggaa

SEQ ID NO: 83965 - RNA, 64 nt, Homo Sapiens
ggccccggcccucccuggcucugacguuuuucucccuccgcagguucucagauuucccuccuuu

SEQ ID NO: 83966 - RNA, 64 nt, Homo Sapiens
ugacacgagucugcugugaauguggagccuguuaccuccgcauuccugagaggagcccccuccc

SEQ ID NO: 83967 - RNA, 64 nt, Homo Sapiens
caccgugaagaggaagcggaccccgggaagccagccuccgcagcaucaucccugcuccagcugc

SEQ ID NO: 83968 - RNA, 64 nt, Homo Sapiens
caccccaccccagccugcuagccucucccaccucccuccgcacauggagggucucuaguuccac

SEQ ID NO: 83969 - RNA, 64 nt, Homo Sapiens
acugaccucuugucuccuguguaccauccccuccccuccgcaccauccagccccaggccccucu

SEQ ID NO: 83970 - RNA, 64 nt, Homo Sapiens
acacagacagaagacugugucaugggucauggccccuccgcacaccuacagguuugccaaagga

SEQ ID NO: 83971 - RNA, 64 nt, Homo Sapiens
cugcacacccaggaaaagucugcagacccccagcccuccgcaauaauucaccagaccagaagcc

SEQ ID NO: 83972 - RNA, 64 nt, Homo Sapiens
gcccgccagcuggcuucgaguugaugggcugggcccuccgcacgacuuacaacgacgagggacu

SEQ ID NO: 83973 - RNA, 64 nt, Homo Sapiens
guguaguuuugugacauaaggguggggaacagaaccuccgcaucugggccccagacaagccuuu

SEQ ID NO: 83974 - RNA, 64 nt, Homo Sapiens
caccguggccuggcggcgagcccccggucaccuuccuccgcacggaagaggggccggacgccac

SEQ ID NO: 83975 - RNA, 64 nt, Homo Sapiens
ucagcaguuugggguguggcgcuuugcagacgugccuccgcaccggggggaguguuucugaccu

SEQ ID NO: 83976 - RNA, 64 nt, Homo Sapiens
uuugacgcccuccaucccucccgccaggcacuguccuccgcaaggccuggugcagcccuggcag

SEQ ID NO: 83977 - RNA, 64 nt, Homo Sapiens
ucuaagaauagaaagaaagaaagagaaacgguguccuccgcacagccggucagaacugugugac

SEQ ID NO: 83978 - RNA, 64 nt, Homo Sapiens
cuuaggcaccagacuggaggcccccgggcgcuggccuccgcacauucgucugccuucucacagc

SEQ ID NO: 83979 - RNA, 64 nt, Homo Sapiens
ccacccagcccucccgcucaggccacagccggagccuccgcauugcccccacccccauuuucca

SEQ ID NO: 83980 - RNA, 64 nt, Homo Sapiens
agaggugcuaaaguuucccaucuuugugcagcuaccuccgcauugcuguguagugaccccugcc

SEQ ID NO: 83981 - RNA, 64 nt, Homo Sapiens
ggacuucagagcagcaaggcacacaggacugggcccuccgcagggcgacagcccagcagugccc

SEQ ID NO: 83982 - RNA, 64 nt, Homo Sapiens
ccucuugccuggggccacucccggccccucuaucccuccgcagggagccccuggugguccugaa

SEQ ID NO: 83983 - RNA, 64 nt, Homo Sapiens
ccucagagcucagaggguccggggugggcggugaccuccgcaucugucuacuaacaaggacaug

SEQ ID NO: 83984 - RNA, 64 nt, Homo Sapiens
caccuaaagacauguauauguugcagaaggacaaccuccgcaccucugaagggucuuggcuuga

SEQ ID NO: 83985 - RNA, 64 nt, Homo Sapiens
uggaacucaagcgugaguucgccuucgacgaugcccuccgcaugcuugaggucacuuggaguuc

SEQ ID NO: 83986 - RNA, 64 nt, Homo Sapiens
accaagcgggggauggugcugugagaagcuacucccuccgcagccuuuuaaacaaccagaucuc

SEQ ID NO: 83987 - RNA, 64 nt, Homo Sapiens
ucccaaacaagccucgcuuguccagugaagaaguccuccgcaacccucacugaggcaccccacu

SEQ ID NO: 83988 - RNA, 64 nt, Homo Sapiens
gaggugcauuucugcuggugacuggaggagggaccagaaugaggauacgugagaaauagacccg

SEQ ID NO: 83989 - RNA, 64 nt, Homo Sapiens
gaggcuggaaggccacaaggugcuugcuaaggaacagaaugacccagagucaaggccaagucug

SEQ ID NO: 83990 - RNA, 64 nt, Homo Sapiens
uuaauuuugccuuuuuuuuucccccgcccgcccccagaaugauaaaauaguugcuucccacugc

SEQ ID NO: 83991 - RNA, 64 nt, Homo Sapiens
uccuggggagaaucuaagccccucugauagaggucagaaugaggaacagugagguggaucuuua

SEQ ID NO: 83992 - RNA, 64 nt, Homo Sapiens
agugcaauaguuguaaaucuuggccuucugucagcagaaugauaaaaaucucaaucuucaguuu

SEQ ID NO: 83993 - RNA, 64 nt, Homo Sapiens
aauaauuuaagaggacagaacuuuguaauauaaucagaaugaaacaaaccuccacagcucauuu

SEQ ID NO: 83994 - RNA, 64 nt, Homo Sapiens
uaugguuggaaaacugaggacugaaaguaguagucagaaugaauauugguucuuuaaaauauau

SEQ ID NO: 83995 - RNA, 64 nt, Homo Sapiens
uauguaucccuucucuuuugggggaucgugauuucagaaugaaucaccuuuucugugaggagga

SEQ ID NO: 83996 - RNA, 64 nt, Homo Sapiens
ugcaagaauuuuuugcauuacugguacuccaauucagaaugaucugagaaaagaauaauucuaa

SEQ ID NO: 83997 - RNA, 64 nt, Homo Sapiens
uccaaaauugcaaaccacgccaaaggaaaauagacagaaugauuaaguguuuguaaaccaaguu

SEQ ID NO: 83998 - RNA, 64 nt, Homo Sapiens
agcagccugccccaugcuuccagccugcagaacacagaaugaaacaugcugguagacuccacga

SEQ ID NO: 83999 - RNA, 64 nt, Homo Sapiens
caggaugugcuucugcagccuacagaugcagaaccagaaugagggggacaauuccacccacucg

SEQ ID NO: 84000 - RNA, 64 nt, Homo Sapiens
ccuugucuugaaaaaaaaaauccagucugugugacagaaugagacugagauugugccacugcac

SEQ ID NO: 84001 - RNA, 64 nt, Homo Sapiens
accuguaaauguaagaguggaaaaguguauugcucagaaugauguuuuaggacuacucuucaaa

SEQ ID NO: 84002 - RNA, 64 nt, Homo Sapiens
agaacaugugagauuuugagggguaauaaaaugacagaaugagcuggaaauguaauggauaauu

SEQ ID NO: 84003 - RNA, 64 nt, Homo Sapiens
uauauuacaaccgauauaaaggaagagcccauaacagaaugaccuaaauggaaugcucugaaug

SEQ ID NO: 84004 - RNA, 64 nt, Homo Sapiens
aguccagaaccccugucacaccagaagaagagaucagaaugauggauggccacuaaguguguau

SEQ ID NO: 84005 - RNA, 64 nt, Homo Sapiens
ccaucgagaugaaauuaaacacugaaaacagucccagaaugaccuauaauagaugacaguggca

SEQ ID NO: 84006 - RNA, 64 nt, Homo Sapiens
auucaauggaucacagugaacccagaaaacuagacagaaugaucacauuucccagaaaauguuu

SEQ ID NO: 84007 - RNA, 64 nt, Homo Sapiens
auucccagaaacauuucccauccagaaaacaaggcagaaugaucuuagccaaauagucugaauu

SEQ ID NO: 84008 - RNA, 64 nt, Homo Sapiens
uugaauuguuuugcuucguuuguguugccuuacccagaaugagagucuuuauugcagaagacag

SEQ ID NO: 84009 - RNA, 64 nt, Homo Sapiens
gcuuggauuacaggcgugagguguguugccuuaccagaaugaguagucuuuauugcagaagaca

SEQ ID NO: 84010 - RNA, 64 nt, Homo Sapiens
gcuaggauuacaggcgugaguguguugccuuacccagaaugagucacacuauuucagaagacag

SEQ ID NO: 84011 - RNA, 64 nt, Homo Sapiens
aaaauccuaacccaauagaaaaggugauucuauucagaaugagauggucaugagaauaaaacaa

SEQ ID NO: 84012 - RNA, 64 nt, Homo Sapiens
guagaaaaggcugaauucuguuacucacuaaagacagaaugaauagcaugagaacagcaguuua

SEQ ID NO: 84013 - RNA, 64 nt, Homo Sapiens
gcugacagggucuauggccauccgcaagagaggccagaaugacagucccucgcugcacaaauac

SEQ ID NO: 84014 - RNA, 64 nt, Homo Sapiens
agaccuuugaaugauucuaacgggccucagggaacagaaugaucaugaagccagaccuccccgg

SEQ ID NO: 84015 - RNA, 64 nt, Homo Sapiens
caucauggguccugaugguuuuaaccaugccagccagaaugaagucaaggcaagagaaguggcu

SEQ ID NO: 84016 - RNA, 64 nt, Homo Sapiens
guuuguaauugaaagaaaaauggaaaauaugcuacagaaugaaauuaggaagugguucuccuac

SEQ ID NO: 84017 - RNA, 64 nt, Homo Sapiens
uucauguucaucucagguggcauuugcaggugaccagaaugaggcacaugacagugguuauauu

SEQ ID NO: 84018 - RNA, 64 nt, Homo Sapiens
cuguugaagugcauguuaaaauaauuauaugaagcagaaugagaugauuuaauucuuaccgaaa

SEQ ID NO: 84019 - RNA, 64 nt, Homo Sapiens
cauuguaguggcaaagauaauuuaagauacaguucagaaugacaaauaucauuuguuaugcauu

SEQ ID NO: 84020 - RNA, 64 nt, Homo Sapiens
auuuuuuguauuugcuuuuugucaugaacauugacagaaugacauguauaguuccagauaauuu

SEQ ID NO: 84021 - RNA, 64 nt, Homo Sapiens
aaauacagugugacguguacugucaucaagggguaugcuccaugcuuugagucaccaaugaagc

SEQ ID NO: 84022 - RNA, 64 nt, Homo Sapiens
gcagaaguggggagcacuuuaaugcaacccagguaugcuccaugcauauccagcugggccagcc

SEQ ID NO: 84023 - RNA, 64 nt, Homo Sapiens
agcuacccuccagacaagggcaagaguuagccagaugcuccaggcagugggaagccaauggagg

SEQ ID NO: 84024 - RNA, 64 nt, Homo Sapiens
ccaucggcacuggcgcccugcuccaucggcacuaaugcuccacucggcgccccacuccaucggc

SEQ ID NO: 84025 - RNA, 64 nt, Homo Sapiens
augccccacucggcgccccacuccaucagcacuaaugcuccacuccauuggcacuaacgcccca

SEQ ID NO: 84026 - RNA, 64 nt, Homo Sapiens
gaggcugagacugcgggaugguccuggggcucugugcagggaggagguggcagcccuguaggga

SEQ ID NO: 84027 - RNA, 64 nt, Homo Sapiens
gcugggaaaucguuugaacccgggaagcggagguugcagggagccgagaucacgccacugcacu

SEQ ID NO: 84028 - RNA, 64 nt, Homo Sapiens
gggaugcuaaacauugaaagcuggguguaggcacugcagggagaguguggaggucugacagggu

SEQ ID NO: 84029 - RNA, 64 nt, Homo Sapiens
gaagagcagauugcuuaugccaugcagaugucccugcagggagcaggugagccagagccugggu

SEQ ID NO: 84030 - RNA, 64 nt, Homo Sapiens
gaccaaguaccaucuuuaucagacaccagcggugugcagggagagugucugcuccuuguugggc

SEQ ID NO: 84031 - RNA, 64 nt, Homo Sapiens
gaagauggcuuaguguuuagguuucugaagcuuuugcagggagaacaugugcuuccauacagug

SEQ ID NO: 84032 - RNA, 64 nt, Homo Sapiens
gaaccagaagcagaggggccauucccauacuugaugcagggaagaugacccagccucuugcagu

SEQ ID NO: 84033 - RNA, 64 nt, Homo Sapiens
auggggagagggucuucaguagcuggccacagugugcagggagaaguugacgccagcccuguaa

SEQ ID NO: 84034 - RNA, 64 nt, Homo Sapiens
accaccaaagccuguucgcacagaagggcgaccuugcagggacucgccgccgcgaccucagugu

SEQ ID NO: 84035 - RNA, 64 nt, Homo Sapiens
gugccuuuagaggaaggagaggauugcugaggaaugcagggacgccuguuucuguccucacacc

SEQ ID NO: 84036 - RNA, 64 nt, Homo Sapiens
ucuuuuaccauuuuugggaagagggauagguaagugcagggaguuugugcugaaacagcgccug

SEQ ID NO: 84037 - RNA, 64 nt, Homo Sapiens
aagaaggucauggccccuggccuggcccccgcccugcagggacacagaagccacaccauuugca

SEQ ID NO: 84038 - RNA, 64 nt, Homo Sapiens
aagaugucaagcuggccgugcagcagugugagggugcagggaccgcccuucuuccauucccaga

SEQ ID NO: 84039 - RNA, 64 nt, Homo Sapiens
agcacgccaaccccagcagucucacggcugcaccugcagggagccugaggggcagggccguaga

SEQ ID NO: 84040 - RNA, 64 nt, Homo Sapiens
ugugggguaagggagggaagacagcaggggacagugcagggaggagggcauuccagccaagggc

SEQ ID NO: 84041 - RNA, 64 nt, Homo Sapiens
ggugacaucaggagucagggacagggaagggugaugcagggaagaagccuuauccaccaaauac

SEQ ID NO: 84042 - RNA, 64 nt, Homo Sapiens
guccucucccccgccccaccccgugcuucagccuugcagggagagugaugcuccaggcaacacg

SEQ ID NO: 84043 - RNA, 64 nt, Homo Sapiens
cuuggccgcuuacuggaagggcguuuuucagagcugcagggacagggugagcagcugaagggcu

SEQ ID NO: 84044 - RNA, 64 nt, Homo Sapiens
ucaggggcagcugcagggccagauggaguuggccugcagggagucagccuuaccccaucagaga

SEQ ID NO: 84045 - RNA, 64 nt, Homo Sapiens
cggaggagaaauaaggccagaggcucacauugcuugcagggaaccgacugaguaaugaagaaga

SEQ ID NO: 84046 - RNA, 64 nt, Homo Sapiens
gagaagugggggaagugaaaucaguggguucuggugcagggagugccugucuguuugcuuaaag

SEQ ID NO: 84047 - RNA, 64 nt, Homo Sapiens
cguggguucucgcaccugcucuaucuggaggcuuugcagggagucagcucccguggccacacag

SEQ ID NO: 84048 - RNA, 64 nt, Homo Sapiens
ccccccagggccccccagcaccuacagcuggggcugcagggagacaacggguggcugcauccag

SEQ ID NO: 84049 - RNA, 64 nt, Homo Sapiens
ugagccaagccacuggggccaugcguaugacuggugcagggaggcaaggcccacauucuccuuc

SEQ ID NO: 84050 - RNA, 64 nt, Homo Sapiens
aacauacuggccguucugaccacccuaggcagccugcagggaauggugaucuguuugaggagag

SEQ ID NO: 84051 - RNA, 64 nt, Homo Sapiens
aaaagugcaaguccauuaugcagaaagugauaagugcagggaggcuuacaauuaaggucaagcc

SEQ ID NO: 84052 - RNA, 64 nt, Homo Sapiens
ucaccaccucaggguggagauacuuauaaaugccugcagggauuguauuucuucuguccaguua

SEQ ID NO: 84053 - RNA, 64 nt, Homo Sapiens
gaggauguaauuccaucauaucucgguuggugagugcagggaaggagugcccguagcgggauga

SEQ ID NO: 84054 - RNA, 64 nt, Homo Sapiens
aacuuuaaacaauguuugaaaauaaguuuccauaugcagggaguuuuacagcuuugaggcuuca

SEQ ID NO: 84055 - RNA, 64 nt, Homo Sapiens
cucugaagcagugaauaaagaucaugugggcugaugcagggaaguuucuauauugccaaguuga

SEQ ID NO: 84056 - RNA, 64 nt, Homo Sapiens
cccaguuuucuaagccuaggugugcagguacagcugcagggaaggagauuuccaggccuauccc

SEQ ID NO: 84057 - RNA, 64 nt, Homo Sapiens
agaagcuuuguggugucaggagugaggccauagaugcagggaguggucccaggugagagaagga

SEQ ID NO: 84058 - RNA, 64 nt, Homo Sapiens
aggggccggccucagcugucgggaggaggggaggugcagggaaguugccugcuggggugaugca

SEQ ID NO: 84059 - RNA, 64 nt, Homo Sapiens
aggggaggugcagggaagaggccugcuggggugaugcagggaggagagccugucucagggaauu

SEQ ID NO: 84060 - RNA, 64 nt, Homo Sapiens
gaggggaacccugggacaggguggaugggggugaugcagggacuaauaugggagggaguguggu

SEQ ID NO: 84061 - RNA, 64 nt, Homo Sapiens
ccacuuugaggcugaggccaggaaagcugacaucugcagggaacuuagaugcccagaugaagag

SEQ ID NO: 84062 - RNA, 64 nt, Homo Sapiens
guuccaagucuguccugucuagccagguauuaauugcagggauagcuuggaaagggaucuggga

SEQ ID NO: 84063 - RNA, 64 nt, Homo Sapiens
ccccuuucugaugaugaaacucgggcugagcagcugcagggagcucaaaagugugagcccugcu

SEQ ID NO: 84064 - RNA, 64 nt, Homo Sapiens
acuguccagguuauaaccugguaccagcagacuuugcagggaagaaagaguuguuccaaucaug

SEQ ID NO: 84065 - RNA, 64 nt, Homo Sapiens
cagccaguauagagacuugguuggcaucuucugcugcagggacuaaaaguauuugacuggggca

SEQ ID NO: 84066 - RNA, 64 nt, Homo Sapiens
ccacccacucaggacucuucugaauugcuuuaggugcagggacacagguaucacaaagcauuug

SEQ ID NO: 84067 - RNA, 64 nt, Homo Sapiens
agacaaauccucaaagcgugggcggcgcugggguugcagggaaacugggccuguaaugaauguc

SEQ ID NO: 84068 - RNA, 64 nt, Homo Sapiens
ggagcuguacggaggcuggaagcacucauccugcugcagggaaggggcuagcguucuuguccaa

SEQ ID NO: 84069 - RNA, 64 nt, Homo Sapiens
uuucccugcgaaacaaaugaagugaggagaggauugcagggacuacccuggcaucucaagaggg

SEQ ID NO: 84070 - RNA, 64 nt, Homo Sapiens
guugcugugcacuaggagcugugaucucccucucugcagggaggccccagccccugcugcuugc

SEQ ID NO: 84071 - RNA, 64 nt, Homo Sapiens
ugugacuguuuggcacuugagacaaaccugccuuugcagggaaagugucucucacgggcauugg

SEQ ID NO: 84072 - RNA, 64 nt, Homo Sapiens
gggcacagaugcugagacagccucuccuucucagugcagggacgucaccccugccaggcaagcc

SEQ ID NO: 84073 - RNA, 64 nt, Homo Sapiens
gggcauagaugcugagacagccucucccucucagugcagggacgucaccccugccaggcaagcc

SEQ ID NO: 84074 - RNA, 64 nt, Homo Sapiens
cggcaccggcgggcgggugggaggugggaguggcugcagggaccccuagugucccuggucuauc

SEQ ID NO: 84075 - RNA, 64 nt, Homo Sapiens
aaggaacgccuuccaggaaccuguggacuaggggugcagggacuucccuuugcaagggguaaca

SEQ ID NO: 84076 - RNA, 64 nt, Homo Sapiens
uuggcacauuuccggguuaggguggaaugggcuuugcagggaagagggcccccugugcacgcau

SEQ ID NO: 84077 - RNA, 64 nt, Homo Sapiens
cagaugccugcagggcuggggcucucgggacagaugcagggaugugugcugcagggcugcuggg

SEQ ID NO: 84078 - RNA, 57 nt, Homo Sapiens
ccugccucucagccgccuagccaagacugcagggauggcccgcagccucaucggggc

SEQ ID NO: 84079 - RNA, 64 nt, Homo Sapiens
ccagagacagcgggccuggcagcgggccgggccaugcagggagcgccucccuauguugccugcc

SEQ ID NO: 84080 - RNA, 64 nt, Homo Sapiens
aagcgccagggaaaugacccacagggaucgcagcugcagggagggccagggagguugggggugg

SEQ ID NO: 84081 - RNA, 64 nt, Homo Sapiens
agcagucccaucucugugggaggcaugcaacgcgugcagggaguucaggugccggucggcguag

SEQ ID NO: 84082 - RNA, 64 nt, Homo Sapiens
cggcagcacacggagaccacguccggaucguuccugcagggaagcagugcgcucuugcugggag

SEQ ID NO: 84083 - RNA, 64 nt, Homo Sapiens
cuuuccuuacugggcccaggggagucauguugccugcagggacuaucuuccuucuccaaagcug

SEQ ID NO: 84084 - RNA, 64 nt, Homo Sapiens
aaaugaguacaucauaaugccuuuuuaacaacuccuagaguacaagaaaagaagauauuaagug

SEQ ID NO: 84085 - RNA, 64 nt, Homo Sapiens
ucugaaugaggauaacccuaaaguacuauuauaacuagaguagauuaauucugugcucuguuua

SEQ ID NO: 84086 - RNA, 64 nt, Homo Sapiens
cuuauugauauuuuuguaacagaauauagcucuuaacugaaaauccagaaccagaaacauaaau

SEQ ID NO: 84087 - RNA, 64 nt, Homo Sapiens
uaauuccuuugaucuuauaaguuaaagcuguaacaacugaaauugcauggaucaaguaagcaua

SEQ ID NO: 84088 - RNA, 64 nt, Homo Sapiens
uuuaagaauuguuccuugggcuucucuucccuguaacugaaagucuguuagaagguacaauuuu

SEQ ID NO: 84089 - RNA, 64 nt, Homo Sapiens
aauuaagccuucauagcguaaauuuaccuuaaauaacugaaaugauuuaaagggaaaaguccua

SEQ ID NO: 84090 - RNA, 64 nt, Homo Sapiens
cccuguucuaguuccuaacacuucugcuuuuaaaaacugaaauucccaaaaagauaacauuuuu

SEQ ID NO: 84091 - RNA, 64 nt, Homo Sapiens
acaguuugcuauaauauaaacuuauuuauaaauuaacugaaauuuaguauggugcauuucauuc

SEQ ID NO: 84092 - RNA, 64 nt, Homo Sapiens
agauuauuuuccauuugaaauuaauguauaauaaaacugaaacaaaaaugagacuuuuuauaug

SEQ ID NO: 84093 - RNA, 64 nt, Homo Sapiens
ucugaacauaauauaauuuccacaaauauuuuuaaacugaaauaauguuacauauguuuauauu

SEQ ID NO: 84094 - RNA, 64 nt, Homo Sapiens
aauaagccaauggaaagaaacaaguagaaaguuuaacugaaauuuucugaauauucuguggugc

SEQ ID NO: 84095 - RNA, 64 nt, Homo Sapiens
cuugaaauagaccuauaaaaaaaucuaacagaacaacugaaauauaaacuuuauccuaaaguuu

SEQ ID NO: 84096 - RNA, 64 nt, Homo Sapiens
augcaacuucaaccuuccagaugcucaggucaaaaacugaaaguugcuuuugacuccucuauuu

SEQ ID NO: 84097 - RNA, 64 nt, Homo Sapiens
cauauauauucucuaaauauuucuugaauuaaugaacugaaaaauguguguuaaaguugcuaag

SEQ ID NO: 84098 - RNA, 64 nt, Homo Sapiens
cgcuucacaauaaaacacagcuuaaaaauaaaauaacugaaagaaauagaauucagcaaauagu

SEQ ID NO: 84099 - RNA, 64 nt, Homo Sapiens
auagaauucagcaaauaguuauuuuuugcacuugaacugaaacguacuguacuguaaauuauga

SEQ ID NO: 84100 - RNA, 64 nt, Homo Sapiens
aaccacaguuucauuauucucauaauccuucugcaacugaaauuacauauugcaggagacauuu

SEQ ID NO: 84101 - RNA, 64 nt, Homo Sapiens
uaguuuuuuuucuaguuuuuaauuuuaacaucagaacugaaauaaaaaauuauggauacguguu

SEQ ID NO: 84102 - RNA, 64 nt, Homo Sapiens
uucucaauaucaacauauuuuuagcaaaacugaaaacugaaaugaugauuaagcuuaaacccug

SEQ ID NO: 84103 - RNA, 64 nt, Homo Sapiens
ugaaauguucucaauaucaaaacccuguuagcaaaacugaaaacaauuguuaugauuaagcuua

SEQ ID NO: 84104 - RNA, 64 nt, Homo Sapiens
gagauuugcccauagguuaaacaugguuagaaacaacugaaagcauaaaagaaaaaucuaggcc

SEQ ID NO: 84105 - RNA, 64 nt, Homo Sapiens
uguauuuuuuauuauuuuaauauacuguaagccaaacugaaauaacauuugcuguuuuauaggu

SEQ ID NO: 84106 - RNA, 64 nt, Homo Sapiens
auuuuauuuugguauauuuaaacagugaaaaacuaacugaaagcacaugaagaguuguaacuug

SEQ ID NO: 84107 - RNA, 64 nt, Homo Sapiens
acuauaaagacaaaguaauucuauuaaaugaacuaacugaaaauaauaauuauaggaagugauu

SEQ ID NO: 84108 - RNA, 64 nt, Homo Sapiens
uaaucaauggauucagaaauuggacucucaagagaacugaaacaaguuuaaacuucauuuagcu

SEQ ID NO: 84109 - RNA, 64 nt, Homo Sapiens
agcuugaauacugcauaugcaguuuaguuucaguaacugaaauaaguuggacaaaaugaguuug

SEQ ID NO: 84110 - RNA, 64 nt, Homo Sapiens
cugagcaacagagauaauuuuuggcuauuuuuauaacugaaaucguaauugucuuugucuugau

SEQ ID NO: 84111 - RNA, 64 nt, Homo Sapiens
uuaaucaaaagaggucauuuuguaauguuuuaugaacugaaauuacuuugauaaagaagcauac

SEQ ID NO: 84112 - RNA, 64 nt, Homo Sapiens
acuauguagugaaauguauuugccauuaaauaauaacugaaaagaauccacuggaggucauuac

SEQ ID NO: 84113 - RNA, 64 nt, Homo Sapiens
aaaaacauguuaauccuuguuugcagaaacaaauaacugaaauacauggauacaucaaguucau

SEQ ID NO: 84114 - RNA, 64 nt, Homo Sapiens
auuuuaaaauuauuugucuagugugccauuuaaaaacugaaaauaugaugugccagcuaaaauu

SEQ ID NO: 84115 - RNA, 64 nt, Homo Sapiens
aagaaguggaaugaggagcucuaauauucacauaaacugaaauaaucucaccugucgcguagcu

SEQ ID NO: 84116 - RNA, 64 nt, Homo Sapiens
uaugucuuaguuauaauuagauugugaaucagccaacugaaaauccuuuuugcauauuucaaug

SEQ ID NO: 84117 - RNA, 64 nt, Homo Sapiens
agcuuucugagaaaagcuagguguuuaauaguuuaacugaaaguuuaacuauuuaaaagacuaa

SEQ ID NO: 84118 - RNA, 64 nt, Homo Sapiens
auccugugucuugauagcaugccucucaugaggcaacugaaaaauuaacugccaagcccagguu

SEQ ID NO: 84119 - RNA, 64 nt, Homo Sapiens
uaauuuaucaguaauuuuuaggauauaaucagagaacugaaaaggacaagaauguguaucuguu

SEQ ID NO: 84120 - RNA, 64 nt, Homo Sapiens
aauguauauguuguaaauaugauucaauguaaagaacugaaaacuaaaaaaaguuugucuuuga

SEQ ID NO: 84121 - RNA, 64 nt, Homo Sapiens
uuaguggcagcacuucuauugucaauuauuccucaacugaaaguuaaagaaauaaaaaauucca

SEQ ID NO: 84122 - RNA, 64 nt, Homo Sapiens
uuuacuuaaucuggaaaacaauauguauucuccuaacugaaauaaacugaaaauaaaaauaaaa

SEQ ID NO: 84123 - RNA, 64 nt, Homo Sapiens
aaaaauaaaaauauguauucgacuccaucucaaaaacugaaaaucagccugggugacagaguga

SEQ ID NO: 84124 - RNA, 64 nt, Homo Sapiens
aaucacugaauggaauguucauaacuuauuggaaaacugaaaaguaucuccccucccuucagga

SEQ ID NO: 84125 - RNA, 64 nt, Homo Sapiens
ggacucucuuugugacaaagcauaaacauauggaaacugaaaauagaacuugagaaaauuacuu

SEQ ID NO: 84126 - RNA, 64 nt, Homo Sapiens
uaccuuccaaauuugccaagacccaacaaaaugcaacugaaaaagucauuaccaaaauacuaaa

SEQ ID NO: 84127 - RNA, 64 nt, Homo Sapiens
acaacuggcuacaaagaaggaaaaaauaaagguaaacugaaaagauauaucaucaggucuuaaa

SEQ ID NO: 84128 - RNA, 64 nt, Homo Sapiens
ucuguagagaguagcaguaugaaaggguuuugcaaacugaaagaaagaucucauguuaagugga

SEQ ID NO: 84129 - RNA, 64 nt, Homo Sapiens
cuaauuauaggagcauuuguaacuuaagccauguaacugaaaauggaagaaggcaagccucccc

SEQ ID NO: 84130 - RNA, 64 nt, Homo Sapiens
agcuuggauauuuuucugaaaaguuauuugccaaaacugaaauccuucagauguuuuccauggu

SEQ ID NO: 84131 - RNA, 64 nt, Homo Sapiens
augacagaauuaccucugcuuaguaucucauuauaacugaaagaagguuuaucauuacaaauac

SEQ ID NO: 84132 - RNA, 64 nt, Homo Sapiens
agcuuuaagugccuaacccuucuuucccaggauuuucaucaaaaauaauaaauguaggcucagc

SEQ ID NO: 84133 - RNA, 64 nt, Homo Sapiens
uucacaucuaaguugaaacauuuucauuaauguguucaucaaguagacauguggacuggaauuu

SEQ ID NO: 84134 - RNA, 64 nt, Homo Sapiens
aaagagaaauguucaggguuagacuauucucugcuucaucaaggacuuucuguuuuuagggaug

SEQ ID NO: 84135 - RNA, 64 nt, Homo Sapiens
uuauuuuauugagguuuggcgaccuuugcacuauuucaucaagacauuuuguggcuaaagacca

SEQ ID NO: 84136 - RNA, 64 nt, Homo Sapiens
cuuuaaaggaaaaaucaauucacaaaauuaugccuucaucaaaauuuaaagguuacuugaaugu

SEQ ID NO: 84137 - RNA, 64 nt, Homo Sapiens
ggaagccaacuguccugccucagucaagcaugucuucaucaagugcaucuugcccaggaucacu

SEQ ID NO: 84138 - RNA, 64 nt, Homo Sapiens
aaccuuuucaaacuuuucuaaaaugcaaggugcuuucaucaaugaaaauauugaaguucaucug

SEQ ID NO: 84139 - RNA, 64 nt, Homo Sapiens
ucuauucaaauauacaggugccuguauggccccuuucaucaauagauggugcacuacucugagg

SEQ ID NO: 84140 - RNA, 64 nt, Homo Sapiens
aaauauuuuuugaguguaugacucuuaaucucacuucaucaaucucuuucagaucauuuaggau

SEQ ID NO: 84141 - RNA, 64 nt, Homo Sapiens
aaucauggccagcgauuauugguugcaacaauaauucaucaaguuuccuguguauucucauugg

SEQ ID NO: 84142 - RNA, 64 nt, Homo Sapiens
agacccacucugaccccacuaaaaugaccccugauucaucaaaagugaggccuagaauuacccu

SEQ ID NO: 84143 - RNA, 64 nt, Homo Sapiens
gagguaucauuaucaguuacaaauugaguuauucuucaucaaaugacuuuuggaguagagauuu

SEQ ID NO: 84144 - RNA, 64 nt, Homo Sapiens
cacaaaacacagcaaacauaaaaaguuguuacacuucaucaaaaguacaaaguucuguucauca

SEQ ID NO: 84145 - RNA, 64 nt, Homo Sapiens
aguuguuacacuucaucaaaaguacaaaguucuguucaucaaaugaugcuguuaagauagggaa

SEQ ID NO: 84146 - RNA, 64 nt, Homo Sapiens
ucaaaugaauuuggccuggcagggucaccagaaguucaucaaauucccaugugaaccaaauuuc

SEQ ID NO: 84147 - RNA, 64 nt, Homo Sapiens
caugcaagccaaaagggaggacauggcugcuugcuucaucaagguggccacaauagccucauca

SEQ ID NO: 84148 - RNA, 64 nt, Homo Sapiens
cacagccuggucaggagggaaggaccucacuuguuucaucaaauggagugguuuaaaacugauc

SEQ ID NO: 84149 - RNA, 64 nt, Homo Sapiens
aaaaaaacaaaaagacauauucagguacugauuuuucaucaagagauugacauaccaaugauca

SEQ ID NO: 84150 - RNA, 64 nt, Homo Sapiens; identical to SEQ ID NO: 56583

SEQ ID NO: 84151 - RNA, 64 nt, Homo Sapiens; identical to SEQ ID NO: 56584

SEQ ID NO: 84152 - RNA, 64 nt, Homo Sapiens; identical to SEQ ID NO: 56585

SEQ ID NO: 84153 - RNA, 64 nt, Homo Sapiens; identical to SEQ ID NO: 56586

SEQ ID NO: 84154 - RNA, 64 nt, Homo Sapiens; identical to SEQ ID NO: 56587

SEQ ID NO: 84155 - RNA, 64 nt, Homo Sapiens; identical to SEQ ID NO: 56588

SEQ ID NO: 84156 - RNA, 64 nt, Homo Sapiens; identical to SEQ ID NO: 56589

SEQ ID NO: 84157 - RNA, 64 nt, Homo Sapiens; identical to SEQ ID NO: 56590

SEQ ID NO: 84158 - RNA, 64 nt, Homo Sapiens; identical to SEQ ID NO: 56591

SEQ ID NO: 84159 - RNA, 64 nt, Homo Sapiens; identical to SEQ ID NO: 56592

SEQ ID NO: 84160 - RNA, 64 nt, Homo Sapiens; identical to SEQ ID NO: 56593

SEQ ID NO: 84161 - RNA, 64 nt, Homo Sapiens; identical to SEQ ID NO: 56594

SEQ ID NO: 84162 - RNA, 64 nt, Homo Sapiens; identical to SEQ ID NO: 56595

SEQ ID NO: 84163 - RNA, 64 nt, Homo Sapiens; identical to SEQ ID NO: 56596

SEQ ID NO: 84164 - RNA, 64 nt, Homo Sapiens; identical to SEQ ID NO: 56597

SEQ ID NO: 84165 - RNA, 64 nt, Homo Sapiens; identical to SEQ ID NO: 56598

SEQ ID NO: 84166 - RNA, 64 nt, Homo Sapiens
gagcagcaaguuuccauuuggcauuagcccagcacagagccaccggaacaucaagauccuagag

SEQ ID NO: 84167 - RNA, 64 nt, Homo Sapiens
ccuagaggacagccuugccgccacacaguuccagcagagccaggccagccuccuccacaugcag

SEQ ID NO: 84168 - RNA, 64 nt, Homo Sapiens
ggccugggccugcuuuuccaggccagaaggagggcagagccaugagagcaucgugacccuucag

SEQ ID NO: 84169 - RNA, 64 nt, Homo Sapiens
cugggacucccagugaacuuaccaaggcagccuccagagccagcguugccaacuaagcccucga

SEQ ID NO: 84170 - RNA, 64 nt, Homo Sapiens
ggcucugaaggggagggaaggcaacggcucugcccagagccaucccuggagcaugugagcagcg

SEQ ID NO: 84171 - RNA, 64 nt, Homo Sapiens
ggauccuccugugagagugacgucaccuccuuuccagagccauuagugagccuggcuugggaac

SEQ ID NO: 84172 - RNA, 64 nt, Homo Sapiens
cacuucucaucccaaacccagggggacgugcccccagagccacccugggcucuggacaagcacu

SEQ ID NO: 84173 - RNA, 64 nt, Homo Sapiens
ugccagccucgcugggcagguucucccccaaaaccagagccaccauggccacaccccaccccac

SEQ ID NO: 84174 - RNA, 64 nt, Homo Sapiens
guugaaaaguuuucacauaauccaguauuggcaucagagccagaaaugcccucccuagguccag

SEQ ID NO: 84175 - RNA, 64 nt, Homo Sapiens
uugugucaaucaguuuaucccauccccuuggccacagagccauugugauaugaggagauacugg

SEQ ID NO: 84176 - RNA, 64 nt, Homo Sapiens
ggcaaaauagaggguaugaccugggguugcuggccagagccagggaggagccuuaagaagugaa

SEQ ID NO: 84177 - RNA, 64 nt, Homo Sapiens
ucaucucugcaagggacccugacgccugggagaucagagccacugacccuuuauggcacugcua

SEQ ID NO: 84178 - RNA, 64 nt, Homo Sapiens
guguacacauuccuaaaccauuauggaaacuuggcagagccagaaaaacauggaaaaguugccu

SEQ ID NO: 84179 - RNA, 64 nt, Homo Sapiens
ccuccuggguaccggcaacucaagcccagcccuccagagccagcccuugcucuccccagccugc

SEQ ID NO: 84180 - RNA, 64 nt, Homo Sapiens
ucuguggcagguugacacagcguuuauuucacagcagagccaagcccugccacccucccuggca

SEQ ID NO: 84181 - RNA, 64 nt, Homo Sapiens
cagccccgucaggggccaaacugguccucaccuccagagccagcauauaccugccugagauagg

SEQ ID NO: 84182 - RNA, 64 nt, Homo Sapiens
augagaacaaagauuccauugagccacuuggugacagagccaggaagugacuugcccaagguca

SEQ ID NO: 84183 - RNA, 64 nt, Homo Sapiens
uggugacagagccaggaugagacuugcccaaggucagagccacugagaccugaagaggguaagu

SEQ ID NO: 84184 - RNA, 64 nt, Homo Sapiens
ucaucuuccaggugcugaaaauuuuccagagccccagagccagcgacaaggauaaaggaauaug

SEQ ID NO: 84185 - RNA, 64 nt, Homo Sapiens
aaagcaaaccuucuaccucccuuucuccaccauccagagccacauauucucauuuuccuuuuac

SEQ ID NO: 84186 - RNA, 64 nt, Homo Sapiens
gcagcaggagucgggcccugcagcugcccguccccagagccacuaagcccgccccgcuggccgc

SEQ ID NO: 84187 - RNA, 64 nt, Homo Sapiens
agagugacaacagguaacgggcagcuggcaccaucagagccaggccucaaauccggcugaggca

SEQ ID NO: 84188 - RNA, 64 nt, Homo Sapiens
ugacgcccucccugccucccucucccggcauccgcagagccagcgacuuccggcgccgccgccc

SEQ ID NO: 84189 - RNA, 64 nt, Homo Sapiens
gcugagggagccucgacuucagcagaagcuagggcagagccaaucaagcucaugggacacccag

SEQ ID NO: 84190 - RNA, 64 nt, Homo Sapiens
uggguaagaagggugggaguggggccuuugccagcagagccagggcagggcgagcugcaggaau

SEQ ID NO: 84191 - RNA, 64 nt, Homo Sapiens
ccaccugaaggguggaugugcuggagggguggcccagagccauacugcguccacccugagcucg

SEQ ID NO: 84192 - RNA, 64 nt, Homo Sapiens
cacagacccaccacacagcccagcucagccacagcagagccaaucccugcacccgcuaccacac

SEQ ID NO: 84193 - RNA, 64 nt, Homo Sapiens
cagucacuguuccuccuccuagcgacaacagcaccagagccaggaguucuuagccaguugagcc

SEQ ID NO: 84194 - RNA, 64 nt, Homo Sapiens
aggacuuccuugggaagcccggacuucaggaccccagagccacucagccuagguucccauuugg

SEQ ID NO: 84195 - RNA, 64 nt, Homo Sapiens
augaccuggggcuugguuucgagccacagcuauccagagccagccugcccauuggccaugcugg

SEQ ID NO: 84196 - RNA, 64 nt, Homo Sapiens
aaccucucagccgaugcccccacagcacagaccccagagccaggccaaccacacccgguggggg

SEQ ID NO: 84197 - RNA, 64 nt, Homo Sapiens
aaccucucagccgaugcccccacagcacagaccccagagccaggccagccacacccaguggggg

SEQ ID NO: 84198 - RNA, 64 nt, Homo Sapiens
gcuaggcccuggugguguguggagagucaaugggcagagccaggaaggcccagaggaaguuaag

SEQ ID NO: 84199 - RNA, 64 nt, Homo Sapiens
uggccgccacgcagugugcuaggagagagugcugcagagccacgcaagaaucucccagucuggu

SEQ ID NO: 84200 - RNA, 64 nt, Homo Sapiens
cccugacucuccagcuuccaggaagguuccuucucagagccaaauacucuuugugcaagugccu

SEQ ID NO: 84201 - RNA, 64 nt, Homo Sapiens
cuuccugagcagaagaacuggagaaagggaaccacagagccaggaggaaugucugagcagaguc

SEQ ID NO: 84202 - RNA, 64 nt, Homo Sapiens
gaugaguugcacaagauuauacacuguuaaguagcagagccagaauggacuucagaaucccaac

SEQ ID NO: 84203 - RNA, 64 nt, Homo Sapiens
uauuguacaaauaucacucuucagguuuagcuuacagagccauggcuauggauucuuagcucug

SEQ ID NO: 84204 - RNA, 64 nt, Homo Sapiens
accuuugaggcuggucauaccuccaggaacaauacagagccagucaacuuccuggaauccaaga

SEQ ID NO: 84205 - RNA, 64 nt, Homo Sapiens
cuucucuggcccuuaggaucuccccauuuggagacagagccauuuggauauuuuccccuugaac

SEQ ID NO: 84206 - RNA, 64 nt, Homo Sapiens
gggagggaagggcugguguugauuuuccucccugcagagccaauggugcacauugguuuaagcc

SEQ ID NO: 84207 - RNA, 64 nt, Homo Sapiens
caccccaggaggaaaagcccagggucuggggcagcagagccaucgcaucauguuucccagggca

SEQ ID NO: 84208 - RNA, 64 nt, Homo Sapiens
aaucauauaaaaaguguaucaacuugaaacacuacagagccaauguuucucuuucugagaacgu

SEQ ID NO: 84209 - RNA, 64 nt, Homo Sapiens
acucccagccguauugaaaucaggcggagggacacagagccaggcuucagaccuggugcggagc

SEQ ID NO: 84210 - RNA, 64 nt, Homo Sapiens
gaaggggccccaccaccaagccaccacacagugccagagccagaugucugggccgaagcacguc

SEQ ID NO: 84211 - RNA, 64 nt, Homo Sapiens
cuugggaacaugaagcaagugaugauucucccuccagagccacgucuugcccuggagugccgau

SEQ ID NO: 84212 - RNA, 64 nt, Homo Sapiens
gccaagguuugcacucaggguggggucgucuuagcagagccacccucuguccacuugugggucc

SEQ ID NO: 84213 - RNA, 64 nt, Homo Sapiens
ggggcagagggcuuucagcgcccagacagcugcucagagccaagugagaacuccagcuggugcc

SEQ ID NO: 84214 - RNA, 64 nt, Homo Sapiens
aggauagagaaagagacccaacaugauagagggacagagccaaagaaaacuguacucuguccag

SEQ ID NO: 84215 - RNA, 64 nt, Homo Sapiens
agggaaaggggagagggggaucagacauggaggucagagccacaucuccccuacaguuuuaugc

SEQ ID NO: 84216 - RNA, 64 nt, Homo Sapiens
ggucuuggaugagaacaugacuuuuggcaucauucagagccagguuugaauccuggcuauaaaa

SEQ ID NO: 84217 - RNA, 64 nt, Homo Sapiens
agaaauuugcuaggaucacaccacuaauaagcaacagagccaggauucaaacccagguguggcu

SEQ ID NO: 84218 - RNA, 64 nt, Homo Sapiens
auguggcccucaagagccauccccacugccuggccagagccauuguuguccccuacuuccuagg

SEQ ID NO: 84219 - RNA, 64 nt, Homo Sapiens
ccagcuggugguguuaagccagaauuugaccucccagagccaguuuccauuagcugccaugcuc

SEQ ID NO: 84220 - RNA, 64 nt, Homo Sapiens
aaagugguguaaucuccuucucuacaucuguugucagagccacugagugcugugcugcucgacg

SEQ ID NO: 84221 - RNA, 64 nt, Homo Sapiens
cuguugggucaccggcuggaccugcugcagccugcagagccacagucagccugcccacaugcca

SEQ ID NO: 84222 - RNA, 64 nt, Homo Sapiens
uccagccaggccccaagcccacugggguguguggcagagccaggacccaggaggugugauuccu

SEQ ID NO: 84223 - RNA, 64 nt, Homo Sapiens
ccguguaccucaguucccucuugcucagugggggcagagccaccugacucuugcagggguagcc

SEQ ID NO: 84224 - RNA, 64 nt, Homo Sapiens
uuagaaguuccugagggcugccacuccaggaacccagagccacacgaguggagcuucgacccac

SEQ ID NO: 84225 - RNA, 64 nt, Homo Sapiens
gaaucaccggaccuccagcauugaacugcaggggcagagccagucugacagccacuccaggaac

SEQ ID NO: 84226 - RNA, 64 nt, Homo Sapiens
caaaaauaagccacaaccaggaggaaguuaauuucagagccauauagcuacugaggcauaggga

SEQ ID NO: 84227 - RNA, 64 nt, Homo Sapiens
ugccgagcgcgacccugcagagagacagaggaagcagagccaggagggggagccugggugcagc

SEQ ID NO: 84228 - RNA, 64 nt, Homo Sapiens
ggucuguucuguagcagccaagaggagagcgcagcagagccaggcggccacaccagugucccaa

SEQ ID NO: 84229 - RNA, 64 nt, Homo Sapiens
cgggacaccccccgcagcccuuuccccagcaccccagagccagugggugcccgccccacagugc

SEQ ID NO: 84230 - RNA, 64 nt, Homo Sapiens
acuagagcucagggcaucugcacagagcauggggcagagccaggacacgugaccugcacaggau

SEQ ID NO: 84231 - RNA, 64 nt, Homo Sapiens
uuaccuacccugugcauggugaccccaccucuggcagagccacaagaggccucauggcccagga

SEQ ID NO: 84232 - RNA, 64 nt, Homo Sapiens
uagccacuugagaaccagacauuuaaaacuugcucagagccacuaaggguacuugcgaugccgg

SEQ ID NO: 84233 - RNA, 64 nt, Homo Sapiens
ucaugucaugccccaaaguggucuuagggcagcacagagccagguuucauguuccuaaacccau

SEQ ID NO: 84234 - RNA, 64 nt, Homo Sapiens
uacaucgcaauuaccuuaugaaagaaaacauuaucccaguuaccagaaucacuuacucauccua

SEQ ID NO: 84235 - RNA, 64 nt, Homo Sapiens
ggggcucccucucaaauaaaaaaagaaguugcugcccaguuaaaucaguguaauauuaaguuag

SEQ ID NO: 84236 - RNA, 64 nt, Homo Sapiens
ugauauuuaacaccugggaauauugcuuucauuucccaguuaaauucauguuugagaauuuuuu

SEQ ID NO: 84237 - RNA, 64 nt, Homo Sapiens
uugcucugaagacauuucuuagaaaugcagauuucccaguuaucuggguaacaaaaauggcaaa

SEQ ID NO: 84238 - RNA, 64 nt, Homo Sapiens
gagccuguuuggaugauggaugccauuccuuuugcccaguuaaauguucaccaaucauuuuaac

SEQ ID NO: 84239 - RNA, 64 nt, Homo Sapiens
uggagaucuuccuuuaccccucaacuuuaauuugcccaguuauaccucaguguuguagcaguac

SEQ ID NO: 84240 - RNA, 64 nt, Homo Sapiens
ggacaauaucaaauuuacuuagaugcagggacagggaucagaugaaacugacaccaucuuaauu

SEQ ID NO: 84241 - RNA, 64 nt, Homo Sapiens
cucuuucuaagcuuuguaaguaaaaaauauccaaggaucagaguauaaauaauauggauuguuu

SEQ ID NO: 84242 - RNA, 64 nt, Homo Sapiens
accugcgagcuuuaguuuguuucucuaaguggcaggaucagaaaguguccuagucuugccuuuu

SEQ ID NO: 84243 - RNA, 64 nt, Homo Sapiens
aguucuaaggugacucguugagggcugauggugaggaucagagcucccaugagggaagcacgac

SEQ ID NO: 84244 - RNA, 64 nt, Homo Sapiens
uuggggucuucuggccagaguggaucagaccccaggaucagaccaggacccagugccgcaggcc

SEQ ID NO: 84245 - RNA, 64 nt, Homo Sapiens
ccaggaucagaccuugggguagugccgcaggccuggaucagaccagacagucugccuaggaccc

SEQ ID NO: 84246 - RNA, 64 nt, Homo Sapiens
accaggaacauaggaguggaggauucauggagcgggaucagauuauagggaggaugaauuacca

SEQ ID NO: 84247 - RNA, 64 nt, Homo Sapiens
aauaauggaggcaaugguauaggaggauugaggaggaucagaucaucauuuuaggauugucaaa

SEQ ID NO: 84248 - RNA, 64 nt, Homo Sapiens
cugacccuggcccagcucuaggggucucugcccagcacaggaaguccagccugagcccccacca

SEQ ID NO: 84249 - RNA, 64 nt, Homo Sapiens
ccccaggcagucagcagcccugcaacagcugcgugcacaggagcaccuugccugcagaaccagc

SEQ ID NO: 84250 - RNA, 64 nt, Homo Sapiens
uacuccuuuuccuuuuggaucauagcuuaacaaggcacaggaagggaagggaucuugacuaaga

SEQ ID NO: 84251 - RNA, 64 nt, Homo Sapiens
aucugaacauuguuaauggccugugacaugaugagcacaggaacaggcaugaagauauugccau

SEQ ID NO: 84252 - RNA, 64 nt, Homo Sapiens
gaggcuuccuugguuuccaucuagaauauucucagcacaggaauuguggcagcagcaggagcua

SEQ ID NO: 84253 - RNA, 64 nt, Homo Sapiens
cugacacauaguaggcacacuucucccucguacagcacaggaacucauccgcagccugggaacc

SEQ ID NO: 84254 - RNA, 64 nt, Homo Sapiens
uuuugguuuucucuuuucaggcuguuuaacuuaggcacaggagauccacuuuuaaacuugggaa

SEQ ID NO: 84255 - RNA, 64 nt, Homo Sapiens
aucagaucuugugagacuuacuaucacgagaauagcacaggaaagacuggcccccaugauucaa

SEQ ID NO: 84256 - RNA, 64 nt, Homo Sapiens
aucagaucucaugagacuuacuaucaugagaauagcacaggaaagacuggccccccugauucga

SEQ ID NO: 84257 - RNA, 64 nt, Homo Sapiens
agauggccgugugcugugcacagcguccacugcagcacaggaucgaggacggcguggcgaaagu

SEQ ID NO: 84258 - RNA, 64 nt, Homo Sapiens
uucaggugagacccaaguucucaagaaucgaggggcacaggagaccagaggauggacaaguuug

SEQ ID NO: 84259 - RNA, 64 nt, Homo Sapiens
gaaaccaacacccaaagcauggacuaaccccaacgcacaggaaaagguagcuuaccugacacaa

SEQ ID NO: 84260 - RNA, 64 nt, Homo Sapiens
auggcacugauuguuuuagagacuauggagccuggcacaggacugauucugggaugcuccuagu

SEQ ID NO: 84261 - RNA, 55 nt, Homo Sapiens
gguauguccuggugaauuagucucagcacaggaauugaggugggucaggugaagg

SEQ ID NO: 84262 - RNA, 64 nt, Homo Sapiens
caaggcaaaucaagaagacaucaggaaaucagaugcacaggaaauaaaggaaagcugugcuuug

SEQ ID NO: 84263 - RNA, 64 nt, Homo Sapiens
ugaggcgccccaacccguggaggcugcucggggugcacaggagggggucguggagagcuaggag

SEQ ID NO: 84264 - RNA, 64 nt, Homo Sapiens
gaggugcccaggagaagaaagaggugaccccagggcacaggagcuaccuguguggacaggacua

SEQ ID NO: 84265 - RNA, 64 nt, Homo Sapiens
ugacugguaauggaaaaaauaugaauguaacugugcacaggaaaaggaggggggagcagguuuu

SEQ ID NO: 84266 - RNA, 64 nt, Homo Sapiens
gagaaaagugugcgcuccauuaaaauuaauauaggcacaggaaaccacagagauuagggggacu

SEQ ID NO: 84267 - RNA, 64 nt, Homo Sapiens
gagaaaaagaaaucuguugaaaagaagaacguaagcacaggaaagccaugauguacccuccgag

SEQ ID NO: 84268 - RNA, 64 nt, Homo Sapiens
ggcuaccauaacgauauggacucagaucuuauuagcacaggaauucuucaugucccucauccag

SEQ ID NO: 84269 - RNA, 64 nt, Homo Sapiens
aggaggggcgauguggcuggggagcuagggagagacucuggagguggugggucucucgggagac

SEQ ID NO: 84270 - RNA, 64 nt, Homo Sapiens
acuggaaugcaaguccuucuucccuuuggaauguacucuggaucccuuccccugcuuugacccc

SEQ ID NO: 84271 - RNA, 64 nt, Homo Sapiens
acauaagggcugcugugguuuuccucugggcucuacucuggagagucuccgcuggcuuugaauc

SEQ ID NO: 84272 - RNA, 64 nt, Homo Sapiens
uccuuuugcauuaaaaggacuucugucccuggagacucuggaaauggcccagggaagccccugg

SEQ ID NO: 84273 - RNA, 64 nt, Homo Sapiens
ucggaugugguggcaggugccuguagucccagcuacucuggaggcugaggcaggagaauggcgu

SEQ ID NO: 84274 - RNA, 64 nt, Homo Sapiens
aaagaauacaaaugcuccaacauuauuuuuuauaacucuggauuaccgaugcugagaugugugc

SEQ ID NO: 84275 - RNA, 64 nt, Homo Sapiens
uauuaucuccacuuucaaucucccuccaagcucuacucuggaggagucugucccacucugucaa

SEQ ID NO: 84276 - RNA, 64 nt, Homo Sapiens
uuuucuuacucccaaaaaagaaugaacaccccugacucuggagugguguauacugccacaucag

SEQ ID NO: 84277 - RNA, 64 nt, Homo Sapiens
uucucuaauaauaaauaguuccuucuuuuucuggacucuggacuucuuuccacucuggauucag

SEQ ID NO: 84278 - RNA, 64 nt, Homo Sapiens
cagccuucuuuuucuggacuguaucugucuuuccacucuggauucugcacccuccuagggcauu

SEQ ID NO: 84279 - RNA, 64 nt, Homo Sapiens
ucuugcccucuccucaccuccuuuucucucagugacucuggaaccugaaugcagcuuacaagac

SEQ ID NO: 84280 - RNA, 64 nt, Homo Sapiens
ucaggagcuagcagaaaauaacucaaaguugaagacucuggaagauuuugcuuuaaccuaacuc

SEQ ID NO: 84281 - RNA, 64 nt, Homo Sapiens
auguccuguuaaauuuacaacacuaacgauguagacucuggaaaugccuaauaagucaaagaag

SEQ ID NO: 84282 - RNA, 64 nt, Homo Sapiens
cugagguucucuuuuucuuggugcuuuauuagcaacucuggauauuuuuauaaaacuaguuaca

SEQ ID NO: 84283 - RNA, 64 nt, Homo Sapiens
ggguccccacauccagggcgaagagaagaaggggacucuggauagaugggccugugacacccca

SEQ ID NO: 84284 - RNA, 64 nt, Homo Sapiens
ggccugugacaccccaaagauagcccccaguuccacucuggaugacagucuguggccguggucu

SEQ ID NO: 84285 - RNA, 64 nt, Homo Sapiens
cugaggcaggggaauggcuccuguagucccagcuacucuggaggccaggcaugguggugcgcac

SEQ ID NO: 84286 - RNA, 64 nt, Homo Sapiens
gaaacuauaugaauguaagcgcaugaaagaacucacucuggagauggcccaguuuauuucguau

SEQ ID NO: 84287 - RNA, 64 nt, Homo Sapiens
cucugugauccuuugcaggugccaguucucccugacucuggaacgacucuggaaccucugugac

SEQ ID NO: 84288 - RNA, 64 nt, Homo Sapiens
cucugugacgccaguucucccucaguucucccugacucuggaaccauuucacucagcugcuccu

SEQ ID NO: 84289 - RNA, 64 nt, Homo Sapiens
uauuucuuauccaggugguuaaagcauucauaaaggauuauaaaauuuuuuuuuuuuuuuuuuu

SEQ ID NO: 84290 - RNA, 64 nt, Homo Sapiens
ccuagaccuccauucacucuguuucucuucugcuggauuauauaauuuaaaaauaauguguucc

SEQ ID NO: 84291 - RNA, 64 nt, Homo Sapiens
cgugagccaccgugccuggccuuccagagugcugggauuauaggagugauccaccuaccuaggc

SEQ ID NO: 84292 - RNA, 64 nt, Homo Sapiens
cgugcaccaccaugcccagccuccugaguagcugggauuauaggagcaauucuccugccucagc

SEQ ID NO: 84293 - RNA, 64 nt, Homo Sapiens
agcgauucuccugccccagccucccauauagcugggauuauaggugccugccaccaugcccagc

SEQ ID NO: 84294 - RNA, 64 nt, Homo Sapiens
agcgauucuccuguaucagccucccaaguagcugggauuauaggcaugugccaccaugcccagc

SEQ ID NO: 84295 - RNA, 64 nt, Homo Sapiens
gccuuucuauaagcaaauuaaggaagaaaagguaggauuauaagauuucucaauggggaugauu

SEQ ID NO: 84296 - RNA, 64 nt, Homo Sapiens
aagugaucucccacuucagccucccgaguaucugggauuauaagcaagagccacugcucccagc

SEQ ID NO: 84297 - RNA, 64 nt, Homo Sapiens
cgugauccgcccgccucagccuuccaaaguguugggauuauaggcgugagccaccgcgcccagc

SEQ ID NO: 84298 - RNA, 64 nt, Homo Sapiens
agccaucccccaaccuuggccucucgaguagaugggauuauaggcaugugccacggugccugac

SEQ ID NO: 84299 - RNA, 64 nt, Homo Sapiens
uuaaguuccacagauuuuucuguugggcagccaaggauuauaaaccacuucccuaaaggcaaca

SEQ ID NO: 84300 - RNA, 64 nt, Homo Sapiens
ugaauauguaaaggguuuguuuuguauacaaaugggauuauacuaaaauaaguaaugccuauuu

SEQ ID NO: 84301 - RNA, 64 nt, Homo Sapiens
cuuaaaaauagucauuuuucuuauaaagacaaauggauuauagauacuuagaugccagucuacu

SEQ ID NO: 84302 - RNA, 64 nt, Homo Sapiens
aaaauacuuaaauuuguguucacaauuaugagauggauuauaauccuuugucagaaaguauucu

SEQ ID NO: 84303 - RNA, 64 nt, Homo Sapiens
aguaauucccagccauacucguucugacuuucugggauuauaaugggacuuuggcacccaagga

SEQ ID NO: 84304 - RNA, 64 nt, Homo Sapiens
uccuuucuguaccaauuucuuaguaauauuuuugggauuauacuaaauuuucucuggauuguuu

SEQ ID NO: 84305 - RNA, 64 nt, Homo Sapiens
agugauccacucgcuucggccucccaaagugcugggauuauaggcgugagccacugugcccagc

SEQ ID NO: 84306 - RNA, 64 nt, Homo Sapiens
aaagauccacccaccucggccucccaaagugcugggauuauaggcaugaaccaccguguccggc

SEQ ID NO: 84307 - RNA, 64 nt, Homo Sapiens
aaagcaacuucugcuucagugauugaggacuucaccccuugauuagguuaagugagguccccuu

SEQ ID NO: 84308 - RNA, 64 nt, Homo Sapiens
gaggacuucaccccuugauuagguuaagugagguccccuugauuggcugagaccccaccaccaa

SEQ ID NO: 84309 - RNA, 64 nt, Homo Sapiens
gcucaucucucugaauaacauuuaaaaggggcagccccuugauggaucacucuuuuuuuuuuuu

SEQ ID NO: 84310 - RNA, 64 nt, Homo Sapiens
cagagagauccuguucccuauccaggagacauccccccuugaggugcucagcccacaccagacc

SEQ ID NO: 84311 - RNA, 64 nt, Homo Sapiens
ucuucacucuucaaaugccuggcuugggcagcauccccuugaacccuaaauauuaugagaugcu

SEQ ID NO: 84312 - RNA, 64 nt, Homo Sapiens
acuggcaggcaggcucccagagggaggcccugugccccuugacaccaggcuguguuuggcuuuc

SEQ ID NO: 84313 - RNA, 64 nt, Homo Sapiens
cuggcauucuggaagacacggcuaauaucucuguccccuugaucgguguagucaacaaagcugu

SEQ ID NO: 84314 - RNA, 64 nt, Homo Sapiens
acacagcauccacucuccugucaugggacacacaccccuugacccugaagaagcagagccugua

SEQ ID NO: 84315 - RNA, 64 nt, Homo Sapiens; identical to SEQ ID NO: 45658

SEQ ID NO: 84316 - RNA, 64 nt, Homo Sapiens; identical to SEQ ID NO: 45659

SEQ ID NO: 84317 - RNA, 64 nt, Homo Sapiens; identical to SEQ ID NO: 45660

SEQ ID NO: 84318 - RNA, 64 nt, Homo Sapiens; identical to SEQ ID NO: 45661

SEQ ID NO: 84319 - RNA, 64 nt, Homo Sapiens; identical to SEQ ID NO: 45662

SEQ ID NO: 84320 - RNA, 64 nt, Homo Sapiens; identical to SEQ ID NO: 45663

SEQ ID NO: 84321 - RNA, 64 nt, Homo Sapiens
uucaaagucccuauccaggucacuccagaaaaggguauugaaacguugaaaucuaaagcaaauu

SEQ ID NO: 84322 - RNA, 64 nt, Homo Sapiens
auuaaacagagaacuugccauguugagugccauuguauugaacuuauucuaaaggcuuaugcua

SEQ ID NO: 84323 - RNA, 64 nt, Homo Sapiens
ggcaggugggcucuguaaguacagagaugacacaguauugaaauauucucauauacccagauuu

SEQ ID NO: 84324 - RNA, 64 nt, Homo Sapiens
uacuaaauuauaacuaaaaggucaauuagugaaaguauugaaaaaaaucuugaacauuuaugau

SEQ ID NO: 84325 - RNA, 64 nt, Homo Sapiens
aaacaaauuuaccaaaagcacuaucugauuauuuguauugaagaacacaaagcaauuauucuuc

SEQ ID NO: 84326 - RNA, 64 nt, Homo Sapiens
aucccacgcuaugguucauaacacauaagaaacaguauugaaaaaaaccuuucuuuuguuuuuu

SEQ ID NO: 84327 - RNA, 64 nt, Homo Sapiens
uaaaaccaaauauuaguuuuuauuugaaaggaugguauugaauccuaccaaguuucauaccaaa

SEQ ID NO: 84328 - RNA, 64 nt, Homo Sapiens
gcaggugacuuuggcagagaaacaaucaaaucugguauugaacucuuuaggaugaccguuucuu

SEQ ID NO: 84329 - RNA, 64 nt, Homo Sapiens
gucuaguucuaguaugguaacuauucuugaaaugguauugaaaaauaccguuaauucaaauuga

SEQ ID NO: 84330 - RNA, 64 nt, Homo Sapiens
cauuuauuacuaacauagcuuuaaaucuuuaaauguauugaagcauugugcugucugaaaauaa

SEQ ID NO: 84331 - RNA, 64 nt, Homo Sapiens
ugaaauuauuuugcaugcugcugcagccuuuaaaguauugaaguaacuggagaauugccaauac

SEQ ID NO: 84332 - RNA, 64 nt, Homo Sapiens
auuggccaguagcuaagaagugggcuuuuaaagaguauugaagauugaaaggguuuuucuuucu

SEQ ID NO: 84333 - RNA, 64 nt, Homo Sapiens
auagaaugaagaaacagucuuuaacagaaaaaagguauugaaauauuaaauggccaccaaguuu

SEQ ID NO: 84334 - RNA, 64 nt, Homo Sapiens
uguauguaugcuuaauacgugucggucauauacaguauugaauuuuuacuguauaguaauucug

SEQ ID NO: 84335 - RNA, 64 nt, Homo Sapiens
gacccagucuccuuuugucugucuguuccaugcagucacucagggacuaaggguagggguauaa

SEQ ID NO: 84336 - RNA, 64 nt, Homo Sapiens
gacccagacuuacagaguggaacccuuuucugcagucacucagggcugugagcaggucagcagg

SEQ ID NO: 84337 - RNA, 64 nt, Homo Sapiens
uauuauaauagagagauuaaguaacuugccugaggucacucagcucauaaauugcacuuuaggg

SEQ ID NO: 84338 - RNA, 64 nt, Homo Sapiens
gcucauaaauugcacuuuagggauugugcacucagucacucagcuauucugacucuccagcacc

SEQ ID NO: 84339 - RNA, 64 nt, Homo Sapiens
agguuccuugcauuugcugccuuuugucuuggaggucacucagcucugaaugcugcuccacugu

SEQ ID NO: 84340 - RNA, 64 nt, Homo Sapiens
caaaucugucugcugcucccagugacccugcagagucacucagcacagucuuccuugccuuuag

SEQ ID NO: 84341 - RNA, 64 nt, Homo Sapiens
gaacaaugagcacuugaagaguuaccucaagugagucacucagguauggucauguauguaggcu

SEQ ID NO: 84342 - RNA, 64 nt, Homo Sapiens
cuggaguacaguggcacaaugauggucuugcucugucacucaggacauuuuuguguuuuuagga

SEQ ID NO: 84343 - RNA, 64 nt, Homo Sapiens
caucugaccacugggcaccuuagugccaaccugaaccaaagagaccuccuuguuucagcugggc

SEQ ID NO: 84344 - RNA, 64 nt, Homo Sapiens
ugugggaacaagagaugacuuugaggauaaaaggaccaaagaaaaagcuuuacuuagaugauug

SEQ ID NO: 84345 - RNA, 64 nt, Homo Sapiens
gggcaccugcuggaguccggcugugcuuucugggaccaaagaauaguuccugauuccaagucac

SEQ ID NO: 84346 - RNA, 64 nt, Homo Sapiens
uauccaagugcuuccuccaacuuucccugaagcaaccaaagauaguaauuuuaaggggccaaag

SEQ ID NO: 84347 - RNA, 64 nt, Homo Sapiens
aaguccuauaauguggaagaaacaaacaguugcuaccaaagauucuucaaauaaacauacaaau

SEQ ID NO: 84348 - RNA, 64 nt, Homo Sapiens
aauuggccugaauauucucuuggggaaagagggcaccaaagaaaaggguaagugcaucugaggg

SEQ ID NO: 84349 - RNA, 64 nt, Homo Sapiens
caucagagccagaaaugcccucccuagguccaggaccaaagauaaaacaaacacgaggaacaug

SEQ ID NO: 84350 - RNA, 64 nt, Homo Sapiens
gugcuaccauauggagccuaaggauaaagccaauaccaaagaaaacagugacuaaacagagaga

SEQ ID NO: 84351 - RNA, 64 nt, Homo Sapiens
aguuuugccuuaauuuuuuaaguacugcaccaaaaccaaagagcugaccugacuucuguggaac

SEQ ID NO: 84352 - RNA, 64 nt, Homo Sapiens
cucaacauaacuaugaaaucauagcucuguuuucaccaaagaacagaccaauuaacauacuuau

SEQ ID NO: 84353 - RNA, 64 nt, Homo Sapiens
uuuuuguaugcuuaaauaaaaauaaaaauucauaaccaaagagaaucccacauuagcuuguuag

SEQ ID NO: 84354 - RNA, 64 nt, Homo Sapiens
ggugcaguccagacagcuugacugcuuuuaaaugaccaaagaugaccugugguaagcaaccugg

SEQ ID NO: 84355 - RNA, 64 nt, Homo Sapiens
uagggcaagagaggcaggugggaaauuuauagcaaccaaagaaaauccagauauuugagaagca

SEQ ID NO: 84356 - RNA, 64 nt, Homo Sapiens
gaagccaaauagguagccaaagacagauauaaacaccaaagacgcagagagaccugcuaaaacc

SEQ ID NO: 84357 - RNA, 64 nt, Homo Sapiens
uaauagacaacuccagauugacauugacugcuuaaccaaagaaauugaucuuuuucaagcccga

SEQ ID NO: 84358 - RNA, 64 nt, Homo Sapiens
ucuuucuuacagaucaaagguccaucaucaaaacaccaaagacucaagacacagaagaugauga

SEQ ID NO: 84359 - RNA, 64 nt, Homo Sapiens
ggcugccucccuuccucagcccauuagguuaaacaccaaagaaagacugguguguacugaauag

SEQ ID NO: 84360 - RNA, 64 nt, Homo Sapiens
uuauuuggaaccuucuaagaggaaaucaaccaggaccaaagagccuuaaaggacacacagcaau

SEQ ID NO: 84361 - RNA, 64 nt, Homo Sapiens
augcccuucuccuuauuguaggacuauggagugcaccaaagagaaucagcucaggacugccauu

SEQ ID NO: 84362 - RNA, 64 nt, Homo Sapiens
aaaguccacccuugguuccuaaaagggccaaagaaccaaagaagcugccccagcuggggaaauc

SEQ ID NO: 84363 - RNA, 64 nt, Homo Sapiens
ucugaaauauauaguaaauguggggagaaccccaaccaaagaaacaagaaauauuaauaccaca

SEQ ID NO: 84364 - RNA, 64 nt, Homo Sapiens
cauccaagcaauaaaguggacaaccuuaaccaacaccaaagaaaauaaagcaaaaagcaggcca

SEQ ID NO: 84365 - RNA, 64 nt, Homo Sapiens
caccuuuccagaaaaaagucaauuguucagguacaccaaagaggaagaagagcuguggaggcca

SEQ ID NO: 84366 - RNA, 64 nt, Homo Sapiens
ccuggcacacuggggucugcacaaggcuuugucaaccaaagacagcuucccccuuuugauugcc

SEQ ID NO: 84367 - RNA, 64 nt, Homo Sapiens
ucucaaauuuuaaguuaaacuaccuaaaauaaauaccaaagauaaugcauauuuuugcacagug

SEQ ID NO: 84368 - RNA, 64 nt, Homo Sapiens
gcuauuaugauguuuugcaaaggaaaauaaucaaaccaaagaguauucagugauauguaaauua

SEQ ID NO: 84369 - RNA, 64 nt, Homo Sapiens
cuuugauugaauucccuuuucugguuugggaaauaccaaagaggaauguucauuuaucaaaaau

SEQ ID NO: 84370 - RNA, 64 nt, Homo Sapiens
uucagggaaacuccaguauaaccaaugggaauggaccaaagagucguguuucguaagcccaggc

SEQ ID NO: 84371 - RNA, 64 nt, Homo Sapiens
cuggugugcauggggcagcaccaacggcagccaaaccaaagacaggaccagaggucauaggugc

SEQ ID NO: 84372 - RNA, 64 nt, Homo Sapiens
agauggaccggcucuugcucgcuuaggagaccucaccaaagagacgggcagaugguggaaggca

SEQ ID NO: 84373 - RNA, 64 nt, Homo Sapiens
gaaauggagaguagugagcaaaacaucagauuucaccaaagaaccaaagugacuccacaauugg

SEQ ID NO: 84374 - RNA, 64 nt, Homo Sapiens
aggggaaacugcacuuagacugacagaauugaacaccaaagaauuugcuggcuuccaaauuggg

SEQ ID NO: 84375 - RNA, 64 nt, Homo Sapiens
agcgcuuuaugcccaugaugucauuucaggcucaaccaaagaggaucaaacaggaauuccaucu

SEQ ID NO: 84376 - RNA, 64 nt, Homo Sapiens
uuucagcugagaacagauuugacucacagacauuaccaaagaggagcuugugaauccaggaaaa

SEQ ID NO: 84377 - RNA, 64 nt, Homo Sapiens
augccuauaauuccagcacuuugggaggccaaggcagaaggaucacuugagaccaggaguucaa

SEQ ID NO: 84378 - RNA, 64 nt, Homo Sapiens
ggugugguggcaugcgcauguagucccagcuacucagaaggaugaggugggaggaucucuugag

SEQ ID NO: 84379 - RNA, 64 nt, Homo Sapiens
cuggcugaagggaauuaacagauaguaucaagcgcagaaggaaugugccaguauggcucccugg

SEQ ID NO: 84380 - RNA, 64 nt, Homo Sapiens
aagaagcauaagcaagacaaaaacagagagaccgcagaaggaggaagauacugugguacuguca

SEQ ID NO: 84381 - RNA, 64 nt, Homo Sapiens
aacauggucaccaucuaacuaguuuucauuaauccagaaggauggcagcuuugacugcuuucca

SEQ ID NO: 84382 - RNA, 64 nt, Homo Sapiens
ugcucagggcuccugggggguguacaggcaauggcagaaggagagaugugaaaagccuccaagc

SEQ ID NO: 84383 - RNA, 64 nt, Homo Sapiens
cugccauauugugaaaaacuuuaguggacaagggcagaaggaagagggaagaccuguuaggaag

SEQ ID NO: 84384 - RNA, 64 nt, Homo Sapiens
cugaaugcacuugguuuauuguugggggugcucucagaaggaaccugugaaagccuuuaucagu

SEQ ID NO: 84385 - RNA, 64 nt, Homo Sapiens
ucugugugcaucaaccgagcgaggggcagcugaacagaaggauggaggcaugucugagccacuu

SEQ ID NO: 84386 - RNA, 64 nt, Homo Sapiens
aggugcuguuggcaauugcagagcaagaggccaucagaaggacgugugcccucagggacuggca

SEQ ID NO: 84387 - RNA, 64 nt, Homo Sapiens
aacuggcuugccuguggaccacaacaacaacaaacagaaggauaaaacaacaacaacaacaaca

SEQ ID NO: 84388 - RNA, 64 nt, Homo Sapiens
gguagaaaaaaacacacauuguucuugaacauuucagaaggaguguugugacggauguauggau

SEQ ID NO: 84389 - RNA, 64 nt, Homo Sapiens
aaauaugucugccaaguuguuagaaucuuugaaucagaaggaaaaaaagcagcgcugguugaca

SEQ ID NO: 84390 - RNA, 64 nt, Homo Sapiens
ucccaaccugagauuuguaguccaggauuacaaccagaaggaaaguaugacagauuucuacuua

SEQ ID NO: 84391 - RNA, 64 nt, Homo Sapiens
agcacugaacgauuucaagcccuacgcaccagaacagaaggaggguggaggaagugaucagagg

SEQ ID NO: 84392 - RNA, 64 nt, Homo Sapiens
ccggugggggcugggcucccgugagguccuagggcagaaggaggugcuugcagggccucucgcu

SEQ ID NO: 84393 - RNA, 64 nt, Homo Sapiens
agucagcaaggaagccgggugucgcucacacaaccagaaggagcugaguuuggcaacaacccaa

SEQ ID NO: 84394 - RNA, 64 nt, Homo Sapiens
ggugcguggcuucccuguccuuugauucaaggcucagaaggaauugcuuucugcuuaguauuuu

SEQ ID NO: 84395 - RNA, 64 nt, Homo Sapiens
gugagugccuuucccuccuacuuuccucaaaaagcagaaggagagcggagcugcugagugacag

SEQ ID NO: 84396 - RNA, 64 nt, Homo Sapiens
gcaggaguguccuggcuguggagaucugcacagucagaaggacgccaaaccaggacacuacccu

SEQ ID NO: 84397 - RNA, 64 nt, Homo Sapiens
cccagacaucccgaggaaguggggagagacaccacagaaggagagcgggcuggcggcaguccca

SEQ ID NO: 84398 - RNA, 64 nt, Homo Sapiens
cugcuccaccuggggggacuuccagaaaugcagucagaaggacccaggcaacuucgagaacgga

SEQ ID NO: 84399 - RNA, 64 nt, Homo Sapiens
ggcuugucugccagcucacagaggucgucacacucagaaggacacgccugugucagguguggau

SEQ ID NO: 84400 - RNA, 64 nt, Homo Sapiens
aaguuagugcuuacauuuuauucuguggaagaugcagaaggaggagaaugcccacaaguggguc

SEQ ID NO: 84401 - RNA, 64 nt, Homo Sapiens
cagauuuggcugcccaagaaucuuccuggcugcucagaaggagguuuccagaaggaacgagcca

SEQ ID NO: 84402 - RNA, 64 nt, Homo Sapiens
gagccaucuuccuggcugcuagcuugcagcuuuccagaaggaacuugcagccucaguucagaag

SEQ ID NO: 84403 - RNA, 64 nt, Homo Sapiens
cauuucauuauuucugcuuccugggggaaggaugcagaaggagucugaugcucaacaucccuua

SEQ ID NO: 84404 - RNA, 64 nt, Homo Sapiens
caaaggagaguccugggagcccacaagauccaggcagaaggagauggguuuggggcuggcccca

SEQ ID NO: 84405 - RNA, 64 nt, Homo Sapiens
augccuguaaucucagcacuuugggaggcugaggcagaaggauuaccugaggcaaggaguuuga

SEQ ID NO: 84406 - RNA, 64 nt, Homo Sapiens
acaucucaucucaggaaguggugguggggguagucagaaggaaaaauaacuggacaucuuugug

SEQ ID NO: 84407 - RNA, 64 nt, Homo Sapiens
caccucaacacaucccuucagugacucagagucucagaaggaaacccugacuccuggggccauu

SEQ ID NO: 84408 - RNA, 64 nt, Homo Sapiens
auggcaacauggaauauuguccuccaugccccuccagaaggaccuaggagaguaggugagcuuu

SEQ ID NO: 84409 - RNA, 64 nt, Homo Sapiens
cuuuaggaguauaugugggcaacauuuacuuugccagaaggagcccagauauaggcugaacaga

SEQ ID NO: 84410 - RNA, 64 nt, Homo Sapiens
gacuggugaaaagauguaucuggaacagagacaucagaaggaaaaaugagagucuguaugauuc

SEQ ID NO: 84411 - RNA, 64 nt, Homo Sapiens
cguggacuugaucauggacuggugccuuugcauucagaaggagagcugucagcguagcaccgaa

SEQ ID NO: 84412 - RNA, 64 nt, Homo Sapiens
ccgaucugggacugaaacgcuuacaccucugccucagaaggagucccccaugcccugccugaaa

SEQ ID NO: 84413 - RNA, 64 nt, Homo Sapiens
acaccagcucucagggcagagauuggcuuggggccagaaggacccuccccaacccuggagacac

SEQ ID NO: 84414 - RNA, 64 nt, Homo Sapiens
ucauaacaugaauugauggucaauuucccuucagcagaaggaaaaggugauuuagaucaguagc

SEQ ID NO: 84415 - RNA, 64 nt, Homo Sapiens
cgaagcaggguuugaggguuggguggauggagcucagaaggaaaccccagccccaccacggaug

SEQ ID NO: 84416 - RNA, 64 nt, Homo Sapiens
ccauccccagcaugggcaaggccagccuuucuggcagaaggagcuguccucaacucagggccgc

SEQ ID NO: 84417 - RNA, 64 nt, Homo Sapiens
cccacugugcacagguuugagaggacaaguucaucagaaggaaggcaguccuuagaagucacau

SEQ ID NO: 84418 - RNA, 64 nt, Homo Sapiens
ggugaacauguuugugggccuuuugacugaguggcagaaggaaacugcucaggaagagaaacag

SEQ ID NO: 84419 - RNA, 64 nt, Homo Sapiens
gaaagaaagaugggaggaagagaaagcaaaggaacagaaggaagagaaggaaggagggaagaaa

SEQ ID NO: 84420 - RNA, 64 nt, Homo Sapiens
gagggaagaaaagaaagcaaaaggaagggaagggcagaaggaagggaggcggagaggggagaag

SEQ ID NO: 84421 - RNA, 64 nt, Homo Sapiens
uuugauuucaccauuaagaacuuacucauuugcuagguuguaaauuuaauuuuuaaaagauauu

SEQ ID NO: 84422 - RNA, 64 nt, Homo Sapiens
aaccuuaaggacucguuaccuauggacccauacuagguuguacauucuacuacaguuuuuuccu

SEQ ID NO: 84423 - RNA, 64 nt, Homo Sapiens
uuuuagggaacggggaguggauccaggacaggggagguuguaaccccugagaaaugaacauugg

SEQ ID NO: 84424 - RNA, 64 nt, Homo Sapiens
agugaagcccacagaaaauaaguagcuccuccacagguuguaagcuaggucuagcugacugcaa

SEQ ID NO: 84425 - RNA, 64 nt, Homo Sapiens
uaugccucugaaaauuuuauuaguuuauucuuguggagaauaccaagaaaauguguauuugccc

SEQ ID NO: 84426 - RNA, 64 nt, Homo Sapiens
uguauuuauuugucccaagugucuuuuuguaagaggagaauaaacaauaaggaauuacugauca

SEQ ID NO: 84427 - RNA, 64 nt, Homo Sapiens
cuaauaaacuuguaucgaggauaaacuuguauauggagaauaaauuugcugcuauucugggaga

SEQ ID NO: 84428 - RNA, 64 nt, Homo Sapiens
cuuguauauggagaauaaacuugcugcuauucugggagaauaaaacauccaauucaaguuuuau

SEQ ID NO: 84429 - RNA, 64 nt, Homo Sapiens
caaguuuuccagaucauuccuacaaaguaaacugggagaauaauaagucugaaagaguguggag

SEQ ID NO: 84430 - RNA, 64 nt, Homo Sapiens
ucacauuaugaucuugacaggugcacuuuacuggggagaauaaaaaggaccauacgguaaagcu

SEQ ID NO: 84431 - RNA, 64 nt, Homo Sapiens
caacauuuuccuaucaugaaaucucuuucagagaggagaauacaacaucuuaguccagacauuu

SEQ ID NO: 84432 - RNA, 64 nt, Homo Sapiens
acuacuaaaaauaaauauuuuuggagauuaaaauggagaauagaaguaauuacauuauuuaggu

SEQ ID NO: 84433 - RNA, 64 nt, Homo Sapiens
cauuuucauucagcuaucugcuccaaaguacaagggagaauaccugggaguaggaaacgaugga

SEQ ID NO: 84434 - RNA, 64 nt, Homo Sapiens
gauagaugauauacuagauucuugccacaauauuggagaauaauuuuuacuugcggugacuauu

SEQ ID NO: 84435 - RNA, 64 nt, Homo Sapiens
auucccugacaaacauugcuuaggaaagagggccggagaauaagaagccagcaccucaucaguc

SEQ ID NO: 84436 - RNA, 64 nt, Homo Sapiens
gccuguaaucccagcuacucaagaggcugaggcaggagaauagcuugaacccgggaggcagagg

SEQ ID NO: 84437 - RNA, 64 nt, Homo Sapiens
aauuuuucuuccucuccacuucuuagaggcauucaguuagcaaagagguuggagcaacaacuuu

SEQ ID NO: 84438 - RNA, 64 nt, Homo Sapiens
gggaaguguguuuagaaggguucaggacuuugugaguuagcaugacccuaaaauucuaggggau

SEQ ID NO: 84439 - RNA, 64 nt, Homo Sapiens
uuuuaaagguaauuuucuaagcauaccuuuggaauuuuuccaucuuuuuugaggcuuuuggucc

SEQ ID NO: 84440 - RNA, 64 nt, Homo Sapiens
caacccucaguuaugauacuuaugugcguguuuuuuuuuccaaaguuuuucccaaggagaagau

SEQ ID NO: 84441 - RNA, 64 nt, Homo Sapiens
agcuauuuuuuguuuuuguucuuuucguuuuuuuuuuuuccaaaaauagugacuuccuucucca

SEQ ID NO: 84442 - RNA, 64 nt, Homo Sapiens
cuuaguagaugagagaguucuaggcuacuguggcuuuuuccaguagauuuagaugagauuaugu

SEQ ID NO: 84443 - RNA, 64 nt, Homo Sapiens
uccuguuauugguaguucugaacguuagauauuuuuuuuccauggggucaaaagguaccuaagu

SEQ ID NO: 84444 - RNA, 64 nt, Homo Sapiens
ggaaaaauaggggacagaaaucagguauuggcaguuuuuccauuuucauuugugugugaauuuu

SEQ ID NO: 84445 - RNA, 64 nt, Homo Sapiens
gaagagucgaguccucugaguccuuuggcauccauuuuuccaaaguuaaaccuucuuuaucucc

SEQ ID NO: 84446 - RNA, 64 nt, Homo Sapiens
caugucacuaauugugaauucuauugugaucuauuuuuuccagcuuuuuuucuuccauaaacua

SEQ ID NO: 84447 - RNA, 64 nt, Homo Sapiens
ugaaauguauuaacacaccugggaucugaccuuuuuuuuccaguacuccuaacaacauuuucgg

SEQ ID NO: 84448 - RNA, 64 nt, Homo Sapiens
gcaguuaacccaacuccuaaaaauauuuccauuguuuuuccaaauuucaguacaacuggaauuu

SEQ ID NO: 84449 - RNA, 64 nt, Homo Sapiens
uguuugugacaucucuuauuaugagcauggaauguuuuuccauuacaaagcugugcuccuauuc

SEQ ID NO: 84450 - RNA, 64 nt, Homo Sapiens
uugcccaagcuggucuugaauuuguagagauguguuuuuccaugcaguuaauuuuuuguauuug

SEQ ID NO: 84451 - RNA, 64 nt, Homo Sapiens
uuguagacaaaugaaauuugacuucuuaacuuguuuuuuccauguaagggcugaaaggugcucu

SEQ ID NO: 84452 - RNA, 64 nt, Homo Sapiens
uuaagaacaaaugccauuaguaugcaagaaauuguuuuuccauguauacacuaugauuagaaaa

SEQ ID NO: 84453 - RNA, 64 nt, Homo Sapiens
uuucguuugaauuuucuuucuaaugauuuacuuauuuuuccaaaguuuucauuuagugcuuuga

SEQ ID NO: 84454 - RNA, 64 nt, Homo Sapiens
gaagugagggaauauuucagauauauaauacauuuuuuuccaugagaauguuucaaaugcuuaa

SEQ ID NO: 84455 - RNA, 64 nt, Homo Sapiens
gaauauuuuuaguuuucuguaaauuaucaguuauuuuuuccagucuccuuagaaaaauggcaac

SEQ ID NO: 84456 - RNA, 64 nt, Homo Sapiens
gacgcauucccuguggacaguugacagcuuuuuuuuuuuccauauaccugauagucuguguaca

SEQ ID NO: 84457 - RNA, 64 nt, Homo Sapiens
caauuauuucagcgcagguaucacccacgagaaauuuuuccagaguuucacaggcauuuuugga

SEQ ID NO: 84458 - RNA, 64 nt, Homo Sapiens
cucuuuuuugguuccauaugaacuuuaaaguaguuuuuuccaauucugugaagaaagucaucgg

SEQ ID NO: 84459 - RNA, 64 nt, Homo Sapiens
aaagaauaaaauauuuuggaugaauauuaauggcuuuuuccauuuuuaaugugaucccuucauu

SEQ ID NO: 84460 - RNA, 64 nt, Homo Sapiens
agugaagggacauucucuacugggagccaguggauuuuuccagcuucagaccauuuucuuuucu

SEQ ID NO: 84461 - RNA, 64 nt, Homo Sapiens
acaaaaagaugucucagguuauaagcaaauugcuuuuuuccaaauaugucaaagcuuugacucu

SEQ ID NO: 84462 - RNA, 64 nt, Homo Sapiens
uccucuuuugugcugcuucuaguaaaauucaguuuuuuuccaguucacaucuucggagaugagg

SEQ ID NO: 84463 - RNA, 64 nt, Homo Sapiens
cugccaaucauauugggaaacaaggaaagggacuuuuuuccagugcacacaggacaccagucuu

SEQ ID NO: 84464 - RNA, 64 nt, Homo Sapiens
agcgucgaagacucucuuucgguuuuguaguugauuuuuccaagggaacugcugauuuucggug

SEQ ID NO: 84465 - RNA, 64 nt, Homo Sapiens
uacuggaaauuccaaauuugauuuuauuuuuguuuuuuuccaauugggauuuuucaauuuuauu

SEQ ID NO: 84466 - RNA, 64 nt, Homo Sapiens
aguauuguuaccugcuugaaaagcuuccuauuuuuuuuuccaguguaauaaacuacugcauuuu

SEQ ID NO: 84467 - RNA, 64 nt, Homo Sapiens
acugcuaccacaacuauauuguggcuguaucuuguuuuuccacuuuuuacauacugcugucuau

SEQ ID NO: 84468 - RNA, 64 nt, Homo Sapiens
cacuuuuuugaguggaugauucucucuccuguacuuuuuccagaacauuugcgaaugguuccau

SEQ ID NO: 84469 - RNA, 64 nt, Homo Sapiens
guccuuccugauucaugccugauauugggauuuuuuuuuccagccuucuugaugccaaggggcu

SEQ ID NO: 84470 - RNA, 64 nt, Homo Sapiens
uaacaaugcuuucuauguucauauacuguuuaccuuuuuccauggagucuccuggcaaagaaua

SEQ ID NO: 84471 - RNA, 64 nt, Homo Sapiens
caguacauuccauucaugcaguagauaugaaggcuuuuuccaaguuugucauauaaaguaauca

SEQ ID NO: 84472 - RNA, 64 nt, Homo Sapiens
uuugauauucauauccuggaaguauacauauuuguuuuuccaaaguuuuauaugcagguuuuug

SEQ ID NO: 84473 - RNA, 64 nt, Homo Sapiens
uuuguguauuuccuuuucugcuauuucuuuucaguuuuuccaaagucaagagucuuaaccuugu

SEQ ID NO: 84474 - RNA, 64 nt, Homo Sapiens
guccugccaccuucuaguucaucccauaggaauguuuuuccaaguccuuccagucuuuuuagaa

SEQ ID NO: 84475 - RNA, 64 nt, Homo Sapiens
cucaggugcugcuggugugagccaaagacuggaguuuuuccagcuggggugggaguggagagac

SEQ ID NO: 84476 - RNA, 64 nt, Homo Sapiens
acuguuugacacccuccuuagagggcugcucuuuuuuuuccagagauaauccuagccauccucu

SEQ ID NO: 84477 - RNA, 64 nt, Homo Sapiens
cuuauauguguauugcuaaucauuaagguauuauuuuuuccacauauaaagcuuugucuuuuug

SEQ ID NO: 84478 - RNA, 64 nt, Homo Sapiens
aacuuucuuuugauuaguguuuuugugguauaucuuuuuccaucauguuacuuuaaauauaucu

SEQ ID NO: 84479 - RNA, 64 nt, Homo Sapiens
aaccguuaacaucacugcuguggccucauacucuuuuuuccauuuucuacaagaagccuuuuag

SEQ ID NO: 84480 - RNA, 64 nt, Homo Sapiens
aaccagugaauuuucaggaauuuaaaaauuagcuuuuuuccacuuaaaggagaaaaauauuugg

SEQ ID NO: 84481 - RNA, 64 nt, Homo Sapiens
gaaaucagugucuuuuacgucguacugcacuuuguuuuuccaaguguggugacuccuuuauauu

SEQ ID NO: 84482 - RNA, 64 nt, Homo Sapiens
ugugaaccuugagugauacuuauuuuuuagcuauuuuuuccaugagugagaauuuauuauagau

SEQ ID NO: 84483 - RNA, 64 nt, Homo Sapiens
accuguucugauuuagcucuaaaaugcaauaaaauuuuuccaaacagugcuuccacauggaaac

SEQ ID NO: 84484 - RNA, 64 nt, Homo Sapiens
ucaaaaugccuuauacaaucguguaggaaagacguuuuuccagucugugauuauuuggaagagu

SEQ ID NO: 84485 - RNA, 64 nt, Homo Sapiens
uuauagguccaguuugaagcauucugacuucugguuuuuccacccugaaaggaaauguuuuucu

SEQ ID NO: 84486 - RNA, 64 nt, Homo Sapiens
auuucagaaacuuaguuuuuagaauaaauauuaauuuuuccacuucaguuuuauucuagaaaau

SEQ ID NO: 84487 - RNA, 64 nt, Homo Sapiens
auuuauuaugcccaaaucaaccucugaaaaaagguuuuuccaggaagauuuacauuuagguuua

SEQ ID NO: 84488 - RNA, 64 nt, Homo Sapiens
acacaugcuaugagcacuccaggaaacacuauauuuuuuccaaaaaauaugugauuauauaugu

SEQ ID NO: 84489 - RNA, 64 nt, Homo Sapiens
ugccaauucuacauguauugcccuugccgggccuuuuuuccaccaaagugagcgauuaguugag

SEQ ID NO: 84490 - RNA, 64 nt, Homo Sapiens
uuuucuugucgcuuguuuuuccacuucugcgauauuuuuccacauaguccccuaaagguauuaa

SEQ ID NO: 84491 - RNA, 64 nt, Homo Sapiens
aaaacucggaucuuuuaaaaagcaucauagaucauuuuuccauaugacacugguuccgauuuua

SEQ ID NO: 84492 - RNA, 64 nt, Homo Sapiens
cuucacuauuuucagaaguuuuuguucuuuuuuuuuuuuccaucacucaguggagaaaagcuuu

SEQ ID NO: 84493 - RNA, 64 nt, Homo Sapiens
gauauggaggcaaggggaacaaagagcaugagucuuuuuccaagaaaacuggugaguuaaguaa

SEQ ID NO: 84494 - RNA, 64 nt, Homo Sapiens
cugagaagaaaugauuacuucugaaaaacauccuuuuuuccagccucugggaaucagccccccc

SEQ ID NO: 84495 - RNA, 64 nt, Homo Sapiens
uuuuuuuuuuuuuucaucuuuuuugucucucucuuuuuuccaucccuuuuuaauuuuuuuaaca

SEQ ID NO: 84496 - RNA, 64 nt, Homo Sapiens
guauauuuguuaugcacuacuuuuguauaucuuguuuuuccaacagugaacauuuuuaggcaca

SEQ ID NO: 84497 - RNA, 64 nt, Homo Sapiens
aagugggugucuaguuuuuacuaaucccuaauuuuuuuuccaguguauugcucauauuaucaga

SEQ ID NO: 84498 - RNA, 64 nt, Homo Sapiens
gugaaaccuuccugcugacaaccaugcagaggaauuuuuccacuuaagucagagccuuccuccc

SEQ ID NO: 84499 - RNA, 64 nt, Homo Sapiens
cuguccacaccucuuuggggaaguuacgauuuuuuuuuuccaucauaauucagucucuucuuau

SEQ ID NO: 84500 - RNA, 64 nt, Homo Sapiens
aaguuugaacuucauaagguuuugcuguuugcaauuuuuccauggcuggcuuucucccacugag

SEQ ID NO: 84501 - RNA, 64 nt, Homo Sapiens
uguguucauuagaacagcguguuuuguuuuuguuuuuuuccaacauagggagaaaccaagagaa

SEQ ID NO: 84502 - RNA, 64 nt, Homo Sapiens
guguaauucucuuugccagcugcacaaagcugauuuuuuccaaagucuaaagacugagcucacc

SEQ ID NO: 84503 - RNA, 64 nt, Homo Sapiens
aauaagucuuaaaaguuccuucaugcauaagauuuuuuuccaguuacuggguuuaacuggugua

SEQ ID NO: 84504 - RNA, 64 nt, Homo Sapiens
agcuauaaucuugcccauagauuuugacauuuaguuuuuccaaggaaaagcuuaccaaaaauau

SEQ ID NO: 84505 - RNA, 64 nt, Homo Sapiens
uuuaagugccuauauaugauagaagggugccacauuuuuccagccauucugauuggauauuuaa

SEQ ID NO: 84506 - RNA, 64 nt, Homo Sapiens
ucaaugaaugacaucacugccuucuccuuguguuuuuuuccaacuaacacagcccaaaaaccua

SEQ ID NO: 84507 - RNA, 64 nt, Homo Sapiens
gguauuuuuccugagcucuacacuuuuuaaguuuuuuuuccacaauuuccucggauucuuucac

SEQ ID NO: 84508 - RNA, 64 nt, Homo Sapiens
uaaacuaaucaaauaaauuaauguauuuauaaaguuuuuccagaauuuacugcccucuuacaua

SEQ ID NO: 84509 - RNA, 64 nt, Homo Sapiens
gugcuccuucuuagcaaucauacuuuaaaauggcuuuuuccaguaaauacgucucauucuucaa

SEQ ID NO: 84510 - RNA, 64 nt, Homo Sapiens
uuucuguauucugaaagcuaaauauuaaguacuauuuuuccauucaaauauucauuuagaauuu

SEQ ID NO: 84511 - RNA, 64 nt, Homo Sapiens
agucugaaacuuuagacaucaaaaguuugagcaguuuuuccaaggcaacauugauaguuagauu

SEQ ID NO: 84512 - RNA, 64 nt, Homo Sapiens
uugcguuucuuauuuugcuuuaaaucucugguaguuuuuccaccccugugacacaauccuaaua

SEQ ID NO: 84513 - RNA, 64 nt, Homo Sapiens
acacugccauauuuuaaaucaacuacuccacguguuuuuccauccaaucacacugcugugauuc

SEQ ID NO: 84514 - RNA, 64 nt, Homo Sapiens
gaccuacugaauaucuagcaugagaaccacugauuuuuuccacucaauaacccacugaccacag

SEQ ID NO: 84515 - RNA, 64 nt, Homo Sapiens
uguaauggauuauguggaaucuaccaggagcuucuuuuuccaaaaucccaaagaggcccugugu

SEQ ID NO: 84516 - RNA, 64 nt, Homo Sapiens
aaaugguaaagaagaaauguaguuuacauuuguauuuuuccagaauucuuuuguccuaugcagu

SEQ ID NO: 84517 - RNA, 64 nt, Homo Sapiens
uucagaccggucuucaaaggaaaagccuguccgauuuuuccauggguuccaguuucagaguucu

SEQ ID NO: 84518 - RNA, 64 nt, Homo Sapiens
aaguuagcugguguuuuacuauuauuguguuacauuuuuccagugucgucauuaaucgguggca

SEQ ID NO: 84519 - RNA, 64 nt, Homo Sapiens
ucccagaccacacaacuaguggaaugauuccuccuuuuuccauuacuuacuuaaucacaguuua

SEQ ID NO: 84520 - RNA, 64 nt, Homo Sapiens
ugcucaauuugaagcagaauucagugaaaaauuauuuuuccacauugaaacacuuugcagacac

SEQ ID NO: 84521 - RNA, 64 nt, Homo Sapiens
uucuuauugcauaucauuuuucuccuuugcucccuuuuuccaauccucaguacaugcuuugcac

SEQ ID NO: 84522 - RNA, 64 nt, Homo Sapiens
uuggcauguagcuacaaauaaaugaaaauacauuuuuuuccauacucucuguuauuaauacaua

SEQ ID NO: 84523 - RNA, 64 nt, Homo Sapiens
ccccaugcaaacuguuccuguaauuuccuauacauuuuuccaauagggagcuuuuaagaaauau

SEQ ID NO: 84524 - RNA, 64 nt, Homo Sapiens
uuuccuuauugacuuuuuguacugcaauggccuuuuuuuccagacaugaacagauuuguguaua

SEQ ID NO: 84525 - RNA, 64 nt, Homo Sapiens
uccucugcaacccuaauuaaaaucaaacagcuuguuuuuccaucgacagaaguguugccuucau

SEQ ID NO: 84526 - RNA, 64 nt, Homo Sapiens
aauaccuacaucaaauggaaaauaucugaaauuuuuuuuccauagcagguauuuucuacuagaa

SEQ ID NO: 84527 - RNA, 64 nt, Homo Sapiens
uaauuauucaacaaaaagcauauccguucaaaaauuuuuccacuaugucuuuuuucuaguggcu

SEQ ID NO: 84528 - RNA, 64 nt, Homo Sapiens
acaaccaaacagucugccuuaaaagugacccacauuuuuccauagcuccucacuuuuuagcccu

SEQ ID NO: 84529 - RNA, 64 nt, Homo Sapiens
acaacucaacauggucaucauguuuucuauaugguuuuuccagcuagcaguacucccuuccaua

SEQ ID NO: 84530 - RNA, 64 nt, Homo Sapiens
cagugguaguagggagugggagggcuuauauugguuuuuccagcuauuaaggggacauauugug

SEQ ID NO: 84531 - RNA, 64 nt, Homo Sapiens
uccaggacacagauuaucaauuuuccaccuuuuguuuuuccaguuuaacucguugcagucugua

SEQ ID NO: 84532 - RNA, 64 nt, Homo Sapiens
uccuuuaacucguugcaguccacuuuccaccaacuuuuuccaagaccuuacucguauaccgugc

SEQ ID NO: 84533 - RNA, 64 nt, Homo Sapiens
ccuuuuugaauugugaugggaaaguagaguuggguuuuuccaguuuugcucuguggugugugag

SEQ ID NO: 84534 - RNA, 64 nt, Homo Sapiens
gcuagcuaugucccuagcugcaggaagccccuauuuuuuccaagcacgaagccaccagucuccc

SEQ ID NO: 84535 - RNA, 64 nt, Homo Sapiens
ccacuuuuaaacuugggaaauaagcaccuguauuuuuuuccaaaacuguuuuuaaagcuguaua

SEQ ID NO: 84536 - RNA, 64 nt, Homo Sapiens
ccguuagugcaucaguaaauguguuauuuugucauuuuuccaaagagaguguuguagguuuucc

SEQ ID NO: 84537 - RNA, 64 nt, Homo Sapiens
uuuuucuaauaguuuuauuaaaaucaugaagauauuuuuccauuagagauuuuucaugauuuug

SEQ ID NO: 84538 - RNA, 64 nt, Homo Sapiens
uacaacaaacaccugugcucauaagacggauuuauuuuuccauuuaacuugcugcaguaugaaa

SEQ ID NO: 84539 - RNA, 64 nt, Homo Sapiens
uaaaucuaguugccucucccccuucaaacagcacuuuuuccacacuucgaaauaaaacacagcu

SEQ ID NO: 84540 - RNA, 64 nt, Homo Sapiens
aaucugcagaaaauuacugaaucuuuuuuauauuuuuuuccauguuuguaaaagaaaaagggau

SEQ ID NO: 84541 - RNA, 64 nt, Homo Sapiens
aguguuuuacuugaaucuucacuaaccagacgacuuuuuccauccaguguugugggucuacaac

SEQ ID NO: 84542 - RNA, 64 nt, Homo Sapiens
uuuacagccuuuauacaaauguauuuaguucucuuuuuuccaacauaaaauucuuguuuuaaga

SEQ ID NO: 84543 - RNA, 64 nt, Homo Sapiens
aaauaaguuuuuuaacuuguaaaacaugucaagauuuuuccaccaagcuagaaaauaaaaaacu

SEQ ID NO: 84544 - RNA, 51 nt, Homo Sapiens
uuagcccuugucuacuaugauuuuuuccagauguuuccuaaagaaguuucc

SEQ ID NO: 84545 - RNA, 64 nt, Homo Sapiens
cuggcuaauuuuuguauuuuuuauaaagacaggguuuuuccauguugcccaggcugguuucgaa

SEQ ID NO: 84546 - RNA, 64 nt, Homo Sapiens
aaaaaaaaacuacuaaauuauugccuuauugauuuuuuuccaaauauauauauuuucaguuuuu

SEQ ID NO: 84547 - RNA, 64 nt, Homo Sapiens
ucaaucaccagaaggagacaucuugaccaaucauuuuuuccaaagcuuuccucaaguuugucuc

SEQ ID NO: 84548 - RNA, 64 nt, Homo Sapiens
uucaugguccuugguaauuuuccuuuugauuuucuuuuuccagggauaaauaauugcuguaaau

SEQ ID NO: 84549 - RNA, 55 nt, Homo Sapiens
uuugugcuaauuuauuccacgacuuuuuuuccauuguaacagugaacaguuauaa

SEQ ID NO: 84550 - RNA, 64 nt, Homo Sapiens
auccaagugauucugauacacucucugaaggugcuuuuuccacaaccugaugauuuuccuucag

SEQ ID NO: 84551 - RNA, 50 nt, Homo Sapiens
cuuccauuuagcaaauguuuuuuuuccaggaagaaggacacuugcaguga

SEQ ID NO: 84552 - RNA, 64 nt, Homo Sapiens
cccuaaacagaccugacagggaaaggacuccuccuuuuuccaugguccagaaagguuuggggca

SEQ ID NO: 84553 - RNA, 64 nt, Homo Sapiens
aucucccauuuuggaauuugccccaauuucggauuuuuuccaaaacauuuauuuccucccucua

SEQ ID NO: 84554 - RNA, 64 nt, Homo Sapiens
augcuuaagaaacucuugaaggcuauuuguguuguuuuuccacaaugugcgaaacucagccauc

SEQ ID NO: 84555 - RNA, 64 nt, Homo Sapiens
auugaagauacuaaaugaugcaaaccaaauggauuuuuuccaugucaugauguaauuuuucuuu

SEQ ID NO: 84556 - RNA, 64 nt, Homo Sapiens
uucuuaagaacaugacacuaaaaaaaaaguguuuuuuuuccaccguugcugauuauuagacagu

SEQ ID NO: 84557 - RNA, 64 nt, Homo Sapiens
ugcuucaugguuaggagucugugaaugauauguauuuuuccaaaagaaaaugguucugugaaaa

SEQ ID NO: 84558 - RNA, 64 nt, Homo Sapiens
ggguuacuuuaaaaaucuguguaucacguaaaauuuuuuccaaaaugugaacuagugccuuugg

SEQ ID NO: 84559 - RNA, 64 nt, Homo Sapiens
acauaauccucuccaacugguuaucuuucuuaacuuuuuccaaccugaaagaugcacugccaua

SEQ ID NO: 84560 - RNA, 64 nt, Homo Sapiens
uagagcacuauguaaauuuauuuccucuuuuuauuuuuuccauaugugcaaccuaauuaguaac

SEQ ID NO: 84561 - RNA, 64 nt, Homo Sapiens
ucaugcuuacaaaaaagaaugacacaaagcuuuauuuuuccacaguuggaugcauuuuauuuua

SEQ ID NO: 84562 - RNA, 64 nt, Homo Sapiens
agcaccaucaggugaaugauguuccugcuuuuguuuuuuccacuuguauaugcacuaauuuuaa

SEQ ID NO: 84563 - RNA, 64 nt, Homo Sapiens
uaugaaaugcuuaauuuauaagcgggcuggagauuuuuuccaauauuguuuucuuugaaaauga

SEQ ID NO: 84564 - RNA, 64 nt, Homo Sapiens
cauaauuaacauaagugguuccuaacgagagcaauuuuuccacccaaaagucauuuggcaacau

SEQ ID NO: 84565 - RNA, 64 nt, Homo Sapiens
aaacaugcauauucacauuaauuaaucgaucagauuuuuccagaauuccguaucagucaccauu

SEQ ID NO: 84566 - RNA, 64 nt, Homo Sapiens
acuuucaauggcaaaaaccgaaaaguaauugugguuuuuccauuuguuuguaauggguuggugc

SEQ ID NO: 84567 - RNA, 64 nt, Homo Sapiens
ucugugcucugucaacaugaucauuugcaguuuuuuuuuccaauuuuagaaauaccccuauuuc

SEQ ID NO: 84568 - RNA, 64 nt, Homo Sapiens
agguuaaaacuuguaaaaaacauaucugcuucuguuuuuccaaaacuucaagaaauuauuuuau

SEQ ID NO: 84569 - RNA, 64 nt, Homo Sapiens
uguagcuaaaauauuuuugcuucucaaguuuauuuuuuuccaagcuuagaaaugugaaguuaua

SEQ ID NO: 84570 - RNA, 64 nt, Homo Sapiens
uucccuacuguaaaauacuuaagacgguuucugauuuuuccacuauuuaaauaaugcugugaug

SEQ ID NO: 84571 - RNA, 64 nt, Homo Sapiens
aggaugucacuacugcaauccaucuguggccgauuuuuuccaagagccaauuuccuuguuuugg

SEQ ID NO: 84572 - RNA, 64 nt, Homo Sapiens
auccuuaaaagaccauugcaaaucaguguaaggguuuuuccaguaauuacucacagcacuuugu

SEQ ID NO: 84573 - RNA, 64 nt, Homo Sapiens
auuaaacuuuuagaaaacuuuagcauuuguuacuuuuuuccauugcguuuacuuucaaaugcac

SEQ ID NO: 84574 - RNA, 64 nt, Homo Sapiens
uuaacagggcggcagucuaguguugaaaguuuuauuuuuccauuuuucuuuuaaguaaauuuuu

SEQ ID NO: 84575 - RNA, 64 nt, Homo Sapiens
uaucuccgugacuccaacuuguggguuuguucuguuuuuccaugagaauaaaauacuggcgguu

SEQ ID NO: 84576 - RNA, 64 nt, Homo Sapiens
augcuucugaaaacuaggucugacucuggggauuuuuuuccagccgaaggaaaaucacuuccgu

SEQ ID NO: 84577 - RNA, 64 nt, Homo Sapiens
auguaaaaaacugguggaaaaagguuuuggauuuuuuuuccagugggguggggggagggcaagc

SEQ ID NO: 84578 - RNA, 64 nt, Homo Sapiens
ccccucaacagcaugcgagcccauaccuucugcauuuuuccaggccugugagggauauaggccu

SEQ ID NO: 84579 - RNA, 64 nt, Homo Sapiens
gucugcccacugaggauagggaaaggauuaaggauuuuuccaccuccucuuaguaacuccugaa

SEQ ID NO: 84580 - RNA, 64 nt, Homo Sapiens
cuaaggacaaauuagcaugcaagcuuggucaaacuuuuuccagcaaaauggaagcaaagacaaa

SEQ ID NO: 84581 - RNA, 64 nt, Homo Sapiens
auggucuuaacuaauuugaauccuucaagaaggauuuuuccauacuauuuuuuaagauagaaga

SEQ ID NO: 84582 - RNA, 64 nt, Homo Sapiens
aauuaucaaugggauaugauugguucaguuuuuuuuuuuccagaguuguuguuugccaagcuaa

SEQ ID NO: 84583 - RNA, 64 nt, Homo Sapiens
aauguaggguuauauuugggagugacugcaagcauuuuuccaucugugugcaacuaacugacuc

SEQ ID NO: 84584 - RNA, 64 nt, Homo Sapiens
uauacauauuuuuagauaaaauuaaaugcucuuauuuuuccaacagcuaaacuacucuuaguug

SEQ ID NO: 84585 - RNA, 64 nt, Homo Sapiens
uuaauuaaaacaaaaaaaaauucuuuuuuuuuuuuuuuuccaauuuuaccuucuuuaaaauagg

SEQ ID NO: 84586 - RNA, 64 nt, Homo Sapiens
guucuuguuccgggacugcaggaaugucucgcaguuuuuccagaaaggaggagucaaggaagcc

SEQ ID NO: 84587 - RNA, 64 nt, Homo Sapiens
uuuuguugauauaucaugaaaaugaacagaauucuuuuuccauacuuauaucuaagaaaaggca

SEQ ID NO: 84588 - RNA, 64 nt, Homo Sapiens
agguuccacagagacaccuuaagaugaguaauauuuuuuccaguaugcuuucuaucacauuucu

SEQ ID NO: 84589 - RNA, 64 nt, Homo Sapiens
gguauuuuacaauauuucaaaucuauaaauaccguuuuuccaaaaucccuuuuuaaaaaagcua

SEQ ID NO: 84590 - RNA, 64 nt, Homo Sapiens
cccauuuuuguccucauaaucuuuccaagccucuuuuuuccauuaaggaaaccauacugaaaac

SEQ ID NO: 84591 - RNA, 64 nt, Homo Sapiens
gccaggauuucuauuuuuaauauuuuugggaaaauuuuuccauaguaccugugccauuuuacau

SEQ ID NO: 84592 - RNA, 64 nt, Homo Sapiens
gcauuuguguaucuggaaaaauauucaagucuuuuuuuuccauuuuuaaugggacuauuugcuu

SEQ ID NO: 84593 - RNA, 64 nt, Homo Sapiens
auucugauuggguaauuuuagaacaucuuuucauuuuuuccauuccugauauucuacuuauuua

SEQ ID NO: 84594 - RNA, 64 nt, Homo Sapiens
uauuuaccauuucuguugcuaguaaucuguuauguuuuuccagauuuaaaaaacucaugagaag

SEQ ID NO: 84595 - RNA, 64 nt, Homo Sapiens
cauugcuugauauaucacuauauuccuuuuaaauuuuuuccaacaugucugaagaagguaguaa

SEQ ID NO: 84596 - RNA, 64 nt, Homo Sapiens
aaugccagaaaccuggauuuacaacaagcccugauuuuuccagccguccggcugcugcccuuca

SEQ ID NO: 84597 - RNA, 64 nt, Homo Sapiens
ggggaugggaaagggccuugacuuguuuggacaguuuuuccagacagucaucacagacuuacgc

SEQ ID NO: 84598 - RNA, 64 nt, Homo Sapiens
uccgauucacacgcuacacaauaggggauuuuuuuuuuuccaugauuuauuuuugacugggcag

SEQ ID NO: 84599 - RNA, 64 nt, Homo Sapiens
uuguccacggccagcacauguguauacgcuucaguuuuuccacaaguuguucugacaacagcgc

SEQ ID NO: 84600 - RNA, 64 nt, Homo Sapiens
ccuugaagucacaguguuuuaaaacugaaaggaauuuuuccacauugaaaauccugagagcuaa

SEQ ID NO: 84601 - RNA, 64 nt, Homo Sapiens
ggugagaauaaguauaaacauuggaaucaaauauuuuuuccagguacacuguuaaaacccaauc

SEQ ID NO: 84602 - RNA, 64 nt, Homo Sapiens
agaccacuuuugagcgcuguaugacugcacuauauguaugcauaauuugauuguuuuacuccca

SEQ ID NO: 84603 - RNA, 64 nt, Homo Sapiens
uuuggggguauaucuauuucuuuauagcugcugauguaugcacauaguguucugccauguaaug

SEQ ID NO: 84604 - RNA, 64 nt, Homo Sapiens
uaggcaaagauuuugaagauugggaagaacaaauuguaugcaugaaggaauuucccuaagcagu

SEQ ID NO: 84605 - RNA, 64 nt, Homo Sapiens
uuuauggauauuaucaaugaagaauguuaaaaaauguaugcagaaagaaaaaaaaacacaaaac

SEQ ID NO: 84606 - RNA, 64 nt, Homo Sapiens
cauuuugucuuuuuucagaagauugcacugucauuguaugcaagcaggaccuggccuggaugcu

SEQ ID NO: 84607 - RNA, 64 nt, Homo Sapiens
cuuuauguguaacuccaaaauauuuuuuuaauauuguaugcaauaaaugaauugcuccccagau

SEQ ID NO: 84608 - RNA, 64 nt, Homo Sapiens
guuucauauuuaaugaauauauccugguuuuuaauguaugcauacuaaagcacauuaaaaacaa

SEQ ID NO: 84609 - RNA, 64 nt, Homo Sapiens
guguguguauaugauguauggucaaggggaaauguguaugcaauaucuacaaagaugcgaauca

SEQ ID NO: 84610 - RNA, 64 nt, Homo Sapiens
cauuuucaagcaaguaauaauuuuugccugugcuuguaugcauguggcaacuuacugacccuug

SEQ ID NO: 84611 - RNA, 64 nt, Homo Sapiens
aaggaugauuaauucugggacuuugcuaaagaguuguaugcacaagacugcuuaaauugauaag

SEQ ID NO: 84612 - RNA, 64 nt, Homo Sapiens
uauauauuuaaaagugucaagcugaguauuaaaauguaugcauguugucuaagaaauugaauac

SEQ ID NO: 84613 - RNA, 64 nt, Homo Sapiens
uugaaauaagcuauuugauguaauacuucuuguguguaugcacaugaacuuagauuuuacauga

SEQ ID NO: 84614 - RNA, 64 nt, Homo Sapiens
aaaugcaguggcaugcuaaguacccaaauaggaguguaugcagaggaugaaagauuaagauuau

SEQ ID NO: 84615 - RNA, 64 nt, Homo Sapiens
aacauuaaauuauaauguuugacuauuauauauguguaugcauuuuacuggcucaaaacuaccu

SEQ ID NO: 84616 - RNA, 64 nt, Homo Sapiens
augaauggcacaggugaugcgucaggugagacuguguaugcaaauuaaauuaguccgguaggau

SEQ ID NO: 84617 - RNA, 64 nt, Homo Sapiens
ggcauuaccccucagguccucuuggaauaaaagcuguaugcauguauaucuguagcauagauga

SEQ ID NO: 84618 - RNA, 64 nt, Homo Sapiens
cucccauguuaaccuaucauucuggaacuucuuauguaugcaagcugaaugucauguuuucucc

SEQ ID NO: 84619 - RNA, 64 nt, Homo Sapiens
guauauugcaauuuauuacucucuguaugacuccuguaugcauuuuuuguacgagaguuuguug

SEQ ID NO: 84620 - RNA, 64 nt, Homo Sapiens
ccccgcuuguguuuacacaaccugcaggcacguguguaugcacuuguguaugcagggcuaugca

SEQ ID NO: 84621 - RNA, 64 nt, Homo Sapiens
gcuaugcaccugcaggcacgggugccaucucuuguguaugcaggccuucauugaaaaccaccac

SEQ ID NO: 84622 - RNA, 64 nt, Homo Sapiens
caaguuuuaguauacaugccaugccagaagauaguguaugcaagaagucuugggaccagaaaau

SEQ ID NO: 84623 - RNA, 64 nt, Homo Sapiens
aaaagucuaggaguuuuuuuguacuuagugaauuuguaugcaacagagaugcugcagcugaugc

SEQ ID NO: 84624 - RNA, 64 nt, Homo Sapiens
aguguauauauguguguauaggcauauauacguguguaugcaucaacacaguauauguaaaacu

SEQ ID NO: 84625 - RNA, 64 nt, Homo Sapiens
agaaaacaagacaguuguucauaaaguuucauuuuguaugcacugauggcaaauucauuagguc

SEQ ID NO: 84626 - RNA, 64 nt, Homo Sapiens
agcuuauuuuggagagauaggaaggucauuuccauguaugcauaauaauccugcaaaguacagg

SEQ ID NO: 84627 - RNA, 64 nt, Homo Sapiens
guugacauuuguuugguuauagugcaauauauuuuguaugcaagcaguuucaauaaaguuugau

SEQ ID NO: 84628 - RNA, 64 nt, Homo Sapiens
uguauguagauauguuuauaaaguauaugcuuuauguaugcauauguaaacuguguaugcauau

SEQ ID NO: 84629 - RNA, 64 nt, Homo Sapiens
uaaguauaugcuuuauguauggaaauguaaacuguguaugcauaguuuuucugaacacuggcug

SEQ ID NO: 84630 - RNA, 64 nt, Homo Sapiens
cuccuagguagagccuccauuacuuuguuccuguuguaugcauuaaucaccgacacacuacuag

SEQ ID NO: 84631 - RNA, 64 nt, Homo Sapiens
uccugaguguagaaacuucuaggaaagauaaaaauguaugcaauucauucaauauuuucuguug

SEQ ID NO: 84632 - RNA, 64 nt, Homo Sapiens
caaaauucugcuuucuucaacaucaaaaauuguguagaaauauuuucagugaaagggaauaacu

SEQ ID NO: 84633 - RNA, 64 nt, Homo Sapiens
aaagcuauugugugaguauauugugcuaaaaucauagaaauaaagauuagauuucuucaucaaa

SEQ ID NO: 84634 - RNA, 64 nt, Homo Sapiens
gaaaaauccugagcaaacaaaaccaccuggcccuuagaaauagcuuuaacuuugcuuaaacuac

SEQ ID NO: 84635 - RNA, 64 nt, Homo Sapiens
cuuaacuuggaucauuucugguaaaugcuuauguuagaaauaagacaaccccagccaaucacaa

SEQ ID NO: 84636 - RNA, 64 nt, Homo Sapiens
cuagagauuuuuaaacucugcaagugguguuuguuagaaauaaaaaagccugugagucaagcau

SEQ ID NO: 84637 - RNA, 64 nt, Homo Sapiens
uugauaauauuuuuacagugcaagauaucuuauguagaaauauuagcugaucuaaaaaugaaag

SEQ ID NO: 84638 - RNA, 64 nt, Homo Sapiens
uuaaaauggugcauuauguauauauauuauaauuuagaaauaccauuuuauaauuuuacuauuc

SEQ ID NO: 84639 - RNA, 64 nt, Homo Sapiens
uugccaauacuucuacauuugagaaggguuuuuuuagaaauacauuuaguaaaguccccaagac

SEQ ID NO: 84640 - RNA, 64 nt, Homo Sapiens
aaauggcaucagauuuaaggauaauacuccaucauagaaauaagccuuaauaaccaguguugcc

SEQ ID NO: 84641 - RNA, 64 nt, Homo Sapiens
gguugauuauugugguuguauuguucacuguguguagaaauaguaugaguacgauuucaauaga

SEQ ID NO: 84642 - RNA, 64 nt, Homo Sapiens
gaaaaaaaauuagguguuuaacauuuacagucaauagaaauaauugugagcaguagaagagacc

SEQ ID NO: 84643 - RNA, 64 nt, Homo Sapiens
agacaaaaggacaucacucuaaguugugagcaaauagaaauaaaaaaaccuuuauuuuaaaguc

SEQ ID NO: 84644 - RNA, 64 nt, Homo Sapiens
cuuuaguugcucuuuucuaaguucagaaguauaauagaaauaauauuaaaauugcuaguuuacc

SEQ ID NO: 84645 - RNA, 64 nt, Homo Sapiens
uuucucuuaccuguuauuuauccuaguaauugccuagaaauaucuacucacuuuuuccaaauga

SEQ ID NO: 84646 - RNA, 64 nt, Homo Sapiens
uuuaaucuaguggguuuuuuauuuuauuuuuucuuagaaauauguagguaagguuuaucuugaa

SEQ ID NO: 84647 - RNA, 64 nt, Homo Sapiens
aaaguuauuaagguugguuuaaaaacaacugcauuagaaauaaugcguguuuggggggcagaau

SEQ ID NO: 84648 - RNA, 64 nt, Homo Sapiens
uguaaagaauuuaagacaagaacugaaaaaaauguagaaauauagaguuaucuguacuuuguuu

SEQ ID NO: 84649 - RNA, 64 nt, Homo Sapiens
uaaaugaugugaaacaaagcaucauguccuaugcuagaaauauuuacuuugaguuuuguuucgu

SEQ ID NO: 84650 - RNA, 64 nt, Homo Sapiens
aguggaaucuucugagcauuccuaaauaucugcuuagaaauaucaugugauaaagagggaccuu

SEQ ID NO: 84651 - RNA, 64 nt, Homo Sapiens
aauugucaaaugaaguauaaacacaugaacuuucuagaaauauuuccucuuuuggauaggucuu

SEQ ID NO: 84652 - RNA, 64 nt, Homo Sapiens
gcuguagcauauucacuaaagagauuuucaaacauagaaauaaaugugauuuaaaacguuuguu

SEQ ID NO: 84653 - RNA, 64 nt, Homo Sapiens
auaaucaacguacaacucuugccuauuaugauuuuagaaauaagugccuguuuuguaauucagg

SEQ ID NO: 84654 - RNA, 64 nt, Homo Sapiens
cccccaucuacuauaaagaaaugucuucgagauguagaaauaaggaauauucugaaaauaaaaa

SEQ ID NO: 84655 - RNA, 64 nt, Homo Sapiens
gcugcaggagugcccugcauuguuuucuuuuaauuagaaauaaaaaguauuagucuaaaugugg

SEQ ID NO: 84656 - RNA, 64 nt, Homo Sapiens
uauuuuauuauauaugugcuaaauaaagcccaccuagaaauagauauuugaugaaagaaaaucc

SEQ ID NO: 84657 - RNA, 64 nt, Homo Sapiens
gaaaugcuuuauauauuacuccuuguuauucaaauagaaauauguuccaguucuuugauauucc

SEQ ID NO: 84658 - RNA, 64 nt, Homo Sapiens
uuuuagcuguauuuguagcaauuaucagguuugcuagaaauauaacuuuuaauacaguagccug

SEQ ID NO: 84659 - RNA, 64 nt, Homo Sapiens
uucaacauuuuacaacugcaguauucaccuaaaguagaaauaaucuguuacuuauuguaaauac

SEQ ID NO: 84660 - RNA, 64 nt, Homo Sapiens
uguuucagcauguaauuuuaacuuuuguggaaaauagaaauaccuucauuuugaaagaaguuuu

SEQ ID NO: 84661 - RNA, 64 nt, Homo Sapiens
uuaaaaauuaaauaaaacuaccuacacacaauuuuagaaauaaauucagagguaauaugcucca

SEQ ID NO: 84662 - RNA, 64 nt, Homo Sapiens
ucuucuuuauuauccuccaauucuaaacgacaaauagaaauacagggcauuucugccuuuuuuu

SEQ ID NO: 84663 - RNA, 64 nt, Homo Sapiens
uuaaagaaaauagucacaauacagaaaagcauuuuagaaauagcuucaaaagcacuuguguauc

SEQ ID NO: 84664 - RNA, 64 nt, Homo Sapiens
ccuggugaucacaaagauaauguucuacuucugauagaaauaauuucucaacaaauguuguuac

SEQ ID NO: 84665 - RNA, 64 nt, Homo Sapiens
cuaaaacugcagaaggaucuuaaagguaccucuguagaaauaacgaaugugguauucauucacu

SEQ ID NO: 84666 - RNA, 64 nt, Homo Sapiens
uacuaaauccagagcuacugacauagggccagcuuagaaauagaauucaaauaccaaauaguuu

SEQ ID NO: 84667 - RNA, 64 nt, Homo Sapiens
agacagguggaauaaguauagaauaucuaagucauagaaauagauggagggauuuugugaugca

SEQ ID NO: 84668 - RNA, 64 nt, Homo Sapiens
aauuuagugguauccuauauuuacuuuccauacauagaaauauaaccauguaccaggaauagcu

SEQ ID NO: 84669 - RNA, 64 nt, Homo Sapiens
cauuugugaauuauccaaauuuguguguugcugcuagaaauaguuacuucauucuuuucugaag

SEQ ID NO: 84670 - RNA, 64 nt, Homo Sapiens
ugauuaaaggccucugccucagagacaauagcauuagaaauaaguuuaaacaucaaauaauuga

SEQ ID NO: 84671 - RNA, 64 nt, Homo Sapiens
caaaaugguuuuuguggcagaaaaaacaugaauuuagaaauauuagagugaggauggauuuaga

SEQ ID NO: 84672 - RNA, 64 nt, Homo Sapiens
gugcuuacucaaguguuaaaagucugucuuucuauagaaauauucagaggaguggaucuguaga

SEQ ID NO: 84673 - RNA, 64 nt, Homo Sapiens
gugucugcucuuacauuauuguggagcccugugauagaaauauguaaaaucucauauuauuuuu

SEQ ID NO: 84674 - RNA, 64 nt, Homo Sapiens
uugugggagaugguugauuuagguuuucaaaagcuagaaauaaaauuuacaugccuuagauuuc

SEQ ID NO: 84675 - RNA, 64 nt, Homo Sapiens
accucacugucucgucugucuaugugacauuaaguagaaauauugguuuuuuuuuuuuuuuuuu

SEQ ID NO: 84676 - RNA, 64 nt, Homo Sapiens
auccuacguuacaacaauaauaucaugggagaaauagaaauagccuaguuugcuuccaauagaa

SEQ ID NO: 84677 - RNA, 64 nt, Homo Sapiens
uucuaaccauccucugaaaaaaauagaaaagcauuagaaauaacuauuuuuucuuucuguacag

SEQ ID NO: 84678 - RNA, 64 nt, Homo Sapiens
caagacagagcaggaaauggauacucuuguuucuuagaaauaaggcugggauggcucucucauc

SEQ ID NO: 84679 - RNA, 64 nt, Homo Sapiens
cuagaggcaugaaaguuaaauguauauauuaugguagaaauaauauugaaggauauuguacuuc

SEQ ID NO: 84680 - RNA, 64 nt, Homo Sapiens
auauagagcacaguaaauaaguuuuuucauuguguagaaauacuuagaugucaaaaccagauuu

SEQ ID NO: 84681 - RNA, 64 nt, Homo Sapiens
auuugacccagccaucccaucaagaaucuagaccuagaaauaccaugccacccaucugauuccu

SEQ ID NO: 84682 - RNA, 64 nt, Homo Sapiens
ccaccaaggcuauucagauugucagggucacuucuagaaauagcaggcgccaacagcacacagg

SEQ ID NO: 84683 - RNA, 64 nt, Homo Sapiens
uuacacuauaauauaaaaccugauauauacacauuagaaauauuccaguucuccguaacagugu

SEQ ID NO: 84684 - RNA, 64 nt, Homo Sapiens
gucuuuuuuuuucuucauuguaaucugcaaaauguagaaauaaauuacuuaaggcaguauccuu

SEQ ID NO: 84685 - RNA, 64 nt, Homo Sapiens
uguuuuuguuagguacagucuggaucauggcauguagaaauagaaauuuagaauuuuacugcag

SEQ ID NO: 84686 - RNA, 64 nt, Homo Sapiens
gaccuuaauuuaaaacuuucaauggagauagggcuagaaauacuuuugccaaauagcauucuua

SEQ ID NO: 84687 - RNA, 64 nt, Homo Sapiens
ugguguagguguuacgcgaagggcgcacagugucuagaaauacuugaucguggcucaaaccuga

SEQ ID NO: 84688 - RNA, 64 nt, Homo Sapiens
uuccagaaguaaaagucccagugauguauucccauagaaauauuuuucaguuguuuaugucguu

SEQ ID NO: 84689 - RNA, 64 nt, Homo Sapiens
aaaaggguaaaacaugacuauacagaaauuuaaauagaaauaguguauauacauauaaaauaca

SEQ ID NO: 84690 - RNA, 64 nt, Homo Sapiens
uuccugguaguauaagucaccuaaaaaagacuucuagaaauauguacuuuaauuauuuguuuuu

SEQ ID NO: 84691 - RNA, 64 nt, Homo Sapiens
aauaaauauggagcugggguuuaacacuaaaaacuagaaauaaacaucucaaacaguaagaguu

SEQ ID NO: 84692 - RNA, 64 nt, Homo Sapiens
cuuguguccuuugaauucucgcccugccagcuccuagaaauaguuucaaucuuggaaucagaug

SEQ ID NO: 84693 - RNA, 64 nt, Homo Sapiens
gauuugcucauaacagguauugaaacuuuauacauagaaauaauacaugauugaagccuuuggc

SEQ ID NO: 84694 - RNA, 64 nt, Homo Sapiens
gaaggugccauuuggcugcuagaggcugcgaucuuagaaauaauauuuuaugaaaauuaaguac

SEQ ID NO: 84695 - RNA, 64 nt, Homo Sapiens
ugcacagaaaaucauuuauauuugagaaaaauuguagaaauauagacugugaaaaagacgucaa

SEQ ID NO: 84696 - RNA, 64 nt, Homo Sapiens
ccaaauuugucuauguaaauaccagaauuuauaguagaaauauaugaggaagcgacacuucgaa

SEQ ID NO: 84697 - RNA, 64 nt, Homo Sapiens
uuucugcuucugaaugauucaauguugggagcaauagaaauaacauucccuuugccuucucuga

SEQ ID NO: 84698 - RNA, 64 nt, Homo Sapiens
uaagagagacagagaccaagaacuugcccaauuuuagaaauacacuaaugugcaguuguugccu

SEQ ID NO: 84699 - RNA, 64 nt, Homo Sapiens
uuaaaauaaagaaaaugcagcaaaaagaaugcuauagaaauauuuggugguuuuuuuuuuuuuu

SEQ ID NO: 84700 - RNA, 64 nt, Homo Sapiens
ucaaaaaaguuaaauaccuaaguagaaaaaaauauagaaauaaagccaagaaucucuuucaguu

SEQ ID NO: 84701 - RNA, 64 nt, Homo Sapiens
ccaaguaaagcauaaggucauauauacuauacaauauguuuauugcacuucccauggggauaaa

SEQ ID NO: 84702 - RNA, 64 nt, Homo Sapiens
guuucuagguguugauauacuuuaauaaaaaugauauguuuaauauuuucccauuaauauauuu

SEQ ID NO: 84703 - RNA, 64 nt, Homo Sapiens
aaagaacauguuuuccuauuacuugacuaucucuuauguuuauuaucauuauuauuuuauuuag

SEQ ID NO: 84704 - RNA, 64 nt, Homo Sapiens
acuagccuucccaguaaaaaucagugagaauguuuauguuuacagguuuuggggggccaguagu

SEQ ID NO: 84705 - RNA, 64 nt, Homo Sapiens
acugggacccucaagaggaaccugugaguuaagcuauguuuacuuuguaagaacugauugcucu

SEQ ID NO: 84706 - RNA, 64 nt, Homo Sapiens
uucuuuaagauguauauaaguuuuguagguucauuauguuuaugcacagugaguucuguuuauu

SEQ ID NO: 84707 - RNA, 64 nt, Homo Sapiens
guuuucuuacuuagugcuuuaaaauguuuuuuuuuauguuuaagaggggcaguuauaaauggac

SEQ ID NO: 84708 - RNA, 64 nt, Homo Sapiens
agucaguagauguuuuauuuuuuagcuauucaguuauguuuauaaguuugcauagcuacuucuc

SEQ ID NO: 84709 - RNA, 64 nt, Homo Sapiens
acuuuuuauauuaccuauuaguuuuggaguucuuuauguuuaaaaauucagguguaaauuuuau

SEQ ID NO: 84710 - RNA, 64 nt, Homo Sapiens
cauaaacuuagaauucuguaucucaugucagaaauauguuuauggccuugcuuuuaaguggugc

SEQ ID NO: 84711 - RNA, 64 nt, Homo Sapiens
aucuuaaagcaauugauagaugcuuacuuucauuuauguuuauuuuguuaauguaaauaguugg

SEQ ID NO: 84712 - RNA, 64 nt, Homo Sapiens
uuuuuuuuaaaucuuaaaacuaguuuuuaacuuuuauguuuaaaaauagaaacuuuaauaauga

SEQ ID NO: 84713 - RNA, 64 nt, Homo Sapiens
auuuuuagguguuuccugaaugauacuuuguuuauauguuuauacaauucguaaaaaccuuaag

SEQ ID NO: 84714 - RNA, 64 nt, Homo Sapiens
uacuguuuucuucucaaaguggaaccugguacauuauguuuaguuuggaccagcuaagcgacag

SEQ ID NO: 84715 - RNA, 64 nt, Homo Sapiens
agacaggcccuuggaccagcagcaguagguacauuauguuuacuaaaagagguuuguuuaagaa

SEQ ID NO: 84716 - RNA, 64 nt, Homo Sapiens
uauuuuuauuauucaugaauuaaauuacuaaaaguauguuuauacugugaauuaauauaaugua

SEQ ID NO: 84717 - RNA, 64 nt, Homo Sapiens
uauucuuacaguacuuguuuuuaguugucaugccuauguuuagaccauaucuuaauguauucac

SEQ ID NO: 84718 - RNA, 64 nt, Homo Sapiens
auauauuuuugacacaauuaaauauuacauagaguauguuuacaacaaauauccugucagccaa

SEQ ID NO: 84719 - RNA, 64 nt, Homo Sapiens
uaauugauacuguguuuuuaugcccaaaucccaguauguuuauguaccaauaaugacucuuacc

SEQ ID NO: 84720 - RNA, 64 nt, Homo Sapiens
uuauuguuuuuauuucuagccauaccucagauaauauguuuaguuuuacauuuuaaaauguuua

SEQ ID NO: 84721 - RNA, 64 nt, Homo Sapiens
cuccagacuaacaugucaguuuuaucaauuauauuauguuuaauuauuuaagauuucuuuaugu

SEQ ID NO: 84722 - RNA, 64 nt, Homo Sapiens
augccauauuuuuagaaagcuuucucuuuaguauuauguuuauagaagugaaauuuaaccuuuu

SEQ ID NO: 84723 - RNA, 64 nt, Homo Sapiens
uuuuuagucacauugaccuguuuacauuuaucucuauguuuaccggguuccuuuuuuuuuaaug

SEQ ID NO: 84724 - RNA, 64 nt, Homo Sapiens
cauaagaaaacauccauagcguaugugucuacucuauguuuauguaacagaugugaucuauuua

SEQ ID NO: 84725 - RNA, 64 nt, Homo Sapiens
auugcccugaucacaaacaaaagccugaauguacuauguuuaaaagacaaaccaaaaauuaacc

SEQ ID NO: 84726 - RNA, 64 nt, Homo Sapiens
cuaaggauaacccagaaacaugggguguccuagguauguuuaucucgacacugaacccccuagg

SEQ ID NO: 84727 - RNA, 64 nt, Homo Sapiens
ggcacuauuauauaauaccuuugagaucuuuguuuauguuuauuagaagaggguaauggaaacu

SEQ ID NO: 84728 - RNA, 64 nt, Homo Sapiens
cuuuccgaaaugaccacauugugcuuuuaguuuguauguuuaaguggucaagcaaggcucuagg

SEQ ID NO: 84729 - RNA, 64 nt, Homo Sapiens
auuuggggacaauuuuauguaucuguguuaaggauauguuuaagaacauaauucuuuuguugcu

SEQ ID NO: 84730 - RNA, 64 nt, Homo Sapiens
gucuuugauuugauuucccuaguaaccuugcagauauguuuaaccaagccauagcccaugccuu

SEQ ID NO: 84731 - RNA, 64 nt, Homo Sapiens
aagugaagugccuacugauauuacuaaaguacauuauguuuacucaaguaaauaauuuucuccc

SEQ ID NO: 84732 - RNA, 64 nt, Homo Sapiens
agaaagcauuucauuuuauuugccuauguucaaauauguuuaauaaugaccaaagugcauucug

SEQ ID NO: 84733 - RNA, 64 nt, Homo Sapiens
aaucacauguucugugugcuauguccugcaccauuauguuuacuggaauaacauuagcaggcug

SEQ ID NO: 84734 - RNA, 64 nt, Homo Sapiens
uuauacucaaaaacaauuucuuaagagauuuguuuauguuuauaauuuguugacacucgugcug

SEQ ID NO: 84735 - RNA, 64 nt, Homo Sapiens
cuauucauuuguuccuuuccuuguauaacucuucuauguuuauuuaaauuauaauauugcugcu

SEQ ID NO: 84736 - RNA, 64 nt, Homo Sapiens
aaugggccaaugcaaaaaauguucauuauuuaucuauguuuauuacgaauuauuaauuggccau

SEQ ID NO: 84737 - RNA, 64 nt, Homo Sapiens
ccuuaaaauaucccccuaccuggguccucagugcuauguuuaaagugcugcagggauggagugg

SEQ ID NO: 84738 - RNA, 64 nt, Homo Sapiens
gaugcugaaggcaaggggagggagcagaagcacuuauguuuacggauauuuuaaacucuguuag

SEQ ID NO: 84739 - RNA, 64 nt, Homo Sapiens
gguguaaaaacauuuuugagauaagguuuuuauuuauguuuauuauuguuagagugaguugcaa

SEQ ID NO: 84740 - RNA, 64 nt, Homo Sapiens
ggucugacaguauuuuguuaaggauauuuguuuguauguuuauucaguauacuuacauaaaaau

SEQ ID NO: 84741 - RNA, 64 nt, Homo Sapiens
aaguuauuaauuuguaaaggauauuuaaaaauuauauguuuauaaguaucuugcacugauaaau

SEQ ID NO: 84742 - RNA, 64 nt, Homo Sapiens
aauaaauaaauaagggaaauauuuuacuagacuuuauguuuaaaccugcugggaauggcaaacg

SEQ ID NO: 84743 - RNA, 64 nt, Homo Sapiens
cacucagcaagugaauuaaucugauucacaggauuauguuuaaucgccaaaaacacacuggcca

SEQ ID NO: 84744 - RNA, 64 nt, Homo Sapiens
augcagauaagugccgaauucaaacccuucauuuuauguuuaagcuccugaaucugcauuccac

SEQ ID NO: 84745 - RNA, 64 nt, Homo Sapiens
caucaggacaacuuugagaaaaucaguccuuuuuuauguuuaaauuauguaucuauuguaaccu

SEQ ID NO: 84746 - RNA, 64 nt, Homo Sapiens
uagcuacaguuaguuauuaaaucuucugauaauauauguuuacuuagcuaucagaagccaagua

SEQ ID NO: 84747 - RNA, 64 nt, Homo Sapiens
aaagcccuucuucuuuccaccacaaauuaaucacuauguuuauaagguaguaucagaauuuuuu

SEQ ID NO: 84748 - RNA, 64 nt, Homo Sapiens
auaaugcauuucuuguggaauaaguucuaaauuuuauguuuauuuauaguccacugcauucuua

SEQ ID NO: 84749 - RNA, 64 nt, Homo Sapiens
auuacuuaugcagauaccguaggacacauuuguguauguuuaaauacauucuuauacaauaaaa

SEQ ID NO: 84750 - RNA, 64 nt, Homo Sapiens
uaugguaaauuuuuuguuaaauaaaauagacccuuauguuuagcauuuuguuuuuagagaacua

SEQ ID NO: 84751 - RNA, 64 nt, Homo Sapiens
gccaauuugguccuuuaauaaguaaagaaaauaauauguuuaaaaauguaaauguuuuacaaau

SEQ ID NO: 84752 - RNA, 64 nt, Homo Sapiens
uugauaaagccagauauguuuuacuuguagcaaauauguuuacauucacuuuuaccuuuaaagu

SEQ ID NO: 84753 - RNA, 64 nt, Homo Sapiens
aaaaaauagagucugccucgcuuuauaacuuaauuauguuuaauugguucuagaaauuugaagu

SEQ ID NO: 84754 - RNA, 64 nt, Homo Sapiens
accaagacuauuaaaaugauaaaaguuuuaaagauauguuuaaguuuauuuuauauuguacaug

SEQ ID NO: 84755 - RNA, 64 nt, Homo Sapiens
uauuaugcuugaaauuuuaaccccuguuuggugcuauguuuauguuucuuuugcaugcauuuuu

SEQ ID NO: 84756 - RNA, 64 nt, Homo Sapiens
gauuuuguguuuuacuugaccaaaaccaaguguauauguuuacauguuuuuauccuguuuagcu

SEQ ID NO: 84757 - RNA, 64 nt, Homo Sapiens
auauauaaaagaauauacaucacaauauaauauuuauguuuauguaauaaaguaaauacagagc

SEQ ID NO: 84758 - RNA, 64 nt, Homo Sapiens
agacuuuaauuuacaaauuaucauaauugguucauauguuuaaacuuccccuuuaaacuaauau

SEQ ID NO: 84759 - RNA, 64 nt, Homo Sapiens
uugcuuuucaugugucuuucccuggggaaguucuuauguuuaucggguguuugugguuaucuua

SEQ ID NO: 84760 - RNA, 64 nt, Homo Sapiens
cccauuaaaagaaaacgugccuucuguauaaguuuauguuuauuccuacauuuuauucauuuuu

SEQ ID NO: 84761 - RNA, 64 nt, Homo Sapiens
uuauuauuuaaaucacuucaguuagcuuucaguguauguuuaauaauauacauuuaaugaugaa

SEQ ID NO: 84762 - RNA, 64 nt, Homo Sapiens
gaauaguucuauacaaaugaaguauggagguguguauguuuauauguauauaacaaaauauuuu

SEQ ID NO: 84763 - RNA, 64 nt, Homo Sapiens
ggagaaaguguauuuguguauauguguguauacauauguuuaucucacacacauuaugagcuug

SEQ ID NO: 84764 - RNA, 64 nt, Homo Sapiens
ucauguggugaauaugcaagaauauuuuguauauuauguuuauuuguacacuuuuuacagcagc

SEQ ID NO: 84765 - RNA, 64 nt, Homo Sapiens
aaggguaagggaauuuaauaugugaacagcuuuguauguuuauggacuguuacagacugaaagg

SEQ ID NO: 84766 - RNA, 64 nt, Homo Sapiens
aguuccaguuguauuuuggugcaaauacacugaauauguuuauuuggugcuauuauucuauucu

SEQ ID NO: 84767 - RNA, 64 nt, Homo Sapiens
ccuaaauauuucuuacuuuaacuucucaccuuuauauguuuauuuuguagauuucaagguacaa

SEQ ID NO: 84768 - RNA, 64 nt, Homo Sapiens
uuauacacuuuuuaaaaucucaaacuucuauuuuuauguuuaacguuuucauuaaaauuuuuuu

SEQ ID NO: 84769 - RNA, 64 nt, Homo Sapiens
aggcugaaagaugacggaugccuagaguuuaccuuauguuuaauuaaaaucaguauuugucuau

SEQ ID NO: 84770 - RNA, 64 nt, Homo Sapiens
uuucaucauuauacuccaacuauuuucgggcaauuauguuuagcaaaguaaaaacuacaugauu

SEQ ID NO: 84771 - RNA, 64 nt, Homo Sapiens
guugccacguguuuuuauguguauuuguggagccuauguuuaauucauuccucauauuucauug

SEQ ID NO: 84772 - RNA, 64 nt, Homo Sapiens
uauguucuucauaaaucuauuauuuauguuuauauauguuuauauaaauguuccuugaaguauu

SEQ ID NO: 84773 - RNA, 64 nt, Homo Sapiens
uauguuuauauauguucuucuugaaguauuuauuuauguuuauaaaaucuauccuaaauguucc

SEQ ID NO: 84774 - RNA, 64 nt, Homo Sapiens
aaauguuauuuguguuagcauguaauggguuuacuauguuuaaauaaguuaauacuuuaaaaau

SEQ ID NO: 84775 - RNA, 64 nt, Homo Sapiens
ugguuuacauuaaauuaugguauuuaacuauuuuuauguuuauacuagguagggucuuucuuau

SEQ ID NO: 84776 - RNA, 64 nt, Homo Sapiens
caugaaacacaaauguccucaacugucaucauucuauguuuacuuucucccaaucacaucaccu

SEQ ID NO: 84777 - RNA, 64 nt, Homo Sapiens
aucucaccacagugaauuauggguaaggugauaauauguuuaauuagcuugauuuaaucauccc

SEQ ID NO: 84778 - RNA, 64 nt, Homo Sapiens
gucuacacagacgccuacagaaaguuucaggaagaggcaagaugcauucaauuugaaagauauu

SEQ ID NO: 84779 - RNA, 64 nt, Homo Sapiens
uggggguggagggugccacagggaaagcuguagaaggcaagaagacucgagaaucccccagagu

SEQ ID NO: 84780 - RNA, 64 nt, Homo Sapiens
auccccugagcccagaaguuuuauuaggcugcagaggcaagaggaaauaaaaauuaaaaaaaaa

SEQ ID NO: 84781 - RNA, 64 nt, Homo Sapiens
cccaacucuacaaaaaaauacagccugguuagcaaggcaagaucugaagccacaaguuugagac

SEQ ID NO: 84782 - RNA, 64 nt, Homo Sapiens
uaucaaucaaugcuaaagcuaguaaauauggcucaggcaagaaucaucauuuuucaaccaucac

SEQ ID NO: 84783 - RNA, 64 nt, Homo Sapiens
gaaccauguggaaauggaauuaugaaaugagggaaggcaagaaauggaaaaacaaauauacaaa

SEQ ID NO: 84784 - RNA, 64 nt, Homo Sapiens
cauacuuuccuucgcugucccucccgcacuccuuaggcaagauuucccaguaaagauuuucugu

SEQ ID NO: 84785 - RNA, 64 nt, Homo Sapiens
auuuccagaggaaagcuagaggaucuaguucaagaggcaagaagaucuggcccucaauuagcua

SEQ ID NO: 84786 - RNA, 64 nt, Homo Sapiens
agagccugagaagcgucaggagcaugugguacagaggcaagagcucuuucccccucccugcuga

SEQ ID NO: 84787 - RNA, 64 nt, Homo Sapiens
cuuucccccucccugcugaagaggaaaggagggaaggcaagauuuuuucccagguagugggaga

SEQ ID NO: 84788 - RNA, 64 nt, Homo Sapiens
ucuuaccagcauuagucauacuggggaagaguaaaggcaagaauuucccccgccccucaguuac

SEQ ID NO: 84789 - RNA, 64 nt, Homo Sapiens
gcauuuccuuugggguuuagauauaaagaaauggaggcaagaaacuuauauuaacacguuuuac

SEQ ID NO: 84790 - RNA, 64 nt, Homo Sapiens
gugugagaaggucuacaccucucagagugcaggcauugcacauggggcccagucagcccugcug

SEQ ID NO: 84791 - RNA, 64 nt, Homo Sapiens
gugugaggaguguacaccugcacauggcacaggcauugcacacggggcccagucagcccugcug

SEQ ID NO: 84792 - RNA, 64 nt, Homo Sapiens
gcaugaaugggccuacaccucauggggugcaggcauugcacagaccugggcucaguccuagcug

SEQ ID NO: 84793 - RNA, 64 nt, Homo Sapiens
gugugaaugggucuacaccucgugggguacaggcauugcacacagggcucgaccagcccagcug

SEQ ID NO: 84794 - RNA, 64 nt, Homo Sapiens
gugugaagggucuacaccugcacagggugcaggcauugcacacgaggcccugccagcccugcug

SEQ ID NO: 84795 - RNA, 64 nt, Homo Sapiens
auucuuuaaggcauacuuuucuacaguuuuauagauugcacaucuugcuacccaagagaaaaug

SEQ ID NO: 84796 - RNA, 64 nt, Homo Sapiens
ugagcaauuacagcagagaaccucauucagccguauugcacagaauuaaauacuagauugggaa

SEQ ID NO: 84797 - RNA, 64 nt, Homo Sapiens
uuggauucuuguuacaguguauccaaucugaaguauugcacaucugaacugggacuguuaacac

SEQ ID NO: 84798 - RNA, 64 nt, Homo Sapiens
uuuaaguuuuucuuccuuuuuucccucuguuuauauugcacaucaagucaaaaacauguuuggg

SEQ ID NO: 84799 - RNA, 64 nt, Homo Sapiens
ucugacauuguuuuccaaagacacacuaaacugcauugcacaguucaaaauuugauuacuuaag

SEQ ID NO: 84800 - RNA, 64 nt, Homo Sapiens
aaacuaguccaguuuaauuuuuuguacuuagaauauugcacauuuucuauauaugaguuauuca

SEQ ID NO: 84801 - RNA, 64 nt, Homo Sapiens
aucagugugugucuuuucauuaucaauuugcuauauugcacagaacauuuuuacaguguuuucu

SEQ ID NO: 84802 - RNA, 64 nt, Homo Sapiens
guucuaacaaggauguaacaacucgcuuauuugaauugcacaauuucuauuaaagaugaggcag

SEQ ID NO: 84803 - RNA, 64 nt, Homo Sapiens
cccauuuuauagcuggggaaacaggcuccgagaaauugcacaaccgaccucagguggccggcag

SEQ ID NO: 84804 - RNA, 64 nt, Homo Sapiens
cgagcccccaccccucccugggcccccaagugagauugcacauuuaacuacuguaaggagagga

SEQ ID NO: 84805 - RNA, 64 nt, Homo Sapiens
uuaauuuguguguuuuuagccaaauaguugcauagcaguauaugcuaguagaucuauauuagau

SEQ ID NO: 84806 - RNA, 64 nt, Homo Sapiens
aguauuaucuuguucaggaauuaacuguccguaagcaguauauuaauagugugaaauauauuac

SEQ ID NO: 84807 - RNA, 64 nt, Homo Sapiens
uuuauuucuuguuaagcaucuuuuugaugauuaaggugacuauucagugcccuuugcaauuacc

SEQ ID NO: 84808 - RNA, 64 nt, Homo Sapiens
gaauuucaggcaacagugccuauuucaguuuucaggugacuagauuaagaagucuugccucagu

SEQ ID NO: 84809 - RNA, 64 nt, Homo Sapiens
uuuuuuuuuucuuacuccaaaauaaaucaaggcugcaaugcagcuggugcuguucagauucuac

SEQ ID NO: 84810 - RNA, 64 nt, Homo Sapiens
cuugggggugggggaguuucccuuuucuaaaaaugcaaugcacuaaaacuauuuuaagaaugua

SEQ ID NO: 84811 - RNA, 64 nt, Homo Sapiens
gauuaacaacagcaagaaaacaccugcugcugaugcaaugcaaugcaucccaaugguugugggg

SEQ ID NO: 84812 - RNA, 64 nt, Homo Sapiens
acaacagcaagaaaacaccugcugcugaugcaaugcaaugcaucccaaugguuguggggauugu

SEQ ID NO: 84813 - RNA, 64 nt, Homo Sapiens
uaguacagucaaauuggggucuucgaccucaaaaaauacauaaugacauaauuuaguuucaugu

SEQ ID NO: 84814 - RNA, 64 nt, Homo Sapiens
aauuuaguuucauguaaugaaacuuuguaaacagaauacauacauguguauauguaaagaauuu

SEQ ID NO: 84815 - RNA, 64 nt, Homo Sapiens
cacugcuuagaggugaccuuaauuuccuuucaggaauacauauuuacuagugacuuucuggaac

SEQ ID NO: 84816 - RNA, 64 nt, Homo Sapiens
auuuuuaaaaauaaaaaaaagacccauaguauuaaauacauaucugcugauuuucccaaaacau

SEQ ID NO: 84817 - RNA, 64 nt, Homo Sapiens
aaacuagaaagggacuuuuucagcaacaacaaaaaauacauauaauuugacauugaguuuaauu

SEQ ID NO: 84818 - RNA, 64 nt, Homo Sapiens
guucuaauuuuguauuuuuucauugguaaauuuaaauacauacuaaauguuccuguaaaagaaa

SEQ ID NO: 84819 - RNA, 64 nt, Homo Sapiens
cccaugcuuaaauuuuauaguaaggagaauuggaaauacauauguccaguuuggaauuacuuau

SEQ ID NO: 84820 - RNA, 64 nt, Homo Sapiens
aucauuuaaauauaauucagaccuacugaauuaaaauacauaaauuuuauaaacucaaauuggc

SEQ ID NO: 84821 - RNA, 64 nt, Homo Sapiens
ggauagcucaucccuaggaaagugggucccuucaaauacauaguggggccugccugugagaaac

SEQ ID NO: 84822 - RNA, 64 nt, Homo Sapiens
guacugcucagugauuaaaucacaggauaaacccaauacauauuaggaagagugugugugucua

SEQ ID NO: 84823 - RNA, 64 nt, Homo Sapiens
uuauagaacuuccaucuguguccaauguuuagcaaauacauauuugauaaacauuuaacuuguu

SEQ ID NO: 84824 - RNA, 64 nt, Homo Sapiens
uccaagaaguuggaugggugcauggagaagcagaaauacauauuggaagcuuccaguccaaucu

SEQ ID NO: 84825 - RNA, 64 nt, Homo Sapiens
ggaaauaaaaaugguuugagcaaacauguauugaaauacauauuggcacugggaaaaguggaaa

SEQ ID NO: 84826 - RNA, 64 nt, Homo Sapiens
uuguuucaaaauguuugaaauucauugaagaaucaauacauauuaacuuugaggcgugauuuca

SEQ ID NO: 84827 - RNA, 64 nt, Homo Sapiens
uuugacauucccucuuccaucaccauaugauaaaaauacauaaaucaagacgacaugagcagcu

SEQ ID NO: 84828 - RNA, 64 nt, Homo Sapiens
cuaaguccauaauuguguuugagggugcaagcagaauacauacccaugaggaaaagaaugcaga

SEQ ID NO: 84829 - RNA, 64 nt, Homo Sapiens
uuuaggucuaagucuugcuaccacacacugcaucaauacauaacaacuucuuuuaaaacaauau

SEQ ID NO: 84830 - RNA, 64 nt, Homo Sapiens
uaggauugaaucaacuagaauauuuuguauuuuaaauacauaaaggaacuagccagauggccau

SEQ ID NO: 84831 - RNA, 64 nt, Homo Sapiens
auuccucaguaucuauuccaaauucaugaugauaaauacauaguuucaaaauuaauuuuuuauu

SEQ ID NO: 84832 - RNA, 64 nt, Homo Sapiens
auacuugagaauuuagcaggaaaaaaaaguaaaaaauacauagauguaaacccaaguaaguucu

SEQ ID NO: 84833 - RNA, 64 nt, Homo Sapiens
uuguuuaaauauaaucuauagauggaauaauuuuaauacauauuucuaugauucauguuuuaaa

SEQ ID NO: 84834 - RNA, 64 nt, Homo Sapiens
ugaacaucauaguuguauauacauaauggcucagaauacauauuucccagauauuuauguuuga

SEQ ID NO: 84835 - RNA, 64 nt, Homo Sapiens
uauccagacauaaaugcuaauauguaaauuagaaaauacauaccuauacucaacuggauaugug

SEQ ID NO: 84836 - RNA, 64 nt, Homo Sapiens
auguagcuucugaaaaacucggaaccauggugucaauacauauccacacauucuauucaucgug

SEQ ID NO: 84837 - RNA, 64 nt, Homo Sapiens
cacacauucuauucaucgugauuuaaaacacgagaauacauaggagaacuuaaaagugagaaaa

SEQ ID NO: 84838 - RNA, 64 nt, Homo Sapiens
cugaaauuauauuuaaaauauauuugagacaugaaauacauacugauaauacauaccucaugaa

SEQ ID NO: 84839 - RNA, 64 nt, Homo Sapiens
uaaaauauauuugagacaugaaauacauacugauaauacauaccucaugaaagauuuuauucuu

SEQ ID NO: 84840 - RNA, 64 nt, Homo Sapiens
uaugcgauacagacagcuaacuuuucuuaugaaaaauacauauuugcauguaaacaaugauuuc

SEQ ID NO: 84841 - RNA, 64 nt, Homo Sapiens
cuguucugguuauaaaccuugcuaaugaaaauacaauacauauaaaaauguauagccauguuau

SEQ ID NO: 84842 - RNA, 64 nt, Homo Sapiens
aucugaugaugaauauaaaacaaaaauacauaaaaauacauaaaaguuuucugcuuuuuaaaua

SEQ ID NO: 84843 - RNA, 64 nt, Homo Sapiens
aauacauaaaaucugaugauuuuuuaaauacaaaaauacauaaacucauaggaaaguuuucugc

SEQ ID NO: 84844 - RNA, 64 nt, Homo Sapiens
caaagcuguaaauuuaaagaagcuuguucuuuaaaauacauagaaacucaaaacuugucucuca

SEQ ID NO: 84845 - RNA, 64 nt, Homo Sapiens
guccuuaguugcauaaggcaauacauuuuacuugaauacauauauuuuuuaacuuugaacauca

SEQ ID NO: 84846 - RNA, 64 nt, Homo Sapiens
acaauagauuagaaaucaaauacuuuguauauaaaauacauaaagacuucuugugaaauuucug

SEQ ID NO: 84847 - RNA, 64 nt, Homo Sapiens
gauguuacucucuugcaccacaaagcuuggauuaaauacauaugccuuaaaucuuaauguuccu

SEQ ID NO: 84848 - RNA, 64 nt, Homo Sapiens
ccaaccaacauggugaaacccugucuccacugaaaauacauaaaauuagccgggugcaguggug

SEQ ID NO: 84849 - RNA, 64 nt, Homo Sapiens
gccugcaugacgggagugagacaccaucucaaaaaauacauauaauaauauaaauaaaaauauc

SEQ ID NO: 84850 - RNA, 64 nt, Homo Sapiens
aagaaaacuucucagguuacuccaugacaacaaaaauacauacgcaguauuauuuagugugguu

SEQ ID NO: 84851 - RNA, 64 nt, Homo Sapiens
uaaccauugaacauuaauuuuacuuguaaaaacaaauacauaaggaggauucugauauuuggca

SEQ ID NO: 84852 - RNA, 64 nt, Homo Sapiens
gaggacaaaaauuacaucuuaagcuaauuccuuaaauacauacaguaggugaauuuucaggaca

SEQ ID NO: 84853 - RNA, 64 nt, Homo Sapiens
ugcugcuauuuucuguccuauuuugagaaauauaaauacauagaaauggugcaucuuaacauuu

SEQ ID NO: 84854 - RNA, 64 nt, Homo Sapiens
ggcugaagaacaacagaagagagucaggauaaaaaauacauacuguggucggcaaggugaggga

SEQ ID NO: 84855 - RNA, 64 nt, Homo Sapiens
aaaaagcauuaauugcacagcuaccauccacacaaauacauaguuuuucugacuucacauuuau

SEQ ID NO: 84856 - RNA, 64 nt, Homo Sapiens
uuagcugggcauuguggcacccuucucuacaaaaaauacauaaaugggcagaauggugaaacca

SEQ ID NO: 84857 - RNA, 64 nt, Homo Sapiens
augagaaaauugugcaugaugaaguucauggaaaaauacauauucuaguacaaggggucuucag

SEQ ID NO: 84858 - RNA, 64 nt, Homo Sapiens
acuaguugaaaaaagucucugaacaauucucucuaauacauauuuucugcaaaugggagcaugg

SEQ ID NO: 84859 - RNA, 64 nt, Homo Sapiens
aggcaagcacuuuguucugagucuuuuaucuccaaauacauaguugucucaaaccaagcaagcu

SEQ ID NO: 84860 - RNA, 64 nt, Homo Sapiens
uuggcuaaauaugacaauuaucugaguaugguuaaauacauacaauuaaaugucugaagccaau

SEQ ID NO: 84861 - RNA, 64 nt, Homo Sapiens
cagcuagacacacucaggaguuuuacgugucccucgauaacaguguccaguuuugugaugcugc

SEQ ID NO: 84862 - RNA, 64 nt, Homo Sapiens
ccaucacaacuccaaagcccccaccggaaucacccgauaacagcacccgaucacagacgagugg

SEQ ID NO: 84863 - RNA, 64 nt, Homo Sapiens
uuauauauauauauauauauaacaccagacaaaucgauaacaacccuuuucccuuuccccuuaa

SEQ ID NO: 84864 - RNA, 64 nt, Homo Sapiens
caugcacugugcaaagcaugcaauuacauaguaccgauaacagccauagugcugugaugaugga

SEQ ID NO: 84865 - RNA, 64 nt, Homo Sapiens
uacucuuaaaucaagcaucaauaaaaacugaacacgauaacacuuuuuuuguuuaagucgagau

SEQ ID NO: 84866 - RNA, 64 nt, Homo Sapiens
aagacaagugaaaaaauauuggcaucgaugaaaccgauaacauuggccucauuggauuucuuua

SEQ ID NO: 84867 - RNA, 64 nt, Homo Sapiens
uuaaggacuaauauugcugauugcacuacacaaacgauaacauucauauauacacauauauauu

SEQ ID NO: 84868 - RNA, 64 nt, Homo Sapiens
uuguaguuacuucuaccaaauagccuuuccuuuucgauaacauuccucaguauuuuuauagcca

SEQ ID NO: 84869 - RNA, 64 nt, Homo Sapiens
uaagugugaauuuuuaaauaguaaagugugaugacgauaacacuuauuuggaguuuauuuagaa

SEQ ID NO: 84870 - RNA, 64 nt, Homo Sapiens
gauaguuuuuaacucuaugguguaaaauaaacagcgauaacaguuuguagacuaaaccaaguau

SEQ ID NO: 84871 - RNA, 64 nt, Homo Sapiens
gcuaccuaggggaaacaagauguagugcuauugccgauaacaaguaagauuuuccacacuacag

SEQ ID NO: 84872 - RNA, 64 nt, Homo Sapiens
aaucgccuuuaagguucagcacaggcguugaugccgauaacaagguguaucugguagaaggcga

SEQ ID NO: 84873 - RNA, 64 nt, Homo Sapiens
acaacccagguuauuuucaaucagaccaggcauucgauaacacacuaaggggguaggaauggaa

SEQ ID NO: 84874 - RNA, 64 nt, Homo Sapiens
augugggaaagccuuuauuucuuucacuucuuuucgauaacaugaaaggacucacacuggagag

SEQ ID NO: 84875 - RNA, 64 nt, Homo Sapiens
aucuccuuaaccacacuuaaucuccaaauaaguacgauaacauagucauagucccacccaacau

SEQ ID NO: 84876 - RNA, 64 nt, Homo Sapiens
gugagcucucugccucuucgaagaauuuuuuuaucgauaacauagugagccacugugcccggcc

SEQ ID NO: 84877 - RNA, 64 nt, Homo Sapiens
ucgacacaucaguaccacuaauggaugauggagacgauaacacucuuuaccaucggguacguga

SEQ ID NO: 84878 - RNA, 64 nt, Homo Sapiens
aaguauagauuccaguagccuaguuuccacagcacgauaacaccaugacgccuacugcuguucc

SEQ ID NO: 84879 - RNA, 64 nt, Homo Sapiens
ucccggguucacgccauucuucucagcucacugcaagcuccaccgcuggagugcagugguauga

SEQ ID NO: 84880 - RNA, 56 nt, Homo Sapiens
cagagauguaugcaugauaaauaaauaagcuccagcacaaaaucaaaaugaaauga

SEQ ID NO: 84881 - RNA, 64 nt, Homo Sapiens
gcuggagggcaguggcacgaucucagcucacugcaagcuccaacucccggguucacgccauucu

SEQ ID NO: 84882 - RNA, 64 nt, Homo Sapiens
ccccuugaaccucauuaaauggugauuucuugcuaagcuccagcccgaguggucuccucucagc

SEQ ID NO: 84883 - RNA, 64 nt, Homo Sapiens
auucccacuccucugagcccggaggggacaccccaagcuccaagcuccaagcuccaggccaaag

SEQ ID NO: 84884 - RNA, 64 nt, Homo Sapiens
cuccucugagcccggaggggacaccccaagcuccaagcuccaagcuccaggccaaaggcugaaa

SEQ ID NO: 84885 - RNA, 64 nt, Homo Sapiens
gagcccggaggggacaccccaagcuccaagcuccaagcuccaggccaaaggcugaaaggcacgu

SEQ ID NO: 84886 - RNA, 64 nt, Homo Sapiens
ggagaugaccaguccuuucucccaaccaggucccaagcuccauucccuuuugaaccucauugga

SEQ ID NO: 84887 - RNA, 64 nt, Homo Sapiens
ccagucuccuaagcgacuggugauuggaugaggaaagcuccaacggacagggaagucuccgccc

SEQ ID NO: 84888 - RNA, 64 nt, Homo Sapiens
acguggagguuagaauagagggcagaguaaaaggaagcuccaucugagcaaguacaccaaauga

SEQ ID NO: 84889 - RNA, 64 nt, Homo Sapiens
gguagggccaccacuacgccuucacuugucacccaagcuccaaccacagagaguuugacaaguu

SEQ ID NO: 84890 - RNA, 64 nt, Homo Sapiens
uuuagaaacuuagugggaaaaguaggaugguauuuuuauguaaagccuugacccaauguuuaaa

SEQ ID NO: 84891 - RNA, 64 nt, Homo Sapiens
uucugauuuauugagauugaauuaugccaccacguuuauguaaaaaugaagguggcaccguggu

SEQ ID NO: 84892 - RNA, 64 nt, Homo Sapiens
agaaauguuucugcuguaguuggauuugcccauauuuauguaggugguuuuaauuuuuuaaaug

SEQ ID NO: 84893 - RNA, 64 nt, Homo Sapiens
acaaaacaaggaaaaugcuguaaauauugcauauuuuauguauuuggaccaaaagguuacaagu

SEQ ID NO: 84894 - RNA, 64 nt, Homo Sapiens
uguguuuuguuuaucaugauuauagaauaaggaauuuauguaaauauacuuaguccuauuucua

SEQ ID NO: 84895 - RNA, 64 nt, Homo Sapiens
cauuauuuuauugucuagcuccaguuaucuguauuuuauguaauguaauugacaggauggcugc

SEQ ID NO: 84896 - RNA, 64 nt, Homo Sapiens
uucuaacuguaguuuuauagaaaguauuaaugcuuuuauguauuucaaaacuuucauauguuaa

SEQ ID NO: 84897 - RNA, 64 nt, Homo Sapiens
auguuaaauggaaauuguuuuaaauguguuugaguuuauguaagcauguauacacugugcuaaa

SEQ ID NO: 84898 - RNA, 64 nt, Homo Sapiens
uaaguuuccauaagucuccuacauagcaguguuauuuauguacagauaagaaaaccauauguca

SEQ ID NO: 84899 - RNA, 64 nt, Homo Sapiens
caggucaauaaaugauauaaaaacauguguucuauuuauguauauauauguauguuucuccaaa

SEQ ID NO: 84900 - RNA, 64 nt, Homo Sapiens
gggaucuuuggggcuaacuucgggaucccugcacuuuauguaagaauguaaaccuggagucuca

SEQ ID NO: 84901 - RNA, 64 nt, Homo Sapiens
auaugaacugaaugaaauggacauuuuuucuuaauuuauguauaaauccauaugauuauacaua

SEQ ID NO: 84902 - RNA, 64 nt, Homo Sapiens
acaaacauguuacuauucauuggacagauaucauuuuauguauaaauacuguucacaucacugg

SEQ ID NO: 84903 - RNA, 64 nt, Homo Sapiens
auagaauuuguauuuuuauuguacuuuaaaaagauuuauguaauagguauauauuuaguggcca

SEQ ID NO: 84904 - RNA, 64 nt, Homo Sapiens
cuaggucccuugucacagcuugguuuuuagacuuuuuauguauauguuuauguacaguauauua

SEQ ID NO: 84905 - RNA, 64 nt, Homo Sapiens
ucacagcuugguuuuuagacuuuuuauguauauguuuauguacaguauauuacucuugacaguu

SEQ ID NO: 84906 - RNA, 52 nt, Homo Sapiens
auggccauuuuucccuauaaguuuuauguaguuaaaugcuuccuagaaaccu

SEQ ID NO: 84907 - RNA, 64 nt, Homo Sapiens
acuuuaucuucauuugggguagaaaaauuauuucuuuauguaguagagacaaauuauucucauu

SEQ ID NO: 84908 - RNA, 64 nt, Homo Sapiens
guuaaagaauuguauugaauuuugcaauuguaguuuuauguacuauuuuuuucugccauuuucu

SEQ ID NO: 84909 - RNA, 64 nt, Homo Sapiens
guuaaagaauuguacugaauuuugcaauuuuaguuuuauguacuauuuaaaaguuucauuuucu

SEQ ID NO: 84910 - RNA, 64 nt, Homo Sapiens
ccuuucuaaccugaaggauacccagauuucuuucuuuauguacaagauggaaaauccccuaccc

SEQ ID NO: 84911 - RNA, 64 nt, Homo Sapiens
acucaugcuuuggcuuaaacuguaauuaauuuauuuuauguacaauaaaucgcauuugaaaaag

SEQ ID NO: 84912 - RNA, 64 nt, Homo Sapiens
agaugacuaauuggcaauuugauaguaguuacauuuuauguaacacuugauauaauaacccaaa

SEQ ID NO: 84913 - RNA, 64 nt, Homo Sapiens
ugcgucaaguuaagggcauuguaaauacuguaguuuuauguagcuugcaacuucuacugaaaug

SEQ ID NO: 84914 - RNA, 64 nt, Homo Sapiens
caguacagugcucuguucauugcaagcuggcaaauuuauguagcuauguggaaugauaugucau

SEQ ID NO: 84915 - RNA, 64 nt, Homo Sapiens
ggaacacaaaacucuuuguaauucuguuaaaucuuuuauguagauuuauuuaugaucagccuac

SEQ ID NO: 84916 - RNA, 64 nt, Homo Sapiens
uuuacaucugugaacuauggcuuaagggacaggauuuauguagcuaaacuaauuuugcaaauca

SEQ ID NO: 84917 - RNA, 64 nt, Homo Sapiens
ugcacuggaauguaaucaagaaaguuagucauguuuuauguaccauguuuucacacgugucucu

SEQ ID NO: 84918 - RNA, 64 nt, Homo Sapiens
uuauauggucuuaauuugguuuaaacuaaugaguuuuauguaaggacauuguuaaauugagcua

SEQ ID NO: 84919 - RNA, 64 nt, Homo Sapiens
gugaguauauuuugcauguuuaagaaacauuaauuuuauguauauuauuuuugccuuacuuucu

SEQ ID NO: 84920 - RNA, 64 nt, Homo Sapiens
gucucucaauggguaaccaugaagauaucaugauuuuauguaaaucucaucuaaaauuuuucua

SEQ ID NO: 84921 - RNA, 64 nt, Homo Sapiens
uacuauacaacaauguucuuuggaguauuuuuauuuuauguauaaaguauuuacagauguuaaa

SEQ ID NO: 84922 - RNA, 64 nt, Homo Sapiens
aaaaacgauaauagccuuaccagagcuagaaaauuuuauguauguuaaaaauugcauuguguua

SEQ ID NO: 84923 - RNA, 64 nt, Homo Sapiens
acuagcuuaccugauuuuaaucagcucaugcuuuuuuauguaggagauagaggguccuccacuu

SEQ ID NO: 84924 - RNA, 64 nt, Homo Sapiens
uagaccgagucuuguuguuuagccuaagagaagauuuauguaguaauuucuucucagguaugga

SEQ ID NO: 84925 - RNA, 64 nt, Homo Sapiens
cuaaaguuuaauuuuaagauguuugaauguucaguuuauguauuugaacuacaauaaaccaacc

SEQ ID NO: 84926 - RNA, 64 nt, Homo Sapiens
aauauaugcauucacuugaaagccuuuuuaaaauuuuauguauuggaugcauuauaaacugaaa

SEQ ID NO: 84927 - RNA, 64 nt, Homo Sapiens
aaaaaguauaaggccacacaacaucuucauucuuuuuauguagucuugagccaccacacccggc

SEQ ID NO: 84928 - RNA, 64 nt, Homo Sapiens
uauuaguauauuacuguuauaaauauuuaaguaauuuauguauucaugggccuucaugcuauuu

SEQ ID NO: 84929 - RNA, 64 nt, Homo Sapiens
gauuuuccagcucucaaguuaaacaaucagcuaauuuauguauauagaugcuaaaugcucauug

SEQ ID NO: 84930 - RNA, 64 nt, Homo Sapiens
uagggauaguggaaugaguucagaggcaauguuauuuauguacacgaaugcaaauuccacucag

SEQ ID NO: 84931 - RNA, 64 nt, Homo Sapiens
caacauugcaguacuguaugaaagauuuuuuuauuuuauguagcauuauugagcuuccucuuaa

SEQ ID NO: 84932 - RNA, 64 nt, Homo Sapiens
acuuuacguuuucaugcugcuguaauguggggcuuuuauguagcaauaaacuuuucaaaauuua

SEQ ID NO: 84933 - RNA, 64 nt, Homo Sapiens
guggggcuuuuauguagcacuaaacuuuucaaaauuuauguaauccuguaacuguuuaagccaa

SEQ ID NO: 84934 - RNA, 64 nt, Homo Sapiens
uuuguaauacuuuccuauauuguuucaucuucuuuuuauguaaaaaauaacuuguuuuuucuca

SEQ ID NO: 84935 - RNA, 64 nt, Homo Sapiens
ucaguuggacacuagguugcaucacugguacaauuuuauguaacauguaaauauguacaagugc

SEQ ID NO: 84936 - RNA, 64 nt, Homo Sapiens
gcucugauucuguaauacuaaaaacugaacagcuuuuauguacaaaacauauuuuuauaugauu

SEQ ID NO: 84937 - RNA, 64 nt, Homo Sapiens
uuuauuaauauuuaaauaugugaagcugaguuaauuuauguaagucauauuuauauuuuuaaga

SEQ ID NO: 84938 - RNA, 64 nt, Homo Sapiens
uauuuauauuuuuaagaaguaccacuugaaacauuuuauguauuaguuuugaaauaauaaugga

SEQ ID NO: 84939 - RNA, 64 nt, Homo Sapiens
uugaaccagauccccaauuaaaacaacaguauuuuuuauguagccauaauuuuuuuuuuuuuuu

SEQ ID NO: 84940 - RNA, 64 nt, Homo Sapiens
uacucacaaaaccauugcagaaaagcaagaaauauuuauguagaaguucuuaugaaaacuuauu

SEQ ID NO: 84941 - RNA, 64 nt, Homo Sapiens
cauguaaagaaaauaagucaguggacucuguuccuuuauguaaacuauauugucuuaaaaguau

SEQ ID NO: 84942 - RNA, 64 nt, Homo Sapiens
uuuuuguacauaguagcauugagaacacugucccuuuauguaaauauaguaucuuaauaaaaau

SEQ ID NO: 84943 - RNA, 64 nt, Homo Sapiens
uaauuuguaaaaguuucuuacuuauuaacuuucuuuuauguaagguugcaaauuugugacuguc

SEQ ID NO: 84944 - RNA, 64 nt, Homo Sapiens
uacuugcaucacaguggccggacacaguuucuuauuuauguaaacugucuugaccauugacuau

SEQ ID NO: 84945 - RNA, 64 nt, Homo Sapiens
uaccuaccaauacuaucugcuauaaaaguauuguuuuauguaguuagcuacuaaaugcaaaaug

SEQ ID NO: 84946 - RNA, 64 nt, Homo Sapiens
cuugaauuuuaucugaacuacuagugucaaaagguuuauguaaacaagguaaccaucucauaua

SEQ ID NO: 84947 - RNA, 64 nt, Homo Sapiens
auuagaagagaaacaaauuccaugcuuuauggaauuuauguagacuggagucuucgugaacugg

SEQ ID NO: 84948 - RNA, 64 nt, Homo Sapiens
gggugacucuuuaauauuaccuuauaguagaaacuuuauguaauauagcuaacuccguauuuac

SEQ ID NO: 84949 - RNA, 64 nt, Homo Sapiens
cacagucuuucccuugaagaaucuuuuuaaaaaauuuauguacugaauacugcaaaacccauau

SEQ ID NO: 84950 - RNA, 64 nt, Homo Sapiens
aguagauguaaaauuucacaacuuuuuacuuuuauuuauguacuugugcuuuugaaaagaguau

SEQ ID NO: 84951 - RNA, 64 nt, Homo Sapiens
uaauaaaguuuuaaaaauuuguauguucaaauuguuuauguauaguauaguaugcuauuucugu

SEQ ID NO: 84952 - RNA, 64 nt, Homo Sapiens
acuuuacuaagcuaaacugcucuuuacaauaggauuuauguaaagcaccgugccuggccaagau

SEQ ID NO: 84953 - RNA, 64 nt, Homo Sapiens
gcacauaaucaugcuauucaacagauaguucauauuuauguauuaguuagaccugcagaugugu

SEQ ID NO: 84954 - RNA, 64 nt, Homo Sapiens
uuaguucugaguuagaccugguuuugcuuucaauuuuauguaccuuuuauucuuaaagcauuca

SEQ ID NO: 84955 - RNA, 64 nt, Homo Sapiens
ugguaagcaugcacaguuugcagucuacaguuuuuuuauguagcacaaaauagguguaccuuua

SEQ ID NO: 84956 - RNA, 64 nt, Homo Sapiens
uguucauguuauauuaaaacuugagauuuguguauuuauguagagucuguauugacaagacugu

SEQ ID NO: 84957 - RNA, 64 nt, Homo Sapiens
ugccauuaauguuucuuaucuauaucuguaucuauuuauguagauauugguauauggcagauuu

SEQ ID NO: 84958 - RNA, 64 nt, Homo Sapiens
uucuuuaacuuauuuugagauuugagauuuaaauuuuauguauuguuuacagucagaguaaauc

SEQ ID NO: 84959 - RNA, 64 nt, Homo Sapiens
cugcugucagugcuggacgaagugcuauaacuacuuuauguaacauuacagaacagcuagaggu

SEQ ID NO: 84960 - RNA, 64 nt, Homo Sapiens
guuuggccacaugucaagccaauuguuuguacuauuuauguaccuuuuucauaacuggaauugc

SEQ ID NO: 84961 - RNA, 64 nt, Homo Sapiens
gucuuuuauaauaaaccauuccuguugucuaaauuuuauguacauucucuuaauuuguauauaa

SEQ ID NO: 84962 - RNA, 64 nt, Homo Sapiens
gaaauauacuuaaaaauucaagcaugcauaaaaauuuauguauuaaaaaauacuguuuguuuaa

SEQ ID NO: 84963 - RNA, 64 nt, Homo Sapiens
gcugaauagcaauuuauacaaaucuuugaggcaguuuauguauuaaugucuaccuguaagcaua

SEQ ID NO: 84964 - RNA, 64 nt, Homo Sapiens
aaaccuuaggaugagcucccuauguacucuuaguuuuauguaagugaucuagcuguuuuauuuu

SEQ ID NO: 84965 - RNA, 64 nt, Homo Sapiens
cuuaguuuuauguaagaaaccuagcuguuuuauuuuuauguacuaggccaucucuaaaauugau

SEQ ID NO: 84966 - RNA, 64 nt, Homo Sapiens
cuuagaucggagugugaaguaaauuaugguauauuuuauguaacauuuuaauguuuaugcucau

SEQ ID NO: 84967 - RNA, 64 nt, Homo Sapiens
caggcaggaugacacuuuguguuaaaguguuauuuuuauguauuaccuggaaugaggcagguuu

SEQ ID NO: 84968 - RNA, 64 nt, Homo Sapiens
gacaggggucuugccaugucgcuaauuuuuguauuuuauguagaggcaugcaccaccaugccug

SEQ ID NO: 84969 - RNA, 64 nt, Homo Sapiens
gaucugugacucugaaauaucuuaaagaacuuccuuuauguaaaggagaagaacaugagguaga

SEQ ID NO: 84970 - RNA, 64 nt, Homo Sapiens
uguaucauuauaggcagaagguauuuggcaaauuuuuauguauuguuuuauguacuguacaagu

SEQ ID NO: 84971 - RNA, 64 nt, Homo Sapiens
ggcagaagguauuuggcaaauuuuuauguauuguuuuauguacuguacaaguaacuuauucuug

SEQ ID NO: 84972 - RNA, 64 nt, Homo Sapiens
acuucuaaagcagaaucaaagauaaagauuuuaauuuauguaaacucccuucauauuaauauuu

SEQ ID NO: 84973 - RNA, 58 nt, Homo Sapiens
aggggaacaaaaaaaaaaaucugagguuuuuauguagaucuccacucaggagugguga

SEQ ID NO: 84974 - RNA, 64 nt, Homo Sapiens
ugguauaacauuugaaaauacugcaaguuuaauuuuuauguagaagaauauuaauuuguaaauu

SEQ ID NO: 84975 - RNA, 64 nt, Homo Sapiens
uaaacuaaauauugaaaaugguuuauucaagugauuuauguauuaccauuaacucauucaugua

SEQ ID NO: 84976 - RNA, 64 nt, Homo Sapiens
cgaaagcaaugcuucuaucaaauacuaguauuaauuuauguaucugguuaaugacauacuugga

SEQ ID NO: 84977 - RNA, 64 nt, Homo Sapiens
uuauuaaaauuggaugcuagagaaucaaguuuauuuuauguauauauuuuucugauuauaagag

SEQ ID NO: 84978 - RNA, 64 nt, Homo Sapiens
acugauguauaugguuaucuggguuauaucuauuuuuauguaaacucuauuuuguuuuuggcaa

SEQ ID NO: 84979 - RNA, 64 nt, Homo Sapiens
auucuuuaaaguuuacaaaaaaaaaccuuauguuuuuauguaaucagucauuacacuagggaga

SEQ ID NO: 84980 - RNA, 64 nt, Homo Sapiens
gaauaaguuucuguuaaaauacuuauucucaauauuuauguauaaaccaugcuucucagcuuuc

SEQ ID NO: 84981 - RNA, 64 nt, Homo Sapiens
auucugaauauacuuguaguuuuacuucuuucuguuuauguacccaauuccuuaugauuauuuu

SEQ ID NO: 84982 - RNA, 64 nt, Homo Sapiens
cuaaaucauuuauuaguuguuuuuugaaagcaguuuuauguauaaauaacaaauguuuauauuu

SEQ ID NO: 84983 - RNA, 64 nt, Homo Sapiens
gaagcucauuuucuaugcagguuuuuaaacgucauuuauguaucauucuuuuuauauaucacac

SEQ ID NO: 84984 - RNA, 64 nt, Homo Sapiens
ggacuugaguauacuuggauuacaaauaugucauuuuauguaaggcggaugugcguugguuaua

SEQ ID NO: 84985 - RNA, 64 nt, Homo Sapiens
uuuauuugaagaaaauguuuauuuuucuaagcaauuuauguaauuugaaauuauugauuuuggc

SEQ ID NO: 84986 - RNA, 64 nt, Homo Sapiens
aacuuggcccuagaccuagggauaagcaauguucuuuauguagccaaugcuacgaaacaaaaga

SEQ ID NO: 84987 - RNA, 64 nt, Homo Sapiens
auuuuugcaauucagacaaggguaaacauuuuacuuuauguaauugccacaucccaagauguaa

SEQ ID NO: 84988 - RNA, 64 nt, Homo Sapiens
uuuccuugcauuugaaugguucaauucuguuguguuuauguagaaaauucacaaaucuguucau

SEQ ID NO: 84989 - RNA, 64 nt, Homo Sapiens
aaaucuaaucaggaaaguaagugacaaaauuacguuuauguacuuucuaagcauauucaaaagg

SEQ ID NO: 84990 - RNA, 64 nt, Homo Sapiens
acauuuuuagaacuccaguuagugggauaugguuuuuauguaaauauggcuucacauucauugc

SEQ ID NO: 84991 - RNA, 64 nt, Homo Sapiens
auauuauuuuaaauguuauuuuaaauuauauuguuuuauguaauauauuuuauguaauauugug

SEQ ID NO: 84992 - RNA, 64 nt, Homo Sapiens
auuguguuaaauuauauuguauauaauauuauauuuuauguaauucuuguauuauaaucuuuua

SEQ ID NO: 84993 - RNA, 64 nt, Homo Sapiens
aacacagcuaauuuacucuucuaacuaaauucuauuuauguaacauagaguaguagcucuauuu

SEQ ID NO: 84994 - RNA, 64 nt, Homo Sapiens
uauugcuuauucaaguaguuauauugagcuauguuuuauguaagaagccauuuucucaucugau

SEQ ID NO: 84995 - RNA, 64 nt, Homo Sapiens
cuauaacggugugaaugauuugucuuucccagaauuuauguacuauuuuaauuuuugaaacuga

SEQ ID NO: 84996 - RNA, 64 nt, Homo Sapiens
uaaauagauuuuaagcuucacaaaguuaauuguauuuauguauguuccagaagaguugcaucaa

SEQ ID NO: 84997 - RNA, 64 nt, Homo Sapiens
uugauguucagacauuuaugggaauccccagauauuuauguaucuaacuacuguauucccacaa

SEQ ID NO: 84998 - RNA, 64 nt, Homo Sapiens
aaaacgcuuugguagauuuggccaggagcuuucuuuuauguaaauuggauaaauacacacacca

SEQ ID NO: 84999 - RNA, 64 nt, Homo Sapiens
uucacccguucacuuacuguauaauuuaaaaucauuuauguagcugagacacuucuguauuuca

SEQ ID NO: 85000 - RNA, 64 nt, Homo Sapiens
uuucacuuugguggucugaagaagaaaaagaaauuuuauguauguauguguaaauauguguaua

SEQ ID NO: 85001 - RNA, 64 nt, Homo Sapiens
uguuuuuuaacaacaacaaaaguuuagguucuaauuuauguaaauaccuaguauguguauuuuu

SEQ ID NO: 85002 - RNA, 64 nt, Homo Sapiens
uaccuuuuuuauucugucggguuacugaccucacuuuauguaaauacuucgcaugacaaauuca

SEQ ID NO: 85003 - RNA, 64 nt, Homo Sapiens
ggcaaugugcuguuaaaguaauagacuuuuaaucuuuauguauuuuuuguuuucucuggaguac

SEQ ID NO: 85004 - RNA, 64 nt, Homo Sapiens
ucuuucuauauagccauuucaaaauagcuaauucuucaauaaaauauguagcagaccaaucucu

SEQ ID NO: 85005 - RNA, 64 nt, Homo Sapiens
gucaauccacauuuacaaagauucaguucccuguuucaauaagauuuaaggcugcaauacaagc

SEQ ID NO: 85006 - RNA, 64 nt, Homo Sapiens
uuauguggaacaucuauagagauaaauagaaauuuucaauaagauguaguaacacugugauuua

SEQ ID NO: 85007 - RNA, 64 nt, Homo Sapiens
agaagggagggaauaaaucaugacuuaucccauuuucaauaacaaaacgaaacuauggcacuaa

SEQ ID NO: 85008 - RNA, 64 nt, Homo Sapiens
aagauaccuaauauuuaaguggggacaucaaaacuucaauaaucucucaggcacaaauauauau

SEQ ID NO: 85009 - RNA, 64 nt, Homo Sapiens
ucaccuuaaaagugaccccuuugaaaggucauuuuucaauaaucucacaggguuggaaagaacu

SEQ ID NO: 85010 - RNA, 64 nt, Homo Sapiens
ggaauugacugaacuucccaaauuucuguaucaauucaauaaauuuucuuaaugugccuaaguu

SEQ ID NO: 85011 - RNA, 64 nt, Homo Sapiens
auacgcauucacgcuguaagauacauuucgaucuuucaauaaagcacuuuccaacuauuauaua

SEQ ID NO: 85012 - RNA, 64 nt, Homo Sapiens
gaauccuaggaaagggcucagccugugauaggcauucaauaaauacuccaaugcugucauuccu

SEQ ID NO: 85013 - RNA, 64 nt, Homo Sapiens
gcugugauuuggggccguuuguacucugcauguauucaauaaauucaauucagcaauaguuauc

SEQ ID NO: 85014 - RNA, 64 nt, Homo Sapiens
aauucacaccuaaauguauaaugcuguuguuuauuucaauaaaauuuggcuacuuguauucuuu

SEQ ID NO: 85015 - RNA, 64 nt, Homo Sapiens
auauucuuagauacugaaaguauuuuuaauuuuuuucaauaaagugcuucuggcgaacugauuu

SEQ ID NO: 85016 - RNA, 64 nt, Homo Sapiens
ucacauaaacuuccuguucucuuaauaugacguguucaauaacugggguuaguuaugaaauguu

SEQ ID NO: 85017 - RNA, 64 nt, Homo Sapiens
ggcuaaggaaagacauguuuuuuuuaagguuucuuucaauaauacaagcccaugcuguuguugg

SEQ ID NO: 85018 - RNA, 64 nt, Homo Sapiens
uccugaauauguacuuuuaacacaagagagacuauucaauaaaaacucacugggucuuucaugu

SEQ ID NO: 85019 - RNA, 64 nt, Homo Sapiens
guucuuuuuuauauuguccuccaccuccaucauuuucaauaaaagauagggcuuuugcucccuu

SEQ ID NO: 85020 - RNA, 64 nt, Homo Sapiens
agaugguaaaacacuguugucauuuuuuccaguauucaauaaguagccuuuguacaaauuuaaa

SEQ ID NO: 85021 - RNA, 64 nt, Homo Sapiens
gagugguucagccaucaccaccaguggccaccuguucaauaaaauugccuagcaccacagugga

SEQ ID NO: 85022 - RNA, 64 nt, Homo Sapiens
gguaagaguagaaccagggcaagucuuuccacauuucaauaaugaauaccuuagauuucuaggu

SEQ ID NO: 85023 - RNA, 64 nt, Homo Sapiens
ugugacuuggcugucuuuggaauuaagagagcauuucaauaaaaugaguuuuagaagugaugga

SEQ ID NO: 85024 - RNA, 64 nt, Homo Sapiens
auggauuuuuaugaaaacuuucuguaacuuggguuucaauaauuuaaaaaaguuacgaacuuuc

SEQ ID NO: 85025 - RNA, 64 nt, Homo Sapiens
aaguuacgaacuuucucuguggcagagucaauaauucaauaaaaaagccgacgaaccgacacgc

SEQ ID NO: 85026 - RNA, 64 nt, Homo Sapiens
guuugugcaauaaguggaagggaugucauccuucuucaauaaaugcugaaugacauucaagcug

SEQ ID NO: 85027 - RNA, 64 nt, Homo Sapiens
uagaccacugagaaaaucuuuauuuacaauaaauuucaauaaaauuugcauaaauauauuccca

SEQ ID NO: 85028 - RNA, 64 nt, Homo Sapiens
uuuuagucaaguaauggcuuuugaaaaaguaaaguucaauaauaacuaaggcugugauuuuuuu

SEQ ID NO: 85029 - RNA, 64 nt, Homo Sapiens
uauacaagggcugugcuaugcuaccauauucuuguucaauaauaauagguuuguuguuuuuuuu

SEQ ID NO: 85030 - RNA, 64 nt, Homo Sapiens
cacuacagaauuuagucaacauuuuauauaauguuucaauaaauguuucuuucaauaaagauac

SEQ ID NO: 85031 - RNA, 64 nt, Homo Sapiens
caacauuuuauauaauguuucaauaaauguuucuuucaauaaagauacuaugugcccuucauag

SEQ ID NO: 85032 - RNA, 64 nt, Homo Sapiens
uauuaagcucuucuauauuaaacacuaauagauauucaauaacggaguaaacuguuccagauaa

SEQ ID NO: 85033 - RNA, 64 nt, Homo Sapiens
uaucuuuuaugucuaaagccauuuuauauuacuuuucaauaaaaagaauaucauggucaacaua

SEQ ID NO: 85034 - RNA, 64 nt, Homo Sapiens
aaaguguuugcagguauuugauuauuucaagagcuucaauaaaauuguuagacagucagggugu

SEQ ID NO: 85035 - RNA, 64 nt, Homo Sapiens
agauggauauggauauauagaaucucaucaaggcuucaauaagaugauucuccuuuuaagcuaa

SEQ ID NO: 85036 - RNA, 64 nt, Homo Sapiens
aacccucaacaaauuacacauugagggaacauacuucaauaagaaccaucuaugcuggacucac

SEQ ID NO: 85037 - RNA, 64 nt, Homo Sapiens
aacaaaacugacaagcaaugaaguaagaacuucauucaauaaguggugcuggcauaacuggcua

SEQ ID NO: 85038 - RNA, 64 nt, Homo Sapiens
uagguuugauuacuaggagauaccaccgacauuuuucaauaaaguacugcaaaaugcuuuugug

SEQ ID NO: 85039 - RNA, 64 nt, Homo Sapiens
auuuaguaaaaauaaaucaaggcuaucggagcaguucaauaacaaagguuacuguugagaaaaa

SEQ ID NO: 85040 - RNA, 64 nt, Homo Sapiens
aacccagccauuccgcauggggaagcauuucauguucaauaagaaaaacaguccaggccaaaga

SEQ ID NO: 85041 - RNA, 64 nt, Homo Sapiens
aaugaaaauucuggguguaaugcaagccaaaugguucaauaaugcacauuaucagagagcacug

SEQ ID NO: 85042 - RNA, 64 nt, Homo Sapiens
cuagcuuaauaggacaguaaaucuguguggggcuagaacaaaauuaagacauguuuggcaauau

SEQ ID NO: 85043 - RNA, 64 nt, Homo Sapiens
aaggugcuuuaccuugagccauuauuugugucagagaacaaaagaaacagaaucaauauauaaa

SEQ ID NO: 85044 - RNA, 64 nt, Homo Sapiens
uccauuuuaauaauggaaugaacuaaaauaaacaagaacaaaagaauaguauaauuauaucagu

SEQ ID NO: 85045 - RNA, 64 nt, Homo Sapiens
agcuaaauaaauuacuuuuauaacuuacuaaagcagaacaaacagugaaacuuucuaaaauauu

SEQ ID NO: 85046 - RNA, 64 nt, Homo Sapiens
aucccuacugcugguuucugccuucuccaugcugagaacaaaaucaccuauucacugcuuaugc

SEQ ID NO: 85047 - RNA, 64 nt, Homo Sapiens
ccuauucacugcuuaugcagucggaagcuccagaagaacaaagagcccaauuaccagaaccaca

SEQ ID NO: 85048 - RNA, 64 nt, Homo Sapiens
aaagacaaacauugcaaguucuuugaaaauauaaagaacaaaaucucaguacuauuucuuuuca

SEQ ID NO: 85049 - RNA, 64 nt, Homo Sapiens
uuuaaaaaaacaaaaagaaagcuuguaaauacauagaacaaauaaucuuuagagcaacuuuaag

SEQ ID NO: 85050 - RNA, 64 nt, Homo Sapiens
aucaaaaugaauagaaagaaaaaauguuuugaaaagaacaaaacaguaaugaauguaaugagag

SEQ ID NO: 85051 - RNA, 64 nt, Homo Sapiens
guagcaugauguauuuaaagggcauuugaagaggagaacaaaauauucaaauuguuaaaacauu

SEQ ID NO: 85052 - RNA, 64 nt, Homo Sapiens
ucauauuugaggcaagcuaagaaauuuuucuagaagaacaaagguacugcuacugauuuuggag

SEQ ID NO: 85053 - RNA, 64 nt, Homo Sapiens
uaauguucuuuuuaugcaaaacuuauauauacacagaacaaaaacaaguuaaggaaacaaaaau

SEQ ID NO: 85054 - RNA, 64 nt, Homo Sapiens
guuccaagcacuuuaggcaggggaccuguuuaagagaacaaaaugauaugaacaaaaauuacag

SEQ ID NO: 85055 - RNA, 64 nt, Homo Sapiens
ccccagcucugugccccaugugccugacuucuuaagaacaaaacauggaagggaauguaaaauu

SEQ ID NO: 85056 - RNA, 64 nt, Homo Sapiens
auuuaguaaagcuuuauaaaauagauguuucucuagaacaaaaucuuuauuuucacauaaguca

SEQ ID NO: 85057 - RNA, 64 nt, Homo Sapiens
cacuaucucagaaauaccuuuuggagcaaaacauagaacaaaauacucagugacaaucaucaua

SEQ ID NO: 85058 - RNA, 64 nt, Homo Sapiens
aggaaucacgcaaagugcuuacuguguaagcccaagaacaaaggcuuucugaaucuucucaggc

SEQ ID NO: 85059 - RNA, 64 nt, Homo Sapiens
uugggguucagaaagauaaaucccaaaaguauggagaacaaaggaacucauuuuaaaggacuag

SEQ ID NO: 85060 - RNA, 64 nt, Homo Sapiens
caugcagaugccccauuugagaaccuuaagccuuagaacaaagucccugucuugacccugaaau

SEQ ID NO: 85061 - RNA, 64 nt, Homo Sapiens
cuuuaaacuucugcaguaaguauuuuaguuuuccagaacaaaagcucucccuaagaacauuaga

SEQ ID NO: 85062 - RNA, 64 nt, Homo Sapiens
guuuacauaaguuccuauacaaagaaugcauuccagaacaaauuccaaauauaaccauuuaaag

SEQ ID NO: 85063 - RNA, 64 nt, Homo Sapiens
auuauguuuccuaacugugacagcagcugauuccagaacaaaucuaaccacuugccucuuucuc

SEQ ID NO: 85064 - RNA, 64 nt, Homo Sapiens
cagucuuuggaccacuauuuuacuggccuuugaaagaacaaaguuuacuucaacuaaaauguuu

SEQ ID NO: 85065 - RNA, 64 nt, Homo Sapiens
auguuggacagcauuugguuuguuugguaagagaagaacaaauauggcuaauuguuaauaaggu

SEQ ID NO: 85066 - RNA, 64 nt, Homo Sapiens
uuauagaaaugaauaccuuugugaaccuagacuuagaacaaauccugcuuuugaaaaaaaaugu

SEQ ID NO: 85067 - RNA, 64 nt, Homo Sapiens
acauuauucuccuauuuuagacauuuugugaaagagaacaaauuguccaguggccuccugucag

SEQ ID NO: 85068 - RNA, 64 nt, Homo Sapiens
auaaaucuguauggcaccaagcauaugcugcacaagaacaaaauacagcagcaaguuuuucagu

SEQ ID NO: 85069 - RNA, 64 nt, Homo Sapiens
ccuaaauaguuuuaguaaaguuucuuugcugcggagaacaaauucuacguguuuugagugucua

SEQ ID NO: 85070 - RNA, 64 nt, Homo Sapiens
acucauuuaaaaaguaauucaauaaaagugaaccagaacaaaucaacagcuaaggaauaauuuu

SEQ ID NO: 85071 - RNA, 64 nt, Homo Sapiens
uugcacaagcaaaguauaaggaaccaguuuuccaagaacaaaucaaagggcaaaaaauucauuu

SEQ ID NO: 85072 - RNA, 64 nt, Homo Sapiens
aaaaagccaccgcaauaauugugaaaagcaaaccagaacaaaacagaaucacauucguuuccca

SEQ ID NO: 85073 - RNA, 64 nt, Homo Sapiens
aaaacaaaacaaacacaaacuggugcugauugaaagaacaaaacguguagaucauuuaugggau

SEQ ID NO: 85074 - RNA, 64 nt, Homo Sapiens
aguauauuuuuaugagggagcaaaaguuagacugagaacaaacguuagaaaaucacuucagauu

SEQ ID NO: 85075 - RNA, 64 nt, Homo Sapiens
aaacuuuauguaauauagcuaacuccguauuuacagaacaaaaaaacacaguucccccuccugu

SEQ ID NO: 85076 - RNA, 64 nt, Homo Sapiens
uguauuaaauauuuuaaaaaugcucauucuuuguagaacaaaaauguuuguaauauuuaagaaa

SEQ ID NO: 85077 - RNA, 64 nt, Homo Sapiens
cgcccugacuuuacagggggcuccaugaucuccuagaacaaaacugccuuugagaacugcuuga

SEQ ID NO: 85078 - RNA, 53 nt, Homo Sapiens
augugggcaagaccuccugaacuagaacaaauaggaauauuuucauggaauuu

SEQ ID NO: 85079 - RNA, 64 nt, Homo Sapiens
caucaacuaacuuggacuaauugugaggaagagcagaacaaauuaguagaaagagguuauaaga

SEQ ID NO: 85080 - RNA, 64 nt, Homo Sapiens
uugauuauauguugauugauaacauauuaaauagagaacaaauaagagagguccuuuacaugac

SEQ ID NO: 85081 - RNA, 64 nt, Homo Sapiens
agaaacugcagugguaauuaaauuaauagaaaagagaacaaacugcagguuuagaaaaaugguu

SEQ ID NO: 85082 - RNA, 64 nt, Homo Sapiens
ugggaggagguguccacauuaucaaccuguaucaagaacaaaaaaaauuaauuucagcuugauu

SEQ ID NO: 85083 - RNA, 64 nt, Homo Sapiens
gcagaaaaggcauaccuaagaaagggugagcaacagaacaaaagauuuaucauggcauuucuua

SEQ ID NO: 85084 - RNA, 64 nt, Homo Sapiens
ggagcgguugcucucugucauuaaaccaaccacgagaacaaagacuuuugcacuaccaaccacu

SEQ ID NO: 85085 - RNA, 64 nt, Homo Sapiens
aaccccccugaccuuuccugcuucaacaacugaaagaacaaaugccuuugcuucucauggcaua

SEQ ID NO: 85086 - RNA, 64 nt, Homo Sapiens
agaaaagaaaaaaaaccugcaaaacauugaaaacagaacaaaugaccauccuuuaaucauaacu

SEQ ID NO: 85087 - RNA, 64 nt, Homo Sapiens
caaaggaaaaugcuuuagaaaacuaaaacaaaacagaacaaaagaaacuagacaaauaaagaca

SEQ ID NO: 85088 - RNA, 64 nt, Homo Sapiens
aguacacaaguauaguggcccaggauguagugaaagaacaaauccuagagucuuugaaauuucu

SEQ ID NO: 85089 - RNA, 64 nt, Homo Sapiens
augucaagucuacaucgacugguaaaacauucaaagaacaaacugacaaugauguucuaccuac

SEQ ID NO: 85090 - RNA, 64 nt, Homo Sapiens
auugaaagaaauuugacucauaaacuuccaaguuagaacaaauauuucuucauuauuguugcuu

SEQ ID NO: 85091 - RNA, 64 nt, Homo Sapiens
gaaugucucaguaauuagaaaucccuuaauaaguagaacaaauguggcaaguaggacuccuauc

SEQ ID NO: 85092 - RNA, 64 nt, Homo Sapiens
guuauguagacauuauacauucuguacuuucuaaagaacaaaauccugugaucuaugcaggacc

SEQ ID NO: 85093 - RNA, 64 nt, Homo Sapiens
ugaaaaucaccauuuuaaaguacugccugaccaaagaacaaaucacuucuuucagagagcuuua

SEQ ID NO: 85094 - RNA, 64 nt, Homo Sapiens
gaugccagcauacauuaaagcgguucacgugcagagaacaaagcagugacaaccauuggcccuu

SEQ ID NO: 85095 - RNA, 64 nt, Homo Sapiens
cacuauguagcuuaaagauuucuguuaauuugaaagaacaaaaacaagacagaacuucugguac

SEQ ID NO: 85096 - RNA, 64 nt, Homo Sapiens
uaccacccaaugcugauguccucaccacaugcggagaacaaaugugaagggaguaggauauugg

SEQ ID NO: 85097 - RNA, 64 nt, Homo Sapiens
ccauuaccuucucccucauuucaggagcagccucagaacaaagugagacaguccagccuggaga

SEQ ID NO: 85098 - RNA, 62 nt, Homo Sapiens
ucuuacagagugcaguaugaaacucaccagcgagaacaaacaccuccccagcccccagcccu

SEQ ID NO: 85099 - RNA, 64 nt, Homo Sapiens
ugcccagcacacugccugagggacaacagacaucagaacaaacccccagagagaaacagucaaa

SEQ ID NO: 85100 - RNA, 64 nt, Homo Sapiens
aagagagaaggaaauuuuaucacaaaacaaaaacagaacaaaagaacaaacaaaaaaaaaaaca

SEQ ID NO: 85101 - RNA, 64 nt, Homo Sapiens
gucaggugccuggagcaaaagcaucugacugagcagaacaaaucuacuucggagacaccugucu

SEQ ID NO: 85102 - RNA, 64 nt, Homo Sapiens
aggcauucaugggaauuguuugaacugguugugcagaacaaacaaggcauuugcaggaugagcc

SEQ ID NO: 85103 - RNA, 64 nt, Homo Sapiens
ggaaaaugguaaaaacuugauuuaaaaugaaaugagaacaaagauauuauuaaucaaugcaaua

SEQ ID NO: 85104 - RNA, 64 nt, Homo Sapiens
ucaauuaaauguauaaugagcauacagucaggaaagaacaaacucugacuugcagaaaugcaga

SEQ ID NO: 85105 - RNA, 64 nt, Homo Sapiens
cugacuugcagaaaugcagaugauugcagugaauagaacaaauuuucuuuguagguggaguuug

SEQ ID NO: 85106 - RNA, 64 nt, Homo Sapiens
gaaaggucuuuuuucacugcaaaaugcugauuugagaacaaaagaggcuaacaccugacuuuag

SEQ ID NO: 85107 - RNA, 64 nt, Homo Sapiens
aacccgaccuuuauugcugggggcaugucacaaaagaacaaaauuuggcgagggaguggauaua

SEQ ID NO: 85108 - RNA, 64 nt, Homo Sapiens
aaaacuuuuuuuuuucauuauagaagacuuuugaagaacaaaguaucauaaauagacuaguuag

SEQ ID NO: 85109 - RNA, 64 nt, Homo Sapiens
gacgcaagauacucuauagccagguagucagaagagaacaaaagauuauuuaaaacaugaguga

SEQ ID NO: 85110 - RNA, 64 nt, Homo Sapiens
uauuuaaguaaaaacaaaaugaugcauuuugagaagaacaaagugugcacucagcggcuggaaa

SEQ ID NO: 85111 - RNA, 64 nt, Homo Sapiens
cucauucaaagcacauuguagauauucagagagaagaacaaauggcuggcuuggcaaaucccca

SEQ ID NO: 85112 - RNA, 64 nt, Homo Sapiens
caccaaaucauuugaaaucaaaaaagcaaaaacaagaacaaaaaaucauuuguuugcuuugaag

SEQ ID NO: 85113 - RNA, 64 nt, Homo Sapiens
agaaauuagaagcgauuccagccuccagccauacagaacaaaugcuuuacagacgucgugauca

SEQ ID NO: 85114 - RNA, 64 nt, Homo Sapiens
uagaaaucugccgauaaccuucugcucucuaaugagaacaaaguucugucugcggaacacugac

SEQ ID NO: 85115 - RNA, 64 nt, Homo Sapiens
uauguaacaggcucaacuuaagaaauucuuugucagaacaaauacagugagcaauuuuuguguc

SEQ ID NO: 85116 - RNA, 64 nt, Homo Sapiens
guuuaggcgaccuucugaaacucacagaagucacgugauggagagaggauucaaagccagggcc

SEQ ID NO: 85117 - RNA, 64 nt, Homo Sapiens
cugaaccaaucacuuuguaugcuaugcuccuacugugauggaaaacaaaaugaguauaacuuau

SEQ ID NO: 85118 - RNA, 64 nt, Homo Sapiens
uaguagacaaggauauuaaacagaaaagacagaggugauggaaugagaaaaaucaguagaaacc

SEQ ID NO: 85119 - RNA, 64 nt, Homo Sapiens
aacaagggucagauuuccucuucuccuuacugcugugauggaauguuuacuuagaugugaagag

SEQ ID NO: 85120 - RNA, 64 nt, Homo Sapiens
guuuggaaagggaauguugggccuuccacccauggugauggauggaugggcagcagguggcgcu

SEQ ID NO: 85121 - RNA, 64 nt, Homo Sapiens
aggaacucagggugcccuuacuacugccugggaagugauggaacagcuguuccuggacagccuu

SEQ ID NO: 85122 - RNA, 64 nt, Homo Sapiens
auucacaguaccaugcgaguagcccacaguuaauucccggcagauucuuuggcuguguuuuauc

SEQ ID NO: 85123 - RNA, 64 nt, Homo Sapiens
agggcugugagcugggcuucuguccuccucugugucccggcauggaagccaguauaagcauuuc

SEQ ID NO: 85124 - RNA, 64 nt, Homo Sapiens
ucagccuguggcucuugaggcccucagcccacccucccggcagcacccggugaccagugguggc

SEQ ID NO: 85125 - RNA, 64 nt, Homo Sapiens
cagggcuuccuggaggcgaucugugggcagccccucccggcagcuagugcuguccucccaucuc

SEQ ID NO: 85126 - RNA, 64 nt, Homo Sapiens
aaacuagccaagggcaagcuauuauucagcagugucccggcacuacuaaccccugcaacaagcc

SEQ ID NO: 85127 - RNA, 64 nt, Homo Sapiens
gaucucagcugggugcgauggcucacgccuguaaucccggcacuuugggaggccaaggugggug

SEQ ID NO: 85128 - RNA, 64 nt, Homo Sapiens
cguaucaacgcuaugaacgcaaggcugugauauggaaccagaaggcugucugaacuuuugaaac

SEQ ID NO: 85129 - RNA, 64 nt, Homo Sapiens
ucaaucuaaaugcauucauucuaaaaaauuuuuugaaccagauaaauaaaauuuuuuuuugaca

SEQ ID NO: 85130 - RNA, 64 nt, Homo Sapiens
gcagccuggcccauggcuguggcagccccacugggaaccagacuggugcuggggguaggacuga

SEQ ID NO: 85131 - RNA, 58 nt, Homo Sapiens
uuuaaaaggccgcaaaaaauacugccaagaaccagauuggaucgauacagauggauaa

SEQ ID NO: 85132 - RNA, 64 nt, Homo Sapiens
aaccugcacuucugccaaggaaggaggcugggcagaaccagaaccaggccuggaaaagaaccag

SEQ ID NO: 85133 - RNA, 64 nt, Homo Sapiens
gaggcugggcagaaccagaaccaggccuggaaaagaaccagaaggaagagagccuggaaaagaa

SEQ ID NO: 85134 - RNA, 64 nt, Homo Sapiens
uuaaacacgagacaaaacaauccauauguuuagggaaccagaaaaguccccuggucugucccuu

SEQ ID NO: 85135 - RNA, 64 nt, Homo Sapiens
gcagggugcuucagaugagcaagagaacccagucgaaccagauaccccaggugggccggaggga

SEQ ID NO: 85136 - RNA, 64 nt, Homo Sapiens
cauccucuguauuuuaaugagagucaauaccagagaaccagaggcuuaucuuaguagacaaaaa

SEQ ID NO: 85137 - RNA, 64 nt, Homo Sapiens
ccaucaucucagaggccccuaugcuacaggccaggaaccagagcaaagccuccugcuccuaccc

SEQ ID NO: 85138 - RNA, 64 nt, Homo Sapiens
gcaguuuuccuugagauaccgacaauccaagagugaaccagaaugcauacaguucuugacuuug

SEQ ID NO: 85139 - RNA, 64 nt, Homo Sapiens
aggcuaaggcauacaguucuugcuggacugguuggaaccagaacaaaacaauuccccuguggcc

SEQ ID NO: 85140 - RNA, 64 nt, Homo Sapiens
gagaggaauccacaggaccaccagaagggagagggaaccagauaugcagaucagagauagagga

SEQ ID NO: 85141 - RNA, 64 nt, Homo Sapiens
gaaccagauaugcagaucagagauagaggaaguggaaccagagagcugggagggaccaagguug

SEQ ID NO: 85142 - RNA, 64 nt, Homo Sapiens
gagaggaauccacaggaccaccagagaggagagggaaccagauaugcagaucagagauagagga

SEQ ID NO: 85143 - RNA, 64 nt, Homo Sapiens; identical to SEQ ID NO: 85141

SEQ ID NO: 85144 - RNA, 64 nt, Homo Sapiens
cucucaacccagucucccuucccagggccacucagaaccagaggucuuuagggccaguguacug

SEQ ID NO: 85145 - RNA, 64 nt, Homo Sapiens
gggaggcaucaggccuucuucugguugcaggagagaaccagagggugggaacggggagggaaga

SEQ ID NO: 85146 - RNA, 64 nt, Homo Sapiens
uuugcagauauucuucgguuugaauaauuaaaaugaaccagauaucagggugguuaauuaaaau

SEQ ID NO: 85147 - RNA, 64 nt, Homo Sapiens
aaaugaaccagauaucagggugguuaauuaaaaugaaccagauaucagggugguuuauaaagcc

SEQ ID NO: 85148 - RNA, 64 nt, Homo Sapiens
ccaaagaugaaagcccagacuucaguaaucuuuugaaccagacguggauggugcugaauuguug

SEQ ID NO: 85149 - RNA, 64 nt, Homo Sapiens
cuugcuaaaguucucuuucuuugagaaaacugaggaaccagaaugcuuagaguucauaaaauaa

SEQ ID NO: 85150 - RNA, 64 nt, Homo Sapiens
gguucuagaugaaccaauuaucuggaaaaugaaagaaccagaguuggaaggcacuugacuggcc

SEQ ID NO: 85151 - RNA, 64 nt, Homo Sapiens
aacaaugggaaagaggacugggagaggaaucuaagaaccagauggcuucagcucucuagaggag

SEQ ID NO: 85152 - RNA, 64 nt, Homo Sapiens
cgaaaccaggccugggccgggaccugaaaccaaggaaccagaccagccuggcgccuaggaacca

SEQ ID NO: 85153 - RNA, 64 nt, Homo Sapiens
ugaaaccaaggaaccagaccagccuggcgccuaggaaccagaccaagcaaaacuaaaggcaggu

SEQ ID NO: 85154 - RNA, 64 nt, Homo Sapiens
uucuugguggcuauuagcagaagugcagaguagggaaccagagcugguuaagggccuagugaag

SEQ ID NO: 85155 - RNA, 64 nt, Homo Sapiens
auuuuacaaggaagaaccucuuaagaaguccucagaaccagaagcaaugugaacucucagcgcu

SEQ ID NO: 85156 - RNA, 64 nt, Homo Sapiens
gggauccacaggaacgacauucauacagggacauuugugaaagcaaagcaagaaugaaugcuuu

SEQ ID NO: 85157 - RNA, 64 nt, Homo Sapiens
uuucaugcuaaucuucaaagguucaugcucaauauugugaaaagcuuuuaaaaguuguuuugaa

SEQ ID NO: 85158 - RNA, 64 nt, Homo Sapiens
aggacugacaagugugcaaaauguuuacaaucuuuugugaaauuguaguuuaucauuaguuugu

SEQ ID NO: 85159 - RNA, 64 nt, Homo Sapiens
ccaccauucugaguuuauuaaacauuuuccauucuugugaaaauuucaaccaguuuguccuuuu

SEQ ID NO: 85160 - RNA, 64 nt, Homo Sapiens
agguauuuuaagauucugcugcuguuuagagaaauugugaaacaagcaaaacaaaacuuuccag

SEQ ID NO: 85161 - RNA, 64 nt, Homo Sapiens
gucauuaaaauaauuuuaaagagugaagaaaauauugugaaaagcucuugguugcacauguuau

SEQ ID NO: 85162 - RNA, 64 nt, Homo Sapiens
acaguaggggaggaaauaauccauacaguuuccuuugugaaagaaaauaucucaguuacauuua

SEQ ID NO: 85163 - RNA, 64 nt, Homo Sapiens
gaagccuaaauucagcaucuagaugugaggcuuuuugugaaagauaagauaauaucaagagucu

SEQ ID NO: 85164 - RNA, 64 nt, Homo Sapiens
cucauggauuugggcaaacuaagaaauuuuacaauugugaaaacccucuaauuuccaaaaaugu

SEQ ID NO: 85165 - RNA, 64 nt, Homo Sapiens
aaaaaucacaaauaaaacaggucuagcccagcccuugugaaaaauuguguguguaaacuguaaa

SEQ ID NO: 85166 - RNA, 64 nt, Homo Sapiens
augagaguaaguugcaaccuucaacuugauuaucuugugaaacguguaccuccuuaauccugcu

SEQ ID NO: 85167 - RNA, 64 nt, Homo Sapiens
ugagcauuaaagguuuugauagacuugacuguguuugugaaaacuguaaaucuggaaauuugau

SEQ ID NO: 85168 - RNA, 64 nt, Homo Sapiens
cguucuguuguguguggcuguaaaaccccaugcuuugugaaaugagaaucuugacauuuuucuu

SEQ ID NO: 85169 - RNA, 64 nt, Homo Sapiens
caugcuuugugaaaugagaaucuugacauuuuucuugugaaauuuggaaaaugugaucaauuga

SEQ ID NO: 85170 - RNA, 64 nt, Homo Sapiens
auaauccuacuaauuucuuugcagcuuauuaauuuugugaaauuuguauauaugaagaauuugc

SEQ ID NO: 85171 - RNA, 64 nt, Homo Sapiens
aaugccucauucaucuagagguaaucuggcagucuugugaaaaccgaacacaacucagaaacuu

SEQ ID NO: 85172 - RNA, 64 nt, Homo Sapiens
cccauuuuuugaaauagagaauauuuuauuauuuuugugaaaauagaguuuugguaaucacuuu

SEQ ID NO: 85173 - RNA, 64 nt, Homo Sapiens
aaaaaaacaaauuguguuuugccuuuuuuuuuuuuugugaaauguugacaaagcacaauuuccc

SEQ ID NO: 85174 - RNA, 64 nt, Homo Sapiens
uauuuaccugcuuguggcuuugagccacauuuuguugugaaauugacauauggaauucauagua

SEQ ID NO: 85175 - RNA, 64 nt, Homo Sapiens
uuucaaucagcgauaucagcaugcucugccuuucuugugaaaguugcugcugguaagcaugugc

SEQ ID NO: 85176 - RNA, 64 nt, Homo Sapiens
ucugaguugaagguuaguuuaaacaugaugaucauugugaaaauuuuuuaaucaaaaacuuaua

SEQ ID NO: 85177 - RNA, 64 nt, Homo Sapiens
uuuaaauaagaaaaacauuccuagaagaugauaauugugaaaaccuccuuuggcuuauuugcuu

SEQ ID NO: 85178 - RNA, 64 nt, Homo Sapiens
uuuauauuuugcaagggucauucuagcugccauauugugaaaaacuuuaguggacaagggcaga

SEQ ID NO: 85179 - RNA, 64 nt, Homo Sapiens
ugguuaauuaaguaaccuaaaguaugcauuaggauugugaaaugucucgugaguaugccaaucc

SEQ ID NO: 85180 - RNA, 64 nt, Homo Sapiens
uaaauuacaacucuuguuauaacuuuuuaaaagauugugaaaauaucaaaauauaaaugaauca

SEQ ID NO: 85181 - RNA, 64 nt, Homo Sapiens
gauuaaauucauaagacuuaauuuguacaauaguuugugaaauaucuuguuacugcuuuuauuu

SEQ ID NO: 85182 - RNA, 64 nt, Homo Sapiens
uuagcagacuguggacuguaauaaaguauauaaauugugaaauauaaaaacuuggaacuuauuc

SEQ ID NO: 85183 - RNA, 64 nt, Homo Sapiens
agugacauguucgaaaccuguccauaaaguaauuuugugaaagaaggagcaagagaacauuccu

SEQ ID NO: 85184 - RNA, 64 nt, Homo Sapiens
augcuaagcaguagucgucaaguugcagaucuuuuugugaaauucaaccugugucuuauagguu

SEQ ID NO: 85185 - RNA, 64 nt, Homo Sapiens
auggagauuugaaaauuugaggagaauauauaucuugugaaaauaugugcagaaagauuccaaa

SEQ ID NO: 85186 - RNA, 64 nt, Homo Sapiens
agcauuuauauuggacuaauaaaagauaaagggauugugaaaagaaaaaaaaaaaaagaaaaga

SEQ ID NO: 85187 - RNA, 64 nt, Homo Sapiens
uuuaucugagauugggauguaauggauuuauauauugugaaauuuauuuguguacagaauucuc

SEQ ID NO: 85188 - RNA, 64 nt, Homo Sapiens
ggaaugugggagauugggacuguuuguugagugauugugaaagagaccuaggggaugugugacc

SEQ ID NO: 85189 - RNA, 64 nt, Homo Sapiens
uaaaucaguuauagguuaauguagauaggauguuuugugaaaaagcaaucuauuguguccaaau

SEQ ID NO: 85190 - RNA, 64 nt, Homo Sapiens
gagaugaaaaacgauuaauguuucauuauuauuauugugaaaauauuauuaacacuggggacuc

SEQ ID NO: 85191 - RNA, 64 nt, Homo Sapiens
ugugacauucccuacccccaauguugucagcugcuugugaaacucagccagguugucuaaccug

SEQ ID NO: 85192 - RNA, 64 nt, Homo Sapiens
cccaccgcuauggucuaucuaugaucaccgugcuuugugaaacugugcauccccuuguagccuu

SEQ ID NO: 85193 - RNA, 64 nt, Homo Sapiens
acuagggcaugauacaguaagugaauaucuaaguuugugaaacuauauauuccaaaacauuuuu

SEQ ID NO: 85194 - RNA, 64 nt, Homo Sapiens
uguguuguguuguccauuguagaaacuaguacauuugugaaaauuacccccuuuuuuaacaaaa

SEQ ID NO: 85195 - RNA, 64 nt, Homo Sapiens
ugaaauuucugcugacuuuaucucuggcaacaaauugugaaacacuucaaggaauuuggggauc

SEQ ID NO: 85196 - RNA, 64 nt, Homo Sapiens
uuuguucaaguucuaauaaauuaaaauguuuucuuugugaaacauaugccaccauaccauuuug

SEQ ID NO: 85197 - RNA, 64 nt, Homo Sapiens
ucuguuguguccucucuuccauuacuuguuaaaauugugaaaacguagucugaaauggugacag

SEQ ID NO: 85198 - RNA, 64 nt, Homo Sapiens
auaaauggggccuuuaaaaauaugaaaaacaaacuugugaaaauguauaaaagaugcaucuguu

SEQ ID NO: 85199 - RNA, 64 nt, Homo Sapiens
uaguauaacacaccucacaguguuaagauuuauauugugaaaugagacacccuaccuucaauug

SEQ ID NO: 85200 - RNA, 64 nt, Homo Sapiens
aaucaucgaacuuggauuucaaaugcaauagacauugugaaagcuggcauuucagaaguauagc

SEQ ID NO: 85201 - RNA, 64 nt, Homo Sapiens
aucaauugcgaugcucccacaacucuuuacagacuugugaaaucuucaagaacaccuuuacucu

SEQ ID NO: 85202 - RNA, 64 nt, Homo Sapiens
ugacaaaggcauagaaucuuggcuuaagucacuuuugugaaauuugugaacaucccgcaguaua

SEQ ID NO: 85203 - RNA, 64 nt, Homo Sapiens
guugaaauuuccuucaugccaguuuuuguugccguugugaaauuuggaaagguagaagaaacag

SEQ ID NO: 85204 - RNA, 64 nt, Homo Sapiens
uuauauuaugauuucugguaauuucaguuuuaacuugugaaagcguguauugguaauuuaaauu

SEQ ID NO: 85205 - RNA, 64 nt, Homo Sapiens
uaaccuucucugcugagcaaguaaaucuuuagccuugugaaaacuguuauaugagggagcaucu

SEQ ID NO: 85206 - RNA, 64 nt, Homo Sapiens
aauguugcaguuuuuuaaaauacaguuccagggauugugaaauaaauuaaaagaauaguuauuu

SEQ ID NO: 85207 - RNA, 64 nt, Homo Sapiens
uauauugauauauauacuaguguaacugaaugguuugugaaaaauucuaaaagcauacacaaug

SEQ ID NO: 85208 - RNA, 64 nt, Homo Sapiens
agauuuaauaaaauuccuucacgaccugguacccuugugaaacuguaaaauauaucauaugggg

SEQ ID NO: 85209 - RNA, 64 nt, Homo Sapiens
caacuuuuuucagguaauagaagugaauaauuuauugugaaauaauucauuuuauaaauguaua

SEQ ID NO: 85210 - RNA, 64 nt, Homo Sapiens
uuauaaaaagauuuucauggugagagggauuuuauugugaaauucuagaaaaaaauauuaccac

SEQ ID NO: 85211 - RNA, 64 nt, Homo Sapiens
caaacauuagggugcacuguaaccauuacagagcuugugaaaagugcagaaaccugagccucac

SEQ ID NO: 85212 - RNA, 64 nt, Homo Sapiens
agucucuguuucauggcaacacuggauaauggcuuugugaaauuuaaaaaauuuuuguagcgac

SEQ ID NO: 85213 - RNA, 64 nt, Homo Sapiens
acaaccauugcauguuugcuuuugauguaucccuuugugaaauuagcacuuuuggggccaaugg

SEQ ID NO: 85214 - RNA, 64 nt, Homo Sapiens
uugaacuagaauaaugaaagucuguacaguauguuugugaaagauguuuuauaccauauaagac

SEQ ID NO: 85215 - RNA, 64 nt, Homo Sapiens
uucagaaacaauagauucuuauucaguauuuuuguugugaaaauauaagcaucauuaguugggg

SEQ ID NO: 85216 - RNA, 64 nt, Homo Sapiens
aacucuaaaauuuugcaugaaaauuacauccaaauugugaaaaucagaucuauuuuguuugcca

SEQ ID NO: 85217 - RNA, 64 nt, Homo Sapiens
guuuuuauaaaugaauguaaaauaauuaaaugaauugugaaauggauguuuaagaaaauauagg

SEQ ID NO: 85218 - RNA, 64 nt, Homo Sapiens
aauggccuugcaguuggcucaguuguuuguuguguugugaaauguuuuaggauuuuuuguauug

SEQ ID NO: 85219 - RNA, 64 nt, Homo Sapiens
uguuguguugugaaauguuuuaggauuuuuuguauugugaaaauaugaauaugauuggauucag

SEQ ID NO: 85220 - RNA, 64 nt, Homo Sapiens
aaauuaacuuucugaauuugaucugucuucagucuugugaaaaaguugaacaaauuuccuaauc

SEQ ID NO: 85221 - RNA, 64 nt, Homo Sapiens
aauuauuuuguuucuaguuuuuucaaguacuacauugugaaagcugauagcuggagaacuuuag

SEQ ID NO: 85222 - RNA, 64 nt, Homo Sapiens
ucuggauuaaaaaauuaccuuuugcaccaugaguuugugaaaaagaggaagcugggggacccau

SEQ ID NO: 85223 - RNA, 64 nt, Homo Sapiens
gguuuauuccacuggagaaacauagggcagcucuuugugaaagucuagaaaucuguggguuaua

SEQ ID NO: 85224 - RNA, 64 nt, Homo Sapiens
uaauuucucucuauagcaccuugcuuuuauacuuuugugaaauuuuacagauuuuagccagucu

SEQ ID NO: 85225 - RNA, 64 nt, Homo Sapiens
guucuucuguuuguauuuuugcgacugaccaggauugugaaagauaaucaaguguugauugugc

SEQ ID NO: 85226 - RNA, 64 nt, Homo Sapiens
uauuuuauauaguaaagugaugcucuguuauauauugugaaauuguagaugaaguacuuugcgg

SEQ ID NO: 85227 - RNA, 64 nt, Homo Sapiens
gagauuaacauuucacaaauguuuagugaaacauuugugaaaaaagaagacuaaauuaagaccu

SEQ ID NO: 85228 - RNA, 64 nt, Homo Sapiens
ccuagaagauacaauaauuagucauaaacaugcauugugaaacuguagagagcagguagcccaa

SEQ ID NO: 85229 - RNA, 64 nt, Homo Sapiens
uaaaaggugacagguagauguuaauuucccuagauugugaaagugaucacgacaaucacacaac

SEQ ID NO: 85230 - RNA, 64 nt, Homo Sapiens
ucauguacuucccuaggacuagaugcauaccguuuugugaaaaccagccauaggaaaacaugug

SEQ ID NO: 85231 - RNA, 64 nt, Homo Sapiens
cuaugucuguguuucuuaggaauguugaagcuuuuugugaaaacuguacuguauacauauauaa

SEQ ID NO: 85232 - RNA, 64 nt, Homo Sapiens
augucauuucuuccugaggaaggaagauuugauguugugaaauaacauucguuacuguugugaa

SEQ ID NO: 85233 - RNA, 64 nt, Homo Sapiens
aagauuugauguugugaaauaacauucguuacuguugugaaaaucugucaugagcauuuguuua

SEQ ID NO: 85234 - RNA, 64 nt, Homo Sapiens
aacuuguuuacuauuggagauuuaguaacagccuuugugaaaugauaacaucauacauaaguca

SEQ ID NO: 85235 - RNA, 64 nt, Homo Sapiens
ggguggaugaaaaugcauucgagcucuccugacuuugugaaaaauuuuugacuuuauauuuccu

SEQ ID NO: 85236 - RNA, 64 nt, Homo Sapiens
cucaagggaaggugaugcagugggcacuggcauuuugugaaacuuauagcauugugauucuuuc

SEQ ID NO: 85237 - RNA, 64 nt, Homo Sapiens
acuuuuagaacagaccuuuuuuaaauauauauauuugugaaagauagguagccuauuuuaauau

SEQ ID NO: 85238 - RNA, 64 nt, Homo Sapiens
accuacuccuauauacugacagugcacaacacauuugugaaauauauauacaacuaugugacuu

SEQ ID NO: 85239 - RNA, 64 nt, Homo Sapiens
cccaguuaaauauauacaacaggcuggaagucuuuugugaaauucguugccacacaaggugcac

SEQ ID NO: 85240 - RNA, 64 nt, Homo Sapiens
caauuaauugcauacaguaauuguaagaugcuaguugugaaauagcacagugguacugucuuuu

SEQ ID NO: 85241 - RNA, 64 nt, Homo Sapiens
gauaguuauauguauacaagguauuauuugagaauugugaaacaagugcaagcugccuaaauau

SEQ ID NO: 85242 - RNA, 64 nt, Homo Sapiens
uagccauacacaugguaacauugacuauggagucuugugaaaguguaaugugcgauggcuaugu

SEQ ID NO: 85243 - RNA, 64 nt, Homo Sapiens
aaggaugccucugauaggaggacaaccaugcaaauugugaaauaguccugaaguucuuggauua

SEQ ID NO: 85244 - RNA, 64 nt, Homo Sapiens
cacaucagcuguuaaccauuugcaccucuaaguguugugaaacuguaaauuucauacauuugac

SEQ ID NO: 85245 - RNA, 64 nt, Homo Sapiens
ugugauauugggcucuucaggaagcauaaagcaauugugaaauacaguauaccgcaguggcucu

SEQ ID NO: 85246 - RNA, 64 nt, Homo Sapiens
guauuucucauuucauuuuagggaugacaaacauuugugaaaccagugagagaaggcuugaugu

SEQ ID NO: 85247 - RNA, 64 nt, Homo Sapiens
cagaucuggagaggagcuggcccggaaggcgugguugugaaagcgcccuucuuauguuaggagg

SEQ ID NO: 85248 - RNA, 64 nt, Homo Sapiens
cagccuucccugugggucucggacacacugaccauugugaaauucagcuugaagacuggcucug

SEQ ID NO: 85249 - RNA, 64 nt, Homo Sapiens
guuuuuuuguuguuauuuugacugacacugugucuugugaaauucaggaaggacaucgggcagg

SEQ ID NO: 85250 - RNA, 64 nt, Homo Sapiens
aaauccauggugaaaaugaaaauuucaaaggaguuugugaaaaaauuuacauauaagucuguuu

SEQ ID NO: 85251 - RNA, 64 nt, Homo Sapiens
ggccaucuuuaagcauauuuacuuuuuuguuuacuugugaaaauacuuuguuucuuacaugugu

SEQ ID NO: 85252 - RNA, 64 nt, Homo Sapiens
aaaguaguucuaguguggucguuauaaaccaauauugugaaaaauagcaacuauucauuuguuc

SEQ ID NO: 85253 - RNA, 64 nt, Homo Sapiens
cucuugguucuauaaacuagauaaaagcagugcuuugugaaaugcaguguucucucuuaacgcc

SEQ ID NO: 85254 - RNA, 64 nt, Homo Sapiens
caaucaauuacuagaugaguucuuucccuacccuuugugaaaacgaauucaccaaccagggguu

SEQ ID NO: 85255 - RNA, 64 nt, Homo Sapiens
cugauuuaaaaagaaaaaaaugcacaagaucuguuugugaaagcgccuccacccaggagacuga

SEQ ID NO: 85256 - RNA, 64 nt, Homo Sapiens
guugaauuaguuagugaauaaucccuauguaccuuugugaaauugccucaguguggccugagaa

SEQ ID NO: 85257 - RNA, 64 nt, Homo Sapiens
uuauccauuuaucuucagguaaguaugccuugccuugugaaaaugauuaagauuuaaaaacgaa

SEQ ID NO: 85258 - RNA, 64 nt, Homo Sapiens
aaaacagcugcuguuaauauucuaaauaaauguauugugaaacccuauuacuguauguugcuuu

SEQ ID NO: 85259 - RNA, 64 nt, Homo Sapiens
uaaccaugcuaaccaccaaggugugagcuugugcuugugaaagcgacagcagccuaguuuucga

SEQ ID NO: 85260 - RNA, 64 nt, Homo Sapiens
aaaauaaaaauuacuaagccuggcugucacaagcuugugaaaggaucagugugucaaagcauua

SEQ ID NO: 85261 - RNA, 64 nt, Homo Sapiens
cuuuuucuccauguauugagcuggauguugaauuuugugaaaugguuuaggauuuccaugauga

SEQ ID NO: 85262 - RNA, 64 nt, Homo Sapiens
ugucagcuacugggaauauuuuuguagagcugcauugugaaaaaaagauggucuuaccugaauc

SEQ ID NO: 85263 - RNA, 64 nt, Homo Sapiens
agauaaaaaauguaucugcagcaacucugcagguuugugaaauaggaugaaacucaaucuuuuu

SEQ ID NO: 85264 - RNA, 64 nt, Homo Sapiens
ucuuucaugaguguccggcaucugcuggucuucauugugaaacgugccagucgugcuuugugaa

SEQ ID NO: 85265 - RNA, 64 nt, Homo Sapiens
gcuggucuucauugugaaacgugccagucgugcuuugugaaaaauaacaaaguggucacagaaa

SEQ ID NO: 85266 - RNA, 64 nt, Homo Sapiens
augugcuuugauucgaagggcugugguuuaagcuuugugaaagauccauuucuggacaugacgu

SEQ ID NO: 85267 - RNA, 64 nt, Homo Sapiens
guacuacagcuuauugacauucuaauaaagucauuugugaaagguagauaucuagacaauuucu

SEQ ID NO: 85268 - RNA, 64 nt, Homo Sapiens
cauuauugauuuaaauaauguguuucugcaauaauugugaaaugaauuuacgaugucucaguga

SEQ ID NO: 85269 - RNA, 64 nt, Homo Sapiens
ugucauaagaaacaaaauaugauuucaaccugaauugugaaaugccuaugggaggcagucccca

SEQ ID NO: 85270 - RNA, 64 nt, Homo Sapiens
cagcguagucagcccuugcggcgcuagggcucgguugugaaauagagcguagggugcugagcug

SEQ ID NO: 85271 - RNA, 64 nt, Homo Sapiens
cuaacugcacacgaagccgcauacucuucucaguuugugaaacguuugggguuugggcuuuuuu

SEQ ID NO: 85272 - RNA, 64 nt, Homo Sapiens
auuauacaacuaagaugaaauauugaaaaacccuuugugaaaguaacuuuucaaguaaaugcac

SEQ ID NO: 85273 - RNA, 64 nt, Homo Sapiens
aauaaguucuuuuaaacagucuuuuuauuguggauugugaaaucaaaaucuggagaaaugcuua

SEQ ID NO: 85274 - RNA, 64 nt, Homo Sapiens
uuugaauuagcuuucauaugaaauagugugacuuuugugaaaaugguaauuuacuacacuuaua

SEQ ID NO: 85275 - RNA, 64 nt, Homo Sapiens
auaauuuuaaggaaaucuuauaggauaauuguaauugugaaaaaaaaugccacuauuguggaaa

SEQ ID NO: 85276 - RNA, 64 nt, Homo Sapiens
aagaaaauuuaccaccuugugaaucauauugcuuuugugaaacaagugaauuaauuucaaauag

SEQ ID NO: 85277 - RNA, 64 nt, Homo Sapiens
uauuauguauuaaguguuugagagacaaauucaguugugaaaagggccuugauguuggggaaac

SEQ ID NO: 85278 - RNA, 64 nt, Homo Sapiens
gaugcauuuauuuuaucaauaccaauuuuuguggccauggcagacauugcuaaucaaucacagc

SEQ ID NO: 85279 - RNA, 64 nt, Homo Sapiens
uugacugcuggcagucuaaaacaguccacccaccccauggcacugccgcgugauucccgcggcc

SEQ ID NO: 85280 - RNA, 64 nt, Homo Sapiens
uuugagagagggggcacuguuagaggggaaugaaccauggcaccaggcccaguucucgugcccu

SEQ ID NO: 85281 - RNA, 64 nt, Homo Sapiens
ccuaaaugcagucagucacaagcagccuuuuucaccauggcaaacuggccaggacacacugaaa

SEQ ID NO: 85282 - RNA, 64 nt, Homo Sapiens
ggaaaacaaacuuaguaucagggguccaugaagcccauggcaucauuuuugaaaauauuucuag

SEQ ID NO: 85283 - RNA, 64 nt, Homo Sapiens
ucaaauuugaaugucauaguacauugugugcuaaccauggcaagcaaacauuuacauuuguuuu

SEQ ID NO: 85284 - RNA, 64 nt, Homo Sapiens
gccaauguguggcucagugccuggacaaaugaugccauggcagacaguagacagaacaacacuu

SEQ ID NO: 85285 - RNA, 64 nt, Homo Sapiens
ccaacaggguucuuggugaugcuggcagccauggccauggcagcggguggcauccaggcugccc

SEQ ID NO: 85286 - RNA, 64 nt, Homo Sapiens
uuuggggccaaaaugaauaagcuggacuuucuccccauggcacuggggaaccauggaaguucag

SEQ ID NO: 85287 - RNA, 64 nt, Homo Sapiens
gggccugggcuuucuuccaagggcacugggggagccauggcaagguuguagguaggguagagau

SEQ ID NO: 85288 - RNA, 64 nt, Homo Sapiens
cugcugagucucccaggacccccuuuggagaugcccauggcaugggcacugcccacaggcucag

SEQ ID NO: 85289 - RNA, 64 nt, Homo Sapiens
gcaucaaagccuuuccuugggaaucugccucccuccauggcagggguggauucgggagcuggga

SEQ ID NO: 85290 - RNA, 64 nt, Homo Sapiens
ucauguuugaaaccaugcuuggcuggaccgggacccauggcaagagcaccugggcaccaguguu

SEQ ID NO: 85291 - RNA, 64 nt, Homo Sapiens
uccccugcuuuuugagguuggguuaaaaugccgaccauggcagaggggucacagcucagguucc

SEQ ID NO: 85292 - RNA, 64 nt, Homo Sapiens
cugcccuacucacucuccauuccuuuuucccaauaaauucuacuccugucuuugcugagagcuu

SEQ ID NO: 85293 - RNA, 64 nt, Homo Sapiens
acuuuuccuaaggcacccacaauugaauaggaucaaauucuacaucacaaaggaaagauuugcc

SEQ ID NO: 85294 - RNA, 64 nt, Homo Sapiens
aagcauaaaucauucaaaucuucauuuaucucuaaaauucuaaaucugaaucuugccuaggugu

SEQ ID NO: 85295 - RNA, 64 nt, Homo Sapiens
uuuccaauauaagguuuaacaaucuuugaagccaaaauucuaguauuaacacaguggaaggaca

SEQ ID NO: 85296 - RNA, 64 nt, Homo Sapiens
uuagccaaaaguuuauguguuuaggccauucucuaaauucuaguaauggaaaagaacucggcug

SEQ ID NO: 85297 - RNA, 64 nt, Homo Sapiens
cacugacaugaaaguugccuuaaaaaaaaaacccaaauucuaagucuuuaacuuuauaagacuu

SEQ ID NO: 85298 - RNA, 64 nt, Homo Sapiens
acaguaugucauguuugcuguauuuuuuucaauaaaauucuauuaaacuucaguaaguacgugu

SEQ ID NO: 85299 - RNA, 64 nt, Homo Sapiens
acacacacuguucugaaagucagccacaaccaaaaaauucuacaucuaugcaaucugaguagag

SEQ ID NO: 85300 - RNA, 64 nt, Homo Sapiens
uuuuguuaaaauaaauaacauuuaauuugacggaaaauucuaaaaaucaacauuugguaacuua

SEQ ID NO: 85301 - RNA, 64 nt, Homo Sapiens
auaacucacuuuucaguuaaguuaggcugaguugaaauucuacuaaguuuucccauauucuuga

SEQ ID NO: 85302 - RNA, 64 nt, Homo Sapiens
aagguugcauaggguuuccucauuggagaccgggaaauucuauucuugggauaaauaauaguaa

SEQ ID NO: 85303 - RNA, 64 nt, Homo Sapiens
accgggaaauucuauucuugggauaaauaauaguaaauucuauaggauucaauacuuaguuugc

SEQ ID NO: 85304 - RNA, 64 nt, Homo Sapiens
aaacaacaacaaggacaacaacaaaaaaccagugaaauucuacaagugucccuuuuaaaaauag

SEQ ID NO: 85305 - RNA, 64 nt, Homo Sapiens
gaagcgauaaacuuuaaauauacuuauuaaaaugaaauucuauuaaguuuuucagaucuuauuu

SEQ ID NO: 85306 - RNA, 64 nt, Homo Sapiens
uuaauauaaacccauaaguucuuacuguacauacaaauucuacugaugcuaauggaauuacugc

SEQ ID NO: 85307 - RNA, 64 nt, Homo Sapiens
cuaaagcuucuauaaaauauuggauuuucccccuaaauucuacuuaguuuagauauguuaagca

SEQ ID NO: 85308 - RNA, 64 nt, Homo Sapiens
agagagaaaguaaaagcacuucacaaaaaaaugaaaauucuaaggacauacaagagccauuguu

SEQ ID NO: 85309 - RNA, 64 nt, Homo Sapiens
aaucaaaagaagaacaauauuucaugacaccugaaaauucuaugaaauucagauuucagugucc

SEQ ID NO: 85310 - RNA, 64 nt, Homo Sapiens
ugauuuguuccuuauuaaagcuucccagcguaugaaauucuaagcugggugggguggcucacac

SEQ ID NO: 85311 - RNA, 64 nt, Homo Sapiens
agcaagacucucucucaaaaaaaaaaaaaaaaaaaaauucuagaccgaaguguacggcagugcc

SEQ ID NO: 85312 - RNA, 64 nt, Homo Sapiens
uauuauaguguugccugucuaacagaucuuugccaaauucuagauaccauucuguaucuuauau

SEQ ID NO: 85313 - RNA, 64 nt, Homo Sapiens
gacauauaucaacacauucagguguggcuguuuaaaauucuaauuugauguauauauauauuaa

SEQ ID NO: 85314 - RNA, 64 nt, Homo Sapiens
cuuuggaaguuuucuuugccuuaguuuuggaaguaaauucuaguuuguaguucucauuuguaau

SEQ ID NO: 85315 - RNA, 64 nt, Homo Sapiens
uggccacugcagauggaguuuuagaguaguaaugaaauucuaccuagaaugcaaaauuggguau

SEQ ID NO: 85316 - RNA, 64 nt, Homo Sapiens
cauuuuagaauugaucagacauuagaacacagaaaaauucuaguacauuuaaauucuaaacaau

SEQ ID NO: 85317 - RNA, 64 nt, Homo Sapiens
agacauuagaacacagaaaaauucuaguacauuuaaauucuaaacaauacaguggaugacccuu

SEQ ID NO: 85318 - RNA, 64 nt, Homo Sapiens
gggcagguuagagacaguauugccuugcugcauaaaauucuagagugaggucacauguuggugc

SEQ ID NO: 85319 - RNA, 64 nt, Homo Sapiens
aaaaccacccacaaagaaaccuuucuaauguucuaaauucuauaauuuuucauggcaacaucag

SEQ ID NO: 85320 - RNA, 64 nt, Homo Sapiens
aggaaagccagccagaggaagugucagcacuuuaaaauucuagaccccaaaaaacuacaaaauc

SEQ ID NO: 85321 - RNA, 64 nt, Homo Sapiens
ggaaaggaagagaacugauuccuacugaaaauucaaauucuauuaccauucuaacuuucauaaa

SEQ ID NO: 85322 - RNA, 64 nt, Homo Sapiens
gcuuaaagauuauaaauuauguaaauacauuaauaaauucuaaguuucauuugacauuccauug

SEQ ID NO: 85323 - RNA, 64 nt, Homo Sapiens
uucugaaaucauauaaaaagaaugucauuaguaaaaauucuaacuucguuuuguuuaaaagaca

SEQ ID NO: 85324 - RNA, 64 nt, Homo Sapiens
aacucccuuuggcuacuuuugaaaaucaagaugagauauauagauauauauccauacauuuuau

SEQ ID NO: 85325 - RNA, 64 nt, Homo Sapiens
uuggcuacuuuugaaaaucaagaugagauauauagauauauauccauacauuuuauugucagaa

SEQ ID NO: 85326 - RNA, 64 nt, Homo Sapiens
cugacaugaauuugaagauauaucuaucuguauggauauauaucuauauguauauagauauaua

SEQ ID NO: 85327 - RNA, 64 nt, Homo Sapiens
ucuaucuguauggauauauaucuauauguauauagauauauaaauacagagagauaucuggcuu

SEQ ID NO: 85328 - RNA, 64 nt, Homo Sapiens
cccuauauaucuugaaucuaauauaauauauauagauauauaauauauaucuguauagacacac

SEQ ID NO: 85329 - RNA, 64 nt, Homo Sapiens
cacacacacacagaaagauguauauguguguguggauauauauacacuaagcaacaauagauuu

SEQ ID NO: 85330 - RNA, 64 nt, Homo Sapiens
uuuucauuuuuuguacuugaucuuaacagucauagauauauacauuuuaaugauuucuaacauu

SEQ ID NO: 85331 - RNA, 64 nt, Homo Sapiens
cuauuuuuuccuaaggauaaaguuaaaacauccagauauauaagugaaacaaaauaucuuuaaa

SEQ ID NO: 85332 - RNA, 64 nt, Homo Sapiens
aaugauuugcuuuucagugagaauauauauaugagauauauauagauauauauucuagguuggg

SEQ ID NO: 85333 - RNA, 64 nt, Homo Sapiens
uuuucagugagaauauauauaugagauauauauagauauauauucuagguuggguggugguaga

SEQ ID NO: 85334 - RNA, 64 nt, Homo Sapiens
guuuguacacagguaacaaaaaguuacuuuaaaagauauauaaagggcuguaagcuaauugugg

SEQ ID NO: 85335 - RNA, 64 nt, Homo Sapiens
cauguguacuauauuuguuuauagacuguagguggauauauaauuuaaaagcuugauuuaauaa

SEQ ID NO: 85336 - RNA, 64 nt, Homo Sapiens
cucucucaauacagauaaacucacacauacuggagauauauauauaauagauauauauaaaauu

SEQ ID NO: 85337 - RNA, 64 nt, Homo Sapiens
uaaacucacacauacuggagauauauauauaauagauauauauaaaauuauuuuaaugcauugu

SEQ ID NO: 85338 - RNA, 64 nt, Homo Sapiens
uagauuauacauauauauacacacguguauaugagauauauaucuuauaucuccacaaacacaa

SEQ ID NO: 85339 - RNA, 64 nt, Homo Sapiens
gggacguuccaugcccagguuaacaaagaacugugauauauagagugucuaauuacaaaaucau

SEQ ID NO: 85340 - RNA, 64 nt, Homo Sapiens
guuucuuugccggcauguugaauauauauacauggauauauaaagauauauauauauauauaua

SEQ ID NO: 85341 - RNA, 64 nt, Homo Sapiens
uauauauauaaauauauauacauauagauagguagauauauauauuuccgagacuguauacguc

SEQ ID NO: 85342 - RNA, 64 nt, Homo Sapiens
ucuauauaucuauauauaugaaaaauuuuuaaaagauauauauaaaagaggaacuucaauuaug

SEQ ID NO: 85343 - RNA, 64 nt, Homo Sapiens
caggcacucucuaaggucuauagauucugcuugggauauauaucuuauggucuuuugauaggaa

SEQ ID NO: 85344 - RNA, 64 nt, Homo Sapiens
caaaguacugcugaacuguggauuuuuugaaugagauauauaauaagaauguggccauuauuuu

SEQ ID NO: 85345 - RNA, 64 nt, Homo Sapiens
cugauaaauauuuaggcugacaauugaacaacaggauauauagauuuuuuuaaaaaucaaaagc

SEQ ID NO: 85346 - RNA, 64 nt, Homo Sapiens
uucuugugccuaguacuuuagaaaaugccuaaucgauauauauaacuuagagacugauuagacu

SEQ ID NO: 85347 - RNA, 64 nt, Homo Sapiens
uuuuuuaaugcaggaaaguauauaucauauauaugauauauauuugauauauaugugauauaua

SEQ ID NO: 85348 - RNA, 64 nt, Homo Sapiens
uaucauauauaugauauauauaugauauauaugugauauauauaugcugucuaaaugauauaua

SEQ ID NO: 85349 - RNA, 64 nt, Homo Sapiens
ugauauauauauaucauauaaaugauauauauaugauauauaugcuucuuggaucugcugucua

SEQ ID NO: 85350 - RNA, 64 nt, Homo Sapiens
ugauauauaugugauauauaucugcugucuaaaugauauauauaugccuggucaccuucuugga

SEQ ID NO: 85351 - RNA, 64 nt, Homo Sapiens
uuuaaaaaaacauagcugcaauaaaauacuuaaagauauauaaaauggaagauucaagaaaacu

SEQ ID NO: 85352 - RNA, 64 nt, Homo Sapiens
uacccaguagcuaaaaugguugaagcaagugggagauauauaaaagucaucaguucguguuguc

SEQ ID NO: 85353 - RNA, 64 nt, Homo Sapiens
uuuuuuaaagagcaacugccggccugacugcacugauauauauuauauauauuucccccuaugg

SEQ ID NO: 85354 - RNA, 64 nt, Homo Sapiens
ucccccuauggggccugacucuuuuaauuguauagauauauauuauauuuuacaauaaaagcaa

SEQ ID NO: 85355 - RNA, 64 nt, Homo Sapiens
aaaaacuaugaggaaaacuuauauuagaacuuuugauauauacuaaaauacugauuaucuuaau

SEQ ID NO: 85356 - RNA, 64 nt, Homo Sapiens
ugagagaacgaaagccaaagugucauuuaagagagauauauaugaaaaaguaacauuaauauau

SEQ ID NO: 85357 - RNA, 64 nt, Homo Sapiens
gcuuuguguacaaaaaugguauauguaggccuuugauauauaaucaagugccauuagaugauau

SEQ ID NO: 85358 - RNA, 64 nt, Homo Sapiens
uaggccuuugauauauaaugaagugccauuagaugauauauauguuuaagacuuauuauaauuc

SEQ ID NO: 85359 - RNA, 64 nt, Homo Sapiens
uagaucucuuuagucuuuucgggucuucagagucgauauauaggaguaauaguguauggcauug

SEQ ID NO: 85360 - RNA, 64 nt, Homo Sapiens
uguauauauagauguauauauauacacacacagagauauauacauauggcuguacuuuugcaua

SEQ ID NO: 85361 - RNA, 64 nt, Homo Sapiens
uaaucuacaauuggcuuuuuaaaaauaaccuguugauauauaauugucaguccaaaugaauaug

SEQ ID NO: 85362 - RNA, 64 nt, Homo Sapiens
cuaagcuuguauaugauuauggugggugauuucagauauauaagcagauaagcacagauuauug

SEQ ID NO: 85363 - RNA, 64 nt, Homo Sapiens
uuguucacucguacaugccuagccuacagaaggggauauauauuaugaaauggucauuuuucug

SEQ ID NO: 85364 - RNA, 64 nt, Homo Sapiens
aacaguagcuauagccauuaaccaaaggacagaugauauauauauauaugauauauauauauau

SEQ ID NO: 85365 - RNA, 64 nt, Homo Sapiens
cauuaaccaaaggacagaugauauauauauauaugauauauauauauauauaaguucuuuuuua

SEQ ID NO: 85366 - RNA, 64 nt, Homo Sapiens
uauauauaaauaauauacuuaaaauuuauauauagauauauauaucucuuuccuccuuaaaaac

SEQ ID NO: 85367 - RNA, 64 nt, Homo Sapiens
uaugacgcgucacagaaucuuauauauauauacagauauauauauauacagauaucuauaucua

SEQ ID NO: 85368 - RNA, 64 nt, Homo Sapiens
ugagagacugggaagggaaaagcauauauauauagauauauagagauauagauauauauacagg

SEQ ID NO: 85369 - RNA, 64 nt, Homo Sapiens
gaaaagcauauauauauagauauauagagauauagauauauauacaggaaacaccgcauccuug

SEQ ID NO: 85370 - RNA, 64 nt, Homo Sapiens
ucccacugcccuugacuuugugagaugaagcuguacuccccauuaggcuccuucaucccaguuu

SEQ ID NO: 85371 - RNA, 64 nt, Homo Sapiens
ccccguguuuggugucuuagccuccagagcccucacuccccacuucccugcccugccauccuga

SEQ ID NO: 85372 - RNA, 64 nt, Homo Sapiens
aaaggugggcaaaguucccucugacucuucccccacuccccaucuuacugauuuaauuuaauuu

SEQ ID NO: 85373 - RNA, 64 nt, Homo Sapiens
cacuccccaucuuacugauuuaauuuaauuuuucacuccccagagucuaauauggauucugacu

SEQ ID NO: 85374 - RNA, 64 nt, Homo Sapiens
gcuccugugcagggauaggacuccugaacuggccacuccccaguccagcagagagaguugaccc

SEQ ID NO: 85375 - RNA, 64 nt, Homo Sapiens
gccuccaggacuggggcuugccugcacaaauggaacuccccaggaccccucuguccagccagcu

SEQ ID NO: 85376 - RNA, 64 nt, Homo Sapiens
ccagcauuucauucauaccaaugaggucacccugacuccccaccggaagauagcacaaggccua

SEQ ID NO: 85377 - RNA, 64 nt, Homo Sapiens
acccucggagagaggugguguccacuuuccugccacuccccacugcugcucagugcuuuucucu

SEQ ID NO: 85378 - RNA, 64 nt, Homo Sapiens
acgccaggcaccacagccuccaaaaauggcagugacuccccagcccagcaccccuuccucgugg

SEQ ID NO: 85379 - RNA, 64 nt, Homo Sapiens
cuccaacuccauacuccacuccaagugccccaccacuccccaaccccucuccaggccugucaag

SEQ ID NO: 85380 - RNA, 64 nt, Homo Sapiens
aggcgccacuuuguauauuucaggacugggaccuacuccccagaugccaccugagaggagcuuc

SEQ ID NO: 85381 - RNA, 64 nt, Homo Sapiens
ugguggagcugugcucccuugagugcacuugagcacuccccagaccagaucacuuuuuggacac

SEQ ID NO: 85382 - RNA, 64 nt, Homo Sapiens
cccacccaccacccugcugugcuugggaacccccacuccccacuccccacaucccaacauccug

SEQ ID NO: 85383 - RNA, 64 nt, Homo Sapiens
accacccugcugugcuugggaacccccacuccccacuccccacaucccaacauccuggugucug

SEQ ID NO: 85384 - RNA, 64 nt, Homo Sapiens
gcucgggugggggcugaggcaaauuugccaucucacuccccaagcuaccaagcugaagguaucc

SEQ ID NO: 85385 - RNA, 64 nt, Homo Sapiens
gugccugagauggcugugcccucccagagauaaaacuccccaagugaaagucccugacaugaag

SEQ ID NO: 85386 - RNA, 64 nt, Homo Sapiens
gugccugaaauggccgugccgucucagagaugaaacuccccaagccgaggugcagcugccaaaa

SEQ ID NO: 85387 - RNA, 64 nt, Homo Sapiens; identical to SEQ ID NO: 73636

SEQ ID NO: 85388 - RNA, 64 nt, Homo Sapiens; identical to SEQ ID NO: 73637

SEQ ID NO: 85389 - RNA, 64 nt, Homo Sapiens; identical to SEQ ID NO: 73638

SEQ ID NO: 85390 - RNA, 64 nt, Homo Sapiens; identical to SEQ ID NO: 73639

SEQ ID NO: 85391 - RNA, 64 nt, Homo Sapiens; identical to SEQ ID NO: 73640

SEQ ID NO: 85392 - RNA, 64 nt, Homo Sapiens; identical to SEQ ID NO: 73641

SEQ ID NO: 85393 - RNA, 64 nt, Homo Sapiens; identical to SEQ ID NO: 73642

SEQ ID NO: 85394 - RNA, 64 nt, Homo Sapiens; identical to SEQ ID NO: 73643

SEQ ID NO: 85395 - RNA, 64 nt, Homo Sapiens; identical to SEQ ID NO: 73644

SEQ ID NO: 85396 - RNA, 64 nt, Homo Sapiens; identical to SEQ ID NO: 73645

SEQ ID NO: 85397 - RNA, 64 nt, Homo Sapiens; identical to SEQ ID NO: 73646

SEQ ID NO: 85398 - RNA, 64 nt, Homo Sapiens; identical to SEQ ID NO: 73647

SEQ ID NO: 85399 - RNA, 64 nt, Homo Sapiens; identical to SEQ ID NO: 73648

SEQ ID NO: 85400 - RNA, 64 nt, Homo Sapiens; identical to SEQ ID NO: 73649

SEQ ID NO: 85401 - RNA, 64 nt, Homo Sapiens; identical to SEQ ID NO: 73650

SEQ ID NO: 85402 - RNA, 64 nt, Homo Sapiens; identical to SEQ ID NO: 73651

SEQ ID NO: 85403 - RNA, 64 nt, Homo Sapiens; identical to SEQ ID NO: 73652

SEQ ID NO: 85404 - RNA, 64 nt, Homo Sapiens; identical to SEQ ID NO: 73653

SEQ ID NO: 85405 - RNA, 64 nt, Homo Sapiens; identical to SEQ ID NO: 73654

SEQ ID NO: 85406 - RNA, 64 nt, Homo Sapiens; identical to SEQ ID NO: 73655

SEQ ID NO: 85407 - RNA, 64 nt, Homo Sapiens; identical to SEQ ID NO: 73656

SEQ ID NO: 85408 - RNA, 64 nt, Homo Sapiens; identical to SEQ ID NO: 73657

SEQ ID NO: 85409 - RNA, 64 nt, Homo Sapiens; identical to SEQ ID NO: 73658

SEQ ID NO: 85410 - RNA, 64 nt, Homo Sapiens; identical to SEQ ID NO: 73659

SEQ ID NO: 85411 - RNA, 64 nt, Homo Sapiens; identical to SEQ ID NO: 73660

SEQ ID NO: 85412 - RNA, 64 nt, Homo Sapiens; identical to SEQ ID NO: 73661

SEQ ID NO: 85413 - RNA, 64 nt, Homo Sapiens; identical to SEQ ID NO: 73662

SEQ ID NO: 85414 - RNA, 64 nt, Homo Sapiens; identical to SEQ ID NO: 73663

SEQ ID NO: 85415 - RNA, 63 nt, Homo Sapiens; identical to SEQ ID NO: 73664

SEQ ID NO: 85416 - RNA, 64 nt, Homo Sapiens; identical to SEQ ID NO: 73665

SEQ ID NO: 85417 - RNA, 64 nt, Homo Sapiens; identical to SEQ ID NO: 73666

SEQ ID NO: 85418 - RNA, 64 nt, Homo Sapiens; identical to SEQ ID NO: 73667

SEQ ID NO: 85419 - RNA, 64 nt, Homo Sapiens; identical to SEQ ID NO: 73668

SEQ ID NO: 85420 - RNA, 64 nt, Homo Sapiens; identical to SEQ ID NO: 73669

SEQ ID NO: 85421 - RNA, 64 nt, Homo Sapiens; identical to SEQ ID NO: 73670

SEQ ID NO: 85422 - RNA, 64 nt, Homo Sapiens; identical to SEQ ID NO: 73671

SEQ ID NO: 85423 - RNA, 64 nt, Homo Sapiens; identical to SEQ ID NO: 73672

SEQ ID NO: 85424 - RNA, 64 nt, Homo Sapiens; identical to SEQ ID NO: 73673

SEQ ID NO: 85425 - RNA, 64 nt, Homo Sapiens; identical to SEQ ID NO: 73674

SEQ ID NO: 85426 - RNA, 64 nt, Homo Sapiens; identical to SEQ ID NO: 73675

SEQ ID NO: 85427 - RNA, 64 nt, Homo Sapiens; identical to SEQ ID NO: 73676

SEQ ID NO: 85428 - RNA, 64 nt, Homo Sapiens; identical to SEQ ID NO: 73677

SEQ ID NO: 85429 - RNA, 64 nt, Homo Sapiens; identical to SEQ ID NO: 73678

SEQ ID NO: 85430 - RNA, 64 nt, Homo Sapiens; identical to SEQ ID NO: 73679

SEQ ID NO: 85431 - RNA, 64 nt, Homo Sapiens; identical to SEQ ID NO: 73680

SEQ ID NO: 85432 - RNA, 64 nt, Homo Sapiens; identical to SEQ ID NO: 73681

SEQ ID NO: 85433 - RNA, 64 nt, Homo Sapiens; identical to SEQ ID NO: 73682

SEQ ID NO: 85434 - RNA, 64 nt, Homo Sapiens; identical to SEQ ID NO: 73683

SEQ ID NO: 85435 - RNA, 64 nt, Homo Sapiens; identical to SEQ ID NO: 73684

SEQ ID NO: 85436 - RNA, 64 nt, Homo Sapiens; identical to SEQ ID NO: 73685

SEQ ID NO: 85437 - RNA, 64 nt, Homo Sapiens; identical to SEQ ID NO: 73686

SEQ ID NO: 85438 - RNA, 64 nt, Homo Sapiens; identical to SEQ ID NO: 73687

SEQ ID NO: 85439 - RNA, 64 nt, Homo Sapiens; identical to SEQ ID NO: 73688

SEQ ID NO: 85440 - RNA, 64 nt, Homo Sapiens; identical to SEQ ID NO: 73689

SEQ ID NO: 85441 - RNA, 64 nt, Homo Sapiens; identical to SEQ ID NO: 73690

SEQ ID NO: 85442 - RNA, 64 nt, Homo Sapiens; identical to SEQ ID NO: 73691

SEQ ID NO: 85443 - RNA, 64 nt, Homo Sapiens; identical to SEQ ID NO: 73692

SEQ ID NO: 85444 - RNA, 64 nt, Homo Sapiens; identical to SEQ ID NO: 73693

SEQ ID NO: 85445 - RNA, 64 nt, Homo Sapiens; identical to SEQ ID NO: 73694

SEQ ID NO: 85446 - RNA, 64 nt, Homo Sapiens; identical to SEQ ID NO: 73695

SEQ ID NO: 85447 - RNA, 64 nt, Homo Sapiens; identical to SEQ ID NO: 73696

SEQ ID NO: 85448 - RNA, 64 nt, Homo Sapiens; identical to SEQ ID NO: 73697

SEQ ID NO: 85449 - RNA, 64 nt, Homo Sapiens; identical to SEQ ID NO: 73698

SEQ ID NO: 85450 - RNA, 64 nt, Homo Sapiens; identical to SEQ ID NO: 73699

SEQ ID NO: 85451 - RNA, 64 nt, Homo Sapiens; identical to SEQ ID NO: 73700

SEQ ID NO: 85452 - RNA, 64 nt, Homo Sapiens; identical to SEQ ID NO: 73701

SEQ ID NO: 85453 - RNA, 64 nt, Homo Sapiens; identical to SEQ ID NO: 73702

SEQ ID NO: 85454 - RNA, 64 nt, Homo Sapiens; identical to SEQ ID NO: 73703

SEQ ID NO: 85455 - RNA, 64 nt, Homo Sapiens; identical to SEQ ID NO: 73704

SEQ ID NO: 85456 - RNA, 64 nt, Homo Sapiens; identical to SEQ ID NO: 73705

SEQ ID NO: 85457 - RNA, 64 nt, Homo Sapiens; identical to SEQ ID NO: 73706

SEQ ID NO: 85458 - RNA, 64 nt, Homo Sapiens; identical to SEQ ID NO: 73707

SEQ ID NO: 85459 - RNA, 64 nt, Homo Sapiens; identical to SEQ ID NO: 79919

SEQ ID NO: 85460 - RNA, 64 nt, Homo Sapiens; identical to SEQ ID NO: 79920

SEQ ID NO: 85461 - RNA, 64 nt, Homo Sapiens; identical to SEQ ID NO: 79921

SEQ ID NO: 85462 - RNA, 64 nt, Homo Sapiens; identical to SEQ ID NO: 79922

SEQ ID NO: 85463 - RNA, 64 nt, Homo Sapiens; identical to SEQ ID NO: 79923

SEQ ID NO: 85464 - RNA, 64 nt, Homo Sapiens; identical to SEQ ID NO: 79924

SEQ ID NO: 85465 - RNA, 64 nt, Homo Sapiens; identical to SEQ ID NO: 79925

SEQ ID NO: 85466 - RNA, 64 nt, Homo Sapiens; identical to SEQ ID NO: 79926

SEQ ID NO: 85467 - RNA, 64 nt, Homo Sapiens; identical to SEQ ID NO: 79927

SEQ ID NO: 85468 - RNA, 64 nt, Homo Sapiens; identical to SEQ ID NO: 79928

SEQ ID NO: 85469 - RNA, 64 nt, Homo Sapiens; identical to SEQ ID NO: 79929

SEQ ID NO: 85470 - RNA, 64 nt, Homo Sapiens; identical to SEQ ID NO: 79930

SEQ ID NO: 85471 - RNA, 64 nt, Homo Sapiens; identical to SEQ ID NO: 79931

SEQ ID NO: 85472 - RNA, 64 nt, Homo Sapiens; identical to SEQ ID NO: 79932

SEQ ID NO: 85473 - RNA, 64 nt, Homo Sapiens; identical to SEQ ID NO: 79933

SEQ ID NO: 85474 - RNA, 64 nt, Homo Sapiens; identical to SEQ ID NO: 79934

SEQ ID NO: 85475 - RNA, 64 nt, Homo Sapiens; identical to SEQ ID NO: 79935

SEQ ID NO: 85476 - RNA, 64 nt, Homo Sapiens; identical to SEQ ID NO: 79936

SEQ ID NO: 85477 - RNA, 64 nt, Homo Sapiens; identical to SEQ ID NO: 79937

SEQ ID NO: 85478 - RNA, 64 nt, Homo Sapiens; identical to SEQ ID NO: 79938

SEQ ID NO: 85479 - RNA, 64 nt, Homo Sapiens; identical to SEQ ID NO: 79939

SEQ ID NO: 85480 - RNA, 64 nt, Homo Sapiens
acacccagcuaauuuuuuuucugggacuacaggugccugccaccugccucagccuccugaguag

SEQ ID NO: 85481 - RNA, 64 nt, Homo Sapiens
aagaaacgugcuugaaucuaauugagucauuacugccugccacuaacccuuuuguuuguuucca

SEQ ID NO: 85482 - RNA, 64 nt, Homo Sapiens
ugccucagccucccaaguagcugggauuacaggugccugccaccaugccuggcuaauuuuuuug

SEQ ID NO: 85483 - RNA, 64 nt, Homo Sapiens
ugccucagccuccugaguagcugggacuacaggcgccugccaccacgcccagcuaauuuuugua

SEQ ID NO: 85484 - RNA, 64 nt, Homo Sapiens
agacccacccacgcucugacggccugagcagggggccugccacccucagggcugguucccagcu

SEQ ID NO: 85485 - RNA, 64 nt, Homo Sapiens
agagcacauguccucuggccgccucaggaggccagccugccaugagcucuaccacauucaggag

SEQ ID NO: 85486 - RNA, 64 nt, Homo Sapiens
cagaagcacaaaugcuguccauggccgugaggcugccugccaggugaauggacauagcgugaga

SEQ ID NO: 85487 - RNA, 64 nt, Homo Sapiens
gguucaaaccccaccucaguagguggaggggagcgccugccauugguuguauuuuuguucugag

SEQ ID NO: 85488 - RNA, 64 nt, Homo Sapiens
gaaucacagagacaucgggguauugagaaacgcagccugccaggagagcaaacuagggucucag

SEQ ID NO: 85489 - RNA, 64 nt, Homo Sapiens
cugugauuuugugaggcuugugucaaaugcugcagccugccaagccauugcuauacuguaccag

SEQ ID NO: 85490 - RNA, 64 nt, Homo Sapiens
caguguacuggugugggguggaggcccuggcucugccugccauccuagggcccuguucuggcug

SEQ ID NO: 85491 - RNA, 64 nt, Homo Sapiens
accaucaucauuaacugagcaccagcugugcuaagccugccacgggcguauccuugcagccuca

SEQ ID NO: 85492 - RNA, 64 nt, Homo Sapiens
cugcccgaggauguacagagcagccaccuucaaugccugccaccuagaggagccacgugccgcc

SEQ ID NO: 85493 - RNA, 64 nt, Homo Sapiens
gccaagugcccuagaguccaguagcucagagccugccugccaggcuccagccucaaucuguucc

SEQ ID NO: 85494 - RNA, 64 nt, Homo Sapiens
cagcuacugcccagggcccgcaguguuggcugcugccugccacagccucugugacugcagugga

SEQ ID NO: 85495 - RNA, 64 nt, Homo Sapiens
ucugugacugcaguggagcggcgaauucccuguggccugccaugccuucggcaucagaggaugg

SEQ ID NO: 85496 - RNA, 64 nt, Homo Sapiens
cuucugcagagaaguucccuucaccgcauccgucgccugccaaacugaaggcuacugcagguca

SEQ ID NO: 85497 - RNA, 64 nt, Homo Sapiens
ugccaaacugaaggcuacugcaggucacugaguugccugccauccaaaggggaugggcgggauu

SEQ ID NO: 85498 - RNA, 64 nt, Homo Sapiens
aagcuguggcagcucuuuucccuguucaccucccgccugccagggaaggcaggacccgcucugc

SEQ ID NO: 85499 - RNA, 64 nt, Homo Sapiens
ugccucagccuccccaguagcugggacuacaggcgccugccaacaugccuggcuaauuuuuuuu

SEQ ID NO: 85500 - RNA, 64 nt, Homo Sapiens
gcaccaccuaccuggcuuccugcaaggccuucacgccugccagggucagcugcagcccccacuc

SEQ ID NO: 85501 - RNA, 64 nt, Homo Sapiens
acaaaggccaauauauaauguucuauugcuaggagccugccagaugaaauucaaagaaaacuuu

SEQ ID NO: 85502 - RNA, 64 nt, Homo Sapiens
uuguuguaaacauugcaaaacagcucagcugucugccugccacugaaggaguuuuuacaugcca

SEQ ID NO: 85503 - RNA, 64 nt, Homo Sapiens
aggcccugggucccacgcccugggugcccacauggccugccaacuagggccugcaaauggagug

SEQ ID NO: 85504 - RNA, 64 nt, Homo Sapiens
ggaguccuggccccugaaucaccagagccaccaagccugccagaggggucucauucauggcuug

SEQ ID NO: 85505 - RNA, 64 nt, Homo Sapiens
ggagcagggggaaaaggugcacuuggccaguggcgccugccaggagugaguccaugcguugucu

SEQ ID NO: 85506 - RNA, 64 nt, Homo Sapiens
ugcaaagcuagugaguagcugucagguucccugggccugccaucagggaucacuaaauuuaagg

SEQ ID NO: 85507 - RNA, 64 nt, Homo Sapiens
agauugcagauguucugucuuccaucccaaacaagccugccaugagguaggauccuagggguuu

SEQ ID NO: 85508 - RNA, 64 nt, Homo Sapiens
uuaaaauauugucaguuuuucaucgucgucccuagccugccaacagccaucugcccagacagcc

SEQ ID NO: 85509 - RNA, 64 nt, Homo Sapiens
ggcagggcugagcuggagccgccccucucagcccgccugccacggccuuuccuuaaaggccauc

SEQ ID NO: 85510 - RNA, 64 nt, Homo Sapiens
ggggcgaggcugggggagggcggcgccgcggcgggccugccagcugggggccuuugcggcgcgc

SEQ ID NO: 85511 - RNA, 64 nt, Homo Sapiens
cggggaaaaugcaggcugaguggggcgaccuccugccugccaggagcccccuuucaggacacag

SEQ ID NO: 85512 - RNA, 64 nt, Homo Sapiens
ugggcuugucaucugcuggaacaggcgccauggggccugccagcccugccugccaggucccuua

SEQ ID NO: 85513 - RNA, 64 nt, Homo Sapiens
ugcuggaacaggcgccauggggccugccagcccugccugccaggucccuuagcaccuguccccc

SEQ ID NO: 85514 - RNA, 64 nt, Homo Sapiens
guuccagcacuguucaggcugccugucaucccgggccugccagcuccccugagugaugagcacu

SEQ ID NO: 85515 - RNA, 64 nt, Homo Sapiens
ggccucgccagcccucuggggcauugugggagaugccugccaggaaugagcaagcucuguugcu

SEQ ID NO: 85516 - RNA, 64 nt, Homo Sapiens
ggaucucacagaguucuuaagauggaauuuuccagccugccagucaugaaucucagacagccug

SEQ ID NO: 85517 - RNA, 64 nt, Homo Sapiens
aauuuuccagccugccagucaugaaucucagacagccugccaccuauugcccugauuuguguua

SEQ ID NO: 85518 - RNA, 64 nt, Homo Sapiens
cuccucuccccguuuucucugggaucagagucuggccugccaggguuucccuguguggaccaug

SEQ ID NO: 85519 - RNA, 64 nt, Homo Sapiens
cccucggcucugccgcggugugggagguggccaggccugccagcaaagcaggcugaucgggcaa

SEQ ID NO: 85520 - RNA, 64 nt, Homo Sapiens
ggcuucacccacccccacgcgcaauuuucccuucgccugccaugggacuuugagcgacucucgg

SEQ ID NO: 85521 - RNA, 64 nt, Homo Sapiens
cucccccuucaaugcaccucgcguugucccaagagccugccacccuuucuuaugcccgggagcc

SEQ ID NO: 85522 - RNA, 64 nt, Homo Sapiens
ccagacccccaccucccaccccuuuauuccagcugccugccaccaagggacuacucucuucacc

SEQ ID NO: 85523 - RNA, 64 nt, Homo Sapiens
uuggggacuugaggggggucagggccccucccuugccugccacucaugaggggccaccucaucc

SEQ ID NO: 85524 - RNA, 64 nt, Homo Sapiens
acacgcuggucugagaugagggcaggaaggagaggcagggcaggggcauccagcgcugccugga

SEQ ID NO: 85525 - RNA, 64 nt, Homo Sapiens
ccagggcccaugcuggcugcuccgagaguggugugcagggcaggugggccccugaaguuccauc

SEQ ID NO: 85526 - RNA, 64 nt, Homo Sapiens
gacagccaccuuggaaggccccugcuagggacaggcagggcaggucccacaugugucucccaag

SEQ ID NO: 85527 - RNA, 64 nt, Homo Sapiens
accuuugauugucuuuccagagaugcugcucucugcagggcaccaccuucaaggcacagcccuu

SEQ ID NO: 85528 - RNA, 64 nt, Homo Sapiens
accugccagaauuguugccugagcgugccaggcugcagggcaggcaguaaaaggcccccacaua

SEQ ID NO: 85529 - RNA, 64 nt, Homo Sapiens
ggcucugguucugccaggaggugccagcccaaaugcagggcaugucuggcugguuccacuaaau

SEQ ID NO: 85530 - RNA, 64 nt, Homo Sapiens
gccagccugucccucauuacgacugaagagcugagcagggcacuagccuggccuuuccuggaca

SEQ ID NO: 85531 - RNA, 64 nt, Homo Sapiens
gaaucaguucuucacucuccucucaggccuggaggcagggcauacuaggaucuguccaagacac

SEQ ID NO: 85532 - RNA, 64 nt, Homo Sapiens
aaccuccgaagccagacucuggaacaggagggcagcagggcacugacaugcugggaacucgcau

SEQ ID NO: 85533 - RNA, 64 nt, Homo Sapiens
uugacaucacuggcauggugguugggacccaguggcagggcacagggccuggcccauguauggc

SEQ ID NO: 85534 - RNA, 64 nt, Homo Sapiens
cccagccucaaauccaggacccugccaggcacaggcagggcaggaccagcccacgcugacuaca

SEQ ID NO: 85535 - RNA, 64 nt, Homo Sapiens
ggagacuauggggagcccacccagguacacggcagcagggcagaauguggaugagugaagggag

SEQ ID NO: 85536 - RNA, 55 nt, Homo Sapiens
gccuccucuguuuucuaggccaagggcagggcaccccaaagagaacaacaacuga

SEQ ID NO: 85537 - RNA, 64 nt, Homo Sapiens
auguugcgugagaggcccauccuguguaauuggagcagggcacacuugcuuccuguugaguuaa

SEQ ID NO: 85538 - RNA, 64 nt, Homo Sapiens
gaacauuuauuugaaccucuuagccacauuuccagcagggcaaaccaacugaugcccuggaaga

SEQ ID NO: 85539 - RNA, 64 nt, Homo Sapiens
cgcugggcgcucccgggccgcgcgucugcguuaggcagggcaggguagugcagggcacaccuuc

SEQ ID NO: 85540 - RNA, 64 nt, Homo Sapiens
ggccgcgcgucugcguuaggcagggcaggguagugcagggcacaccuuccccgggguucggggu

SEQ ID NO: 85541 - RNA, 64 nt, Homo Sapiens
gcaggcucaccuguuccugggacugucugagauggcagggcacuugcccugguggcucccaccu

SEQ ID NO: 85542 - RNA, 64 nt, Homo Sapiens
aguccaggcgccuccacgcugcaccgugaggacugcagggcauguccccgugaggggcuauggg

SEQ ID NO: 85543 - RNA, 64 nt, Homo Sapiens
gacugugugcgaggcaaugcaauuaaaacccuuggcagggcaucgggcaggcuguuacuggcua

SEQ ID NO: 85544 - RNA, 64 nt, Homo Sapiens
cuguuacuggcuaaauuaaaugccaugaaucauugcagggcaggaaaugaacccaucuuuugcc

SEQ ID NO: 85545 - RNA, 64 nt, Homo Sapiens
caccugacuuggcuggggaggaccagggcccugggcagggcagggcagccugucacccguguga

SEQ ID NO: 85546 - RNA, 64 nt, Homo Sapiens
gacuuggcuggggaggaccagggcccugggcagggcagggcagccugucacccgugugaagaug

SEQ ID NO: 85547 - RNA, 64 nt, Homo Sapiens
ggauuucuguucugagagcagcgugggcagcaaggcagggcagcccagagguggcagcggcagg

SEQ ID NO: 85548 - RNA, 64 nt, Homo Sapiens
guuguguguuuuuccuggugcuucaagagcgugugcagggcaagugccgucacugggaacugca

SEQ ID NO: 85549 - RNA, 64 nt, Homo Sapiens
gacacuguaggagcauagcaucuggcagggcagggcagggcaguaagcacuuucauggcugccc

SEQ ID NO: 85550 - RNA, 64 nt, Homo Sapiens
gcagugacacuguaggagcaugcccucuggcagggcagggcaggccucaaagcacuuucauggc

SEQ ID NO: 85551 - RNA, 64 nt, Homo Sapiens
gcagggcagugacacuguagauggcugcccucuggcagggcagggaugaccucaaagcacuuuc

SEQ ID NO: 85552 - RNA, 64 nt, Homo Sapiens
agcugcuggggugggacuugaccgucaccuggaagcagggcaccgccuccucccgacuugacuc

SEQ ID NO: 85553 - RNA, 64 nt, Homo Sapiens
gggagaugcucaggggccagguaaacugggggaggcagggcacaagcagcaggauggugaagua

SEQ ID NO: 85554 - RNA, 64 nt, Homo Sapiens
agggcccucccuccagccuaguguaccaagagcagcagggcagaugugcccacugcugcuccau

SEQ ID NO: 85555 - RNA, 64 nt, Homo Sapiens
cccccacccaaggccgggcccagccagaggaggggcagggcagggcaggagguuucuggauguu

SEQ ID NO: 85556 - RNA, 64 nt, Homo Sapiens
acccaaggccgggcccagccagaggaggggcagggcagggcaggagguuucuggauguuuguug

SEQ ID NO: 85557 - RNA, 64 nt, Homo Sapiens
cuuuccccaccgagagcugggccgggagaggaccgcagggcagguggcgugagguccguguugc

SEQ ID NO: 85558 - RNA, 64 nt, Homo Sapiens
ggcugguuggcugggcccagcuccugggggcugggcagggcagggcagggccggguccacuucc

SEQ ID NO: 85559 - RNA, 64 nt, Homo Sapiens
guuggcugggcccagcuccugggggcugggcagggcagggcagggccggguccacuuccauugu

SEQ ID NO: 85560 - RNA, 64 nt, Homo Sapiens
gaagaaauaaauggucucaugcccacugaacgcugcagggcagguggcagccggaggugcguaa

SEQ ID NO: 85561 - RNA, 64 nt, Homo Sapiens
ccaugguggcagccggaggucacaggccuucccugcagggcagcggccugaaaggucugccuca

SEQ ID NO: 85562 - RNA, 64 nt, Homo Sapiens
cggacaggacagacacguugagaagcugcagggagcagggcaccaagggagugugcacugugcu

SEQ ID NO: 85563 - RNA, 64 nt, Homo Sapiens
gggugucuuuccagccuuugccagucuagccccagcagggcaccguguaugaaugcaguuuggu

SEQ ID NO: 85564 - RNA, 62 nt, Homo Sapiens
cagggggggcuucccgcccuagccacugcagggcagggcaggacuccaucccagaugccuga

SEQ ID NO: 85565 - RNA, 57 nt, Homo Sapiens
gcaggcagggggggcuucccagccacugcagggcaggacuccaucccagaugccuga

SEQ ID NO: 85566 - RNA, 64 nt, Homo Sapiens
gaagcugccaagcuccgcacaguacaagggcagggcagggcaggagagagaaccgagagguccc

SEQ ID NO: 85567 - RNA, 64 nt, Homo Sapiens
gcagggaagcugccaagcucgucccaguacaagggcagggcaggcugagagagagaaccgagag

SEQ ID NO: 85568 - RNA, 64 nt, Homo Sapiens
gaaggcugggguggggggaggccuccaccucugugcagggcacaccagaaggagcaggcccugg

SEQ ID NO: 85569 - RNA, 64 nt, Homo Sapiens
cccccggggaggggccagagagauguugaggcgagcagggcaggcucucuugccaaaaagcaca

SEQ ID NO: 85570 - RNA, 64 nt, Homo Sapiens
ccccugggcaccaagggagcgagggggaauaagagcagggcagcccccugggugccgcugucag

SEQ ID NO: 85571 - RNA, 64 nt, Homo Sapiens
auuggacuggagugaaugggcacagggguggagcgcagggcagccccagucaccacgagcuguu

SEQ ID NO: 85572 - RNA, 64 nt, Homo Sapiens; identical to SEQ ID NO: 81841

SEQ ID NO: 85573 - RNA, 64 nt, Homo Sapiens; identical to SEQ ID NO: 81842

SEQ ID NO: 85574 - RNA, 64 nt, Homo Sapiens; identical to SEQ ID NO: 81843

SEQ ID NO: 85575 - RNA, 64 nt, Homo Sapiens; identical to SEQ ID NO: 81844

SEQ ID NO: 85576 - RNA, 64 nt, Homo Sapiens; identical to SEQ ID NO: 81845

SEQ ID NO: 85577 - RNA, 64 nt, Homo Sapiens; identical to SEQ ID NO: 81846

SEQ ID NO: 85578 - RNA, 64 nt, Homo Sapiens; identical to SEQ ID NO: 81847

SEQ ID NO: 85579 - RNA, 64 nt, Homo Sapiens; identical to SEQ ID NO: 81848

SEQ ID NO: 85580 - RNA, 64 nt, Homo Sapiens; identical to SEQ ID NO: 81849

SEQ ID NO: 85581 - RNA, 64 nt, Homo Sapiens; identical to SEQ ID NO: 81850

SEQ ID NO: 85582 - RNA, 64 nt, Homo Sapiens; identical to SEQ ID NO: 81851

SEQ ID NO: 85583 - RNA, 61 nt, Homo Sapiens; identical to SEQ ID NO: 81852

SEQ ID NO: 85584 - RNA, 64 nt, Homo Sapiens; identical to SEQ ID NO: 81853

SEQ ID NO: 85585 - RNA, 51 nt, Homo Sapiens; identical to SEQ ID NO: 81854

SEQ ID NO: 85586 - RNA, 64 nt, Homo Sapiens; identical to SEQ ID NO: 81855

SEQ ID NO: 85587 - RNA, 64 nt, Homo Sapiens; identical to SEQ ID NO: 81856

SEQ ID NO: 85588 - RNA, 64 nt, Homo Sapiens; identical to SEQ ID NO: 81857

SEQ ID NO: 85589 - RNA, 64 nt, Homo Sapiens; identical to SEQ ID NO: 81858

SEQ ID NO: 85590 - RNA, 64 nt, Homo Sapiens; identical to SEQ ID NO: 81859

SEQ ID NO: 85591 - RNA, 64 nt, Homo Sapiens; identical to SEQ ID NO: 81860

SEQ ID NO: 85592 - RNA, 64 nt, Homo Sapiens; identical to SEQ ID NO: 81861

SEQ ID NO: 85593 - RNA, 64 nt, Homo Sapiens; identical to SEQ ID NO: 81862

SEQ ID NO: 85594 - RNA, 64 nt, Homo Sapiens; identical to SEQ ID NO: 81863

SEQ ID NO: 85595 - RNA, 64 nt, Homo Sapiens; identical to SEQ ID NO: 81864

SEQ ID NO: 85596 - RNA, 64 nt, Homo Sapiens; identical to SEQ ID NO: 81865

SEQ ID NO: 85597 - RNA, 64 nt, Homo Sapiens; identical to SEQ ID NO: 81866

SEQ ID NO: 85598 - RNA, 64 nt, Homo Sapiens; identical to SEQ ID NO: 81867

SEQ ID NO: 85599 - RNA, 64 nt, Homo Sapiens; identical to SEQ ID NO: 81868

SEQ ID NO: 85600 - RNA, 64 nt, Homo Sapiens; identical to SEQ ID NO: 81869

SEQ ID NO: 85601 - RNA, 64 nt, Homo Sapiens; identical to SEQ ID NO: 81870

SEQ ID NO: 85602 - RNA, 64 nt, Homo Sapiens; identical to SEQ ID NO: 81871

SEQ ID NO: 85603 - RNA, 64 nt, Homo Sapiens; identical to SEQ ID NO: 81872

SEQ ID NO: 85604 - RNA, 64 nt, Homo Sapiens; identical to SEQ ID NO: 81873

SEQ ID NO: 85605 - RNA, 64 nt, Homo Sapiens; identical to SEQ ID NO: 81874

SEQ ID NO: 85606 - RNA, 64 nt, Homo Sapiens; identical to SEQ ID NO: 81875

SEQ ID NO: 85607 - RNA, 64 nt, Homo Sapiens; identical to SEQ ID NO: 81876

SEQ ID NO: 85608 - RNA, 64 nt, Homo Sapiens; identical to SEQ ID NO: 81877

SEQ ID NO: 85609 - RNA, 64 nt, Homo Sapiens; identical to SEQ ID NO: 81878

SEQ ID NO: 85610 - RNA, 64 nt, Homo Sapiens; identical to SEQ ID NO: 81879

SEQ ID NO: 85611 - RNA, 64 nt, Homo Sapiens; identical to SEQ ID NO: 81880

SEQ ID NO: 85612 - RNA, 64 nt, Homo Sapiens; identical to SEQ ID NO: 81881

SEQ ID NO: 85613 - RNA, 64 nt, Homo Sapiens; identical to SEQ ID NO: 81882

SEQ ID NO: 85614 - RNA, 64 nt, Homo Sapiens; identical to SEQ ID NO: 81883

SEQ ID NO: 85615 - RNA, 64 nt, Homo Sapiens; identical to SEQ ID NO: 81884

SEQ ID NO: 85616 - RNA, 64 nt, Homo Sapiens; identical to SEQ ID NO: 81885

SEQ ID NO: 85617 - RNA, 64 nt, Homo Sapiens; identical to SEQ ID NO: 81886

SEQ ID NO: 85618 - RNA, 64 nt, Homo Sapiens; identical to SEQ ID NO: 81887

SEQ ID NO: 85619 - RNA, 64 nt, Homo Sapiens; identical to SEQ ID NO: 81888

SEQ ID NO: 85620 - RNA, 64 nt, Homo Sapiens; identical to SEQ ID NO: 81889

SEQ ID NO: 85621 - RNA, 64 nt, Homo Sapiens; identical to SEQ ID NO: 81890

SEQ ID NO: 85622 - RNA, 64 nt, Homo Sapiens; identical to SEQ ID NO: 81891

SEQ ID NO: 85623 - RNA, 64 nt, Homo Sapiens; identical to SEQ ID NO: 81892

SEQ ID NO: 85624 - RNA, 64 nt, Homo Sapiens; identical to SEQ ID NO: 81893

SEQ ID NO: 85625 - RNA, 64 nt, Homo Sapiens; identical to SEQ ID NO: 81894

SEQ ID NO: 85626 - RNA, 64 nt, Homo Sapiens; identical to SEQ ID NO: 81895

SEQ ID NO: 85627 - RNA, 64 nt, Homo Sapiens; identical to SEQ ID NO: 81896

SEQ ID NO: 85628 - RNA, 64 nt, Homo Sapiens; identical to SEQ ID NO: 81897

SEQ ID NO: 85629 - RNA, 64 nt, Homo Sapiens; identical to SEQ ID NO: 81898

SEQ ID NO: 85630 - RNA, 64 nt, Homo Sapiens; identical to SEQ ID NO: 81899

SEQ ID NO: 85631 - RNA, 64 nt, Homo Sapiens; identical to SEQ ID NO: 81900

SEQ ID NO: 85632 - RNA, 64 nt, Homo Sapiens; identical to SEQ ID NO: 81901

SEQ ID NO: 85633 - RNA, 64 nt, Homo Sapiens; identical to SEQ ID NO: 81902

SEQ ID NO: 85634 - RNA, 64 nt, Homo Sapiens; identical to SEQ ID NO: 81903

SEQ ID NO: 85635 - RNA, 64 nt, Homo Sapiens; identical to SEQ ID NO: 81904

SEQ ID NO: 85636 - RNA, 64 nt, Homo Sapiens; identical to SEQ ID NO: 81905

SEQ ID NO: 85637 - RNA, 64 nt, Homo Sapiens; identical to SEQ ID NO: 81906

SEQ ID NO: 85638 - RNA, 64 nt, Homo Sapiens; identical to SEQ ID NO: 81907

SEQ ID NO: 85639 - RNA, 64 nt, Homo Sapiens; identical to SEQ ID NO: 81908

SEQ ID NO: 85640 - RNA, 64 nt, Homo Sapiens; identical to SEQ ID NO: 81909

SEQ ID NO: 85641 - RNA, 64 nt, Homo Sapiens; identical to SEQ ID NO: 81910

SEQ ID NO: 85642 - RNA, 64 nt, Homo Sapiens; identical to SEQ ID NO: 81911

SEQ ID NO: 85643 - RNA, 64 nt, Homo Sapiens; identical to SEQ ID NO: 81912

SEQ ID NO: 85644 - RNA, 64 nt, Homo Sapiens; identical to SEQ ID NO: 81913

SEQ ID NO: 85645 - RNA, 64 nt, Homo Sapiens; identical to SEQ ID NO: 81914

SEQ ID NO: 85646 - RNA, 64 nt, Homo Sapiens; identical to SEQ ID NO: 81915

SEQ ID NO: 85647 - RNA, 64 nt, Homo Sapiens; identical to SEQ ID NO: 81916

SEQ ID NO: 85648 - RNA, 64 nt, Homo Sapiens; identical to SEQ ID NO: 81917

SEQ ID NO: 85649 - RNA, 64 nt, Homo Sapiens; identical to SEQ ID NO: 81918

SEQ ID NO: 85650 - RNA, 64 nt, Homo Sapiens; identical to SEQ ID NO: 81919

SEQ ID NO: 85651 - RNA, 64 nt, Homo Sapiens; identical to SEQ ID NO: 81920

SEQ ID NO: 85652 - RNA, 64 nt, Homo Sapiens; identical to SEQ ID NO: 81921

SEQ ID NO: 85653 - RNA, 64 nt, Homo Sapiens; identical to SEQ ID NO: 81922

SEQ ID NO: 85654 - RNA, 64 nt, Homo Sapiens; identical to SEQ ID NO: 81923

SEQ ID NO: 85655 - RNA, 64 nt, Homo Sapiens; identical to SEQ ID NO: 81924

SEQ ID NO: 85656 - RNA, 64 nt, Homo Sapiens; identical to SEQ ID NO: 81925

SEQ ID NO: 85657 - RNA, 64 nt, Homo Sapiens; identical to SEQ ID NO: 81926

SEQ ID NO: 85658 - RNA, 64 nt, Homo Sapiens; identical to SEQ ID NO: 81927

SEQ ID NO: 85659 - RNA, 64 nt, Homo Sapiens; identical to SEQ ID NO: 81928

SEQ ID NO: 85660 - RNA, 64 nt, Homo Sapiens; identical to SEQ ID NO: 81929

SEQ ID NO: 85661 - RNA, 64 nt, Homo Sapiens; identical to SEQ ID NO: 81930

SEQ ID NO: 85662 - RNA, 64 nt, Homo Sapiens; identical to SEQ ID NO: 81931

SEQ ID NO: 85663 - RNA, 64 nt, Homo Sapiens; identical to SEQ ID NO: 81932

SEQ ID NO: 85664 - RNA, 64 nt, Homo Sapiens; identical to SEQ ID NO: 81933

SEQ ID NO: 85665 - RNA, 64 nt, Homo Sapiens; identical to SEQ ID NO: 81934

SEQ ID NO: 85666 - RNA, 64 nt, Homo Sapiens; identical to SEQ ID NO: 81935

SEQ ID NO: 85667 - RNA, 64 nt, Homo Sapiens; identical to SEQ ID NO: 81936

SEQ ID NO: 85668 - RNA, 64 nt, Homo Sapiens; identical to SEQ ID NO: 81937

SEQ ID NO: 85669 - RNA, 64 nt, Homo Sapiens; identical to SEQ ID NO: 81938

SEQ ID NO: 85670 - RNA, 64 nt, Homo Sapiens; identical to SEQ ID NO: 81939

SEQ ID NO: 85671 - RNA, 64 nt, Homo Sapiens; identical to SEQ ID NO: 81940

SEQ ID NO: 85672 - RNA, 64 nt, Homo Sapiens; identical to SEQ ID NO: 81941

SEQ ID NO: 85673 - RNA, 64 nt, Homo Sapiens; identical to SEQ ID NO: 81942

SEQ ID NO: 85674 - RNA, 64 nt, Homo Sapiens; identical to SEQ ID NO: 81943

SEQ ID NO: 85675 - RNA, 64 nt, Homo Sapiens; identical to SEQ ID NO: 81944

SEQ ID NO: 85676 - RNA, 64 nt, Homo Sapiens
uauugauuuuugauuaugaaaaucaaaaauuuucacauuugauuaugaaaaucuccaaacauau

SEQ ID NO: 85677 - RNA, 64 nt, Homo Sapiens
gucuguaagucucuuuccaucuacagaguuuagcacauuugaacguugcugguugaaaucccga

SEQ ID NO: 85678 - RNA, 64 nt, Homo Sapiens
uuugcagugucaugugagggacauuugaccuuugacauuugaccccuuauaguccuaagccaag

SEQ ID NO: 85679 - RNA, 64 nt, Homo Sapiens
uuugacauuugaccuuugcaaguccuaagccaagacauuugaccuuguccuaucucucccuuau

SEQ ID NO: 85680 - RNA, 64 nt, Homo Sapiens
uguggaaaaagaaacaggguuuugaacucuguuaacauuugaaaaauauauuuucaaauucacu

SEQ ID NO: 85681 - RNA, 64 nt, Homo Sapiens
gcaaaguggcacuaaugaagcuuuugccuuuuguacauuugagauuuuuguauauaguguuugc

SEQ ID NO: 85682 - RNA, 64 nt, Homo Sapiens
cggggaaacaaaauuauucucugagagggaaaggacauuugagggaaacaucaaauuuccccau

SEQ ID NO: 85683 - RNA, 64 nt, Homo Sapiens
auucuggucucaggcaugaccacguccagugaagacauuugaggcagcacaucucaggacccag

SEQ ID NO: 85684 - RNA, 64 nt, Homo Sapiens
aauaaguccuaaagugaagaagccaucaauuuuaacauuugaugucuagauaacauucaugaga

SEQ ID NO: 85685 - RNA, 64 nt, Homo Sapiens
agaaauucauuaaagaaaaaccacagauacugaaacauuugacacauaaaaguaauuaauugcu

SEQ ID NO: 85686 - RNA, 64 nt, Homo Sapiens
ucgaugauaaauaaagcaaaugcaucauauguucacauuugauaaguauaugccaaaaaaugaa

SEQ ID NO: 85687 - RNA, 64 nt, Homo Sapiens
aaguguggucaggaaaggccccacugauaagguaacauuugagcaagucugaaaaaggcaaggg

SEQ ID NO: 85688 - RNA, 64 nt, Homo Sapiens
aaaaauugcccuaugaaaacuuuaaaucucuaaaacauuugaaauacuaccauauuugugauuu

SEQ ID NO: 85689 - RNA, 64 nt, Homo Sapiens
uaagaaaacaugaaugaacuagaagauauuaaaaacauuugacauugguaagaaauauugauac

SEQ ID NO: 85690 - RNA, 64 nt, Homo Sapiens
aaaccagccuugguguguuucuacacucaauaaaacauuugacauuuuacaguacuccagaugu

SEQ ID NO: 85691 - RNA, 64 nt, Homo Sapiens
gugaggacaauguggcuugcaugccaagccugacacauuugacauucauuaaucuccaucaugu

SEQ ID NO: 85692 - RNA, 64 nt, Homo Sapiens
gcaugaguucgagaccagccccauggcggguggaacauuugaggaaucccagcacuuugggagg

SEQ ID NO: 85693 - RNA, 64 nt, Homo Sapiens
aaguacacaucuuucauaucagaugguaaagaccacauuugaauccugucagccaacuuuagac

SEQ ID NO: 85694 - RNA, 64 nt, Homo Sapiens
uucugucuacagcuagaagcugugccccaguuccacauuugauuacacaugugagauuugcugc

SEQ ID NO: 85695 - RNA, 64 nt, Homo Sapiens
aaauugaaaaugagaaauuaaaccugcaagugaaacauuugaaacgauuauacuuucuacauaa

SEQ ID NO: 85696 - RNA, 64 nt, Homo Sapiens
uucugaaguuauaccuagugauguuuuuugcaguacauuugaauggauuguagacacugccuca

SEQ ID NO: 85697 - RNA, 64 nt, Homo Sapiens
uccuuguucucauuuacacccugcaguuuggaccacauuugaccucauaaguuuuuccuuuuaa

SEQ ID NO: 85698 - RNA, 64 nt, Homo Sapiens
ucgugguuccacuagauguaacuuaaaggaguuaacauuugaggacuuuguucuacaucagauu

SEQ ID NO: 85699 - RNA, 64 nt, Homo Sapiens
ucgugguuccgcuagauguaacuuauaggaguuaacauuugaggacuuuguucugcaucagauc

SEQ ID NO: 85700 - RNA, 64 nt, Homo Sapiens
uaaaaaccaaauuuuuagaugcaaguaaccugguacauuugaaagcccugauacuauaagcuca

SEQ ID NO: 85701 - RNA, 64 nt, Homo Sapiens
agaaaaugugauccauaguaaaaaaguuuuuccuacauuugacuaaggguuguaaaaaucugug

SEQ ID NO: 85702 - RNA, 64 nt, Homo Sapiens
uaaaugcgguacccuuuacucauauuaaauacccacauuugacagaaucaguggugucugaaau

SEQ ID NO: 85703 - RNA, 64 nt, Homo Sapiens
ugagaaccccuuuuaauugaaaaagaucauuuuuacauuugaacucauucuaugcugauuuuac

SEQ ID NO: 85704 - RNA, 64 nt, Homo Sapiens
uaguacuauauuaagugcacuugaguggaauucaacauuugacuaauaaaaugaguucaucaug

SEQ ID NO: 85705 - RNA, 64 nt, Homo Sapiens
ucaguguguguuuugaggucuuauguaauugaugacauuugagagaaaugguggcuuuuuuuag

SEQ ID NO: 85706 - RNA, 64 nt, Homo Sapiens
cuucucaaagagagaccaacaucaugcuuuuaacacauuugaugagguuuuuuauuuguguuuu

SEQ ID NO: 85707 - RNA, 64 nt, Homo Sapiens
cugggauuccaggugugagccgcugcggccgaccacauuugauguuugaaguuguaaucugucc

SEQ ID NO: 85708 - RNA, 64 nt, Homo Sapiens
uuauauauauauacauuuuuuuuccuucugcaauacauuugaaaacuuguuugggagacucugc

SEQ ID NO: 85709 - RNA, 64 nt, Homo Sapiens
aaacugugguugauagccagucacugccuuaagaacauuugaugcaagauggccagcacugaac

SEQ ID NO: 85710 - RNA, 64 nt, Homo Sapiens
uaaaucuguuguguacauuucaacaaauacuuuuacauuugacauuacugaggucauucugagu

SEQ ID NO: 85711 - RNA, 64 nt, Homo Sapiens
cuuaacguguuucuuaaacuuuuguaguaaaugaacauuugaaauccauuuugauaaaccugcu

SEQ ID NO: 85712 - RNA, 64 nt, Homo Sapiens
cuuuguagcugccuccuagaagcacauucugagcacauuugagaccucuguguuagaggggaga

SEQ ID NO: 85713 - RNA, 64 nt, Homo Sapiens
aaguuuuguuuuuaucuugccuguuggcuucaauacauuugagaauacgcugaagagggaaaau

SEQ ID NO: 85714 - RNA, 64 nt, Homo Sapiens
ugccaguagagcugugaagaaacagcugcagagaacauuugaccuuccuggcauucuugucugc

SEQ ID NO: 85715 - RNA, 64 nt, Homo Sapiens
uauuuuaacucuuacuagaaaaucuaaucuuaaaacauuugaauucuaaacauguaaaauguga

SEQ ID NO: 85716 - RNA, 64 nt, Homo Sapiens
aguagaaaaauuagaaauuauagcacauuugaguacauuugaaacaguuuuuuauuacuaaaaa

SEQ ID NO: 85717 - RNA, 64 nt, Homo Sapiens
acauuugaaaaguagaaaaauuacuaaaaauagcacauuugaguuuuaauuacucaguuuuuua

SEQ ID NO: 85718 - RNA, 64 nt, Homo Sapiens
gugugugugguuauaucaaacuuuuacgacuuuuacauuugaguaaccaucaacacgauuaguu

SEQ ID NO: 85719 - RNA, 64 nt, Homo Sapiens
aauauuagcaaaucaggaaugcaaggcuuguucaacauuugauauucaguguaauccauugcau

SEQ ID NO: 85720 - RNA, 64 nt, Homo Sapiens
uucagugcaauccauugcaugcaagccuuguucaacauuugauaaauguuagcaaaucaggaau

SEQ ID NO: 85721 - RNA, 64 nt, Homo Sapiens
aaccaucaacacaauuaguuaaacugguacuuuuacauuugaguugugugugugugguuauaac

SEQ ID NO: 85722 - RNA, 64 nt, Homo Sapiens
uccuugggacucuuaagugcggcuacauuugggaacauuugacuucccuggugccgauguaaag

SEQ ID NO: 85723 - RNA, 64 nt, Homo Sapiens
uuaccuucauaugccacuaaagccgaagaagaaaacauuugaaugaauuuaagcucuguuuuaa

SEQ ID NO: 85724 - RNA, 64 nt, Homo Sapiens
agccgucuuucuuggccugaugggcagaugcuggacauuugaggauguaaggggugaugcauga

SEQ ID NO: 85725 - RNA, 64 nt, Homo Sapiens
aggcagagcaccuuggggcuccuucucaauggugacauuugaagugcaaaacuguuuucuucuu

SEQ ID NO: 85726 - RNA, 64 nt, Homo Sapiens
auucaaggauccaggaugccaaaaauaugugugaacauuugaaacauuuuuauuugcugcuuuu

SEQ ID NO: 85727 - RNA, 64 nt, Homo Sapiens
aaaauuuugucugcacuugaguucacuugaguuuacauuugaaaugugcauguuuauuuauaua

SEQ ID NO: 85728 - RNA, 64 nt, Homo Sapiens
aaaacaaacaagcaagcagacacacacagugaacacauuugauuaauuguguuguuucaacguu

SEQ ID NO: 85729 - RNA, 64 nt, Homo Sapiens
uuguuuuuaaaggauguguuuguaugcauucuggacauuugaauuaaaaaaaaaguauugugau

SEQ ID NO: 85730 - RNA, 64 nt, Homo Sapiens
gucuuuuauauauggauuacgaauacguauaagcacauuugacugcuuagaauauugauuucuu

SEQ ID NO: 85731 - RNA, 64 nt, Homo Sapiens
auuuauuauuuacagcuuagauuuguuuagugcuacauuugauagaagguuuauucugaucaua

SEQ ID NO: 85732 - RNA, 64 nt, Homo Sapiens
gauccuuuuuccuuaauuuauacaugauccaggcacauuugaaauuugguaggcauugcaaaca

SEQ ID NO: 85733 - RNA, 64 nt, Homo Sapiens
caggcacauuugaaauuugguaggcauugcaaacacauuugaauauuguguauuucauacuauu

SEQ ID NO: 85734 - RNA, 64 nt, Homo Sapiens
aauuauauuuuuccaaccacugguuguuuuaauuacauuugaauugucauguuuauuaccuaua

SEQ ID NO: 85735 - RNA, 64 nt, Homo Sapiens
acuguccuuccugcuuuaucuuuauauguaagugacauuugaauaugcuucguggaaugcugca

SEQ ID NO: 85736 - RNA, 64 nt, Homo Sapiens
aaccaauggaaauugcuauauuuggggaugucauacauuugauauugcuucagcauuucaaaua

SEQ ID NO: 85737 - RNA, 64 nt, Homo Sapiens
uuuagacuacugccucuaccauuaacuagcccagacauuugaauggccuuguaaacagcucacu

SEQ ID NO: 85738 - RNA, 64 nt, Homo Sapiens
ccagugagggcucaaguuagauugaauggccaaaacauuugacuuuuacccauacauuuagcaa

SEQ ID NO: 85739 - RNA, 64 nt, Homo Sapiens
uuccacuaucauuguauccaaccugacuuuucucacauuugaacccagggauuguucuugacau

SEQ ID NO: 85740 - RNA, 64 nt, Homo Sapiens
aaacuccaccuauuuugcaauaaacaaucagaccacauuugaagcuacucuugcugcacuuaug

SEQ ID NO: 85741 - RNA, 64 nt, Homo Sapiens
ucauugguuauauuaccaaucuuuguaacaugacacauuugaaaguacaguaacaaucugcuuu

SEQ ID NO: 85742 - RNA, 64 nt, Homo Sapiens
uuuuagcuaaauauauacucuucucuaguuuaaaacauuugaacuugccuaguuagugugguug

SEQ ID NO: 85743 - RNA, 64 nt, Homo Sapiens
uuagaaaaaguccugcuuuaaguaauauguagccacauuugaauccucuaccacaagucuuuuu

SEQ ID NO: 85744 - RNA, 64 nt, Homo Sapiens
uuuucuuggaaagauauaauuugagcaguggcuuuaugcagacuccaagaacaaaaccaccagg

SEQ ID NO: 85745 - RNA, 64 nt, Homo Sapiens
uucuggaccccuauuuaucucaaaacucuuaauauaugcagaccaacaggucuuugcauuccuu

SEQ ID NO: 85746 - RNA, 64 nt, Homo Sapiens
uacaucaacuccuaagggguccucugggauuaguuaugcagauauuaaaucacccgaagacacu

SEQ ID NO: 85747 - RNA, 64 nt, Homo Sapiens
gcccuuaauucuuuuccagcuuuucauauuaauguaugcagagucucaccaagcucaaagacac

SEQ ID NO: 85748 - RNA, 64 nt, Homo Sapiens
uuuuccauccaacagcaguguguagagagaauauuaugcagaugccguuaauuuuuuacccuau

SEQ ID NO: 85749 - RNA, 64 nt, Homo Sapiens
cauuuccauucauuuccauacuggcuuuugauuauaugcagauuccuaguagcaugccuuaccu

SEQ ID NO: 85750 - RNA, 64 nt, Homo Sapiens
aacaacagugugaucauugguuggacacugugguuaugcagaagcagagaugaggaggcuggcc

SEQ ID NO: 85751 - RNA, 64 nt, Homo Sapiens
aauugugaaggguuguguucuuuauggcagguucuaugcagauugugccagagcaugugcgugu

SEQ ID NO: 85752 - RNA, 64 nt, Homo Sapiens
ugcaugcugaggacgaccagcugaggguguauuauaugcagaauuacauaaacgaagcucucaa

SEQ ID NO: 85753 - RNA, 64 nt, Homo Sapiens
ugaacauuuuucuauucauucauuuugaaauaauuaugcagacacaucagcuguuaaccauuug

SEQ ID NO: 85754 - RNA, 64 nt, Homo Sapiens
auagauacagccuuuucagaguaugucaguauauuaugcagaagauccaagagagggaagaaga

SEQ ID NO: 85755 - RNA, 64 nt, Homo Sapiens
uccaugguuuguguguagccugcauggggugcuauaugcagacucagaggccuugauggagagu

SEQ ID NO: 85756 - RNA, 64 nt, Homo Sapiens
ggauauagaguuuguaccaaaaauauuuagauauccuaaauauauaagauauccuaaauauuua

SEQ ID NO: 85757 - RNA, 64 nt, Homo Sapiens
uaaaauauuuagauauccuaggcucuuaagauauccuaaauauuagcuucugugaggaccuuuu

SEQ ID NO: 85758 - RNA, 64 nt, Homo Sapiens
ugaauugagagacauacucucuuuauuaacauuuccuaaauaacaguggaucuaggguuacuuu

SEQ ID NO: 85759 - RNA, 64 nt, Homo Sapiens
auuuuuuaaauucuugaugcaucuggacuugguaccuaaauaucgaaaaauuccaagaguuaca

SEQ ID NO: 85760 - RNA, 64 nt, Homo Sapiens
uaguaucccuucacuacaaauucucugaagaccaccuaaauaucacuugcucugccacugcccg

SEQ ID NO: 85761 - RNA, 64 nt, Homo Sapiens
uacuggaaacgucaccggaaucaggaccgagagcccuaaauaagucacacagcacccugaaagu

SEQ ID NO: 85762 - RNA, 64 nt, Homo Sapiens
cccaaacuuuaccucuaaaucauguguaacuuaaccuaaauacuggucuguguuaacuuuugaa

SEQ ID NO: 85763 - RNA, 64 nt, Homo Sapiens
uggacuuuccuuuucauuucacuuugaguaccccccuaaauagcccugguuaugaucaguugac

SEQ ID NO: 85764 - RNA, 64 nt, Homo Sapiens
caggacagucucuugagggguuuuguuucuguuuccuaaauacuccuaaauaauauuucuaauc

SEQ ID NO: 85765 - RNA, 64 nt, Homo Sapiens
ucuugagggguuuuguuucuguuuccuaaauacuccuaaauaauauuucuaaucagccauuaug

SEQ ID NO: 85766 - RNA, 64 nt, Homo Sapiens
guuuaacuuugcacucucuaugcauaugagguuuccuaaauaaaugaggaguagcauaguuuaa

SEQ ID NO: 85767 - RNA, 64 nt, Homo Sapiens
ggaauguauauguauaucaaaacauguaguacacccuaaauauauauaauuuuuauuugucaaa

SEQ ID NO: 85768 - RNA, 64 nt, Homo Sapiens
agccaccaugcccagcugcuccuuuauuuuaaucccuaaauauaaucccuaaauauaguuauau

SEQ ID NO: 85769 - RNA, 64 nt, Homo Sapiens
agcugcuccuuuauuuuaaucccuaaauauaaucccuaaauauaguuauauuucauacuuaguu

SEQ ID NO: 85770 - RNA, 64 nt, Homo Sapiens
agcuuuaacuuugcuuaaacuacaaacacaagcaaaacuucacggggucauacuacauacaagc

SEQ ID NO: 85771 - RNA, 64 nt, Homo Sapiens
auacuugccugugacauuuugccacuggaacacuaaacuucaugaauugcgccucagauuuuuc

SEQ ID NO: 85772 - RNA, 64 nt, Homo Sapiens
uuuaaagcauccaaaugguaauuaacaggcagcaaaacuucagaacuaguucugcaucuacugu

SEQ ID NO: 85773 - RNA, 64 nt, Homo Sapiens
caucuuaaaaaaaaaaaauccuuccauugaauagaaacuucaaaguccuucaucagaucauggc

SEQ ID NO: 85774 - RNA, 64 nt, Homo Sapiens
guuuuuuuaaugauugaggaaaaagucauuuagaaaacuucaguuuucggccagcgcgucgagg

SEQ ID NO: 85775 - RNA, 64 nt, Homo Sapiens
uuacccuaaaacuuaaaguauaauaaaaaaaaaaaaacuucaguuuucuaaaaauuauauuuaa

SEQ ID NO: 85776 - RNA, 64 nt, Homo Sapiens
aagggaugcauugagcagucuucgaaacuucaagaaacuucaauuuaucugaacauaccuguuu

SEQ ID NO: 85777 - RNA, 64 nt, Homo Sapiens
aaacuucaauaagggaugcaauaccuguuuuucgaaacuucaagcugcugaaaauuaucugaac

SEQ ID NO: 85778 - RNA, 64 nt, Homo Sapiens
uccugaguucaagccauucuucuuggcucacugcaaacuucaccgcuggaaugcaauggcguga

SEQ ID NO: 85779 - RNA, 64 nt, Homo Sapiens
gaaauucacaaaaaaauuaauaccucuguggagaaaacuucaaaacuuaaaaaaggacauagaa

SEQ ID NO: 85780 - RNA, 64 nt, Homo Sapiens
gaaguggcauaguuuuaucaauaucugucaaauuaaacuucaaggcaaaacuuuuuuauugaga

SEQ ID NO: 85781 - RNA, 64 nt, Homo Sapiens
aggcaaauuuuagcaaaaauuaaaauucuuaagaaaacuucacuaauauauagucauaaugugg

SEQ ID NO: 85782 - RNA, 64 nt, Homo Sapiens
uuuuuagcaacagcugaauaaauuuuuuauauuuaaacuucaaucacauuuauauuuaaacuuc

SEQ ID NO: 85783 - RNA, 64 nt, Homo Sapiens
uuuuuauauuuaaacuucaaucacauuuauauuuaaacuucaaugggaaaaaagguccgaauuu

SEQ ID NO: 85784 - RNA, 64 nt, Homo Sapiens
uggccucucucccauuucccgcuguggcugagccaaacuucauuacuuuccuuaggcccucugc

SEQ ID NO: 85785 - RNA, 64 nt, Homo Sapiens
ccugagaaaagagaacuuucucuuaagaaguuggaaacuucauuuuaccuucgugacccuggua

SEQ ID NO: 85786 - RNA, 64 nt, Homo Sapiens
uguuugauuaaaauagagaaguaucuuuuucuaaaaacuucaaggaagcugcaauguaacauag

SEQ ID NO: 85787 - RNA, 64 nt, Homo Sapiens
aaucaccuuaucaggaaggaaaagugagcaccaaaaacuucauuagcuuauagacuaugagaga

SEQ ID NO: 85788 - RNA, 64 nt, Homo Sapiens
cuuuuuguguaauucacuuuauuuauuuuauuacaaacuucaagauuauuuaagugaagauauu

SEQ ID NO: 85789 - RNA, 64 nt, Homo Sapiens
gaaucuuuauaauuucuuuccaaagauaccaaauaaacuucaguguuuucaucuaauucucuua

SEQ ID NO: 85790 - RNA, 64 nt, Homo Sapiens
uuuuaaaaaaucuguuguucgcugacauaacaccaaacuucauuauagcaaaaauaguuaaaau

SEQ ID NO: 85791 - RNA, 64 nt, Homo Sapiens
aacuaaaaucauugucaaaaaguauugcagucuaaaacuucaaaaguagauuauggccuuuuua

SEQ ID NO: 85792 - RNA, 64 nt, Homo Sapiens
ccuggacugugaugggaacagcccagugcagucuaaacuucaauuguguugaaacuacuuuaau

SEQ ID NO: 85793 - RNA, 64 nt, Homo Sapiens
gacaaaguaauaaaucauguuuaucuauugauuuaaacuucaucaguuuugcauccuacugaga

SEQ ID NO: 85794 - RNA, 64 nt, Homo Sapiens
aguacuaaaaggaauaucauaagggcuguagcucaaacuucauaauacauaaaucacugggguc

SEQ ID NO: 85795 - RNA, 64 nt, Homo Sapiens
acuuucuaccauauauuacguuuuuguuauuaaaaaacuucauuggccacuagugaaguuaguc

SEQ ID NO: 85796 - RNA, 64 nt, Homo Sapiens
uccucaaggacauuacuagugacucagaaaauucaaacuucagaaaugaaauccaaagcuuggu

SEQ ID NO: 85797 - RNA, 64 nt, Homo Sapiens
ccuccaaggauguuuaaaaucuaguugggaaaacaaacuucaucaagaguaaaugcaguggcau

SEQ ID NO: 85798 - RNA, 64 nt, Homo Sapiens
caauuugaaauuccauauaacuucaugaaguuuuaaacuucaugcuccgcuccuuaaugugaaa

SEQ ID NO: 85799 - RNA, 64 nt, Homo Sapiens
aaguuuuaaacuucaugcaacgcuccuuaaugugaaacuucaugagacgagagagagaagccuc

SEQ ID NO: 85800 - RNA, 64 nt, Homo Sapiens
auuugcuaguagugcuaacuuacaacaaauuuccaaacuucauaaauuuuaaauuaguauauac

SEQ ID NO: 85801 - RNA, 64 nt, Homo Sapiens
guaguaaauucaaauaggaauccauuuaaaaaacaaacuucauuaauguccucaucuccuacuc

SEQ ID NO: 85802 - RNA, 64 nt, Homo Sapiens
uauugucuaagcuuuaauccacuguguuaggucaaaacuucaaauacaugcauuuuucaauaua

SEQ ID NO: 85803 - RNA, 64 nt, Homo Sapiens
aaccuaucagcuuaguuuuuuaacaugguagucuaaacuucaaggcuugcucuaucuccuagag

SEQ ID NO: 85804 - RNA, 64 nt, Homo Sapiens
ugcacaucguugaaugaagagagucuuuuugcacaaacuucacuugaaauugugccacugauga

SEQ ID NO: 85805 - RNA, 64 nt, Homo Sapiens
uuggggaauuaccuuauuuuauauuguuguaaacaaacuucaaauucuacaugugcgacuuuuc

SEQ ID NO: 85806 - RNA, 64 nt, Homo Sapiens
agcagguagauggaugacaguugcucauucugagaaacuucacucuuuucacuuaugcaucacg

SEQ ID NO: 85807 - RNA, 64 nt, Homo Sapiens
uugccaucggaucaucaacaagucuucuauuuacaaacuucaaaaaacacaaaacaacauucau

SEQ ID NO: 85808 - RNA, 64 nt, Homo Sapiens
gugagacaugcuuauuuugcuaaaggaugcacccaaacuucaaacuucaagcaaaugaaaugga

SEQ ID NO: 85809 - RNA, 64 nt, Homo Sapiens
augcuuauuuugcuaaaggaugcacccaaacuucaaacuucaagcaaaugaaauggacaaugca

SEQ ID NO: 85810 - RNA, 64 nt, Homo Sapiens
agaacaaacuuuacuugauauuccauguauagaaaaacuucauuaauucaguuguaccccagug

SEQ ID NO: 85811 - RNA, 64 nt, Homo Sapiens
agagcuacuuucuauccaaaaagcagcaaguagcaaacuucaggaaaaaacacucaaauaguag

SEQ ID NO: 85812 - RNA, 64 nt, Homo Sapiens
agcccuggaucucccaauggccuuccaauccuuaaacugccaaucgccccacccguuccuaccu

SEQ ID NO: 85813 - RNA, 64 nt, Homo Sapiens
auuguaauccagucccuucuuggaaccuaaauugaacugccaaguacugcgcaugcaagagacc

SEQ ID NO: 85814 - RNA, 64 nt, Homo Sapiens
ccauuuuuuuucuuaaagcauauucuuugcaucuaacugccagugccauugucaaaacuuauuu

SEQ ID NO: 85815 - RNA, 64 nt, Homo Sapiens
gauguagcauaaaaauugucccgguuugaguuauaacugccaguagaugaccagucacaaguga

SEQ ID NO: 85816 - RNA, 64 nt, Homo Sapiens
cccugguccccccacaaggccucagcccagucacaacugccauuuccagucucugcugaguguc

SEQ ID NO: 85817 - RNA, 64 nt, Homo Sapiens
cauuggcagcggcugaacuuggcauuuccuugcuaacugccagauguggccaaccuuuguccau

SEQ ID NO: 85818 - RNA, 64 nt, Homo Sapiens
uuugcacaaguuuccagaaauaguguuaacacaaaacugccaacacaaaugccaaacaaaguau

SEQ ID NO: 85819 - RNA, 64 nt, Homo Sapiens
gucagugugcgcuuauguacggccuacguguuugaacugccauaaaugccagcucucaccagau

SEQ ID NO: 85820 - RNA, 64 nt, Homo Sapiens
uauaacagauacauuucccugccuuagaaauguaaacugccauauagugcucuuaagccuaaau

SEQ ID NO: 85821 - RNA, 64 nt, Homo Sapiens
auuuucugucagaugagaaccauuugccuugcagaacugccauuauacauacggucagguuuaa

SEQ ID NO: 85822 - RNA, 64 nt, Homo Sapiens
uguaguagacucggguccuguccacagcccuagcugccagcaaugcuguccucacagaggcaua

SEQ ID NO: 85823 - RNA, 64 nt, Homo Sapiens
ugugcuccacugugacgguggcccggggggaggaugccagcagccugccuauggcuccagcugu

SEQ ID NO: 85824 - RNA, 64 nt, Homo Sapiens
caggccaaugcaagaggccaaggcuggagaggcgugccagcaaggccagggauggccggagggc

SEQ ID NO: 85825 - RNA, 64 nt, Homo Sapiens
gggcaucucgggcuuggcugcagacugugaugacugccagcacaccacggaaggacaugcuguc

SEQ ID NO: 85826 - RNA, 64 nt, Homo Sapiens
uguuucugggucuuggagguaagagccacuuuccugccagcacacgcccucccugcaguugagg

SEQ ID NO: 85827 - RNA, 64 nt, Homo Sapiens
gugcaggguggacaucaccuuggaggcccugcacugccagcaucuggagaccguccuggagcug

SEQ ID NO: 85828 - RNA, 64 nt, Homo Sapiens
ugauuccuuggugacagguugagggcagcuccagugccagcaauaggguggcacagaagcucau

SEQ ID NO: 85829 - RNA, 64 nt, Homo Sapiens
gaccccagggacuugccuuccccacccacucugcugccagcaggcccagggaucccugaccugc

SEQ ID NO: 85830 - RNA, 64 nt, Homo Sapiens
cacccugguuguucucugggcuuggaggguacagugccagcagcuuccuugcccaauugauguu

SEQ ID NO: 85831 - RNA, 64 nt, Homo Sapiens
cuaaaucuggaguuuuacaagccagcacugccuuugccagcaucccaugugcauuaaauacuuu

SEQ ID NO: 85832 - RNA, 64 nt, Homo Sapiens
gccuuugccagcauccuaaaugcauuaaauacuuugccagcacuaauagaauagcauuuccaug

SEQ ID NO: 85833 - RNA, 64 nt, Homo Sapiens
gauguuccagugucccuggucucugcccaccagaugccagcacucccaccauucguggcaacca

SEQ ID NO: 85834 - RNA, 64 nt, Homo Sapiens
gugcuuucauccgucacaaacuggcaccuguaccugccagcaggagcaugauggggacuuccau

SEQ ID NO: 85835 - RNA, 64 nt, Homo Sapiens
aacauucuagaguauuccagaacucugagugccuugccagcacuaugaauaagucggacuuauu

SEQ ID NO: 85836 - RNA, 64 nt, Homo Sapiens
cagcaucuccuggccuggccugaagcucccccccugccagcaccggccccuacccugcccugcc

SEQ ID NO: 85837 - RNA, 64 nt, Homo Sapiens
agauacuguccccucuggagguguggccguguuuugccagcaugucucugugcuuuuggccucu

SEQ ID NO: 85838 - RNA, 64 nt, Homo Sapiens
gacucaggaacagcaagucaguggaagcaucagaugccagcacucaggcguuccuuuugggacu

SEQ ID NO: 85839 - RNA, 64 nt, Homo Sapiens
ugggugggggauguggguguuggaugucugugugugccagcagggugaaugggugaggcugaug

SEQ ID NO: 85840 - RNA, 64 nt, Homo Sapiens
uucuuuacugcaaagacaggguuucuaucugaccugccagcaccagagauauauuaaagcacaa

SEQ ID NO: 85841 - RNA, 64 nt, Homo Sapiens
ggauggcagagacuuccuugucaucauggagaagugccagcaggggacugggaaaagcacucua

SEQ ID NO: 85842 - RNA, 64 nt, Homo Sapiens
agccuugaguccauugccaaauuuucagcacaccugccagcaacuugggggaauaagcgaaggu

SEQ ID NO: 85843 - RNA, 64 nt, Homo Sapiens
ccugggaaaaggcuguggcccagcccugggacccugccagcagcaggaccacaaccccugccag

SEQ ID NO: 85844 - RNA, 64 nt, Homo Sapiens
ccugggacccugccagcagcaggaccacaaccccugccagcagcgcgucgcuccucugcucaac

SEQ ID NO: 85845 - RNA, 64 nt, Homo Sapiens
gagugcuuuuuugguaccacgagacccggcccucugccagcauaaaccacucacaccccagggg

SEQ ID NO: 85846 - RNA, 64 nt, Homo Sapiens
aaaauaagccgucaaguaguaagaagaacuuggaugccagcaaagagaauggggcugggcagau

SEQ ID NO: 85847 - RNA, 64 nt, Homo Sapiens
aacuugaagaagguugucagcugcagccacuuucugccagcaucugcagccacuuucugccagc

SEQ ID NO: 85848 - RNA, 64 nt, Homo Sapiens
cagccacuuucugccagcaucugcagccacuuucugccagcaucugcagccagcaagcugggac

SEQ ID NO: 85849 - RNA, 64 nt, Homo Sapiens
uuccauuucagccaguggguagcugauaagccagugccagcauccagcaugagcagaugucggg

SEQ ID NO: 85850 - RNA, 64 nt, Homo Sapiens
cguuacugcucuccuucccuucaugauaagccagugccagcauccagcgugagcagacgucggg

SEQ ID NO: 85851 - RNA, 64 nt, Homo Sapiens
caccuggcccuccuccuuuuuggugcaggacagcugccagcaccacuccacccgaccccagcag

SEQ ID NO: 85852 - RNA, 64 nt, Homo Sapiens
cccagcaccugcuagcaggacccgcgccuccuccugccagcaccgggaggugucccacugaagc

SEQ ID NO: 85853 - RNA, 64 nt, Homo Sapiens
gcccgcguggugacccagaaacccacagcucgguugccagcaguuuuucaggcagcgucuguga

SEQ ID NO: 85854 - RNA, 64 nt, Homo Sapiens
ggggcggccggcugguggguaccugagcgaggggugccagcaagagggcgccgaugucgagggc

SEQ ID NO: 85855 - RNA, 64 nt, Homo Sapiens
guauauggaauacaaaagcuaauggagcuccacaugccagcaccaauuaagugggcuggagaag

SEQ ID NO: 85856 - RNA, 64 nt, Homo Sapiens
uuggggugguuaagucuuauaggggcccuccugcugccagcagggggagaugcugccagcacac

SEQ ID NO: 85857 - RNA, 64 nt, Homo Sapiens
caggggcccuccugcugccauccuggggagaugcugccagcacaggugcaggugagccggcgug

SEQ ID NO: 85858 - RNA, 64 nt, Homo Sapiens
gggagcugcuccgcccuugcuggcagaggucuggugccagcacuggauggccaugccccgugcc

SEQ ID NO: 85859 - RNA, 64 nt, Homo Sapiens
ucuuucaagaguaacaaaaaaaugcaaacuguaaugaaacuacauuguauuucuaagugugaaa

SEQ ID NO: 85860 - RNA, 64 nt, Homo Sapiens
caaguauguccauguguuucuuauaagguacacuugaaacuagugaguguuugucacauuucac

SEQ ID NO: 85861 - RNA, 54 nt, Homo Sapiens
aagcugaagaaggugacugaauuuugaaacuacacccucaguaaagcaaacagg

SEQ ID NO: 85862 - RNA, 64 nt, Homo Sapiens
guuaaaagugaacauuuugaagguuuuuaacuggugaaacuagccuggaauaaugccaccagag

SEQ ID NO: 85863 - RNA, 64 nt, Homo Sapiens
cagugguuuuggggguuauccacuuuuauuuuuuugaaacuagcucucauucugucacccaggc

SEQ ID NO: 85864 - RNA, 64 nt, Homo Sapiens
acuugggaggcugaggcaggagaaucacaaggauugaaacuaugcaguguguucuccaaacaug

SEQ ID NO: 85865 - RNA, 64 nt, Homo Sapiens
aauugccugugugcacauauuuuuagaugaaaaaugaaacuaccuuacaauauuauuuuuuuaa

SEQ ID NO: 85866 - RNA, 64 nt, Homo Sapiens
guugauguguucauuccaguuauucacuuacagaugaaacuaaaacaaauaaaggcaagcuauu

SEQ ID NO: 85867 - RNA, 63 nt, Homo Sapiens
accuugugacaucuguuuaaaagagaggaagaaugaaacuaagaaaauucuauguuaauuaca

SEQ ID NO: 85868 - RNA, 64 nt, Homo Sapiens
aaaacaaaaaucuguguaacuguaaaacauugaaugaaacuauuuuaccugaacuagauuuuau

SEQ ID NO: 85869 - RNA, 64 nt, Homo Sapiens
uauaguaaagaggguuuuuauacaaacuuauucuugaaacuaaauuuauucaaauaagauuauu

SEQ ID NO: 85870 - RNA, 64 nt, Homo Sapiens
aauagaaaauaagauauacaucagaaauuucccaugaaacuaaauuuaaaugcaauuuauuauu

SEQ ID NO: 85871 - RNA, 64 nt, Homo Sapiens
auauguauauguauauuuaaucaaccagcaguuuugaaacuagucauccugguacaaaaguuuu

SEQ ID NO: 85872 - RNA, 64 nt, Homo Sapiens
cuuuccugaaccuucucagugguuuacaugccucugaaacuaugugcaauauuuuugguugaca

SEQ ID NO: 85873 - RNA, 64 nt, Homo Sapiens
guaaucccugcuggucauaggaaaacacacgguucuaauuaagugugaagguauagcuauugca

SEQ ID NO: 85874 - RNA, 64 nt, Homo Sapiens
auacuguuauguauaugcuaaauguugguaaauacuaauuaauuuccaucauuuguagacuugu

SEQ ID NO: 85875 - RNA, 64 nt, Homo Sapiens
aucucaccccauauuguucuuaaauaaguauagacuaauuaaccuaagcuaccuuuaacaacgu

SEQ ID NO: 85876 - RNA, 64 nt, Homo Sapiens
uuauaggcaugagccaccgugcccagccuacuuucuaauuaauuaaaaaaaaaaaaaaaaaaaa

SEQ ID NO: 85877 - RNA, 64 nt, Homo Sapiens
ugcuucuguugcacuuuaguuaagugaguacacucuaauuaacucuaauuaaaagcauagugua

SEQ ID NO: 85878 - RNA, 64 nt, Homo Sapiens
gcauaguguauaagugaguacauuuuuguguuaacuaauuaaaaauaauaaauuaucaauuaca

SEQ ID NO: 85879 - RNA, 64 nt, Homo Sapiens
aaagcaccacuguucuguucauuuccuagcuguucuaauuaagaaaacuauuaagaugagcaac

SEQ ID NO: 85880 - RNA, 64 nt, Homo Sapiens
uguuuauugacaggucuuuucaaauaaugcuuuucuaauuaauagccaaagauuucauaucuaa

SEQ ID NO: 85881 - RNA, 64 nt, Homo Sapiens
uggaauaugcaacauuguccaaaaaaccuaauagcuaauuaauccauagcauguuuauaucugc

SEQ ID NO: 85882 - RNA, 64 nt, Homo Sapiens
gaaacaugcuuaccagauucuaauuuaaauuuugcuaauuaacucucacccuguuaugucuugc

SEQ ID NO: 85883 - RNA, 64 nt, Homo Sapiens
uuucuuuuaucuugauaacuccuagugagggaaucuaauuaagauuucaugcuguucuuuguaa

SEQ ID NO: 85884 - RNA, 64 nt, Homo Sapiens
auuguuuauuuccaaggcauguauuauucaauuucuaauuaaaauauaucagggcuuauauuuu

SEQ ID NO: 85885 - RNA, 64 nt, Homo Sapiens
ggaucauuauuauggcauuuuagaaaauugaccucuaauuaaguuuccagccuaauuaaggaca

SEQ ID NO: 85886 - RNA, 64 nt, Homo Sapiens
acauagaaaauugaccucuaugcuagguuccagccuaauuaaggaaauacuuuuuauguaucau

SEQ ID NO: 85887 - RNA, 64 nt, Homo Sapiens
gaggcagaugagcuuacaaguauugaaauaauuacuaauuaaucacaaaugugaaguuaugcau

SEQ ID NO: 85888 - RNA, 64 nt, Homo Sapiens
ugaaguuaugcaugauguaaaaaauacaaacauucuaauuaaaggcuuugcaacacaugccuug

SEQ ID NO: 85889 - RNA, 64 nt, Homo Sapiens
uugucuccauacauaucugauuuugccuccuguucuaauuaauugauccccuccauuuuuugug

SEQ ID NO: 85890 - RNA, 64 nt, Homo Sapiens
aaauccgccacuuucaugacgagaucggaaauaacuaauuaaacacauuccccgagaguguaaa

SEQ ID NO: 85891 - RNA, 64 nt, Homo Sapiens
gaacagaccaauaaugaguuccaaaauuuaaucacuaauuaaaaaucuaucaaacaaaacucug

SEQ ID NO: 85892 - RNA, 64 nt, Homo Sapiens
aauugcaacaaaaacaaaaauugacaagugggaccuaauuaaacuaaauaacuucugcacagca

SEQ ID NO: 85893 - RNA, 64 nt, Homo Sapiens
uugcuguaauauaaaacuuagaaguaaaccacugcuaauuaaucauuuuaaacuuucaaaaacu

SEQ ID NO: 85894 - RNA, 64 nt, Homo Sapiens
ccaaauuaauuacaaucugguuguuuagccuaugcuaauuaagcccucuuaguaguaguauuca

SEQ ID NO: 85895 - RNA, 64 nt, Homo Sapiens
gcuaccauguuaauacaucauuuuuuguuucuuccuaauuaacaaaagggcucuauaaugauua

SEQ ID NO: 85896 - RNA, 64 nt, Homo Sapiens
auaauuucaauuuuuaaauuucuuggugcuuugucuaauuaauuacaucccauaacuugucagg

SEQ ID NO: 85897 - RNA, 64 nt, Homo Sapiens
caccugccccucaacucucccacaugccucucucaggccaaacuauagccaaggccaaaggaag

SEQ ID NO: 85898 - RNA, 64 nt, Homo Sapiens
aagcacaugccucucucaggagccgagauagccaaggccaaagguguggguuucuaaagcugcc

SEQ ID NO: 85899 - RNA, 64 nt, Homo Sapiens
accaacugaucaccacuaacucagagccuccuccaggccaaacagccccaaagucaauuaaagg

SEQ ID NO: 85900 - RNA, 64 nt, Homo Sapiens
uuuguggaaccagaggcacagagagagucaacugaggccaaaagaggccugagagaaacugagg

SEQ ID NO: 85901 - RNA, 64 nt, Homo Sapiens
caugccuauucugcaggugucuaauauacacaaaaggccaaaacuauaguaucuacuucuggua

SEQ ID NO: 85902 - RNA, 64 nt, Homo Sapiens
agcuugacccuggcucacagaaaaugcaucaagaaggccaaaccgcuccaccagugggccuugg

SEQ ID NO: 85903 - RNA, 64 nt, Homo Sapiens
gccaugcaucuauaaaggucacaccuaugucaacaggccaaacagccuugcucuugccaccagg

SEQ ID NO: 85904 - RNA, 64 nt, Homo Sapiens
cucagacaguuggcagacgucccuccacugccaaaggccaaaagauaguuguuuucuaacccag

SEQ ID NO: 85905 - RNA, 64 nt, Homo Sapiens
uacugaauuuagcgaauuugaaaugaaucuuggaaggccaaagcuaaagcauucaacauugugu

SEQ ID NO: 85906 - RNA, 64 nt, Homo Sapiens
ccaccacuuacuagguuugucagaucuggguucaaggccaaauugcacuucggcucuggaguua

SEQ ID NO: 85907 - RNA, 64 nt, Homo Sapiens
ggagaaauaaacgcauucugguaggaguuaaaauaggccaaacuuguauuggcuguucauguau

SEQ ID NO: 85908 - RNA, 64 nt, Homo Sapiens
aaugcugcgcauacccagagugggcuuucccaauaggccaaaaagucuucaggacaccauuaga

SEQ ID NO: 85909 - RNA, 64 nt, Homo Sapiens
gggagcguggucguggaagaaacaacccaccugaaggccaaaugccagagauuugggguugggg

SEQ ID NO: 85910 - RNA, 64 nt, Homo Sapiens
caggcuccuccuugcccccaccuugccccaggaaaggccaaaguccaggugacugcccuccuuc

SEQ ID NO: 85911 - RNA, 64 nt, Homo Sapiens
ccaacucuguaaaacacacucuugccucuagaguaggccaaaugcuaccagcaaauagcccuaa

SEQ ID NO: 85912 - RNA, 64 nt, Homo Sapiens
cagagaugaggcuaaggcaagcagcagcagaaugaggccaaaugggacuucuggguacugagaa

SEQ ID NO: 85913 - RNA, 64 nt, Homo Sapiens
ugucuuccaucacuguaagucgacagaggggccgaggccaaaagagugucuggggcuccuggua

SEQ ID NO: 85914 - RNA, 64 nt, Homo Sapiens
acuggccccuuaauucccacaggcccccccagcaaggccaaagggaggccccuggguauugucc

SEQ ID NO: 85915 - RNA, 64 nt, Homo Sapiens
auccucuuuguuuguucaaaggaccaguuuuccuaggccaaagaagucucuuccccauguuagu

SEQ ID NO: 85916 - RNA, 64 nt, Homo Sapiens
ccucauuuuacagaugaggaagggcucugagaagaggccaaagcgaccacagauuuggacagga

SEQ ID NO: 85917 - RNA, 64 nt, Homo Sapiens
gcugcagucaccccuugugcacaaagaccccaggaggccaaagguccagccuggagggaagggg

SEQ ID NO: 85918 - RNA, 64 nt, Homo Sapiens
acuuggcaaauaauugacaaucaggccaaaaaucaggccaaauggcuaaaaaucaggcuaaaaa

SEQ ID NO: 85919 - RNA, 64 nt, Homo Sapiens
ucaggccaaaugacuuggcaucaggcuaaaaaucaggccaaaaagggaagaguccugcuaaaaa

SEQ ID NO: 85920 - RNA, 64 nt, Homo Sapiens
uguuuaaaauaaaguauuaauacuuuaaagucaaauaagauauaguguuuacauucuuuagguc

SEQ ID NO: 85921 - RNA, 64 nt, Homo Sapiens
augcuaauuuauuguuucuugguuucaccuuuguauaagauauagccaagacugaagaaaccaa

SEQ ID NO: 85922 - RNA, 64 nt, Homo Sapiens
uuagggucauucuccuuaauaggcuuuuauguuaauaagauauauuuuuagaagagcuuguuug

SEQ ID NO: 85923 - RNA, 64 nt, Homo Sapiens
uauuuuuagaagagcuuguuugggagauuagagaauaagauaaaagaaccaaaaccuuaggaua

SEQ ID NO: 85924 - RNA, 64 nt, Homo Sapiens
ucuguucagaaucuuacagugaucaagcauuuuuauaagauauuugcaauuuuuguaaauauuu

SEQ ID NO: 85925 - RNA, 64 nt, Homo Sapiens
ccaagucugaauuuacauuugacuaaagcagcacauaagauaauuugcuaaaaugcuaaucuuu

SEQ ID NO: 85926 - RNA, 64 nt, Homo Sapiens
aaugccuuuaaucaguccucacaccuuucuacacauaagauaauuuauacuggagaggaacucu

SEQ ID NO: 85927 - RNA, 64 nt, Homo Sapiens
aauacuuuaaaccaauccucaaaccucacuaaacauaagauaauacugaaaacuuuacaaaccu

SEQ ID NO: 85928 - RNA, 64 nt, Homo Sapiens
aaagccuuuaaccaguuuucaacccuuauuacacauaagauaauucauagcggagagaaacccc

SEQ ID NO: 85929 - RNA, 64 nt, Homo Sapiens
aaagccuuuaacugguccucaacucuuauuacacauaagauaauucacaguggagaaaaacccu

SEQ ID NO: 85930 - RNA, 64 nt, Homo Sapiens
aaagcuuuuaaccaagucucaacacuuacuauacauaagauaauuuauacuggagcaaaaccuu

SEQ ID NO: 85931 - RNA, 64 nt, Homo Sapiens
caaguauaaaugacaaguacuuaccguuuugucuauaagauacacaguuucugcucuuaagggc

SEQ ID NO: 85932 - RNA, 64 nt, Homo Sapiens
gugcugaagagaaaacaguugauuggaaugggcuauaagauauuauuucagauuacuuuuuaau

SEQ ID NO: 85933 - RNA, 64 nt, Homo Sapiens
gcaacaaucauugcuacugacauaucuauuuggaauaagauacauuauaaugauuuuuaaaaaa

SEQ ID NO: 85934 - RNA, 64 nt, Homo Sapiens
aauaucuuuaccuuauuaauacauaaauaagugaauaagauaaaaacauacuuauccucugaac

SEQ ID NO: 85935 - RNA, 64 nt, Homo Sapiens
auggagaccugaauaauucuaacaauuuuacaacauaagauagaaacucacuggaaauccaauu

SEQ ID NO: 85936 - RNA, 64 nt, Homo Sapiens
uccaucucgccccuucccuuuguuuuacccagaaauaagauaacuguuuuuuguuuguuuguuu

SEQ ID NO: 85937 - RNA, 64 nt, Homo Sapiens
aaagcuuuucaccaguacuuuacccuuaauacacauaagauaauuaaugcuggagagaaacccu

SEQ ID NO: 85938 - RNA, 64 nt, Homo Sapiens
aaagauuucuauugauucucauaccuuacuaaauauaagauaauucauauuggagagaaauucu

SEQ ID NO: 85939 - RNA, 64 nt, Homo Sapiens
aaagcuuuuaacaaauccucauccauuaguaaacauaagauaauucauacuggagagaaaaccu

SEQ ID NO: 85940 - RNA, 64 nt, Homo Sapiens
aaagccuuuagccugucccuccaauuuacugcacauaagauaauuuauacuggagagaagcccu

SEQ ID NO: 85941 - RNA, 64 nt, Homo Sapiens
aaagcuuuuaaccaauuuucaaaccuuacuaaacauaagauaacucauacuggagaaaaaucuu

SEQ ID NO: 85942 - RNA, 64 nt, Homo Sapiens
aauuacacagcuaaaaaggaaaaaaaacaccaaaauaagauaaaauaaaacaaauuuaaacacc

SEQ ID NO: 85943 - RNA, 64 nt, Homo Sapiens
aauaagauaaaauaaaacaaauuuaaacaccaaaauaagauauaauaaaacauuuguuuuugca

SEQ ID NO: 85944 - RNA, 64 nt, Homo Sapiens
ggcuuuagggcucccccggcugggggcugugcaguccggucagggcgggaggggaaaugcaccg

SEQ ID NO: 85945 - RNA, 64 nt, Homo Sapiens
guucccuuggcagggccuugcucagagaugcucuuccggucagaguuuuguguugugcgcaggc

SEQ ID NO: 85946 - RNA, 64 nt, Homo Sapiens
aguucugccgugcgauggggcagcagcuuuuguguccggucaccucuguaugacugacgcuugg

SEQ ID NO: 85947 - RNA, 64 nt, Homo Sapiens
uucugacuuuucagggcaguugugagcgaccacauccggucaagcaaaguucugggauuacagg

SEQ ID NO: 85948 - RNA, 64 nt, Homo Sapiens
uggcuaguaguuucuucauuugaaauuguaagcauccggucaguaagaaugcccauccaguuuu

SEQ ID NO: 85949 - RNA, 64 nt, Homo Sapiens
agaagugaaaaggcugccucgaucucacggaccauccggucacccagcugccaagucauuugag

SEQ ID NO: 85950 - RNA, 54 nt, Homo Sapiens
agaaaagaagugaaucuugaggauuccggucagcuaccuaggcaucaccuuguu

SEQ ID NO: 85951 - RNA, 64 nt, Homo Sapiens
auguggcccacaucugaccuggcagcccauguauuccggucauuagggaugggaagccaugagg

SEQ ID NO: 85952 - RNA, 64 nt, Homo Sapiens
ucucugggccucaguuaaugauaugacuggacaauccggucaccgauccugcuacagauucaac

SEQ ID NO: 85953 - RNA, 64 nt, Homo Sapiens
cuucuguucucugucacaaccccaggugauuugguccggucaaaggccauacuuggggcccuaa

SEQ ID NO: 85954 - RNA, 64 nt, Homo Sapiens
gauucagaugugcugaaagcucugccucuggcuuuccggucauggguuccaguuaauucaugcc

SEQ ID NO: 85955 - RNA, 64 nt, Homo Sapiens
gaaagucacuucauucuaacuagaugcgcccacuuccggucauuauuucguuugcaugauguau

SEQ ID NO: 85956 - RNA, 64 nt, Homo Sapiens
cuuuucuccuccucucuccucucuguucccgucuuccggucauucaaccucccccuccuguccc

SEQ ID NO: 85957 - RNA, 64 nt, Homo Sapiens
ccucgcgcccucuccuucuucuggaggcgccccguccggucagcagcuacagugugucauagag

SEQ ID NO: 85958 - RNA, 64 nt, Homo Sapiens
ggcccuggaggggggguccccgcggcagcugaccuccggucaccugcuuccccuucugugcaaa

SEQ ID NO: 85959 - RNA, 64 nt, Homo Sapiens
uccuucuugcucagggccuagauaccuggaagacuccggucaccuccagaagcuaggagggagg

SEQ ID NO: 85960 - RNA, 64 nt, Homo Sapiens
ggugucagaucccauccugcuccucuccagaguuuccggucaccuccguguucucagggagugc

SEQ ID NO: 85961 - RNA, 64 nt, Homo Sapiens
agggcaccaaucccaccuccgagggagggagccguccggucagucuugggagagauauaaagug

SEQ ID NO: 85962 - RNA, 64 nt, Homo Sapiens
ucugguggugagaggcugguagagaaaacauauuuccggucaucccugaugcagggaaggaaga

SEQ ID NO: 85963 - RNA, 64 nt, Homo Sapiens
gacagugggagcuguguuacuagcacuauauaauuccggucagugcugacaaauaacauuuaac

SEQ ID NO: 85964 - RNA, 64 nt, Homo Sapiens
acccagaggaugcagggaaagcacacugugucuuuccggucauuggauccucucccuuucccca

SEQ ID NO: 85965 - RNA, 64 nt, Homo Sapiens
aguuaaacuauuuugagcauuagaauggaggaaauccggucagccaagugcagaguucagacuu

SEQ ID NO: 85966 - RNA, 64 nt, Homo Sapiens
uauuagaaagcugacccaacaagagcucucugccuccggucacucuugcuguggugcuacgugg

SEQ ID NO: 85967 - RNA, 64 nt, Homo Sapiens
ugaucccaucucuuuucccuucuuuccuccugguuccggucaguucagaggauuuaacaaucac

SEQ ID NO: 85968 - RNA, 64 nt, Homo Sapiens
cccuggcaaucccaccaaaucuucccagcaacacuccggucagccuggagcggagcugaggcuc

SEQ ID NO: 85969 - RNA, 64 nt, Homo Sapiens
ugaggaaucccagggugacucugucggggaagaauccggucacagccuccccucagagacaggc

SEQ ID NO: 85970 - RNA, 64 nt, Homo Sapiens
gucuucauguggagcccucaccacaaucccugacuccggucauuugugccuuucucuugucauc

SEQ ID NO: 85971 - RNA, 64 nt, Homo Sapiens
ggcauggccagucguggcaggccggccuucagcguccggucagggaagcgugcagcccaaaugg

SEQ ID NO: 85972 - RNA, 64 nt, Homo Sapiens
cugaaacugucccuccagaggcuucaggagcggguccggucauuaaaacaguugucuggcauca

SEQ ID NO: 85973 - RNA, 64 nt, Homo Sapiens
auccccauccuauaguucauaguccucuccugguuccggucaaagccuuuccucagccuucacc

SEQ ID NO: 85974 - RNA, 64 nt, Homo Sapiens
aaacggugaauauuauagaauguggauuuguguauccggucaccugucugaaaacaucacuuuu

SEQ ID NO: 85975 - RNA, 64 nt, Homo Sapiens; identical to SEQ ID NO: 70731

SEQ ID NO: 85976 - RNA, 64 nt, Homo Sapiens; identical to SEQ ID NO: 70732

SEQ ID NO: 85977 - RNA, 64 nt, Homo Sapiens; identical to SEQ ID NO: 70733

SEQ ID NO: 85978 - RNA, 64 nt, Homo Sapiens; identical to SEQ ID NO: 70734

SEQ ID NO: 85979 - RNA, 64 nt, Homo Sapiens; identical to SEQ ID NO: 70735

SEQ ID NO: 85980 - RNA, 64 nt, Homo Sapiens; identical to SEQ ID NO: 70736

SEQ ID NO: 85981 - RNA, 64 nt, Homo Sapiens; identical to SEQ ID NO: 70737

SEQ ID NO: 85982 - RNA, 64 nt, Homo Sapiens; identical to SEQ ID NO: 70738

SEQ ID NO: 85983 - RNA, 64 nt, Homo Sapiens; identical to SEQ ID NO: 70739

SEQ ID NO: 85984 - RNA, 64 nt, Homo Sapiens; identical to SEQ ID NO: 70740

SEQ ID NO: 85985 - RNA, 64 nt, Homo Sapiens
cuuacuaacaccuaugauguuaccugaaaucaaucucccauauguaugcuguaugcuaugcuaa

SEQ ID NO: 85986 - RNA, 64 nt, Homo Sapiens
aaaaaaaacugucuugucuacuuuuagcuucauucucccauauuuugaaggguguguaacuuca

SEQ ID NO: 85987 - RNA, 64 nt, Homo Sapiens
gcuggcucaggaagaaaccccccuacaucuucagcucccauagcacaaaggggagaagggccag

SEQ ID NO: 85988 - RNA, 64 nt, Homo Sapiens
aucacugaguggcuugugaucagagaccuuuucucucccauaccucccaagcuuugaauacccc

SEQ ID NO: 85989 - RNA, 64 nt, Homo Sapiens
cucacucugucugguauaggcuaauuuugaagaacucccauaaguuucugcugcuucucccaua

SEQ ID NO: 85990 - RNA, 64 nt, Homo Sapiens
aauuuugaagaacucccauaaguuucugcugcuucucccauaacugcugccaccaccaucagaa

SEQ ID NO: 85991 - RNA, 64 nt, Homo Sapiens
ugucacuguacuaucuacauguggaagaauguucaaguugaauccuaaugccgugaaugaaaca

SEQ ID NO: 85992 - RNA, 64 nt, Homo Sapiens
aaugaaacacagucuguguagggaaugagcaaaaaaguugaauuccaauugcuuuuuggccuuu

SEQ ID NO: 85993 - RNA, 64 nt, Homo Sapiens
ugaacaugcucuucaaaaagaugcacuuaguauuaaguugaaacuugaacaaauagauggucac

SEQ ID NO: 85994 - RNA, 64 nt, Homo Sapiens
aggacaguguuucaacaagccuaggcuaucucguaaguugaaaaauaucccacuauaguugcuu

SEQ ID NO: 85995 - RNA, 64 nt, Homo Sapiens
caugucaaaggaacuuuugagugaugacucugagaaguugaauugcuugaagaguucaucacgg

SEQ ID NO: 85996 - RNA, 64 nt, Homo Sapiens
uuaauaaaugaaggcaugagaggaaguaaguagcaaguugaaggacagguaguugagaugaaac

SEQ ID NO: 85997 - RNA, 64 nt, Homo Sapiens
acuucuuauuugaaguuaaaauuucuuauuugaaaaguugaaauuuaugagcuuugaagauugc

SEQ ID NO: 85998 - RNA, 64 nt, Homo Sapiens
ucuagacucaccaagaacuacauguuaugauguuaaguugaaguugaaacaugauguuuugcau

SEQ ID NO: 85999 - RNA, 64 nt, Homo Sapiens
cucaccaagaacuacauguuaugauguuaaguugaaguugaaacaugauguuuugcauuaaauu

SEQ ID NO: 86000 - RNA, 64 nt, Homo Sapiens
aaacuuguauguaucuguauagacgacauggcagaaguugaaaccuaaaaaguaaaaaugaaaa

SEQ ID NO: 86001 - RNA, 64 nt, Homo Sapiens
augguuuuguuauuucuugagucuagguugcaguaaguugaaaugacuuuaugaagggaagauu

SEQ ID NO: 86002 - RNA, 64 nt, Homo Sapiens
cauacauacuuuacaagcaaguuaaauggagauaaaguugaaaucauagaagaugcaaaugacc

SEQ ID NO: 86003 - RNA, 64 nt, Homo Sapiens
cccugcccgcaagagcuaaguaggaucuuacuguaaguugaagggaguuuugcccuaacucaug

SEQ ID NO: 86004 - RNA, 64 nt, Homo Sapiens
gcagugugaacgcaucccaacauagguuaagagcaaguugaaaacaaaggccauggcauucugc

SEQ ID NO: 86005 - RNA, 64 nt, Homo Sapiens
uggugucuguuuauguaacucugacuugcuggaaaaguugaaacuccaaauaaucugaaacuag

SEQ ID NO: 86006 - RNA, 64 nt, Homo Sapiens
aaaaggcacaguuaacaaaauuaacaaggacaaaaaguugaaagcguuggacaaauuuugaguu

SEQ ID NO: 86007 - RNA, 64 nt, Homo Sapiens
ggggaauauuuggccacauacucuccaucuuaccaaguugaaaacugaaacaugucuguuaccc

SEQ ID NO: 86008 - RNA, 64 nt, Homo Sapiens
auuauagugaguacccuuauaaguaaaaguuucaaaguugaaaguuuaauuuugggaaauuuua

SEQ ID NO: 86009 - RNA, 64 nt, Homo Sapiens
uguuccugcauuucagcaguauuuuuacauuaaaaaguugaauagcaucauggaacgccacagg

SEQ ID NO: 86010 - RNA, 64 nt, Homo Sapiens
uaugaucauaagucaaaaaugaaaauaugaucauaaguugaaaaugauaaacccaucauaaguu

SEQ ID NO: 86011 - RNA, 64 nt, Homo Sapiens
uaugaucauaaguugaaaaugauaaacccaucauaaguugaaaaaugugauggguuugcauccu

SEQ ID NO: 86012 - RNA, 64 nt, Homo Sapiens
auuguuaguccgggaccuucuuuuuaaaaauccuaaguugaaucgcuuucccaucaucauaaaa

SEQ ID NO: 86013 - RNA, 64 nt, Homo Sapiens
ugcauugaauacacccaaccguccaaaauauuggaaguugaaaaucucaauaaacccaucguaa

SEQ ID NO: 86014 - RNA, 64 nt, Homo Sapiens
gacacuuuguugcaacccuuuuucaaguacuugaaaguugaaaauuugaaaucuugguauugau

SEQ ID NO: 86015 - RNA, 64 nt, Homo Sapiens
guuaacuccuguauauaucauuaaaauaaaucugaaguugaaguaguguuuuuaguuaaauuau

SEQ ID NO: 86016 - RNA, 64 nt, Homo Sapiens
accacccaagaugacuaccauauaauuuauuuaaaaguugaaaacuuccuuuagaaggaacugu

SEQ ID NO: 86017 - RNA, 64 nt, Homo Sapiens
auuuguucccaggauuuauuacauacuuuuccuaaaguugaagcuacuacgaucacagacacag

SEQ ID NO: 86018 - RNA, 64 nt, Homo Sapiens
ugacugcucuguacaucauguuauuaauuuaacaaaguugaaagacugaagacauugucauguu

SEQ ID NO: 86019 - RNA, 64 nt, Homo Sapiens
aucauuguuagaagcauuucugugcauucaguagaaguugaagaugagcagugucaguaaauac

SEQ ID NO: 86020 - RNA, 64 nt, Homo Sapiens
aaaagcacauuucauguguauucaacccuaaguaaaguugaaugaaacuuaacagaauggaaau

SEQ ID NO: 86021 - RNA, 64 nt, Homo Sapiens
uuucuaagguugugcuaauucuuuugguugugaaaaguugaauuuuucuguugccuucguuuuc

SEQ ID NO: 86022 - RNA, 64 nt, Homo Sapiens
gcaacuccaagacacauaauugucagauucaccaaaguugaaaugaaggaaaaaauguuaaggg

SEQ ID NO: 86023 - RNA, 64 nt, Homo Sapiens
aacacguacacccucccaagacuaaaccaggaagaaguugaaucucugaauagaccaauaacag

SEQ ID NO: 86024 - RNA, 64 nt, Homo Sapiens
gcacuucgcaacugacuucuuguccugggguuaaaaguugaagauauuuucugaugauauuaaa

SEQ ID NO: 86025 - RNA, 64 nt, Homo Sapiens
guuaaaaguugaagauauuuucugaugauauuaaaaguugaagauauuucugcacuugggcccu

SEQ ID NO: 86026 - RNA, 64 nt, Homo Sapiens
aaucaauaaauaaacucaaccgaaauggguaugaaaguugaaauggguauguaaguugaaaacc

SEQ ID NO: 86027 - RNA, 64 nt, Homo Sapiens
accgaaauggguaugaaaguugaaauggguauguaaguugaaaaccagaaguuuugagaaacau

SEQ ID NO: 86028 - RNA, 64 nt, Homo Sapiens
cacagguaccccaaggaguagaugccaggguccuaaguugaaaaugaugucgauugggggcggg

SEQ ID NO: 86029 - RNA, 64 nt, Homo Sapiens
uguacagcacuuauagaaauaagcuguucuuuugaaguugaaauacccaguaaaauguugaaga

SEQ ID NO: 86030 - RNA, 64 nt, Homo Sapiens
cccuguuugauuucuucaugcuuuugcccuucucaaguugaaguugcauacauccaauaucgua

SEQ ID NO: 86031 - RNA, 64 nt, Homo Sapiens
uguguccugacucccuugaggcuuauaaugggccaaguugaagacuguugaugaucccuggugg

SEQ ID NO: 86032 - RNA, 64 nt, Homo Sapiens
uguauucagguacaaaucuuaucaggaaaaaaagaucaggaaguaaacaacgaaaugaaaaggu

SEQ ID NO: 86033 - RNA, 64 nt, Homo Sapiens
aaagaucaggaaguuguauucgaaaugaaaagguaucaggaaaauuuaaaugcuaaagaaacaa

SEQ ID NO: 86034 - RNA, 64 nt, Homo Sapiens
uguauaacacaucuuagagcuucacaucaguuugaucaggaaagguuaucugucauuuuuuuuu

SEQ ID NO: 86035 - RNA, 64 nt, Homo Sapiens
uuuaguuaucugucauuuuuuuuuuucauucauuaucaggaaguagaauuuauuaugucagaug

SEQ ID NO: 86036 - RNA, 64 nt, Homo Sapiens
auacauagugauucguauacuuuuaaugucaugaaucaggaaggcacuucuuuaagcuuuuuuu

SEQ ID NO: 86037 - RNA, 64 nt, Homo Sapiens
aaaucuaugcauauugagguuugaucuuuucuaaaucaggaaaauuuacuaagguuuagcaccu

SEQ ID NO: 86038 - RNA, 64 nt, Homo Sapiens
aauauccugccauaguaaaaucauuaaucaccuuaucaggaaggaaaagugagcaccaaaaacu

SEQ ID NO: 86039 - RNA, 64 nt, Homo Sapiens
acuucagcuacuugcauuuguuugccaucuguugaucaggaacucacugcaugugugaugguug

SEQ ID NO: 86040 - RNA, 64 nt, Homo Sapiens
ucccugagaaacgguuuuaaggauuaagaacuauaucaggaacaguuuuaaugauuucaccaug

SEQ ID NO: 86041 - RNA, 64 nt, Homo Sapiens
guccagacuuugaacuugccugccagccuucagcaucaggaaaggccaaguccugggugugagu

SEQ ID NO: 86042 - RNA, 64 nt, Homo Sapiens
guuacuggagaguucuugaagccagggauaccauaucaggaacuauucaggaucuaugauauuu

SEQ ID NO: 86043 - RNA, 64 nt, Homo Sapiens
gaaauguguauuuuggcuacacauccacaguagcaucaggaauaaaggcuuaaacuaaaccuug

SEQ ID NO: 86044 - RNA, 64 nt, Homo Sapiens
auauuucuuugaaagcugaauacuaacaaggaagaucaggaauaaacaaacuaaguuacuuuuu

SEQ ID NO: 86045 - RNA, 64 nt, Homo Sapiens
uucuuuagaaaugggugggagaaugaaaaugcaaaucaggaaaccacauuaaagucaaggaaau

SEQ ID NO: 86046 - RNA, 64 nt, Homo Sapiens
uagacaacuugcagauaauuucuuuauugaaacuaucaggaaguuuuacuaugaaauuuuacau

SEQ ID NO: 86047 - RNA, 64 nt, Homo Sapiens
agcuuauaugcaaacauaauaaauauuauuaaauaucaggaaagcuaacauuucauacaagaua

SEQ ID NO: 86048 - RNA, 64 nt, Homo Sapiens
ucucucagugugaacaugccuucugugggcggaaaucaggaagccaccagcuguuaauggagag

SEQ ID NO: 86049 - RNA, 64 nt, Homo Sapiens
acagaauaacucaguuuuuuguaauggauugacaaucaggaagaaaaggaauggauaaaguagu

SEQ ID NO: 86050 - RNA, 64 nt, Homo Sapiens
ccagugccagaggacagacaacccucagugucauaucaggaagcaauaaaaccagagggagagg

SEQ ID NO: 86051 - RNA, 64 nt, Homo Sapiens
aacacagaugcagaaauccucaaaauauuagcaaaucaggaaugcaaggcuuguucaacauuug

SEQ ID NO: 86052 - RNA, 64 nt, Homo Sapiens
cuugauguuuccaacuagacacuuuccuacuaagaucaggaacauggcaaggaacaccacacca

SEQ ID NO: 86053 - RNA, 64 nt, Homo Sapiens
uggcaaggaacaccacugcugcuuuccuacuaagaucaggaacacuugauguuuccaacuaaau

SEQ ID NO: 86054 - RNA, 64 nt, Homo Sapiens
caagccuuguucaacauuuguaaaauguuagcaaaucaggaaugaacacagaugcagaaauccu

SEQ ID NO: 86055 - RNA, 64 nt, Homo Sapiens
gaucguuugagccugggaggcagagguugcagugaucaggaauugugccacugcacuccaaccu

SEQ ID NO: 86056 - RNA, 64 nt, Homo Sapiens
gaaaaauuuagacggucuucauuuuaaaauuggcaucaggaaggauuaccaugaacuuauuuua

SEQ ID NO: 86057 - RNA, 64 nt, Homo Sapiens
cugccucaguuauugaacuuauuaaaauaaaauuaucaggaauauacauauauaaaauauauau

SEQ ID NO: 86058 - RNA, 64 nt, Homo Sapiens
uagcucugugauucaugagugcagacccagaauuaucaggaacaauuuacucccagauccucuu

SEQ ID NO: 86059 - RNA, 64 nt, Homo Sapiens
uucuuuccuuucucuucuuuuaucuccaagguuaaucaggaaaaauagcuuuugacaggggaaa

SEQ ID NO: 86060 - RNA, 64 nt, Homo Sapiens
aaaaacucaauaacuagcuauuuuugaccuccugaucaggaacuuuaguugaagcguaaaucua

SEQ ID NO: 86061 - RNA, 64 nt, Homo Sapiens
cguuguuuaccaaauuuucuuagauuuggucaucaucaggaagcauuuguaaaaauaaaaaucu

SEQ ID NO: 86062 - RNA, 64 nt, Homo Sapiens
aagcuguguuuacagggcauuccaagugauucuuaucaggaaaugugaaaaacacuccuguaca

SEQ ID NO: 86063 - RNA, 64 nt, Homo Sapiens
gcuuugggauggcaccuauacuggguuuucccauaucaggaagggugaauguggaaauggccac

SEQ ID NO: 86064 - RNA, 64 nt, Homo Sapiens
caauugugaauuccugcccagguaugaucaguggaucaggaaugcgcccagagugcucaaggcu

SEQ ID NO: 86065 - RNA, 64 nt, Homo Sapiens
cuuccuaaccguccugucuucucuuggcgcucuuuccuuccaccuuucccaagaguccugguug

SEQ ID NO: 86066 - RNA, 64 nt, Homo Sapiens
cauccuugcauucuuccuagaagaguuccucugcuccuuccauuccauuuuuguguuuguuuug

SEQ ID NO: 86067 - RNA, 64 nt, Homo Sapiens
cguuuggagagaaugacuagcauuuaucuucuuuuccuuccaugccaaagguuggagucugcug

SEQ ID NO: 86068 - RNA, 64 nt, Homo Sapiens
uggaucccacacuggcagagauggggccaccccuuccuuccaggcacaucucacauugccaugu

SEQ ID NO: 86069 - RNA, 64 nt, Homo Sapiens
cacuucagcugggucacauccaucccuccauucauccuuccauccaucuuuccauccauuaccu

SEQ ID NO: 86070 - RNA, 64 nt, Homo Sapiens
uuccauccaucuuuccauccauuaccuccauccauccuuccaacauauauuuauugaguaccua

SEQ ID NO: 86071 - RNA, 64 nt, Homo Sapiens
accaacugcauugguuuuccugcaugaauuccacuccuuccagaguauaagucugggcacugga

SEQ ID NO: 86072 - RNA, 64 nt, Homo Sapiens
gcucuuccagaugaggcccauuaaaacuuaacuauccuuccaggguaccucucauuugggcacc

SEQ ID NO: 86073 - RNA, 64 nt, Homo Sapiens
auugccacugagagaucugcugucagucugcuuauccuuccacgguaaguaaauuguguuuucu

SEQ ID NO: 86074 - RNA, 64 nt, Homo Sapiens
gacuuggggaaaaauggggaagaguugaaauacguccuuccacccaaaccuuuguuuaguaaua

SEQ ID NO: 86075 - RNA, 64 nt, Homo Sapiens
uacuuuuauuugcaacauuuacaguccuucaaaauccuuccaaagaauucuuauacacauuggg

SEQ ID NO: 86076 - RNA, 64 nt, Homo Sapiens
uuacuugagccuuuaauggacuuauuucuucaaauccuuccaaaaauuauuauaagcauugaaa

SEQ ID NO: 86077 - RNA, 64 nt, Homo Sapiens
ccuucccaccuuucccccacgagaacauucaguuuccuuccaacuugcaucucauccuggccug

SEQ ID NO: 86078 - RNA, 64 nt, Homo Sapiens
acucugaagagagagaccacccccuauucaggucuccuuccacacugcaccauagccugcggcu

SEQ ID NO: 86079 - RNA, 64 nt, Homo Sapiens
agacuucccuccuguucuccuuugcucgcauuaauccuuccaagcuugugcacacccuugugcc

SEQ ID NO: 86080 - RNA, 64 nt, Homo Sapiens
ucuucugcgguaauucaucauucccauuuuuuucuccuuccauccagaaguguuaacuauugua

SEQ ID NO: 86081 - RNA, 64 nt, Homo Sapiens
cuaaccuugagccacagugugcggggcucagggcuccuuccauuaggugagggggccgaccccu

SEQ ID NO: 86082 - RNA, 64 nt, Homo Sapiens
gcggauacucccuugaaauugccugacaguggguuccuuccaugaaaaugggugcccuggaggg

SEQ ID NO: 86083 - RNA, 64 nt, Homo Sapiens
gucuuuccucugugcuggccuaggacauuaggauuccuuccacggcuccggccgcuaggacccu

SEQ ID NO: 86084 - RNA, 64 nt, Homo Sapiens
ugagcuucuuccgugguuuccuuuuggaaacuccuccuuccaacaagcagugggaucccggggc

SEQ ID NO: 86085 - RNA, 64 nt, Homo Sapiens
gcugagggggucaguagguggacuguggugaaacuccuuccaagacgacugggauuucuucuga

SEQ ID NO: 86086 - RNA, 64 nt, Homo Sapiens
gacugaggucuccaagcuagaccucacuguuuccuccuuccaggugcuuugacugcgaaaggaa

SEQ ID NO: 86087 - RNA, 64 nt, Homo Sapiens
uccacauccccuaacaucuggaugucaccaauuuuccuuccaucuaaaguuguaaaaauauugu

SEQ ID NO: 86088 - RNA, 64 nt, Homo Sapiens
uccuaauuucuaaagcaaucaauucauguuaaaguccuuccagauauaaacaugcaaaaaaacu

SEQ ID NO: 86089 - RNA, 64 nt, Homo Sapiens
ccuuuccccgccccucaaaucguccuuuaagucuuccuuccaagugcuguggggcauaacgaug

SEQ ID NO: 86090 - RNA, 64 nt, Homo Sapiens
cgcacuccucuguagaugugugcccagugggaguuccuuccagccccaggaccacagcagcagc

SEQ ID NO: 86091 - RNA, 64 nt, Homo Sapiens
ugauaaaucauucuucuucaggagccuugggacuuccuuccauagucgcccaccucagcgccca

SEQ ID NO: 86092 - RNA, 64 nt, Homo Sapiens
caggaauagauuuuucuuaccucuaucguugauauccuuccauccuagacuagaaauccaucau

SEQ ID NO: 86093 - RNA, 64 nt, Homo Sapiens
uugaccccauggaggauugcccugaagaaauaaguccuuccacucaggauguggacuacugagc

SEQ ID NO: 86094 - RNA, 64 nt, Homo Sapiens
aaucgccucccgcagccccgcucccagaccucuguccuuccacccuguccacaucccucugccc

SEQ ID NO: 86095 - RNA, 64 nt, Homo Sapiens
gcagaguucccuauuccccucacagguguuugcuuccuuccagauucagacugaaaacauguuu

SEQ ID NO: 86096 - RNA, 64 nt, Homo Sapiens
guuguauauauaauauugcauaaaacaccacuccuccuuccaaagaguugacuaacucaaccug

SEQ ID NO: 86097 - RNA, 64 nt, Homo Sapiens
gucauucaggaaggacaaggcuuuacccagaauguccuuccagaauccuccgcaaaggaaagcu

SEQ ID NO: 86098 - RNA, 64 nt, Homo Sapiens
ucucccucccuuguccaucuuaaacucuuuuccuuccuuccauuuuuuaacaaaucuuaauuau

SEQ ID NO: 86099 - RNA, 64 nt, Homo Sapiens
uuccugcucuuucuccuuuuaccaagcagaucccuccuuccagcgggccucagccugggaaguc

SEQ ID NO: 86100 - RNA, 64 nt, Homo Sapiens
ucucucucucucuuuugguuccuccauuacuucuuccuuccaggcucguucccccugucucccu

SEQ ID NO: 86101 - RNA, 64 nt, Homo Sapiens
aaaguccaaguagagauuacacccagaacaccauuccuuccaggagcaguaggugggagguuug

SEQ ID NO: 86102 - RNA, 64 nt, Homo Sapiens
caaaaggacgacgguggccaacuaaagcaagucuuccuuccacccuguggccugcacuugagcc

SEQ ID NO: 86103 - RNA, 64 nt, Homo Sapiens
ucucuuugccaaguuguuuuccuuucagggccuguccuuccaguuuagaacaguaccaugaauc

SEQ ID NO: 86104 - RNA, 64 nt, Homo Sapiens
ucgauauguacauauuacucacguauaccccauuuccuuccagucagcccaacauuuuccacca

SEQ ID NO: 86105 - RNA, 64 nt, Homo Sapiens
ccccuauucugguaacuaccacuaccaggaggcuuccuuccagcuccagcccccuauucuggua

SEQ ID NO: 86106 - RNA, 64 nt, Homo Sapiens
ccccuauucugguaacuaccucucccaggaggcuuccuuccagcacugagguguucaaaucgaa

SEQ ID NO: 86107 - RNA, 64 nt, Homo Sapiens
aagugugaacuugugaauguaauugaucuuuccuuccuuccagagaaagauuuaagggacacug

SEQ ID NO: 86108 - RNA, 64 nt, Homo Sapiens
uagcccaccauaggcacagcacaucccaccacucuccuuccaguccugaccaggccccagccgg

SEQ ID NO: 86109 - RNA, 64 nt, Homo Sapiens
cagauguuaauggggacccuuuagggaaguugucuccuuccauuagaguugucuguccaggccc

SEQ ID NO: 86110 - RNA, 64 nt, Homo Sapiens
gucacucuuggucccuggaaccuuugcucugauuuccuuccaaggagaggggcgccuuuucagc

SEQ ID NO: 86111 - RNA, 64 nt, Homo Sapiens
uaaauggcauuuuauaauaucaaugauagaaaacuccuuccaauaaaguuauauuuaugacuug

SEQ ID NO: 86112 - RNA, 64 nt, Homo Sapiens
guccuggcugauugguguuccauuuuuggagcuuuccuuccagaaaugguguugaaggacuucu

SEQ ID NO: 86113 - RNA, 64 nt, Homo Sapiens
gcuggucuggccuggugacucucaggguaucuucuccuuccagcuacuuucgcucacugaucuc

SEQ ID NO: 86114 - RNA, 64 nt, Homo Sapiens
cauguaugggcucccaaggacccagcagccuggauccuuccagagcaucccuccuggaggccug

SEQ ID NO: 86115 - RNA, 64 nt, Homo Sapiens
uccuguggcuggucugggguggggucuguugugguccuuccacggugucaguggccugaagucc

SEQ ID NO: 86116 - RNA, 64 nt, Homo Sapiens
ggcuggguacucagcagccacucugagccggggcuccuuccaggagcugaaauccaccugucuc

SEQ ID NO: 86117 - RNA, 64 nt, Homo Sapiens
uauaucacaaauacccaagugcucaucaguuacuuccuuccauugagcauuagcaagugucacu

SEQ ID NO: 86118 - RNA, 64 nt, Homo Sapiens
cauuaaggaaacagauuuguacuguccucagauuuccuuccaccagcagacaagacuccuuaga

SEQ ID NO: 86119 - RNA, 64 nt, Homo Sapiens
aagaaaacugcugcuuucagcccugcuauaaaauuccuuccaugauuguuucuauauauuuugc

SEQ ID NO: 86120 - RNA, 64 nt, Homo Sapiens
uacguaucuuaaaggaugugugccaccuuaacaauccuuccagcuauuuaauucuccuuuacau

SEQ ID NO: 86121 - RNA, 64 nt, Homo Sapiens
ccagaguggcccaguagagcuggccgugcaggccuccuuccagcuaugaggucaccuacggcug

SEQ ID NO: 86122 - RNA, 64 nt, Homo Sapiens
cugcauccccuccccauccaccuaagccccuuccuccuuccauuucucagggcagcccuugacu

SEQ ID NO: 86123 - RNA, 64 nt, Homo Sapiens
ugccugaccccuucacuauggaaggguuuacugcuccuuccauccuccacccccauaagauugu

SEQ ID NO: 86124 - RNA, 64 nt, Homo Sapiens
auaacuaggcaaaaagaagucccagauuacuccuuccuuccaauaccuauuuucugcagcugcu

SEQ ID NO: 86125 - RNA, 64 nt, Homo Sapiens
cugggcccguggccugaacccuccugcacuccuccagcuggagucucaccgcggaucccaggaa

SEQ ID NO: 86126 - RNA, 64 nt, Homo Sapiens
ugggcacacggccccugccguggggcucacucugcagcuggagagacagcauaccugaaaccug

SEQ ID NO: 86127 - RNA, 64 nt, Homo Sapiens
ugugcugggggugguagaaaggaugcugcugaggcagcuggaggagugggaguagcucagaggg

SEQ ID NO: 86128 - RNA, 64 nt, Homo Sapiens
guggcuggcugaggugcaugggccccacacaggacagcuggagaaugggccguccacuuggccu

SEQ ID NO: 86129 - RNA, 58 nt, Homo Sapiens
gagaaaccaccagcaacuaagcugcauucagcuggaguuccucggaacgggaggacuc

SEQ ID NO: 86130 - RNA, 64 nt, Homo Sapiens
ggacaguggcugaggggcuuccuguugcagccuucagcuggacucaggguuggggucacuggag

SEQ ID NO: 86131 - RNA, 64 nt, Homo Sapiens
cccucaucagcuccccacaccagucaaggcuucucagcuggagaaccggggagcagcuggacac

SEQ ID NO: 86132 - RNA, 64 nt, Homo Sapiens
ccagucaaggcuucucagcuggagaaccggggagcagcuggacacccagccaaggcccugccaa

SEQ ID NO: 86133 - RNA, 64 nt, Homo Sapiens
gguggugagcacaucugggaggcuggucucccuccagcuggaauugcugcucucugagggagag

SEQ ID NO: 86134 - RNA, 64 nt, Homo Sapiens
gggugaugaugaccaagaauuacaaguagaauggcagcuggaauuuaaggagggacaagaauca

SEQ ID NO: 86135 - RNA, 64 nt, Homo Sapiens
uccaaguacauauggauuuuuaaacagggggcaacagcuggauccccgagguggucuuuuguuu

SEQ ID NO: 86136 - RNA, 64 nt, Homo Sapiens
auguugaugggguuuguuguaccaguggagauuucagcuggacuuuuaaucuacuucuuugacu

SEQ ID NO: 86137 - RNA, 64 nt, Homo Sapiens
agugcggaugcaagagcaccuggccaagcgagagcagcuggauuuuauggagagcaugcuaucc

SEQ ID NO: 86138 - RNA, 64 nt, Homo Sapiens
cugaggcuccgccccagcccucagccccaggccccagcuggagaaaaaacauugcccagggauu

SEQ ID NO: 86139 - RNA, 64 nt, Homo Sapiens
ucaccucuauugccuucuugcacugaggauuuuucagcuggauuucugcaauccaagcuacuca

SEQ ID NO: 86140 - RNA, 64 nt, Homo Sapiens
cucaugauuuuuccuuugugaaaucccugguuuucagcuggaagcgguggguaaaugaggucug

SEQ ID NO: 86141 - RNA, 64 nt, Homo Sapiens
aggccccaccuccuccuccauacguucagaggugcagcuggaggcugcuguggggaccacacug

SEQ ID NO: 86142 - RNA, 64 nt, Homo Sapiens
cccagaggacuuuauucggaccaagcagagcucacagcuggacagguguuguauauagagugga

SEQ ID NO: 86143 - RNA, 64 nt, Homo Sapiens
caugcaccuggccggccaccugccacugggcccacagcuggagcagcuggacagagguuucugg

SEQ ID NO: 86144 - RNA, 64 nt, Homo Sapiens
ggccggccaccugccacugggcccacagcuggagcagcuggacagagguuucugggagaccuac

SEQ ID NO: 86145 - RNA, 64 nt, Homo Sapiens
ggcgucuucugcggagaaaugugaagcaacagcccagcuggaagccccaggucccggaggggaa

SEQ ID NO: 86146 - RNA, 64 nt, Homo Sapiens
ucuccaggaaaccaggccaucucugagucccaggcagcuggacaccucccugucucuccgccag

SEQ ID NO: 86147 - RNA, 64 nt, Homo Sapiens
ggaagccuggggcacguccucgcacguggcagugcagcuggagagcugcggggcucuuguuggc

SEQ ID NO: 86148 - RNA, 64 nt, Homo Sapiens
gcuaucccccgccccucaagacuucuccuugaggcagcuggagaggaaaagauccaggcccucc

SEQ ID NO: 86149 - RNA, 64 nt, Homo Sapiens
uauuaagaucugguagagguaccagcuuccuuuccagcuggagaggccccaacacuggaugguu

SEQ ID NO: 86150 - RNA, 64 nt, Homo Sapiens
ccaggcccgggguuguuggggagagaggcagaggcagcuggagcgccguucucuccugcuggga

SEQ ID NO: 86151 - RNA, 64 nt, Homo Sapiens
gacagagccaaacuccgucaacgccacugcacuccagcuggaguacuuguagugagccaagauc

SEQ ID NO: 86152 - RNA, 64 nt, Homo Sapiens
gacagcccuggagccagguguauuauguaaaucccagcuggacacaggcuccccggggccuucc

SEQ ID NO: 86153 - RNA, 64 nt, Homo Sapiens
cugaccagcucccccucccucucgucucccccaacagcuggaccgucaagagugaauucccuca

SEQ ID NO: 86154 - RNA, 64 nt, Homo Sapiens
caggggcuuccuggugcugggucaucaucauggccagcuggaggccucucauuuagccuguccu

SEQ ID NO: 86155 - RNA, 64 nt, Homo Sapiens
gggccggcuggcgcggcuggagcuggagcgggcacagcuggagaugcagagccagcagcugcgc

SEQ ID NO: 86156 - RNA, 64 nt, Homo Sapiens
gaugcagagccagcagcugcgcgaguccaaccagcagcuggaccugagcgccugccggcugacc

SEQ ID NO: 86157 - RNA, 64 nt, Homo Sapiens
gggcuucugucccugucagccucugcagcacacgcagcuggagaagcuggaggcuacgcauggc

SEQ ID NO: 86158 - RNA, 64 nt, Homo Sapiens
cuacgcauggccucugcagcaguggaauagaaugcagcuggaggcuaacuggcccaggcacugg

SEQ ID NO: 86159 - RNA, 64 nt, Homo Sapiens
uccaaggccaaguccugcagcuaaaaagcagcagcagcuggaauugaagaccagcaggggcuuc

SEQ ID NO: 86160 - RNA, 64 nt, Homo Sapiens
gugaagguaauggcuccucugagaaccccaucuccagcuggaacacuguugcuaugacaacagg

SEQ ID NO: 86161 - RNA, 64 nt, Homo Sapiens
agguucaucccucaguuggggggaacguaggacccagcuggagccucuugagggagaugagagg

SEQ ID NO: 86162 - RNA, 64 nt, Homo Sapiens
ucuaggggcacauccagucuccaucgugcugcagcagcuggacugagggcagagccuguaggug

SEQ ID NO: 86163 - RNA, 64 nt, Homo Sapiens
ucaguucccuccugugucaaguagcuaacugcagcagcuggacugagggcagagucugugggug

SEQ ID NO: 86164 - RNA, 60 nt, Homo Sapiens
uugggguggggcuguccugaugcacgcagacagcuggaagggucuugguuuucugaaacu

SEQ ID NO: 86165 - RNA, 64 nt, Homo Sapiens
acugcagccuugacccccucccugaccuccccgccagcuggacuccagccauccuccugccuca

SEQ ID NO: 86166 - RNA, 64 nt, Homo Sapiens
gugaccccucgggacugccuggugcaggugguggcagcuggagggacccaugcagcacccaggu

SEQ ID NO: 86167 - RNA, 64 nt, Homo Sapiens
aggucagagcagacccuccccugccggccugcgccagcuggaccugauggcccccuguggcgcc

SEQ ID NO: 86168 - RNA, 64 nt, Homo Sapiens
cagaggaaaacgcuucuuucuccuccagcugaaucagcuggaucccaguguccuggcuguuugg

SEQ ID NO: 86169 - RNA, 64 nt, Homo Sapiens
aucgcucaaacaccuguuugcagaccccaugcaccagcuggaggggccguaacugcaggacugc

SEQ ID NO: 86170 - RNA, 64 nt, Homo Sapiens
uuaagagaaagucaccugccaaugcucaagcccccagcuggaagauagcaauuccccuacauca

SEQ ID NO: 86171 - RNA, 64 nt, Homo Sapiens
uuaagaaaaagucgcccgaagggccccucacccccagcuggaaacagaaggcacuaagcuuccu

SEQ ID NO: 86172 - RNA, 64 nt, Homo Sapiens
ccgcauuagcucuagcaaugagguucacuggauacagcuggauacuggggugagucucuugccu

SEQ ID NO: 86173 - RNA, 64 nt, Homo Sapiens
agcuuggggcuggaugaaggggucuccgccagcucagcuggagccggagccggggagacucuga

SEQ ID NO: 86174 - RNA, 64 nt, Homo Sapiens
cuuggcccggcagcaccacgcugacuauagcaaccagcuggacccggccucuggcacccgaaac

SEQ ID NO: 86175 - RNA, 64 nt, Homo Sapiens
ccgcucuggauaagacacccaaccccaacuccagcagcuggacucugggcccacaaggggaggg

SEQ ID NO: 86176 - RNA, 64 nt, Homo Sapiens
gcccagaauaaccgccacccuugccauccugcaacagcuggacucaaguuuccaggaaguggag

SEQ ID NO: 86177 - RNA, 64 nt, Homo Sapiens
agcagggaagggggacccaaggcaggagguacaccagcuggacaaauugcagggaggggaggga

SEQ ID NO: 86178 - RNA, 64 nt, Homo Sapiens
cugggguaggagggccugccugagucccagcucccagcuggagaauccaccagcacaagaagag

SEQ ID NO: 86179 - RNA, 64 nt, Homo Sapiens
caggugguggccuggccgguuggcgaucucccgacagcuggauccggcaaugugaagcuuuugu

SEQ ID NO: 86180 - RNA, 64 nt, Homo Sapiens
uuccauuguccuccccuggccaggccuccuggcucagcuggaagugcauggcuucuuucucccu

SEQ ID NO: 86181 - RNA, 64 nt, Homo Sapiens
cccuccccagacugccugcugucaaaccacggagcagcuggagccugcccuguccacggcccgu

SEQ ID NO: 86182 - RNA, 64 nt, Homo Sapiens
acuaugcaaagagaggagguugagaguguucuggcagcuggagcucuuuuccuuguccuuccug

SEQ ID NO: 86183 - RNA, 64 nt, Homo Sapiens
ccccacccucccaucgguccuacauggggcugugcagcuggagccaaaaaggcaagguagaaag

SEQ ID NO: 86184 - RNA, 64 nt, Homo Sapiens
ccaccgagaucucccucaggcuggccagguuuugcagcuggaauucuccucuuggucccagggc

SEQ ID NO: 86185 - RNA, 64 nt, Homo Sapiens
cucacccucucuggaccucaucuguaagaggagccagcuggauaagaugauuucugaagacgcu

SEQ ID NO: 86186 - RNA, 64 nt, Homo Sapiens
ucaguuuaucuuuccaggauauaugaaaagggaccagcuggaagacuagccucacucuguccuc

SEQ ID NO: 86187 - RNA, 64 nt, Homo Sapiens
accuugccacccauucuucccguucuuaacuuugaaccauaaagggugccaggucugggugaaa

SEQ ID NO: 86188 - RNA, 64 nt, Homo Sapiens
gugccaggucugggugaaagggauacuuuuaugcaaccauaagacaaacuccugaaaugccaag

SEQ ID NO: 86189 - RNA, 64 nt, Homo Sapiens
auucccccugcccuagcucuucucuaacuugguuaaccauaaccauaaccagauucccuugcaa

SEQ ID NO: 86190 - RNA, 64 nt, Homo Sapiens
ccugcccuagcucuucucuaacuugguuaaccauaaccauaaccagauucccuugcaaucgauu

SEQ ID NO: 86191 - RNA, 64 nt, Homo Sapiens
cucaaaaaugcugugacagcuuuuuggcugcuuuaaccauaagaaaaaugauugguggaugauu

SEQ ID NO: 86192 - RNA, 64 nt, Homo Sapiens
uuacuguuucuagucaaaaaugagacuucgaucaaaccauaagauuuuauacugcagauaguca

SEQ ID NO: 86193 - RNA, 64 nt, Homo Sapiens
gggaccccucccccauuauuugggguagggggcaccccuacagugugcagcgcccguggugauc

SEQ ID NO: 86194 - RNA, 64 nt, Homo Sapiens
uacccauggguggaagcuaaggaaaccaggacguccccuacaccugaaagggaccgugaguagu

SEQ ID NO: 86195 - RNA, 64 nt, Homo Sapiens
aaaugcucaagcccugaguuaggccauagcaacuccccuacaucugcccaagaaacaccgagug

SEQ ID NO: 86196 - RNA, 64 nt, Homo Sapiens
aaaugcucaagcccccagcuaggccauagcaauuccccuacaucgucgcccgaaacaccaagug

SEQ ID NO: 86197 - RNA, 64 nt, Homo Sapiens
cgcauggauucugggucuccaguacauagugggcccccuacauagugugucauacacagggccu

SEQ ID NO: 86198 - RNA, 64 nt, Homo Sapiens
agagauuccuccccugcuaagacccccugccaugccccuacaguuauuaaaaccagggauccgu

SEQ ID NO: 86199 - RNA, 64 nt, Homo Sapiens
ugugguauugaggccccuaaaucaauuauucaggccccuacaguuuuuccauuaauuucucaac

SEQ ID NO: 86200 - RNA, 64 nt, Homo Sapiens
ccgggcgcaguggcucacgcucaucaagaaugugccccuacaggaaaaagugauuuaacuuacc

SEQ ID NO: 86201 - RNA, 64 nt, Homo Sapiens
cccuucagaaauuugugcugauuuggucccugugccagggcacagggggucaggcacuguggaa

SEQ ID NO: 86202 - RNA, 64 nt, Homo Sapiens
ggggcagcagcuggacagccauuagaccucagugccagggcacucuuccuccagcugggaucuc

SEQ ID NO: 86203 - RNA, 64 nt, Homo Sapiens
augaauaugaagaaaaauacacagccaccucuguccagggcaguaagaagggcugcaaggaagg

SEQ ID NO: 86204 - RNA, 64 nt, Homo Sapiens
ucaccugagggcuggcaggaaggggcgagaaaucccagggcauuguaccaaggaccuaguuccu

SEQ ID NO: 86205 - RNA, 64 nt, Homo Sapiens
accagcucuuacgccucagccagcaccacugccaccagggcaacugcagcagcaucucaugcau

SEQ ID NO: 86206 - RNA, 64 nt, Homo Sapiens
agcaucucaugcauaacccuguggcuugcuucccccagggcagcacaggcuaagucaggaacau

SEQ ID NO: 86207 - RNA, 64 nt, Homo Sapiens
uuccaacacugcucuucugcaccaugagaccaacccagggcaagaucccaucccaucacaucag

SEQ ID NO: 86208 - RNA, 64 nt, Homo Sapiens
uagccaacaggagaggaggccuccugggguuuccccagggcaguaggucaaacgaccucaucac

SEQ ID NO: 86209 - RNA, 64 nt, Homo Sapiens
ucagccuccucccuccaugcguuagcagggguccccagggcaaggaggggaagggugggucuca

SEQ ID NO: 86210 - RNA, 64 nt, Homo Sapiens
gauggggcuuuggguccucgaacagagauggaagccagggcaugccaugcagacaggaucaccu

SEQ ID NO: 86211 - RNA, 64 nt, Homo Sapiens
gccaugccacaucuguauaugccagcuggcugugccagggcagacugcccaccccgugccccca

SEQ ID NO: 86212 - RNA, 64 nt, Homo Sapiens
ccagggacucccuggccugagcccuccacucuauccagggcagggaccauccucccaaacuagg

SEQ ID NO: 86213 - RNA, 64 nt, Homo Sapiens
augccaccugcuacacucuucuugguaggaaugaccagggcagggggccuggugcuccucucug

SEQ ID NO: 86214 - RNA, 64 nt, Homo Sapiens
gucuggcucucugggcugcugugccagcugcuccccagggcaugagaaauugguacaaagugca

SEQ ID NO: 86215 - RNA, 64 nt, Homo Sapiens
gaaccuggguggggagggcgaagggggugcacaaccagggcaaggcuccccacuuccuuagucc

SEQ ID NO: 86216 - RNA, 64 nt, Homo Sapiens
uccucacuauggccccagugccuugaggcccaggccagggcagccaguggcucuagcucaggga

SEQ ID NO: 86217 - RNA, 64 nt, Homo Sapiens
gcguagggagaggguggauuuguucugaaaguguccagggcaaaugaugacaggcagugugaug

SEQ ID NO: 86218 - RNA, 64 nt, Homo Sapiens
gccaacuugagccucuuuccgacagcuucuacagccagggcauuugcugcuucaugagcgggag

SEQ ID NO: 86219 - RNA, 64 nt, Homo Sapiens
acucaccccuaagugggcugggagccaggcagggccagggcagcugggugggggccggggcugg

SEQ ID NO: 86220 - RNA, 64 nt, Homo Sapiens
accccacucaccaguucugcugccucaggucaggccagggcagugcugcugcagagcuagaagg

SEQ ID NO: 86221 - RNA, 64 nt, Homo Sapiens
gacagcuggguaugaggugcuuacggcacaguguccagggcagcugggugugcagggacugggg

SEQ ID NO: 86222 - RNA, 64 nt, Homo Sapiens
gugauucugccuccauccugguuuccccaaagccccagggcaccauccuuaggggagaaggucu

SEQ ID NO: 86223 - RNA, 64 nt, Homo Sapiens
cacauauugggcuuacccagaguggagcacaccuccagggcauguggcugacacugggucaaug

SEQ ID NO: 86224 - RNA, 64 nt, Homo Sapiens
aaccugggcccaggaguugcuccaggaacaggcuccagggcagggcagggcucagcccagggca

SEQ ID NO: 86225 - RNA, 64 nt, Homo Sapiens
caggaacaggcuccagggcagugcagggcucagcccagggcaucgggugaugggcucugcugac

SEQ ID NO: 86226 - RNA, 64 nt, Homo Sapiens
auuauaaucaaaauuaguuugucaucaaagaucaccagggcauagaugcucaucauuuguugau

SEQ ID NO: 86227 - RNA, 64 nt, Homo Sapiens
gacagacuaaaagagcauaucucagaucucccauccagggcaaggauaauuccacacuuacauc

SEQ ID NO: 86228 - RNA, 64 nt, Homo Sapiens
ucccagcagaggcuucaggugcuuuguguagaguccagggcagcuggagcuuuguuggggagac

SEQ ID NO: 86229 - RNA, 64 nt, Homo Sapiens
aagccaguaggcaacacagccagcacggugcucuccagggcagccccucucagacgaggaggca

SEQ ID NO: 86230 - RNA, 64 nt, Homo Sapiens
acccuccuuauuucuguuacuacuugucuguggcccagggcaguggcuuuccugaggcagcagc

SEQ ID NO: 86231 - RNA, 64 nt, Homo Sapiens
ggcccccacuucccaguggcugcuuccuggggacccagggcaccccggcaccuucaggcacgcu

SEQ ID NO: 86232 - RNA, 64 nt, Homo Sapiens
caggugccagccuccacuggcaucagugacaagcccagggcacagcccacccggggguccucgc

SEQ ID NO: 86233 - RNA, 64 nt, Homo Sapiens
ccccucaccuugucccuccucagccagcagaggcccagggcaagggacaggaggacagggguuc

SEQ ID NO: 86234 - RNA, 64 nt, Homo Sapiens
guuaggccuggauguuugccggcccaaggcacagccagggcacaugcucucaugggcucaccug

SEQ ID NO: 86235 - RNA, 64 nt, Homo Sapiens
ucuagcaucagagcaaaagcuauguguguggauuccagggcaacgagcccuggaccuuuugucc

SEQ ID NO: 86236 - RNA, 64 nt, Homo Sapiens
gcgcucgaggugugcuguuagccacgucagcagcccagggcacaacugcugcuagcggccugcc

SEQ ID NO: 86237 - RNA, 64 nt, Homo Sapiens
augcaagcggaugucggcaccagaggcaagguuaccagggcaccgugagguggccuggggaggg

SEQ ID NO: 86238 - RNA, 64 nt, Homo Sapiens
ugcagaagcugggaaggaccauuggagggcagugccagggcauuuugauguuuauacccucuga

SEQ ID NO: 86239 - RNA, 64 nt, Homo Sapiens
ggaccuggcguggccacuucaaaaaaaaaaaaagccagggcaaauccccacccccugccaaaaa

SEQ ID NO: 86240 - RNA, 64 nt, Homo Sapiens
ccgggcacaguggcucacgccuggacuuaaaaagccagggcaggugggcaccacagggaacauc

SEQ ID NO: 86241 - RNA, 64 nt, Homo Sapiens
gugagacccagcccucauccgcagcagugugaggccagggcagacagggcuacccugagcugag

SEQ ID NO: 86242 - RNA, 64 nt, Homo Sapiens
gccccaggcauugccaagggcacagccuccccugccagggcaggaguguuagggaagggccugc

SEQ ID NO: 86243 - RNA, 64 nt, Homo Sapiens
uguugggugaauguggagagaaauguggaggcggccagggcaguagaccaugucuucuuagagc

SEQ ID NO: 86244 - RNA, 64 nt, Homo Sapiens
ucacccaccucaagacaagcacugcuggcuguaaccagggcacaccucccguuuguccuugagg

SEQ ID NO: 86245 - RNA, 64 nt, Homo Sapiens
cucuugaaaacggccucggggggauggcacgauaccagggcagcgguugguuccggugagugua

SEQ ID NO: 86246 - RNA, 64 nt, Homo Sapiens
acaggggaggguguucaaggguacagggauugcaccagggcagagcuucacagggcugcaaagg

SEQ ID NO: 86247 - RNA, 64 nt, Homo Sapiens
guggcaggaacaacuauccuuuugccuauguccuccagggcacgccacacugugucgucguuug

SEQ ID NO: 86248 - RNA, 64 nt, Homo Sapiens
gaggggcgaagccagugcuugcccugaacaugccccagggcacuagggcgucccccucaacccu

SEQ ID NO: 86249 - RNA, 64 nt, Homo Sapiens
aagccacaggaggcagcgccacugcucucuagcuccagggcacuuuggcaggacucaaccaagc

SEQ ID NO: 86250 - RNA, 64 nt, Homo Sapiens
ucacugcgcugggaggugggaguggugccaguugccagggcaaggcagcguugagaagggggug

SEQ ID NO: 86251 - RNA, 64 nt, Homo Sapiens
gcgugggagggguagucgaaggagggaccucacuccagggcacggggggcugggccuugcaggu

SEQ ID NO: 86252 - RNA, 64 nt, Homo Sapiens
cuccuggccagcuuccagcccagaguccucaaguccagggcaccuugggcccagcgcaggcaga

SEQ ID NO: 86253 - RNA, 64 nt, Homo Sapiens
cccagaagcccccagggugggauuucucaggcugccagggcaggcccaggccucaggaagaagg

SEQ ID NO: 86254 - RNA, 64 nt, Homo Sapiens
ggucuggggcagcagagccaucgcaucauguuucccagggcaacuugaggucugacuuuuggcu

SEQ ID NO: 86255 - RNA, 64 nt, Homo Sapiens
ucaguaugguucucggaguccaaaggguuuuaagccagggcacaaccagaaaaguggcucucuu

SEQ ID NO: 86256 - RNA, 64 nt, Homo Sapiens
aaaaacauggggagcccggaggacaggcugcuguccagggcagaggccaugaagaagugcuucc

SEQ ID NO: 86257 - RNA, 55 nt, Homo Sapiens
gugacuuacaugggaagugaugccaccagggcagccucaccuccuccccaucauc

SEQ ID NO: 86258 - RNA, 64 nt, Homo Sapiens
uccucccugcagaagccauuagcagaccuuugggccagggcagccucccuauaauuuucuucau

SEQ ID NO: 86259 - RNA, 64 nt, Homo Sapiens
uggugggagacaucaguagugucaccuucuaccaccagggcaaggagcuggacugcaggugcug

SEQ ID NO: 86260 - RNA, 64 nt, Homo Sapiens
uuaaucgaugaauguaaacucgggggugcuggggccagggcagauguggggauguuuugacauu

SEQ ID NO: 86261 - RNA, 64 nt, Homo Sapiens
caggggccacacuaugccugguuccaggguggccccagggcaggccuucccagagggucuuacu

SEQ ID NO: 86262 - RNA, 64 nt, Homo Sapiens
gauccugugcugcugucugggggcuccagcaagcccagggcaagcauacucccuuucagggcca

SEQ ID NO: 86263 - RNA, 64 nt, Homo Sapiens
gcaccacaagaaagggaggguacgccaggcgagcccagggcacagaugcugagacagccucucc

SEQ ID NO: 86264 - RNA, 64 nt, Homo Sapiens
cucagugcagggacgucaccccugccaggcaagcccagggcacagaugccaggauggcuucucc

SEQ ID NO: 86265 - RNA, 64 nt, Homo Sapiens
ucucagugcgaggcuucaccccugccaggcaagcccagggcauagaugcugagacagccucucc

SEQ ID NO: 86266 - RNA, 64 nt, Homo Sapiens
cucagugcagggacgucaccccugccaggcaagcccagggcacagaggccgggacggccucucc

SEQ ID NO: 86267 - RNA, 64 nt, Homo Sapiens
ucucagugugaggcuucacccaugcuaggcaagcccagggcacagaugccgggauggccccucc

SEQ ID NO: 86268 - RNA, 64 nt, Homo Sapiens
cucagugcgggaacgucaccccugccaggcaagcccagggcacagaugcugcgauggccucuuc

SEQ ID NO: 86269 - RNA, 64 nt, Homo Sapiens
cugaaauguacgccugaauugcuuugggcacgguccagggcaaaggcgcagagaugagcacaca

SEQ ID NO: 86270 - RNA, 64 nt, Homo Sapiens
gggccucaccgccucccgggccuucuccucaaggccagggcagaccccgccucacacacgcacu

SEQ ID NO: 86271 - RNA, 64 nt, Homo Sapiens
acaguuaucgacaaugcauuggaaugcagaaaaaccagggcaggaauucccacagauaaucuga

SEQ ID NO: 86272 - RNA, 64 nt, Homo Sapiens
ccucagacacccugccugugaaccugucuuugagccagggcaggaaggaaacaaauucaaggac

SEQ ID NO: 86273 - RNA, 64 nt, Homo Sapiens
cccuauaccuccuuaucugccccugcugccuugcccagggcacagucacugagagcuucguuac

SEQ ID NO: 86274 - RNA, 64 nt, Homo Sapiens
ccuacggcugccgccagucuagcccggcauauacccagggcaccggcagguauggcacccuggg

SEQ ID NO: 86275 - RNA, 64 nt, Homo Sapiens
ggaacagcagaacuuagggugccgucucugguccccagggcaagguacuugagggggacuggag

SEQ ID NO: 86276 - RNA, 64 nt, Homo Sapiens
gcuaaacccaaaugggggcuaggguggcuggggcccagggcauccagaugugggggccugucca

SEQ ID NO: 86277 - RNA, 64 nt, Homo Sapiens
uggaaaacaggagauccuaaccaaagauugcaacccagggcaaaagagcaguuggaggaagcau

SEQ ID NO: 86278 - RNA, 64 nt, Homo Sapiens
gucccucccuggcuugccuucucccuccucagcuccagggcaguaccugccacugccgucaccu

SEQ ID NO: 86279 - RNA, 56 nt, Homo Sapiens
gcuucaaacagcgcagauaaaugcaggcaagaaaagaugccgccguugcugccguc

SEQ ID NO: 86280 - RNA, 64 nt, Homo Sapiens
ccuauuuuuguuuguuuauacaaauaucugauuugcaagaaaaagugcaugggagggguuuuag

SEQ ID NO: 86281 - RNA, 64 nt, Homo Sapiens
gagcagucugccugugagugauggcaagaaaggugcaagaaaguauguggguguggccgaggug

SEQ ID NO: 86282 - RNA, 64 nt, Homo Sapiens
ugcaagaaagugagcagucuuggccgaggugauggcaagaaaggcuauuggaggaaugugggug

SEQ ID NO: 86283 - RNA, 64 nt, Homo Sapiens
aaguccuguguuguauuugugcuuugugacuaaugcaagaaagcaguuuucuagauugucacau

SEQ ID NO: 86284 - RNA, 64 nt, Homo Sapiens
uuucuucucuccccuccuucuuuugcuuccagaagcaagaaaaguucucuaauuccaauauguc

SEQ ID NO: 86285 - RNA, 64 nt, Homo Sapiens
agagugacuugauuugcuuuaaaaguauaaauuagcaagaaaggaaaaaaucauugccauaaga

SEQ ID NO: 86286 - RNA, 64 nt, Homo Sapiens
ccgaugaaguaaacgccuuagugcuucagacccagcaagaaauuauugguaauauuuaugucua

SEQ ID NO: 86287 - RNA, 64 nt, Homo Sapiens
gguauacaggauaaacuacauacacugaucccuugcaagaaauuugaucucaguuauaaucuaa

SEQ ID NO: 86288 - RNA, 64 nt, Homo Sapiens
uccuaaaauucuagccauuugucacacaaccacagcaagaaacguguucuauaucuagagugug

SEQ ID NO: 86289 - RNA, 64 nt, Homo Sapiens
auuacuucacuauaauuacaaggacaaauuauuagcaagaaauaagaauaguauuagaagaauu

SEQ ID NO: 86290 - RNA, 64 nt, Homo Sapiens
uaucugucccuguggucugagcaagaacugcucugcaagaaaaaaguacugcauugcaccauga

SEQ ID NO: 86291 - RNA, 64 nt, Homo Sapiens
aaaauuuaagaauuaaauugcccuaaaugucauugcaagaaauaaaaucucaaaucacacugaa

SEQ ID NO: 86292 - RNA, 64 nt, Homo Sapiens
uacuuuuauuauauuguuuacaaauauauuucaugcaagaaacagaaaaaaaaaaaaacccuuu

SEQ ID NO: 86293 - RNA, 64 nt, Homo Sapiens
auaaacuauaggauagauagaaugguuauuuuaugcaagaaauauuguaccgcaagggugguuu

SEQ ID NO: 86294 - RNA, 64 nt, Homo Sapiens
guagagaggaaccagauuggguggggggaaagcagcaagaaaaggaagcaugaagauuccuggg

SEQ ID NO: 86295 - RNA, 64 nt, Homo Sapiens
gcaaaacaaauacugaagcaaugaagacaugaaggcaagaaacaagauauuggaaacaguaugc

SEQ ID NO: 86296 - RNA, 63 nt, Homo Sapiens
cacauaccuucauguggcucauuuccacugaacaaaaccuacgcuuccucucucuaccagucu

SEQ ID NO: 86297 - RNA, 63 nt, Homo Sapiens
cacauaccuucaugugguucauuuccacugaacaaaaccuacacuuccucucucuaccagucu

SEQ ID NO: 86298 - RNA, 63 nt, Homo Sapiens
cacguaccuucaugugauucgaagucacugaacaaaaccuacacagcuggcugagacacugaa

SEQ ID NO: 86299 - RNA, 63 nt, Homo Sapiens
uucauaugauauacauguuauuauuucuucacuaaaaccuauuuuuaaaaucaaacucaguuu

SEQ ID NO: 86300 - RNA, 63 nt, Homo Sapiens
uaaauaugcuuuagaauuuucucccuuacuguuaaaaccuaaugggcuguguuauauuaaguu

SEQ ID NO: 86301 - RNA, 63 nt, Homo Sapiens
uacauuuggauaaacaacauugagauuaugaugaaaaccuacauauuccauguuuggaagacc

SEQ ID NO: 86302 - RNA, 63 nt, Homo Sapiens
ccagcguacuauaaugaaaacauccuuguuuugaaaaccuaaaagacaggcucuguauauaua

SEQ ID NO: 86303 - RNA, 63 nt, Homo Sapiens
cacuauagaagggaauaguacaaauuguguaaaaaaaccuaugucucugaaauggguaaagga

SEQ ID NO: 86304 - RNA, 63 nt, Homo Sapiens
uaccugauuauugcacauuaauuuuuuaacugaaaaaccuaguagcuuauauaaggucauuac

SEQ ID NO: 86305 - RNA, 63 nt, Homo Sapiens
auuguauauaguaagaaaagaucaaaagacuuuaaaaccuaaaugacuuuugacauacaaacu

SEQ ID NO: 86306 - RNA, 63 nt, Homo Sapiens
aguaauuaugaauuuaagaccauauuauuaucaaaaaccuagagaccaaucauauaucugaaa

SEQ ID NO: 86307 - RNA, 63 nt, Homo Sapiens
aucucaagucuagugaagacagccaacagaaacaaaaccuagcauagggauagaaaauaccau

SEQ ID NO: 86308 - RNA, 63 nt, Homo Sapiens
aaauaaaaaugcaugauuaaaaacuaagaauaaaaaaccuauuuuuauguuuccuaaaggaaa

SEQ ID NO: 86309 - RNA, 63 nt, Homo Sapiens
ucuccagaacaugagaugagagcuuacaguuugaaaaccuagccagagcaucuugaccuaauc

SEQ ID NO: 86310 - RNA, 63 nt, Homo Sapiens
gagcuaaaggcuuugucugccccucuccagcauaaaaccuagugguuuuuaccccacccucaa

SEQ ID NO: 86311 - RNA, 63 nt, Homo Sapiens
cauguuaaaaaaaaaaauguauuucauaucuauaaaaccuauauagccauuuagcugaagccc

SEQ ID NO: 86312 - RNA, 63 nt, Homo Sapiens
gcacaugccuguauuacugaaagcuaaauccucaaaaccuaguaaggggacuaaugauucauu

SEQ ID NO: 86313 - RNA, 63 nt, Homo Sapiens
auuacuauaaacaccuguaugcacacaaacuagaaaaccuagaaaaaauuaauaaauuccuug

SEQ ID NO: 86314 - RNA, 63 nt, Homo Sapiens
aaucaacucaagauggauuaaagacuuaaauauaaaaccuaaaaguauuaaauuccuagaaga

SEQ ID NO: 86315 - RNA, 63 nt, Homo Sapiens
ugaaaaccaaaauuauaggauucuuuuuuaguaaaaaccuauaaaccaaaauuauaggauuuu

SEQ ID NO: 86316 - RNA, 63 nt, Homo Sapiens
uaaaaaccaaaauuauaggauucuuuuuuaguaaaaaccuauaaccaaaauuauaggauuuuu

SEQ ID NO: 86317 - RNA, 63 nt, Homo Sapiens
uaaaaaccaaaauuauaggaccacuggugaguaaaaaccuauaauauuucggggguaauagag

SEQ ID NO: 86318 - RNA, 64 nt, Homo Sapiens
uagcuggggcucuuccauuuagagauaaaacauuuuuucccaagucaauccacuuuugggguuc

SEQ ID NO: 86319 - RNA, 64 nt, Homo Sapiens
uugccuggcccugcuucugucaaauucccgaaaguuuucccacucaaggcucaggcuguauugg

SEQ ID NO: 86320 - RNA, 64 nt, Homo Sapiens
ugaagucuuguauauucugucauggagucauaaauuuucccaacggucaucuuuuuugcccuuu

SEQ ID NO: 86321 - RNA, 64 nt, Homo Sapiens
cauaaacaugccacauccauacguucuugugauguuuucccauguuguaaauaggagagaacug

SEQ ID NO: 86322 - RNA, 64 nt, Homo Sapiens
cucuuggcguucaggaaacacagauucuuuguccuuuucccaacagcccaggcuguugauaccu

SEQ ID NO: 86323 - RNA, 64 nt, Homo Sapiens
uugaagggcagucuucucuggcuuguuuuuuuguuuuucccagaaaaucaguauuauuuuuuaa

SEQ ID NO: 86324 - RNA, 64 nt, Homo Sapiens
uguaguuaagaaacuggaaaaugguuucuucauguuuucccaacucuuucauccaguguccaaa

SEQ ID NO: 86325 - RNA, 64 nt, Homo Sapiens
gaacccugcccucuccccuccugcugcuguagaguuuucccaaagcaguguccaggagagaauu

SEQ ID NO: 86326 - RNA, 64 nt, Homo Sapiens
aaauuauuuauucuauuuuaagccuucuaucauauuuucccauccaauuguuugguuucagugg

SEQ ID NO: 86327 - RNA, 64 nt, Homo Sapiens
uccacucccauggcuuaauugccuaucagacgcauuuucccagacgaaagcaauguuggguugg

SEQ ID NO: 86328 - RNA, 64 nt, Homo Sapiens
gauuauugauuggauugacuuuuuugcauuaaauuuuucccagcaaaauaaaucauauggcgag

SEQ ID NO: 86329 - RNA, 64 nt, Homo Sapiens
cauugaugagaauuuauuggcaguucagauuguguuuucccaacuuaggcucuuuauuaauugg

SEQ ID NO: 86330 - RNA, 64 nt, Homo Sapiens
aaaaguaauaaacuuacucuaaacuaguugcgguuuuucccauuauuuauauuagguuggugca

SEQ ID NO: 86331 - RNA, 64 nt, Homo Sapiens
auaauaacuaacauuuauaugacauggagaaagauuuucccauaagaugcuuccccuuggcuau

SEQ ID NO: 86332 - RNA, 64 nt, Homo Sapiens
auacacacauccauccuaaacuauacuaaagcccuuuucccaugcauggauggaaauggaagau

SEQ ID NO: 86333 - RNA, 64 nt, Homo Sapiens
ucuguaacucccuagagccacagguucucauuccuuuucccauuauacuucucacaauucaguu

SEQ ID NO: 86334 - RNA, 64 nt, Homo Sapiens
caauccagccauaaaaauuaacuugugauuuuuuuuuucccaaagucaugcuuuuccuuaauua

SEQ ID NO: 86335 - RNA, 64 nt, Homo Sapiens
gaaaguuucuauuugguugauaaaaggaacaauuuuuucccacuuuugaugccugugaugcaau

SEQ ID NO: 86336 - RNA, 64 nt, Homo Sapiens
caccacuugacggcuacaagugccgacuccugaauuuucccaugguguucugacuucaagggcu

SEQ ID NO: 86337 - RNA, 64 nt, Homo Sapiens
ccuaaauuaaugaaccauauuuuuaaaauccuauuuuucccaaacagggcccucugcagcccau

SEQ ID NO: 86338 - RNA, 64 nt, Homo Sapiens
cuguucuuuaugcauugucucaacacuuucccuuuuuucccaaaaugaguagagaauuaaagcc

SEQ ID NO: 86339 - RNA, 64 nt, Homo Sapiens
ccccauuuuuucuuuucaccacccuguugagcaauuuucccaaaaaaagggcagcaauuauuaa

SEQ ID NO: 86340 - RNA, 64 nt, Homo Sapiens
uugauacauacccugauuugugucugcuacuuuauuuucccaauuaccuacuugaaacaguguc

SEQ ID NO: 86341 - RNA, 64 nt, Homo Sapiens
ucugacuucguggugugagcaggagcacacuccauuuucccauguguuuucuacacccagcuag

SEQ ID NO: 86342 - RNA, 64 nt, Homo Sapiens
guaaucaugaaagaaggcucugaagaaaccccauuuuucccaggaaaaagauuggcacaaagca

SEQ ID NO: 86343 - RNA, 64 nt, Homo Sapiens
uggaaacauauacuguaugccaaauaucccugccuuuucccaccccucuagaaccugccuuuuu

SEQ ID NO: 86344 - RNA, 64 nt, Homo Sapiens
aaacauggcuuaucaauuuuuucaaagaauucuuuuuucccaaaaagaggaguaacaaaauguc

SEQ ID NO: 86345 - RNA, 64 nt, Homo Sapiens
uuguuugaaauaccauuuuuuucuccuuuuguguuuuucccacuuuccaauguacucaagaaaa

SEQ ID NO: 86346 - RNA, 64 nt, Homo Sapiens
caugacuuucuggaagccucccaacuauucuugcuuuucccagacagcucccacucccaugucu

SEQ ID NO: 86347 - RNA, 64 nt, Homo Sapiens
aacaagguaggcuucaaagagccuauauuccucuuuuucccacaccgaucaagucaacucagua

SEQ ID NO: 86348 - RNA, 64 nt, Homo Sapiens
gaaugcagcaguaaauccaaccaccugugcaauauuuucccaugugucagaaucaaggcuucgg

SEQ ID NO: 86349 - RNA, 64 nt, Homo Sapiens
ggacaugaguaaagcaguguaaauguggaugcucuuuucccaggccuuuucucccaagaugcag

SEQ ID NO: 86350 - RNA, 64 nt, Homo Sapiens
acaggaaauaugucccccccacuuuggucuccauuuuucccaggcaaacuacuuucuuaauauc

SEQ ID NO: 86351 - RNA, 64 nt, Homo Sapiens
ccuuuccagggcauaaaacugggaaaaacuggcuuuuucccagcuuauaauuucuacccauguu

SEQ ID NO: 86352 - RNA, 64 nt, Homo Sapiens
guuuaaaaccaucacuuuuuguuuucauucccauuuuucccauuuucaguuuccccaaguaccu

SEQ ID NO: 86353 - RNA, 64 nt, Homo Sapiens
ucccaccccccaguuuucagucucgcugucuuucuuuucccaccuguucagucccuucccugcu

SEQ ID NO: 86354 - RNA, 64 nt, Homo Sapiens
uauuuaauauagcucucuuagguguuuccauauuuuuucccaagucaauuuaaucaucaccacc

SEQ ID NO: 86355 - RNA, 64 nt, Homo Sapiens
gacgucuagggggacucugggcauggcucaggccuuuucccaucuaguguacugagccugcggu

SEQ ID NO: 86356 - RNA, 64 nt, Homo Sapiens
uuuauauagaggaaacacuacuuaauucuuguuuuuuucccaguugcuauauucaccaaaagga

SEQ ID NO: 86357 - RNA, 64 nt, Homo Sapiens
uuuauauagaggaaacacugacuuacuucuuguuuuuucccaguuugcuauauucaccaaaagg

SEQ ID NO: 86358 - RNA, 64 nt, Homo Sapiens
uccccaugauucucuacaaagcucuugcacacccuuuucccauucaauuugugagccaggcagg

SEQ ID NO: 86359 - RNA, 64 nt, Homo Sapiens
aggaucuacuagaugcauuauacuccauaccugcuuuucccauggccgcccuacggaaaauccc

SEQ ID NO: 86360 - RNA, 64 nt, Homo Sapiens
ugaaagggaaaaaccauauugccuuguguguugcuuuucccagucaaaagggucugaccuuaga

SEQ ID NO: 86361 - RNA, 64 nt, Homo Sapiens
cagaagugcccugcgcuuucaggcagugucucuguuuucccaaggugaaacuuagauaucaugg

SEQ ID NO: 86362 - RNA, 64 nt, Homo Sapiens
acaaaagagcuuuuuucucguuuuugaagcauuauuuucccaacuggguuuuucuacuaauuau

SEQ ID NO: 86363 - RNA, 64 nt, Homo Sapiens
ucaggaagggcuuugggaugaauggccaccuggguuuucccauaccucucuuggugaaugugga

SEQ ID NO: 86364 - RNA, 64 nt, Homo Sapiens
ugaaccaaauuucagggucagucauuuaguuuccuuuucccaugaauaaaucagaggaaaaauu

SEQ ID NO: 86365 - RNA, 64 nt, Homo Sapiens
auuccagaaagcaaaaggcugaaauaggaaaugauuuucccauaagcuguugaagaauuagagg

SEQ ID NO: 86366 - RNA, 64 nt, Homo Sapiens
agguuacccauaacagaagaauuguaucucacauuuuucccaggagagacaauauuuuuccacc

SEQ ID NO: 86367 - RNA, 64 nt, Homo Sapiens
acccaaccauucucuaaagcagcucauccccuuauuuucccacaggccagugaugauuuccccc

SEQ ID NO: 86368 - RNA, 64 nt, Homo Sapiens
caauagaaacuauuuauugugcauaaccuuaguauuuucccaacuaucaaaauuuucaacauau

SEQ ID NO: 86369 - RNA, 64 nt, Homo Sapiens
guaugucacuguuggaaauaagaaaauaaauuguuuuucccaaagagcagaauuuaaaaaagaa

SEQ ID NO: 86370 - RNA, 64 nt, Homo Sapiens
cuacucuagaaagcauggaaggaaagucgcauuauuuucccauucgcauuucuuaaacuaaaca

SEQ ID NO: 86371 - RNA, 64 nt, Homo Sapiens
ccucuucaagguugcaaacugcucacuucuugcauuuucccaugucuacagcuagagaacucuu

SEQ ID NO: 86372 - RNA, 64 nt, Homo Sapiens
gagguaggcacugguuugcccagagaauuuuuauuuuucccagaccacacuugccuuuaggccu

SEQ ID NO: 86373 - RNA, 64 nt, Homo Sapiens
uguacuucagcgcuagccccacaaaagaaucacguuuucccauuguucuaaguauuuauuuaaa

SEQ ID NO: 86374 - RNA, 64 nt, Homo Sapiens
cgcauccugccuguagauggaauuccaguugucuuuuucccagccggaccaucaaccuucgaga

SEQ ID NO: 86375 - RNA, 64 nt, Homo Sapiens
auugaaggcugacauggagaauguuuacuuuucuauuuggcauagcuaacuacacuuugauacu

SEQ ID NO: 86376 - RNA, 64 nt, Homo Sapiens
guaggucauccacuuuuucagguaaacauuuuucauuuggcaaauggcauaauuauuugaaagu

SEQ ID NO: 86377 - RNA, 64 nt, Homo Sapiens
aggccguugggcuucaggauguggggagggaaccauuuggcauagcagcccaggauggacagca

SEQ ID NO: 86378 - RNA, 64 nt, Homo Sapiens
uuaaacuugacauuaucguaaauucaacuuguauauuuggcagacaggcaaaacaugcuccaca

SEQ ID NO: 86379 - RNA, 64 nt, Homo Sapiens
aauucccaagauggacauugcauauuaagagugaauuuggcaggaaaugugugacaguguuugu

SEQ ID NO: 86380 - RNA, 64 nt, Homo Sapiens
augucagcuuuauaguugccggaacugugauuggauuuggcaacguacaguguagaaagcagug

SEQ ID NO: 86381 - RNA, 64 nt, Homo Sapiens
aaagaaagcaguuacucuuggagcuuaugccuucauuuggcaagggaagucuuuuuaacuaguu

SEQ ID NO: 86382 - RNA, 64 nt, Homo Sapiens
uuuugacauuuuugaagagauaauaaauguuuuaauuuggcaguuugagugauugggaaaagga

SEQ ID NO: 86383 - RNA, 64 nt, Homo Sapiens
agccucgcagcuccguggggcccuccgccccagccccagccagccaggcccugguggaaaggcu

SEQ ID NO: 86384 - RNA, 64 nt, Homo Sapiens
ucuggccccaccucccucaagucugcgccccguccccagccagacccacucgcugccgggaccc

SEQ ID NO: 86385 - RNA, 64 nt, Homo Sapiens
accccuagaacugccauucccaagaccucugucucccagccaaccacccuuggaacuugccucu

SEQ ID NO: 86386 - RNA, 64 nt, Homo Sapiens
gcagccguccaguacugcuggcuuccucuggaggcccagccacaggcugggguuggggugugug

SEQ ID NO: 86387 - RNA, 64 nt, Homo Sapiens
gccaccgcgcccagcgauuguuucuugaggcuuccccagccauauggaacuauaagucaauuaa

SEQ ID NO: 86388 - RNA, 64 nt, Homo Sapiens
ccaugcugacuuggagaaccccagaucucuggggcccagccaggcagggugugggggcagcugu

SEQ ID NO: 86389 - RNA, 64 nt, Homo Sapiens
gcucugggggucggagacaccgcugcuuagcacccccagccagaacacccugagggucucgggg

SEQ ID NO: 86390 - RNA, 64 nt, Homo Sapiens
ccucggaacgggaggacucgcagcucucccuuuccccagccaggaugagggaauuagacaaugg

SEQ ID NO: 86391 - RNA, 64 nt, Homo Sapiens
uacugaagugucuaaaaagaacagaaggacccaccccagccauaaugcagacuuucccauuccu

SEQ ID NO: 86392 - RNA, 64 nt, Homo Sapiens
cuuucagcccuucccacaggaaacaucaagaagccccagccaggaggggccaggcugccaaggc

SEQ ID NO: 86393 - RNA, 64 nt, Homo Sapiens
uugccccucagaccuugcauccacagaagcacaacccagccaaacaccacagccuucuccagag

SEQ ID NO: 86394 - RNA, 64 nt, Homo Sapiens
ccccacuugccuugggcguguccacugagccuuccccagccagucuuguucucaauuuuguuuu

SEQ ID NO: 86395 - RNA, 61 nt, Homo Sapiens
agcuccuuccugaugaaugaagacccagguacccagccauaaagccacauugaguagucua

SEQ ID NO: 86396 - RNA, 64 nt, Homo Sapiens
cagcaguuucuuauaagcauaacuuaucauauggcccagccauuucacuacuagaaauugacgc

SEQ ID NO: 86397 - RNA, 64 nt, Homo Sapiens
ccuuacuauuuuuuuaaagacgugagccaccgcgcccagccaaacaaagugcugggauuacagg

SEQ ID NO: 86398 - RNA, 64 nt, Homo Sapiens
caacagacaagauggaagaaccucgagucagggccccagccaccccagaggggucaggccgacg

SEQ ID NO: 86399 - RNA, 64 nt, Homo Sapiens
ugggccugggacuucugccuauggagcucuugggcccagccagcccuguacuuuggggaaacag

SEQ ID NO: 86400 - RNA, 64 nt, Homo Sapiens
ccugacacauuccagccaguguaccugccuccuucccagccaucggagauccuccauccuaaaa

SEQ ID NO: 86401 - RNA, 64 nt, Homo Sapiens
cccugaaggccuuaccaacacccuuggcuguucacccagccauuaaaccaucccuucccuuucu

SEQ ID NO: 86402 - RNA, 64 nt, Homo Sapiens
agacagcaugaaucaaggaaaagagcucaaaguucccagccaauucacccucccuccuccaagg

SEQ ID NO: 86403 - RNA, 64 nt, Homo Sapiens
aagagucucuggcccagucaugcacaucuguagccccagccauccuugugccuucaccucugau

SEQ ID NO: 86404 - RNA, 64 nt, Homo Sapiens
accucucagucuggcucugcuguguaguccauagcccagccagaugagcuugcagccucauagg

SEQ ID NO: 86405 - RNA, 64 nt, Homo Sapiens
gcccaacacuucccagggugcugcugccacccgccccagccagccaccugcuccugacagccag

SEQ ID NO: 86406 - RNA, 64 nt, Homo Sapiens
ccccagcacugaaucccagcgcugcccugaggcccccagccacucccuccagcagccugguuca

SEQ ID NO: 86407 - RNA, 64 nt, Homo Sapiens
guucugggcgccugauuuugcugugacucccagacccagccacuguuucugccacccuguaaca

SEQ ID NO: 86408 - RNA, 64 nt, Homo Sapiens
aagggugaagaagagccaugggacacagaguugacccagccagggggaaagcccagcucucuuu

SEQ ID NO: 86409 - RNA, 64 nt, Homo Sapiens
gagcacgccugccucccucuccccuccgcccucacccagccaauccgaggcugcuucgcacuuu

SEQ ID NO: 86410 - RNA, 64 nt, Homo Sapiens
ugccccagggcagcuaccuaugggucuuugcuuccccagccagccucuccucacugugacccac

SEQ ID NO: 86411 - RNA, 64 nt, Homo Sapiens
gguggaucaccagaggucaggaguucgagaccagcccagccaacauggcaaaaccccaucucua

SEQ ID NO: 86412 - RNA, 64 nt, Homo Sapiens
aacuuuccaucugcuuguauuuuccauacacauccccagccagaaguuaguguccgaagaccga

SEQ ID NO: 86413 - RNA, 64 nt, Homo Sapiens
ucagagauacaguccacagguggacaaagggauccccagccagagagagagagaccagccaaca

SEQ ID NO: 86414 - RNA, 64 nt, Homo Sapiens
acaggcagacaucagccacauggaauccugacaucccagccagccggccagacucucaucuuga

SEQ ID NO: 86415 - RNA, 64 nt, Homo Sapiens
gacccccagcaaaucaggaccuaucuaggcagaccccagccagacccccgccagacagacuccc

SEQ ID NO: 86416 - RNA, 64 nt, Homo Sapiens
acugugaugcgaaaugaucaugacugauggaaaacccagccaccuuucucauugccauuaguaa

SEQ ID NO: 86417 - RNA, 64 nt, Homo Sapiens
augccacaggugaacuuucgcaguuguuucucuucccagccagucacuuagcauuggcuugcuu

SEQ ID NO: 86418 - RNA, 64 nt, Homo Sapiens
caggacuccugggacaucccguuucccagccaggcccagccaccagccgggucggggucugccu

SEQ ID NO: 86419 - RNA, 64 nt, Homo Sapiens
cccagccacccaggacuccugggucugccuguuucccagccagggccuugcuggagccgggucg

SEQ ID NO: 86420 - RNA, 64 nt, Homo Sapiens
augaauaauccaggcuucagcaacacuccucuuucccagccagcaaaggcugugaauuugaauu

SEQ ID NO: 86421 - RNA, 64 nt, Homo Sapiens
cgggugggagacuucagaugggcucaguaccugucccagccacaggcuucuuguccaccucuuc

SEQ ID NO: 86422 - RNA, 64 nt, Homo Sapiens
auggccagucuucauaauagcaacguaccuucaccccagccacaugccccagccaauacaaauu

SEQ ID NO: 86423 - RNA, 64 nt, Homo Sapiens
auaauagcaacguaccuucaccccagccacaugccccagccaauacaaauuggaaaaucuggcc

SEQ ID NO: 86424 - RNA, 64 nt, Homo Sapiens
cuggggcacugagacaguuguuuggcagccccagcccagccaggggcucauccuucucagcucu

SEQ ID NO: 86425 - RNA, 64 nt, Homo Sapiens
uccuccaguccugggccccauccuugagggccuucccagccagccagcaggagaggcaagaacu

SEQ ID NO: 86426 - RNA, 64 nt, Homo Sapiens
agucccucuccuggagcuggggguccacacaucucccagccaaguccaagagggcagggccagu

SEQ ID NO: 86427 - RNA, 64 nt, Homo Sapiens
caagagggcagggccaguuccucccaucuucaggcccagccaggcagggggcagucggcuccuc

SEQ ID NO: 86428 - RNA, 64 nt, Homo Sapiens
gcuccgucuuugaagaaagaagagauggucucuccccagccaugggccacccuugccagugacu

SEQ ID NO: 86429 - RNA, 64 nt, Homo Sapiens
uucucaacugcucggccucuugggccaggcugugcccagccagcccugggagaacuggguagca

SEQ ID NO: 86430 - RNA, 64 nt, Homo Sapiens
gcucugcagcgagcccugggaccacucaucccugcccagccagcuucagugcccggggccgcuu

SEQ ID NO: 86431 - RNA, 64 nt, Homo Sapiens
gaccuuggacaccaccaccugcugagcuucccgucccagccaugcaguggggccccuggggugc

SEQ ID NO: 86432 - RNA, 64 nt, Homo Sapiens
cccuguucccugagaccuggccucaaagggcugacccagccauacguagauccuggggucuuuc

SEQ ID NO: 86433 - RNA, 64 nt, Homo Sapiens
gugccugcagccuagucccugcccaagcuucucccccagccacccucugccccugugguagagc

SEQ ID NO: 86434 - RNA, 64 nt, Homo Sapiens
ugagagcaugagcacuuccccaugcagucucucgcccagccaggcagcaucucaguccuuccuc

SEQ ID NO: 86435 - RNA, 64 nt, Homo Sapiens
auggguaguuuuuauucucucgugagccaccgugcccagccagacaaagugcugggauuacagg

SEQ ID NO: 86436 - RNA, 64 nt, Homo Sapiens
aggcagcagccuucguggcaagaacuagcgugagcccagccaggcgccuccccaccgggcucuc

SEQ ID NO: 86437 - RNA, 64 nt, Homo Sapiens
ggagugacaucuucaucugcucugaauacuggugcccagccagcccgugacagcuucccccuaa

SEQ ID NO: 86438 - RNA, 64 nt, Homo Sapiens
gaagaaaguguccauucuuugccuuccuggagcucccagccagagcugagcuuaggcacccgag

SEQ ID NO: 86439 - RNA, 64 nt, Homo Sapiens
gccggggaccgguguuucacauguccuuacuguccccagccaggucagugucccuccugcggug

SEQ ID NO: 86440 - RNA, 64 nt, Homo Sapiens
cauggucuuuccguuucuuaaggcacgcugcacucccagccagaaggggcgguggcugguccuc

SEQ ID NO: 86441 - RNA, 64 nt, Homo Sapiens
uucaaugccugccacccugcggagccacgugccgcccagccaccgggucagaccacccccuaga

SEQ ID NO: 86442 - RNA, 64 nt, Homo Sapiens
aucccuugcuggaaggcucacccgucuggacccucccagccacugugcccucgggucuguccuc

SEQ ID NO: 86443 - RNA, 64 nt, Homo Sapiens
cagggccuugaggaggauguuugcuggagugucucccagccaauaucuucuggccaaucaaggc

SEQ ID NO: 86444 - RNA, 64 nt, Homo Sapiens
cacacagagaagcaaauucuaccccugccucugccccagccagcaaacauaccccaucccaccc

SEQ ID NO: 86445 - RNA, 64 nt, Homo Sapiens
cuucagucuguccgacaggauuuaccgucacuagcccagccaggugcuggugcugucagugauu

SEQ ID NO: 86446 - RNA, 60 nt, Homo Sapiens
guggcagcaaggccaccugaggcccugucucccagccacuuucccuccuggcacugccac

SEQ ID NO: 86447 - RNA, 64 nt, Homo Sapiens
uccuuaggccccagccugggcccagacccauccucccagccagguuucccuccagcaggcuccu

SEQ ID NO: 86448 - RNA, 64 nt, Homo Sapiens
agccuguacccagaggccuuggacuagacgaagccccagccaguggcagaacugggucucucag

SEQ ID NO: 86449 - RNA, 64 nt, Homo Sapiens
gcggucgggccugggccguuaucuccccacaacccccagccaaucaggacuuuccagacuuggc

SEQ ID NO: 86450 - RNA, 64 nt, Homo Sapiens
guccuggacuucaagagugagggccccugcugggcccagccaccaggacagcaggaaccagggc

SEQ ID NO: 86451 - RNA, 64 nt, Homo Sapiens
agaggcuaagaggaagacuggccaggcccaaggacccagccaucaaaaccagccucaaaucugg

SEQ ID NO: 86452 - RNA, 64 nt, Homo Sapiens
ggcaugcaggcagggugugcgugcgccuucauagcccagccaagaugugagcaaacacacacac

SEQ ID NO: 86453 - RNA, 64 nt, Homo Sapiens
cuagugcccaagcagcuaaacuucucccuacacucccagccaacggcugugaccaccccccauc

SEQ ID NO: 86454 - RNA, 64 nt, Homo Sapiens
cucccuucucuccucuggggggccaggucaccuccccagccaccgggcuuguuuaggauuggag

SEQ ID NO: 86455 - RNA, 64 nt, Homo Sapiens
gccgagauucgagggucaaccgcucaaccuuuggcccagccaucccccucccuagucccaccca

SEQ ID NO: 86456 - RNA, 64 nt, Homo Sapiens
cggaucuccaggcccagccucccaugcauggccucccagccacccugugagcuccccaauccaa

SEQ ID NO: 86457 - RNA, 64 nt, Homo Sapiens
agguucucuccugugagcucccacacaggccuggcccagccagcugccugccuccggcccugcc

SEQ ID NO: 86458 - RNA, 64 nt, Homo Sapiens
aguuaaagggcugaggguugaggagaaucaguggcccagccagaagaugggccacagacugggg

SEQ ID NO: 86459 - RNA, 64 nt, Homo Sapiens
cacugguguccugucucuugauggggccgccuggcccagccacuagccaucuugguuuuaggaa

SEQ ID NO: 86460 - RNA, 64 nt, Homo Sapiens
ucccuggauaggaagggauaucuacuccccuguccccagccauacuuguuuuccagacagaaaa

SEQ ID NO: 86461 - RNA, 64 nt, Homo Sapiens
ugucccuccuaugcacagaggggcacuuccccaccccagccagggcauccccagcacugguccu

SEQ ID NO: 86462 - RNA, 55 nt, Homo Sapiens
aauucagcugaagggaccaacagggcccagccacaaugggggccccagcaguuaa

SEQ ID NO: 86463 - RNA, 64 nt, Homo Sapiens
cucagaguaggcgcccaaaguuaaugaauggaugcccagccaagguuuguagcuuaugacuuau

SEQ ID NO: 86464 - RNA, 64 nt, Homo Sapiens
ccuucuuuccuuccugccuuucucucagggcucccccagccauuuccucacaugugcugcgacc

SEQ ID NO: 86465 - RNA, 64 nt, Homo Sapiens
ccugcugcacuaaggacuuaggcccugcaaccuucccagccacuaggcuauggaguuugcugug

SEQ ID NO: 86466 - RNA, 64 nt, Homo Sapiens
gcucccuguccagaauucggauaccugcacccaccccagccaggcuuuccugccccuccccauc

SEQ ID NO: 86467 - RNA, 64 nt, Homo Sapiens
ugaaaccuuuagggcagcuugccccggccccggccccagccagaguuccugcggagugaagagg

SEQ ID NO: 86468 - RNA, 64 nt, Homo Sapiens
ccccuuuucuuuucuacccuagccauuccugguacccagccaucugcccaggggugcccccucc

SEQ ID NO: 86469 - RNA, 64 nt, Homo Sapiens
guucgccucuaguuucucagggauggagcgagagcccagccagagaacaguaagaggagcugcu

SEQ ID NO: 86470 - RNA, 64 nt, Homo Sapiens
uucaucacagcuaaaccugguucccuccaaaccucccagccacucgggcuuguaacugucugag

SEQ ID NO: 86471 - RNA, 64 nt, Homo Sapiens
aucacagugacagugucauggggagcugggcgggcccagccaaacccuccuucuuccuagagcc

SEQ ID NO: 86472 - RNA, 64 nt, Homo Sapiens
ggcgggcccagccaaacccuccuucuuccuagagcccagccagcaggcaggaguuccuggaccc

SEQ ID NO: 86473 - RNA, 64 nt, Homo Sapiens
cuugacuguccccaaacucuguggcuguccaccucccagccauaaucuccugagcuuagugucc

SEQ ID NO: 86474 - RNA, 64 nt, Homo Sapiens
gcuugacacgcccacagucacaggcagcaggcuccccagccaggacagcugaggaguggccggg

SEQ ID NO: 86475 - RNA, 64 nt, Homo Sapiens
cagggccauccacugugacgcucccugucugugucccagccacguggcgcaggugccaugccug

SEQ ID NO: 86476 - RNA, 64 nt, Homo Sapiens
gguggagccaagugguccaggggcuucccuucuccccagccagagcucugccuucucaggcccc

SEQ ID NO: 86477 - RNA, 64 nt, Homo Sapiens
guuugcaugcuucgugccacacgcccgcggugaucccagccagggccccgagcgcagaggcgga

SEQ ID NO: 86478 - RNA, 64 nt, Homo Sapiens
cacagccagagucaaugccuucaugggaagggcucccagccacacccagaguggcccaaagcug

SEQ ID NO: 86479 - RNA, 64 nt, Homo Sapiens
gguagaaaacuccaggguccccugccaccgacugcccagccacuccaagcccccuggcagcugc

SEQ ID NO: 86480 - RNA, 64 nt, Homo Sapiens
uuuggcccaagacugggcuguaguuacauuaaugcccagccagccaccccugccacucacccuu

SEQ ID NO: 86481 - RNA, 64 nt, Homo Sapiens
uccugggcucccugccugugguuggggugggagccccagccaaauccuuacucagcuaccucgg

SEQ ID NO: 86482 - RNA, 64 nt, Homo Sapiens
aauccuuacucagcuaccucgccaggacagcccucccagccaugcuucucuccaagugugccag

SEQ ID NO: 86483 - RNA, 64 nt, Homo Sapiens
gcagaggggccuccccaggagagcccuggugggucccagccaggcagcgugaggcuucagccug

SEQ ID NO: 86484 - RNA, 64 nt, Homo Sapiens
gacggaaugccuggucuugaucuggaagggacaccccagccaggccucagaucaucucugucac

SEQ ID NO: 86485 - RNA, 64 nt, Homo Sapiens
gggccaccucuuccuccaagacacaccaccaaaacccagccaauaaaaugacccaacgaugucc

SEQ ID NO: 86486 - RNA, 64 nt, Homo Sapiens
ggucgagcacugccccgccgcugagaccagcccacccagccagucccugggccugcaggagagg

SEQ ID NO: 86487 - RNA, 64 nt, Homo Sapiens
augcugcaggccaagcuggggcuuuuuggguccacccagccaggcuuuucccacuuucugggug

SEQ ID NO: 86488 - RNA, 64 nt, Homo Sapiens
gucugggagcuauaugggaauguagaugcuggagcccagccaagcccagcaucucuuccuccuu

SEQ ID NO: 86489 - RNA, 64 nt, Homo Sapiens
gcuggcgauaaaggaccgagauuccugacagccucccagccaggaagagggaaagagggcugcc

SEQ ID NO: 86490 - RNA, 64 nt, Homo Sapiens
agcacagucucuauggugcuccccgggccagcagcccagccagccgcucuuggccccaagguug

SEQ ID NO: 86491 - RNA, 64 nt, Homo Sapiens
ggaaagcaaacuucauccuaugucauggcccgcccccagccaugguggcuuaauccagaggccc

SEQ ID NO: 86492 - RNA, 64 nt, Homo Sapiens
aacaaacaagggaccaagugcaggccuucccugacccagccaggcucagugccaccacccccgg

SEQ ID NO: 86493 - RNA, 64 nt, Homo Sapiens
agccccgccuggccaucaguccaccccaccugggcccagccaggcccucgauggacagccucac

SEQ ID NO: 86494 - RNA, 51 nt, Homo Sapiens
ggcgggcagggcagacugacgcccagccagaagaaggacuggaaggacuga

SEQ ID NO: 86495 - RNA, 64 nt, Homo Sapiens
ccugccucugucucucuucuggccugagccugggcccagccaccuccugacggguccccugggu

SEQ ID NO: 86496 - RNA, 64 nt, Homo Sapiens
cauaggucucccauggcgcaaugagucaguggcccccagccaggcagugugggcauugccacug

SEQ ID NO: 86497 - RNA, 64 nt, Homo Sapiens
gccaccugauccccagcugugucuccuccagggccccagccauguguucgucgccccgugugcc

SEQ ID NO: 86498 - RNA, 64 nt, Homo Sapiens
cuugccccugccccuaccccugccagcgcccacccccagccagggccccucgccuuccuccccu

SEQ ID NO: 86499 - RNA, 64 nt, Homo Sapiens
uaaugaaccaggcauuguggcaugcgccuauagucccagccacucaagaggcacaggcgggagg

SEQ ID NO: 86500 - RNA, 64 nt, Homo Sapiens
uggcucggcccugcccccaguauacugaccauuccccagccacuucccuuccgcacuuaccacu

SEQ ID NO: 86501 - RNA, 64 nt, Homo Sapiens
uccccagccacuucccuuccgcacuuaccacucccccagccacgccccuccccgcugaccgcuc

SEQ ID NO: 86502 - RNA, 64 nt, Homo Sapiens
gaggccucuacacagaagaaagcagcccccaugucccagccacuucugggucccagccagcagc

SEQ ID NO: 86503 - RNA, 64 nt, Homo Sapiens
gaaagcagcccccaugucccagccacuucugggucccagccagcagcacggauguuacuguccu

SEQ ID NO: 86504 - RNA, 64 nt, Homo Sapiens
cacaccagacucuggaacccuucugccgugaaaccccagccagcacugcccccuccagcccauu

SEQ ID NO: 86505 - RNA, 64 nt, Homo Sapiens
ugucccgagugcgccaaggaccgaucugacuccgcccagccagaucaggcucccucuauuaaag

SEQ ID NO: 86506 - RNA, 64 nt, Homo Sapiens
ugucuggaaucccagcuccgucuuccugcagaggcccagccacgacccuuccacacguuugauu

SEQ ID NO: 86507 - RNA, 64 nt, Homo Sapiens
cucucugaacucauccagccuugcgccuggcacgcccagccaaaaugaccaggacaucaugcug

SEQ ID NO: 86508 - RNA, 64 nt, Homo Sapiens
gccccaacucuuuucccgggaccauacugagucccccagccacgcugcugacauuaccauuauu

SEQ ID NO: 86509 - RNA, 64 nt, Homo Sapiens
ucagaccagccaaccuuuguggaauaagccccagcccagccaaaccaaacccagaugccugagg

SEQ ID NO: 86510 - RNA, 64 nt, Homo Sapiens
gccuagaggagcaccaucuacaguugugccauuccccagccacugccuucaugcugcccccgcc

SEQ ID NO: 86511 - RNA, 64 nt, Homo Sapiens
uuccgucugcccccucgucaccaggugugauagccccagccaggucacaccuggccucacacuu

SEQ ID NO: 86512 - RNA, 64 nt, Homo Sapiens
agcaugaacucagagcauugucagaaggugggcacccagccaacccuggcaaucugggaagggu

SEQ ID NO: 86513 - RNA, 64 nt, Homo Sapiens
ccuaggaacaccuguccaucgguauugaauguugcccagccaccaagaguggguugaccaauuu

SEQ ID NO: 86514 - RNA, 64 nt, Homo Sapiens
cgaguggccuucuuugaagagcucuagcaggugacccagccaccccaggaccugccacuucucc

SEQ ID NO: 86515 - RNA, 64 nt, Homo Sapiens
ccagucugcacggcccaucugcuucaccuucccucccagccacgugccaguggccacagcccac

SEQ ID NO: 86516 - RNA, 64 nt, Homo Sapiens
caccuugccccaaggaaaccagcccugggugccacccagccacuuagggucuacagggugggac

SEQ ID NO: 86517 - RNA, 64 nt, Homo Sapiens
auggauguuguggcccugugucuuccuagugugacccagccaggagcggaagcuucaggcguuu

SEQ ID NO: 86518 - RNA, 64 nt, Homo Sapiens
ggcugagguggggccgggccacaccccugcccaucccagccagggugcugugcccccguccaga

SEQ ID NO: 86519 - RNA, 64 nt, Homo Sapiens
cucgggggucaggagcucagcguccgcuacucagcccagccaaaacccucccagacgucuccuc

SEQ ID NO: 86520 - RNA, 64 nt, Homo Sapiens
gcuauaauuguuuuuuaaaucugguacacucuggcccagccagauacauuguugauuguuauga

SEQ ID NO: 86521 - RNA, 64 nt, Homo Sapiens
cugagaaaauguaagcagaccaagaaauaaugaucccagccagauacagaaaccucagugaaau

SEQ ID NO: 86522 - RNA, 64 nt, Homo Sapiens
cuggcugggacugggaacagucccccagccacuccccagccagccaggguuggcaccuuccccc

SEQ ID NO: 86523 - RNA, 64 nt, Homo Sapiens
ccccagccagccuggcugggcaccuucccccucccccagccacucuccucaggaccaggguugg

SEQ ID NO: 86524 - RNA, 64 nt, Homo Sapiens
uguguacaggggcucacuuugaagaugaacauaucccagccaccccagcacuggccucccugug

SEQ ID NO: 86525 - RNA, 64 nt, Homo Sapiens
gacucuauacagugagggccagugccacuugguccccagccaugugugacuuugggcgagucuc

SEQ ID NO: 86526 - RNA, 63 nt, Homo Sapiens
ccacagcccuagcugccagcaaugcuguccucacagaggcauagucgcccccagcuggguugu

SEQ ID NO: 86527 - RNA, 63 nt, Homo Sapiens
caggaucaugccuucugugucuggaagaggcggcagaggcaacaguguuuaggauuuggguua

SEQ ID NO: 86528 - RNA, 63 nt, Homo Sapiens
gcgugagugugguggugugaccuucaggcugcacagaggcaaggacccagauguggcagcaug

SEQ ID NO: 86529 - RNA, 63 nt, Homo Sapiens
ccauccgugcggccuuggccacaucccuauuaacagaggcagcuccacuucagacagggacaa

SEQ ID NO: 86530 - RNA, 63 nt, Homo Sapiens
cugucauuuucccuuccuaccccaacccugagccagaggcaucugacagcccuuucccagagg

SEQ ID NO: 86531 - RNA, 63 nt, Homo Sapiens
ggcagagcugggcggcauccacagccagagaggcagaggcaagagcagagccaggcugugccc

SEQ ID NO: 86532 - RNA, 63 nt, Homo Sapiens
cacuuaaaggagaaaaauauuugggacuagcagcagaggcaguaagagaugugaaccuuggug

SEQ ID NO: 86533 - RNA, 63 nt, Homo Sapiens
aacgagaugagaagacugugauccucauguacucagaggcacuucccuccuaagucaaagacc

SEQ ID NO: 86534 - RNA, 63 nt, Homo Sapiens
uuucccauucacuucucuagaaagcugccaagacagaggcagaaagaaauggaugauaguucu

SEQ ID NO: 86535 - RNA, 63 nt, Homo Sapiens
guuauuuauguacauagggaaaauuccacucagcagaggcaauaauuuugaaguaacgaaugc

SEQ ID NO: 86536 - RNA, 63 nt, Homo Sapiens
auuacugcauuguuugucacgaggaacuaaaaccagaggcauuugcuaauaaaugucauccaa

SEQ ID NO: 86537 - RNA, 63 nt, Homo Sapiens
uccacagaaggggggcugcccucaaaaagauggcagaggcaaauacaaaccauuagaaaauaa

SEQ ID NO: 86538 - RNA, 63 nt, Homo Sapiens
agaggaccguggagcguuucgccugccugcgugcagaggcaggacccaggagccccccaggcu

SEQ ID NO: 86539 - RNA, 63 nt, Homo Sapiens
gcuggcuuucaagcgugguuuuuugcuaagagccagaggcaggucuucuggaguucucagggg

SEQ ID NO: 86540 - RNA, 63 nt, Homo Sapiens
gcacaggugggugauguccuuggcugcugccgucagaggcagcccccugcacagggaggggcu

SEQ ID NO: 86541 - RNA, 63 nt, Homo Sapiens
gccugaaccucgggcuccugaggccccucuguccagaggcaggagcacccacccugguucucc

SEQ ID NO: 86542 - RNA, 63 nt, Homo Sapiens
gccacagcugugagggccaaggaccauggcccgcagaggcacuuugcucaggguggggggcug

SEQ ID NO: 86543 - RNA, 63 nt, Homo Sapiens
accuuugcggguggggcguuacugccaaaacuccagaggcaaaguggaccuggcaaccacaag

SEQ ID NO: 86544 - RNA, 63 nt, Homo Sapiens
ccuggaacauugggccugaguggagaugggagacagaggcaggccagaagguucucucugcac

SEQ ID NO: 86545 - RNA, 63 nt, Homo Sapiens
gccuguggcagcgccgcuggacccuaggaggcucagaggcaguggugugggagcccugucugc

SEQ ID NO: 86546 - RNA, 63 nt, Homo Sapiens
uugaagaggcugacuuggcccacugcuaagcggcagaggcagggccagccauccugucgcaag

SEQ ID NO: 86547 - RNA, 63 nt, Homo Sapiens
ugcugcacacacaagcaucuucacccagcaccacagaggcacccccccccugucgucugcucu

SEQ ID NO: 86548 - RNA, 63 nt, Homo Sapiens
gccuuugucugucuaucuggcucauuuaacccucagaggcagcggggguuggaaggauggggg

SEQ ID NO: 86549 - RNA, 53 nt, Homo Sapiens
ccuucuuuucauggugguagcuccagaggcaggcagaggaaauauugucagag

SEQ ID NO: 86550 - RNA, 63 nt, Homo Sapiens
cucugcuggccuacagcuugucuguuucucaagcagaggcaggaagagcuagucuuagcauuu

SEQ ID NO: 86551 - RNA, 63 nt, Homo Sapiens
caaagggggagucccucgucucuugugacucagcagaggcaguggccacguucagggaggggc

SEQ ID NO: 86552 - RNA, 63 nt, Homo Sapiens
ugccccccagcuacuguaugcccccgacccccgcagaggcagaaugaacccauagggagcuga

SEQ ID NO: 86553 - RNA, 63 nt, Homo Sapiens
agugggggaucagggaaggugggagguuggugucagaggcagggagggcagaggaaguacuua

SEQ ID NO: 86554 - RNA, 63 nt, Homo Sapiens
gggcagugcaggggacucugggcacaggcugggcagaggcacacugaggggaacccugggaca

SEQ ID NO: 86555 - RNA, 63 nt, Homo Sapiens
agaugaaggacaaaaggaagcugcuguggggugcagaggcagacugaggccauggcaggacag

SEQ ID NO: 86556 - RNA, 63 nt, Homo Sapiens
ucaggaccagagaagggaaaugacuucuccaggcagaggcagaucugagucuagaacccaggc

SEQ ID NO: 86557 - RNA, 63 nt, Homo Sapiens
ucagagaacagagaucacacacaccaaaccagacagaggcagggcagcauggagacagguaga

SEQ ID NO: 86558 - RNA, 63 nt, Homo Sapiens
ggcuccggggggaguggggcccugcgcuagaggcagaggcaguucuuuguucaagcguuccuc

SEQ ID NO: 86559 - RNA, 63 nt, Homo Sapiens
ucuuuguucaagcguuccucuggggaccggcagcagaggcaccguguucucucagcccuggau

SEQ ID NO: 86560 - RNA, 63 nt, Homo Sapiens
caguagcaagaaagcagagcaaacaaacagaggcagaggcaggaagacaaaaaaaaaaaaaaa

SEQ ID NO: 86561 - RNA, 63 nt, Homo Sapiens
ggcaggcaguagcaagaaagaaaaaaaaacaaacagaggcagaaaauguaagacaaaaaaaaa

SEQ ID NO: 86562 - RNA, 63 nt, Homo Sapiens
gccagacuuuuccgucguuucuccaagcuugcacagaggcaaguccacagcggcgacccaggc

SEQ ID NO: 86563 - RNA, 63 nt, Homo Sapiens
gaggugggccccggcccuggugggaguccccaucagaggcagucacagcggagccaugggggc

SEQ ID NO: 86564 - RNA, 63 nt, Homo Sapiens
cuggcuccgcuguguggauggggagaucggggccagaggcagaacccuggugaggaagcucca

SEQ ID NO: 86565 - RNA, 63 nt, Homo Sapiens
cucgcuucucugugacugauguuaggcugggcccagaggcacagccggggccugccuagcacu

SEQ ID NO: 86566 - RNA, 63 nt, Homo Sapiens
augugucaaaggcuuuuggagugaccaaaagcacagaggcagcggguggggcgccuggguggu

SEQ ID NO: 86567 - RNA, 63 nt, Homo Sapiens
gguccccaaggucgcugccacccuugcccggggcagaggcagaagcccacauaugcugugacg

SEQ ID NO: 86568 - RNA, 63 nt, Homo Sapiens
aggaucgcuugagcucaggagcacuuugggaggcagaggcaggggcucacaccugucauccua

SEQ ID NO: 86569 - RNA, 63 nt, Homo Sapiens
cuccuggcaucgaguggguguuuuugguuggggcagaggcaugucaggcaaggucuggagaca

SEQ ID NO: 86570 - RNA, 63 nt, Homo Sapiens
aguuccuuuaaagcacaucuucagcaggagugacagaggcagauggcacugagaugcauccac

SEQ ID NO: 86571 - RNA, 63 nt, Homo Sapiens
caacagacuuauacacuaaguuuaagaaucuuccagaggcaguacccuuaaaguacaguguua

SEQ ID NO: 86572 - RNA, 63 nt, Homo Sapiens
cccagccucagaacccaggaucccucagaaucccagaggcaguccugcagggguggagggcag

SEQ ID NO: 86573 - RNA, 63 nt, Homo Sapiens
ccgugggucucugucucagugcucaggcaagcacagaggcagcgaaagacucuuaauuaagag

SEQ ID NO: 86574 - RNA, 63 nt, Homo Sapiens
guaauaaagcacuucagggcuggaaacuaagcucagaggcaagcugcuucuaagaggcuaacc

SEQ ID NO: 86575 - RNA, 63 nt, Homo Sapiens
ccugggaugccccaguuucuuuggccacaggagcagaggcagagagaaggaucugcuccgccu

SEQ ID NO: 86576 - RNA, 63 nt, Homo Sapiens
acuaggaucagggacagaucaugauggaccccucagaggcaagggucugggggacagacaagg

SEQ ID NO: 86577 - RNA, 63 nt, Homo Sapiens
aggcagccaggcaggguggguacccagcugggccagaggcacgcagcuaugcaaaucccuacc

SEQ ID NO: 86578 - RNA, 63 nt, Homo Sapiens
cuggagugaugcggccacaaggacacguggagacagaggcagagacacagacacagagcagga

SEQ ID NO: 86579 - RNA, 63 nt, Homo Sapiens
gacugaagugaugcugccccggccacauaaagacagaggcagagacacagacacaaagcagga

SEQ ID NO: 86580 - RNA, 63 nt, Homo Sapiens
ggugaggaagggucuccaggcucccaggcacugcagaggcaccagggucuccaggcuuuauuc

SEQ ID NO: 86581 - RNA, 64 nt, Homo Sapiens
auauauugugauuauuuucguugauaaagaacuagauacaaagaccucugaaauugaugauaaa

SEQ ID NO: 86582 - RNA, 64 nt, Homo Sapiens
guguuuuuuuuuccaaaguuuuucccaaggagaagauacaaauauaugguagcuauuguuuaaa

SEQ ID NO: 86583 - RNA, 64 nt, Homo Sapiens
uccauagcuccggggcugcucauccagaugcauggauacaaauucaacccaggauacaaacuuc

SEQ ID NO: 86584 - RNA, 64 nt, Homo Sapiens
uccauccagaugcauggauacugugccaacccaggauacaaacuuuuugguucaacuggaaucu

SEQ ID NO: 86585 - RNA, 64 nt, Homo Sapiens
ucuuuuuucagguggauuuuuucauaauuuccaugauacaaagauaaugucuaagaaauccagc

SEQ ID NO: 86586 - RNA, 64 nt, Homo Sapiens
uggguuugauucaaagcccuaauagaugaagugagauacaaagccuauugucacaugaugaaua

SEQ ID NO: 86587 - RNA, 64 nt, Homo Sapiens
agaauuaaauaauuuuuaaaaggugguaaagaaggauacaaaggagaacucagcagagauuuau

SEQ ID NO: 86588 - RNA, 64 nt, Homo Sapiens
uauagauuuaaaauaaucucaagcugcauccacagauacaaaaaaauauaggagccaugaaaug

SEQ ID NO: 86589 - RNA, 64 nt, Homo Sapiens
ugcugguagggagcgauauuauaaagcagcugaggauacaaauguaacaggaaaaugagagaaa

SEQ ID NO: 86590 - RNA, 64 nt, Homo Sapiens
cuuuuauaaaaaauauuguuaaggguuuaaacuugauacaaaacuagaaucaguggauggaaac

SEQ ID NO: 86591 - RNA, 64 nt, Homo Sapiens
uucugauuggggugaugagaguuagugcauaauggauacaaaguguggggauggagaaugggua

SEQ ID NO: 86592 - RNA, 64 nt, Homo Sapiens
auagaaaauuguggcuuucaccaagagaccucuugauacaaacauacauauucuagauauucuc

SEQ ID NO: 86593 - RNA, 64 nt, Homo Sapiens
aagaauuuugcuuuauuuuaucuaaaagauccuggauacaaauuaaugaaaauaagccagguau

SEQ ID NO: 86594 - RNA, 64 nt, Homo Sapiens
ugauauuuaaaaauauacacuaaaaagucagagugauacaaaaguuaguguguuuucaguaugc

SEQ ID NO: 86595 - RNA, 64 nt, Homo Sapiens
cuuacaggauguuagagacaaaacaagcagacaccugaaacaaucaacgcccaauaaaacaaag

SEQ ID NO: 86596 - RNA, 64 nt, Homo Sapiens
gaaacauuauuaauugguaggguaagcagacacucugaaacaaugagaaaaauacuaaaaauug

SEQ ID NO: 86597 - RNA, 64 nt, Homo Sapiens
agaguagucuuucaaucugaagauguaagacuuccugaaacaaguucucaagaagucuuuacau

SEQ ID NO: 86598 - RNA, 64 nt, Homo Sapiens
auuucauaaagucugaggauuuucgucaaccuuacugaaacacacuggugcuuucaucaucaga

SEQ ID NO: 86599 - RNA, 64 nt, Homo Sapiens
auucuacuucuuguuccaagcccaguccucuuaacugaaacagccagucuguugccugaaacag

SEQ ID NO: 86600 - RNA, 64 nt, Homo Sapiens
ccaguccucuuaacugaaacgaucagucuguugccugaaacagcccaccacugugaugcgaaau

SEQ ID NO: 86601 - RNA, 64 nt, Homo Sapiens
agugaggaccuguaauccagcauucuuguuaaagcugaaacacugaaacagccauugccuugac

SEQ ID NO: 86602 - RNA, 64 nt, Homo Sapiens
ccuguaauccagcauucuuguuaaagcugaaacacugaaacagccauugccuugaccaacauau

SEQ ID NO: 86603 - RNA, 64 nt, Homo Sapiens
caaccacacgcuguuggggagagcgaugugcucccugaaacagaauaaaccccacaugccccag

SEQ ID NO: 86604 - RNA, 64 nt, Homo Sapiens
aaccccacaugccccaggagggcggugucucagccugaaacauaaccguccuugugcuguggcu

SEQ ID NO: 86605 - RNA, 64 nt, Homo Sapiens
cuuccccuccuauaaucauaauaaucaugauaaccugaaacauguuacugggacucgacauuuu

SEQ ID NO: 86606 - RNA, 64 nt, Homo Sapiens
cuuggagcugucacauagcaggggcaaccucacacugaaacaaaggaagugaugucccauuauu

SEQ ID NO: 86607 - RNA, 64 nt, Homo Sapiens
gaaaagauggcccugucagccacccucucucagucugaaacauccaacauccccagaaggcuua

SEQ ID NO: 86608 - RNA, 64 nt, Homo Sapiens
ccuguggaaaagaagagagacagagagacagugucugaaacaggauggcagaauaggcucacau

SEQ ID NO: 86609 - RNA, 64 nt, Homo Sapiens
ugcacaugacagaaagcuggaagaaauagucaaccugaaacacaugauggaauuauaauucaga

SEQ ID NO: 86610 - RNA, 64 nt, Homo Sapiens
gaaacuuucauaucaauaauugauuauguauuaacugaaacaaaagacuagagaaagacacagu

SEQ ID NO: 86611 - RNA, 64 nt, Homo Sapiens
aggagcagaagcaaagagcagacacacauacagccugaaacagaccuggacagacagacacagc

SEQ ID NO: 86612 - RNA, 64 nt, Homo Sapiens
cagccugaaacagaccuggacagacagacacagccugaaacagacccggacagacagacacagc

SEQ ID NO: 86613 - RNA, 64 nt, Homo Sapiens
cagccugaaacagacccggacagacagacacagccugaaacagacccagacaaacagacagaca

SEQ ID NO: 86614 - RNA, 64 nt, Homo Sapiens
aacagacccagacaaacagacagacagacacagccugaaacagacccagacagacagacagaca

SEQ ID NO: 86615 - RNA, 64 nt, Homo Sapiens
gccugaaacagacccagacagacagacagacagccugaaacagacccagacacagccugaaaca

SEQ ID NO: 86616 - RNA, 64 nt, Homo Sapiens
cagacagacagccugaaacagacccagacacagccugaaacagauccggacagacagacagaaa

SEQ ID NO: 86617 - RNA, 64 nt, Homo Sapiens
cugaaacagauccggacagacagacagaaacagccugaaacagacccagacagacagacagaca

SEQ ID NO: 86618 - RNA, 64 nt, Homo Sapiens
cugaaacagacccagacagacagacagacacagccugaaacagacccggacagacagacagaca

SEQ ID NO: 86619 - RNA, 64 nt, Homo Sapiens
cugaaacagacccggacagacagacagacacagccugaaacagacccggacagacagacagaca

SEQ ID NO: 86620 - RNA, 64 nt, Homo Sapiens; identical to SEQ ID NO: 86619

SEQ ID NO: 86621 - RNA, 64 nt, Homo Sapiens
cugaaacagacccggacagacagacagacacagccugaaacagaccuagacagacagacacaga

SEQ ID NO: 86622 - RNA, 64 nt, Homo Sapiens
uugaaacagacccagacaaacagacagacacagccugaaacagacccagacacagccugaaaca

SEQ ID NO: 86623 - RNA, 64 nt, Homo Sapiens
gacagacacagccugaaacagacccagacacagccugaaacagacccggacagacagacagaca

SEQ ID NO: 86624 - RNA, 64 nt, Homo Sapiens
cugaaacagacccggacagacagacagacacagccugaaacagacccagacagacagacagaca

SEQ ID NO: 86625 - RNA, 64 nt, Homo Sapiens
cugaaacagacccagacagacagacagacacagccugaaacagacccagacagacagaccgacg

SEQ ID NO: 86626 - RNA, 64 nt, Homo Sapiens
cuaaaacagaccuggacagacaggcagacguagucugaaacagaccugaacagacagacagacg

SEQ ID NO: 86627 - RNA, 64 nt, Homo Sapiens
ggcauguggcacuuugucagggcagcccaggaaucugaaacaggaucaaacucugcuuccuggg

SEQ ID NO: 86628 - RNA, 64 nt, Homo Sapiens
uuccaucccacugggaaaacgucucagguggccucugaaacaccacuccuuuuugugugugugc

SEQ ID NO: 86629 - RNA, 64 nt, Homo Sapiens
cuugacaaagcaaguagagaagaaacacaaauagcugaaacaaaaauuuuauguggaaaaguaa

SEQ ID NO: 86630 - RNA, 64 nt, Homo Sapiens
guaucuuccaucagcauaacauucucauugaaaucugaaacaagauugauaauauuuaaucagc

SEQ ID NO: 86631 - RNA, 64 nt, Homo Sapiens
cuugugcuaagauggaaagguucaaaaaaaaagacugaaacaaggugacagagcgagacuccau

SEQ ID NO: 86632 - RNA, 64 nt, Homo Sapiens
caggccagaugugguggcuccguuccucuuaagacugaaacaagcugugaaugaacaaugaagu

SEQ ID NO: 86633 - RNA, 64 nt, Homo Sapiens
uauccauuuuauacaaucacugauacagucuaugucaaaaaaccaacagaccauuauuccucuu

SEQ ID NO: 86634 - RNA, 64 nt, Homo Sapiens
agcuacaaaguaauucaccagcaugacaaaauggucaaaaaauaagucaucagcacuuaagaaa

SEQ ID NO: 86635 - RNA, 64 nt, Homo Sapiens
cugaaguuuuaguuaagauuuucacacauuaauaucaaaaaaguaaguuuaguauuuguuucuc

SEQ ID NO: 86636 - RNA, 64 nt, Homo Sapiens
aguaauuacaguggaaugaguacuggacaaggagucaaaaaacuugauuucagguccuagcucu

SEQ ID NO: 86637 - RNA, 64 nt, Homo Sapiens
ggcuuuuacuaucuuucuuaaaaaaaaaaaaaagucaaaaaaauucaaaaaaggggaugauacu

SEQ ID NO: 86638 - RNA, 64 nt, Homo Sapiens
aucuuucuuaaaaaaaaaaaaaagucaaaaaaauucaaaaaaggggaugauacuagccuuaaca

SEQ ID NO: 86639 - RNA, 64 nt, Homo Sapiens
aaaaaaaaaaaguaauuggcagcgagacuccgucucaaaaaaaacacuccagccugggcaacag

SEQ ID NO: 86640 - RNA, 64 nt, Homo Sapiens
aaaagcccguggcaauuaauagcgagacuccgucucaaaaaacacacuccagccugggugacag

SEQ ID NO: 86641 - RNA, 64 nt, Homo Sapiens
acaaaaaaaaaaacaaaaaaagcgagacucuaucucaaaaaaaacacuccagccugggcaacag

SEQ ID NO: 86642 - RNA, 64 nt, Homo Sapiens
aaaaaaaauagaauguguauagugagacucugucucaaaaaaaacacuccagccugggcgacag

SEQ ID NO: 86643 - RNA, 64 nt, Homo Sapiens
uaauuguauauuauucaagcaccuuuguugaagcucaaaaaaaaugaugccucuuuaaacuuua

SEQ ID NO: 86644 - RNA, 64 nt, Homo Sapiens
aauuauaggaguauuuauguaacuaucuuaugcuucaaaaaacaaaaguauuugugugcaugug

SEQ ID NO: 86645 - RNA, 64 nt, Homo Sapiens
guaauuaauccauuccuggcauaaaaagucuuuaucaaaaaaaauuguagaugcuugcuuuuug

SEQ ID NO: 86646 - RNA, 64 nt, Homo Sapiens
ugcaucauaguucuacaguuuguuuuuguuuucuucaaaaaagcuguaagagaauuaucugcaa

SEQ ID NO: 86647 - RNA, 64 nt, Homo Sapiens
aaauauaguuuuguauaauagcauagauuuuccuucaaaaaaugaacauuuauauaucuacaaa

SEQ ID NO: 86648 - RNA, 64 nt, Homo Sapiens
aaauggugggauuuuuuuuuaucaugauuaaauaucaaaaaauugcccuaugaaaacuuuaaau

SEQ ID NO: 86649 - RNA, 64 nt, Homo Sapiens
aaaaacaccuaaaauuugaaaaaugauuguaggaucaaaaaaggcagaugaaauuacuuaauac

SEQ ID NO: 86650 - RNA, 64 nt, Homo Sapiens
uacauucauuuuuagguggagagacaauugcaugucaaaaaaugauagguaucagagcagucua

SEQ ID NO: 86651 - RNA, 64 nt, Homo Sapiens
cauugauacucauuaaugcaauuuucuuaugaaaucaaaaaaugcaauuuuauaucacaguuuu

SEQ ID NO: 86652 - RNA, 64 nt, Homo Sapiens
cuaaaacuuuggcugggcauaacuuuugagugccucaaaaaaugauggugacucugaugcucuc

SEQ ID NO: 86653 - RNA, 64 nt, Homo Sapiens
aaaaaaaaaaaaaagacauuagcaagacuccgucucaaaaaaaacacuccagccuaggcaacag

SEQ ID NO: 86654 - RNA, 62 nt, Homo Sapiens
acauuuuuauuaguggauagcguuguuggaauucaaaaaacagacaauauugccauagaaau

SEQ ID NO: 86655 - RNA, 64 nt, Homo Sapiens
gucuugacuaaugguucccgguuuagcugaagauucaaaaaaaaaaaaaaaagcuuuaugcuaa

SEQ ID NO: 86656 - RNA, 64 nt, Homo Sapiens
uucuuugccauuuccuagauuaaucaauccugucucaaaaaaugcaagaauccucuugagccag

SEQ ID NO: 86657 - RNA, 64 nt, Homo Sapiens
ugcugucaaggcuugaagagaagguucuuuuaugucaaaaaaccggauucaaucuucuuaucag

SEQ ID NO: 86658 - RNA, 64 nt, Homo Sapiens
uuuucuuuuuuuaacugcaaucuuauuucuuuucucaaaaaaaucucuauacuuugucucugug

SEQ ID NO: 86659 - RNA, 64 nt, Homo Sapiens
aaaaaaaaaaaaguggcucuagcaagacucugacucaaaaaaaacacuccagucugggcgacag

SEQ ID NO: 86660 - RNA, 64 nt, Homo Sapiens
aaaaaaaaaaaaaaaaagagagugagacuccaucucaaaaaaaacacuccagccugggcaacag

SEQ ID NO: 86661 - RNA, 64 nt, Homo Sapiens
agccaggugugguggcaugucuccacaaaaaaauucaaaaaauuacaucaugacgaaaccccau

SEQ ID NO: 86662 - RNA, 64 nt, Homo Sapiens
aaaaaaagaaaagaaaaagaagccagacucugucucaaaaaaaacacuccagccugggugacag

SEQ ID NO: 86663 - RNA, 64 nt, Homo Sapiens
uauauuuaaaaaauaaaaauagagagacccugucucaaaaaauacacuccagucuggaugacag

SEQ ID NO: 86664 - RNA, 64 nt, Homo Sapiens
uuaauuaaguacaaccaacccauagcuuugcacuucaaaaaagcuuucaagcucaucuguuaug

SEQ ID NO: 86665 - RNA, 64 nt, Homo Sapiens
aaaaaaaaaaaacuucaguaagcgagacuugguuucaaaaaaaaacacuccagccuggcgacag

SEQ ID NO: 86666 - RNA, 64 nt, Homo Sapiens
ugaccaaaacaaacaaacagacuaugaagauguuucaaaaaaucuucaguuuucaggaugauac

SEQ ID NO: 86667 - RNA, 64 nt, Homo Sapiens
ucuuuauucaaaugaaaacauguuugaugacuggucaaaaaauaagcucauaaucuauuuuuuu

SEQ ID NO: 86668 - RNA, 64 nt, Homo Sapiens
cacuccagccugggcaacaaagugagacuccaucucaaaaaaaaaaaaaaaaaaaaaaaaaaaa

SEQ ID NO: 86669 - RNA, 64 nt, Homo Sapiens
aaaaaaaaaaaggagagaagagugagacccugucucaaaaaaaacacuccagccugggcaacag

SEQ ID NO: 86670 - RNA, 64 nt, Homo Sapiens
caaaaauuagcuaggcauggggcuaaauccguguucaaaaaauagagggcagccugggaaacau

SEQ ID NO: 86671 - RNA, 64 nt, Homo Sapiens
guuuauaucacauagacauaucuuuauuuauuuuucaaaaaaauuuuaaguuaauugaacuuuu

SEQ ID NO: 86672 - RNA, 64 nt, Homo Sapiens
cucauuucuuuuugaagugauagaaaauugaaugucaaaaaaagcauauaugagacuugaaucg

SEQ ID NO: 86673 - RNA, 64 nt, Homo Sapiens
cagagauauuacucuuugauauugcuaaaacauuucaaaaaacuguuuagcaguacaagcuucu

SEQ ID NO: 86674 - RNA, 64 nt, Homo Sapiens
auaaaaagaaucuuaaaauaagcgagacuccaucucaaaaaaaaacuccagccucggugacaag

SEQ ID NO: 86675 - RNA, 64 nt, Homo Sapiens
ggguuauaagacauugcuuuauuacauauaaacuucaaaaaaguagcucauaaauaauuggcuu

SEQ ID NO: 86676 - RNA, 64 nt, Homo Sapiens
ugcacuccagucuggguaacagggagacugcaucucaaaaaaaaaaaaaaaaaaaaaaaagggc

SEQ ID NO: 86677 - RNA, 64 nt, Homo Sapiens
aaaaaaaagggcuguccauguauucacacaccccucaaaaaaagccuuuaguuccuacuuuagc

SEQ ID NO: 86678 - RNA, 64 nt, Homo Sapiens
gaaaauacugguugaaauuuucagaugauagaccucaaaaaaucuauuguuugccacugagggu

SEQ ID NO: 86679 - RNA, 64 nt, Homo Sapiens
aaaaaaaaggcauucuaguaagugagaccccaucucaaaaaagagcauuccugcugagcaacag

SEQ ID NO: 86680 - RNA, 64 nt, Homo Sapiens
uauuuguuuuuguuacgugucgacacccgugugcucaaaaaaguguaugccgguccuacucacg

SEQ ID NO: 86681 - RNA, 64 nt, Homo Sapiens
uugccuuuaaauuccugggucccccuguuguuugucaaaaaaaauccucuuuaucaugcuuuuu

SEQ ID NO: 86682 - RNA, 64 nt, Homo Sapiens
cacuccagccugggugauagagcaagaccccaacucaaaaaaaaaaaaaaggaucccacgguuc

SEQ ID NO: 86683 - RNA, 64 nt, Homo Sapiens
cacuccagccugggcgacagagcaagacuccaucucaaaaaaaaaguuaauuaauuaauuagau

SEQ ID NO: 86684 - RNA, 64 nt, Homo Sapiens
caagcccuacuuuggccaacauccugcuuauuucucaaaaaagagggacagugaaaacaaaaac

SEQ ID NO: 86685 - RNA, 64 nt, Homo Sapiens
gcacuccagccugggugacuagcaaaacuccaucucaaaaaaaaaaaaaagaaagaaagaaacu

SEQ ID NO: 86686 - RNA, 64 nt, Homo Sapiens
uuugauaugauaauaaucaugaucacaacugagaucaaaaaaauauaugacagauuauuuuguu

SEQ ID NO: 86687 - RNA, 64 nt, Homo Sapiens
cacuccagccugggcgacagagcaagacuccgucucaaaaaaaaaaaaaaaaaaaaaaaaagag

SEQ ID NO: 86688 - RNA, 64 nt, Homo Sapiens
aaaagagagagagagagaaaagugagacuccaucucaaaaaaaacacuccagccugggucacag

SEQ ID NO: 86689 - RNA, 64 nt, Homo Sapiens
aaagauucugugucagagccagugagacccugucucaaaaaaaacacuccggccugggugacag

SEQ ID NO: 86690 - RNA, 64 nt, Homo Sapiens
aaaaaaauuacaaauggggcagcaaaacuccgucucaaaaaaaaacuccagccugggcaacaag

SEQ ID NO: 86691 - RNA, 64 nt, Homo Sapiens
cucucccaggaccucggaugucuaagugggacauucaaaaaacuaacucccucucugugcauuu

SEQ ID NO: 86692 - RNA, 64 nt, Homo Sapiens
uuauaguagaaacguaauugauugugauuguaacucaaaaaaauucaaaagauguucugauaac

SEQ ID NO: 86693 - RNA, 64 nt, Homo Sapiens
auuagcauuggacaucuuaacauaugaaaaaacaucaaaaaacaaaaugcucuguaugucacua

SEQ ID NO: 86694 - RNA, 64 nt, Homo Sapiens
aaaaaaauucagauugcugaaccgagacacugucucaaaaaaauacacuccagccugaugacag

SEQ ID NO: 86695 - RNA, 64 nt, Homo Sapiens
gcagacuggccaggcacaguagcaaaacccugucucaaaaaaaucauuccagccuggaugacag

SEQ ID NO: 86696 - RNA, 64 nt, Homo Sapiens
ucaguauuaagguuuucauguggaaaggugucauucaaaaaaaaaguaauuggcauacauauuc

SEQ ID NO: 86697 - RNA, 64 nt, Homo Sapiens
ucuuaauguuucugguuaugacagauaaguuugcucaaaaaauguggaugaagccauuauuguu

SEQ ID NO: 86698 - RNA, 64 nt, Homo Sapiens
uacuaccaacccugaacgucucaggacaaauaauucaaaaaagagaucuacauuuucuggaaaa

SEQ ID NO: 86699 - RNA, 64 nt, Homo Sapiens
cacucuagccugggcaaccaagagugaaacugucucaaaaaacaacuuuuaucaaugucugcaa

SEQ ID NO: 86700 - RNA, 64 nt, Homo Sapiens
cacuccagccugggugacagagcgacccucugucucaaaaaauaauaauaauaauaaauaaaac

SEQ ID NO: 86701 - RNA, 64 nt, Homo Sapiens
acaagacuuuugagcaaucugaauuaaaaauacaucaaaaaaguaauagcgcucauuugcuaaa

SEQ ID NO: 86702 - RNA, 64 nt, Homo Sapiens
acuccagccugggugacaagagugaaacuccaucucaaaaaaaaagaaaagaagguccagcuuu

SEQ ID NO: 86703 - RNA, 64 nt, Homo Sapiens
ccacuuaacacuuugauuagcaugaacuugccaaucaaaaaaugacaaucaauuugagaaaaua

SEQ ID NO: 86704 - RNA, 64 nt, Homo Sapiens
acuccagccugggcgacaagagcaaaacuccgucucaaaaaaaaaaaaaagauacaaagucugc

SEQ ID NO: 86705 - RNA, 64 nt, Homo Sapiens
guucaucguuugccuagcaugucccuguggcgucucaaaaaaaaguuucaucgucccgucauug

SEQ ID NO: 86706 - RNA, 64 nt, Homo Sapiens
ugguuuacuuaauacaaaaaaaaaaaaaagaauuucaaaaaaaaaaguuguuugcuuaaaaaaa

SEQ ID NO: 86707 - RNA, 64 nt, Homo Sapiens
cuguccagccugggugacagagcaagacugcguuucaaaaaaaaaaaaaaaaaaacccauuaaa

SEQ ID NO: 86708 - RNA, 64 nt, Homo Sapiens
cacuccagucugggugacagagcaagacuccaucucaaaaaauaaauaaauagaaagagagaga

SEQ ID NO: 86709 - RNA, 64 nt, Homo Sapiens
cacucuagucugggugacagagcgagacucugucucaaaaaaaaaaaaauaaagccgggcgugg

SEQ ID NO: 86710 - RNA, 64 nt, Homo Sapiens
gugcuccagccugagcaacaagagcgaaacugucucaaaaaaaagaagaaaauaaauaaauaaa

SEQ ID NO: 86711 - RNA, 64 nt, Homo Sapiens
auuaaauaaauuauuauaacagugagacucugucucaaaaaaaacacuccagccugggugacag

SEQ ID NO: 86712 - RNA, 64 nt, Homo Sapiens
auuaaaauaaauuuaaauacagcaagacucugccucaaaaaaaacacuccagccugggcaacag

SEQ ID NO: 86713 - RNA, 64 nt, Homo Sapiens
ugcuauuguuuagacuuuccauuucauuuguacuucaaaaaauaagcugaaccagugucuuuac

SEQ ID NO: 86714 - RNA, 64 nt, Homo Sapiens
cagcagcaauugaaaugcuauggaaacaguaucuucaaaaaaauaguauauuaagacaugcuga

SEQ ID NO: 86715 - RNA, 64 nt, Homo Sapiens
gucuuuacaaaaaaacaaaacuaaaucuacuguuucaaaaaaguaaaugacacaaaugacuggg

SEQ ID NO: 86716 - RNA, 64 nt, Homo Sapiens
agacaguuuauuaaaaaugacaaaaaacaaacaaucaaaaaaaacuaaaacauuuacagaguua

SEQ ID NO: 86717 - RNA, 64 nt, Homo Sapiens
aaaaaacaacaaaaacuuagaacaagacccugucucaaaaaaaaacuccagccuggggugauag

SEQ ID NO: 86718 - RNA, 64 nt, Homo Sapiens
aaaaaaaauccacucauauaagcaagacuccauuucaaaaaaaauacuccagccugggcgacag

SEQ ID NO: 86719 - RNA, 64 nt, Homo Sapiens
aaaaaaaaagagagagagagagugagaccuuaucucaaaaaaaacacugaagccuggaugacag

SEQ ID NO: 86720 - RNA, 64 nt, Homo Sapiens
aaaaagucacuuuuggcuaaagggagacuccaucucaaaaaaaacacuccagccugggcaacag

SEQ ID NO: 86721 - RNA, 64 nt, Homo Sapiens
uauuuuuauagaauuuuuguuuuauguuaaugacucaaaaaagggcugcugcuguuuucuucau

SEQ ID NO: 86722 - RNA, 64 nt, Homo Sapiens
aaugauuuugcugcagacuuccccgaccccagcaucaaaaaacccgucaacccacugccuccca

SEQ ID NO: 86723 - RNA, 64 nt, Homo Sapiens
cacuccagccuggguaacagagugagacuccaucucaaaaaaaaaaaaaauagauauuuuucca

SEQ ID NO: 86724 - RNA, 64 nt, Homo Sapiens
guacagcuauuguggaaaacaguguagagguuucucaaaaaauuaaaacuaucauacaacccag

SEQ ID NO: 86725 - RNA, 64 nt, Homo Sapiens
guugaauauuugucugaacauuuuauuucaaaguucaaaaaaacagaggcugcaaaauucauuu

SEQ ID NO: 86726 - RNA, 64 nt, Homo Sapiens
ggauuuuauuuuaaugugacuagaugucaccacuucaaaaaaucaauuuguucuuagaaccugg

SEQ ID NO: 86727 - RNA, 64 nt, Homo Sapiens
uuccuuguaauuauacuuaagaucuucaauuucuucaaaaaaugaaggaucaaaauuuuccagu

SEQ ID NO: 86728 - RNA, 64 nt, Homo Sapiens
gggaacuauaaccuuaggauuccugaaaagaauuucaaaaaaaaaauaaagacacuguugccaa

SEQ ID NO: 86729 - RNA, 64 nt, Homo Sapiens
aaaaagaaaaaagaaagaaaagcgaaccucugucucaaaaaaaacacuccagccggggugacag

SEQ ID NO: 86730 - RNA, 64 nt, Homo Sapiens
aaaaacaaaaacaaacaaacaguaagacucugucucaaaaaaaauacuccagcuugggcaacag

SEQ ID NO: 86731 - RNA, 64 nt, Homo Sapiens
guccagauuccacgugcagcagccuuaaaguuuaucaaaaaauuguuucuguaaauuauuuagc

SEQ ID NO: 86732 - RNA, 64 nt, Homo Sapiens
aaauugcuaugcaaucuugauuaggauaaccauuucaaaaaauaucugaauuuaaggaaauucu

SEQ ID NO: 86733 - RNA, 64 nt, Homo Sapiens
aaaauaauaauaaaauaaguagcaagacucugucucaaaaaaaacacuccagccugggcgacag

SEQ ID NO: 86734 - RNA, 64 nt, Homo Sapiens
aaaaaaagaaaaaaaagcacagcgaaacucugucucaaaaaagaauuccagccugggcaacaaa

SEQ ID NO: 86735 - RNA, 64 nt, Homo Sapiens
aaaaaagagguggguggauuagcgaaacucugucucaaaaaaaaacuccagccugggcaacaag

SEQ ID NO: 86736 - RNA, 64 nt, Homo Sapiens
gaaaaggagagaaaguaacuguuuacucaaucauucaaaaaagaccaggcuacacacagaaaau

SEQ ID NO: 86737 - RNA, 64 nt, Homo Sapiens
auuggaccuaaauaauuagacaaagaaauaugucucaaaaaacuguuaaaaaaaaaaaaagaua

SEQ ID NO: 86738 - RNA, 64 nt, Homo Sapiens
caugccgcugcacuccagccugggagacugcaucucaaaaaagaaaaauaaacgaaguaaaaga

SEQ ID NO: 86739 - RNA, 64 nt, Homo Sapiens
ucuccagccugcaugacgggagugagacaccaucucaaaaaauacauauaauaauauaaauaaa

SEQ ID NO: 86740 - RNA, 64 nt, Homo Sapiens
uuaaaaaagaaguaacuugcgugucaccaaaucaucaaaaaaccuaaaagguuauauucuaguu

SEQ ID NO: 86741 - RNA, 64 nt, Homo Sapiens
aaaaaaaaaaaaaaggaaaaagugagacuccgucucaaaaaaaacacuccagccuggaugacag

SEQ ID NO: 86742 - RNA, 64 nt, Homo Sapiens
cacaguacuccauuuuggggucuucuagcaucucucaaaaaauuaaguuuacuguuucuucugu

SEQ ID NO: 86743 - RNA, 64 nt, Homo Sapiens
cuuggagugcuugccuuuccaaagccaaaaggaaucaaaaaaucauaauuucauuuucuuggcc

SEQ ID NO: 86744 - RNA, 64 nt, Homo Sapiens
aaaaagagaagaaaaacugcagaacaagacugucucaaaaaaaaugcacuccagccugggugac

SEQ ID NO: 86745 - RNA, 64 nt, Homo Sapiens
uuuucugugaagugcuagaacaguagaguaggagucaaaaaaccaugggucagugacacugaaa

SEQ ID NO: 86746 - RNA, 64 nt, Homo Sapiens
uuuuuggucauuaaaucgaaugacaaccagggauucaaaaaaaacuggguuaagcuaccaaaaa

SEQ ID NO: 86747 - RNA, 64 nt, Homo Sapiens
aaaaauaaaaaaauaaaaacagccagaccuugucucaaaaaauacugcagccugagagagagag

SEQ ID NO: 86748 - RNA, 64 nt, Homo Sapiens
uauguaugcauucaccuugccucuugcacaaaugucaaaaaaaagaugguaauaucucaaagaa

SEQ ID NO: 86749 - RNA, 64 nt, Homo Sapiens
aauguuuuucaaccagcaccuaaaaagacucuuuucaaaaaaucacagaaacaaccuaggacaa

SEQ ID NO: 86750 - RNA, 64 nt, Homo Sapiens
aaaaaaaagaguuaaucuagagugaaacuccaccucaaaaaaaaacuccagccugggcgacaag

SEQ ID NO: 86751 - RNA, 64 nt, Homo Sapiens
aaaaaaaaacucagcuucuuagugagacuccgucucaaaaaaaagcacuccagccuggugacag

SEQ ID NO: 86752 - RNA, 64 nt, Homo Sapiens
aauauguguacaauuaaaaucagaaacuaaauuuucaaaaaauuagaucuguucaauuauuuuu

SEQ ID NO: 86753 - RNA, 64 nt, Homo Sapiens
aauggacuguaaccaguugcauggaacuaaaugaucaaaaaaagaaaguacauuaugcuuuuua

SEQ ID NO: 86754 - RNA, 64 nt, Homo Sapiens
cacuccagucggguuaacagagcaagacacugucucaaaaaaaaaaaaaaaaaaaaguaucaac

SEQ ID NO: 86755 - RNA, 64 nt, Homo Sapiens
uauugaaugagugaaccagaaaauuagaagauggucaaaaaaaguccaaguuaccaauuuuuua

SEQ ID NO: 86756 - RNA, 64 nt, Homo Sapiens
ugcacuccagccuggcgacagagcaaggcuccacucaaaaaaaagauuuaaaggggaaaaaauu

SEQ ID NO: 86757 - RNA, 64 nt, Homo Sapiens
ugcacaucagccugagugacagagagacuuugucucaaaaaaaaaagaaaauuuuaauuuuaau

SEQ ID NO: 86758 - RNA, 64 nt, Homo Sapiens
auugugacccuugccagaaaaacauugcacagcuucaaaaaaacagcguuuuucccaggcagau

SEQ ID NO: 86759 - RNA, 64 nt, Homo Sapiens
aaaagaaaaaaaagaaguacagugaaacuccgucucaaaaaaaaacuccauccuggacaacagg

SEQ ID NO: 86760 - RNA, 64 nt, Homo Sapiens
cacuccagccugggcgacagagugagacuccgucucaaaaaaaaaaagaagguuguacccacag

SEQ ID NO: 86761 - RNA, 64 nt, Homo Sapiens
cacuccagccugggcaacacagggagacuccaucucaaaaaaaaaaaaaaaaaaaaaaagacau

SEQ ID NO: 86762 - RNA, 64 nt, Homo Sapiens
cacuccagccugggcgauagagcuagacucugucucaaaaaaaaaacaaaaaacaaguaacucu

SEQ ID NO: 86763 - RNA, 64 nt, Homo Sapiens
cacuccagccugggugacagagcgagacuccgucucaaaaaaaaaaaaaaauucggccaggugc

SEQ ID NO: 86764 - RNA, 64 nt, Homo Sapiens
acaaaaacgguaagcuuuuaaauaaaacucugucucaaaaaaaacacuccagccugggcgacug

SEQ ID NO: 86765 - RNA, 64 nt, Homo Sapiens
uguuaaacaucauucuuaucuuuauuuuauauuuucaaaaaaauuuuacuaaaaugauauaggg

SEQ ID NO: 86766 - RNA, 64 nt, Homo Sapiens
cacuccagccugggcgacagggcaagacucugucucaaaaaaaauaaaaaacugaccaucuagu

SEQ ID NO: 86767 - RNA, 64 nt, Homo Sapiens
aauacucauuuuuuaaguguaauuaaguugaagaucaaaaaauggaaauguauaauuaaaucau

SEQ ID NO: 86768 - RNA, 64 nt, Homo Sapiens
acuucacaauuauaauaaauguguggaaaagucuucaaaaaaauuucacaccuugcaaaaggag

SEQ ID NO: 86769 - RNA, 64 nt, Homo Sapiens
ucugcccaaaggcuccuagaucugauaaacaacuucaaaaaaguuucaggauacaaaaucugug

SEQ ID NO: 86770 - RNA, 64 nt, Homo Sapiens
aaaaaauaaaaaaucuaaggaaugagacucugugucaaaaaaaucacuucagccugggugacag

SEQ ID NO: 86771 - RNA, 64 nt, Homo Sapiens
agggggggcgggggacggguagcaagacucuguuucaaaaaaaauacgccaaccugggucacau

SEQ ID NO: 86772 - RNA, 64 nt, Homo Sapiens
guuuuuauaaugaaguuguuacagaauuacauuuucaaaaaaagaguagauuuuucaauguuuu

SEQ ID NO: 86773 - RNA, 64 nt, Homo Sapiens
aaauuccagugucuguauacuuucagagcuggguucaaaaaaaaccccaugaaggcagcugagc

SEQ ID NO: 86774 - RNA, 64 nt, Homo Sapiens
acuccagccugggcaacaagagcaaaauucugccucaaaaaaaaaaauaguaauaauacaaaaa

SEQ ID NO: 86775 - RNA, 64 nt, Homo Sapiens
cacucaagcuuggaugacagagcaagacuccguuucaaaaaaaaaaaaccuccucucuuccuuc

SEQ ID NO: 86776 - RNA, 64 nt, Homo Sapiens
aauaaacuucauuuuaaccuaaaaaaucaaaaaaucaaaaaaauuuuaaaaaaacaaaaaacaa

SEQ ID NO: 86777 - RNA, 64 nt, Homo Sapiens
aaaaaaauaauaaacuucauaaaaacaaaaaaaaucaaaaaauccaguuuuauuuaaaaaaaca

SEQ ID NO: 86778 - RNA, 64 nt, Homo Sapiens
auaauugguucuggcaaguuuggccagacugacuucaaaaaauuaauguguauccagggacauu

SEQ ID NO: 86779 - RNA, 64 nt, Homo Sapiens
uguacuccagccugggcaacagcgagacuccaucucaaaaaaaaaggaaauguguaucaagaac

SEQ ID NO: 86780 - RNA, 64 nt, Homo Sapiens
agugcuuccaguagauuuuagaacauucuuugccucaaaaaaccugcaaagaugaugugagauu

SEQ ID NO: 86781 - RNA, 64 nt, Homo Sapiens
ccuacaacugcaaaacgucuuacugaaccaacaaucaaaaaaugguucuguuuuaaaaaggauu

SEQ ID NO: 86782 - RNA, 64 nt, Homo Sapiens
aauaaauaaaauaaauucuuagugaaacuccaucucaaaaaauaugcacuccagccugggcaac

SEQ ID NO: 86783 - RNA, 64 nt, Homo Sapiens
auaauauuuucaccauccagaaaaaccuuaaaugucaaaaaaaauaaaaaaaaaacaaaaacaa

SEQ ID NO: 86784 - RNA, 64 nt, Homo Sapiens
aaaaaaaaguaagaaagaaaagcgagacuccaucucaaaaaaaagcacuccagccuggcaacag

SEQ ID NO: 86785 - RNA, 64 nt, Homo Sapiens
guaucucuaaauacaggauuagugagacucugucucaaaaaaaacgcuccagccugagugauag

SEQ ID NO: 86786 - RNA, 64 nt, Homo Sapiens
uugggaccaaaaaaugcacuuaaagauaauauauucaaaaaauaauuaauguaauuccucugga

SEQ ID NO: 86787 - RNA, 64 nt, Homo Sapiens
uccaggguacuccuggacaggcaacacauaaguuucaaaaaauacauauuuuucaaaugaagaa

SEQ ID NO: 86788 - RNA, 64 nt, Homo Sapiens
ucacauaugcucccuaaaaaaccauuuucuucuucccuuugaucaagcaccaucugaaaggggc

SEQ ID NO: 86789 - RNA, 64 nt, Homo Sapiens
uuuuuggauaaaagaugaugacuuuccuauauugcccuuugaaauuuuuauguaaauuuguaau

SEQ ID NO: 86790 - RNA, 64 nt, Homo Sapiens
aaagacuccaguuaaaaaaauacgaauacuuuugcccuuugauuuuuuguuuuucauucagucu

SEQ ID NO: 86791 - RNA, 64 nt, Homo Sapiens
gcaguccugaucagagccguagaugcuccuugggcccuuugaguugugcagccgcugagcgagg

SEQ ID NO: 86792 - RNA, 64 nt, Homo Sapiens
aaauugacagcagugacuugaaaaugauucugcucccuuugaaagcauucauuuugcuagaacu

SEQ ID NO: 86793 - RNA, 64 nt, Homo Sapiens
ugcuguauugaaaguaggaauauaguuuuaaaaacccuuugaacaaagugugugcauaaccagu

SEQ ID NO: 86794 - RNA, 64 nt, Homo Sapiens
guaacaaguuaagaaaauuuugacugaagaaagacccuuugaagucaccauuaggcaggguguu

SEQ ID NO: 86795 - RNA, 64 nt, Homo Sapiens
auaucccaaaggauagucuuaaaaggcaaauguacccuuugaccuaaaagaugcaaacauuaca

SEQ ID NO: 86796 - RNA, 64 nt, Homo Sapiens
uugcauuagugauuaugauuaacauuuaaaaaauuaagaguauuuauuuaaaaacgagaaauac

SEQ ID NO: 86797 - RNA, 64 nt, Homo Sapiens
uagaggacacugauuaguugggcuguugccaaaauaagaguauuuucuaaaaguuaaccuugug

SEQ ID NO: 86798 - RNA, 64 nt, Homo Sapiens
acuguaauggccucaagauagagagauacccuuauaagaguaaagaauuaagaugauagucaac

SEQ ID NO: 86799 - RNA, 64 nt, Homo Sapiens
caacacuggaaaugaguucuggguaagugaguuauaagaguacaugcucuaguaacucugguag

SEQ ID NO: 86800 - RNA, 64 nt, Homo Sapiens
aaagggcccugguaaaauaguggaucucaguuuuuaagaguacaagcucuuguuucuguuuagu

SEQ ID NO: 86801 - RNA, 64 nt, Homo Sapiens
aaguuuccuuuuaauucuaccaaccccagauaaguaagaguacuauuaauagaacacagagugu

SEQ ID NO: 86802 - RNA, 64 nt, Homo Sapiens
caucccccccucaggcuugaaaguccucaaagagacccacuaucccauaucacugcccagaggg

SEQ ID NO: 86803 - RNA, 64 nt, Homo Sapiens
aaugacuucuuugcuauuuugguuuugcaaaaagacccacuaucaaggaaugcugcaugugcua

SEQ ID NO: 86804 - RNA, 64 nt, Homo Sapiens
ggaggcccuuuacauagaaaacagcauucuuuuugccaaauaugaccaaauuacuuuuauuuau

SEQ ID NO: 86805 - RNA, 64 nt, Homo Sapiens
ccuuggucuugaauuuccuagccucuacaacuaagccaaauaaauuucuguuuauuauaaauaa

SEQ ID NO: 86806 - RNA, 64 nt, Homo Sapiens
uggacuucauagacacaaaggcuucgaagcacaagccaaauaugucaauauuuguauguaagaa

SEQ ID NO: 86807 - RNA, 64 nt, Homo Sapiens
auacaggcucauuuucaugcaaauucuuccuagagccaaauaaauaaagacuuaggugaauuag

SEQ ID NO: 86808 - RNA, 64 nt, Homo Sapiens
uauuccuuuugccuaaguuuaaagucaaaauguugccaaauauucuaaucucagauuggcaguu

SEQ ID NO: 86809 - RNA, 64 nt, Homo Sapiens
acaccuucugaucuuagccaaugugucaggugcagccaaauaucgaagcuaucuuaaaucugug

SEQ ID NO: 86810 - RNA, 64 nt, Homo Sapiens
ccucuuuucuuucuaaaaauaugcagaacagugagccaaauaaacaugcuuccuauacaguucu

SEQ ID NO: 86811 - RNA, 64 nt, Homo Sapiens
uccauuuuuuuuuuuuuuuuaaaaggagguaaucgccaaauaguaaugguuuuuaaguacuugg

SEQ ID NO: 86812 - RNA, 64 nt, Homo Sapiens
uaugugcacuuugcacuagaauaguaauggaggugccaaauaaugggaaaacaagaggccaaau

SEQ ID NO: 86813 - RNA, 64 nt, Homo Sapiens
guaauggaggugccaaauaaggggaaaacaagaggccaaauauauuuaggcacagcuauuuaua

SEQ ID NO: 86814 - RNA, 64 nt, Homo Sapiens
ggucucugccccaggcauggugcucuauaucuuggccaaauaaauuacuuuccuugaauaucca

SEQ ID NO: 86815 - RNA, 64 nt, Homo Sapiens
aagcaagaguauuuggagcaagaagcugcaaugcgccaaauacacaauaggccuuuucuuuauc

SEQ ID NO: 86816 - RNA, 64 nt, Homo Sapiens
aaagcaccauuuuuuucuucgagcauccuauagugccaaauaaugguaucuucugaauguucaa

SEQ ID NO: 86817 - RNA, 64 nt, Homo Sapiens
aucuuuaggauauauuuacauuugaaaaaaaucugccaaauagcguacuuuugagcuacuauua

SEQ ID NO: 86818 - RNA, 64 nt, Homo Sapiens
agauuagguaaaaugagauuuuaauucuuaaguggccaaauaacuugucuuugauacauuuauu

SEQ ID NO: 86819 - RNA, 64 nt, Homo Sapiens
uaacacuaaugcuuuguuuaugcuaauacuaauagccaaauagaguuaaauauuguagauaaau

SEQ ID NO: 86820 - RNA, 64 nt, Homo Sapiens
gugcagccgcagaauaugcauaaccagggaaccagccaaauacuauacggaacgacucacuuaa

SEQ ID NO: 86821 - RNA, 64 nt, Homo Sapiens
uucucaguauuuggaacuaauucaaaggaauugggccaaauauaucauuaaucuaaagacagag

SEQ ID NO: 86822 - RNA, 64 nt, Homo Sapiens
ggccuuccuuacuuaaugucuucuuuucccuacucuaaugcauuucuaacucacuuuggagcuu

SEQ ID NO: 86823 - RNA, 64 nt, Homo Sapiens
ucgaaacugccaagggugcuggugcggauggacacuaaugcagccacgauuggagaauacuuug

SEQ ID NO: 86824 - RNA, 64 nt, Homo Sapiens
cugaagaucaugcuauauuuuauauaugaagccccuaaugcaaagcucuuuaccucuugcuauu

SEQ ID NO: 86825 - RNA, 64 nt, Homo Sapiens
uuguuuucuccuugcuuuaagcagugaaguuauccuaaugcaaaagagcuuaguagaaaaugag

SEQ ID NO: 86826 - RNA, 64 nt, Homo Sapiens
uguguggacaucaguaggcaaguaaccaguuuuacuaaugcauucaucgcucaucuucauugcu

SEQ ID NO: 86827 - RNA, 64 nt, Homo Sapiens
cucagaccgaaggugcugccuucauccuccccaccuaaugcauuuuugaaaccaaagguaccua

SEQ ID NO: 86828 - RNA, 64 nt, Homo Sapiens
cccaaugugacaaauuuguuuuuuuuccuguuuucuaaugcagguguuuuuuuuuuucuuuuuc

SEQ ID NO: 86829 - RNA, 64 nt, Homo Sapiens
acaaguucugucuugggcuuuuguaugguaguugcuaaugcagagagucccucuaguggccauu

SEQ ID NO: 86830 - RNA, 64 nt, Homo Sapiens
guguaugauaacaaaaacucgauuccugcagccacuaaugcauugacgguagcuuuuggaggaa

SEQ ID NO: 86831 - RNA, 64 nt, Homo Sapiens
uguugcauaauagccugcauacagcucaauggaacuaaugcagaugaaaccuauuaccguacuc

SEQ ID NO: 86832 - RNA, 64 nt, Homo Sapiens
ugagagauaagcuucggcagaaacaaaaaauuuccuaaugcaucguuuucaguguugcugagag

SEQ ID NO: 86833 - RNA, 64 nt, Homo Sapiens
aaaaauauuuuuauuuaaauccaccugacuuccccuaaugcauuuaauuguuuuuacaaagaau

SEQ ID NO: 86834 - RNA, 64 nt, Homo Sapiens
gacuagaagccucaguuuccugagugagggaccccuaaugcaggaguggggagagguugggcag

SEQ ID NO: 86835 - RNA, 64 nt, Homo Sapiens
ugccucagagauuccccuacuuauuucaaacucucuaaugcacccuuuccaaacacugaaggau

SEQ ID NO: 86836 - RNA, 64 nt, Homo Sapiens
guuuaccuuaccccacacccccucaacauguagacuaaugcagccauuggugguacauuuauuu

SEQ ID NO: 86837 - RNA, 64 nt, Homo Sapiens
ggggaaaauaaacuuaacucuacaaaagcaaacucuaaugcaugcaagaaucauuagguuggca

SEQ ID NO: 86838 - RNA, 64 nt, Homo Sapiens
ggaaauuggacaguuuugauacaaacuuuguuugcuaaugcacugaugagucuaguuucauuau

SEQ ID NO: 86839 - RNA, 64 nt, Homo Sapiens
ggguucagucucaugccauauuuacuccuaguaccuaaugcagugccuggcacacagcaagugc

SEQ ID NO: 86840 - RNA, 64 nt, Homo Sapiens
acugucaugcagauaguauaauuugguauaugugcuaaugcauugaguagaggauuauuuuaac

SEQ ID NO: 86841 - RNA, 64 nt, Homo Sapiens
aaauauuguacaguauugucauguacaagcguaccuaaugcacacuuuaucuuuuauuguacaa

SEQ ID NO: 86842 - RNA, 64 nt, Homo Sapiens
cucaauccguugcaugaaauaauuacuaugugcccuaaugcacacaaauagcuaaggagaaucc

SEQ ID NO: 86843 - RNA, 64 nt, Homo Sapiens
auuauacaauuuuuccuguaauauacuuguaauucuaaugcaaagaggcaaauucgauuugaac

SEQ ID NO: 86844 - RNA, 64 nt, Homo Sapiens
aaagcaaguccuguguuguacacaugcuuugugacuaaugcaaguuugaaguuuucuagauugu

SEQ ID NO: 86845 - RNA, 64 nt, Homo Sapiens
gcuuuuggagacugcuaagugucaaaggagcaggcuaaugcaaacuugcuugcuguucuuuugg

SEQ ID NO: 86846 - RNA, 64 nt, Homo Sapiens
uagaaagaccuuucuccuuggaguuucuuuauuccuaaugcagucgucgggcuagguuauccau

SEQ ID NO: 86847 - RNA, 64 nt, Homo Sapiens
uuaauauugccuaugcugcuuuuaaaggcuaucacuaaugcaugguaucauucauuaaacauag

SEQ ID NO: 86848 - RNA, 64 nt, Homo Sapiens
aauguacagaagauaaaaaaaauuuuguggcucccuaaugcaaucauuuguaaugaugcuacau

SEQ ID NO: 86849 - RNA, 64 nt, Homo Sapiens
ugaagacuuauuacauggcuguuuuaauguaucucuaaugcauuggaaauuucauuucaaauau

SEQ ID NO: 86850 - RNA, 64 nt, Homo Sapiens
cauuucugcaccuuuggggugggaaucuuccagccuaaugcagguaccugccugagccaccuca

SEQ ID NO: 86851 - RNA, 64 nt, Homo Sapiens
uucuuccccagaaauaguaaacuugcagcugccccuaaugcagcauauuuuucuuaccaaagga

SEQ ID NO: 86852 - RNA, 64 nt, Homo Sapiens
gagguauuacaaguugcuaguuuauaaugucuuacuaaugcagaaacaaggaaaaaagcaaaau

SEQ ID NO: 86853 - RNA, 64 nt, Homo Sapiens
uggcaauuggaaaucuuauaaaaacuagucaagccuaaugcaacuggcuaaaggauaguaccac

SEQ ID NO: 86854 - RNA, 64 nt, Homo Sapiens
augguuucaacuaguagguaaucugcuuauauuucuaaugcaaacuuaacaauuguguacuuuu

SEQ ID NO: 86855 - RNA, 64 nt, Homo Sapiens
uauuuguaaaccagauuuguaaauauuuuaugugcuaaugcaugcuguaaagaugucuaggacg

SEQ ID NO: 86856 - RNA, 64 nt, Homo Sapiens
cugggucuggccagggcuuccacauauugagaaccuaaugcacuauuggccacacacugaguug

SEQ ID NO: 86857 - RNA, 64 nt, Homo Sapiens
agauuaucaaaaaguauaaacuaauuggucauuccuaaugcauucaguauccugcugguucacu

SEQ ID NO: 86858 - RNA, 64 nt, Homo Sapiens
uuaaaacauauuucauuuuaucuauagccaacugcuaaugcaaaggcucucaaaguauaaucuu

SEQ ID NO: 86859 - RNA, 64 nt, Homo Sapiens
aaaaaaaaaguauguauucuuucaacugaucaaacuaaugcaaaaugcuuugaagguucugauu

SEQ ID NO: 86860 - RNA, 64 nt, Homo Sapiens
caaucaucuauuacagaugccaggaggauuacaucuaaugcaggcucagcuucuucaccaucaa

SEQ ID NO: 86861 - RNA, 64 nt, Homo Sapiens
aacucuuuuugucacaguuagagaaugagguugacuaaugcauauuaugaauugaguccacaaa

SEQ ID NO: 86862 - RNA, 64 nt, Homo Sapiens
ucugauaaggcucagcugcuuuauaguucucuggcuaaugcagcagauacucuuccugccagug

SEQ ID NO: 86863 - RNA, 64 nt, Homo Sapiens
aaauaauacacauaauuuuuuggacuaaagagugcuaaugcagggaaaauaaguccagaagcac

SEQ ID NO: 86864 - RNA, 64 nt, Homo Sapiens
cacugaugaacaugcaaacucauauuuuuguuaccuaaugcaucacacuauaauaaacugugaa

SEQ ID NO: 86865 - RNA, 64 nt, Homo Sapiens
auugcuagguaaagaggucauaaugaagauuaaccuaaugcagaaaaacagaaaagguucugaa

SEQ ID NO: 86866 - RNA, 64 nt, Homo Sapiens
aaucaacagaaucacucacauuuucuuuuugccucuaaugcagaguuuuguucaaucggguuuc

SEQ ID NO: 86867 - RNA, 64 nt, Homo Sapiens
ggccuugaagcuuacaguauugaagugcccucuccuaaugcagaguagacccugguguuuucuu

SEQ ID NO: 86868 - RNA, 64 nt, Homo Sapiens
gacagauucuaaauauuuugaugccacuuuaacacuaaugcacugaacugcagaaguuuuuuua

SEQ ID NO: 86869 - RNA, 64 nt, Homo Sapiens
gcuaguugccuuuuuaagauuagaaacaguaaugcuaaugcaugauguuuauguugugagcaug

SEQ ID NO: 86870 - RNA, 64 nt, Homo Sapiens
augguuuugcaacuguaauaguagcuguaucguucuaaugcagacauuggauuuggugacuguc

SEQ ID NO: 86871 - RNA, 64 nt, Homo Sapiens
aacuacuuggcauguaagaaauagcgucaguguccuaaugcauauugugacuguuugcauauac

SEQ ID NO: 86872 - RNA, 64 nt, Homo Sapiens
uacuaguaccauuaucuucuuuugccuaaaauuacuaaugcaccacgucagucugcuuccuuca

SEQ ID NO: 86873 - RNA, 64 nt, Homo Sapiens
aacgacuuggcauguaagaaauagcgucaguguccuaaugcauauugugacuguuugcauauac

SEQ ID NO: 86874 - RNA, 64 nt, Homo Sapiens
auccccauucuuucucuuugaaaaaaaaaaaggccuaaugcauuauuuugucauaaaaugcuau

SEQ ID NO: 86875 - RNA, 64 nt, Homo Sapiens
ccacuucacaaaguuuguguggggauuaaaugagcuaaugcagauucauucauucagaaaaauu

SEQ ID NO: 86876 - RNA, 64 nt, Homo Sapiens
guacaaucugcuuauccuugccaagagacagggacuaaugcacuuugcagaaaaggcucaauau

SEQ ID NO: 86877 - RNA, 64 nt, Homo Sapiens
ugacuaggcuuuuuccaaaaacauauaucaugaucuaaugcagaaaauuacaugucagugcauc

SEQ ID NO: 86878 - RNA, 64 nt, Homo Sapiens
uaagaagcugauaaaaucugucuaauuucaaccccuaaugcauuucuuaaaccacaccgaggug

SEQ ID NO: 86879 - RNA, 64 nt, Homo Sapiens
auauuaaacaucauguugaaacaucacuucaagacuaaugcauauuuacauugaauuugacccu

SEQ ID NO: 86880 - RNA, 64 nt, Homo Sapiens
ucucaguucccaccaguaaaauuauccugaguagcuaaugcaccuugagaaaaaucuggcauac

SEQ ID NO: 86881 - RNA, 64 nt, Homo Sapiens
auguccacuugccuuccucuccgaggcaacuacucuaaugcauuugguauguaacuuuaaauuu

SEQ ID NO: 86882 - RNA, 64 nt, Homo Sapiens
aagcaccccugguacucagcacacacaugcuuaccuaaugcaucacugugacaaaagccacacg

SEQ ID NO: 86883 - RNA, 64 nt, Homo Sapiens
aucucaaggugaagaucuaaaugugaacaguuuacuaaugcacuacugaaguuuaaaucugugg

SEQ ID NO: 86884 - RNA, 64 nt, Homo Sapiens
auggaugcaacuagaggcuauuauccuaagcaaccuaaugcaagaacagaaaaccacauacugc

SEQ ID NO: 86885 - RNA, 64 nt, Homo Sapiens
uacauuguuuagguaacuggaguaugcuccuggucuaaugcauuaguaacuagaucggggaucu

SEQ ID NO: 86886 - RNA, 64 nt, Homo Sapiens
cagaauuguggaguguuuuuacauugaucuuuugcuaaugcaauuagcauuauguuuugcaugu

SEQ ID NO: 86887 - RNA, 64 nt, Homo Sapiens
ucuaugauuugaguucaguguuuaaggauucuaccuaaugcagauauauguauauaucuauaua

SEQ ID NO: 86888 - RNA, 64 nt, Homo Sapiens
augguuucuauucuguguuuugaauuuuuauuuucuaaugcaguggaaaagaaacagaucaucc

SEQ ID NO: 86889 - RNA, 64 nt, Homo Sapiens
gggagcagggcauaggaagaaaaugucaguagugcuaaugcauuuugcacuagaacgcuucggg

SEQ ID NO: 86890 - RNA, 64 nt, Homo Sapiens
gguucuuaguguucacaacuuccauaagauacugcuaaugcaccaguauuaaaacacaucgacg

SEQ ID NO: 86891 - RNA, 64 nt, Homo Sapiens
ucugggguagagaagccgagagacccuguccucccuaaugcacuguggcccaguccccuugccu

SEQ ID NO: 86892 - RNA, 64 nt, Homo Sapiens
aggaucuggcaucauacaaaaugaagccagaccacuaaugcauuacaguaguucuugaauacaa

SEQ ID NO: 86893 - RNA, 64 nt, Homo Sapiens
cuuagaacguggguauuuuuuuucuugagaaaagcuaaugcaccuacagauggcccccaacauu

SEQ ID NO: 86894 - RNA, 64 nt, Homo Sapiens
acguagcuuuuccgucuucaccccaaauaaaguccuaaugcaucagccucagcuguuucucuua

SEQ ID NO: 86895 - RNA, 64 nt, Homo Sapiens
uuuucugcuuauaaaugcuaucauuaugaaaaggcuaaugcagcucuuucuguucuuacuuuuu

SEQ ID NO: 86896 - RNA, 64 nt, Homo Sapiens
aaaucgccaggauuuccaaaaaugguuuuguuuucuaaugcaauagggcugucuucagugcuuu

SEQ ID NO: 86897 - RNA, 64 nt, Homo Sapiens
ccuucuaccugguguuuacugucacauauguucucuaaugcagugauucugcaaaccuaacagg

SEQ ID NO: 86898 - RNA, 64 nt, Homo Sapiens
uuuucugugaggaggagggguugcaacuugauagcuaaugcaccuucuuuugcuuugaugauuu

SEQ ID NO: 86899 - RNA, 64 nt, Homo Sapiens
ucuacagcauucaaaugaagaucaauauaaaauacuaaugcaauaauuggucuuaauuuauaua

SEQ ID NO: 86900 - RNA, 64 nt, Homo Sapiens
uaaacauaaaaugucauucaggguuuccugacugcuaaugcagaaaggaaaaucguaaaggaaa

SEQ ID NO: 86901 - RNA, 64 nt, Homo Sapiens
gauuuugauacuaaacugugcguuguacauaguucuaaugcauuguauugaccaccaguacuuc

SEQ ID NO: 86902 - RNA, 64 nt, Homo Sapiens
ugucucccauaagaaaugugcuuuuuagagcuuccuaaugcauguguugcauuauugcagcauu

SEQ ID NO: 86903 - RNA, 64 nt, Homo Sapiens
cauagcagccuuccucucacuacuuuccuggcaucuaaugcaacaaacuuaucacacacacaca

SEQ ID NO: 86904 - RNA, 64 nt, Homo Sapiens
gaaacagagguaaaaaaaagaagugugcgcccggcuaaugcagcgguguggaccgaggaacaac

SEQ ID NO: 86905 - RNA, 64 nt, Homo Sapiens
aucuguuuuucuccuacuuugguaggugaagaaacuaaugcaaauaauucuuaugugcacuaaa

SEQ ID NO: 86906 - RNA, 64 nt, Homo Sapiens
cugucugcucaaugccauugugcagagaagcacccuaaugcauaagcuuuuuaaugcuguaaaa

SEQ ID NO: 86907 - RNA, 64 nt, Homo Sapiens
uuuggagaggggagagguggaaauuccuaaauggcuaaugcacuguucccuccagcccgaaugc

SEQ ID NO: 86908 - RNA, 64 nt, Homo Sapiens
guccuuucuuauggacucgcaggauuuuagaacccuaaugcacccuggaggguagcugggccag

SEQ ID NO: 86909 - RNA, 64 nt, Homo Sapiens
aucucacacuuucaugaguuaugauucucauugacuaaugcaucaaaacugguucaucauggaa

SEQ ID NO: 86910 - RNA, 64 nt, Homo Sapiens
guauggaagcauugggcuggauguucacacugaccuaaugcagaugaccauugggagcaaagcc

SEQ ID NO: 86911 - RNA, 64 nt, Homo Sapiens
ggaugaauaaguuaaauacaugcacuuuuauuuucuaaugcagauguacuuuuugaacauaagc

SEQ ID NO: 86912 - RNA, 64 nt, Homo Sapiens
gaggguaggagucuagccgacaaucuuaacgugacuaaugcacagcgggacggcggugcuaggu

SEQ ID NO: 86913 - RNA, 64 nt, Homo Sapiens
agagaucuuuuaaaaaauaaaagaaaccuagaaucuaaugcagaacccaguuuugaaaccaaaa

SEQ ID NO: 86914 - RNA, 64 nt, Homo Sapiens
agagaaaaaaguucuuuuagagguaugaaacagccuaaugcauuagagggaauaaucugagcaa

SEQ ID NO: 86915 - RNA, 64 nt, Homo Sapiens
acaaaggcuugcaaagauaggagaggcuccaucucuaaugcauguagaagcuccuuacgggugc

SEQ ID NO: 86916 - RNA, 64 nt, Homo Sapiens
gcuaagagagguuuccgaaggguuuugcuacauucuaaugcauguauucggguuaggggaaugg

SEQ ID NO: 86917 - RNA, 64 nt, Homo Sapiens
ucuccauuuuugccuuggugcucaucuuaauggccuaaugcacccccaaacauggaaauaucac

SEQ ID NO: 86918 - RNA, 64 nt, Homo Sapiens
uuucuggaagguuaugacacuuuacuguuuacagcuaaugcauaguuacuugcaugccaugguu

SEQ ID NO: 86919 - RNA, 64 nt, Homo Sapiens
cuccuccuuuaacugagucaucaucuuaguccaacuaaugcagucgauacaaugcguagauaga

SEQ ID NO: 86920 - RNA, 64 nt, Homo Sapiens
gauaccaaaaaaaaaggaaaacuggaagugcuaucuaaugcaguccacugcuuuucagcauugu

SEQ ID NO: 86921 - RNA, 64 nt, Homo Sapiens
uucucuuuuuuuuuuuuuuuuuauauugucuugccuaaugcauaugauuuuuguaauuggaggu

SEQ ID NO: 86922 - RNA, 64 nt, Homo Sapiens
aucccacuacccgugagcuaaucucucagccccacuaaugcagaggggcuggaggggcccccac

SEQ ID NO: 86923 - RNA, 64 nt, Homo Sapiens
uaccaagacaagcaggcuguucccuggaaaaaaucuaaugcaaggagggcuaguucacagcaaa

SEQ ID NO: 86924 - RNA, 64 nt, Homo Sapiens
cccucuccaguccccucacaaucccagauggguucuaaugcagcugcuggggccugaugcccug

SEQ ID NO: 86925 - RNA, 64 nt, Homo Sapiens
cacuccuaggugaagaagugcccucuuccuucaucuaaugcagcccuucuucaugaaaccaggg

SEQ ID NO: 86926 - RNA, 64 nt, Homo Sapiens
ucacccucauccuggugcuugggaguggcaagcccuaaugcaacaacagcuugaggucccugag

SEQ ID NO: 86927 - RNA, 64 nt, Homo Sapiens
gggucaccgcuggagaagaagggcuccuccuugccuaaugcagggaaggucuccacucuccucu

SEQ ID NO: 86928 - RNA, 64 nt, Homo Sapiens
uguaaaacaggauuuucuaguuccuagugaaggccuaaugcacugucauuaugacuuauacuaa

SEQ ID NO: 86929 - RNA, 64 nt, Homo Sapiens
uuugcacaagguagaaguuaggcccccuuucugacuaaugcaguguugagccugucugaauuug

SEQ ID NO: 86930 - RNA, 64 nt, Homo Sapiens
ugguaugaguagguuuggccgaggaugaccaggacuaaugcaugccaucauacgcaugguccug

SEQ ID NO: 86931 - RNA, 64 nt, Homo Sapiens
guaggcuacuccaugauaguauuucaaaugucugcuaaugcagaggcaugcuugacuauuucuu

SEQ ID NO: 86932 - RNA, 64 nt, Homo Sapiens
ccauuccucucuuguuuauacuuucaaccagcgacuaaugcaaugaaaggaaauggcauugcug

SEQ ID NO: 86933 - RNA, 64 nt, Homo Sapiens; identical to SEQ ID NO: 86932

SEQ ID NO: 86934 - RNA, 64 nt, Homo Sapiens
aaguugaagucgacugccaaacaaccuuacggcgcuaaugcauuaagccagaguugcuucucuu

SEQ ID NO: 86935 - RNA, 64 nt, Homo Sapiens
auggguauaaaaacaaauuuguggcauuuuuagucuaaugcauguuuucauccacuauccagua

SEQ ID NO: 86936 - RNA, 64 nt, Homo Sapiens
caagguuaaggggaagacgcgccuuuuuuuuuuucuaaugcaucagccaccgcccccagccuga

SEQ ID NO: 86937 - RNA, 64 nt, Homo Sapiens
gauaugaaacacggcuuacauaauauaaaaacuacuaaugcacuaugaacugccccccccacau

SEQ ID NO: 86938 - RNA, 64 nt, Homo Sapiens
agcaaaaucauuuugaguuaagccaguucuuagccuaaugcaaacugcagcgccuuuaagcaua

SEQ ID NO: 86939 - RNA, 64 nt, Homo Sapiens
ugauuuaauguauguuuaauucuauuuaucaugucuaaugcaugagggcuuaaccuauaugaac

SEQ ID NO: 86940 - RNA, 64 nt, Homo Sapiens
gaaagauaaguagaccagucgacagaugaaaaaccuaaugcauaggguacuauuauuuccauuu

SEQ ID NO: 86941 - RNA, 64 nt, Homo Sapiens
guuguccaagagcacacugaaaguugaauguuaucuaaugcauuccucuaccuuucagaagauc

SEQ ID NO: 86942 - RNA, 64 nt, Homo Sapiens
augguggcuuguuucaugguuuuuguauuugugucuaaugcacguuuuaacaugauagacgcaa

SEQ ID NO: 86943 - RNA, 64 nt, Homo Sapiens
uucuuguccacgguuuuguugaguuuucacucuucuaaugcaagggucucacacugugaaccac

SEQ ID NO: 86944 - RNA, 64 nt, Homo Sapiens
auagaacccagggcucugaaacagcucuagccgccuaaugcacuucacagguaacuccccaagg

SEQ ID NO: 86945 - RNA, 64 nt, Homo Sapiens
aauuuuaagguuuauaguucccucaacacaauugcuaaugcagaauaguguaaaaugcgcuuca

SEQ ID NO: 86946 - RNA, 64 nt, Homo Sapiens
ccuagaauguauuuuaaauaauuaacauuuacuccuaaugcacggucuuuuaagggcaucacaa

SEQ ID NO: 86947 - RNA, 64 nt, Homo Sapiens
cgguggccucaucaccagagcaucgccaggauuucuaaugcacucaguuucccuacauagcagg

SEQ ID NO: 86948 - RNA, 64 nt, Homo Sapiens
uuuauaagagaaguuuaacauguuaucggacauucuaaugcauaauuuuacagcccuuggcuug

SEQ ID NO: 86949 - RNA, 64 nt, Homo Sapiens
agcaacaaagccacugauacuucaguguuugaaccuaaugcaacguguacguggaauuuugugu

SEQ ID NO: 86950 - RNA, 64 nt, Homo Sapiens
auguuucuaguuuuuugcuuuauugccuugcauucuaaugcaguuuguucuguaacucgagagc

SEQ ID NO: 86951 - RNA, 64 nt, Homo Sapiens
gauagagagagcuaaacuguuggaagucaaauuccuaaugcauaguauaugcuuuaacaucaaa

SEQ ID NO: 86952 - RNA, 64 nt, Homo Sapiens
uacccaccagggagaugucucccggguucuaccccuaaugcaaacccucagacugucaggcaag

SEQ ID NO: 86953 - RNA, 64 nt, Homo Sapiens
aguaugauuguuuuauuagcuacauggguauuagcuaaugcaguuuaauguguauuaaagggcu

SEQ ID NO: 86954 - RNA, 64 nt, Homo Sapiens
cauuuagucuaaacuuagucugguugucaaauuccuaaugcaacggaauacagcgauauaauuu

SEQ ID NO: 86955 - RNA, 64 nt, Homo Sapiens
gaaaagauacauaaagcaauaaacuaauucauaacuaaugcauaaauguuccaaucuaaauaaa

SEQ ID NO: 86956 - RNA, 56 nt, Homo Sapiens
uuuuuuuuuuuuuaagguaagaagaucuaaugcauccuauauccaguaaguagaau

SEQ ID NO: 86957 - RNA, 64 nt, Homo Sapiens
gacuauggucucagugauaauaguggacugaaaacuaaugcaagaugcagcagauaauuguuca

SEQ ID NO: 86958 - RNA, 64 nt, Homo Sapiens
ucauaggugcuagcuagagcaucugagccuuuuccuaaugcagcccuuauacuaucuuuuuauu

SEQ ID NO: 86959 - RNA, 64 nt, Homo Sapiens
cgcucaaccuuuuuaaaugguuuuucaaugucaucuaaugcaaaacuaaaauauuccucuacua

SEQ ID NO: 86960 - RNA, 64 nt, Homo Sapiens
gaguuuuguuuagagcaguuaacaucugaagugucuaaugcauuaacuuuuguaagguacugaa

SEQ ID NO: 86961 - RNA, 64 nt, Homo Sapiens
aaucacauaaauauagcgagagggaagauagacucuaaugcaaucaugaagcuuaccgacuagu

SEQ ID NO: 86962 - RNA, 64 nt, Homo Sapiens
ucaucacuuggagcaguuucuguauuccuuuucucuaaugcagccugcuuguucaaauacugug

SEQ ID NO: 86963 - RNA, 64 nt, Homo Sapiens
uaauaauguaacuuuguuaauaggugcauaaacacuaaugcagucaauuugaacaaaagaagug

SEQ ID NO: 86964 - RNA, 64 nt, Homo Sapiens
uuugaaggaagcacaugugcaccuuuccuuuacacuaaugcacuuaggauguuucugcaucaug

SEQ ID NO: 86965 - RNA, 64 nt, Homo Sapiens
agaaaagccuuuuaaucucuuauuuuguauuguucuaaugcaacuuuccuuaaugaaaaauaca

SEQ ID NO: 86966 - RNA, 64 nt, Homo Sapiens
cugcuucucucgcauguuuuuuacugugccugaucuaaugcaaggcaacugauguuucuuaguu

SEQ ID NO: 86967 - RNA, 64 nt, Homo Sapiens
cugggaugaaacuaaagcaaaguuuggaaucccacuaaugcaaaauguauaaacuuuagaguag

SEQ ID NO: 86968 - RNA, 64 nt, Homo Sapiens
cugguuugauauaaugcugcauauaaucaauauccuaaugcauuaaagaaaaauaauuauuuaa

SEQ ID NO: 86969 - RNA, 64 nt, Homo Sapiens
cccagacaccccagaagggcacucaggaaauauacuaaugcaggcagggucuuuuaguugaagc

SEQ ID NO: 86970 - RNA, 64 nt, Homo Sapiens
gagagggagucuggccccaggcaggacggcgacacuaaugcaggugggcccggggaccucacag

SEQ ID NO: 86971 - RNA, 64 nt, Homo Sapiens
uggccgacugggacuuuucaaggcccaugaucgacuaaugcaguuggcucuggccucuuuaggg

SEQ ID NO: 86972 - RNA, 64 nt, Homo Sapiens
gcaguggcucagcagcaagauccuccacugcugccuaaugcaaguucucucuccuccguccccu

SEQ ID NO: 86973 - RNA, 64 nt, Homo Sapiens
caggagcauuugcaugcaguuggcaggugggagucuaaugcaguggaagucugccuggugaggc

SEQ ID NO: 86974 - RNA, 64 nt, Homo Sapiens
gugacaccuaguuuuccucauaaugcggggaagacuaaugcauggaacacaccugccuuuugug

SEQ ID NO: 86975 - RNA, 64 nt, Homo Sapiens
acugauaucuaaauauugauuucugccuuccuugcuaaugcaccauuagaagauauuagucuug

SEQ ID NO: 86976 - RNA, 64 nt, Homo Sapiens
agacccccaacuuuaacagagaggugucuuauuucuaaugcaacucagcuuuuucugguuuaua

SEQ ID NO: 86977 - RNA, 64 nt, Homo Sapiens
gauucuuucucacuacuaucacagucauuuuuaacuaaugcaguaugugaacaauuuucaugag

SEQ ID NO: 86978 - RNA, 64 nt, Homo Sapiens
uucuaacaugauagaggcaauuuuguauuugagucuaaugcacgauggugauuuguuucauggu

SEQ ID NO: 86979 - RNA, 64 nt, Homo Sapiens
cgggguuuaauaccuaggugaguaggaaaaagagcuaaugcaugauuaauuuuuaggggagagc

SEQ ID NO: 86980 - RNA, 64 nt, Homo Sapiens; identical to SEQ ID NO: 24913

SEQ ID NO: 86981 - RNA, 64 nt, Homo Sapiens; identical to SEQ ID NO: 24914

SEQ ID NO: 86982 - RNA, 64 nt, Homo Sapiens; identical to SEQ ID NO: 24915

SEQ ID NO: 86983 - RNA, 64 nt, Homo Sapiens; identical to SEQ ID NO: 24916

SEQ ID NO: 86984 - RNA, 64 nt, Homo Sapiens; identical to SEQ ID NO: 24917

SEQ ID NO: 86985 - RNA, 64 nt, Homo Sapiens; identical to SEQ ID NO: 24918

SEQ ID NO: 86986 - RNA, 64 nt, Homo Sapiens; identical to SEQ ID NO: 24919

SEQ ID NO: 86987 - RNA, 64 nt, Homo Sapiens; identical to SEQ ID NO: 24920

SEQ ID NO: 86988 - RNA, 64 nt, Homo Sapiens; identical to SEQ ID NO: 24921

SEQ ID NO: 86989 - RNA, 64 nt, Homo Sapiens; identical to SEQ ID NO: 24922

SEQ ID NO: 86990 - RNA, 64 nt, Homo Sapiens; identical to SEQ ID NO: 24923

SEQ ID NO: 86991 - RNA, 64 nt, Homo Sapiens; identical to SEQ ID NO: 24924

SEQ ID NO: 86992 - RNA, 64 nt, Homo Sapiens; identical to SEQ ID NO: 24925

SEQ ID NO: 86993 - RNA, 64 nt, Homo Sapiens; identical to SEQ ID NO: 24926

SEQ ID NO: 86994 - RNA, 64 nt, Homo Sapiens; identical to SEQ ID NO: 24927

SEQ ID NO: 86995 - RNA, 64 nt, Homo Sapiens; identical to SEQ ID NO: 24928

SEQ ID NO: 86996 - RNA, 64 nt, Homo Sapiens; identical to SEQ ID NO: 24929

SEQ ID NO: 86997 - RNA, 64 nt, Homo Sapiens; identical to SEQ ID NO: 24930

SEQ ID NO: 86998 - RNA, 64 nt, Homo Sapiens; identical to SEQ ID NO: 24931

SEQ ID NO: 86999 - RNA, 64 nt, Homo Sapiens; identical to SEQ ID NO: 24932

SEQ ID NO: 87000 - RNA, 64 nt, Homo Sapiens; identical to SEQ ID NO: 24933

SEQ ID NO: 87001 - RNA, 64 nt, Homo Sapiens; identical to SEQ ID NO: 24934

SEQ ID NO: 87002 - RNA, 64 nt, Homo Sapiens; identical to SEQ ID NO: 24935

SEQ ID NO: 87003 - RNA, 64 nt, Homo Sapiens; identical to SEQ ID NO: 24936

SEQ ID NO: 87004 - RNA, 64 nt, Homo Sapiens
uaaggccaucuagugccaacuccccccccaccauuccccucacugcacuuuggaccccuggggc

SEQ ID NO: 87005 - RNA, 64 nt, Homo Sapiens
cuggcuuuucugccguggauucucccccgucuucuccccucagcaauuccugcaaaggguuaaa

SEQ ID NO: 87006 - RNA, 64 nt, Homo Sapiens
ccacuguagcugugacguguuuucuuuggugcccuccccucaccacccuacucuguguggcugc

SEQ ID NO: 87007 - RNA, 64 nt, Homo Sapiens
gggaggggagcaggggagggaugcucccuaccuguccccucacaaauagcacagcugcccuccc

SEQ ID NO: 87008 - RNA, 64 nt, Homo Sapiens
cuggugacccuccaagaugccccugcccucaguuuccccucaugaucuggccucugcccccuuc

SEQ ID NO: 87009 - RNA, 64 nt, Homo Sapiens
ugccuugucugccuggcaaguucaucucucacgauccccucaaaggcccccuccuccaggaagg

SEQ ID NO: 87010 - RNA, 64 nt, Homo Sapiens
uccgacuggggcucccugaggacagggcugugucuccccucagccuggggcucccugagucagg

SEQ ID NO: 87011 - RNA, 64 nt, Homo Sapiens
cucagccuggggcucccugagucagggcugugucuccccucagacuggggcucccugaggacgg

SEQ ID NO: 87012 - RNA, 64 nt, Homo Sapiens
ucaaaguggggcucccucaggacagcguugugucuccccucagacugcggcucccugaggacgg

SEQ ID NO: 87013 - RNA, 64 nt, Homo Sapiens
auccauagaguggacaguaacuugucucccuuguuccccucaggggcugcuccgacaggggaga

SEQ ID NO: 87014 - RNA, 64 nt, Homo Sapiens
cucugggagcugugaaagggggagcaggugccaguccccucacuuagagcugggauugguggag

SEQ ID NO: 87015 - RNA, 64 nt, Homo Sapiens
accuucugaaccuucuucaaacaguaguacaagcuccccucagccagccugccugcccagcgag

SEQ ID NO: 87016 - RNA, 64 nt, Homo Sapiens
aacugcgcucccccaaccccucgcccugccaucuuccccucaagccugcuaaguuaucccaggc

SEQ ID NO: 87017 - RNA, 64 nt, Homo Sapiens
aucgaugccuccuuucugggacucccggcacaacuccccucauccagggagggaggcagcugcu

SEQ ID NO: 87018 - RNA, 64 nt, Homo Sapiens
gcuuggcuagguaguucuguguggcgguggucauuccccucauuaaacaccaguucuuggugac

SEQ ID NO: 87019 - RNA, 64 nt, Homo Sapiens
cuguugagcagcauaauaaucccgggagaaugauuccccucauagaaagacaaaagcauccauc

SEQ ID NO: 87020 - RNA, 64 nt, Homo Sapiens
aaugauuccccucauagaaagacaaaagcauccauccccucauaguuaaguagccacugguguc

SEQ ID NO: 87021 - RNA, 64 nt, Homo Sapiens
agguagacaaaacagcagcuccuacugagacugguccccucaaagcccccacacugccuuucgc

SEQ ID NO: 87022 - RNA, 64 nt, Homo Sapiens
cacuugagggcgccugagggcccccuugcugggguccccucaucggugcaacuccugccuccau

SEQ ID NO: 87023 - RNA, 64 nt, Homo Sapiens
ugggcccugggaucuggaaccaacacaccccuguuccccucagcuuucccuccucgcuggccug

SEQ ID NO: 87024 - RNA, 64 nt, Homo Sapiens
agccccugcccacccugacagagggagcugggccuccccucauccucuguaacucccgccuuca

SEQ ID NO: 87025 - RNA, 64 nt, Homo Sapiens
aauuaagacugcauuaugaaagucaacagcucuuuccccucagcucuucuccuggaaugacugg

SEQ ID NO: 87026 - RNA, 64 nt, Homo Sapiens
uuuccccucagcucuucuccuggaaugacuggcuuccccucaaauuggcacugagauuugcuac

SEQ ID NO: 87027 - RNA, 64 nt, Homo Sapiens
uggggcagguggagggagcagucuucguucuuccuccccucaguggcaguuuggucuucaccug

SEQ ID NO: 87028 - RNA, 64 nt, Homo Sapiens
ccugccguacgugccauuccacucucuucagcucuccccucaacagcaugcgagcccauaccuu

SEQ ID NO: 87029 - RNA, 64 nt, Homo Sapiens
cugcccaccucucccugcauguggagcucgccccuccccucagcggggcaguuagagcagccuc

SEQ ID NO: 87030 - RNA, 64 nt, Homo Sapiens
acccugcuucucccggggacccucuguccucccauccccucaaccuucugcuccagccccuuug

SEQ ID NO: 87031 - RNA, 64 nt, Homo Sapiens
ugccgcgucgcccucccagguaaaagcacacucauccccucacuuggcagcugccacgccgccc

SEQ ID NO: 87032 - RNA, 64 nt, Homo Sapiens
gugcaagccccugcuccagagggaaaagcagcucuccccucagacccccgccaaaagcugcuca

SEQ ID NO: 87033 - RNA, 64 nt, Homo Sapiens
agcugcaugagaaaucuaucggugaagagagaaguccccucacuaauaggagaagguggaaaug

SEQ ID NO: 87034 - RNA, 64 nt, Homo Sapiens
cucuccccacaccacccaccugggggggcugccuuccccucagcauuccacgguuaggcccccc

SEQ ID NO: 87035 - RNA, 64 nt, Homo Sapiens
uccccagaccucugucccuguuccccuccacuccuccccucacuccccugcucccccgaccacc

SEQ ID NO: 87036 - RNA, 64 nt, Homo Sapiens
uguuccugguucccgcuuuccacuuccaaaucccuccccucaccuucccccacugccccccaag

SEQ ID NO: 87037 - RNA, 64 nt, Homo Sapiens
ggugcuggggagggaggacugugaauggcuguucuccccucacugcugagucucccaggacccc

SEQ ID NO: 87038 - RNA, 64 nt, Homo Sapiens
guuucuugcucaugguggcucauuuauuacauaguccccucaccccacuaauggauaaugggag

SEQ ID NO: 87039 - RNA, 51 nt, Homo Sapiens
cugaggaagaugacaaguaacuccccucagggauacgacacaugcccauga

SEQ ID NO: 87040 - RNA, 64 nt, Homo Sapiens
gccccccucacucuguuuccuguucagcauguacuccccucauccgauuccccucuaucaguca

SEQ ID NO: 87041 - RNA, 64 nt, Homo Sapiens
gagaucagcgacccugaggaagaugacgaguaacuccccucagggauacgacacaugcccauga

SEQ ID NO: 87042 - RNA, 64 nt, Homo Sapiens
cugcuuuucccauugccaugcguccuggucaagcuccccucacucuguuuccuggucagcaugu

SEQ ID NO: 87043 - RNA, 64 nt, Homo Sapiens
gcuccccucacucuguuuccuggucagcauguacuccccucauccgauuccccuguagcaguca

SEQ ID NO: 87044 - RNA, 64 nt, Homo Sapiens
gaacccaggagguggagguugcagugagccgucaucgcgccacuaagccaagaucgcgccacug

SEQ ID NO: 87045 - RNA, 64 nt, Homo Sapiens
ugcagugagccgucaucgcgccacuaagccaagaucgcgccacugcacuccagccugggcgaca

SEQ ID NO: 87046 - RNA, 64 nt, Homo Sapiens
uugucucccuugucagcaggguuguuggaguucagcggggcagcgcugcugagcccacccagag

SEQ ID NO: 87047 - RNA, 64 nt, Homo Sapiens
gccccacuccuuugugcacauaacuggcaccucugcggggcaguggcacgggccucggugcagg

SEQ ID NO: 87048 - RNA, 64 nt, Homo Sapiens
ugcccgagcaggcuccuugcaaagacagcagcgugcggggcagagccccgggagggcgcgucug

SEQ ID NO: 87049 - RNA, 64 nt, Homo Sapiens
uguuguugguuuuagcuuccaguggcuucuuucugcggggcaucaggcugcugggguagccgcc

SEQ ID NO: 87050 - RNA, 64 nt, Homo Sapiens
accgugaccgugaccgcgagcacaaacggggggagcggggcagugagcggggcagggaugaggc

SEQ ID NO: 87051 - RNA, 64 nt, Homo Sapiens
accgcgagcacaaacggggggagcggggcagugagcggggcagggaugaggcccgagguggggg

SEQ ID NO: 87052 - RNA, 64 nt, Homo Sapiens
ucuuuuugccauggcuaaucccugcauuuccauucagggaaaaggugguagugagcauagaacu

SEQ ID NO: 87053 - RNA, 64 nt, Homo Sapiens
agauggcugccuggacuggaaucaaaucuaauuucagggaaaugaagauggaauuugaagguca

SEQ ID NO: 87054 - RNA, 64 nt, Homo Sapiens
uccccuggauucgcuggacugcaaaaaggagcaccagggaaagcucagcaaaggcucaggaggc

SEQ ID NO: 87055 - RNA, 64 nt, Homo Sapiens
cacuccugagucacugaauucgaggaggguggggcagggaaagggcuggccccccugcugaaau

SEQ ID NO: 87056 - RNA, 64 nt, Homo Sapiens
gaccagucacuaaucucugagacuccauuuucuccagggaaacgaggcuugcccagauagacua

SEQ ID NO: 87057 - RNA, 64 nt, Homo Sapiens
gcacaauggccugggaaguugaggucacuuuuuacagggaaauagaagaaacugagaaccuagu

SEQ ID NO: 87058 - RNA, 64 nt, Homo Sapiens
gcauaaauagccaugugaauuccacaagaagcaccagggaaaguuuagagauuugcggcaaugg

SEQ ID NO: 87059 - RNA, 64 nt, Homo Sapiens
cuguucuuucugccuguacuggaucuguuauuuucagggaaacaggccccagggccccccugag

SEQ ID NO: 87060 - RNA, 64 nt, Homo Sapiens
auuucuuggaaaaggagagaggaauccccuagagcagggaaagcagugccugccagcuguugug

SEQ ID NO: 87061 - RNA, 64 nt, Homo Sapiens
ccucccuuugguaaaucugcaccccagggcccaucagggaaaugggcccagacagucccccuug

SEQ ID NO: 87062 - RNA, 64 nt, Homo Sapiens
ggaugggaccugggcccagaugcuaguaccaacacagggaaaacagacucagaggggaagaggg

SEQ ID NO: 87063 - RNA, 64 nt, Homo Sapiens
uauuuuacuaguccaaucacugaaaaggcuuuuucagggaaaaaagguggucccauaggucuug

SEQ ID NO: 87064 - RNA, 64 nt, Homo Sapiens
gauggucaggcccaguucuccccugcgcccugugcagggaaagggaguggggagcggagcuugg

SEQ ID NO: 87065 - RNA, 64 nt, Homo Sapiens
gacacuuuagugcaaagagcugagcacauuccagcagggaaacgaacuccgaugugcgcccauu

SEQ ID NO: 87066 - RNA, 64 nt, Homo Sapiens
uugggaaaagaauuauguagauaccacauggagacagggaaacaauugugguaaaacuguggau

SEQ ID NO: 87067 - RNA, 64 nt, Homo Sapiens
uuucuucacccucacucuucgguggaggugccuucagggaaaguaucuugaagaaaaaucuuuu

SEQ ID NO: 87068 - RNA, 64 nt, Homo Sapiens
aucucccuagcucagagaauagaacuccauucuucagggaaagggcagagccccucuuaucuug

SEQ ID NO: 87069 - RNA, 64 nt, Homo Sapiens
cagcgaggcccucugcaagaagcucaaggaagcucagggaaaauggacguauucagagaguguu

SEQ ID NO: 87070 - RNA, 64 nt, Homo Sapiens
agggaaggagcagggaugagacuggcaauggucacagggaaagauguggccuuuugugaugguu

SEQ ID NO: 87071 - RNA, 64 nt, Homo Sapiens
aagcaccgugcugacagauaucaaaguacucuagcagggaaaauaauuuguuugcuguguaagg

SEQ ID NO: 87072 - RNA, 64 nt, Homo Sapiens
gacaagacagauaaaucugaaggucauguggcaucagggaaagggcauggcugugucuuuugca

SEQ ID NO: 87073 - RNA, 64 nt, Homo Sapiens
guggucucgggccugggugagggcuguguccuuccagggaaauuucgaagcaugucuuugccau

SEQ ID NO: 87074 - RNA, 64 nt, Homo Sapiens
agcucacagacgccguuaaacuucuguucgugugcagggaaagcuucuguuuguaagguaagag

SEQ ID NO: 87075 - RNA, 64 nt, Homo Sapiens
auguauaaacaaauguguaaguucacaguguagacagggaaaaauccuaacccccaacagaggu

SEQ ID NO: 87076 - RNA, 64 nt, Homo Sapiens
gaggaggcgagacuagaacuaggaagacugcuggcagggaaaucgggccagaagaaugagagag

SEQ ID NO: 87077 - RNA, 64 nt, Homo Sapiens
guaguuuaaguggcaaauaaccaucaggauagcacagggaaacugccuguuccacacccccaca

SEQ ID NO: 87078 - RNA, 52 nt, Homo Sapiens
gccaggaauggcagugucuuuccagggaaagauccaccagaucagacacuga

SEQ ID NO: 87079 - RNA, 64 nt, Homo Sapiens
accaggauucugugaguucugcagggaaaggaggcagggaaaagcugcccgacucacucacagu

SEQ ID NO: 87080 - RNA, 64 nt, Homo Sapiens
aggcagggaaaagaccaggaacucacucacagugcagggaaaggggagcagcuccuucugcccg

SEQ ID NO: 87081 - RNA, 64 nt, Homo Sapiens
ccagcaagccagagcgggcgacagguacacgggccagggaaaugugcacagagcucugcuugaa

SEQ ID NO: 87082 - RNA, 64 nt, Homo Sapiens
gagccuauucucacacaugagucuccaccugaggcagggaaagaagagggagugggaggggucu

SEQ ID NO: 87083 - RNA, 64 nt, Homo Sapiens
caaauauugggaggggagaagaucuaaccagcaacagggaaaagagaaauauuaucuuucaaug

SEQ ID NO: 87084 - RNA, 64 nt, Homo Sapiens
aaguauucaugaugacucuauuuggaaugauauucagggaaaucacaauaauauagcaguaguu

SEQ ID NO: 87085 - RNA, 64 nt, Homo Sapiens
ucacuguuccuuuuuuuagguuagaaauuaacagcagggaaaugccaucuuauuaccugagacg

SEQ ID NO: 87086 - RNA, 64 nt, Homo Sapiens
ccuuucccuagaaauuggcucaccuugggaaacccagggaaagaaucagcagguucucugcccu

SEQ ID NO: 87087 - RNA, 64 nt, Homo Sapiens
cucucucagauccauaauccauacucagugaaagcagggaaaaaauauuuucacuuauuuuauu

SEQ ID NO: 87088 - RNA, 64 nt, Homo Sapiens
aaccuguguaaguauugugaaaacccuuuucuuccagggaaaaauuauuggaaauuccuuaacu

SEQ ID NO: 87089 - RNA, 64 nt, Homo Sapiens
aagggauuucccugucucagagcagccuuugccccagggaaaugggcucugggcuggcugccug

SEQ ID NO: 87090 - RNA, 64 nt, Homo Sapiens
ggcagcccucccagugcccaagggccaccaaccccagggaaacagggccagcacagaggggccu

SEQ ID NO: 87091 - RNA, 64 nt, Homo Sapiens
gggguggcggggggcauguaccacaggguggcagcagggaaaaaaauuagaaaagggugaaaga

SEQ ID NO: 87092 - RNA, 64 nt, Homo Sapiens
uacccacccgcuguucuccaugcaaacaaagcgccagggaaaugacccacagggaucgcagcug

SEQ ID NO: 87093 - RNA, 64 nt, Homo Sapiens
aaauguuuggaagguuuauuucucaugcacauuccagggaaaagcagagaguaaauuagagacg

SEQ ID NO: 87094 - RNA, 64 nt, Homo Sapiens
ucaucggcuuucagaaggagaccacgggaauguucagggaaacaaugucagcuucucugaggac

SEQ ID NO: 87095 - RNA, 64 nt, Homo Sapiens
cucucugaauaaccuagccaauaucaaacgagaacagggaaacauugaagaggcaguucgcuug

SEQ ID NO: 87096 - RNA, 64 nt, Homo Sapiens
ugcccauucaaauuuagcaaguguacugcagcagcagggaaaacugcaggaagcucugaugcau

SEQ ID NO: 87097 - RNA, 64 nt, Homo Sapiens
uaugauucuagaugagaaguuauaucaagaaagauguggccaaucagauugagucauccaggca

SEQ ID NO: 87098 - RNA, 64 nt, Homo Sapiens
acauuuuccagauggcgaggucacagcagagagauguggccaccuagccuuuccuuauccccuu

SEQ ID NO: 87099 - RNA, 64 nt, Homo Sapiens
cggauauccuaauagaaauucuaaccuccugcuguguggccaaacucaguaaugcuccauugcu

SEQ ID NO: 87100 - RNA, 64 nt, Homo Sapiens
cuuuaaaccugugguccccauuaauauaaagaaauguggccauggaaauguacaaacuagaauu

SEQ ID NO: 87101 - RNA, 64 nt, Homo Sapiens
aaguagccagggugaagagaggcagagucauacguguggccagggcucagagcagaaaguaagg

SEQ ID NO: 87102 - RNA, 64 nt, Homo Sapiens
ugcuccccauucuugaaagccagagcaggccacauguggccaucuggcuugugacgcuauaaga

SEQ ID NO: 87103 - RNA, 64 nt, Homo Sapiens
ucugcagcagaaagaaaggggccugggcagcagguguggccagucccucugccaaggccugugc

SEQ ID NO: 87104 - RNA, 64 nt, Homo Sapiens
ggcgauggguggcuagagugaugaacucaagcccuguggccacaguucugggagccuucaaccc

SEQ ID NO: 87105 - RNA, 64 nt, Homo Sapiens
aagcuguggaaggugacaaauaucuaaauaugaauguggccacaaggggagcagaguccgagcu

SEQ ID NO: 87106 - RNA, 64 nt, Homo Sapiens
acagguuucauaaaauuacaggagacacaacaaauguggccauuugcaauuauagaaauacauc

SEQ ID NO: 87107 - RNA, 64 nt, Homo Sapiens
auuuaaaccuauacucacuuuaggagagguugucuguggccagagggagguucagugaauugug

SEQ ID NO: 87108 - RNA, 64 nt, Homo Sapiens
aaccucuguauuugaaucagccucaccaagcugcuguggccauccaguuugaaauugagcugga

SEQ ID NO: 87109 - RNA, 64 nt, Homo Sapiens
ggcugaacuuggcauuuccuugcuaacugccagauguggccaaccuuuguccauaugcaaacca

SEQ ID NO: 87110 - RNA, 64 nt, Homo Sapiens
ccuuaacgagcaauagaauguauggucaccuggguguggccagugcccgcugugcccugcauga

SEQ ID NO: 87111 - RNA, 64 nt, Homo Sapiens
cugcagagcugcgugccguuauacgcgaaggguguguggccagggaacccugaggaguggaguc

SEQ ID NO: 87112 - RNA, 64 nt, Homo Sapiens
gugucagcagagagagucucauacacgaagggcguguggccaucgaacccugaggaguggaguc

SEQ ID NO: 87113 - RNA, 64 nt, Homo Sapiens
gcacgcccuacuccacugcccuggcagcagcagguguggccaauggaggggggugcuggccccc

SEQ ID NO: 87114 - RNA, 64 nt, Homo Sapiens
ggcaggaggggugaguccccuacucccucuucacuguggccacagcccccuugcccuccgccug

SEQ ID NO: 87115 - RNA, 64 nt, Homo Sapiens
uccuuguaauuugaguauaaauguauuuuugucuuguggccauucuuuguagauaauuucugca

SEQ ID NO: 87116 - RNA, 64 nt, Homo Sapiens
auccucccaccgcccugcccuccccaccgaguccuguggccauucagagcggccacaugacuuu

SEQ ID NO: 87117 - RNA, 64 nt, Homo Sapiens
ccugcacagggaggggcugauccugccucagcuguguggccaugugggggcagcaggggccugg

SEQ ID NO: 87118 - RNA, 64 nt, Homo Sapiens
accccaaagguguccaugccccaguucuaagcccuguggccaggugcugucacacagcaaaggg

SEQ ID NO: 87119 - RNA, 64 nt, Homo Sapiens
ggucacacauguacauccuggaagcugcccaagguguggccacuuguagggcagugagaggaag

SEQ ID NO: 87120 - RNA, 64 nt, Homo Sapiens
cuauucccacauggggagcagaaucgguuacugauguggccaccggccgggcuggaggcccagg

SEQ ID NO: 87121 - RNA, 64 nt, Homo Sapiens
cggcucuaccuucagccgugaagcaccugugccguguggccaucagagcuaucccccgccccuc

SEQ ID NO: 87122 - RNA, 64 nt, Homo Sapiens
cugucagggucccuaagggaggacacucagggccuguggccaggcagggcggaggccugcugug

SEQ ID NO: 87123 - RNA, 64 nt, Homo Sapiens
ugcccuggcugcagucagugcccagggcgaggaauguggccaggggauccaggaccugggaucc

SEQ ID NO: 87124 - RNA, 64 nt, Homo Sapiens
gucaucaggcacccagguuccuacugucuugccauguggccacaguuagcaacaaaggaggcug

SEQ ID NO: 87125 - RNA, 64 nt, Homo Sapiens
uguugugaguuccauguccucuuggaucagucacuguggccaugcauguuuggccacaugauua

SEQ ID NO: 87126 - RNA, 64 nt, Homo Sapiens
cagacgaggaagguauccagccucaagucaucauuguggccaggaagauggaauacaccaaaug

SEQ ID NO: 87127 - RNA, 64 nt, Homo Sapiens
uuuaccuuccaguaacauacuccagaugcugcaguguggccagacccagcgcugcccucugccg

SEQ ID NO: 87128 - RNA, 64 nt, Homo Sapiens
uuguguccccaacugcaggaaagagcccggucacuguggccaucgguuaugaggaaguuuaaug

SEQ ID NO: 87129 - RNA, 64 nt, Homo Sapiens
auuuaaaaaaaaaaaaacaacaaaagaguuuguguguggccaggacuaaacagcugcuucuuaa

SEQ ID NO: 87130 - RNA, 64 nt, Homo Sapiens
auaaaauaucacuacccacauaaccuauaauuuguguggccagcaauuuauugaacacuaaaau

SEQ ID NO: 87131 - RNA, 64 nt, Homo Sapiens
gaaggcgcaugguucuggacggcccagcagcuccuguggccacagcagcuuuguacacgaagac

SEQ ID NO: 87132 - RNA, 64 nt, Homo Sapiens
ccagggcugcaaugcagcauguugcccuggcaccuguggccaguacucgggacagacuaagggc

SEQ ID NO: 87133 - RNA, 64 nt, Homo Sapiens
uagccucguaacuucacuguuuggauguaaaagauguggccaucguguggccccagggcgguuc

SEQ ID NO: 87134 - RNA, 64 nt, Homo Sapiens
ucuuaaccauuccagucuauuugcggggcguauguguggccagcacgaaugguagcagccagcu

SEQ ID NO: 87135 - RNA, 64 nt, Homo Sapiens
guuugugcagcagcuuuguggccaggcagaaguuuguggccaggauggagggaaaaagccuuga

SEQ ID NO: 87136 - RNA, 64 nt, Homo Sapiens
cagugcccagcuuaagcauccugccuggugucacuguggccaaaugaccccaagucccccggcc

SEQ ID NO: 87137 - RNA, 64 nt, Homo Sapiens
cagaccaagucccuauaaacaaggaccuuccaguccaggggaaugacugugcaagguaguaucu

SEQ ID NO: 87138 - RNA, 64 nt, Homo Sapiens
cuugagcccaggaguucaagaccagccugagcaaccaggggagaccuuguuucuacaaaagaau

SEQ ID NO: 87139 - RNA, 64 nt, Homo Sapiens
uaaguaggauguuguugccuuuaacuuuucuuauccaggggaaaauugccauuuuagggucagc

SEQ ID NO: 87140 - RNA, 64 nt, Homo Sapiens
agaaagaaagacgcugggcccaauuuugacuuggccaggggacaccuugguguguuuguuaucu

SEQ ID NO: 87141 - RNA, 64 nt, Homo Sapiens
ggugaagcaucugcuggacaagucggaccacuggccaggggaccuuugauugucuuuccagaga

SEQ ID NO: 87142 - RNA, 64 nt, Homo Sapiens
uggagaccaaggcaauaguccuuuccacuacaggccaggggaugggacaagaaguagggaacag

SEQ ID NO: 87143 - RNA, 64 nt, Homo Sapiens
cugcgaaggagagguucuguaaagguccccuuccccaggggagcgccaugggaacgccaacugg

SEQ ID NO: 87144 - RNA, 64 nt, Homo Sapiens
ggcuguuugcuggcucaggcuuuuuuuuuugucuccaggggaggcccagccuuuuuuuuuuuuu

SEQ ID NO: 87145 - RNA, 64 nt, Homo Sapiens
auauacgugauuuaaucugcaauagguggaauaaccaggggaacugguuaugaauaugugaaug

SEQ ID NO: 87146 - RNA, 64 nt, Homo Sapiens
augaugcuuuuucucugaaguggugugggaaguaccaggggacuggcagaagcccaggcccucu

SEQ ID NO: 87147 - RNA, 64 nt, Homo Sapiens
gacaccacagaaggagacccggcuggcggcagucccaggggagaggggucgucgagaggcugcg

SEQ ID NO: 87148 - RNA, 64 nt, Homo Sapiens
gccacccacaggccauguccugaucuuccuccugccaggggagacuuuccgcacucugagacca

SEQ ID NO: 87149 - RNA, 64 nt, Homo Sapiens
uccucccgugccccuccccgcuguccucuuggccccaggggagaagaugaggccaucagagaug

SEQ ID NO: 87150 - RNA, 64 nt, Homo Sapiens
aagaugaggccaucagagauggccaggagaagggccaggggaauagagcuauuuuuuuaacaaa

SEQ ID NO: 87151 - RNA, 64 nt, Homo Sapiens
ugcccaccugucaaacaaagccagaagcugagcaccaggggaugaguggagguuaaggcugagg

SEQ ID NO: 87152 - RNA, 64 nt, Homo Sapiens
ggggugggguggagaacuccuaggguggcuggguccaggggaugggagguugugggcauugaug

SEQ ID NO: 87153 - RNA, 64 nt, Homo Sapiens
acugggcugacaguaaaagcacagaauacaaaacccaggggauggggcugggaggggcugugag

SEQ ID NO: 87154 - RNA, 64 nt, Homo Sapiens
cuccccuaaagguagaagauacucgagcaugcugccaggggagcuggauggugaaacaccugaa

SEQ ID NO: 87155 - RNA, 64 nt, Homo Sapiens
gcaaagggcgucucagggaaggcgagggcagaccccaggggaaaugggcaccaggggacgcucu

SEQ ID NO: 87156 - RNA, 64 nt, Homo Sapiens
cucuggcgagggcagaccccgcaaugagugggcaccaggggacgccccuucccccucgaccccc

SEQ ID NO: 87157 - RNA, 64 nt, Homo Sapiens
cccucugacccuggcccagggaccccucacggggccaggggaggcauagcagaaagacuggccc

SEQ ID NO: 87158 - RNA, 64 nt, Homo Sapiens
cugggggugcagagcccaccuggguaccugacccccaggggaugaaaaugcaaggaugagucug

SEQ ID NO: 87159 - RNA, 64 nt, Homo Sapiens
ggcagagaccugggaugggagaaguccuggggcgccaggggauccagccuagagcagaccuuag

SEQ ID NO: 87160 - RNA, 64 nt, Homo Sapiens
uccaagagcacccaccaagacacagcaggacaggccaggggagggcaucuggaccagggcaucc

SEQ ID NO: 87161 - RNA, 64 nt, Homo Sapiens
acagcgccaauaacaauacagugucugaguaucuccaggggaugauuucuggcucuuugucucc

SEQ ID NO: 87162 - RNA, 64 nt, Homo Sapiens
cugaagcugauuuguaaugauuggcacucuucagccaggggaguggguaggccauagccaagga

SEQ ID NO: 87163 - RNA, 64 nt, Homo Sapiens
ggacccgugggauggugccccucacccugaggccccaggggagacaaaaaacugcuccuucacc

SEQ ID NO: 87164 - RNA, 64 nt, Homo Sapiens
ggagggagcgaggggcucacgaagggcucugagcccaggggaggcaggggccacacggcgggag

SEQ ID NO: 87165 - RNA, 64 nt, Homo Sapiens
ggcaggagucccagcaccaucaggauugagggagccaggggagguuauccuaugggggccugag

SEQ ID NO: 87166 - RNA, 64 nt, Homo Sapiens
ccauccagccuguaggaaacggccuacaaggcuuccaggggauggagcccugccaggggcugug

SEQ ID NO: 87167 - RNA, 64 nt, Homo Sapiens
uaaauguggagauuaaauaaaaauauaaaaagauccaggggacaccaccucccuucuucuaacu

SEQ ID NO: 87168 - RNA, 64 nt, Homo Sapiens
acuuccaaauguuaauuuuuuagccccucuuccuccaggggagaccaguucuguuccuucugac

SEQ ID NO: 87169 - RNA, 64 nt, Homo Sapiens
ucagggagcagggccaggcgggcucgggggccggccaggggagcaccccacucaacuacucaga

SEQ ID NO: 87170 - RNA, 64 nt, Homo Sapiens
ccaggcucucugguggccgccccugugcaccuggccaggggaagcccgggggucuggggccucc

SEQ ID NO: 87171 - RNA, 64 nt, Homo Sapiens
ccccuagccgucaucuccacacucaccaggcccaccaggggagggggcuggccugggggucuug

SEQ ID NO: 87172 - RNA, 64 nt, Homo Sapiens
aagauacaagaggcaguaggaccuggguuggaacccaggggagcagacuggggggcuguugccc

SEQ ID NO: 87173 - RNA, 64 nt, Homo Sapiens
caacaccccggccucggggcuccugguggcagcaccaggggacacaccugccaaacccaccaga

SEQ ID NO: 87174 - RNA, 64 nt, Homo Sapiens
gaugcugucacucagccagaucaguauugacccaccaggggaggugggguuuggugagagacgc

SEQ ID NO: 87175 - RNA, 64 nt, Homo Sapiens
gcugcuaaaaggccuugugagguggccccacccuccaggggagcuggugaagaugggccacaga

SEQ ID NO: 87176 - RNA, 64 nt, Homo Sapiens
ggacagccuuuguuuucugagauaccaaagagagccaggggagggccccggguucggcggccag

SEQ ID NO: 87177 - RNA, 64 nt, Homo Sapiens
ccuucuguaguaauaaaguuuuugccacuguaaauaaaaacaguauccguagcuaucaggauca

SEQ ID NO: 87178 - RNA, 64 nt, Homo Sapiens
cauuaguaauauuucaguuggguaucuuuuuaaguaaaaacaacaaauaaacucuguacaugua

SEQ ID NO: 87179 - RNA, 64 nt, Homo Sapiens
acauuuaaaaagaugacauauaccaccacuuacuuaaaaacaauaaaagcaauagauuugauua

SEQ ID NO: 87180 - RNA, 64 nt, Homo Sapiens
ucuguuagcuuccaguaaaaauauuuguuuuuaguaaaaacaaauuuaaauauauuuacauguu

SEQ ID NO: 87181 - RNA, 64 nt, Homo Sapiens
uuugucucucugacuugauuucuauaaaugcuuuuaaaaacaagugaagccccucuuuauuuca

SEQ ID NO: 87182 - RNA, 64 nt, Homo Sapiens
cauuguucucaguuucccugccaacauugaaaaauaaaaacagcagcuuuucuccuuuaccacc

SEQ ID NO: 87183 - RNA, 64 nt, Homo Sapiens
auuacuggggccccauggcagucuccacuaaacauaaaaacaaagggaaacaaagcgagacccu

SEQ ID NO: 87184 - RNA, 64 nt, Homo Sapiens
ccaaauguccaagaaugaauuaauagccaauaaguaaaaacaacuuucacauuaucauugcuca

SEQ ID NO: 87185 - RNA, 64 nt, Homo Sapiens
gguucuuagucuuuagcuauuauugaaaguagaauaaaaacauguuuauccacaacuuuucaag

SEQ ID NO: 87186 - RNA, 64 nt, Homo Sapiens
aauaauaccauaauacauggagaauugcuaaauauaaaaacauaaaagcacauuuuaaggaaca

SEQ ID NO: 87187 - RNA, 64 nt, Homo Sapiens
guuaaacuaauauguuuauaaauugcaaacaaauuaaaaacacacauugguugcuuuucaauau

SEQ ID NO: 87188 - RNA, 64 nt, Homo Sapiens
cuauauucccacuuuauaaacagcccugaaauaguaaaaacaagucucauuugaaccucauaac

SEQ ID NO: 87189 - RNA, 64 nt, Homo Sapiens
gugaacuuaauugaaauuuuacuuagacacuuucuaaaaacaggagaggugaauuugcauuuac

SEQ ID NO: 87190 - RNA, 64 nt, Homo Sapiens
uuuuaaaaaguggaguaaaaucugaaguacaguuuaaaaacacuaucugaguuuucagagugcu

SEQ ID NO: 87191 - RNA, 64 nt, Homo Sapiens
uuccucaaugacuuagauacaaucuaaaccagcuuaaaaacagucuucauuuguauacauuugg

SEQ ID NO: 87192 - RNA, 64 nt, Homo Sapiens
agcuuccacguugccuucugaacagcgagaugaguaaaaacaucacuucauaauggugcuuuca

SEQ ID NO: 87193 - RNA, 64 nt, Homo Sapiens
accaagcucccuucccuuccucuucaguccuauuuaaaaacaaauccugauuuuucaauguuau

SEQ ID NO: 87194 - RNA, 64 nt, Homo Sapiens
agugcaccaucgcacccggcuggguuaucuaguuuaaaaacacuuuuuuucaaggaaaccgaag

SEQ ID NO: 87195 - RNA, 64 nt, Homo Sapiens
uaauaagagguguaaaaacuaucacaggaagaaauaaaaacagauuuuugaaggugagaugaua

SEQ ID NO: 87196 - RNA, 64 nt, Homo Sapiens
uuuugaagcuugacauuuuaguuugccauuauguuaaaaacaucuaaauagguguuaguuucuc

SEQ ID NO: 87197 - RNA, 64 nt, Homo Sapiens
aauccuuguucaguucuuaaguuucgguuuuuuuuaaaaacaggaugcaacuuaaacuuuucuu

SEQ ID NO: 87198 - RNA, 64 nt, Homo Sapiens
guauauacuuuauuauuuuuaagauauaucaauauaaaaacaaggugcauucaagcugugugac

SEQ ID NO: 87199 - RNA, 64 nt, Homo Sapiens
uaaguaccuagaagagcuccuaaagugcagaccuuaaaaacagcccuugauuuacagugcaggg

SEQ ID NO: 87200 - RNA, 64 nt, Homo Sapiens
uaggaagaaaugcuugcucugaaauaguauagauuaaaaacacucaguagaaaagaaucuaaaa

SEQ ID NO: 87201 - RNA, 64 nt, Homo Sapiens
gaaauuaucacuuggauguggagguuuuacuuuuuaaaaacauucagcuuaauuaccuuaccuu

SEQ ID NO: 87202 - RNA, 64 nt, Homo Sapiens
auagacacaaucaagacaauagugcaccguuccuuaaaaacagcaucugaggaaucccccuuuu

SEQ ID NO: 87203 - RNA, 64 nt, Homo Sapiens
aaucucuaggguaagccagaaggcaagaucagauuaaaaacaccauguuucuaagcauccauuu

SEQ ID NO: 87204 - RNA, 64 nt, Homo Sapiens
aguacuugaaauguauugacugcugacuauauuuuaaaaacaaaaugaaauaauuugaguugua

SEQ ID NO: 87205 - RNA, 64 nt, Homo Sapiens
cauuuggugcucugcuaaccauuuauauaaaacuuaaaaacaagagaaaagaaaaaucaauuag

SEQ ID NO: 87206 - RNA, 64 nt, Homo Sapiens
ugguuugucaguuuaucuuaagcaugucaauucauaaaaacaagucauuuuuguauuuuucauc

SEQ ID NO: 87207 - RNA, 64 nt, Homo Sapiens
uuuacugucuguuggauaauggcuguaaaauguuuaaaaacaaaacaaaacaaaaaagaggcac

SEQ ID NO: 87208 - RNA, 64 nt, Homo Sapiens
cacagggcuuucaguuuggcaaaggaaaagcagauaaaaacagaacauuccauauguuucuuuc

SEQ ID NO: 87209 - RNA, 64 nt, Homo Sapiens
aauaguuauucucuaagaggaaacuaguguuuguuaaaaacaaaaauaaaaacaaaaccacaca

SEQ ID NO: 87210 - RNA, 64 nt, Homo Sapiens
cuaagaggaaacuaguguuuguuaaaaacaaaaauaaaaacaaaaccacacaaggagaacccaa

SEQ ID NO: 87211 - RNA, 64 nt, Homo Sapiens
aagcaagucuagcaauugaauugauuguugauaauaaaaacaaauccaagaguguaccauuaac

SEQ ID NO: 87212 - RNA, 64 nt, Homo Sapiens
aaaguuggaaggcagaaacccaaaaaaguaaaaauaaaaacaaaacuuguuuagaaaaaaaaga

SEQ ID NO: 87213 - RNA, 64 nt, Homo Sapiens
ugauuuuuuuaaaagucacaccucuuguuuuuauuaaaaacaaaaaugcuuuugcauggacuau

SEQ ID NO: 87214 - RNA, 64 nt, Homo Sapiens
gguuuggcacuagcagcaguaguccugauaauauuaaaaacauugcuuuauuucacauuuuuuc

SEQ ID NO: 87215 - RNA, 64 nt, Homo Sapiens
uuaauuacauuguggaagauuauuuuuuaucuuguaaaaacacuuuuuugguuuaauauauauu

SEQ ID NO: 87216 - RNA, 64 nt, Homo Sapiens
agacacaaaagcauacacaggaaaaaaugaugcauaaaaacauggcuucuguagaacaauagag

SEQ ID NO: 87217 - RNA, 64 nt, Homo Sapiens
auagaaaaguuaaggucugagugcaugugugcauuaaaaacauuucacuaccuauucucucaug

SEQ ID NO: 87218 - RNA, 64 nt, Homo Sapiens
uuuacauaccugucuguagguaagcaaguguuaguaaaaacaauuuugucaaacaguacuccug

SEQ ID NO: 87219 - RNA, 64 nt, Homo Sapiens
aaaauuagcugggggugguaaacccugucucuacuaaaaacauacagccuggccaacauggcaa

SEQ ID NO: 87220 - RNA, 64 nt, Homo Sapiens
cgaaacaacugacuucauacuuacuguugcuauguaaaaacaaaggggaccuagugaauggucu

SEQ ID NO: 87221 - RNA, 64 nt, Homo Sapiens
uuuguaauuuuaaguaaaauccugcacaugaguguaaaaacaugaaugauaaaaaaaacugcuc

SEQ ID NO: 87222 - RNA, 64 nt, Homo Sapiens
cagaaaaaguauaauuuauaauagauaaaaauuuuaaaaacagcagaaaauaauuuuuaaaaua

SEQ ID NO: 87223 - RNA, 64 nt, Homo Sapiens
uuaggaaauaguuaugagauuaagggaaaaucuauaaaaacaagguuagcauauucucaacaca

SEQ ID NO: 87224 - RNA, 64 nt, Homo Sapiens
auuuuguuauauggaaugguuaauuuuuaccuaauaaaaacauagaugaaauacauuguauuuu

SEQ ID NO: 87225 - RNA, 64 nt, Homo Sapiens
aaaagcuaaagcugccaaauuucuguugaacucuuaaaaacagcucauguuuguuuguccucuc

SEQ ID NO: 87226 - RNA, 64 nt, Homo Sapiens
auuuaaauaacuuauuuuucuccauugcuguucuuaaaaacauuguaaguagcuguaauauacc

SEQ ID NO: 87227 - RNA, 64 nt, Homo Sapiens
aaaagaagcaggugaaaaugcuaguagcaacuuuuaaaaacauacauaggucacuuuaaauguu

SEQ ID NO: 87228 - RNA, 64 nt, Homo Sapiens
uugguugcauauuugcuaaggguuugagagaagauaaaaacauugaguaauagagaauucuuca

SEQ ID NO: 87229 - RNA, 64 nt, Homo Sapiens
ugucuguggcauuuguauacaaauaaaguagguguaaaaacaacuucagccauuagaagcuauc

SEQ ID NO: 87230 - RNA, 64 nt, Homo Sapiens
uauuaauagauguuuucccuggaaauauuugauuuaaaaacauaagggacuuguaagcauuucu

SEQ ID NO: 87231 - RNA, 64 nt, Homo Sapiens
aaaccauccacucuguauauuaagguagggggaguaaaaacaagaggggaaauggauugggguu

SEQ ID NO: 87232 - RNA, 64 nt, Homo Sapiens
ucagcuggguguggugccaccuacagaaaaaauuuaaaaacagaaauauagugagaccaugucu

SEQ ID NO: 87233 - RNA, 64 nt, Homo Sapiens
uuugccuuugaaacguuaauagaaagucuaauguuaaaaacaacucuaaguugccaacuggcaa

SEQ ID NO: 87234 - RNA, 64 nt, Homo Sapiens
aaaaauuagccgggcgugguacccccaucucuacuaaaaacacaagccugaccagcauggugga

SEQ ID NO: 87235 - RNA, 64 nt, Homo Sapiens
acuuauaguauaccacuaauaggcaccagagggauaaaaacaaucaugugccagaugcuccgcu

SEQ ID NO: 87236 - RNA, 64 nt, Homo Sapiens
uuacaagauauuuguuuuauuaauauuugcuggcuaaaaacaaaugugguuuuuauauauuuuu

SEQ ID NO: 87237 - RNA, 64 nt, Homo Sapiens
uuuccacuuuugcugaagcuuuuaaucagauguguaaaaacaauugaccagcuaggcuauuuag

SEQ ID NO: 87238 - RNA, 64 nt, Homo Sapiens
cuggcugcaaagaagaaucaacagggacacuuuuuaaaaacacucuuaucagccugggcaacac

SEQ ID NO: 87239 - RNA, 62 nt, Homo Sapiens
gcgagacccugucucaaaaaaauaaaauaaaaaauaaaaacacccuugccugcgcuccauuc

SEQ ID NO: 87240 - RNA, 64 nt, Homo Sapiens
gcauguauagguaugaucuguguaaaaucugacauaaaaacagugcuauucugagugaaaauuu

SEQ ID NO: 87241 - RNA, 64 nt, Homo Sapiens
uuuuaaagacaaagcauucuaaaugaacucaauauaaaaacauucauuuggaauguacauacug

SEQ ID NO: 87242 - RNA, 64 nt, Homo Sapiens
accugaugaaacagaugaagaaacaaaaguaaauuaaaaacaaaacaaaaaaaaaaacaaaaaa

SEQ ID NO: 87243 - RNA, 64 nt, Homo Sapiens
acaaaaaaaaaaacaaaaaaagaaaaauagaaauuaaaaacaaauuaagguuucugaguuaacc

SEQ ID NO: 87244 - RNA, 64 nt, Homo Sapiens
uauuguaccauguaccuaauuucaugcuuccagguaaaaacagauauuuaccuuuuaagacauu

SEQ ID NO: 87245 - RNA, 64 nt, Homo Sapiens
acuuuugcuuuuuuauuuacucucauauauauuuuaaaaacacugugaaaaaaauuauucaugc

SEQ ID NO: 87246 - RNA, 64 nt, Homo Sapiens
aguuauucauaaagagaaaacauuuaaaguuguauaaaaacauggaaauagaaaaggaagacag

SEQ ID NO: 87247 - RNA, 64 nt, Homo Sapiens
uccugguuuuuaauguaugccugcuaaagcacauuaaaaacaaacacaguuuuagaaucuacug

SEQ ID NO: 87248 - RNA, 64 nt, Homo Sapiens
ggggcuaucauuuuuaaagauauuuagguaagcauaaaaacauagccaaauauuaaauaugguu

SEQ ID NO: 87249 - RNA, 64 nt, Homo Sapiens
agaagaauuuauguuaaacuuuaagguaaggguguaaaaacauuuuugagauaagguuuuuauu

SEQ ID NO: 87250 - RNA, 64 nt, Homo Sapiens
aauaauuaucaggacuuuuuucaggaguggguuauaaaaacauucaaguuggucugacaguauu

SEQ ID NO: 87251 - RNA, 64 nt, Homo Sapiens
guuuggaagaagaacaagaauuccacaugagaaguaaaaacaguuuacaguacucagcaaaaga

SEQ ID NO: 87252 - RNA, 64 nt, Homo Sapiens
aaugaagaacaacuuuaucaaggaagcuaguauuuaaaaacaaauucaugagcaagcugcaaau

SEQ ID NO: 87253 - RNA, 64 nt, Homo Sapiens
aauaauuggaauauauugcaggcauuaagcucauuaaaaacaaacuggcuugcagaaggguccg

SEQ ID NO: 87254 - RNA, 64 nt, Homo Sapiens
aaacauuuuuuaaaaaaugaacaguguaugucuauaaaaacaaugcuuuaauuucuuccguuug

SEQ ID NO: 87255 - RNA, 64 nt, Homo Sapiens
cacauuggugagaugcaccccuuauacauauuucuaaaaacagguuauccuccuuuccgacccu

SEQ ID NO: 87256 - RNA, 64 nt, Homo Sapiens
aaauggugcaugucauugagaaggugguuuauuguaaaaacaggacuuccaaaaacaagggaac

SEQ ID NO: 87257 - RNA, 64 nt, Homo Sapiens
uguaaauaaaagaaaacacaaauaccaaauacaguaaaaacaaagguagagaguguugaaauuc

SEQ ID NO: 87258 - RNA, 64 nt, Homo Sapiens
uuggcuuugucucauugaucaagugauuuuaauuuaaaaacaaaugaaaauaaaaaguauuccc

SEQ ID NO: 87259 - RNA, 64 nt, Homo Sapiens
uaggaagaaauugaaauuucaauguugauaugaguaaaaacaaaaauaaauccagauacauauu

SEQ ID NO: 87260 - RNA, 64 nt, Homo Sapiens
cauuugaacacaguagucccgacauuuugcagauuaaaaacauuauagaaaggacauuacuaau

SEQ ID NO: 87261 - RNA, 64 nt, Homo Sapiens
uuaauguuuuauagacccugaaaauaguaaaauauaaaaacaaauaaaaacaaaaaaacacaaa

SEQ ID NO: 87262 - RNA, 64 nt, Homo Sapiens
aaaacacaaaaaaauaguaaauuacuuauugauuuaaaaacaaaaaacauaaugcuaguccuag

SEQ ID NO: 87263 - RNA, 64 nt, Homo Sapiens
uuucuggggaauccaauuauaguugcuuuguauuuaaaaacaagaacagccaaggguuguucgc

SEQ ID NO: 87264 - RNA, 64 nt, Homo Sapiens
uuugucgugucuauaaaggaagaacaaaacaaaauaaaaacagagcccuagagaaaugcuguua

SEQ ID NO: 87265 - RNA, 64 nt, Homo Sapiens
ucgcaugcauaggauuuguucuacagguagauuuuaaaaacacguuaaagggccuuaaggcauu

SEQ ID NO: 87266 - RNA, 64 nt, Homo Sapiens
aacgggugaaagaggguuucaauaaaauuuuaaauaaaaacagcauuagaauuguccuuuucau

SEQ ID NO: 87267 - RNA, 64 nt, Homo Sapiens
aagaagucuugaaguuggguguuuccagaauugguaaaaacagcagcucauagaauuuugagua

SEQ ID NO: 87268 - RNA, 64 nt, Homo Sapiens
gucaucagaugccugcuugauaauauauaaacaauaaaaacaacuuucacuucuuccuauugua

SEQ ID NO: 87269 - RNA, 64 nt, Homo Sapiens
ugaucucuuucuucuguuuuggagaguuuauuauuaaaaacauuucuuugauaaaauggccauc

SEQ ID NO: 87270 - RNA, 64 nt, Homo Sapiens
gcauuuccagcuaaucucuucugcucuaaauauuuaaaaacaguucuucucaaacauuuucauu

SEQ ID NO: 87271 - RNA, 64 nt, Homo Sapiens
gaaaaaucuucgcuuuucauaguuagcuuaagcauaaaaacaaauugugggaaagcagaacuga

SEQ ID NO: 87272 - RNA, 64 nt, Homo Sapiens
aaaaauuaagaggggccaagagauuaaaaauaaauaaaaacauaaaucaguucuaugcugccaa

SEQ ID NO: 87273 - RNA, 64 nt, Homo Sapiens
cuaggucaauguuuuucaagggcugaucaaaacuuaaaaacacauuuaaguggcuugauuaaau

SEQ ID NO: 87274 - RNA, 64 nt, Homo Sapiens
uauagaaaauucauuuaauuuugcaauuuuaauuuaaaaacauuucuucugcauagaaaaagaa

SEQ ID NO: 87275 - RNA, 64 nt, Homo Sapiens
cacagcacuguucaucuggccaaacaacugugguuaaaaacacauguaaaaugcuuuuuaacag

SEQ ID NO: 87276 - RNA, 64 nt, Homo Sapiens
gcccaggaauucuuccaguaggugcucagcuauuuaaaaacaaaacuauucucaaacauucauc

SEQ ID NO: 87277 - RNA, 64 nt, Homo Sapiens
uagguuccauccuuuacguguuuaaaaaaaagcauaaaaacauuuuaaaaacauagaaaaauuc

SEQ ID NO: 87278 - RNA, 64 nt, Homo Sapiens
cuuuacguguuuaaaaaaaagcauaaaaacauuuuaaaaacauagaaaaauucagcaaaccauu

SEQ ID NO: 87279 - RNA, 64 nt, Homo Sapiens
gaauuucauucauaaugcugaaacugugugaaauuaaaaacaaacugauuucauauuguauuuu

SEQ ID NO: 87280 - RNA, 64 nt, Homo Sapiens
cguuaacuucagaggaaggagcguuuaugcuuuuuaaaaacacaguuuauacacuggaaauguu

SEQ ID NO: 87281 - RNA, 64 nt, Homo Sapiens
gucugucuugugacaguuucaucugaacuuaacuuaaaaacaacuguuaauguucuaguugugc

SEQ ID NO: 87282 - RNA, 64 nt, Homo Sapiens
cugaaagcaggaaugccuacauuaauuccuacauuaaaaacagccaucuacccuugauuaucua

SEQ ID NO: 87283 - RNA, 64 nt, Homo Sapiens
cacuccugaauuuacuuggauuuaaagagguuaauaaaaacaaacuauaaacucucuagacugg

SEQ ID NO: 87284 - RNA, 64 nt, Homo Sapiens
cccaaagcagcagaaggcagggguuaaaucaggauaaaaacagacaucaguggaaucgaaaacc

SEQ ID NO: 87285 - RNA, 64 nt, Homo Sapiens
gaaaugaaggauuucacacuucagaauauuuuacuaaaaacauuccagucuuggccgggugcgg

SEQ ID NO: 87286 - RNA, 64 nt, Homo Sapiens
agaccagccugggaacacagcgagacccucucauuaaaaacaacaaaacaaaacaauuccaguc

SEQ ID NO: 87287 - RNA, 64 nt, Homo Sapiens
aacagcaagaaaaaugcuuauaauguaguacaauuaaaaacaacacaucuccacuaccagugcu

SEQ ID NO: 87288 - RNA, 64 nt, Homo Sapiens
acucuuauuagcacugcaaaagcuccugagaauuuaaaaacacaguaauucucuggauguuagg

SEQ ID NO: 87289 - RNA, 64 nt, Homo Sapiens
ggaagucuuuucaccaaaccaagucagggugauauaaaaacauucugcugggccuuuuuucauc

SEQ ID NO: 87290 - RNA, 64 nt, Homo Sapiens
ggagaagaagcugagcuauuagcagaaaauacaguaaaaacacauuuucuuaaaagucuaagau

SEQ ID NO: 87291 - RNA, 64 nt, Homo Sapiens
uucuaagucauguauaggcuuucauauaacuuguuaaaaacaugguggagcacaaaaggagauu

SEQ ID NO: 87292 - RNA, 64 nt, Homo Sapiens
caagugccaagauguugaguuauuguugaaaaguuaaaaacaacggaggggagugaacagugcc

SEQ ID NO: 87293 - RNA, 64 nt, Homo Sapiens
gacgucuucaauaugccagaaaauauguauugauuaaaaacaaagcacacaguaggcacucaau

SEQ ID NO: 87294 - RNA, 64 nt, Homo Sapiens
gugaauuucuuucacuuaagugcgucauaauugcuaaaaacaggugugacagaaguaaauauag

SEQ ID NO: 87295 - RNA, 64 nt, Homo Sapiens
ucauguucaaaggagcuuuucuagacuguaaguuuaaaaacaauuuuaaaaauuaggcuuauug

SEQ ID NO: 87296 - RNA, 64 nt, Homo Sapiens
aaauauaaugcuaguccuagauuacuuauugauuuaaaaacaaaaaaaagauuacuuaauuuug

SEQ ID NO: 87297 - RNA, 64 nt, Homo Sapiens
uuaaaaacaaaaaaaagauuacuuaauuuugauuuaaaaacaaaaaaucguaaaauacaaaaac

SEQ ID NO: 87298 - RNA, 64 nt, Homo Sapiens
cucauggcuuugaucuucaaaaggaagagccuuuuaaaaacauuugccaaccucaagaauaaau

SEQ ID NO: 87299 - RNA, 64 nt, Homo Sapiens
uugaaaaccgugaauuaagauauucuuaucaguauaaaaacacugagauugcuuaccucccaaa

SEQ ID NO: 87300 - RNA, 64 nt, Homo Sapiens
gaaaugguuuaacaaacuaguuaucauuuuuaaauaaaaacaggcuuuauacagaagcacaacc

SEQ ID NO: 87301 - RNA, 64 nt, Homo Sapiens
agagcacugaaucaaaagaauuuuguuccuuuuuuaaaaacacaauuuugagucuugcauuacu

SEQ ID NO: 87302 - RNA, 64 nt, Homo Sapiens
auuucguugauaucaguaguaaauauauauaagcuaaaaacaguugagguaauacugauuuuga

SEQ ID NO: 87303 - RNA, 64 nt, Homo Sapiens
aaaccaggauucuacuguuuaagcucauugacaguaaaaacaacauaauacagagaauagcuau

SEQ ID NO: 87304 - RNA, 64 nt, Homo Sapiens
agaaaauacaagagaaaauuauaauguaaaaugguaaaaacauaaguaguuuuuuuuucaauua

SEQ ID NO: 87305 - RNA, 64 nt, Homo Sapiens
caauagaugacacugaugguuuuacuccuuuuuuuaaaaacacaugcgcgcgcacacacacaug

SEQ ID NO: 87306 - RNA, 64 nt, Homo Sapiens
uuuacaaaaaaacaaaaaccuuuuaccaagauuauaaaaacacuugugaaauauuauuuuauua

SEQ ID NO: 87307 - RNA, 64 nt, Homo Sapiens
uuuuuuuaagcacuggggaucaaaaauaaaauaauaaaaacaaauccuccacugacuacugacu

SEQ ID NO: 87308 - RNA, 64 nt, Homo Sapiens
gauuuaaagcacuuuuaaaucuuauccugcccccuaaaaacaaaagguuuugaucacaagggga

SEQ ID NO: 87309 - RNA, 64 nt, Homo Sapiens
aaccaugcaauuaccugccuuaguucuuuugucauaaaaacaaucacuugguugguuguauugu

SEQ ID NO: 87310 - RNA, 64 nt, Homo Sapiens
uucugguuagcuaauugaacuuuugugaccuguuuaaaaacaaaucaaauuuauugaacaaaug

SEQ ID NO: 87311 - RNA, 64 nt, Homo Sapiens
cuccagcccguaugacagagugagacccuguuucuaaaaacaaaacaaacaaacaaacaaacaa

SEQ ID NO: 87312 - RNA, 64 nt, Homo Sapiens
auauuuaauuaugguuuucuugaaacguguaaauuaaaaacacaaucaguguucaggcuucagu

SEQ ID NO: 87313 - RNA, 64 nt, Homo Sapiens
gaugugaccacacucuucuuaauuuuguucacaguaaaaacacuuuuuugaguuauuaggcuua

SEQ ID NO: 87314 - RNA, 64 nt, Homo Sapiens
aagggcaaaccuaggaagcucuucucacaagaauuaaaaacaaaucccaagcccuaaagagaac

SEQ ID NO: 87315 - RNA, 64 nt, Homo Sapiens
uagguuuaacaaaccuuccugaaacgugauauuuuaaaaacaugauauauauauauauuuaucu

SEQ ID NO: 87316 - RNA, 64 nt, Homo Sapiens
uuacauuucaggaauucugugcucuuaaauauauuaaaaacaauauaaaucaagacuucugugu

SEQ ID NO: 87317 - RNA, 64 nt, Homo Sapiens
ucagauuuuaauccgaauuuuguuggcaacuccauaaaaacauuguaucagguacauuccagcc

SEQ ID NO: 87318 - RNA, 64 nt, Homo Sapiens
gcuucaacaguauugccagguuccuaaaauugucuaaaaacaugauuuggcuuccauuuuugca

SEQ ID NO: 87319 - RNA, 64 nt, Homo Sapiens
aaaucauggaagauugcauaccugugugguauuuuaaaaacaaguugacuuuuucaguuucuug

SEQ ID NO: 87320 - RNA, 64 nt, Homo Sapiens
ggaguagugauaaacaccuuaaucauaaaaugaauaaaaacaaaaaaaccauggggcuugucug

SEQ ID NO: 87321 - RNA, 64 nt, Homo Sapiens
uuucuuccacuuuaauuuaaaaguucaugucauuuaaaaacaagucaagaaauuaaaauuguau

SEQ ID NO: 87322 - RNA, 64 nt, Homo Sapiens
ugcuuuuauguguauuuuauauugcaugcuuuuguaaaaacaugcugggugaugaaagauuagu

SEQ ID NO: 87323 - RNA, 64 nt, Homo Sapiens
ucguugggcuuuaaaagaaaagguuuggcagaacuaaaaacaaaacucacguaucaucucaaua

SEQ ID NO: 87324 - RNA, 64 nt, Homo Sapiens
uacacccacagaacccggcuuuguccccaaagaauaaaaacaccucucuaaaagcugcucuucc

SEQ ID NO: 87325 - RNA, 64 nt, Homo Sapiens
gagagagguguccuccugacauccaggcagucguuaaaaacacauugcucacugcaggcaggca

SEQ ID NO: 87326 - RNA, 64 nt, Homo Sapiens
aaacaaagaaaagcuuguauccccgaugcuaaauuaaaaacagauccuucauuacucaucacau

SEQ ID NO: 87327 - RNA, 64 nt, Homo Sapiens
uuuacaaguuacaaccaacucuuaauucuuaauuuaaaaacauggaacggguacuacacuuuau

SEQ ID NO: 87328 - RNA, 64 nt, Homo Sapiens
auuuauauauagauauauauuucucuuuccuccuuaaaaacaaaagcacuuuuuagauuuuuuu

SEQ ID NO: 87329 - RNA, 64 nt, Homo Sapiens
cuaauguucuuccuuuuacauccuggaacaacaauaaaaacauuuuuuuaaacuugucuacugu

SEQ ID NO: 87330 - RNA, 64 nt, Homo Sapiens
uuuuuuuuuuuuuuuacugcauguuacauugaaauaaaaacaaaguaaaaugagcaauugccuu

SEQ ID NO: 87331 - RNA, 64 nt, Homo Sapiens
cagugugacuuuaauauuauguuuagucacagcuuaaaaacauugugcagggcaauguuucaaa

SEQ ID NO: 87332 - RNA, 64 nt, Homo Sapiens
auugggaaacuagagaacacuuccugcauugaaauaaaaacauuccucccaugaaauugcguuc

SEQ ID NO: 87333 - RNA, 64 nt, Homo Sapiens
acaaaacuuuuuuuagaagauccuguugaauggguaaaaacaaacgugugugucuaauuuuuuu

SEQ ID NO: 87334 - RNA, 64 nt, Homo Sapiens
gcaucuauuuuggcagaaauaauguaaguauccuuaaaaacaaaaucagacugaucuaauguga

SEQ ID NO: 87335 - RNA, 64 nt, Homo Sapiens
caccauauaaacuugcauuucuuuuuaaauccuuuaaaaacacuuauuaugcugauggagcaug

SEQ ID NO: 87336 - RNA, 64 nt, Homo Sapiens
uucaagggauaaggccuucuaaagugcuaguguuuaaaaacauuuucuaccaguguuucaauuu

SEQ ID NO: 87337 - RNA, 64 nt, Homo Sapiens
uuuaagaaaagauaaacaccauuuuauuuauuuauaaaaacaaaauuaguuucaaauauuuuug

SEQ ID NO: 87338 - RNA, 64 nt, Homo Sapiens
uacauugaccagcgcugggugauacagauucugauaaaaacauaaauguauuaguucaucucca

SEQ ID NO: 87339 - RNA, 64 nt, Homo Sapiens
gcccagcgcuaagggcugcuagcagcaggcaugaucagggcaggcugugugucugagcccacuc

SEQ ID NO: 87340 - RNA, 64 nt, Homo Sapiens
gggauggugacuucugagcucaaguucugacuuuucagggcaguugugagcgaccacauccggu

SEQ ID NO: 87341 - RNA, 64 nt, Homo Sapiens
uucaaucccucaccuaguccgcuggguugagaggucagggcacuauuaacucucccugaugugu

SEQ ID NO: 87342 - RNA, 64 nt, Homo Sapiens
gggugugaggcaugagcugggggggcccccuuuuucagggcagagaaugaggcgugugcacugu

SEQ ID NO: 87343 - RNA, 64 nt, Homo Sapiens
acugaucacaggugucaccguaguggcuaccaccucagggcagccccucccuccagcuggcggg

SEQ ID NO: 87344 - RNA, 64 nt, Homo Sapiens
gugugguggcuuaugccuguucuuaagauaaaaaucagggcagguaauaauuugaaauucaucu

SEQ ID NO: 87345 - RNA, 64 nt, Homo Sapiens
uaaggacaggauaaaggccugucugaugauggugucagggcagccucaggguguucugcugguu

SEQ ID NO: 87346 - RNA, 64 nt, Homo Sapiens
ugcaauuauuagguuuuguuuccauauauucugcucagggcacuucagagaacuugcuuaaucu

SEQ ID NO: 87347 - RNA, 64 nt, Homo Sapiens
gcggagacgcgucagauggcucaggaacccagcuucagggcaucucccacgugcaaaaucaaca

SEQ ID NO: 87348 - RNA, 64 nt, Homo Sapiens
acuuuuccucauucuuaauaggugucuaagaaugucagggcaaaaguaugggcauuuuucuugc

SEQ ID NO: 87349 - RNA, 64 nt, Homo Sapiens
ggaugcuccuggagccucuucucuggcugcuaccucagggcaugguuguggccccaccaacacc

SEQ ID NO: 87350 - RNA, 64 nt, Homo Sapiens
gcccaggcagcucauucacuaccugugauccaccucagggcacgggcaaacacauaggcuugcg

SEQ ID NO: 87351 - RNA, 64 nt, Homo Sapiens
accccguuguaaugugccacaacacccucaauagucagggcaacugguggagcauggaagucga

SEQ ID NO: 87352 - RNA, 64 nt, Homo Sapiens
ggaacauggggguagaguggauauaggccaaaccucagggcaagagauuccuuucuccugcuuc

SEQ ID NO: 87353 - RNA, 64 nt, Homo Sapiens
guguauuugaucagaaguggaaucucuugccuuuucagggcaaauuugacaugccuuuuccaca

SEQ ID NO: 87354 - RNA, 64 nt, Homo Sapiens
cagugaugaaauggaccccuccacacaggcauccucagggcacagggcccugggggcaccuucc

SEQ ID NO: 87355 - RNA, 64 nt, Homo Sapiens
aaaugacaggaauuccagagccaggugcauccacucagggcagccaguguugguggagcugccu

SEQ ID NO: 87356 - RNA, 64 nt, Homo Sapiens
agcuuccuccaggguuccccagccaccucccagcucagggcacaguguaucgacaaucugucag

SEQ ID NO: 87357 - RNA, 64 nt, Homo Sapiens
agaggacaccuccccaucacucagcauucccagcucagggcacaggcaggcugggguccucgcu

SEQ ID NO: 87358 - RNA, 64 nt, Homo Sapiens
cuuugcaaccgacagcaaacagcuuucuccggccucagggcagaaaaagggaauggcagggagu

SEQ ID NO: 87359 - RNA, 64 nt, Homo Sapiens
aggacacagccaggacggcagaggccuccuggccucagggcaugcccugccuaccuucugaaau

SEQ ID NO: 87360 - RNA, 64 nt, Homo Sapiens
cagguggcucaugggcuguacugaggugcccagcucagggcagcgugaccugggacgggugggc

SEQ ID NO: 87361 - RNA, 64 nt, Homo Sapiens
ccuugacuccuaagccccuugucccaccacguucucagggcagccagucagggagggagggagu

SEQ ID NO: 87362 - RNA, 64 nt, Homo Sapiens
acuaacaggcgcaaaaguagcuuccugucagggaucagggcagcuuaucuaaaauuagccagcu

SEQ ID NO: 87363 - RNA, 64 nt, Homo Sapiens
gauuaucuaaaauuagccaguagacacuucagugucagggcacaguuucuauagccccuaugau

SEQ ID NO: 87364 - RNA, 64 nt, Homo Sapiens
aacauuaccuaaaaggcacuaacaugcucagguuccccagaaagaggcguaagaagggccucuc

SEQ ID NO: 87365 - RNA, 64 nt, Homo Sapiens
agcuucaaggcucacaauggaagcacugucauuuccccagaaaagcuguguucccuaugcugaa

SEQ ID NO: 87366 - RNA, 64 nt, Homo Sapiens
ugccuucucuaugcagccugcccuccaucauccaccccagaauugcucucuuuccucucuuagc

SEQ ID NO: 87367 - RNA, 64 nt, Homo Sapiens
guccuggaggcagguugugcagcuuaggggaggaccccagaaucuggaccccagagucuggaag

SEQ ID NO: 87368 - RNA, 64 nt, Homo Sapiens
cugaugugaaagagauucuggaaauccaaauguuccccagaaauucugauaucaaaacauucca

SEQ ID NO: 87369 - RNA, 64 nt, Homo Sapiens
agagggcucugggugcccauacucuucccuuguuccccagaaguugcagggccccuccacgccc

SEQ ID NO: 87370 - RNA, 64 nt, Homo Sapiens
ccuuccucuccacugcaggcgcccuguucugggcccccagaaccugcgggacgagaaccaguag

SEQ ID NO: 87371 - RNA, 64 nt, Homo Sapiens
ccugaccucauuugggcacccccccgucccuccaccccagaagcuucccccgccgccacugugc

SEQ ID NO: 87372 - RNA, 64 nt, Homo Sapiens
aagcagcucuuggacccacgcucagcaugggugcccccagaagucagcucugccucgcagcccc

SEQ ID NO: 87373 - RNA, 64 nt, Homo Sapiens
gggcccagcuugcucagucaaggggcugccaggcccccagaaaacacuuggagccaucggguag

SEQ ID NO: 87374 - RNA, 64 nt, Homo Sapiens
cagugugcaugcaacacacuuaggggaggaguggccccagaauucagcacgcacacaacacaca

SEQ ID NO: 87375 - RNA, 64 nt, Homo Sapiens
acauucuccucuggggcucuaccucuccacacuuccccagaagggaaaagggcacccuggauua

SEQ ID NO: 87376 - RNA, 64 nt, Homo Sapiens
aaaucacuccuuggugggcagcauccugaggcuuccccagaaccaggccucugcucuggcccuc

SEQ ID NO: 87377 - RNA, 64 nt, Homo Sapiens
gaggagugggcuuugaacuucacgaaacugggacccccagaaggaaggaaagggaagaagagau

SEQ ID NO: 87378 - RNA, 64 nt, Homo Sapiens
gcagagcugagcaggcuuggaggaauaaggggauccccagaagugugggggaggggggagaguc

SEQ ID NO: 87379 - RNA, 64 nt, Homo Sapiens
cuugaugaagaaaugucuuuagggugaaaccgaaccccagaaaauggcuuggaaaggggucagc

SEQ ID NO: 87380 - RNA, 64 nt, Homo Sapiens
uuguuguuugccuacugaagggcuuaaauuuugcccccagaaucaagaggacugagaauacuuu

SEQ ID NO: 87381 - RNA, 64 nt, Homo Sapiens
agacagagccugccacaucccuccagaccaggaaccccagaagguggcgcuguuggggagacuc

SEQ ID NO: 87382 - RNA, 64 nt, Homo Sapiens
uggggaguucuguccugcccccagacgaauuggcccccagaagaggaagcugaccgcacagugu

SEQ ID NO: 87383 - RNA, 64 nt, Homo Sapiens
aaguaaaaggcucaucaguuuuagcaucucugcuccccagaaaauuguaagcauccucaccagc

SEQ ID NO: 87384 - RNA, 64 nt, Homo Sapiens
auaaaacaaggacuuauucacacauguucuagaaccccagaauggcccaaguuaccugagacca

SEQ ID NO: 87385 - RNA, 64 nt, Homo Sapiens
ggggccagcacaguagugaaggcggucuccuggaccccagaagcgugcugugguguggacuggg

SEQ ID NO: 87386 - RNA, 64 nt, Homo Sapiens
aaggagcugcuucucucuucucccaguucuaccuccccagaagccuuccuccccagguggggcu

SEQ ID NO: 87387 - RNA, 64 nt, Homo Sapiens
gccugcaggugccuuguugcgcccccuccccaguccccagaacuggacaccugaggcagccagc

SEQ ID NO: 87388 - RNA, 64 nt, Homo Sapiens
agccgacacacagggagacgagagcaaacacccaccccagaacacugaaggggagcucugagac

SEQ ID NO: 87389 - RNA, 64 nt, Homo Sapiens
guuaacaguugaguguucagaaaauuuucuucuuccccagaagagcacuccugcuuuuguggga

SEQ ID NO: 87390 - RNA, 64 nt, Homo Sapiens
ugugugugagacugaguauggagggucugugagcccccagaaaugguuuauggauaggcuucaa

SEQ ID NO: 87391 - RNA, 64 nt, Homo Sapiens
agcuggagugcauaggucaguccuggagagcugcccccagaagaccaggagcucggacugcugg

SEQ ID NO: 87392 - RNA, 64 nt, Homo Sapiens
cugaggccaagggggccacuccaccaagcuccucccccagaaccccccaccgccauuggcaucc

SEQ ID NO: 87393 - RNA, 64 nt, Homo Sapiens
gaacgccagacaggaacacguccaaucucuguagccccagaaguugucuccucuccugauuucc

SEQ ID NO: 87394 - RNA, 64 nt, Homo Sapiens
acauaaacuuggaguccaucccacaggaauucaaccccagaaagcaaacguucaguucaagucu

SEQ ID NO: 87395 - RNA, 64 nt, Homo Sapiens
uggcccccucaaagaauuucuguggggauuuguaccccagaauccuguucccccaucccuucuc

SEQ ID NO: 87396 - RNA, 64 nt, Homo Sapiens
cugacacccaaauccagaaucccuggucuugaguccccagaacuuugccucuugacugucccuu

SEQ ID NO: 87397 - RNA, 64 nt, Homo Sapiens
gagccgccugcccuuucucuccgcuccagccucuccccagaacggcucuuuuugucacacagga

SEQ ID NO: 87398 - RNA, 64 nt, Homo Sapiens
aguuccucuccauccgccaccuccccucccgcugccccagaaguuucuaucauuccauggagaa

SEQ ID NO: 87399 - RNA, 64 nt, Homo Sapiens
aguuucgcucagagcuugucuccuuggcuuccaaccccagaaaugccugcugggccuuaagcuu

SEQ ID NO: 87400 - RNA, 64 nt, Homo Sapiens
acaggccaacccuggcacaggucaugucugcagcccccagaauguucuggacaugcaccaccag

SEQ ID NO: 87401 - RNA, 64 nt, Homo Sapiens
aggcugaagaggaaaggcagccccagaacaggauccccagaagcgccagucucuggcuguggcu

SEQ ID NO: 87402 - RNA, 64 nt, Homo Sapiens
ggauccccagaagcaggcugcucuggcuguggcuccccagaacaaggagagcccaggagccagu

SEQ ID NO: 87403 - RNA, 64 nt, Homo Sapiens
uucugucccucaugccugaggaaagaggcaggggccccagaagccuucaccaggggaugggcag

SEQ ID NO: 87404 - RNA, 64 nt, Homo Sapiens
accacugcuggaucccaggggcacuuggggcagcccccagaagggacucccagacugcagggga

SEQ ID NO: 87405 - RNA, 64 nt, Homo Sapiens
gaaggggugaggagagcagccagaggaaaaccagccccagaaugcugcaacuucucuucucucu

SEQ ID NO: 87406 - RNA, 64 nt, Homo Sapiens
ugccagccugagugggcaaggaagcagguggaucccccagaaggaaccgcagcucgcgaggcac

SEQ ID NO: 87407 - RNA, 64 nt, Homo Sapiens
gguaccuggagcgagagcuucuccgcccuuccaccaaccccacaggccgcuucgcggguggagc

SEQ ID NO: 87408 - RNA, 64 nt, Homo Sapiens
auagagaaauaacuuuuucuugcucauucccuuacaaccccaaucuauacauggauuuuuagaa

SEQ ID NO: 87409 - RNA, 64 nt, Homo Sapiens
ugcguggcuguuccccuuggcuggagcauucagccaaccccagcguccccccugaggcguucau

SEQ ID NO: 87410 - RNA, 64 nt, Homo Sapiens
gguggugguaagccgccaacgcaccugggggcugcaaccccaccggacgggugguccggaggga

SEQ ID NO: 87411 - RNA, 64 nt, Homo Sapiens
ugccuucaugcccuagggcccccuguccccuccccaaccccaaggcccagucccgcaguacauc

SEQ ID NO: 87412 - RNA, 64 nt, Homo Sapiens
acuccccaaagugccugccagggcccaaccugcccaaccccagccaaagccuucugggcugucg

SEQ ID NO: 87413 - RNA, 64 nt, Homo Sapiens
uucguccccuauucauuaacagugugugcaaaugcaaccccaggacacauuauuguucugauag

SEQ ID NO: 87414 - RNA, 64 nt, Homo Sapiens
gcccugcucauguuuuuuuccuguccccuuagaccaaccccagguguccacugcagggguucug

SEQ ID NO: 87415 - RNA, 64 nt, Homo Sapiens
aaauucuaguuguuauuugguggaagcaguagcccaaccccaguuuaggggaagguagcacagg

SEQ ID NO: 87416 - RNA, 64 nt, Homo Sapiens
gaauaugcugaccuuucacccugccaucccaucccaaccccagcucacuagccuucauauaugc

SEQ ID NO: 87417 - RNA, 64 nt, Homo Sapiens
ucagucaggaagcugcccauucuuggaaggguuccaaccccaaggucugaggaucugacuuggg

SEQ ID NO: 87418 - RNA, 64 nt, Homo Sapiens
cucccuuugcuguaccuggggagaguugguaucucaaccccaagcaucgacaaggcgcauaaug

SEQ ID NO: 87419 - RNA, 64 nt, Homo Sapiens
cuucuuggugccccaucucuugucuguguccuuccaaccccaagcugcuuauguggcccaaccc

SEQ ID NO: 87420 - RNA, 64 nt, Homo Sapiens
uguguccuuccaaccccaagcugcuuauguggcccaaccccacugcugucaacuaggcuugaac

SEQ ID NO: 87421 - RNA, 64 nt, Homo Sapiens
acacaaucagaaaugacaaaggggacauuaccaccaaccccacagaaauacgaaaaacccucaa

SEQ ID NO: 87422 - RNA, 64 nt, Homo Sapiens
auaaagaacucaaacaaaucaacaaugagaaaaacaaccccauuaaaaacugggcaaaggccau

SEQ ID NO: 87423 - RNA, 64 nt, Homo Sapiens
ggaggaggaggaggaggaagccuaaucccaaccccaaccccaugugccaagcuuggaucauggc

SEQ ID NO: 87424 - RNA, 64 nt, Homo Sapiens
cccaugggaggaggaggaggcauggcccuaaucccaaccccaaccagggaugccaagcuuggau

SEQ ID NO: 87425 - RNA, 64 nt, Homo Sapiens
ugugcuuucugggaccaaagcagaguuccugauuccaagucaccauagugacauagcuagagcg

SEQ ID NO: 87426 - RNA, 64 nt, Homo Sapiens
auguauuuccucuccccauuuccaagugcuuccuccaagucaaccugaagcaaccaaagauaua

SEQ ID NO: 87427 - RNA, 64 nt, Homo Sapiens
ccuugguacagugguuuuuaaauacugagaagaaccaagucagguuuuuuaaagcagacuaaaa

SEQ ID NO: 87428 - RNA, 64 nt, Homo Sapiens
gauggucuccacaggucuuuccaccucugugaguccaagucaggucaaucagcaaggacccauc

SEQ ID NO: 87429 - RNA, 64 nt, Homo Sapiens
aaauguuagauaugugggaaaggccuuuauucugccaagucauuucgaagacaugaaaaaacuc

SEQ ID NO: 87430 - RNA, 64 nt, Homo Sapiens
aaauguaagauaugugggaaaggcuuuuauucugccaagucauuucaaauaccugaaaaaucuu

SEQ ID NO: 87431 - RNA, 64 nt, Homo Sapiens
uccccuagggccuggaagggugggagguaugucuagggggcagugucucuuccagggggaauuc

SEQ ID NO: 87432 - RNA, 64 nt, Homo Sapiens
caggggaggggaaaccuuuuucauucaacauuguagggggcaagcuuuggugcgcccccugcug

SEQ ID NO: 87433 - RNA, 64 nt, Homo Sapiens
ugcaugucuccugcaaugagguauuggguaaaggagggggcaccgcccggccgucugucucuug

SEQ ID NO: 87434 - RNA, 64 nt, Homo Sapiens
uaaagacggaacaaguuuagggguggugggugggagggggcaaguccaauuuuauauuuaaggg

SEQ ID NO: 87435 - RNA, 64 nt, Homo Sapiens
agaaagaaauaaaccucauccauuuggccucuggagggggcagaggcaaaggaaccacccuacc

SEQ ID NO: 87436 - RNA, 64 nt, Homo Sapiens
ccaguggaauggaaagaauguccuccuggcuuccagggggcagccugacagcccaacaccaccu

SEQ ID NO: 87437 - RNA, 64 nt, Homo Sapiens
cccccagccugcucucuaggggagaucaaaccagagggggcaggcugagaccucaggcaggauu

SEQ ID NO: 87438 - RNA, 64 nt, Homo Sapiens
uugagccccucccuuccccacagaagggcuaggcagggggcaaagaggagagggcugaggaggg

SEQ ID NO: 87439 - RNA, 64 nt, Homo Sapiens
gaaggaaaagcugaggggggguggccagccugguagggggcagacucaggggccuucccugggg

SEQ ID NO: 87440 - RNA, 64 nt, Homo Sapiens
gggcugggaggucucagggguccaggugaggggcagggggcauggacaagcccacugggucugg

SEQ ID NO: 87441 - RNA, 64 nt, Homo Sapiens
gccggcgaguaaaguauuauuguggcagugcugaagggggcauucugucggagggcuggacauu

SEQ ID NO: 87442 - RNA, 64 nt, Homo Sapiens
guggucaggcccagccucucggcaccuuugagagagggggcacucuuagaggggaaugaaccau

SEQ ID NO: 87443 - RNA, 64 nt, Homo Sapiens
gccagguagcugggggagugggggcaccccaaagagggggcacugaacuggcugggcuugucag

SEQ ID NO: 87444 - RNA, 64 nt, Homo Sapiens
ccaaagagggggcacugccauggcugggcuugucagggggcacccccuuuugacuggaaugaac

SEQ ID NO: 87445 - RNA, 64 nt, Homo Sapiens
ggggacccagggaacaucggucuacucaggugugagggggcaggucugaccugccccaaaguug

SEQ ID NO: 87446 - RNA, 64 nt, Homo Sapiens
acaugccuucccuccccagccacaccgugcacgaagggggcacaggagaggagaggggcugugc

SEQ ID NO: 87447 - RNA, 64 nt, Homo Sapiens
ccaaauagaaggggucuggcccgggcauccacguagggggcaggggcaggggcgggcggaggga

SEQ ID NO: 87448 - RNA, 64 nt, Homo Sapiens
uuggagggggaagagaucccaggaggugcaguggagggggcaagcuuugcuccuucaguucugc

SEQ ID NO: 87449 - RNA, 64 nt, Homo Sapiens
gcaaaccuaccccggaucucuggcuucagccgccagggggcaguggcagcccuggggcccuuuc

SEQ ID NO: 87450 - RNA, 64 nt, Homo Sapiens
cccuuccaccuuuccccgagaccgucgucgcuggagggggcaggguccagcccgccuggaucgg

SEQ ID NO: 87451 - RNA, 64 nt, Homo Sapiens
cugguuaaaagcaagaaauucgagggcaggggagagggggcauucuucagggugaggcugcugg

SEQ ID NO: 87452 - RNA, 64 nt, Homo Sapiens
ucccacggagcgggcuugaaggagcaggguccccagggggcagcaaggggcccccugugaccga

SEQ ID NO: 87453 - RNA, 64 nt, Homo Sapiens
cuaccccuagugcuagucccagaggaugcugcggagggggcagccucagcucucuuuucagaga

SEQ ID NO: 87454 - RNA, 64 nt, Homo Sapiens
uggcucuaggcuugggacugcggcugccacaggaagggggcaucccccuacuuuggguguuggg

SEQ ID NO: 87455 - RNA, 64 nt, Homo Sapiens
agccauauggggucugcacacucaucucagcucuagggggcacggcuacagccaggccggcugc

SEQ ID NO: 87456 - RNA, 64 nt, Homo Sapiens
acuugggagguuccagcagggcacagggaaaugcagggggcaggcuacugcuccuucuccccuu

SEQ ID NO: 87457 - RNA, 64 nt, Homo Sapiens
ggccuguagaucagggauagcaagugaacuugggagggggcacgggucucugugggugggaaug

SEQ ID NO: 87458 - RNA, 64 nt, Homo Sapiens
gauacaucaucgggaaaaaacugaccucugcaagagggggcauucccuagcccuucuaccccac

SEQ ID NO: 87459 - RNA, 64 nt, Homo Sapiens
accagaugcgucccaagaugguggugccauccccagggggcaugcccggcucuacgggggccgc

SEQ ID NO: 87460 - RNA, 64 nt, Homo Sapiens
cggucgggcaggggcuggagcccgcagcccuggcagggggcaugcugcguccuuugguccuguc

SEQ ID NO: 87461 - RNA, 64 nt, Homo Sapiens
cuguugcuaggaggggcacauggagugggacaggagggggcaccuucuccagaugaugucccug

SEQ ID NO: 87462 - RNA, 64 nt, Homo Sapiens
aggagggggcaccuucuccagaugaugucccuggagggggcaggagguaccucccucucccucu

SEQ ID NO: 87463 - RNA, 64 nt, Homo Sapiens
cuccuuccccuacaaucccauccugagccauugcagggggcagggaaguucacccccccccacc

SEQ ID NO: 87464 - RNA, 64 nt, Homo Sapiens
cccgacuuuccucugggauauaaaaaaggggguaagggggcaaagagagcccucugggccucuc

SEQ ID NO: 87465 - RNA, 64 nt, Homo Sapiens
gagcaucucuuccucuucuggcugucugcugacaagggggcaugcucugccccagugcucucuu

SEQ ID NO: 87466 - RNA, 64 nt, Homo Sapiens
gagccuccagacccugcuaagguggagcuguggcagggggcacuaguggacucugugcucacug

SEQ ID NO: 87467 - RNA, 64 nt, Homo Sapiens
aagugaucuugguaguaucccagaucuguccagcagggggcaguagguugccuuggugcugccc

SEQ ID NO: 87468 - RNA, 64 nt, Homo Sapiens
uguuccugagguccucgccugucucucugucugcagggggcacuucagaagcuguugcuacugc

SEQ ID NO: 87469 - RNA, 64 nt, Homo Sapiens
ccuacagugggaccccucccuggugaucugggguagggggcacccugugacugugcagcgcccg

SEQ ID NO: 87470 - RNA, 64 nt, Homo Sapiens
ggcagcgaggggcaggacccucacugcccagugaagggggcaagcuaccccuuccaugcucauc

SEQ ID NO: 87471 - RNA, 64 nt, Homo Sapiens
cuggggcuacccaugggcaaguggggcucgggguagggggcacugcuugaagcacagcacuugg

SEQ ID NO: 87472 - RNA, 64 nt, Homo Sapiens
gagggaagaugggugcugggagaggguugggggcagggggcaaggaaaauugcuaccugauuug

SEQ ID NO: 87473 - RNA, 64 nt, Homo Sapiens
agaagcccgggagaggcccaccacauggcagcccagggggcaggcuguggcugccaggucuggg

SEQ ID NO: 87474 - RNA, 64 nt, Homo Sapiens
cugcauaauuaucaauggcguuuauggcgcaugcagggggcaacuuauaaacugaaccaugacc

SEQ ID NO: 87475 - RNA, 64 nt, Homo Sapiens
cucccauuucuguccuuggccuugggaguagcugagggggcagacuagggaguagggcuggcag

SEQ ID NO: 87476 - RNA, 64 nt, Homo Sapiens
gagggggcagacuagggaguagggcuggcaggggagggggcagacagccucgccucgcacccuu

SEQ ID NO: 87477 - RNA, 64 nt, Homo Sapiens
gccuccagcuuccaaagagcgugaggagggcggcagggggcacggggcacugcccggcccggcu

SEQ ID NO: 87478 - RNA, 64 nt, Homo Sapiens
gcccggcccggcugugaggaccccaagcucaagaagggggcacuagcgcugggcccucccuugc

SEQ ID NO: 87479 - RNA, 64 nt, Homo Sapiens
caggcaggcccccucccgugccucccaccaccccagggggcaggcgucuucuccccagccccgu

SEQ ID NO: 87480 - RNA, 64 nt, Homo Sapiens
caagauaucacugacuucaacccagaggaucgagccccugcacccugccuggggcccuggggug

SEQ ID NO: 87481 - RNA, 64 nt, Homo Sapiens
ugugcuguccuagggggagggagagcagagcucgccccugcacugcagccuugugggggagggc

SEQ ID NO: 87482 - RNA, 64 nt, Homo Sapiens
cuccgccucccggguucgagggcgcgaucuuggcccccugcaacugccuaggcuggagugcagu

SEQ ID NO: 87483 - RNA, 64 nt, Homo Sapiens
ccccgucugcugggccugcuccagccgugccuucccccugcaggguggcggugcgcacgggccu

SEQ ID NO: 87484 - RNA, 64 nt, Homo Sapiens
cccuggguccagcccccucucaccuucguuggagccccugcaucgggaaaccucccgaccccug

SEQ ID NO: 87485 - RNA, 64 nt, Homo Sapiens
uucguuggagccccugcaucgggaaaccucccgaccccugcacccaggauaagccucaggcccu

SEQ ID NO: 87486 - RNA, 64 nt, Homo Sapiens
ucacggugcaauauucaccaggugggggugagggccccugcaauuuggccaccauuaaacacgg

SEQ ID NO: 87487 - RNA, 64 nt, Homo Sapiens
cacacgugccacaccugcgccuggcccccaaaugccccugcacaauggagcagaauacuuaagc

SEQ ID NO: 87488 - RNA, 64 nt, Homo Sapiens
cuggcaggugggauuggcucaaccugcccuuucuccccugcagauucacaguucaagcacccca

SEQ ID NO: 87489 - RNA, 64 nt, Homo Sapiens
cccaugggaaugccgcagggacccuggcccccugccccugcacuaccugagguccuggcucccc

SEQ ID NO: 87490 - RNA, 64 nt, Homo Sapiens
gugacuagacguccuaacugggcagcccaacccuccccugcaaguuuguagcucaaguuguaau

SEQ ID NO: 87491 - RNA, 64 nt, Homo Sapiens
accauuaggaaaauauggccauacugcuuuuuuaccccugcacuauuucagugcaccacagaau

SEQ ID NO: 87492 - RNA, 64 nt, Homo Sapiens
cuuccccucuacacaggacaggcacagcagugccccccugcagccccugaaccccugggugggu

SEQ ID NO: 87493 - RNA, 64 nt, Homo Sapiens
cccugaaccccuggguggguacuaggcuuaggguccccugcauguuuuuggucuuggcucguau

SEQ ID NO: 87494 - RNA, 64 nt, Homo Sapiens
cuucccuagcccccucaauagccuggacccucaaccccugcaaccuguggaguggggagguugg

SEQ ID NO: 87495 - RNA, 64 nt, Homo Sapiens
uccccagagggcugcccacgcaccuuuacaccuaccccugcaagcagcccagccccaguacugc

SEQ ID NO: 87496 - RNA, 64 nt, Homo Sapiens
uugcauuuauuguaaugaaaucuacugaucaaugccccugcaggaaugaggcugaguguuuguu

SEQ ID NO: 87497 - RNA, 64 nt, Homo Sapiens
aguuuucuguugccacugcauaccaaacaguggcccccugcauuucuaaaaauguuuaaauaua

SEQ ID NO: 87498 - RNA, 64 nt, Homo Sapiens
gggcugccagcugagccaccugcgaccuccaccaccccugcaguaugugguggggacagcgcau

SEQ ID NO: 87499 - RNA, 64 nt, Homo Sapiens
ggcucauaggggacagccccucagcacuuccuguccccugcagacacagagagacaguucucag

SEQ ID NO: 87500 - RNA, 64 nt, Homo Sapiens
cauuugaacgccagguaucuccccuccucucucuccccugcagaggcauguagggaacagcagg

SEQ ID NO: 87501 - RNA, 64 nt, Homo Sapiens
cauuggucccagaguagcugaagggaagccaaccccccugcagcacaaauaggccccccagucc

SEQ ID NO: 87502 - RNA, 64 nt, Homo Sapiens
gugggcaggugauucugugggcaggggaugugcuccccugcaccucuggggugcagaaaccucu

SEQ ID NO: 87503 - RNA, 64 nt, Homo Sapiens
agaugggacagccagcccugccuaucuggacaggccccugcagccucuguccccuggccuagcc

SEQ ID NO: 87504 - RNA, 64 nt, Homo Sapiens
uuggacuuggaaggugugcggggacuggccgaggccccugcacccugcgcaucaggacugcuuc

SEQ ID NO: 87505 - RNA, 64 nt, Homo Sapiens
cuguuaacacuguguccugggggggcugggaaguccccugcaucccaugguacccugguauugg

SEQ ID NO: 87506 - RNA, 64 nt, Homo Sapiens
ugaaaccaaacguccaccugcaacccucccugaaccccugcaaagagcccucccugaaccccug

SEQ ID NO: 87507 - RNA, 64 nt, Homo Sapiens
ccucccugaaccccugcaaagagcccucccugaaccccugcaaccuuccccgguugugggacaa

SEQ ID NO: 87508 - RNA, 64 nt, Homo Sapiens
gcuugggucucucucggccccugucuguucccagccccugcagauucugagcaaaggcccuggg

SEQ ID NO: 87509 - RNA, 64 nt, Homo Sapiens
cagggcagggcgagcugcaggaaucaccccucugccccugcagcuggaaugugccacagaggcc

SEQ ID NO: 87510 - RNA, 64 nt, Homo Sapiens
gggcuaaacugcaggggccuaggagacgggguguccccugcaggggaguccgaugguuuucagc

SEQ ID NO: 87511 - RNA, 64 nt, Homo Sapiens
cuacaaacugggccucgggccuuccuuccaagggccccugcagcgguuccagccccuggcaggg

SEQ ID NO: 87512 - RNA, 64 nt, Homo Sapiens
cuggccuccccgcacaggcuccagggucugcccgccccugcagcagaaagcguagacccggggc

SEQ ID NO: 87513 - RNA, 64 nt, Homo Sapiens
auuccaggcaccucccguuuccacucugcaggggccccugcagggggugaagggcguccgcugg

SEQ ID NO: 87514 - RNA, 64 nt, Homo Sapiens
cuuugugucaccugccugcgcucuccagauaugaccccugcacccaccccccacagccugcccu

SEQ ID NO: 87515 - RNA, 64 nt, Homo Sapiens
agaggcggguggagcgugaagcaggcuggaggugccccugcacgggagguggcguuugcuaacc

SEQ ID NO: 87516 - RNA, 64 nt, Homo Sapiens
gggugguggaagcaggugucacggugcaagucucccccugcaccccucccccagcuugagccgu

SEQ ID NO: 87517 - RNA, 64 nt, Homo Sapiens
ccagcuaaauuugauaauuucugggaaagaacucccccugcaaagaagcagccccaacucauca

SEQ ID NO: 87518 - RNA, 64 nt, Homo Sapiens
ugacacagguuaacuaaaguggccaccuuuaaagccccugcauauagccagaugcccugcuccu

SEQ ID NO: 87519 - RNA, 64 nt, Homo Sapiens
aaggagcugccuggacccgugcccucuccccugcccccugcaggaaacaggcacugcccuggug

SEQ ID NO: 87520 - RNA, 64 nt, Homo Sapiens
ggaacuggaggcagggaacagccugccaccuggaccccugcauuacccauuccuucccagaggg

SEQ ID NO: 87521 - RNA, 64 nt, Homo Sapiens
cuccuggcccgcucaccuucugcuuacgccuccaccccugcagcaggggcagagcacaccccag

SEQ ID NO: 87522 - RNA, 64 nt, Homo Sapiens
cgcacacgcacacagccuggaaccgaggccgucgccccugcacacucccuuuuccccaggaaug

SEQ ID NO: 87523 - RNA, 64 nt, Homo Sapiens
uguggggccugcacacagcccuggcccggaacagccccugcaacgauuggaugacugggaagcg

SEQ ID NO: 87524 - RNA, 64 nt, Homo Sapiens
gcccaugcaccagagccacugggcaggacccccgccccugcaggcugcuccagugggccaaguu

SEQ ID NO: 87525 - RNA, 64 nt, Homo Sapiens
uucucucuugccugcuccugucccuccagcacguccccugcaccacggcauagcuuaggugcgc

SEQ ID NO: 87526 - RNA, 64 nt, Homo Sapiens
gggccuugcggcacaggacugugcccugugcuguccccugcaccccggcucagcugagcugggg

SEQ ID NO: 87527 - RNA, 64 nt, Homo Sapiens
ucugucugggaggggggagugaaggggcccuagcccccugcacuccgccgccucagagccaugc

SEQ ID NO: 87528 - RNA, 64 nt, Homo Sapiens
ccacuucaugaggggaggggcgaggggaagcccaccccugcaugcuucuggcuggagcaccucc

SEQ ID NO: 87529 - RNA, 64 nt, Homo Sapiens
ccagagcagggaggugucguggaacuggguagacccccugcagcguuaggggcccauuuguggg

SEQ ID NO: 87530 - RNA, 64 nt, Homo Sapiens
ccccugggcugcugcucugagcccaucuguucucccccugcaagaaggggcaaugcucuugugu

SEQ ID NO: 87531 - RNA, 64 nt, Homo Sapiens
gcucaggggucagcagggaccgggaggauccugaccccugcaggagagucacacccagggacca

SEQ ID NO: 87532 - RNA, 64 nt, Homo Sapiens
agccgccgggcgugagacgcgcugaccacggcuuccccugcaggcccuguccucguggugaguc

SEQ ID NO: 87533 - RNA, 64 nt, Homo Sapiens
ugccugucccuggccugccuugauuucagccacaccccugcagcccugcaucccagcucugggg

SEQ ID NO: 87534 - RNA, 64 nt, Homo Sapiens
ugagaacgcagugucaggugugggacuccuucugccccugcaguggguguuacgggcggugugc

SEQ ID NO: 87535 - RNA, 64 nt, Homo Sapiens
gagcgaaccggucagcaccagcacccacuuggagccccugcaaggcagguggggggcucagccu

SEQ ID NO: 87536 - RNA, 64 nt, Homo Sapiens
cuggaguggcucauuguggcucaagggacugugaccccugcacauaggggacaagaguuugaac

SEQ ID NO: 87537 - RNA, 64 nt, Homo Sapiens
acaccaucuucuaaaggcuuuugcccuacucagcccaaccuagaccuguagauuucccucuccu

SEQ ID NO: 87538 - RNA, 64 nt, Homo Sapiens
uuguuaaauaauguaguuuuauauagcugauagaccaaccuauauccaaacuuuuauaaaauau

SEQ ID NO: 87539 - RNA, 64 nt, Homo Sapiens
guugaggacuauuagaacugguuccccucaccacccaaccuacccaccuaugucauacugucuc

SEQ ID NO: 87540 - RNA, 64 nt, Homo Sapiens
accuuaaagauacuguugguuuuacagaugcucuccaaccuauuuucuauaagaugagguagug

SEQ ID NO: 87541 - RNA, 64 nt, Homo Sapiens
gaagaccuugucccaacucgaugggcacagccagccaaccuaagacuauguugguacuuggacu

SEQ ID NO: 87542 - RNA, 64 nt, Homo Sapiens
uaaagaaaauaaagcugugauaaauacuguaauuccaaccuacauuagaaggucuaaguguagg

SEQ ID NO: 87543 - RNA, 64 nt, Homo Sapiens
ccccuuaggguguguauccagaaggguuccuaacccaaccuacuagagcaaagaaaggugacug

SEQ ID NO: 87544 - RNA, 64 nt, Homo Sapiens
cccucaaguagaccccagugucuucucccuccucccaaccuacacccaauagguuuuuuucuga

SEQ ID NO: 87545 - RNA, 64 nt, Homo Sapiens
ccacauccaaaauuauguauuuuguauauauaggccaaccuauacuuaauuuuagugacguauu

SEQ ID NO: 87546 - RNA, 64 nt, Homo Sapiens
uuuuuugcagccuaaaauccuuuuuguaagaaacccaaccuauuuuuaagucaaguugagguua

SEQ ID NO: 87547 - RNA, 64 nt, Homo Sapiens
ccccuggaaagauggcuuccgcacaguuuugcaaccaaccuacugcagugcaagguggccuugg

SEQ ID NO: 87548 - RNA, 64 nt, Homo Sapiens
cugaaagccuucagacauuagaaggagggaaaaaccaaccuacugaagaaaauggagacaaaca

SEQ ID NO: 87549 - RNA, 64 nt, Homo Sapiens
uggccgugaccucuauuuguuugcuuuuaauuugccaaccuaucgcugcuggcagcacuuuuug

SEQ ID NO: 87550 - RNA, 64 nt, Homo Sapiens
uaacuuguauaaauuuuaggucaaauccuucaagccaaccuauacuaaaaauuaguuccauaau

SEQ ID NO: 87551 - RNA, 64 nt, Homo Sapiens
uugaaguaccaccaaaaaagcguuuuguuuugugccaaccuauuaaaccagagaccaaauguca

SEQ ID NO: 87552 - RNA, 64 nt, Homo Sapiens
accagcgauagugauugauacugcucaacacagcccaaccuauagugcccugugacuucucucc

SEQ ID NO: 87553 - RNA, 64 nt, Homo Sapiens
ugggauuacaggagugagccacugugcccagccuccaaccuaauuugaguuucauuuguauuuu

SEQ ID NO: 87554 - RNA, 64 nt, Homo Sapiens
ugcuucugauuuuucuugcauuuuaaauucucagccaaccuacagccaugaucuuuagcacagu

SEQ ID NO: 87555 - RNA, 64 nt, Homo Sapiens
acgguggccuaggguacaggcaacaaugagcagaccaaccuaaauuuggggaaauuaggagagg

SEQ ID NO: 87556 - RNA, 64 nt, Homo Sapiens
cauuccucccugcccaaucccagugcagucaaggccaaccuaggcagcagccaccuucucagga

SEQ ID NO: 87557 - RNA, 64 nt, Homo Sapiens
ucaccaugguuuuucacauuaggauaaaaccugcccaaccuaccaaaggcucaccuuuguggag

SEQ ID NO: 87558 - RNA, 64 nt, Homo Sapiens
accacauaucgucuguauugggaaccugcagaggccaaccuacaguuggagauuacgucuaugu

SEQ ID NO: 87559 - RNA, 64 nt, Homo Sapiens
auuugauggcagugguuuaucaauugcuuuugcaccaaccuaauacagaucuauuagguuggug

SEQ ID NO: 87560 - RNA, 64 nt, Homo Sapiens
aauaaaaaauccgaacagcauauguguauaguuaccaaccuaaagcacuuuuaagguuuuuuua

SEQ ID NO: 87561 - RNA, 64 nt, Homo Sapiens
aggguggcauuggguuggacguucuggguacaagccaaccuagucccacguuguacgugaaugu

SEQ ID NO: 87562 - RNA, 64 nt, Homo Sapiens
gucgguguguucaguaucacgcucaagacaagggccaaccuauuacuucacacaccucaaauac

SEQ ID NO: 87563 - RNA, 64 nt, Homo Sapiens
aguaccauacuacaaauauuuaaaugcaaaauuaccaaccuauauagcaguuuuauuugcccua

SEQ ID NO: 87564 - RNA, 64 nt, Homo Sapiens
uaugucuaccuccuccauuaugucuucgucucuuccaaccuaucuguucugucucccaauguac

SEQ ID NO: 87565 - RNA, 64 nt, Homo Sapiens
uauauuuuggcacaauuauacacauuggaaagggccaaccuauuagggcucaaguauguauaug

SEQ ID NO: 87566 - RNA, 64 nt, Homo Sapiens
aauaaaaagaaagucgcguuguuauauuucuaaaccaaccuaacaagaauuaagcagaguuggg

SEQ ID NO: 87567 - RNA, 64 nt, Homo Sapiens
aucuuuguuuuguaugaucuauuuagaguuuuaaccaaccuagaucugucagcuaagcuaauuu

SEQ ID NO: 87568 - RNA, 64 nt, Homo Sapiens
gaccauuuuuaggaucauagguaucgaaaccgauccaaccuagaucaaguuugcuggaaacauu

SEQ ID NO: 87569 - RNA, 64 nt, Homo Sapiens
auuaugugugucuuguacagauacacaagaauggccaaccuaaaacuagcuuuagauuaccccu

SEQ ID NO: 87570 - RNA, 64 nt, Homo Sapiens
uggcacacaaggaggcgaggcuaugcguucgaggccaaccuaggcaaaauuggaaaaaaaaaaa

SEQ ID NO: 87571 - RNA, 64 nt, Homo Sapiens
ugaucucguuuacuccauguuaaucacauuccuaccaaccuaaauuucugccaagucaguucuc

SEQ ID NO: 87572 - RNA, 64 nt, Homo Sapiens
gggcugccauccaucgccuaguaaccacggcaacccaaccuacucuaaaaccaaaccaaaaaaa

SEQ ID NO: 87573 - RNA, 64 nt, Homo Sapiens
ggaugggaaaaguggacucucauuguagugacucccaaccuaccuaauaauuuguuaacuuagg

SEQ ID NO: 87574 - RNA, 64 nt, Homo Sapiens
gccugacugucacgugccuuuuccaggccuggcuccaaccuaaaaaaauuguuugaaaaacauu

SEQ ID NO: 87575 - RNA, 64 nt, Homo Sapiens
aaaaaagccaccggaggaaaggaaaaaacaucggccaaccuagaaacguuuucauucgucauuc

SEQ ID NO: 87576 - RNA, 64 nt, Homo Sapiens
ccacagacggcuucggcugugccuagggcaacagccaaccuaggagccagcgggcuuucgggga

SEQ ID NO: 87577 - RNA, 64 nt, Homo Sapiens
uggcccuucugcccuucccuguguuucucacuuuccaaccuaaucccuggcucaggguuauugc

SEQ ID NO: 87578 - RNA, 64 nt, Homo Sapiens
agcaggaggagcuucaucuguucccuucccaccuccaaccuagcccuacugcccaccccacccc

SEQ ID NO: 87579 - RNA, 64 nt, Homo Sapiens
agcuagagccauuuaacauuuccucuuuccaagaccaaccuacaauuuucccuugauaaccaua

SEQ ID NO: 87580 - RNA, 64 nt, Homo Sapiens
caaggggauucuccugcucuucugggcucagaccccaaccuagugcaccuccuuaggcccugcc

SEQ ID NO: 87581 - RNA, 62 nt, Homo Sapiens
ugaccucccggggacagugggaacaggauaauccaaccuacgcuucuucguugcucaacuaa

SEQ ID NO: 87582 - RNA, 64 nt, Homo Sapiens
uucugccaugggaacugguuuucuuccucuucccccaaccuaaccacccaccccugccuugcuu

SEQ ID NO: 87583 - RNA, 64 nt, Homo Sapiens
ggauguuaagugguaucuacgacuuaaaaauuugccaaccuaguaucuccaacacuuaaguuca

SEQ ID NO: 87584 - RNA, 64 nt, Homo Sapiens
cuuaaaaacauaugguggcccaacaaauuaucauccaaccuauacaucccuucuaugguauucc

SEQ ID NO: 87585 - RNA, 64 nt, Homo Sapiens
gcucucagggaaagccucuguagucagauuuugcccaaccuaauuucauuuaguaauuaaauuu

SEQ ID NO: 87586 - RNA, 64 nt, Homo Sapiens
auuguguggguuuuuuaauucacccucuccaugcccaaccuaagaaccccaucauaugacaugc

SEQ ID NO: 87587 - RNA, 64 nt, Homo Sapiens
aggccgauucagaaacuugacuauuacuuuugcaccaaccuaauauuuuuaauggcaaaagcca

SEQ ID NO: 87588 - RNA, 64 nt, Homo Sapiens
uaggucauucaggacagcuagccaaguccccuccccaaccuaauucacagaacuggagaaccag

SEQ ID NO: 87589 - RNA, 64 nt, Homo Sapiens
uuuaguuuuuuuguuuuuuuauacaaccuaauccccaaccuacuuuugcagcucgcccaaagag

SEQ ID NO: 87590 - RNA, 64 nt, Homo Sapiens
ggcaguuuuuggucuuuuaccucugaucuuguccccaaccuaagccagcuagcugcgugcuccc

SEQ ID NO: 87591 - RNA, 64 nt, Homo Sapiens
gcuuauuugaacuugagaccauuguaagcaugacccaaccuaccacccuguuuuuacauaucca

SEQ ID NO: 87592 - RNA, 64 nt, Homo Sapiens
uuacuccuuuuaaacaccagcacccgucuuuuccccaaccuaaaaccaaccaccagcauuucac

SEQ ID NO: 87593 - RNA, 64 nt, Homo Sapiens
uuuuuagccuauauaugcaaacagauuugcaguaccaaccuaugcagccaagcaaccucagcag

SEQ ID NO: 87594 - RNA, 64 nt, Homo Sapiens
uguugaaaagaguuacuguuauuaucagaauuugccaaccuaaagaaugaauuuuuaaauucau

SEQ ID NO: 87595 - RNA, 64 nt, Homo Sapiens
gaguagcugggauuacaggcgugugccaccaugcccaaccuauuuuuguauuuuuuaguagaga

SEQ ID NO: 87596 - RNA, 64 nt, Homo Sapiens
uauuuauuacuauaauuugcaaagaaaucucuuaccaaccuacauauauauuuuauuuaauuua

SEQ ID NO: 87597 - RNA, 64 nt, Homo Sapiens
uaacugacauaaucuugaucgauaagaauuaaaaccaaccuauggaaaguacucgacaccuuua

SEQ ID NO: 87598 - RNA, 64 nt, Homo Sapiens
aggugaggucacguggccucccaggccugacuucccaaccuacagcauugacgccaacuuggcu

SEQ ID NO: 87599 - RNA, 50 nt, Homo Sapiens
aagcacaaauuuaguuugggccaaccuaagugcaucgggauucagaauga

SEQ ID NO: 87600 - RNA, 64 nt, Homo Sapiens
uaacuuuuuguggaggaauuucucucauuccagcccaaccuauuggagaauuuuuaaaacaaaa

SEQ ID NO: 87601 - RNA, 64 nt, Homo Sapiens
gcaggcaccaaagcaagugcucuuguccccaccaccaaccuauaaggucucuugugcccuguuc

SEQ ID NO: 87602 - RNA, 64 nt, Homo Sapiens
aauguaggcuuucauguugccauguugaaggugcccaaccuaaagggagaaugagaccuggagu

SEQ ID NO: 87603 - RNA, 64 nt, Homo Sapiens
ugccaggccccaugcuggguccacggagcuggagccaaccuacgcgugacccacucagccuuau

SEQ ID NO: 87604 - RNA, 64 nt, Homo Sapiens
agagugcugggauuacaggcgugagccacuguggccaaccuaauuuuuguauuauuuaguagag

SEQ ID NO: 87605 - RNA, 64 nt, Homo Sapiens
ccgguggugugacuucguugguugaggugugucuccaaccuacaucagaccaugaaguucaacc

SEQ ID NO: 87606 - RNA, 56 nt, Homo Sapiens
agcaauaaauguuuuuguuugaccaaccaaccuaagacauugaucaagauuuguag

SEQ ID NO: 87607 - RNA, 64 nt, Homo Sapiens
gauucacuccuuaucuaugaaaaucugcaaguggccaaccuagacaauguauguuuggaguucc

SEQ ID NO: 87608 - RNA, 64 nt, Homo Sapiens
uagcaacauuuguuuuaguccugagacagcacagccaaccuagcuggagucugucaauguccua

SEQ ID NO: 87609 - RNA, 64 nt, Homo Sapiens
caaagaaaauacggcuucucgagcugcugcuuugccaaccuaagcugccugucauugcugcaaa

SEQ ID NO: 87610 - RNA, 64 nt, Homo Sapiens
agugggcugacccaucccucccaggcgcuggggaccaaccuagcaaugaagguugggaagguug

SEQ ID NO: 87611 - RNA, 64 nt, Homo Sapiens
cggggaggagaggguuugcuaaucugcucccagcccaaccuauuaccaccccaccucgcuggga

SEQ ID NO: 87612 - RNA, 64 nt, Homo Sapiens
agugugcugggauuacaggcaugagcuacuaugcccaaccuauccuguucuuuuaauugaaagu

SEQ ID NO: 87613 - RNA, 55 nt, Homo Sapiens
uguacuuaucuguccccauggccacccaaccuaaaagccgcacuacuucaccuga

SEQ ID NO: 87614 - RNA, 64 nt, Homo Sapiens
gcccaagcagcuaaacuuggcccuacacucccagccaaccuaguugaccaccccccauccuucu

SEQ ID NO: 87615 - RNA, 64 nt, Homo Sapiens
guucugugccaugcuagagcgcugcuugccuggcccaaccuagccuucaccuggccccaccaug

SEQ ID NO: 87616 - RNA, 64 nt, Homo Sapiens
auuucaaguuuaauaaaauauuucccuuugcuucccaaccuaaaacaaaggggaugcccagugg

SEQ ID NO: 87617 - RNA, 64 nt, Homo Sapiens
uggggcagguccagaguccacagucccagaaaccccaaccuagcauuccagggccagagccaug

SEQ ID NO: 87618 - RNA, 64 nt, Homo Sapiens
gcagcaaggagcagggcuuggggaaaacugauggccaaccuagaaagaugaaggacaaaaggaa

SEQ ID NO: 87619 - RNA, 64 nt, Homo Sapiens
gaacaucguagcuuagccaaugcauugaauacacccaaccuacuaaaauauuggaaguugaaaa

SEQ ID NO: 87620 - RNA, 64 nt, Homo Sapiens
gaggaauuuucccucggccuuacugacaaggacaccaaccuagggugcaaacagauggacuaug

SEQ ID NO: 87621 - RNA, 64 nt, Homo Sapiens
ugaaaguaauggcaaaaccacaauuacuuuuuuaccaaccuaauaacaauguauuagcaaauau

SEQ ID NO: 87622 - RNA, 64 nt, Homo Sapiens
ucuauccaacagggagccacaguauuuaaauugaccaaccuaauguuacaacuacuuugaggug

SEQ ID NO: 87623 - RNA, 64 nt, Homo Sapiens
gagucacuguaacucuagaagauuaaccuuccagccaaccuauuuuccuuucccuugucucucu

SEQ ID NO: 87624 - RNA, 64 nt, Homo Sapiens
ucccuggaccuccuggugucaccgccaugccucaccaaccuaugucauuaucucccacaacuag

SEQ ID NO: 87625 - RNA, 64 nt, Homo Sapiens
cccuuuccugcgggcuuuucauucucucuccuguccaaccuaaccuccccuauccacccagccc

SEQ ID NO: 87626 - RNA, 64 nt, Homo Sapiens
cucuucggugcuuagagagaaggcaauugaaaaaccaaccuacaauacaacagagcacuuuuug

SEQ ID NO: 87627 - RNA, 64 nt, Homo Sapiens
caagaucccauggguuguguggccaacuaggcagccaaccuaaguuacaaggcuuuaucucagg

SEQ ID NO: 87628 - RNA, 64 nt, Homo Sapiens
aaacuaccuaccguguguaucagggacagauuuuccaaccuaaguucugcagaauuauuuccuu

SEQ ID NO: 87629 - RNA, 64 nt, Homo Sapiens
ggcuuugcaguuggcaagcucaacugguacagaaccaaccuagauuagaguacgaaauuccugg

SEQ ID NO: 87630 - RNA, 64 nt, Homo Sapiens
uauugagacgggaaaaacucgcuguaaaauaaugccaaccuagauaaugcuauaauaaauuauu

SEQ ID NO: 87631 - RNA, 64 nt, Homo Sapiens
auaugaguauuaaauaugguaugcuuaguauauuccaaccuaagauaguuaacuaccugagacc

SEQ ID NO: 87632 - RNA, 64 nt, Homo Sapiens
gcgggguuucacgcucaccugaaaacaccuguucccaaccuacuucuuggugcaaguugaccaa

SEQ ID NO: 87633 - RNA, 64 nt, Homo Sapiens
ugacagagcaagacccugucugagccaccacacuccaaccuaggaggcugcagugagccaugau

SEQ ID NO: 87634 - RNA, 64 nt, Homo Sapiens
cuacugccaugaccuuccgcgcacauucaauccuccaaccuacccguaucaugguucuugacca

SEQ ID NO: 87635 - RNA, 64 nt, Homo Sapiens
cugugucugcgaaguccuauggggaggcggcacuccaaccuaacccgcguguccccggggccca

SEQ ID NO: 87636 - RNA, 64 nt, Homo Sapiens
agguugcagugagccgagaucgcgccauugcacuccaaccuaggugacaaagcuacacgccauc

SEQ ID NO: 87637 - RNA, 64 nt, Homo Sapiens
aagagauccagugggacaaugcuauuuuuguaugccaaccuagauaggauuauaaagcaagacu

SEQ ID NO: 87638 - RNA, 64 nt, Homo Sapiens
caaaaguuggaucugaguuuggagaaagauauuuccaaccuaaguggguauuauuuugaaacca

SEQ ID NO: 87639 - RNA, 64 nt, Homo Sapiens
ugccuuuaauugucuaaaacaaaaacaaaaccagccaaccuauguuacacgugagauuaaaacc

SEQ ID NO: 87640 - RNA, 64 nt, Homo Sapiens
aaucccaauugcaccuucuggugcuauucugucaccaaccuaaggucucuggccuguggaucca

SEQ ID NO: 87641 - RNA, 64 nt, Homo Sapiens
cuucccaaagcagcaggcgccuccaggcuggggcccaaccuagaaggcaggggucaaucuaaca

SEQ ID NO: 87642 - RNA, 64 nt, Homo Sapiens
gagugcgaacgucuugcuguuguguuuuuaugucccaaccuagaaaccuuagcugucuuuucug

SEQ ID NO: 87643 - RNA, 64 nt, Homo Sapiens
ugugaccaggguguggcugacaccugggcuaccuccaaccuacaugugcaacgcuguugacuac

SEQ ID NO: 87644 - RNA, 64 nt, Homo Sapiens
ggaggcauuucuacuuccuugaguuuugcuguugccaaccuaaaacauuucccuuuggaacaug

SEQ ID NO: 87645 - RNA, 64 nt, Homo Sapiens
cuucuaccuaguaggagucaugccccuguagugcccaaccuagccagguagccaccacugugcc

SEQ ID NO: 87646 - RNA, 64 nt, Homo Sapiens
cucuagaggggcugggaagggugagcuacugcccccaaccuaccaugggcugcuccugggccug

SEQ ID NO: 87647 - RNA, 64 nt, Homo Sapiens
acucuuucgguagguggaagcacccaucugucugccaaccuaaacaguuucacagaaaauaagg

SEQ ID NO: 87648 - RNA, 64 nt, Homo Sapiens
aaaguuuggcccuaaaaaaaaaaaugugucuuguccaaccuacaccaguaaauauggguugaau

SEQ ID NO: 87649 - RNA, 64 nt, Homo Sapiens
cacagcauuucagaugcuguuggacuucauguccccaaccuagcuuggugagggcuguaacugu

SEQ ID NO: 87650 - RNA, 64 nt, Homo Sapiens
uauaagaggggcagagaggacaacuccgcuuuggccaaccuagccaaggcugcagcauauagac

SEQ ID NO: 87651 - RNA, 64 nt, Homo Sapiens
cugaauucuuuccccaaagacgaccagcauuuaaccaaccuaagggcccaaaggccuuggacaa

SEQ ID NO: 87652 - RNA, 64 nt, Homo Sapiens
cccuucaucacuugguucugcagugcaccacaggccaaccuacggacaccuggcuugccaccca

SEQ ID NO: 87653 - RNA, 64 nt, Homo Sapiens
uaaaaaccccaccauuuggacagggaguugaaguccaaccuauuuuuuuuucuuuuuuagaaaa

SEQ ID NO: 87654 - RNA, 64 nt, Homo Sapiens
uaauagacauuaaagcuaaacuuggccuguuuuuccaaccuauugcaggagucaggucccuaca

SEQ ID NO: 87655 - RNA, 64 nt, Homo Sapiens
caacauggugaaaccccgucucaggaguucgagaccaaccuagcaaggugggcggaucacaagg

SEQ ID NO: 87656 - RNA, 64 nt, Homo Sapiens
aacaaaagaggacagaagcagaccacucugugcaccaaccuaaaaaauuacagagaagagaaaa

SEQ ID NO: 87657 - RNA, 64 nt, Homo Sapiens
acacacacucgugcagugggggaguucuggcuccccaaccuaaccccuagccgucaucuccaca

SEQ ID NO: 87658 - RNA, 64 nt, Homo Sapiens
aaacauucugaaauuuauuuggaaccagaaaagcccaaccuaaauagcaaaagcaauccuaagc

SEQ ID NO: 87659 - RNA, 64 nt, Homo Sapiens
aauucuccauuucacuugaccccugcccaccucuccaaccuaacuggcuuacuuccuagucuac

SEQ ID NO: 87660 - RNA, 64 nt, Homo Sapiens; identical to SEQ ID NO: 87659

SEQ ID NO: 87661 - RNA, 64 nt, Homo Sapiens
aguucuccauuucacuugaccccugcccaccucuccaaccuaacuggcuuacuuccuagucuac

SEQ ID NO: 87662 - RNA, 64 nt, Homo Sapiens
aauucucuauuucacuugaccccugcccaccucuccaaccuaacuggcuuacuuccuagucuac

SEQ ID NO: 87663 - RNA, 64 nt, Homo Sapiens; identical to SEQ ID NO: 87661

SEQ ID NO: 87664 - RNA, 64 nt, Homo Sapiens; identical to SEQ ID NO: 87659

SEQ ID NO: 87665 - RNA, 64 nt, Homo Sapiens
aaguaucuauuucacuugaccccugcccaccucuccaaccuaacuggcuuacuuccuaguccua

SEQ ID NO: 87666 - RNA, 64 nt, Homo Sapiens
cuccacuagcuccaaaauccccacucacgcagacccaaccuaacaugccgaccucauccuaacu

SEQ ID NO: 87667 - RNA, 64 nt, Homo Sapiens
cagaccuggugccuugacgcgcccagguguccccccaaccuaacagugcaaagccgcccccaga

SEQ ID NO: 87668 - RNA, 64 nt, Homo Sapiens
ggcuggcccaucugagagcaucuccccacucucgccaaccuaucggggcauagcccagggaugc

SEQ ID NO: 87669 - RNA, 64 nt, Homo Sapiens
uuggcagcaccaccccagggaccuagcugugcccccaaccuagacaucaaagcugagucacugg

SEQ ID NO: 87670 - RNA, 63 nt, Homo Sapiens
acagcguuauccaggcccaauacaaauaaaccaaccaaccuacaaaaugccuuacacauuccu

SEQ ID NO: 87671 - RNA, 64 nt, Homo Sapiens
uuaaccucaaggucucgcaugguggggccccugaccaaccuacacaaguucccucccacaagug

SEQ ID NO: 87672 - RNA, 64 nt, Homo Sapiens
agaaaggggggcggugaucaggucaccagugaccccaaccuaugcucucggucuuuccuggagg

SEQ ID NO: 87673 - RNA, 64 nt, Homo Sapiens
ugccacagcuggggcugagccauccccuccccauccaaccuaaacccuuccuccuuccauucug

SEQ ID NO: 87674 - RNA, 64 nt, Homo Sapiens
gcucuaugccucaguuuccccauaauacccuuuuccaaccuaccucacaagguuaucagaaaga

SEQ ID NO: 87675 - RNA, 64 nt, Homo Sapiens
ggggcgggggaaaugggggaaugacacaucccccccaaccuacccccaccccaaaagcagcucc

SEQ ID NO: 87676 - RNA, 64 nt, Homo Sapiens
uuagagcuaaaaaggcccuuagagggaaucuagcccaaccuacauuccacccuguuacuuaugu

SEQ ID NO: 87677 - RNA, 64 nt, Homo Sapiens
uacauccuguccacacugcuggagauacuaagucccaaccuaaaugauggaaggagcaucuccc

SEQ ID NO: 87678 - RNA, 64 nt, Homo Sapiens
uggcaagguccuucccugggaaucaccacucgguccaaccuagacaaccaagaccgcuauaccu

SEQ ID NO: 87679 - RNA, 64 nt, Homo Sapiens
uaacagagagacaccucugugacaccacugcacuccaaccuaggaggcugcagugagcugugau

SEQ ID NO: 87680 - RNA, 64 nt, Homo Sapiens
caacacagugagaacucauccggguguucaagggccaaccuagggcgggaggacugauugaguc

SEQ ID NO: 87681 - RNA, 63 nt, Homo Sapiens
ccguauuuucuaggacaagaguucucagucacugugcaauaugcccccugggucccaggaggg

SEQ ID NO: 87682 - RNA, 63 nt, Homo Sapiens
ugucucaguacaauccaaauuugucguagacuugugcaauauauacuguuguggguuggagaa

SEQ ID NO: 87683 - RNA, 63 nt, Homo Sapiens
acucaguaagacagugcagugcucaguaaggcagugcaauacucaguaacaguguaguacuca

SEQ ID NO: 87684 - RNA, 63 nt, Homo Sapiens
caguacucaggaaugcagcacaguacucaggcagugcaauacucagugcgguacucaguaaca

SEQ ID NO: 87685 - RNA, 63 nt, Homo Sapiens
caccaguuuugcccucugccccugcaauucacggugcaauauuacggggugggggugagggcc

SEQ ID NO: 87686 - RNA, 63 nt, Homo Sapiens
uccccaccccucaguugacgucuaagauauacagugcaauagcccucccuuccccaguuuuuc

SEQ ID NO: 87687 - RNA, 63 nt, Homo Sapiens
ggcccuguuggcaagaugaggcaauauuaggcggugcaauagagauggugucuaacgagcagu

SEQ ID NO: 87688 - RNA, 63 nt, Homo Sapiens
aggcggugcaauagaggcccugucuaacgagcagugcaauauugacauggauaagugagaugg

SEQ ID NO: 87689 - RNA, 63 nt, Homo Sapiens
acuaugagauuuuuaaaaaauggggccgcugaugugcaauaucaaagugaacuugugaguauu

SEQ ID NO: 87690 - RNA, 63 nt, Homo Sapiens
uaccucucuuuugugacucuuguacagcuuaaugugcaauaaaggaaaaguuauaucugucuu

SEQ ID NO: 87691 - RNA, 63 nt, Homo Sapiens
uuguggccacuggaaaucccaacagaccucucugugcaauaacgcuguaagagucuggcuuag

SEQ ID NO: 87692 - RNA, 63 nt, Homo Sapiens
aaagguguauguauguuuuguugugugaaagaugugcaauaacuauauuauacauacacaagu

SEQ ID NO: 87693 - RNA, 63 nt, Homo Sapiens
uacacaugucaacuugauggcuaggggauauuugugcaauaaaauuauaauaaccucccaguu

SEQ ID NO: 87694 - RNA, 63 nt, Homo Sapiens
aacauacuaguacagauuuuuugaaaauguuaagugcaauaaaaauaugucuuaauuuugagu

SEQ ID NO: 87695 - RNA, 63 nt, Homo Sapiens
auguauuuguuuguauuuugaaaauauuuuuaugugcaauaaaaauacuucaauacuucauuu

SEQ ID NO: 87696 - RNA, 63 nt, Homo Sapiens
ucaauacuucauuuaaaauaucaauucuauuacgugcaauacuagguuugugacuuuccuaaa

SEQ ID NO: 87697 - RNA, 63 nt, Homo Sapiens
ugauguggcaaaucucuauuaguguuggaaaaugugcaauaugauauuugcaagacauagaau

SEQ ID NO: 87698 - RNA, 63 nt, Homo Sapiens
ucacaguguuuuuauugcucgcccagacaccaugugcaauaagauugguguucguuuccauca

SEQ ID NO: 87699 - RNA, 63 nt, Homo Sapiens
ggagacaaaggaggaauuuacuuucuucaccaagugcaauagauuacugaugugauauucugu

SEQ ID NO: 87700 - RNA, 63 nt, Homo Sapiens
ccacaacaaaaacccaaguuuucugugcuacaugugcaauauuuguuaugaauguuaucacaa

SEQ ID NO: 87701 - RNA, 63 nt, Homo Sapiens
guuucauguccauucaagugacuuuuauucugagugcaauauuucaauagccuuguagugaua

SEQ ID NO: 87702 - RNA, 63 nt, Homo Sapiens
auguacaguauuuuuuguuguuuuuaucaucaugugcaauauuacugauuuguuuccaugcug

SEQ ID NO: 87703 - RNA, 63 nt, Homo Sapiens
ucucuacucuuuaguagaguucgagacacagaagugcaauaacugcccuaauuaagcaacuau

SEQ ID NO: 87704 - RNA, 63 nt, Homo Sapiens; identical to SEQ ID NO: 87702

SEQ ID NO: 87705 - RNA, 63 nt, Homo Sapiens; identical to SEQ ID NO: 87703

SEQ ID NO: 87706 - RNA, 64 nt, Homo Sapiens
accugaggcagggguacgcuugcugaaauggcuguggccccagccuccaggcauuauccccagg

SEQ ID NO: 87707 - RNA, 64 nt, Homo Sapiens
uccuccccuguacauagucuggaggggugccugcuggccccaugaggccaggaugguggugugg

SEQ ID NO: 87708 - RNA, 64 nt, Homo Sapiens
acagcuugaccugaggcugucaaaggaagguggauggccccagcaagccccaucuucuaaaugg

SEQ ID NO: 87709 - RNA, 64 nt, Homo Sapiens
cugggcccugggcuggaaucuccguuagcuccuguggccccacccuccauccaaggccagguuc

SEQ ID NO: 87710 - RNA, 64 nt, Homo Sapiens
gugcagggacccgagggccagguuagcacagcgcuggccccagcauggagggaagcccuguggg

SEQ ID NO: 87711 - RNA, 64 nt, Homo Sapiens
gggauuuugaguugaacuuuacugggggugucccuggccccacaagccaggaccugcuguguga

SEQ ID NO: 87712 - RNA, 64 nt, Homo Sapiens
gcgacuugccugccccugaagcccuuguucccauuggccccaguuugcauucugcagguuuucc

SEQ ID NO: 87713 - RNA, 64 nt, Homo Sapiens
gggcagugugcaugcaacacacuuaggggaggaguggccccagaauucagcacgcacacaacac

SEQ ID NO: 87714 - RNA, 64 nt, Homo Sapiens
gcggcuccacccugggcugccuccucggccucccuggccccagcuacacccucggacuccugcc

SEQ ID NO: 87715 - RNA, 64 nt, Homo Sapiens
ccggacgugggaggugucugaacuaacacggaauuggccccacagcuaaccccaaccagcaggc

SEQ ID NO: 87716 - RNA, 64 nt, Homo Sapiens
agguccuccauuacagaggcccagcgcacaucgcuggccccacaaacguucagggguacagcca

SEQ ID NO: 87717 - RNA, 64 nt, Homo Sapiens
cuccuaaacagacaguuuaauuauaguugcggccuggccccauccucacuuccucuuuuuauuu

SEQ ID NO: 87718 - RNA, 64 nt, Homo Sapiens
cugggccaucucuuaggugagagccuccugugccuggccccagcuccccagagaggcacucagu

SEQ ID NO: 87719 - RNA, 64 nt, Homo Sapiens
ccccagacagggugggcuucccaagcacagagccuggccccagggcucuggacagcagaagccu

SEQ ID NO: 87720 - RNA, 64 nt, Homo Sapiens
ccgccacuucccucgggcccgcccagaacaucccuggccccaccgcccugccuccccauugugu

SEQ ID NO: 87721 - RNA, 64 nt, Homo Sapiens
aaugucuuaaccuaaaccaucauuuccauucugguggccccacuccuuauguugcucuuucuau

SEQ ID NO: 87722 - RNA, 64 nt, Homo Sapiens
uggggucucugagcaguggggagcgggggcuaacuggccccaggcggaggggcuuggagcagag

SEQ ID NO: 87723 - RNA, 64 nt, Homo Sapiens
cccgcagcaccagccugagccacaguggggcccauggccccagcuggcugggucgccccuccuc

SEQ ID NO: 87724 - RNA, 64 nt, Homo Sapiens
cuggcaaugaugccacaccugcucgggcacccucuggccccacacaggcuggccgcgcaccggg

SEQ ID NO: 87725 - RNA, 64 nt, Homo Sapiens
ugggggcaguggcaggagccccccaccagcaugauggccccagcgcagcaggcagacagcucac

SEQ ID NO: 87726 - RNA, 64 nt, Homo Sapiens
acuucugaucucaguccucugcacuccacccugcuggccccagggcccggagcagccuguuccu

SEQ ID NO: 87727 - RNA, 64 nt, Homo Sapiens
gccagucuccucucaagcaagccuccugaaccacuggccccaaccaacccacuggugggguggg

SEQ ID NO: 87728 - RNA, 64 nt, Homo Sapiens
gugagaggaaagaggcgggggcgggugaggagacuggccccaggccccagccacggcugcagag

SEQ ID NO: 87729 - RNA, 64 nt, Homo Sapiens
ucugguuuuugaaaauuuggacagccucaccuuuuggccccaucguucccaagcaguucaugau

SEQ ID NO: 87730 - RNA, 64 nt, Homo Sapiens
cuguucccaagcaguucaugcagagggcccagaauggccccacuucccucugugcagccacagc

SEQ ID NO: 87731 - RNA, 64 nt, Homo Sapiens
guuccaggggcccugauuuccucggaugugcuauuggccccaggacugaagcugccucccuuca

SEQ ID NO: 87732 - RNA, 64 nt, Homo Sapiens
acaugccuggcaucugucuccccuuguuccugaguggccccacauggggcucugagcaggcugu

SEQ ID NO: 87733 - RNA, 64 nt, Homo Sapiens
cacaccauccuaugagcccagugagccccacuccuggccccacuggccccacucccaccauccu

SEQ ID NO: 87734 - RNA, 64 nt, Homo Sapiens
cccaccauccugugagccccugugagaccacgccuggccccacucggccccacucacucuaucc

SEQ ID NO: 87735 - RNA, 64 nt, Homo Sapiens
uaccucggggagucaugugccacacagaagccuguggccccacuccucacccuuauccaggacc

SEQ ID NO: 87736 - RNA, 64 nt, Homo Sapiens
agccacucaguuccaagggaucuucugggauggcuggccccacauccuucccuccacuccaccc

SEQ ID NO: 87737 - RNA, 64 nt, Homo Sapiens
ugacugagucucccagcccagacccagggacccuuggccccaagcucagcucuaagaaccgccc

SEQ ID NO: 87738 - RNA, 64 nt, Homo Sapiens
aucugagccuccaccacauagacugaaacuccccuggccccagcccucuccugccuggccuggc

SEQ ID NO: 87739 - RNA, 64 nt, Homo Sapiens
gccucuggaacugugcguucgucugggugggcaguggccccauagcuccuggcccugccccuag

SEQ ID NO: 87740 - RNA, 64 nt, Homo Sapiens
acggccacucgagaccccggucagcccugugcucuggccccagagugggacgagccacccgcuu

SEQ ID NO: 87741 - RNA, 64 nt, Homo Sapiens
auuuuaaauaggaaaaacagguauuauuuuuauuuggccccauucauuauuuuauuuuugguuu

SEQ ID NO: 87742 - RNA, 64 nt, Homo Sapiens
auuuuauuuuugguuuguauugagccaccacaucuggccccauuaagugcugggauuacaaaug

SEQ ID NO: 87743 - RNA, 64 nt, Homo Sapiens
ugcucuuuccucccccgaggccucccucccaguauggccccaccugugaccccaccugcucuuu

SEQ ID NO: 87744 - RNA, 64 nt, Homo Sapiens
uguucuuuccuccccugccgccccccccaagguguggccccaccggccccaccugcucuuuccu

SEQ ID NO: 87745 - RNA, 64 nt, Homo Sapiens
ugcucuuuccuccccccccacucccccaccaguauggccccaccguggccccgccugcucuuuc

SEQ ID NO: 87746 - RNA, 64 nt, Homo Sapiens
aagaaugucccccaccccuuggccucugccuccuuggccccacauuucugcaaacauaaauauu

SEQ ID NO: 87747 - RNA, 64 nt, Homo Sapiens
gcccaaccugccccuucacuuugccuuccugaguuggccccacuccacuugggggucugcauug

SEQ ID NO: 87748 - RNA, 64 nt, Homo Sapiens
gaguggcaaagcuggcccugacgccuggguuucuuggccccagcugcccagcaggugccucgau

SEQ ID NO: 87749 - RNA, 64 nt, Homo Sapiens
gagauaccaagggcauggguggucccugcuucgauggccccaaagcugggccagaguuaaggga

SEQ ID NO: 87750 - RNA, 64 nt, Homo Sapiens
ugccccaccccagcucauccaugugcuuguacccuggccccacggggaggcuugcccuucccug

SEQ ID NO: 87751 - RNA, 64 nt, Homo Sapiens
gucaccuccucagugcaguuagccugagcuccccuggccccaggugccuccaucagagcauuua

SEQ ID NO: 87752 - RNA, 64 nt, Homo Sapiens
gaccgggggaagcugagcccggaccacgucucccuggccccagucaaggcuuuguaaaccggcu

SEQ ID NO: 87753 - RNA, 64 nt, Homo Sapiens
uccucuuccugccucucucaccccaccccugaacuggccccagcccggcucggccucuugagag

SEQ ID NO: 87754 - RNA, 64 nt, Homo Sapiens
cauggaaacgcacaaccccuggcagcgcccagccuggccccaagcccagacgcggaaaccgggu

SEQ ID NO: 87755 - RNA, 64 nt, Homo Sapiens
cucuggcuggugcugggccgaugucgagaaccgauggccccaccgucccucccugauaccaagu

SEQ ID NO: 87756 - RNA, 64 nt, Homo Sapiens
cguuucauaggcuguccacuuuuggucugcaugauggccccauguuacaaaacucacgggccuc

SEQ ID NO: 87757 - RNA, 63 nt, Homo Sapiens
agaagaaaugccuucagaugccuuaauaaagugauggccccacggcccaccuucuagaugacc

SEQ ID NO: 87758 - RNA, 64 nt, Homo Sapiens
acaucggggcuccgaggcaggcaggagcgcucccuggccccaacggcucacaccccacacccgg

SEQ ID NO: 87759 - RNA, 64 nt, Homo Sapiens
ugcauguuguagcaaacauuauauguuugaaauacuucauaaugcagcaugaaaccuaauaugu

SEQ ID NO: 87760 - RNA, 64 nt, Homo Sapiens
auuuuacuuaaaaucuguaagacacauucuguuucuucauaaaauacagguaucuuggauuuca

SEQ ID NO: 87761 - RNA, 64 nt, Homo Sapiens
auaaaacaacucauguuagauuaaaacuuuuuugcuucauaauauuauuuccacugugagauuc

SEQ ID NO: 87762 - RNA, 64 nt, Homo Sapiens
ggacgccacguuaggguugguuacaaccuccaugcuucauaagcuauugcguaccaagaguuga

SEQ ID NO: 87763 - RNA, 64 nt, Homo Sapiens
caaguuacuguucagaauacuuaauaucuccucucuucauaauuaucaauagccccaagcucau

SEQ ID NO: 87764 - RNA, 64 nt, Homo Sapiens
auuaaguacucuugauacaaaauauacuuuuaaacuucauaaccuuuuuauaaaaguuguugca

SEQ ID NO: 87765 - RNA, 64 nt, Homo Sapiens
ucccugucucuaggucgcugagagaggugcuuuucuucauaaaaccuuugggguuuggauuucc

SEQ ID NO: 87766 - RNA, 64 nt, Homo Sapiens
guguaaaagaugcauggagucaggagaaaaccaccuucauaaacugcucugugcaaagaggaau

SEQ ID NO: 87767 - RNA, 64 nt, Homo Sapiens
cauggaaaacucacugcugauucugaauauccuucuucauaaaucuuauuuuaucccagaugug

SEQ ID NO: 87768 - RNA, 64 nt, Homo Sapiens
gaagcagcuuuaaacaaauuacaguucauguuugcuucauaaauccuuccuuucuaggcuggua

SEQ ID NO: 87769 - RNA, 64 nt, Homo Sapiens
gagacuuuaaagucguuuugggaacugugaugugauguggaaauacugauguuuccaguaaggg

SEQ ID NO: 87770 - RNA, 64 nt, Homo Sapiens
guuucuaucuagauuuaaauauauuugucaaugaauguggaauagaaaaucuaaacaugacaau

SEQ ID NO: 87771 - RNA, 64 nt, Homo Sapiens
ugcauauguggggugaaaccagaaagccccuauaauguggaauagaaauugaugaccggaaacu

SEQ ID NO: 87772 - RNA, 64 nt, Homo Sapiens
gcaaggauuucccuggccccuugauguuuccaccauguggaaaagaugcacuguaaauccggca

SEQ ID NO: 87773 - RNA, 64 nt, Homo Sapiens
agugguugaaaugagagcuagugaugacagaaggauguggaaugucuucuugacaucauugugu

SEQ ID NO: 87774 - RNA, 64 nt, Homo Sapiens
cauggaaugggaaggggaaggggagucuuacuauauguggaauaaacuugcucaguguugccac

SEQ ID NO: 87775 - RNA, 64 nt, Homo Sapiens
uauuagaaacuacagaguuuuauuagaaacuucuauguggaaaauguugguacuauguggaaaa

SEQ ID NO: 87776 - RNA, 64 nt, Homo Sapiens
uauuagaaacuucuauguggcagcuguugguacuauguggaaaaucuuucauaucuuggauuug

SEQ ID NO: 87777 - RNA, 64 nt, Homo Sapiens
auuuguguguauguguaugucaauucaugacauuauguggaauccuaaaccuuugguggcuggg

SEQ ID NO: 87778 - RNA, 64 nt, Homo Sapiens
aauuauauuauguuuaauuauuuaagauuucuuuauguggaacaucuauagagauaaauagaaa

SEQ ID NO: 87779 - RNA, 64 nt, Homo Sapiens
guccccugaggcccagcaguaccugcuucccuguauguggaagcagcaccucauucccgccauc

SEQ ID NO: 87780 - RNA, 64 nt, Homo Sapiens
agucuuucaggaaggaagcccuuccuuauguuacauguggaaagccugccuuccaagacaugug

SEQ ID NO: 87781 - RNA, 64 nt, Homo Sapiens
uuauguuacauguggaaagccugccuuccaagacauguggaaguaauugauccaccugccagag

SEQ ID NO: 87782 - RNA, 50 nt, Homo Sapiens
accuuaacccaccuaaguaaauguggaaacauccgauauaaaucucauag

SEQ ID NO: 87783 - RNA, 64 nt, Homo Sapiens
acucuacaaauucccucuugguguaaaauucaagauguggaaauucuaacuuuuuugaaauuua

SEQ ID NO: 87784 - RNA, 64 nt, Homo Sapiens
ugggacucuuggaaucaggagacaaagcuaccacauguggaaagguacuauguguccaugucau

SEQ ID NO: 87785 - RNA, 64 nt, Homo Sapiens
ggcacuauccagaaauaguggacagaggucuggcauguggaaaccuuggaucucggucacaggg

SEQ ID NO: 87786 - RNA, 64 nt, Homo Sapiens
gcugcuacugggacauccacaggaccuaauguuuauguggaaucuccaggcugccaucgagggc

SEQ ID NO: 87787 - RNA, 64 nt, Homo Sapiens
uucauuucagagaaaagcccuauacguguagugaauguggaaaagacuucagauugaauucaca

SEQ ID NO: 87788 - RNA, 64 nt, Homo Sapiens
uucacacaggagagaaagcacaugaauguaaugaauguggaaaagcuuucagucaaaccucaug

SEQ ID NO: 87789 - RNA, 64 nt, Homo Sapiens
uaagacuuaagcaaagccuuuuucauauuugaaaauguggaaagaaaagauguuccuaaaaggu

SEQ ID NO: 87790 - RNA, 64 nt, Homo Sapiens
aguuacuuuguggaucuuguccaaauuuagugaaauguggaagucaaccagaccaaugauggaa

SEQ ID NO: 87791 - RNA, 64 nt, Homo Sapiens
ucccgugaacgucuccuuccucacauagaguagaauguggaauucuguauuuuucuggagcagu

SEQ ID NO: 87792 - RNA, 64 nt, Homo Sapiens
cguugaguuugcuuuuagaggugcucuucagggcauguggaauuccacccuuguauuuuaucac

SEQ ID NO: 87793 - RNA, 64 nt, Homo Sapiens
cucauauaagacagaaacccuauggguguaaugaauguggaaaaucauucugugugaagucaag

SEQ ID NO: 87794 - RNA, 64 nt, Homo Sapiens
uguugaguugcaggauaucuagcaauuuaagaaaauguggaaaaaauauuuuuauugagaaaua

SEQ ID NO: 87795 - RNA, 64 nt, Homo Sapiens
uaagauucagggcaagcuaaguagggagggauguauguggaagggcuuaaggucagaggagugu

SEQ ID NO: 87796 - RNA, 64 nt, Homo Sapiens
caaaguguuggaaaaucaaagucucccaaauuuaauguggaagaauugauccucuucaguugga

SEQ ID NO: 87797 - RNA, 64 nt, Homo Sapiens
acacacacacacacaaacaauccaguguuuugucauguggaaaaucaaaacaaguuagaaagca

SEQ ID NO: 87798 - RNA, 64 nt, Homo Sapiens
ggagguucuguuauuaaagaaacaaugugaaauaauguggaaauuaauacugauaaagacuauc

SEQ ID NO: 87799 - RNA, 64 nt, Homo Sapiens
uaggaagucaaucugugugcugguuuuguugguuauguggaaaucacaaacuccagaggagcaa

SEQ ID NO: 87800 - RNA, 64 nt, Homo Sapiens
caaaguauaaauauuuuguuucuuuauggaggacauguggaaggaguuugaggguuugggaugg

SEQ ID NO: 87801 - RNA, 64 nt, Homo Sapiens
ggaacuuuguguuaugcucuucuguggaauuacuauguggaaaucugcugcagcccugggaaug

SEQ ID NO: 87802 - RNA, 64 nt, Homo Sapiens
ggggcccugggcauuucugcugcuuguagcuuugauguggaacaucuccaugcccugacaacag

SEQ ID NO: 87803 - RNA, 64 nt, Homo Sapiens
aucauacagcugagaaacccuaugaauguaaggaauguggaaaagccuucagcaggaaagaaaa

SEQ ID NO: 87804 - RNA, 64 nt, Homo Sapiens
uucauacgggugagaaacccuaugcauguacaguauguggaaaagccuuuagucagaaaucaaa

SEQ ID NO: 87805 - RNA, 64 nt, Homo Sapiens
gacuuugcugaauucucaagcccugcaucagggaauguggaaauugaauucacaguggagaaga

SEQ ID NO: 87806 - RNA, 64 nt, Homo Sapiens
aacuuuguaucucaggucuucuaugaauguaaaaauguggaagcaaacucacuggggagaaacc

SEQ ID NO: 87807 - RNA, 64 nt, Homo Sapiens
cccuucaguuuccuuacagguaugaauguaaagaauguggaaaauucauacuggagagaaaccc

SEQ ID NO: 87808 - RNA, 64 nt, Homo Sapiens
gcauuuagauacuacuacucuuugaguguaaaaaauguggaaaacucacacuggagauaaaccc

SEQ ID NO: 87809 - RNA, 64 nt, Homo Sapiens
accuacauaucuucuguagguaugaauguaaacaauguggaaaaaucacacuguacagaaacgc

SEQ ID NO: 87810 - RNA, 64 nt, Homo Sapiens
gcauuccgauaccaccaaucuuuaaguguaaagaauguggaaaacucacacuggagauaaaccc

SEQ ID NO: 87811 - RNA, 64 nt, Homo Sapiens
gucuugagccaucauucaucugggaaagcaguguauguggaaaacuccuucuggaggaaagcuu

SEQ ID NO: 87812 - RNA, 64 nt, Homo Sapiens
uauuccacauguguauauauuuccacauguguguauguggaauaauguggaauauauacauaua

SEQ ID NO: 87813 - RNA, 64 nt, Homo Sapiens
uauacauauauuccacauguuuccacauguguguauguggaauaguuccauauauauacauaua

SEQ ID NO: 87814 - RNA, 64 nt, Homo Sapiens
ucagcccugccucccuuuccacagaggugguuuuauguggaacgagguaccuugucuggggaag

SEQ ID NO: 87815 - RNA, 64 nt, Homo Sapiens
gcccagaagaggggcuguguggccugggaauaccauguggaagguugggcuucaaguuaacagg

SEQ ID NO: 87816 - RNA, 64 nt, Homo Sapiens
cugaugauguguuaggauugcuacugaugcugucauguggaaacuauuuaaaggcacuauuaua

SEQ ID NO: 87817 - RNA, 64 nt, Homo Sapiens
caaugcaaguaagacuuucugaaaacacuugaugauguggaaaugcugcaggauuaaauaacuu

SEQ ID NO: 87818 - RNA, 64 nt, Homo Sapiens
cucagugcuuugugcucccucccaaagaggcagucaggcugaugccucccuguuuggaacccuc

SEQ ID NO: 87819 - RNA, 64 nt, Homo Sapiens
cuggcccaacagaaaaacccaacaaagugcaauacaggcugaacaaaaccaacaccaacucaac

SEQ ID NO: 87820 - RNA, 64 nt, Homo Sapiens
cacagcgcugugagccagacccuccuugggcagacaggcugacuggcagcaccagcuuuggggg

SEQ ID NO: 87821 - RNA, 64 nt, Homo Sapiens
cacuacagccugaguaggccugaguggccguggccaggcugagaccugucaggccauacugaca

SEQ ID NO: 87822 - RNA, 64 nt, Homo Sapiens
ugggcccaaagguugggaguaggagacaguaucccaggcugacaagggcuugcccuuuaccuug

SEQ ID NO: 87823 - RNA, 64 nt, Homo Sapiens
uauaacauuaauauuauugagaguaucugcuuuccaggcugaagugauucauucauuauucuag

SEQ ID NO: 87824 - RNA, 64 nt, Homo Sapiens
aggcugccuuggauggccucaggccagguaaccccaggcugaaggggcccugcuccccaucccc

SEQ ID NO: 87825 - RNA, 64 nt, Homo Sapiens
ggugaggccucuaaagguccucucccaaacugaccaggcugaugucaaccuaacccccucaggg

SEQ ID NO: 87826 - RNA, 64 nt, Homo Sapiens
uggcuccagacccgcccccaaccugagacagaaccaggcugagccaggccuccacccccacccc

SEQ ID NO: 87827 - RNA, 64 nt, Homo Sapiens
auuuuuaguagagacgggguuucucuauguuggucaggcugaucucgaacucccgaccucaggu

SEQ ID NO: 87828 - RNA, 64 nt, Homo Sapiens
uuuaaagaucuuugcuugcaaggggccacaggcacaggcugauauaaagacaaggaaacgcugc

SEQ ID NO: 87829 - RNA, 64 nt, Homo Sapiens
ggccucgccucuagauugacuguuccacaaacagcaggcugaauuauuccuuuggaaaauucac

SEQ ID NO: 87830 - RNA, 64 nt, Homo Sapiens
cagccugagagacagugggcacggggacagugaucaggcugacagugaccaagacacuaacaaa

SEQ ID NO: 87831 - RNA, 64 nt, Homo Sapiens
caggugcuggaugccacaguucccugcagccaaucaggcugaaaaugcagauuaccgcacaaau

SEQ ID NO: 87832 - RNA, 64 nt, Homo Sapiens
aacaccucagaccuucugaaggaagccaggacgucaggcugacccugugaccucccagaaccau

SEQ ID NO: 87833 - RNA, 64 nt, Homo Sapiens
ggguucagaaccagccuggcggcagccuucuucacaggcugaggcggggugaaggucagacuaa

SEQ ID NO: 87834 - RNA, 64 nt, Homo Sapiens
uucacacagguagucugccaccagcaagguucagcaggcugaaccaaaaugcaacuggacaacc

SEQ ID NO: 87835 - RNA, 64 nt, Homo Sapiens
gaccugacaccauguugggguagcagaaaaaguacaggcugagcuggcuggcuggacagacuga

SEQ ID NO: 87836 - RNA, 64 nt, Homo Sapiens
cgugguucaucccugguuaaaaagcaaacaaacacaggcugaaaacccaugcugcuguuauaca

SEQ ID NO: 87837 - RNA, 64 nt, Homo Sapiens
uccagagaacucaccugacaaaugucucugagcacaggcugacaccaaaguggcacaacugcac

SEQ ID NO: 87838 - RNA, 64 nt, Homo Sapiens
uccagcaggcgcugccuucacccacggaucugcccaggcugaaggcacacgcucaaugccccac

SEQ ID NO: 87839 - RNA, 64 nt, Homo Sapiens
gucauggauggcugagcagagagcggggaaaaugcaggcugaguggggcgaccuccugccugcc

SEQ ID NO: 87840 - RNA, 64 nt, Homo Sapiens
cugcucagcucugggccauucuccacagcaaccccaggcugaagcagguucccaagcucagagg

SEQ ID NO: 87841 - RNA, 64 nt, Homo Sapiens
uucuguggagggacaaguggacucagggcagcgccaggcugaccacagcacagccaacacgcac

SEQ ID NO: 87842 - RNA, 64 nt, Homo Sapiens
ggcuggggagagacuuuaggcagaagcugugaugcaggcugacugccagccgaggggcugggua

SEQ ID NO: 87843 - RNA, 64 nt, Homo Sapiens
acagagcacagagauccugccuucuuccuacuaucaggcugaccuaaugggguugggcugcucg

SEQ ID NO: 87844 - RNA, 64 nt, Homo Sapiens
ccuguuggagggguggagggauguuccccugagccaggcugagacuagaaccccaucuucccug

SEQ ID NO: 87845 - RNA, 64 nt, Homo Sapiens
ccaggcugagacuagaaccccaucuucccugagccaggcugagacuagaaccccaucuucccca

SEQ ID NO: 87846 - RNA, 64 nt, Homo Sapiens
gggguggcacacaucaguagucccagcuacucugcaggcugaggugggaggauugcuugaaccc

SEQ ID NO: 87847 - RNA, 64 nt, Homo Sapiens
ucuggugaagccagaauggagacacccgugaccucaggcugaaagucacucgacauuggucucu

SEQ ID NO: 87848 - RNA, 64 nt, Homo Sapiens
ggagcugagaggagcugagggucuggaaggagaacaggcugagguacucuucucagcucucugg

SEQ ID NO: 87849 - RNA, 64 nt, Homo Sapiens
ccaaucuagccucuccugucgccaguggugccuucaggcugaugaccagccuacagauguuccu

SEQ ID NO: 87850 - RNA, 64 nt, Homo Sapiens
agugugcuuucugauugaccugcugcagcccaaucaggcugaauucccacucuucagcgucuuu

SEQ ID NO: 87851 - RNA, 64 nt, Homo Sapiens
cgugucauuucugccuuuguuugggacaggcagacaggcugaggaagucaccagugauugugga

SEQ ID NO: 87852 - RNA, 64 nt, Homo Sapiens
auuauuuguguucuaacaggaggaugaacuugcugaaaauaaaacuuugcuauguauuuacucu

SEQ ID NO: 87853 - RNA, 64 nt, Homo Sapiens
auagcauuuauuucugugcccuuaaacccauuuagaaaauaacuacaaaguaaaaauguagagg

SEQ ID NO: 87854 - RNA, 64 nt, Homo Sapiens
gaaaaaucaugucaucuucuauuuguacagaaaugaaaauaaaauaugaaaauaaugaaagaaa

SEQ ID NO: 87855 - RNA, 64 nt, Homo Sapiens
aucuucuauuuguacagaaaugaaaauaaaauaugaaaauaaugaaagaaaugaaaagauagcu

SEQ ID NO: 87856 - RNA, 64 nt, Homo Sapiens
gugggcaaaugucauuguuaccucuguguguuaagaaaauaaaaauauuuucuaaaggucugua

SEQ ID NO: 87857 - RNA, 64 nt, Homo Sapiens
auuuugaaucccucuuccucacuuuuuuuucuaagaaaauaaacauuuuacuguuuuuauggau

SEQ ID NO: 87858 - RNA, 64 nt, Homo Sapiens
aaauauugucacaaguaaauagcaaucaaaaggagaaaauaacuuuuguauuuuuuuaaugugu

SEQ ID NO: 87859 - RNA, 64 nt, Homo Sapiens
aacuugaucuaacugaaaaaaacaccuuguguaagaaaauaaaaugaaagauuggauuuucuau

SEQ ID NO: 87860 - RNA, 64 nt, Homo Sapiens
gauucuuguaccuaacauuuaguuuuuaguagaugaaaauaauguccagaguuuauaauuacgu

SEQ ID NO: 87861 - RNA, 64 nt, Homo Sapiens
uguuguacuuuuuauucaauuuuuguaaauaagugaaaauaauugcaaguuguacuguaugcag

SEQ ID NO: 87862 - RNA, 64 nt, Homo Sapiens
caaguuuugaagccugcuaaagcucauuuaguuagaaaauaaggauucauaugcuucccagaga

SEQ ID NO: 87863 - RNA, 64 nt, Homo Sapiens
agguauuuucuccaaauguuacuuggguuaggaagaaaauaauuagaugacuauucaguggcua

SEQ ID NO: 87864 - RNA, 64 nt, Homo Sapiens
caccuggcaucuuacaucuguuaagaaauuuguggaaaauaacuuuuuuuuuccaguaaugagc

SEQ ID NO: 87865 - RNA, 64 nt, Homo Sapiens
ccuggacuuuaauugcacccaacgauacaauccugaaaauaauagaauugucugaacacaguag

SEQ ID NO: 87866 - RNA, 64 nt, Homo Sapiens
ugccccucaggggaauucggagcuagaggacauggaaaauaaagccaggaaagucaaaaaaacg

SEQ ID NO: 87867 - RNA, 64 nt, Homo Sapiens
aaaagcgcaaagaggagaaugaagauccagaaaggaaaauaaagaagaagggcuucggcgccau

SEQ ID NO: 87868 - RNA, 64 nt, Homo Sapiens
acuccagccggggugacagagugagacuccgacugaaaauaaauaaauaaauaaauaaauaaau

SEQ ID NO: 87869 - RNA, 64 nt, Homo Sapiens
aaaaaguuuauuuuccuuuugucugggcaguagugaaaauaacuacucacaacauucacuaugu

SEQ ID NO: 87870 - RNA, 64 nt, Homo Sapiens
gaauuuggaggcuggaguaaaacaaaaaacgaaugaaaauaacuaguuaaagaaaggaaaagaa

SEQ ID NO: 87871 - RNA, 64 nt, Homo Sapiens
uaauuaauauauuaaaauuccagaaucuuguuuugaaaauaaccuugaaauucuauuuauaaua

SEQ ID NO: 87872 - RNA, 64 nt, Homo Sapiens
uagacucuaguauuuauggguuucaccuuuucaggaaaauaacuauaaagaccagaaauucccu

SEQ ID NO: 87873 - RNA, 64 nt, Homo Sapiens
uaugaggaaaaguuuaaccuuuaggauuccaugugaaaauaaaagccuuaucggggcgaaccuu

SEQ ID NO: 87874 - RNA, 64 nt, Homo Sapiens
gcucugucaaaagcacaaaaccuuuucaaaucaagaaaauaagucaaaaacagagucgcuuuug

SEQ ID NO: 87875 - RNA, 64 nt, Homo Sapiens
uaguauugaagacuuacauguucaccuaaccuuugaaaauaaagucuauaauaaauuaacaaga

SEQ ID NO: 87876 - RNA, 64 nt, Homo Sapiens
aagaacucuggaguggucuagaccaaaaggaaaagaaaauaaaggucacauuuuucuacuauuu

SEQ ID NO: 87877 - RNA, 64 nt, Homo Sapiens
guguacuacacuuugaaauaagaaaauaacaaaugaaaauaaauucucuguaaucugcuaugaa

SEQ ID NO: 87878 - RNA, 64 nt, Homo Sapiens
aaugaaaauaaauguguacuaaucugcuaugaaagaaaauaacaagguuucuuucuuucucugu

SEQ ID NO: 87879 - RNA, 64 nt, Homo Sapiens
caucuaaaguccuggcccuggcccuuacuauuaggaaaauaaacagacaaaaacaaguaaauau

SEQ ID NO: 87880 - RNA, 64 nt, Homo Sapiens
uaauaaaguaugacccacauuacuuuuuaugggugaaaauaagacaaaaauaauaguuuuagug

SEQ ID NO: 87881 - RNA, 64 nt, Homo Sapiens
aguauauuuuagaaauuuguuaaugagaguaaaagaaaauaaauguguauagcucaguuuggau

SEQ ID NO: 87882 - RNA, 64 nt, Homo Sapiens
cuuguuuaaauguccauuuuuauucuuuauguuugaaaauaaauuauggggauccuauuuagcu

SEQ ID NO: 87883 - RNA, 64 nt, Homo Sapiens
uaaagacaaaguaauucuauuaaaugaacuaacugaaaauaauaauuauaggaagugauuauuc

SEQ ID NO: 87884 - RNA, 64 nt, Homo Sapiens
ucuguagaauuuauuuuaacuaugaccuuuaauugaaaauaaauaauuaaaauaucagacaugu

SEQ ID NO: 87885 - RNA, 64 nt, Homo Sapiens
ccagaagcacuggacuaaagguacaccaugccucgaaaauaaguggccaggcauggccuaguaa

SEQ ID NO: 87886 - RNA, 64 nt, Homo Sapiens
cucaugucagacccagaaagacucuaguuaaaaagaaaauaaaucaaacaaaacagauaugcuu

SEQ ID NO: 87887 - RNA, 64 nt, Homo Sapiens
uauaaauuuugaaacuaugauuccagaaucaaaagaaaauaaaaagaauugaccuuaauuuguu

SEQ ID NO: 87888 - RNA, 64 nt, Homo Sapiens
aaggcuaauauauaauuuuuaaaaaaggagagaagaaaauaaagcugucucaaaaaaaaaaaaa

SEQ ID NO: 87889 - RNA, 64 nt, Homo Sapiens
agcaacuuaugaaaguagaccuguuauuggagaugaaaauaaaaaauuaucauaucuuccauuc

SEQ ID NO: 87890 - RNA, 64 nt, Homo Sapiens
aaauuaucauaucuuccauuugcaaagacuuuuugaaaauaauuuuggaauagaauugguaagu

SEQ ID NO: 87891 - RNA, 64 nt, Homo Sapiens
uagaugacuuuguggccaucuuguuauugaguaagaaaauaaagcauggacaucaugaaaauaa

SEQ ID NO: 87892 - RNA, 64 nt, Homo Sapiens
guuauugaguaagaaaauaaagcauggacaucaugaaaauaacagauguuacccaaacucaucu

SEQ ID NO: 87893 - RNA, 64 nt, Homo Sapiens
uguguugaugagagaauaaucuugggcagucugggaaaauaaggaaggcaucuccuucuuacuc

SEQ ID NO: 87894 - RNA, 64 nt, Homo Sapiens
uaucauuaauaaauauaccuuugcucuuuucagggaaaauaacaaccacccuuacugauaguug

SEQ ID NO: 87895 - RNA, 64 nt, Homo Sapiens
cacaguguccucaggauauguugaauugcuaauagaaaauaaugccguaggcagagugcucacu

SEQ ID NO: 87896 - RNA, 64 nt, Homo Sapiens
cuuuaaaaagcccucuuaauaaauugaaaacucugaaaauaacugguaagguacaaguguguua

SEQ ID NO: 87897 - RNA, 64 nt, Homo Sapiens
guguuucacaguauuucuaugauuuuuguuauaugaaaauaauauauugaaggucauaaucagu

SEQ ID NO: 87898 - RNA, 64 nt, Homo Sapiens
uguuuuguuuuuuucuguuuugcucuuccuuguggaaaauaaagaaugauuuaauuuuuccuau

SEQ ID NO: 87899 - RNA, 64 nt, Homo Sapiens
guagcucuggcuuggugcuuuuaauaaaguggcugaaaauaauaccugccauuuaaccccacag

SEQ ID NO: 87900 - RNA, 64 nt, Homo Sapiens
uacccuguauucaaaauuacauuacuagugagcagaaaauaacaagucuguuuuauguguuuug

SEQ ID NO: 87901 - RNA, 64 nt, Homo Sapiens
gacucugaauauuuguuacaacuguuuagcuuaugaaaauaaucacaaaucuuaaaguaucgga

SEQ ID NO: 87902 - RNA, 64 nt, Homo Sapiens
aucaagcuauuugggguguuuguuaguaaauagggaaaauaaucucaaaggaguuaaauguauu

SEQ ID NO: 87903 - RNA, 64 nt, Homo Sapiens
cagcauaccacgccacaggguuagaaccaacgaagaaaauaaaaugagggugcccagcuuauaa

SEQ ID NO: 87904 - RNA, 64 nt, Homo Sapiens
uacaagugugcaaauuaugacugcgugagccuuagaaaauaaaauguauaaagggcaacacaug

SEQ ID NO: 87905 - RNA, 64 nt, Homo Sapiens
uugcaguauuuaaagcuuaagcuuucaggaaaaagaaaauaagaauucagugugugcaugacaa

SEQ ID NO: 87906 - RNA, 64 nt, Homo Sapiens
ggaaaguguaggugaaaaaacuuguaacuguauugaaaauaaauaccauuaaacugugaucagu

SEQ ID NO: 87907 - RNA, 64 nt, Homo Sapiens
acuuuguuuugguacauuugguugugcuuguggggaaaauaaaaacgcagagauccuuauauau

SEQ ID NO: 87908 - RNA, 64 nt, Homo Sapiens
accgugcugacagauaucaaaguacucuagcagggaaaauaauuuguuugcuguguaaggaaga

SEQ ID NO: 87909 - RNA, 64 nt, Homo Sapiens
ugauaaguuuacacacugugcaaucucacaaucugaaaauaaaguugaguuggcuguguuuucu

SEQ ID NO: 87910 - RNA, 64 nt, Homo Sapiens
auuuaauauuucuuuaaauacaaauuauguuggggaaaauaaagaucuuugccuuaccugauca

SEQ ID NO: 87911 - RNA, 64 nt, Homo Sapiens
uacugcccucuuacauaauguuuuuucaaagcaagaaaauaauuuaaaaugugaaaaaacauua

SEQ ID NO: 87912 - RNA, 64 nt, Homo Sapiens
uaugggcaaaaacauucuauuauagugaacuaaugaaaauaacagcguauuuucaauauuuucu

SEQ ID NO: 87913 - RNA, 64 nt, Homo Sapiens
aaaaaaaaaaaucaaguaauuguuuuccuaugaggaaaauaaccaugagcuguaucaugcuacu

SEQ ID NO: 87914 - RNA, 64 nt, Homo Sapiens
aaauauguucguuuaucauuaacugauuuaaaaggaaaauaauaaacagucuucauuuuuaagu

SEQ ID NO: 87915 - RNA, 64 nt, Homo Sapiens
aaacagucuucauuuuuaagcuuauagaaaaggagaaaauaauuuggacauaaagaaaauccua

SEQ ID NO: 87916 - RNA, 64 nt, Homo Sapiens
uuuauuucuauccaaauuuguaggauugacuuaugaaaauaaauuuuacaugaagcucaagugu

SEQ ID NO: 87917 - RNA, 64 nt, Homo Sapiens
gacauugcucguuucucaugaaggcagcuuuucagaaaauaacauuagucacuuccucacaugg

SEQ ID NO: 87918 - RNA, 64 nt, Homo Sapiens
guucuuacuggaaugucuagcauucuacauuaaagaaaauaaugcuuguagaauauguauuaau

SEQ ID NO: 87919 - RNA, 64 nt, Homo Sapiens
uacauugccuuuuguccauuucaagaaaauacuugaaaauaaauauuuuuaugagcacagacuu

SEQ ID NO: 87920 - RNA, 64 nt, Homo Sapiens
aauuuauuauuucaaaagaauaugucuuaaaagggaaaauaaaaacuuucuguugaaucacaac

SEQ ID NO: 87921 - RNA, 64 nt, Homo Sapiens
uuacuuauaucaauuuaaaauuugcuagugguuugaaaauaauaauguacugacuacauguaug

SEQ ID NO: 87922 - RNA, 64 nt, Homo Sapiens
ugaaauauccuaaaauauagugguuuaaagaguagaaaauaagaaauaauuucgguacaucuua

SEQ ID NO: 87923 - RNA, 64 nt, Homo Sapiens
uaauuuguuguauauaguucguuaucccuauggugaaaauaaauuuggcagagagguacaguau

SEQ ID NO: 87924 - RNA, 64 nt, Homo Sapiens
augcuauaauuuggguaugguuuguauaguauuggaaaauaaaaaagauaugcacagucuauuu

SEQ ID NO: 87925 - RNA, 64 nt, Homo Sapiens
gagaaucacuuuucuagacaggguggcugugaaagaaaauaauguggaugaagguggguauugg

SEQ ID NO: 87926 - RNA, 64 nt, Homo Sapiens
gugggaggggagaaagggaaccuuuucuuaaaaugaaaauaauuacugcuauuuuaaaauuucu

SEQ ID NO: 87927 - RNA, 64 nt, Homo Sapiens
uaagcauuuacaucacguacucauaaccuauuaugaaaauaaaugaaacuggcuggguauggug

SEQ ID NO: 87928 - RNA, 64 nt, Homo Sapiens
ucccauccuggccaaugcuuaaauacuauuuguugaaaauaauucuuugagacagauuucagcu

SEQ ID NO: 87929 - RNA, 64 nt, Homo Sapiens
guuuuguguuuuuuucuggaacuacuucaagugagaaaauaaaaaaaaauggugacaaagcugu

SEQ ID NO: 87930 - RNA, 64 nt, Homo Sapiens
auacaauuaaggcugacauucauuguuucaugcagaaaauaaagagucuuuagucaaaucucug

SEQ ID NO: 87931 - RNA, 64 nt, Homo Sapiens
ccuugaggaugugaacauaacuuuauuuuuucuugaaaauaaagaucacauugugcuacuacga

SEQ ID NO: 87932 - RNA, 64 nt, Homo Sapiens
auucuuauuucaugaaaauuauuugcagcugagagaaaauaaucacuuuguguuucagccaugu

SEQ ID NO: 87933 - RNA, 64 nt, Homo Sapiens
cggauuuauuuuuccauuuaacuugcugcaguaugaaaauaagauaaugcuuucgauaguguua

SEQ ID NO: 87934 - RNA, 64 nt, Homo Sapiens
uacuagagaauguauauuuuuauaugcuguggaugaaaauaacucaccuguguuugcauauuua

SEQ ID NO: 87935 - RNA, 64 nt, Homo Sapiens
ucuaaaggaaaguagcacauugcuuggcagaaaagaaaauaaggauggccagaaaauauuguau

SEQ ID NO: 87936 - RNA, 64 nt, Homo Sapiens
acuuuauaaacaccaucugcuuuuuaagaaaauggaaaauaaaaauaaaggaaaucaaauguua

SEQ ID NO: 87937 - RNA, 64 nt, Homo Sapiens
gugccuugagagaccacucauagguugcagcagagaaaauaaaugagguggaugucagaucugg

SEQ ID NO: 87938 - RNA, 64 nt, Homo Sapiens
auugugcuuuaugugguagucuuacccugaaacagaaaauaaaugaaacacauuugccuaucuu

SEQ ID NO: 87939 - RNA, 64 nt, Homo Sapiens
uucuuucuagaaacacauuuuuucuagcuaauaugaaaauaauuauuacuuggguauucucuga

SEQ ID NO: 87940 - RNA, 64 nt, Homo Sapiens
gcauauaugcacagauacacacacacacacacacgaaaauaaauaaauguucauauucuucugu

SEQ ID NO: 87941 - RNA, 64 nt, Homo Sapiens
aacagacauuuauuuucuccucucccuugaauaagaaaauaaguuuuccauuccuaugaacugu

SEQ ID NO: 87942 - RNA, 64 nt, Homo Sapiens
uucaacucaagcauaaagcuaaaucacuuugggagaaaauaaaauaacauuuauaggaggaaaa

SEQ ID NO: 87943 - RNA, 64 nt, Homo Sapiens
aagauuuggaaaggaaguauaaaagacaauuacagaaaauaagcagggucagcaacaacaaaga

SEQ ID NO: 87944 - RNA, 64 nt, Homo Sapiens
caagauagauccauuuggacauauuuaggcaagagaaaauaaacaaacccauuaggcaugccua

SEQ ID NO: 87945 - RNA, 64 nt, Homo Sapiens
uauauuaauuuuugaaacccgcacugacaagauggaaaauaaaucucaagaacaccuuuguuuu

SEQ ID NO: 87946 - RNA, 64 nt, Homo Sapiens
cuucugagaaaaaguucaaggaaaauguagauuagaaaauaagaagagcagaaauaaaaaggaa

SEQ ID NO: 87947 - RNA, 64 nt, Homo Sapiens
uuuuacaaaaagucacuuuucuucuuuuaguguagaaaauaauuauugcaugacuauuauuuau

SEQ ID NO: 87948 - RNA, 64 nt, Homo Sapiens
aaaucuuuaaauguauugaagcauugugcugucugaaaauaaggaauugcuuauaaaccagcca

SEQ ID NO: 87949 - RNA, 64 nt, Homo Sapiens
uauguagcugauuuaauaagcuaguuagugaauggaaaauaaguguggaguauuaaaaauguuc

SEQ ID NO: 87950 - RNA, 64 nt, Homo Sapiens
uuuugguggugaggaggaagaacaaauaauagaagaaaauaaaaaugagauagaagaaaaguaa

SEQ ID NO: 87951 - RNA, 64 nt, Homo Sapiens
auuaguaguuaccuguaaauggcagaucuuuuaggaaaauaagagaaagguaagggcucuuuug

SEQ ID NO: 87952 - RNA, 64 nt, Homo Sapiens
gauuccuggagggaagaccauuccuguuacaaaugaaaauaagcaacagaauuagcuacaucca

SEQ ID NO: 87953 - RNA, 64 nt, Homo Sapiens
caucuccaggugaugcccaaggcacagggcugcagaaaauaaaccuccagauuccaccaacacg

SEQ ID NO: 87954 - RNA, 64 nt, Homo Sapiens
uaaauuucauaauguuagucuuagacgaaguguagaaaauaaaaggcuauaauagcaauaaaag

SEQ ID NO: 87955 - RNA, 64 nt, Homo Sapiens
aaaugcauuauguaaggucacugacuuuucagaagaaaauaaacgcauuaaggaaguauaugau

SEQ ID NO: 87956 - RNA, 64 nt, Homo Sapiens
cuggagaguucuguuauuaaacagcgugaaucaugaaaauaagcguuaggagggccugugguag

SEQ ID NO: 87957 - RNA, 64 nt, Homo Sapiens
gagauguccacacaaauggaauccuacauuauuggaaaauaaauacuuugauacgccucaucuu

SEQ ID NO: 87958 - RNA, 64 nt, Homo Sapiens
aaaugaaaaagauccuuuucaaaaaggugauccugaaaauaaaacuaacacuccaguauuuugu

SEQ ID NO: 87959 - RNA, 64 nt, Homo Sapiens
ggaaaugggaaauggauggaaaugggaaaggagggaaaauaauagcccagugagagcugaauga

SEQ ID NO: 87960 - RNA, 64 nt, Homo Sapiens
aaaugguaucuaauuaauaacuagucugacaucagaaaauaaaauugaggcugauuuuuaaaaa

SEQ ID NO: 87961 - RNA, 64 nt, Homo Sapiens
gugugaaaacaagugucaaaauuccucauauagagaaaauaauuuugaguuuagaguauuaucu

SEQ ID NO: 87962 - RNA, 64 nt, Homo Sapiens
uccuugaaagcccauuaaguggaauagacuuucugaaaauaagaguucuuuaccucaguccucc

SEQ ID NO: 87963 - RNA, 64 nt, Homo Sapiens
aaaaacugagacuauggacauucaaaucaugggagaaaauaauuuuguagauuauguuccauug

SEQ ID NO: 87964 - RNA, 64 nt, Homo Sapiens
uaggauucuuuuggggaagagucauaauucuuuugaaaauaaccaugaauacacuuacaguuag

SEQ ID NO: 87965 - RNA, 64 nt, Homo Sapiens
agauguuuauauauuaacgacaauuuuuuuuuuggaaaauaaaaagugccuaaaagauguaugu

SEQ ID NO: 87966 - RNA, 64 nt, Homo Sapiens
uaucaaaggcaagauaucauuuauuggacuucuugaaaauaaaaguuacaaaauccaacaacaa

SEQ ID NO: 87967 - RNA, 64 nt, Homo Sapiens
ggaaagugugacacaguuuuuaaauuuagauguagaaaauaaugaauuaaugagauuggugaaa

SEQ ID NO: 87968 - RNA, 64 nt, Homo Sapiens
ggagauuuuuuuuuucacaguugaguuaguuugugaaaauaaagaacucuguagcucaccaagg

SEQ ID NO: 87969 - RNA, 64 nt, Homo Sapiens
uugcccucaugaagaaucccuagaggaagauaaggaaaauaaguauuuuccaguuuugcuugac

SEQ ID NO: 87970 - RNA, 64 nt, Homo Sapiens
ucuucagagauaacuucaagagcaaaaaaagugagaaaauaauuuugcucucuagucucugaaa

SEQ ID NO: 87971 - RNA, 64 nt, Homo Sapiens
uauaaauaccaugucaaauucuuuucauuacaaggaaaauaaguacaacuaauuauuguugaua

SEQ ID NO: 87972 - RNA, 64 nt, Homo Sapiens
uuaagauuacuggccuuuggugaauauauccagagaaaauaaacuuauguuuggaugcagcagc

SEQ ID NO: 87973 - RNA, 64 nt, Homo Sapiens
uuugaaaguagggugauugauauuuucucucagggaaaauaauuauuggauaaauaugaauaaa

SEQ ID NO: 87974 - RNA, 64 nt, Homo Sapiens
gaaacuuguuuuuuuaacgucagccagauauuuagaaaauaaccucaaaaguguuuauaugguc

SEQ ID NO: 87975 - RNA, 64 nt, Homo Sapiens
uagagagaucccaucucuaaaaaauaaaauauaagaaaauaaaacuuaggggauauacagauuu

SEQ ID NO: 87976 - RNA, 64 nt, Homo Sapiens
cugugaggcucaaggcugguauggauaacgaggagaaaauaaaauacuggugcugaaaggaagg

SEQ ID NO: 87977 - RNA, 64 nt, Homo Sapiens
uauuuguagcuucucuucuagggauccugauuuugaaaauaauccagcauaaacgggggugggg

SEQ ID NO: 87978 - RNA, 64 nt, Homo Sapiens
gaauaagaaguuaccuacucaaaaaagaaaaaaugaaaauaaaguuuaagaauuaaaaaaauac

SEQ ID NO: 87979 - RNA, 64 nt, Homo Sapiens
gaguaucacagcucuuuuagaggaaguuuauucagaaaauaaagagccaacagaguaaagugga

SEQ ID NO: 87980 - RNA, 62 nt, Homo Sapiens
ucaagaagagcaaagcaugggaacgggcuuggaagaaaauaauucagaugaugaagaaagag

SEQ ID NO: 87981 - RNA, 64 nt, Homo Sapiens
cuccugaacaucuaaaagauauuuugcaaaaaaggaaaauaacuuacagaugcaaacagcuaua

SEQ ID NO: 87982 - RNA, 64 nt, Homo Sapiens
ugagaaagaccuuuguuccuauuuuuucacuugugaaaauaauuguaguaaccccugcccaggu

SEQ ID NO: 87983 - RNA, 64 nt, Homo Sapiens
aaauuuaucucacaauaaguuuaaaaaucuugaagaaaauaauaacuaugauuuauuggguuuc

SEQ ID NO: 87984 - RNA, 64 nt, Homo Sapiens
gagcuucuaagggcaucuuaacaggaugcuacaugaaaauaaggaaagaaauuaauacauauca

SEQ ID NO: 87985 - RNA, 64 nt, Homo Sapiens
augugcuuaauuccuacagugaguuuauauuuuugaaaauaaaagcuaguaaauauucuuucug

SEQ ID NO: 87986 - RNA, 64 nt, Homo Sapiens
uuuguuuauuuuaaagcaagaauggaagacccuugaaaauaaagaaguaauuauugacacauuu

SEQ ID NO: 87987 - RNA, 64 nt, Homo Sapiens
ccuguugggcguuacuagaaacuauggaaaacuggaaaauaacuuugaaaaaauuggauaaagu

SEQ ID NO: 87988 - RNA, 64 nt, Homo Sapiens
uuuucccauauauuauuaaagucaucuuacuaaugaaaauaaugcauccucucuauaauuugga

SEQ ID NO: 87989 - RNA, 64 nt, Homo Sapiens
ggauaaaggauggcuaagaggaauaugcauuugagaaaauaagauauuuccuuuuaccuaauuu

SEQ ID NO: 87990 - RNA, 64 nt, Homo Sapiens
guauacgugucaacacagcuaaaauuuuuuuaaagaaaauaauugccucaagaugguuuucaaa

SEQ ID NO: 87991 - RNA, 64 nt, Homo Sapiens
acauuaguuacaagauuuuuauauuuuuuuuaaggaaaauaaaagcaaauugugccuaagcgaa

SEQ ID NO: 87992 - RNA, 64 nt, Homo Sapiens
uugcuuguagaaacaauuuugaaagccccuugaggaaaauaaaaaucaagaagaacacuuuucu

SEQ ID NO: 87993 - RNA, 64 nt, Homo Sapiens
uaauacauuguaauacuguaugauaaucaugugugaaaauaauuuuugaaauauccuuuggcug

SEQ ID NO: 87994 - RNA, 64 nt, Homo Sapiens
ggucagaaugcaagugacuuagucagggagagaugaaaauaauaauagccuuuggcucacccag

SEQ ID NO: 87995 - RNA, 64 nt, Homo Sapiens
aacaguguuugaggacagaacuaaauuuuaucuugaaaauaaaugcuacuucguaauguuguua

SEQ ID NO: 87996 - RNA, 64 nt, Homo Sapiens
ugcagugauuauauuucugauagaacaacacuuggaaaauaauuuguccaguuauauuguuuuu

SEQ ID NO: 87997 - RNA, 64 nt, Homo Sapiens
auucugggccuuacuuguuuccaaaaaugucuuagaaaauaaaauguauuuaugcccuuauauc

SEQ ID NO: 87998 - RNA, 64 nt, Homo Sapiens
auacacagguaauuuaguaucaguagugaaugcagaaaauaaaaauuaaucaauggauauccuu

SEQ ID NO: 87999 - RNA, 64 nt, Homo Sapiens
uuuauggguuuuuuugguuaugagagauaauggagaaaauaauucucaaguuaugaaauaaaac

SEQ ID NO: 88000 - RNA, 64 nt, Homo Sapiens
uuauaauccauuuaaagugagucauguuuugugggaaaauaauuuaguccaaauauaagaaacu

SEQ ID NO: 88001 - RNA, 64 nt, Homo Sapiens
ugcaguuauugauucuugccuuugauggagaagggaaaauaaauacuuccuauucuuucuuaaa

SEQ ID NO: 88002 - RNA, 64 nt, Homo Sapiens
cuguacccaucaaucuuauuuuugugcucuagcagaaaauaacucauuaagaaauaauuuuaga

SEQ ID NO: 88003 - RNA, 64 nt, Homo Sapiens
uaauggugggguuuucugcuuuguuuuuauuuaagaaaauaaacacgacauauuuaaagaaggu

SEQ ID NO: 88004 - RNA, 64 nt, Homo Sapiens
ggauuggaugaaagucaaagguugucuacuuuaagaaaauaaaauacccugaauggagcccagc

SEQ ID NO: 88005 - RNA, 64 nt, Homo Sapiens
cugaauagaauuugaagcagucugaauguucuuugaaaauaacuggaguuauuagcauacccua

SEQ ID NO: 88006 - RNA, 64 nt, Homo Sapiens
ccacuuuuaaaaaugacacauauuuaaacacuuagaaaauaaaguuaacacuuacugaagugcu

SEQ ID NO: 88007 - RNA, 64 nt, Homo Sapiens
gacgagaaaacaauaacgauaaaagacagugaaagaaaauaacgauaaaagacagugaaagaaa

SEQ ID NO: 88008 - RNA, 64 nt, Homo Sapiens
cagugaaagaaaauaacgauaaaagacagugaaagaaaauaacaauaaaagacaaggaaaaaau

SEQ ID NO: 88009 - RNA, 64 nt, Homo Sapiens
aaggauauuuaagugagcauuuucuaguucauaugaaaauaaccauaguacaggaugauuucug

SEQ ID NO: 88010 - RNA, 64 nt, Homo Sapiens
uaggugaagcauacuccaguguuuuagggguuuugaaaauaaauauuuaaauuucacaguccuc

SEQ ID NO: 88011 - RNA, 64 nt, Homo Sapiens
uaugaacaacuuucaacaauaacuacugcaauuagaaaauaaaaauguaaagaaaucagauaca

SEQ ID NO: 88012 - RNA, 64 nt, Homo Sapiens
uguuugaaauccaagaauaaauaagcuaugcacagaaaauaaaagauuccuauaauacagugcu

SEQ ID NO: 88013 - RNA, 64 nt, Homo Sapiens
agauuuuuccaguguugauuccucaaaguaguuagaaaauaaacuuuccaaucacuuaguagcc

SEQ ID NO: 88014 - RNA, 64 nt, Homo Sapiens
uauaaaacauuuccaaucacagccuacuagacuugaaaauaaagaaaccccacuuaugggugua

SEQ ID NO: 88015 - RNA, 60 nt, Homo Sapiens
acaaagaaguuuggaugaggaauuugcagccuuuaccacuguaguuuucuaaacgcugca

SEQ ID NO: 88016 - RNA, 60 nt, Homo Sapiens
ucuaugacuucuacauaacauguuacaaugcuuuaccaaaauuuagaugccuuccuaaau

SEQ ID NO: 88017 - RNA, 60 nt, Homo Sapiens
uauagauucaguaucuacuacccauauuuacuuuaccaaauauauuucuccucacugcau

SEQ ID NO: 88018 - RNA, 60 nt, Homo Sapiens
agaugguauuugcacauuuaagauauguuacuuuaccaauuuuuaaugguaaucaacucu

SEQ ID NO: 88019 - RNA, 60 nt, Homo Sapiens
auuaggaucucaccucuuucgucucuguaccuuuaccaacccacuugguuggcucccuuu

SEQ ID NO: 88020 - RNA, 60 nt, Homo Sapiens
uuuuccugguggcuuggcuuuucucuuacucuuuaccaagaucucauauuuucucccucu

SEQ ID NO: 88021 - RNA, 60 nt, Homo Sapiens
augucgauggggcaagaacucagacuucuacuuuaccaaguaccacacacucuggaaugc

SEQ ID NO: 88022 - RNA, 60 nt, Homo Sapiens
ucucuaagcucaagaugcaucccauugccacuuuaccauucuauuucccaagggaaccau

SEQ ID NO: 88023 - RNA, 60 nt, Homo Sapiens
ccugaggcuucuguucaauuucauagacuccuuuaccauguaaaauuugucugauauuug

SEQ ID NO: 88024 - RNA, 60 nt, Homo Sapiens
guuagucaauuguaucagguuuuccaagaccuuuaccaguaaauuauguuucuguaugua

SEQ ID NO: 88025 - RNA, 60 nt, Homo Sapiens
aaauaucauguuaaauuagaaugaauuuaucuuuaccaaaaaccauguugcguucaaaga

SEQ ID NO: 88026 - RNA, 60 nt, Homo Sapiens
uagagacaggacagaauguguucuuuucuccuuuaccaguccuauuuuucaaugggaaga

SEQ ID NO: 88027 - RNA, 64 nt, Homo Sapiens; identical to SEQ ID NO: 24975

SEQ ID NO: 88028 - RNA, 64 nt, Homo Sapiens; identical to SEQ ID NO: 24976

SEQ ID NO: 88029 - RNA, 64 nt, Homo Sapiens; identical to SEQ ID NO: 24977

SEQ ID NO: 88030 - RNA, 64 nt, Homo Sapiens; identical to SEQ ID NO: 24978

SEQ ID NO: 88031 - RNA, 64 nt, Homo Sapiens; identical to SEQ ID NO: 24979

SEQ ID NO: 88032 - RNA, 64 nt, Homo Sapiens; identical to SEQ ID NO: 24980

SEQ ID NO: 88033 - RNA, 64 nt, Homo Sapiens; identical to SEQ ID NO: 24981

SEQ ID NO: 88034 - RNA, 64 nt, Homo Sapiens; identical to SEQ ID NO: 24982

SEQ ID NO: 88035 - RNA, 64 nt, Homo Sapiens
cuaaacguuggugaaaguuauaaccuccugccugggagaaaauauacaucaccuaaaaugaacu

SEQ ID NO: 88036 - RNA, 64 nt, Homo Sapiens
ugccaacuaaacuacucuuuaggcagccuucugaggagaaaagcaacccuguuucaaauccacu

SEQ ID NO: 88037 - RNA, 64 nt, Homo Sapiens
accuguaaauaugaaagaacaaagguuauuuccuggagaaaagacaauuuauucaacaccaacg

SEQ ID NO: 88038 - RNA, 64 nt, Homo Sapiens
ucaucauaugggcacaacucugguguccuucuauggagaaaaccucaaguaaaguuuuauucug

SEQ ID NO: 88039 - RNA, 64 nt, Homo Sapiens
gaaaagcagaaaggaaaaaaaaugaggagaaaaaggagaaaaggcauagguagaugguaaagag

SEQ ID NO: 88040 - RNA, 64 nt, Homo Sapiens
gagaaaagggaaaagcagaagguaaagagaaugaggagaaaaagggagggucacauagguagau

SEQ ID NO: 88041 - RNA, 64 nt, Homo Sapiens
cucuguuucgaauauagccacagaaauaaaggauggagaaaaaucugggacagguaauuuugca

SEQ ID NO: 88042 - RNA, 64 nt, Homo Sapiens
uucuguuucgaacauagccacagaaauaaaggauggagaaaaaucugggacagguaauuuugca

SEQ ID NO: 88043 - RNA, 64 nt, Homo Sapiens
uucuguuuugaguauagccagagaaaacaaggauggagaaaaaucuaggacagguaauuuugaa

SEQ ID NO: 88044 - RNA, 64 nt, Homo Sapiens
uucuguuuuggguauagccagagaaaacaaggauggagaaaaaucuaggacagguaauuuugaa

SEQ ID NO: 88045 - RNA, 64 nt, Homo Sapiens
agaagaaaaaggaaaagggcaaauugaaagucaaggagaaaaagcgcaaagaggagaaugaaga

SEQ ID NO: 88046 - RNA, 64 nt, Homo Sapiens
cucugaaacaugguggccugagagaagaagagcuggagaaaaugaaagaagagcgugaaaggug

SEQ ID NO: 88047 - RNA, 64 nt, Homo Sapiens
augggauugccacucacccauuuucccugagaaaggagaaaaaggcagaauggcccuagaguuc

SEQ ID NO: 88048 - RNA, 64 nt, Homo Sapiens
uagcaaauccaucagcagggcucaauacguucugggagaaaacugccacaaagccgguaaaugc

SEQ ID NO: 88049 - RNA, 64 nt, Homo Sapiens
aaaauugcaauucuacuuaaagaaaaacuucucuggagaaaaaugcggaguuguuaaggacuga

SEQ ID NO: 88050 - RNA, 64 nt, Homo Sapiens
gcccagcuuggcgugggguuuugagaauuccuuuggagaaaacaagaaauucuguugaagacag

SEQ ID NO: 88051 - RNA, 64 nt, Homo Sapiens
aaguauuaaugaaaaaagagccauaagcauuccaggagaaaaucucaagggagcuacauagagc

SEQ ID NO: 88052 - RNA, 64 nt, Homo Sapiens
cuaagaauuucaggagugauguaugucuuaagagggagaaaaaaauauuucuuauuacuuuuuc

SEQ ID NO: 88053 - RNA, 64 nt, Homo Sapiens
aaaucaauuuaaaaaauggguaacacaacaauaaggagaaaaaugaauauauaaauaacucuua

SEQ ID NO: 88054 - RNA, 64 nt, Homo Sapiens
uuugcgagucauauauaugauaaccugcagaaugggagaaaauacuaucaagaaggugaaaaga

SEQ ID NO: 88055 - RNA, 64 nt, Homo Sapiens
augugugugugugcucaagauguggcuauuuuggggagaaaauuugaaucaucaaauaaaagaa

SEQ ID NO: 88056 - RNA, 64 nt, Homo Sapiens
ucuucaaucguggaaagaaaaggccuaaaggacaggagaaaagggcaacagcucuuuugagagg

SEQ ID NO: 88057 - RNA, 64 nt, Homo Sapiens
agcaggacuucaggucuuccuggggguggauauaggagaaaauuucugccuggcacacaccugg

SEQ ID NO: 88058 - RNA, 64 nt, Homo Sapiens
agucccacuccugucaccccacgcucugcacuggggagaaaacgggaggugcucgugcuggccc

SEQ ID NO: 88059 - RNA, 64 nt, Homo Sapiens
aacuagaaaaccaaugaaaauuaaauauuuaagaggagaaaaguuauaaacauaauucaaauau

SEQ ID NO: 88060 - RNA, 64 nt, Homo Sapiens
guuuuuggagagcugugaaucagcuauaaauauaggagaaaaaucacaguauuucuauuuaagg

SEQ ID NO: 88061 - RNA, 64 nt, Homo Sapiens
acauuaaaaagauaccaacauuuuaccaaaagauggagaaaagcugaaaaaggagaauugcaaa

SEQ ID NO: 88062 - RNA, 64 nt, Homo Sapiens
aauuaucaggaaagcuaaagagaaaaaauauaaaggagaaaaucaguaaauuauagaauguaua

SEQ ID NO: 88063 - RNA, 64 nt, Homo Sapiens
uuuuuuaaguaguguuauaggcuaaaauaauuugggagaaaauauuauuaaacuagucaaaaau

SEQ ID NO: 88064 - RNA, 64 nt, Homo Sapiens
gcugcugcugagauggacucugggaaugaaugugggagaaaaucuucuacacaucugccuaacu

SEQ ID NO: 88065 - RNA, 64 nt, Homo Sapiens
cucaacuuuuacuaaacauaagguaauucauacuggagaaaagccauacaaaugagaagaaugu

SEQ ID NO: 88066 - RNA, 64 nt, Homo Sapiens
cucaaauguuguucaacaccagaaaauuuauauuggagaaaagcacuguaaauguaaugcauuu

SEQ ID NO: 88067 - RNA, 64 nt, Homo Sapiens
cgcaaagcucacugaacauaaguuaauucauacuggagaaaaacccuacaaauguaaagaaugu

SEQ ID NO: 88068 - RNA, 64 nt, Homo Sapiens
cucaacucuuauuacacauaagauaauucacaguggagaaaaacccuacaaaugugaagaaugu

SEQ ID NO: 88069 - RNA, 64 nt, Homo Sapiens
gucacacuugauuguauauaagauaauucauacuggagaaaacucccagaaguggaguuuuccu

SEQ ID NO: 88070 - RNA, 64 nt, Homo Sapiens
uucaaacuuuguucaauaccaggaaauuuauauuggagaaaaacccuaugaguguaaugaauuu

SEQ ID NO: 88071 - RNA, 64 nt, Homo Sapiens
gucacgcuugauuguagguaagauaauuuauauuggagaaaaauccuccaaguaugaagaaugu

SEQ ID NO: 88072 - RNA, 64 nt, Homo Sapiens
cucaaacuuuguucgacaucagggaauuuguauuggagaaaaacccugcaaauguaauaaauau

SEQ ID NO: 88073 - RNA, 64 nt, Homo Sapiens
ccauccauucuguuacacuuuguauuuucuaacuggagaaaagagugaggaacagaauguuuua

SEQ ID NO: 88074 - RNA, 64 nt, Homo Sapiens
ggaccuuggaggaugaaggcgaguaugugacacuggagaaaaguggaccaggcaugucuuuugc

SEQ ID NO: 88075 - RNA, 64 nt, Homo Sapiens
auacuuaaauuaggauuucuuaaagaaaacauagggagaaaacuuuacaugcaauuaaaaaugg

SEQ ID NO: 88076 - RNA, 64 nt, Homo Sapiens
auuaaacagucuucauuuuucuacuuauagaaaaggagaaaauaauuuggacauaaagaaaauc

SEQ ID NO: 88077 - RNA, 64 nt, Homo Sapiens
caaacuuguaauugugucuuagcauaucauagagggagaaaaguccauugcccucauggaacag

SEQ ID NO: 88078 - RNA, 64 nt, Homo Sapiens
aaacagaaaccugguuauaaguauugaaaagacaggagaaaagaaguuucuggacguuugugca

SEQ ID NO: 88079 - RNA, 64 nt, Homo Sapiens
uuuuuggcuuuagauuuaaaguaauuuuuuuaaaggagaaaaauaguucauaaggaggugagaa

SEQ ID NO: 88080 - RNA, 64 nt, Homo Sapiens
aggauauauucuugcagacgacaguugucgaaguggagaaaauggauacuaugcaagaaaaugu

SEQ ID NO: 88081 - RNA, 64 nt, Homo Sapiens
cuuaaggacaugcuaggggauugugaaaagcuggggagaaaauguuacagccuuagaagaaaga

SEQ ID NO: 88082 - RNA, 64 nt, Homo Sapiens
auaugcuuauacacuguugggcuggugagguuguggagaaaaagaaugucagaaaauaacagau

SEQ ID NO: 88083 - RNA, 64 nt, Homo Sapiens
guugcaaacuaugcaucugacagcuuacagaaugggagaaaauucuaucaagagaguaaacaga

SEQ ID NO: 88084 - RNA, 64 nt, Homo Sapiens
auuccagaaguuaaucauuugaauucugaacacuggagaaaaaccgaaaaauggacggggcaug

SEQ ID NO: 88085 - RNA, 64 nt, Homo Sapiens
uaagauugcuauauuuuggguuauuuucuugacaggagaaaaagaucuaaagaucuuuuauuuu

SEQ ID NO: 88086 - RNA, 64 nt, Homo Sapiens
cugggaguucucuggcuucacgaagcauguuuacggagaaaacuacaaccuaucaguacccaag

SEQ ID NO: 88087 - RNA, 64 nt, Homo Sapiens
agcgaaaagaccaagaucaaauaauagcugggguggagaaaaaaauagcucaagacacaguuaa

SEQ ID NO: 88088 - RNA, 64 nt, Homo Sapiens
aaagcaaaucagaaaacccagcccauuucuggggggagaaaaaaauuuuccuucugaagucuga

SEQ ID NO: 88089 - RNA, 64 nt, Homo Sapiens
aagaaaagauucuucuuaaauuaacuaaagaagaggagaaaaagugcccaguaaaauuucagga

SEQ ID NO: 88090 - RNA, 64 nt, Homo Sapiens
uaauaauuucucaaugaauuagaaucacaguuguggagaaaaaggcaggguuuauauuuuguau

SEQ ID NO: 88091 - RNA, 64 nt, Homo Sapiens
uccuugaagcugcuugucucaaguaugcauugccggagaaaacgcugaauagaaagagcacagu

SEQ ID NO: 88092 - RNA, 64 nt, Homo Sapiens
ccuguaaguaaaacgaauguauagaagucacacaggagaaaaauucauacuuuuguuuugcaac

SEQ ID NO: 88093 - RNA, 64 nt, Homo Sapiens
uuaucauauuuuaggcuuuuuguacauuuauuugggagaaaauugcaaauacauagagagauuc

SEQ ID NO: 88094 - RNA, 64 nt, Homo Sapiens
uuucugggauuacaaugaauucaugaggguaaauggagaaaauaaucuguuaaauuucacaaag

SEQ ID NO: 88095 - RNA, 64 nt, Homo Sapiens
cucaaccaaaguuaugcucaaaaucuuuuuuaagggagaaaaauguaauuaacuggugcuuuga

SEQ ID NO: 88096 - RNA, 64 nt, Homo Sapiens
cgaucaccaaaaugaaaagguggacuguagauugggagaaaauauuugcaaaccguuaucuggu

SEQ ID NO: 88097 - RNA, 64 nt, Homo Sapiens
aaagauaagagauagcaagugucagcaagggucuggagaaaagggaauuuuuguauacuguugg

SEQ ID NO: 88098 - RNA, 64 nt, Homo Sapiens
gaaguaauauggcccacacuuuauucaccacccuggagaaaaaaaaacccaggaauauguggaa

SEQ ID NO: 88099 - RNA, 64 nt, Homo Sapiens
uacaaugcaauacuuacauuuuaauacucuuguaggagaaaaagcaacuguauaaaugaaugua

SEQ ID NO: 88100 - RNA, 64 nt, Homo Sapiens
ucaucaucgauucuacuuuaauggggcugaacggggagaaaaggagaggggaaaaugaguuuuu

SEQ ID NO: 88101 - RNA, 64 nt, Homo Sapiens
cuuguaaguugcuaaacgagcuugcucuucagugggagaaaacaugcagaacguauugguccag

SEQ ID NO: 88102 - RNA, 64 nt, Homo Sapiens
uuauuuauuaccguucccuuuaccagaggugggaggagaaaaaguagguuugaacagugggaga

SEQ ID NO: 88103 - RNA, 64 nt, Homo Sapiens
aagaggcaugaagaaguauugucccagaaggagaggagaaaaugguaauauauguuuaacugga

SEQ ID NO: 88104 - RNA, 64 nt, Homo Sapiens
caguagaaacccagaaaagaaugacuuauaaccaggagaaaaauaugcaaagaagcaauaaaau

SEQ ID NO: 88105 - RNA, 64 nt, Homo Sapiens
cgaugcaucaagcuuguuugaaaagggaaaaaaaggagaaaaaaugcaucuuuuuaaaacaagg

SEQ ID NO: 88106 - RNA, 64 nt, Homo Sapiens
agaaaagcaaaugaguguuuuagcaacugguguuggagaaaaaauaauagagauugauaagauu

SEQ ID NO: 88107 - RNA, 64 nt, Homo Sapiens
ccaaagccacuaguauuagauaggggaagcggauggagaaaaacccccacaaggggagaaaaag

SEQ ID NO: 88108 - RNA, 64 nt, Homo Sapiens
uaggggaagcggauggagaaccacccccacaaggggagaaaaagauauuuaaacaucaucucac

SEQ ID NO: 88109 - RNA, 64 nt, Homo Sapiens
caaaaauaaaauaauuauaacuuauauuccaguaggagaaaaagauggucucugcccuucggag

SEQ ID NO: 88110 - RNA, 64 nt, Homo Sapiens
cuccugcuaacuuuuuuucugacuggcaccgccaggagaaaauuagguuauuggugacuuacug

SEQ ID NO: 88111 - RNA, 64 nt, Homo Sapiens
aguagauuuuaauuugacucuuucacuuuuuguuggagaaaaauucaacagcaaacuucagccg

SEQ ID NO: 88112 - RNA, 64 nt, Homo Sapiens
gccucaauauauuuguaaccuaugauucccagugggagaaaaauaaucagauuguuuucacagu

SEQ ID NO: 88113 - RNA, 64 nt, Homo Sapiens
gggcaggcuuggggaaaauggccaugcaggagguggagaaaauuggaacucuacucaacccauu

SEQ ID NO: 88114 - RNA, 64 nt, Homo Sapiens
uuguguaacaaguacugcucccagcagcaauuagggagaaaacuagucuaaauuauuucaacug

SEQ ID NO: 88115 - RNA, 64 nt, Homo Sapiens
uucaaaccuuacuguacaucagagaauucauacuggagaaaagccauauaaauguagugagugu

SEQ ID NO: 88116 - RNA, 64 nt, Homo Sapiens
uauaggcaauaggaaucuccugcaaacuccuacaggagaaaaguuguaugaauguggaaacuuu

SEQ ID NO: 88117 - RNA, 64 nt, Homo Sapiens
auaaaauugcugggaauauuugacucuccguauuggagaaaauaaaauuacaacauuacgacau

SEQ ID NO: 88118 - RNA, 64 nt, Homo Sapiens
cuggaauuugaaaagccaaacugugaaaccauugggagaaaauagaugauauugucuaugacgu

SEQ ID NO: 88119 - RNA, 64 nt, Homo Sapiens
uagguuuccaggccucacagccaagcugaagcuuggagaaaacucugcauucccaugagggcaa

SEQ ID NO: 88120 - RNA, 64 nt, Homo Sapiens
ucugauuguuagacuguaaugcuauuccucuaugggagaaaaaaauuaauauaaagaaaaacaa

SEQ ID NO: 88121 - RNA, 64 nt, Homo Sapiens
ccauaugucagaagcucccagcaccuccuacuugggagaaaagugagccaucugcuggucagga

SEQ ID NO: 88122 - RNA, 64 nt, Homo Sapiens
uuuaguuuuccugaaaucaccaggucaggcacaaggagaaaagguuccuggauacugacuaacu

SEQ ID NO: 88123 - RNA, 64 nt, Homo Sapiens
aaauuaugcuagagcaauuagacacccauggcgaggagaaaaaagaaccucuacuuaaaccuca

SEQ ID NO: 88124 - RNA, 64 nt, Homo Sapiens
uacauaaaacuagauaacuuugaaaaaagccacaggagaaaaaucuucaggaucuugggcuagg

SEQ ID NO: 88125 - RNA, 64 nt, Homo Sapiens
gguaaguacauaauugugaauuuguauauaaaaaggagaaaaauguugaggacagugacugcca

SEQ ID NO: 88126 - RNA, 64 nt, Homo Sapiens
cagaaguguaaucucuguauacccaaaagcuacgggagaaaaaguucuuuucaucucagucaua

SEQ ID NO: 88127 - RNA, 64 nt, Homo Sapiens; identical to SEQ ID NO: 87431

SEQ ID NO: 88128 - RNA, 64 nt, Homo Sapiens; identical to SEQ ID NO: 87432

SEQ ID NO: 88129 - RNA, 64 nt, Homo Sapiens; identical to SEQ ID NO: 87433

SEQ ID NO: 88130 - RNA, 64 nt, Homo Sapiens; identical to SEQ ID NO: 87434

SEQ ID NO: 88131 - RNA, 64 nt, Homo Sapiens; identical to SEQ ID NO: 87435

SEQ ID NO: 88132 - RNA, 64 nt, Homo Sapiens; identical to SEQ ID NO: 87436

SEQ ID NO: 88133 - RNA, 64 nt, Homo Sapiens; identical to SEQ ID NO: 87437

SEQ ID NO: 88134 - RNA, 64 nt, Homo Sapiens; identical to SEQ ID NO: 87438

SEQ ID NO: 88135 - RNA, 64 nt, Homo Sapiens; identical to SEQ ID NO: 87439

SEQ ID NO: 88136 - RNA, 64 nt, Homo Sapiens; identical to SEQ ID NO: 87440

SEQ ID NO: 88137 - RNA, 64 nt, Homo Sapiens; identical to SEQ ID NO: 87441

SEQ ID NO: 88138 - RNA, 64 nt, Homo Sapiens; identical to SEQ ID NO: 87442

SEQ ID NO: 88139 - RNA, 64 nt, Homo Sapiens; identical to SEQ ID NO: 87443

SEQ ID NO: 88140 - RNA, 64 nt, Homo Sapiens; identical to SEQ ID NO: 87444

SEQ ID NO: 88141 - RNA, 64 nt, Homo Sapiens; identical to SEQ ID NO: 87445

SEQ ID NO: 88142 - RNA, 64 nt, Homo Sapiens; identical to SEQ ID NO: 87446

SEQ ID NO: 88143 - RNA, 64 nt, Homo Sapiens; identical to SEQ ID NO: 87447

SEQ ID NO: 88144 - RNA, 64 nt, Homo Sapiens; identical to SEQ ID NO: 87448

SEQ ID NO: 88145 - RNA, 64 nt, Homo Sapiens; identical to SEQ ID NO: 87449

SEQ ID NO: 88146 - RNA, 64 nt, Homo Sapiens; identical to SEQ ID NO: 87450

SEQ ID NO: 88147 - RNA, 64 nt, Homo Sapiens; identical to SEQ ID NO: 87451

SEQ ID NO: 88148 - RNA, 64 nt, Homo Sapiens; identical to SEQ ID NO: 87452

SEQ ID NO: 88149 - RNA, 64 nt, Homo Sapiens; identical to SEQ ID NO: 87453

SEQ ID NO: 88150 - RNA, 64 nt, Homo Sapiens; identical to SEQ ID NO: 87454

SEQ ID NO: 88151 - RNA, 64 nt, Homo Sapiens; identical to SEQ ID NO: 87455

SEQ ID NO: 88152 - RNA, 64 nt, Homo Sapiens; identical to SEQ ID NO: 87456

SEQ ID NO: 88153 - RNA, 64 nt, Homo Sapiens; identical to SEQ ID NO: 87457

SEQ ID NO: 88154 - RNA, 64 nt, Homo Sapiens; identical to SEQ ID NO: 87458

SEQ ID NO: 88155 - RNA, 64 nt, Homo Sapiens; identical to SEQ ID NO: 87459

SEQ ID NO: 88156 - RNA, 64 nt, Homo Sapiens; identical to SEQ ID NO: 87460

SEQ ID NO: 88157 - RNA, 64 nt, Homo Sapiens; identical to SEQ ID NO: 87461

SEQ ID NO: 88158 - RNA, 64 nt, Homo Sapiens; identical to SEQ ID NO: 87462

SEQ ID NO: 88159 - RNA, 64 nt, Homo Sapiens; identical to SEQ ID NO: 87463

SEQ ID NO: 88160 - RNA, 64 nt, Homo Sapiens; identical to SEQ ID NO: 87464

SEQ ID NO: 88161 - RNA, 64 nt, Homo Sapiens; identical to SEQ ID NO: 87465

SEQ ID NO: 88162 - RNA, 64 nt, Homo Sapiens; identical to SEQ ID NO: 87466

SEQ ID NO: 88163 - RNA, 64 nt, Homo Sapiens; identical to SEQ ID NO: 87467

SEQ ID NO: 88164 - RNA, 64 nt, Homo Sapiens; identical to SEQ ID NO: 87468

SEQ ID NO: 88165 - RNA, 64 nt, Homo Sapiens; identical to SEQ ID NO: 87469

SEQ ID NO: 88166 - RNA, 64 nt, Homo Sapiens; identical to SEQ ID NO: 87470

SEQ ID NO: 88167 - RNA, 64 nt, Homo Sapiens; identical to SEQ ID NO: 87471

SEQ ID NO: 88168 - RNA, 64 nt, Homo Sapiens; identical to SEQ ID NO: 87472

SEQ ID NO: 88169 - RNA, 64 nt, Homo Sapiens; identical to SEQ ID NO: 87473

SEQ ID NO: 88170 - RNA, 64 nt, Homo Sapiens; identical to SEQ ID NO: 87474

SEQ ID NO: 88171 - RNA, 64 nt, Homo Sapiens; identical to SEQ ID NO: 87475

SEQ ID NO: 88172 - RNA, 64 nt, Homo Sapiens; identical to SEQ ID NO: 87476

SEQ ID NO: 88173 - RNA, 64 nt, Homo Sapiens; identical to SEQ ID NO: 87477

SEQ ID NO: 88174 - RNA, 64 nt, Homo Sapiens; identical to SEQ ID NO: 87478

SEQ ID NO: 88175 - RNA, 64 nt, Homo Sapiens; identical to SEQ ID NO: 87479

SEQ ID NO: 88176 - RNA, 64 nt, Homo Sapiens
cugcagauccacuuaggccccaggguccacggauggccccaaaggcugagggccccaaagccac

SEQ ID NO: 88177 - RNA, 64 nt, Homo Sapiens
gccccaggguccacggauggccccaaaggcugagggccccaaagccacuugucuccuaggaucc

SEQ ID NO: 88178 - RNA, 64 nt, Homo Sapiens
cacgcaaugucaggccauggugagccuugcugguggccccaagaccuugggcucacacucucac

SEQ ID NO: 88179 - RNA, 64 nt, Homo Sapiens
ucaucacaccagggggccaucggugagcagaugaggccccaagcgcaggacuccagggcgugca

SEQ ID NO: 88180 - RNA, 64 nt, Homo Sapiens
ucugggccucauguagcucaccccggucacgcaugaaggcaaaagcaggucagaagcgaauacu

SEQ ID NO: 88181 - RNA, 64 nt, Homo Sapiens
uauuuuuuuaagucauuucauguuucugucuggggaaggcaaguuaguuaaguaucacugaugu

SEQ ID NO: 88182 - RNA, 64 nt, Homo Sapiens
cugugagaaguucucugggaguguggguacauuugaaggcaagugacuucaguugagggcaagu

SEQ ID NO: 88183 - RNA, 64 nt, Homo Sapiens
uaagccacuuguguaguugggccccuccaggguugaaggcaagaggagaaaggcacagcguuug

SEQ ID NO: 88184 - RNA, 64 nt, Homo Sapiens
acacacacaaauacacaaucucuaggguaagccagaaggcaagaucagauuaaaaacaccaugu

SEQ ID NO: 88185 - RNA, 64 nt, Homo Sapiens
ugugccauggcugguguauauaugugcaauguuagaaggcaaaagagugaugguaggcagaggg

SEQ ID NO: 88186 - RNA, 64 nt, Homo Sapiens
gaggcuacaagggguguguaaccguguaacacgugaaggcaaugcucaccucuucuuuaccaga

SEQ ID NO: 88187 - RNA, 64 nt, Homo Sapiens
uuuucuaaaugucuuuuucacaaucauguacugggaaggcaauuucauacuaaacugauuaaau

SEQ ID NO: 88188 - RNA, 64 nt, Homo Sapiens
uuucaggaaaugugcauggucuacccgcuuuaucgaaggcaagaauccgguuuggaauauaaaa

SEQ ID NO: 88189 - RNA, 64 nt, Homo Sapiens
acuuggacagcuuucugcccccucuuucacuaaggaaggcaaaugaagugaaaaaaaaaaaugc

SEQ ID NO: 88190 - RNA, 64 nt, Homo Sapiens
caaaccaccaggacugaaagaagaaaacaguacagaaggcaaaguuuacagauguuuuuaauuc

SEQ ID NO: 88191 - RNA, 64 nt, Homo Sapiens
aucugaccguucuauuguguggaugaccacauaagaaggcaauuuuaguguauuaaucauagau

SEQ ID NO: 88192 - RNA, 64 nt, Homo Sapiens
acagaaccaaauaaauguguguuagcacucuagggaaggcaaaaaaaguaucucguuacuggaa

SEQ ID NO: 88193 - RNA, 64 nt, Homo Sapiens
cuccccaacuuaagccauguaaaaccuaucggaagaaggcaagcuugaagacaaaauauuuggg

SEQ ID NO: 88194 - RNA, 64 nt, Homo Sapiens
cugcucccugaguccagucccucuggaaggcaacgaaggcaauggggcuccaccagccagaagc

SEQ ID NO: 88195 - RNA, 64 nt, Homo Sapiens
aaggcaaugcugcucccugagccagaagccucuggaaggcaacggacuccguggggcuccacca

SEQ ID NO: 88196 - RNA, 64 nt, Homo Sapiens
gcacaccagugcaagcagaugacaaaaaggugcagaaggcaaucuuaaaacagaaaggugcagg

SEQ ID NO: 88197 - RNA, 64 nt, Homo Sapiens
uaauagaugaugguaaguuccacuuugguuauuggaaggcaagucauuauuacugguauuaguu

SEQ ID NO: 88198 - RNA, 64 nt, Homo Sapiens
auguaaaggagucaaaacuaaaucuugaaauuaagaaggcaaaaguuuugaaggcaaaauugca

SEQ ID NO: 88199 - RNA, 64 nt, Homo Sapiens
uugcaaaucuugaaauuaagaaaagaucuguuuugaaggcaaaaauacuuuuuacaauuaaaaa

SEQ ID NO: 88200 - RNA, 64 nt, Homo Sapiens
cuuucccugacuccuggugcccucucccuuuguccccccagagagacauaugcccccagagaga

SEQ ID NO: 88201 - RNA, 64 nt, Homo Sapiens
gcccucucccuuuguccccccagagagacauaugcccccagagagagcaaaucgaagcguggga

SEQ ID NO: 88202 - RNA, 64 nt, Homo Sapiens
agccucagaacugaaggagacaaguaaucauuaacccccagaccaugaagugauccuuaacccc

SEQ ID NO: 88203 - RNA, 64 nt, Homo Sapiens
uuggguuccucucuccucucggaggaaagugcaucccccagagcggucacagggggugucgggc

SEQ ID NO: 88204 - RNA, 64 nt, Homo Sapiens
ccugcccuagacccugccagaaaagggggcucuucccccagagaaguggcuuggagggaacuuc

SEQ ID NO: 88205 - RNA, 64 nt, Homo Sapiens
auuuggacaucuggggaaguggagauuaaccccucccccagacucgugccuugccucucaggac

SEQ ID NO: 88206 - RNA, 64 nt, Homo Sapiens
uacuucgagaguagcccugucuuguccccuccuacccccagauuagcaccaccccucucacucu

SEQ ID NO: 88207 - RNA, 64 nt, Homo Sapiens
acuaacauaacuuauuaaaggaggggucccuccucccccagagcaguccucaacacuaugucag

SEQ ID NO: 88208 - RNA, 64 nt, Homo Sapiens
cagugcuggaaaugcagccacuggcagaucuggccccccagacgucaccgcagggccucugaag

SEQ ID NO: 88209 - RNA, 64 nt, Homo Sapiens
ccgcugggacuggaugugccggcacugaggggugcccccagaccuugcagggcagacagugccu

SEQ ID NO: 88210 - RNA, 64 nt, Homo Sapiens
uaagcagcucuuggacccacccucagcaugggugcccccagaagccagcucugccucgcagccc

SEQ ID NO: 88211 - RNA, 64 nt, Homo Sapiens
gccaucucuuccauuuuugacagaaggcugcuugcccccagagaugugguucagguggggucuc

SEQ ID NO: 88212 - RNA, 64 nt, Homo Sapiens
aacugcucccaccucuccuucagcccggcagcagcccccagaggcaaggucugugggcucuagg

SEQ ID NO: 88213 - RNA, 64 nt, Homo Sapiens
gacucugcaccuggcccuuucaugccauccauggcccccagacuaggauccugaccugacuauc

SEQ ID NO: 88214 - RNA, 64 nt, Homo Sapiens
cccaggcucacuucaguguuccccuuggaagaggcccccagauggggggcugagucuucccugg

SEQ ID NO: 88215 - RNA, 64 nt, Homo Sapiens
ccacagucagaacugaaucuacucaaagauucagcccccagauccuagcuuuuagcuauaaacc

SEQ ID NO: 88216 - RNA, 64 nt, Homo Sapiens
gcuggagugggguacagaguaugagccggcuggucccccagaaagcucaauucucagggcugga

SEQ ID NO: 88217 - RNA, 64 nt, Homo Sapiens
augggacaccaggccugacucaggcagguucugccccccagaccccacacacggccgccccacg

SEQ ID NO: 88218 - RNA, 64 nt, Homo Sapiens
cccaccgggucugggcucuggaaggagccagaugcccccagaaaggugggugguggagacggca

SEQ ID NO: 88219 - RNA, 64 nt, Homo Sapiens
caggcguggagguguccccaccccuuccaccugucccccagacccaaagcucucuccccacccu

SEQ ID NO: 88220 - RNA, 64 nt, Homo Sapiens
uacuuucagagcgcuagcuggacuccuuggguuucccccagacaauggcgggaaaacacugacu

SEQ ID NO: 88221 - RNA, 64 nt, Homo Sapiens
aaaaccuggauucgacaggggaugguuccaugagcccccagaugccagcccuggacugaggaug

SEQ ID NO: 88222 - RNA, 64 nt, Homo Sapiens
ugggcccagcuugcucagucaaggggcugccaggcccccagaaaacacuuggagccaucgggua

SEQ ID NO: 88223 - RNA, 64 nt, Homo Sapiens
aauucagcacgcacacaacacacaagggagagaacccccagaugagaaaauaggaaggagcaau

SEQ ID NO: 88224 - RNA, 64 nt, Homo Sapiens
ccugaccacccccuggguccccuugggcugcccucccccagacccuccauggcaggcaucccug

SEQ ID NO: 88225 - RNA, 64 nt, Homo Sapiens
agagagcaauaagagcccaggguccuaucagugccccccagaguacaaugagagaccaggagua

SEQ ID NO: 88226 - RNA, 64 nt, Homo Sapiens
gucacccuccucccccauggagguuuccaggggucccccagacaugaaagaggggugagcugga

SEQ ID NO: 88227 - RNA, 64 nt, Homo Sapiens
gauagucacauguuuuucuuccuuguccccacggcccccagaacaacauucucccugcuggcag

SEQ ID NO: 88228 - RNA, 64 nt, Homo Sapiens
auaccucugacccacccagcccuccgcgguuggccccccagaccgggggagccuaggcccagcu

SEQ ID NO: 88229 - RNA, 64 nt, Homo Sapiens
cagguaccucccuuggucccauggacagcaggcgcccccagaugcccugccacagggcacugga

SEQ ID NO: 88230 - RNA, 64 nt, Homo Sapiens
cugggcccccagccucuggcgccccacucuggugcccccagacccacagacacugaccucagag

SEQ ID NO: 88231 - RNA, 64 nt, Homo Sapiens
ggaggagugggcuuugaacuucacgaaacugggacccccagaaggaaggaaagggaagaagaga

SEQ ID NO: 88232 - RNA, 64 nt, Homo Sapiens
uggcucagccaaccuccuucagaagucccugaggcccccagaccuuuguggguuaugaggacac

SEQ ID NO: 88233 - RNA, 64 nt, Homo Sapiens
ugaggucauaauaucccucuaggacuuaccuguucccccagaucuugccuugggaccacauuug

SEQ ID NO: 88234 - RNA, 64 nt, Homo Sapiens
caaucuuaacuaccuacccaaaggauuugcauuacccccagauucugugccaacaaccuuuuaa

SEQ ID NO: 88235 - RNA, 64 nt, Homo Sapiens
cugcagggccuggugaugcuccccccagagaccccccccagacauggccucucaucaggaucug

SEQ ID NO: 88236 - RNA, 64 nt, Homo Sapiens
ccccccccagacacugcaggucaucaggaucugccccccagagacaguaaaggcuccuggccuc

SEQ ID NO: 88237 - RNA, 64 nt, Homo Sapiens
aucaguccuugaagagcagcaaaggaaggagcugcccccagagcccugccaccugagaagaugg

SEQ ID NO: 88238 - RNA, 64 nt, Homo Sapiens
uccucuuccuucagcaaagggcaggugucuuuuccccccagaucugccacuuuaggauggcgau

SEQ ID NO: 88239 - RNA, 64 nt, Homo Sapiens
agcuggggguccgcaucccuaccucagcuuaggacccccagagccaagguggcugggaucuggc

SEQ ID NO: 88240 - RNA, 64 nt, Homo Sapiens
caucugugguccaggccggcaucguccuggccaccccccagaucuggugccugcuggccggccc

SEQ ID NO: 88241 - RNA, 64 nt, Homo Sapiens
guucuuggagagaagugcaaguacccucccugugcccccagaagcugauaaauugagggcacuu

SEQ ID NO: 88242 - RNA, 64 nt, Homo Sapiens
accgggaggcaccccacccuagccccgagggacgcccccagaggcgccccccggagguggcagc

SEQ ID NO: 88243 - RNA, 64 nt, Homo Sapiens
aagcuggagugcauaggucaguccuggagagcugcccccagaagcccaggagcucggacugcug

SEQ ID NO: 88244 - RNA, 64 nt, Homo Sapiens
ccugaggccaagggggccaccccaccaagcuccucccccagaaccccccaccgccauuggcauc

SEQ ID NO: 88245 - RNA, 64 nt, Homo Sapiens
aauggagcagcagcaggacagacccccacgaggccccccagagaggaggaagaucccacggagg

SEQ ID NO: 88246 - RNA, 64 nt, Homo Sapiens
acacugccugagggacaacagacaucagaacaaacccccagagagaaacagucaaaaucagggc

SEQ ID NO: 88247 - RNA, 64 nt, Homo Sapiens
uggcccuuguuuacagugagggucccacccccaacccccagaggugcuucuccccccaucccag

SEQ ID NO: 88248 - RNA, 64 nt, Homo Sapiens
gcugucgggaccacaucuguuuccuugggcgucucccccagagugggcagucaccacccagccc

SEQ ID NO: 88249 - RNA, 61 nt, Homo Sapiens
guccccaagauccuccuuagaaucccacagucccccagacccuccuuagaaugccacaguc

SEQ ID NO: 88250 - RNA, 64 nt, Homo Sapiens
uuagaaugccacagucccccaacccuccacagagcccccagacccaccagaacuuccacagacg

SEQ ID NO: 88251 - RNA, 64 nt, Homo Sapiens
gcucggucacuugaguguuugaccucccuuccagcccccagaaagcugagcacagaccagcagc

SEQ ID NO: 88252 - RNA, 64 nt, Homo Sapiens
cuucuugaaacgagagccaguaacucccuuacagcccccagaccccuccuccacucccuuuuug

SEQ ID NO: 88253 - RNA, 64 nt, Homo Sapiens
acgaagaggucaagaaccuucucagaaaguuucacccccagaggacagaagucgcaggcagccu

SEQ ID NO: 88254 - RNA, 64 nt, Homo Sapiens
gagccgagacucggaaaguguccuuaaaguuucacccccagagggaaccccaguacugacagcc

SEQ ID NO: 88255 - RNA, 64 nt, Homo Sapiens
uccuucccuuggaugcuuucgccaaguggacugacccccagauuccucucaggcagaugccgag

SEQ ID NO: 88256 - RNA, 64 nt, Homo Sapiens
agguucaccugccaacaggccuucuggagcgagacccccagaagccaaagacuucauccggcac

SEQ ID NO: 88257 - RNA, 64 nt, Homo Sapiens
gccauggagugggaauccccagccgaggcccuaggccccucagcagggaagggauccccgggga

SEQ ID NO: 88258 - RNA, 64 nt, Homo Sapiens
ucugcaucuuggaggcagggaggugagggcaggugccccucagacacuucaggaagguaguuug

SEQ ID NO: 88259 - RNA, 64 nt, Homo Sapiens
caugccgggaagccagagaccugcaggggccucggccccucacaucguguaugucucuccuuga

SEQ ID NO: 88260 - RNA, 64 nt, Homo Sapiens
ucucugcucccuucuucaguaagcaaggagccccgccccucaggcccagccucuggcaagaggu

SEQ ID NO: 88261 - RNA, 64 nt, Homo Sapiens
aucgguauauuaaguccaaaagaugguccgggcugccccucacaaaagcuucugcauccacgug

SEQ ID NO: 88262 - RNA, 64 nt, Homo Sapiens
gagccugggacccuguuuacaguugcacaucugggccccucacuguggggauugaucauucuca

SEQ ID NO: 88263 - RNA, 64 nt, Homo Sapiens
cccacagcccugagaugggccggcccccuuccuggccccucauggcgggacuggagaaaugguc

SEQ ID NO: 88264 - RNA, 64 nt, Homo Sapiens
cccggcccauaucccugguugccucauggccagcgccccucagccucugccacugugaaccggc

SEQ ID NO: 88265 - RNA, 64 nt, Homo Sapiens
ccaaggggucuguauauacagccuccuggccggggccccucaccggaccccucccuugcucagu

SEQ ID NO: 88266 - RNA, 64 nt, Homo Sapiens
ugggccuuuccugugccaacuaauguacagaguggccccucaccaacauuaaucaccaaaguau

SEQ ID NO: 88267 - RNA, 64 nt, Homo Sapiens
gaccucacgcugacgagcaacagaagcacuuguggccccucaagugcucgaguuccuggaugug

SEQ ID NO: 88268 - RNA, 64 nt, Homo Sapiens
cugcccagcuucuacucagacauggauuggugcugccccucaugccaucagggaccuccaggug

SEQ ID NO: 88269 - RNA, 64 nt, Homo Sapiens
ggccuuucccaccuggagagaaacuuccagaccagccccucauaccacagccaagaggggccuu

SEQ ID NO: 88270 - RNA, 64 nt, Homo Sapiens
ggccuuucccaccgguagagaaacuuccagaccagccccucacaccacagccaagagaagccuu

SEQ ID NO: 88271 - RNA, 64 nt, Homo Sapiens
ggccuuuaccaccuggagagaagcuuccagaccagccccucacaccacagccaggagaggccuu

SEQ ID NO: 88272 - RNA, 64 nt, Homo Sapiens; identical to SEQ ID NO: 88269

SEQ ID NO: 88273 - RNA, 64 nt, Homo Sapiens
ggccuuucucaccuggagagaaacuuccagaccagccccucacaccaccgccaggagaggccuu

SEQ ID NO: 88274 - RNA, 64 nt, Homo Sapiens
ggccuuucccaccgggagagaaacuuccagaccagccccucacaccacagccaggagaggccuu

SEQ ID NO: 88275 - RNA, 64 nt, Homo Sapiens
ggccuuucccaccgggagaggaacuuccagaccagccccucacaccacagccaggagaggccuu

SEQ ID NO: 88276 - RNA, 64 nt, Homo Sapiens
ucacucccuuuggcuacccuggccgugccuggcagccccucaggccccacagguggguccuggu

SEQ ID NO: 88277 - RNA, 64 nt, Homo Sapiens
acggaaaucucugggacaauggcuccuccagagggccccucagagccaggugcuggccagaugc

SEQ ID NO: 88278 - RNA, 64 nt, Homo Sapiens
uuguagcccucugagcccucauccugcaggcagagccccucagugcucugagaaaccugcccug

SEQ ID NO: 88279 - RNA, 64 nt, Homo Sapiens
uccaggagucaacaugccaagcaucuuagaaauagccccucaaugagaaaagccgaaaaagcau

SEQ ID NO: 88280 - RNA, 64 nt, Homo Sapiens
aaggaccuuagaggcagggaaaugaguuugggcggccccucauagggagaguaagaacuaaggg

SEQ ID NO: 88281 - RNA, 64 nt, Homo Sapiens
ccccaaagcaguuagacuauggagagccgacccagccccucaggaacccucauccuucaaagac

SEQ ID NO: 88282 - RNA, 64 nt, Homo Sapiens
cuccccuagacucaggcuuccuuuggagauuaaggccccucagagaucaacagaccaacauuuu

SEQ ID NO: 88283 - RNA, 64 nt, Homo Sapiens
cugaggcuggcaaguggggcaacguguggaggaagccccucauaauuuggagaaaacuugauac

SEQ ID NO: 88284 - RNA, 64 nt, Homo Sapiens
uauugccauacaauuuuaauuuauacaaguauuggccccucaagugguuggaaauuuuuuuuuu

SEQ ID NO: 88285 - RNA, 64 nt, Homo Sapiens
cauguggcacuucugagcuccuucccgggccgcugccccucagcuccuggcccugccucuggcc

SEQ ID NO: 88286 - RNA, 64 nt, Homo Sapiens
cggcauccccugcagagucacugaggggacugcugccccucacuggcagagaggaggggagguc

SEQ ID NO: 88287 - RNA, 64 nt, Homo Sapiens
aaugcaucuaucugucugccaucuguccuaauuggccccucaccgcugagguuuggguggugug

SEQ ID NO: 88288 - RNA, 64 nt, Homo Sapiens
caucggaucacugccuucuucccaaccggguagugccccucaccugggaagccuggcaaagcug

SEQ ID NO: 88289 - RNA, 64 nt, Homo Sapiens
ugugcccagcauuuugugugcucagccccgcugagccccucauugcacuggaugggauguacuu

SEQ ID NO: 88290 - RNA, 64 nt, Homo Sapiens
caccugugccguguggccaugagagcuaucccccgccccucaagacuucuccuugaggcagcug

SEQ ID NO: 88291 - RNA, 64 nt, Homo Sapiens
cccuuguuaaugaugcuccugccucugccucccagccccucacccagcacagcucugccuggac

SEQ ID NO: 88292 - RNA, 64 nt, Homo Sapiens
aggcagacccccaccaccauacaugcugucuguggccccucagacauucuguuucaucucccau

SEQ ID NO: 88293 - RNA, 64 nt, Homo Sapiens
ccugucaccucccucucaccaacccggggucugagccccucauuccugaccguccguguucuca

SEQ ID NO: 88294 - RNA, 64 nt, Homo Sapiens
gcaggcccacagcacucugaagugcuugcuaugugccccucaugaucagggccugcauuuaugg

SEQ ID NO: 88295 - RNA, 64 nt, Homo Sapiens
uggcagaguccauaguggaggauucucaggcugggccccucaccaagggcagccccagcagcug

SEQ ID NO: 88296 - RNA, 64 nt, Homo Sapiens
acuaccccucaacagagaugacuuugaugacucugccccucagcagggcuuacuaagcacuacc

SEQ ID NO: 88297 - RNA, 64 nt, Homo Sapiens
aagcacuaccccuuaacagggaugacuccgcacugccccucaacagggaugacucagcagagau

SEQ ID NO: 88298 - RNA, 64 nt, Homo Sapiens
agcagggaugacacagcaaggaugacucagcacugccccucagcaaggaugacucagcacugcc

SEQ ID NO: 88299 - RNA, 64 nt, Homo Sapiens
cucaacagacaugacucagggauggcuuaguacugccccucagcagggaugacucagcaccgcc

SEQ ID NO: 88300 - RNA, 64 nt, Homo Sapiens
aacagggaugacucagcagggaugacucagcaccgccccucaacaggcaugacucugcagagau

SEQ ID NO: 88301 - RNA, 64 nt, Homo Sapiens; identical to SEQ ID NO: 88298

SEQ ID NO: 88302 - RNA, 64 nt, Homo Sapiens
cucaacagggaugacucagggauggcuuaguacugccccucaacagggaugacucagcagggau

SEQ ID NO: 88303 - RNA, 64 nt, Homo Sapiens; identical to SEQ ID NO: 88300

SEQ ID NO: 88304 - RNA, 64 nt, Homo Sapiens
aacaggcaugacucugcagagaugacuuaguacugccccucagcagggaugacucaguacugcc

SEQ ID NO: 88305 - RNA, 64 nt, Homo Sapiens
uaguacugccccucagcagggaugacucaguacugccccucagcagggaugacucagcacugcc

SEQ ID NO: 88306 - RNA, 64 nt, Homo Sapiens
caguacugccccucagcagggaugacucagcacugccccucaacagggaugacucagcagggau

SEQ ID NO: 88307 - RNA, 64 nt, Homo Sapiens
agcagugaugacacagcaaggaugacucagcacugccccucagcaaggaugacucagcacugcc

SEQ ID NO: 88308 - RNA, 64 nt, Homo Sapiens; identical to SEQ ID NO: 88299

SEQ ID NO: 88309 - RNA, 64 nt, Homo Sapiens
uaguacugccccucagcagggaugacucagcaccgccccucaacagggaugacucagcacugcc

SEQ ID NO: 88310 - RNA, 64 nt, Homo Sapiens
cagcaccgccccucaacagggaugacucagcacugccccucaacagggaugacucagcagggau

SEQ ID NO: 88311 - RNA, 64 nt, Homo Sapiens
agcagcgaugacacagcaaggaugacucagcacugccccucaccaaggaugacucagcacugcc

SEQ ID NO: 88312 - RNA, 64 nt, Homo Sapiens
cucaacagacaugacucagggauggcuuaguacugccccucagcagggaugacucagcagggau

SEQ ID NO: 88313 - RNA, 64 nt, Homo Sapiens
aacagggaugacucagcagggaugacucagcacugccccucaacagggaugacugcagggauga

SEQ ID NO: 88314 - RNA, 64 nt, Homo Sapiens
ucaacagggaugacugcagggaugacucagcacugccccucagcagggaugacucagcacugcc

SEQ ID NO: 88315 - RNA, 64 nt, Homo Sapiens
cagcacugccccucagcagggaugacucagcacugccccucagcagggaugacucagcagggau

SEQ ID NO: 88316 - RNA, 64 nt, Homo Sapiens
agcagggaugacucagcagggaugacucagcaccgccccucaacaggcaugacucugcagagau

SEQ ID NO: 88317 - RNA, 64 nt, Homo Sapiens
aacaggcaugacucugcagagaugacucagcacugccccucagcagggauggcucagcagggau

SEQ ID NO: 88318 - RNA, 64 nt, Homo Sapiens
agcagggauggcucagcagggaugacucagcauugccccucaacagggaugacucagcagacuc

SEQ ID NO: 88319 - RNA, 64 nt, Homo Sapiens
gacucagcagacucagcagggaugacucagcacugccccucaacagacaugacucagcagggau

SEQ ID NO: 88320 - RNA, 64 nt, Homo Sapiens
aacagacaugacucagcagggaugacucagcaccgccccucagcaaggaugacucagcagggau

SEQ ID NO: 88321 - RNA, 64 nt, Homo Sapiens
aggugggauccugaaggcacuagcugacagacgggccccucaauccuguccucugaaggauugu

SEQ ID NO: 88322 - RNA, 64 nt, Homo Sapiens
cuggcucugaggucacaucagcuagguuugggaggccccucagcuugguuugggagugcccgug

SEQ ID NO: 88323 - RNA, 64 nt, Homo Sapiens
ggacagcaggccuggcacugggaggugggggugagccccucacagccuugccccuccccaaggc

SEQ ID NO: 88324 - RNA, 64 nt, Homo Sapiens
uggccacuggggccaccacccugaccaccacugugccccucauuguuacugccuugugagauaa

SEQ ID NO: 88325 - RNA, 64 nt, Homo Sapiens
ggcccugcacaugaugggguuugguggacccagugccccucacggcugccgcaagucugcugca

SEQ ID NO: 88326 - RNA, 64 nt, Homo Sapiens
cggugagcuuccugcagccuguggauguccugcagccccucagcccuacccccaaguuucuccu

SEQ ID NO: 88327 - RNA, 64 nt, Homo Sapiens
uggcccccggccacugucucggggcccaccucucgccccucaucuugguaauuagccagccuca

SEQ ID NO: 88328 - RNA, 64 nt, Homo Sapiens
uuccuuugcagaacuucagggacugggagcagaggccccucacucaacgacguuugugcgacau

SEQ ID NO: 88329 - RNA, 64 nt, Homo Sapiens
cugccccaccccgagaaccccucacacuggcccagccccucacaaugcccguuggacuuugccc

SEQ ID NO: 88330 - RNA, 64 nt, Homo Sapiens
cuggcccagccccucacacugcccguuggacuuugccccucacaccaggccgcaggagugggau

SEQ ID NO: 88331 - RNA, 64 nt, Homo Sapiens
agaugccaccacugcacuccagccugggcaacagagcgagaaccugucucaaaaaaaacaaaaa

SEQ ID NO: 88332 - RNA, 64 nt, Homo Sapiens
agguguguguauagguguguguuuggagagugugagcgagaacuaacaugguaaaauguuaggu

SEQ ID NO: 88333 - RNA, 64 nt, Homo Sapiens
aaaaguugucucuagauacaaugauccuuacuggagcgagaauaauauuucucuucaaggcgag

SEQ ID NO: 88334 - RNA, 64 nt, Homo Sapiens
cauuagaauaauucgugaacgagagagcgucgagagcgagaacgagacgaagagagauugcaga

SEQ ID NO: 88335 - RNA, 64 nt, Homo Sapiens
ucccaccccuccccccccccgccccgcccccagcagcgagaacaaggcgguugccggagcuuaa

SEQ ID NO: 88336 - RNA, 64 nt, Homo Sapiens
aaggaagagaaaugcaaaguggaggauggaggacagcgagaagaggcuaggaguuggacggaau

SEQ ID NO: 88337 - RNA, 64 nt, Homo Sapiens
ugucaagaucagaugguuuuacuauuguggcagaagcgagaaaacuuuguuuauugaaaaaaaa

SEQ ID NO: 88338 - RNA, 64 nt, Homo Sapiens
uuucuuccacguaaggaaaaguaguguaaacaguagcgagaaaauggaaaccacagaggaagau

SEQ ID NO: 88339 - RNA, 64 nt, Homo Sapiens
ugcuuuuuauaagaguugucauuguuggaaauucuuaaauaaaacugauuuaaauaauaugugu

SEQ ID NO: 88340 - RNA, 64 nt, Homo Sapiens
uugucauuguuggaaauucuuaaauaaaacugauuuaaauaauaugugucuuuguuuugcagcc

SEQ ID NO: 88341 - RNA, 64 nt, Homo Sapiens
cuacccuucuuucccuuuagaaaacugugauuaauuaaauaaaaagucuuacuacuauaacaac

SEQ ID NO: 88342 - RNA, 64 nt, Homo Sapiens
aauauaugcagaccaacaggucuuugcauuccuuuuaaauaacugguugugacaaagcuuguug

SEQ ID NO: 88343 - RNA, 64 nt, Homo Sapiens
uuuuauaugcaucauaaaauuucccauuucugcauuaaauaaacagaggaggggggucaaguga

SEQ ID NO: 88344 - RNA, 64 nt, Homo Sapiens
aaagugccauuuuauuuuuagugcuaaauucuuguuaaauaauguaguuuuauauagcugauag

SEQ ID NO: 88345 - RNA, 64 nt, Homo Sapiens
uauuuauuauucacucaaguauuaacauucucuauuaaauaagaggagguguuguaaagagcug

SEQ ID NO: 88346 - RNA, 64 nt, Homo Sapiens
ucaucaaagcaaucuuugugauauuacuucgcuauuaaauaaagaaaauuggaugcaagacaau

SEQ ID NO: 88347 - RNA, 64 nt, Homo Sapiens
ugaauuuggguaugaacagauugccugcuuucccuuaaauaacacuuagauuuauuggaccagu

SEQ ID NO: 88348 - RNA, 64 nt, Homo Sapiens
ugaauucugguuacauguguuuuucucucccuccuuaaauaaagagagggguuaaacaugcccu

SEQ ID NO: 88349 - RNA, 64 nt, Homo Sapiens
cuauucuagcauuuaaauuuaaauuuuauuaaaauuaaauaauuuaaaucuagcauuuaaauuu

SEQ ID NO: 88350 - RNA, 64 nt, Homo Sapiens
uuaaaauuaaauaauuuaaaucuagcauuuaaauuuaaauaauuuaagucuagcauuuacuuuu

SEQ ID NO: 88351 - RNA, 64 nt, Homo Sapiens
uuaaauuuaaauaauuuaagucuagcauuuacuuuuaaauaauuauaaugaaguuuugaaauac

SEQ ID NO: 88352 - RNA, 64 nt, Homo Sapiens
gcucguaacacaacuaauuaauuaaaugugcuuuuuaaauaaaaaucugcgaaacuauacuugu

SEQ ID NO: 88353 - RNA, 64 nt, Homo Sapiens
ggaaagagcaaguuugcucauuuuguuuuguguuuuaaauaaaaugugacuuuaguucaggaag

SEQ ID NO: 88354 - RNA, 64 nt, Homo Sapiens
aacguauugugaguacugauuauaaacagccaucuuaaauaagcugcucaaacugcuuuauacu

SEQ ID NO: 88355 - RNA, 64 nt, Homo Sapiens
gaguauugggccuaauugcaaugucuuaggugauuuaaauaaauaacuuugaaaaauuuugcaa

SEQ ID NO: 88356 - RNA, 64 nt, Homo Sapiens
gugcaugcuuuucucuugcuguguaaaacuuauauuaaauaaaucuuauggagccccucguguc

SEQ ID NO: 88357 - RNA, 64 nt, Homo Sapiens
guuaauagcuauccuaaauuucuuuauaaaugcauuaaauaagauauauauuaauaugcaugcu

SEQ ID NO: 88358 - RNA, 64 nt, Homo Sapiens
cauggcaauaagugucagacuuaaauaaaaaauauuaaauaaaauuuuuuuaaaaauuaaaaga

SEQ ID NO: 88359 - RNA, 64 nt, Homo Sapiens
aauauuaaauaaaacauggcuaaaaauuaaaagauuaaauaaaauacuguuaauggguuuuuuu

SEQ ID NO: 88360 - RNA, 64 nt, Homo Sapiens
uuaugggauugcaaccagcagaaaaggaauuuguuuaaauaacauuuuauagaaaaugcaugga

SEQ ID NO: 88361 - RNA, 64 nt, Homo Sapiens
gacaaaaaccagcagccaaagauacaccuacugguuaaauaauuaauuuguauggauauuucau

SEQ ID NO: 88362 - RNA, 64 nt, Homo Sapiens
uauuuaauccuagcucuuuggagaaaaguuuuuuuuaaauaaauugcuuaugaaacagauuuau

SEQ ID NO: 88363 - RNA, 64 nt, Homo Sapiens
uaacuugauuaaucaaccagaauagaaaauagaauuaaauaauuauuuaguuauuauauuuagg

SEQ ID NO: 88364 - RNA, 64 nt, Homo Sapiens
auuuaaugucuaggauaauuuuuaaaagaggaaauuaaauaauuuuacaugucucauauuuuca

SEQ ID NO: 88365 - RNA, 64 nt, Homo Sapiens
guuugcccuguucaaaguacuaaaacuagauaacuuaaauaauuuaagccaauaaauaauauua

SEQ ID NO: 88366 - RNA, 64 nt, Homo Sapiens
uagagcugaauuaccuacagaaacuguuucugguuuaaauaauuagcacaaauuggccuaagua

SEQ ID NO: 88367 - RNA, 64 nt, Homo Sapiens
ucuuggagucuagguugccuugucucuccuauuuuuaaauaagugaaauuugggagauuguaaa

SEQ ID NO: 88368 - RNA, 64 nt, Homo Sapiens
auuuuuaaaauuugauuuuaaauuucaaauaaauuuaaauaaauuuuaaauaaauuuuaaauaa

SEQ ID NO: 88369 - RNA, 64 nt, Homo Sapiens
uugauuuuaaauuucaaauaaauuuaaauaaauuuuaaauaaauuuuaaauaaaauuuuacaga

SEQ ID NO: 88370 - RNA, 64 nt, Homo Sapiens
uuucaaauaaauuuaaauaaauuuuaaauaaauuuuaaauaaaauuuuacagagacguggucuc

SEQ ID NO: 88371 - RNA, 64 nt, Homo Sapiens
uuuugcuguugugccaguuaaucauaggaucccauuaaauaagugugcuaacaucgaauauaga

SEQ ID NO: 88372 - RNA, 64 nt, Homo Sapiens
agcuuguuucauaacauguuauuuuccugugucauuaaauaauuacuucaauguuguauuucgu

SEQ ID NO: 88373 - RNA, 64 nt, Homo Sapiens
guuugaaaaagaaaaucuccagcaagcaucucauuuaaauaaagguuugucaucuuuaaaaaua

SEQ ID NO: 88374 - RNA, 64 nt, Homo Sapiens
augcguauauaagcaaauauguaaucuuuauuuuuuaaauaaaugggaucauauuauauauucu

SEQ ID NO: 88375 - RNA, 64 nt, Homo Sapiens
ugcaguacuguguucuucagcuagaggcagcuuuuuaaauaaugcaaguguauuuauuagcauu

SEQ ID NO: 88376 - RNA, 64 nt, Homo Sapiens
uaaguugcugaaaaguauuaacaugguauuaagcuuaaauaauacguaaugggacuagauggcc

SEQ ID NO: 88377 - RNA, 64 nt, Homo Sapiens
uuaauaacauagggugacuuguguuuuuagguauuuaaauaauaaaauuucaagggauaguuuu

SEQ ID NO: 88378 - RNA, 64 nt, Homo Sapiens
ugcuguccucauuagguaaugauaaauauuucccuuaaauaauugacuauuuugcuguguuuua

SEQ ID NO: 88379 - RNA, 64 nt, Homo Sapiens
agcuguauauucaccaguguggcacucaugguuuuuaaauaagauuaguauuaucuguuuauaa

SEQ ID NO: 88380 - RNA, 64 nt, Homo Sapiens
cuaaauacaaaugcaaaugaagcauuaguaauacuuaaauaauuuuacugugcuacauaaagua

SEQ ID NO: 88381 - RNA, 64 nt, Homo Sapiens
aacugcugugucugacuuacaaacuauccacaauuuaaauaaagucucucucccccuaccuacc

SEQ ID NO: 88382 - RNA, 64 nt, Homo Sapiens
ucuugggcauuuaucuuuuacaaaucaaaaagcuuuaaauaaauaaaauucagucugauaaccu

SEQ ID NO: 88383 - RNA, 64 nt, Homo Sapiens
aaguugaaauuuaugagcuuugaagauugcuaaauuaaauaauuuauagcuccaaaaacaaaaa

SEQ ID NO: 88384 - RNA, 64 nt, Homo Sapiens
uuaaaaauugccccaaauacugacauugagugcauuaaauaacaaauuaucuuugauacauuaa

SEQ ID NO: 88385 - RNA, 64 nt, Homo Sapiens
ggaaagacauccuguguucaaaauuaaagaaggcuuaaauaaauaaaacuacaaaauuggaaag

SEQ ID NO: 88386 - RNA, 64 nt, Homo Sapiens
ccauuuauaauaccaucagaauaugaaaacgaaguuaaauaauucuuuauacuagcaacaaaca

SEQ ID NO: 88387 - RNA, 64 nt, Homo Sapiens
aaaaauugaauuuuauuguuauguuuaacuacguuuaaauaaauaugggggagauugucuucca

SEQ ID NO: 88388 - RNA, 64 nt, Homo Sapiens
guauguaagcaguaguaguuuaaauaaaguugccuuaaauaaguuuacuacauauauugauuuu

SEQ ID NO: 88389 - RNA, 64 nt, Homo Sapiens
uugccuuaaauaaguguaugacauauauugauuuuuaaauaaagagugacagauauaauuuacu

SEQ ID NO: 88390 - RNA, 64 nt, Homo Sapiens
ccauuuaauuaaaacguucuauuuuauagucuuuuuaaauaaauuuuaucucucuugaugucag

SEQ ID NO: 88391 - RNA, 64 nt, Homo Sapiens
auugaaacuuaucucaaaugaaaaaaauuuuuuuuuaaauaauaaaaguaggccagauaaguua

SEQ ID NO: 88392 - RNA, 64 nt, Homo Sapiens
guuuaaaugauaauuugcuucauuuuaaccuauauuaaauaaauuuuuuucucuuuauguauua

SEQ ID NO: 88393 - RNA, 64 nt, Homo Sapiens
uaacaauguuuguacuuaugauuuuuaauaaauguuaaauaagccauuaguauaaagagucugu

SEQ ID NO: 88394 - RNA, 64 nt, Homo Sapiens
uuuuuauaauuucauucguaguagaacuuuguuuuuaaauaauguuuggcccaauguugaagau

SEQ ID NO: 88395 - RNA, 64 nt, Homo Sapiens
cuuuauuauuugcaaguuggaauauuuuuccaaauuaaauaaucguaguucugaguaauccuag

SEQ ID NO: 88396 - RNA, 64 nt, Homo Sapiens
auacaaugguuaauaguaaaauucuuuauggcuuuuaaauaaaugugcguucaugcuuuuucgu

SEQ ID NO: 88397 - RNA, 64 nt, Homo Sapiens
aaagccugaguguucuuagaucugcugcugcuuauuaaauaaaguguagaaugggauguauucu

SEQ ID NO: 88398 - RNA, 64 nt, Homo Sapiens
aauggauggccacaagaaaaauaaaguaaaugucuuaaauaauuuaaccauaaauuuucuguca

SEQ ID NO: 88399 - RNA, 64 nt, Homo Sapiens
gcagaauuugcaguggcaucuaaagagaucuuuuuuaaauaaaaauuauguauuguggcauaau

SEQ ID NO: 88400 - RNA, 64 nt, Homo Sapiens
cuggaccaacauucuuguuuuugcuuuuguuuuuuuaaauaauucuagucuggagcuaacugug

SEQ ID NO: 88401 - RNA, 64 nt, Homo Sapiens
agucuaguuuguauguagguaugaagggaauuuuuuaaauaaauugaaaagcugugaacagcau

SEQ ID NO: 88402 - RNA, 64 nt, Homo Sapiens
uguuaaagaaaaguauauucaaugaagaugaaauuuaaauaaaaaaggacagagucuauccucc

SEQ ID NO: 88403 - RNA, 64 nt, Homo Sapiens
uacauagcugcaauguguacaauggcugauuuaauuaaauaaaauguacaaguguuaaaugugg

SEQ ID NO: 88404 - RNA, 64 nt, Homo Sapiens
acuaaaaugauuugugagaauaaaaucacuagauuuaaauaaucuagugauuuuaaauaaucac

SEQ ID NO: 88405 - RNA, 64 nt, Homo Sapiens
acuaaaaucacuagauuuaacuaggauagugauuuuaaauaauccagccuaugcuuaaugcaag

SEQ ID NO: 88406 - RNA, 64 nt, Homo Sapiens
auggaaauacaagggaaaacuucaccacugagcuuuaaauaagauuccuuuguguacuugguuu

SEQ ID NO: 88407 - RNA, 64 nt, Homo Sapiens
auaaagaaaagauuucccacaaauauaaaauguuuuaaauaaaaccuaauacccacaaaacuua

SEQ ID NO: 88408 - RNA, 64 nt, Homo Sapiens
auaauaacuaguguuuaugagaauauucccuauguuaaauaauauuuguaccuguuauauauau

SEQ ID NO: 88409 - RNA, 64 nt, Homo Sapiens
augaauguugauuucauuacgcuuuuaaggcauuuuaaauaaccuacuauguauauuaugcuua

SEQ ID NO: 88410 - RNA, 64 nt, Homo Sapiens
gguuuuuguguuuucugaaugcuuggggauuauuuuaaauaauuucuugcacugagguuuuuuu

SEQ ID NO: 88411 - RNA, 64 nt, Homo Sapiens
cauaugacacugguuccgauuuuaaaaauuauuuuuaaauaaccgauuauugauuacuguauuu

SEQ ID NO: 88412 - RNA, 64 nt, Homo Sapiens
aaacacaaaagcuuuauacaaaauauuguugaauuuaaauaagguaaaucuuuuuuaguuuaua

SEQ ID NO: 88413 - RNA, 64 nt, Homo Sapiens
cuuaauauguuccaguaaggguauuaaguaaaaauuaaauaaacguauuaaguuuaacauauua

SEQ ID NO: 88414 - RNA, 64 nt, Homo Sapiens
agcuggguuuugggguugagaagaguucauuuauuuaaauaaaguuucuauuuaaaaaccuuuu

SEQ ID NO: 88415 - RNA, 64 nt, Homo Sapiens
gaaucacagaaaugauauucugcaagaauuucuuuuaaauaaaaaguuugggggugcaauauaa

SEQ ID NO: 88416 - RNA, 64 nt, Homo Sapiens
uuggguucaaccuuugaaucaauuuuaccacugauuaaauaaaugacucaaagacaucuguaag

SEQ ID NO: 88417 - RNA, 64 nt, Homo Sapiens
gacaucaguauaaaagugccaaaccugcccucuuuuaaauaaaaauguaaaaaggccacuccca

SEQ ID NO: 88418 - RNA, 64 nt, Homo Sapiens
uugcaugaaaacauuaugacuuuuuucucuuaguuuaaauaaacuccaagguaacuggacuucu

SEQ ID NO: 88419 - RNA, 64 nt, Homo Sapiens
ucaguacaugaaaggcaauuuuaaaugccauguguuaaauaaagguuaauuaaauuaaguuuaa

SEQ ID NO: 88420 - RNA, 64 nt, Homo Sapiens
aauaaacuguuugaaaugcaaaagaauuaaagaguuaaauaaaacucuguucagccuguuuuaa

SEQ ID NO: 88421 - RNA, 64 nt, Homo Sapiens
uaauuuuaagacugaaacccagacauugauaauauuaaauaauucaauucuucuuuucaaauga

SEQ ID NO: 88422 - RNA, 64 nt, Homo Sapiens
uugcccugcaaguacccaguaauuuggcaaucucuuaaauaauaaaagagauguauggcauuuu

SEQ ID NO: 88423 - RNA, 64 nt, Homo Sapiens
ugagacuacuuccuuuauaacaaaugcaaauggguuaaauaaaauuagaccucugauucuaagu

SEQ ID NO: 88424 - RNA, 64 nt, Homo Sapiens
guguauauacauccuagcuauuucaugguguuuauuaaauaauuuuuuaucucugugcuuucuu

SEQ ID NO: 88425 - RNA, 64 nt, Homo Sapiens
auauaaaaauauguacauuagucugcaucucuuauuaaauaaaaaaauaaauaaauaaaucugg

SEQ ID NO: 88426 - RNA, 64 nt, Homo Sapiens
aaauaaaucugggucugcaugcuaacauauuuaauuaaauaaauaaaaaauguggaguuggagg

SEQ ID NO: 88427 - RNA, 64 nt, Homo Sapiens
ccauuauuuuuauaucaauaucacuuacuaagccuuaaauaaaguucagggcaacuacaaauaa

SEQ ID NO: 88428 - RNA, 64 nt, Homo Sapiens
uuauacuuugccaaagcuguaagaaagaagccacuuaaauaagcuaaauuguuuucuuucuucc

SEQ ID NO: 88429 - RNA, 64 nt, Homo Sapiens
gauaacugucagauaaaacuaacauuuauuuaacuuaaauaaaaaauuaaaauuuuagauacuu

SEQ ID NO: 88430 - RNA, 64 nt, Homo Sapiens
cccaggcagauuuacauauuucaaaggucggauauuaaauaaguaaacuugaaaggaauucucc

SEQ ID NO: 88431 - RNA, 64 nt, Homo Sapiens
uggauuugaacacaauuugaaauuaccaaauaauuuaaauaaagcaaagauuuuguacugcuaa

SEQ ID NO: 88432 - RNA, 64 nt, Homo Sapiens
caauacuuagaucuacuguaauccaguaauauacuuaaauaagcaaggcuaccuaccacgugcu

SEQ ID NO: 88433 - RNA, 64 nt, Homo Sapiens
uaccuugacuucauuuauaugaauuuccacuuuauuaaauaauagaaaagaaaaucccggugcu

SEQ ID NO: 88434 - RNA, 64 nt, Homo Sapiens
aggcuguucuggcuuuuuaucuucuuagcucaucuuaaauaagcaguacacuuggaugcagugc

SEQ ID NO: 88435 - RNA, 64 nt, Homo Sapiens
uaucuacauauauagguacaugccauccauuauuuuaaauaaacuaauagguuuucagaauuau

SEQ ID NO: 88436 - RNA, 64 nt, Homo Sapiens
agaauuauuuuuaacugaacguuuuuguuguuuuuuaaauaaaguagccauauguaacgggauu

SEQ ID NO: 88437 - RNA, 64 nt, Homo Sapiens
uuuuaagcuugacaaaugcacugauuguuauacuuuaaauaacuaaaaaucugagaauccacag

SEQ ID NO: 88438 - RNA, 64 nt, Homo Sapiens
gggaaauuuauuuucuacgcuauucaaagauauuuuaaauaauauuuuaaaaacaugaaauuuu

SEQ ID NO: 88439 - RNA, 62 nt, Homo Sapiens
auguuguguccgucuuuauugguuuauuaaaaaauuaaauaauuugaauauuuaaauuuuau

SEQ ID NO: 88440 - RNA, 64 nt, Homo Sapiens
uauuuuuguuucuuuucauuaaauucaugcuggcuuaaauaaucuagaggaagaguaaaaccag

SEQ ID NO: 88441 - RNA, 64 nt, Homo Sapiens
ccucuaaauauguuuugucaacagugagagauuuuuaaauaaagucuuguaacuuugauaauga

SEQ ID NO: 88442 - RNA, 64 nt, Homo Sapiens
aagaauuuuucuccaauuuuuauuacugguauuuuuaaauaaaguugcuuuugaagucugucag

SEQ ID NO: 88443 - RNA, 64 nt, Homo Sapiens
aagcuggaaaauauuuuuagggcugugcagcuccuuaaauaauacuccugguccccacuuuaaa

SEQ ID NO: 88444 - RNA, 64 nt, Homo Sapiens
uaacaagaauuggagcaugccuguugcuuuuauguuaaauaagaaaauaguaacucuccaaauc

SEQ ID NO: 88445 - RNA, 64 nt, Homo Sapiens
uuuuaauacuuguuugacaauuaaaaacguucauuuaaauaaaaccuuaacauggcucaauaac

SEQ ID NO: 88446 - RNA, 64 nt, Homo Sapiens
ugucuuaaguaaauuagcaugugggaauauauacuuaaauaauuuuuagaaauaaauugcaaag

SEQ ID NO: 88447 - RNA, 64 nt, Homo Sapiens
acugaaaagacuauguagugggucauuacugccauuaaauaauauuacccaagaauccacugga

SEQ ID NO: 88448 - RNA, 64 nt, Homo Sapiens
gcauugcuuaaugguuucucaauuaacuaauuuuuuaaauaaauacuggauaaacuuuacauaa

SEQ ID NO: 88449 - RNA, 64 nt, Homo Sapiens
cauguuucuuuucuauagaggagauguuccuaucuuaaauaaagaugaaagcuuuagaaggcau

SEQ ID NO: 88450 - RNA, 64 nt, Homo Sapiens
augaaagcuuuagaaggcauaucucagcauuguguuaaauaaaaauuauucaccuaagaauaga

SEQ ID NO: 88451 - RNA, 64 nt, Homo Sapiens
uauauuagucgacuguguuaucaaaaguaaauuuuuaaauaaaaaauuuauccauuuauaggcu

SEQ ID NO: 88452 - RNA, 64 nt, Homo Sapiens
cuuguuauuuuggcauauuuaaagaccucauucuuuaaauaaaaccccucauuucuuucugccc

SEQ ID NO: 88453 - RNA, 64 nt, Homo Sapiens
caauccucuauugaacauauaaggauccucagauuuaaauaaguacuuuuuuuuuuuuuaauca

SEQ ID NO: 88454 - RNA, 64 nt, Homo Sapiens
uuuagucuuugauucagucaguauuugguuuauguuaaauaaaaaaucaguaucauggaaaaga

SEQ ID NO: 88455 - RNA, 64 nt, Homo Sapiens
ucugaagacaggugcuugaacuugucaguuuguuuuaaauaaauacaauaguugaaaauuuuuc

SEQ ID NO: 88456 - RNA, 64 nt, Homo Sapiens
ccucucaaauucauaacaguucuauuuaacugaauuaaauaaccauaugaaaaaucuuuugggu

SEQ ID NO: 88457 - RNA, 64 nt, Homo Sapiens
auuaugccuuggaaugguucacuuaaaugacauuuuaaauaaguuuauguauacaucugaauga

SEQ ID NO: 88458 - RNA, 64 nt, Homo Sapiens
aauuuguaaauguuaagaauuuuuuuuauaucuguuaaauaaaaauuauuuccaacaaccuuaa

SEQ ID NO: 88459 - RNA, 64 nt, Homo Sapiens
acuuauuuuuucugauuguguagagguuugacuuuuaaauaauucagcaguuguugacaauugu

SEQ ID NO: 88460 - RNA, 64 nt, Homo Sapiens
ccaaauagaccagaauuggcacuuccaauuuucuuuaaauaaucaaggaaucugaaacacuugu

SEQ ID NO: 88461 - RNA, 64 nt, Homo Sapiens
uccuacacaaaugauagcauucaaauuccuauuuuuaaauaauucagggauuuuugaguccuau

SEQ ID NO: 88462 - RNA, 64 nt, Homo Sapiens
ugcacaaaacuuugauucuuauggccuaaauuuauuaaauaaaagauuuaaguuacaauguuuu

SEQ ID NO: 88463 - RNA, 64 nt, Homo Sapiens
guaaauacuaauguacugcuguaaacugcauacguuaaauaaauuuuuguuuaauaaugagugu

SEQ ID NO: 88464 - RNA, 64 nt, Homo Sapiens
gcagguuaaccucaaugauaccuguauaauucacuuaaauaaaaacugccuguacuguuaauuu

SEQ ID NO: 88465 - RNA, 64 nt, Homo Sapiens
gauugaugauaucuuuuaagagggcagugcuuaguuaaauaaaauaucauuuccuucaaaauga

SEQ ID NO: 88466 - RNA, 64 nt, Homo Sapiens
ggggcgacguugaucauagauucagagcccuuuguuaaauaagaguugcuuggagaacaccucc

SEQ ID NO: 88467 - RNA, 64 nt, Homo Sapiens
ucuucuggcuucugaacucuuccucugccucucuuuaaauaaauaacacagaauuucaaguggu

SEQ ID NO: 88468 - RNA, 64 nt, Homo Sapiens
aaauccagugaaacagcaccauuucuuaguaucauuaaauaacuagaaaguaucaaguauugcu

SEQ ID NO: 88469 - RNA, 64 nt, Homo Sapiens
uuauaaauuuaauaacauucgaagaucuggaaaguuaaauaaaucuaccugacauuuauuccaa

SEQ ID NO: 88470 - RNA, 64 nt, Homo Sapiens
uguggaaucuuuccuaaugaacuucauuucugguuuaaauaacuaaauagauaugaaacauguu

SEQ ID NO: 88471 - RNA, 64 nt, Homo Sapiens
aaaaauauguuuauuuuuuauaggaagauggucuuuaaauaacccaguuauuuuaguuacaggu

SEQ ID NO: 88472 - RNA, 64 nt, Homo Sapiens
uuaaaucaaauacaguuauuauaauucacugcacuuaaauaaguaaccuuuaaguuagcuuucc

SEQ ID NO: 88473 - RNA, 64 nt, Homo Sapiens
guaaauucucuugcauguucccuggaaaaugcauuuaaauaauaaucuguauuggaaauauguu

SEQ ID NO: 88474 - RNA, 64 nt, Homo Sapiens
cgaucuguacccagcugggugugguuuucuucucuuaaauaacuagacguuuuuuuccuccaag

SEQ ID NO: 88475 - RNA, 64 nt, Homo Sapiens
aagaggaaugagccaggagaacaaacuaauuccuuuaaauaaauaaaaaaaaaaaaugcaaaug

SEQ ID NO: 88476 - RNA, 64 nt, Homo Sapiens
uugucauucaaaauauauuuuaacccaaaauaaguuaaauaauuugugcauguuugugugugua

SEQ ID NO: 88477 - RNA, 64 nt, Homo Sapiens
ucucuaagacauucuccaaauugauuuuaucucuuuaaauaaaaacuuuaaauaaaaguauuag

SEQ ID NO: 88478 - RNA, 62 nt, Homo Sapiens
cuccaaauugauuuuaucucuuuaaauaaaaacuuuaaauaaaaguauuagaaauguuuucu

SEQ ID NO: 88479 - RNA, 64 nt, Homo Sapiens
auuuauguaaaguauauguauuugagugcagaauuuaaauaaggcucuaccucaaagaccuuug

SEQ ID NO: 88480 - RNA, 64 nt, Homo Sapiens
uuuggaauuauaaaauauagguaaaaguacguaauuaaauaauguuuuugguauuucugguuuu

SEQ ID NO: 88481 - RNA, 64 nt, Homo Sapiens
aagaaacauguauaagaaaccagauuuaaguguuuuaaauaaaauguaaacaguuuuuauuugg

SEQ ID NO: 88482 - RNA, 64 nt, Homo Sapiens
ugaugugcuuguauaucgauuagcugugucacuuuuaaauaagaaguccacacaagcaagccaa

SEQ ID NO: 88483 - RNA, 64 nt, Homo Sapiens
acauaaccucauucugaauagaagcaguauuuuguuaaauaaaucuaaugaaauguacuucaga

SEQ ID NO: 88484 - RNA, 64 nt, Homo Sapiens
uauuauaaccuuucagaaaugucucaaaaaaaaauuaaauaaaugggugacagagugagacucu

SEQ ID NO: 88485 - RNA, 64 nt, Homo Sapiens
aggaaauuagaaguguuaggauugauugaagauuuuaaauaaacaugauguacuuuguaaaaaa

SEQ ID NO: 88486 - RNA, 64 nt, Homo Sapiens
gugauugugacuaaggcacgcauuauaaaacaccuuaaauaaaauuuagaauaucaucuugaac

SEQ ID NO: 88487 - RNA, 64 nt, Homo Sapiens
uguaaaauccugcuaacuagauugcucagcugauuuaaauaauuaaguuucauaucacucauga

SEQ ID NO: 88488 - RNA, 64 nt, Homo Sapiens
uuuacauaacuguaaguccuuguuggaauaauuuuuaaauaauguagcuuuaaaagaguauuua

SEQ ID NO: 88489 - RNA, 64 nt, Homo Sapiens
uucuucuuuccuucauuuuaugcaaggccuuuaauuaaauaagauuaauagacaaaucacauuu

SEQ ID NO: 88490 - RNA, 64 nt, Homo Sapiens
ugcaugccauugagacaccuacaagugaugcacuuuaaauaaucagaaauuugagaagcuucuc

SEQ ID NO: 88491 - RNA, 64 nt, Homo Sapiens
uauuuuaggaauucuaaacacgugacuucucauuuuaaauaaaaaaauuguauuagaaaauuag

SEQ ID NO: 88492 - RNA, 64 nt, Homo Sapiens
uauuugaacaagcuaggaaauugugacucuaauauuaaauaagaaauauaacaaaauguguaau

SEQ ID NO: 88493 - RNA, 64 nt, Homo Sapiens
uaaauuuucuaaauaaaaaguauauauauaccuuuuaaauaaaauuuauaucuugggacuuaug

SEQ ID NO: 88494 - RNA, 64 nt, Homo Sapiens
gcaagcuguccugagcccaucaagcacgcaaguauuaaauaagaccauccauugugcaaaacca

SEQ ID NO: 88495 - RNA, 64 nt, Homo Sapiens
uuaaagauuaagcauaguaacugacucuuaaguguuaaauaauguagaaguaaaaaaauuuuuu

SEQ ID NO: 88496 - RNA, 64 nt, Homo Sapiens
agcuugaauauuauuucacauuccuuuuucuuuuuuaaauaaacagguuugcuuuggaaaggcu

SEQ ID NO: 88497 - RNA, 64 nt, Homo Sapiens
aauacauuuucaaaaugcagcucuuauuuaaaauuuaaauaaggaucuugguacaaauucagau

SEQ ID NO: 88498 - RNA, 64 nt, Homo Sapiens
ugguacuucgcucaucaggcuggugaauauauuauuaaauaauguuaucguacgucacagugua

SEQ ID NO: 88499 - RNA, 64 nt, Homo Sapiens
uucuuuuaacguaaagcugcugcuauuucuguauuuaaauaacucucaauuccuuuuuguaagg

SEQ ID NO: 88500 - RNA, 64 nt, Homo Sapiens
uugcuacuuauauaaaaauugguagguagcuacauuaaauaaaucaagauuuuuuaaaacuuga

SEQ ID NO: 88501 - RNA, 64 nt, Homo Sapiens
uauaaauuauaugguccuugaagaaaguggacacuuaaauaagcacaaagaauaggaugggaua

SEQ ID NO: 88502 - RNA, 64 nt, Homo Sapiens
uuaugcuaauuaguuacauuacacagucuaacucuuaaauaaaacaaaaaugucaguauugaca

SEQ ID NO: 88503 - RNA, 64 nt, Homo Sapiens
acugugugcuuguuuuauaaaauuuugcuuuuaauuaaauaaaagcuggaagcaaaguauaacc

SEQ ID NO: 88504 - RNA, 64 nt, Homo Sapiens
uuuaggaacuucagagaucguguauugagauuucuuaaauaaugcuucagauauuauugcuuua

SEQ ID NO: 88505 - RNA, 64 nt, Homo Sapiens
aguuuacagcaugauaguccaaguggugauaacuuuaaauaaaacucaaauuuuuacuguuugu

SEQ ID NO: 88506 - RNA, 64 nt, Homo Sapiens
acuucagaaucccaacuacaauacaaauguuuauuuaaauaaagaagaaagcuauuguacaaau

SEQ ID NO: 88507 - RNA, 64 nt, Homo Sapiens
cuuuuagagccaaaaaaacucaggcacaaagaaguuaaauaacuugccgggugcgguggcucac

SEQ ID NO: 88508 - RNA, 64 nt, Homo Sapiens
caaaaacaaaacaaaacaacaacaaaaaaagaaguuaaauaacuuguuuaagaucacacagcua

SEQ ID NO: 88509 - RNA, 64 nt, Homo Sapiens
uguagcuuaauauuaaagauggauuuaaauaauuuuaaauaauucauuuauuugagaaaacacu

SEQ ID NO: 88510 - RNA, 64 nt, Homo Sapiens
uuaaauaauuuguagcuuaaagaaaacacuggauuuaaauaauuucuuccuguacauuuauuug

SEQ ID NO: 88511 - RNA, 64 nt, Homo Sapiens
caaauguuaacaaaagagcaugcaguuaaggacuuuaaauaaauggaaaauguucuugaucauu

SEQ ID NO: 88512 - RNA, 64 nt, Homo Sapiens
aaaauaauaccagauuuuaaaaaaauauuuugauuuaaauaacauuaucaaugugauuguaauu

SEQ ID NO: 88513 - RNA, 64 nt, Homo Sapiens
caccauauuuuacuuuuuuaggauuuuucccccuuuaaauaaaaauauuagaucaaauacuaua

SEQ ID NO: 88514 - RNA, 64 nt, Homo Sapiens
acaaugggcagugucugcuauagggcuucaggcauuaaauaaaaccgaggguuguugauuuugc

SEQ ID NO: 88515 - RNA, 64 nt, Homo Sapiens
aauaaaaauacuuguauuuuucacucaccauaauuuaaauaaaguggcuauauaggaagaaaua

SEQ ID NO: 88516 - RNA, 64 nt, Homo Sapiens
auauacaugcacaucagcucaagccacuuaaauguuaaauaagagacauucuaaaauaccauua

SEQ ID NO: 88517 - RNA, 64 nt, Homo Sapiens
aaagugugaggucuacuuuaauuuaaaaugauacuuaaauaaagaaaaacaauguuagaagguu

SEQ ID NO: 88518 - RNA, 64 nt, Homo Sapiens
caaaucucauuguaaagcuauuggcaaguguuuuuuaaauaaaaacauuuugugggguagugau

SEQ ID NO: 88519 - RNA, 64 nt, Homo Sapiens
acguaauguuccaaucuaaauuuaugccaucuucuuaaauaaguauuuuuaaguuaucuuuaag

SEQ ID NO: 88520 - RNA, 64 nt, Homo Sapiens
cguauguauaauuaagugaauguuuugcuuuucuuuaaauaaaaauugaaaugcugugguugug

SEQ ID NO: 88521 - RNA, 64 nt, Homo Sapiens
auauucauuuacccgaguuagcuuguauacauauuuaaauaaacucugcugcuccuagggccau

SEQ ID NO: 88522 - RNA, 64 nt, Homo Sapiens
acaauguaggagcagcuuuuccaaauuugucuuauuaaauaaaauuucuagaaaaagucuagug

SEQ ID NO: 88523 - RNA, 64 nt, Homo Sapiens
uuucauauuuuuuaaguguuucauuuugcuuuacuuaaauaaucaaacugucuucuucuguucc

SEQ ID NO: 88524 - RNA, 64 nt, Homo Sapiens
uaugcacagacauggagagauaaggaucauauuauuaaauaauauugguuggaucacauacauu

SEQ ID NO: 88525 - RNA, 64 nt, Homo Sapiens
ugaacuuguuaauuagaaugagauaaaaacagcuuuaaauaauuacauaauggacgcaaaugac

SEQ ID NO: 88526 - RNA, 64 nt, Homo Sapiens
ccuuaacaucucuauaaacgauuucagaaaccccuuaaauaauuauuaacauggaugcagaaua

SEQ ID NO: 88527 - RNA, 64 nt, Homo Sapiens
aaaccaaguaauguauaauguggcuuuuguugaguuaaauaagaugcuauauaauggagaagaa

SEQ ID NO: 88528 - RNA, 64 nt, Homo Sapiens
cauuaucagaaccugcagugaaauuaaacuuauguuaaauaaaaccaguuugcaggugcacaaa

SEQ ID NO: 88529 - RNA, 64 nt, Homo Sapiens
ugugugugccaccaaacacguuauuggcaccuuuuuaaauaagcucucaugaucaagaugguga

SEQ ID NO: 88530 - RNA, 64 nt, Homo Sapiens
uggauagauuuuaaugggaaaauuauaauucagauuaaauaaaaaacaauucccuuuucccugu

SEQ ID NO: 88531 - RNA, 64 nt, Homo Sapiens
uaacaguuugcuauagcuuacugcuuaacuaauuuuaaauaaggaaauaaguauguuagaugca

SEQ ID NO: 88532 - RNA, 64 nt, Homo Sapiens
uaaaaaauguuagauguuggugauaaguugacaguuaaauaaaauucucuaaaauugcuucuaa

SEQ ID NO: 88533 - RNA, 64 nt, Homo Sapiens
ccuauuugcaaauuagaaugccugaaguuggaauuuaaauaauugcaggcagcucaucucaugu

SEQ ID NO: 88534 - RNA, 64 nt, Homo Sapiens
acacuuggacucuuuucaaauucuauuauuauuuuuaaauaaucauaaaagcuguguuauuguu

SEQ ID NO: 88535 - RNA, 64 nt, Homo Sapiens
gaaguaauuuuggguggggagaugacuacagacauuaaauaaucggcaagacuuuucuuugaag

SEQ ID NO: 88536 - RNA, 64 nt, Homo Sapiens
uaaccccgggcaagacuuuuauuacauaaauaaauuaaauaaaaaugaucgcuuucuacacugu

SEQ ID NO: 88537 - RNA, 64 nt, Homo Sapiens
aaaauguuacucuuuuguacuuugcuucugauuuuuaaauaaauucacauacuauuuugccaua

SEQ ID NO: 88538 - RNA, 64 nt, Homo Sapiens
uguuguuauuugauacauuuuaagugucuguggcuuaaauaauacaugcuccaauguauguaca

SEQ ID NO: 88539 - RNA, 64 nt, Homo Sapiens
guucuucauacuuaggacucuuaaguaguuauaauuaaauaacuuucuuggugaaacacuauaa

SEQ ID NO: 88540 - RNA, 64 nt, Homo Sapiens
uacucucuacuuuuauccauggauuugauaaaguuuaaauaauuguauuaaggucauguaccaa

SEQ ID NO: 88541 - RNA, 64 nt, Homo Sapiens
cuugucucggucaccugugcucuugugaaaucaguuaaauaagaucuaauaaaacucggacccu

SEQ ID NO: 88542 - RNA, 64 nt, Homo Sapiens
uuauuuguguuagcauguaauggguuuacuauguuuaaauaaguuaauacuuuaaaaauuuuca

SEQ ID NO: 88543 - RNA, 64 nt, Homo Sapiens
aaggaguaacugaauugaaucaaccaguuugcauuuaaauaaaagaacaggcucaguggucuuc

SEQ ID NO: 88544 - RNA, 64 nt, Homo Sapiens
cucaguggacuucuauagauacuuguuaaccuaaccuaauuauggcuuccuauaauguaaacgg

SEQ ID NO: 88545 - RNA, 64 nt, Homo Sapiens
accaaagugaugauguggagauuuuguuaacaccccuaauuacauccuuguguuuccuuaauuu

SEQ ID NO: 88546 - RNA, 64 nt, Homo Sapiens
caagguugagaauccauugcgacugccuagauucccacagcagagcucuucuuggucuuggcua

SEQ ID NO: 88547 - RNA, 64 nt, Homo Sapiens
uucaucuuuacgauaacucacaccaaauaaaagcccacagcagcaugugggaaagguaaagcaa

SEQ ID NO: 88548 - RNA, 51 nt, Homo Sapiens
aacuggaggagaccagcuagcccacagcaaccaaagagacuuccucuuggc

SEQ ID NO: 88549 - RNA, 64 nt, Homo Sapiens
gaagcuacugcaagguuccaggcuugggccugggccacagcaacagcaguggucaaauaucuag

SEQ ID NO: 88550 - RNA, 64 nt, Homo Sapiens
ggagucaguguuauuacugguggaugcaccguguccacagcagcccccaaucccagcgaugcgu

SEQ ID NO: 88551 - RNA, 64 nt, Homo Sapiens
cauucauuuggaugcagugaaaagggcagaaauaccacagcagagaauaaaauugauaauguug

SEQ ID NO: 88552 - RNA, 64 nt, Homo Sapiens
uaaaaugacagaaguuagcuguagaugaccuaucccacagcaaucggaguucuugaagaagaaa

SEQ ID NO: 88553 - RNA, 64 nt, Homo Sapiens
cagucccaucgacguucacugucucacucacccuccacagcacuccucaucuggcacuaugcau

SEQ ID NO: 88554 - RNA, 64 nt, Homo Sapiens
cccuaacauggaggcaaaauuccagcagccccaaccacagcauugaccagaggagugcuggagc

SEQ ID NO: 88555 - RNA, 64 nt, Homo Sapiens
ucauagcacaaaaaaagguugauggaccagacugccacagcagcaaaaacacaguccugagagg

SEQ ID NO: 88556 - RNA, 64 nt, Homo Sapiens
ccauggcacaacuaacaccugauagacuagacugccacagcagcaaaaaacacaaucuuaaggg

SEQ ID NO: 88557 - RNA, 64 nt, Homo Sapiens
cauaucucagccauucauugaaacaauguuaaggccacagcacauauuuucaguaaauacauuu

SEQ ID NO: 88558 - RNA, 64 nt, Homo Sapiens
accaagcauauuagaagaggcacugucaggcugcccacagcaacaacaaagcaaauauguucau

SEQ ID NO: 88559 - RNA, 64 nt, Homo Sapiens
gcacugggaauuucuacucuuuggcgucugaugaccacagcaaaucuucauugccucucucccc

SEQ ID NO: 88560 - RNA, 64 nt, Homo Sapiens
ggcccccucuccccagccucucaggcauggguguccacagcacuccugccaggcuggggcuucc

SEQ ID NO: 88561 - RNA, 64 nt, Homo Sapiens
uccaucagcucagcagagcucccucaggaggagaccacagcauggcaggaguggagagcuggug

SEQ ID NO: 88562 - RNA, 64 nt, Homo Sapiens
cagccacugcaggcagcaugacaugcuuuugucuccacagcaacuaucccagcaaauugggauc

SEQ ID NO: 88563 - RNA, 64 nt, Homo Sapiens
cagcagcaguuuccaagacgggccagaaacgcauccacagcaguggcacccgcggcucaggggc

SEQ ID NO: 88564 - RNA, 64 nt, Homo Sapiens
gcacugagcuguuggggcacacugcccagcccggccacagcagcucagccagucacagcuccac

SEQ ID NO: 88565 - RNA, 64 nt, Homo Sapiens
ccugugcugcccgccucaggcagaccuagaguguccacagcagggagaccacaaaauacaaggc

SEQ ID NO: 88566 - RNA, 64 nt, Homo Sapiens
aucaggcagcacccaugggccaugagcacccaccccacagcacccugccaagcaggacuuggca

SEQ ID NO: 88567 - RNA, 64 nt, Homo Sapiens
cgguaaggaaguggguggcacaggauagaggcucccacagcagccaccccgccccuccauaguu

SEQ ID NO: 88568 - RNA, 64 nt, Homo Sapiens
ccuugccccccacccaagaagcccugcccuccagccacagcaguccacagcagcaggguuaaga

SEQ ID NO: 88569 - RNA, 64 nt, Homo Sapiens
cacccaagaagcccugcccuccagccacagcaguccacagcagcaggguuaagacucagcacag

SEQ ID NO: 88570 - RNA, 64 nt, Homo Sapiens
gcacaccacaacacacaacacaccucaccucacaccacagcacaccucaccacaccacaccgca

SEQ ID NO: 88571 - RNA, 64 nt, Homo Sapiens
cgcacugcaccauaccucaccacaucucaccacaccacagcacaccucaccacacaacacacca

SEQ ID NO: 88572 - RNA, 64 nt, Homo Sapiens
cacauucucaggauaaacauucuugaguugcaguccacagcauuccauucucaguaaugggaga

SEQ ID NO: 88573 - RNA, 64 nt, Homo Sapiens
gagcucagccagccgugguguccgccugcgagagccacagcaaggccagcugccuguucuuacc

SEQ ID NO: 88574 - RNA, 64 nt, Homo Sapiens
ccugaacaaccaguaugugugcuuuucucugugaccacagcagcagccuggucauuugcugucc

SEQ ID NO: 88575 - RNA, 64 nt, Homo Sapiens
gcugcauuugaaugauuuccguggauggagauucccacagcaaggggguguccgucaguuauua

SEQ ID NO: 88576 - RNA, 64 nt, Homo Sapiens
aggccucuccccuggcaccugcuucaguuguccuccacagcacugauuugcagcccacaagcug

SEQ ID NO: 88577 - RNA, 64 nt, Homo Sapiens
aaaguugugcagagcgcuggggacuccagacuccccacagcagcagagacucgggacugaggca

SEQ ID NO: 88578 - RNA, 64 nt, Homo Sapiens
gcuggacgcuguggaaauggcuguucccagccucccacagcagauccagggugguagugcuggg

SEQ ID NO: 88579 - RNA, 64 nt, Homo Sapiens
uggccaaccaacacuucucaauuacaggugugagccacagcacccagccucccaaaguguuggg

SEQ ID NO: 88580 - RNA, 64 nt, Homo Sapiens
guuugccacgugcugcccgugacagcacauugagccacagcauuuguagacaggacagaggggu

SEQ ID NO: 88581 - RNA, 64 nt, Homo Sapiens
caggcccuugggcaggcuggggugacggcagaggccacagcaccagcucugacaaguccuauca

SEQ ID NO: 88582 - RNA, 64 nt, Homo Sapiens
ggggagccccuucugcucagcucugggccauucuccacagcaaccccaggcugaagcagguucc

SEQ ID NO: 88583 - RNA, 64 nt, Homo Sapiens
agggacaaguggacucagggcagcgccaggcugaccacagcacagccaacacgcaccugccuca

SEQ ID NO: 88584 - RNA, 64 nt, Homo Sapiens
ugccacaacggccagcaggugccccauccucugcccacagcagacucugucccauggcucuccg

SEQ ID NO: 88585 - RNA, 64 nt, Homo Sapiens
agggccugguguggaaccagggagcugugggaagccacagcagaaauggaagaaaaacaggucu

SEQ ID NO: 88586 - RNA, 64 nt, Homo Sapiens
ugcuggggugggaaagggccggagcuggcccaggccacagcacccacagcuggcuuguaaggca

SEQ ID NO: 88587 - RNA, 64 nt, Homo Sapiens
ggcuuccccaucucaccuggugcagucucuuggcccacagcacuccugaauaaacagaaugagc

SEQ ID NO: 88588 - RNA, 64 nt, Homo Sapiens
uggugccucuauugaagacuuugcccugccacuuccacagcaguaagccgaaaggaugaagagu

SEQ ID NO: 88589 - RNA, 64 nt, Homo Sapiens
cccaagcggaaugaggccaagacuggcgcugacaccacagcagcugggccccucuuccagcagc

SEQ ID NO: 88590 - RNA, 64 nt, Homo Sapiens
uaacccagucuuucuucacucuggcuucaaaaagccacagcagagcauugucaccgcaggugcu

SEQ ID NO: 88591 - RNA, 64 nt, Homo Sapiens
cagccaggucugacuccaaagcuguuccauuacaccacagcauuguguggaauuugaggucuag

SEQ ID NO: 88592 - RNA, 64 nt, Homo Sapiens
ugaguaaaauacucuuuuuaaaaaaagucaagaaccacagcacuuucaaaugggcucgugaccc

SEQ ID NO: 88593 - RNA, 64 nt, Homo Sapiens
uccauguggacuuaggaagggaugagugaugcccccacagcaccuccugcgaggcuaugagugg

SEQ ID NO: 88594 - RNA, 64 nt, Homo Sapiens
auuuuauaauauaccaauguuacauuuucugaaacguagcaaacaggauauucaaaagauucuu

SEQ ID NO: 88595 - RNA, 64 nt, Homo Sapiens
cgcgugucucauuugccaggaagauggguucccacguagcaaaucguacauugugcccuguagc

SEQ ID NO: 88596 - RNA, 64 nt, Homo Sapiens
aaaauuuuaugcccucgcauacauuauguuccuccguagcaagaauaccuugaaaaaucaaaga

SEQ ID NO: 88597 - RNA, 64 nt, Homo Sapiens
uaauacuagauaauaaggaaagaguuugggcucccguagcaaacguuuuaagugauucgguuaa

SEQ ID NO: 88598 - RNA, 64 nt, Homo Sapiens
cuuucucucaaggugcuaaaacagcccucaaagacguagcaacuagccacaccacccucucccg

SEQ ID NO: 88599 - RNA, 64 nt, Homo Sapiens
aucaugaaaaacacuucaacguaaaagcuggggccguagcaaaacaaaggcauuaaaaacucca

SEQ ID NO: 88600 - RNA, 64 nt, Homo Sapiens
uuuuuaaacaaguuaguauuaaugcguuggcccacguagcaaaaagauauuugauuaucuuaaa

SEQ ID NO: 88601 - RNA, 64 nt, Homo Sapiens
uugguugcuggaauggcuguuauaguuuaugugacguagcaaucccucguugguaaggcguuuu

SEQ ID NO: 88602 - RNA, 64 nt, Homo Sapiens
cuugacuuacccuaggugggugugaaagagcacccguagcaaggaaaauuuucucuauuagugu

SEQ ID NO: 88603 - RNA, 64 nt, Homo Sapiens
ucucaugcuccccccccuccuuauuuguagcaaucguagcaacuaauuccacuaaguacaaggg

SEQ ID NO: 88604 - RNA, 64 nt, Homo Sapiens
gcaauaccgggggacccugccugccccccaaccucguagcaacauggcucccacaggacaaucg

SEQ ID NO: 88605 - RNA, 64 nt, Homo Sapiens
ucuguggcaguuuuaaaaaggaaggaccuaaauucguagcaaauuccacacauuuaaaacauuu

SEQ ID NO: 88606 - RNA, 64 nt, Homo Sapiens
ccaugaagcaccuuccuaacacaucgccugucuccguagcaauguccugcagguggcuuccaga

SEQ ID NO: 88607 - RNA, 64 nt, Homo Sapiens
gugcauuccagguuacugcacuugucugaugugacguagcaacacccaggucuucuuaaaacaa

SEQ ID NO: 88608 - RNA, 64 nt, Homo Sapiens
ucuguauaugaauauguauauuuucuacuguaaacguagcaagaggcccugagggccuagcauu

SEQ ID NO: 88609 - RNA, 64 nt, Homo Sapiens
gggucaucgaggugugucuauggaagagaagauccguagcaacccuccaggucguucucggagc

SEQ ID NO: 88610 - RNA, 64 nt, Homo Sapiens
cagcugaggacuucggagcuugucaggaaguggccguagcaacuuggcggagacaggcuaugag

SEQ ID NO: 88611 - RNA, 64 nt, Homo Sapiens
auaggggauuuuucugaacacugcaaaaauagaacguagcaaaauggcuucaguuaucacuuuu

SEQ ID NO: 88612 - RNA, 64 nt, Homo Sapiens
ccaccucuuucccuuuugaagagacagcaacagccguagcaaaagcagcugcugcuccugcuau

SEQ ID NO: 88613 - RNA, 64 nt, Homo Sapiens
gcgaguagccagucuuucuuuaacaucaaucaaccguagcaauguggucaucacgaagucuuca

SEQ ID NO: 88614 - RNA, 64 nt, Homo Sapiens
cugcauugguauuuagaaaauucaaaauuguaaccguagcaaaauuuugaggcucaguuaauau

SEQ ID NO: 88615 - RNA, 64 nt, Homo Sapiens
uuaaccuuuuuuuuuuccaguauuauaacauuuucguagcaaaaaugacugaucauacaaaacg

SEQ ID NO: 88616 - RNA, 64 nt, Homo Sapiens
auugcccaggcuagagugcaauggugcgaucuaggcucaccacaaccucugccuuccagguuca

SEQ ID NO: 88617 - RNA, 64 nt, Homo Sapiens
guuugucucauggucagcucgccucucaaagauggcucaccaaucaccugccuguuuuuacuua

SEQ ID NO: 88618 - RNA, 64 nt, Homo Sapiens
ugaagcacuuagaacugauggccagcacaugagggcucaccaaguguaagccacaaauacacau

SEQ ID NO: 88619 - RNA, 64 nt, Homo Sapiens
ggaugucaucauucaccauuuauccaggauggccgcucaccaggcaauuugcuaggcucggggg

SEQ ID NO: 88620 - RNA, 64 nt, Homo Sapiens
auuuuccuuuucuagcuucauaggaauauugugagcucaccaugcuguggagguugggaaagag

SEQ ID NO: 88621 - RNA, 64 nt, Homo Sapiens
aaucuauuucagggaauguucugucuagugauuugcucaccauuugauauauaaugaauuauag

SEQ ID NO: 88622 - RNA, 64 nt, Homo Sapiens
uugcaaaguauuuuuccugccucauguagugauugcucaccacuagaauacucacguuuuuuaa

SEQ ID NO: 88623 - RNA, 64 nt, Homo Sapiens
gguugguucuugaguggcuauucuuguuuuaauugcucaccaaugcuagugaagaagcaggagc

SEQ ID NO: 88624 - RNA, 64 nt, Homo Sapiens; identical to SEQ ID NO: 75157

SEQ ID NO: 88625 - RNA, 64 nt, Homo Sapiens; identical to SEQ ID NO: 75158

SEQ ID NO: 88626 - RNA, 64 nt, Homo Sapiens; identical to SEQ ID NO: 75159

SEQ ID NO: 88627 - RNA, 64 nt, Homo Sapiens; identical to SEQ ID NO: 75160

SEQ ID NO: 88628 - RNA, 64 nt, Homo Sapiens; identical to SEQ ID NO: 75161

SEQ ID NO: 88629 - RNA, 64 nt, Homo Sapiens; identical to SEQ ID NO: 75162

SEQ ID NO: 88630 - RNA, 64 nt, Homo Sapiens; identical to SEQ ID NO: 75163

SEQ ID NO: 88631 - RNA, 64 nt, Homo Sapiens; identical to SEQ ID NO: 75164

SEQ ID NO: 88632 - RNA, 64 nt, Homo Sapiens; identical to SEQ ID NO: 75165

SEQ ID NO: 88633 - RNA, 64 nt, Homo Sapiens; identical to SEQ ID NO: 75166

SEQ ID NO: 88634 - RNA, 64 nt, Homo Sapiens; identical to SEQ ID NO: 75167

SEQ ID NO: 88635 - RNA, 64 nt, Homo Sapiens; identical to SEQ ID NO: 75168

SEQ ID NO: 88636 - RNA, 64 nt, Homo Sapiens; identical to SEQ ID NO: 75169

SEQ ID NO: 88637 - RNA, 64 nt, Homo Sapiens; identical to SEQ ID NO: 75170

SEQ ID NO: 88638 - RNA, 64 nt, Homo Sapiens; identical to SEQ ID NO: 75171

SEQ ID NO: 88639 - RNA, 64 nt, Homo Sapiens; identical to SEQ ID NO: 75172

SEQ ID NO: 88640 - RNA, 64 nt, Homo Sapiens; identical to SEQ ID NO: 75173

SEQ ID NO: 88641 - RNA, 64 nt, Homo Sapiens; identical to SEQ ID NO: 75174

SEQ ID NO: 88642 - RNA, 64 nt, Homo Sapiens; identical to SEQ ID NO: 75175

SEQ ID NO: 88643 - RNA, 64 nt, Homo Sapiens; identical to SEQ ID NO: 75176

SEQ ID NO: 88644 - RNA, 64 nt, Homo Sapiens; identical to SEQ ID NO: 75177

SEQ ID NO: 88645 - RNA, 64 nt, Homo Sapiens; identical to SEQ ID NO: 75178

SEQ ID NO: 88646 - RNA, 64 nt, Homo Sapiens; identical to SEQ ID NO: 75179

SEQ ID NO: 88647 - RNA, 64 nt, Homo Sapiens; identical to SEQ ID NO: 75180

SEQ ID NO: 88648 - RNA, 64 nt, Homo Sapiens; identical to SEQ ID NO: 75181

SEQ ID NO: 88649 - RNA, 64 nt, Homo Sapiens; identical to SEQ ID NO: 75182

SEQ ID NO: 88650 - RNA, 64 nt, Homo Sapiens; identical to SEQ ID NO: 75183

SEQ ID NO: 88651 - RNA, 64 nt, Homo Sapiens; identical to SEQ ID NO: 75184

SEQ ID NO: 88652 - RNA, 64 nt, Homo Sapiens; identical to SEQ ID NO: 75185

SEQ ID NO: 88653 - RNA, 64 nt, Homo Sapiens; identical to SEQ ID NO: 75186

SEQ ID NO: 88654 - RNA, 64 nt, Homo Sapiens; identical to SEQ ID NO: 75187

SEQ ID NO: 88655 - RNA, 64 nt, Homo Sapiens; identical to SEQ ID NO: 75188

SEQ ID NO: 88656 - RNA, 64 nt, Homo Sapiens; identical to SEQ ID NO: 75189

SEQ ID NO: 88657 - RNA, 64 nt, Homo Sapiens; identical to SEQ ID NO: 75190

SEQ ID NO: 88658 - RNA, 64 nt, Homo Sapiens; identical to SEQ ID NO: 75191

SEQ ID NO: 88659 - RNA, 64 nt, Homo Sapiens; identical to SEQ ID NO: 75192

SEQ ID NO: 88660 - RNA, 64 nt, Homo Sapiens; identical to SEQ ID NO: 75193

SEQ ID NO: 88661 - RNA, 64 nt, Homo Sapiens; identical to SEQ ID NO: 75194

SEQ ID NO: 88662 - RNA, 64 nt, Homo Sapiens; identical to SEQ ID NO: 75195

SEQ ID NO: 88663 - RNA, 64 nt, Homo Sapiens; identical to SEQ ID NO: 75196

SEQ ID NO: 88664 - RNA, 64 nt, Homo Sapiens; identical to SEQ ID NO: 75197

SEQ ID NO: 88665 - RNA, 64 nt, Homo Sapiens
uauaugaacauuuuucuuuuauuguuuuaucuucacagaaaauaaaagguguuaauuugcuuuu

SEQ ID NO: 88666 - RNA, 64 nt, Homo Sapiens
uguguuuucaaaacuuugcaaauucaucuguuacacagaaaauuuugacuuaaaacaucugcug

SEQ ID NO: 88667 - RNA, 64 nt, Homo Sapiens
ccacaaggcuaaaauauuuacauucucacccauuacagaaaaaguuugauaauuccugcuuuau

SEQ ID NO: 88668 - RNA, 64 nt, Homo Sapiens
cuaucaaaagcuaaauauggcacacuuguucuuuacagaaaaauaaagauauuuuaaacaaaau

SEQ ID NO: 88669 - RNA, 64 nt, Homo Sapiens
cuauguacauagggaacuuaguucugggccauguacagaaaauaucacuguaauauaccaaaag

SEQ ID NO: 88670 - RNA, 64 nt, Homo Sapiens
cauaagccauccagaucaacacccuuucuuccauacagaaaagggcuaaccauaccacagcugg

SEQ ID NO: 88671 - RNA, 64 nt, Homo Sapiens
cuucuccacuuucuagccaggugggggaguggccacagaaaauuggaggucucuaagaauauaa

SEQ ID NO: 88672 - RNA, 64 nt, Homo Sapiens
gaagacagcucuuauauugcgcccugcagagggcacagaaaaugagucagaaguuucugccgca

SEQ ID NO: 88673 - RNA, 64 nt, Homo Sapiens
ccauuuaaaagugaucauuuaguuuuacauucuuacagaaaaguacauacuuggcaaauuuuug

SEQ ID NO: 88674 - RNA, 64 nt, Homo Sapiens
uuucuagggauuuguguggauuaaugaagacuacacagaaaaccaacauucacaaagauuugcg

SEQ ID NO: 88675 - RNA, 64 nt, Homo Sapiens
caacuccugggaaaaaaggucuuuaaaaauaacaacagaaaauaguucagaaauuggcacaucc

SEQ ID NO: 88676 - RNA, 64 nt, Homo Sapiens
ccugaccaaauucuaaaaccaaaaaucaucaaagacagaaaaugcaaaugccagaauuaaaaaa

SEQ ID NO: 88677 - RNA, 64 nt, Homo Sapiens
aacuacuuauauuucagagcacaugucaugcaucacagaaaagcuuaaguacuaaggcacaaag

SEQ ID NO: 88678 - RNA, 64 nt, Homo Sapiens
ccacauacaguauugguaaauuuguuuaauauuuacagaaaaauaaagucuauuucuuuaaagu

SEQ ID NO: 88679 - RNA, 64 nt, Homo Sapiens
ugugauaauagcauuuuuguaacuugccauccgcacagaaaauacgagaaaaucugcauguuug

SEQ ID NO: 88680 - RNA, 64 nt, Homo Sapiens
aaaaaucuccccaguagagaaacauuuggaaaagacagaaaacuaaaaaggaagaaaaaagauc

SEQ ID NO: 88681 - RNA, 64 nt, Homo Sapiens
agacaaaacaauccccaucauuuaaguuuaaaaaacagaaaaacauauacagaaaaauauauau

SEQ ID NO: 88682 - RNA, 64 nt, Homo Sapiens
auauauuuuaaguuuaaaaagaauauaaacauauacagaaaaauguagucaggugcucaaugga

SEQ ID NO: 88683 - RNA, 64 nt, Homo Sapiens
uuccauaauugaacuagauuaguuuagagucaggacagaaaagcgaguauccaauaaaggagac

SEQ ID NO: 88684 - RNA, 64 nt, Homo Sapiens
aaaagagagacaaacucuagaaagagaaugaaugacagaaaaaacagacgugacguccugccag

SEQ ID NO: 88685 - RNA, 64 nt, Homo Sapiens
aaaaaaccucuaugcaaucucaaacaaacagaaaacagaaaacauucaaaaaaucugaccaaaa

SEQ ID NO: 88686 - RNA, 64 nt, Homo Sapiens
gaaaacaaaaaaaccucuauaccaaaacaaacaaacagaaaacaaagauguuucaaaaaaucug

SEQ ID NO: 88687 - RNA, 64 nt, Homo Sapiens
uuucaaccuaaauacugacugcuggacauaaaucacagaaaauuuaacuuaagaaaauuuacaa

SEQ ID NO: 88688 - RNA, 64 nt, Homo Sapiens
guuaccuacaucaauuaauuaaaugaacuuauguacagaaaacauguauaaauauaagucuaua

SEQ ID NO: 88689 - RNA, 64 nt, Homo Sapiens
guugcauuuguauuaacaagagugcauuuucaucacagaaaagacaaaaaguacuaggcuacua

SEQ ID NO: 88690 - RNA, 64 nt, Homo Sapiens
aaaaaaaagaacguugcaaaaaaaaaaaaaaaaaacagaaaaagaaacugaauuaggcagucuu

SEQ ID NO: 88691 - RNA, 64 nt, Homo Sapiens
ugaaaaacuguuugguaagcgaacauuuuuaaaaacagaaaaauucccccccaaauuuuauuau

SEQ ID NO: 88692 - RNA, 50 nt, Homo Sapiens
uugcuuauuucuuuugcagcacagaaaacuuuaaaauucuugcacaauaa

SEQ ID NO: 88693 - RNA, 64 nt, Homo Sapiens
cagaauauuaauacaauuaauauuaauauuaacuacagaaaagacaaacaguagagaacagcaa

SEQ ID NO: 88694 - RNA, 64 nt, Homo Sapiens
aguccugagcgaaaacaggagaguuagucgcccuacagaaaacccagcuagacuauuggguaug

SEQ ID NO: 88695 - RNA, 64 nt, Homo Sapiens
aaaugcucugugaugguaaauaaaauuggagcagacagaaaagauauagcaaaugaagaaauau

SEQ ID NO: 88696 - RNA, 64 nt, Homo Sapiens
ucauguuuguuguaaccugagguauccaaaugcuacagaaaaauuuaugacccaaauacaaauc

SEQ ID NO: 88697 - RNA, 64 nt, Homo Sapiens
caaauggggccucauuaaacuaaagagcuucugcacagaaaaagaaacuagcaacacaguaaac

SEQ ID NO: 88698 - RNA, 64 nt, Homo Sapiens
uagaggcuauuauccuaagcaaccuaaugcaagaacagaaaaccacauacugcaucuucccauu

SEQ ID NO: 88699 - RNA, 64 nt, Homo Sapiens
auuuaaaaaacaagaaugcaaccaaaucauuggaacagaaaaggaagcuugcuuguuuuaaaca

SEQ ID NO: 88700 - RNA, 64 nt, Homo Sapiens
uguccacgugcuuuuguauggagacauaaacuguacagaaaacuauguauacauagaaguaucu

SEQ ID NO: 88701 - RNA, 64 nt, Homo Sapiens
uagggaagaauaaaauuaacaaaauuuggaaaauacagaaaauaugcaaucauagugacuucag

SEQ ID NO: 88702 - RNA, 64 nt, Homo Sapiens
uuuaaaaacagaucagcugggagaccaugucucuacagaaaaaaaccagcuaaggcaauauagu

SEQ ID NO: 88703 - RNA, 64 nt, Homo Sapiens
uaaaaaauacaaaaagcagacugauguacuggaaacagaaaaguauuuccuccauacuauaagu

SEQ ID NO: 88704 - RNA, 64 nt, Homo Sapiens
guaauaauuuacguguauucuuuuucucuauagcacagaaaacagauaguuaacugaugauagg

SEQ ID NO: 88705 - RNA, 64 nt, Homo Sapiens
uuagccagauugcuuuuugcaaccaaagcuguggacagaaaagccuccuuaagugagcugaggg

SEQ ID NO: 88706 - RNA, 64 nt, Homo Sapiens
aauaggcuuuauuuguaagagcaguuuuauguuuacagaaaaauuaggcacaaagggauuccca

SEQ ID NO: 88707 - RNA, 64 nt, Homo Sapiens
uggaauugugguauuuuuuucuguauugauuuuaacagaaaauuucaauuuauagagguuagga

SEQ ID NO: 88708 - RNA, 64 nt, Homo Sapiens
aauuucaauuuauagagguuaggaauuccaaacuacagaaaauguuuguuuuuagugucaaauu

SEQ ID NO: 88709 - RNA, 64 nt, Homo Sapiens
aaaugauuuaaaaucaaaucugacguauuacaaaacagaaaaauagaauaagaaugaaaacugc

SEQ ID NO: 88710 - RNA, 64 nt, Homo Sapiens
cacauaacucugguguguuacacuguguauacagacagaaaaauuagaaaucuaaaugaauuau

SEQ ID NO: 88711 - RNA, 64 nt, Homo Sapiens
uacagauaagaauuuauuucgaauauacuaaauaacagaaaagucuaauuccaaaauuauggcu

SEQ ID NO: 88712 - RNA, 64 nt, Homo Sapiens
ggccgcuccgcuccccugcuccugucugucucggacagaaaacacgaggcuccuugugucaagc

SEQ ID NO: 88713 - RNA, 64 nt, Homo Sapiens
gauuucagaugaacucugcuguuuagaaguaaccacagaaaagcaaagucaguguacacucuga

SEQ ID NO: 88714 - RNA, 64 nt, Homo Sapiens
aguagugaguuaaagcuacaggucaguuuaugaaacagaaaaguaggaaugcauuuucugggug

SEQ ID NO: 88715 - RNA, 64 nt, Homo Sapiens
ugaugugcacugcauuagaaaugagguagcugacacagaaaaaggauguuuugauaggaauaau

SEQ ID NO: 88716 - RNA, 64 nt, Homo Sapiens
uucuugaacugaucauugaaaacuuauaaaccuaacagaaaagccacauaauauuuagugucau

SEQ ID NO: 88717 - RNA, 64 nt, Homo Sapiens
uauccagcacaaaaacuauuucuggcugaauagcacagaaaaguauuuuaaccuaccuguagag

SEQ ID NO: 88718 - RNA, 64 nt, Homo Sapiens
aauauuuuuaagcagagaauauuuuggcaacagcacagaaaacucuacauuugcuuaaauugcu

SEQ ID NO: 88719 - RNA, 64 nt, Homo Sapiens
gcucaguuaaauguaagugucuuugguauuuauuacagaaaaguuuuacagcuacaaaaaccua

SEQ ID NO: 88720 - RNA, 64 nt, Homo Sapiens
uccaaguuaugauuuauuuugcaacuaccucaggacagaaaagauuuauggggauuuuaaaaau

SEQ ID NO: 88721 - RNA, 64 nt, Homo Sapiens
uauuaguugugccugguucuuguaauuugauuuuacagaaaaggaaaugacacuugagauccuu

SEQ ID NO: 88722 - RNA, 64 nt, Homo Sapiens
aaauauaccuguuaaguucgcuccauuguggaauacagaaaauuuucaugaguccugcuucuag

SEQ ID NO: 88723 - RNA, 64 nt, Homo Sapiens
uauuucuaguuaucacuuaaacugaagcacagggacagaaaauaaauggaaccuccauuuucaa

SEQ ID NO: 88724 - RNA, 64 nt, Homo Sapiens
ccaggaugagaucagaaggagcauccuccagcugacagaaaaauucugggauggggucagaaau

SEQ ID NO: 88725 - RNA, 64 nt, Homo Sapiens
uagccaggcgugguggcacaucucuacugaaaauacagaaaaguaccaacauggagaaacccag

SEQ ID NO: 88726 - RNA, 64 nt, Homo Sapiens
uugacuuaauuuauuuauuuuuugaaaagaagagacagaaaauaccuuauuaucugcagggacu

SEQ ID NO: 88727 - RNA, 64 nt, Homo Sapiens
uuuguccuucugcaauacaugcacuugaaaauaaacagaaaagagauguuuaauaacaaguuua

SEQ ID NO: 88728 - RNA, 64 nt, Homo Sapiens
gaagcucugauucagcugggugugugacguauccacagaaaagaaaaccuuuauuuaggccuuc

SEQ ID NO: 88729 - RNA, 64 nt, Homo Sapiens
auuaaaguauuauuaauaauauuuuuuccuuaaaacagaaaaaaucagagaaaugcaugggaau

SEQ ID NO: 88730 - RNA, 64 nt, Homo Sapiens
ugaugcuggggacacagcauggagaagagggaaaacagaaaaccuggacaaggaaggaauaaag

SEQ ID NO: 88731 - RNA, 64 nt, Homo Sapiens
aagguugagggcaauggacaccaggccagagcaaacagaaaaagcauggauauguuauacugaa

SEQ ID NO: 88732 - RNA, 64 nt, Homo Sapiens
uaguuuuguuuuaauaaaccguauugcaagaaacacagaaaaugugauuuuuaugcuuguuagu

SEQ ID NO: 88733 - RNA, 64 nt, Homo Sapiens
auaauguaggugaucggagcugcagaaaauaagcacagaaaauuuagauguguauuuccucccc

SEQ ID NO: 88734 - RNA, 64 nt, Homo Sapiens
uacuauuaauuugcucagugcacuuuuuucaaauacagaaaaaagauucuccauuauaguuaca

SEQ ID NO: 88735 - RNA, 64 nt, Homo Sapiens
uuuguuacagcaauccuaggaagcuaauacucugacagaaaaaaaucuuggauaauaugcauga

SEQ ID NO: 88736 - RNA, 64 nt, Homo Sapiens
guuuuaucaauaugauuaucaaaucacagcauauacagaaaagacuuggacuuauuguauguuu

SEQ ID NO: 88737 - RNA, 64 nt, Homo Sapiens
aagaaagcaugguauuaaacuaucauagaaguagacagaaaaagaaaaaaggacucauggcauu

SEQ ID NO: 88738 - RNA, 64 nt, Homo Sapiens
acaaaaaauaaccccaaaaugauuuuuuuuuagaacagaaaacaguauaagcauggagaacagu

SEQ ID NO: 88739 - RNA, 64 nt, Homo Sapiens
aacacacacacacacaacaauccucuuucagaaaacagaaaaaaugugaauugauaauaaacug

SEQ ID NO: 88740 - RNA, 64 nt, Homo Sapiens
aucugaacugagaaaggagcucaaaccuuuuauuacagaaaaaauauuagaauugugucauuua

SEQ ID NO: 88741 - RNA, 64 nt, Homo Sapiens
caguguuccugcauuuaccaagggucuggugugaacagaaaaaaaaauuucucagugccuucuc

SEQ ID NO: 88742 - RNA, 64 nt, Homo Sapiens
cauuuguuacucucuguucuuugacugcccacccacagaaaagcaaaauaaccaacuaccuacu

SEQ ID NO: 88743 - RNA, 64 nt, Homo Sapiens
uuaaccauauuuuaaaaguaccaauuuuguuuuuacagaaaagauaaaacucaaaagagaacag

SEQ ID NO: 88744 - RNA, 64 nt, Homo Sapiens
guaacagcugaggucaagauggacagaaaacagaacagaaaagaaauaugugagguaguaagga

SEQ ID NO: 88745 - RNA, 64 nt, Homo Sapiens
gaacagaaaagaguaacagcagguaguaaggaggacagaaaacagaaggagagagaaauaugug

SEQ ID NO: 88746 - RNA, 64 nt, Homo Sapiens
cuuuguaaaaaguagcauccugaucuauaaaugcacagaaaauauuauaaaaagucaaacauug

SEQ ID NO: 88747 - RNA, 64 nt, Homo Sapiens
uuguuuaaaugcuugaagcauuguugcaugagcaacagaaaaaaaaccaaaacuguaaauaugg

SEQ ID NO: 88748 - RNA, 64 nt, Homo Sapiens
aguuguuccuguugugugguccuugucacagaaaacagaaaaacgagguugucccugcaguacu

SEQ ID NO: 88749 - RNA, 64 nt, Homo Sapiens
gaaaaacaguuguuccuguucaguacuccuugucacagaaaacaucugggugagguugucccug

SEQ ID NO: 88750 - RNA, 64 nt, Homo Sapiens
cggauaguuuuaacaacagguccuguuuguugcaacagaaaacuacaguuugauuaaaacauug

SEQ ID NO: 88751 - RNA, 64 nt, Homo Sapiens
gcugaagacaguggccaugcuagaaacaaucacuacagaaaacagguaaaauagguaaaauacc

SEQ ID NO: 88752 - RNA, 64 nt, Homo Sapiens
cagaauccccaagugccugcuuuugaugaugucuacagaaaaugcuggcugagcugaacacauu

SEQ ID NO: 88753 - RNA, 64 nt, Homo Sapiens
ugagcugaacacauuugcccaauuccaggugugcacagaaaaccgagaauauucaaaauuccaa

SEQ ID NO: 88754 - RNA, 64 nt, Homo Sapiens
auguucugauauccuccuacaguaguuuaaauugacagaaaaauuugaauguuuucuucuuaac

SEQ ID NO: 88755 - RNA, 64 nt, Homo Sapiens
uauaccugaacuguagugguuugaucggauggagacagaaaacccgauuuuuauucucauaaau

SEQ ID NO: 88756 - RNA, 64 nt, Homo Sapiens
cuaaaaacaaaacucacguaucaucucaauagauacagaaaaggcuuuugauaaaauucaacuu

SEQ ID NO: 88757 - RNA, 64 nt, Homo Sapiens
uggaagccauuauccuaaaugaacucacucagaaacagaaaaccaaauaccacauguucucacu

SEQ ID NO: 88758 - RNA, 64 nt, Homo Sapiens
gcagugaacacaugccaaaaccuuaauagugcagacagaaaacugaaggugccauuuggcugcu

SEQ ID NO: 88759 - RNA, 64 nt, Homo Sapiens
uguagauuucaaauuuuauucugccacauugaguacagaaaagugggaaaaaaaucuaagcugu

SEQ ID NO: 88760 - RNA, 64 nt, Homo Sapiens
gacuccugaauuggaagaggaagaacuucuguuuacagaaaacuguauuguuauauaugucagg

SEQ ID NO: 88761 - RNA, 64 nt, Homo Sapiens
acaauucaagcaguagacaaaguugcucacaaauacagaaaacaucuuuuugucuacuucgcaa

SEQ ID NO: 88762 - RNA, 64 nt, Homo Sapiens
uguggcaaaguuuuuaacuaauacaccuuauugcacagaaaaucauuuauauuugagaaaaauu

SEQ ID NO: 88763 - RNA, 64 nt, Homo Sapiens
cuuguaucagaucuuauuguccacauuuuguacuacagaaaaacucugaagaggucacucaaac

SEQ ID NO: 88764 - RNA, 64 nt, Homo Sapiens
gaaagaaaacugucagcaauucuaugcugacauaacagaaaauguagaugagauagaugaaaua

SEQ ID NO: 88765 - RNA, 64 nt, Homo Sapiens
guguccuaugcccagcugcacagcuuacccucaaacagaaaauaaugaagccuucuuccuccca

SEQ ID NO: 88766 - RNA, 62 nt, Homo Sapiens
uauuguggaaucuuugaaaggacaaggccucugugaaugaaucagucccagggaagcauuug

SEQ ID NO: 88767 - RNA, 62 nt, Homo Sapiens
uuguaaaucuuugcuaaguaguguuuuccuuggugaaugaagucauuguugucuucaagugu

SEQ ID NO: 88768 - RNA, 62 nt, Homo Sapiens
gcuguuuggaaguguaaugauuuuaucacauggugaaugacuacuaagaguaaugauuauau

SEQ ID NO: 88769 - RNA, 62 nt, Homo Sapiens
augacuacuaagaguaaugauuauaucacauugugaaugacuacuugccacaguaaaaauac

SEQ ID NO: 88770 - RNA, 62 nt, Homo Sapiens
uacagaguaauauucuguggcccuuugacuuugugaaugagcacaaugaaaugccgccuacu

SEQ ID NO: 88771 - RNA, 62 nt, Homo Sapiens
uuuaggugauuuaaaaauauaccguguugguggugaaugacuauugaugacuguguuaagug

SEQ ID NO: 88772 - RNA, 62 nt, Homo Sapiens
uauaguuacaaauuuuagguuggugaauccaagugaaugaaauaucagcauaacuauguggg

SEQ ID NO: 88773 - RNA, 62 nt, Homo Sapiens
uauaaauuucucuuugcauauaauacauauuugugaaugagacauauucccaaaaaauucuu

SEQ ID NO: 88774 - RNA, 62 nt, Homo Sapiens
auucugaaguugccacaaaaaauaagacacuggugaaugagaguauaauuguuuuucuucua

SEQ ID NO: 88775 - RNA, 62 nt, Homo Sapiens
guauggaggauuugaggaacaguaaccaggaugugaaugauuuuguuacaucaguguucacu

SEQ ID NO: 88776 - RNA, 62 nt, Homo Sapiens
uuguauauguaacucuaagagaccuuccuagagugaaugaagguagaaaacugaaaagggag

SEQ ID NO: 88777 - RNA, 62 nt, Homo Sapiens
cuucucacaauccgagcugcucuuuguccucugugaaugaagguacuuuugcuuccauuuca

SEQ ID NO: 88778 - RNA, 64 nt, Homo Sapiens; identical to SEQ ID NO: 45664

SEQ ID NO: 88779 - RNA, 64 nt, Homo Sapiens; identical to SEQ ID NO: 45665

SEQ ID NO: 88780 - RNA, 64 nt, Homo Sapiens; identical to SEQ ID NO: 45666

SEQ ID NO: 88781 - RNA, 64 nt, Homo Sapiens; identical to SEQ ID NO: 45667

SEQ ID NO: 88782 - RNA, 64 nt, Homo Sapiens
ugauucuccuaaagagcagucugccuaagagaaucaaccaaaggauuucaaagcuuuauucugu

SEQ ID NO: 88783 - RNA, 64 nt, Homo Sapiens
gaugauguggagucuucuguaacaccccuaauuacaaccaaaguuuuccuuaauuuauuuuguu

SEQ ID NO: 88784 - RNA, 64 nt, Homo Sapiens
ggaguuccguaggcagagugaaucuuuggucacucaaccaaacaauccaacgacacaaucuuuu

SEQ ID NO: 88785 - RNA, 64 nt, Homo Sapiens
aauacaaucuaacuuuuaccaaaacaaaacaaaacaaccaaacaguccugugaggcaaaaaaac

SEQ ID NO: 88786 - RNA, 64 nt, Homo Sapiens
uaugcucauccagacaagcuagggagaaaaaucucaaccaaaguugcuuugaaaaucuuuuuua

SEQ ID NO: 88787 - RNA, 64 nt, Homo Sapiens
gcaguuuuccuaacuugauuucuuggaaauccuccaaccaaauacucucacagguacagcuguu

SEQ ID NO: 88788 - RNA, 64 nt, Homo Sapiens
uaaauaucuauaugacgcucuuaaaaaaacaucccaaccaaaaccaaccaaacaaaaacauccu

SEQ ID NO: 88789 - RNA, 64 nt, Homo Sapiens
uaugacgcucuuaaaaaaacaucccaaccaaaaccaaccaaacaaaaacauccucacaacuccc

SEQ ID NO: 88790 - RNA, 64 nt, Homo Sapiens
acccacaaaugauagaccggcaaagacuuggaaccaaccaaaauugcagcacuguuuacaauag

SEQ ID NO: 88791 - RNA, 64 nt, Homo Sapiens
ccauguuuccuacuguguuaagccuuugugccagcaaccaaaucaagccuaagccauaccaugc

SEQ ID NO: 88792 - RNA, 64 nt, Homo Sapiens
ccugagguggcaccguacucaguguugugaugcccccaccuagggaggacucaaugcucuuugu

SEQ ID NO: 88793 - RNA, 64 nt, Homo Sapiens
caguucucagaccgaaggugcugccuucauccuccccaccuaaugcauuuuugaaaccaaaggu

SEQ ID NO: 88794 - RNA, 64 nt, Homo Sapiens
guaacucuagaaguuccuuugacuaggcugcaaucccaccuauaugcucagcccuaagagcugu

SEQ ID NO: 88795 - RNA, 64 nt, Homo Sapiens
uuuuauaauguauauuauauggccaccuccaaaccccaccuaggcacuguuugcauaucgcuca

SEQ ID NO: 88796 - RNA, 64 nt, Homo Sapiens
ccagcacacacacucccugcacccaggaggccuccccaccuaccugccaggccucaggcccagg

SEQ ID NO: 88797 - RNA, 64 nt, Homo Sapiens
cauauuccuuacccucugucucuccucccuguaucccaccuaugguucaguguugcaagagucu

SEQ ID NO: 88798 - RNA, 64 nt, Homo Sapiens
cugugacccuuucgcuuuugcauucacccuccuucccaccuaccuguccuggggcuguugagca

SEQ ID NO: 88799 - RNA, 64 nt, Homo Sapiens
acccccacccccgacccucgauuuauugucuguccccaccuaggagaccccgacauuccucggu

SEQ ID NO: 88800 - RNA, 64 nt, Homo Sapiens
guugguucgcaaagugcaaaauccuccacgcacccccaccuaucagccgggccguccguguucc

SEQ ID NO: 88801 - RNA, 64 nt, Homo Sapiens
cgcucuugaacaucccacuaugaauggaaaccuucccaccuaagcccaccuaccucccugaugc

SEQ ID NO: 88802 - RNA, 64 nt, Homo Sapiens
ucccugaugcugaauggaaaguggucuccaagaccccaccuaccgagccuuuauuccacgucgc

SEQ ID NO: 88803 - RNA, 64 nt, Homo Sapiens
aagagaauauguucuuuuuaacauuuguaucccaagcagaaauaauucucaucauccaaacuga

SEQ ID NO: 88804 - RNA, 64 nt, Homo Sapiens
ugcaagcacccugaucucacaucgggagcaguggagcagaaaugcuccaaggcagcaaagcaga

SEQ ID NO: 88805 - RNA, 64 nt, Homo Sapiens
auuagaaauguuaacauuuauuucuaguccucaaagcagaaauagucagcaaaauuagaaguca

SEQ ID NO: 88806 - RNA, 64 nt, Homo Sapiens
gccuagaaccaguuuuaagacggauauguuggguagcagaaaagacuguugauguuuuguucac

SEQ ID NO: 88807 - RNA, 64 nt, Homo Sapiens
gaaaaaaagguuaagcauaaaaagaaagggaaaaagcagaaacacugcagaagacacaaacaaa

SEQ ID NO: 88808 - RNA, 64 nt, Homo Sapiens
cacaaaaugaaaauguaguaguacaaccaguuguagcagaaaauauuccuguaauaccacugag

SEQ ID NO: 88809 - RNA, 64 nt, Homo Sapiens
uuuagauuugaauguuuuaagauaggagagacuuagcagaaaauacuuggcuugccagggccac

SEQ ID NO: 88810 - RNA, 64 nt, Homo Sapiens
auuucucacaaggaaaaaaacauucuauauuuguagcagaaaucagugguuugaaaagucauac

SEQ ID NO: 88811 - RNA, 64 nt, Homo Sapiens
auucaguuuuuguaguaaagugaguaacugacaaagcagaaacucuguuacaguuuuauugcuc

SEQ ID NO: 88812 - RNA, 52 nt, Homo Sapiens
augaauuuguccaauuguguagagcagaaaaguugauguggacaugaaguga

SEQ ID NO: 88813 - RNA, 64 nt, Homo Sapiens
uauuaaauagccaugagcuucacugcuuagagggagcagaaaggucaacaucuaaaagcaccuu

SEQ ID NO: 88814 - RNA, 64 nt, Homo Sapiens
agaggaggagaaacagggugagucaagguaaaggagcagaaauguaguuacaagccaggucguc

SEQ ID NO: 88815 - RNA, 64 nt, Homo Sapiens
ggcgaacuucagucuuuuuagaagagacuuccugagcagaaaugaacauaugaagcuuaggagu

SEQ ID NO: 88816 - RNA, 54 nt, Homo Sapiens
uugaagccagaaggacaacauaauagcagaaauuaaaaggaggaaaaacaguaa

SEQ ID NO: 88817 - RNA, 64 nt, Homo Sapiens
aacuccguaaugaauggaauaucaguaaguauuuagcagaaacuugccaggggucugcucuagc

SEQ ID NO: 88818 - RNA, 64 nt, Homo Sapiens
caaguuaucaggacagagauugguccacacacuaagcagaaaacuuuuuaaagagaaguugccu

SEQ ID NO: 88819 - RNA, 64 nt, Homo Sapiens
acucacuaaguauggaaaacugauucugggaggaagcagaaaugucccuagauaacagcaugua

SEQ ID NO: 88820 - RNA, 64 nt, Homo Sapiens
acuccagccugggaacaagagugaaacucucaaaagcagaaacaaaaacccaacauauaugggc

SEQ ID NO: 88821 - RNA, 64 nt, Homo Sapiens
auacccaugccuuaaagaggggcaguuucucaaaagcagaaacaugccgccaguucucaaguuu

SEQ ID NO: 88822 - RNA, 64 nt, Homo Sapiens
ccaaagguguugauuuacaaagaggccagcuaauagcagaaaucaugacccugaaagagagaug

SEQ ID NO: 88823 - RNA, 64 nt, Homo Sapiens
cuguucaggcaggcuuucugacccuagcuauaccagcagaaaacagacaguuagagacucuguc

SEQ ID NO: 88824 - RNA, 64 nt, Homo Sapiens
cucugaagguccaaagaguuauaugugacacugcagcagaaaggccucuuguucaugucagcuu

SEQ ID NO: 88825 - RNA, 64 nt, Homo Sapiens
aucaucaccaucauaaccuucaggcuguuuacaaagcagaaaauugggugcugugggucaccaa

SEQ ID NO: 88826 - RNA, 64 nt, Homo Sapiens
caaacuccagccccaccacacaaggcaaucuggaagcagaaaugcuucccugugucuccccuaa

SEQ ID NO: 88827 - RNA, 64 nt, Homo Sapiens
ggagaaugucaaggaagacuuuugguagagaaggagcagaaagauguguuuuugggaagaagaa

SEQ ID NO: 88828 - RNA, 64 nt, Homo Sapiens
uuuguugcuuucuuaccuacuauuggcccuaaauagcagaaagaagagaagugaccgagagaac

SEQ ID NO: 88829 - RNA, 64 nt, Homo Sapiens
acauccguuuauuaucaagggcaaccuuggugaaagcagaaagggugugugcuauugcauauau

SEQ ID NO: 88830 - RNA, 64 nt, Homo Sapiens
uguaagcuccuauuugcuuaucuuguuuauuucaagcagaaaucaauaaauuccauaacccucu

SEQ ID NO: 88831 - RNA, 64 nt, Homo Sapiens
agagcugcaguuagacgggguuacgggggcuaaaagcagaaaaaaaauuccauuucaucgggau

SEQ ID NO: 88832 - RNA, 64 nt, Homo Sapiens
ucugaaucucuccagcagccagaggcacgugagaagcagaaagagcugguaaauaaagccuugg

SEQ ID NO: 88833 - RNA, 64 nt, Homo Sapiens
ccacaguccaaaagacaagcuuguuuaucaccuuagcagaaaaauagaauuagagacaucugau

SEQ ID NO: 88834 - RNA, 64 nt, Homo Sapiens
acaguaaaaacacaggagaauaaaagucuaagauagcagaaaaugauacuacaaauaauuuucu

SEQ ID NO: 88835 - RNA, 64 nt, Homo Sapiens
uuauauguuuuaaucucccuugucccucagaauaagcagaaaauauaacugcagcuguaugucg

SEQ ID NO: 88836 - RNA, 64 nt, Homo Sapiens
caugacuuaccauuccagcugcaugggaaagcaaagcagaaaacagugccccaaauggaaaaaa

SEQ ID NO: 88837 - RNA, 64 nt, Homo Sapiens
uacaacucauggaagguaaaugccagucaggcacagcagaaaccgaaaaaaaaguacaaccaaa

SEQ ID NO: 88838 - RNA, 64 nt, Homo Sapiens
gccaugcucagagaauccuaaaaagaauggaauaagcagaaacugcugauccccugugugagag

SEQ ID NO: 88839 - RNA, 64 nt, Homo Sapiens
gcauugaauuugcuacuguaggaguauuuuuaggagcagaaacugcaaacacauuucauuguga

SEQ ID NO: 88840 - RNA, 64 nt, Homo Sapiens
acuugaauagcacaucaauagguuacuggacaaaagcagaaaaaccuguuacaggauagccugc

SEQ ID NO: 88841 - RNA, 64 nt, Homo Sapiens
acuguucccuuuauuuuaacguagcaagcaagaaagcagaaacuggaauuacaauugcaugcag

SEQ ID NO: 88842 - RNA, 62 nt, Homo Sapiens
ugcacuaauaauacuuaccaaugcugcaggucagcagaaauuauccaaaguuuauggacuaa

SEQ ID NO: 88843 - RNA, 64 nt, Homo Sapiens
aaggggucucgguggagcugugcaccagcagccaagcagaaagaaacacgcgacauggacucug

SEQ ID NO: 88844 - RNA, 64 nt, Homo Sapiens
cagacugcccugcuggggccgggccggaggguggagcagaaaggggaccccggagccgagcgag

SEQ ID NO: 88845 - RNA, 64 nt, Homo Sapiens
ccuuucucucuuugccuuuaguuugcccgacaccagcagaaaaguggaccuugggggcugguuc

SEQ ID NO: 88846 - RNA, 64 nt, Homo Sapiens
ggagaaggagaggauccggucggcagcagcccugagcagaaagcuggaggggggacugucgcgg

SEQ ID NO: 88847 - RNA, 64 nt, Homo Sapiens
auuuucccacugguguguagaaaaugcaaacaugagcagaaaauagagagcacaaaaaugggag

SEQ ID NO: 88848 - RNA, 64 nt, Homo Sapiens
cuaacaaaagcuucucagcuuucucauaacuaaaagcagaaaagacuccguuugaaguaucacc

SEQ ID NO: 88849 - RNA, 64 nt, Homo Sapiens
ggaacauuugaucuagcagcagggaugagaggaaagcagaaaugaaugaacugugaaagcuccu

SEQ ID NO: 88850 - RNA, 64 nt, Homo Sapiens
agaggaaaggacucauucaugucacgcuuccuugagcagaaaagagcacugagagcacuuggga

SEQ ID NO: 88851 - RNA, 64 nt, Homo Sapiens
agaggccacacuuucugggauguuuaaacugaguagcagaaaacauuaucuauccuugaugaug

SEQ ID NO: 88852 - RNA, 64 nt, Homo Sapiens
caugugcagggugggcuggugguagguucugaacagcagaaaccguuugcuccuguuguuacug

SEQ ID NO: 88853 - RNA, 64 nt, Homo Sapiens
cauucaagauuugcaggccucagccugggaugagagcagaaaagaaaagggacucagguaagcc

SEQ ID NO: 88854 - RNA, 64 nt, Homo Sapiens
gauauauuuucagauuuuuuuuaaugucauucugagcagaaauauuauugucacuuuuaaaaug

SEQ ID NO: 88855 - RNA, 64 nt, Homo Sapiens
cccuuaugacaucagcaauacagacuacuucuuccccagauagcuggcuggguggcaccagcag

SEQ ID NO: 88856 - RNA, 64 nt, Homo Sapiens
aaauuagccaagugugguagagugugccugaagucccagauacuuggggggcugaggugggagg

SEQ ID NO: 88857 - RNA, 64 nt, Homo Sapiens
uggugaugguuagcauaugggcuucuuuuuugcccccagauacagugagggaaugguaguuaag

SEQ ID NO: 88858 - RNA, 64 nt, Homo Sapiens
cuaaaguuacaaacagaccaguguuacuuacagucccagauacacaugggaagagcguagacag

SEQ ID NO: 88859 - RNA, 64 nt, Homo Sapiens
cagcaacuuugugucuuuggguacugacccuggacccagauaagguucauauuugaguuuaauu

SEQ ID NO: 88860 - RNA, 64 nt, Homo Sapiens
cgccggugguggaacugguccggcacguagagaacccagauagaggcccuggggugcagaggcc

SEQ ID NO: 88861 - RNA, 64 nt, Homo Sapiens
uaccuaaauauauauauauaugggccucagcuugcccagauacagagcccucggggccuccucc

SEQ ID NO: 88862 - RNA, 64 nt, Homo Sapiens
accaaaaccaagcauaagaguagacauugaggggcccagauaagcuggaaggguucccuugucc

SEQ ID NO: 88863 - RNA, 64 nt, Homo Sapiens
agagauggaagccaggacaagggagcccaccgggcccagauagagacuucagaacccacuccug

SEQ ID NO: 88864 - RNA, 64 nt, Homo Sapiens
uuuugaaaaaucccuccaagugauucuuuuacaucccagauagaaaacccuaaauuaaagguga

SEQ ID NO: 88865 - RNA, 64 nt, Homo Sapiens
gcugaugggccgggcauguuugcagggccucuugcugcuuaagauguccagccagccagccagc

SEQ ID NO: 88866 - RNA, 64 nt, Homo Sapiens
gugcuguccagccagccagcgaggaugcagccaccugcuuaacuaugggcugccagcaacugca

SEQ ID NO: 88867 - RNA, 64 nt, Homo Sapiens
aacuauuuuaccaagaaaaaucucagcuugcuuacugcuuaauuaaaaaccuacaauuuacaca

SEQ ID NO: 88868 - RNA, 64 nt, Homo Sapiens
ucccugccuucaagacugugagcuuuggauagcccugcuuaaauguuugucaacaacaagaguc

SEQ ID NO: 88869 - RNA, 64 nt, Homo Sapiens
gaauaucaagucccagccccugcaacccaggcugcugcuuaauuuucaugucaguaucaucaaa

SEQ ID NO: 88870 - RNA, 64 nt, Homo Sapiens
aauuuucaugucaguaucaucaaaauccaauguucugcuuaaacucaagauggaaaguccaguc

SEQ ID NO: 88871 - RNA, 64 nt, Homo Sapiens
acaaacuuuguauaauagcaaaucgggaaggggacugcuuaaaauguuaaugcaguguuuuucu

SEQ ID NO: 88872 - RNA, 64 nt, Homo Sapiens
uauuuuauaaacauuuuuauaauauauuauuuuacugcuuaaauuccaaguccugaaguagaug

SEQ ID NO: 88873 - RNA, 64 nt, Homo Sapiens
aaagucggggguuguuaggcuuuucugccugcuccugcuuaaacacaagaaggaauccuggauu

SEQ ID NO: 88874 - RNA, 64 nt, Homo Sapiens
uaaagugauacgauaauauuacucuugauugcugcugcuuaauuugauguaauauguuuaaagu

SEQ ID NO: 88875 - RNA, 64 nt, Homo Sapiens
agcucaguauuguguggacacuuacgagaguuuucugcuuaauugaaguguaauauagguugua

SEQ ID NO: 88876 - RNA, 64 nt, Homo Sapiens
ggcucccaagagagaggccuuuucaguugagacucugcuuaagagaagauccaaaguuaaagcu

SEQ ID NO: 88877 - RNA, 64 nt, Homo Sapiens
ugugggcgugcccggaagcagagcgccacacucgcugcuuaagcucccccagcucuuuccagaa

SEQ ID NO: 88878 - RNA, 64 nt, Homo Sapiens
ucgcaacugggccccuuucaaggcuguuuaaacgcugcuuaaaguaaaugcuggacacggaggc

SEQ ID NO: 88879 - RNA, 64 nt, Homo Sapiens
ugggggcugccaugaggggguugcagccggccugcugcuuaaggaaccacccucggaugauggg

SEQ ID NO: 88880 - RNA, 64 nt, Homo Sapiens
auguaagccaagcuaaaugauuaggaaaaugucccugcuuaauaagcucugcuuaauguacuac

SEQ ID NO: 88881 - RNA, 64 nt, Homo Sapiens
uacuacuuaggaaaaugucccauuuacuguagcucugcuuaaugugggaguaauacugacaauc

SEQ ID NO: 88882 - RNA, 64 nt, Homo Sapiens; identical to SEQ ID NO: 86383

SEQ ID NO: 88883 - RNA, 64 nt, Homo Sapiens; identical to SEQ ID NO: 86384

SEQ ID NO: 88884 - RNA, 64 nt, Homo Sapiens; identical to SEQ ID NO: 86385

SEQ ID NO: 88885 - RNA, 64 nt, Homo Sapiens; identical to SEQ ID NO: 86386

SEQ ID NO: 88886 - RNA, 64 nt, Homo Sapiens; identical to SEQ ID NO: 86387

SEQ ID NO: 88887 - RNA, 64 nt, Homo Sapiens; identical to SEQ ID NO: 86388

SEQ ID NO: 88888 - RNA, 64 nt, Homo Sapiens; identical to SEQ ID NO: 86389

SEQ ID NO: 88889 - RNA, 64 nt, Homo Sapiens; identical to SEQ ID NO: 86390

SEQ ID NO: 88890 - RNA, 64 nt, Homo Sapiens; identical to SEQ ID NO: 86391

SEQ ID NO: 88891 - RNA, 64 nt, Homo Sapiens; identical to SEQ ID NO: 86392

SEQ ID NO: 88892 - RNA, 64 nt, Homo Sapiens; identical to SEQ ID NO: 86393

SEQ ID NO: 88893 - RNA, 64 nt, Homo Sapiens; identical to SEQ ID NO: 86394

SEQ ID NO: 88894 - RNA, 61 nt, Homo Sapiens; identical to SEQ ID NO: 86395

SEQ ID NO: 88895 - RNA, 64 nt, Homo Sapiens; identical to SEQ ID NO: 86396

SEQ ID NO: 88896 - RNA, 64 nt, Homo Sapiens; identical to SEQ ID NO: 86397

SEQ ID NO: 88897 - RNA, 64 nt, Homo Sapiens; identical to SEQ ID NO: 86398

SEQ ID NO: 88898 - RNA, 64 nt, Homo Sapiens; identical to SEQ ID NO: 86399

SEQ ID NO: 88899 - RNA, 64 nt, Homo Sapiens; identical to SEQ ID NO: 86400

SEQ ID NO: 88900 - RNA, 64 nt, Homo Sapiens; identical to SEQ ID NO: 86401

SEQ ID NO: 88901 - RNA, 64 nt, Homo Sapiens; identical to SEQ ID NO: 86402

SEQ ID NO: 88902 - RNA, 64 nt, Homo Sapiens; identical to SEQ ID NO: 86403

SEQ ID NO: 88903 - RNA, 64 nt, Homo Sapiens; identical to SEQ ID NO: 86404

SEQ ID NO: 88904 - RNA, 64 nt, Homo Sapiens; identical to SEQ ID NO: 86405

SEQ ID NO: 88905 - RNA, 64 nt, Homo Sapiens; identical to SEQ ID NO: 86406

SEQ ID NO: 88906 - RNA, 64 nt, Homo Sapiens; identical to SEQ ID NO: 86407

SEQ ID NO: 88907 - RNA, 64 nt, Homo Sapiens; identical to SEQ ID NO: 86408

SEQ ID NO: 88908 - RNA, 64 nt, Homo Sapiens; identical to SEQ ID NO: 86409

SEQ ID NO: 88909 - RNA, 64 nt, Homo Sapiens; identical to SEQ ID NO: 86410

SEQ ID NO: 88910 - RNA, 64 nt, Homo Sapiens; identical to SEQ ID NO: 86411

SEQ ID NO: 88911 - RNA, 64 nt, Homo Sapiens; identical to SEQ ID NO: 86412

SEQ ID NO: 88912 - RNA, 64 nt, Homo Sapiens; identical to SEQ ID NO: 86413

SEQ ID NO: 88913 - RNA, 64 nt, Homo Sapiens; identical to SEQ ID NO: 86414

SEQ ID NO: 88914 - RNA, 64 nt, Homo Sapiens; identical to SEQ ID NO: 86415

SEQ ID NO: 88915 - RNA, 64 nt, Homo Sapiens; identical to SEQ ID NO: 86416

SEQ ID NO: 88916 - RNA, 64 nt, Homo Sapiens; identical to SEQ ID NO: 86417

SEQ ID NO: 88917 - RNA, 64 nt, Homo Sapiens; identical to SEQ ID NO: 86418

SEQ ID NO: 88918 - RNA, 64 nt, Homo Sapiens; identical to SEQ ID NO: 86419

SEQ ID NO: 88919 - RNA, 64 nt, Homo Sapiens; identical to SEQ ID NO: 86420

SEQ ID NO: 88920 - RNA, 64 nt, Homo Sapiens; identical to SEQ ID NO: 86421

SEQ ID NO: 88921 - RNA, 64 nt, Homo Sapiens; identical to SEQ ID NO: 86422

SEQ ID NO: 88922 - RNA, 64 nt, Homo Sapiens; identical to SEQ ID NO: 86423

SEQ ID NO: 88923 - RNA, 64 nt, Homo Sapiens; identical to SEQ ID NO: 86424

SEQ ID NO: 88924 - RNA, 64 nt, Homo Sapiens; identical to SEQ ID NO: 86425

SEQ ID NO: 88925 - RNA, 64 nt, Homo Sapiens; identical to SEQ ID NO: 86426

SEQ ID NO: 88926 - RNA, 64 nt, Homo Sapiens; identical to SEQ ID NO: 86427

SEQ ID NO: 88927 - RNA, 64 nt, Homo Sapiens; identical to SEQ ID NO: 86428

SEQ ID NO: 88928 - RNA, 64 nt, Homo Sapiens; identical to SEQ ID NO: 86429

SEQ ID NO: 88929 - RNA, 64 nt, Homo Sapiens; identical to SEQ ID NO: 86430

SEQ ID NO: 88930 - RNA, 64 nt, Homo Sapiens; identical to SEQ ID NO: 86431

SEQ ID NO: 88931 - RNA, 64 nt, Homo Sapiens; identical to SEQ ID NO: 86432

SEQ ID NO: 88932 - RNA, 64 nt, Homo Sapiens; identical to SEQ ID NO: 86433

SEQ ID NO: 88933 - RNA, 64 nt, Homo Sapiens; identical to SEQ ID NO: 86434

SEQ ID NO: 88934 - RNA, 64 nt, Homo Sapiens; identical to SEQ ID NO: 86435

SEQ ID NO: 88935 - RNA, 64 nt, Homo Sapiens; identical to SEQ ID NO: 86436

SEQ ID NO: 88936 - RNA, 64 nt, Homo Sapiens; identical to SEQ ID NO: 86437

SEQ ID NO: 88937 - RNA, 64 nt, Homo Sapiens; identical to SEQ ID NO: 86438

SEQ ID NO: 88938 - RNA, 64 nt, Homo Sapiens; identical to SEQ ID NO: 86439

SEQ ID NO: 88939 - RNA, 64 nt, Homo Sapiens; identical to SEQ ID NO: 86440

SEQ ID NO: 88940 - RNA, 64 nt, Homo Sapiens; identical to SEQ ID NO: 86441

SEQ ID NO: 88941 - RNA, 64 nt, Homo Sapiens; identical to SEQ ID NO: 86442

SEQ ID NO: 88942 - RNA, 64 nt, Homo Sapiens; identical to SEQ ID NO: 86443

SEQ ID NO: 88943 - RNA, 64 nt, Homo Sapiens; identical to SEQ ID NO: 86444

SEQ ID NO: 88944 - RNA, 64 nt, Homo Sapiens; identical to SEQ ID NO: 86445

SEQ ID NO: 88945 - RNA, 60 nt, Homo Sapiens; identical to SEQ ID NO: 86446

SEQ ID NO: 88946 - RNA, 64 nt, Homo Sapiens; identical to SEQ ID NO: 86447

SEQ ID NO: 88947 - RNA, 64 nt, Homo Sapiens; identical to SEQ ID NO: 86448

SEQ ID NO: 88948 - RNA, 64 nt, Homo Sapiens; identical to SEQ ID NO: 86449

SEQ ID NO: 88949 - RNA, 64 nt, Homo Sapiens; identical to SEQ ID NO: 86450

SEQ ID NO: 88950 - RNA, 64 nt, Homo Sapiens; identical to SEQ ID NO: 86451

SEQ ID NO: 88951 - RNA, 64 nt, Homo Sapiens; identical to SEQ ID NO: 86452

SEQ ID NO: 88952 - RNA, 64 nt, Homo Sapiens; identical to SEQ ID NO: 86453

SEQ ID NO: 88953 - RNA, 64 nt, Homo Sapiens; identical to SEQ ID NO: 86454

SEQ ID NO: 88954 - RNA, 64 nt, Homo Sapiens; identical to SEQ ID NO: 86455

SEQ ID NO: 88955 - RNA, 64 nt, Homo Sapiens; identical to SEQ ID NO: 86456

SEQ ID NO: 88956 - RNA, 64 nt, Homo Sapiens; identical to SEQ ID NO: 86457

SEQ ID NO: 88957 - RNA, 64 nt, Homo Sapiens; identical to SEQ ID NO: 86458

SEQ ID NO: 88958 - RNA, 64 nt, Homo Sapiens; identical to SEQ ID NO: 86459

SEQ ID NO: 88959 - RNA, 64 nt, Homo Sapiens; identical to SEQ ID NO: 86460

SEQ ID NO: 88960 - RNA, 64 nt, Homo Sapiens; identical to SEQ ID NO: 86461

SEQ ID NO: 88961 - RNA, 55 nt, Homo Sapiens; identical to SEQ ID NO: 86462

SEQ ID NO: 88962 - RNA, 64 nt, Homo Sapiens; identical to SEQ ID NO: 86463

SEQ ID NO: 88963 - RNA, 64 nt, Homo Sapiens; identical to SEQ ID NO: 86464

SEQ ID NO: 88964 - RNA, 64 nt, Homo Sapiens; identical to SEQ ID NO: 86465

SEQ ID NO: 88965 - RNA, 64 nt, Homo Sapiens; identical to SEQ ID NO: 86466

SEQ ID NO: 88966 - RNA, 64 nt, Homo Sapiens; identical to SEQ ID NO: 86467

SEQ ID NO: 88967 - RNA, 64 nt, Homo Sapiens; identical to SEQ ID NO: 86468

SEQ ID NO: 88968 - RNA, 64 nt, Homo Sapiens; identical to SEQ ID NO: 86469

SEQ ID NO: 88969 - RNA, 64 nt, Homo Sapiens; identical to SEQ ID NO: 86470

SEQ ID NO: 88970 - RNA, 64 nt, Homo Sapiens; identical to SEQ ID NO: 86471

SEQ ID NO: 88971 - RNA, 64 nt, Homo Sapiens; identical to SEQ ID NO: 86472

SEQ ID NO: 88972 - RNA, 64 nt, Homo Sapiens; identical to SEQ ID NO: 86473

SEQ ID NO: 88973 - RNA, 64 nt, Homo Sapiens; identical to SEQ ID NO: 86474

SEQ ID NO: 88974 - RNA, 64 nt, Homo Sapiens; identical to SEQ ID NO: 86475

SEQ ID NO: 88975 - RNA, 64 nt, Homo Sapiens; identical to SEQ ID NO: 86476

SEQ ID NO: 88976 - RNA, 64 nt, Homo Sapiens; identical to SEQ ID NO: 86477

SEQ ID NO: 88977 - RNA, 64 nt, Homo Sapiens; identical to SEQ ID NO: 86478

SEQ ID NO: 88978 - RNA, 64 nt, Homo Sapiens; identical to SEQ ID NO: 86479

SEQ ID NO: 88979 - RNA, 64 nt, Homo Sapiens; identical to SEQ ID NO: 86480

SEQ ID NO: 88980 - RNA, 64 nt, Homo Sapiens; identical to SEQ ID NO: 86481

SEQ ID NO: 88981 - RNA, 64 nt, Homo Sapiens; identical to SEQ ID NO: 86482

SEQ ID NO: 88982 - RNA, 64 nt, Homo Sapiens; identical to SEQ ID NO: 86483

SEQ ID NO: 88983 - RNA, 64 nt, Homo Sapiens; identical to SEQ ID NO: 86484

SEQ ID NO: 88984 - RNA, 64 nt, Homo Sapiens; identical to SEQ ID NO: 86485

SEQ ID NO: 88985 - RNA, 64 nt, Homo Sapiens; identical to SEQ ID NO: 86486

SEQ ID NO: 88986 - RNA, 64 nt, Homo Sapiens; identical to SEQ ID NO: 86487

SEQ ID NO: 88987 - RNA, 64 nt, Homo Sapiens; identical to SEQ ID NO: 86488

SEQ ID NO: 88988 - RNA, 64 nt, Homo Sapiens; identical to SEQ ID NO: 86489

SEQ ID NO: 88989 - RNA, 64 nt, Homo Sapiens; identical to SEQ ID NO: 86490

SEQ ID NO: 88990 - RNA, 64 nt, Homo Sapiens; identical to SEQ ID NO: 86491

SEQ ID NO: 88991 - RNA, 64 nt, Homo Sapiens; identical to SEQ ID NO: 86492

SEQ ID NO: 88992 - RNA, 64 nt, Homo Sapiens; identical to SEQ ID NO: 86493

SEQ ID NO: 88993 - RNA, 51 nt, Homo Sapiens; identical to SEQ ID NO: 86494

SEQ ID NO: 88994 - RNA, 64 nt, Homo Sapiens; identical to SEQ ID NO: 86495

SEQ ID NO: 88995 - RNA, 64 nt, Homo Sapiens; identical to SEQ ID NO: 86496

SEQ ID NO: 88996 - RNA, 64 nt, Homo Sapiens; identical to SEQ ID NO: 86497

SEQ ID NO: 88997 - RNA, 64 nt, Homo Sapiens; identical to SEQ ID NO: 86498

SEQ ID NO: 88998 - RNA, 64 nt, Homo Sapiens; identical to SEQ ID NO: 86499

SEQ ID NO: 88999 - RNA, 64 nt, Homo Sapiens; identical to SEQ ID NO: 86500

SEQ ID NO: 89000 - RNA, 64 nt, Homo Sapiens; identical to SEQ ID NO: 86501

SEQ ID NO: 89001 - RNA, 64 nt, Homo Sapiens; identical to SEQ ID NO: 86502

SEQ ID NO: 89002 - RNA, 64 nt, Homo Sapiens; identical to SEQ ID NO: 86503

SEQ ID NO: 89003 - RNA, 64 nt, Homo Sapiens; identical to SEQ ID NO: 86504

SEQ ID NO: 89004 - RNA, 64 nt, Homo Sapiens; identical to SEQ ID NO: 86505

SEQ ID NO: 89005 - RNA, 64 nt, Homo Sapiens; identical to SEQ ID NO: 86506

SEQ ID NO: 89006 - RNA, 64 nt, Homo Sapiens; identical to SEQ ID NO: 86507

SEQ ID NO: 89007 - RNA, 64 nt, Homo Sapiens; identical to SEQ ID NO: 86508

SEQ ID NO: 89008 - RNA, 64 nt, Homo Sapiens; identical to SEQ ID NO: 86509

SEQ ID NO: 89009 - RNA, 64 nt, Homo Sapiens; identical to SEQ ID NO: 86510

SEQ ID NO: 89010 - RNA, 64 nt, Homo Sapiens; identical to SEQ ID NO: 86511

SEQ ID NO: 89011 - RNA, 64 nt, Homo Sapiens; identical to SEQ ID NO: 86512

SEQ ID NO: 89012 - RNA, 64 nt, Homo Sapiens; identical to SEQ ID NO: 86513

SEQ ID NO: 89013 - RNA, 64 nt, Homo Sapiens; identical to SEQ ID NO: 86514

SEQ ID NO: 89014 - RNA, 64 nt, Homo Sapiens; identical to SEQ ID NO: 86515

SEQ ID NO: 89015 - RNA, 64 nt, Homo Sapiens; identical to SEQ ID NO: 86516

SEQ ID NO: 89016 - RNA, 64 nt, Homo Sapiens; identical to SEQ ID NO: 86517

SEQ ID NO: 89017 - RNA, 64 nt, Homo Sapiens; identical to SEQ ID NO: 86518

SEQ ID NO: 89018 - RNA, 64 nt, Homo Sapiens; identical to SEQ ID NO: 86519

SEQ ID NO: 89019 - RNA, 64 nt, Homo Sapiens; identical to SEQ ID NO: 86520

SEQ ID NO: 89020 - RNA, 64 nt, Homo Sapiens; identical to SEQ ID NO: 86521

SEQ ID NO: 89021 - RNA, 64 nt, Homo Sapiens; identical to SEQ ID NO: 86522

SEQ ID NO: 89022 - RNA, 64 nt, Homo Sapiens; identical to SEQ ID NO: 86523

SEQ ID NO: 89023 - RNA, 64 nt, Homo Sapiens; identical to SEQ ID NO: 86524

SEQ ID NO: 89024 - RNA, 64 nt, Homo Sapiens; identical to SEQ ID NO: 86525

SEQ ID NO: 89025 - RNA, 64 nt, Homo Sapiens
aguauaucuucuuugggguuauuuuuuuuuguuaugucacaaucguuuaagccuacaaucauug

SEQ ID NO: 89026 - RNA, 64 nt, Homo Sapiens
uggcaaaaugcugaaaguuugaauacuuaaacacugucacaagagaacgaaaguaaagauguuu

SEQ ID NO: 89027 - RNA, 64 nt, Homo Sapiens
uagcccaagccugucuuucccagcgucauguuugugucacaaaagcaguuauuuuaaaaucuga

SEQ ID NO: 89028 - RNA, 64 nt, Homo Sapiens
acuaccccuaaccugccaggaugcucaaguccacugucacaaucccuuucagaaaacauuagug

SEQ ID NO: 89029 - RNA, 64 nt, Homo Sapiens
uucuuaaacaugcugucccaacauuugugaguugugucacaagugagucauuaucaaugguaga

SEQ ID NO: 89030 - RNA, 64 nt, Homo Sapiens
uauuuuuagaaggaggaaaaguagauacgcaaauugucacaacuaagagugauaauuugguagc

SEQ ID NO: 89031 - RNA, 64 nt, Homo Sapiens
acagaagagagaaauauugucuccaaauaaacagugucacaaguaccuacuaaacagaaaaugc

SEQ ID NO: 89032 - RNA, 64 nt, Homo Sapiens
ccucaaucugaaacaaugagguggaagccaaaauugucacaauuuagguaaugugagcaaagau

SEQ ID NO: 89033 - RNA, 64 nt, Homo Sapiens
aaagacacugguguaucucagaaggggaugguguugucacaaacugugguuaauccaaucaauu

SEQ ID NO: 89034 - RNA, 64 nt, Homo Sapiens
caaccaguaggauauuucuacaagguguucauuuugucacaagcuguagauaacagcaagagau

SEQ ID NO: 89035 - RNA, 64 nt, Homo Sapiens
cucaguguggccugagaaaugauuauucacugccugucacaagcacauaagaaccauggccuug

SEQ ID NO: 89036 - RNA, 64 nt, Homo Sapiens
aguuaaugugauuaagauuuaucucauuggaacaugucacaaaacccaaauuauaaaugugaca

SEQ ID NO: 89037 - RNA, 64 nt, Homo Sapiens
ucaugguguagggaaacuugacuaauguaaugauugucacaaagucuucaguaacgcuacaacg

SEQ ID NO: 89038 - RNA, 64 nt, Homo Sapiens
ugcaaaacauaggagaauucaugcaggagagaaaugucacaagugugaugaguguugcaaagcc

SEQ ID NO: 89039 - RNA, 64 nt, Homo Sapiens
aggcaugccccuuagaagacaagggcagagacacugucacaaaccacacacacccucaugugug

SEQ ID NO: 89040 - RNA, 64 nt, Homo Sapiens
cggcaggcacuggugaggaggcagucaaagccacugucacaagccgcuuaagacaccucugcau

SEQ ID NO: 89041 - RNA, 64 nt, Homo Sapiens
guucuucaauauauagauaucauacuguaguguacaguauuauauuuccuaauuuuauuuauuu

SEQ ID NO: 89042 - RNA, 64 nt, Homo Sapiens
ccaaacuguuuuugcaacaauucauuaauuuugucaguauuacauuauuuucuguacuuuuuug

SEQ ID NO: 89043 - RNA, 64 nt, Homo Sapiens
agaauaggcagcaguuccuuugaagcacccaugucaguauuagaguuaagcucacccuguucuu

SEQ ID NO: 89044 - RNA, 64 nt, Homo Sapiens
auuccucuguacuuuccuuugcacuacaaugcaucaguauuaugcuuuuuaauuuaaugugcuc

SEQ ID NO: 89045 - RNA, 64 nt, Homo Sapiens
augucucccucucagggguaucuguccagccccucaguauuaccgcuugaggcucagaagagcc

SEQ ID NO: 89046 - RNA, 64 nt, Homo Sapiens
gaauagucccagcuggagagacuuccccuuuucccaguauuacuccaggguccuucccugcccc

SEQ ID NO: 89047 - RNA, 64 nt, Homo Sapiens
gauauucagcaaaaguauuauuuucugauauaugcaguauuacauuaucuuacugguucaacau

SEQ ID NO: 89048 - RNA, 64 nt, Homo Sapiens
ggaccaaauuugguguuuguuaacaaagagcaaucaguauuauuuaccuguaucaaaggaauuu

SEQ ID NO: 89049 - RNA, 64 nt, Homo Sapiens
uuacccucuguaagauacugauucuuccuggggccaguauuaccuuguaugcaaauauuacaua

SEQ ID NO: 89050 - RNA, 64 nt, Homo Sapiens
auacagauguacuagcuaaagucucuuuaugugucaguauuaagaguaauauguagccagauua

SEQ ID NO: 89051 - RNA, 64 nt, Homo Sapiens
uauuuguaaaaaccauuguuuuuugagcaccuuucaguauuaugcaauucuguaaguggugacu

SEQ ID NO: 89052 - RNA, 64 nt, Homo Sapiens
guuauauauauaguuaauauauuaccccccauugcaguauuauuacuuguuaggaaguagcuua

SEQ ID NO: 89053 - RNA, 64 nt, Homo Sapiens
augaaggcugugcgaccaucaggcuguguuaggacaguauuagcaaaggaaaucgccuagcucc

SEQ ID NO: 89054 - RNA, 64 nt, Homo Sapiens
cguucuagaaagccacuguugcauucacucggggcaguauuaacucauucguaccaugccaaac

SEQ ID NO: 89055 - RNA, 64 nt, Homo Sapiens
gacuugccaaacagucuuuuaugaaggaaaguuacaguauuaauuuuugaaaagguuuuuuuua

SEQ ID NO: 89056 - RNA, 64 nt, Homo Sapiens
gacccuacaacugcccugggacauuucacuguaccaguauuaacugcaaacagcaauaauuguc

SEQ ID NO: 89057 - RNA, 64 nt, Homo Sapiens
acccuuaugagaagugaagguuuuguaaacuuuccaguauuaauuugggcggguauuccccgcu

SEQ ID NO: 89058 - RNA, 64 nt, Homo Sapiens
ugauauuaagaucaaagggaggaagggaagacagcaguauuaauucacccuagauuacucaauu

SEQ ID NO: 89059 - RNA, 64 nt, Homo Sapiens
uuauaaccaauucuaaaauuuauuauuuuuaaagcaguauuauucauaauuaaacuauuucugc

SEQ ID NO: 89060 - RNA, 64 nt, Homo Sapiens
acaguaucugcagauacuauaaaaucuauguuuucaguauuaugcauacacuucuuaaaaugug

SEQ ID NO: 89061 - RNA, 64 nt, Homo Sapiens
gauucacuuuguguguguuagugcucuaaaguagcaguauuauuauuaaacuguccccagagua

SEQ ID NO: 89062 - RNA, 64 nt, Homo Sapiens
ucaugaacuuugagaaugggcuuccuuuuugguucaguauuagugagagggagagggagaugga

SEQ ID NO: 89063 - RNA, 64 nt, Homo Sapiens
ucauuuaaucuuuacuacacuccugcaacauagacaguauuauuacauucaguauuacaauggc

SEQ ID NO: 89064 - RNA, 64 nt, Homo Sapiens
uacacuccugcaacauagacaguauuauuacauucaguauuacaauggcagaaacagacagaaa

SEQ ID NO: 89065 - RNA, 64 nt, Homo Sapiens
gucagugguacacagacauuacuuuauagaaguacaguauuaaauacaauauuuauaacuauaa

SEQ ID NO: 89066 - RNA, 64 nt, Homo Sapiens
auaagcaguugcuucaaaauagcgucuuaaacagcaguauuacuguucuaaucauuucagcagu

SEQ ID NO: 89067 - RNA, 64 nt, Homo Sapiens
cuucucugucucaugugugcucuucuucuuucuacaguauuauguacucuacugauaucuaaau

SEQ ID NO: 89068 - RNA, 64 nt, Homo Sapiens
acauuuugccaaaauuauuaauauaagaagcuuucaguauuagugaugucaucugucacuauag

SEQ ID NO: 89069 - RNA, 64 nt, Homo Sapiens
uguaaagucauuguuuaaaguguugcucucuucacaguauuaugacaguaucuuacaaaaaacg

SEQ ID NO: 89070 - RNA, 64 nt, Homo Sapiens
guuuugcuaagccgcuucauagaugaugucuugucaguauuacuccauguuagcucauggugua

SEQ ID NO: 89071 - RNA, 64 nt, Homo Sapiens
agggccaggaguggcguuuccgcacaggauuuccuaagacgagagggauuuagccaagagcaca

SEQ ID NO: 89072 - RNA, 64 nt, Homo Sapiens
auaccuucaguuugaaucuguuuuuauaucucaguaagacgaggcuugcaacucuuaguguuua

SEQ ID NO: 89073 - RNA, 64 nt, Homo Sapiens
uuuuggaauaacuuggaaguaagguucauucccuuaagacgauggauucuguugaacuaugggg

SEQ ID NO: 89074 - RNA, 64 nt, Homo Sapiens
gucauuuccacuuggaaaguaagucuacuguagauaagacgauucuugaacacuaccucuugug

SEQ ID NO: 89075 - RNA, 64 nt, Homo Sapiens
aucucuucuauuaaauuacaaaaucauuaaauauuaagacgaccauggacugggaaguucuuuu

SEQ ID NO: 89076 - RNA, 64 nt, Homo Sapiens
gcauuauuacauuuugugaaugguguucagccuauaagacgaagucucacaagaccuauaggaa

SEQ ID NO: 89077 - RNA, 64 nt, Homo Sapiens
gauuuagguacgucaaagcauuuccucugacauguaagacgaauggagaacuauccaaaacuaa

SEQ ID NO: 89078 - RNA, 64 nt, Homo Sapiens
aucauuccccccgugaagucugcuuaccaaaacauaagacgacuuauauauuugaaagaaguca

SEQ ID NO: 89079 - RNA, 64 nt, Homo Sapiens
ugacugcacaagagcacugcuuuuccccuuccuguaagacgauguuguuuugaacagaacuguu

SEQ ID NO: 89080 - RNA, 64 nt, Homo Sapiens
guuauguaaaguuucucgguguguucuguuaauguaagacgaugaacaguuguguauaguguuu

SEQ ID NO: 89081 - RNA, 64 nt, Homo Sapiens
agcaugaagcauaucugggaauaucuuuugccuuuaagacgauucauucuugucuagagggaaa

SEQ ID NO: 89082 - RNA, 64 nt, Homo Sapiens
auauccucauauuuuuaccauauuuuaagaacuuuaagacgauuaauuguaaauaauuuauuug

SEQ ID NO: 89083 - RNA, 64 nt, Homo Sapiens
uuggaucacggcuugguucaauacaaaacugauguaagacgaacugcaaagucuugccagagau

SEQ ID NO: 89084 - RNA, 64 nt, Homo Sapiens
caggaucuacuauauuagaauacauguauucuuauaagacgaccuaugaucuuuuaaguuucua

SEQ ID NO: 89085 - RNA, 64 nt, Homo Sapiens
augaauaaaacuuuaaauuguaaauuuauuuuaauaagacgaucagacagguuguuuuugcaau

SEQ ID NO: 89086 - RNA, 64 nt, Homo Sapiens
uuaaucuuuaauuuuacauuuccuaaauauauuuuaagacgaaacauuuguucuauagcuuuuc

SEQ ID NO: 89087 - RNA, 64 nt, Homo Sapiens
ggcgaaaacuuuucugaaaauuugugucaucaccuaagacgauuucuguaacaaucucaaggca

SEQ ID NO: 89088 - RNA, 64 nt, Homo Sapiens
uaauuuuaauuucauaggauugcauuuuuaaaaauaagacgauugucuacugucuggcuucuuu

SEQ ID NO: 89089 - RNA, 64 nt, Homo Sapiens
uuuaaucuaaaaguacuuucugccauaauucacauaagacgaauaacaguggggugauuucauu

SEQ ID NO: 89090 - RNA, 64 nt, Homo Sapiens
acauauauauaauauauaugaagacuguaaauguuaagacgacuaguguucuuauuaguauauu

SEQ ID NO: 89091 - RNA, 64 nt, Homo Sapiens
ggacgagcgauugagguguaugucuguguuuuaauaagacgagaugucaaaaaguuugguucug

SEQ ID NO: 89092 - RNA, 64 nt, Homo Sapiens
ccucuccuacucucuguggcaguuucauauuugcuaagacgaauuugcucauuaaacauuuugu

SEQ ID NO: 89093 - RNA, 64 nt, Homo Sapiens
uaaccuacuuacuccguaaggacauuuuagucaguaagacgauaaggaguuuuauauuaaggga

SEQ ID NO: 89094 - RNA, 64 nt, Homo Sapiens
cugcaguccaccuguuuguauucuugucauuuuguaagacgaccaauuuuuccaauagauuuca

SEQ ID NO: 89095 - RNA, 64 nt, Homo Sapiens
gggccuggaagaccaucccagccucugaguucucuuugaguaugagugauuacuuggauuuuag

SEQ ID NO: 89096 - RNA, 64 nt, Homo Sapiens
cccucuccccauugccccacaaccuuacucuaaauuugaguagagaaaagcuccuaaagugacc

SEQ ID NO: 89097 - RNA, 64 nt, Homo Sapiens
guuuuguugaaggaucaaccccaaauucuggguauuugaguacaugugaaucauggauuuggua

SEQ ID NO: 89098 - RNA, 64 nt, Homo Sapiens
guugucugaaaggugugguuuuauugaaugucuauuugaguaucauuuaaaaaguauuugccuu

SEQ ID NO: 89099 - RNA, 64 nt, Homo Sapiens
ugucaggaaauaaggucacuuuaugucaaaauuauuugaguacuaugggaccuggcgcaguggc

SEQ ID NO: 89100 - RNA, 64 nt, Homo Sapiens
acaacaacaacaacaacaacaaaccacaaaauuauuugaguacugugaaggauuauuugucuaa

SEQ ID NO: 89101 - RNA, 64 nt, Homo Sapiens
ccuauaugucaccuagggaaugugugguaagagguuugaguagugacugcgugaucgugcacuu

SEQ ID NO: 89102 - RNA, 64 nt, Homo Sapiens
ucugaugagugaugcuugccguguuuauaaaauguuugaguauuuggugucuugccccauucuu

SEQ ID NO: 89103 - RNA, 64 nt, Homo Sapiens
ccucuaguugacuuuucucugaggaagucaguuauuugaguaaguguuuguggggagagggaag

SEQ ID NO: 89104 - RNA, 64 nt, Homo Sapiens
aaaaaaaucuucugcugcaccugaauucagguccuuugaguaaaaacuuaaaaggacaugccca

SEQ ID NO: 89105 - RNA, 64 nt, Homo Sapiens
aauaauuaaaccauaaggaagaugccuuuuguguuuugaguaagugcauaagaaagagaaaaga

SEQ ID NO: 89106 - RNA, 64 nt, Homo Sapiens
uggcuguauuuguugaguauuuugcucugaagguuuugaguaccauuuagguaagcaggcuucc

SEQ ID NO: 89107 - RNA, 64 nt, Homo Sapiens
gaugggaguuucaccauguuacuaauuuuuguauuuugaguagaggugugcgccaccaugcccg

SEQ ID NO: 89108 - RNA, 64 nt, Homo Sapiens
cagauuccuuguaucacuuguaggugauguggccuuugaguauggacaaaguaaagguggaaac

SEQ ID NO: 89109 - RNA, 64 nt, Homo Sapiens
cccuccaaagauaccauucaguauuguggguucauuugaguaaguauaagcuguaauaguggag

SEQ ID NO: 89110 - RNA, 64 nt, Homo Sapiens
ugcacauuuaaaaaauaucaguuuguaccaucuguuugaguauauuaugauuugaaaguuggaa

SEQ ID NO: 89111 - RNA, 64 nt, Homo Sapiens
gggugcuggggggacggggugaguggaaacuuaguuugaguaaugaaggaaucuucacagaagc

SEQ ID NO: 89112 - RNA, 64 nt, Homo Sapiens
cuccccuuguaagggaauucuggggcagcuaugguuugaguaugcaguuugcaucguguuucua

SEQ ID NO: 89113 - RNA, 64 nt, Homo Sapiens
uuuauaaugucucuuuuaaacgugccuggccucauuugaguauuggauuacaggcaugagccac

SEQ ID NO: 89114 - RNA, 64 nt, Homo Sapiens
uuuuuuuuuuuuuuuuuuuucuacaccuggcacauuugaguauuagugcugggauuacaggcca

SEQ ID NO: 89115 - RNA, 64 nt, Homo Sapiens
acuguccuacccuuuuuuauucucaaauguuuguuuugaguaaccguagugccaaaauuucagu

SEQ ID NO: 89116 - RNA, 64 nt, Homo Sapiens
uguccuuuuuaugaguguuuauauuuuaaaguacuuugaguauuuuugggggggguguaaauga

SEQ ID NO: 89117 - RNA, 63 nt, Homo Sapiens
cccgccucuuccccuuucugucccgggauaccuggcggcaagagacuucuuggcuauugucca

SEQ ID NO: 89118 - RNA, 63 nt, Homo Sapiens
guuaucuccucucauacaucaagccccagaggaggcggcaagaggaacagccacaaacaagua

SEQ ID NO: 89119 - RNA, 63 nt, Homo Sapiens
aggauguaacauaaugaaacacaccugucuaggggcggcaaucaacagucuuacacagagagg

SEQ ID NO: 89120 - RNA, 63 nt, Homo Sapiens
uugaagacguggacggaggaccgccagcacaguggcggcaacaaugcggaaggauugcaaugc

SEQ ID NO: 89121 - RNA, 63 nt, Homo Sapiens
ugauaugucugcaugcaaaguggaacagaguugggcggcaaugacagaagagcuuccuuggcc

SEQ ID NO: 89122 - RNA, 63 nt, Homo Sapiens
gcgagaccaaauaucauuuuuagaggaagccagggcggcaaauuuccagaaacuuuauauggg

SEQ ID NO: 89123 - RNA, 63 nt, Homo Sapiens
ugcaagaaggagggacugucgagggcggcccuuggcggcaacauauccacccccagcccaacc

SEQ ID NO: 89124 - RNA, 63 nt, Homo Sapiens
augggguggagggggccaccggggcagggagggggcggcaaggggggaaugggaguugucucc

SEQ ID NO: 89125 - RNA, 63 nt, Homo Sapiens
cucuagagggcuggugauugaggggcccgggcuggcggcaaagagggguuuggucucggggcu

SEQ ID NO: 89126 - RNA, 53 nt, Homo Sapiens
agcuccaagacucaaaguagcccggcggcaagaggcccauguuccggagagaa

SEQ ID NO: 89127 - RNA, 63 nt, Homo Sapiens
gaagcccugacaacaacuaucaccaaaagacgaggcggcaaagauccagcggggcuucugggc

SEQ ID NO: 89128 - RNA, 63 nt, Homo Sapiens
caccaccccagcccccacccauaaagacagaagggcggcaacagggggcuggagaaggccugg

SEQ ID NO: 89129 - RNA, 63 nt, Homo Sapiens
gaaagggacgauggagaagguuugcuucuggcuggcggcaaggccuccccgggagccucagag

SEQ ID NO: 89130 - RNA, 63 nt, Homo Sapiens
agcggggaugauguuaaguguggccaagcgcacggcggcaaguuuucaagcacugaguuucua

SEQ ID NO: 89131 - RNA, 63 nt, Homo Sapiens
gccuggaugugggccaaguccacuguccuccuuggcggcaaaagcccauugaagaagaaccag

SEQ ID NO: 89132 - RNA, 63 nt, Homo Sapiens
agaacagaacacugaagacugccacgggaucccggcggcaaggacagagccccucuaggagaa

SEQ ID NO: 89133 - RNA, 63 nt, Homo Sapiens
ggugggccgagggccggguagaugcuauguuggggcggcaagcacgugcagguggagcucugg

SEQ ID NO: 89134 - RNA, 63 nt, Homo Sapiens
gggcguggaccacccgcccuggcaguugaauggggcggcaauugcggggcccaccuuagaccg

SEQ ID NO: 89135 - RNA, 63 nt, Homo Sapiens
augaaggagagauacuuaggaaauccuaaaagaggcggcaagaagguaccucccuguguaacu

SEQ ID NO: 89136 - RNA, 63 nt, Homo Sapiens
gccucagcccagcccacccuuuacacagauaguggcggcaaugccucgugcucacggauuuua

SEQ ID NO: 89137 - RNA, 63 nt, Homo Sapiens
cacccaggcaccgaggcaagggggggagaugugggcggcaagcgcgauucuaguuaauaaaaa

SEQ ID NO: 89138 - RNA, 63 nt, Homo Sapiens
ucuccgagagacuuuccauuuccuuggaguuauggcggcaaguaaguaucauaguauuaagaa

SEQ ID NO: 89139 - RNA, 63 nt, Homo Sapiens
uuccaugacccuuugccuguuccgcauccuggaggcggcaaagggugaaauccgcauugaugg

SEQ ID NO: 89140 - RNA, 63 nt, Homo Sapiens
ucugucuggauugaguccuacagugucagauagggcggcaaaugccaaagcagggaaacaggg

SEQ ID NO: 89141 - RNA, 63 nt, Homo Sapiens
gucccggccucacucagcucacagggcgugccaggcggcaacaccagaaucuuccagaagccc

SEQ ID NO: 89142 - RNA, 63 nt, Homo Sapiens
aggccagguagucccggcacacccgguaaccgaggcggcaaggcugaccaaugaugggcggug

SEQ ID NO: 89143 - RNA, 63 nt, Homo Sapiens
cccagccccuucucagaccaggcaacccggcuuggcggcaaaggccuggaggggcagggcugg

SEQ ID NO: 89144 - RNA, 63 nt, Homo Sapiens
ccaaacuugugaacucgugacaaucacaaacuuggcggcaaaguggcgacucaaccuuggggg

SEQ ID NO: 89145 - RNA, 63 nt, Homo Sapiens
ggcuggacauggccaagacacaaggcauuccacggcggcaagcugaccgcacagcagucuggc

SEQ ID NO: 89146 - RNA, 63 nt, Homo Sapiens
acacugcaccucuccuuuccggugggaggagagggcggcaaugcauccacuauuaaugcacua

SEQ ID NO: 89147 - RNA, 63 nt, Homo Sapiens
gagagcgcacccuacucuuuccgugacgaugagggcggcaaaaacagacauuucuuccuucau

SEQ ID NO: 89148 - RNA, 64 nt, Homo Sapiens; identical to SEQ ID NO: 85128

SEQ ID NO: 89149 - RNA, 64 nt, Homo Sapiens; identical to SEQ ID NO: 85129

SEQ ID NO: 89150 - RNA, 64 nt, Homo Sapiens; identical to SEQ ID NO: 85130

SEQ ID NO: 89151 - RNA, 58 nt, Homo Sapiens; identical to SEQ ID NO: 85131

SEQ ID NO: 89152 - RNA, 64 nt, Homo Sapiens; identical to SEQ ID NO: 85132

SEQ ID NO: 89153 - RNA, 64 nt, Homo Sapiens; identical to SEQ ID NO: 85133

SEQ ID NO: 89154 - RNA, 64 nt, Homo Sapiens; identical to SEQ ID NO: 85134

SEQ ID NO: 89155 - RNA, 64 nt, Homo Sapiens; identical to SEQ ID NO: 85135

SEQ ID NO: 89156 - RNA, 64 nt, Homo Sapiens; identical to SEQ ID NO: 85136

SEQ ID NO: 89157 - RNA, 64 nt, Homo Sapiens; identical to SEQ ID NO: 85137

SEQ ID NO: 89158 - RNA, 64 nt, Homo Sapiens; identical to SEQ ID NO: 85138

SEQ ID NO: 89159 - RNA, 64 nt, Homo Sapiens; identical to SEQ ID NO: 85139

SEQ ID NO: 89160 - RNA, 64 nt, Homo Sapiens; identical to SEQ ID NO: 85140

SEQ ID NO: 89161 - RNA, 64 nt, Homo Sapiens; identical to SEQ ID NO: 85141

SEQ ID NO: 89162 - RNA, 64 nt, Homo Sapiens; identical to SEQ ID NO: 85142

SEQ ID NO: 89163 - RNA, 64 nt, Homo Sapiens; identical to SEQ ID NO: 85141

SEQ ID NO: 89164 - RNA, 64 nt, Homo Sapiens; identical to SEQ ID NO: 85144

SEQ ID NO: 89165 - RNA, 64 nt, Homo Sapiens; identical to SEQ ID NO: 85145

SEQ ID NO: 89166 - RNA, 64 nt, Homo Sapiens; identical to SEQ ID NO: 85146

SEQ ID NO: 89167 - RNA, 64 nt, Homo Sapiens; identical to SEQ ID NO: 85147

SEQ ID NO: 89168 - RNA, 64 nt, Homo Sapiens; identical to SEQ ID NO: 85148

SEQ ID NO: 89169 - RNA, 64 nt, Homo Sapiens; identical to SEQ ID NO: 85149

SEQ ID NO: 89170 - RNA, 64 nt, Homo Sapiens; identical to SEQ ID NO: 85150

SEQ ID NO: 89171 - RNA, 64 nt, Homo Sapiens; identical to SEQ ID NO: 85151

SEQ ID NO: 89172 - RNA, 64 nt, Homo Sapiens; identical to SEQ ID NO: 85152

SEQ ID NO: 89173 - RNA, 64 nt, Homo Sapiens; identical to SEQ ID NO: 85153

SEQ ID NO: 89174 - RNA, 64 nt, Homo Sapiens; identical to SEQ ID NO: 85154

SEQ ID NO: 89175 - RNA, 64 nt, Homo Sapiens; identical to SEQ ID NO: 85155

SEQ ID NO: 89176 - RNA, 64 nt, Homo Sapiens
agauaaauaccuuucaagugugagcuuagacgucaacccuaaaauacuuaaccguaaugcuaau

SEQ ID NO: 89177 - RNA, 64 nt, Homo Sapiens
uuuucugcaguuauuucucuuguucuggccaaacaacccuaaaaauccuuaccauuccacaaag

SEQ ID NO: 89178 - RNA, 64 nt, Homo Sapiens
cugcucuaaaaaaugaagugcucaauuuuucuguaacccuaaagagaauucucuguacuuuuug

SEQ ID NO: 89179 - RNA, 64 nt, Homo Sapiens
gcuuauuguuaagugaaaacaaaagacauauaggaacccuaaaugaauuagacaucaagucauu

SEQ ID NO: 89180 - RNA, 64 nt, Homo Sapiens
uauuacaaaauaagucccgcauuuuauuuuucaaaacccuaaaauaaaaaaaauugauuuccau

SEQ ID NO: 89181 - RNA, 64 nt, Homo Sapiens
agagaagaaucuuaaugaacaagagaaggggagaaacccuaaaagacaaggaaggaaaagaaag

SEQ ID NO: 89182 - RNA, 64 nt, Homo Sapiens
agagaaguggacuccaaaccucauuuuaguuguagaagaaaauuucuuacaaaacaaauuccac

SEQ ID NO: 89183 - RNA, 64 nt, Homo Sapiens
cucuggagaauuucucccacuccccaccucugcagaagaaaauuuugcucuuauaaaaccucau

SEQ ID NO: 89184 - RNA, 64 nt, Homo Sapiens
uaccccaugaaauguaaauacuguaucauaaguagaagaaaauaauuuuuguuuucuaaaaaug

SEQ ID NO: 89185 - RNA, 64 nt, Homo Sapiens
ccuuuuuacugaaaguaagugacuuaaaaggauggaagaaaaacuacaugguuggaguguuuuu

SEQ ID NO: 89186 - RNA, 64 nt, Homo Sapiens
aaauuacagugugaacaagagaaaaacaggaauagaagaaaaaaguugcagguugaauuaucua

SEQ ID NO: 89187 - RNA, 61 nt, Homo Sapiens
aaaggggcaucugcuuauaagaagugagagagaagaaaaaucaugucccaaguucugagaa

SEQ ID NO: 89188 - RNA, 64 nt, Homo Sapiens
ggauuuguuuuuuacaucuccuuuuuccuuccuugaagaaaaauucuuggcugucccaaggauu

SEQ ID NO: 89189 - RNA, 64 nt, Homo Sapiens
agauugggggaguggggagggggaagaagaacaggaagaaaaaaaguacucugaacugcuccaa

SEQ ID NO: 89190 - RNA, 64 nt, Homo Sapiens
ggauugaacucacagauggauaccaacacggucagaagaaaaacggacagaacgguucuuguau

SEQ ID NO: 89191 - RNA, 64 nt, Homo Sapiens
ggacuucaacgccagugacuguguaccuccagcagaagaaaaucaggugucuggucuugggggc

SEQ ID NO: 89192 - RNA, 64 nt, Homo Sapiens
cuggucuugggggcacugugcucacuucuagagagaagaaaaaggcuggguuuggacuucaugc

SEQ ID NO: 89193 - RNA, 64 nt, Homo Sapiens
uguccugccaggcucuguacuguccuuuguguaugaagaaaaugcuguuagcccucucucaggc

SEQ ID NO: 89194 - RNA, 64 nt, Homo Sapiens
caugggcuugcugacuuagccaaagaagaguuaagaagaaaauacacacaaguauacagacugu

SEQ ID NO: 89195 - RNA, 64 nt, Homo Sapiens
acauguaaaacaagaaaaguugaagaagauaugugaagaaaaauguauuuuuccuaaauagaaa

SEQ ID NO: 89196 - RNA, 64 nt, Homo Sapiens
gauggcuaaguuugcaugaaauaccuaucuaaaagaagaaaacuaaaguccauauggacugugg

SEQ ID NO: 89197 - RNA, 64 nt, Homo Sapiens
uguugguaauugauacauggcugcagacauugaugaagaaaaucauagaaaucaugaauguggu

SEQ ID NO: 89198 - RNA, 64 nt, Homo Sapiens
ggcaugcaccaaggaauuguuagagguugguggggaagaaaauaggccuugcucuuguggagcu

SEQ ID NO: 89199 - RNA, 64 nt, Homo Sapiens
uaggggcugcucugacgguggucaugcagacaaggaagaaaacuaauagccugcucaguagagg

SEQ ID NO: 89200 - RNA, 64 nt, Homo Sapiens
uuaguucauaaguaaaggcauguauaucaaaagugaagaaaaagucaggauuauuuaacuuacc

SEQ ID NO: 89201 - RNA, 64 nt, Homo Sapiens
cucaccuggccacuguuuagaucagaaagagcuagaagaaaagguguuccuucacugccacaga

SEQ ID NO: 89202 - RNA, 64 nt, Homo Sapiens
uucuuugccugaguuuuaauugcuguugcaaaaagaagaaaacaccuuuguuuuuacuaguguc

SEQ ID NO: 89203 - RNA, 64 nt, Homo Sapiens
aggggaagaagaucaaaaccgaaaagaagaaggggaagaaaagaaggggaagaagaucaaagaa

SEQ ID NO: 89204 - RNA, 64 nt, Homo Sapiens
agaaggggaagaaaagaaggggaagaagaucaaagaagaaaagaggaaggggaagaaaagaagg

SEQ ID NO: 89205 - RNA, 64 nt, Homo Sapiens
aggggaagaagaucaaagaaaagaaggggaaggggaagaaaagaaauuuauugcagaaauugaa

SEQ ID NO: 89206 - RNA, 64 nt, Homo Sapiens
cuaacuuucaguuagagguucuauguucagaauugaagaaaaucauauuaccgugguuuaugaa

SEQ ID NO: 89207 - RNA, 64 nt, Homo Sapiens
uuaggcuauaaauguccuaauagcaacuuugauggaagaaaauagguauucuggugaugggguu

SEQ ID NO: 89208 - RNA, 64 nt, Homo Sapiens
cagcagcaucaagaggaggaagcaggaaaagcaagaagaaaagagagcaugcagugauggaaga

SEQ ID NO: 89209 - RNA, 64 nt, Homo Sapiens
aagagguggcaccaugaagaucccucaggaaagggaagaaaaaggcagagagcaaaccaaucag

SEQ ID NO: 89210 - RNA, 64 nt, Homo Sapiens
cgacaucaagaaggaaagguagaaaaagcaagaagaagaaaaggaacaugcugagcagaacauc

SEQ ID NO: 89211 - RNA, 64 nt, Homo Sapiens
aauuagaauauuuucaacauaagaaaagaaaaaugaagaaaaguggaggaagaaagggagagag

SEQ ID NO: 89212 - RNA, 64 nt, Homo Sapiens
aaaaugaagaaaaguaauuaaagaaagggagagagaagaaaagaauaaaaagaagagagggagg

SEQ ID NO: 89213 - RNA, 64 nt, Homo Sapiens
gauggcaugaaagaaugaccgauuguggcuggaggaagaaaaagguucccaaguggugagguga

SEQ ID NO: 89214 - RNA, 64 nt, Homo Sapiens
agcagcagacgaaagagaaauuaaaaaucuguuagaagaaaaaauguuccuucuuuuuaccuuu

SEQ ID NO: 89215 - RNA, 64 nt, Homo Sapiens
agcuuguuuuuaaaacuuaaguacaaacauacuggaagaaaaccgauuggaggccauggccuau

SEQ ID NO: 89216 - RNA, 64 nt, Homo Sapiens
gcuuauagaauaaaagcuaugacagcaaaauguugaagaaaaaacaggacuguaaagauuuguu

SEQ ID NO: 89217 - RNA, 64 nt, Homo Sapiens
uacaaugaacugcuuuuccugugcacuuuuuuaugaagaaaaagcaagcugacuuggcacuuaa

SEQ ID NO: 89218 - RNA, 64 nt, Homo Sapiens
gaaagcucuccuaauacuuacuuaaauagccauggaagaaaauuaugcuugucccuucugacug

SEQ ID NO: 89219 - RNA, 64 nt, Homo Sapiens
guacagaaaagcuuuuuguguguuuaaaaaaauugaagaaaauucaggaagaaacguguuaaua

SEQ ID NO: 89220 - RNA, 64 nt, Homo Sapiens
cacuuucuuccaauccaagcaccuuaccuccuaagaagaaaagcucgauugccaaagagcaucu

SEQ ID NO: 89221 - RNA, 64 nt, Homo Sapiens
acaaaaauggaagcaaacaaaauucaucaucagagaagaaaauaucacuuuuucuuuuuuacgg

SEQ ID NO: 89222 - RNA, 64 nt, Homo Sapiens
ugguuuaauuggacuuaaagauacccgagacugggaagaaaaaguucacgcugcugauaaagac

SEQ ID NO: 89223 - RNA, 64 nt, Homo Sapiens
agguuuacuuggacuuacagguacccgagacugggaagaaaaaguuaaugcugcugauaaagac

SEQ ID NO: 89224 - RNA, 64 nt, Homo Sapiens
auaugauuuauuagcacaacgacagaggggaacagaagaaaauaagaggcugacaauaagguuu

SEQ ID NO: 89225 - RNA, 64 nt, Homo Sapiens
ggccuugaauugacaaauuauaucaauuggaaaggaagaaaaaaugucucuaaaggguuaaaug

SEQ ID NO: 89226 - RNA, 64 nt, Homo Sapiens
uccccagaaggcauccaucauuagggcccuuaaagaagaaaaucacucagcccuguugcaaugc

SEQ ID NO: 89227 - RNA, 64 nt, Homo Sapiens
auauauauauaucuuauuuauugcaagagguaaagaagaaaacuuauuuuuucuauaaguuuua

SEQ ID NO: 89228 - RNA, 64 nt, Homo Sapiens
gaaccucauccaugccuggacaucuggauugauggaagaaaagaaaaaggagcagagagcuguc

SEQ ID NO: 89229 - RNA, 64 nt, Homo Sapiens
gaagagugguuaccuauaccucuuauugaagaaagaagaaaaguugcaaggauuagccaaaucu

SEQ ID NO: 89230 - RNA, 64 nt, Homo Sapiens
ccgcacaucagaggaaagcuaaagaaauagcauugaagaaaauacaaaaaaaaaaaaaaaaaag

SEQ ID NO: 89231 - RNA, 64 nt, Homo Sapiens
guacugugaccugagagacaaaaucaaaagaaaugaagaaaaaacucccugcugauuuguuucu

SEQ ID NO: 89232 - RNA, 64 nt, Homo Sapiens
acuuaaguacaacuguagugugcaagcaaaaaccgaagaaaaaccuucaaugacaugaaaacug

SEQ ID NO: 89233 - RNA, 64 nt, Homo Sapiens
uuacaacuuuuaacaccccauuuaugauuuagaugaagaaaauuuccucuagaauguguaucuu

SEQ ID NO: 89234 - RNA, 64 nt, Homo Sapiens
aagaaaaacaaguguucaggaaaaaaauacaaaggaagaaaagagugagaguaacaauaaagaa

SEQ ID NO: 89235 - RNA, 64 nt, Homo Sapiens
aagaaaaaagauagaaaaaauuagaucgacuggagaagaaaaaauauuucccaauuacaggaaa

SEQ ID NO: 89236 - RNA, 64 nt, Homo Sapiens
cagaugguuuguggcaggugaauauaagaguggagaagaaaagugcauggauuuugguaguuga

SEQ ID NO: 89237 - RNA, 64 nt, Homo Sapiens
cacagaagauacacuuccgcaauggcuucauuuugaagaaaagccucaaucucagcgugugacc

SEQ ID NO: 89238 - RNA, 64 nt, Homo Sapiens
acagauaggcugaugguuauacugaguaggcacagaagaaaaguaaaauuauuuucucaauuuu

SEQ ID NO: 89239 - RNA, 64 nt, Homo Sapiens
ugaguagugguaaguuuuguacuaacauaguuuggaagaaaaaucucuuugcaaaauguauauu

SEQ ID NO: 89240 - RNA, 64 nt, Homo Sapiens
ucaauuaaaauuuuguuuauuuaaaaauaauugagaagaaaaacagugcuuuguuuccgugcac

SEQ ID NO: 89241 - RNA, 64 nt, Homo Sapiens
aaaaauucacacugccagcggauuuuuuuuuaaagaagaaaaaaaaaaccaugacgcaaagaga

SEQ ID NO: 89242 - RNA, 64 nt, Homo Sapiens
uaccuuaucuuugucacaggguguucuuuuuuaugaagaaaaauuugaaaaugauaaaagcuaa

SEQ ID NO: 89243 - RNA, 64 nt, Homo Sapiens
augauuuguacaugccauugaaaauuauuaaucagaagaaaauuaagcagggucuuugcuauac

SEQ ID NO: 89244 - RNA, 64 nt, Homo Sapiens
ggcacagaaguuuaagacuaugaguuuuuagggugaagaaaaaacuguacaguuuaaaugaaaa

SEQ ID NO: 89245 - RNA, 64 nt, Homo Sapiens
uguacaguuuaaaugaaaauguuuuucuucauuugaagaaaauuuguugauaaaccauggcaac

SEQ ID NO: 89246 - RNA, 64 nt, Homo Sapiens
uuuucuacacauuuguauacaaaaucggauacaggaagaaaagggagaggugagcuaacauuug

SEQ ID NO: 89247 - RNA, 64 nt, Homo Sapiens
cauaguguggauaggacuagucucauuucucugagaagaaaacuaaggcgcggaaauuugucua

SEQ ID NO: 89248 - RNA, 64 nt, Homo Sapiens
auaaaaaagaaagaaaacaaaacucgcccuacaggaagaaaaggauucuccucuguauauaauu

SEQ ID NO: 89249 - RNA, 64 nt, Homo Sapiens
ggugauaagcacaaaucucuacuccucaugacaugaagaaaaagacugaaugugaagggaguuu

SEQ ID NO: 89250 - RNA, 64 nt, Homo Sapiens
cuggauuuuuuuuuuuaaaaaaaagaaaaaaaaagaagaaaaguauaccagauaccaaaagcua

SEQ ID NO: 89251 - RNA, 64 nt, Homo Sapiens
uuuacauguacccaaaaaccauaaucaucucuuggaagaaaaugcugagaucaaugaauuauuc

SEQ ID NO: 89252 - RNA, 64 nt, Homo Sapiens
cgaugacauuucuaagcuacagcguacuccaggagaagaaaagauuaauaccuuaaaagaagaa

SEQ ID NO: 89253 - RNA, 64 nt, Homo Sapiens
uacuccaggagaagaaaagauuaauaccuuaaaagaagaaaacacucaagaagcagcaguccug

SEQ ID NO: 89254 - RNA, 64 nt, Homo Sapiens
uuuuguuuuuauuaaauggacaugacuggugagagaagaaaacaaaucuuaaaaguguuguuau

SEQ ID NO: 89255 - RNA, 64 nt, Homo Sapiens
aauguucugacaguugugauuccuauccugguuagaagaaaauuaaguaaacaaaacccacauu

SEQ ID NO: 89256 - RNA, 64 nt, Homo Sapiens
auguauaaaauaguuuuaguauccuuuucuuaaagaagaaaaacaaguuucacagacaucauag

SEQ ID NO: 89257 - RNA, 64 nt, Homo Sapiens
aguuaaauaagacauacccaggaggcagauggaagaagaaaaacaugagaggaggcagagagag

SEQ ID NO: 89258 - RNA, 64 nt, Homo Sapiens
ccaagcuuaggguauuuuuccuaaaagaagaaaagaagaaaaaauuggucaaaaucugcaaacu

SEQ ID NO: 89259 - RNA, 64 nt, Homo Sapiens
agaaaaaaccaagcuuagggugcaaacucuaaaagaagaaaagacaugucuguuggucaaaauc

SEQ ID NO: 89260 - RNA, 64 nt, Homo Sapiens
auaagacuuuaaacaguugaagcugucauagagugaagaaaagguuuuuuuuuuuuguagaagu

SEQ ID NO: 89261 - RNA, 64 nt, Homo Sapiens
guuugaguagcagcagugcuuucuucuaauacgugaagaaaauaugaccaucaaugccuaugaa

SEQ ID NO: 89262 - RNA, 64 nt, Homo Sapiens
uugcuuguaaauccuaaucuuagaguuaucaaaagaagaaaaaacugaagguacuuuacucccu

SEQ ID NO: 89263 - RNA, 64 nt, Homo Sapiens
gaaaguccuggcugugguugcagaaacacuguuggaagaaaagagaugacuaagucaagugucu

SEQ ID NO: 89264 - RNA, 64 nt, Homo Sapiens
augucucuggaucccuggaaaaaagaucuucuuugaagaaaaguaaaagaagaaaaaagaaagg

SEQ ID NO: 89265 - RNA, 64 nt, Homo Sapiens
gaaaggaaaagaucuucuuuuaccaaaccaaaaagaagaaaaaacuucuguuuuaaacuuuggg

SEQ ID NO: 89266 - RNA, 64 nt, Homo Sapiens
ugauauggaccuguuggucuaugucaucuuuucagaagaaaagcauuuaauugccaaugggagg

SEQ ID NO: 89267 - RNA, 64 nt, Homo Sapiens
ucuuuaaaaauaacuuagauucaaauuuauaguagaagaaaaaaaaucuuucagauaagaggug

SEQ ID NO: 89268 - RNA, 64 nt, Homo Sapiens
ugauauggaccuguugguccauaucaucuuuucagaagaaaagcauuuaauugccaaugggagg

SEQ ID NO: 89269 - RNA, 64 nt, Homo Sapiens; identical to SEQ ID NO: 89267

SEQ ID NO: 89270 - RNA, 64 nt, Homo Sapiens
gcacagacugggagaacuaacaagugacauaacagaagaaaaauaucauucaagauugguucug

SEQ ID NO: 89271 - RNA, 64 nt, Homo Sapiens
ugaauuuuacaugugcaauguuccugacugcaaugaagaaaaggccuucuggagauuucuguuu

SEQ ID NO: 89272 - RNA, 64 nt, Homo Sapiens
acauuuaauaaauguaugugccauucauauuugagaagaaaagaguaggcucucacuagaguua

SEQ ID NO: 89273 - RNA, 64 nt, Homo Sapiens
aauguggccaaacaauuauuauauuucauaaaaugaagaaaaagaagaagugcauagguccaua

SEQ ID NO: 89274 - RNA, 64 nt, Homo Sapiens
cugguaugaaaucauuuuuucacaaaucuuaugugaagaaaagaaacccauaauuuuaaugcua

SEQ ID NO: 89275 - RNA, 64 nt, Homo Sapiens
acggguaucuucauagcagcccugugauuuuggugaagaaaaaaaaagugagugagauguaaau

SEQ ID NO: 89276 - RNA, 64 nt, Homo Sapiens
ugucuucgucuuuauguugaugucucaaaaaauagaagaaaaugcugugaaucacaaaguguac

SEQ ID NO: 89277 - RNA, 64 nt, Homo Sapiens
auucaucacaguguacaguuacagaacuacuacggaagaaaauuccacagugagucagcccuuc

SEQ ID NO: 89278 - RNA, 64 nt, Homo Sapiens
aaucaacccauccauagaaacacuuaauuuagaggaagaaaaaacaaauauauuagucuagggc

SEQ ID NO: 89279 - RNA, 64 nt, Homo Sapiens
gaauaacugaacaaauauaugaaauggcaguaaggaagaaaacagaacucacugauggagaugu

SEQ ID NO: 89280 - RNA, 64 nt, Homo Sapiens
ugcucagggauuuauaauuugugaugaggaggaagaagaaaaaggcaagucaaugucaccgaca

SEQ ID NO: 89281 - RNA, 64 nt, Homo Sapiens
uaaacccugugccucagcugauagccacaguggggaagaaaacuaacuucuuacuauaacaguc

SEQ ID NO: 89282 - RNA, 64 nt, Homo Sapiens
caccagcacaucacuaugcaucuguuccaggaaagaagaaaagcgagcgaggaagacggaaaag

SEQ ID NO: 89283 - RNA, 64 nt, Homo Sapiens
gugggggguggggaggggggugagaagacaagaugaagaaaagccuuacauuucaguuucuuca

SEQ ID NO: 89284 - RNA, 64 nt, Homo Sapiens
auggagugccauccugcuaggugaguacagaccagaagaaaauuuaguugggaaaauacuuguu

SEQ ID NO: 89285 - RNA, 64 nt, Homo Sapiens
ccuauuaccuuuguagcagccacaucagaaagcagaagaaaacaguauuucugaaggcauuguu

SEQ ID NO: 89286 - RNA, 64 nt, Homo Sapiens
agaagagaaaaaauuaagaaaaaaaucaaaaaaggaagaaaacuaaaaaaaaaaaaaaucaaau

SEQ ID NO: 89287 - RNA, 64 nt, Homo Sapiens
uggugucagauucaucaaacaaaaaauaaaucucgaagaaaaaaaaugcacuuacaugugcuua

SEQ ID NO: 89288 - RNA, 64 nt, Homo Sapiens
auuuguaaagcuuucagugaaacacuacauacacgaagaaaaggaacaagguuuaacuauuuaa

SEQ ID NO: 89289 - RNA, 64 nt, Homo Sapiens
uuauaaaacaaggcuagccauauuuaggacaacugaagaaaagcuggaaaaaaaaacaagcaaa

SEQ ID NO: 89290 - RNA, 64 nt, Homo Sapiens
uguuuggaagaccagaaugugaagacaaguaguagaagaaaaugaaugcugcugcugagacuga

SEQ ID NO: 89291 - RNA, 64 nt, Homo Sapiens
ugaggcaaaguagugaauauguuuuauauguuaugaagaaaagaauuguuguaaguuuuugauu

SEQ ID NO: 89292 - RNA, 64 nt, Homo Sapiens
cuguaauugcuacucagcaaguuggaaaacuaaugaagaaaacaaucauaauuacauuaccagu

SEQ ID NO: 89293 - RNA, 56 nt, Homo Sapiens
uaagagcugccgaaaugcacagaauugaagaaaaguuguauuuuucuuuccaguaa

SEQ ID NO: 89294 - RNA, 64 nt, Homo Sapiens
accacuuuuuuuaaccauuauuaugcaaaauuuagaagaaaaguuauuggcaugguuguugcau

SEQ ID NO: 89295 - RNA, 64 nt, Homo Sapiens
aguguuaaguuuuuaaucugggagcagggcauaggaagaaaaugucaguagugcuaaugcauuu

SEQ ID NO: 89296 - RNA, 64 nt, Homo Sapiens
ggaaugucagaaaugacuuuaucaucgucaucuugaagaaaaauaugaacacugaugaagguca

SEQ ID NO: 89297 - RNA, 64 nt, Homo Sapiens
aaccagucacuaggauauuucuacccaugcaacggaagaaaaacccauuacuccagaagaguau

SEQ ID NO: 89298 - RNA, 64 nt, Homo Sapiens
agcgcaaggaauccucuaguuaauuucauuagaggaagaaaaccccucuuuuuuauuuuaagau

SEQ ID NO: 89299 - RNA, 64 nt, Homo Sapiens
aaccagcaggaaaguacagagagaaagaagagaagaagaaaaucacccuaugaaaaaauuaguu

SEQ ID NO: 89300 - RNA, 64 nt, Homo Sapiens
aacugggaaaauuucuucgaaagucuugucucaagaagaaaacgugcuccagccugggcgacag

SEQ ID NO: 89301 - RNA, 64 nt, Homo Sapiens
gaaacguggcaucauuuggguauaguuuuaagaggaagaaaacauguaugucucuaggacauuu

SEQ ID NO: 89302 - RNA, 64 nt, Homo Sapiens
auguggagcaccagccucggggcggcgggucuuagaagaaaaucugaacaacugcagagagaaa

SEQ ID NO: 89303 - RNA, 64 nt, Homo Sapiens
aaauagcuuauuauagaauuauauaguagggguugaagaaaacauuuuagauguuauuaugcua

SEQ ID NO: 89304 - RNA, 64 nt, Homo Sapiens
accugcauuuggcaggaagaauuaguaaauaugugaagaaaaagagcggcuuucuaauagagag

SEQ ID NO: 89305 - RNA, 64 nt, Homo Sapiens
ucuuaaauaacuccauucauacaaauugggaugggaagaaaauccuuuccucuugggaaaguaa

SEQ ID NO: 89306 - RNA, 64 nt, Homo Sapiens
aagaccacaagucugcaggaaacucuggaaucaggaagaaaagcuauguucauacucuaaaucu

SEQ ID NO: 89307 - RNA, 64 nt, Homo Sapiens
gagacaaagaucacuacagaccaaaacagaagaagaagaaaaaaaagaaaaagaaaucuaagca

SEQ ID NO: 89308 - RNA, 64 nt, Homo Sapiens
ggagaaaaaaauagcucaagacacaguuaaucgagaagaaaagaaauauguacagaaccauaaa

SEQ ID NO: 89309 - RNA, 64 nt, Homo Sapiens
aauaaaaggaagagguuuauaauacagucuaagugaagaaaauauuguaaauacacuuuacgug

SEQ ID NO: 89310 - RNA, 64 nt, Homo Sapiens
aacccaaaccagugaaguuuguaaaacgcaacaagaagaaaaccaaugaaaaauaguaaucaua

SEQ ID NO: 89311 - RNA, 64 nt, Homo Sapiens
gucugggaggauagcgcucaugcaguacuugauagaagaaaacagauucagugcuuaccgauga

SEQ ID NO: 89312 - RNA, 64 nt, Homo Sapiens
caauaguugcuugaauuaugcagccaaagccauagaagaaaaagaucaaucagcauauacauuu

SEQ ID NO: 89313 - RNA, 64 nt, Homo Sapiens
agacaugaaaagaguggugaauauuuaacauguggaagaaaacaaguaaaguuuugguuauuau

SEQ ID NO: 89314 - RNA, 64 nt, Homo Sapiens
gugaggacucaggaaaaauaaaacauuugucagagaagaaaaacuugguauuucacugaauuuc

SEQ ID NO: 89315 - RNA, 64 nt, Homo Sapiens
ucuaucaaaggcagaucagucuacagguacaauagaagaaaagaacauauuuacagacuccuaa

SEQ ID NO: 89316 - RNA, 64 nt, Homo Sapiens
gucuauacaaaggcuugcuacuugugauaaaaaugaagaaaagaggaaaaggaauguagcucaa

SEQ ID NO: 89317 - RNA, 64 nt, Homo Sapiens
aguuaggagaaagaagagcacuucugcuucugaggaagaaaaggcaucauuuuaucgagagaac

SEQ ID NO: 89318 - RNA, 64 nt, Homo Sapiens
gacuccugaaugauuuagacaacuucaaaauacagaagaaaagcaaaugacuaguaaacaugug

SEQ ID NO: 89319 - RNA, 64 nt, Homo Sapiens
uaggcaagaaggacagcaguaaaugaagaccauggaagaaaagaaggaaugccaaagaucgagg

SEQ ID NO: 89320 - RNA, 64 nt, Homo Sapiens
ucuuacacggcuguaauugaggagagaugauuaggaagaaaauguuucauggugauggugcaag

SEQ ID NO: 89321 - RNA, 64 nt, Homo Sapiens
ucugcagucaauuuuuaucucuuuggcacauucugaagaaaaucauauuccuguucccacagaa

SEQ ID NO: 89322 - RNA, 64 nt, Homo Sapiens
uguccuuccuucuccaaaaaugguacucuuggaggaagaaaaacguuagugggaguggucaaau

SEQ ID NO: 89323 - RNA, 64 nt, Homo Sapiens
ugaccuuugcucugguuaaaguucaauguaacaagaagaaaacuuauuauuauucuuaggaaua

SEQ ID NO: 89324 - RNA, 64 nt, Homo Sapiens
augcgguauuugcuuuugccacucuaguucugcggaagaaaagguacgcagcugccgaacucug

SEQ ID NO: 89325 - RNA, 64 nt, Homo Sapiens
cucaguugauaaaccuuaguuuuuccaggaaagggaagaaaacagggcacuugcauccauugcc

SEQ ID NO: 89326 - RNA, 64 nt, Homo Sapiens
auaagcccucuauacauaaaauaugagaaauacagaagaaaauaaaacuuauuaacaacuguga

SEQ ID NO: 89327 - RNA, 64 nt, Homo Sapiens
caacauuuuaauacagauugcugugaacuauuuugaagaaaacauuuuaaaaaaucaaaaggca

SEQ ID NO: 89328 - RNA, 64 nt, Homo Sapiens
ccaaauaauuaccuuccauucauuccccuaaacagaagaaaagaaaaaaaugagugguucaguu

SEQ ID NO: 89329 - RNA, 64 nt, Homo Sapiens
aauugauuacuggcauuggauauauuauuuuaaugaagaaaauaaacuaacaauacauucugug

SEQ ID NO: 89330 - RNA, 64 nt, Homo Sapiens
ucugacauuacuuuagcaauucaacuugaugugagaagaaaaaacaaauguuucaacacaaaau

SEQ ID NO: 89331 - RNA, 64 nt, Homo Sapiens
agagaccuauguugaaaaccccugaaaauucacugaagaaaaaucauuacucuuuuucucagua

SEQ ID NO: 89332 - RNA, 64 nt, Homo Sapiens
uuaaacaccugcucauggucacauagcccaggcagaagaaaaucucggacuuggaauagauccc

SEQ ID NO: 89333 - RNA, 64 nt, Homo Sapiens
cugagcaacaagagcgaaacugucucaaaaaaaagaagaaaauaaauaaauaaaaaucagagca

SEQ ID NO: 89334 - RNA, 64 nt, Homo Sapiens
ugucuaccucacaugcaggucuagggugaggauugaagaaaauaguggugaugagggcuuuaac

SEQ ID NO: 89335 - RNA, 64 nt, Homo Sapiens
gaaccagagcuccaagucuuuaauuugccaagaugaagaaaaugaguucucaaggagggaaugc

SEQ ID NO: 89336 - RNA, 64 nt, Homo Sapiens
aacuggucuaaacuucaaauaucauuuuaccuuugaagaaaaccagaaaacauucaaaagaacu

SEQ ID NO: 89337 - RNA, 64 nt, Homo Sapiens
aacaggaucuucagaaaaacuacccugugacuaugaagaaaauauauauugcuagcccaaaaau

SEQ ID NO: 89338 - RNA, 64 nt, Homo Sapiens
aaaauaaggguauaauuuuguaggucauaugauugaagaaaauauuauuuuaacaauguaaagc

SEQ ID NO: 89339 - RNA, 64 nt, Homo Sapiens
uucacgcugcugauaaagacauaccugagaccaggaagaaaaagagguuuaauuggacuuacag

SEQ ID NO: 89340 - RNA, 64 nt, Homo Sapiens
ucacacugcugauaaagacauuccucaagauugugaagaaaaagagguuuaauuggacuuacag

SEQ ID NO: 89341 - RNA, 64 nt, Homo Sapiens
ccugccugcugaccacuggacgcugcuccaugcugaagaaaagugacagucuccaggggacauu

SEQ ID NO: 89342 - RNA, 64 nt, Homo Sapiens
uuggacacaugaauuaaaucccaagggaaagugagaagaaaauuaauguauuagcaaccagugu

SEQ ID NO: 89343 - RNA, 64 nt, Homo Sapiens
ugugugaucuuuaauaacacuuucaauaaaagaugaagaaaaugauccaucuccaguggaaugu

SEQ ID NO: 89344 - RNA, 64 nt, Homo Sapiens
uaacagaagccagugaagcaauugauuucaaagugaagaaaauguugauuaacuuaaugccacc

SEQ ID NO: 89345 - RNA, 64 nt, Homo Sapiens
agcuucuuuccauaucaaguugcauccaacuugagaagaaaaaaguaucuuuuaaacucaguuc

SEQ ID NO: 89346 - RNA, 64 nt, Homo Sapiens
uuugaauuuaccuucauaugguuuuaaagccgaagaagaaaacaugcuuaagaauuuaagcucu

SEQ ID NO: 89347 - RNA, 64 nt, Homo Sapiens
cccagcagugccugguucugagcaaacucccagggaagaaaacggcccugucuccauggccagg

SEQ ID NO: 89348 - RNA, 64 nt, Homo Sapiens
uccaagcaccggggcgaaaaaccacaaaggaaaggaagaaaauuuauauauauauaauauaaaa

SEQ ID NO: 89349 - RNA, 64 nt, Homo Sapiens
aggugggguguuugggaggcugcgugccagucaagaagaaaaagguuugcauucucacauugcc

SEQ ID NO: 89350 - RNA, 64 nt, Homo Sapiens
uagauccuuuuauaggugagaaaaaaacaaucuggaagaaaaaaaccacacaaagacauugauu

SEQ ID NO: 89351 - RNA, 64 nt, Homo Sapiens
gggggucugggagaaaauaguuacugcuaauggagaagaaaacaucagccaagugucuuucuag

SEQ ID NO: 89352 - RNA, 64 nt, Homo Sapiens
auguaaaguuuaaucuauaaagaagaggccuuuggaagaaaauuucaggucuuuacugaauguu

SEQ ID NO: 89353 - RNA, 64 nt, Homo Sapiens
aagguagaguagaggccuauaagaagaaagagaagaagaaaaagaggauccugaacggaaaagg

SEQ ID NO: 89354 - RNA, 64 nt, Homo Sapiens
aaaaaagaagaggauccugaucagaucacaagaagaagaaaaagcuacagaaacaccaucugau

SEQ ID NO: 89355 - RNA, 64 nt, Homo Sapiens
aaaaaacaggaaaaaaagaaaaugaagaaaaacugaagaaaaaaaaaauuuugcagcgaagaga

SEQ ID NO: 89356 - RNA, 64 nt, Homo Sapiens
ugaagaaaaaaaaaaaacagcagcgaagagaaaugaagaaaaacucacaaaaaaaaaaauuuug

SEQ ID NO: 89357 - RNA, 64 nt, Homo Sapiens
uagauuagaaaauaagacuugcagaaauaaaaaggaagaaaaugagaacucaggaagagguaga

SEQ ID NO: 89358 - RNA, 64 nt, Homo Sapiens
guuuuauuugagugcuuuaaugucauucuauuaugaagaaaacauacuaaagccaugucaugac

SEQ ID NO: 89359 - RNA, 64 nt, Homo Sapiens
aauuuuguauaguuuauuuccuguuauuuuuggugaagaaaaucgaaaaauauggaaaauauug

SEQ ID NO: 89360 - RNA, 64 nt, Homo Sapiens
ccguaagguguauguagaccauauuugauauuuggaagaaaaaguuuuaaaaauaggcuuucuu

SEQ ID NO: 89361 - RNA, 64 nt, Homo Sapiens
guugcugagguuuuuuaauacaauuugaagcauagaagaaaauacagguaaaaaaucauucacc

SEQ ID NO: 89362 - RNA, 64 nt, Homo Sapiens
gcugcccauuucaguacccuguugugaggagaaagaagaaaauggcaaggcuucaggaaacaga

SEQ ID NO: 89363 - RNA, 64 nt, Homo Sapiens
caggaaucaauuuugaggguucagauuuagcuuggaagaaaaaaaagaaacauacauccuucag

SEQ ID NO: 89364 - RNA, 64 nt, Homo Sapiens
augagauuuuuuaguaaagaugagaaagaugguugaagaaaauuagugcauaauuucucaguga

SEQ ID NO: 89365 - RNA, 64 nt, Homo Sapiens
gacuuuugguggugaggaggaagaacaaauaauagaagaaaauaaaaaugagauagaagaaaag

SEQ ID NO: 89366 - RNA, 64 nt, Homo Sapiens
agaacaaauaauagaagaaaauaaaaaugagauagaagaaaaguaagaaccaagauucauauga

SEQ ID NO: 89367 - RNA, 64 nt, Homo Sapiens
caaagagcuaaacuuauucagaaaggaaugacuagaagaaaaaggagacaauaccauguuguuc

SEQ ID NO: 89368 - RNA, 64 nt, Homo Sapiens
uucauugauuuuaaacauuuuauuccuacuuucagaagaaaaauauaauacggaaaaaauuaua

SEQ ID NO: 89369 - RNA, 64 nt, Homo Sapiens
ggagaaaaggaaaagaaaaaaaaaagaagaagaagaagaaaagagaagaagaaaaaaacgaaaa

SEQ ID NO: 89370 - RNA, 64 nt, Homo Sapiens
agaaaaaaaaaagaagaagaagaagaaaagagaagaagaaaaaaacgaaaacagucaaccaacc

SEQ ID NO: 89371 - RNA, 64 nt, Homo Sapiens
ccauuauaacaaaugacaaauccacaauggaauagaagaaaaucauccuaggugaggguagcag

SEQ ID NO: 89372 - RNA, 64 nt, Homo Sapiens
uguaugggugagaggaaggaugaaaaagaggaaagaagaaaaaaacccaauggucugugaucau

SEQ ID NO: 89373 - RNA, 64 nt, Homo Sapiens
aaaauuauuuuggacuaugaauaaagaugaacaggaagaaaaagcuuaguuaauucuucaaaag

SEQ ID NO: 89374 - RNA, 64 nt, Homo Sapiens
ugaaaauggaauguuuucuuucggugugcgccaagaagaaaagguagacucuauuuucucugau

SEQ ID NO: 89375 - RNA, 64 nt, Homo Sapiens
uuaagugauugaugcuguuuaaaaaaaaaaagaggaagaaaauccuaauaagcaaguguaaaaa

SEQ ID NO: 89376 - RNA, 64 nt, Homo Sapiens
uaccagcuuuggaacgagauuuuaacacauuguugaagaaaaggauuaaggguuauacucaguu

SEQ ID NO: 89377 - RNA, 64 nt, Homo Sapiens
aaaaaacaacaguuaaaagcgagaggcuuucauugaagaaaagaaaaacaugucuuuucaaaau

SEQ ID NO: 89378 - RNA, 64 nt, Homo Sapiens
augucuuuucaaaaugagagcaccuuuguugcuugaagaaaaacaguugaggaauuuccucuac

SEQ ID NO: 89379 - RNA, 64 nt, Homo Sapiens
ucaaugaacuugaagaguaauagauacagaaaaagaagaaaaaaaaaaucccgaguggagagau

SEQ ID NO: 89380 - RNA, 64 nt, Homo Sapiens
cuauuguuuuuuauaacaaagaauaccuaaacaggaagaaaauugucaguuuauuaaauguuua

SEQ ID NO: 89381 - RNA, 64 nt, Homo Sapiens
acacauugauaacacaggucaguuauggaggaaagaagaaaauggcaguaagguuucaagguac

SEQ ID NO: 89382 - RNA, 64 nt, Homo Sapiens
ugccuacaggccauaguuaaaaaaaaaaaaaagagaagaaaaacgacagaacaagacugucuca

SEQ ID NO: 89383 - RNA, 64 nt, Homo Sapiens
uagaaagguugcaauuauauuaaauaguaauagugaagaaaaaaaaacuggaacuugacaauua

SEQ ID NO: 89384 - RNA, 64 nt, Homo Sapiens
aaacucagggaucacugggaggaaaaaaaaagaagaagaaaaagagcacagcaguaaacuaugg

SEQ ID NO: 89385 - RNA, 64 nt, Homo Sapiens
gcgcaaugagagaagcagcaguggguacaaggaggaagaaaaagggcuugcagagaguggaaag

SEQ ID NO: 89386 - RNA, 64 nt, Homo Sapiens
ggaauauucaugaaacuucauugcagggguaauagaagaaaaaguaaauugggaggacuuaaug

SEQ ID NO: 89387 - RNA, 64 nt, Homo Sapiens
cagguuuguugaacaaugccuuuucagguuggaagaagaaaaauagccucaaucucccacccca

SEQ ID NO: 89388 - RNA, 64 nt, Homo Sapiens
uagaucaucuugaaguauuauuucacauugaaaagaagaaaauauauugauaacuauagauguu

SEQ ID NO: 89389 - RNA, 64 nt, Homo Sapiens
uuauaauucagguuugaucaaggugugaauaacugaagaaaauaacuugcuggcuauauaggaa

SEQ ID NO: 89390 - RNA, 64 nt, Homo Sapiens
aaacugcuuucuucucgagguauaaccgucggcagaagaaaaggguuccaccucuccccaaccg

SEQ ID NO: 89391 - RNA, 64 nt, Homo Sapiens
uccggccaauggcagaagugggggaaaauuuuuagaagaaaagcaaacaugugagaccaaucau

SEQ ID NO: 89392 - RNA, 64 nt, Homo Sapiens
ccgggcaugguggcucaugcaaauaaaaauagaagaagaaaaggaccguggauuguauuuaaaa

SEQ ID NO: 89393 - RNA, 64 nt, Homo Sapiens
gacccgcaggcuccucccagguucgcuccugugagaagaaaacuaauccaugaugccggacaga

SEQ ID NO: 89394 - RNA, 64 nt, Homo Sapiens
ccacacaccugaauuuucagucacuggaggaacagaagaaaaguccagucuucucaugagcugu

SEQ ID NO: 89395 - RNA, 64 nt, Homo Sapiens
aacuuauuuuguauugaaacuuuuaaacaauacugaagaaaaaaaaacuuuuccgacaucuguu

SEQ ID NO: 89396 - RNA, 64 nt, Homo Sapiens
gccuuauugaaaaacuaaagcaaauucuuuauaggaagaaaauaugggaauuugauuacacaua

SEQ ID NO: 89397 - RNA, 64 nt, Homo Sapiens
agaccuaaaaauaauucucuuguauuuuggagaugaagaaaaaagucauucaccugggagggau

SEQ ID NO: 89398 - RNA, 64 nt, Homo Sapiens
ccuggccaugccuucuugccuuuggaaaaaugaugaagaaaaccuuggcuccuuccuugucugg

SEQ ID NO: 89399 - RNA, 64 nt, Homo Sapiens
caaaacuuggaaagauggaggagaaaaagaaaaggaagaaaaaaaugucacccauagucucacc

SEQ ID NO: 89400 - RNA, 64 nt, Homo Sapiens
ggccccaccaagaggguggaucacaccucagugggaagaaaaauaaaauuuccuucagguuuua

SEQ ID NO: 89401 - RNA, 64 nt, Homo Sapiens
gcaugcuuugauaucugguucagacuaucaucaggaagaaaaaaaaaucccacaguaccugaaa

SEQ ID NO: 89402 - RNA, 64 nt, Homo Sapiens
agaguaguuaugugauuauuacagucaauagaaugaagaaaauuggcugugucuauaacuugac

SEQ ID NO: 89403 - RNA, 64 nt, Homo Sapiens
acuuuggcugugucuauaacaaucaucagaggccgaagaaaaacucauguucuucaucuucuca

SEQ ID NO: 89404 - RNA, 64 nt, Homo Sapiens
aucaagaagagcaaagcauggaggaacgggcuuggaagaaaauagguuucagaugaugaagaaa

SEQ ID NO: 89405 - RNA, 64 nt, Homo Sapiens
aaggaaagaaugagucuaauaaugugaacaaaaggaagaaaaucaaguccaaaagucacuuuug

SEQ ID NO: 89406 - RNA, 64 nt, Homo Sapiens
aagagaaacuagaaacaguucuagccuuccaagagaagaaaaagacuuaaagaauuugucaauc

SEQ ID NO: 89407 - RNA, 64 nt, Homo Sapiens
aaguucuauuuuauuaauuugaagaggagccucagaagaaaacacacauacuaccuagaaguaa

SEQ ID NO: 89408 - RNA, 64 nt, Homo Sapiens
aggccgagugaaggugcugggugccgaggaggaggaagaaaaacgcucagcgcgucucagcuca

SEQ ID NO: 89409 - RNA, 64 nt, Homo Sapiens
gcagcaagaaauaucucuuuuuuucaaagaggaagaagaaaauacaggccagaagaaaaguugc

SEQ ID NO: 89410 - RNA, 64 nt, Homo Sapiens
ugcuuuucaaagaggaagaagaauaugcaggccagaagaaaaguuugccagcugucuacacaaa

SEQ ID NO: 89411 - RNA, 64 nt, Homo Sapiens
aaaaaacaaaaaacuaaagguuauuuagaaaaaggaagaaaaacuucuccaccaagcauuuggu

SEQ ID NO: 89412 - RNA, 64 nt, Homo Sapiens
cuucuggauguccagccagcaggcguggccgagggaagaaaaagaggacuggaggccgccaggc

SEQ ID NO: 89413 - RNA, 64 nt, Homo Sapiens
uuuaugagagaaaaggaaaaaggaaucaaagguggaagaaaaaaaaagccaaauucuguuuacg

SEQ ID NO: 89414 - RNA, 64 nt, Homo Sapiens
uacgccuaaugaacaagcacaguuuuucaauggugaagaaaaaagcaccagacuuuuuuucuuu

SEQ ID NO: 89415 - RNA, 64 nt, Homo Sapiens
ucaacaaaauugauagaccgcuagcaagacuaaugaagaaaagagagaagaaucaaauagaugc

SEQ ID NO: 89416 - RNA, 64 nt, Homo Sapiens
cuuacauguuagaccuaaaaccauaaaaacccuagaagaaaaccuaggcaauaccauucaggac

SEQ ID NO: 89417 - RNA, 64 nt, Homo Sapiens
uaucaaacuaccaauggcauuuuucacagaaucagaagaaaacauucugaaauuuauuuggaac

SEQ ID NO: 89418 - RNA, 64 nt, Homo Sapiens
cuuaaauauaaaaccuaaaaguauuaaauuccuagaagaaaacccaggaaaugccauucuggac

SEQ ID NO: 89419 - RNA, 64 nt, Homo Sapiens
aaaaacacagcaugagaacuucgugaagcauacagaagaaaaaccuucagccagauugaaugcu

SEQ ID NO: 89420 - RNA, 64 nt, Homo Sapiens
uccaaccuuuugucuucccugggccacauuggaagaagaaaaauugucuugugccacacauaca

SEQ ID NO: 89421 - RNA, 64 nt, Homo Sapiens
cauggaacuuuuaaugaaggacagugucuucuuugaagaaaaucaagcucguguuuuuauucga

SEQ ID NO: 89422 - RNA, 64 nt, Homo Sapiens
gacuuaaaaccaaauucagggacaaauggauagagaagaaaagggucaaacaucgagauuacau

SEQ ID NO: 89423 - RNA, 64 nt, Homo Sapiens
ugauggauuggacguugugacucuugccuuuuaagaagaaaaaaaagauaggacaaaguauuug

SEQ ID NO: 89424 - RNA, 64 nt, Homo Sapiens
ccucuagacacaugaaggccaguuauaugcuggagaagaaaaauaucacauccauucucaaggu

SEQ ID NO: 89425 - RNA, 64 nt, Homo Sapiens
uuaaaaccaaaccucguuuaggagagccagccaagaagaaaauuuaaaggcaacuugcaggaga

SEQ ID NO: 89426 - RNA, 64 nt, Homo Sapiens
ccuauaaaaaguggcuaaucgguuagucucuccugaagaaaaagcagaguugagaguuggguga

SEQ ID NO: 89427 - RNA, 64 nt, Homo Sapiens
aaaucauugaacugagggggaaaaauguaacuaggaagaaaaacccaauuuaagaaauuacaua

SEQ ID NO: 89428 - RNA, 64 nt, Homo Sapiens
gucauuucugcugaaaaaacagaugauccugguggaagaaaagguugaaggcagcugcccucgg

SEQ ID NO: 89429 - RNA, 64 nt, Homo Sapiens
gcugcuuucagcaaaagucaaaaauuccuuccaugaagaaaacuauauauuuugccccugcuau

SEQ ID NO: 89430 - RNA, 64 nt, Homo Sapiens
gcaaguuguucaauuuuaauucagaaaaaucaaggaagaaaaaaaaaguuuccauggaagcugu

SEQ ID NO: 89431 - RNA, 64 nt, Homo Sapiens
uucagguacuaucagaaaccacuggguaacaacagaagaaaaccacuucuugguguuggaggcc

SEQ ID NO: 89432 - RNA, 64 nt, Homo Sapiens
uuaaucucuucuauuuuguugucguugcuuguuugaagaaaaucaugacauuccaaguugacau

SEQ ID NO: 89433 - RNA, 64 nt, Homo Sapiens
acuuuaggaaacagagcugccaauugaaacagaagaagaaaaaaaaaaaaagcagcagacaaca

SEQ ID NO: 89434 - RNA, 64 nt, Homo Sapiens
cggccacaccgcugaaggccaaagaggccacaaagaagaaaaagaaacaguuugggaagaaaag

SEQ ID NO: 89435 - RNA, 64 nt, Homo Sapiens
aagaggccacaaagaagaaaaagaaacaguuugggaagaaaaggaaaagaaucccgcccacuaa

SEQ ID NO: 89436 - RNA, 64 nt, Homo Sapiens
aaauguguaagucacccccaccaaaaacaaaagagaagaaaaagaauagaaagaauuauccagu

SEQ ID NO: 89437 - RNA, 64 nt, Homo Sapiens
cacucucuuuccaauuucacuuugguggucugaagaagaaaaagaaauuuuauguauguaugug

SEQ ID NO: 89438 - RNA, 64 nt, Homo Sapiens
aagacugaaauaaaacucugcugcaggaaagauggaagaaaagacagucaaauggggugggggu

SEQ ID NO: 89439 - RNA, 64 nt, Homo Sapiens
aguagugaauccccucauuuugugcauucacuuugaagaaaaagguuucucaaagaugcacacu

SEQ ID NO: 89440 - RNA, 64 nt, Homo Sapiens
uuuuugauguugauuuugaccuguucaugauucagaagaaaaacaaacuuuuuuggauuuuuuu

SEQ ID NO: 89441 - RNA, 64 nt, Homo Sapiens
ucuccucuaaucuguguacacaucuccaagcaaggaagaaaaaacaaacucugcucagacgccu

SEQ ID NO: 89442 - RNA, 64 nt, Homo Sapiens
acacgaacaggugucuuaaucuuaacaaaagcaagaagaaaagcacuuaaacggaugggauuca

SEQ ID NO: 89443 - RNA, 64 nt, Homo Sapiens
caaaaacaagaacaaaaacacauuuguuugcuuugaagaaaaaguccauacuuaaagaccaaau

SEQ ID NO: 89444 - RNA, 64 nt, Homo Sapiens
ucauggggaggucuaccuucuuuauaguuuuggggaagaaaauaaaaaaucaucucacaugcau

SEQ ID NO: 89445 - RNA, 64 nt, Homo Sapiens
gcuauuaaugggcuaauaaauauugguguuauuggaagaaaaauuaaauaaauaauuuaaauuu

SEQ ID NO: 89446 - RNA, 64 nt, Homo Sapiens
aguaacauuauccuuagguuccuaaguaaaacaggaagaaaaucuguccauaugucuuuaccua

SEQ ID NO: 89447 - RNA, 64 nt, Homo Sapiens
agagguagauacagucagugcaagaggaucagaugaagaaaaggaaauggacuuuagacaaaag

SEQ ID NO: 89448 - RNA, 64 nt, Homo Sapiens
agagguagauacagucagugaaggaacaccugaugaagaaaaggagucaauauggauuuagaaa

SEQ ID NO: 89449 - RNA, 64 nt, Homo Sapiens
cuuaaauguuauguauauggucuaaaauauuuaugaagaaaauaacaaaauacauucuuuuugc

SEQ ID NO: 89450 - RNA, 64 nt, Homo Sapiens
cuguuaucauuuuuuccuguugggaaguuaaagggaagaaaacaugauuaacuuggaugaguuu

SEQ ID NO: 89451 - RNA, 64 nt, Homo Sapiens
cccuuaacuuucuuuccaaugacucggccggagagaagaaaaggcccccaauaagaagagauga

SEQ ID NO: 89452 - RNA, 64 nt, Homo Sapiens
gcagacguuuccccucucucaaaacacaacugcugaagaaaauauuacaccaagcccuucccau

SEQ ID NO: 89453 - RNA, 64 nt, Homo Sapiens
acacugagaacuagaggaggguugaugccacuuugaagaaaagaagauaggccuggaagagacu

SEQ ID NO: 89454 - RNA, 64 nt, Homo Sapiens
aggaagcaguugccuuccgguuuauacauugaaggaagaaaagaccuuuaggaaagaagaccug

SEQ ID NO: 89455 - RNA, 64 nt, Homo Sapiens
ucuccugauaauucaagggagcucaaagucacaagaagaaaaaugaaaggaaaaaacagcagcc

SEQ ID NO: 89456 - RNA, 64 nt, Homo Sapiens
uaaauuuuauuggggaccauggaaugguaguugagaagaaaacuauuugcacacaacagauuuu

SEQ ID NO: 89457 - RNA, 64 nt, Homo Sapiens
guuggggagagguguucgguuuccccagccuguuaaugaacagccauacguguaagcuuuuucu

SEQ ID NO: 89458 - RNA, 64 nt, Homo Sapiens
ggcugggagggagaggggcuccggcuuucucugaaaugaacacugcucuucagcaguucaagua

SEQ ID NO: 89459 - RNA, 64 nt, Homo Sapiens
uuucaaauauaaaacuauauguuuauguuuuaagaaugaacacuagcucugcuguauuuuaaau

SEQ ID NO: 89460 - RNA, 64 nt, Homo Sapiens
auucuuaaauaaaacauucaaaaugugaugaccaaaugaacaaaacaaaguagguguucaacaa

SEQ ID NO: 89461 - RNA, 64 nt, Homo Sapiens
gaagugaggcuucccaagaaacauacaucugugaaaugaacaagucccuggugauguuucuucc

SEQ ID NO: 89462 - RNA, 64 nt, Homo Sapiens
gaacuuggccacaggccccaaauggaaaaaccaaaaugaacacuaaagggacuuucugaaggaa

SEQ ID NO: 89463 - RNA, 64 nt, Homo Sapiens
guaagguuagcuagcuuccuccaaaucuugugauaaugaacaccuggcagaacuggcacuaggu

SEQ ID NO: 89464 - RNA, 64 nt, Homo Sapiens
aaaagauguaaaaacauuuuaccaagagcacaugaaugaacagguaaguuuuuauuuuacuuga

SEQ ID NO: 89465 - RNA, 64 nt, Homo Sapiens
caaacuagauuugguauguuagaaugaacaaguuaaugaacaaaaaaauucucauuauuugcaa

SEQ ID NO: 89466 - RNA, 64 nt, Homo Sapiens
uuaaugaacaaacaaacuagcauuauuugcaaagaaugaacaaguuaauggaaaaaaaaauucu

SEQ ID NO: 89467 - RNA, 64 nt, Homo Sapiens
auuguuaggaccacugaggaacgacaguacuuucaaugaacauaccugagucccaauuacauuc

SEQ ID NO: 89468 - RNA, 64 nt, Homo Sapiens
uauaaaauguaucaacacacacaguaguguauuaaaugaacaucgcugcaaucgcuuuccuaaa

SEQ ID NO: 89469 - RNA, 64 nt, Homo Sapiens
gcauauucagggcauguuuauugcuaaagaugagaaugaacaaaagcauacuaaaaugaacaag

SEQ ID NO: 89470 - RNA, 64 nt, Homo Sapiens
uugcuaaagaugagaaugaaggcaagcauacuaaaaugaacaagggauggagcgcagauaucca

SEQ ID NO: 89471 - RNA, 64 nt, Homo Sapiens
uaaugaaggacuccacugugccccacuuucugccaaugaacaguggcuugauaauaccaaguau

SEQ ID NO: 89472 - RNA, 64 nt, Homo Sapiens
cuuuuuaaacuacuaguuuuaaaaaccuguguuaaaugaacaguaauugccugguagguuuggu

SEQ ID NO: 89473 - RNA, 64 nt, Homo Sapiens
caaacuaaacuuuggccauccacugcuuuucuugaaugaacagcuaaugcccaauauccaccga

SEQ ID NO: 89474 - RNA, 64 nt, Homo Sapiens
aaugugagugcucucuaaauuuagaggcaucuuuaaugaacaugauguuaaagagggaguuuug

SEQ ID NO: 89475 - RNA, 64 nt, Homo Sapiens
cccaacuuccuuuaauuauugcuugucuuaaaauaaugaacacuacagauagaaaauaugauau

SEQ ID NO: 89476 - RNA, 64 nt, Homo Sapiens
uaaugagacaugaauugugucucaacagaaacuaaaugaacauuucagaauaaauuauugcugu

SEQ ID NO: 89477 - RNA, 64 nt, Homo Sapiens
uggcuugaaacuuguguaucauaugugauuuugaaaugaacaccuugaauagcacuaauuuuua

SEQ ID NO: 89478 - RNA, 64 nt, Homo Sapiens
uuuugugacuguuaccaugugaaaguccuguugaaaugaacaauugucugccccacaaucaaga

SEQ ID NO: 89479 - RNA, 64 nt, Homo Sapiens
uggaaguaaauucuaguuuguaguucucauuuguaaugaacacauuaacgacuagauuaaaaua

SEQ ID NO: 89480 - RNA, 64 nt, Homo Sapiens
auaacuuuucuaaauguagugccuuuaaaggaaaaaugaacacagggaagugacuuugcuacaa

SEQ ID NO: 89481 - RNA, 64 nt, Homo Sapiens
aaaauuuucuaagauuaacugguaguucauuguaaaugaacauaaugaacagaauuuaugacuc

SEQ ID NO: 89482 - RNA, 64 nt, Homo Sapiens
uaagauuaacugguaguucauuguaaaugaacauaaugaacagaauuuaugacuccacugugga

SEQ ID NO: 89483 - RNA, 64 nt, Homo Sapiens
uaaaaauucccagaccacaguaaugccuugaaagaaugaacaaauagaaauuauccuuucuuac

SEQ ID NO: 89484 - RNA, 64 nt, Homo Sapiens
uguacauacacucaggaagggcagaggcccaauaaaugaacaaaaauucauuuucauuuguugg

SEQ ID NO: 89485 - RNA, 64 nt, Homo Sapiens
cucugcuacucuuaggcugcauaguuuaugagaaaaugaacacaugcauuuauggauccaguau

SEQ ID NO: 89486 - RNA, 64 nt, Homo Sapiens
guggauugcauuguuaggaagaacauuuggugggaaugaacacuccugggcauaccgcugacuu

SEQ ID NO: 89487 - RNA, 64 nt, Homo Sapiens
auagcacuguaacggaaaaugauucuguuaauguaaugaacaugggaaagaccagccuuggccu

SEQ ID NO: 89488 - RNA, 64 nt, Homo Sapiens
acagccacuauccauuuggaaaacuuaaaagaauaaugaacaguuauguucuaucuagauucag

SEQ ID NO: 89489 - RNA, 64 nt, Homo Sapiens
uauaaaaagagaauaugguaaaugaaaaaauaaaaaugaacaggucucugauaaaaagaaaaaa

SEQ ID NO: 89490 - RNA, 64 nt, Homo Sapiens
cugggagugguggcucagccauuagggauacaaaaaugaacagguagacauuucaaacugucac

SEQ ID NO: 89491 - RNA, 64 nt, Homo Sapiens; identical to SEQ ID NO: 85770

SEQ ID NO: 89492 - RNA, 64 nt, Homo Sapiens; identical to SEQ ID NO: 85771

SEQ ID NO: 89493 - RNA, 64 nt, Homo Sapiens; identical to SEQ ID NO: 85772

SEQ ID NO: 89494 - RNA, 64 nt, Homo Sapiens; identical to SEQ ID NO: 85773

SEQ ID NO: 89495 - RNA, 64 nt, Homo Sapiens; identical to SEQ ID NO: 85774

SEQ ID NO: 89496 - RNA, 64 nt, Homo Sapiens; identical to SEQ ID NO: 85775

SEQ ID NO: 89497 - RNA, 64 nt, Homo Sapiens; identical to SEQ ID NO: 85776

SEQ ID NO: 89498 - RNA, 64 nt, Homo Sapiens; identical to SEQ ID NO: 85777

SEQ ID NO: 89499 - RNA, 64 nt, Homo Sapiens; identical to SEQ ID NO: 85778

SEQ ID NO: 89500 - RNA, 64 nt, Homo Sapiens; identical to SEQ ID NO: 85779

SEQ ID NO: 89501 - RNA, 64 nt, Homo Sapiens; identical to SEQ ID NO: 85780

SEQ ID NO: 89502 - RNA, 64 nt, Homo Sapiens; identical to SEQ ID NO: 85781

SEQ ID NO: 89503 - RNA, 64 nt, Homo Sapiens; identical to SEQ ID NO: 85782

SEQ ID NO: 89504 - RNA, 64 nt, Homo Sapiens; identical to SEQ ID NO: 85783

SEQ ID NO: 89505 - RNA, 64 nt, Homo Sapiens; identical to SEQ ID NO: 85784

SEQ ID NO: 89506 - RNA, 64 nt, Homo Sapiens; identical to SEQ ID NO: 85785

SEQ ID NO: 89507 - RNA, 64 nt, Homo Sapiens; identical to SEQ ID NO: 85786

SEQ ID NO: 89508 - RNA, 64 nt, Homo Sapiens; identical to SEQ ID NO: 85787

SEQ ID NO: 89509 - RNA, 64 nt, Homo Sapiens; identical to SEQ ID NO: 85788

SEQ ID NO: 89510 - RNA, 64 nt, Homo Sapiens; identical to SEQ ID NO: 85789

SEQ ID NO: 89511 - RNA, 64 nt, Homo Sapiens; identical to SEQ ID NO: 85790

SEQ ID NO: 89512 - RNA, 64 nt, Homo Sapiens; identical to SEQ ID NO: 85791

SEQ ID NO: 89513 - RNA, 64 nt, Homo Sapiens; identical to SEQ ID NO: 85792

SEQ ID NO: 89514 - RNA, 64 nt, Homo Sapiens; identical to SEQ ID NO: 85793

SEQ ID NO: 89515 - RNA, 64 nt, Homo Sapiens; identical to SEQ ID NO: 85794

SEQ ID NO: 89516 - RNA, 64 nt, Homo Sapiens; identical to SEQ ID NO: 85795

SEQ ID NO: 89517 - RNA, 64 nt, Homo Sapiens; identical to SEQ ID NO: 85796

SEQ ID NO: 89518 - RNA, 64 nt, Homo Sapiens; identical to SEQ ID NO: 85797

SEQ ID NO: 89519 - RNA, 64 nt, Homo Sapiens; identical to SEQ ID NO: 85798

SEQ ID NO: 89520 - RNA, 64 nt, Homo Sapiens; identical to SEQ ID NO: 85799

SEQ ID NO: 89521 - RNA, 64 nt, Homo Sapiens; identical to SEQ ID NO: 85800

SEQ ID NO: 89522 - RNA, 64 nt, Homo Sapiens; identical to SEQ ID NO: 85801

SEQ ID NO: 89523 - RNA, 64 nt, Homo Sapiens; identical to SEQ ID NO: 85802

SEQ ID NO: 89524 - RNA, 64 nt, Homo Sapiens; identical to SEQ ID NO: 85803

SEQ ID NO: 89525 - RNA, 64 nt, Homo Sapiens; identical to SEQ ID NO: 85804

SEQ ID NO: 89526 - RNA, 64 nt, Homo Sapiens; identical to SEQ ID NO: 85805

SEQ ID NO: 89527 - RNA, 64 nt, Homo Sapiens; identical to SEQ ID NO: 85806

SEQ ID NO: 89528 - RNA, 64 nt, Homo Sapiens; identical to SEQ ID NO: 85807

SEQ ID NO: 89529 - RNA, 64 nt, Homo Sapiens; identical to SEQ ID NO: 85808

SEQ ID NO: 89530 - RNA, 64 nt, Homo Sapiens; identical to SEQ ID NO: 85809

SEQ ID NO: 89531 - RNA, 64 nt, Homo Sapiens; identical to SEQ ID NO: 85810

SEQ ID NO: 89532 - RNA, 64 nt, Homo Sapiens; identical to SEQ ID NO: 85811

SEQ ID NO: 89533 - RNA, 64 nt, Homo Sapiens
uuaagauacacaacuuguuucuuaguucauauaaucucgggauacacacacacacacacauaua

SEQ ID NO: 89534 - RNA, 64 nt, Homo Sapiens
caaauaaggaaagcacugaaauguugugauugggucucgggaaaugcucagauugaugucuuac

SEQ ID NO: 89535 - RNA, 64 nt, Homo Sapiens
caugaccuucacgagcaauacugcgucaucaccaucucgggacgcgcccucccuucuccacagg

SEQ ID NO: 89536 - RNA, 64 nt, Homo Sapiens
guuuugucuguugccgucaguaucugcgacucugucucgggaaugauucuuuccuguaaagucu

SEQ ID NO: 89537 - RNA, 64 nt, Homo Sapiens
ucguuugggaguguucugugcccuauucccuaacucucgggaccaugcccuccaauccuuucca

SEQ ID NO: 89538 - RNA, 64 nt, Homo Sapiens
uguauuuucuaauaaaugacccuuguaucuccuuucucgggaauacuucccacuucccagaauc

SEQ ID NO: 89539 - RNA, 64 nt, Homo Sapiens
ugcagcugauacuuguuugggcacaccuccaaguucucgggauuagaaggacaagagcacuccc

SEQ ID NO: 89540 - RNA, 64 nt, Homo Sapiens
gggagcuagggagagacucuggagguggugggucucucgggagaccccuaaugaggaaguugag

SEQ ID NO: 89541 - RNA, 64 nt, Homo Sapiens
ggcugccucaucaacggcaagaggaaaggaggggucucgggacaucuccagacccuaccaacug

SEQ ID NO: 89542 - RNA, 64 nt, Homo Sapiens
ugcggaucugggaaauggcucugccuuaggcacuucucgggaauuugaggccagccugaggaac

SEQ ID NO: 89543 - RNA, 64 nt, Homo Sapiens
ccugggguccuuuuuuuuauuuucugaaaaucacucucgggacugccguccucgcugcuggggg

SEQ ID NO: 89544 - RNA, 64 nt, Homo Sapiens
uggaacauuguuauccuuguccuucugagcacucucucgggagugccuucacuccaccuuuagu

SEQ ID NO: 89545 - RNA, 64 nt, Homo Sapiens
acuuagagccucgaacccgcccaaccgcugccuuucucgggaguaggugugaacccagggcccg

SEQ ID NO: 89546 - RNA, 64 nt, Homo Sapiens
ggacucagaaguaugccauggguacaacagaauaucucgggaauagaaauacgcuauguuguag

SEQ ID NO: 89547 - RNA, 64 nt, Homo Sapiens
uugcaacaagguuaccucuauuuugccacaagcgucucgggauuguguuugacuugugucuguc

SEQ ID NO: 89548 - RNA, 64 nt, Homo Sapiens
acuccucuacucacagcugaucaacaacugcuacucucgggaaggaaggcuucaaucauuugga

SEQ ID NO: 89549 - RNA, 64 nt, Homo Sapiens
gcgcgggugguguguguguuugaguugcaauuucucucgggaugaagugccgcgaaaaaaugga

SEQ ID NO: 89550 - RNA, 64 nt, Homo Sapiens
ugugaugaacucccaggagaaggacacucuucccucucgggauguuugccugccaccucugccc

SEQ ID NO: 89551 - RNA, 64 nt, Homo Sapiens
uuuauuuaggcugugacucucucucuaaugcugcucucgggaaggacgaaagugaccugcaagg

SEQ ID NO: 89552 - RNA, 64 nt, Homo Sapiens
aggcggugaggccagggcuuccagccucgugcugucucgggacuccugaccguggugugcgugu

SEQ ID NO: 89553 - RNA, 64 nt, Homo Sapiens
ucuccugggcugucucuggucuggucagccuggcucucgggaaauucagccaugagcagggaaa

SEQ ID NO: 89554 - RNA, 64 nt, Homo Sapiens
aguugaacaaaaauuaugaaaagguauauuugcuucucgggaaagcaaagaagcugcuuuaaaa

SEQ ID NO: 89555 - RNA, 64 nt, Homo Sapiens
guagcaccaugccaaccagcgagaaggagggaggucucgggaguuaagcagagcuguucuuggg

SEQ ID NO: 89556 - RNA, 64 nt, Homo Sapiens
aucacaccucgacacccaacuccuuggaguagccucucgggaggacagugaccccgagccgcuc

SEQ ID NO: 89557 - RNA, 64 nt, Homo Sapiens
cuucuguguuucccaaguauauuugccuacagcaucucgggacgcuugccucaacuucccucuc

SEQ ID NO: 89558 - RNA, 64 nt, Homo Sapiens
ucauagcaaccucaaguaaucuuuauucugagggucucgggauugcagguugaaaaacacaacc

SEQ ID NO: 89559 - RNA, 64 nt, Homo Sapiens
cacacucggaagaucccgugugugcacgcuggcuucucgggaccagccagggccaaggcuuggg

SEQ ID NO: 89560 - RNA, 64 nt, Homo Sapiens
auugcucuucugucuauaaauuuuaauuauauuuucucgggauuauuccauguucagcagagua

SEQ ID NO: 89561 - RNA, 64 nt, Homo Sapiens
acagaaguaccuugauuuaauuuuuuaaacguguucucgggaaguuagggcuaaagaaaauuuu

SEQ ID NO: 89562 - RNA, 64 nt, Homo Sapiens
ugcaaaugaacuucagacggaccucaggguagguucucgggacugaaggaaggccaagccauua

SEQ ID NO: 89563 - RNA, 64 nt, Homo Sapiens
ugcugccgucagacuccugcgcaucggcaagggcucucgggagccuggcucuggauggagccag

SEQ ID NO: 89564 - RNA, 64 nt, Homo Sapiens
guugcugugaccucccuaagacacugaagauacuucucgggaaaggaucaucgccguugaaaug

SEQ ID NO: 89565 - RNA, 64 nt, Homo Sapiens
ccucccaagggcucagaugcugcuggcagaguugucucgggagcggggugagcugcagggugaa

SEQ ID NO: 89566 - RNA, 64 nt, Homo Sapiens
cauuccgugcggugguaucucccaggcucuacauucucgggagcggcgccucccaagggggucc

SEQ ID NO: 89567 - RNA, 64 nt, Homo Sapiens
uguuguaagaauaggcauuaacacaaaggaggcgucucgggagaggauuagguuccauccuuua

SEQ ID NO: 89568 - RNA, 64 nt, Homo Sapiens
gcggugugucuuuccagaaggucacguggaaaugucucgggacuugggucccggagugcccgug

SEQ ID NO: 89569 - RNA, 64 nt, Homo Sapiens
aauuuuauagaaaaauaaaguaaaagaaaauuucucucgggaauaguuauuuacuuugggcauu

SEQ ID NO: 89570 - RNA, 64 nt, Homo Sapiens
uuauuaugacucaauaaaaggcaggacucggaauucucgggaaacugggcaagaaccuaaagua

SEQ ID NO: 89571 - RNA, 64 nt, Homo Sapiens
auccuauaacuugcuuuacucaggagcggggacuucucgggaaagggcuggcaguagggaguuc

SEQ ID NO: 89572 - RNA, 64 nt, Homo Sapiens
auguugagagaugauucuuucuuggcccuggccaucucgggaagcuugauggcaauccuggaag

SEQ ID NO: 89573 - RNA, 64 nt, Homo Sapiens
gcaucgaggaagggccgaggaaugugaagccagaucucgggacucagauuggaauguuacaucu

SEQ ID NO: 89574 - RNA, 64 nt, Homo Sapiens
acuccuuccacucugggggcggaggggaauggcuucucgggacccucagcuagcgugggugccc

SEQ ID NO: 89575 - RNA, 64 nt, Homo Sapiens
ucugaaaugaugcuggaugguuccuuuacacauuucucgggaaaugggacauggauucuugauc

SEQ ID NO: 89576 - RNA, 64 nt, Homo Sapiens
aggggaacuugugccccagacauuaggcagccagucucgggagacacaaaguaggaucccagug

SEQ ID NO: 89577 - RNA, 64 nt, Homo Sapiens
cgaggaaauuauuccugagacugagguucaguacucucgggacuaauuuaagacggugaugaaa

SEQ ID NO: 89578 - RNA, 64 nt, Homo Sapiens
ccucuagcaggccuaagacauggccugagcaacaucucgggaguuagccccagggaucacuggc

SEQ ID NO: 89579 - RNA, 64 nt, Homo Sapiens
aggggaggggaacuuccacccgaggggaagaugcucucgggacaguuucccgggcagcuccugg

SEQ ID NO: 89580 - RNA, 64 nt, Homo Sapiens
cccauucccaagggagacugaccaucaugcccucucucgggagcccuagcccugcuccaacucc

SEQ ID NO: 89581 - RNA, 64 nt, Homo Sapiens
gaggccgccaguggagaucagccucggccucgagucucgggacaaacaagugccuucagggcug

SEQ ID NO: 89582 - RNA, 64 nt, Homo Sapiens
caggacccuccugacuggugcuggcuggugguuuucucgggaagugggguucccgcacccuggg

SEQ ID NO: 89583 - RNA, 64 nt, Homo Sapiens
uuucaucuaggauuuuaaggggccucuucugcuuucucgggaauugggaauccgcccaucuggg

SEQ ID NO: 89584 - RNA, 64 nt, Homo Sapiens
agaagacaaaagguaaagacgcaacguuuccaacucucgggacgccaaggccgcaggacuggag

SEQ ID NO: 89585 - RNA, 64 nt, Homo Sapiens
ggcauucaggcccagaugccugcagggcuggggcucucgggacagaugcagggaugugugcugc

SEQ ID NO: 89586 - RNA, 64 nt, Homo Sapiens
caacacccucaaccggcuccaucacauccucaggucucgggaccauggggggcucagaggggag

SEQ ID NO: 89587 - RNA, 64 nt, Homo Sapiens
aacaaauauucgggacuuucagucaaaacucuucucucgggacaucccaccuggaccucuucaa

SEQ ID NO: 89588 - RNA, 64 nt, Homo Sapiens
cuccccgguuccuccccugcgccuucccucuuccucucgggagcucuguguccccaguagcuca

SEQ ID NO: 89589 - RNA, 64 nt, Homo Sapiens
agcugccuucgcaccuugcucaaccaccacaagcucucgggacuuagcccaggcaagagagaag

SEQ ID NO: 89590 - RNA, 64 nt, Homo Sapiens
cccacuggaaaaaaauaguuuuuucauuaguauuucucgggaggacccaaaaguuaaggucagc

SEQ ID NO: 89591 - RNA, 64 nt, Homo Sapiens
agccccuuaggaggacaggccugcagcauccuggucucgggaggcuucugucauugcucacaca

SEQ ID NO: 89592 - RNA, 64 nt, Homo Sapiens
cccaagaaucagcaacugcagugugaggacagcgucucgggaggcaggacccuagggagacccg

SEQ ID NO: 89593 - RNA, 64 nt, Homo Sapiens
aagauuugagguuuuuccagaagcuuugucugccucucgggaggaaggccguggggcugggacc

SEQ ID NO: 89594 - RNA, 64 nt, Homo Sapiens
aacccacccucuucagagcccacacacccccgcgucucgggagaacagagggcugcccccacca

SEQ ID NO: 89595 - RNA, 64 nt, Homo Sapiens
cugccugguccucugcguuguagugcuaccucaaucucgggagaaacagcccuauauucuaaca

SEQ ID NO: 89596 - RNA, 64 nt, Homo Sapiens
cacagacgcccgagacccacggcgggagggggacucucgggagcaacgucgagaccccaccgag

SEQ ID NO: 89597 - RNA, 64 nt, Homo Sapiens
acuugggccucugccucuguaccugcagcucugcucucgggauggugcuuccuuuaucuugaag

SEQ ID NO: 89598 - RNA, 64 nt, Homo Sapiens
gcccuaacagcuagaaucaacuugagagccuuggggaaauuagggguggcacuuaugguggugg

SEQ ID NO: 89599 - RNA, 64 nt, Homo Sapiens
ucaucagguggaaagucuggagcuucacaaugauggaaauuauucaauucagucucuuaagauu

SEQ ID NO: 89600 - RNA, 64 nt, Homo Sapiens
ugcauaccugccagcucguaugccucuggcauggggaaauuaagggaacagugucuguuugcau

SEQ ID NO: 89601 - RNA, 64 nt, Homo Sapiens
auauccgugauauuaugucgauuuuuaacugaggggaaauuaacuaguccagccuaaaaugcuu

SEQ ID NO: 89602 - RNA, 64 nt, Homo Sapiens
cuaguccuuuuaagggguaauuuuguuagagauuggaaauuauaugugagauuugacacuaagu

SEQ ID NO: 89603 - RNA, 64 nt, Homo Sapiens
auuuuucaaagaacaaagcuuugcauccuagauuggaaauuaaaaaauaaacauauauucuugc

SEQ ID NO: 89604 - RNA, 64 nt, Homo Sapiens
guuugucuauuuuugacaauauauuccuguuaaaggaaauuaaauauggaaggcuguuaaauua

SEQ ID NO: 89605 - RNA, 64 nt, Homo Sapiens
ucugagaucuagucccucucuaccugugaggauaggaaauuaguuccauugagugaaugaugaa

SEQ ID NO: 89606 - RNA, 64 nt, Homo Sapiens
uuagcaauuuuuuuuucucuuuuauccauuuuauggaaauuagcagaugugugaauacuuaauu

SEQ ID NO: 89607 - RNA, 64 nt, Homo Sapiens
caccgauguagcacuucccacuuuagcaaauggaggaaauuaagcacuaggcaguucccacuuu

SEQ ID NO: 89608 - RNA, 64 nt, Homo Sapiens
uaggauuggcaauguaaagagcagauaccagaagggaaauuauuacugauucuuucugugauua

SEQ ID NO: 89609 - RNA, 64 nt, Homo Sapiens
gauucuuucugugauuagcaaaccuuuugccccuggaaauuacuguuuaggaaagcagugcuuu

SEQ ID NO: 89610 - RNA, 64 nt, Homo Sapiens
caaaaguaaauugggaaggauaacaacuggaacuggaaauuauauaacuucacuagagcauaca

SEQ ID NO: 89611 - RNA, 64 nt, Homo Sapiens
uauuagaauuuaaagaauuuaacuuuagaguauaggaaauuaacuaugcugaaaguaugcucug

SEQ ID NO: 89612 - RNA, 64 nt, Homo Sapiens
uggaauucaacuaagaucugucagcuguccccagggaaauuaagauuuggaaaaaugcaguguc

SEQ ID NO: 89613 - RNA, 64 nt, Homo Sapiens
uucacauauaaaguacaucagucugacccuuguaggaaauuauaauuaaccuuaugaaucagaa

SEQ ID NO: 89614 - RNA, 64 nt, Homo Sapiens
agucauggaauaauguuuaaguuguuauuugcauggaaauuaaguaggcuguuuauuuaucuaa

SEQ ID NO: 89615 - RNA, 64 nt, Homo Sapiens
caggagacuguucuaccuuuuaauuugaaaacaaggaaauuaaauuuuaacagaaaucuuuuaa

SEQ ID NO: 89616 - RNA, 64 nt, Homo Sapiens
gcaacaaaagaagcccggcuucucucaggugaaaggaaauuaagaaagacccuggcuuucauuu

SEQ ID NO: 89617 - RNA, 64 nt, Homo Sapiens
ggauuaacccacuagcucuuggccugagguuacuggaaauuagggccauggacucuguccugaa

SEQ ID NO: 89618 - RNA, 64 nt, Homo Sapiens
uaugaguucaaaaugcaaugaggaaaucugacagggaaauuaucuguaugaacuaaaaguaagg

SEQ ID NO: 89619 - RNA, 64 nt, Homo Sapiens
gacuccauuuaaaaauaucacagggugggggcaaggaaauuagcugagauucaucucaggauug

SEQ ID NO: 89620 - RNA, 64 nt, Homo Sapiens
ucuguaaauccaguugcauuugucaguguagguaggaaauuauuuuuuuuuaguuuaaauauac

SEQ ID NO: 89621 - RNA, 64 nt, Homo Sapiens
cauauacauaucacuaauaggaaauagaguugagggaaauuaucauuuguacauagccauucua

SEQ ID NO: 89622 - RNA, 64 nt, Homo Sapiens
acuuguuaacuucuuacagcacagauguuaaauaggaaauuauucagcggaaaugucauuauga

SEQ ID NO: 89623 - RNA, 64 nt, Homo Sapiens
aaauucuaacuuuacauguagcugcuuccuuuguggaaauuauaaaguacucugguuaauaaau

SEQ ID NO: 89624 - RNA, 64 nt, Homo Sapiens
guguuuacauguucuuuucuucuggugauugcuaggaaauuacucaauccaauuuccuaggguu

SEQ ID NO: 89625 - RNA, 64 nt, Homo Sapiens
auacccaacauauguuuacuuuaugaacuuaaauggaaauuaauuuauuguagacuacaucucu

SEQ ID NO: 89626 - RNA, 64 nt, Homo Sapiens
uuauaagcacacaccuaaaggaauaguuagacauggaaauuauuuuuaaguagguuguaaguuu

SEQ ID NO: 89627 - RNA, 64 nt, Homo Sapiens
aacuugcugcuguuuuaauaguggauauuuuacuggaaauuaaguuccguuuccagaaagagcu

SEQ ID NO: 89628 - RNA, 64 nt, Homo Sapiens
ccaccagagggcacaagcauaucacuuuuaguaaggaaauuacuagcuuguguugcuauuuaca

SEQ ID NO: 89629 - RNA, 64 nt, Homo Sapiens
ucuuuaaauuauuuaaucaaccuugucuuuucaaggaaauuaccacuuaaagagauaguuggua

SEQ ID NO: 89630 - RNA, 64 nt, Homo Sapiens
uccuucccuuccuuguagccuuuugacuuucauuggaaauuaggauguaaaucugcucaggaga

SEQ ID NO: 89631 - RNA, 64 nt, Homo Sapiens
ggugucuguaucaguggauuucccauccccugugggaaauuaguaggcucauuuacuguuuuag

SEQ ID NO: 89632 - RNA, 64 nt, Homo Sapiens
cacccauuuuaaauuggugaagaagacauugaauggaaauuauuaaauuaggauaacuucacug

SEQ ID NO: 89633 - RNA, 64 nt, Homo Sapiens
auaacuucacugagaagacagcauggguuuucugggaaauuagguagaauauuaaaacugcuuu

SEQ ID NO: 89634 - RNA, 64 nt, Homo Sapiens
uuaagauaggagucuaaacuccacagaaaaggauaauaccaagagcuuguauuguuaccuuagu

SEQ ID NO: 89635 - RNA, 64 nt, Homo Sapiens
ccaggaggugauauuauuuucagugcucagcugaaauaccaaccccaggaauaagaacuccauu

SEQ ID NO: 89636 - RNA, 64 nt, Homo Sapiens
ccaggcaaaaacauuacaaggccaggauuacccuaauaccaaaguucccaaaucauuuugugag

SEQ ID NO: 89637 - RNA, 64 nt, Homo Sapiens
gugaaagaggccaucauagcagacaaauacugcuaauaccaaaacuagauuaagaaaaaacaga

SEQ ID NO: 89638 - RNA, 64 nt, Homo Sapiens
auuuguuuuaggacaaauuuuaagaaaaugugggaauaccaaauguccuuuauaagaaaaauaa

SEQ ID NO: 89639 - RNA, 64 nt, Homo Sapiens
ucuguuuuuccuuucgguuauaucuuugguuuugaauaccaacauuuaaaaugaugguauuuua

SEQ ID NO: 89640 - RNA, 64 nt, Homo Sapiens
auucauuucaugauguaaagaaauuugggagguuaauaccaaguaguuauucuacauuuucuug

SEQ ID NO: 89641 - RNA, 64 nt, Homo Sapiens; identical to SEQ ID NO: 89640

SEQ ID NO: 89642 - RNA, 64 nt, Homo Sapiens
uaguuuuacuuguggcuuauugucacuuuaguaaaauaccaauuuagauguuugcuucuguaga

SEQ ID NO: 89643 - RNA, 64 nt, Homo Sapiens
ugaaaucuuaguucaaucugucucgggcuuauagaauaccaaacauaauaagaguaguuuacaa

SEQ ID NO: 89644 - RNA, 64 nt, Homo Sapiens; identical to SEQ ID NO: 81719

SEQ ID NO: 89645 - RNA, 64 nt, Homo Sapiens; identical to SEQ ID NO: 81720

SEQ ID NO: 89646 - RNA, 64 nt, Homo Sapiens; identical to SEQ ID NO: 81721

SEQ ID NO: 89647 - RNA, 64 nt, Homo Sapiens; identical to SEQ ID NO: 81722

SEQ ID NO: 89648 - RNA, 64 nt, Homo Sapiens; identical to SEQ ID NO: 81723

SEQ ID NO: 89649 - RNA, 64 nt, Homo Sapiens; identical to SEQ ID NO: 81724

SEQ ID NO: 89650 - RNA, 64 nt, Homo Sapiens; identical to SEQ ID NO: 81725

SEQ ID NO: 89651 - RNA, 64 nt, Homo Sapiens; identical to SEQ ID NO: 81726

SEQ ID NO: 89652 - RNA, 64 nt, Homo Sapiens; identical to SEQ ID NO: 81727

SEQ ID NO: 89653 - RNA, 64 nt, Homo Sapiens; identical to SEQ ID NO: 81728

SEQ ID NO: 89654 - RNA, 64 nt, Homo Sapiens; identical to SEQ ID NO: 81729

SEQ ID NO: 89655 - RNA, 64 nt, Homo Sapiens; identical to SEQ ID NO: 81730

SEQ ID NO: 89656 - RNA, 64 nt, Homo Sapiens; identical to SEQ ID NO: 81731

SEQ ID NO: 89657 - RNA, 64 nt, Homo Sapiens; identical to SEQ ID NO: 81732

SEQ ID NO: 89658 - RNA, 64 nt, Homo Sapiens; identical to SEQ ID NO: 81733

SEQ ID NO: 89659 - RNA, 64 nt, Homo Sapiens; identical to SEQ ID NO: 81734

SEQ ID NO: 89660 - RNA, 63 nt, Homo Sapiens
aaauuuuauuggccuggguacaggaaauucagaugaggcaagauuauuaauuaaucacauuug

SEQ ID NO: 89661 - RNA, 63 nt, Homo Sapiens
cuuuguggacaugaauuguugggcaugagcaacugaggcaaacaaccagaggaaaugcauaca

SEQ ID NO: 89662 - RNA, 63 nt, Homo Sapiens
ucgcauguacccucuguauucucaacaauccugugaggcaaauaugcuuucucaugacaguuu

SEQ ID NO: 89663 - RNA, 63 nt, Homo Sapiens
augccaccacaguauucuaacccuuguaacugaugaggcaaugaguuuauaauacucacuuga

SEQ ID NO: 89664 - RNA, 63 nt, Homo Sapiens
gaaaauccagcacaccaagcaccagucuucuucugaggcaaaagaaaaguguugucauuuuca

SEQ ID NO: 89665 - RNA, 63 nt, Homo Sapiens
uaagaaggaugcuggucagagcugcagaaaauaugaggcaauuaaaagucuuuagcuguuagc

SEQ ID NO: 89666 - RNA, 63 nt, Homo Sapiens
aaauuauuaaaaauacauuauuuaucugguaaaugaggcaaaagcaucuauuuauuuagauga

SEQ ID NO: 89667 - RNA, 63 nt, Homo Sapiens
agagggugauucuuuccccaucacagagucuacugaggcaaggugcucuguguccucaggaag

SEQ ID NO: 89668 - RNA, 63 nt, Homo Sapiens
cuaguucaagaacucauucuuuuaaauugccacugaggcaaccugguccuuaaauuucuuuuu

SEQ ID NO: 89669 - RNA, 63 nt, Homo Sapiens
uuuacucugcaaugguccuucauacaguuuucaugaggcaaguucugaguccauuaucuuuca

SEQ ID NO: 89670 - RNA, 64 nt, Homo Sapiens
gugacaugcuggcuuuugugcccagaggcuucuccaaagggaggcagcuggaaaaggccugugg

SEQ ID NO: 89671 - RNA, 64 nt, Homo Sapiens
cucuugccugcuccaucucaaaccucccacccugcaaagggaauaauggaggcuguaggaauau

SEQ ID NO: 89672 - RNA, 64 nt, Homo Sapiens
uuccaucccuguacccuuagauaagcuggagcgacaaagggacaauuuguccacccacccucca

SEQ ID NO: 89673 - RNA, 64 nt, Homo Sapiens
cuuucucuaaggucucugacuugucugggacccccaaagggaucguuauaaagaaagaagaucu

SEQ ID NO: 89674 - RNA, 64 nt, Homo Sapiens
agugaauuagccagcuagaagccguuuucuugcucaaagggaacauaaguccuuuucucccugu

SEQ ID NO: 89675 - RNA, 64 nt, Homo Sapiens
cuuuaauccaaagaaagauuaggugguuuuauuucaaagggaaaauuuagcagucagauuaggu

SEQ ID NO: 89676 - RNA, 64 nt, Homo Sapiens
aaugcaggaacucucuugguaguuuguaaauacacaaagggaugugucgagggaugggagcgau

SEQ ID NO: 89677 - RNA, 64 nt, Homo Sapiens
uccucuacaauuaacaaaacuuaucucugauauacaaagggauauaaauauauacacuuaaaua

SEQ ID NO: 89678 - RNA, 64 nt, Homo Sapiens
uuuaguagugccucuaagcaccccaugcuccaaucaaagggauucaggugugcugcgcgggaag

SEQ ID NO: 89679 - RNA, 64 nt, Homo Sapiens
uaagcgauugugcaggaguacugaccuuuuuucccaaagggacugaaagacucacccugcagcu

SEQ ID NO: 89680 - RNA, 64 nt, Homo Sapiens
ugauggccauuccguucaaacuccagacaccauacaaagggagaucuuauugcacugaauucaa

SEQ ID NO: 89681 - RNA, 64 nt, Homo Sapiens
cccuguguugucucaaguuuuacuucuucacagccaaagggagcaagaugaauaucauagccuu

SEQ ID NO: 89682 - RNA, 64 nt, Homo Sapiens; identical to SEQ ID NO: 89598

SEQ ID NO: 89683 - RNA, 64 nt, Homo Sapiens; identical to SEQ ID NO: 89599

SEQ ID NO: 89684 - RNA, 64 nt, Homo Sapiens; identical to SEQ ID NO: 89600

SEQ ID NO: 89685 - RNA, 64 nt, Homo Sapiens; identical to SEQ ID NO: 89601

SEQ ID NO: 89686 - RNA, 64 nt, Homo Sapiens; identical to SEQ ID NO: 89602

SEQ ID NO: 89687 - RNA, 64 nt, Homo Sapiens; identical to SEQ ID NO: 89603

SEQ ID NO: 89688 - RNA, 64 nt, Homo Sapiens; identical to SEQ ID NO: 89604

SEQ ID NO: 89689 - RNA, 64 nt, Homo Sapiens; identical to SEQ ID NO: 89605

SEQ ID NO: 89690 - RNA, 64 nt, Homo Sapiens; identical to SEQ ID NO: 89606

SEQ ID NO: 89691 - RNA, 64 nt, Homo Sapiens; identical to SEQ ID NO: 89607

SEQ ID NO: 89692 - RNA, 64 nt, Homo Sapiens; identical to SEQ ID NO: 89608

SEQ ID NO: 89693 - RNA, 64 nt, Homo Sapiens; identical to SEQ ID NO: 89609

SEQ ID NO: 89694 - RNA, 64 nt, Homo Sapiens; identical to SEQ ID NO: 89610

SEQ ID NO: 89695 - RNA, 64 nt, Homo Sapiens; identical to SEQ ID NO: 89611

SEQ ID NO: 89696 - RNA, 64 nt, Homo Sapiens; identical to SEQ ID NO: 89612

SEQ ID NO: 89697 - RNA, 64 nt, Homo Sapiens; identical to SEQ ID NO: 89613

SEQ ID NO: 89698 - RNA, 64 nt, Homo Sapiens; identical to SEQ ID NO: 89614

SEQ ID NO: 89699 - RNA, 64 nt, Homo Sapiens; identical to SEQ ID NO: 89615

SEQ ID NO: 89700 - RNA, 64 nt, Homo Sapiens; identical to SEQ ID NO: 89616

SEQ ID NO: 89701 - RNA, 64 nt, Homo Sapiens; identical to SEQ ID NO: 89617

SEQ ID NO: 89702 - RNA, 64 nt, Homo Sapiens; identical to SEQ ID NO: 89618

SEQ ID NO: 89703 - RNA, 64 nt, Homo Sapiens; identical to SEQ ID NO: 89619

SEQ ID NO: 89704 - RNA, 64 nt, Homo Sapiens; identical to SEQ ID NO: 89620

SEQ ID NO: 89705 - RNA, 64 nt, Homo Sapiens; identical to SEQ ID NO: 89621

SEQ ID NO: 89706 - RNA, 64 nt, Homo Sapiens; identical to SEQ ID NO: 89622

SEQ ID NO: 89707 - RNA, 64 nt, Homo Sapiens; identical to SEQ ID NO: 89623

SEQ ID NO: 89708 - RNA, 64 nt, Homo Sapiens; identical to SEQ ID NO: 89624

SEQ ID NO: 89709 - RNA, 64 nt, Homo Sapiens; identical to SEQ ID NO: 89625

SEQ ID NO: 89710 - RNA, 64 nt, Homo Sapiens; identical to SEQ ID NO: 89626

SEQ ID NO: 89711 - RNA, 64 nt, Homo Sapiens; identical to SEQ ID NO: 89627

SEQ ID NO: 89712 - RNA, 64 nt, Homo Sapiens; identical to SEQ ID NO: 89628

SEQ ID NO: 89713 - RNA, 64 nt, Homo Sapiens; identical to SEQ ID NO: 89629

SEQ ID NO: 89714 - RNA, 64 nt, Homo Sapiens; identical to SEQ ID NO: 89630

SEQ ID NO: 89715 - RNA, 64 nt, Homo Sapiens; identical to SEQ ID NO: 89631

SEQ ID NO: 89716 - RNA, 64 nt, Homo Sapiens; identical to SEQ ID NO: 89632

SEQ ID NO: 89717 - RNA, 64 nt, Homo Sapiens; identical to SEQ ID NO: 89633

SEQ ID NO: 89718 - RNA, 64 nt, Homo Sapiens
cuggggcuggacgcagguccgugugagugaccgcggccccgagcccaggacaugcugcucccuu

SEQ ID NO: 89719 - RNA, 64 nt, Homo Sapiens
cuggggcuggacgcaggucccggugagugaccgcggccccgagcguuagucgcuccuugcuaac

SEQ ID NO: 89720 - RNA, 64 nt, Homo Sapiens
cugcccacacucagagcaagucagcccacucucccuguuacacacuguuacacacuguccgcuc

SEQ ID NO: 89721 - RNA, 64 nt, Homo Sapiens
cuguccgcucucagcccacucagucugcuucucccuguuacacaccucauuguggccccacacc

SEQ ID NO: 89722 - RNA, 64 nt, Homo Sapiens
gagaguauuaacguuuuuguucuccuccggcccccuguuacaaugaaggggcaaaaguauuugc

SEQ ID NO: 89723 - RNA, 64 nt, Homo Sapiens
cucgacaucaaacugccuggauuuuucuaccacccuguuacaucauaacaacuucugaaacaca

SEQ ID NO: 89724 - RNA, 64 nt, Homo Sapiens
ucucuuccuuuugcuucuagucaaccuuaaugggcuguuacagaaacuaguucguguuuauaua

SEQ ID NO: 89725 - RNA, 64 nt, Homo Sapiens
cuguaacuaucagcugcaauaccauggugaccagcuguuacaaaagauuuuuuccuguuuuauc

SEQ ID NO: 89726 - RNA, 64 nt, Homo Sapiens
uccugccuucuuacccccaacucuagggaugggacuguuacaauacuucaagaucacucuuuac

SEQ ID NO: 89727 - RNA, 64 nt, Homo Sapiens
uaggacauccaugccaggugaggugccugggucccuguuacaagucaggagcccuguagggaga

SEQ ID NO: 89728 - RNA, 64 nt, Homo Sapiens
guaaguggauggaugacacaauugcaauaaagcucuguuacaaccauaaccuuauuugaaauga

SEQ ID NO: 89729 - RNA, 64 nt, Homo Sapiens
uuuuuggcaucugguaauauuuaaaaggcaaaugcuguuacaaaacagugggaacaaguuucua

SEQ ID NO: 89730 - RNA, 64 nt, Homo Sapiens
ccuugacugugaggcaggacuucccucgcuugaacuguuacacauacgaugugugugucacauc

SEQ ID NO: 89731 - RNA, 64 nt, Homo Sapiens
uuucucaucugggaauuugaaaucucggugcuuacuguuacaccaauuuguccaaagaguugaa

SEQ ID NO: 89732 - RNA, 64 nt, Homo Sapiens
ggaggccaggaggggagcugucauuucacacccccgaagggagggcgccuuccacuccaucauu

SEQ ID NO: 89733 - RNA, 64 nt, Homo Sapiens
gaugugcaucugcccuaaguaaauucuucagccacgaagggaugacaagacccuccgcccgagu

SEQ ID NO: 89734 - RNA, 64 nt, Homo Sapiens
ccugggcaggcugcagccucaugccaugucucucucccacuaccugaugggcacauggacaggc

SEQ ID NO: 89735 - RNA, 64 nt, Homo Sapiens
cuggccuugcaguggguguguggggaagucacugucccacuaugggucuccacuacccagucac

SEQ ID NO: 89736 - RNA, 64 nt, Homo Sapiens
gagcuagguuuucucagagggaggccugccauccaccccucaggaggcucagggguuggucuga

SEQ ID NO: 89737 - RNA, 64 nt, Homo Sapiens
gcucacucagaccccaaggaucauuaaggacuccaccccucagaauguuauugaaggggauggu

SEQ ID NO: 89738 - RNA, 64 nt, Homo Sapiens
auccuuccucaggacuuggcagcccucaccccucaccccucaccagcugcccaccucguucccc

SEQ ID NO: 89739 - RNA, 64 nt, Homo Sapiens
ccucaccauccuuccucaggguuccccagcccucaccccucaccccccaucagcugcccaccuc

SEQ ID NO: 89740 - RNA, 64 nt, Homo Sapiens
acuguggggaucauucucuccuuucagagugcugaccccucaucgcuugucuggcgucaacugg

SEQ ID NO: 89741 - RNA, 64 nt, Homo Sapiens
cccucuguccucauuguuugugggcccuggacacaccccucagcccuuccugcugaggugggac

SEQ ID NO: 89742 - RNA, 64 nt, Homo Sapiens
cagcaucauggagacccgcaggcggggcuuagccaccccucaaacccagggcccccuggcaccu

SEQ ID NO: 89743 - RNA, 64 nt, Homo Sapiens
cuccuuggauauuucccaagaaccccccacauacaccccucacaagccaccccuccugagaggc

SEQ ID NO: 89744 - RNA, 64 nt, Homo Sapiens
cuguccuccggacuuaggaaagagggaauagcucaccccucauuagugacuuccgcaggaauug

SEQ ID NO: 89745 - RNA, 64 nt, Homo Sapiens
gcuuccguucuuacugccuucggucuucagcugcaccccucaccuaaguggggugcagcccugg

SEQ ID NO: 89746 - RNA, 64 nt, Homo Sapiens
gucauuuucucccugagcuguaggguggaccuggaccccucagagaugcucgacugcagggucc

SEQ ID NO: 89747 - RNA, 64 nt, Homo Sapiens
cuccguccagugucacccacacauugguccggggaccccucagugcagagccugaaguuggggg

SEQ ID NO: 89748 - RNA, 64 nt, Homo Sapiens
gguuuaagagaccaggucuuuuugugugggguuuaccccucacacuugguguuucucucuguaa

SEQ ID NO: 89749 - RNA, 64 nt, Homo Sapiens
gguuucauuguuuccuucugugucuuuuguggugaccccucaggcggggguucagcggggccuc

SEQ ID NO: 89750 - RNA, 64 nt, Homo Sapiens
uuucccucucccuucuucccagggcaaaauuuacaccccucacgcucacugucuuaagugagcc

SEQ ID NO: 89751 - RNA, 64 nt, Homo Sapiens
caugucgcaaaaugaaccaagaguuucucuaaggaccccucaaaagcagaccucagggaggguu

SEQ ID NO: 89752 - RNA, 64 nt, Homo Sapiens
uucuucugcccauagacggggaugacucagcacuaccccucaacagagaugacuuugaugacuc

SEQ ID NO: 89753 - RNA, 64 nt, Homo Sapiens
agcagggaugacucagcagggaugacucagcaccaccccucaacagggaugacucagcagggau

SEQ ID NO: 89754 - RNA, 64 nt, Homo Sapiens
ggggacagggccaguguuggguaugggggcucggaccccucacuucuugucuauucagacgcug

SEQ ID NO: 89755 - RNA, 64 nt, Homo Sapiens
caacagccgcccccgcaggcgccuccagaggcccaccccucaugcggcagcacacucaucccgc

SEQ ID NO: 89756 - RNA, 64 nt, Homo Sapiens
cagagacuuccuucauuaacgcccuuagauuccaaccccucaaugaccccauggucacccugaa

SEQ ID NO: 89757 - RNA, 64 nt, Homo Sapiens
gcagauucccagauuaacagagucccuauccccaaccccucagacugaguagcaccuucaggcu

SEQ ID NO: 89758 - RNA, 64 nt, Homo Sapiens; identical to SEQ ID NO: 84807

SEQ ID NO: 89759 - RNA, 64 nt, Homo Sapiens; identical to SEQ ID NO: 84808

SEQ ID NO: 89760 - RNA, 64 nt, Homo Sapiens
aacagugcaggugauuuuaaacuauuaugaauagugcugcgauaauagugcugcgauaaacagc

SEQ ID NO: 89761 - RNA, 64 nt, Homo Sapiens
aacagcacuauuaugaauaggcuauuacgaauagugcugcgauauagguugguuccauaacuuu

SEQ ID NO: 89762 - RNA, 64 nt, Homo Sapiens
ggaaguauacuggucuguuagcagagacaaacuuuuuuuagaauugaagucugaaacaaacaaa

SEQ ID NO: 89763 - RNA, 64 nt, Homo Sapiens
cuaggaaaauauuauuaaauuuauaucccuaaaauuuuuagaaaucucucaaaaucuuuccaaa

SEQ ID NO: 89764 - RNA, 64 nt, Homo Sapiens
uagguacugaagaaucccaguuucagcagcauucuuuuuagauuggugagaguuugcuuccccc

SEQ ID NO: 89765 - RNA, 64 nt, Homo Sapiens
uacauguaaaauaccaagaauuuuaaaguaauauuuuuuagaaauuguccgucucuuuuuuuuu

SEQ ID NO: 89766 - RNA, 64 nt, Homo Sapiens
uuuguugcgauguuuguacauuucuagaaaacauuuuuuagaaaaggguaaagucaaguuucua

SEQ ID NO: 89767 - RNA, 64 nt, Homo Sapiens
ggucuuacucugucacccagucuuuuuucuuuuuuuuuuagacaaaucucuuccaguugcuuuu

SEQ ID NO: 89768 - RNA, 64 nt, Homo Sapiens
uuucaguuuucugcuauuuuuuagguguacuuccuuuuuagaauaauguugaauucucaugcuu

SEQ ID NO: 89769 - RNA, 64 nt, Homo Sapiens
aaacugugauggaugagcuacuguagaaauuucauuuuuagauuugucaaaauaguuccuguuu

SEQ ID NO: 89770 - RNA, 64 nt, Homo Sapiens
uaugcauguggacauuuuuauagguuuucaaccuuuuuuagauuacuauauuguagauuuacug

SEQ ID NO: 89771 - RNA, 64 nt, Homo Sapiens
uccuuacucugaugucuguaaaaccugaugcuuuuuuuuagaacuucauuaucuuuauuauaau

SEQ ID NO: 89772 - RNA, 64 nt, Homo Sapiens
ucuaucaaucaguaguuagcucaacggacacugguuuuuagaccgcauccugcuuagagaccaa

SEQ ID NO: 89773 - RNA, 64 nt, Homo Sapiens
auguugugcuguauguucuuauuguuaaagugcuuuuuuagaaauuagggagaaguuaaugacc

SEQ ID NO: 89774 - RNA, 64 nt, Homo Sapiens
cucucaauaaaauuuuucuauuaguuucuuauacuuuuuagaauaaugcagugguaaaaauuug

SEQ ID NO: 89775 - RNA, 64 nt, Homo Sapiens
auuucgucugaauaaguacaaccaagaaaacuuguuuuuagaaucaaaaugugaguaaauugaa

SEQ ID NO: 89776 - RNA, 64 nt, Homo Sapiens
gaggguaauccaggucuuuuuuuuuuuuuuuuuuuuuuuagacagagucucacucuguugcucu

SEQ ID NO: 89777 - RNA, 64 nt, Homo Sapiens
uucuacuugaaaucaggaguuuuauaaaacaacauuuuuagacguggucaucuuuuauugguuu

SEQ ID NO: 89778 - RNA, 64 nt, Homo Sapiens
ugaucaucuuagaaaacucaagcauguugagauauuuuuagauuuaaaauaauuuaugcaauga

SEQ ID NO: 89779 - RNA, 64 nt, Homo Sapiens
guuuccauugcuuuuauauagcauuuuuaggagguuuuuagaaucuuauuuccacaaauauuuu

SEQ ID NO: 89780 - RNA, 64 nt, Homo Sapiens
uuguuccuaaaaaggaauaaagagggcgguucuuuuuuuagauaugucuuuuuugggggagggc

SEQ ID NO: 89781 - RNA, 64 nt, Homo Sapiens
guaugccacuuuuguuuaaguagaaaaagagauauuuuuagauuagauuacauaauaguauuuc

SEQ ID NO: 89782 - RNA, 64 nt, Homo Sapiens
ugaacaugacauguucagcuucauauaugcgaacuuuuuagacaucuaucuuuaauuguucgua

SEQ ID NO: 89783 - RNA, 64 nt, Homo Sapiens
gaaauuuagggcaaaauaaacuugauuuaauuccuuuuuagaaauuuguuuaaaucuggcuuua

SEQ ID NO: 89784 - RNA, 64 nt, Homo Sapiens
uuauauagggcaagugguucuuuaugcaguuuucuuuuuagaguccuugcccccuguuccuggg

SEQ ID NO: 89785 - RNA, 64 nt, Homo Sapiens
ucacuuaauuugucucauuuuacaguuccuaguguuuuuagaagauugucuuguuuuuaaaaaa

SEQ ID NO: 89786 - RNA, 64 nt, Homo Sapiens
auuuuauuuauacugugaagugaauauuuguuucuuuuuagaacucaccaauuuauuaacaggu

SEQ ID NO: 89787 - RNA, 64 nt, Homo Sapiens
ucagaaauguuaaaguugauaagugacuucauucuuuuuagacauauuuuuuaacauagaacag

SEQ ID NO: 89788 - RNA, 64 nt, Homo Sapiens
aaaguaaaaauaggucagcaauuguauugaauucuuuuuagaucguuuuauguacuguuaaaga

SEQ ID NO: 89789 - RNA, 64 nt, Homo Sapiens
acaguaaaaauagguuggcaauuguacugaauucuuuuuagaucguuuuauguacuguuaaaga

SEQ ID NO: 89790 - RNA, 64 nt, Homo Sapiens
auuauuaccauaaauaacaauuucagaaacuuaguuuuuagaauaaauauuaauuuuuccacuu

SEQ ID NO: 89791 - RNA, 64 nt, Homo Sapiens
uuuuuccacuucaguuuuauucuagaaaauacccuuuuuagaaauccaguuuuaguuuugucau

SEQ ID NO: 89792 - RNA, 64 nt, Homo Sapiens
aauuuagaaaaacaaaacaaaccugcuugucuuauuuuuagaaucacagugcauuguuuuuucu

SEQ ID NO: 89793 - RNA, 64 nt, Homo Sapiens
auuacaaaggaucuguuugcuugucuguguacaguuuuuagaacuuauucucccaugaacguuc

SEQ ID NO: 89794 - RNA, 64 nt, Homo Sapiens
ugugguggacuucauagaugcuaguucagagagauuuuuagagcuaauuauaauagaaaugcgg

SEQ ID NO: 89795 - RNA, 64 nt, Homo Sapiens
aaaucuggauaaaugugcaaaauauguauugugcuuuuuagaaccaaaugcccaguuuuugcuu

SEQ ID NO: 89796 - RNA, 64 nt, Homo Sapiens
uuuucccuuguuuuaauuuguauguuuguacuacuuuuuagaugcuuaaacuauacauaagcua

SEQ ID NO: 89797 - RNA, 64 nt, Homo Sapiens
gauugaaauaaaaaguaucgggugccaacugugauuuuuagaagaacuguuguaaagccuuuga

SEQ ID NO: 89798 - RNA, 64 nt, Homo Sapiens
cuaaguauaaagauuuaaauuauuuuuaauacgguuuuuagaaccacagacuaucccucuuuuu

SEQ ID NO: 89799 - RNA, 64 nt, Homo Sapiens
uuaauacgguuuuuagaaccacagacuaucccucuuuuuagagcauccugaucaauugcaagua

SEQ ID NO: 89800 - RNA, 64 nt, Homo Sapiens
aucccuuuucuccccaccuccacacacuacauuuuuuuuagauuuaaauaguuuuacuauuuua

SEQ ID NO: 89801 - RNA, 64 nt, Homo Sapiens
auuuagaggguaacuuaaaucaguuauuuuuagcuuuuuagaacuuugaucugcuagggauugu

SEQ ID NO: 89802 - RNA, 64 nt, Homo Sapiens
uagugaaauaguuacuauuucaugaaaguagauauuuuuagaauuuuugaaauaccacaguugu

SEQ ID NO: 89803 - RNA, 64 nt, Homo Sapiens
uccuuucgauauaaaacucuuugaagaaauaugauuuuuagaaaucagcuacccauuauagcac

SEQ ID NO: 89804 - RNA, 64 nt, Homo Sapiens
agcaaagacucagggguuacgguaaaauaauacauuuuuagacacccaaauaaucaagggugaa

SEQ ID NO: 89805 - RNA, 64 nt, Homo Sapiens
gcguuucgcucuuguugcccuguaaguucuuuuuuuuuuagacaagcaauucgauguuuaagua

SEQ ID NO: 89806 - RNA, 64 nt, Homo Sapiens
uuucauuaauacuguaguuauuaaacccauuuuuuuuuuagaauuauauguuguuguuguuguu

SEQ ID NO: 89807 - RNA, 64 nt, Homo Sapiens
ugcuuuuuaaaaauccaauaaauuugagcuauuuuuuuuagagguguuuuucuuuagauuuaua

SEQ ID NO: 89808 - RNA, 64 nt, Homo Sapiens
cagaagaaaaaccuguuaaauucaaguauuaaaauuuuuagaucaaaaaggcaaaugauuuuau

SEQ ID NO: 89809 - RNA, 64 nt, Homo Sapiens
ugagagcuacuucgcccaaauuacaaaaugaguguuuuuagauucaagugacaguaaaaggauu

SEQ ID NO: 89810 - RNA, 64 nt, Homo Sapiens
acauggaauucucugauuuugagccgaacaugaguuuuuagacuguaucuugacaugagguucc

SEQ ID NO: 89811 - RNA, 64 nt, Homo Sapiens
ugccaccacccccaguuaauauuuuuuuuaauuuuuuuuagaggcaggaucuugcuguccaauu

SEQ ID NO: 89812 - RNA, 64 nt, Homo Sapiens
aucuugaagugaaaccaccacaauggccauuuuuuuuuuagauggaguuuugcaguggugcaau

SEQ ID NO: 89813 - RNA, 64 nt, Homo Sapiens
gacuacaguuucgugugccaccaugccuggcuaauuuuuagaauuuuuuguagggacagggccu

SEQ ID NO: 89814 - RNA, 64 nt, Homo Sapiens
cagcuugucagagacuuccuauggaagaaagaauuuuuuagauacuaucauuagguuggauaug

SEQ ID NO: 89815 - RNA, 64 nt, Homo Sapiens
uauuaaaguacguuucaauguugggugaauuuuguuuuuagaugccaauaaaacuuauuuguuu

SEQ ID NO: 89816 - RNA, 64 nt, Homo Sapiens
ucuguuuucauagccacugguuuaaaucauuaaauuuuuagaucucuuguauguagaggcuauu

SEQ ID NO: 89817 - RNA, 64 nt, Homo Sapiens
uguaaaaaccauauuugcaguuuuccaaaagauguuuuuagaguugagugguucagucaugagg

SEQ ID NO: 89818 - RNA, 64 nt, Homo Sapiens
agaauaagaaaacuuugcuuucugagacugaaguuuuuuagacagcucacuucaauaacuauuu

SEQ ID NO: 89819 - RNA, 64 nt, Homo Sapiens
uacauguuuuaaguaaauguggcuaguguauuuauuuuuagaggcugagaauuagcuaaaugga

SEQ ID NO: 89820 - RNA, 64 nt, Homo Sapiens
uuguguuacaacuguagcaaccauaaaacaguauuuuuuagaagacaaucuggaaacugugagc

SEQ ID NO: 89821 - RNA, 64 nt, Homo Sapiens
cucugugauugugaauugcaguucaguucuuguguuuuuagacuguuagacaaaagugcucacg

SEQ ID NO: 89822 - RNA, 64 nt, Homo Sapiens
uggaaacagagcaaaagaacaacccuaguaccuuuuuuuagaaacaguacgauaaauuauuuuu

SEQ ID NO: 89823 - RNA, 64 nt, Homo Sapiens
augcaugggauaugcacccagguuucuuuuacaguuuuuagaaucguuuuuagaggguggugug

SEQ ID NO: 89824 - RNA, 64 nt, Homo Sapiens
ugcacccagguuucuuuuacaguuuuuagaaucguuuuuagaggguggugugucugacaccaug

SEQ ID NO: 89825 - RNA, 64 nt, Homo Sapiens
cuuuagaaggguggucuuuacaaaccagugaaguuuuuuagaaccaacaagaagaaaaccaacc

SEQ ID NO: 89826 - RNA, 64 nt, Homo Sapiens
cgauugcaaauagugauguaccaaaugcaguuuauuuuuagaccgguuggcucuuacacccauu

SEQ ID NO: 89827 - RNA, 64 nt, Homo Sapiens
aguauauaucucuuuaaaaagcaagggugggagguuuuuagaagccuuuccguuggggaugggg

SEQ ID NO: 89828 - RNA, 64 nt, Homo Sapiens
uaaaguaaaagcauaucgcuguuaaaaacuggacuuuuuagaagucauggccccuguagccagg

SEQ ID NO: 89829 - RNA, 64 nt, Homo Sapiens
uacagaauguucacagcaaaacacguuuggucuguuuuuagauucuugaagaauucaauagucu

SEQ ID NO: 89830 - RNA, 64 nt, Homo Sapiens
auuauuugaugugacaugaacucaaaauccugcauuuuuagauuccuuuuaguucuaauugagg

SEQ ID NO: 89831 - RNA, 64 nt, Homo Sapiens
gcccuuuuuuauuugcccucugcgauccaccugcuuuuuagaagucugccgagugagaaggcca

SEQ ID NO: 89832 - RNA, 64 nt, Homo Sapiens
auuuugcuuuuuaugucucccauaagaaaugugcuuuuuagagcuuccuaaugcauguguugca

SEQ ID NO: 89833 - RNA, 64 nt, Homo Sapiens
aggacgaggccuucaagccugccccucuucugcuuuuuuagacaguauuuuuagagcuggaaag

SEQ ID NO: 89834 - RNA, 64 nt, Homo Sapiens
caagccugccccucuucugcuuuuuuagacaguauuuuuagagcuggaaagaaauuuucuagcc

SEQ ID NO: 89835 - RNA, 64 nt, Homo Sapiens
ugaggaauuuuuaaauauucuuuuuuuuuuccuauuuuuagacaucaauucuauagauucugac

SEQ ID NO: 89836 - RNA, 64 nt, Homo Sapiens
agggauuugggaugaagugaagaggucaaauuacuuuuuagaagaagggaaucuaaaaaccauc

SEQ ID NO: 89837 - RNA, 64 nt, Homo Sapiens
uggauucugaauauaauaaauucaaaguacccuuuuuuuagaguuucuaauaaaguaguaugua

SEQ ID NO: 89838 - RNA, 64 nt, Homo Sapiens
cuuuuaaauaagaaguccacacaagcaagccaaauuuuuagaugacgaaguccauaaauaacua

SEQ ID NO: 89839 - RNA, 64 nt, Homo Sapiens
uguuaugcuauaccaaucugcaguaaaaaaaauuuuuuuagaugauucuauauaacuucgucuc

SEQ ID NO: 89840 - RNA, 64 nt, Homo Sapiens
uuuuucuuuuuuucccuaagugaucaacaucaaauuuuuagaauuaaaauacauuuaacucagg

SEQ ID NO: 89841 - RNA, 64 nt, Homo Sapiens
agaacuuuacgagcgugacaaaaggaagagugaguuuuuagaaggaaccaaaauaagacuuacu

SEQ ID NO: 89842 - RNA, 64 nt, Homo Sapiens
auuuagaaacaauugauugccauauauacauguguuuuuagaacuaaaauauaggcauauaccu

SEQ ID NO: 89843 - RNA, 64 nt, Homo Sapiens
gagguuuucacucauaaauuuaaaccaguguauuuuuuuagaacugguuuguguauauauauag

SEQ ID NO: 89844 - RNA, 64 nt, Homo Sapiens
accaaaaggauauucugaaaaauggccaacaauuuuuuuagaaguagcaucccaagcagcgugc

SEQ ID NO: 89845 - RNA, 64 nt, Homo Sapiens
aaaauuguucuccuucuaaaguuaccaaguucuauuuuuagaauccagcuuuugguauuucauu

SEQ ID NO: 89846 - RNA, 64 nt, Homo Sapiens
ggacauuuccuccuuccugaaguuuugagaggaauuuuuagagauuuagaauaaauucuuagaa

SEQ ID NO: 89847 - RNA, 64 nt, Homo Sapiens
uuuugaaggcucaggagcauccauaggcauuugcuuuuuagaaauguccacugcaauggcaaaa

SEQ ID NO: 89848 - RNA, 64 nt, Homo Sapiens
cccauauuauuuacaaugucuugauaauucuaccuuuuuagagcaagaauaguaucugcuaaug

SEQ ID NO: 89849 - RNA, 64 nt, Homo Sapiens
ccagcaguuaccuuaaagcuuuguguaguaauguuuuuuagaacaaguaaugauuucuugauaa

SEQ ID NO: 89850 - RNA, 64 nt, Homo Sapiens
gcaaaaacuaucugaagauuuuuuaggggauuuuuuuuuagacauucaaacaguauauaacuuu

SEQ ID NO: 89851 - RNA, 64 nt, Homo Sapiens
uaaugaaaacuuccuuucuguuacauugaauugauuuuuagaggauuuccugcucuuaauaaaa

SEQ ID NO: 89852 - RNA, 64 nt, Homo Sapiens
uuuguguggcuccuauuuuuggcagucagcacucuuuuuagaucguaccucuguucuggaucug

SEQ ID NO: 89853 - RNA, 64 nt, Homo Sapiens
caaacuuguggaaguaucaucuuugauguaaaccuuuuuagacccagacaguauauguuuuaaa

SEQ ID NO: 89854 - RNA, 64 nt, Homo Sapiens
uucuuaaaagacguuaaaaugggaaaaaaggagguuuuuagacucucaaaguuuugaagucagu

SEQ ID NO: 89855 - RNA, 64 nt, Homo Sapiens
agaauggaaaaugacugaaauccaauuuagauuauuuuuagaguauuuuuccagcaaauucaau

SEQ ID NO: 89856 - RNA, 64 nt, Homo Sapiens
acuauucaaaaauuaacauuuucaucucaguaaguuuuuagaacaucaaaauguuuucugagcu

SEQ ID NO: 89857 - RNA, 64 nt, Homo Sapiens
ccaacuguuaacuggaagcuuuugauaauuuuuuuuuuuagaacaauuuggaacauuaaaauuu

SEQ ID NO: 89858 - RNA, 64 nt, Homo Sapiens
ggugaacucuggaagcagggauugugucuggcucuuuuuagagcuggaaauguaguggcuuuca

SEQ ID NO: 89859 - RNA, 64 nt, Homo Sapiens
aagaccaaaaaauucaauguaauaaaaugaggcuuuuuuagaggucgcuauagaauaaugcauu

SEQ ID NO: 89860 - RNA, 64 nt, Homo Sapiens
aauauauauaaauauauaauuuuguuuuguuuuguuuuuagaaauggagauguaaguuguuggu

SEQ ID NO: 89861 - RNA, 64 nt, Homo Sapiens
ucccuacauuugugcuugguggcccuauuuuuuuuuuuuagagaggccuugagacauacagguc

SEQ ID NO: 89862 - RNA, 64 nt, Homo Sapiens
aaaguuggggguggguugcaaaauguucuuucaguuuuuagaaccuccauuuuauaaaagaauu

SEQ ID NO: 89863 - RNA, 64 nt, Homo Sapiens
ggcucuaggggagaauucauuucuggccuuuucauuuuuagaggcugaccguaauucuugacuu

SEQ ID NO: 89864 - RNA, 64 nt, Homo Sapiens
gcguguuugauauuguuaauauaauaauaauuauuuuuuagaguacugcuuuuguauguauguu

SEQ ID NO: 89865 - RNA, 64 nt, Homo Sapiens
aaguacugaaauaaugagugaccaauuugaaggauuuuuagauuauuuaaucuuugcuuauguu

SEQ ID NO: 89866 - RNA, 64 nt, Homo Sapiens
uacccauugaagggguuccuuuuccauugcucaguuuuuagaaaauaauucucaucuuuuuucu

SEQ ID NO: 89867 - RNA, 64 nt, Homo Sapiens
ucauuuuuaauauccugaacugaaugauaguguuuuuuuagaugaagaacugaugucagccugc

SEQ ID NO: 89868 - RNA, 64 nt, Homo Sapiens
cugagcauggcugaaguauuaaaauguuuaauauuuuuuagagcaaaauuguuggaaagcauuu

SEQ ID NO: 89869 - RNA, 64 nt, Homo Sapiens
gagguuuaagaacaugaagauucuaaaaggucaguuuuuagagauagaucuauaguugcauugu

SEQ ID NO: 89870 - RNA, 64 nt, Homo Sapiens
acucagguggggagcucauggugccgcuggggacuuuuuagagaaauguaaagagaauagcuau

SEQ ID NO: 89871 - RNA, 64 nt, Homo Sapiens
ccuccuuccggccaauggcagaagugggggaaaauuuuuagaagaaaagcaaacaugugagacc

SEQ ID NO: 89872 - RNA, 64 nt, Homo Sapiens
uaacuuuguuggcaauauuugccguguagaauuuuuuuuagauauccauuguaaauuugaaaca

SEQ ID NO: 89873 - RNA, 64 nt, Homo Sapiens
ugcuguggcauauuuugcuuuauuuaaaaauuuuuuuuuagagaugaguucuugcucugucacc

SEQ ID NO: 89874 - RNA, 64 nt, Homo Sapiens
cauaugccagaauauaagagcaaguguuaucuacuuuuuagaugggaauugcagaagcugcauc

SEQ ID NO: 89875 - RNA, 64 nt, Homo Sapiens
auuuguuuuaggugauuuaauuuaaacuaguauuuuuuuagauuuuaauuccucaggguuuuaa

SEQ ID NO: 89876 - RNA, 64 nt, Homo Sapiens
aacaaaacaacuuuguagcauaugcaaaaacuacuuuuuagagaggugaagagguccagaauga

SEQ ID NO: 89877 - RNA, 64 nt, Homo Sapiens
gaguuuugcucuuguugccuauuuuuuuucuuuuuuuuuagacacacgagccacugguuauugg

SEQ ID NO: 89878 - RNA, 64 nt, Homo Sapiens
ucauggucauucuguauguaucucuuaaagucuguuuuuagacuaaggcaauucaguaucuccc

SEQ ID NO: 89879 - RNA, 64 nt, Homo Sapiens
uggggucucacuauguuuccuuuaaaaaaaaauuuuuuuagagaucaucaccaugccuagcuca

SEQ ID NO: 89880 - RNA, 64 nt, Homo Sapiens
cccagaucucggaggcuacauacugaaugguaaauuuuuagagaaaucuaacccauuucugaua

SEQ ID NO: 89881 - RNA, 64 nt, Homo Sapiens
uaaaagagcuaacguucuuauuaaggcuuugugguuuuuagaguugcaucuaugaaccugggga

SEQ ID NO: 89882 - RNA, 64 nt, Homo Sapiens
aaauuucaauacagauacuucuuuuagaaguaaauuuuuagauuuuauugucaguagaaaaaag

SEQ ID NO: 89883 - RNA, 64 nt, Homo Sapiens
augacaaaucucuguccccugaguguuaauuugauuuuuagaaauggccaaaagucacgugauc

SEQ ID NO: 89884 - RNA, 64 nt, Homo Sapiens
auuuuuaugauuucuaaaguaacaauaaaagcaguuuuuagaguugaguuccagagagggcagg

SEQ ID NO: 89885 - RNA, 64 nt, Homo Sapiens
uauaaauucacgucuugucacugcugugaaauuauuuuuagaauucuagguauaugcuuucucu

SEQ ID NO: 89886 - RNA, 64 nt, Homo Sapiens
auuucagaaauauacauuuacuuccuacauuauauuuuuagaauuguguauuugauaaauauuu

SEQ ID NO: 89887 - RNA, 64 nt, Homo Sapiens
gauuauuugccaucauuaguaccucucaacuuacuuuuuagaggacaagaaacaaucuguagau

SEQ ID NO: 89888 - RNA, 64 nt, Homo Sapiens
aaaauguucaccagaugcaagaauguaccuuuucuuuuuagaaagccaaauguacuuuagacau

SEQ ID NO: 89889 - RNA, 64 nt, Homo Sapiens
cauuuuaaacugcugauauuggauauaaugcugcuuuuuagagacaccuaaauugcaguaucag

SEQ ID NO: 89890 - RNA, 64 nt, Homo Sapiens
aagccaaaugcuuaaacugaucaaugacuguagcuuuuuagacuguuggucaaagaacauucua

SEQ ID NO: 89891 - RNA, 64 nt, Homo Sapiens
ccauucucccugcauccuuguccuugcaggugcuuuuuuagaugcuccaauaugucuucuuuug

SEQ ID NO: 89892 - RNA, 64 nt, Homo Sapiens
ugaaauaucaauggguuugcauaucuaggcccuuuuuuuagaccaaugccuaugccauccucca

SEQ ID NO: 89893 - RNA, 64 nt, Homo Sapiens
auugaaaaaaauauaugauuguauaaugugauuuuuuuuagaauagggggaaccuuauuuauuu

SEQ ID NO: 89894 - RNA, 64 nt, Homo Sapiens
cucuuaauucucagccaugugcuuauuauauuucuuuuuagauugucuaucuguauaacacaca

SEQ ID NO: 89895 - RNA, 64 nt, Homo Sapiens
aaauuguuccaugcugguggaaagauagagauuguuuuuagagguugguuguuguguuuuagga

SEQ ID NO: 89896 - RNA, 64 nt, Homo Sapiens
uuuuuauaaguauguauuacuuuuguaaucagaauuuuuagaaaguauuuugcugauuuaaagg

SEQ ID NO: 89897 - RNA, 64 nt, Homo Sapiens
gucagaauuguuuuugaaagccuaagaacccagcuuuuuagaaaggauuuucacacuggcauuu

SEQ ID NO: 89898 - RNA, 64 nt, Homo Sapiens
caaugcuugcuuuuauuuuaaccaucuuuuacuauuuuuagaaggaaacuagcuuuaguagugg

SEQ ID NO: 89899 - RNA, 64 nt, Homo Sapiens
cucccuuuccuauagagauauguaauuuauauuuuuuuuagaucuucuuauguuguguuacuaa

SEQ ID NO: 89900 - RNA, 64 nt, Homo Sapiens
uggguaggauugugaauuuccaugucuaaauauauuuuuagaagacaagcccaccgcuucugua

SEQ ID NO: 89901 - RNA, 64 nt, Homo Sapiens
caguaauuuuacuuuuaaggauacagaguugauauuuuuagaaaugcugaaagugaggaugagg

SEQ ID NO: 89902 - RNA, 64 nt, Homo Sapiens
ucuuuucuuuugcacuacaaugugauuauuuauuuuuuuagauuugaaaaauguuggugguuuu

SEQ ID NO: 89903 - RNA, 64 nt, Homo Sapiens
guuagaaccugguccuaagcguuaucagucaauauuuuuagauaccacauuuggaauacuuuuu

SEQ ID NO: 89904 - RNA, 64 nt, Homo Sapiens
gucucacuuugucgcccagguuuauuauuauuauuuuuuagacacgacuaauuucaaaaugcuu

SEQ ID NO: 89905 - RNA, 64 nt, Homo Sapiens
gccacacagggccggugcugcuuuauuucagacucugccccagguuccaggaauccgaaccccg

SEQ ID NO: 89906 - RNA, 64 nt, Homo Sapiens
cgaacacugcgguccuugccaaaguaaaaugaagcugccccaggacaagggguuaccaugagcu

SEQ ID NO: 89907 - RNA, 64 nt, Homo Sapiens
cucggcucaccucuuccuccaagccccgcccccucugccccacgugccggcccuccuggugcuc

SEQ ID NO: 89908 - RNA, 64 nt, Homo Sapiens
cagggcuggaaguccuugcccacuucccacucuccugccccaaucuaucuaguacuucccaggc

SEQ ID NO: 89909 - RNA, 64 nt, Homo Sapiens
auggcaaaugaauggcacaccauuucuccuucuccugccccagggcagguaccacugaucugca

SEQ ID NO: 89910 - RNA, 64 nt, Homo Sapiens
agggccaaggccugcugagcugauucuccagcugcugccccagccuuuccgccuugcacagcac

SEQ ID NO: 89911 - RNA, 64 nt, Homo Sapiens
ccaccuuacccuuauuccucucuguccacauuuucugccccaccuuacuucuccucccugacag

SEQ ID NO: 89912 - RNA, 64 nt, Homo Sapiens
cccugcccuuuuuccuugacuguucauuuuuuuccugccccacugcuugggauggggaguugca

SEQ ID NO: 89913 - RNA, 64 nt, Homo Sapiens
auaaauauauaaagcuauauuuucaggcuccugccugccccaggcccccugccccacucccauc

SEQ ID NO: 89914 - RNA, 64 nt, Homo Sapiens
cuauauuuucaggcuccugccugccccaggcccccugccccacucccaucucuucuucccugcc

SEQ ID NO: 89915 - RNA, 64 nt, Homo Sapiens
cuguccuugucacgaucacaugaguguguggucucugccccagcacaccugguggauaccuggu

SEQ ID NO: 89916 - RNA, 64 nt, Homo Sapiens
ccaccucacagcuacucaguuacccaacccugcccugccccaccgccccaccucccccuucccc

SEQ ID NO: 89917 - RNA, 64 nt, Homo Sapiens
cagccagccagucuugccuacagggccccucccucugccccaaguacccagcuccuuuuguccc

SEQ ID NO: 89918 - RNA, 64 nt, Homo Sapiens
cccccaaccccgcggugcuccugggccccaugcucugccccaagagaacaagucacagcugcag

SEQ ID NO: 89919 - RNA, 64 nt, Homo Sapiens
gucucaucuguacaccgacagggcgagcuggccucugccccacaccauuguaagcaagugccuu

SEQ ID NO: 89920 - RNA, 64 nt, Homo Sapiens
ccaggaauggagcucuuccccccccuccugaccucugccccacuagcuguguuguaaaccaggu

SEQ ID NO: 89921 - RNA, 64 nt, Homo Sapiens
guccacuacaccagcugccaaaacccagaucagucugccccaaagaaguguggagucagaaugc

SEQ ID NO: 89922 - RNA, 64 nt, Homo Sapiens
acccaaaaaacaauggcuauacaggggagcaagccugccccagugcagcaggguccuugagaga

SEQ ID NO: 89923 - RNA, 64 nt, Homo Sapiens
cucccuccugcccaaagugagaaaacgucagccucugccccaccagauacaccagcucacaaau

SEQ ID NO: 89924 - RNA, 64 nt, Homo Sapiens
gcaucugccaacuccaguauguucugcauggcgccugccccaggcacuaaccccacuucugugu

SEQ ID NO: 89925 - RNA, 64 nt, Homo Sapiens
cuuucaaggaggaaaccagacagggcuggcucugcugccccaaccagggccuugcccagauaga

SEQ ID NO: 89926 - RNA, 64 nt, Homo Sapiens
ccauaucuacuggccuuuguugggaagauuuaggcugccccagaggggagaagcagcauugaag

SEQ ID NO: 89927 - RNA, 64 nt, Homo Sapiens
uaccauacugucucuggagugaugguguccuucccugccccaccacgcaugcucagugccuuuu

SEQ ID NO: 89928 - RNA, 64 nt, Homo Sapiens
gaggccgucacuggaguggcgucugcagcagcugcugccccagcacccgcucagccuguccugg

SEQ ID NO: 89929 - RNA, 50 nt, Homo Sapiens
ccaggccccgguggcgguaacugccccaaggccccagggacagaggccaa

SEQ ID NO: 89930 - RNA, 64 nt, Homo Sapiens
ugaccuccugucacucacugaggccaucagggcccugccccaggccuggacgggcccuccuucc

SEQ ID NO: 89931 - RNA, 64 nt, Homo Sapiens
cagcgccuccaggcccagcuucccagagcucccucugccccagcgccuguggguuuccauggcu

SEQ ID NO: 89932 - RNA, 64 nt, Homo Sapiens
cugcggcuugcccagucccggccgccuguccucacugccccaggccugccuccugcuugcgggg

SEQ ID NO: 89933 - RNA, 64 nt, Homo Sapiens
agccuggacccccagcuuugcccaacaccagccccugccccagcccaaguccaaauguuuacag

SEQ ID NO: 89934 - RNA, 64 nt, Homo Sapiens
cuguuccagacaacugccaacgucacugagggcccugccccagcggcccuggccccaggcucua

SEQ ID NO: 89935 - RNA, 64 nt, Homo Sapiens
gucagguggucaauguccuggugauuuuaugagacugccccacugagaaaacuuacuuacuuca

SEQ ID NO: 89936 - RNA, 64 nt, Homo Sapiens
ugucacaaucccuuucagaaaacauuaguggccgcugccccagcuacagagacggccgaaaugc

SEQ ID NO: 89937 - RNA, 64 nt, Homo Sapiens
ugcagacauguuuacuaaugauaaauaagagcuucugccccaccgauggcccacuuuuguuuau

SEQ ID NO: 89938 - RNA, 64 nt, Homo Sapiens
aagcuggaggcugcuccagagcucuugucccucacugccccaguugaccagcuccuccagucau

SEQ ID NO: 89939 - RNA, 64 nt, Homo Sapiens
agggcccugcauguuggagaagagauuuucugcccugccccaccauuccaacuucugccugugg

SEQ ID NO: 89940 - RNA, 64 nt, Homo Sapiens
caagcccaaacuugguuucucugacccggccucucugccccaccugggggggacccugccucag

SEQ ID NO: 89941 - RNA, 64 nt, Homo Sapiens
cuccccgccuuagagccucgccuuucccacccuccugccccacacaccucacccggccucuucg

SEQ ID NO: 89942 - RNA, 55 nt, Homo Sapiens
ccaccuccacucccaccucagcacccugccccaccacgccucucgccgccucuga

SEQ ID NO: 89943 - RNA, 64 nt, Homo Sapiens
augacccucaggaauugcaaggacugucugucuccugccccaugagacaaccacagauccuaca

SEQ ID NO: 89944 - RNA, 64 nt, Homo Sapiens
ucgggagacagcagcuuuggauccucagccccuccugccccagggacuauuacccaagagaggu

SEQ ID NO: 89945 - RNA, 64 nt, Homo Sapiens
gucuucccaucacaugaagacaucagguuggguccugccccacugccccucccccuguuccugc

SEQ ID NO: 89946 - RNA, 64 nt, Homo Sapiens
guuggguccugccccacugccccucccccuguuccugccccaagccgucaaucagauuguggag

SEQ ID NO: 89947 - RNA, 64 nt, Homo Sapiens
ccugaggcagcgcuccauggcccucacccaccagcugccccaucugggcgcuuuggagguuugc

SEQ ID NO: 89948 - RNA, 64 nt, Homo Sapiens
gacaugggaagaccacgggaaaagcccccagcagcugccccaggagugacagccgguguccugg

SEQ ID NO: 89949 - RNA, 64 nt, Homo Sapiens
aacauggcagaagcacaggugaaauggaaugccccugccccaggggaagaaaaagcaucagggg

SEQ ID NO: 89950 - RNA, 64 nt, Homo Sapiens
cccccgacuguguucaggagagggcuguuugccucugccccauccugucugcaggugaaacagg

SEQ ID NO: 89951 - RNA, 64 nt, Homo Sapiens
guuccugacuucuugcuggcugugccugauagaccugccccagcucgcccugugccaccccaac

SEQ ID NO: 89952 - RNA, 64 nt, Homo Sapiens
cccuccgucccacuccacuccaggcugccggcaccugccccauucccuggccugguuuccuaac

SEQ ID NO: 89953 - RNA, 64 nt, Homo Sapiens
ccauucugcggccugguucugcaaggaaccagggcugccccaccgcccgccgucugccgcccua

SEQ ID NO: 89954 - RNA, 64 nt, Homo Sapiens
ucggucuacucaggugugagggggcaggucugaccugccccaaaguuggcuccauccuggacaa

SEQ ID NO: 89955 - RNA, 64 nt, Homo Sapiens
ccgaaccgugaauguagggcccccagccucaccucugccccaggaccaacaacacccugguuug

SEQ ID NO: 89956 - RNA, 64 nt, Homo Sapiens
gccacccaccggacccucgcacgccgugccaggccugccccagacgcgucugcaggccgcuugc

SEQ ID NO: 89957 - RNA, 64 nt, Homo Sapiens
cccaagggccuggacaccccuccccaggcaggugcugccccaggaggacuguccucgggaauga

SEQ ID NO: 89958 - RNA, 64 nt, Homo Sapiens
ccaagcaacauuugcuccugcccuggggccagcucugccccagcccugagagggguggugaggc

SEQ ID NO: 89959 - RNA, 64 nt, Homo Sapiens
acagcuuugcaccccggcaucagcacaggggucccugccccacccuccggcagcucagggagug

SEQ ID NO: 89960 - RNA, 64 nt, Homo Sapiens
caaauacagcucuuucuagcaaaaucaggcagcucugccccaucgguaggggcaccgauuaguc

SEQ ID NO: 89961 - RNA, 64 nt, Homo Sapiens
ucaggcuguugccauggaaguucagggccauagacugccccacuuaaacucuugucagucuggg

SEQ ID NO: 89962 - RNA, 64 nt, Homo Sapiens
gccaggguccccugggaagaugcccccaagacaccugccccaaguggguggauaucugccuucc

SEQ ID NO: 89963 - RNA, 64 nt, Homo Sapiens
ucacuacaguugguucuauuauccuccccuuccucugccccaagagaugcacuagaagaccuuc

SEQ ID NO: 89964 - RNA, 64 nt, Homo Sapiens
uugucgcuuuuaggaccuccuacuccaggcaaaccugccccauccugaggggaucaggcuuuuc

SEQ ID NO: 89965 - RNA, 64 nt, Homo Sapiens
ggucccaggucaggcccacccccugcaccuccaccugccccagccccugccucugccccaagug

SEQ ID NO: 89966 - RNA, 64 nt, Homo Sapiens
cccccugcaccuccaccugccccagccccugccucugccccaaguggggccagcugcccucacu

SEQ ID NO: 89967 - RNA, 64 nt, Homo Sapiens
ggguugggguuucugccacuuccgggucuaggcccugccccaaauccagccaguccugccccag

SEQ ID NO: 89968 - RNA, 64 nt, Homo Sapiens
ccgggucuaggcccugccccaaauccagccaguccugccccagcccacccccacauuggagccc

SEQ ID NO: 89969 - RNA, 64 nt, Homo Sapiens
acagcccagccugagcucugggugggaaagcagccugccccaugcuuccagccugcagaacaca

SEQ ID NO: 89970 - RNA, 64 nt, Homo Sapiens
uuuggugcacucaggcauggcugggacaagccagcugccccaggguucuuccccuggugauucu

SEQ ID NO: 89971 - RNA, 64 nt, Homo Sapiens
gauacuggcacuuuaaaaagcugagagucccuuccugccccaccggagaaggcucugcucagcc

SEQ ID NO: 89972 - RNA, 64 nt, Homo Sapiens
ugccggcugguuccagcagcgaggugcugcuuuucugccccaccccuccucgcccuggugaggg

SEQ ID NO: 89973 - RNA, 64 nt, Homo Sapiens
uggagaaggaagcugccuggucccccagggggcucugccccaccggauacucuuggagaguugu

SEQ ID NO: 89974 - RNA, 64 nt, Homo Sapiens
ugcucccgagagaugacacuguauacccacuaggcugccccacgugcuggcaaaggcuggcugu

SEQ ID NO: 89975 - RNA, 64 nt, Homo Sapiens
ggcccgagagaagcugacaaguugcagugugccucugccccaugaguuagucaccgcugugugu

SEQ ID NO: 89976 - RNA, 64 nt, Homo Sapiens
ucuuugcuccuggcaccucgugucccacagcuugcugccccauuccacaugccacucgcugccu

SEQ ID NO: 89977 - RNA, 64 nt, Homo Sapiens
cggucaggguuauggcacgaaaccugaauacuuccugccccaggcauuagcaucugacacagcc

SEQ ID NO: 89978 - RNA, 64 nt, Homo Sapiens
uccucauaggcagagaagccgccaaggccaagcccugccccagaaacgccuccaagaccagcag

SEQ ID NO: 89979 - RNA, 64 nt, Homo Sapiens
cacuccaggauguuagggucggagaccaugggcccugccccaccccugccaccucccaccuaga

SEQ ID NO: 89980 - RNA, 64 nt, Homo Sapiens
cccacacugcaggaggauuugucucuaagaggugcugccccaaagcuccccaagcaucaauacu

SEQ ID NO: 89981 - RNA, 64 nt, Homo Sapiens
cuguuuuugcuauggcuguaaagguauuuuuccucugccccacucccugccauaccuuuauccu

SEQ ID NO: 89982 - RNA, 64 nt, Homo Sapiens
cagagaaggauguccguuccaggagcacacggcccugccccauccugggccuuaccuccccugc

SEQ ID NO: 89983 - RNA, 64 nt, Homo Sapiens
aagccugugccaccugcaagugcccgcccugccccugccccaacccccaccgaagagcccugag

SEQ ID NO: 89984 - RNA, 64 nt, Homo Sapiens
gggagcccagaacuugcaguaacccuuuaggguccugccccaggcccagccagggcugaggagc

SEQ ID NO: 89985 - RNA, 64 nt, Homo Sapiens
caggcggcccgcuucccauuucucaaaccccgcucugccccauuguucuccuuucccuuauacu

SEQ ID NO: 89986 - RNA, 64 nt, Homo Sapiens
gaggcaggggguggggggccgcccugccccaguccugccccaggggaaggcaggaggguccccu

SEQ ID NO: 89987 - RNA, 64 nt, Homo Sapiens
ccugccccagggaggcaggggaggguccccugcccugccccagucuuuggcuccuggaaggcag

SEQ ID NO: 89988 - RNA, 64 nt, Homo Sapiens
cagaggugacucagugccucagucacacuggccccugccccagcuguggaccugucuguuacgg

SEQ ID NO: 89989 - RNA, 59 nt, Homo Sapiens
agccccuucucugguagcccaccuggccccugccccacccggaccccagcgggcucuga

SEQ ID NO: 89990 - RNA, 64 nt, Homo Sapiens
caggccuggcccagccagcagccugccuccggcccugccccacaagccaggccucccgcaugcu

SEQ ID NO: 89991 - RNA, 64 nt, Homo Sapiens
gaagccucagucccucccuccaaauccauacccccugccccagagugugccugcuauccagccg

SEQ ID NO: 89992 - RNA, 64 nt, Homo Sapiens
uaacuucaguccugcuccagcgaauccaagcucccugccccaaacuucagaauuccauaucuug

SEQ ID NO: 89993 - RNA, 64 nt, Homo Sapiens
cguuagaauauaggucucuucagaacccagggcucugccccaguacccacgauuuucuccagcu

SEQ ID NO: 89994 - RNA, 64 nt, Homo Sapiens
agcgggccugagccacguccccaccgccaacccccugccccaggccuccccaacccaccucaug

SEQ ID NO: 89995 - RNA, 64 nt, Homo Sapiens
ggccugggccgagccucuacucucugcuguuauccugccccaaggugccaggaggcaccugagu

SEQ ID NO: 89996 - RNA, 64 nt, Homo Sapiens
cucuccugcucucucagaacgcugacuuucucaacugccccagccgcucugcugguuuuagucg

SEQ ID NO: 89997 - RNA, 64 nt, Homo Sapiens
ccuacucaaggagucaggugccuuuccaggagcucugccccaccccugccccagcacuucccag

SEQ ID NO: 89998 - RNA, 64 nt, Homo Sapiens
acuucccagccuuuccaggaaaaugccccauucccugccccagcugaagggcacagcugcuggc

SEQ ID NO: 89999 - RNA, 64 nt, Homo Sapiens
ugcagauccagagguuucuggcagccaguaccuccugccccaugcugcccgcuucucacccuau

SEQ ID NO: 90000 - RNA, 64 nt, Homo Sapiens
gggaccucaaaggugauugugccaggcucugcgccugccccacacccucccuuacccuccucca

SEQ ID NO: 90001 - RNA, 64 nt, Homo Sapiens
ucuguccagcagggggcaguagguugccuuggugcugccccagacuggggcuggaaauguuagg

SEQ ID NO: 90002 - RNA, 64 nt, Homo Sapiens
cuuugacugguuacccuccuuuagucaagccggacugccccagugggaagaaggugggagggca

SEQ ID NO: 90003 - RNA, 64 nt, Homo Sapiens
ccuaccccuuccucuccauguaccuacugucacccugccccagucaccccacccaccccugaca

SEQ ID NO: 90004 - RNA, 64 nt, Homo Sapiens
ugacuuggaggcccuggcucacagugauguggggcugccccagcuuugcuuugagucugauaug

SEQ ID NO: 90005 - RNA, 64 nt, Homo Sapiens
gcccuggaugucacacucccaggagacagagccccugccccauguagcaugauccgagacaucc

SEQ ID NO: 90006 - RNA, 64 nt, Homo Sapiens
gcuugcccaggagugugccguguguggcugggcccugccccacaaccggguaagucccucccca

SEQ ID NO: 90007 - RNA, 64 nt, Homo Sapiens
gccuagcaauguaucuucaggaaaacggcauugacugccccaaaugcaaguucucguacgcccu

SEQ ID NO: 90008 - RNA, 64 nt, Homo Sapiens
ggccaggcucacagggacuccggcauagcagacccugccccagcaggcccccuuguccuuccug

SEQ ID NO: 90009 - RNA, 64 nt, Homo Sapiens
ccccucucucugguucccagcaccugccugagaccugccccaggcacccauaaccuggaauucc

SEQ ID NO: 90010 - RNA, 64 nt, Homo Sapiens
gucaaggucacaggcauccaugugugcaaaccaucugccccagcugccuccacagacugcuguc

SEQ ID NO: 90011 - RNA, 64 nt, Homo Sapiens
uccacagacugcugucuccuuguccuccucggcccugccccacuucagggcugcugugagaugg

SEQ ID NO: 90012 - RNA, 64 nt, Homo Sapiens
ggugaggugagugcucgagggaggggagugcuuucugccccaugccuccaacuacuguaugcag

SEQ ID NO: 90013 - RNA, 64 nt, Homo Sapiens
cuccacaaccucgagccugggcucugguccacuacugccccagaccacccucaaagcuggucuu

SEQ ID NO: 90014 - RNA, 64 nt, Homo Sapiens
gucaucuuggugcugugagagguaggagggcagccugccccaucuaggaaucugggaagggcug

SEQ ID NO: 90015 - RNA, 64 nt, Homo Sapiens
guuugugagaauguggccgcccuuuuccugcccucugccccauguggguggggggccucguggc

SEQ ID NO: 90016 - RNA, 64 nt, Homo Sapiens
gcugggaccuauguguuuguguggucguuccaaacugccccagggcuuugggggcggcacuugg

SEQ ID NO: 90017 - RNA, 64 nt, Homo Sapiens
gggcccccaugccacagucuggcuuucccuccaucugccccaggacaagagcaagaaggacauc

SEQ ID NO: 90018 - RNA, 64 nt, Homo Sapiens
gcucauggaugaauggcgagccaccuguugucagcugccccaagccucugggauauguggauuc

SEQ ID NO: 90019 - RNA, 64 nt, Homo Sapiens
ccuucagacccggcugcaacuuccuaagcugccccugccccagcuccucucugcaacccagccc

SEQ ID NO: 90020 - RNA, 64 nt, Homo Sapiens
ccugcggccgggcugcccuucgcugccaggacaccugccccagcgcggcuuggccgccauccgg

SEQ ID NO: 90021 - RNA, 64 nt, Homo Sapiens
uuuuccuagcaucaguccgaaccaugcgcccgcccugccccaacugugugcugguccugcugug

SEQ ID NO: 90022 - RNA, 64 nt, Homo Sapiens
ggagucagcuuucaagauugccugugccccugcucugccccauccuggcuggcagggcugcaug

SEQ ID NO: 90023 - RNA, 64 nt, Homo Sapiens
uucagcauucuguucugcacugugggcuggcucucugccccaacccugggcacuggccccuggc

SEQ ID NO: 90024 - RNA, 64 nt, Homo Sapiens
ggucgcagcuacccucagcccacagcaguguccccugccccagaggcgcccacccugggcucca

SEQ ID NO: 90025 - RNA, 64 nt, Homo Sapiens
ggcccagacccugggcaaacagccuuccuuucuccugccccaagaggagcugggggaaggcagg

SEQ ID NO: 90026 - RNA, 64 nt, Homo Sapiens
agugccguccacgacccugacagucccagcccugcugccccauggccacgugcccacagaugug

SEQ ID NO: 90027 - RNA, 64 nt, Homo Sapiens
cagacggggcugcagagugacacuggcugggcaccugccccacgaccaaugacaaggauuucca

SEQ ID NO: 90028 - RNA, 64 nt, Homo Sapiens
cuuucccaacacuucagacugcaagugagcaaaccugccccaucccgugcaaaacaugcuaccu

SEQ ID NO: 90029 - RNA, 64 nt, Homo Sapiens
acuccuaggacauguucccuucuccuuccaacugcugccccaaaggaagcuuucucugcuucag

SEQ ID NO: 90030 - RNA, 64 nt, Homo Sapiens
cuuguuuaauaucuuaagacuuccccucaacaugcugccccaguuaaucagcaaccugacucag

SEQ ID NO: 90031 - RNA, 64 nt, Homo Sapiens
gacgcgagugcuggugacgcacggcauuagcuuccugccccagacagacuucaucauugugcua

SEQ ID NO: 90032 - RNA, 64 nt, Homo Sapiens
uuccccuaagcagaaaacuggcccugcccugccccugccccauuuccuccucaucugauccccc

SEQ ID NO: 90033 - RNA, 64 nt, Homo Sapiens
cagagaguggggaggcgucagcgccuggccagggcugccccaguccuuuggugcccggugagcg

SEQ ID NO: 90034 - RNA, 64 nt, Homo Sapiens
uccugccaccccacccuuccucuguguguuaucucugccccacagcagccccugggcagcacca

SEQ ID NO: 90035 - RNA, 64 nt, Homo Sapiens
ucuagacuugcaagggagaggaacagggaccaggcugccccacggucccugaaggguccaagga

SEQ ID NO: 90036 - RNA, 64 nt, Homo Sapiens
ucuggaucuagcuguccuucuccgaguggcacgccugccccaggaugcccccuuucccuccccc

SEQ ID NO: 90037 - RNA, 64 nt, Homo Sapiens
uguguucagggguccugugagacuguggcucuaccugccccaccccacugguaccuuuggggaa

SEQ ID NO: 90038 - RNA, 64 nt, Homo Sapiens
gguaccuuuggggaagacugaggugugaagaccccugccccacucccgagucuugccucacccc

SEQ ID NO: 90039 - RNA, 64 nt, Homo Sapiens
gccuuggaaccugcugccuugcccccggcgugggcugccccagugugccugcugcucagggcuc

SEQ ID NO: 90040 - RNA, 64 nt, Homo Sapiens
uggcaggcccugcgcagggcgccagccuccuggccugccccaagacagcuuugcugaaggccug

SEQ ID NO: 90041 - RNA, 64 nt, Homo Sapiens
gccugucccuucugguaaaagcuuggauguugcacugccccacuugcugcaugucuggucuggg

SEQ ID NO: 90042 - RNA, 64 nt, Homo Sapiens
cuguguagcucuuccugcauuccccacccuggcccugccccagcgaauguccaguggucccagc

SEQ ID NO: 90043 - RNA, 64 nt, Homo Sapiens
aagcccacagccucaccugccccagcccuaaacccugccccaggcucucuccuggacuggucuu

SEQ ID NO: 90044 - RNA, 64 nt, Homo Sapiens
ggaauagaauggagggagcugcccuggcauguuccugccccacaaccccugccauuuaccagca

SEQ ID NO: 90045 - RNA, 64 nt, Homo Sapiens
ggggauccugcccccgcccuaccuuggagcgagucugccccaguaaguucaagcuggacugaag

SEQ ID NO: 90046 - RNA, 64 nt, Homo Sapiens
cucgcuggcacucaguuccccuucaggcccagcacugccccagagagcagcaggccccgagccc

SEQ ID NO: 90047 - RNA, 64 nt, Homo Sapiens
cugcugagaaaacacuccgcuucacaccugagcccugccccaccagcagaaugccucccaggau

SEQ ID NO: 90048 - RNA, 64 nt, Homo Sapiens
gcuaguuacugauagccacaggaaguugagacuucugccccauucucuccaauggcugggugaa

SEQ ID NO: 90049 - RNA, 64 nt, Homo Sapiens
agugggcccucguccccuccccccucccaauucucugccccaggcuaauauuagggacugggga

SEQ ID NO: 90050 - RNA, 64 nt, Homo Sapiens
guggugucauuggcagagggucauuuuaggagagcugccccagccccucgaacgccuggcuugg

SEQ ID NO: 90051 - RNA, 64 nt, Homo Sapiens
cgcggugaccccgcggcggccugagggacgcucccugccccaucccggcuguugggcugggccg

SEQ ID NO: 90052 - RNA, 64 nt, Homo Sapiens
gggacugaugggcagagucgccaggaucuggucgcugccccaggcugucccggugcugccccag

SEQ ID NO: 90053 - RNA, 64 nt, Homo Sapiens
caggaucuggucgcugccccggccugucccggugcugccccagcgaccuuaggcccauagagag

SEQ ID NO: 90054 - RNA, 64 nt, Homo Sapiens
gcuuagaaaagcuaacaaggguguguccccuguccugccccaccgguuugcuggcuuuguaaua

SEQ ID NO: 90055 - RNA, 64 nt, Homo Sapiens
acucuugcuauuuguaacuuggggauggucuccccugccccagggcacauaagagcaaaggcuc

SEQ ID NO: 90056 - RNA, 64 nt, Homo Sapiens
cccggaaggaggaacgcugcuuccagagagggugcugccccauauguagcucauaagacccuca

SEQ ID NO: 90057 - RNA, 64 nt, Homo Sapiens
ucacuugcucaacaccagacucugugaccuucuccugccccauucucagaaaacggaaucucug

SEQ ID NO: 90058 - RNA, 64 nt, Homo Sapiens
cuccaaucugcacuuugauugccuccccacugcucugccccacccugcagugucugaagcgccu

SEQ ID NO: 90059 - RNA, 64 nt, Homo Sapiens
cugaaggaacugaggccuggccugagcuguucuucugccccauacuugagcaagggcagggguc

SEQ ID NO: 90060 - RNA, 64 nt, Homo Sapiens
cucccagcuuucugugugcacagccugccccagccugccccagcuccacgugcucgccucugcc

SEQ ID NO: 90061 - RNA, 64 nt, Homo Sapiens
cugccccagccucccagcuucgccucugcccagccugccccagcagcagauggauccacgugcu

SEQ ID NO: 90062 - RNA, 64 nt, Homo Sapiens
cccuucauuauggaccugggcccuaccggaaccccugccccaguuaccacaacucaggccggcu

SEQ ID NO: 90063 - RNA, 64 nt, Homo Sapiens
gccaaggccccacagagcccaaaacagaagggggcugccccagcccagcagagcacagaguuuc

SEQ ID NO: 90064 - RNA, 64 nt, Homo Sapiens
gcccuggccggggccgcgggauaucaauaucaggcugccccacuccacguuccccagcacaucc

SEQ ID NO: 90065 - RNA, 64 nt, Homo Sapiens
cagcacaucccagguggugggagcagaggguacccugccccaccaggguccuuagggaugcucu

SEQ ID NO: 90066 - RNA, 64 nt, Homo Sapiens
ugggcacuguccuuccaccugugccagccacccccugccccacugcugaaugaaggccauuuca

SEQ ID NO: 90067 - RNA, 64 nt, Homo Sapiens
cagaugcaugaauguuugcgaauguugacugccacugccccacacacugugucuuuauagaauu

SEQ ID NO: 90068 - RNA, 64 nt, Homo Sapiens
aucauggagcccugcgaccuaugugcccuugaagcugccccacaccuucgagggccucugcccc

SEQ ID NO: 90069 - RNA, 64 nt, Homo Sapiens
ugcccuugaagcugccccacaccuucgagggccucugccccaugcauccccuacugaggagggg

SEQ ID NO: 90070 - RNA, 64 nt, Homo Sapiens
ccugugcauuuccacggacuacccagagugaccccugccccacccauggugacugaggacagag

SEQ ID NO: 90071 - RNA, 64 nt, Homo Sapiens
gucaggggaccugggaagcuaugaugcagcccuccugccccagugggucuggucuguucuggca

SEQ ID NO: 90072 - RNA, 64 nt, Homo Sapiens
uuuaaaacgagguggaauaccuccugaggauuaucugccccauuuuucugauucuucuugcaau

SEQ ID NO: 90073 - RNA, 64 nt, Homo Sapiens
aggucaucuccagggcucaguuuggaccuccuagcugccccaucuuuuauuugcaguccuucca

SEQ ID NO: 90074 - RNA, 64 nt, Homo Sapiens
uauuuaacaguaauacaggagauccuccaaaggccugccccauguugcccuuuuaaaacauugg

SEQ ID NO: 90075 - RNA, 64 nt, Homo Sapiens
cccaggagccccccugaggccugucucccacccccugccccagaucccugccauuuugccucuc

SEQ ID NO: 90076 - RNA, 64 nt, Homo Sapiens
cacagugcccaacaccccgucucauuauuuuucacugccccagagcagcuccacagggcagggc

SEQ ID NO: 90077 - RNA, 64 nt, Homo Sapiens
cuccuccuucccuccccucccuucccuggguuuucugccccagcagggcucccugcccugaccu

SEQ ID NO: 90078 - RNA, 64 nt, Homo Sapiens
ccgagaacccucagcucucacccagccccucacacugccccaccgacuuugccccucacacugg

SEQ ID NO: 90079 - RNA, 64 nt, Homo Sapiens
ccccagcaagggcacucccacugccgggcugccucugccccagcgccccagccucccugagggc

SEQ ID NO: 90080 - RNA, 64 nt, Homo Sapiens
cgcuguguuuguccguggguuuccaguugugcgucugccccacucgagaaccugccguggaaac

SEQ ID NO: 90081 - RNA, 64 nt, Homo Sapiens
ccuggcucuuuccuaaccccagacccccuaugcccugccccagcauuuuggacgaggccuaagu

SEQ ID NO: 90082 - RNA, 64 nt, Homo Sapiens
gcugagcagugauuguggccgcccccagccccugcugccccagccugugucuguucuccucgag

SEQ ID NO: 90083 - RNA, 64 nt, Homo Sapiens
gccuucccguguggccugagggcugucgagugagcugccccagccccucccagcccuugcccag

SEQ ID NO: 90084 - RNA, 64 nt, Homo Sapiens
gaggugggaaaacggacccaaaccccagugugcccugccccaugccuuuccuuuagugguggga

SEQ ID NO: 90085 - RNA, 62 nt, Homo Sapiens
gugugaucuuugugucuccuuuuugccaagcacauucugauuuucuuguuggaacacagguc

SEQ ID NO: 90086 - RNA, 62 nt, Homo Sapiens
ggaauaagaacuccauuucaaacaguucuggccauucugagccugcuuuugugauugcucau

SEQ ID NO: 90087 - RNA, 62 nt, Homo Sapiens
uuuuuuucugaauuuuuuuuugagugggacaccauucugaaucccccacccaccgcaagcuu

SEQ ID NO: 90088 - RNA, 62 nt, Homo Sapiens
uugaaacccaugaucaccccgcgccaucuucacauucugaagccuucuuccccaauaugccu

SEQ ID NO: 90089 - RNA, 62 nt, Homo Sapiens
uugaagguggguguuggaacuuagacucuaaacauucugauuaugcugaaaggcagcguuuu

SEQ ID NO: 90090 - RNA, 62 nt, Homo Sapiens
acggcagcuuuccuaaaaaguugcacuccaugcauucugauacacagcaaggcuuuugugcc

SEQ ID NO: 90091 - RNA, 62 nt, Homo Sapiens
uaauuaauuuggagcacaaacauuuucccacucauucugaauaagaaggaaagaugguuaaa

SEQ ID NO: 90092 - RNA, 62 nt, Homo Sapiens
auugaguuccaguugaaguuaaauuuuaaagccauucugauuggcaugcuuaaauuuuaacu

SEQ ID NO: 90093 - RNA, 62 nt, Homo Sapiens
ccucuuguauucaaucugugugcuggugugugcauucugagaaaagguugugcucgcuacac

SEQ ID NO: 90094 - RNA, 62 nt, Homo Sapiens
ggguguguggcauuguguucaaauauuuauuacauucugacaaaguagagaaaaucaucaau

SEQ ID NO: 90095 - RNA, 62 nt, Homo Sapiens
cauaucauucugugauuaaauuggugcuauaacauucugacaaaaaaugaucuguaguuuuu

SEQ ID NO: 90096 - RNA, 62 nt, Homo Sapiens
cugaaggagagagucuuuuaccuuaaaauuuucauucugaaugcccccuagggucuauaauu

SEQ ID NO: 90097 - RNA, 62 nt, Homo Sapiens
aauaacaaagcaaaccaauauaauuauauggucauucugaccccagcucuuauacaaauuau

SEQ ID NO: 90098 - RNA, 62 nt, Homo Sapiens
ugccuccuguuuauugagaacuaugcauugaacauucugaaucauucuaagccucuggagag

SEQ ID NO: 90099 - RNA, 62 nt, Homo Sapiens
aguggugaucacaugccagaucucuagugaggcauucugagcuaucggauuuaccuuaagcu

SEQ ID NO: 90100 - RNA, 62 nt, Homo Sapiens
ggggagcagguaagagcagagauuuauuccuacauucugaauugauacaacuccccgaucua

SEQ ID NO: 90101 - RNA, 62 nt, Homo Sapiens
guucaaaugccaaauagugauuagaagacgaccauucugaucugugugugaucuggucacua

SEQ ID NO: 90102 - RNA, 62 nt, Homo Sapiens
cucuuuguauaugcaaauugcaagauuuaaaccauucugaugcaaggauaaaccuuuacuuu

SEQ ID NO: 90103 - RNA, 62 nt, Homo Sapiens
ccuuugcauagcuggguugcagcugcgaaccucauucugacugugaacuaagcaagcuuuga

SEQ ID NO: 90104 - RNA, 62 nt, Homo Sapiens
acacgucugugcccugaaggaacacuggccuccauucugacaucugggcuggggccucagga

SEQ ID NO: 90105 - RNA, 62 nt, Homo Sapiens
agcagaccccugagaucugggcauaggcaccgcauucugaucuggacaaagucgggacagca

SEQ ID NO: 90106 - RNA, 62 nt, Homo Sapiens
aaucaaaacaccgcaccagccagcagaauggacauucugacaucgccagccgacgcccugaa

SEQ ID NO: 90107 - RNA, 62 nt, Homo Sapiens
aguuugguccacuuggcucuguucccccaaagcauucugacaggaucauuuugauguugaau

SEQ ID NO: 90108 - RNA, 62 nt, Homo Sapiens
aaggauccuaaauuucccuuccugcaaauaggcauucugagcgguuuuguaggcaggcugua

SEQ ID NO: 90109 - RNA, 64 nt, Homo Sapiens
cgaggcaagcagaagcagcggccgcagcgaagcugccguucauguguuggaggccaaauguggc

SEQ ID NO: 90110 - RNA, 64 nt, Homo Sapiens
aacucccgagcacuaaguagacgggguagagucagccguucaugcuuuguggggaguucacagc

SEQ ID NO: 90111 - RNA, 64 nt, Homo Sapiens
cauuuaaaaucugugaagcaaauccagacuccuugccguucagccacugugaaaccagaaucug

SEQ ID NO: 90112 - RNA, 64 nt, Homo Sapiens
ucuaacauggucucaguuaaaaaguucugccuaagccguucaguccaacuuguuuccuccccuc

SEQ ID NO: 90113 - RNA, 64 nt, Homo Sapiens
agaucugggaggcacucucuaguuccaacagaaugccguucacaaaggccccugccccacuuuu

SEQ ID NO: 90114 - RNA, 64 nt, Homo Sapiens
aaucgcaagaggaagguggagcaguaucucaacugccguucaacaucaauaagguccauucugc

SEQ ID NO: 90115 - RNA, 64 nt, Homo Sapiens
ggacaccgcaccagacccucuaaccugcauugcagccguucacccuucccucaugguggcagcc

SEQ ID NO: 90116 - RNA, 64 nt, Homo Sapiens
uuacaaggaucagccaugugagaaauucuucggugccguucagcacauuaacgaugacaggggu

SEQ ID NO: 90117 - RNA, 64 nt, Homo Sapiens
auacuuccagcuucuuggcuuuuggauuuggagagccguucaaggauaaagaguauggauaauc

SEQ ID NO: 90118 - RNA, 64 nt, Homo Sapiens
ccagugacuuuccuucccuuucacaugaggaucugccguucauguugcuuucuccuuuguccuc

SEQ ID NO: 90119 - RNA, 64 nt, Homo Sapiens
ucuuugaccaaugcauaguuuggcagaaaaaucagccguucauuuagaagaaucuuagcagaga

SEQ ID NO: 90120 - RNA, 64 nt, Homo Sapiens
gcuacucccuggggugggcucacugggcaccuaggccguucaugacuacgugagcucagaagag

SEQ ID NO: 90121 - RNA, 64 nt, Homo Sapiens
ggcuccccgggucucucacuguugcaguggccuggccguucagccugucucccccaacaccccg

SEQ ID NO: 90122 - RNA, 64 nt, Homo Sapiens
aggcacgcuccucagcuggucaccucccggcuuugccguucagauggggcuccugaggcucagg

SEQ ID NO: 90123 - RNA, 64 nt, Homo Sapiens
ggugagguugaugggaagaccugauucuccgggagccguucaauccaagaaaacguaugaguuu

SEQ ID NO: 90124 - RNA, 64 nt, Homo Sapiens
ccuccaaacugcagcuggucuggcuuacuguuuugccguucaaaaaggucgcgaauccguggga

SEQ ID NO: 90125 - RNA, 64 nt, Homo Sapiens
gacauuuaucgucaucaucugcucugaguggaaggccguucagagaggcuagagguucuuauuc

SEQ ID NO: 90126 - RNA, 64 nt, Homo Sapiens
aauuuaucuacuauuccuaauuauucauuuguaagccguucaguucauuuauaauaagaaugag

SEQ ID NO: 90127 - RNA, 64 nt, Homo Sapiens
gagggcggccaaguccucgcugagcagagagggagccguucaugucagagacucacugccagaa

SEQ ID NO: 90128 - RNA, 50 nt, Homo Sapiens
gcaccuugugguguaguggggccguucagaccucccaccucuuccucuga

SEQ ID NO: 90129 - RNA, 64 nt, Homo Sapiens
ucuuuggccacuauuugcuuggcuaccgugucuggccguucacauaucugggauuacauauguc

SEQ ID NO: 90130 - RNA, 64 nt, Homo Sapiens
guggucuuucagguuaucuuccaugguugugccugccguucaugucugcggagucaucacgcag

SEQ ID NO: 90131 - RNA, 64 nt, Homo Sapiens
gaagucaacugcuguucagccucagaauaaaggugccguucacuggcucaguuaccuccugugu

SEQ ID NO: 90132 - RNA, 64 nt, Homo Sapiens
cucugggcgcuuggacauagacacguggucccaggccguucagccugaccucaggcagcaggca

SEQ ID NO: 90133 - RNA, 64 nt, Homo Sapiens
ggguggggccgggccccccuacgggaugcccacggccguucaucaucuugucccucgucccccu

SEQ ID NO: 90134 - RNA, 64 nt, Homo Sapiens
cucccuccucuuuucucuccagccuugcagcguggccguucacaucacgcgcuucacuaagccu

SEQ ID NO: 90135 - RNA, 64 nt, Homo Sapiens
accacggagauccucaagucgaugagugugugcugccguucauuccagcauuggagaggacuac

SEQ ID NO: 90136 - RNA, 64 nt, Homo Sapiens
cugguuaguuuucuaccuaccaaccccugaaggggccguucagccauugauuuggacagcucac

SEQ ID NO: 90137 - RNA, 65 nt, Homo Sapiens
aagguacucugaaacaugguggccugagagaagaagagcuggagaaaaugaaagaagagcgugaa

SEQ ID NO: 90138 - RNA, 65 nt, Homo Sapiens
aucagcaaaugucuuuagaucuccaucucccccucgagcuggaccauuugguuacccucgggaug

SEQ ID NO: 90139 - RNA, 65 nt, Homo Sapiens
aggcccugcacugccagcaucuggagaccguccuggagcuggagguggaaaauggugccuggagg

SEQ ID NO: 90140 - RNA, 65 nt, Homo Sapiens
ugcauagcuacgugaggccugcacagcuaaguguggagcuggacuacggcggcaguauggaauuc

SEQ ID NO: 90141 - RNA, 65 nt, Homo Sapiens
acuauguauggagcuuuguaucuuuaugaaagacugagcuggaccacccaugccaaggagcgagc

SEQ ID NO: 90142 - RNA, 65 nt, Homo Sapiens
uuuuaauuagaaauaaagcuguucaacuugaaaaugagcuggagaauuuuacuaagcaguuucua

SEQ ID NO: 90143 - RNA, 65 nt, Homo Sapiens
aguccuggggcucuggggccccugcuuuauaaguggagcuggaauaaaugcagcaaauccuucac

SEQ ID NO: 90144 - RNA, 65 nt, Homo Sapiens
uuugaagcacaaaugcagcaaaggacaaccaaagugagcuggaucugagcaguuugccaacugag

SEQ ID NO: 90145 - RNA, 65 nt, Homo Sapiens
caggaugcgaagcagcuguaggccuugggaaucaggagcuggagcuugggcuggggagaggaaca

SEQ ID NO: 90146 - RNA, 65 nt, Homo Sapiens
ccacuccuuuuuuucccauucccuucccauuucuagagcuggaaccuccaaggguggaaacuugc

SEQ ID NO: 90147 - RNA, 65 nt, Homo Sapiens
gguuuccaggggucccccagacaugaaagaggggugagcuggaggaagucauggugucacugggg

SEQ ID NO: 90148 - RNA, 65 nt, Homo Sapiens
cagaccaggguuggacaaaaccccaugagggcggggagcuggaagaaaagucucuuggggaccuc

SEQ ID NO: 90149 - RNA, 65 nt, Homo Sapiens
aacacaauucucuccagagaauggacaacuaacccgagcuggacccugccuguaucaccgguuga

SEQ ID NO: 90150 - RNA, 65 nt, Homo Sapiens
cauggcuguuuauuaugaaaaauauaauguacuuagagcuggauuuaaaucaucaggucuuauaa

SEQ ID NO: 90151 - RNA, 65 nt, Homo Sapiens
cagucaaggauaaaacaagcacgcgcacaaucaaggagcuggaacacacucuccaggccgucaaa

SEQ ID NO: 90152 - RNA, 65 nt, Homo Sapiens
gaaugauuugacaguguccaaacugagacauucuggagcuggaaagccugucacacuagagugug

SEQ ID NO: 90153 - RNA, 65 nt, Homo Sapiens
aacuuugucccuuuacuucuaagacuaguccauaggagcuggaagcagugugucgaugggaacug

SEQ ID NO: 90154 - RNA, 65 nt, Homo Sapiens
cagcgucagugugucgauggcacugcccacagcaggagcuggauccucccugcagugccaacaug

SEQ ID NO: 90155 - RNA, 65 nt, Homo Sapiens
ggguggcccagcugguuauugacucugacuugggugagcuggaguugggggugucucgggcccag

SEQ ID NO: 90156 - RNA, 65 nt, Homo Sapiens
cugugcucuggugugugggugauugggcagggccugagcuggacaggggagcuccuaguagggga

SEQ ID NO: 90157 - RNA, 65 nt, Homo Sapiens
gugaggagggcgagcugucucgccgccugcguguggagcuggagucccugguccuggccauccca

SEQ ID NO: 90158 - RNA, 65 nt, Homo Sapiens
gugggcgugguacgugugcgccuuggggggcugcagagcuggaggucgcacgccugggagguggc

SEQ ID NO: 90159 - RNA, 65 nt, Homo Sapiens
cugcccugcagccuggagaauggggcccccauggggagcuggagcagccaggggcccuggccuga

SEQ ID NO: 90160 - RNA, 65 nt, Homo Sapiens
uugccuuuggcuuuccagguccaaugccuggucuggagcuggagccgguaacaggcacggcuggc

SEQ ID NO: 90161 - RNA, 60 nt, Homo Sapiens
ucuacgacgggcugguauagucccaggcuggagcuggaugccugggaaccacucaccucc

SEQ ID NO: 90162 - RNA, 65 nt, Homo Sapiens
ugccgcagcauggaaaacagggcgccuaaggcugggagcuggaagaaggggcauuggguacccag

SEQ ID NO: 90163 - RNA, 65 nt, Homo Sapiens
ggggagcaaugagaggagggaauccugggaggugggagcuggaaucagcccacucucuggacacc

SEQ ID NO: 90164 - RNA, 65 nt, Homo Sapiens
aaccaaaacugggucucucucucuguguguucauggagcuggagauccuaugguaggacguguac

SEQ ID NO: 90165 - RNA, 65 nt, Homo Sapiens
gagguggggucucuucaccucuuguucuugggcuugagcuggauacuguccacagcucugucugc

SEQ ID NO: 90166 - RNA, 65 nt, Homo Sapiens
cugccagccgcuuccugccuagcggggccgggcgggagcuggagccaugaggcuggccagcccuc

SEQ ID NO: 90167 - RNA, 65 nt, Homo Sapiens
ggcccugagaaaucagagucaaccuucgaccguuugagcuggaggggggcuccguaagaagcuga

SEQ ID NO: 90168 - RNA, 65 nt, Homo Sapiens
caaccuacgugccaggccccucagccuuauccacggagcuggagcagcuccaauucgugacccac

SEQ ID NO: 90169 - RNA, 65 nt, Homo Sapiens
uggccacggccaagaacgacaccauugaccagauagagcuggagugggagaaggaguaucaggag

SEQ ID NO: 90170 - RNA, 65 nt, Homo Sapiens
ccaagauccaggagaaagccaguaacaaccugucggagcuggacauggucuucaaggggcucaug

SEQ ID NO: 90171 - RNA, 65 nt, Homo Sapiens
aggugucuuugaaggaaagcgcggccuguugggcagagcuggacaguuuccugguccaucucauu

SEQ ID NO: 90172 - RNA, 65 nt, Homo Sapiens
acaauaauguguccuucuacugccagacugaaccagagcuggaacugacgguuuaugcugggcac

SEQ ID NO: 90173 - RNA, 65 nt, Homo Sapiens
aucuugaaaauauuuuuuuuuuuugccucgaggcugagcuggaaaacauugaugccugggggacc

SEQ ID NO: 90174 - RNA, 65 nt, Homo Sapiens
uagauuuuauucuuccuugcgugguagacacucuugagcuggacucauugugucuuaacaaaggu

SEQ ID NO: 90175 - RNA, 65 nt, Homo Sapiens
aggaggagggcaaacccgaggaguuggcacuggcagagcuggagguccggaugcgugccagcaau

SEQ ID NO: 90176 - RNA, 65 nt, Homo Sapiens
gccuccggaugcgugccagccaggcccauaggaaggagcuggaaggucugacagagcuggugcug

SEQ ID NO: 90177 - RNA, 65 nt, Homo Sapiens
gcauagcagaaagacuggccccuuccuaggguuaugagcuggaacuguuucuacuuucagucuuc

SEQ ID NO: 90178 - RNA, 65 nt, Homo Sapiens
cauucuccuggugccgcugcugcucccuguuucuggagcuggauguuccccagcuggcaguugag

SEQ ID NO: 90179 - RNA, 65 nt, Homo Sapiens
aggaugagaggcuguggcagcaggagacucugcaggagcuggagaggcugcgggagcuggagagg

SEQ ID NO: 90180 - RNA, 65 nt, Homo Sapiens
agcaggagacucugcaggagcuggagaggcugcgggagcuggagaggaugcuggagcuggggugg

SEQ ID NO: 90181 - RNA, 65 nt, Homo Sapiens
aucugacaggacagcuuuaagaacaccugcggaaggagcuggagaagcagcuacaagcagaggcu

SEQ ID NO: 90182 - RNA, 65 nt, Homo Sapiens
aucuggcaggacagcuuuaagaacaccugcggaaggagcuggagaagcagcuacaagcagaggcu

SEQ ID NO: 90183 - RNA, 65 nt, Homo Sapiens
uuuauacugaaggaauuugugcuguguauuggggggagcuggauccagagcuggagggggugggu

SEQ ID NO: 90184 - RNA, 65 nt, Homo Sapiens
gaauuugugcuguguauuggggggagcuggauccagagcuggaggggguggguccgggggaggga

SEQ ID NO: 90185 - RNA, 65 nt, Homo Sapiens
uaucccauggcuccucgccaaagacugaaauuguggagcuggagggcgcccccuccccggaguuu

SEQ ID NO: 90186 - RNA, 65 nt, Homo Sapiens
gaccucaccaccucuuuuccuuugagcccaaggcagagcuggagcuggcgccacccagacagcgu

SEQ ID NO: 90187 - RNA, 65 nt, Homo Sapiens
uggccgggcugcagagccgggaccucagcgagagugagcuggaugugacccugagcggcgcccac

SEQ ID NO: 90188 - RNA, 65 nt, Homo Sapiens
gcgacacgcagggggcucggcaggggagccccgcagagcuggacaccccaaauuggccucggugg

SEQ ID NO: 90189 - RNA, 64 nt, Homo Sapiens
cauuuuggauauaggucagugaggcccagggagaggccaugauucgcccaaagccagacagcaa

SEQ ID NO: 90190 - RNA, 64 nt, Homo Sapiens
aaggacuguuuuuuccugagcuuggccagaagggggccaugaggccucaguggacuuuccaccc

SEQ ID NO: 90191 - RNA, 64 nt, Homo Sapiens
gcugagauggaacccuuuuggcccccgagcugggggccaugagcuccagacccccagcaacccu

SEQ ID NO: 90192 - RNA, 64 nt, Homo Sapiens
uucaccucuggagaguagggcuguggaaggaauuggccaugacccuccuggaacucugaaccug

SEQ ID NO: 90193 - RNA, 64 nt, Homo Sapiens
accugaggggcaucugcccaaguaugcuuacugaggccaugagaucaguacccgaacucacuuc

SEQ ID NO: 90194 - RNA, 64 nt, Homo Sapiens
uaugccaugugaaugcaggcaugcuggcucccagggccaugaacuuuguccgguggaaggccuu

SEQ ID NO: 90195 - RNA, 64 nt, Homo Sapiens
aaaagcccugaguuucaaguauccuuguugacacggccaugaccacuuuccccgugggccaugg

SEQ ID NO: 90196 - RNA, 64 nt, Homo Sapiens
ggggcagggaucgacaggcaaauauguaccgccuggccaugaccaggcugcuaagaagcaccag

SEQ ID NO: 90197 - RNA, 64 nt, Homo Sapiens
gaggggucccacacaguaagacagccuuugugcaggccaugaugguuccuguaccagcgagucc

SEQ ID NO: 90198 - RNA, 64 nt, Homo Sapiens
uuccucugcuuugaaagccccagaaaucaguguuggccaugaugacaacuacagaaaaaccaga

SEQ ID NO: 90199 - RNA, 64 nt, Homo Sapiens
ccccuagccauuuuuacuguuauccuauuuagauggccaugaagaggaugcugugaaauuccca

SEQ ID NO: 90200 - RNA, 64 nt, Homo Sapiens
uaggaaaccccccaaugucuguugaacagcuaucacguugaaccacgugaaacugcuguuuucu

SEQ ID NO: 90201 - RNA, 64 nt, Homo Sapiens
uaggggggcuugauucaacaaagccacagacuuaacguugaaauuuucuucaggaauuuucuag

SEQ ID NO: 90202 - RNA, 64 nt, Homo Sapiens
aucagaugaugucuucuccuuuuccaaacaccacacguugaaagcauuuauaaauccaagucug

SEQ ID NO: 90203 - RNA, 64 nt, Homo Sapiens
ugguggcucacaccuguaaucccaacacuuugggacguugaaaugggagaauugcuugagucca

SEQ ID NO: 90204 - RNA, 64 nt, Homo Sapiens
cccuauccaggucacuccagaaaaggguauugaaacguugaaaucuaaagcaaauuugcaauuu

SEQ ID NO: 90205 - RNA, 64 nt, Homo Sapiens
ggccaaaguccuacaaucggaauggauucaugccacguugaagauaaaauuauccucucucuga

SEQ ID NO: 90206 - RNA, 64 nt, Homo Sapiens
cagagucuuauaacaccucccaugguucuguguuacguugaagccaaagggccuccuuggcugg

SEQ ID NO: 90207 - RNA, 64 nt, Homo Sapiens
gauuugcuuuguuaacaaaagauuacuccuauucacguugaaguccauggaggugcagagauga

SEQ ID NO: 90208 - RNA, 64 nt, Homo Sapiens
acuguguguaucucuagauaagaagauaugcaccacguugaaaauacucaguguagaucucuau

SEQ ID NO: 90209 - RNA, 63 nt, Homo Sapiens
auacauuagauguguguuuuaaaaugcauaaaacacguugaaauacauuaaugaaccauuagu

SEQ ID NO: 90210 - RNA, 64 nt, Homo Sapiens
aagcuguaauguaauuuuauauuuucuuauagccacguugaaguaaaaacaaacagguacagug

SEQ ID NO: 90211 - RNA, 64 nt, Homo Sapiens
gcagcauuuuugaaaagggacagaauggacaaugacguugaaacgagagacagaaagagagccu

SEQ ID NO: 90212 - RNA, 64 nt, Homo Sapiens
aacaguauacaagaacccuguguaaaugagguuuacguugaagauaaugcuaugucacuauuuu

SEQ ID NO: 90213 - RNA, 64 nt, Homo Sapiens
aaugauuuuuuaauaugugaaugaccucauuuugacguugaaaaaaguuuaggugccuuugcgg

SEQ ID NO: 90214 - RNA, 64 nt, Homo Sapiens
guaauccccaauguuagaggccccaccaaaucucacguugaagugauaugguuuggaucugugu

SEQ ID NO: 90215 - RNA, 64 nt, Homo Sapiens
gaggaaaauguggccuguuuacaaaacauucagcacguugaagaaaguguucccaauggagugg

SEQ ID NO: 90216 - RNA, 64 nt, Homo Sapiens
aggccagugccaaguccacauuccuccagcugauacguugaagcaaacucuuacugccuuucuc

SEQ ID NO: 90217 - RNA, 64 nt, Homo Sapiens
cagugcaucuguucauccauccugcacuuggcccacguugaacuccauggugccugagagagac

SEQ ID NO: 90218 - RNA, 64 nt, Homo Sapiens
uuugugauucuguguggccucauuaucguggaacacguugaauggaagagcaucucauacauau

SEQ ID NO: 90219 - RNA, 64 nt, Homo Sapiens
gcuaaugaguaugugcucauacagaucagcaccaacguugaacacacagagaagcucugauagc

SEQ ID NO: 90220 - RNA, 64 nt, Homo Sapiens
agaugcuuugaguuuaaaccgcgggccuccuuuuacguugaauccgagaaauuugaugagagag

SEQ ID NO: 90221 - RNA, 64 nt, Homo Sapiens
caggaagagggccugagguucuccuagugcaggaacguugaauauuggcaaugauuccugguuc

SEQ ID NO: 90222 - RNA, 64 nt, Homo Sapiens
ucauaacaacaucucaaaaauuuggggaaacacaacguugaaaacuuccuaagaaaaggaaucu

SEQ ID NO: 90223 - RNA, 64 nt, Homo Sapiens
auaucacuucagggcuuggauagccugaauguggacguugaaacccucuaguugacuuuucucu

SEQ ID NO: 90224 - RNA, 64 nt, Homo Sapiens
uuuaagggucucaguccccgaccucagaaacauaacguugaacuggcaguggugggugucugaa

SEQ ID NO: 90225 - RNA, 64 nt, Homo Sapiens
ccagauuauucucuagccaagccccaccuuuguuacguugaaaucccucauuuauuuucuucuc

SEQ ID NO: 90226 - RNA, 64 nt, Homo Sapiens
ugaacaaaaagcauuaaacuggcuccaucagaagacguugaagggcagugaagagcacagacuc

SEQ ID NO: 90227 - RNA, 64 nt, Homo Sapiens
cucaaagcuauacuaagaagugacuuacauguugacguugaagguaauauuuaacuuaaauauu

SEQ ID NO: 90228 - RNA, 64 nt, Homo Sapiens
uggauugcgacugguuuuauacggccugccuauaacguugaaaauccauguacuacauaauaau

SEQ ID NO: 90229 - RNA, 64 nt, Homo Sapiens
ugagccacuucuccccacccuccagaagggguccacguugaauucugaaucaucuugaaaauaa

SEQ ID NO: 90230 - RNA, 64 nt, Homo Sapiens
caagauccuaugucuguugucauggaggagaacuacguugaaauuaaacggacagagaaaugca

SEQ ID NO: 90231 - RNA, 64 nt, Homo Sapiens
ugauagaaguuauuugcuaauagcuucuauucuuacguugaaaauaguuguaaaagcugaugaa

SEQ ID NO: 90232 - RNA, 64 nt, Homo Sapiens
uauuaaaauaacaaaucuggauguacagaauuuaacguugaauacuugauguagauuuuacucu

SEQ ID NO: 90233 - RNA, 62 nt, Homo Sapiens
agaaucaauucuucaacucaaaucugccuaaaacguugaaggugucuaaaucagaugacuga

SEQ ID NO: 90234 - RNA, 64 nt, Homo Sapiens
uucuccaaagaagauauacaaauggcaaauacauacguugaaagauccuuaauauuguuagcca

SEQ ID NO: 90235 - RNA, 64 nt, Homo Sapiens
caggguggcaguuucccuugagcaaagcagccagacguugaacuguguuuccuuucccugggcg

SEQ ID NO: 90236 - RNA, 64 nt, Homo Sapiens
uauaagcaccucucuaaagaaucuuuaguuuccgacguugaauuauagaccaguuugaguaagu

SEQ ID NO: 90237 - RNA, 64 nt, Homo Sapiens
aaauauuagcuuugauggcaaauucaagaaaagaacguugaaccgcaauggauguagaaaauaa

SEQ ID NO: 90238 - RNA, 64 nt, Homo Sapiens
aaaacaaauuauucauucauaugaugcuuucuuaacguugaaauugcacauucacauuggacug

SEQ ID NO: 90239 - RNA, 64 nt, Homo Sapiens
ugauaugcuucgcacugagcacaucacauuuaggacguugaagauuuuuuuuuuuuuuuuuuuu

SEQ ID NO: 90240 - RNA, 64 nt, Homo Sapiens
caguaauguggcuacacaguacuuuccacacaggacguugaaaaaaaauuguacagugauagca

SEQ ID NO: 90241 - RNA, 64 nt, Homo Sapiens
ugccauguuuccuuuugcguucuuccagaagagaacguugaaagagcuuugaagaccuaccugu

SEQ ID NO: 90242 - RNA, 64 nt, Homo Sapiens
uauaugaacauacuuuccuaaauaugugcaguauacguugaaugugcuuuguauuguaguaacc

SEQ ID NO: 90243 - RNA, 64 nt, Homo Sapiens
gaacacaccacuuuuuacuguugaaaccaacacaacguugaaauccaggcuuauacgcagacuc

SEQ ID NO: 90244 - RNA, 64 nt, Homo Sapiens
cuggugagggacauuguagugcagggacucugccacguugaauuaggccaggcagggagcagau

SEQ ID NO: 90245 - RNA, 64 nt, Homo Sapiens
aucuuuaagucuuuguccccgagaaauagugcuuacguugaaaaaaaaacugaacaagguugag

SEQ ID NO: 90246 - RNA, 64 nt, Homo Sapiens
ucagauuaaucucuucugaaaaugagcacaaagaacguugaaguuccuguuuuaauaauuuuaa

SEQ ID NO: 90247 - RNA, 64 nt, Homo Sapiens
uucacaauguuaaaauguuaaagcccuguuauaaacguugaacuaaacuuuucuccauuuuaaa

SEQ ID NO: 90248 - RNA, 64 nt, Homo Sapiens
auguugcauuuaugaugcaguuucaaguaccaaaacguugaauugaugaugcaguuuucauaua

SEQ ID NO: 90249 - RNA, 64 nt, Homo Sapiens
ugaaauuuugaucccaauagaauucauuucucuuacguugaauccccaaucauaauuaagccgu

SEQ ID NO: 90250 - RNA, 64 nt, Homo Sapiens
ucaaagugugguguuugguuugccuggagaugccacguugaaucaugugauucuagauuaacau

SEQ ID NO: 90251 - RNA, 64 nt, Homo Sapiens
aaggacaauuuguguuggauagcgagaacuaugaacguugaaacagauaaucuuauucugauga

SEQ ID NO: 90252 - RNA, 64 nt, Homo Sapiens
cuuuuuaagagaaguguguauuguaaaauugauuacguugaaugcacuuuuuaaauugauaauu

SEQ ID NO: 90253 - RNA, 64 nt, Homo Sapiens
uuuaaaccaaacggaacucuucaucuuaaacuacacguugaaaaucaacccaauaauucuguau

SEQ ID NO: 90254 - RNA, 64 nt, Homo Sapiens
uuauagaugggacaaugcacuccagugaauggaaacguugaaauuuauacugcagguagguauu

SEQ ID NO: 90255 - RNA, 64 nt, Homo Sapiens
agaaaaccuauuuuuaaaugcgggccuuuccacuacguugaagagcaccgcugugacugggcuc

SEQ ID NO: 90256 - RNA, 64 nt, Homo Sapiens
aaaagaauaugguuuugguucccauuucuaguucacguugaaugacaggccuggagcuguagaa

SEQ ID NO: 90257 - RNA, 50 nt, Homo Sapiens
gcaaggagcagaagacauagacguugaaacagaaacagaaggaugaagga

SEQ ID NO: 90258 - RNA, 64 nt, Homo Sapiens
gcaccuuaaaucuaaucagcaaacuauaauuuguacguugaaaccugcaacacauuagaaacuu

SEQ ID NO: 90259 - RNA, 64 nt, Homo Sapiens
aacuauauuaauguggagaucugucaaugaaaauacguugaauaggucuuuuaccucauauuuu

SEQ ID NO: 90260 - RNA, 64 nt, Homo Sapiens
accuaggguacaguccuugacagaauugacuauaacguugaacaguccuguaucaaaacugaag

SEQ ID NO: 90261 - RNA, 64 nt, Homo Sapiens
uuugucuugaaacaaaaacuguuuuaagacgucuacguugaauuauucagagaauuaagcaaua

SEQ ID NO: 90262 - RNA, 64 nt, Homo Sapiens
ucuggaucuuuccuuuguauuccauaucuuuucuacguugaaugucugugcgauuuuuagcaca

SEQ ID NO: 90263 - RNA, 64 nt, Homo Sapiens
aguucgaaucugguaaacauagaccaaaauggaaacguugaauacauguccagcuuccagaaua

SEQ ID NO: 90264 - RNA, 58 nt, Homo Sapiens
aaaagcaaucacaguguuaaaagaagacacguugaaaugaugcaggcugcuccuaugu

SEQ ID NO: 90265 - RNA, 58 nt, Homo Sapiens; identical to SEQ ID NO: 90264

SEQ ID NO: 90266 - RNA, 64 nt, Homo Sapiens
ucuuuguguucuucaaugagaaaucaaauuugagacguugaaauuggagcugcgugcugcugca

SEQ ID NO: 90267 - RNA, 64 nt, Homo Sapiens
cccucucuaccauauugggacucucuuuuucucaaucucccagcccaggacugaaacuuucuug

SEQ ID NO: 90268 - RNA, 64 nt, Homo Sapiens
acugaaacuuucuugcucuccacgucccaggcucaucucccaggagccaugcugagaauaaaca

SEQ ID NO: 90269 - RNA, 64 nt, Homo Sapiens
uacugaggagcaagacuguccaguucuccuccacaucucccaucccagaaucaggaucugggac

SEQ ID NO: 90270 - RNA, 64 nt, Homo Sapiens
gcccuguggggugcccccgaugggaggcugucccaucucccaguccccaucucuuuuuccccac

SEQ ID NO: 90271 - RNA, 64 nt, Homo Sapiens
ggugacgucuuacuggugaucaucuccucaccccaucucccaccuuguggaauaaauacauguu

SEQ ID NO: 90272 - RNA, 64 nt, Homo Sapiens
acgguuucuguucugcccccucagggaugugggaaucucccagacuuguuuccugugcccauca

SEQ ID NO: 90273 - RNA, 64 nt, Homo Sapiens
gaagacauaucaugugugagauaacuuccuucacaucucccauggucccuagcaaaaugcuagg

SEQ ID NO: 90274 - RNA, 64 nt, Homo Sapiens
agcuguuuccuugccaacaggucccuuccucuccaucucccaccaaacuagggcaccauugauu

SEQ ID NO: 90275 - RNA, 64 nt, Homo Sapiens
gccccugauuuugccuuaaguucuugccugagugaucucccagccugucuucugucuccuuuug

SEQ ID NO: 90276 - RNA, 64 nt, Homo Sapiens
ugguuuauaaaaucccuuaaguugauacuuuaaaaucucccauuauucuauauaaaagaaguca

SEQ ID NO: 90277 - RNA, 64 nt, Homo Sapiens
ccagcgcugagugggagaagcuuccgauggaugaaucucccacuuggaccugguggcuacgaau

SEQ ID NO: 90278 - RNA, 64 nt, Homo Sapiens
auuguucccauuccauguguucugaauucagcucaucucccagcauauagauauauccuccuuu

SEQ ID NO: 90279 - RNA, 64 nt, Homo Sapiens
ccuguggcacuccccacccauagaccuucagaucaucucccacacccuggaucucacucuccuc

SEQ ID NO: 90280 - RNA, 64 nt, Homo Sapiens
gccuuuucagguuggaagaagaaaaauagccucaaucucccaccccauguaggcacuaccuccc

SEQ ID NO: 90281 - RNA, 64 nt, Homo Sapiens
caacccugaagauaaucaaggccaguuacucaucaucucccaaccacuguuuccucaacugccc

SEQ ID NO: 90282 - RNA, 64 nt, Homo Sapiens
ccaaagccaaaugcaguuccaaauaguggacauaaucucccagggaaaucugggcucgaggccu

SEQ ID NO: 90283 - RNA, 64 nt, Homo Sapiens
ucuuugucacuuggacuauuucagcaacagucucaucucccagauuaccucugugcacacugac

SEQ ID NO: 90284 - RNA, 64 nt, Homo Sapiens
ggcauaggacuugcagguuccuaggagcaggagcaucucccaucgcacgugcuuucugcucuuc

SEQ ID NO: 90285 - RNA, 64 nt, Homo Sapiens
ugcaguggcaugaucauggcuuacugcagccuugaucucccaggcucaagcgauccuucugccu

SEQ ID NO: 90286 - RNA, 64 nt, Homo Sapiens
acauuuauucccuucuauuccaaacaugccaucuaucucccagguucacccuucauucuuucaa

SEQ ID NO: 90287 - RNA, 64 nt, Homo Sapiens
cuccucaggguucugaggucuauuuucuggguggaucucccauagcacugugcugcccaaggag

SEQ ID NO: 90288 - RNA, 64 nt, Homo Sapiens
ucccaggaugugagugggucugaagauacauucccaaauaaacgaccuaggcuagaagauaaga

SEQ ID NO: 90289 - RNA, 64 nt, Homo Sapiens
gacuguuuuugacaauuuuuuuaucaagaaagagcaaauaaaaagcagugguaaugauccaaag

SEQ ID NO: 90290 - RNA, 64 nt, Homo Sapiens
uuuaaaaauucaauugaaaauguauuguauuuuucaaauaaaaagaggaaauaauucucugcug

SEQ ID NO: 90291 - RNA, 64 nt, Homo Sapiens
uaaccaaagauuguccauuaucaacagagaucagcaaauaaauauuuuaauuuccucuguaauu

SEQ ID NO: 90292 - RNA, 64 nt, Homo Sapiens
uuugucacuugagcuuauguugaguugaaaacugcaaauaaaagcauuuucauaucauuugcau

SEQ ID NO: 90293 - RNA, 64 nt, Homo Sapiens
uacuagaauacugcuaguuaugcaaguacaccugcaaauaaaacagauuuauaauaauaugggc

SEQ ID NO: 90294 - RNA, 62 nt, Homo Sapiens
guccucucuuuuauuuuaagauaaauaaagguaucaaauaaaaauggugcgcuguuuugcau

SEQ ID NO: 90295 - RNA, 64 nt, Homo Sapiens
cugaauauuuaguaaguuuaauuauauuagaauccaaauaaaccuuucuguugugaaaauaaag

SEQ ID NO: 90296 - RNA, 53 nt, Homo Sapiens
cugaaagagauugcuaauaaaaucaaauaaaacuguaugaacucuaauggaga

SEQ ID NO: 90297 - RNA, 64 nt, Homo Sapiens
ucacaacauucacuauguuugcaaggaauuaacacaaauaaaagaugccuuuuuacuuaaacac

SEQ ID NO: 90298 - RNA, 64 nt, Homo Sapiens
uucucaaaauacauugguuuaaagccuuauaaaccaaauaaaaauuccagaggucauggaacag

SEQ ID NO: 90299 - RNA, 64 nt, Homo Sapiens
uuuuucucacagugucaaggccauggaaauauuccaaauaaauuuuguuuuugguuacaugaua

SEQ ID NO: 90300 - RNA, 64 nt, Homo Sapiens
aguaaccaugucuuugucuaacuuuuuuuuucuucaaauaaaaacgcaguauuuauuaaaacau

SEQ ID NO: 90301 - RNA, 64 nt, Homo Sapiens
gugucuugguuugaugucauuaaaaaugcaaagucaaauaaaagugauuuuuugccaucguuga

SEQ ID NO: 90302 - RNA, 64 nt, Homo Sapiens
uaggcuacagguauagcugaagaacuaaauaaaacaaauaaaaccuaaugaaggguuuuuuaaa

SEQ ID NO: 90303 - RNA, 64 nt, Homo Sapiens
uggggagaugggaaucuuuggaaaaccaaugcgacaaauaaaguuuuaaaaaauuaaaauuucu

SEQ ID NO: 90304 - RNA, 64 nt, Homo Sapiens
uccauccuucccucucccaaaaggggcucccucucaaauaaaucaagaaguugcugcccaguua

SEQ ID NO: 90305 - RNA, 64 nt, Homo Sapiens
uuaaagacacaaugcacacuaaaaugauacaagucaaauaaaucgaaaacaaucagggcacauu

SEQ ID NO: 90306 - RNA, 64 nt, Homo Sapiens
caaaucuuugucacgucugaccaaguuguccaggcaaauaaacuaaaacaaaagccagacaaac

SEQ ID NO: 90307 - RNA, 64 nt, Homo Sapiens
uauauucuugcuugcauccuuagcuuacucuauucaaauaaacaaauuuggucauucuuugcca

SEQ ID NO: 90308 - RNA, 64 nt, Homo Sapiens
augauucauauauuuuaugaaucagaauaaccuucaaauaaaauaaaucuaagucgguuaaaau

SEQ ID NO: 90309 - RNA, 64 nt, Homo Sapiens
aaaauauuuucauuauacaugaaauucaacuuuccaaauaaaaguucuacuucauguaauccaa

SEQ ID NO: 90310 - RNA, 64 nt, Homo Sapiens
uggaagaaacaaacaguugcuaccaaagauucuucaaauaaacauacaaauaaauguguauauu

SEQ ID NO: 90311 - RNA, 64 nt, Homo Sapiens
acaguugcuaccaaagauucuucaaauaaacauacaaauaaauguguauauuuaauguuuuauu

SEQ ID NO: 90312 - RNA, 64 nt, Homo Sapiens
ggcguaacguaaaguguauucuguacauaauuuacaaauaaaacauuuuauuuuaauuguuacu

SEQ ID NO: 90313 - RNA, 64 nt, Homo Sapiens
caaggcugcaaucacuuuaauaguuucuuuuuagcaaauaaauguucauugaugaagugccugg

SEQ ID NO: 90314 - RNA, 64 nt, Homo Sapiens
cauuccaguuauucacuuacagaugaaacuaaaacaaauaaaggcaagcuauuaucaguuuggu

SEQ ID NO: 90315 - RNA, 64 nt, Homo Sapiens
uucacuccccuccccuccccacccccaauagauucaaauaaauaaaauccugagcaaauuaaua

SEQ ID NO: 90316 - RNA, 64 nt, Homo Sapiens
ucaggauuuagagaaggagcuaaaugucauagugcaaauaaaugaaaauugcaauuucuacaaa

SEQ ID NO: 90317 - RNA, 64 nt, Homo Sapiens
ucauagugcaaauaaaugucaauugcaauuucuacaaauaaaugcuuuuaaaaauguuuuugaa

SEQ ID NO: 90318 - RNA, 64 nt, Homo Sapiens
uuacauucaagcucuucuauacauguaaauucaccaaauaaauauuucuuuuguaaaugaccuc

SEQ ID NO: 90319 - RNA, 64 nt, Homo Sapiens
uagaguaagugugauauauguuguauguaaaacccaaauaaaggaaaaucaaagugcagauugc

SEQ ID NO: 90320 - RNA, 64 nt, Homo Sapiens
cugauuuguugauuuuuuuugauaauuggccaugcaaauaaaaaaaguugcaaagaguacaaau

SEQ ID NO: 90321 - RNA, 64 nt, Homo Sapiens
ucuaguaaucucuaauuccagugucuuuacacagcaaauaaauuggagaauauugcucccauau

SEQ ID NO: 90322 - RNA, 64 nt, Homo Sapiens
auauuuaucuuugaacauguagcaucucuuuccgcaaauaaaugcagacuuugguuuugauuua

SEQ ID NO: 90323 - RNA, 64 nt, Homo Sapiens
ggugcaauugcuucuguuugcuaaugcugcuuugcaaauaaaacuugcugccgaccacccacgg

SEQ ID NO: 90324 - RNA, 64 nt, Homo Sapiens
cauuuacauguaacuucugacauuucacucugugcaaauaaagaacaugaggauaccugugcug

SEQ ID NO: 90325 - RNA, 64 nt, Homo Sapiens
guaguauguaaaacccaaacaaguagaacccaagcaaauaaaauuauuuaaaauaauuuuaaag

SEQ ID NO: 90326 - RNA, 64 nt, Homo Sapiens
cuaagcuaauuuuauauuugguauacaugcaugucaaauaaaguuaauuuuacauacuauucuc

SEQ ID NO: 90327 - RNA, 64 nt, Homo Sapiens
ggguccuugaggccugccaguguguaaagguguucaaauaaagggcuguuucuacagguaacau

SEQ ID NO: 90328 - RNA, 64 nt, Homo Sapiens
accauuaauuuuauuuguuuuuguucuauguaaucaaauaaaauuugaguaacauguaauggua

SEQ ID NO: 90329 - RNA, 64 nt, Homo Sapiens
cgagaagggaagggguaugcaguuuacccaaguccaaauaaagcauuucacuagguuacacguu

SEQ ID NO: 90330 - RNA, 64 nt, Homo Sapiens
ccuuauuaaggcuuuaguaauuuguauguaaugucaaauaaaaggaauucaaaucugaguaaau

SEQ ID NO: 90331 - RNA, 64 nt, Homo Sapiens
gaggacauguuuuuguuuuccaagaguuuauuuccaaauaaaauaauuccuuucuauccuacaa

SEQ ID NO: 90332 - RNA, 64 nt, Homo Sapiens
cuaaacauuaaucaaucaucguucguagcuuucccaaauaaacucuguuuaagaugggcagcua

SEQ ID NO: 90333 - RNA, 64 nt, Homo Sapiens
uuuaguguuuauuuugagcuaggauguggaucuccaaauaaagacaugagccuuccuuugagga

SEQ ID NO: 90334 - RNA, 64 nt, Homo Sapiens
cagagagaagagacagaacuggaguccaaggggacaaauaaagggaaauuuagcaauaaggaga

SEQ ID NO: 90335 - RNA, 64 nt, Homo Sapiens
gucagcucaccacccccucuggcuaaaacucaagcaaauaaagccgcuuccugucauuaagcau

SEQ ID NO: 90336 - RNA, 64 nt, Homo Sapiens
ucaccuugugauucaguguaucuguuuacuaacucaaauaaagcaauuguucccucuggagggg

SEQ ID NO: 90337 - RNA, 64 nt, Homo Sapiens
guuugacauaguuuuacuuuauagcaugaaacaccaaauaaaauuuuaauuuguuuaaaucaac

SEQ ID NO: 90338 - RNA, 64 nt, Homo Sapiens
agaauaaugugacaacauuaccagauaaacuaaucaaauaaauuaauguauuuauaaaguuuuu

SEQ ID NO: 90339 - RNA, 64 nt, Homo Sapiens
acauucugccuugcuguagugaagagacccacuccaaauaaaaaaggggccacacggggcuucu

SEQ ID NO: 90340 - RNA, 64 nt, Homo Sapiens
agaucagcaauaaugacuauguaaucucaaaaaacaaauaaaauauucuuaacauggacucuua

SEQ ID NO: 90341 - RNA, 64 nt, Homo Sapiens
uaguuuaaucugaaaucuugacccaguuauuuaacaaauaaauaccucauugauuauauuuaaa

SEQ ID NO: 90342 - RNA, 64 nt, Homo Sapiens
caaacgguggauaaaguauuaaguaacuaagugccaaauaaaugcuggaaaucuugaccucucc

SEQ ID NO: 90343 - RNA, 64 nt, Homo Sapiens
ucuauacugguaauacuuucuauuauuuugaauucaaauaaauuuauuauuauaaauauagcca

SEQ ID NO: 90344 - RNA, 64 nt, Homo Sapiens
caaaucuuuugucaacaggaucugcuuuacuuuacaaauaaaacauacuucaaucaggauauua

SEQ ID NO: 90345 - RNA, 64 nt, Homo Sapiens
ucagucucacuguuggcugucauugugacaaagucaaauaaacccccaaggacgacacacagua

SEQ ID NO: 90346 - RNA, 64 nt, Homo Sapiens
cuggcuucaggaaagucuagaagcaauauuucuucaaauaaaagguguuuaaacuuuuuucugu

SEQ ID NO: 90347 - RNA, 64 nt, Homo Sapiens
aggaauguuuucauaaucgaaagaaacggguauccaaauaaaaccaaguucuugacauuggucu

SEQ ID NO: 90348 - RNA, 64 nt, Homo Sapiens
aucuucaaacccaccaaaccaacaggauaauugacaaauaaacgccauaggcuaggcugaacug

SEQ ID NO: 90349 - RNA, 64 nt, Homo Sapiens
augcuggaauacucaagaauuauuuuacucugaucaaauaaauaguuuguagugaugggaagug

SEQ ID NO: 90350 - RNA, 64 nt, Homo Sapiens
ucauagcaguuaauauaaaauauuacgugaccggcaaauaaaucuuguucccugcuguccuccg

SEQ ID NO: 90351 - RNA, 64 nt, Homo Sapiens
aaagccuggauuugauauuacugaaaccacuuuccaaauaaacugccagcucaucuuccaggug

SEQ ID NO: 90352 - RNA, 64 nt, Homo Sapiens
ugggcagcauuguugagagauugguaacacugagcaaauaaauauguugagaaugaugacagca

SEQ ID NO: 90353 - RNA, 64 nt, Homo Sapiens
agaauagaacucauaucuuuuaaauauauaggaacaaauaaauaaauuguugugugugcacaua

SEQ ID NO: 90354 - RNA, 64 nt, Homo Sapiens
uaacacaaaaugauauacacugaaguugaugaagcaaauaaauauucuggcuucuuuuucaagg

SEQ ID NO: 90355 - RNA, 64 nt, Homo Sapiens
aauguuuuaucacucaaaaauccauuagaaguuucaaauaaauugcuuucuugcuagcuguauu

SEQ ID NO: 90356 - RNA, 64 nt, Homo Sapiens
ucuaaaaacaaaacaaaacacaaaauccccuguucaaauaaacaaaaaauccaagauugauuca

SEQ ID NO: 90357 - RNA, 64 nt, Homo Sapiens
uugugauacaguuaaaaggugcagcugccagugacaaauaaaaacuuuuguuacaucucauuau

SEQ ID NO: 90358 - RNA, 64 nt, Homo Sapiens
ugccauguaauaugaaagcuccagaaguuuaugacaaauaaauauuguuuucucauuucuuaaa

SEQ ID NO: 90359 - RNA, 64 nt, Homo Sapiens
aguuuccauaaggugucagccuaauuagaauuuccaaauaaaacagcagaacaguuuuaaaaau

SEQ ID NO: 90360 - RNA, 64 nt, Homo Sapiens
uuacaguuuuguaagagaaguacuguuggaucaacaaauaaaggugggguaaaagugguuaacg

SEQ ID NO: 90361 - RNA, 64 nt, Homo Sapiens
uuccugaccaaauuguuuugugcuuuagaauguucaaauaaaauaguaacaucuaaagcauuau

SEQ ID NO: 90362 - RNA, 64 nt, Homo Sapiens
uuagcuggaacgaaggcagcugucaaaaauccgacaaauaaaaucaauguauaauuuagacguc

SEQ ID NO: 90363 - RNA, 64 nt, Homo Sapiens
aauuauauuauuuccucugcucaguaucauuuuucaaauaaaggauuuaacugaucucugaggu

SEQ ID NO: 90364 - RNA, 64 nt, Homo Sapiens
augucaacuuuuuagauguuucaccacucuuuugcaaauaaagcauccuuucugcucuguugca

SEQ ID NO: 90365 - RNA, 64 nt, Homo Sapiens
caaaugaaaauuucuucaaauaagccuuuuguuucaaauaaaacuugucucaaaacaugcuucu

SEQ ID NO: 90366 - RNA, 64 nt, Homo Sapiens
aaugagcacagcucuuuguuguuauuagccuuaucaaauaaauaaucuacugugaauauaaaau

SEQ ID NO: 90367 - RNA, 64 nt, Homo Sapiens
ucaaaucaauuucaaggaaauuuuaauaggcgagcaaauaaaauagaauuucuggauaguagga

SEQ ID NO: 90368 - RNA, 64 nt, Homo Sapiens
ucagccagucucauucuauaauuucuacuguuuacaaauaaaaccuggcaagagacuuccuuug

SEQ ID NO: 90369 - RNA, 64 nt, Homo Sapiens
agaguuuacaaugcacaggguuauuuuugcagaucaaauaaaucuuucuccauagaauaaucau

SEQ ID NO: 90370 - RNA, 64 nt, Homo Sapiens
ugggcagcuaaauuuuucaguuccaugugccucccaaauaaaaaacagaaaauaaguaguuuuu

SEQ ID NO: 90371 - RNA, 64 nt, Homo Sapiens
guaagaauccugacuuuuuuauauuuggaaacaucaaauaaaaauggaaaaaaugaucauggcu

SEQ ID NO: 90372 - RNA, 64 nt, Homo Sapiens
uguacaaggcugcuuguuuuuuuauugccaaagucaaauaaacgggagacugucaugcucaugc

SEQ ID NO: 90373 - RNA, 64 nt, Homo Sapiens
agacugucaugcucaugcaugaauagaauuuagucaaauaaaaaauuuuggucauuugguacug

SEQ ID NO: 90374 - RNA, 64 nt, Homo Sapiens
gugucacaaguacagaagagacagaaaaugccuccaaauaaacagcuuuguguuuaccuacuaa

SEQ ID NO: 90375 - RNA, 64 nt, Homo Sapiens
caguguuuuauagugaaauccauuuuuaaaaagacaaauaaaaaacacuucaaaagugugcuua

SEQ ID NO: 90376 - RNA, 64 nt, Homo Sapiens
ucuuagaacaauuuugcccugauuacugaagcgucaaauaaagcuggagugaaaauuuuguuuu

SEQ ID NO: 90377 - RNA, 64 nt, Homo Sapiens
uucaacaguuguauuuggaguuaaauuauuuuaacaaauaaauuuauuuaaugaaacucuggau

SEQ ID NO: 90378 - RNA, 64 nt, Homo Sapiens
agggccuuaaugucacccaccagaaaacuaacuccaaauaaacgcuuacccuuuccuuuagguu

SEQ ID NO: 90379 - RNA, 64 nt, Homo Sapiens
uguaguuugacagaaccaucaguaaagacauaagcaaauaaauggucuuggugcaccuggucug

SEQ ID NO: 90380 - RNA, 64 nt, Homo Sapiens
aggccaugucugacuucaagauauuaaagguauacaaauaaauauuuguaccucuauugugccu

SEQ ID NO: 90381 - RNA, 64 nt, Homo Sapiens
aauaacugauuuuuuaagacccuuugguucuaugcaaauaaaaauguuggaauuuuaagucuuu

SEQ ID NO: 90382 - RNA, 64 nt, Homo Sapiens
auaacugaaagaagagcaguucccaguacacuuacaaauaaaacaaauacaacagggggaugug

SEQ ID NO: 90383 - RNA, 64 nt, Homo Sapiens
caaacuaaaacaaaacagaacaccaaaaacuagacaaauaaagaacaaaaacaaaccuaccaac

SEQ ID NO: 90384 - RNA, 64 nt, Homo Sapiens
ggugggcuggaucugugacugauugaaaugcaugcaaauaaaaaagacaauauuaaagucuguu

SEQ ID NO: 90385 - RNA, 64 nt, Homo Sapiens
gcucacuucucucuucacccaucuuuuuuaaaaacaaauaaaugaauaaagcugcugugacaca

SEQ ID NO: 90386 - RNA, 64 nt, Homo Sapiens
cauuuagacaaaauucucaggcaacuauuuguuucaaauaaaaaaaaguaaccucuugcuuggu

SEQ ID NO: 90387 - RNA, 64 nt, Homo Sapiens
uugccccuauugugcucuguuggaacuguccugccaaauaaauuggaggaagauguucacauac

SEQ ID NO: 90388 - RNA, 64 nt, Homo Sapiens
aaaaagagagcuuaaugauaauauuguggugccacaaauaaaauggauuuauuagaauuucaua

SEQ ID NO: 90389 - RNA, 64 nt, Homo Sapiens
ccgacagaaggaaccagcguguauaugaggguaucaaauaaaauugcuacuacuuaccuaccac

SEQ ID NO: 90390 - RNA, 64 nt, Homo Sapiens
aaugaacccaugagaaauguuaacuccucaaauacaaauaaauucccaggcugaaaauauuuuu

SEQ ID NO: 90391 - RNA, 64 nt, Homo Sapiens
guguuuuauuccuuuagcguuucuugcucaucuccaaauaaaacuacuggaagcccauaaagca

SEQ ID NO: 90392 - RNA, 64 nt, Homo Sapiens
uggacuuuuacaaaacccauuggacucauuacuccaaauaaacacaguucagaggcaacgaaac

SEQ ID NO: 90393 - RNA, 64 nt, Homo Sapiens
ugugagucagugugcagcauggcaaaaacagaaccaaauaaauggaaguuagcacucuagggaa

SEQ ID NO: 90394 - RNA, 64 nt, Homo Sapiens
aaagcguaaaaggagaccuaagagcguccccucacaaauaaauuacugagccacagauaauaca

SEQ ID NO: 90395 - RNA, 64 nt, Homo Sapiens
gguuuuaagauuuacuucagcuugucaccaguuucaaauaaaucccuaauagguaacaaguaaa

SEQ ID NO: 90396 - RNA, 64 nt, Homo Sapiens
guuucucugacaggcaguuuuuaacuguuuuccacaaauaaaaauaauaugucaugggauuaaa

SEQ ID NO: 90397 - RNA, 64 nt, Homo Sapiens
cagaguucuuaguaacaggggcaguuccugaauucaaauaaaccauuuuguauguuuggauuuu

SEQ ID NO: 90398 - RNA, 64 nt, Homo Sapiens
uuauguacauauugacaaauauucauuuauucaacaaauaaaaaguauguacaaaacaugauac

SEQ ID NO: 90399 - RNA, 64 nt, Homo Sapiens
ccaauuguaucuauaacugaugacucaugaaucacaaauaaaaguugcagaauggaaacugccc

SEQ ID NO: 90400 - RNA, 64 nt, Homo Sapiens
uaugauuaggaggacaucaugaaugacaaaaacucaaauaaaugaaauauucucucuuuggcug

SEQ ID NO: 90401 - RNA, 64 nt, Homo Sapiens
uugacuucuuucuuucugauaugucaucuacaaacaaauaaaaugauuuucuuuacagaagguc

SEQ ID NO: 90402 - RNA, 64 nt, Homo Sapiens
gaauguguuuguuaguuccaguuauucuauucugcaaauaaacuuucaacuaauuuuuggugcu

SEQ ID NO: 90403 - RNA, 64 nt, Homo Sapiens
uucucuauuuuauauuucauagauuuaaaaaacccaaauaaagauggauuuaaaauucacugug

SEQ ID NO: 90404 - RNA, 64 nt, Homo Sapiens
aguuugauuaccuagaaaguguguauagaaacugcaaauaaacgugacugcaauuaaacaaccg

SEQ ID NO: 90405 - RNA, 64 nt, Homo Sapiens
uauuccuuccaguaaugccacuguauuuugucuccaaauaaaagaagcuuauuguaguauguuu

SEQ ID NO: 90406 - RNA, 64 nt, Homo Sapiens
agcuaagcuuuaaacuucauuuuauguccuuucacaaauaaauuaguuuaaaacagaaaguggc

SEQ ID NO: 90407 - RNA, 64 nt, Homo Sapiens
aauguaaccuauuaucaugggcaguagggcucugcaaauaaaauuaggaguuguucaaaucacu

SEQ ID NO: 90408 - RNA, 64 nt, Homo Sapiens
gguaucuacauucaugugauuugugugugauguucaaauaaaguguggcaauuuuaaauuuaua

SEQ ID NO: 90409 - RNA, 64 nt, Homo Sapiens
cauacacacuuucuaguucuuguaaaauugaauucaaauaaaauaucuaguagacuucugcaca

SEQ ID NO: 90410 - RNA, 64 nt, Homo Sapiens
guuuucaauaggguguagaccuccaguaccuuuguaacuaaagucugucuagucauuguaaaua

SEQ ID NO: 90411 - RNA, 64 nt, Homo Sapiens
uuguugaugacauuagauuaguaguugcauuaaauaacuaaauucccauugugauuaauugaaa

SEQ ID NO: 90412 - RNA, 64 nt, Homo Sapiens
aagauguaucaguauauugucacaguugugcuguuaacuaaaaaugcugagaccccuuuuuaua

SEQ ID NO: 90413 - RNA, 64 nt, Homo Sapiens
gaaaucuacaccaaagugguuuuuuaaaauuacauaacuaaaaauaaaccacacuguggauaca

SEQ ID NO: 90414 - RNA, 64 nt, Homo Sapiens
aguguuaucugacuaauuccaccuucucaauuuauaacuaaaauaaauauucucuucaaaugcc

SEQ ID NO: 90415 - RNA, 64 nt, Homo Sapiens
guucucagcuuggaauaaugguaaccacugcuaauaacuaaaauauuuaccuucagcuuauuug

SEQ ID NO: 90416 - RNA, 64 nt, Homo Sapiens
ucuuacuauaaugaaagaaagacuggcaauauuauaacuaaaaauuuaugauuuucaucauaaa

SEQ ID NO: 90417 - RNA, 64 nt, Homo Sapiens
cuaagauaauguuuccuaguuuucaagucaauuuuaacuaaaaaaagacaugcacuuuccauau

SEQ ID NO: 90418 - RNA, 64 nt, Homo Sapiens
aacuuuuauacuaggcuucuuaacaacaugguaguaacuaaagaacaacgcugagacaaucccc

SEQ ID NO: 90419 - RNA, 64 nt, Homo Sapiens
cuuccaggagaaaaauuccaaggggacagaaauauaacuaaaugucuaggugguucauuuugaa

SEQ ID NO: 90420 - RNA, 64 nt, Homo Sapiens
aaaaaaaacaaaaacaagcauauuauuauuguuauaacuaaaaaaaaacaaacagcaauaacaa

SEQ ID NO: 90421 - RNA, 64 nt, Homo Sapiens
accaaauacugaaguuaaguauuuuuaagaauuauaacuaaaagaauauguuuuaaaaugucuu

SEQ ID NO: 90422 - RNA, 64 nt, Homo Sapiens
uuuuccuuuucucucaaacuuauuguaaagauuuuaacuaaaguauuuauagucauaauuauuu

SEQ ID NO: 90423 - RNA, 64 nt, Homo Sapiens
gauuuauagucauaauuauuaauguguacauauuuaacuaaagaucuuuauacaaauaccaugu

SEQ ID NO: 90424 - RNA, 64 nt, Homo Sapiens
uuuggcuuucaauuccaaaacaugauuuaauuucuaacuaaauuaguauggcacuaguuaugaa

SEQ ID NO: 90425 - RNA, 64 nt, Homo Sapiens
ccugcuuaucaauauucaguuugaugagcacuauuaacuaaaauaugaaacuuaaaaacaaaag

SEQ ID NO: 90426 - RNA, 64 nt, Homo Sapiens
ccuuacuacacucaacugauugggaucuagaauguaacuaaauugcuuauaaaugucagcauuu

SEQ ID NO: 90427 - RNA, 64 nt, Homo Sapiens
caaagaaucuugcacucaaugcacagugugauguuaacuaaaacgaguuaaauauuuaggaggc

SEQ ID NO: 90428 - RNA, 64 nt, Homo Sapiens
auagcauuucuaagauauuuauuuaaggguauguuaacuaaagggguaaaaucaauguuacaaa

SEQ ID NO: 90429 - RNA, 64 nt, Homo Sapiens
ugaaaacuaaguaaguuuauuaggcaggcacuaguaacuaaaacaaucauuuaagguccuuuua

SEQ ID NO: 90430 - RNA, 64 nt, Homo Sapiens
cagacaugguguacugaucagaaauguucaguuuuaacuaaaacuaaauuuauguuauuuggcu

SEQ ID NO: 90431 - RNA, 64 nt, Homo Sapiens
gcugcaaaauaauuguagacaaaauaauggcauuuaacuaaagauggagcaugaucuaaguaca

SEQ ID NO: 90432 - RNA, 64 nt, Homo Sapiens
aacggaauggaaugccaagaaucugcauugagaauaacuaaacauuguuacuguacauacuauc

SEQ ID NO: 90433 - RNA, 64 nt, Homo Sapiens
accauccaguugccuguuacagaauaacucuucuuaacuaaaaaccuagucaaacaaggaagcu

SEQ ID NO: 90434 - RNA, 64 nt, Homo Sapiens
cuaugagccuaaaaccucuuuaaaaacggucaguuaacuaaaaaauaaaaaucaagucuuuagg

SEQ ID NO: 90435 - RNA, 64 nt, Homo Sapiens
aaaaucaagucuuuaggagaguagaaaacacaauuaacuaaaaagcagggacaucugaaagaga

SEQ ID NO: 90436 - RNA, 64 nt, Homo Sapiens
guuuuucguuuugcacaugggaagagaugaucaauaacuaaaauugcccaaaguguauggcuca

SEQ ID NO: 90437 - RNA, 64 nt, Homo Sapiens
accauauuuauucauuauuuaagguggaggaccuuaacuaaaggccuuauuuuguauuucacuu

SEQ ID NO: 90438 - RNA, 64 nt, Homo Sapiens
uuaaccaguaaacacucuguugugugguucugguuaacuaaaaaaaauggaauuaucuauggga

SEQ ID NO: 90439 - RNA, 64 nt, Homo Sapiens
ucagaaaauuaagaagcugacuuauuaacucaaauaacuaaauugucaguauuccuacagaauu

SEQ ID NO: 90440 - RNA, 64 nt, Homo Sapiens
uuguuugcccaaaagaauccuuugcuucuucuuuagauaacaacauuacaacuguuaaggaggu

SEQ ID NO: 90441 - RNA, 64 nt, Homo Sapiens
guucuugaauauuuugcugucuuuucuaaaauugagauaacauauuucucuucagaaaaguucc

SEQ ID NO: 90442 - RNA, 64 nt, Homo Sapiens
aggagucugcugguucuccuugaggauagugcuuagauaacagacucauuaaacauuuacugag

SEQ ID NO: 90443 - RNA, 64 nt, Homo Sapiens
uugcacuuauuaauggucuuuauuuuucuagcauagauaacaauugauucuuuagauucauaua

SEQ ID NO: 90444 - RNA, 64 nt, Homo Sapiens
gaaacagcguuaucgccuaccggauuuccugagaagauaacagucuuggauuuccuccagaguu

SEQ ID NO: 90445 - RNA, 64 nt, Homo Sapiens
gcuguuaauacuuaaacugcgucacaagaagaacagauaacaaauacaaaucccuuaccaauuu

SEQ ID NO: 90446 - RNA, 54 nt, Homo Sapiens
ugaaagcugggaaguuaugaaugaagauaacauucacccauaaccaagagaacu

SEQ ID NO: 90447 - RNA, 64 nt, Homo Sapiens
cucagguagcugcaucaccaggcuugcuuggcguagauaacaauacacugaaauacuccugaag

SEQ ID NO: 90448 - RNA, 64 nt, Homo Sapiens
aacaucuccugccuaaaaugcauugaauauuuuaagauaacagauauacuggcuggagguuugu

SEQ ID NO: 90449 - RNA, 64 nt, Homo Sapiens
ccaccucauuuucaguuaacaugugccauuaaauagauaacauccuguggauuuagggauauuu

SEQ ID NO: 90450 - RNA, 64 nt, Homo Sapiens; identical to SEQ ID NO: 64767

SEQ ID NO: 90451 - RNA, 64 nt, Homo Sapiens; identical to SEQ ID NO: 64768

SEQ ID NO: 90452 - RNA, 64 nt, Homo Sapiens; identical to SEQ ID NO: 64769

SEQ ID NO: 90453 - RNA, 64 nt, Homo Sapiens; identical to SEQ ID NO: 64770

SEQ ID NO: 90454 - RNA, 64 nt, Homo Sapiens; identical to SEQ ID NO: 64771

SEQ ID NO: 90455 - RNA, 64 nt, Homo Sapiens; identical to SEQ ID NO: 64772

SEQ ID NO: 90456 - RNA, 64 nt, Homo Sapiens; identical to SEQ ID NO: 64773

SEQ ID NO: 90457 - RNA, 64 nt, Homo Sapiens; identical to SEQ ID NO: 64774

SEQ ID NO: 90458 - RNA, 64 nt, Homo Sapiens; identical to SEQ ID NO: 64775

SEQ ID NO: 90459 - RNA, 64 nt, Homo Sapiens; identical to SEQ ID NO: 64776

SEQ ID NO: 90460 - RNA, 64 nt, Homo Sapiens; identical to SEQ ID NO: 64777

SEQ ID NO: 90461 - RNA, 64 nt, Homo Sapiens; identical to SEQ ID NO: 64778

SEQ ID NO: 90462 - RNA, 64 nt, Homo Sapiens; identical to SEQ ID NO: 64779

SEQ ID NO: 90463 - RNA, 64 nt, Homo Sapiens; identical to SEQ ID NO: 64780

SEQ ID NO: 90464 - RNA, 64 nt, Homo Sapiens; identical to SEQ ID NO: 64781

SEQ ID NO: 90465 - RNA, 64 nt, Homo Sapiens; identical to SEQ ID NO: 64782

SEQ ID NO: 90466 - RNA, 64 nt, Homo Sapiens; identical to SEQ ID NO: 64783

SEQ ID NO: 90467 - RNA, 64 nt, Homo Sapiens; identical to SEQ ID NO: 64784

SEQ ID NO: 90468 - RNA, 64 nt, Homo Sapiens; identical to SEQ ID NO: 64785

SEQ ID NO: 90469 - RNA, 64 nt, Homo Sapiens; identical to SEQ ID NO: 64786

SEQ ID NO: 90470 - RNA, 64 nt, Homo Sapiens; identical to SEQ ID NO: 64787

SEQ ID NO: 90471 - RNA, 64 nt, Homo Sapiens; identical to SEQ ID NO: 64788

SEQ ID NO: 90472 - RNA, 64 nt, Homo Sapiens; identical to SEQ ID NO: 64789

SEQ ID NO: 90473 - RNA, 64 nt, Homo Sapiens; identical to SEQ ID NO: 64790

SEQ ID NO: 90474 - RNA, 64 nt, Homo Sapiens; identical to SEQ ID NO: 64791

SEQ ID NO: 90475 - RNA, 64 nt, Homo Sapiens; identical to SEQ ID NO: 64792

SEQ ID NO: 90476 - RNA, 64 nt, Homo Sapiens; identical to SEQ ID NO: 64793

SEQ ID NO: 90477 - RNA, 64 nt, Homo Sapiens; identical to SEQ ID NO: 64794

SEQ ID NO: 90478 - RNA, 64 nt, Homo Sapiens; identical to SEQ ID NO: 64795

SEQ ID NO: 90479 - RNA, 64 nt, Homo Sapiens; identical to SEQ ID NO: 64796

SEQ ID NO: 90480 - RNA, 64 nt, Homo Sapiens; identical to SEQ ID NO: 64797

SEQ ID NO: 90481 - RNA, 64 nt, Homo Sapiens; identical to SEQ ID NO: 64798

SEQ ID NO: 90482 - RNA, 64 nt, Homo Sapiens; identical to SEQ ID NO: 64799

SEQ ID NO: 90483 - RNA, 64 nt, Homo Sapiens; identical to SEQ ID NO: 64800

SEQ ID NO: 90484 - RNA, 64 nt, Homo Sapiens; identical to SEQ ID NO: 64801

SEQ ID NO: 90485 - RNA, 64 nt, Homo Sapiens; identical to SEQ ID NO: 64802

SEQ ID NO: 90486 - RNA, 64 nt, Homo Sapiens; identical to SEQ ID NO: 64803

SEQ ID NO: 90487 - RNA, 64 nt, Homo Sapiens
cucagaucucaccauugcacuccagccugggcgacugagcgagacucuaucucaaaacaaucaa

SEQ ID NO: 90488 - RNA, 64 nt, Homo Sapiens
uccaccauugugauuuguuccugccccaccuuaacugagcgauuaaccugugaacuuccuucuc

SEQ ID NO: 90489 - RNA, 64 nt, Homo Sapiens
gcuccaccaacaccucugugagucucaucaucagcugagcgaugaugccuuacagguugcauag

SEQ ID NO: 90490 - RNA, 64 nt, Homo Sapiens
gaguaagaccuuaucuuuuaccaacuacuccagccugagcgacagaguuccaggcuggaguaca

SEQ ID NO: 90491 - RNA, 64 nt, Homo Sapiens
ccucuuccugcugggcucccuuguucccguggcucugagcgagggacaggcccucauggcaggc

SEQ ID NO: 90492 - RNA, 64 nt, Homo Sapiens
cguacucagaacguccaggaagacggcaggaggccugagcgauccggcugaccacuccuuuugg

SEQ ID NO: 90493 - RNA, 64 nt, Homo Sapiens
gcucucacuguauuagagcgcaaggcacagucuucugagcgaguccacguccaaucaugggcca

SEQ ID NO: 90494 - RNA, 64 nt, Homo Sapiens
ugauuuaaauaacuuccugauuggaguguguaagcugagcgauuucuaauaaaauuuuaguugu

SEQ ID NO: 90495 - RNA, 64 nt, Homo Sapiens
gcagugagccgagauugugccccugcacuccagccugagcgacagugagacucugucucagucc

SEQ ID NO: 90496 - RNA, 64 nt, Homo Sapiens
acaaguuuagcuugucccuguucgcuaggcaggccugagcgaauuauuucugaggugguucuaa

SEQ ID NO: 90497 - RNA, 64 nt, Homo Sapiens
cacauuaaggaacuucacggcuagcuaugaagggcugagcgaguuggcuuggccaggauuggca

SEQ ID NO: 90498 - RNA, 64 nt, Homo Sapiens
acaccacacuuuguuuggacaacguccuugcagacugagcgaugaacguccacgggauuaacag

SEQ ID NO: 90499 - RNA, 64 nt, Homo Sapiens
ucccucagaugacgggcgccgggccaccaucucacugagcgacagugaccugcugcggcuggag

SEQ ID NO: 90500 - RNA, 64 nt, Homo Sapiens
ccgagauugcaccacugcauuccagccugggugacugagcgagacucugucucaaaaaaaaaaa

SEQ ID NO: 90501 - RNA, 64 nt, Homo Sapiens
agacaaguccaaagcucguuuguggauugugggacugagcgaaggaguacaaauauauccacgu

SEQ ID NO: 90502 - RNA, 64 nt, Homo Sapiens
guccagccaagggcugaguguguccggcugaggccugagcgaguauguccggcugaaggcugag

SEQ ID NO: 90503 - RNA, 64 nt, Homo Sapiens
cccaagcccuuccuuaagccacuggggucaugcacugagcgaccugggguuuggaagugucugc

SEQ ID NO: 90504 - RNA, 64 nt, Homo Sapiens
cauuuacaacugaaaccuaggaagccccugaguccugagcgaaaacaggagaguuagucgcccu

SEQ ID NO: 90505 - RNA, 64 nt, Homo Sapiens
gaaccagcaggaguggccuggcacauggaccggccugagcgaugugcacuccacccaagccagg

SEQ ID NO: 90506 - RNA, 64 nt, Homo Sapiens
uggcgcccaaugccacaggggagcagaugugauucugagcgacacgaggugcuuccuggcagga

SEQ ID NO: 90507 - RNA, 64 nt, Homo Sapiens
aacaucucucaaaauaaaaaucccucuucccgcucugagcgauucagcucugcccgcagcuugu

SEQ ID NO: 90508 - RNA, 64 nt, Homo Sapiens
uuuucugaauuccugcgccuuccugacgugagcccugagcgaucuucuaugcaguucugccaug

SEQ ID NO: 90509 - RNA, 64 nt, Homo Sapiens
gagugaaacugucucaaaaacacugcauuucagccugagcgacagcagugagccgagaucacgu

SEQ ID NO: 90510 - RNA, 64 nt, Homo Sapiens
acacaacauuugugucacuguacaguuuuguggacugagcgaggaaaaacaacaaauaauuuaa

SEQ ID NO: 90511 - RNA, 64 nt, Homo Sapiens
cuguccucuguggcagguccgaaggaagccaacccugagcgagcccucugugccagcgucccag

SEQ ID NO: 90512 - RNA, 64 nt, Homo Sapiens
uugauuagaaucucagguuucagcuccugcuguccugagcgaacuugccugaugcagggcugug

SEQ ID NO: 90513 - RNA, 64 nt, Homo Sapiens
agggccuggcauguuuguccugcucugccugggacugagcgaguggacuuagggcugggcaggc

SEQ ID NO: 90514 - RNA, 64 nt, Homo Sapiens
uccaagaugcuggcaccaagauucuuuuuggaaacugagcgaaacucuccucuccccuuugugg

SEQ ID NO: 90515 - RNA, 64 nt, Homo Sapiens
agaugcuccuugggcccuuuccccugugcagccgcugagcgaggucuugaugcaugcacuguuc

SEQ ID NO: 90516 - RNA, 64 nt, Homo Sapiens
aaugucaacuucgggaggguuauuuccaaaccaccugagcgagucuguuaugcuucucauuuua

SEQ ID NO: 90517 - RNA, 64 nt, Homo Sapiens
guguaacaucugugcacaccauccauuccgcucgcugagcgauggaaaagcuugccuggaagac

SEQ ID NO: 90518 - RNA, 64 nt, Homo Sapiens
gcccuggccuccugggggcgggguugugggggggcugagcgacacucagggacaccucaguugu

SEQ ID NO: 90519 - RNA, 64 nt, Homo Sapiens
auuaucuaaaguguguuguugagaggauuuuuuucugagcgauuauuuguaaccucagcucugg

SEQ ID NO: 90520 - RNA, 64 nt, Homo Sapiens
aggcgaggccagcgaggguggggcaugcuggccucugagcgauccuccugugccggugggcggg

SEQ ID NO: 90521 - RNA, 64 nt, Homo Sapiens
ccuugauuuguguugucacccacagcuauggaaccugagcgacacugacacccuaaaagccauc

SEQ ID NO: 90522 - RNA, 64 nt, Homo Sapiens
cuaguguucaggaucuccuccaaguuuuuauaaacugagcgagagaugauggagaguuuggccu

SEQ ID NO: 90523 - RNA, 64 nt, Homo Sapiens
gguacuguacagcuggcucuacuuccccauggcccugagcgaguggagucugccacccaggauc

SEQ ID NO: 90524 - RNA, 64 nt, Homo Sapiens
cugaacacaaccagagguggcaggagaauuucuacugagcgagcugggccgguuaguguauguc

SEQ ID NO: 90525 - RNA, 64 nt, Homo Sapiens
auggaggacccaacaggaggccguggcucugaugcugagcgaagcuauaggcucuuguuggaua

SEQ ID NO: 90526 - RNA, 64 nt, Homo Sapiens
cugucuggcuugggggagauccccagccaaggagcugagcgaggcaggccuguucccuaagggg

SEQ ID NO: 90527 - RNA, 64 nt, Homo Sapiens
gggcaagacucagucucaaacacugcguuccagccugagcgacagcagugagccgagaucgcac

SEQ ID NO: 90528 - RNA, 64 nt, Homo Sapiens
ugacaccauguuggggguugagaaaaaguacaggcugagcgaccuggcuggacagacugauagc

SEQ ID NO: 90529 - RNA, 64 nt, Homo Sapiens
gagcaagaaucugucucaaacaccguacuccagucugagcgacagcacugagccgagaucacac

SEQ ID NO: 90530 - RNA, 64 nt, Homo Sapiens
acucaagugucucaguccaccccagaaggaccuccugagcgauggggcagucaccugcccagau

SEQ ID NO: 90531 - RNA, 64 nt, Homo Sapiens
agucccaggcguaaagggggauguucuaugccggcugagcgagaaaaagaggaauaugaaacaa

SEQ ID NO: 90532 - RNA, 64 nt, Homo Sapiens
ggagcccccagcaugggaaugaggggcucugcaacugagcgaagcugcgggcuaggaggcugga

SEQ ID NO: 90533 - RNA, 64 nt, Homo Sapiens
caguccaugucuucaccagggagccauuugagugcugagcgacaagaggcucagagggcaugac

SEQ ID NO: 90534 - RNA, 64 nt, Homo Sapiens
uccuucccccauuucugcguccaccccugaacuccugagcgacagaagccccaggccuccacca

SEQ ID NO: 90535 - RNA, 64 nt, Homo Sapiens
caccaguagccaggugaaggggccuuccccgcugcugagcgagauguagccugggucucccacg

SEQ ID NO: 90536 - RNA, 64 nt, Homo Sapiens
aggacuacauuucccaagagucugcgcuaauuaccugagcgaccggaucacucccacuagggac

SEQ ID NO: 90537 - RNA, 64 nt, Homo Sapiens
cuccuagauggaucucagcggcauuaagcugugccugagcgaguuuguagugacucacugcaca

SEQ ID NO: 90538 - RNA, 64 nt, Homo Sapiens
cagggcaggucccgucccugcugucccugccuggcugagcgaccgaccuggauucuggucccug

SEQ ID NO: 90539 - RNA, 64 nt, Homo Sapiens
gaaggaaggacagacggaccggcgagaggcgaggcugagcgaaagggacucuggcgucccggca

SEQ ID NO: 90540 - RNA, 64 nt, Homo Sapiens
cacauuacauauaucaucaaugacgugccuggcccugagcgaaguaaauggguggugugauuuu

SEQ ID NO: 90541 - RNA, 64 nt, Homo Sapiens
ccagagccgugugcgccugcguuuuaccaauaaacugagcgaccgcucgccacgcucagugccc

SEQ ID NO: 90542 - RNA, 64 nt, Homo Sapiens
cucuagagggugagaauuuggugaauuuaucacucugagcgaguuuugaauuguaaacuuguca

SEQ ID NO: 90543 - RNA, 64 nt, Homo Sapiens
ggugccagcaagggggcggcgaugucgagggcaccugagcgagggcagagccccucagggcgcc

SEQ ID NO: 90544 - RNA, 64 nt, Homo Sapiens
ggcaucacacccucugccuauccucaaaacaggccugagcgauggccuuugagagccuccaggu

SEQ ID NO: 90545 - RNA, 64 nt, Homo Sapiens
ugcugacgcugcccgugcucagacugcugugcagcugagcgagugguccagucugccgcugaug

SEQ ID NO: 90546 - RNA, 64 nt, Homo Sapiens
cuguuucagauggaaaaauauaaacuauuuuuuucugagcgauacauuaaacuauuuuccccag

SEQ ID NO: 90547 - RNA, 64 nt, Homo Sapiens
guauggggaagaugucaagcccuucaagccaccccugagcgaugcugaguuucacacguaccug

SEQ ID NO: 90548 - RNA, 64 nt, Homo Sapiens
ugaaggaggugcugaguuuuguaucuuuuuaaucauaaucaacaucaguuuuugacccaacuaa

SEQ ID NO: 90549 - RNA, 64 nt, Homo Sapiens
caaaggaaggacuaaaaagccuccacggacaucgauaaucaagagauuauuaagaucuuugcua

SEQ ID NO: 90550 - RNA, 64 nt, Homo Sapiens
caggugaacugaaaaguuauuuuaacuauuauacauaaucaagauccugccucuacggaauuag

SEQ ID NO: 90551 - RNA, 64 nt, Homo Sapiens
acacugucuugaaauugaaucuguccaucuguuuauaaucaagaacauaucagaaauauauagg

SEQ ID NO: 90552 - RNA, 64 nt, Homo Sapiens
aaacucuuugcuucugcuaagaagcagucuaaauauaaucaacguacagugagcucuuugaagc

SEQ ID NO: 90553 - RNA, 64 nt, Homo Sapiens
aguuguauauucuugcaaugcauaaaaugacauuauaaucaacaaacuuaugguuuguuucaau

SEQ ID NO: 90554 - RNA, 64 nt, Homo Sapiens
uuuucugagaguugggugaggguaaagcuuuucuauaaucaagcucaauacaccaaggaaacug

SEQ ID NO: 90555 - RNA, 64 nt, Homo Sapiens
guauccuuuccucaguguguauaugacagccaguauaaucaauacccuagguuaugcgucuaua

SEQ ID NO: 90556 - RNA, 64 nt, Homo Sapiens
gaaccagacugugucuuauuugugcauggaacaaauaaucaaaauucuaaaauauccuccaaug

SEQ ID NO: 90557 - RNA, 64 nt, Homo Sapiens
ucaccuugucucaugacuuucaacuauuuuucacauaaucaaacgaguccaucucaaaaaaaaa

SEQ ID NO: 90558 - RNA, 64 nt, Homo Sapiens
uuaagaauuugugacauguauuaaugaugagguaauaaucaaauuuguaagccagucagguuau

SEQ ID NO: 90559 - RNA, 64 nt, Homo Sapiens
caguuaacaaguauauuggcuaaauguugcccuaauaaucaaugugcagccaucccccucauuu

SEQ ID NO: 90560 - RNA, 64 nt, Homo Sapiens
cucacagacaucugaaaagugaauggccaagcuggucuaguagaugaggcuggacugaggaggg

SEQ ID NO: 90561 - RNA, 64 nt, Homo Sapiens
ucucuaagcuucugaaguguuagagguagagauggucuaguaaagauguaguaguaauguuuua

SEQ ID NO: 90562 - RNA, 64 nt, Homo Sapiens
cccagucccuacacugacuacccugaucucucuugucuaguacgcacauaugcacacaggcaga

SEQ ID NO: 90563 - RNA, 64 nt, Homo Sapiens
augggagaagagagacaggguucuuuucagcagagucuaguaguuucucuguaaggcaaaauaa

SEQ ID NO: 90564 - RNA, 64 nt, Homo Sapiens
agaaagcugaugcuugaucuugcacaauuuuuaugucuaguauguaugcuugagugaaugugcg

SEQ ID NO: 90565 - RNA, 64 nt, Homo Sapiens
agagaaugcugguagcuuaauacucugauuuucugucuaguaucagaauugugggcuguagcgu

SEQ ID NO: 90566 - RNA, 64 nt, Homo Sapiens
caggugcugucagcccagggugccggugaaaacagucuaguacacaguugauuuccucuugaac

SEQ ID NO: 90567 - RNA, 64 nt, Homo Sapiens
uauacuuuucccuauuuuuguauggauuauggaagucuaguaaauagauugaauuuaaaguaag

SEQ ID NO: 90568 - RNA, 64 nt, Homo Sapiens
agcaggcaaacacauaucuuuauguacauauguagucuaguaaaagaaaauauuaccauguaaa

SEQ ID NO: 90569 - RNA, 64 nt, Homo Sapiens
aauuguaauugaauauguuuggauuauaagauuugucuaguaaaaaaccucagagaaggcaugu

SEQ ID NO: 90570 - RNA, 64 nt, Homo Sapiens
uaggaucauuuauugggcagucuacaagaauccugucuaguaaaauacagcgacaauccuguuu

SEQ ID NO: 90571 - RNA, 64 nt, Homo Sapiens
auaaaugucaacuuuugcugggcuaaugggaaaugucuaguaaguugauaucuguuucaguuag

SEQ ID NO: 90572 - RNA, 64 nt, Homo Sapiens
caugacuugaacaacuguguuuuaaaguacuguagucuaguagguaacuuuguggcaaaaauuu

SEQ ID NO: 90573 - RNA, 64 nt, Homo Sapiens
aucauaaguuuuuuugagaguugcauuauaaaaugucuaguagcuaagaggaaaguaauuuuug

SEQ ID NO: 90574 - RNA, 64 nt, Homo Sapiens
uuaagugagagagaaagggcggugucagcuuuucgucuaguaacgugggucagugggagcugca

SEQ ID NO: 90575 - RNA, 64 nt, Homo Sapiens
caaaauauuuaaauuuaugaucuaacugauaaaggucuaguaucgaaaacauauuugcaaauca

SEQ ID NO: 90576 - RNA, 64 nt, Homo Sapiens
augcagcgguccucaaguuggccuggcugguaccgucuaguacucaauuagaacuuuuugauca

SEQ ID NO: 90577 - RNA, 64 nt, Homo Sapiens
aaagauauauaaagggcuguaagcuaauuguggugucuaguaaguagcauaaugagaugugagg

SEQ ID NO: 90578 - RNA, 64 nt, Homo Sapiens
uucccuuuaacauagaaguguccagcugcguacagucuaguaaccagcaacuguaaacgaaccu

SEQ ID NO: 90579 - RNA, 64 nt, Homo Sapiens
ucauuaggaucuaaaguuguccauuuucucucuugucuaguauugggagaacuguccacucaug

SEQ ID NO: 90580 - RNA, 64 nt, Homo Sapiens
acaauguacaagguauguaccauuguaaccucgugucuaguagagugggcauguauuagccagu

SEQ ID NO: 90581 - RNA, 64 nt, Homo Sapiens
aauucugauaauuugcuucucauaauuaucuuaugucuaguaauaagaauguaauuuauuuuua

SEQ ID NO: 90582 - RNA, 64 nt, Homo Sapiens
ugggaaaaaagcaacugguuauuauauguauauugucuaguaauauuuuuuaauaagaacauua

SEQ ID NO: 90583 - RNA, 64 nt, Homo Sapiens
uguuuucauucuggccagcaaugaucuuuuuucugucuaguacuuuucaauggagucuuuaagc

SEQ ID NO: 90584 - RNA, 64 nt, Homo Sapiens
gaguucaaguacauaaaguacauaacaagcgaacgucuaguacaauucuuacuuauguguaugg

SEQ ID NO: 90585 - RNA, 64 nt, Homo Sapiens
ugugguagagcugagauuagaauccagauuccuagucuaguauccuucccacuguaccacauua

SEQ ID NO: 90586 - RNA, 64 nt, Homo Sapiens
uuugugcuuuugaaaugucuguuuugacaucauagucuaguaaaauuuugacagugcauaugua

SEQ ID NO: 90587 - RNA, 64 nt, Homo Sapiens
uuauguagacaaaacuuauaauuuccaaacuguugucuaguauacagugaucaguugcucucug

SEQ ID NO: 90588 - RNA, 64 nt, Homo Sapiens
gcacuguaauaauucauuuuuguucacacuugaagucuaguaguuuuguaaagugcaugaguca

SEQ ID NO: 90589 - RNA, 64 nt, Homo Sapiens
ccauucagguaccaucaccuggucccaucaacaggucuaguauguagcucacugauaacagagg

SEQ ID NO: 90590 - RNA, 64 nt, Homo Sapiens
cauuuacauuuaggguucaccccacauuuuggcugucuaguauuaaaaaaaaaucugguaucaa

SEQ ID NO: 90591 - RNA, 64 nt, Homo Sapiens
ugacucuccucugagcuguaaauaacaaccgaaugucuaguaaacugccuaauuuuuaguguuu

SEQ ID NO: 90592 - RNA, 64 nt, Homo Sapiens
gcuuuaacugaauauuugauuauauuauuugguagucuaguaugaaauguucauaaauguuuua

SEQ ID NO: 90593 - RNA, 64 nt, Homo Sapiens
aacaaucaccaccaccauuauuaaacuguaacuugucuaguaaauugucacuagaacuauuugc

SEQ ID NO: 90594 - RNA, 64 nt, Homo Sapiens
aauuaauuacacagaagccuuuugaucaaaagaagucuaguaagauaaccaaggugauucagga

SEQ ID NO: 90595 - RNA, 64 nt, Homo Sapiens
caugucuaaaguucaaacuuugccuuucuccauugucuaguagaucaacauaucagguggucau

SEQ ID NO: 90596 - RNA, 64 nt, Homo Sapiens
cagauggagagcuucagaaugggcuauccuuagagucuaguacaucuugaggccucucagcagg

SEQ ID NO: 90597 - RNA, 64 nt, Homo Sapiens
augggcuauauauugccucuguuuaauacuguaugucuaguaaguuguccucauauucagucca

SEQ ID NO: 90598 - RNA, 64 nt, Homo Sapiens
ccuuucccuuuucuuucaguuuuuuuaaucgcaugucuaguauauuaagucuccauagcccucc

SEQ ID NO: 90599 - RNA, 64 nt, Homo Sapiens
ccgugcugaggcuccacauagcuccuggaccugugucuaguacauacugaagcgauggucagag

SEQ ID NO: 90600 - RNA, 64 nt, Homo Sapiens
uagcuuccagaacccacccugcacagugcuuggggucuaguaugcggcagauaugaaaugccug

SEQ ID NO: 90601 - RNA, 64 nt, Homo Sapiens
ggaucucacucagccgcagaggccccauugccuggucuaguagcagacgucucaagacugaaac

SEQ ID NO: 90602 - RNA, 64 nt, Homo Sapiens
cucuuggaaagaaaaccaaggauuacucuuguuugucuaguaugacaaauauaggugccuuuuu

SEQ ID NO: 90603 - RNA, 64 nt, Homo Sapiens
ugucuuauagguaaccaacauaacuugaucuucugucuaguacuacagaagaaauauuucugug

SEQ ID NO: 90604 - RNA, 64 nt, Homo Sapiens
uuaaaauguguuaaauaugauuuggggagagacugucuaguaauaauaaagcauuaaaauuucu

SEQ ID NO: 90605 - RNA, 64 nt, Homo Sapiens
aaacguucccacaaugcacaauuuuauauccaaugucuaguauacagguugcugcaugcaauaa

SEQ ID NO: 90606 - RNA, 64 nt, Homo Sapiens
ugcuauguguugggagaaacuccgucuuggccaugucuaguaauuuuuguauaaaguuuccgac

SEQ ID NO: 90607 - RNA, 64 nt, Homo Sapiens
ucaggaggaaagacacuuaaagacacuuuuacaugucuaguaauucuugauguucaucuucagc

SEQ ID NO: 90608 - RNA, 64 nt, Homo Sapiens
uauuauugcagcuugaucauuuauauaaauauuugucuaguacaaugcuugacauacagcauug

SEQ ID NO: 90609 - RNA, 64 nt, Homo Sapiens
uagcacaaguuagggaggaagaggcaggcgaugagucuaguagcacccaggacggcuuguagcu

SEQ ID NO: 90610 - RNA, 64 nt, Homo Sapiens
ucgcugaguccgugcccuuuuaguuaguucugcagucuaguaugguccccauuugcccuuccac

SEQ ID NO: 90611 - RNA, 64 nt, Homo Sapiens
gcuugcacauggauugauuaacuccccuuaaaaugucuaguaaaauuaaaagccucuagaagua

SEQ ID NO: 90612 - RNA, 64 nt, Homo Sapiens
caauacuaccucugaauguuacaacgaauuuacagucuaguacuuauuacaugcugcuauacac

SEQ ID NO: 90613 - RNA, 64 nt, Homo Sapiens
aaauuuauguuauuuggcuaaauguuaugaugcagucuaguacgaguauugcaucuaauuccag

SEQ ID NO: 90614 - RNA, 64 nt, Homo Sapiens
ucacuaaaucaucauuacgacucucuuucauccagucuaguauacauagugaaaagacagugac

SEQ ID NO: 90615 - RNA, 64 nt, Homo Sapiens
ucaugguuaacacgcauuuaaaauuauuucaugagucuaguaguucuuugauuuauagcaggau

SEQ ID NO: 90616 - RNA, 64 nt, Homo Sapiens
gguaccuuugcuugaaccgugcaaccacaucugggucuaguagguggaucccauccaguugguu

SEQ ID NO: 90617 - RNA, 64 nt, Homo Sapiens
aaucgaagcuuucuuuucaccaugacuuuauaaugucuaguaaacaauauuucuacuucccaca

SEQ ID NO: 90618 - RNA, 64 nt, Homo Sapiens
uuaauaaugcacuauuacccaagagaucuugcaggucuaguauuauaggcuuccaaggcauagg

SEQ ID NO: 90619 - RNA, 64 nt, Homo Sapiens
uguuuuuuuuuuuuuuuuuguaguuuauuuuggagucuaguauuucaauaauuuaagaaucaga

SEQ ID NO: 90620 - RNA, 64 nt, Homo Sapiens
uucuucacuaaaggagaccaaacuguuccuugcggucuaguauuuaagaacuggaacuugaaag

SEQ ID NO: 90621 - RNA, 64 nt, Homo Sapiens
accacaguggcuaaaguagaugggcuguggcuuugucuaguaguuguaucaaaaguggguucuc

SEQ ID NO: 90622 - RNA, 64 nt, Homo Sapiens
cucucccuuugcuaguacuuucucuaaaguacuagucuaguaaaauuuauucuuguuagaaggu

SEQ ID NO: 90623 - RNA, 64 nt, Homo Sapiens
agcucuaaauccauuuuuguguagggagaauaaugucuaguaauguggaagaauagcuaucauu

SEQ ID NO: 90624 - RNA, 64 nt, Homo Sapiens
agaaagguaagaaugugcuugcuggagagucacagucuaguagaucucuugucuuuacugggaa

SEQ ID NO: 90625 - RNA, 64 nt, Homo Sapiens
acagggauggaauguaaauauccagagaauuugggucuaguauaguacauuuucccuuccauuu

SEQ ID NO: 90626 - RNA, 64 nt, Homo Sapiens
aauguugcccaguaagcacccugucuugucuggugucuaguauuguucugaccaaaccguuuca

SEQ ID NO: 90627 - RNA, 64 nt, Homo Sapiens
cauaagaaaauucauacuggucagcugauucucagucuaguaaaugaagaaugugguaaauccu

SEQ ID NO: 90628 - RNA, 64 nt, Homo Sapiens
guccacucuccauucuguguccacuugugacaaugucuaguaagauggugucuguuaccucuuc

SEQ ID NO: 90629 - RNA, 64 nt, Homo Sapiens
ugagccccuuauuuucuuuuuuuucccuccccaggucuaguagcucuaacuaaaaaguucuugg

SEQ ID NO: 90630 - RNA, 64 nt, Homo Sapiens
agcauuggaaaugaugaaugaaucauaccagaacgucuaguauaauuacagucaugcauugcuu

SEQ ID NO: 90631 - RNA, 64 nt, Homo Sapiens
agaauaccacacuuuaauauuaaauauucauaaggucuaguaucuugauaauaauguagauguu

SEQ ID NO: 90632 - RNA, 64 nt, Homo Sapiens
cuaaucucauuaaacaaauauucuccaugggccugucuaguagauuaauggaucugguuggccg

SEQ ID NO: 90633 - RNA, 64 nt, Homo Sapiens
ccacuugccuccccaaucuguuaaacagcuucgugucuaguaugagcucaguacuugcccugug

SEQ ID NO: 90634 - RNA, 64 nt, Homo Sapiens
guuuacaauagaguuguaaggaagucccucuauagucuaguauaaacacaucuugaaagaugua

SEQ ID NO: 90635 - RNA, 64 nt, Homo Sapiens
uuggcauuucaguuaaaagauugugaaaaaacccugggcugaagguaagucauuuuuaguuugg

SEQ ID NO: 90636 - RNA, 64 nt, Homo Sapiens
guagugacuguuugauuuuacggguguggaggugugggcugaagagccauuggggaggcagaug

SEQ ID NO: 90637 - RNA, 64 nt, Homo Sapiens
uaccuacagucccuggcugcaugugcugguaacuugggcugacccuagcuggaggaggggucug

SEQ ID NO: 90638 - RNA, 64 nt, Homo Sapiens
uuucucuuuaggcggaaaugggggaggaggccacugggcugaauaccauugggugcauagagau

SEQ ID NO: 90639 - RNA, 64 nt, Homo Sapiens
ugucuccacgucucuuuguguccuggugaugauaugggcugaaaauuugucuggguauagucac

SEQ ID NO: 90640 - RNA, 64 nt, Homo Sapiens
caaaauucugagauuguugguugcuaucuccaucugggcugaucgggaucgaagacauuucaaa

SEQ ID NO: 90641 - RNA, 64 nt, Homo Sapiens
gacauuucgucauuuaaguacaaauugcucuaucugggcugauaguaagggaucgaaaacauuu

SEQ ID NO: 90642 - RNA, 64 nt, Homo Sapiens
aaggcacugcccaaaauuucacucucucuaggacugggcugaugccccacuuccacuccccucu

SEQ ID NO: 90643 - RNA, 64 nt, Homo Sapiens
auugccagaaucuucuucucagauagcuggucauugggcugauccccaacaaucagguccccug

SEQ ID NO: 90644 - RNA, 64 nt, Homo Sapiens
gguccuuugcccgguggugggaggauggagggauugggcugaagcugcuccaccucauccuugc

SEQ ID NO: 90645 - RNA, 64 nt, Homo Sapiens
uaaagcuccccgggcgucagaguugagcccugccugggcugaaggacugucuucacgaagucag

SEQ ID NO: 90646 - RNA, 64 nt, Homo Sapiens
aucucaaagccagcauaauuaacuacuuugauugugggcugaccuuuguuuuuuuaacaaucag

SEQ ID NO: 90647 - RNA, 64 nt, Homo Sapiens
cagugccaaggugcaugacccucugagaagucacugggcugauuugaccuccgacucauugguu

SEQ ID NO: 90648 - RNA, 64 nt, Homo Sapiens
cugcccugagggggcgccuuuguccccuggcagcugggcugaguagcucccguuagccaggacu

SEQ ID NO: 90649 - RNA, 57 nt, Homo Sapiens
cagcgagugauucccgcgcuacccgcuugggcugaggcugccgcaggcacccaguga

SEQ ID NO: 90650 - RNA, 64 nt, Homo Sapiens
ugcuucccuaggaucccgucuuccagagaaccugugggcugacugcccuccgaagagaguucug

SEQ ID NO: 90651 - RNA, 64 nt, Homo Sapiens
uaugucuggcagaugagggcuggcugccguuuucugggcugaugggugcccuuuccuggcaguc

SEQ ID NO: 90652 - RNA, 64 nt, Homo Sapiens
gccuuggaccgggagucagagcucagcagugcaaugggcugacauguuuacagugcagaaggcg

SEQ ID NO: 90653 - RNA, 64 nt, Homo Sapiens
ggcucuauggaugugguuguuuuggugaauccagugggcugaguguaagaauccaggagcaagc

SEQ ID NO: 90654 - RNA, 64 nt, Homo Sapiens
cagggaagcucugaagcagucaaguugaaucaugugggcugauguuuaccauuuucuauauugc

SEQ ID NO: 90655 - RNA, 64 nt, Homo Sapiens
uuguauucugccauggcgcaaaaaucauuuuuucugggcugauggcugcccaggccuucccagg

SEQ ID NO: 90656 - RNA, 64 nt, Homo Sapiens
uuucuccugcuucucuccagggaacccaacccucugggcugaccggcuuugcccggccgcccca

SEQ ID NO: 90657 - RNA, 64 nt, Homo Sapiens
ccagcccuggggaagauucccccagucuacuugcugggcugaguuccacccaacgcccaggcac

SEQ ID NO: 90658 - RNA, 64 nt, Homo Sapiens
uuagccaugaucugcaggggucugggagucaggcccggccuauugcuugggucucucuccauuu

SEQ ID NO: 90659 - RNA, 64 nt, Homo Sapiens
agguugcagugagcugagauggcaccacugcacuccggccuaggcaacgagagcaaaacuccaa

SEQ ID NO: 90660 - RNA, 64 nt, Homo Sapiens
caggacucugcaggucaaggauaugugaugagcaccggccuaaguguuugcucuucagauuccu

SEQ ID NO: 90661 - RNA, 64 nt, Homo Sapiens
gcucccagcccuugacugucagcggaaaugcaguccggccuaggcauagaaagucuccugcggg

SEQ ID NO: 90662 - RNA, 64 nt, Homo Sapiens
ugucagggaggcaaaaaaggggaguagauggugcccggccuaucaauccugcauaaccccauua

SEQ ID NO: 90663 - RNA, 64 nt, Homo Sapiens
aaagugcuggaauuacaggccugagccaccccacccggccuauuuucuuaaaggggaacaaaug

SEQ ID NO: 90664 - RNA, 64 nt, Homo Sapiens
uguuaaaggaauccuuuuguaugacuuguccagaccggccuauugcccuacccguuugauucuc

SEQ ID NO: 90665 - RNA, 64 nt, Homo Sapiens
cucgaccugccccccacccccgaagucugauuuaccggccuacuacuggugacuuaaggagcug

SEQ ID NO: 90666 - RNA, 64 nt, Homo Sapiens
ccguggaggcccaucacaccgaugcacguuccucccggccuaguccagccuuucuuuccccucu

SEQ ID NO: 90667 - RNA, 64 nt, Homo Sapiens
ccauauuuuuuuaaugggacgugagccaccgcgcccggccuauuagagugcugggauuacaggc

SEQ ID NO: 90668 - RNA, 64 nt, Homo Sapiens
aaagugcugggauuacaggugugagcuaccgcgcccggccuauuaucuuguacuuucuaacuga

SEQ ID NO: 90669 - RNA, 64 nt, Homo Sapiens
aaucuccuuauuuuauuucuuugcugacaaucagccggccuauaauacaguaaauauauugugu

SEQ ID NO: 90670 - RNA, 64 nt, Homo Sapiens
guacugccauucagaaaagcggaccacaaugcccccggccuaaaggaaaagcugcacucaccaa

SEQ ID NO: 90671 - RNA, 64 nt, Homo Sapiens
agucuuugccuucauaaauuucagacugcaugggccggccuagguggagcauucgguagcguau

SEQ ID NO: 90672 - RNA, 64 nt, Homo Sapiens
cugaccgccucaacgccauuucgugugagccagcccggccuaauaaaagccaagcccgggaccc

SEQ ID NO: 90673 - RNA, 64 nt, Homo Sapiens
gcccgaccgcgccggacgcgcccacgagggccucccggccuaggcccgggccggccucgggcca

SEQ ID NO: 90674 - RNA, 64 nt, Homo Sapiens
gcagugagcggagacugcaccacugcauuccagcccggccuacaagaacaaaacuccaucucaa

SEQ ID NO: 90675 - RNA, 64 nt, Homo Sapiens
gguugugaauguguuuuuauucagguaugcugugccggccuacaaugggguuaaacauucucac

SEQ ID NO: 90676 - RNA, 64 nt, Homo Sapiens
uuucacuuuaauuuggcagccugagccaccgcgcccggccuauuaaaguacugggauuacaggc

SEQ ID NO: 90677 - RNA, 64 nt, Homo Sapiens
ugccauccgcgugacgcuaggugccugccccuccccggccuaugggagggaccuugaccuucug

SEQ ID NO: 90678 - RNA, 64 nt, Homo Sapiens
aaagugcugggauuacaggcgugagccaccgugcccggccuacaaauguuaacaaagcaauuac

SEQ ID NO: 90679 - RNA, 64 nt, Homo Sapiens
caagaaaagucaaggcccuuagucaccagcaaagccggccuaaccuccugcagaguuuggaaga

SEQ ID NO: 90680 - RNA, 64 nt, Homo Sapiens
uuuucugacugauauggaaauccauauugugaaaccggccuaaucuguugaccagaaaggacac

SEQ ID NO: 90681 - RNA, 64 nt, Homo Sapiens
aggcagcuccugccacuaucgugcuccuuuuuucccggccuacgccuucccuccaaucaucacu

SEQ ID NO: 90682 - RNA, 64 nt, Homo Sapiens
cucggcacaaagcggagggaggcuguggucgcugccggccuaggugucccaggugccccgccuu

SEQ ID NO: 90683 - RNA, 64 nt, Homo Sapiens
auucuuuuuuuuuuuuuuuuaugagccacugugcccggccuaugaaagugcugggauuacaggc

SEQ ID NO: 90684 - RNA, 64 nt, Homo Sapiens
aggcaggaagccaaggugcagccacaaggggaccccggccuaggcuaccccagccaacaccaag

SEQ ID NO: 90685 - RNA, 64 nt, Homo Sapiens
caccuccccgcucucccugucuggguucccacucccggccuagggcagccccuucuggccggug

SEQ ID NO: 90686 - RNA, 64 nt, Homo Sapiens
auucaaucacgacguuaaccggcucgagagagcgccggccuagaggcucauuaucuauuuauuu

SEQ ID NO: 90687 - RNA, 64 nt, Homo Sapiens
caucugggcccaagagcugcccucuccuccuacaccggccuacccugaaauaacuggaacccag

SEQ ID NO: 90688 - RNA, 64 nt, Homo Sapiens
aggggaccuuggguaacaucgguccuuuucuccuccggccuaguuugugccccuguaggaggua

SEQ ID NO: 90689 - RNA, 64 nt, Homo Sapiens
cccugcucacaucacagcugggcccccuugauuaccggccuagcgguguggcauggcucagucu

SEQ ID NO: 90690 - RNA, 64 nt, Homo Sapiens
agguugcagugagcugagaucaugccacugcacuccggccuaggugacagagggaaacuccauc

SEQ ID NO: 90691 - RNA, 64 nt, Homo Sapiens
uccccaccuuucguguaagggugagccacugcgcccggccuauuaaagugcugggauuacaggc

SEQ ID NO: 90692 - RNA, 64 nt, Homo Sapiens
ugaaugugggaaucagaaaaaccuguucccaucaccggccuagccuagaauccuagccuagaag

SEQ ID NO: 90693 - RNA, 64 nt, Homo Sapiens
caggcccggcccucccgcccccgaccugaccacgccggccuaggguuccagacugguuggacuu

SEQ ID NO: 90694 - RNA, 64 nt, Homo Sapiens
caggcuggagugcaguggugaugagcuacugcacccggccuaacaaagugcugggauuacaggc

SEQ ID NO: 90695 - RNA, 64 nt, Homo Sapiens
guccucgcccuacauugaguacacgccggccagcccggccuacgcccaguacccaccggccacc

SEQ ID NO: 90696 - RNA, 64 nt, Homo Sapiens
cuuuguuuuuaaaaugaacuaugagccaccaugcccggccuaaaaaagugcuaggauuacaggc

SEQ ID NO: 90697 - RNA, 64 nt, Homo Sapiens
cacgaagaccaaagcagccucccacugccccaaaccggccuagacccugcugccaggcccucuc

SEQ ID NO: 90698 - RNA, 64 nt, Homo Sapiens
gcuuccuucgccagaggccugcggucucccacuuccggccuagucugccagcuuuugcuggcac

SEQ ID NO: 90699 - RNA, 64 nt, Homo Sapiens
ugcuuuaaccuuaagcugaucuggcaggcauuugccggccuauguauugccaguccugcuuuuc

SEQ ID NO: 90700 - RNA, 64 nt, Homo Sapiens
acuaaaaugacauuuauuccaaagagcaaacugaccggccuaaagcuucgaaguuacaggacua

SEQ ID NO: 90701 - RNA, 64 nt, Homo Sapiens
aaagugcugggaugacaggcgugagccaccgcgcccggccuauaccucauuuucuacaugucgc

SEQ ID NO: 90702 - RNA, 64 nt, Homo Sapiens
caacuuuuuccuuuaaaggacuccuaaacuaagcacagaagaguuggcgucaucuuaaaaauac

SEQ ID NO: 90703 - RNA, 64 nt, Homo Sapiens
agaagaguuggcgucaucuuaaaaauaccaaauaacagaagaucgcauugcagaugauaucagg

SEQ ID NO: 90704 - RNA, 64 nt, Homo Sapiens
gacaucuuuugauauucuuauaaauggaacuuacacagaagaaauagggauaugauaaccacua

SEQ ID NO: 90705 - RNA, 64 nt, Homo Sapiens
gcagagaacaguuaaucccuaaggucuugacaaaacagaagaaaaacaagccuccucguccuag

SEQ ID NO: 90706 - RNA, 64 nt, Homo Sapiens
cugaccucaccccugccaccuagacuguaaagacacagaagauggagaacauggauuaggaucc

SEQ ID NO: 90707 - RNA, 64 nt, Homo Sapiens
cauaacuuuagaaauacgggauucauuuuggggaacagaagaucaauaccacguaaaucaagcc

SEQ ID NO: 90708 - RNA, 64 nt, Homo Sapiens
caucuucaagaucaccaaaacagcuaaagcugccacagaagaggagcaaagccaauacaaaaau

SEQ ID NO: 90709 - RNA, 64 nt, Homo Sapiens
gaacucgaaaucccaaugaaugucggaaaagguaacagaagauguuuuucuuaaccugucuagc

SEQ ID NO: 90710 - RNA, 64 nt, Homo Sapiens
aggccugcuucacuugcagauguuuugagagauuacagaagagguauaugcaauauauuccaga

SEQ ID NO: 90711 - RNA, 64 nt, Homo Sapiens
uaauugccucuacucugagucacuaucuucccugacagaagacaaggaccaggucuggccugau

SEQ ID NO: 90712 - RNA, 64 nt, Homo Sapiens
guugcagugaaaaauaguaggccacuuggcucacacagaagaaaggaguuaggaaaaguaagua

SEQ ID NO: 90713 - RNA, 64 nt, Homo Sapiens
uugcuaaaagaguuaaaaguaugugaggaaaaaaacagaagacaaauaaugaaaugacuaaguu

SEQ ID NO: 90714 - RNA, 64 nt, Homo Sapiens
ccuugucucgaaaaggaauccuccagccggggugacagaagagagucgugauugugccacugca

SEQ ID NO: 90715 - RNA, 64 nt, Homo Sapiens
uugucuaccaguacacaggcugcagaagacagagacagaagaaagagaucaagggcagauaacu

SEQ ID NO: 90716 - RNA, 64 nt, Homo Sapiens
uggcugagaugaccugguccuaggacacccuuggacagaagacuggccuaccuagcagaccugg

SEQ ID NO: 90717 - RNA, 64 nt, Homo Sapiens
ucccucuucccagaaaaccagucuguguuuacagacagaagagaaggaagccauagugucacuu

SEQ ID NO: 90718 - RNA, 64 nt, Homo Sapiens
uaauuacaugaaugcaccuggaaugacauuuguaacagaagacggucugacuugcuuucaguau

SEQ ID NO: 90719 - RNA, 64 nt, Homo Sapiens
acagucaggguggacucaaucuuucugguucuccacagaagacgucucugcaagaagccuggag

SEQ ID NO: 90720 - RNA, 64 nt, Homo Sapiens
uuuaaauguuauuuuggaaagggguuuuggggacacagaagaauaaguaaacacaucucggagg

SEQ ID NO: 90721 - RNA, 64 nt, Homo Sapiens
gcugcuguaagaccaccaaaaaugagucagaaacacagaagacuauuucaggcaugugggccug

SEQ ID NO: 90722 - RNA, 64 nt, Homo Sapiens
acccuucaggaacccuuuaguuuauuaaucuuauacagaagaaacuaacuuagaaacaaaggau

SEQ ID NO: 90723 - RNA, 64 nt, Homo Sapiens
aaaaggaaaaugggugguugggagagaaacuagaacagaagaugugcaauagggcucagagcag

SEQ ID NO: 90724 - RNA, 64 nt, Homo Sapiens
ugccugaagcucagcgugaagucugaaauaugcaacagaagaaauauaucucuaucucucuacu

SEQ ID NO: 90725 - RNA, 64 nt, Homo Sapiens
uuucaagaauaaagccaucauaagaccucaugccacagaagagauaaaagugcuuuuuauacca

SEQ ID NO: 90726 - RNA, 64 nt, Homo Sapiens
ggagugguuugaucuauauacacugugacgauggacagaagaaaauugugaaaguucaaauucg

SEQ ID NO: 90727 - RNA, 64 nt, Homo Sapiens
uuuaaaaaaaaaaaaggaaaaaaaaagaaaacacacagaagagaaagaggaaaaaaaagcaaca

SEQ ID NO: 90728 - RNA, 64 nt, Homo Sapiens
aaaaaaaagcaacaaaaaaaacaaaaaaacacaaacagaagaggagaaaaaaaucaaaaaagcg

SEQ ID NO: 90729 - RNA, 64 nt, Homo Sapiens
uuuauuauuuauuuggcuuuuuuauuuguauccaacagaagaugguuaucuuaugagacucugu

SEQ ID NO: 90730 - RNA, 64 nt, Homo Sapiens
acuggguaacaucuaucacauuucaguguucaagacagaagaagaacagaaaugugaucauuga

SEQ ID NO: 90731 - RNA, 64 nt, Homo Sapiens
caccguggaagucauggguaucaagcauuuccuuacagaagagcugcauguucucucuuugggu

SEQ ID NO: 90732 - RNA, 64 nt, Homo Sapiens
ucccacugcagaagggccucuuguuuuauuacauacagaagagcauauucuuuaugcagaaguc

SEQ ID NO: 90733 - RNA, 64 nt, Homo Sapiens
cagugauuugggaugagucucuacucaagaaaagacagaagagaaacuuaagagaaaaagaaac

SEQ ID NO: 90734 - RNA, 64 nt, Homo Sapiens
aaaugcuuugggaugagucucuguugaagaaaggacagaagaggcaggaaagagaaaaagaaau

SEQ ID NO: 90735 - RNA, 64 nt, Homo Sapiens
uaaaauguuuuacaaguaauguaaaagcuaguaucauucuuacauacuucuguguuuaaauuuu

SEQ ID NO: 90736 - RNA, 64 nt, Homo Sapiens
guaucauucuuacauacuucuguguuuaaauuuucauucuuaccaaaacaguuaacucuuucuu

SEQ ID NO: 90737 - RNA, 64 nt, Homo Sapiens
gguacuguuaaguaaaccagauuuucuaaauaggcauucuuaaaauuucagacuuacaaagcua

SEQ ID NO: 90738 - RNA, 64 nt, Homo Sapiens
gcuuaaguauaauuuauagaauuucagugcaguucauucuuaauggaaaaucugaaaccuaaau

SEQ ID NO: 90739 - RNA, 64 nt, Homo Sapiens
augaguagcaggccuuagugcaucacuggcaucucauucuuaggaaacuugucuuugauacaaa

SEQ ID NO: 90740 - RNA, 64 nt, Homo Sapiens
cucucuaacacagagaagcacuaacuuagauccucauucuuaauauuuauauguaucuauuuuu

SEQ ID NO: 90741 - RNA, 64 nt, Homo Sapiens
augguuggcuucuugucugcuuguucacuuaaaacauucuuaaaccaucccugggguuugcaag

SEQ ID NO: 90742 - RNA, 64 nt, Homo Sapiens
guuuuuccaucccugggguuugcucacaauugugcauucuuaggcaguugugaugguuguuaaa

SEQ ID NO: 90743 - RNA, 64 nt, Homo Sapiens
ucacuucuugagaaggaaguuuaaaucaauguuacauucuuauauuuuuguugaagguuguaug

SEQ ID NO: 90744 - RNA, 64 nt, Homo Sapiens
cacgugggguugggggaaaggguuuauaaucggccauucuuaagcuuaaaccuugguagaucug

SEQ ID NO: 90745 - RNA, 64 nt, Homo Sapiens
accaagggaaauacugcuccucaaguaugugguucauucuuagaugguuaccuucucauucaug

SEQ ID NO: 90746 - RNA, 64 nt, Homo Sapiens
guuacguccuccccccaccccacaaaauuucaaccauucuuaauguuguaauuuaacagaaaaa

SEQ ID NO: 90747 - RNA, 64 nt, Homo Sapiens
agcucaauuuaaauaauugagcuucaagaguagacauucuuacuuaauaccuuuaaccucacua

SEQ ID NO: 90748 - RNA, 64 nt, Homo Sapiens
cuuuuuuuagaaaggaaaagaaaauguacuuuuacauucuuaauuaaaaugcuuuuuuaauauu

SEQ ID NO: 90749 - RNA, 64 nt, Homo Sapiens
aguagaaaaccaaggacaauuaugacuuggugaccauucuuaggagucccauuggugaggauau

SEQ ID NO: 90750 - RNA, 64 nt, Homo Sapiens
auguauuuccacuugcccuguuaacuaggguaagcauucuuaacaggggggcgcugucuagcac

SEQ ID NO: 90751 - RNA, 64 nt, Homo Sapiens
aguucuaaauuuuauguuuagauauaguccacugcauucuuauaucuuguagcuguuguuuuua

SEQ ID NO: 90752 - RNA, 64 nt, Homo Sapiens
caauaaaaaggacacauuugaaagaaaacaauuacauucuuauauuccauagcuuauuaacacu

SEQ ID NO: 90753 - RNA, 64 nt, Homo Sapiens
acauuguauguuaauagaaaugcaguuauguuaucauucuuauaucuaggaugauuuucccccu

SEQ ID NO: 90754 - RNA, 64 nt, Homo Sapiens
uaaucuuugaaaacucauacaaaaaucagaaagacauucuuaguuaaguuagauguuuuaguuu

SEQ ID NO: 90755 - RNA, 64 nt, Homo Sapiens
uggagauccuaacugagaauuuucuaccuguguucauucuuaccgagaaaaggagaaaggagcu

SEQ ID NO: 90756 - RNA, 64 nt, Homo Sapiens
gacuccuuucucuaucccaagccaaccaagagcacauucuuaaaggaaaagucaacaucuucuc

SEQ ID NO: 90757 - RNA, 64 nt, Homo Sapiens
uguacagcauggcugugcuccaucugauuuaccccauucuuaaguucugagaguauguucucaa

SEQ ID NO: 90758 - RNA, 64 nt, Homo Sapiens
cuucguucuauaacuaauguaccuuaacuucccccauucuuauauuuacaagaagcuaagucau

SEQ ID NO: 90759 - RNA, 64 nt, Homo Sapiens
uguggguuauuguaugucacuaguauuagcauagcauucuuaaaggaaugcagugcucaaaacc

SEQ ID NO: 90760 - RNA, 64 nt, Homo Sapiens
guuaguuuuaauauuccugauauuuacaaauauucauucuuauauacaaugaaaaaaauaacuu

SEQ ID NO: 90761 - RNA, 64 nt, Homo Sapiens
cugagaauuauagaugggguaucuccaaaacuagcauucuuaaaauuaugaggggcacauucuu

SEQ ID NO: 90762 - RNA, 64 nt, Homo Sapiens
uccaaaacuagcauucuuaacauuaugaggggcacauucuuaucauauaauuauguuauuuagu

SEQ ID NO: 90763 - RNA, 64 nt, Homo Sapiens
cucggcguggauggcagccucaggacacacaccccugccucaaggugcugagcccccgccuugc

SEQ ID NO: 90764 - RNA, 64 nt, Homo Sapiens
caucuuucccaucucgccugagagcggcugagggcugccucacugcaaauccuccccacagcgu

SEQ ID NO: 90765 - RNA, 64 nt, Homo Sapiens
caggcccgaagccccagcuugcccuggccugugccugccucaggugccagcuagaugucucgcu

SEQ ID NO: 90766 - RNA, 64 nt, Homo Sapiens
ccguuucuucaucccaugagaccaacaacacugucugccucagaacauagccgugaucaagaug

SEQ ID NO: 90767 - RNA, 64 nt, Homo Sapiens
ugcaaccucuaccuccuggguucaagcaaaucuccugccucagccuccaaaguagcugggauua

SEQ ID NO: 90768 - RNA, 64 nt, Homo Sapiens
ugcaaccuccgccucccagguucaagcaauucuccugccucagccucccgaguagcuggaauua

SEQ ID NO: 90769 - RNA, 64 nt, Homo Sapiens
aucuccugcuuucaugucccuggagggcucuggccugccucaaaaccccuucugccucaggugg

SEQ ID NO: 90770 - RNA, 64 nt, Homo Sapiens
cccuggagggcucuggccugccucaaaaccccuucugccucagguggggaggaacaagcugaac

SEQ ID NO: 90771 - RNA, 64 nt, Homo Sapiens
cucucgaguagcugggauuauucaagcaauucuccugccucagcugcaaccucugccuccuugg

SEQ ID NO: 90772 - RNA, 64 nt, Homo Sapiens
cucccgaguagcugggacugugcaagcaauuauccugccucagcugcaaccucugccuccuggg

SEQ ID NO: 90773 - RNA, 64 nt, Homo Sapiens
cuccuagagugcugggauuacucaggcagucugccugccucagcgcugguugcaaacucuugag

SEQ ID NO: 90774 - RNA, 64 nt, Homo Sapiens
cucccgaguagcugggaguguucaagcaauucuccugccucagcugcaaccuccgccucccggg

SEQ ID NO: 90775 - RNA, 64 nt, Homo Sapiens
ucccaaguagcugggacuacuucaagcgauucuccugccucagcugcaaccuccaccucccggg

SEQ ID NO: 90776 - RNA, 64 nt, Homo Sapiens
cucccaaaguguggggauuacucaagugguccuccugccucagcgcuggucuugaacuccuggc

SEQ ID NO: 90777 - RNA, 64 nt, Homo Sapiens
cucccgaguaccugggacuauucaagcaauuuuccugccucagcugcaaccuccgccucccagg

SEQ ID NO: 90778 - RNA, 64 nt, Homo Sapiens
cucccgaguagcugagauuauuccagcaauucuccugccucagcugcaaccuucgccaccuggg

SEQ ID NO: 90779 - RNA, 64 nt, Homo Sapiens
cuaagacucaguggggaggggagagcuucuguugcugccucaugggacuuagcugggagaaaga

SEQ ID NO: 90780 - RNA, 64 nt, Homo Sapiens
cuccugaaacaucacugcccagcccacuaagguucugccucagcagagcuaccuccccggggac

SEQ ID NO: 90781 - RNA, 64 nt, Homo Sapiens
ucugucucuggcagcucugccuugccuuccccagcugccucaacaaacuugguuaggacucugg

SEQ ID NO: 90782 - RNA, 64 nt, Homo Sapiens
gccuguuggaggcugggaaccccgcagcgcgaggcugccucaucaacggcaagaggaaaggagg

SEQ ID NO: 90783 - RNA, 64 nt, Homo Sapiens
acacugaagggcuggaaugcuggcuggccacucucugccucaguggccucccuacagccuggaa

SEQ ID NO: 90784 - RNA, 64 nt, Homo Sapiens
aauuccacaccccuguacccccccagggggcccucugccucauggcaaaggcuugccccaaauc

SEQ ID NO: 90785 - RNA, 64 nt, Homo Sapiens
cacugcacugcagccugggcgacagagcgagauucugccucaaaaauaaacaaauaaauuuuaa

SEQ ID NO: 90786 - RNA, 64 nt, Homo Sapiens
uagcuuacaagccagcuggauguaagaucguucucugccucacaccgcuuuuaggccaaaaaaa

SEQ ID NO: 90787 - RNA, 64 nt, Homo Sapiens
cuccugaguagcuggauuacuucaagugauucuccugccucagcugcaacuucugccucuuggg

SEQ ID NO: 90788 - RNA, 64 nt, Homo Sapiens
ugcaaccuccaccucccggauucaagcgauucuccugccucagccuccugaguagcuggaacua

SEQ ID NO: 90789 - RNA, 64 nt, Homo Sapiens
guuggacuggaaacccuuggcucaagcaauuugccugccucagccucccaaagugcugggauua

SEQ ID NO: 90790 - RNA, 64 nt, Homo Sapiens
ucugggacuuggccucaccccacccauggaauaccugccucaucccaaagaucagguaugggcu

SEQ ID NO: 90791 - RNA, 64 nt, Homo Sapiens
gugcgugcgugcguguguguguguguguguguuucugccucauucaguuucuggggucaaauca

SEQ ID NO: 90792 - RNA, 64 nt, Homo Sapiens
ugcaaccuuugccucccagguucaagcgauucuucugccucagccucccgaguagcugggacca

SEQ ID NO: 90793 - RNA, 64 nt, Homo Sapiens
uggcucacugcuaccucuaccaugagcaauucuccugccucagccucccaaguagcuggaacua

SEQ ID NO: 90794 - RNA, 64 nt, Homo Sapiens
cuucugaguagcugggauuauucaaguaauucuccugccucagguacaaccucugccucccggg

SEQ ID NO: 90795 - RNA, 64 nt, Homo Sapiens
cuccccaguagcugggauuauuuaagcaauucuccugccucagcugcaaccucugccuccuggg

SEQ ID NO: 90796 - RNA, 64 nt, Homo Sapiens
cucccaaagugcugggauuaaccucaugaucugccugccucagcaggauggucuugaucuccug

SEQ ID NO: 90797 - RNA, 64 nt, Homo Sapiens
cucccgaauggcugggacuauucacaccauucuccugccucaacugcaagcucugccucccagg

SEQ ID NO: 90798 - RNA, 64 nt, Homo Sapiens
cucccaaagugcugggauuacucaggugauccaccugccucagcgcuggucuugaacuccugac

SEQ ID NO: 90799 - RNA, 64 nt, Homo Sapiens
cucccaaguagcugggacuauucaagcaauucuccugccucagcugcaaccucugccucccgag

SEQ ID NO: 90800 - RNA, 64 nt, Homo Sapiens
cucccgaguagcugggacuauucaagcaauucuccugccucagcugcagccuccuccucuuggg

SEQ ID NO: 90801 - RNA, 64 nt, Homo Sapiens
aauauguguuuucuuuagcugccaacuguccugccugccucaagcaugucuucaucaaguggaa

SEQ ID NO: 90802 - RNA, 64 nt, Homo Sapiens
gggcugggagcccacaccccacucaccaguucugcugccucaggucaggccagggcagugcugc

SEQ ID NO: 90803 - RNA, 64 nt, Homo Sapiens
ugccaccuccgccucucuaguucaagcgauuuuccugccucagccucccgaguagcugggauuc

SEQ ID NO: 90804 - RNA, 64 nt, Homo Sapiens
cucaaugcaaaucuccaggguucaaucgauucuccugccucacccucccauguagcugggauua

SEQ ID NO: 90805 - RNA, 64 nt, Homo Sapiens
ugcaaccuccaccucccagguucaagcaauucuucugccucagccucccaaguagcugggauua

SEQ ID NO: 90806 - RNA, 64 nt, Homo Sapiens
acuggucucaaacuccugaccucaagugauccaccugccucagccucccaaagugcugggauua

SEQ ID NO: 90807 - RNA, 64 nt, Homo Sapiens
ugcaaccuccaccucccagguucaagugauucuccugccucagccuccugaguagcugggacua

SEQ ID NO: 90808 - RNA, 64 nt, Homo Sapiens
cucucaaguuguuuuuuuuccucaagcaauccuccugccucagcgcuggucuugaaccccuggc

SEQ ID NO: 90809 - RNA, 64 nt, Homo Sapiens
cuucugaguagcuaggacuacucaugcaaucuuccugccucagguguaaccucaaacuccugga

SEQ ID NO: 90810 - RNA, 64 nt, Homo Sapiens
uguaaccuccgccucccagguucaggugauucuccugccucagccuccugaguagcugggauua

SEQ ID NO: 90811 - RNA, 64 nt, Homo Sapiens
aggcuggucucgaacuccugaccucgugauccgccugccucagccucccaaagugcugggauua

SEQ ID NO: 90812 - RNA, 64 nt, Homo Sapiens
cucccagcagccuccagaaccaugcccaggucuccugccucacaucacaauaaucugggaccca

SEQ ID NO: 90813 - RNA, 64 nt, Homo Sapiens
gcaccacaaaagagcucucuguacuuuccccaugcugccucaaaaguucugugaguuucggggu

SEQ ID NO: 90814 - RNA, 64 nt, Homo Sapiens
ugcaacgucugccuccuggguucaagcaauucuccugccucagccuccugaguagcugggauua

SEQ ID NO: 90815 - RNA, 64 nt, Homo Sapiens
uccaagcucccccucccguguucacgccauucuccugccucagccucccgaguagcugggacua

SEQ ID NO: 90816 - RNA, 64 nt, Homo Sapiens
ugcaaccuccgccuccuggguucaagcaauucuccugccucagccucccaaguagcuuggacua

SEQ ID NO: 90817 - RNA, 64 nt, Homo Sapiens
ucucaccugugagcuguggggaucacaaggcugccugccucagucuuggaguccuguuggguga

SEQ ID NO: 90818 - RNA, 64 nt, Homo Sapiens
guugacguuguguccuccuccccaaaagacacagcugccucacgauaccccugccucacgaaaa

SEQ ID NO: 90819 - RNA, 64 nt, Homo Sapiens
aaaacccaaaagacacagcucugacuucauaccccugccucacguguaaaaacaaacgaaacaa

SEQ ID NO: 90820 - RNA, 64 nt, Homo Sapiens
cugaaaagcuaguccuaacggcuauaucuccacucugccucagaccaaccaaaccucuugcucu

SEQ ID NO: 90821 - RNA, 64 nt, Homo Sapiens
aacugauucuaucuuuguagucucaugcugguggcugccucaucauucuuuggucucuuuugac

SEQ ID NO: 90822 - RNA, 64 nt, Homo Sapiens
cucccaaguagcuaggauuauucaagcgauucuucugccucagcugcaaccuccaccuccuggg

SEQ ID NO: 90823 - RNA, 64 nt, Homo Sapiens
cucccgaguaguugggauuauucaagcgauucuccugccucagccacaacuucggccuccuggg

SEQ ID NO: 90824 - RNA, 64 nt, Homo Sapiens
agguaaaguguuagcacacagacuguuaaaaugucugccucacagauaggagggaaaauauaua

SEQ ID NO: 90825 - RNA, 64 nt, Homo Sapiens
ugcaagcuccgccucccggguucacgccauucuccugccucagccuccugaguagcuggggcua

SEQ ID NO: 90826 - RNA, 64 nt, Homo Sapiens
cuggaauaugagaggaugggaggcccuuuagaaccugccucaaugccaucucucacucuccuuc

SEQ ID NO: 90827 - RNA, 64 nt, Homo Sapiens
uauugacccuuuuuugccuucucuuucuccuucacugccucaaguuacagccagaggaaaggag

SEQ ID NO: 90828 - RNA, 64 nt, Homo Sapiens
accuccccccuaccccugaguucaagcgauucuccugccucagccugcugaguaguugggauua

SEQ ID NO: 90829 - RNA, 64 nt, Homo Sapiens
ggcaaccucugccucccagguucaagcgauuguccugccucagucuccugaguagcugggacua

SEQ ID NO: 90830 - RNA, 64 nt, Homo Sapiens
cucccgaguagcugggacuauucacgccauucuccugccucagcugcaagcuccgccucccggg

SEQ ID NO: 90831 - RNA, 64 nt, Homo Sapiens
gguaauaaauggugcuagaucauuccuuaacccgcugccucagucuuuccugacacugcgaaua

SEQ ID NO: 90832 - RNA, 64 nt, Homo Sapiens
uucccgaguagcugggacuauucacgccauucuccugccucagcggcacgcuccgccucccggg

SEQ ID NO: 90833 - RNA, 64 nt, Homo Sapiens
cucccaaguagcucggacuauucacgccauucuccugccucagcugcaagcuccgccucucggg

SEQ ID NO: 90834 - RNA, 64 nt, Homo Sapiens
ccuggugaagcaacugcuacuuuaccuaugugugcugccucauuaagaauggaaagggaugaca

SEQ ID NO: 90835 - RNA, 64 nt, Homo Sapiens
cucccgaguagcugggacuauucaagugauucuccugccucagcuccaaccuccaccuuccagg

SEQ ID NO: 90836 - RNA, 64 nt, Homo Sapiens
cucccaaaaugcugggauuaaccucaugauccaccugccucagcgccaggcuggucuugaacug

SEQ ID NO: 90837 - RNA, 64 nt, Homo Sapiens
cucccgaguagcugggauuauucaagcaauucuccugccucagcugcaaccuccgucucuuagg

SEQ ID NO: 90838 - RNA, 64 nt, Homo Sapiens
cuccugaguagcuggaacuauucaagcaauucuccugccucaguugcaaccuccaccucccagg

SEQ ID NO: 90839 - RNA, 64 nt, Homo Sapiens
ugcaagcucugcguccuggguugacgccauucuccugccucagccucccgaguagcugggacua

SEQ ID NO: 90840 - RNA, 64 nt, Homo Sapiens
ugcaagcuccgccucccggguucacgccauucuccugccucagccucccguguagcugggacua

SEQ ID NO: 90841 - RNA, 64 nt, Homo Sapiens
gauagaaauccuuguguccagugcccagcaacuccugccucagccucccgagcagcugggacua

SEQ ID NO: 90842 - RNA, 64 nt, Homo Sapiens
aggauggucuugaucucuugaccuugugauccaccugccucaucaucccaaagugcugggauua

SEQ ID NO: 90843 - RNA, 64 nt, Homo Sapiens
guuuguuuguuucccacuuuuuuccuaugcuggucugccucaaagucucaagaccaaggugacu

SEQ ID NO: 90844 - RNA, 64 nt, Homo Sapiens
gcuggucucaaacuccugggcucaagcaauccuccugccucagcuuccugaguagcuggaacca

SEQ ID NO: 90845 - RNA, 64 nt, Homo Sapiens
ugcccacgcgcucagacaugauaugcggcuaugccugccucaaagguacuuugaguuccaaaag

SEQ ID NO: 90846 - RNA, 64 nt, Homo Sapiens
ugcaagcuccaacucccggguucacgccauucuccugccucagccuuccaaguagcugggacua

SEQ ID NO: 90847 - RNA, 64 nt, Homo Sapiens
cuccugaguagcugggauuaugcaagugauucuccugccucagcugcaaccuccgccuuccagu

SEQ ID NO: 90848 - RNA, 64 nt, Homo Sapiens
uagaauaacacuucacuaauuugguuuucuaggacugccucaaccauggugcuagauuguuuac

SEQ ID NO: 90849 - RNA, 64 nt, Homo Sapiens
acccccaagccuaugcccugccagggacuggucacugccucaggggcccaaucuuaccuguucu

SEQ ID NO: 90850 - RNA, 64 nt, Homo Sapiens
cucauggucagagcaguggauaaaugugcuuugccugccucagcucuucuugcucauccccuua

SEQ ID NO: 90851 - RNA, 64 nt, Homo Sapiens
cucccaaagugcugggauuaaccuugugauccgccugccucagcaggauggucuugaucuccug

SEQ ID NO: 90852 - RNA, 64 nt, Homo Sapiens
cucccgaguagcugggacuauucacgccauucuccugccucagcugcaagcucugccucccagg

SEQ ID NO: 90853 - RNA, 64 nt, Homo Sapiens
guggucacucaaggccucgcuucacgcccaucuucugccucauacccugucucaggauugucuc

SEQ ID NO: 90854 - RNA, 64 nt, Homo Sapiens
cuggccccucugggcccagccaccagcccggcuccugccucacggccggccucccggcagccuc

SEQ ID NO: 90855 - RNA, 64 nt, Homo Sapiens
aggucaccugccgcccugugcagcagcucuggcucugccucaggcagguguuccgugggacccu

SEQ ID NO: 90856 - RNA, 64 nt, Homo Sapiens
cucccauagcugggacuacauucacgccauucuccugccucagcugcaagcuccgccucccggg

SEQ ID NO: 90857 - RNA, 64 nt, Homo Sapiens
ugcaaccuccgccucccagguucaagugauucuccugccucauccuccugaguagcugggauua

SEQ ID NO: 90858 - RNA, 64 nt, Homo Sapiens
gcuugucucaaacuccuaaccucaacugauccaccugccucagccucccaaagugccgccggga

SEQ ID NO: 90859 - RNA, 64 nt, Homo Sapiens
cguugccugagaagaaguggcagaguccagugcucugccucagacaacuccaggaaagagcagu

SEQ ID NO: 90860 - RNA, 64 nt, Homo Sapiens
cuuccaacuagcugggacuacucaagcaauccuccugccucagcugcagccucauacuccuggg

SEQ ID NO: 90861 - RNA, 64 nt, Homo Sapiens
ugcaaccucugcccccuggguucaagcgauucuccugccucagccucccuaguagcugggacua

SEQ ID NO: 90862 - RNA, 64 nt, Homo Sapiens
gccagucucaaacuccugaccucaggugauccaccugccucagccucccagacuguugggauua

SEQ ID NO: 90863 - RNA, 64 nt, Homo Sapiens
ccaucccucggggcccaggcccucacccgaagggcugccucacucuguggugucaggcacuggg

SEQ ID NO: 90864 - RNA, 64 nt, Homo Sapiens
uugggggcugcacuaccugcguccguggaagccucugccucagcggggacggccuccugcugca

SEQ ID NO: 90865 - RNA, 64 nt, Homo Sapiens
ucaggaagcacauaaugucuuuguuuccuuacuacugccucaccagacugcuacaugugugaug

SEQ ID NO: 90866 - RNA, 64 nt, Homo Sapiens
uuuucuuucucacuguaaauauguaccaccgcaccugccucacaugaguagccaggacuauggc

SEQ ID NO: 90867 - RNA, 64 nt, Homo Sapiens
acauguccacacccacgucagugcccagggugcccugccucaggagucgccagccagaaacgug

SEQ ID NO: 90868 - RNA, 64 nt, Homo Sapiens
cuccugaguagcugggauuauucaagcgacucuccugccucagcugcaaccuccuucucccagg

SEQ ID NO: 90869 - RNA, 64 nt, Homo Sapiens
uggagggaaaccaaaauuggccaacauucaaauucugccucaucuugaaagagaauuuuuggaa

SEQ ID NO: 90870 - RNA, 64 nt, Homo Sapiens
aggcaccagcaccagggcccguaaagggcugggucugccucagaagccugugaggaucugaaga

SEQ ID NO: 90871 - RNA, 64 nt, Homo Sapiens
gcugguucagcagcacccuccagggucugggcuccugccucaccaaucccaucucgcaggagag

SEQ ID NO: 90872 - RNA, 64 nt, Homo Sapiens
cuccugaguagcugggacuacucaccccauucuccugccucagcugcaagcucugccucccggg

SEQ ID NO: 90873 - RNA, 64 nt, Homo Sapiens
cuccugaguagcuggcauuauucaagcaguucuccugccucagcugcgaccucugccucccagg

SEQ ID NO: 90874 - RNA, 64 nt, Homo Sapiens
ugcaacauccaccucccagguucaagcaauucuccugccucagccucccaaguagcugggauua

SEQ ID NO: 90875 - RNA, 64 nt, Homo Sapiens
gcuagucucgaacuucugaccucaggugauccaccugccucagccucccaaauugcugggauua

SEQ ID NO: 90876 - RNA, 64 nt, Homo Sapiens
gcugcugcuugguggaaguaacaggacguggauucugccucauaaguggcaguuucccuuuucu

SEQ ID NO: 90877 - RNA, 64 nt, Homo Sapiens
cguaucuucuugcuuccaugugucuuuuccccugcugccucacuccccacccccacuugccagg

SEQ ID NO: 90878 - RNA, 64 nt, Homo Sapiens
ucaagagagccugggggucuaacagggagcccggcugccucaccuggccacagccuccacacca

SEQ ID NO: 90879 - RNA, 64 nt, Homo Sapiens
accugccaagucugucaucacugugggguguagccugccucagagggaccugcaaucaccucuc

SEQ ID NO: 90880 - RNA, 64 nt, Homo Sapiens
uggcuguguccccugccugagggcucugugccuccugccucagaugcggccugugccagagagg

SEQ ID NO: 90881 - RNA, 64 nt, Homo Sapiens
ugcagccucgacuucucggggccaagcgauccuccugccucagccuucugaguagcugggacca

SEQ ID NO: 90882 - RNA, 64 nt, Homo Sapiens
ccuaauuuuuuauuucuuguagagaugaggucuccugccucagccucccaaagugcuggaauuu

SEQ ID NO: 90883 - RNA, 64 nt, Homo Sapiens
cuccugaguagcugggauuauucaaacgauucugcugccucagcugcaaccuccaccuccuggg

SEQ ID NO: 90884 - RNA, 64 nt, Homo Sapiens
cauacugaguaaaauaaauaaaugcuaguaaaagcugccucauauggggugugaguccugauua

SEQ ID NO: 90885 - RNA, 64 nt, Homo Sapiens
cuccggaguagcugggacuacuuacaccacuguccugccucagcagcuccgccucccggguuua

SEQ ID NO: 90886 - RNA, 64 nt, Homo Sapiens
cucccaaagugcugggauuacucaggugauccaccugccucagcgcuggucucaaauuccuggc

SEQ ID NO: 90887 - RNA, 64 nt, Homo Sapiens
cucccaaguagcugggauuauucaagcgauucuccugccucagcugcacccuccaccucccagg

SEQ ID NO: 90888 - RNA, 64 nt, Homo Sapiens
cucccaaaguucugggauuacccaggugaucugccugccucagcgcucguaucaaacccuugac

SEQ ID NO: 90889 - RNA, 64 nt, Homo Sapiens
cucccuaguagcugggauuauucaagugguucuccugccucagcugcagccuccgccuccuggg

SEQ ID NO: 90890 - RNA, 64 nt, Homo Sapiens
ccuggucucaaacuccugaccucaggugauccaccugccucagccucccaaagugcugggauua

SEQ ID NO: 90891 - RNA, 64 nt, Homo Sapiens
ugcaaccucugccucccgaguucaagcaauucuccugccucagccucccgaguagcugggauua

SEQ ID NO: 90892 - RNA, 64 nt, Homo Sapiens
aaggagaggcccugggggacccucugaagcauuucugccucacuuuaugucaucugcuucuccc

SEQ ID NO: 90893 - RNA, 64 nt, Homo Sapiens
ggccuugggggucugggcugggcauccauggucacugccucagcccagccaggcugugccuuug

SEQ ID NO: 90894 - RNA, 64 nt, Homo Sapiens
ugcaacagucucaugggucaccacguggggagggcugccucagcagguuucucagaccacggag

SEQ ID NO: 90895 - RNA, 64 nt, Homo Sapiens
cggcucacugcaaccucugucucaagcgauucuccugccucagccuccugaguagcugggauua

SEQ ID NO: 90896 - RNA, 64 nt, Homo Sapiens
gagcuguuguauagaucccacucauaugauuguccugccucauggguguaauucagcauaaaac

SEQ ID NO: 90897 - RNA, 64 nt, Homo Sapiens
uucccgaguagcugggacuauucacgccauucuccugccucagcugcaggcucugccuccuggg

SEQ ID NO: 90898 - RNA, 64 nt, Homo Sapiens
ggcucccagccacagguucccucuucugcugccccugccucaugaggucccaaccgucucugcc

SEQ ID NO: 90899 - RNA, 64 nt, Homo Sapiens
cucaccaaaguguugggauucuuaaaugacucuucugccucagcgcuggucucgaacuccuggg

SEQ ID NO: 90900 - RNA, 54 nt, Homo Sapiens
accagagaguggccagcuaagagccugccucaccccuuaccaaugagggcaggg

SEQ ID NO: 90901 - RNA, 64 nt, Homo Sapiens
ugugagggaaauagggaccccccgacuugcccuccugccucagucuuucccccacccugucucu

SEQ ID NO: 90902 - RNA, 64 nt, Homo Sapiens
acugcaccaauucuugauuugggcccugugcugccugccucauaguaucugccuuggucuugcu

SEQ ID NO: 90903 - RNA, 64 nt, Homo Sapiens
agcgcugaguuggguuugugacucuucccucucccugccucacaggauugugacuccccagccc

SEQ ID NO: 90904 - RNA, 64 nt, Homo Sapiens
ucagcagaaguaacugaaguagaucaggaaggggcugccucaggaaaauuccuagauccuagga

SEQ ID NO: 90905 - RNA, 64 nt, Homo Sapiens
uaaucagugucagugaauccacagucuuuacuuccugccucauaaagggccaggucuccccagu

SEQ ID NO: 90906 - RNA, 64 nt, Homo Sapiens
cacaaucgcugccuccuggguucaagcaauucuccugccucagccucccgaguagcugggacua

SEQ ID NO: 90907 - RNA, 64 nt, Homo Sapiens
ugcagccucagacuccuggguucaagcaauccuccugccucagccucccaaguagcugagacua

SEQ ID NO: 90908 - RNA, 64 nt, Homo Sapiens
gcuggucuugaacucuuggccucaaguaauccuccugccucagccucccaaaguguugggauug

SEQ ID NO: 90909 - RNA, 64 nt, Homo Sapiens
ugcaaccucugccucccgaguucaagcaauucuccugccucagccuccugaguagcugggauua

SEQ ID NO: 90910 - RNA, 64 nt, Homo Sapiens
ggcuggucucaaacuucugaccucaaaugauugccugccucagccucccaaagugcugggauua

SEQ ID NO: 90911 - RNA, 64 nt, Homo Sapiens
uguggccggaugcuuccaacuuugucagucuuuucugccucaacuucuuccagacaucagucac

SEQ ID NO: 90912 - RNA, 64 nt, Homo Sapiens
ucaagaaccuguauauguguuguguuagaggcaucugccucaagucuauguacaguguuugcug

SEQ ID NO: 90913 - RNA, 64 nt, Homo Sapiens
augcuucgaaaggcagcuucagagcaggcacagccugccucagccccaggcagugccuagcucc

SEQ ID NO: 90914 - RNA, 64 nt, Homo Sapiens
uccagcaccuguaggaacucuccagaggacaagccugccucaccguucaagggccugaggcaga

SEQ ID NO: 90915 - RNA, 64 nt, Homo Sapiens
caaacaggguaucacgcuugguucagacccacagcugccucaaguagcgaguggcgggccuggg

SEQ ID NO: 90916 - RNA, 64 nt, Homo Sapiens
ccuaacccgaggcuguguggaaggagucccugcucugccucagcgccaggccagccccaucugg

SEQ ID NO: 90917 - RNA, 64 nt, Homo Sapiens
gcucaaccaauaacuauugcacaaccaucugucccugccucaguucccucuucuguaacaugaa

SEQ ID NO: 90918 - RNA, 64 nt, Homo Sapiens
caacccacucuuuuuucccaccacccacucuccucugccucaguaaguaucuggaggaagaaaa

SEQ ID NO: 90919 - RNA, 64 nt, Homo Sapiens
aacuugguauugagcacguaaagcacagaucgcacugccucaaugaagcuucuacuccugcagu

SEQ ID NO: 90920 - RNA, 64 nt, Homo Sapiens
cccauuuugcugaaaauaaugcaaccuggauuuucugccucagcacuccuuuuuucccaguccu

SEQ ID NO: 90921 - RNA, 64 nt, Homo Sapiens
cuccagaguaucugggauuagcucaagugauccucugccucagcagccggucucaaacuccuga

SEQ ID NO: 90922 - RNA, 64 nt, Homo Sapiens
cuccccaguagcuggaacuaucaagccaucccuccugccucagcgcauccuccaguuccugggu

SEQ ID NO: 90923 - RNA, 64 nt, Homo Sapiens
gaccuaaccucuuucuucucucaccuauauuuaacugccucagugcugcuuaugucuaaaggga

SEQ ID NO: 90924 - RNA, 64 nt, Homo Sapiens
cuccugaguagcugggauuauuaaaagaauucuccugccucagcugcaaccuccgccucuuggg

SEQ ID NO: 90925 - RNA, 64 nt, Homo Sapiens
cucccaaagugcugggauuacucaagugaucugccugccucagcguuggucucgaacuccugac

SEQ ID NO: 90926 - RNA, 64 nt, Homo Sapiens
cuccugaguagcugggaauauucaagcaauucuccugccucagcugcaaccuucaccuccuggg

SEQ ID NO: 90927 - RNA, 64 nt, Homo Sapiens
uaguggagggggccuucagcccucugcacccugccugccucacaccccgccuucaggagcccuc

SEQ ID NO: 90928 - RNA, 64 nt, Homo Sapiens
cagagguggggaugggcagagagggcuggccacucugccucaggacuugaccucaaguguucug

SEQ ID NO: 90929 - RNA, 64 nt, Homo Sapiens
ugcaaccucagccuccuggauuuaagugauucuccugccucagccucccaaguagcugggauua

SEQ ID NO: 90930 - RNA, 64 nt, Homo Sapiens; identical to SEQ ID NO: 90811

SEQ ID NO: 90931 - RNA, 64 nt, Homo Sapiens
uggcuggcugcugugugccugguuuccucacauccugccucagcuucaccacccuggcuuaugu

SEQ ID NO: 90932 - RNA, 64 nt, Homo Sapiens
uaacuuuuauacuuugugcaggucgcggcgcuuccugccucauccucggcugcauggggcgggg

SEQ ID NO: 90933 - RNA, 64 nt, Homo Sapiens
ugcaaccucugccucccugguucaagugauucuccugccucauccucccaagaagcugagauua

SEQ ID NO: 90934 - RNA, 64 nt, Homo Sapiens
gcuggucuugaacuccugaccucaggugauccaccugccucagccucccaaagugcugagauua

SEQ ID NO: 90935 - RNA, 64 nt, Homo Sapiens
uacaaccuccgccucccauguucaagcgauucuccugccucagccucccgaguagcugggacua

SEQ ID NO: 90936 - RNA, 64 nt, Homo Sapiens
cagucccuccacauuucccccuagccugccuccccugccucaccagcccuggcaacugcuaauc

SEQ ID NO: 90937 - RNA, 64 nt, Homo Sapiens
cucccaaguagcugggauuauucaagcaguucuccugccucagcugcaaccucugccuccuggg

SEQ ID NO: 90938 - RNA, 64 nt, Homo Sapiens
gcucaguuuauugaagacauguuuuuuuuuuguucugccucaaauagagagguuuuagauuuuu

SEQ ID NO: 90939 - RNA, 64 nt, Homo Sapiens
ugaccuccccgccagcuggacuccagccauccuccugccucagcuucccagauagcugggccac

SEQ ID NO: 90940 - RNA, 64 nt, Homo Sapiens
ugcaagcuccgccucccagguucacaccauucuccugccucagccuccccaguagcugggacua

SEQ ID NO: 90941 - RNA, 64 nt, Homo Sapiens
ugcagccuccauccucuggguucaagcaauucuccugccucaggcuccugaguagcugggauua

SEQ ID NO: 90942 - RNA, 64 nt, Homo Sapiens
ugcaaccucugucuccuggguucaaacgauccuacugccucauccuucggaguagcugggauua

SEQ ID NO: 90943 - RNA, 64 nt, Homo Sapiens
ugcaaccucugccuccuaaguucaggcgauucuccugccucagcuucccgaguaacugagauua

SEQ ID NO: 90944 - RNA, 64 nt, Homo Sapiens
gcuggucucaaacuccugaccucaggugaucuaccugccucagccucccaaagugcugagauua

SEQ ID NO: 90945 - RNA, 64 nt, Homo Sapiens
cuccgaaguagcugggauuauucaagagauucuccugccucagccgcaaccuccgccucccagg

SEQ ID NO: 90946 - RNA, 64 nt, Homo Sapiens
cuccugagcagcugggauuauucaagcgauucuccugccucagcugcaaccuccaccucccagg

SEQ ID NO: 90947 - RNA, 64 nt, Homo Sapiens
gaagagagaaccugaagaucauguagaagcuuagcugccucagauaaaggaaacuucaugaagg

SEQ ID NO: 90948 - RNA, 64 nt, Homo Sapiens
uuggagguuuuaucagccaagagcgacacugucccugccucaggucauguuucugcaugucagc

SEQ ID NO: 90949 - RNA, 64 nt, Homo Sapiens
gauuucaagaaggaaauaaauccacuccucucaacugccucagcccagcccugcccacccuccc

SEQ ID NO: 90950 - RNA, 64 nt, Homo Sapiens
uaccuaaugauuccgcgcggcgcauucagugcaccugccucagcagacacagaaccaacaaaac

SEQ ID NO: 90951 - RNA, 64 nt, Homo Sapiens
uguacccuugaacuccugggcucaagugauccuccugccucagccuccuuaguagcugggacua

SEQ ID NO: 90952 - RNA, 64 nt, Homo Sapiens
gcugaucuugaauucccgggcucaagugguccuccugccucagccucccacaggaucgggauua

SEQ ID NO: 90953 - RNA, 64 nt, Homo Sapiens
uccugucuugcugagcccucaucucucugugauucugccucagccgggggcagagauaagggcc

SEQ ID NO: 90954 - RNA, 64 nt, Homo Sapiens
cucccaaguagcugggauuauucaagcaauuauccugccucaggugcaaccuccaccucccagg

SEQ ID NO: 90955 - RNA, 64 nt, Homo Sapiens
cucccgaguagcuggaauuauucaagugauucuccugccucagcugcaacccccgccccccggg

SEQ ID NO: 90956 - RNA, 64 nt, Homo Sapiens
uaaccaaguagcugggacuaggguucaagcaacccugccucagccacuacagccuccaacucuu

SEQ ID NO: 90957 - RNA, 64 nt, Homo Sapiens
cucccuaguagcugggauuauucaagugauucuccugccucagcugugcccuucaccuucuggg

SEQ ID NO: 90958 - RNA, 64 nt, Homo Sapiens
cucccgaguagcugggauuguucaagcgacucuccugccucagcugcaaccuccaccucccuga

SEQ ID NO: 90959 - RNA, 64 nt, Homo Sapiens
cucccgaguagcugucuuuaacuaaacgauucuccugccucagcuuauaauagcccuucccaaa

SEQ ID NO: 90960 - RNA, 64 nt, Homo Sapiens
acacaucagagaaugacuguguugagaaucauggcugccucaccaacccauaugccccucugaa

SEQ ID NO: 90961 - RNA, 64 nt, Homo Sapiens
cggccaggccugcagacccagacuccagccagaccugccucacccaccaaugcagccggggcug

SEQ ID NO: 90962 - RNA, 64 nt, Homo Sapiens
gccucagccaggcagcccaccccacccuggggcccugccucaccaaggaaauaaagacucaagc

SEQ ID NO: 90963 - RNA, 64 nt, Homo Sapiens
uaugaguguaaggaaugugggaaagccuucagaucugccucacaccuucaaauucaugaaagga

SEQ ID NO: 90964 - RNA, 64 nt, Homo Sapiens
uaugaguguaagcaaugugggaaagccuucagaucugccucaauccuucaaaugcaugcuggga

SEQ ID NO: 90965 - RNA, 64 nt, Homo Sapiens
ugcaaccuccaucuccggggcucaagcgcuucuccugccucagccuccugaguagcugggauua

SEQ ID NO: 90966 - RNA, 64 nt, Homo Sapiens
ugcaaccuccaccucccggguucaagugauucuccugccucagccucuugaguagcugggacua

SEQ ID NO: 90967 - RNA, 64 nt, Homo Sapiens
ugcaaccuccacccccggggaucaagcaacucuccugccucagccucccuaguagcugggauua

SEQ ID NO: 90968 - RNA, 64 nt, Homo Sapiens
ugcaaccuccacauccuggguucaagugauucuccugccucagccucuggaggagcugguauca

SEQ ID NO: 90969 - RNA, 64 nt, Homo Sapiens
ugcaagcuccgccucccggguucacgccauucuccugccucagccuccugaguagcugggacua

SEQ ID NO: 90970 - RNA, 64 nt, Homo Sapiens
aggauggucucgaucuccugaccuccugaugcgccugccucagccucccagugcugggauuaua

SEQ ID NO: 90971 - RNA, 64 nt, Homo Sapiens
ugcaaccuccgccuccuggguuccaacgauucuccugccucagccucccgaguagcugggccua

SEQ ID NO: 90972 - RNA, 64 nt, Homo Sapiens
ugcaaccuccgccucccggguucaagcaauucuccugccucagccucccaaguagcugggauua

SEQ ID NO: 90973 - RNA, 64 nt, Homo Sapiens
acuggucucaaacuccugaccucaggcgauccaucugccucagccugaaagugcuaggauuaca

SEQ ID NO: 90974 - RNA, 64 nt, Homo Sapiens
ugcagccuccaccuccuggguucaagcgauucuccugccucagccucccgaguagcugggauua

SEQ ID NO: 90975 - RNA, 64 nt, Homo Sapiens
gcugguuuggaacuccugacuucaaauuacccaccugccucagccucccaaagugcuggcauua

SEQ ID NO: 90976 - RNA, 64 nt, Homo Sapiens
cugcaaccucugccucccggguucaagcaauuaacugccucagcuucccuaguaauggauuaca

SEQ ID NO: 90977 - RNA, 64 nt, Homo Sapiens
ugcaaccuccgccuccuggguucaagcgauucuccugccucagccuccugaguagcugggauua

SEQ ID NO: 90978 - RNA, 64 nt, Homo Sapiens
ugcaaccucugccucccaaguucaacugauucuucugccucagccucccgaguagcagggauua

SEQ ID NO: 90979 - RNA, 64 nt, Homo Sapiens
caggcuuguuaugaacugaccucaagugaucugccugccucagcuucucaggugugaccuacug

SEQ ID NO: 90980 - RNA, 64 nt, Homo Sapiens
cucaauaaauaaauuaauugcccuccccgcuucccugccucaccagagaggucaccccuacccu

SEQ ID NO: 90981 - RNA, 64 nt, Homo Sapiens
ccccucagccccugccgacccccaugcauccucccugccucacuucucucugauucccacaggc

SEQ ID NO: 90982 - RNA, 64 nt, Homo Sapiens
cucccgaguagcugggacucuucaagcgauucuccugccucagcugcaacuuccgccucccggg

SEQ ID NO: 90983 - RNA, 64 nt, Homo Sapiens
cucacgaguagcuggaauuauucaagugauucuccugccucagcugcaaccucugccucccggg

SEQ ID NO: 90984 - RNA, 64 nt, Homo Sapiens
cucaguagcugggauuauuguuccagugauucuccugccucacccgcaaccuccaccuccugag

SEQ ID NO: 90985 - RNA, 64 nt, Homo Sapiens
uuggugauuagauuccuaaggucaguacugcaggcugccucaccgaagggucauggauggugag

SEQ ID NO: 90986 - RNA, 64 nt, Homo Sapiens
cuccugaguagcugggacuauucacgccauucuccugccucagcaagcuccgccuccucccggg

SEQ ID NO: 90987 - RNA, 64 nt, Homo Sapiens
cuccaaaguagcugggauuauucaagcgauucuccugccucagcagcaaccucugccuccuggg

SEQ ID NO: 90988 - RNA, 64 nt, Homo Sapiens
cuccugaguagcugggacuauucaagcaauucuccugccucagcugcaaccuccacuucucagg

SEQ ID NO: 90989 - RNA, 64 nt, Homo Sapiens
cucccgaguagcugggacuauucacgccauucuccugccucagcugcaagcuccgccuccuggg

SEQ ID NO: 90990 - RNA, 64 nt, Homo Sapiens
cccccuaguagcuggcauuaaggucaaagcaauccugccucagguggcgcaaccucugccuccc

SEQ ID NO: 90991 - RNA, 64 nt, Homo Sapiens
cuuccaaguagcugggauuauucaagcaauucuucugccucagcggcucacuguaaccucuggg

SEQ ID NO: 90992 - RNA, 64 nt, Homo Sapiens
cucccaaagugcuuggauuacucauaugauccaccugccucagcgcugguuucaaacuccugac

SEQ ID NO: 90993 - RNA, 64 nt, Homo Sapiens
cucccaaguagcugggauuauucaagcaauuauccugccucagcugcaaccucugccuuccagg

SEQ ID NO: 90994 - RNA, 64 nt, Homo Sapiens
cuccuaaguagcugggauuauucacgcaauucuccugccucagcuguaaccuccaccuccuggg

SEQ ID NO: 90995 - RNA, 64 nt, Homo Sapiens
cucuugaguagcugggauuauucaagugguucuccugccucagcugcaaccucugccucacagg

SEQ ID NO: 90996 - RNA, 64 nt, Homo Sapiens
gguucaagugguucuccugcgcucacugcaaccucugccucacaagugcaauggcacaaucuug

SEQ ID NO: 90997 - RNA, 64 nt, Homo Sapiens
cucccaaaguucugggauuaacuucaugguccgccugccucagcacuguggucucaaucuccug

SEQ ID NO: 90998 - RNA, 64 nt, Homo Sapiens
cuccugaguagcugggacuauucacaccauucuccugccucagcugcaagcuccgccuccuggg

SEQ ID NO: 90999 - RNA, 64 nt, Homo Sapiens
gguuucaaaucucuccuuucccucuccacccguucugccucaguccaaauuccccuaaagguuc

SEQ ID NO: 91000 - RNA, 64 nt, Homo Sapiens
ccuaagaagcacucucccuuugcuccucucuguccugccucagggugacagugucaaggaaccc

SEQ ID NO: 91001 - RNA, 64 nt, Homo Sapiens
ggcuguggaggaggccccucggucagggagcggccugccucaccccugaauagcuccuucggcc

SEQ ID NO: 91002 - RNA, 64 nt, Homo Sapiens
gguaaccucugccucccagguucaagcgagucuccugccucagccuucugaguagcugggauua

SEQ ID NO: 91003 - RNA, 64 nt, Homo Sapiens
cgcaaccuccgccucccggguucaagcgauucuccugccucagccucccaaguagcugggauua

SEQ ID NO: 91004 - RNA, 64 nt, Homo Sapiens
gcuggucucaaacucccgaccucaaguagucugccugccucaaccucccaaagugcugggauua

SEQ ID NO: 91005 - RNA, 64 nt, Homo Sapiens
cucccaaagugcugggauuacucaggugauccaccugccucagcgcuggucucaaacuccugac

SEQ ID NO: 91006 - RNA, 64 nt, Homo Sapiens
cucccgaguagcugagacuauucaagcgauucuccugccucagcugcaaccucugcccccuggg

SEQ ID NO: 91007 - RNA, 64 nt, Homo Sapiens
uucccaaguagcugagauuauuuaagcaaugcuucugccucagccacaaccuccaccuccuggg

SEQ ID NO: 91008 - RNA, 64 nt, Homo Sapiens
cuccugaguagcugggacuauucacaccauucuccugccucagcugcaagcucugccucccgug

SEQ ID NO: 91009 - RNA, 64 nt, Homo Sapiens
guggcugggaagggaaggaaguggcaacccucagcugccucaucggaggacagagccgguuucc

SEQ ID NO: 91010 - RNA, 64 nt, Homo Sapiens
caccaagcuuuuuccuaccacucaaaacuggccacugccucagcuucauggggggucagcuggu

SEQ ID NO: 91011 - RNA, 64 nt, Homo Sapiens
aaaaacacugaauaaccaagagcgcuccagcuagcugccucauccaacaaauucugcauggucc

SEQ ID NO: 91012 - RNA, 64 nt, Homo Sapiens
ggaccaguccagcuuccagccgcuggugcuccuucugccucauguccccacaccacccagcagg

SEQ ID NO: 91013 - RNA, 64 nt, Homo Sapiens
agcaccaguugacugcucguaugugguguuuggccugccucagccuuggaagcuugaauuauaa

SEQ ID NO: 91014 - RNA, 64 nt, Homo Sapiens
ugcagucuccgccuccugaguucaagcgauucuccugccucagccucccaaguagcugggacug

SEQ ID NO: 91015 - RNA, 64 nt, Homo Sapiens
uguuuuucacacuaaacauaugaaugcagcacugcugccucagcucagcuucgugccuggguuc

SEQ ID NO: 91016 - RNA, 64 nt, Homo Sapiens
uaagacuaaugcuuucuguggacaccacugagcucugccucaacuccacccucugcgaccggag

SEQ ID NO: 91017 - RNA, 64 nt, Homo Sapiens
ugcaaccucugccucccagguugaagcgauucuccugccucagccucccaaguagcugggauua

SEQ ID NO: 91018 - RNA, 64 nt, Homo Sapiens
ugcaagcuuccccuuccggguucaugccauucuccugccucagccucccgaguagcugggacua

SEQ ID NO: 91019 - RNA, 64 nt, Homo Sapiens
uccagcuguuaccagcuucugagcuagagcuguacugccucacguacacccccaccucuguaaa

SEQ ID NO: 91020 - RNA, 64 nt, Homo Sapiens
ugcaaccuccaccuccugaguucaagcaauucuccugccucagccucccaaguagcugggacua

SEQ ID NO: 91021 - RNA, 64 nt, Homo Sapiens
ugcaaccuccgccucccagguacaagagauucuccugccucagccucccgaguagcugggacua

SEQ ID NO: 91022 - RNA, 64 nt, Homo Sapiens
gcaccagagugaacagggcaaucaaucacugaaccugccucaugcucugcagcaggcaagacca

SEQ ID NO: 91023 - RNA, 64 nt, Homo Sapiens
gugguugggagucugaccagauccagguaagggccugccucagcagagggaggcccaugaggcc

SEQ ID NO: 91024 - RNA, 64 nt, Homo Sapiens
ucagguggcagcggacucugacuccacugaggaacugccucagaagcugcgaucacaacuuugg

SEQ ID NO: 91025 - RNA, 64 nt, Homo Sapiens
ucagaagcugcgaucacaacuuuggcugaagccccugccucacucuagggcaccugaccuggcc

SEQ ID NO: 91026 - RNA, 64 nt, Homo Sapiens
cucccaaagugcugggauuauucaagcaauucuccugccucagccguaaccucugccuccugac

SEQ ID NO: 91027 - RNA, 64 nt, Homo Sapiens
cuccaaguagcugggacuacuucaggcgauucuccugccucagcugcaaccuccgccucccagg

SEQ ID NO: 91028 - RNA, 64 nt, Homo Sapiens
ugaugauuuguauacaguggucuauccugggugccugccucaugcugcagugugagcugcugcc

SEQ ID NO: 91029 - RNA, 64 nt, Homo Sapiens
aagcuguaacagaauggguucccucacucaguuucugccucacauacccucugcuacccacuag

SEQ ID NO: 91030 - RNA, 63 nt, Homo Sapiens
acgaaagcccuacauugagcuccaaucugcucggggugggacgggugcuucccacaccucugg

SEQ ID NO: 91031 - RNA, 63 nt, Homo Sapiens
agugggucuccauuccccgagaagccgggggcagggugggauggggaagaccaggagcagagu

SEQ ID NO: 91032 - RNA, 63 nt, Homo Sapiens
ccuugcugauuugauauuuuuggucauggagaagggugggauugggugggaaugggguggaag

SEQ ID NO: 91033 - RNA, 63 nt, Homo Sapiens
uugauauuuuuggucauggagaagggugggauugggugggaaugggguggaagggugaugggg

SEQ ID NO: 91034 - RNA, 63 nt, Homo Sapiens
cuuuagaugggaaagugaggggcuugagaaagugggugggaggagggaaggauuuuuuaggag

SEQ ID NO: 91035 - RNA, 63 nt, Homo Sapiens
accuuuuguaccuuucuuuggggaauggggugggggugggagaggagguagauggggaagaaa

SEQ ID NO: 91036 - RNA, 63 nt, Homo Sapiens
cuuuuguuaacacuauuaaugggguggggaauagggugggaguggggguuugggagacgggug

SEQ ID NO: 91037 - RNA, 63 nt, Homo Sapiens
ggggaauagggugggaguggggguuugggagacgggugggaaagggugguuggggggaccgau

SEQ ID NO: 91038 - RNA, 63 nt, Homo Sapiens
cagaaaugcucaaauggguacaaccaucaccaagggugggaugggagggcagaggggaaauaa

SEQ ID NO: 91039 - RNA, 63 nt, Homo Sapiens
gaauguuccuaaagaacugcugccccacagugagggugggagcagcggaacagggaaugccag

SEQ ID NO: 91040 - RNA, 63 nt, Homo Sapiens
ugccagacacaggcucgcugcugcuggaaggcggggugggacuuccuuccucuguccggagag

SEQ ID NO: 91041 - RNA, 63 nt, Homo Sapiens
aggcggggcuacagauugggcggggcuucucuugggugggacagggcuucuccugcgggggcg

SEQ ID NO: 91042 - RNA, 63 nt, Homo Sapiens
accaggcuccaauggggcggggcuucucuccgcgggugggacucuucccugggaaccgcccuc

SEQ ID NO: 91043 - RNA, 63 nt, Homo Sapiens
uaccgcaggugcaucgcguccgugacuucgccugggugggaugccccucuucugcgucuguuc

SEQ ID NO: 91044 - RNA, 63 nt, Homo Sapiens
cucggggcccagggguggagccggcuccucagcgggugggaacuggcgcguuucucggagcuc

SEQ ID NO: 91045 - RNA, 63 nt, Homo Sapiens
uuucuccaagccugcuuugugcuucucaccuuugggugggaugccuugccagugugucuuacu

SEQ ID NO: 91046 - RNA, 63 nt, Homo Sapiens
gccagcgcagcguucugggcuccucagucgcaggggugggaugugagucaugcggauuaucca

SEQ ID NO: 91047 - RNA, 63 nt, Homo Sapiens
gugucuuuacuauguccuagaguggccugcugggggugggaggccccagcucuugaagggcug

SEQ ID NO: 91048 - RNA, 63 nt, Homo Sapiens
gugagcaaagggagcagaaaauuccgaaggguagggugggaagacugcccccugcuugaauug

SEQ ID NO: 91049 - RNA, 63 nt, Homo Sapiens
caugccuuccucccccuauugguggacucagaugggugggacacaucucucucuccuuccugg

SEQ ID NO: 91050 - RNA, 63 nt, Homo Sapiens
gguggugcuuaaaagaggaagccccugaggguggggugggacgccugggccaagcugacacca

SEQ ID NO: 91051 - RNA, 63 nt, Homo Sapiens
cuucuuccucaaguuucggcguucuugugcuaugggugggaguuggcccagacaguauuugca

SEQ ID NO: 91052 - RNA, 63 nt, Homo Sapiens
ugagaggcccuggcucuggccaggcugggaucugggugggaggcuggggcucuucuucuucca

SEQ ID NO: 91053 - RNA, 63 nt, Homo Sapiens
ggggagaaaacgggaggugcucgugcuggcccugggugggagcggggaguccuggugagaccc

SEQ ID NO: 91054 - RNA, 63 nt, Homo Sapiens
ugggcuggggccuuccuccagggaaggaggcuggggugggaacacuggccucccccagaauaa

SEQ ID NO: 91055 - RNA, 63 nt, Homo Sapiens
gagcugggcuggccaguacagccaguggggagugggugggaggcaccaaaacuuggcagcugu

SEQ ID NO: 91056 - RNA, 63 nt, Homo Sapiens
ucucugacggugcucguucauuucuguacgugugggugggaauguuguaauauaaaaacugug

SEQ ID NO: 91057 - RNA, 63 nt, Homo Sapiens
gcugccucagccaagcugagaacacgcagccaggggugggaaagguuuacagaccagggaccg

SEQ ID NO: 91058 - RNA, 63 nt, Homo Sapiens
aaaggaaagaagcaacagucauuuuuauguugugggugggagguuuugcaacuggguaucuua

SEQ ID NO: 91059 - RNA, 63 nt, Homo Sapiens
aucacuugagcccaggagguucucaggaggcuggggugggaagacaugccuguagucccagcu

SEQ ID NO: 91060 - RNA, 63 nt, Homo Sapiens
uggaaaagaaggcagccuagguggagggcucaugggugggacacaggcuuacugagcugucca

SEQ ID NO: 91061 - RNA, 63 nt, Homo Sapiens
agaugaaaauaucagcuuuugggagggggagaugggugggaggugcucagcacauauuugcau

SEQ ID NO: 91062 - RNA, 63 nt, Homo Sapiens
aggaagaaagggaagaauuaaagcaggcggguugggugggagguugccaaggcucaucuugag

SEQ ID NO: 91063 - RNA, 63 nt, Homo Sapiens
aggaagaaagggaagaauuaaagcaggcggguugggugggagguugaguuuguugccacugag

SEQ ID NO: 91064 - RNA, 63 nt, Homo Sapiens
acugucccucuggggacguggccagggguuccugggugggaggccgguggugcuuucugggca

SEQ ID NO: 91065 - RNA, 63 nt, Homo Sapiens
acagguuucuaguuuuuaccaaagcaaaggccugggugggagaccgucagcuugauaauuacu

SEQ ID NO: 91066 - RNA, 63 nt, Homo Sapiens
ugagggccccaauguauguguggcugugggugugggugggagugugucugcugaguaaggaac

SEQ ID NO: 91067 - RNA, 63 nt, Homo Sapiens
cggaaacauacagaggaugccuuuucugugauugggugggauuuuuucccuuuuuauguggga

SEQ ID NO: 91068 - RNA, 63 nt, Homo Sapiens
gaagaguuuagaaugaggcagcggugagaagaagggugggagggcgugggggccccugggugg

SEQ ID NO: 91069 - RNA, 63 nt, Homo Sapiens
uuuuucaauccuccacucuaagugauuccuccagggugggaagcacggggagcaauggaauca

SEQ ID NO: 91070 - RNA, 63 nt, Homo Sapiens
cauugucgucuuuucuauugaggguugggauuugggugggagaggaaagcaaauuuuauuuuc

SEQ ID NO: 91071 - RNA, 63 nt, Homo Sapiens
ggauaguggcagggguggggguugcuaaggaaagggugggaugggaguggguaaagaguuugg

SEQ ID NO: 91072 - RNA, 63 nt, Homo Sapiens
gaggggaaaggcaaaugcaggagcagggguggggggugggaggugauggggaagcugcuggag

SEQ ID NO: 91073 - RNA, 63 nt, Homo Sapiens
gaaggcuggggguuuuguaauuuuggugggguugggugggaaguuuuuaaggggguaguuuua

SEQ ID NO: 91074 - RNA, 63 nt, Homo Sapiens
aaacauguuuuggggggggagcaaaaaagaggugggugggaugcuguuuuuaggucugggagg

SEQ ID NO: 91075 - RNA, 63 nt, Homo Sapiens
agaaauucuugagcaaauuuggacuuguggggugggugggacccaguugggaaaggaaagcca

SEQ ID NO: 91076 - RNA, 63 nt, Homo Sapiens
uaagucaguugcagcuguaauuuuuaccuucaggggugggagcuuuuauuuuccagaacucau

SEQ ID NO: 91077 - RNA, 63 nt, Homo Sapiens
ugguuugacuuuuuuucccugagggugagggaugggugggaagagaggacaucuguccagucu

SEQ ID NO: 91078 - RNA, 63 nt, Homo Sapiens
accguuggcauuaucaggauucguguuuugugggggugggaguggagaguaggguggucuugu

SEQ ID NO: 91079 - RNA, 63 nt, Homo Sapiens
aaagaggcuuuugggccaaaaugugaggguggugggugggaugggcagggaaggaauccuggu

SEQ ID NO: 91080 - RNA, 63 nt, Homo Sapiens
ggaagggcgggcaaggaguggggagggagucuggggugggagggaggcaucugcaugggucuu

SEQ ID NO: 91081 - RNA, 63 nt, Homo Sapiens
auggaugcaacugaagcagaggaguugaauuuggggugggaggaagucuuuuguauuggguca

SEQ ID NO: 91082 - RNA, 63 nt, Homo Sapiens
aacaaaggcaauggugaaaagccaggagcugaagggugggaaccugauuccucugcugucccu

SEQ ID NO: 91083 - RNA, 63 nt, Homo Sapiens
gggauggggguguguuuuaugggguucuggauagggugggacacuuuugauguuccuauugug

SEQ ID NO: 91084 - RNA, 63 nt, Homo Sapiens
gcccccaccuccauccauuuaaauuaucagucugggugggaaauauuccccuaaaaugucuau

SEQ ID NO: 91085 - RNA, 63 nt, Homo Sapiens
uccucccucagagcuggggcagcugccucccaggggugggacucugggcucagagagaggccc

SEQ ID NO: 91086 - RNA, 63 nt, Homo Sapiens
cugacaugcucgggaaagggcagaggucacugggggugggaaggucauccaguccagacucag

SEQ ID NO: 91087 - RNA, 63 nt, Homo Sapiens
gaaaagagagguaguuuagaacucucugcauaggggugggaauuaaucaaaaaccucagaggc

SEQ ID NO: 91088 - RNA, 63 nt, Homo Sapiens
auuaagcacacaaaugcuaaggcagaauuuugagggugggagagaagaaaagggaaagaagcu

SEQ ID NO: 91089 - RNA, 63 nt, Homo Sapiens
ugggaaguaacaguacuuagcacucuugguggugggugggaggguggguacaggccagggaua

SEQ ID NO: 91090 - RNA, 63 nt, Homo Sapiens
cacaauagccugaaugggauuucagguuaggcagggugggaggggaggcucucuggcuuuagu

SEQ ID NO: 91091 - RNA, 63 nt, Homo Sapiens
cuggcuuggguguggcugaggcaccacugcaaggggugggagcgucugcugggcugccaggcg

SEQ ID NO: 91092 - RNA, 63 nt, Homo Sapiens
cugucugcugggcugccaggggucugccgaugggggugggagcgggcgcagguggaggggaca

SEQ ID NO: 91093 - RNA, 63 nt, Homo Sapiens
ccauguuuucauuuccuuuugcccaaaugagcggggugggaagaggguuagucuuaugugagc

SEQ ID NO: 91094 - RNA, 63 nt, Homo Sapiens
cuguccugccuucuuucccucugcgaggcaguggggugggauucagagugcuuagucugcuca

SEQ ID NO: 91095 - RNA, 63 nt, Homo Sapiens
caggucuguagucuuugggucuuugggaggccagggugggaggaucacuugagcucaggaguu

SEQ ID NO: 91096 - RNA, 63 nt, Homo Sapiens
ggcucagguggggucacucuggcagcucagagagggugggagugggcccaaugcacuuuguuc

SEQ ID NO: 91097 - RNA, 63 nt, Homo Sapiens
uucuggcucuuccaggcugggagagccuuccaggggugggacacccugugauggggcccugcc

SEQ ID NO: 91098 - RNA, 63 nt, Homo Sapiens
uugcauaagaccagggggaagagugucagcguggggugggaauucccgcggccuccaccugcu

SEQ ID NO: 91099 - RNA, 63 nt, Homo Sapiens
aggggagggccagauggcauccuggcuuggggcgggugggaccuacccaggcucugagacuuu

SEQ ID NO: 91100 - RNA, 63 nt, Homo Sapiens
uggggagcuggucugccucagagacagaguagggggugggagcagagccucggugagggucuu

SEQ ID NO: 91101 - RNA, 63 nt, Homo Sapiens
cucuucccuuugagaagauauuuucccacaaaggggugggaagccaggagugagaaggaauuc

SEQ ID NO: 91102 - RNA, 63 nt, Homo Sapiens
uugaccaucguccuuccucucaagcuagccagagggugggagccuaaggaagcgugggguagc

SEQ ID NO: 91103 - RNA, 63 nt, Homo Sapiens
uagggaggugggguacauuucucugagcagucagggugggaagaaagaaugcaagaguggacu

SEQ ID NO: 91104 - RNA, 63 nt, Homo Sapiens
cuauuguuaucugacaucucuugacaugcccgugggugggaugggaguggaggguucauauga

SEQ ID NO: 91105 - RNA, 63 nt, Homo Sapiens
guucucucccauggggaaagauucucacugcuggggugggaagauucucgcugcuggggugug

SEQ ID NO: 91106 - RNA, 63 nt, Homo Sapiens
ggguauggagaugcaauuuggacguucggggcagggugggaguuuuguuuguuuguuuuuuaa

SEQ ID NO: 91107 - RNA, 63 nt, Homo Sapiens
auguggggugaggguucuuacugcagcguugcggggugggagaccggcucuguccugugugcg

SEQ ID NO: 91108 - RNA, 63 nt, Homo Sapiens
auguguuuguauacaaagggggggcugggaucugggugggaauugggagcuauaugggaagug

SEQ ID NO: 91109 - RNA, 63 nt, Homo Sapiens
cccguaccgcggcuggcuggggcugggggguuggggugggacacacaguuucccucgccccug

SEQ ID NO: 91110 - RNA, 63 nt, Homo Sapiens
gagaacuaugaaccaggaagcuccaucgcugaggggugggaauacgugggccuggaacucuaa

SEQ ID NO: 91111 - RNA, 63 nt, Homo Sapiens
ugggucuucagaucauaaacgcaccagcugcuggggugggacucaccgucaccuggaagcagg

SEQ ID NO: 91112 - RNA, 63 nt, Homo Sapiens
gcccaagcgcuccggcggagcccaaaagggugggggugggaggggcagaggccaacggauccc

SEQ ID NO: 91113 - RNA, 63 nt, Homo Sapiens
gcgggggaggcugggagcugggccuccugcguggggugggacucgcaggggccgggucuccgu

SEQ ID NO: 91114 - RNA, 63 nt, Homo Sapiens
caagcccccaggggagcccucccuggcguccgagggugggagucgggguguggcaggccgcgg

SEQ ID NO: 91115 - RNA, 63 nt, Homo Sapiens
uuugugugugugcacgcauggcugagcaugugugggugggagucagcacauucacgauacugu

SEQ ID NO: 91116 - RNA, 63 nt, Homo Sapiens
ucucuggguugucauucacuuugagagcccgaggggugggagggagugaugcaggcagacgcu

SEQ ID NO: 91117 - RNA, 63 nt, Homo Sapiens
guugaggugagucauggccucuugcuggcaauggggugggaggaguacccccaaguccucuca

SEQ ID NO: 91118 - RNA, 63 nt, Homo Sapiens
cgaggccggagagcuggugacuuuggggacagggggugggaaggggauggacacccccagcug

SEQ ID NO: 91119 - RNA, 63 nt, Homo Sapiens
uucgggcaguccugugugaggauuaagggacgggggugggagguaggcuguggggugggcugg

SEQ ID NO: 91120 - RNA, 63 nt, Homo Sapiens
guuuuucucuguggcuguauguggguugcuugggggugggaugggaagaggcucuuugcaaac

SEQ ID NO: 91121 - RNA, 63 nt, Homo Sapiens
gugugggguugggggaugaggucagggggucuugggugggaguugggggccccuucauuuccc

SEQ ID NO: 91122 - RNA, 63 nt, Homo Sapiens
ggaagaaaaacucuauuuuugaaaaaaaaaggggggugggagggcuggaagcagaaacaaaau

SEQ ID NO: 91123 - RNA, 63 nt, Homo Sapiens
gucugcagggaauuggggggggugagcacucuggggugggaggcgucccugcggaagccacag

SEQ ID NO: 91124 - RNA, 63 nt, Homo Sapiens
acucugccaaauggaaaaugaccaaauuuaagagggugggacaguccccugcuccucucccag

SEQ ID NO: 91125 - RNA, 63 nt, Homo Sapiens
uuccuggaaucaguuuauuauacugaaaacugggggugggaguagggagcuaguuuguugaua

SEQ ID NO: 91126 - RNA, 63 nt, Homo Sapiens
ugcccgggaagugcagcaggcagcuuuucuuuggggugggacuugcccugagcuuggagcugc

SEQ ID NO: 91127 - RNA, 63 nt, Homo Sapiens
ggccucguuuuccuggucuugacugcucuguuugggugggagaagauucucugggggucccca

SEQ ID NO: 91128 - RNA, 63 nt, Homo Sapiens
ggcuuuaucagguaucaucacaagcuacagguggggugggaaaccagugcuccuacugguucc

SEQ ID NO: 91129 - RNA, 63 nt, Homo Sapiens
cacccccuccagugcuccuaagaaagagggauggggugggaggcuaagggaucagggagagga

SEQ ID NO: 91130 - RNA, 63 nt, Homo Sapiens
cagaggugcaucuaggguccacucagggagggagggugggacaccccagaggcaaggcugugc

SEQ ID NO: 91131 - RNA, 63 nt, Homo Sapiens
ccccuuuuuuuuuguuuuguucuguuuuguuuugggugggagggugggaaauuuggguuuuua

SEQ ID NO: 91132 - RNA, 63 nt, Homo Sapiens
uuuuuguuuuguucuguuuuguuuugggugggagggugggaaauuuggguuuuuaaguccucu

SEQ ID NO: 91133 - RNA, 63 nt, Homo Sapiens
uuccuccacccuaagcccuggggcccugaaauggggugggagggcaggggugggagcccuccu

SEQ ID NO: 91134 - RNA, 63 nt, Homo Sapiens
gcccuggggcccugaaauggggugggagggcaggggugggagcccuccuaguggguuuggggg

SEQ ID NO: 91135 - RNA, 64 nt, Homo Sapiens
cacugucuuuaaguugaaacuguuaagcugaauaaaaacuuaagcugcaaauugauaacuucgc

SEQ ID NO: 91136 - RNA, 64 nt, Homo Sapiens
uccuuuucuuaguuucacauucuuccuuuguucuaaaacuuagacugacaucuagcuuugacaa

SEQ ID NO: 91137 - RNA, 64 nt, Homo Sapiens
auguauugguuuucagacugucugaccuucaaauaaaacuuauuaugggaacauggacaccauu

SEQ ID NO: 91138 - RNA, 64 nt, Homo Sapiens
ccuguauauguuuuuauuugauguaaguuucagcaaaacuuauagaguuuaacagcagccugau

SEQ ID NO: 91139 - RNA, 64 nt, Homo Sapiens
aaacuggcacaauuuuauauuuuuuaagcuuuucaaaacuuacucacaauuagaguuugguuuu

SEQ ID NO: 91140 - RNA, 64 nt, Homo Sapiens
aaacaugaugaucauugugaaacauuuuuaaucaaaaacuuauagcauacagccuucagaagcc

SEQ ID NO: 91141 - RNA, 64 nt, Homo Sapiens
uaccucuucaccugacccugcccccacuugccauaaaacuuagcuaaguuuuguuuuguuuuuc

SEQ ID NO: 91142 - RNA, 64 nt, Homo Sapiens
aacauggugaaaccuggucucuacauaaaauacaaaaacuuagaugggcaugguggugugugcc

SEQ ID NO: 91143 - RNA, 64 nt, Homo Sapiens
gaaauguaauuauguucuaagugccuccaaguucaaaacuuauuggaauguugagagugugguu

SEQ ID NO: 91144 - RNA, 64 nt, Homo Sapiens
aucauauaucagaauuuuauuguauaugaugaacaaaacuuaaaauuuuuuaaauuuaauuuuu

SEQ ID NO: 91145 - RNA, 64 nt, Homo Sapiens
acuguuucagaguucuaaaaaggcaguuuuuuaaaaaacuuaaguugauaaaaacuguaagaau

SEQ ID NO: 91146 - RNA, 64 nt, Homo Sapiens
auggcccaaaacaaaagccauuaauggaaaacacaaaacuuaaguaagaauuugcacaugaaug

SEQ ID NO: 91147 - RNA, 64 nt, Homo Sapiens
guuaauuuuagucaccaaugaaccaccucacugcaaaacuuauuauaguugcaggcaaaaaaaa

SEQ ID NO: 91148 - RNA, 64 nt, Homo Sapiens
ugaacucuuuauguuuaaaaucaugucauuauggaaaacuuacaaguguaacuagcuaguagcu

SEQ ID NO: 91149 - RNA, 64 nt, Homo Sapiens
accaguauaacguucaacaacaguuauuuugacaaaaacuuauuuugugauuccuacagugaaa

SEQ ID NO: 91150 - RNA, 64 nt, Homo Sapiens
auuuaaaguuguaucuugacacaggaaaugggaaaaaacuuaaaaauuaauaugguguauuuuu

SEQ ID NO: 91151 - RNA, 64 nt, Homo Sapiens
ugcagucauuuggugcucugcuaaccauuuauauaaaacuuaaaaacaagagaaaagaaaaauc

SEQ ID NO: 91152 - RNA, 64 nt, Homo Sapiens
auaguuuugauuuuugaguuuuuaacagaaguauaaaacuuaacauucucauagcuccuguccu

SEQ ID NO: 91153 - RNA, 64 nt, Homo Sapiens
aaaaaauccuuacugacuaguuaugugagaugcuaaaacuuacaacauugcaguuacugauaca

SEQ ID NO: 91154 - RNA, 64 nt, Homo Sapiens
uuucauggagugccaccuaaucagccauacugggaaaacuuacugaugaccucaauauugacuu

SEQ ID NO: 91155 - RNA, 64 nt, Homo Sapiens
gcacaauaauccuugccuauaaaaauaaaaaaaaaaaacuuagaugugauauuugacaacucua

SEQ ID NO: 91156 - RNA, 64 nt, Homo Sapiens
aguuuugugggacuuguuauuacauuguugucuuaaaacuuacuaugcccaacauuuuguguau

SEQ ID NO: 91157 - RNA, 64 nt, Homo Sapiens
aaucccuuaucaugaaguuugcuccuacacuuugaaaacuuaagaagaguguaucugugaaaga

SEQ ID NO: 91158 - RNA, 64 nt, Homo Sapiens
gcccccuacaccaagaguguguaaaacaucugauaaaacuuacacaaagauuaaagcaugaaau

SEQ ID NO: 91159 - RNA, 64 nt, Homo Sapiens
uacuauuucccuugaaauuuaaaaugucaaagagaaaacuuauaugccuguguggauuuuugug

SEQ ID NO: 91160 - RNA, 64 nt, Homo Sapiens
cuugggacuuggcaaauuccuucccagaaaaaaaaaaacuuacagagaaaugauauauaccacu

SEQ ID NO: 91161 - RNA, 64 nt, Homo Sapiens
gcucccauuguaauguaaggcaaaaggaaauguaaaaacuuagaagccccucacuccccagagu

SEQ ID NO: 91162 - RNA, 64 nt, Homo Sapiens
aauugugccuaaaaacuauguuugccccuaggagaaaacuuaaucauugcacugaaugauuucu

SEQ ID NO: 91163 - RNA, 64 nt, Homo Sapiens
auguaaugaugacauaguugaugcauccaauccuaaaacuuacauuccaaaggaauuauaucau

SEQ ID NO: 91164 - RNA, 64 nt, Homo Sapiens
uauuguuuaaauuugacuuaugggagaucagucaaaaacuuagaagguuuaacacuucacugau

SEQ ID NO: 91165 - RNA, 64 nt, Homo Sapiens
uuuuguuugguauauuuacuaagugcacucuuucaaaacuuauucuauaacuuuaucaauucau

SEQ ID NO: 91166 - RNA, 64 nt, Homo Sapiens
aauuguucauccauauauaagaaauuaucgaauuaaaacuuaauguaugucaauuauuuucaaa

SEQ ID NO: 91167 - RNA, 64 nt, Homo Sapiens
auacagaaaugaaugagugugguuauguucuaauaaaacuuauuuauaaaaacaaggggaggcu

SEQ ID NO: 91168 - RNA, 64 nt, Homo Sapiens
auauaugaucugcauuuucuugaacugaucauugaaaacuuauaaaccuaacagaaaagccaca

SEQ ID NO: 91169 - RNA, 64 nt, Homo Sapiens
uacccuuucaaacuauuuaucacaauuugggugaaaaacuuaagguaauaaccuuuuuguauau

SEQ ID NO: 91170 - RNA, 64 nt, Homo Sapiens
auuggcacuaaagaauacaugccauucugauuuuaaaacuuacagccaauucacaaguuacacu

SEQ ID NO: 91171 - RNA, 64 nt, Homo Sapiens
auuuaaaacugauaauaucuuauauugccauacaaaaacuuaacaauauguuuaaagauauuua

SEQ ID NO: 91172 - RNA, 64 nt, Homo Sapiens
gauuuucucuuugcauaaaucaauucuggaugcuaaaacuuagaccaacaaacuguacuuuaua

SEQ ID NO: 91173 - RNA, 64 nt, Homo Sapiens
gaugucccuuuaaacagacugcugccuucagcuaaaaacuuaauguucuuuauaccuuuguaug

SEQ ID NO: 91174 - RNA, 64 nt, Homo Sapiens
aacuuagguuauuuuugcuuccgaauuugaaugaaaaacuuaaugccauggauuuuuuucuuuu

SEQ ID NO: 91175 - RNA, 64 nt, Homo Sapiens
auuaccuuggugcucugugugaaacuugcuuaucaaaacuuagcucccugaacauaggaaaaua

SEQ ID NO: 91176 - RNA, 64 nt, Homo Sapiens
gagguacaaguggcugaaaagauagcagggcaugaaaacuuagaggaaguggggaaguguucca

SEQ ID NO: 91177 - RNA, 64 nt, Homo Sapiens
uuaaaauugcugaauuuacccucauauucuuuaaaaaacuuaaagcauuaugaauguagagaaa

SEQ ID NO: 91178 - RNA, 64 nt, Homo Sapiens
aaaaaaaauaaagacacuguugccaaugugacccaaaacuuaagaacauacuaauggcauauau

SEQ ID NO: 91179 - RNA, 64 nt, Homo Sapiens
aagcccccguuuacauguagaaagcuugcuuugaaaaacuuaaagccuauagcuucccuuccgg

SEQ ID NO: 91180 - RNA, 64 nt, Homo Sapiens
aaaacaaacacaaaaagaugucuuguuuugucucaaaacuuaaacaauuuuaaaaaugugacuu

SEQ ID NO: 91181 - RNA, 64 nt, Homo Sapiens
ucagauuuuucucaucuguagcuaaaugaaguuaaaaacuuauucaucuucauguuccuaauag

SEQ ID NO: 91182 - RNA, 64 nt, Homo Sapiens
gauucacugauuucuuagaccuucgguaagauggaaaacuuaguauuugaaauaauguuuugua

SEQ ID NO: 91183 - RNA, 64 nt, Homo Sapiens
uaauagagccuagcaguuacuuuaaacucuuuguaaaacuuagauuacauuucacaaaagauau

SEQ ID NO: 91184 - RNA, 64 nt, Homo Sapiens
acuuaccuaggaaacccauuagaaaagauagcacaaaacuuaagucuuuucucccuuaugaaaa

SEQ ID NO: 91185 - RNA, 64 nt, Homo Sapiens
ccugaguucaauauauuauuaacagcaguauuuuaaaacuuaggguugaacugggcaugguggc

SEQ ID NO: 91186 - RNA, 64 nt, Homo Sapiens
gaucccaucucuaaaaaauaaaauauaagaaaauaaaacuuaggggauauacagauuuaaauau

SEQ ID NO: 91187 - RNA, 64 nt, Homo Sapiens
uuauucuuaggcccucguggauuuuuuuuuucagaaaacuuaaacaaaaaaagacuuacuaaga

SEQ ID NO: 91188 - RNA, 64 nt, Homo Sapiens
uagguuucuguauuuauauauuaaaauacaaaaaaaaacuuauaaaauguuuaaaaaaauguuc

SEQ ID NO: 91189 - RNA, 64 nt, Homo Sapiens
uuguguugguacauuggcagagacauaugcuuuaaaaacuuaaauauuucggaggcacauguug

SEQ ID NO: 91190 - RNA, 64 nt, Homo Sapiens
aagaagugcagagggguuuuuuguguauugcgugaaaacuuauaaaacaaauguuaacagaaug

SEQ ID NO: 91191 - RNA, 64 nt, Homo Sapiens
uucagaacauguguuaauaguauauaugccacugaaaacuuagguccuguaucauacuuuuuuc

SEQ ID NO: 91192 - RNA, 64 nt, Homo Sapiens
guggauuuuaaaaaaucaaucaauggugcaaaaaaaaacuuaaagcaaaauaguauugcugaac

SEQ ID NO: 91193 - RNA, 64 nt, Homo Sapiens
gauggccuuuugaugaaugucuuccacaguaaagaaaacuuaguggcuuaauuuaggaaacaug

SEQ ID NO: 91194 - RNA, 64 nt, Homo Sapiens
uaaauuuguguguaaaauauacuuauuuuuuuuaaaaacuuacucaaaaaaauauagcguaaau

SEQ ID NO: 91195 - RNA, 64 nt, Homo Sapiens
guaauauuauuuuuaaaaucguuauuagaccaggaaaacuuaaucacuguacuucucaaaguug

SEQ ID NO: 91196 - RNA, 64 nt, Homo Sapiens
auggacacagcugacuggaccaaaaaaaaaaaaaaaaacuuaaggacagagugagacuccaucu

SEQ ID NO: 91197 - RNA, 64 nt, Homo Sapiens
augggccaggugcgguggcuagaacuauuuauuaaaaacuuaagcaccagccugggcagcagca

SEQ ID NO: 91198 - RNA, 64 nt, Homo Sapiens
ucagagagcauuuuacuacugagcugcaaagggaaaaacuuaaaauggauaugaaaagugaaga

SEQ ID NO: 91199 - RNA, 64 nt, Homo Sapiens
cagccauggccccagacuugucgcacggaugcagaaaacuuaauggaggaggcugaggucagaa

SEQ ID NO: 91200 - RNA, 64 nt, Homo Sapiens
gcaaucuuuuacuaugcauuaagaccucugauucaaaacuuauuagaacaguagcuucugcugg

SEQ ID NO: 91201 - RNA, 64 nt, Homo Sapiens
gccagaccccaucucuauuuauauauauauauauaaaacuuagaguuuuuaucuuccccuaaaa

SEQ ID NO: 91202 - RNA, 64 nt, Homo Sapiens
auucucuuuuuuuuuuuuuuuuuuuuugguuaugaaaacuuagggacuaaaauuaauauaaaaa

SEQ ID NO: 91203 - RNA, 64 nt, Homo Sapiens
aguaccuccaggcugaaagacuguuguaccaguaaaaacuuaaaggcacaaauucuccuugaag

SEQ ID NO: 91204 - RNA, 64 nt, Homo Sapiens
uuauuauuauauuuuauuucuuuggucugugagcaacucaaagaggcagaagaggagaaugacu

SEQ ID NO: 91205 - RNA, 64 nt, Homo Sapiens
agugucuuuucagccuuuccaucuuuacaaauaaaacucaaaaaagccguccagcuuaucccau

SEQ ID NO: 91206 - RNA, 64 nt, Homo Sapiens
ugaauguauaauacaauucuuaaguucaccugauaacucaaaaggugauuguucuggagugaau

SEQ ID NO: 91207 - RNA, 64 nt, Homo Sapiens
cugagaaccccaagcugauacaggagaagaggcaaacucaaaugagauggugucuuagaugcca

SEQ ID NO: 91208 - RNA, 64 nt, Homo Sapiens
auuaauauuuugacuauuuuuauauauaaagaagaacucaaaaaauuauguucaaauuuguaca

SEQ ID NO: 91209 - RNA, 64 nt, Homo Sapiens
cagaguaaguaggcagcacuuuuaaaaauaugugaacucaaauauugcacuucuuucaagaugu

SEQ ID NO: 91210 - RNA, 64 nt, Homo Sapiens
uaagacuagaaccuauaggaaacuacuuggagcaaacucaaaggacagauuagggaucgagauu

SEQ ID NO: 91211 - RNA, 64 nt, Homo Sapiens
cagaaagcgugauagaggagagaauuuuugacaaaacucaaaaguuguuugcacagcuguucuu

SEQ ID NO: 91212 - RNA, 64 nt, Homo Sapiens
uuuugauaaugacuggacaucagaagaggaaaaaaacucaaaacaaaagcgagagagacuauug

SEQ ID NO: 91213 - RNA, 64 nt, Homo Sapiens
ucaaaacaaaagcgagagagacuauugccauaugaacucaaaagcuaucaugguguucacucua

SEQ ID NO: 91214 - RNA, 64 nt, Homo Sapiens
gaacaugggaauucauacugagaugcaaucucucaacucaaaaauguauuaaaaauaggauccc

SEQ ID NO: 91215 - RNA, 64 nt, Homo Sapiens
uggucucuccagauauuaacaagaauuguuguguaacucaaagauuugcuuuuauagacuugau

SEQ ID NO: 91216 - RNA, 64 nt, Homo Sapiens
auauagucugaaucuuaggaagaagguaaaagaaaggaggcaagagaauaguuaugaugaauau

SEQ ID NO: 91217 - RNA, 64 nt, Homo Sapiens
guuaugaugaauauguguuaagugccugcucugaaggaggcaauguucuucucauuugaauccu

SEQ ID NO: 91218 - RNA, 64 nt, Homo Sapiens
augagaacaguggcacaccaaaucggagucacuuaggaggcagccuuauucuaccagggcugaa

SEQ ID NO: 91219 - RNA, 64 nt, Homo Sapiens
agcugucuuccuuauucuacgugcuaaggggcuaaggaggcaucacaacacaccuuaggaacau

SEQ ID NO: 91220 - RNA, 64 nt, Homo Sapiens
ugggauccaccuucuuccuuaggaucaauuagagaggaggcaccgcaaaggaaacugggugggg

SEQ ID NO: 91221 - RNA, 64 nt, Homo Sapiens
aggggcagagaguaaaaaacguuuuugaaaugcuaggaggcagaacuauggggugcacucuaca

SEQ ID NO: 91222 - RNA, 64 nt, Homo Sapiens
gagagggaggcagauggaaguugguuuuaaugagaggaggcagauuccaaacuaagcuagauuc

SEQ ID NO: 91223 - RNA, 64 nt, Homo Sapiens
gucaucaguuugugacauacgugugcuacaauauaggaggcacaauuguuguuuaaguuccaag

SEQ ID NO: 91224 - RNA, 64 nt, Homo Sapiens
uuuccgucuguccuaaaggggaaauuuucuuaccaggaggcaacgaaagccuuuuugagauuaa

SEQ ID NO: 91225 - RNA, 55 nt, Homo Sapiens
cauuuggaagguuagucuugucuacaggaggcagcaggacuuugugaccaaauag

SEQ ID NO: 91226 - RNA, 64 nt, Homo Sapiens
auuuugacagggaaggaaguauauugaaaaucaaaggaggcaaauaagacaaaaaaauauauau

SEQ ID NO: 91227 - RNA, 64 nt, Homo Sapiens
gguugcagugagccaaggucgauugcuugagcccaggaggcagaugaggaggcugaggugggag

SEQ ID NO: 91228 - RNA, 64 nt, Homo Sapiens
agggugagagggaguggggagggagagggcaggaaggaggcagagcuguccgugggagguggag

SEQ ID NO: 91229 - RNA, 64 nt, Homo Sapiens
aaggugguggcgugaccuuaacucucagaagcagaggaggcagguggguggagggggaugcugg

SEQ ID NO: 91230 - RNA, 64 nt, Homo Sapiens
ggggaaacugcuccccaauauuugggaagauaauaggaggcauuuccuggggaguugaccgaca

SEQ ID NO: 91231 - RNA, 64 nt, Homo Sapiens
gaagaaagggggccugcaaaggggguccaaugcaaggaggcagguucccuagcaaaguauuugu

SEQ ID NO: 91232 - RNA, 64 nt, Homo Sapiens
ggguggucugagucuccucacugacauuucccccaggaggcaggucauaggcagagaagcccuu

SEQ ID NO: 91233 - RNA, 64 nt, Homo Sapiens
gcccugcagccucccguccagggcacuaagccacaggaggcagcagcacugcucucuagcucca

SEQ ID NO: 91234 - RNA, 64 nt, Homo Sapiens
gcugggagagggaaagacauucagacccacagaaaggaggcagcacacagagaaagaugcacag

SEQ ID NO: 91235 - RNA, 64 nt, Homo Sapiens
cauuguuagcaucagauuauaccucauuauuaaaaggaggcauggccacacaugaagaaauggu

SEQ ID NO: 91236 - RNA, 64 nt, Homo Sapiens
ugccuacauguacuacgucucaagcugaacaggaaggaggcagccggaagcugcagcaggugua

SEQ ID NO: 91237 - RNA, 64 nt, Homo Sapiens
gguguaccugcggaagcugccgccaaugaggaggaggaggcagaaugaagacuguccggagcuu

SEQ ID NO: 91238 - RNA, 64 nt, Homo Sapiens
agccaaggccaaaagugaacgaaaacuauucuaaaggaggcagguucauuucuaauacucuuac

SEQ ID NO: 91239 - RNA, 55 nt, Homo Sapiens
uggaggauggacugggcccgaggucaggaggcaagauucacagaaacagauguga

SEQ ID NO: 91240 - RNA, 64 nt, Homo Sapiens
aggcucugagggagaugggcuugggggcuguaggaggaggcagggauuccagggugucaggaag

SEQ ID NO: 91241 - RNA, 64 nt, Homo Sapiens
augcucugaggcagaugggcuugggggcucuaggaggaggcagggacuccagggugucaggaag

SEQ ID NO: 91242 - RNA, 64 nt, Homo Sapiens
cggugauguaguauggccugacagcucuguuuagaggaggcaacacugaucccccagaugcagg

SEQ ID NO: 91243 - RNA, 64 nt, Homo Sapiens
ggggcggagccccggcucuuauagaagcuucagcaggaggcaagcguguucucagcacauaugg

SEQ ID NO: 91244 - RNA, 64 nt, Homo Sapiens
uaugcaaaugugaaauaaccgaucuauaacgugaaggaggcagacaugagcuguacuacucagu

SEQ ID NO: 91245 - RNA, 64 nt, Homo Sapiens
uagaaguaaauuuuuacacuauuuuguuguuuaaaggaggcauuucuacuuccuugaguuuugc

SEQ ID NO: 91246 - RNA, 64 nt, Homo Sapiens
ccuguaaggggccagagccuuggaggacacuaagaggaggcaggaggagcaacucaaaucccca

SEQ ID NO: 91247 - RNA, 64 nt, Homo Sapiens
gaguugcuaaguggccggaaaacaagccugagggaggaggcaggaguuggaguuaccuuaggcc

SEQ ID NO: 91248 - RNA, 64 nt, Homo Sapiens
gagguugggcagcugaacaguguuggcuuucaugaggaggcagaaagcagaggcuggccucaga

SEQ ID NO: 91249 - RNA, 64 nt, Homo Sapiens
gccaccugucccaccucaaaugggucugggggucaggaggcaggguuuuaucucugucuaccau

SEQ ID NO: 91250 - RNA, 64 nt, Homo Sapiens
acucuguguuguaauuucaggggagcaucaguggaggaggcagugggggcagcagcagccuccu

SEQ ID NO: 91251 - RNA, 64 nt, Homo Sapiens
ucaggaggcugaggcaggagaaucacuugaacccaggaggcagagguugcagucagccaagauc

SEQ ID NO: 91252 - RNA, 64 nt, Homo Sapiens
aucuucuuagcccagagagcaguggaguugagugaggaggcagauguccugucugugagccagu

SEQ ID NO: 91253 - RNA, 64 nt, Homo Sapiens
gcuuugaagaaagagcugauggugcagaagcagcaggaggcacuugaggagcaggcggcucugg

SEQ ID NO: 91254 - RNA, 64 nt, Homo Sapiens
ggacucagccaugcacaccuugagcagcgccggcaggaggcacggaaggaacugugcuccguuc

SEQ ID NO: 91255 - RNA, 64 nt, Homo Sapiens
cgagaaaccuguggucuagaaccacagcaagaagaggaggcaugcuggccugcaccggaagacu

SEQ ID NO: 91256 - RNA, 64 nt, Homo Sapiens
cuguggucuggcccccucccuguccaggccccgcaggaggcagaugcagucccaggcauccucc

SEQ ID NO: 91257 - RNA, 64 nt, Homo Sapiens
ugccuggccuggccugggacaccuccucucugccaggaggcaauaaaagccagcgccgggaccu

SEQ ID NO: 91258 - RNA, 64 nt, Homo Sapiens
ugugacuagccugccaauggggacccaaagauccaggaggcacuucuggcaucguuuuccgcca

SEQ ID NO: 91259 - RNA, 64 nt, Homo Sapiens
gacggguacaggggguaccaaugaaaaggacuguaggaggcagaauuauaaaaaaacaaaauaa

SEQ ID NO: 91260 - RNA, 64 nt, Homo Sapiens
cggguguggauuugaauguggacuucggaaucccaggaggcaggggccgggcucuccuccaccg

SEQ ID NO: 91261 - RNA, 64 nt, Homo Sapiens
aguucagcccauuguacgugcaggucccgugggaaggaggcaaaagccccugcuucuuacuuug

SEQ ID NO: 91262 - RNA, 64 nt, Homo Sapiens
uuguuuguuacugccacuucuuuuuaggagcaaaucuccccagggguguacgguauuucuugac

SEQ ID NO: 91263 - RNA, 64 nt, Homo Sapiens
ugaauguguguagcugcuuuuucacucgugguccucuccccaucccuugcucugaccccagagc

SEQ ID NO: 91264 - RNA, 64 nt, Homo Sapiens
caauuuggcacaggcagcagucucccucccaggcucuccccaucuccccugcuuugguguugag

SEQ ID NO: 91265 - RNA, 64 nt, Homo Sapiens
acuuguucugaggacauccacacaauaguaggaaucuccccaaccaaucugugaauuucauggg

SEQ ID NO: 91266 - RNA, 64 nt, Homo Sapiens
gguuugaaguacuauuuucccaggguggcuucaaucuccccaccuaggaugucagcccugucca

SEQ ID NO: 91267 - RNA, 64 nt, Homo Sapiens
uaggaugucagcccuguccaaggaccuucccucuucuccccaguuccugggcaaucacuucacc

SEQ ID NO: 91268 - RNA, 64 nt, Homo Sapiens
ugccccccggggauucagggccaccaucagagccucuccccaggccagacuuccccaccuucag

SEQ ID NO: 91269 - RNA, 64 nt, Homo Sapiens
cuccuuacaagacuuuguggugccuacggcacccucuccccaaccgcuccugcuccauggacuc

SEQ ID NO: 91270 - RNA, 64 nt, Homo Sapiens
gaaaacauuucaaagcugaggagggggcuauuucucuccccacuuucccggagcacagcccugg

SEQ ID NO: 91271 - RNA, 64 nt, Homo Sapiens
ccuccagccucucccggcuggugcccugcccccaucuccccaggaaggugcugagcuuagccuu

SEQ ID NO: 91272 - RNA, 64 nt, Homo Sapiens
cugacuccuucucccugacucuacuuucuggaagucuccccaggaccuccucagggucaaaggg

SEQ ID NO: 91273 - RNA, 64 nt, Homo Sapiens
caagcucugaagucccugcauggccaugugacccucuccccaggacuggggacccugcacaguc

SEQ ID NO: 91274 - RNA, 64 nt, Homo Sapiens
ucagggcucuagacccgagccccagacugaguccucuccccaaaucuccccugcagucuggguu

SEQ ID NO: 91275 - RNA, 64 nt, Homo Sapiens
ccagcauccccaaacugguagggcuccaggauugucuccccacuaaaaaaaugggucuccuucu

SEQ ID NO: 91276 - RNA, 64 nt, Homo Sapiens
ccuccagaaggcauaacccuuaaucauucccuuuucuccccacuuuacuuuuguuccuuuuccc

SEQ ID NO: 91277 - RNA, 64 nt, Homo Sapiens
uucauacucuucccagggauuucuuacccuuucuucuccccauuuucaaccgcugagguuugau

SEQ ID NO: 91278 - RNA, 64 nt, Homo Sapiens
cucagaggugcucagagguacuguuacgucucccucuccccaagcucaugaugaagugccauuu

SEQ ID NO: 91279 - RNA, 64 nt, Homo Sapiens
aaccacauccuaccuagggaguaccccauguaugucuccccacuuccugcgaucagccccuggg

SEQ ID NO: 91280 - RNA, 64 nt, Homo Sapiens
ugggacaucaagccuagcauaagagucagcuuuuucuccccauuugcccuucagccuucaaagu

SEQ ID NO: 91281 - RNA, 64 nt, Homo Sapiens
aagaugaaagauucagugguucagcugcugacccucuccccaaguacaucaaaaucuggcagag

SEQ ID NO: 91282 - RNA, 64 nt, Homo Sapiens
gccucuggcuccacaccuccggcuuuuuccaucuucuccccacauguuuugacacugagcuugg

SEQ ID NO: 91283 - RNA, 64 nt, Homo Sapiens
caccccacgcccgcacccccgugcuuuguaauauucuccccaccccuuccccacccuugagaag

SEQ ID NO: 91284 - RNA, 64 nt, Homo Sapiens
acagcucaaaauauccacacaaggaggcaaauugucuccccaaggggauaagucuuuugucauc

SEQ ID NO: 91285 - RNA, 64 nt, Homo Sapiens
gggggauaagucuuuugucauuuaguggcuugggucuccccaguccggcaacaccaagaggguu

SEQ ID NO: 91286 - RNA, 64 nt, Homo Sapiens
accaccucuguggccuccauucucucccaccccaucuccccaccccuuuucugaucaugccccu

SEQ ID NO: 91287 - RNA, 64 nt, Homo Sapiens
uuuauaaaaacuaaaaugcaggcagaguguugucucuccccaaaacuuccucuccucuuaccug

SEQ ID NO: 91288 - RNA, 64 nt, Homo Sapiens
gcccggugucggggaggggugcuuucuuuccucaucuccccacuccccacucucagccugggag

SEQ ID NO: 91289 - RNA, 64 nt, Homo Sapiens
gcuaccugggcauuuguggucauuucaguuuccaucuccccagcgggggcucccugggugaaag

SEQ ID NO: 91290 - RNA, 64 nt, Homo Sapiens
ccaggccccgccuggaaggaagucguuccucaacucuccccaaggcaccugucuccaaucagag

SEQ ID NO: 91291 - RNA, 64 nt, Homo Sapiens
auuugcauaacaauccuauuaagguaggugcucuucuccccauuuuacaaaugagaaaucugag

SEQ ID NO: 91292 - RNA, 64 nt, Homo Sapiens
aaguaaauuuccuugucauuccuaucucuugaguucuccccagaggcaaucacugcuacugguu

SEQ ID NO: 91293 - RNA, 64 nt, Homo Sapiens
gaaugugaggcauugucaccguuuccgaacugccucuccccaaaagcagauugugcgcacacuc

SEQ ID NO: 91294 - RNA, 64 nt, Homo Sapiens
gacuagacgugaccuggcagagcaauucagucccucuccccaaaugaggaaauguucucaauug

SEQ ID NO: 91295 - RNA, 64 nt, Homo Sapiens
cccuuggccucugaggcugacuuugaguuuggguucuccccagcgcaugcacacaacauccucu

SEQ ID NO: 91296 - RNA, 64 nt, Homo Sapiens
uccucugcccagaggggcagcagcucucccugguucuccccagggcagacgggguagggcgggc

SEQ ID NO: 91297 - RNA, 64 nt, Homo Sapiens
caccccuuccaccugucccccagacccaaagcucucuccccacccuaccugcccaccuggggcu

SEQ ID NO: 91298 - RNA, 64 nt, Homo Sapiens
aaaaaaucucagaaucugaaauaagcccuaaauuucuccccaaaaucaagacucuugagagcau

SEQ ID NO: 91299 - RNA, 64 nt, Homo Sapiens
uaauauguguauauuuuuugguuuuccuacagcuucuccccaucuuucaaaagaaucacgaaau

SEQ ID NO: 91300 - RNA, 64 nt, Homo Sapiens
aucuaaaacugggguuugggggaagguuucagccucuccccacuccccuugccccacacccuuu

SEQ ID NO: 91301 - RNA, 64 nt, Homo Sapiens
aaagaugccauucucucccuaaggucugguggagucuccccaucuugcauacccuucugcaagc

SEQ ID NO: 91302 - RNA, 64 nt, Homo Sapiens
caccagcugucugcuggguugagauuuucugagcucuccccaaucuggugaggauguuugaucc

SEQ ID NO: 91303 - RNA, 64 nt, Homo Sapiens
cucagcugcuguccgccugacagcacuggcccccucuccccagcuccucaggcaugggugucca

SEQ ID NO: 91304 - RNA, 64 nt, Homo Sapiens
ucucacccccacccucucccagcgaacggccacaucuccccaccaaaagucaucgcaacuucag

SEQ ID NO: 91305 - RNA, 64 nt, Homo Sapiens
uugcuaaaccgacaaggaaggcugugugcuuagcucuccccagagggagggcgagaagggugug

SEQ ID NO: 91306 - RNA, 64 nt, Homo Sapiens
ccugcccccaccuacuagaugccaggggcacuguucuccccagccccccgccccaguugugaca

SEQ ID NO: 91307 - RNA, 64 nt, Homo Sapiens
uucccccucucaugguaggccagggacugggcuuucuccccacuaagggcaaggccccaguuuu

SEQ ID NO: 91308 - RNA, 64 nt, Homo Sapiens
agaugccguggauacgccagggucccagggggaaucuccccaagcucacacucucucccgcuua

SEQ ID NO: 91309 - RNA, 64 nt, Homo Sapiens
agugucguugauuuaaaggagccagugcuuccccucuccccagguaguuggucagcuguggacu

SEQ ID NO: 91310 - RNA, 64 nt, Homo Sapiens
accagcagcagcagggcccuccucccccaccagcucuccccacagggccccucagcaucaugga

SEQ ID NO: 91311 - RNA, 64 nt, Homo Sapiens
gagaggggcuggggagcucagcuuggucucagagucuccccaccagauacuguuuaaaaaagua

SEQ ID NO: 91312 - RNA, 64 nt, Homo Sapiens
aguuaccagaauuuucaauggaaaaugagggguuucuccccacugauauuuuacauagagucau

SEQ ID NO: 91313 - RNA, 64 nt, Homo Sapiens
uaucacggguuuuuguuaauguuucauaaguaauucuccccacuugauuuuucuucuauaaaau

SEQ ID NO: 91314 - RNA, 64 nt, Homo Sapiens
acccuuucacacauuccugagugcugccaucuucucuccccacccucgcagcccaugccugggg

SEQ ID NO: 91315 - RNA, 64 nt, Homo Sapiens
auggauggccacagcucagccggaccacacccucucuccccagcccccugucaacacaugagaa

SEQ ID NO: 91316 - RNA, 64 nt, Homo Sapiens
acuacuguuuucuacuguaacccauuccuguuccucuccccaccccuggcaaaugaaucaaaga

SEQ ID NO: 91317 - RNA, 64 nt, Homo Sapiens
auuuacauguugaagcaccuguggguugauaaugucuccccaaacaauacauuuugauucucuu

SEQ ID NO: 91318 - RNA, 64 nt, Homo Sapiens
uaaaguacauuauguuuacucaaguaaauaauuuucuccccaugguacacucuaguguaggcua

SEQ ID NO: 91319 - RNA, 64 nt, Homo Sapiens
ugcaaauucuauccucuaaacuuaucuggugcauucuccccaccccacccccauuauauaaggg

SEQ ID NO: 91320 - RNA, 64 nt, Homo Sapiens
gagucaccuucccuugccacuuugcacgacgcccucuccccaccccuaccccuggcuguacugc

SEQ ID NO: 91321 - RNA, 64 nt, Homo Sapiens
uugcuuuucccucuuuucuuacuccuccucuuucucuccccaacccccauucucaucugcaccc

SEQ ID NO: 91322 - RNA, 64 nt, Homo Sapiens
guagaauucaaucagagcucgguuagcaucaaguucuccccaggcuuggcucuugguaccugug

SEQ ID NO: 91323 - RNA, 64 nt, Homo Sapiens
cauuugccaagggaggcggacccagaggagcagcucuccccaggugauccguccgaggcugcuu

SEQ ID NO: 91324 - RNA, 64 nt, Homo Sapiens
gccaaguccacugaggcccggaccccggacugcgucuccccagccccccucggcguccucucuc

SEQ ID NO: 91325 - RNA, 64 nt, Homo Sapiens
cccagccucugccggcuccccuaggcaaccccuuucuccccaggagcgggugcggcugauuccc

SEQ ID NO: 91326 - RNA, 64 nt, Homo Sapiens
ccagagcggcuuccagagcacacccucuccccacucuccccacgggcagcagcugcagcaagcg

SEQ ID NO: 91327 - RNA, 64 nt, Homo Sapiens
cuccccacgccagagcggcucagcaagcgcacccucuccccacugccuccuaaggcagcagcug

SEQ ID NO: 91328 - RNA, 64 nt, Homo Sapiens
gcacgaggauguguugccugacccagcagaggcuucuccccauaccaggguuggcugguggguc

SEQ ID NO: 91329 - RNA, 64 nt, Homo Sapiens
guggcaacucuggugaaaccagggacagaucacaucuccccagagaggcaaugugaccagucac

SEQ ID NO: 91330 - RNA, 64 nt, Homo Sapiens
uucuuccuccuccugaccuuauuuugcucuucacucuccccagccaauaaagcgucuguggcga

SEQ ID NO: 91331 - RNA, 64 nt, Homo Sapiens
gcacacagaauacuauuaaugugcacccagcuggucuccccaggcaagaagguauccucuuccc

SEQ ID NO: 91332 - RNA, 64 nt, Homo Sapiens
uagaucugcgguuuccccucuacccugccucccgucuccccagaaugggaauuucuuuuauguu

SEQ ID NO: 91333 - RNA, 64 nt, Homo Sapiens
agcugauggugagcggcacagucccacuuccccaucuccccaaguaggugguguuagaaaaccu

SEQ ID NO: 91334 - RNA, 64 nt, Homo Sapiens
aggaccagaauuuuuuaucuagagaccagcauguucuccccaaagaccaagauauucugccaaa

SEQ ID NO: 91335 - RNA, 64 nt, Homo Sapiens
aggaccagaauuuuuugucuagagaccagcauguucuccccaaagaccagaauauucuaccuaa

SEQ ID NO: 91336 - RNA, 64 nt, Homo Sapiens
aagaccaggacuuuuuaucuagagaccagcauguucuccccaaagacuggaauauucuacccaa

SEQ ID NO: 91337 - RNA, 64 nt, Homo Sapiens
uccagccccucccucuggguagcauacugugugcucuccccaucgcuccuuaaacccucugggg

SEQ ID NO: 91338 - RNA, 64 nt, Homo Sapiens
gcugccauggcagcuaucaggagaggagcacuugucuccccaggacugcuacagcugguccaca

SEQ ID NO: 91339 - RNA, 64 nt, Homo Sapiens
gcaccaggcaauacccauccaucacccaucucacucuccccaguccucaggcagcagcuuuucc

SEQ ID NO: 91340 - RNA, 64 nt, Homo Sapiens
uucucucuaugucuguuucacuuuuuggauugcaucuccccaaaaacuaaaugugaaaucccua

SEQ ID NO: 91341 - RNA, 64 nt, Homo Sapiens
ccaugcuggcaucuguagcucgguggcuugacauucuccccagggacuucccgguuccuaguuc

SEQ ID NO: 91342 - RNA, 64 nt, Homo Sapiens
ugggggaggugucagcugggccccuccugugcuaucuccccagaggacaucccugacuccaccc

SEQ ID NO: 91343 - RNA, 64 nt, Homo Sapiens
gguccccgccccaguggcugccugaguuccagccucuccccaagaacaaaggcuggagaagggc

SEQ ID NO: 91344 - RNA, 64 nt, Homo Sapiens
gcgccuuccucccacguuuuaagagggacaggccucuccccagcguagagguggggccccuucc

SEQ ID NO: 91345 - RNA, 64 nt, Homo Sapiens
uuuuugauagucaacuucgacuaggaaauaaaaaucuccccaauaaaaaugccuugcugauuca

SEQ ID NO: 91346 - RNA, 64 nt, Homo Sapiens
ucuagaaauuguaguucauagagcagcauuuguuucuccccacaagaagcagagcagaugauuc

SEQ ID NO: 91347 - RNA, 64 nt, Homo Sapiens
cugcuccuccugguuucuguuuccccuuccucacucuccccaugcugacuuggcucuguaacag

SEQ ID NO: 91348 - RNA, 64 nt, Homo Sapiens
cuccccuuggccucaccuucucuggcccuuaggaucuccccauuuggagacagagccauuugga

SEQ ID NO: 91349 - RNA, 64 nt, Homo Sapiens
aaguccccaagacaaucucgggaagucccgguggucuccccaaguucuggcaucuccccaguau

SEQ ID NO: 91350 - RNA, 64 nt, Homo Sapiens
auggaagucccgguggucucuuccaguucuggcaucuccccaguuuggacgacuucugcucccu

SEQ ID NO: 91351 - RNA, 64 nt, Homo Sapiens
auccacaccgggccuggcgccccacacugaugauucuccccagcacccucgggggcuuucggcu

SEQ ID NO: 91352 - RNA, 64 nt, Homo Sapiens
ccagggcuccccccgugcugggugggcgcucgcgucuccccaccgaaggcugcuggggugcgca

SEQ ID NO: 91353 - RNA, 64 nt, Homo Sapiens
ccgcuucuucccugggggccggacccaccagcucucuccccaucggcuggagaggcagacggug

SEQ ID NO: 91354 - RNA, 54 nt, Homo Sapiens
cccucaccugcacccuaggaccucucuccccacacccgagagaagaagcaguga

SEQ ID NO: 91355 - RNA, 64 nt, Homo Sapiens
cacagccugaagggaggcccgcaagaacagccccucuccccaguuuaaaggggguuugucagaa

SEQ ID NO: 91356 - RNA, 64 nt, Homo Sapiens
ccacccacccagcugcugucccuuccccucagccucuccccacaaggccccccugggggggcug

SEQ ID NO: 91357 - RNA, 64 nt, Homo Sapiens
cuucaugccuuccccacccuaggaaggcugagccucuccccagcccagcaguguccuggggaga

SEQ ID NO: 91358 - RNA, 64 nt, Homo Sapiens
gccucugcugaugcacagagcuccacccauaccuucuccccacagagacuacugaccuucucac

SEQ ID NO: 91359 - RNA, 64 nt, Homo Sapiens
gugauccuaagaauguacagaccuuucccaccucucuccccaaacccacgcccgucucuuucuc

SEQ ID NO: 91360 - RNA, 64 nt, Homo Sapiens
cccgucucuuucucaccuuugaucucccuucucaucuccccacggagccucauccagccucaga

SEQ ID NO: 91361 - RNA, 64 nt, Homo Sapiens
aaguggcucagaccccucagaagggucacuggccucuccccaggccccccaucaccagagucuu

SEQ ID NO: 91362 - RNA, 64 nt, Homo Sapiens
ccaggcaccccucuuuuuacagaaccaccgccccucuccccaccccccccaccuccagggccuu

SEQ ID NO: 91363 - RNA, 64 nt, Homo Sapiens
ggccuccccgccuccaacccggucucccucuccaucuccccaguagggcacuuacuaagggagg

SEQ ID NO: 91364 - RNA, 64 nt, Homo Sapiens
uucuugaacucgggcagcaccaccgcgcccagucucuccccacgcugggauuacaggccugagc

SEQ ID NO: 91365 - RNA, 64 nt, Homo Sapiens
uuauuuuuuaauuacuauuuuugaacugaaucacucuccccacgguuccaaguugcaacugacc

SEQ ID NO: 91366 - RNA, 64 nt, Homo Sapiens
uuuggggucagaggccgggagggcccagguuugcucuccccaaggggccgaccucaaguucaag

SEQ ID NO: 91367 - RNA, 64 nt, Homo Sapiens
acauccagagucuguccccucugccucucuccucucuccccagaucccacugucccaccgccuc

SEQ ID NO: 91368 - RNA, 64 nt, Homo Sapiens
ccaccccauuuacagggugaccacccccagggggucuccccaccaaucuccggagccaacacca

SEQ ID NO: 91369 - RNA, 64 nt, Homo Sapiens
uguauuucagcagaccccgguccuuugaugagccucuccccaggccacgaugaacuugcucuuu

SEQ ID NO: 91370 - RNA, 64 nt, Homo Sapiens
ccagcccuuccuauuuccuuuccuauuuuuuuuuucuccccacacuuucuugggacucccaccu

SEQ ID NO: 91371 - RNA, 64 nt, Homo Sapiens
ccacuggggcuccuacagagcuguggaauguaccucuccccaacacuguuuuguuagcgagcac

SEQ ID NO: 91372 - RNA, 64 nt, Homo Sapiens
cuuuucuuccucuucaaaguaaggcacuuuacucucuccccacuaacuucuacuuuuccucuua

SEQ ID NO: 91373 - RNA, 64 nt, Homo Sapiens
ccuuucuucccuccucaaucaaagguaccuuaucucuccccacuuuuuuccuugauuucuuuuu

SEQ ID NO: 91374 - RNA, 64 nt, Homo Sapiens
ggcuguuucacaguauucugucuuuuucccuugcucuccccagguaaucuguacuaugggugaa

SEQ ID NO: 91375 - RNA, 64 nt, Homo Sapiens
gggaggcggccuccgcccauagguggccugcccuucuccccagauccccuagccuuccaaaccc

SEQ ID NO: 91376 - RNA, 64 nt, Homo Sapiens
gcugauacggcauccugcgacccacacccauagcucuccccacaguggcccccgaagaauggaa

SEQ ID NO: 91377 - RNA, 64 nt, Homo Sapiens
aauaagccuugucguugacuuuagggacucaauuucuccccaggguggaugggggaaauggugc

SEQ ID NO: 91378 - RNA, 64 nt, Homo Sapiens
acuuguuauuuguuuuuauuauuacuguuugucuucuccccaggguucaguccucaaggggcca

SEQ ID NO: 91379 - RNA, 64 nt, Homo Sapiens
aaagcuccagguguuccaaacucauuaacuaaauucuccccagaaugcuuuuaaauuuuccagg

SEQ ID NO: 91380 - RNA, 64 nt, Homo Sapiens
aaaauacuggagcaacaaugccccugcuuccauuucuccccaccucacucucaccaagucacca

SEQ ID NO: 91381 - RNA, 64 nt, Homo Sapiens
uggacgggaaggagaacagaggagagggaaagagaagcccaaccucugugaucauaugagggcc

SEQ ID NO: 91382 - RNA, 64 nt, Homo Sapiens
acagugguaguuagaggugaaaaguagagcugucaagcccaagggcuuagcuuuagggcuccuc

SEQ ID NO: 91383 - RNA, 64 nt, Homo Sapiens
ggguuauaacccaaacuauauaauaaauauuuacaagcccaaacuaauauaaaugauugaaugg

SEQ ID NO: 91384 - RNA, 64 nt, Homo Sapiens
uugaguuugcuaaugcuuccaacuuagucauuugaagcccaagagucuaauuuuauaugcccug

SEQ ID NO: 91385 - RNA, 64 nt, Homo Sapiens
guucuuuagcuuuuuauaauaucaaagugaaguaaagcccaaguagguguuuuuaguacaagac

SEQ ID NO: 91386 - RNA, 64 nt, Homo Sapiens
cugguuuuaaaguuaccugaguaauuaucuuaccaagcccaagaaugugaggcgauuauuuuaa

SEQ ID NO: 91387 - RNA, 64 nt, Homo Sapiens
cuauaacauuuuuacaauaagauguacaauuuauuaccuauauggaaguggccaacagauauaa

SEQ ID NO: 91388 - RNA, 64 nt, Homo Sapiens
uuauguagagaguuuauaugcacauaauaaccuguaccuauaaaucgugcaauaaccauaugcg

SEQ ID NO: 91389 - RNA, 64 nt, Homo Sapiens
uaaguguguaugauaaugaauugacugcuguuauuaccuauagcuauccaguauagcagugacu

SEQ ID NO: 91390 - RNA, 64 nt, Homo Sapiens
gcauaaggcauuaaaugacaucagaaugaauuuguaccuauaaaaaauuuccacaagcauugcu

SEQ ID NO: 91391 - RNA, 64 nt, Homo Sapiens
aauaugagaucugaagcacguuuggaucauuaaauaccuauauguucuauauaggaccauuaug

SEQ ID NO: 91392 - RNA, 64 nt, Homo Sapiens
uucgaauuucaacacuagaaugacuaaaacuaucuaccuauagaacuaucuguagauaguauac

SEQ ID NO: 91393 - RNA, 64 nt, Homo Sapiens
uaagaaauagaauuagggagaguuuacacuuacuuaccuauauaucagcagauuuuucuggaag

SEQ ID NO: 91394 - RNA, 64 nt, Homo Sapiens
auauaaaguaacauagcucuaaauaaauuauaaauaccuauaaaauaaauuguaaauaccuaua

SEQ ID NO: 91395 - RNA, 64 nt, Homo Sapiens
auaaauuauaaauaccuauaggauaaauuguaaauaccuauaaauuguagcuuuaucccaaucu

SEQ ID NO: 91396 - RNA, 64 nt, Homo Sapiens
aaauaccgcuguguuuguuucgccauggcuucagggaugcuacauggcucuugcaccuuuuacu

SEQ ID NO: 91397 - RNA, 64 nt, Homo Sapiens
ugaaaagugagaguuacgcauugcagccaugaagggaugcuaggaucaauuauggcaguaccuu

SEQ ID NO: 91398 - RNA, 64 nt, Homo Sapiens
aaaaacuacauggggaaacacugaguaugaagcgggaugcuauuuuguccacccugggacacuu

SEQ ID NO: 91399 - RNA, 64 nt, Homo Sapiens
uggggaugcuggacggcucacccucaaccccucuggaugcuacaugacaucccagaagcccagc

SEQ ID NO: 91400 - RNA, 64 nt, Homo Sapiens
acuaaccuugagaccugaggguuuccacagugggaaccccaauagggcuagggcucucagguag

SEQ ID NO: 91401 - RNA, 64 nt, Homo Sapiens
ugcuucaguguuaagaguggggcaaugaagagugaaccccaaugaagagugaucccaacuuugg

SEQ ID NO: 91402 - RNA, 64 nt, Homo Sapiens
cgcugacuggguggggacagacuuacucacucuuaaccccaauccccucagcugagcagugauc

SEQ ID NO: 91403 - RNA, 64 nt, Homo Sapiens
ugggcuugauggguggguuuacacucuagacugaaaccccaaagcuaccaaacaacagaaaccc

SEQ ID NO: 91404 - RNA, 64 nt, Homo Sapiens
gucaaggguaguagcuguauaaguaucucuccuuaaccccaauucugggcuuuucugggaauug

SEQ ID NO: 91405 - RNA, 64 nt, Homo Sapiens
guagucucuuuucuuucuguugcccuaaauaagaaaccccaaaucauuuguaguuugccccacc

SEQ ID NO: 91406 - RNA, 64 nt, Homo Sapiens
cuugguacccauucccauuucacaaacuccuccaaaccccaaaccccaaacggaaaucucuggg

SEQ ID NO: 91407 - RNA, 64 nt, Homo Sapiens
cccauucccauuucacaaacuccuccaaaccccaaaccccaaacggaaaucucugggacaaugg

SEQ ID NO: 91408 - RNA, 64 nt, Homo Sapiens
aacucucacucuugcucaagcuccucccuccccaaaccccaagguaaguaaaaaaucauuuuuc

SEQ ID NO: 91409 - RNA, 64 nt, Homo Sapiens
aauuccaucucguuucuucuucguccaccuucccaaccccaaacgcgugauacucaacauuuca

SEQ ID NO: 91410 - RNA, 64 nt, Homo Sapiens
ucaggccgaaugaucaagggggaacaggaaaagaaaccccaaacaacuuuugguaagggaaaag

SEQ ID NO: 91411 - RNA, 64 nt, Homo Sapiens
ugaagauuauuuuuuaugagaaacaacaaaaaauaaccccaaaaugauuuuuuuuuagaacaga

SEQ ID NO: 91412 - RNA, 64 nt, Homo Sapiens
cacgcugucucagaaaacgaaaacggaggaaaaaaaccccaaaccccaaacaaucuuaauaaac

SEQ ID NO: 91413 - RNA, 64 nt, Homo Sapiens
ucucagaaaacgaaaacggaggaaaaaaaccccaaaccccaaacaaucuuaauaaacacgacug

SEQ ID NO: 91414 - RNA, 64 nt, Homo Sapiens
cagucaggaagcugcccauucuuggaaggguuccaaccccaaguucugaggaucugacuugggu

SEQ ID NO: 91415 - RNA, 64 nt, Homo Sapiens
ucccuuugcuguaccugggcagaguugguaucucaaccccaagcaucgacaaggcgcauaaugg

SEQ ID NO: 91416 - RNA, 64 nt, Homo Sapiens
uaaauugcaaauuuuaaaauaauuauuaauuuaaaaccccaaagaaauugcaugagauuagcaa

SEQ ID NO: 91417 - RNA, 64 nt, Homo Sapiens
agaaaagaaaauggaauaauuggcuucuggcccaaaccccaagcuuuccaguauugguacaucu

SEQ ID NO: 91418 - RNA, 64 nt, Homo Sapiens
uccacugucaccaagcuggagcaagugaugaagcagaguggauggcagaagagaugucagcaaa

SEQ ID NO: 91419 - RNA, 64 nt, Homo Sapiens
uugacucuuccacaccugcccugcccugcuccagagaguggaccucugaccccacccugggcca

SEQ ID NO: 91420 - RNA, 56 nt, Homo Sapiens
uuuuauaggcagaaccuuagagaagaagaguggaagaugacggagaugcauuuuga

SEQ ID NO: 91421 - RNA, 64 nt, Homo Sapiens
aacaaagcagcaguuuuagccaggguucaaugauagaguggagguaaauuaagagccuccaggc

SEQ ID NO: 91422 - RNA, 64 nt, Homo Sapiens
ugggaagacagggaaaggaacacuuuccuaggagagaguggagacccuaccagcauccagguuc

SEQ ID NO: 91423 - RNA, 64 nt, Homo Sapiens
ccaggcuucucugaaaccagaucucaugggguccagaguggagucuggaguaccagcgcauauc

SEQ ID NO: 91424 - RNA, 64 nt, Homo Sapiens
cacauggagcaucagguagagccagaguggaaacagaguggaaaaauaguuuauguucucagca

SEQ ID NO: 91425 - RNA, 64 nt, Homo Sapiens
cagaguggaaacacauggaguguucucagcagccagaguggaaagcagggcugggaauaguuua

SEQ ID NO: 91426 - RNA, 64 nt, Homo Sapiens
cccacagcugauggucacuguuuuggcuggcuccagaguggacagguacgcucuguccacagca

SEQ ID NO: 91427 - RNA, 64 nt, Homo Sapiens
ucugaccucccugcuugcauugggucugggagagagaguggaauauuugguagggaccuugaca

SEQ ID NO: 91428 - RNA, 64 nt, Homo Sapiens
uacuccugugcucuggaggcugcagagcugacccagaguggagucugagucugaguccugucuc

SEQ ID NO: 91429 - RNA, 64 nt, Homo Sapiens
ucucugagcagucagggugggaagaaagaaugcaagaguggacugaaugugccuaauggagaag

SEQ ID NO: 91430 - RNA, 64 nt, Homo Sapiens
uuuuugaugaaaggugugcugaggcugugccuagagaguggagagagcuguccucgguguuacc

SEQ ID NO: 91431 - RNA, 64 nt, Homo Sapiens
gcgcagcccugacucccagguuuguguucuggccagaguggaguagcuuacagugccaaugccg

SEQ ID NO: 91432 - RNA, 64 nt, Homo Sapiens
cuguguuuuccaggaaauucauagagaagagaauagaguggaugaugugacuugaaguuuuugc

SEQ ID NO: 91433 - RNA, 64 nt, Homo Sapiens
aguuggcgugcugugugcacuguggauuaggaacagaguggagcuguaaccagucucuucucug

SEQ ID NO: 91434 - RNA, 64 nt, Homo Sapiens
guguuucaacucucuuuucauugcuguuuccagaagaguggagagugugguuucaggcaaggua

SEQ ID NO: 91435 - RNA, 64 nt, Homo Sapiens
uagagcgcgguuuuauuuuugugcugggagagucagaguggaugugccuuugcugagugugugu

SEQ ID NO: 91436 - RNA, 64 nt, Homo Sapiens
gcggccagcaaguuugagacgguaacacacaccaagaguggaguuccuuggcugucagagucag

SEQ ID NO: 91437 - RNA, 62 nt, Homo Sapiens
aggagcugacacguccucucggucgcgcucuucagucccacguccccgcccacccucugccu

SEQ ID NO: 91438 - RNA, 62 nt, Homo Sapiens
gguccacgauguacaaaguccauccguucucccagucccaaggcuuucgaagacucugcugc

SEQ ID NO: 91439 - RNA, 62 nt, Homo Sapiens
uuugauauuucuuauauacuuggaauauguuacagucccacagaaauggauuguuggugcuu

SEQ ID NO: 91440 - RNA, 62 nt, Homo Sapiens
aaauggauuguuggugcuuugcuguuuacaugcagucccaagcaugaauuugugaugucuuu

SEQ ID NO: 91441 - RNA, 62 nt, Homo Sapiens
ucgccccucugugccuaugcuaccagcugggucagucccaucggggcuggcgggcggcggcu

SEQ ID NO: 91442 - RNA, 62 nt, Homo Sapiens
agcaaccgccccuuccccaaauucauggagaccagucccagucugaacgccuccgcaggcag

SEQ ID NO: 91443 - RNA, 62 nt, Homo Sapiens
ccugugagcaccgagaagaacugggcgacucccagucccaccugugcugugacagucccacg

SEQ ID NO: 91444 - RNA, 62 nt, Homo Sapiens
cugggcgacucccagucccaccugugcugugacagucccacguggcuaugacagacuguuua

SEQ ID NO: 91445 - RNA, 62 nt, Homo Sapiens
gcagggcccaguccaggggccccaggccuccccagucccagugugcgagccccacuuggaca

SEQ ID NO: 91446 - RNA, 62 nt, Homo Sapiens
aggacaugccucccaccaaauguccccugcuccagucccacuccugucaccccacgcucugc

SEQ ID NO: 91447 - RNA, 62 nt, Homo Sapiens
ccucucucucccaggucccagccccuuuuccccagucccagacaauuccauucaaucuuugg

SEQ ID NO: 91448 - RNA, 62 nt, Homo Sapiens
aggaaagguuuuccuuauuuugugugcuuucccagucccauuccucagcuucuucacaggca

SEQ ID NO: 91449 - RNA, 62 nt, Homo Sapiens
cccagccgcuuggcgaugccagccaagcucugcagucccagcggugggaccuagggaggcau

SEQ ID NO: 91450 - RNA, 62 nt, Homo Sapiens
aggcgagaagggcugcuucccugaagcucccacagucccaucugcuucaggcccccgccuug

SEQ ID NO: 91451 - RNA, 62 nt, Homo Sapiens
cuguggccaggccuuacaucacugugcagacccagucccacaacccuguccugcagucccac

SEQ ID NO: 91452 - RNA, 62 nt, Homo Sapiens
cugugcagacccagucccacgacccuguccugcagucccacaccuggcagggccaccugcag

SEQ ID NO: 91453 - RNA, 62 nt, Homo Sapiens
cccacucaugcuguuccugaggccgcccucuccagucccaggagccgugucuagaguuccug

SEQ ID NO: 91454 - RNA, 62 nt, Homo Sapiens
accgugguggaggaagucacccagcuguuucucagucccagaggccgguggcugguuuugaa

SEQ ID NO: 91455 - RNA, 62 nt, Homo Sapiens
acuucguaccugcucaggagcccccacugucccagucccacucaggcccaucucuggcuggc

SEQ ID NO: 91456 - RNA, 62 nt, Homo Sapiens
cacggaagccaggaaucaaacugccuggguuccagucccagcucugccaguuaugcccagcu

SEQ ID NO: 91457 - RNA, 62 nt, Homo Sapiens
gccauugagacuaguaacgggcguucugggcacagucccacugugcacagguuugagaggac

SEQ ID NO: 91458 - RNA, 62 nt, Homo Sapiens
ggugguccccaacagugccuagggguacaguacagucccauuacacuagagcagggcucuau

SEQ ID NO: 91459 - RNA, 62 nt, Homo Sapiens
gcacugcccuaggagcccggaccccacgagcucagucccagcucugccucugacucgcugug

SEQ ID NO: 91460 - RNA, 62 nt, Homo Sapiens
ggccauggcuuuccugcaagaccacugacgagcagucccauggugauaaagggcagcccggc

SEQ ID NO: 91461 - RNA, 62 nt, Homo Sapiens
cucagaacccaggauaggaagaaucccagaggcagucccagcggguggagggcagucccuca

SEQ ID NO: 91462 - RNA, 62 nt, Homo Sapiens
agggccccuagccagggacacucuuccagccacagucccaugccaaccuccggggcgaccuu

SEQ ID NO: 91463 - RNA, 62 nt, Homo Sapiens
ccacccuccugcccugugcccagguguugggacagucccacccucccugcuauuuauauccc

SEQ ID NO: 91464 - RNA, 62 nt, Homo Sapiens
cugccuccucugaggaaucuggcccugucugacagucccagaccccccguucucuccucuuu

SEQ ID NO: 91465 - RNA, 64 nt, Homo Sapiens
cugucucuguuaaguguuuuaucuagucuaacuccaacagaaauauuaagggcugugaaaagaa

SEQ ID NO: 91466 - RNA, 64 nt, Homo Sapiens
cccaugccgccuguccaguuuggcugcagcuggacaacagaagcgaaauagaugucugcacucc

SEQ ID NO: 91467 - RNA, 64 nt, Homo Sapiens
aaauugaagauacuggcuaaaauuauuuguacagcaacagaaguuguaagcccuaguaauggcc

SEQ ID NO: 91468 - RNA, 64 nt, Homo Sapiens
acucacacauacaaguacacucuaaugcagaaaucaacagaaucggguuucuuuucuuuuugcc

SEQ ID NO: 91469 - RNA, 64 nt, Homo Sapiens
uuauucucuuaacaguuccauggguggcuuuaaacaacagaaauuagaacaaauuaccacaaac

SEQ ID NO: 91470 - RNA, 64 nt, Homo Sapiens
uuuauuggauuuaguacugaaacauauauauacacaacagaaaguacuauauauguuacauacu

SEQ ID NO: 91471 - RNA, 64 nt, Homo Sapiens
uucagaaguuuggcaauagucagcaguugaaugacaacagaagcuuucacauacagcccucccc

SEQ ID NO: 91472 - RNA, 64 nt, Homo Sapiens
aguugagucgucaucacuuugggccaagacuuggcaacagaagccacuacaugugguuuauaga

SEQ ID NO: 91473 - RNA, 64 nt, Homo Sapiens
ucaagucucuuccagagugcggaaaguaccugaccaacagaacuggggcagggacuguguucag

SEQ ID NO: 91474 - RNA, 64 nt, Homo Sapiens
aaaaacgaaaaacaaaaaaauuuugcuugggcaccaacagaauuuccucuuuguagaugaugua

SEQ ID NO: 91475 - RNA, 64 nt, Homo Sapiens
guaucugagcagugauaccaaccacaucugaagucaacagaagauccaaguuuaaaauugccug

SEQ ID NO: 91476 - RNA, 64 nt, Homo Sapiens
aaaaaaucacacuauauuaauauuuuauauuugccaacagaaacauggcagauagguaucaaua

SEQ ID NO: 91477 - RNA, 64 nt, Homo Sapiens
uugcuagguuuugcuacaugcccaggaucugcuccaacagaauagugguagccaucaagcacuu

SEQ ID NO: 91478 - RNA, 64 nt, Homo Sapiens
agggacaagaggguucacacuacaagggagaagacaacagaaagggaaagccucuguccgccuu

SEQ ID NO: 91479 - RNA, 64 nt, Homo Sapiens
gaaauccuaauccuucuguuccccagaacucagacaacagaaaggaacucuagccaaaggcaag

SEQ ID NO: 91480 - RNA, 64 nt, Homo Sapiens
cuagccaaaggcaagccccaguggagaaaaauaucaacagaacuggaagaaaggcugagucuag

SEQ ID NO: 91481 - RNA, 64 nt, Homo Sapiens
uuucacuucgggacauuuaauaauggaccaaauucaacagaacaccaggaaggucaagacgcuc

SEQ ID NO: 91482 - RNA, 64 nt, Homo Sapiens
uuccugauaaauaagaggugaugacauggauauacaacagaaaacacuuugaguugaaaguaaa

SEQ ID NO: 91483 - RNA, 64 nt, Homo Sapiens
aauccaucagacagaggaaucaauaauaaaacugcaacagaacuaucaacuguauacuuauuug

SEQ ID NO: 91484 - RNA, 64 nt, Homo Sapiens
guugaaauaagaaacaagaguauuacuuuuccuacaacagaaccuggugaaacuucagguauug

SEQ ID NO: 91485 - RNA, 64 nt, Homo Sapiens
auugugauuuuuuuguaaaagaagcuguacgaaucaucauaaauaauuccaauagucugcacuu

SEQ ID NO: 91486 - RNA, 64 nt, Homo Sapiens
uaacuacauuaggguuugcgggucugauggucgccaucauaacugcauacucaacucugccguu

SEQ ID NO: 91487 - RNA, 64 nt, Homo Sapiens
aguaucuguugcauuaaggcacauagugggauuacaucauaaaccucccauaauuuuugucauu

SEQ ID NO: 91488 - RNA, 64 nt, Homo Sapiens
uuuuuauuuuugucauguagaauacuacuguggucaucauaauguaaucuauuucuguaccuuu

SEQ ID NO: 91489 - RNA, 64 nt, Homo Sapiens
gucauugaucccuggcucagaggauagcgguuuccaucauaaaccaagaugaugaguucagccu

SEQ ID NO: 91490 - RNA, 64 nt, Homo Sapiens
ccuccuguucccugggucagaggauagcgguuuccaucauaaaccaagaugaugaguucagccu

SEQ ID NO: 91491 - RNA, 64 nt, Homo Sapiens
ucaaaaaauccuaaaacauacaucccuauaaacccaucauaaagcucagcuugaaauggggcug

SEQ ID NO: 91492 - RNA, 64 nt, Homo Sapiens
uaaaaaugcauauaacguuaauucccaauaaacccaucauaagucucgauuuacauugugguua

SEQ ID NO: 91493 - RNA, 64 nt, Homo Sapiens
ccaccaccuucaguaacaaggguacgauaugggggucugccaagcugugaggaccaguagccac

SEQ ID NO: 91494 - RNA, 64 nt, Homo Sapiens
gcaggcccuuagggcaggaagggacgaugagcaagucugccacaccaccuggugacugggaagg

SEQ ID NO: 91495 - RNA, 64 nt, Homo Sapiens
agugggagacggcagugcaauccugaugagugaugucugccaggcaccguaaguuugauuagug

SEQ ID NO: 91496 - RNA, 64 nt, Homo Sapiens
augucugccaggcaccguaaguuugauuagugaugucugccacgggcagggauggaaggagcag

SEQ ID NO: 91497 - RNA, 64 nt, Homo Sapiens
uuagcugagaagaauuaucuaaucaauuagugaugucugccauggaugcaguagaggaaagugg

SEQ ID NO: 91498 - RNA, 64 nt, Homo Sapiens
cuagcaggagagcaugcccauauuggcuuacuuugucugccacagacacagacagagggaguug

SEQ ID NO: 91499 - RNA, 64 nt, Homo Sapiens
ggcccugggccugccucaccacggaccaaagggagucugccagggccccucuccccagggaagc

SEQ ID NO: 91500 - RNA, 64 nt, Homo Sapiens
uggcucuacuuccccauggcccugagcgaguggagucugccacccaggauccccaaggcacuug

SEQ ID NO: 91501 - RNA, 64 nt, Homo Sapiens
aaugcaagcauaauaucuggaaaauuugcugccugccuucuacuucucaaaucuuucuuguaaa

SEQ ID NO: 91502 - RNA, 64 nt, Homo Sapiens
uuaacuaacuagaucuauugaauuucagagaagagccuucuaacuuguuuacacaaaaacgagu

SEQ ID NO: 91503 - RNA, 64 nt, Homo Sapiens
auacuguaagguaaugagcucaaaugauguuuuugccuucuaauuuggaaaaugauuuuuuuuc

SEQ ID NO: 91504 - RNA, 64 nt, Homo Sapiens
aggaaaguguagauuggaaaauggcaaauguuaagccuucuaaaucuuguacauaacuauuucg

SEQ ID NO: 91505 - RNA, 64 nt, Homo Sapiens
uguauuguuccuuugugcucuaagcagcacacuugccuucuauuuauuuaaguguaaacauuuc

SEQ ID NO: 91506 - RNA, 64 nt, Homo Sapiens
aguucauuuacaguucuaaauguaauguuuuuaagccuucuaucuuuuuaggacacaguuuguu

SEQ ID NO: 91507 - RNA, 64 nt, Homo Sapiens
ggcccuguauucccccuggaaggaagggaaucaugccuucuauauacagacagauugccuucag

SEQ ID NO: 91508 - RNA, 64 nt, Homo Sapiens
gcuuaccauuuucaccuuccuugccuaugcccuugccuucuaguuccaaauauuuuagccagcu

SEQ ID NO: 91509 - RNA, 64 nt, Homo Sapiens; identical to SEQ ID NO: 88257

SEQ ID NO: 91510 - RNA, 64 nt, Homo Sapiens; identical to SEQ ID NO: 88258

SEQ ID NO: 91511 - RNA, 64 nt, Homo Sapiens; identical to SEQ ID NO: 88259

SEQ ID NO: 91512 - RNA, 64 nt, Homo Sapiens; identical to SEQ ID NO: 88260

SEQ ID NO: 91513 - RNA, 64 nt, Homo Sapiens; identical to SEQ ID NO: 88261

SEQ ID NO: 91514 - RNA, 64 nt, Homo Sapiens; identical to SEQ ID NO: 88262

SEQ ID NO: 91515 - RNA, 64 nt, Homo Sapiens; identical to SEQ ID NO: 88263

SEQ ID NO: 91516 - RNA, 64 nt, Homo Sapiens; identical to SEQ ID NO: 88264

SEQ ID NO: 91517 - RNA, 64 nt, Homo Sapiens; identical to SEQ ID NO: 88265

SEQ ID NO: 91518 - RNA, 64 nt, Homo Sapiens; identical to SEQ ID NO: 88266

SEQ ID NO: 91519 - RNA, 64 nt, Homo Sapiens; identical to SEQ ID NO: 88267

SEQ ID NO: 91520 - RNA, 64 nt, Homo Sapiens; identical to SEQ ID NO: 88268

SEQ ID NO: 91521 - RNA, 64 nt, Homo Sapiens; identical to SEQ ID NO: 88269

SEQ ID NO: 91522 - RNA, 64 nt, Homo Sapiens; identical to SEQ ID NO: 88270

SEQ ID NO: 91523 - RNA, 64 nt, Homo Sapiens; identical to SEQ ID NO: 88271

SEQ ID NO: 91524 - RNA, 64 nt, Homo Sapiens; identical to SEQ ID NO: 88269

SEQ ID NO: 91525 - RNA, 64 nt, Homo Sapiens; identical to SEQ ID NO: 88273

SEQ ID NO: 91526 - RNA, 64 nt, Homo Sapiens; identical to SEQ ID NO: 88274

SEQ ID NO: 91527 - RNA, 64 nt, Homo Sapiens; identical to SEQ ID NO: 88275

SEQ ID NO: 91528 - RNA, 64 nt, Homo Sapiens; identical to SEQ ID NO: 88276

SEQ ID NO: 91529 - RNA, 64 nt, Homo Sapiens; identical to SEQ ID NO: 88277

SEQ ID NO: 91530 - RNA, 64 nt, Homo Sapiens; identical to SEQ ID NO: 88278

SEQ ID NO: 91531 - RNA, 64 nt, Homo Sapiens; identical to SEQ ID NO: 88279

SEQ ID NO: 91532 - RNA, 64 nt, Homo Sapiens; identical to SEQ ID NO: 88280

SEQ ID NO: 91533 - RNA, 64 nt, Homo Sapiens; identical to SEQ ID NO: 88281

SEQ ID NO: 91534 - RNA, 64 nt, Homo Sapiens; identical to SEQ ID NO: 88282

SEQ ID NO: 91535 - RNA, 64 nt, Homo Sapiens; identical to SEQ ID NO: 88283

SEQ ID NO: 91536 - RNA, 64 nt, Homo Sapiens; identical to SEQ ID NO: 88284

SEQ ID NO: 91537 - RNA, 64 nt, Homo Sapiens; identical to SEQ ID NO: 88285

SEQ ID NO: 91538 - RNA, 64 nt, Homo Sapiens; identical to SEQ ID NO: 88286

SEQ ID NO: 91539 - RNA, 64 nt, Homo Sapiens; identical to SEQ ID NO: 88287

SEQ ID NO: 91540 - RNA, 64 nt, Homo Sapiens; identical to SEQ ID NO: 88288

SEQ ID NO: 91541 - RNA, 64 nt, Homo Sapiens; identical to SEQ ID NO: 88289

SEQ ID NO: 91542 - RNA, 64 nt, Homo Sapiens; identical to SEQ ID NO: 88290

SEQ ID NO: 91543 - RNA, 64 nt, Homo Sapiens; identical to SEQ ID NO: 88291

SEQ ID NO: 91544 - RNA, 64 nt, Homo Sapiens; identical to SEQ ID NO: 88292

SEQ ID NO: 91545 - RNA, 64 nt, Homo Sapiens; identical to SEQ ID NO: 88293

SEQ ID NO: 91546 - RNA, 64 nt, Homo Sapiens; identical to SEQ ID NO: 88294

SEQ ID NO: 91547 - RNA, 64 nt, Homo Sapiens; identical to SEQ ID NO: 88295

SEQ ID NO: 91548 - RNA, 64 nt, Homo Sapiens; identical to SEQ ID NO: 88296

SEQ ID NO: 91549 - RNA, 64 nt, Homo Sapiens; identical to SEQ ID NO: 88297

SEQ ID NO: 91550 - RNA, 64 nt, Homo Sapiens; identical to SEQ ID NO: 88298

SEQ ID NO: 91551 - RNA, 64 nt, Homo Sapiens; identical to SEQ ID NO: 88299

SEQ ID NO: 91552 - RNA, 64 nt, Homo Sapiens; identical to SEQ ID NO: 88300

SEQ ID NO: 91553 - RNA, 64 nt, Homo Sapiens; identical to SEQ ID NO: 88298

SEQ ID NO: 91554 - RNA, 64 nt, Homo Sapiens; identical to SEQ ID NO: 88302

SEQ ID NO: 91555 - RNA, 64 nt, Homo Sapiens; identical to SEQ ID NO: 88300

SEQ ID NO: 91556 - RNA, 64 nt, Homo Sapiens; identical to SEQ ID NO: 88304

SEQ ID NO: 91557 - RNA, 64 nt, Homo Sapiens; identical to SEQ ID NO: 88305

SEQ ID NO: 91558 - RNA, 64 nt, Homo Sapiens; identical to SEQ ID NO: 88306

SEQ ID NO: 91559 - RNA, 64 nt, Homo Sapiens; identical to SEQ ID NO: 88307

SEQ ID NO: 91560 - RNA, 64 nt, Homo Sapiens; identical to SEQ ID NO: 88299

SEQ ID NO: 91561 - RNA, 64 nt, Homo Sapiens; identical to SEQ ID NO: 88309

SEQ ID NO: 91562 - RNA, 64 nt, Homo Sapiens; identical to SEQ ID NO: 88310

SEQ ID NO: 91563 - RNA, 64 nt, Homo Sapiens; identical to SEQ ID NO: 88311

SEQ ID NO: 91564 - RNA, 64 nt, Homo Sapiens; identical to SEQ ID NO: 88312

SEQ ID NO: 91565 - RNA, 64 nt, Homo Sapiens; identical to SEQ ID NO: 88313

SEQ ID NO: 91566 - RNA, 64 nt, Homo Sapiens; identical to SEQ ID NO: 88314

SEQ ID NO: 91567 - RNA, 64 nt, Homo Sapiens; identical to SEQ ID NO: 88315

SEQ ID NO: 91568 - RNA, 64 nt, Homo Sapiens; identical to SEQ ID NO: 88316

SEQ ID NO: 91569 - RNA, 64 nt, Homo Sapiens; identical to SEQ ID NO: 88317

SEQ ID NO: 91570 - RNA, 64 nt, Homo Sapiens; identical to SEQ ID NO: 88318

SEQ ID NO: 91571 - RNA, 64 nt, Homo Sapiens; identical to SEQ ID NO: 88319

SEQ ID NO: 91572 - RNA, 64 nt, Homo Sapiens; identical to SEQ ID NO: 88320

SEQ ID NO: 91573 - RNA, 64 nt, Homo Sapiens; identical to SEQ ID NO: 88321

SEQ ID NO: 91574 - RNA, 64 nt, Homo Sapiens; identical to SEQ ID NO: 88322

SEQ ID NO: 91575 - RNA, 64 nt, Homo Sapiens; identical to SEQ ID NO: 88323

SEQ ID NO: 91576 - RNA, 64 nt, Homo Sapiens; identical to SEQ ID NO: 88324

SEQ ID NO: 91577 - RNA, 64 nt, Homo Sapiens; identical to SEQ ID NO: 88325

SEQ ID NO: 91578 - RNA, 64 nt, Homo Sapiens; identical to SEQ ID NO: 88326

SEQ ID NO: 91579 - RNA, 64 nt, Homo Sapiens; identical to SEQ ID NO: 88327

SEQ ID NO: 91580 - RNA, 64 nt, Homo Sapiens; identical to SEQ ID NO: 88328

SEQ ID NO: 91581 - RNA, 64 nt, Homo Sapiens; identical to SEQ ID NO: 88329

SEQ ID NO: 91582 - RNA, 64 nt, Homo Sapiens; identical to SEQ ID NO: 88330

SEQ ID NO: 91583 - RNA, 64 nt, Homo Sapiens
uucccggccucacgcacccugcccaccagccccucggaagcaugugacaacagcagaggguaca

SEQ ID NO: 91584 - RNA, 64 nt, Homo Sapiens
caagcugauccugcugcaccacaagcacccagaacggaagcaggcaccacuaacuuaugaaaag

SEQ ID NO: 91585 - RNA, 64 nt, Homo Sapiens; identical to SEQ ID NO: 58312

SEQ ID NO: 91586 - RNA, 64 nt, Homo Sapiens; identical to SEQ ID NO: 58313

SEQ ID NO: 91587 - RNA, 64 nt, Homo Sapiens; identical to SEQ ID NO: 58314

SEQ ID NO: 91588 - RNA, 64 nt, Homo Sapiens; identical to SEQ ID NO: 58315

SEQ ID NO: 91589 - RNA, 64 nt, Homo Sapiens; identical to SEQ ID NO: 58316

SEQ ID NO: 91590 - RNA, 64 nt, Homo Sapiens; identical to SEQ ID NO: 58317

SEQ ID NO: 91591 - RNA, 64 nt, Homo Sapiens; identical to SEQ ID NO: 58318

SEQ ID NO: 91592 - RNA, 64 nt, Homo Sapiens; identical to SEQ ID NO: 58319

SEQ ID NO: 91593 - RNA, 64 nt, Homo Sapiens; identical to SEQ ID NO: 58320

SEQ ID NO: 91594 - RNA, 64 nt, Homo Sapiens; identical to SEQ ID NO: 58321

SEQ ID NO: 91595 - RNA, 64 nt, Homo Sapiens; identical to SEQ ID NO: 58322

SEQ ID NO: 91596 - RNA, 64 nt, Homo Sapiens; identical to SEQ ID NO: 58323

SEQ ID NO: 91597 - RNA, 64 nt, Homo Sapiens; identical to SEQ ID NO: 58324

SEQ ID NO: 91598 - RNA, 64 nt, Homo Sapiens; identical to SEQ ID NO: 58325

SEQ ID NO: 91599 - RNA, 64 nt, Homo Sapiens; identical to SEQ ID NO: 58326

SEQ ID NO: 91600 - RNA, 64 nt, Homo Sapiens; identical to SEQ ID NO: 58327

SEQ ID NO: 91601 - RNA, 64 nt, Homo Sapiens; identical to SEQ ID NO: 58328

SEQ ID NO: 91602 - RNA, 64 nt, Homo Sapiens; identical to SEQ ID NO: 58329

SEQ ID NO: 91603 - RNA, 64 nt, Homo Sapiens; identical to SEQ ID NO: 58330

SEQ ID NO: 91604 - RNA, 64 nt, Homo Sapiens; identical to SEQ ID NO: 58331

SEQ ID NO: 91605 - RNA, 64 nt, Homo Sapiens; identical to SEQ ID NO: 58332

SEQ ID NO: 91606 - RNA, 64 nt, Homo Sapiens; identical to SEQ ID NO: 58333

SEQ ID NO: 91607 - RNA, 64 nt, Homo Sapiens; identical to SEQ ID NO: 58334

SEQ ID NO: 91608 - RNA, 64 nt, Homo Sapiens; identical to SEQ ID NO: 58335

SEQ ID NO: 91609 - RNA, 64 nt, Homo Sapiens; identical to SEQ ID NO: 58336

SEQ ID NO: 91610 - RNA, 64 nt, Homo Sapiens; identical to SEQ ID NO: 58337

SEQ ID NO: 91611 - RNA, 64 nt, Homo Sapiens; identical to SEQ ID NO: 58338

SEQ ID NO: 91612 - RNA, 64 nt, Homo Sapiens; identical to SEQ ID NO: 58339

SEQ ID NO: 91613 - RNA, 64 nt, Homo Sapiens; identical to SEQ ID NO: 58340

SEQ ID NO: 91614 - RNA, 64 nt, Homo Sapiens; identical to SEQ ID NO: 58341

SEQ ID NO: 91615 - RNA, 64 nt, Homo Sapiens; identical to SEQ ID NO: 58342

SEQ ID NO: 91616 - RNA, 64 nt, Homo Sapiens; identical to SEQ ID NO: 58343

SEQ ID NO: 91617 - RNA, 64 nt, Homo Sapiens; identical to SEQ ID NO: 58344

SEQ ID NO: 91618 - RNA, 64 nt, Homo Sapiens; identical to SEQ ID NO: 58345

SEQ ID NO: 91619 - RNA, 64 nt, Homo Sapiens; identical to SEQ ID NO: 58346

SEQ ID NO: 91620 - RNA, 64 nt, Homo Sapiens; identical to SEQ ID NO: 58347

SEQ ID NO: 91621 - RNA, 64 nt, Homo Sapiens; identical to SEQ ID NO: 58348

SEQ ID NO: 91622 - RNA, 64 nt, Homo Sapiens; identical to SEQ ID NO: 58349

SEQ ID NO: 91623 - RNA, 64 nt, Homo Sapiens; identical to SEQ ID NO: 58350

SEQ ID NO: 91624 - RNA, 64 nt, Homo Sapiens; identical to SEQ ID NO: 58351

SEQ ID NO: 91625 - RNA, 64 nt, Homo Sapiens; identical to SEQ ID NO: 58352

SEQ ID NO: 91626 - RNA, 64 nt, Homo Sapiens; identical to SEQ ID NO: 58353

SEQ ID NO: 91627 - RNA, 64 nt, Homo Sapiens; identical to SEQ ID NO: 58354

SEQ ID NO: 91628 - RNA, 64 nt, Homo Sapiens; identical to SEQ ID NO: 58355

SEQ ID NO: 91629 - RNA, 64 nt, Homo Sapiens; identical to SEQ ID NO: 58356

SEQ ID NO: 91630 - RNA, 64 nt, Homo Sapiens; identical to SEQ ID NO: 58357

SEQ ID NO: 91631 - RNA, 64 nt, Homo Sapiens; identical to SEQ ID NO: 58358

SEQ ID NO: 91632 - RNA, 64 nt, Homo Sapiens; identical to SEQ ID NO: 58359

SEQ ID NO: 91633 - RNA, 64 nt, Homo Sapiens; identical to SEQ ID NO: 58360

SEQ ID NO: 91634 - RNA, 64 nt, Homo Sapiens; identical to SEQ ID NO: 58361

SEQ ID NO: 91635 - RNA, 64 nt, Homo Sapiens; identical to SEQ ID NO: 58362

SEQ ID NO: 91636 - RNA, 64 nt, Homo Sapiens; identical to SEQ ID NO: 58363

SEQ ID NO: 91637 - RNA, 64 nt, Homo Sapiens; identical to SEQ ID NO: 58364

SEQ ID NO: 91638 - RNA, 64 nt, Homo Sapiens; identical to SEQ ID NO: 58365

SEQ ID NO: 91639 - RNA, 64 nt, Homo Sapiens; identical to SEQ ID NO: 58366

SEQ ID NO: 91640 - RNA, 64 nt, Homo Sapiens; identical to SEQ ID NO: 58367

SEQ ID NO: 91641 - RNA, 64 nt, Homo Sapiens; identical to SEQ ID NO: 58368

SEQ ID NO: 91642 - RNA, 64 nt, Homo Sapiens; identical to SEQ ID NO: 58369

SEQ ID NO: 91643 - RNA, 64 nt, Homo Sapiens; identical to SEQ ID NO: 58370

SEQ ID NO: 91644 - RNA, 64 nt, Homo Sapiens; identical to SEQ ID NO: 58371

SEQ ID NO: 91645 - RNA, 64 nt, Homo Sapiens; identical to SEQ ID NO: 58372

SEQ ID NO: 91646 - RNA, 64 nt, Homo Sapiens; identical to SEQ ID NO: 58373

SEQ ID NO: 91647 - RNA, 64 nt, Homo Sapiens; identical to SEQ ID NO: 58374

SEQ ID NO: 91648 - RNA, 64 nt, Homo Sapiens; identical to SEQ ID NO: 58375

SEQ ID NO: 91649 - RNA, 64 nt, Homo Sapiens; identical to SEQ ID NO: 58376

SEQ ID NO: 91650 - RNA, 64 nt, Homo Sapiens; identical to SEQ ID NO: 58377

SEQ ID NO: 91651 - RNA, 64 nt, Homo Sapiens; identical to SEQ ID NO: 58378

SEQ ID NO: 91652 - RNA, 64 nt, Homo Sapiens; identical to SEQ ID NO: 58379

SEQ ID NO: 91653 - RNA, 64 nt, Homo Sapiens; identical to SEQ ID NO: 58380

SEQ ID NO: 91654 - RNA, 64 nt, Homo Sapiens; identical to SEQ ID NO: 58381

SEQ ID NO: 91655 - RNA, 64 nt, Homo Sapiens; identical to SEQ ID NO: 58382

SEQ ID NO: 91656 - RNA, 64 nt, Homo Sapiens; identical to SEQ ID NO: 58383

SEQ ID NO: 91657 - RNA, 64 nt, Homo Sapiens; identical to SEQ ID NO: 58384

SEQ ID NO: 91658 - RNA, 64 nt, Homo Sapiens; identical to SEQ ID NO: 58385

SEQ ID NO: 91659 - RNA, 64 nt, Homo Sapiens; identical to SEQ ID NO: 58386

SEQ ID NO: 91660 - RNA, 64 nt, Homo Sapiens; identical to SEQ ID NO: 58387

SEQ ID NO: 91661 - RNA, 64 nt, Homo Sapiens; identical to SEQ ID NO: 58388

SEQ ID NO: 91662 - RNA, 64 nt, Homo Sapiens; identical to SEQ ID NO: 58389

SEQ ID NO: 91663 - RNA, 64 nt, Homo Sapiens; identical to SEQ ID NO: 58390

SEQ ID NO: 91664 - RNA, 64 nt, Homo Sapiens; identical to SEQ ID NO: 58391

SEQ ID NO: 91665 - RNA, 64 nt, Homo Sapiens; identical to SEQ ID NO: 58392

SEQ ID NO: 91666 - RNA, 64 nt, Homo Sapiens; identical to SEQ ID NO: 58393

SEQ ID NO: 91667 - RNA, 64 nt, Homo Sapiens; identical to SEQ ID NO: 58394

SEQ ID NO: 91668 - RNA, 64 nt, Homo Sapiens; identical to SEQ ID NO: 58395

SEQ ID NO: 91669 - RNA, 64 nt, Homo Sapiens; identical to SEQ ID NO: 58396

SEQ ID NO: 91670 - RNA, 64 nt, Homo Sapiens; identical to SEQ ID NO: 58397

SEQ ID NO: 91671 - RNA, 64 nt, Homo Sapiens; identical to SEQ ID NO: 58398

SEQ ID NO: 91672 - RNA, 64 nt, Homo Sapiens; identical to SEQ ID NO: 58399

SEQ ID NO: 91673 - RNA, 64 nt, Homo Sapiens; identical to SEQ ID NO: 58400

SEQ ID NO: 91674 - RNA, 64 nt, Homo Sapiens; identical to SEQ ID NO: 58401

SEQ ID NO: 91675 - RNA, 64 nt, Homo Sapiens; identical to SEQ ID NO: 58402

SEQ ID NO: 91676 - RNA, 64 nt, Homo Sapiens; identical to SEQ ID NO: 58403

SEQ ID NO: 91677 - RNA, 64 nt, Homo Sapiens; identical to SEQ ID NO: 58404

SEQ ID NO: 91678 - RNA, 64 nt, Homo Sapiens; identical to SEQ ID NO: 58405

SEQ ID NO: 91679 - RNA, 64 nt, Homo Sapiens; identical to SEQ ID NO: 58406

SEQ ID NO: 91680 - RNA, 64 nt, Homo Sapiens; identical to SEQ ID NO: 58407

SEQ ID NO: 91681 - RNA, 64 nt, Homo Sapiens; identical to SEQ ID NO: 58408

SEQ ID NO: 91682 - RNA, 64 nt, Homo Sapiens; identical to SEQ ID NO: 58409

SEQ ID NO: 91683 - RNA, 64 nt, Homo Sapiens; identical to SEQ ID NO: 58410

SEQ ID NO: 91684 - RNA, 64 nt, Homo Sapiens; identical to SEQ ID NO: 58411

SEQ ID NO: 91685 - RNA, 64 nt, Homo Sapiens; identical to SEQ ID NO: 58412

SEQ ID NO: 91686 - RNA, 64 nt, Homo Sapiens; identical to SEQ ID NO: 58413

SEQ ID NO: 91687 - RNA, 64 nt, Homo Sapiens; identical to SEQ ID NO: 58414

SEQ ID NO: 91688 - RNA, 64 nt, Homo Sapiens; identical to SEQ ID NO: 58415

SEQ ID NO: 91689 - RNA, 64 nt, Homo Sapiens; identical to SEQ ID NO: 58416

SEQ ID NO: 91690 - RNA, 64 nt, Homo Sapiens; identical to SEQ ID NO: 58417

SEQ ID NO: 91691 - RNA, 64 nt, Homo Sapiens; identical to SEQ ID NO: 58418

SEQ ID NO: 91692 - RNA, 64 nt, Homo Sapiens; identical to SEQ ID NO: 58419

SEQ ID NO: 91693 - RNA, 64 nt, Homo Sapiens; identical to SEQ ID NO: 58420

SEQ ID NO: 91694 - RNA, 64 nt, Homo Sapiens; identical to SEQ ID NO: 58421

SEQ ID NO: 91695 - RNA, 64 nt, Homo Sapiens; identical to SEQ ID NO: 58422

SEQ ID NO: 91696 - RNA, 64 nt, Homo Sapiens; identical to SEQ ID NO: 58423

SEQ ID NO: 91697 - RNA, 64 nt, Homo Sapiens; identical to SEQ ID NO: 58424

SEQ ID NO: 91698 - RNA, 64 nt, Homo Sapiens; identical to SEQ ID NO: 58425

SEQ ID NO: 91699 - RNA, 64 nt, Homo Sapiens; identical to SEQ ID NO: 58426

SEQ ID NO: 91700 - RNA, 64 nt, Homo Sapiens; identical to SEQ ID NO: 58427

SEQ ID NO: 91701 - RNA, 64 nt, Homo Sapiens; identical to SEQ ID NO: 58428

SEQ ID NO: 91702 - RNA, 64 nt, Homo Sapiens; identical to SEQ ID NO: 58429

SEQ ID NO: 91703 - RNA, 64 nt, Homo Sapiens; identical to SEQ ID NO: 58430

SEQ ID NO: 91704 - RNA, 64 nt, Homo Sapiens; identical to SEQ ID NO: 58431

SEQ ID NO: 91705 - RNA, 64 nt, Homo Sapiens; identical to SEQ ID NO: 58432

SEQ ID NO: 91706 - RNA, 64 nt, Homo Sapiens; identical to SEQ ID NO: 58433

SEQ ID NO: 91707 - RNA, 64 nt, Homo Sapiens; identical to SEQ ID NO: 58434

SEQ ID NO: 91708 - RNA, 64 nt, Homo Sapiens; identical to SEQ ID NO: 58435

SEQ ID NO: 91709 - RNA, 50 nt, Homo Sapiens; identical to SEQ ID NO: 58436

SEQ ID NO: 91710 - RNA, 64 nt, Homo Sapiens; identical to SEQ ID NO: 58437

SEQ ID NO: 91711 - RNA, 64 nt, Homo Sapiens; identical to SEQ ID NO: 58438

SEQ ID NO: 91712 - RNA, 64 nt, Homo Sapiens; identical to SEQ ID NO: 58439

SEQ ID NO: 91713 - RNA, 64 nt, Homo Sapiens; identical to SEQ ID NO: 58440

SEQ ID NO: 91714 - RNA, 64 nt, Homo Sapiens; identical to SEQ ID NO: 58441

SEQ ID NO: 91715 - RNA, 64 nt, Homo Sapiens; identical to SEQ ID NO: 58442

SEQ ID NO: 91716 - RNA, 64 nt, Homo Sapiens; identical to SEQ ID NO: 58443

SEQ ID NO: 91717 - RNA, 64 nt, Homo Sapiens; identical to SEQ ID NO: 58444

SEQ ID NO: 91718 - RNA, 64 nt, Homo Sapiens; identical to SEQ ID NO: 58445

SEQ ID NO: 91719 - RNA, 64 nt, Homo Sapiens; identical to SEQ ID NO: 58446

SEQ ID NO: 91720 - RNA, 64 nt, Homo Sapiens; identical to SEQ ID NO: 58447

SEQ ID NO: 91721 - RNA, 64 nt, Homo Sapiens; identical to SEQ ID NO: 58448

SEQ ID NO: 91722 - RNA, 64 nt, Homo Sapiens; identical to SEQ ID NO: 58449

SEQ ID NO: 91723 - RNA, 64 nt, Homo Sapiens; identical to SEQ ID NO: 58450

SEQ ID NO: 91724 - RNA, 64 nt, Homo Sapiens; identical to SEQ ID NO: 58451

SEQ ID NO: 91725 - RNA, 64 nt, Homo Sapiens; identical to SEQ ID NO: 58452

SEQ ID NO: 91726 - RNA, 64 nt, Homo Sapiens; identical to SEQ ID NO: 58453

SEQ ID NO: 91727 - RNA, 64 nt, Homo Sapiens; identical to SEQ ID NO: 58454

SEQ ID NO: 91728 - RNA, 64 nt, Homo Sapiens; identical to SEQ ID NO: 58455

SEQ ID NO: 91729 - RNA, 64 nt, Homo Sapiens; identical to SEQ ID NO: 58456

SEQ ID NO: 91730 - RNA, 64 nt, Homo Sapiens; identical to SEQ ID NO: 58457

SEQ ID NO: 91731 - RNA, 64 nt, Homo Sapiens; identical to SEQ ID NO: 58458

SEQ ID NO: 91732 - RNA, 64 nt, Homo Sapiens; identical to SEQ ID NO: 58459

SEQ ID NO: 91733 - RNA, 64 nt, Homo Sapiens; identical to SEQ ID NO: 58460

SEQ ID NO: 91734 - RNA, 64 nt, Homo Sapiens; identical to SEQ ID NO: 58461

SEQ ID NO: 91735 - RNA, 64 nt, Homo Sapiens; identical to SEQ ID NO: 58462

SEQ ID NO: 91736 - RNA, 64 nt, Homo Sapiens; identical to SEQ ID NO: 58463

SEQ ID NO: 91737 - RNA, 64 nt, Homo Sapiens; identical to SEQ ID NO: 58464

SEQ ID NO: 91738 - RNA, 64 nt, Homo Sapiens; identical to SEQ ID NO: 58465

SEQ ID NO: 91739 - RNA, 64 nt, Homo Sapiens; identical to SEQ ID NO: 58466

SEQ ID NO: 91740 - RNA, 64 nt, Homo Sapiens; identical to SEQ ID NO: 58467

SEQ ID NO: 91741 - RNA, 64 nt, Homo Sapiens
aagcgacaggaggccagcuccugggguuccugggagccgggaacagauuggcuacggaacgccc

SEQ ID NO: 91742 - RNA, 64 nt, Homo Sapiens
ucccugcccuugccguggguccggcguuccucccagccgggaucacagugggcagccggcaccc

SEQ ID NO: 91743 - RNA, 64 nt, Homo Sapiens
cuggggcccugcagugcgcucuaggcugugcgugagccgggacuguacccacagcuugcugagg

SEQ ID NO: 91744 - RNA, 64 nt, Homo Sapiens
agggcugcucuucuugggccagggaaagcagggcagccgggaccugcggcugugccuggacuga

SEQ ID NO: 91745 - RNA, 64 nt, Homo Sapiens
cagagguggccugggaccgccaguugcacgccugccaccucagccagcccccgcccagcucauc

SEQ ID NO: 91746 - RNA, 64 nt, Homo Sapiens
agccucgccuuucuacccaggcccccugcccugcccaccucaggcccccacccuccacuccucc

SEQ ID NO: 91747 - RNA, 64 nt, Homo Sapiens
ugcagccucgaccucccaggcucaagugauccucccaccucagccuccagaguagcuaggacua

SEQ ID NO: 91748 - RNA, 64 nt, Homo Sapiens
gcuggucucaaacuccuggguucaagccauccucccaccucagccucccaaaaugcugggauua

SEQ ID NO: 91749 - RNA, 64 nt, Homo Sapiens
uguagucucgaccucccaggcucaagcuguccucccaccucagccucccaaguagcugagacua

SEQ ID NO: 91750 - RNA, 64 nt, Homo Sapiens
gcuggucucaaacuccugggcucaagcgauccucccaccucagcuucucaaaguucugggacua

SEQ ID NO: 91751 - RNA, 64 nt, Homo Sapiens
aaaagccuugaccuccugggcucaggugauccucccaccucagccuccugaguagcuaggacua

SEQ ID NO: 91752 - RNA, 64 nt, Homo Sapiens
ugcagccucugccuccugggcucaaacaguccucccaccucagccuucugaguagcugagacua

SEQ ID NO: 91753 - RNA, 64 nt, Homo Sapiens
uucguagggaccuugauuuucagccacucugugcccaccucaucuucugccucccucaugcucg

SEQ ID NO: 91754 - RNA, 64 nt, Homo Sapiens
ggcacccucacugcuggugaccguguaagcuaucccaccucagcaccaaacaugacuguucuuu

SEQ ID NO: 91755 - RNA, 64 nt, Homo Sapiens
gcauugucaguaggauacaucuuaaccagaaccgccaccucaaugagauuucaguuucccaggg

SEQ ID NO: 91756 - RNA, 64 nt, Homo Sapiens
gcauugucaguagaauacaucuuaaccagaaccgccaccucaaugagauuucaguuucccaggg

SEQ ID NO: 91757 - RNA, 64 nt, Homo Sapiens
ugcagcuuugaccucccagacccaagugauccucccaccucagccucccucagagcugggacua

SEQ ID NO: 91758 - RNA, 64 nt, Homo Sapiens
gcugaucucgagcuccugggcucaagugauccucccaccucagccucccaaagugcugggauua

SEQ ID NO: 91759 - RNA, 64 nt, Homo Sapiens
cagggaacuucugagaaguuaucugcagagagccccaccucacucccuuuggcuacccuggccg

SEQ ID NO: 91760 - RNA, 64 nt, Homo Sapiens
gugucacugaucacaggugucaccguaguggcuaccaccucagggcagccccucccuccagcug

SEQ ID NO: 91761 - RNA, 64 nt, Homo Sapiens
uaaauaugugaaauuuuaucccugugcccuuuccccaccucaggcccuaccccuggacccuccc

SEQ ID NO: 91762 - RNA, 64 nt, Homo Sapiens
uccccccccgccccucugcuucccuccccacccaccaccucaaggguagggaguugcucuuccu

SEQ ID NO: 91763 - RNA, 64 nt, Homo Sapiens
ugcaaccuccaccucccagacucaagccauccucccaccucaaccucccaaguagcugggacua

SEQ ID NO: 91764 - RNA, 64 nt, Homo Sapiens
cucuuuacagccucucucugugacuggaaucucuccaccucaucguaucuaaggauaacccaga

SEQ ID NO: 91765 - RNA, 64 nt, Homo Sapiens
ccugcuugcugcugcuuuacuacauuccagaugcccaccucauccaauuuccagagccacuauc

SEQ ID NO: 91766 - RNA, 64 nt, Homo Sapiens
ugcagccucgaccuccccagcucaagcaauccucccaccucagccuccuaaguaccugguacua

SEQ ID NO: 91767 - RNA, 64 nt, Homo Sapiens
gcuggucuugaacuccugaacucaagugauccgcccaccucagccucccaaaguguugggauua

SEQ ID NO: 91768 - RNA, 64 nt, Homo Sapiens
cucccaaagcgguggaauuacucaagcagucugcccaccucagagguggucucgaauuccugga

SEQ ID NO: 91769 - RNA, 64 nt, Homo Sapiens
cauccaaauagcugggaccacucaagcgauucucccaccucagcuauagccuugaccucucagg

SEQ ID NO: 91770 - RNA, 64 nt, Homo Sapiens
aaaaaaaaaaagaauccaauacaagagugagacuccaccucaaacccggcacuccagccuggcg

SEQ ID NO: 91771 - RNA, 64 nt, Homo Sapiens
cucccagcuaauugagaccacccaagugauccuuccaccucaguuuuuuuuuaacccuccuggg

SEQ ID NO: 91772 - RNA, 64 nt, Homo Sapiens
gggcaaauggggucggggggucaagggacagggaccaccucaccaggcccggcccggcgagugg

SEQ ID NO: 91773 - RNA, 64 nt, Homo Sapiens
cuuucgugaauguucuccacccccauccccgaccccaccucacuggcccugcuggucccugucg

SEQ ID NO: 91774 - RNA, 64 nt, Homo Sapiens
gcaguucaagcaauucuccucacuucagccuccgccaccucaaggcaguggugugaucucggcu

SEQ ID NO: 91775 - RNA, 64 nt, Homo Sapiens
cucccaaagcauuaggauuaaaacuccuuggcuuccaccucagcucauagcucacugcagccug

SEQ ID NO: 91776 - RNA, 64 nt, Homo Sapiens
ccccagguaacugggacuacuuuaagcaauccucccaccucagcgcagccucaacugccccagg

SEQ ID NO: 91777 - RNA, 64 nt, Homo Sapiens
cucccaaagugcugagauuacucaaaugacccacccaccucagcgcuagucuugaacuccugac

SEQ ID NO: 91778 - RNA, 64 nt, Homo Sapiens
ccuggucucaaacuccuguccucaagugauccucccaccucagccuuucaaagugcuggaauua

SEQ ID NO: 91779 - RNA, 64 nt, Homo Sapiens
ugcaagcuccgccuccuggguucacgccauucucccaccucagcuucccaagcagcugggacua

SEQ ID NO: 91780 - RNA, 64 nt, Homo Sapiens
uuugggguucucugcuugaaugucuucuccuuuaccaccucaccuuguugguaccucccucccu

SEQ ID NO: 91781 - RNA, 64 nt, Homo Sapiens
ugggucugucugaggaaggagggggucccgccuuccaccucaacacaucccuucagugacucag

SEQ ID NO: 91782 - RNA, 64 nt, Homo Sapiens
cucccaaagugcuuggaugacucaagugauccucccaccucagccuggucucuuaacuccuagg

SEQ ID NO: 91783 - RNA, 64 nt, Homo Sapiens
cucccauguggcugggacuacucaaaugauccuuccaccucagcugccgcuucaaucuccuggg

SEQ ID NO: 91784 - RNA, 64 nt, Homo Sapiens
gcuggucucaaacucuugaccucaggugauccacccaccucagccucccaaagugcugggauua

SEQ ID NO: 91785 - RNA, 64 nt, Homo Sapiens
cugcagccucaaccuccugggcuaagugauccucccaccucagccucccgaauagcugggacua

SEQ ID NO: 91786 - RNA, 64 nt, Homo Sapiens
uauucucaaccuccugggcucaaaugaucuccucccaccucagccucccaaguagcugagacua

SEQ ID NO: 91787 - RNA, 64 nt, Homo Sapiens
gcuggucucaaacuccuggccucaagcaauccucccaccucagccuccuaaagcacugggauua

SEQ ID NO: 91788 - RNA, 64 nt, Homo Sapiens
agacaccuccagcacagcuugaccccagcgccuaccaccucaacucguggccuacgggcagagg

SEQ ID NO: 91789 - RNA, 64 nt, Homo Sapiens
gaacagaaagcauuugcccuaagaugaaaaccacccaccucaagcucucaccgcugccauugag

SEQ ID NO: 91790 - RNA, 64 nt, Homo Sapiens
gcccacagccaagguagggugcauggcacucuucccaccucaguuggcuucugucuguagagcc

SEQ ID NO: 91791 - RNA, 64 nt, Homo Sapiens
cugccaggauggcgugugugaaagacuuguguccccaccucaggagaugcacgaugcugggguc

SEQ ID NO: 91792 - RNA, 64 nt, Homo Sapiens
cucuggaguagcugggacuacucaagugauccuuccaccucagcugcagccuugaacucccaga

SEQ ID NO: 91793 - RNA, 64 nt, Homo Sapiens
cucucaaagugcugggauuacucaggugauccacccaccucagcgcuggucucaaacuccugcc

SEQ ID NO: 91794 - RNA, 64 nt, Homo Sapiens
uucuggcugucccuacccugcaccccagagaccuccaccucaacuuucucaucucauuggcccc

SEQ ID NO: 91795 - RNA, 64 nt, Homo Sapiens
cugacacacagccagcuggcagcacccccaucugccaccucagaccccucuaguuucaugggcg

SEQ ID NO: 91796 - RNA, 64 nt, Homo Sapiens
cuccuaaaguccuaggauuauucaagugauccucccaccucagcgcuggucucgaauuccugga

SEQ ID NO: 91797 - RNA, 64 nt, Homo Sapiens
cucccaagggugugugugaccucaagugauccucccaccucagcugcaaccucugccuccugag

SEQ ID NO: 91798 - RNA, 64 nt, Homo Sapiens
caaugccacagaccccugagcgccagacccugccccaccucacuucccucccuucccgcugagc

SEQ ID NO: 91799 - RNA, 64 nt, Homo Sapiens
gaggauuguaauucccaccccucuugcuucuuccccaccucaccaucucccagacccucuuccc

SEQ ID NO: 91800 - RNA, 64 nt, Homo Sapiens
cuccaggacauuccuuucccugccuggcccagccccaccucagucgguuugaauguugguucca

SEQ ID NO: 91801 - RNA, 54 nt, Homo Sapiens
cagggccccucccuugccugggggccaccucaucaggggagggccaaggcauga

SEQ ID NO: 91802 - RNA, 64 nt, Homo Sapiens
uuagauggaagcauuuccuauccagugugaauaaaaagaacaguuguaguaaauuauuauaaag

SEQ ID NO: 91803 - RNA, 64 nt, Homo Sapiens
ccaaacacuaugucagauggggguaaaauccauuaaagaacaggaaaaaauaauuauaagauga

SEQ ID NO: 91804 - RNA, 64 nt, Homo Sapiens
aagugugcuaacaucgaauauagagaaaacugguaaagaacauuccaguaggaaaagaaaagaa

SEQ ID NO: 91805 - RNA, 64 nt, Homo Sapiens
gaaaacugguaaagaacauuccaguaggaaaagaaaagaacaaucuuccauuucugggcuuggc

SEQ ID NO: 91806 - RNA, 64 nt, Homo Sapiens
ggaauuuuguuuuugguuucugccucuuaacuuaaaagaacauagcauccaaauaggagucuuc

SEQ ID NO: 91807 - RNA, 64 nt, Homo Sapiens
guugaaauuggaaaggacuuccuguaguggcaaaaaagaacaguauaacaccaucuggagucuu

SEQ ID NO: 91808 - RNA, 64 nt, Homo Sapiens
auugauauuugugcugaggugauauuccugucuaaaagaacaacauugucuuucuuuucuagca

SEQ ID NO: 91809 - RNA, 64 nt, Homo Sapiens
ucagucauuguuaguucuugucuaguuuucauuaaaagaacaaagaucuuuuauauggauaucu

SEQ ID NO: 91810 - RNA, 64 nt, Homo Sapiens
ucagcuuauauuuuuuaucuuguaaaaccaacaaaaagaacaaaagguugucuaaguguuuuua

SEQ ID NO: 91811 - RNA, 64 nt, Homo Sapiens
auaucucagguugucuaaguuuuuuaaucaucaaaaagaacaacgcgcccggccuuaaauguuu

SEQ ID NO: 91812 - RNA, 64 nt, Homo Sapiens
uguuuccuugaaugcuugcuuaauauuucaagauaaagaacaaaggaaaaaaaucucugcucau

SEQ ID NO: 91813 - RNA, 64 nt, Homo Sapiens
aagaagacauaagacuucagcaaaccaaauguggaaagaacacaaucaaugagaaucuguucac

SEQ ID NO: 91814 - RNA, 64 nt, Homo Sapiens
uaauaaauguauguguggggcauauuugagaagaaaagaacauucucucacuagaguuaccauu

SEQ ID NO: 91815 - RNA, 64 nt, Homo Sapiens
acugaaaaaguucaucugauauaauuauugaaaaaaagaacacgaaccuauggcaguugguuga

SEQ ID NO: 91816 - RNA, 64 nt, Homo Sapiens
gaagguggucauuccuucaaacuaaagaagcuguaaagaacauuuuuuuuuuuuuuuaaguaac

SEQ ID NO: 91817 - RNA, 64 nt, Homo Sapiens
uugucaaucugaacagagcacugcgcccggccaaaaagaacauugggauuacaggcgugagcca

SEQ ID NO: 91818 - RNA, 64 nt, Homo Sapiens
auaaaagcuuucuguaguugcuuccuuuaucagaaaagaacauuugauaccaugguauaucauu

SEQ ID NO: 91819 - RNA, 64 nt, Homo Sapiens
auuugauaccaugguauaucauuuccucuucauuaaagaacagcuuuucuaaauguugggggaa

SEQ ID NO: 91820 - RNA, 64 nt, Homo Sapiens
uauuuuuacuuuuuuauuauaauuuugauauuaaaaagaacagagauggggucuugcuuuguug

SEQ ID NO: 91821 - RNA, 64 nt, Homo Sapiens
cauuuuuguauuuuaauagucuacaggcuauauaaaagaacauggcuuuuugacugauaaaagu

SEQ ID NO: 91822 - RNA, 64 nt, Homo Sapiens
cucugucaccccgccgccacgagcccagugacagaaagaacagccccgcugcuccugccccuug

SEQ ID NO: 91823 - RNA, 64 nt, Homo Sapiens
uucucauugauguugugaaauuuauucagacuuuaaagaacaauaaaagaaaagcuagaauuua

SEQ ID NO: 91824 - RNA, 64 nt, Homo Sapiens
uauucaagccuguugucuuaacauuuuguauaaaaaagaacaacagaaauuaucugucauuuga

SEQ ID NO: 91825 - RNA, 64 nt, Homo Sapiens
aagaaucuaaaagauaacagauuauuugcuuaugaaagaacaauauagucugggaaucccagaa

SEQ ID NO: 91826 - RNA, 64 nt, Homo Sapiens
accugggucaacucuuuuaauuuauauacaaagcaaagaacaacauuaauggagaugcacaaug

SEQ ID NO: 91827 - RNA, 64 nt, Homo Sapiens
gaagauuuuuuucuauuuaaaaccccauuuuccuaaagaacaaaguaguaaaauaaaaaaaaau

SEQ ID NO: 91828 - RNA, 64 nt, Homo Sapiens
aaugaacauguuuauugcagauucuucuuuuuugaaagaacaacagcaaaacauccacaacucu

SEQ ID NO: 91829 - RNA, 64 nt, Homo Sapiens
uuuaucuauugucaguauuuuauguugaauauguaaagaacauuaaaguccuaaaacaucuaag

SEQ ID NO: 91830 - RNA, 64 nt, Homo Sapiens
agucccugaugcaguauguuuauuugugauguuuaaagaacauuucuuggcugggcgcugcggc

SEQ ID NO: 91831 - RNA, 64 nt, Homo Sapiens
auaaauagaaagagagagagaggaaaaaaaaagaaaagaacacuucuuuauuugagggacuuuc

SEQ ID NO: 91832 - RNA, 64 nt, Homo Sapiens
acgacuuuucauggauauugagagagaacaaguuaaagaacaacaaaggcaaaaagaacaaaag

SEQ ID NO: 91833 - RNA, 64 nt, Homo Sapiens
ugagagagaacaaguuaaagaacaacaaaggcaaaaagaacaaaagaagaaaauugaaaaguaa

SEQ ID NO: 91834 - RNA, 64 nt, Homo Sapiens
uguuaauauuuuuuaaaaauauuaagcacaagauaaagaacagcaaauuuauaccuauuugugu

SEQ ID NO: 91835 - RNA, 64 nt, Homo Sapiens
ugccuaaauuauaaauugguaaccagucauuuucaaagaacaggagguggcaguuuauuucuca

SEQ ID NO: 91836 - RNA, 64 nt, Homo Sapiens
aauuauaagcauaaaaacucagggcuuuuuuuucaaagaacaaaauaauguuuuacuaugauuu

SEQ ID NO: 91837 - RNA, 64 nt, Homo Sapiens
auuuauguauuguaugacagcaauauccuuuuuuaaagaacagauaaagugcucauugcuucuu

SEQ ID NO: 91838 - RNA, 64 nt, Homo Sapiens
ucuuguaaaguuucuuaacuguuuuuuugaggagaaagaacagauuuauuuauagacuuaacuu

SEQ ID NO: 91839 - RNA, 64 nt, Homo Sapiens
auaaaaacccaaaguuccuuauuuugaaauugucaaagaacaaagcgguguuuuucuuuuaaac

SEQ ID NO: 91840 - RNA, 64 nt, Homo Sapiens
agaguacacaaguauaguggcccaggauguagugaaagaacaaauccuagagucuuugaaauuu

SEQ ID NO: 91841 - RNA, 64 nt, Homo Sapiens
uaaugucaagucuacaucgacugguaaaacauucaaagaacaaacugacaaugauguucuaccu

SEQ ID NO: 91842 - RNA, 64 nt, Homo Sapiens
auguuauguagacauuauacccucuguacuuucuaaagaacaaacuccugugaucuaugcagga

SEQ ID NO: 91843 - RNA, 64 nt, Homo Sapiens
aaaagaugaaugaaagaaccuauuuuacuuuuuuaaagaacagacuugagauauuccaaaguuu

SEQ ID NO: 91844 - RNA, 64 nt, Homo Sapiens
ucugaaaaucaccauuuuaauauacugccugaccaaagaacaaaggacuucuuucagagagcuu

SEQ ID NO: 91845 - RNA, 64 nt, Homo Sapiens
aaagagaaaagccuucuguguuugcugguucaggaaagaacaggguccagucaggguccugaag

SEQ ID NO: 91846 - RNA, 64 nt, Homo Sapiens
acaucagaaugcuccucucuauuauagaaauuccaaagaacagcaguucuguguuuauuuuuua

SEQ ID NO: 91847 - RNA, 64 nt, Homo Sapiens
aaaagcacagcucucacuggccaguagcugccaaaaagaacacccaucguauaaggaaauccag

SEQ ID NO: 91848 - RNA, 64 nt, Homo Sapiens
cucucucauguggggauguuugugcugcagacaaaaagaacaaaaaaaaauuuuuaaauaccac

SEQ ID NO: 91849 - RNA, 64 nt, Homo Sapiens
auguaaauucaugaauaauggucucaacagcagaaaagaacaaaggugugugugaaacagugaa

SEQ ID NO: 91850 - RNA, 64 nt, Homo Sapiens
cagugauuugaaaaaggaaaaacuggugacuaccaaagaacaagccaggaaacuguagcuucuu

SEQ ID NO: 91851 - RNA, 64 nt, Homo Sapiens
aauuaggaagcauuucgaaccugcgcaacagaccaaagaacaguacaaagaacauccguguacc

SEQ ID NO: 91852 - RNA, 64 nt, Homo Sapiens
uuucgaaccugcgcaacagaccaaagaacaguacaaagaacauccguguacccaguacccugac

SEQ ID NO: 91853 - RNA, 64 nt, Homo Sapiens
guggaaagcacugcagcgauuucucaaagacauaaaagaacauagcauucaacccagcauccca

SEQ ID NO: 91854 - RNA, 64 nt, Homo Sapiens
acauauacaccauggaauacuaugcagccauaaaaaagaacaagacuguguccuuuacagcaac

SEQ ID NO: 91855 - RNA, 64 nt, Homo Sapiens
aaaaaaaaaagaacuuguacgaaaagguuaaaaaaaagaacaaaucaaaggguuaagucuauuu

SEQ ID NO: 91856 - RNA, 64 nt, Homo Sapiens
caaaauaaacucagugcucaauuuauuagaaaucaaagaacacuugcacaugauuuuuaaaggu

SEQ ID NO: 91857 - RNA, 64 nt, Homo Sapiens
acuguguauuggucauggauuaauaagaucuugcaaagaacaguaguauaacauuuguauaauu

SEQ ID NO: 91858 - RNA, 64 nt, Homo Sapiens
ugaaaaaugauauuuugucuuguugaaaggcacaaaagaacacccuuuaucaaguuauaaaaua

SEQ ID NO: 91859 - RNA, 64 nt, Homo Sapiens
acugugcaaagccccaguagucggauuccggggaaaagaacaaguaucuaguuuugaugacaau

SEQ ID NO: 91860 - RNA, 64 nt, Homo Sapiens
cauuugagcuggucuggagcagaguuucucccucaaagaacacagagaaaucagagaguggcug

SEQ ID NO: 91861 - RNA, 64 nt, Homo Sapiens
ugaucaaugacuguagcuuuuuagacuguuggucaaagaacauucuacuucacaguaauagcuc

SEQ ID NO: 91862 - RNA, 64 nt, Homo Sapiens
aacugaauugaaucaaccaguuugcauuuaaauaaaagaacaggcucaguggucuuccuguaga

SEQ ID NO: 91863 - RNA, 64 nt, Homo Sapiens
aggagcggaguuguuaaggaaugaccuccaccaaagcccauauaagaccugcaggugcugcccc

SEQ ID NO: 91864 - RNA, 64 nt, Homo Sapiens
cccuugagauagauggcuacgcuaaguauuguggagcccauagcguuuacacuuggggacaagu

SEQ ID NO: 91865 - RNA, 64 nt, Homo Sapiens
uaauugcuggaaaauuguaugucaccauagugauagcccauaaagugugauuuauuaaguugua

SEQ ID NO: 91866 - RNA, 64 nt, Homo Sapiens
caaagauaauggauugcacauuuuaaauauuaauagcccauauauugugguuccaaaauaauuu

SEQ ID NO: 91867 - RNA, 64 nt, Homo Sapiens
uaaaauaaaaauaaaagucuaauuuucuuuucuguccaaacaaggacucuaaugaaagcugaug

SEQ ID NO: 91868 - RNA, 64 nt, Homo Sapiens
cuugcugugcccuuuaaugguuucagaucguguuuccaaacaccgccacggauugcaggccaaa

SEQ ID NO: 91869 - RNA, 64 nt, Homo Sapiens
ucacucaggaagggaggcucaaagccaccucauuuccaaacaucuuacagacaagcuuauuucc

SEQ ID NO: 91870 - RNA, 64 nt, Homo Sapiens
guccaaugccaugagacugauauuuaugucaauguccaaacaaacauauggugauaugccaaaa

SEQ ID NO: 91871 - RNA, 64 nt, Homo Sapiens
aaaggaaauaauuguuuuauucuguugaaugcaguccaaacaugacauauauuuuauauccucu

SEQ ID NO: 91872 - RNA, 64 nt, Homo Sapiens
uugagcucucuaaccuccuucuaccugaaaaacauccaaacacccagugacaauaaacaaagua

SEQ ID NO: 91873 - RNA, 64 nt, Homo Sapiens
gccucucucuuuacuuggacuaaaggauucucacuccaaacaugcuggaaauaaauauaguuau

SEQ ID NO: 91874 - RNA, 64 nt, Homo Sapiens
aacaacaaaauaacauguuuucccaaugcuaauuuccaaacaacuuccucuguuauauagcuuu

SEQ ID NO: 91875 - RNA, 64 nt, Homo Sapiens
aacuuugagagcagugggguuuuuuuucagaaguuccaaacagcaugcagagguuugcuuugcu

SEQ ID NO: 91876 - RNA, 64 nt, Homo Sapiens
caaacaaacacucacugcauauaaacaaucaaaauccaaacaaaaacaaaacaaaacauaaaau

SEQ ID NO: 91877 - RNA, 64 nt, Homo Sapiens
gguaguuuuaugucaaaauaauaaaaaauuccucuccaaacaugaucuuaccgagcuguagaaa

SEQ ID NO: 91878 - RNA, 64 nt, Homo Sapiens
uccugcuuccuucauuggggaaaagaugaaaguguccaaacacacugaaaagauggcauagcuu

SEQ ID NO: 91879 - RNA, 64 nt, Homo Sapiens
acagagggccuccaagugagaaauuuggauagagaaugaggaagugggccuugaaggauggaug

SEQ ID NO: 91880 - RNA, 64 nt, Homo Sapiens
aaucauucacaacugagcaacauuaacucuccucaaugaggaagcaccagccagcuuacacagg

SEQ ID NO: 91881 - RNA, 64 nt, Homo Sapiens
aagcaaaagcagaaaccccuuuguggcaagaaaaaaugaggaagggcaaaagacacuucuuaca

SEQ ID NO: 91882 - RNA, 64 nt, Homo Sapiens
aagcaaaaguggaaaccccuuggcagcaagagaaaaugaggaagggugaaaggcacuucuuaca

SEQ ID NO: 91883 - RNA, 64 nt, Homo Sapiens
aaucaccuuaaaacauguuccccagcuaccguuaaaugaggacacucucugugguuugacuuac

SEQ ID NO: 91884 - RNA, 64 nt, Homo Sapiens
ucuaagaggcauaugcugcuuauguuagauaacaaaugaggaugcccugaaaccaugauuggca

SEQ ID NO: 91885 - RNA, 64 nt, Homo Sapiens
uggcuggcauuuuuccccuuaaggauagaguuggaaugaggauggaauuuugugaagcugcauu

SEQ ID NO: 91886 - RNA, 64 nt, Homo Sapiens
cagccuugacuucuugcccacgggccuuauggagaaugaggauucuucuuagcccacauuccuc

SEQ ID NO: 91887 - RNA, 64 nt, Homo Sapiens
ugcaguaaacagaauucagguaucauugcccaagaaugaggauaguuggccucucucuucacuu

SEQ ID NO: 91888 - RNA, 64 nt, Homo Sapiens
uagucauuauuccuuuucagguaacauucacccaaaugaggauagcucaucugguccugaagua

SEQ ID NO: 91889 - RNA, 64 nt, Homo Sapiens
uguguuggcucacuacguagaacauauccaaaauaaugaggaaagaaugccuucaacugaaaaa

SEQ ID NO: 91890 - RNA, 64 nt, Homo Sapiens
ugccacaaauuguauggugaucuacaauguagaaaaugaggaaacauuuauuuacacucuugau

SEQ ID NO: 91891 - RNA, 64 nt, Homo Sapiens
cagagacuaugugguccaucgccuucauuguguaaaugaggacacagacuggcuuggucgcagu

SEQ ID NO: 91892 - RNA, 64 nt, Homo Sapiens
acugcccggccugccucccaccuggaagucugggaaugaggagauugagauaaacuuuugaaau

SEQ ID NO: 91893 - RNA, 64 nt, Homo Sapiens
gagaagauaaaggaaacuucaacgugcucuucuaaaugaggaggcucccagacguagaguagga

SEQ ID NO: 91894 - RNA, 64 nt, Homo Sapiens
gaaagguuucaaauuuagggaguagcauuugggcaaugaggaagaaaaagauaagauuuacuca

SEQ ID NO: 91895 - RNA, 64 nt, Homo Sapiens
uucaugaugauuuaggaauuacggaacuuuuuuuaaugaggaauuuuaaacgagcuauuauggu

SEQ ID NO: 91896 - RNA, 64 nt, Homo Sapiens
uuugacauucaaauuaugugaaauaaagaaguggaaugaggagcucuaauauucacauaaacug

SEQ ID NO: 91897 - RNA, 64 nt, Homo Sapiens; identical to SEQ ID NO: 45477

SEQ ID NO: 91898 - RNA, 64 nt, Homo Sapiens; identical to SEQ ID NO: 45478

SEQ ID NO: 91899 - RNA, 64 nt, Homo Sapiens; identical to SEQ ID NO: 45479

SEQ ID NO: 91900 - RNA, 64 nt, Homo Sapiens; identical to SEQ ID NO: 45480

SEQ ID NO: 91901 - RNA, 64 nt, Homo Sapiens; identical to SEQ ID NO: 45481

SEQ ID NO: 91902 - RNA, 64 nt, Homo Sapiens; identical to SEQ ID NO: 45482

SEQ ID NO: 91903 - RNA, 64 nt, Homo Sapiens; identical to SEQ ID NO: 45483

SEQ ID NO: 91904 - RNA, 64 nt, Homo Sapiens; identical to SEQ ID NO: 45484

SEQ ID NO: 91905 - RNA, 64 nt, Homo Sapiens; identical to SEQ ID NO: 45485

SEQ ID NO: 91906 - RNA, 64 nt, Homo Sapiens; identical to SEQ ID NO: 45486

SEQ ID NO: 91907 - RNA, 64 nt, Homo Sapiens; identical to SEQ ID NO: 45487

SEQ ID NO: 91908 - RNA, 56 nt, Homo Sapiens; identical to SEQ ID NO: 45488

SEQ ID NO: 91909 - RNA, 64 nt, Homo Sapiens; identical to SEQ ID NO: 45489

SEQ ID NO: 91910 - RNA, 64 nt, Homo Sapiens; identical to SEQ ID NO: 45490

SEQ ID NO: 91911 - RNA, 64 nt, Homo Sapiens; identical to SEQ ID NO: 45491

SEQ ID NO: 91912 - RNA, 64 nt, Homo Sapiens; identical to SEQ ID NO: 45492

SEQ ID NO: 91913 - RNA, 64 nt, Homo Sapiens; identical to SEQ ID NO: 45493

SEQ ID NO: 91914 - RNA, 64 nt, Homo Sapiens; identical to SEQ ID NO: 45494

SEQ ID NO: 91915 - RNA, 64 nt, Homo Sapiens; identical to SEQ ID NO: 45495

SEQ ID NO: 91916 - RNA, 64 nt, Homo Sapiens; identical to SEQ ID NO: 45496

SEQ ID NO: 91917 - RNA, 64 nt, Homo Sapiens; identical to SEQ ID NO: 45497

SEQ ID NO: 91918 - RNA, 64 nt, Homo Sapiens; identical to SEQ ID NO: 45498

SEQ ID NO: 91919 - RNA, 64 nt, Homo Sapiens; identical to SEQ ID NO: 45499

SEQ ID NO: 91920 - RNA, 64 nt, Homo Sapiens; identical to SEQ ID NO: 45500

SEQ ID NO: 91921 - RNA, 64 nt, Homo Sapiens; identical to SEQ ID NO: 45501

SEQ ID NO: 91922 - RNA, 64 nt, Homo Sapiens; identical to SEQ ID NO: 45502

SEQ ID NO: 91923 - RNA, 64 nt, Homo Sapiens; identical to SEQ ID NO: 45503

SEQ ID NO: 91924 - RNA, 64 nt, Homo Sapiens; identical to SEQ ID NO: 45504

SEQ ID NO: 91925 - RNA, 64 nt, Homo Sapiens; identical to SEQ ID NO: 45505

SEQ ID NO: 91926 - RNA, 64 nt, Homo Sapiens; identical to SEQ ID NO: 45506

SEQ ID NO: 91927 - RNA, 64 nt, Homo Sapiens; identical to SEQ ID NO: 45507

SEQ ID NO: 91928 - RNA, 64 nt, Homo Sapiens; identical to SEQ ID NO: 45508

SEQ ID NO: 91929 - RNA, 64 nt, Homo Sapiens; identical to SEQ ID NO: 45509

SEQ ID NO: 91930 - RNA, 64 nt, Homo Sapiens; identical to SEQ ID NO: 45510

SEQ ID NO: 91931 - RNA, 64 nt, Homo Sapiens; identical to SEQ ID NO: 45511

SEQ ID NO: 91932 - RNA, 64 nt, Homo Sapiens; identical to SEQ ID NO: 45512

SEQ ID NO: 91933 - RNA, 64 nt, Homo Sapiens; identical to SEQ ID NO: 45513

SEQ ID NO: 91934 - RNA, 64 nt, Homo Sapiens; identical to SEQ ID NO: 45514

SEQ ID NO: 91935 - RNA, 64 nt, Homo Sapiens; identical to SEQ ID NO: 45515

SEQ ID NO: 91936 - RNA, 64 nt, Homo Sapiens; identical to SEQ ID NO: 45516

SEQ ID NO: 91937 - RNA, 64 nt, Homo Sapiens; identical to SEQ ID NO: 45517

SEQ ID NO: 91938 - RNA, 64 nt, Homo Sapiens; identical to SEQ ID NO: 45518

SEQ ID NO: 91939 - RNA, 64 nt, Homo Sapiens; identical to SEQ ID NO: 45519

SEQ ID NO: 91940 - RNA, 64 nt, Homo Sapiens; identical to SEQ ID NO: 45520

SEQ ID NO: 91941 - RNA, 64 nt, Homo Sapiens; identical to SEQ ID NO: 45521

SEQ ID NO: 91942 - RNA, 64 nt, Homo Sapiens; identical to SEQ ID NO: 45522

SEQ ID NO: 91943 - RNA, 64 nt, Homo Sapiens; identical to SEQ ID NO: 45523

SEQ ID NO: 91944 - RNA, 64 nt, Homo Sapiens; identical to SEQ ID NO: 45524

SEQ ID NO: 91945 - RNA, 64 nt, Homo Sapiens; identical to SEQ ID NO: 45525

SEQ ID NO: 91946 - RNA, 64 nt, Homo Sapiens; identical to SEQ ID NO: 45526

SEQ ID NO: 91947 - RNA, 64 nt, Homo Sapiens; identical to SEQ ID NO: 45527

SEQ ID NO: 91948 - RNA, 64 nt, Homo Sapiens; identical to SEQ ID NO: 45528

SEQ ID NO: 91949 - RNA, 64 nt, Homo Sapiens; identical to SEQ ID NO: 45529

SEQ ID NO: 91950 - RNA, 64 nt, Homo Sapiens; identical to SEQ ID NO: 45530

SEQ ID NO: 91951 - RNA, 64 nt, Homo Sapiens; identical to SEQ ID NO: 45531

SEQ ID NO: 91952 - RNA, 64 nt, Homo Sapiens; identical to SEQ ID NO: 45532

SEQ ID NO: 91953 - RNA, 64 nt, Homo Sapiens; identical to SEQ ID NO: 45533

SEQ ID NO: 91954 - RNA, 64 nt, Homo Sapiens; identical to SEQ ID NO: 45534

SEQ ID NO: 91955 - RNA, 64 nt, Homo Sapiens; identical to SEQ ID NO: 45535

SEQ ID NO: 91956 - RNA, 64 nt, Homo Sapiens; identical to SEQ ID NO: 45536

SEQ ID NO: 91957 - RNA, 64 nt, Homo Sapiens; identical to SEQ ID NO: 45537

SEQ ID NO: 91958 - RNA, 64 nt, Homo Sapiens; identical to SEQ ID NO: 45538

SEQ ID NO: 91959 - RNA, 64 nt, Homo Sapiens; identical to SEQ ID NO: 45539

SEQ ID NO: 91960 - RNA, 64 nt, Homo Sapiens; identical to SEQ ID NO: 45540

SEQ ID NO: 91961 - RNA, 64 nt, Homo Sapiens; identical to SEQ ID NO: 45541

SEQ ID NO: 91962 - RNA, 64 nt, Homo Sapiens; identical to SEQ ID NO: 45542

SEQ ID NO: 91963 - RNA, 64 nt, Homo Sapiens; identical to SEQ ID NO: 45543

SEQ ID NO: 91964 - RNA, 64 nt, Homo Sapiens; identical to SEQ ID NO: 45544

SEQ ID NO: 91965 - RNA, 64 nt, Homo Sapiens; identical to SEQ ID NO: 45545

SEQ ID NO: 91966 - RNA, 64 nt, Homo Sapiens; identical to SEQ ID NO: 45546

SEQ ID NO: 91967 - RNA, 64 nt, Homo Sapiens; identical to SEQ ID NO: 45547

SEQ ID NO: 91968 - RNA, 64 nt, Homo Sapiens; identical to SEQ ID NO: 45548

SEQ ID NO: 91969 - RNA, 64 nt, Homo Sapiens; identical to SEQ ID NO: 45549

SEQ ID NO: 91970 - RNA, 64 nt, Homo Sapiens; identical to SEQ ID NO: 45550

SEQ ID NO: 91971 - RNA, 64 nt, Homo Sapiens; identical to SEQ ID NO: 45551

SEQ ID NO: 91972 - RNA, 64 nt, Homo Sapiens; identical to SEQ ID NO: 45552

SEQ ID NO: 91973 - RNA, 64 nt, Homo Sapiens; identical to SEQ ID NO: 45553

SEQ ID NO: 91974 - RNA, 64 nt, Homo Sapiens; identical to SEQ ID NO: 45554

SEQ ID NO: 91975 - RNA, 64 nt, Homo Sapiens; identical to SEQ ID NO: 45555

SEQ ID NO: 91976 - RNA, 64 nt, Homo Sapiens; identical to SEQ ID NO: 45556

SEQ ID NO: 91977 - RNA, 64 nt, Homo Sapiens; identical to SEQ ID NO: 45557

SEQ ID NO: 91978 - RNA, 64 nt, Homo Sapiens; identical to SEQ ID NO: 45558

SEQ ID NO: 91979 - RNA, 64 nt, Homo Sapiens; identical to SEQ ID NO: 45559

SEQ ID NO: 91980 - RNA, 64 nt, Homo Sapiens; identical to SEQ ID NO: 45560

SEQ ID NO: 91981 - RNA, 64 nt, Homo Sapiens; identical to SEQ ID NO: 45561

SEQ ID NO: 91982 - RNA, 64 nt, Homo Sapiens; identical to SEQ ID NO: 45562

SEQ ID NO: 91983 - RNA, 64 nt, Homo Sapiens; identical to SEQ ID NO: 45563

SEQ ID NO: 91984 - RNA, 64 nt, Homo Sapiens; identical to SEQ ID NO: 45564

SEQ ID NO: 91985 - RNA, 64 nt, Homo Sapiens; identical to SEQ ID NO: 45565

SEQ ID NO: 91986 - RNA, 64 nt, Homo Sapiens; identical to SEQ ID NO: 45566

SEQ ID NO: 91987 - RNA, 64 nt, Homo Sapiens; identical to SEQ ID NO: 45567

SEQ ID NO: 91988 - RNA, 64 nt, Homo Sapiens; identical to SEQ ID NO: 45568

SEQ ID NO: 91989 - RNA, 64 nt, Homo Sapiens; identical to SEQ ID NO: 45569

SEQ ID NO: 91990 - RNA, 64 nt, Homo Sapiens; identical to SEQ ID NO: 45570

SEQ ID NO: 91991 - RNA, 64 nt, Homo Sapiens; identical to SEQ ID NO: 45571

SEQ ID NO: 91992 - RNA, 64 nt, Homo Sapiens; identical to SEQ ID NO: 45572

SEQ ID NO: 91993 - RNA, 64 nt, Homo Sapiens; identical to SEQ ID NO: 45573

SEQ ID NO: 91994 - RNA, 64 nt, Homo Sapiens; identical to SEQ ID NO: 45574

SEQ ID NO: 91995 - RNA, 64 nt, Homo Sapiens; identical to SEQ ID NO: 45575

SEQ ID NO: 91996 - RNA, 64 nt, Homo Sapiens; identical to SEQ ID NO: 45576

SEQ ID NO: 91997 - RNA, 64 nt, Homo Sapiens; identical to SEQ ID NO: 45577

SEQ ID NO: 91998 - RNA, 64 nt, Homo Sapiens; identical to SEQ ID NO: 45578

SEQ ID NO: 91999 - RNA, 64 nt, Homo Sapiens; identical to SEQ ID NO: 45579

SEQ ID NO: 92000 - RNA, 64 nt, Homo Sapiens; identical to SEQ ID NO: 45580

SEQ ID NO: 92001 - RNA, 64 nt, Homo Sapiens; identical to SEQ ID NO: 45581

SEQ ID NO: 92002 - RNA, 64 nt, Homo Sapiens; identical to SEQ ID NO: 45582

SEQ ID NO: 92003 - RNA, 64 nt, Homo Sapiens; identical to SEQ ID NO: 45583

SEQ ID NO: 92004 - RNA, 64 nt, Homo Sapiens; identical to SEQ ID NO: 45584

SEQ ID NO: 92005 - RNA, 64 nt, Homo Sapiens; identical to SEQ ID NO: 45585

SEQ ID NO: 92006 - RNA, 64 nt, Homo Sapiens; identical to SEQ ID NO: 45586

SEQ ID NO: 92007 - RNA, 64 nt, Homo Sapiens; identical to SEQ ID NO: 45587

SEQ ID NO: 92008 - RNA, 64 nt, Homo Sapiens; identical to SEQ ID NO: 45588

SEQ ID NO: 92009 - RNA, 64 nt, Homo Sapiens; identical to SEQ ID NO: 45589

SEQ ID NO: 92010 - RNA, 64 nt, Homo Sapiens; identical to SEQ ID NO: 45590

SEQ ID NO: 92011 - RNA, 64 nt, Homo Sapiens; identical to SEQ ID NO: 45591

SEQ ID NO: 92012 - RNA, 64 nt, Homo Sapiens; identical to SEQ ID NO: 45592

SEQ ID NO: 92013 - RNA, 64 nt, Homo Sapiens; identical to SEQ ID NO: 45593

SEQ ID NO: 92014 - RNA, 64 nt, Homo Sapiens; identical to SEQ ID NO: 45594

SEQ ID NO: 92015 - RNA, 64 nt, Homo Sapiens; identical to SEQ ID NO: 45595

SEQ ID NO: 92016 - RNA, 64 nt, Homo Sapiens; identical to SEQ ID NO: 45596

SEQ ID NO: 92017 - RNA, 64 nt, Homo Sapiens; identical to SEQ ID NO: 45597

SEQ ID NO: 92018 - RNA, 64 nt, Homo Sapiens; identical to SEQ ID NO: 45598

SEQ ID NO: 92019 - RNA, 64 nt, Homo Sapiens; identical to SEQ ID NO: 45599

SEQ ID NO: 92020 - RNA, 64 nt, Homo Sapiens; identical to SEQ ID NO: 45600

SEQ ID NO: 92021 - RNA, 64 nt, Homo Sapiens; identical to SEQ ID NO: 45601

SEQ ID NO: 92022 - RNA, 64 nt, Homo Sapiens; identical to SEQ ID NO: 45602

SEQ ID NO: 92023 - RNA, 64 nt, Homo Sapiens; identical to SEQ ID NO: 45603

SEQ ID NO: 92024 - RNA, 64 nt, Homo Sapiens; identical to SEQ ID NO: 45604

SEQ ID NO: 92025 - RNA, 64 nt, Homo Sapiens; identical to SEQ ID NO: 45605

SEQ ID NO: 92026 - RNA, 64 nt, Homo Sapiens; identical to SEQ ID NO: 45606

SEQ ID NO: 92027 - RNA, 64 nt, Homo Sapiens; identical to SEQ ID NO: 45607

SEQ ID NO: 92028 - RNA, 64 nt, Homo Sapiens; identical to SEQ ID NO: 45608

SEQ ID NO: 92029 - RNA, 64 nt, Homo Sapiens; identical to SEQ ID NO: 45609

SEQ ID NO: 92030 - RNA, 64 nt, Homo Sapiens; identical to SEQ ID NO: 45610

SEQ ID NO: 92031 - RNA, 64 nt, Homo Sapiens; identical to SEQ ID NO: 45611

SEQ ID NO: 92032 - RNA, 64 nt, Homo Sapiens; identical to SEQ ID NO: 45612

SEQ ID NO: 92033 - RNA, 64 nt, Homo Sapiens; identical to SEQ ID NO: 45613

SEQ ID NO: 92034 - RNA, 64 nt, Homo Sapiens; identical to SEQ ID NO: 45614

SEQ ID NO: 92035 - RNA, 64 nt, Homo Sapiens; identical to SEQ ID NO: 45615

SEQ ID NO: 92036 - RNA, 64 nt, Homo Sapiens; identical to SEQ ID NO: 45616

SEQ ID NO: 92037 - RNA, 64 nt, Homo Sapiens; identical to SEQ ID NO: 45617

SEQ ID NO: 92038 - RNA, 64 nt, Homo Sapiens; identical to SEQ ID NO: 45618

SEQ ID NO: 92039 - RNA, 64 nt, Homo Sapiens; identical to SEQ ID NO: 45619

SEQ ID NO: 92040 - RNA, 64 nt, Homo Sapiens; identical to SEQ ID NO: 45620

SEQ ID NO: 92041 - RNA, 64 nt, Homo Sapiens; identical to SEQ ID NO: 45621

SEQ ID NO: 92042 - RNA, 64 nt, Homo Sapiens; identical to SEQ ID NO: 45622

SEQ ID NO: 92043 - RNA, 64 nt, Homo Sapiens; identical to SEQ ID NO: 45623

SEQ ID NO: 92044 - RNA, 64 nt, Homo Sapiens; identical to SEQ ID NO: 45624

SEQ ID NO: 92045 - RNA, 64 nt, Homo Sapiens; identical to SEQ ID NO: 45625

SEQ ID NO: 92046 - RNA, 64 nt, Homo Sapiens; identical to SEQ ID NO: 45626

SEQ ID NO: 92047 - RNA, 64 nt, Homo Sapiens; identical to SEQ ID NO: 45627

SEQ ID NO: 92048 - RNA, 64 nt, Homo Sapiens; identical to SEQ ID NO: 45628

SEQ ID NO: 92049 - RNA, 64 nt, Homo Sapiens; identical to SEQ ID NO: 45629

SEQ ID NO: 92050 - RNA, 64 nt, Homo Sapiens; identical to SEQ ID NO: 45630

SEQ ID NO: 92051 - RNA, 64 nt, Homo Sapiens; identical to SEQ ID NO: 45631

SEQ ID NO: 92052 - RNA, 64 nt, Homo Sapiens; identical to SEQ ID NO: 45632

SEQ ID NO: 92053 - RNA, 64 nt, Homo Sapiens; identical to SEQ ID NO: 45633

SEQ ID NO: 92054 - RNA, 64 nt, Homo Sapiens; identical to SEQ ID NO: 45634

SEQ ID NO: 92055 - RNA, 64 nt, Homo Sapiens; identical to SEQ ID NO: 45635

SEQ ID NO: 92056 - RNA, 64 nt, Homo Sapiens; identical to SEQ ID NO: 45636

SEQ ID NO: 92057 - RNA, 64 nt, Homo Sapiens; identical to SEQ ID NO: 45637

SEQ ID NO: 92058 - RNA, 64 nt, Homo Sapiens; identical to SEQ ID NO: 45638

SEQ ID NO: 92059 - RNA, 64 nt, Homo Sapiens; identical to SEQ ID NO: 45639

SEQ ID NO: 92060 - RNA, 64 nt, Homo Sapiens; identical to SEQ ID NO: 45640

SEQ ID NO: 92061 - RNA, 64 nt, Homo Sapiens; identical to SEQ ID NO: 45641

SEQ ID NO: 92062 - RNA, 64 nt, Homo Sapiens; identical to SEQ ID NO: 45642

SEQ ID NO: 92063 - RNA, 64 nt, Homo Sapiens; identical to SEQ ID NO: 45643

SEQ ID NO: 92064 - RNA, 64 nt, Homo Sapiens; identical to SEQ ID NO: 45644

SEQ ID NO: 92065 - RNA, 64 nt, Homo Sapiens; identical to SEQ ID NO: 45645

SEQ ID NO: 92066 - RNA, 64 nt, Homo Sapiens; identical to SEQ ID NO: 45646

SEQ ID NO: 92067 - RNA, 64 nt, Homo Sapiens; identical to SEQ ID NO: 45647

SEQ ID NO: 92068 - RNA, 64 nt, Homo Sapiens; identical to SEQ ID NO: 45648

SEQ ID NO: 92069 - RNA, 64 nt, Homo Sapiens; identical to SEQ ID NO: 45649

SEQ ID NO: 92070 - RNA, 64 nt, Homo Sapiens; identical to SEQ ID NO: 45650

SEQ ID NO: 92071 - RNA, 64 nt, Homo Sapiens; identical to SEQ ID NO: 45651

SEQ ID NO: 92072 - RNA, 64 nt, Homo Sapiens; identical to SEQ ID NO: 45652

SEQ ID NO: 92073 - RNA, 64 nt, Homo Sapiens; identical to SEQ ID NO: 45653

SEQ ID NO: 92074 - RNA, 64 nt, Homo Sapiens; identical to SEQ ID NO: 45654

SEQ ID NO: 92075 - RNA, 64 nt, Homo Sapiens; identical to SEQ ID NO: 45655

SEQ ID NO: 92076 - RNA, 64 nt, Homo Sapiens
agauuuuucuuuuaagcccugcucuuucucugagaaccaaaagaugccuugaauauuuauucag

SEQ ID NO: 92077 - RNA, 64 nt, Homo Sapiens
ccuccuuuucuucuagcuuuguuguccucccaggaaccaaaaaaccccagcuauuuucugacca

SEQ ID NO: 92078 - RNA, 64 nt, Homo Sapiens
caaucuguggguuaauaguuaaaagaauguucccaaccaaaaaauucuuaccguaauauuauau

SEQ ID NO: 92079 - RNA, 64 nt, Homo Sapiens
guauauauauguauguuucuccaaaaagugauaaaaccaaaauaucacugacucaucccuaccc

SEQ ID NO: 92080 - RNA, 64 nt, Homo Sapiens
uuaaacaaguagaaagauaacccuaauggauugcaaccaaaacuucugccauggagcagcauua

SEQ ID NO: 92081 - RNA, 64 nt, Homo Sapiens
caaaaauuggaguaacguagacagcucagggccaaaccaaaagaacuugaugcgggagcaacaa

SEQ ID NO: 92082 - RNA, 62 nt, Homo Sapiens
aaaaaaagaaaaaaaucccaccugucacuaccagaaccaaaaucaacuugauuauaaauaca

SEQ ID NO: 92083 - RNA, 64 nt, Homo Sapiens
uuuggaaaguaacaaauaaaagagauauuuguuuaaccaaaauaauuuugaagauacauuugca

SEQ ID NO: 92084 - RNA, 64 nt, Homo Sapiens
cucaugguaguauuuccucuaacuagaagguggaaaccaaaacccuuucuaacagaacuuccau

SEQ ID NO: 92085 - RNA, 64 nt, Homo Sapiens
auguggaccuucuuuaggaauaaacuaggcuaguaaccaaaauauugcccacaguaucuccacu

SEQ ID NO: 92086 - RNA, 64 nt, Homo Sapiens
aauauuucugcauuucagguaaaacaaugaaggaaaccaaaauaaaaccaaaacaaaauuucca

SEQ ID NO: 92087 - RNA, 64 nt, Homo Sapiens
aaauuuccaaaaacaaugaauucuauguuuuauaaaccaaaacauugcuuuaaguguuggcuau

SEQ ID NO: 92088 - RNA, 64 nt, Homo Sapiens
acagaggauaaagaaguuaauggcaugguggaauaaccaaaauguguaucauucuacaaaaaaa

SEQ ID NO: 92089 - RNA, 64 nt, Homo Sapiens
gcuuauagauccucuugcuguucugaggccuuaaaaccaaaaaaauaauggaaugauugcauca

SEQ ID NO: 92090 - RNA, 64 nt, Homo Sapiens
cuaugccccuuaauacuuuacagauagauauguaaaccaaaauauuaauaaaagaagacaaacc

SEQ ID NO: 92091 - RNA, 64 nt, Homo Sapiens
ugccuagaucuuugcaguuacagagggaaccuacaaccaaaaacuaaaaagacaagcgguggga

SEQ ID NO: 92092 - RNA, 64 nt, Homo Sapiens
augcaaacuaugaugccauuucugcauugaaaagaaccaaaaaagcacaggcuccagcaauaug

SEQ ID NO: 92093 - RNA, 64 nt, Homo Sapiens
aaaaucugaaauuuccaucuaaaaccaaaaagcaaaccaaaagaccccaugucuacaaaaauga

SEQ ID NO: 92094 - RNA, 64 nt, Homo Sapiens
caaaccaaaagaaaaaucugcuacaaaaaugaaaaaccaaaaagcauagcaacaccccccaugu

SEQ ID NO: 92095 - RNA, 64 nt, Homo Sapiens
agaugacaaaacuaaguucacucucucucuuuuuaaccaaaaaggagucucucucucucuuucu

SEQ ID NO: 92096 - RNA, 64 nt, Homo Sapiens
ccaaacacccuauguaacuacaaagugaaaaccaaaccaaaaacaucuguauggcaccaaaaau

SEQ ID NO: 92097 - RNA, 64 nt, Homo Sapiens
gaagucuuaauuuaccuucagaaaaguuggaaauaaccaaaacuaauggauauacauccucaca

SEQ ID NO: 92098 - RNA, 64 nt, Homo Sapiens
gugauauuuccagaacuuuuguauaguaaccaaaaaccaaaacagaucauagagauggaaaacu

SEQ ID NO: 92099 - RNA, 64 nt, Homo Sapiens
caaaacagugauauuuccaggaaaacuguauaguaaccaaaaacaucacgagaucauagagaug

SEQ ID NO: 92100 - RNA, 64 nt, Homo Sapiens
auaaauguuccaccaguagggauaggggaaaaguaaccaaaagagagaaagagaaaggaaugcu

SEQ ID NO: 92101 - RNA, 64 nt, Homo Sapiens
gaugcugaauagccuagacaucaaaguuggugugaaccaaaauagagucagcugacccagcauc

SEQ ID NO: 92102 - RNA, 64 nt, Homo Sapiens
caaauauuaagcccuuaaaaaaauaaaaccucugaaccaaaaucuucccaggaauaguacuuaa

SEQ ID NO: 92103 - RNA, 64 nt, Homo Sapiens
acagaggagugaaagaauuaaguggguagacaccaaccaaaaugacuuugaaagcagugagcug

SEQ ID NO: 92104 - RNA, 64 nt, Homo Sapiens
auagaguaucuccgaaugcagcuauguaaaagagaaccaaaacuugagugcucuggauaacuau

SEQ ID NO: 92105 - RNA, 64 nt, Homo Sapiens
aguauuuaucccauuuuaugcaauuaaccaaaucaaccaaaaaaagugaccaugaaguccugua

SEQ ID NO: 92106 - RNA, 64 nt, Homo Sapiens
ucaaggucuuguugauauuauauaguaaaaauaaaaccaaaaauaaauauuauucaaguggcuc

SEQ ID NO: 92107 - RNA, 64 nt, Homo Sapiens
uaaagugucaggauaugcauuagauucucuccugaaccaaaaacacaacagucauuaucuguga

SEQ ID NO: 92108 - RNA, 64 nt, Homo Sapiens
ugccuugcugauucacuaggcuuuuuuaaacaacaaccaaaaaaguuucuauaaggaaauaaua

SEQ ID NO: 92109 - RNA, 64 nt, Homo Sapiens
uccaguuuugagaauaggaagcugaucuaguaguaaccaaaaauggcuucuugucuguaagcca

SEQ ID NO: 92110 - RNA, 64 nt, Homo Sapiens
uauaaauguuauguuugcuaaguuuacagaauggaaccaaaaugaauauuuacauuuuuaauuu

SEQ ID NO: 92111 - RNA, 64 nt, Homo Sapiens
cccuguaggcgugcuagcaagcaugccuuucuguaaccaaaaauucugcucuccugaaucuugg

SEQ ID NO: 92112 - RNA, 64 nt, Homo Sapiens
caguaccccugguaaaccaagccucccacacugaaaccaaaacauaaaaaccaaacccagacaa

SEQ ID NO: 92113 - RNA, 64 nt, Homo Sapiens
cacugaaaccaaaacauaaaaaccaaacccagacaaccaaaacauauucaaagcagcagccacc

SEQ ID NO: 92114 - RNA, 64 nt, Homo Sapiens
aacaaacaaaaaaaacccaagcaagaaaaccaaaaaccaaaacauucuacaguuuugcaccacg

SEQ ID NO: 92115 - RNA, 64 nt, Homo Sapiens
caaaacaaacaaacaaaaaacaccacggcaagaaaaccaaaaacagcaacuuucuacaguuuug

SEQ ID NO: 92116 - RNA, 64 nt, Homo Sapiens
cacagcaaucaggcaagagaaagaaauaaaaggcaaccaaaaagaaaggaagucgaaguaucuc

SEQ ID NO: 92117 - RNA, 64 nt, Homo Sapiens
gaaucagaaaaaaaaagcauuaaaauuuauuugaaaccaaaaaagagcccaaaaagccaaagca

SEQ ID NO: 92118 - RNA, 64 nt, Homo Sapiens
uacccaacuucaaacuauacuacagggcuacaguaaccaaaacugcaugauacugguacaaaag

SEQ ID NO: 92119 - RNA, 64 nt, Homo Sapiens
ccucugggguugaggugauaaucaauagcuuaccaaccaaaaagaguccaggaccagauggauu

SEQ ID NO: 92120 - RNA, 64 nt, Homo Sapiens
gcaucuuccuguuaccaaagcugggcagagacaaaaccaaaaaagagaauuuuagaccaauauc

SEQ ID NO: 92121 - RNA, 64 nt, Homo Sapiens
agaauugaaaaacacuacuuuaaaguucauauggaaccaaaaaagagcccacauugccaaguca

SEQ ID NO: 92122 - RNA, 64 nt, Homo Sapiens
cuaccugacuucaaacuaugcuacaaggcuacauaaccaaaauagcaugguacugguaccaaaa

SEQ ID NO: 92123 - RNA, 64 nt, Homo Sapiens
uuugucuggccucacgugucucagauuuucuaagaaccaaaaaaaaaaaaggaaaaaaaacaca

SEQ ID NO: 92124 - RNA, 64 nt, Homo Sapiens
aaaaaaaaaaggaaaaaaaacacaaaacaacaaaaaccaaaaaaaaaaaaaaucacaaaaacaa

SEQ ID NO: 92125 - RNA, 64 nt, Homo Sapiens
aaaaaaaacccacaaaaucaaaaaaccaaaaacaaaccaaaaaagaggugaaaaacaaacaaaa

SEQ ID NO: 92126 - RNA, 64 nt, Homo Sapiens
aaaccaaaaaaaaaaaaaacaacaaacaaaaaaaaaccaaaaaccaaaggaaccagaggugaaa

SEQ ID NO: 92127 - RNA, 64 nt, Homo Sapiens
aaucacaacagaaaccagcuccaacaaaagagaaaaccaaaaauaaaaaaaggaaagaaacuaa

SEQ ID NO: 92128 - RNA, 64 nt, Homo Sapiens
aaaaaaaaaaaggaaagaaaccaaaaaaacaaccaaccaaaaaagagugacaagggaggaaaga

SEQ ID NO: 92129 - RNA, 64 nt, Homo Sapiens
auaggauuuuuuuuucuucuaaaaccuguauaaaaaccaaaauugauuuuuuucuuuuuuagua

SEQ ID NO: 92130 - RNA, 64 nt, Homo Sapiens
auaggauuuuuuucuuuuuuaaaaccuauaugaaaaccaaaauuggauuuuuucuuuuuuagua

SEQ ID NO: 92131 - RNA, 64 nt, Homo Sapiens
auaggauuuuuucuuuuuuaaaaaccuauauaaaaaccaaaauugauuuuuuucuuuuuuagua

SEQ ID NO: 92132 - RNA, 64 nt, Homo Sapiens
auaggauuuuuuucuuuuuuaaaaccgguaucaaaaccaaaauuggauuuuuucuuuuuuagua

SEQ ID NO: 92133 - RNA, 64 nt, Homo Sapiens
auaggauuuuuucuuuuuuaaaaaccuauauaaaaaccaaaauuaauagagccacuggugagua

SEQ ID NO: 92134 - RNA, 64 nt, Homo Sapiens
cuggcaugggcuggacaguugcuugaaaugaccuaaccaaaaacauucaaggguucugccccca

SEQ ID NO: 92135 - RNA, 64 nt, Homo Sapiens
cgucucauuuguaucuucugauauucuuuauacaaaccaaaaguccccuucaacauuuuuuaug

SEQ ID NO: 92136 - RNA, 64 nt, Homo Sapiens
guagaaaaaaaacaaacaaacaaacagaaaaaaaaaccaaaaaaaaccacccugaguuucucug

SEQ ID NO: 92137 - RNA, 64 nt, Homo Sapiens
gaggaagagggagguggucagggaucggcuggugugccuucaggugucccuuuuccacaguaau

SEQ ID NO: 92138 - RNA, 64 nt, Homo Sapiens
cuugugccccgugugcucagcuggucaggggagcugccuucaggcuagaggccucuccauaugg

SEQ ID NO: 92139 - RNA, 64 nt, Homo Sapiens
caauaauauuuuucucuuugguucagcaugggugugccuucauaucugcuucucuuuccuguaa

SEQ ID NO: 92140 - RNA, 64 nt, Homo Sapiens
uuauuucuucaaaauauaacaaagcaaauaauauugccuucagauuuuuuucuuuuuugauaaa

SEQ ID NO: 92141 - RNA, 64 nt, Homo Sapiens
gaauaaagaaacagacuuuugaguuuauaugcaaugccuucauuagguaccaccggcacuuaca

SEQ ID NO: 92142 - RNA, 64 nt, Homo Sapiens
cccaauguuuguaaauucacaguauuuggaaaacugccuucauuuuccagugugggaaaaacuc

SEQ ID NO: 92143 - RNA, 64 nt, Homo Sapiens
gcuagaucauguuugccuugcgcugccuucaugcugccuucaaaagagauuauucucaccaacc

SEQ ID NO: 92144 - RNA, 64 nt, Homo Sapiens
cugccuucaaagcuagaucaucucaccaacccgcugccuucauguucucuuaaggagagauuau

SEQ ID NO: 92145 - RNA, 64 nt, Homo Sapiens
gcagaccagggguuaccagccucacagcugcagcugccuucaagccuguaggauccacuggcgu

SEQ ID NO: 92146 - RNA, 64 nt, Homo Sapiens
uuuggugugagcuuuuuguuuguuuguuuaguuuugccuucauagguuauaugccaagauagua

SEQ ID NO: 92147 - RNA, 64 nt, Homo Sapiens
aacacgggucuguagaggguugccuucaggacucugccuucaggccacugccacagggguauuc

SEQ ID NO: 92148 - RNA, 64 nt, Homo Sapiens
acucugccuucaggaacacgccacagggguauucugccuucaggcacucugagcugugccacug

SEQ ID NO: 92149 - RNA, 64 nt, Homo Sapiens
acuaguuugagcugcucaaugccuucugaacaguugccuucagagcucaaaagcuguugggaac

SEQ ID NO: 92150 - RNA, 64 nt, Homo Sapiens
auguucaguucgcagcacugucacagaaaaacauugccuucagcuggcuggugaaaccauauaa

SEQ ID NO: 92151 - RNA, 64 nt, Homo Sapiens
acgcgcucuacggaggcuucacugggggccuccaugccuucaccggagccguggggggacagcg

SEQ ID NO: 92152 - RNA, 64 nt, Homo Sapiens
uccccgccggcccugccccucucagugcugacggugccuucaugagccccacgaguccccaccu

SEQ ID NO: 92153 - RNA, 64 nt, Homo Sapiens
cccaaccaaagacacuaguggaccccaccugcggugccuucagcauaaggucccugcuccaccc

SEQ ID NO: 92154 - RNA, 64 nt, Homo Sapiens
cauaagccccucgcacucuggguuuggucuguuuugccuucaccuuccugagcuuucuccuguc

SEQ ID NO: 92155 - RNA, 64 nt, Homo Sapiens
ccacucagcucaccucuccccuuccuguguggccugccuucaccgccggcugccuaccaggggc

SEQ ID NO: 92156 - RNA, 64 nt, Homo Sapiens
aguaugaggguagccucggaauccugugguuuucugccuucaccauauaauguguguuguaaau

SEQ ID NO: 92157 - RNA, 64 nt, Homo Sapiens
uaacccugggcacaguguguucaugcaagacugcugccuucaugcuuaagauuguccacauccu

SEQ ID NO: 92158 - RNA, 64 nt, Homo Sapiens
ucuuuuuccaguaggagagaaguuugcugaggaaugccuucaagcacaaagugaugaaugacug

SEQ ID NO: 92159 - RNA, 64 nt, Homo Sapiens
gaggaaugccuucaagcacaaagugaugaaugacugccuucaagucucaagaaaacacuuuucc

SEQ ID NO: 92160 - RNA, 64 nt, Homo Sapiens
uucugagaaaaugaggcagaaaauaauaaucaaaugccuucaauuuacacagacccaaacaaaa

SEQ ID NO: 92161 - RNA, 64 nt, Homo Sapiens
aguuaagggaggugucccagaucauugccaguagugccuucaucucaacaccuuuuuguuagua

SEQ ID NO: 92162 - RNA, 64 nt, Homo Sapiens
uaacaaacaugcuucgucaggccaucaugauccuugccuucauacuucauauaacaugcuucgu

SEQ ID NO: 92163 - RNA, 64 nt, Homo Sapiens
uaacaugcuucgugccaucagugcucauggucauugccuucauagccuucauauaacaugcuuc

SEQ ID NO: 92164 - RNA, 64 nt, Homo Sapiens
uaacaugcuucgugcucauggccaucauggucauugccuucauaaaaguauuuugguggcagcu

SEQ ID NO: 92165 - RNA, 64 nt, Homo Sapiens
auuuuauuuuauuauuucuuuauguaucuucucuugccuucauuuuuuuuuucacugccuucau

SEQ ID NO: 92166 - RNA, 64 nt, Homo Sapiens
auguaucuucucuugccuucagguuuuuuuucacugccuucauuccauuguuccuacauuuugu

SEQ ID NO: 92167 - RNA, 64 nt, Homo Sapiens
gauaugagcuggagugcaaggaguccuuccacccugccuucagguucucucuggagaaagguua

SEQ ID NO: 92168 - RNA, 64 nt, Homo Sapiens
gucccuccgcacucuccaucagcaaccucacaccugccuucagacccggcugcaacuuccuaag

SEQ ID NO: 92169 - RNA, 64 nt, Homo Sapiens
aggugaagaaugucuggcuccagcccuuucucugugccuucagcagccccuguccucaccaugg

SEQ ID NO: 92170 - RNA, 64 nt, Homo Sapiens
accaggcuggaacccaagccccuuccuccacagcugccuucaguggguagaauggggccagggc

SEQ ID NO: 92171 - RNA, 64 nt, Homo Sapiens
gcccugggcagccccaccucacagccagagucaaugccuucaugggaagggcucccagccacac

SEQ ID NO: 92172 - RNA, 64 nt, Homo Sapiens
ugucccacagggaguagcaagacccaccccacacugccuucaccaucuacaccagugacgccgc

SEQ ID NO: 92173 - RNA, 64 nt, Homo Sapiens
gcugaggugucaggaggggacuucuggcccaccuugccuucagcccuggagugggcagagagua

SEQ ID NO: 92174 - RNA, 64 nt, Homo Sapiens
cuggaguagagcgagcccagcagcccuaaaaggcugccuucauggccaucuagccccaguucag

SEQ ID NO: 92175 - RNA, 64 nt, Homo Sapiens
aaguggggucuggccugggaggaggucugauaagugccuucaaggagcuuacguucuaguuagg

SEQ ID NO: 92176 - RNA, 64 nt, Homo Sapiens
ucaaggagcuuacguucuaguuagggaaauuggaugccuucacaaggcucagugacaaaccuga

SEQ ID NO: 92177 - RNA, 64 nt, Homo Sapiens
gauuuuuaucuucuguagagcuagccgcccugacugccuucagaccuggcccuguagcuuuucu

SEQ ID NO: 92178 - RNA, 64 nt, Homo Sapiens
uugccuacccucuguccugccuuguuauuguaagugccuucaauacuuugcauuuugggauaau

SEQ ID NO: 92179 - RNA, 64 nt, Homo Sapiens
uuuacagagguagcacaacuggcagccaggcccuugccuucauugagaauccagaccaucuugg

SEQ ID NO: 92180 - RNA, 64 nt, Homo Sapiens
uacuucggcuucuuaaacccaaacccagcccaggugccuucagcugaguccaguccccgccccc

SEQ ID NO: 92181 - RNA, 64 nt, Homo Sapiens
gacccauuccauuaaacuacauuauaaaccuuguugccuucacccuucagccucccgcuccagg

SEQ ID NO: 92182 - RNA, 64 nt, Homo Sapiens
gcauagauagcuagaacauaaugugagcaguguuugccuucagguggugggguuauggguaguu

SEQ ID NO: 92183 - RNA, 64 nt, Homo Sapiens
acaauaaguggaacuacauuaguggucucagaagugccuucaggccagucugggaugaaacuag

SEQ ID NO: 92184 - RNA, 64 nt, Homo Sapiens
uggaccuucaucacuaccuccaggguucugaucuugccuucaugcugaaguggaaggauggucu

SEQ ID NO: 92185 - RNA, 64 nt, Homo Sapiens
ucacagugccucugcaacagaaaggucuucagauugccuucagugaaugcaggccaguuacuua

SEQ ID NO: 92186 - RNA, 64 nt, Homo Sapiens
gcaucuugaaaugucccgcucacuggguggagugugccuucagguuccauaaccaucacugugc

SEQ ID NO: 92187 - RNA, 64 nt, Homo Sapiens
aagaugcuuucagugaugcucucuauacucauaaauaagcaaauguggcaggcuuugcuuucug

SEQ ID NO: 92188 - RNA, 64 nt, Homo Sapiens
caccuuuauguauuuucuuaaagcacgccuuuaaauaagcaaaaacuuuaaaaggcaggaaaga

SEQ ID NO: 92189 - RNA, 64 nt, Homo Sapiens
cagcuaggaaauauauaauuuaugaccuggauauauaagcaaauaaaaguugccuuucuuuuuu

SEQ ID NO: 92190 - RNA, 64 nt, Homo Sapiens
aaccccagauagaguugacgaguaacaucuuuguauaagcaaguccucaagcaacaauugcuag

SEQ ID NO: 92191 - RNA, 64 nt, Homo Sapiens
uuggugacuuugcuucacuacagguuaaaagaccauaagcaaacugguuauuuaaaauguaaaa

SEQ ID NO: 92192 - RNA, 64 nt, Homo Sapiens
gaaaaugauaaaagcuaagaugccuucuaacuucauaagcaaaccuuuaacuaauuauguaucu

SEQ ID NO: 92193 - RNA, 64 nt, Homo Sapiens
uuuuccuccuuucggagucaaggaaagccuuucuauaagcaaauuaaggaagaaaagguaggau

SEQ ID NO: 92194 - RNA, 64 nt, Homo Sapiens
aucucccacuucagccucccgaguaucugggauuauaagcaagagccacugcucccagcucaug

SEQ ID NO: 92195 - RNA, 64 nt, Homo Sapiens
uucguuauuuuaucuugucauuuacaacauccauauaagcaacuagccauauaagcaaaauuca

SEQ ID NO: 92196 - RNA, 64 nt, Homo Sapiens
gucauuuacaacauccauauaagcaacuagccauauaagcaaaauucauagaacuacuaaugac

SEQ ID NO: 92197 - RNA, 64 nt, Homo Sapiens
aacuuguaaaccacaucuuuuuugcacuuuuuuuauaagcaaaaacgugccguuuaaaccacug

SEQ ID NO: 92198 - RNA, 64 nt, Homo Sapiens
gaaaacaucuuuguacauuuaagucuguauuauaauaagcaaaaagauuguguguauguauguu

SEQ ID NO: 92199 - RNA, 64 nt, Homo Sapiens
gcaguguuuugcaugcaaaagcccuccuacauaaauaagcaauuuagaagaagcuggugagagu

SEQ ID NO: 92200 - RNA, 64 nt, Homo Sapiens
agcucuagccuucugccuuacuuagggugcugagauaagcaauuaguggcugcugugauguaaa

SEQ ID NO: 92201 - RNA, 64 nt, Homo Sapiens
uuuuuucuuaaccuacuaauaguuuguugaucugauaagcaagagugggcgggugagaaaaacc

SEQ ID NO: 92202 - RNA, 64 nt, Homo Sapiens
uuaaaacucaacauuacuguuaacugugcguuaaauaagcaaauaaacaguggcucauaaaaau

SEQ ID NO: 92203 - RNA, 64 nt, Homo Sapiens
aagaugaacauuuauugaucagaaccggaugaauauaagcaauggaagaucauuuuguauacag

SEQ ID NO: 92204 - RNA, 64 nt, Homo Sapiens
uguggugauaaugaaaagaauuccaaauuccacaauaagcaauaugaagaagagaaauggaugu

SEQ ID NO: 92205 - RNA, 64 nt, Homo Sapiens
uaucuccuagagcaauuuagagcuaaaaccaguaauaagcaaaguuauugguuauaagcaaggu

SEQ ID NO: 92206 - RNA, 64 nt, Homo Sapiens
gagcuaaaaccaguaauaagcaaaguuauugguuauaagcaagguauaagcaguuaaagcaaag

SEQ ID NO: 92207 - RNA, 64 nt, Homo Sapiens
ucuacuauauauugcauuucaguuagaaguuggaauaagcaauuaagagaaguuugauaugagc

SEQ ID NO: 92208 - RNA, 64 nt, Homo Sapiens
aauauugugguuuuaucuacaaccugcacuugauauaagcaauauuggaggcuaucuggauuuu

SEQ ID NO: 92209 - RNA, 64 nt, Homo Sapiens
ggcuuugugacaaaaauguagacaauuuccagguauaagcaaggagccauccugcucugaugag

SEQ ID NO: 92210 - RNA, 64 nt, Homo Sapiens
gauaauaguuuggaguaagggcaauuuggaaucaauaagcaauuuggucaaucucuccacugag

SEQ ID NO: 92211 - RNA, 64 nt, Homo Sapiens; identical to SEQ ID NO: 58746

SEQ ID NO: 92212 - RNA, 64 nt, Homo Sapiens; identical to SEQ ID NO: 58747

SEQ ID NO: 92213 - RNA, 64 nt, Homo Sapiens; identical to SEQ ID NO: 58748

SEQ ID NO: 92214 - RNA, 64 nt, Homo Sapiens; identical to SEQ ID NO: 58749

SEQ ID NO: 92215 - RNA, 64 nt, Homo Sapiens; identical to SEQ ID NO: 58750

SEQ ID NO: 92216 - RNA, 64 nt, Homo Sapiens; identical to SEQ ID NO: 58751

SEQ ID NO: 92217 - RNA, 64 nt, Homo Sapiens; identical to SEQ ID NO: 58752

SEQ ID NO: 92218 - RNA, 64 nt, Homo Sapiens; identical to SEQ ID NO: 58753

SEQ ID NO: 92219 - RNA, 64 nt, Homo Sapiens; identical to SEQ ID NO: 58754

SEQ ID NO: 92220 - RNA, 64 nt, Homo Sapiens; identical to SEQ ID NO: 58755

SEQ ID NO: 92221 - RNA, 64 nt, Homo Sapiens; identical to SEQ ID NO: 58756

SEQ ID NO: 92222 - RNA, 64 nt, Homo Sapiens; identical to SEQ ID NO: 58757

SEQ ID NO: 92223 - RNA, 64 nt, Homo Sapiens; identical to SEQ ID NO: 58758

SEQ ID NO: 92224 - RNA, 64 nt, Homo Sapiens; identical to SEQ ID NO: 58759

SEQ ID NO: 92225 - RNA, 64 nt, Homo Sapiens; identical to SEQ ID NO: 58760

SEQ ID NO: 92226 - RNA, 64 nt, Homo Sapiens; identical to SEQ ID NO: 58761

SEQ ID NO: 92227 - RNA, 64 nt, Homo Sapiens; identical to SEQ ID NO: 58762

SEQ ID NO: 92228 - RNA, 64 nt, Homo Sapiens; identical to SEQ ID NO: 58763

SEQ ID NO: 92229 - RNA, 64 nt, Homo Sapiens
uuaguguggaagauauagguuaaaauaaacuaugcuguuuuauuuaucuucccaaccugauugg

SEQ ID NO: 92230 - RNA, 64 nt, Homo Sapiens
ggggcagugggagggcuugggcuuuuagccacagcuguuuuaagacuucugaucuccugcccug

SEQ ID NO: 92231 - RNA, 64 nt, Homo Sapiens
auugcuacagguuuuuaaaauguaucuuucuaaucuguuuuaucuuaugccuuuaggauaauuu

SEQ ID NO: 92232 - RNA, 64 nt, Homo Sapiens
gugugagguaacaauucaauucugcugcuacuuucuguuuuaagguacaguauguaauaguggg

SEQ ID NO: 92233 - RNA, 64 nt, Homo Sapiens
uguaguucuguguacuuuuuuacagacuguuuuacuguuuuaauuaauacacaguacuuuauug

SEQ ID NO: 92234 - RNA, 64 nt, Homo Sapiens
guuuuaauuguaguucugugcuuuauuguacagacuguuuuacuggcacuguuaauacacagua

SEQ ID NO: 92235 - RNA, 64 nt, Homo Sapiens
uauguagcuucuguuaauauuaaguguuuuuugucuguuuuaccucaauuugaacagauaaguu

SEQ ID NO: 92236 - RNA, 64 nt, Homo Sapiens
ucaaguaugagucccucaggaaaaaaaaaaaauucuguuuuaaaaagcaaucugauucuuagcu

SEQ ID NO: 92237 - RNA, 64 nt, Homo Sapiens
acuugaugacccccaaccaaguggcucccacacccuguuuuacaaaaaagaaaagaccagucca

SEQ ID NO: 92238 - RNA, 64 nt, Homo Sapiens
ggugcaaaguucccuacuuccugugacuucagcucuguuuuacaauaaaaucuugaaaaugccu

SEQ ID NO: 92239 - RNA, 64 nt, Homo Sapiens
cccuaguggguuuucuuuaagauacuuuauacuucuguuuuacuauuuaaaaaaccacuaaagu

SEQ ID NO: 92240 - RNA, 64 nt, Homo Sapiens
aagcuuuaucaacuuggcuuguuccuuuuuaguacuguuuuauguagugcuauaauucuggaua

SEQ ID NO: 92241 - RNA, 64 nt, Homo Sapiens
uuuuuucuucuuaguucugcauuagaaauggcaucuguuuuaggucucaaaauauaacucagcu

SEQ ID NO: 92242 - RNA, 64 nt, Homo Sapiens
augaacuauuccauuacugcagagauuuaaguaucuguuuuaauaagcucuuuuuguuauuuaa

SEQ ID NO: 92243 - RNA, 64 nt, Homo Sapiens
cauugggauauuaaaauauuagccaaauuucucucuguuuuauauaugucuguuuauuucaguu

SEQ ID NO: 92244 - RNA, 64 nt, Homo Sapiens
ucaguuugugguuucugcaaauuuguaacugccucuguuuuaggaguauaaguauuacuuccuu

SEQ ID NO: 92245 - RNA, 64 nt, Homo Sapiens
guauagaacaaguacagcauuacaaaagaaguaucuguuuuauuuuuuuuuacuacuaagcuuu

SEQ ID NO: 92246 - RNA, 64 nt, Homo Sapiens
uguaaaaucagaugcuugcacuucaaauugaagccuguuuuaugguauguuaccuguacuuagg

SEQ ID NO: 92247 - RNA, 64 nt, Homo Sapiens
auaaaagugcaauuucaaguauagccacacuucacuguuuuaaauuguaaaagugaaauaugua

SEQ ID NO: 92248 - RNA, 64 nt, Homo Sapiens
uguuuaaaagaauuuuccuaaauugugauuaugucuguuuuaguauuggauuacauuaaguugg

SEQ ID NO: 92249 - RNA, 64 nt, Homo Sapiens
guugugcuaaauucauagcauugguuaacuaauucuguuuuaugcccuuuuugaaacaaguguc

SEQ ID NO: 92250 - RNA, 64 nt, Homo Sapiens
aggaacagaagggaaaucugucuuuuaaaauaagcuguuuuaagguuaauugccucaggauauu

SEQ ID NO: 92251 - RNA, 64 nt, Homo Sapiens
cugaaaaaugaaagugcucaguuauuugcuuauccuguuuuauuacuaugagguacuguuguga

SEQ ID NO: 92252 - RNA, 64 nt, Homo Sapiens
aaaaaaguaaacaccugagcagagacucaaacuacuguuuuauuaauauagacaagaugucucu

SEQ ID NO: 92253 - RNA, 64 nt, Homo Sapiens
ugugugugugucuuuaguaggaaauggaagaacacuguuuuauuuuuuaaaguguuuaauguuu

SEQ ID NO: 92254 - RNA, 64 nt, Homo Sapiens
cuuacacauuaauguuacuagcaucaggagcuuacuguuuuauuaugauucaucuucaguaauu

SEQ ID NO: 92255 - RNA, 64 nt, Homo Sapiens
aaaaaaucuguguuuguaguguggaaguuggugacuguuuuaaucaucaucuagacuuguuaag

SEQ ID NO: 92256 - RNA, 64 nt, Homo Sapiens
uaucuuaauuuuauuuauaaguuuugguguuuaccuguuuuaaaaugauaauguuggcaucugu

SEQ ID NO: 92257 - RNA, 64 nt, Homo Sapiens
uaaaggaaauuugugcauuauaaaugcaauaucacuguuuuaaacuugacuguuuuauauuauu

SEQ ID NO: 92258 - RNA, 64 nt, Homo Sapiens
cauuauaaaugcaauaucacuguuuuaaacuugacuguuuuauauuauuuuugugugaucaagu

SEQ ID NO: 92259 - RNA, 64 nt, Homo Sapiens
uugucuagcaauuuauauggaaaauuaucuauggcuguuuuaaagccuacagauuuuacauuuu

SEQ ID NO: 92260 - RNA, 64 nt, Homo Sapiens
uuauaagguuaaaauuuugaugcuuugaaaauggcuguuuuaccccaucguuaugauggaaggc

SEQ ID NO: 92261 - RNA, 64 nt, Homo Sapiens
uacugguguauuuucagaacugaguugacaugagcuguuuuaaaauauuacccaaguuucuuca

SEQ ID NO: 92262 - RNA, 64 nt, Homo Sapiens
cucauggaucaauggauuugauugugccgucauucuguuuuaaggucuuuagcuuuucuaugug

SEQ ID NO: 92263 - RNA, 64 nt, Homo Sapiens
uacucauuaguaagugggagucacuguggcuccucuguuuuacaccuguguuuuugugaaagcc

SEQ ID NO: 92264 - RNA, 64 nt, Homo Sapiens
cuguuuugugucuuacgugaaauuucacuguagacuguuuuaaauugccaagacugcacaaaau

SEQ ID NO: 92265 - RNA, 64 nt, Homo Sapiens
caggacuuuuuuuucaaaaugaaauauuuauguacuguuuuaugguaugugguagaguaaguaa

SEQ ID NO: 92266 - RNA, 64 nt, Homo Sapiens
uacaauuuaguuuucaaaaaaaaaaugcaggaaacuguuuuaucagggagcccaaacacccagc

SEQ ID NO: 92267 - RNA, 64 nt, Homo Sapiens
uugauauuuggcuuauaaaguaauuuuuaugaaucuguuuuaugaguuagguaagauuuagccu

SEQ ID NO: 92268 - RNA, 64 nt, Homo Sapiens
auauuuguguaauacuuaaaaaaugaacccaagucuguuuuaaguuucuauuuaaaaauuacaa

SEQ ID NO: 92269 - RNA, 64 nt, Homo Sapiens
gggguugaaaacaagcagcuauuuaauuuuaaugcuguuuuaauguuugauauuaaguuuguaa

SEQ ID NO: 92270 - RNA, 61 nt, Homo Sapiens
cugagcacccuucagauuaagcgucagcuuccuguuuuauagguaauuuuuuuuguaauua

SEQ ID NO: 92271 - RNA, 64 nt, Homo Sapiens
gauuaccaauuucaagugcugccagcuaaaauaacuguuuuaacggguaucuuuuguuuguucu

SEQ ID NO: 92272 - RNA, 64 nt, Homo Sapiens
aucuuucuuuacucauaauguauuuaagaauuugcuguuuuauuuaacgcugcuacucuuaauc

SEQ ID NO: 92273 - RNA, 64 nt, Homo Sapiens
gacaaagagaaaugcaguguaguaugcagagcugcuguuuuaaugccuaugcauuuacucuuuc

SEQ ID NO: 92274 - RNA, 64 nt, Homo Sapiens
uuuuugcaugguuuuuauucuuuccuaauggauccuguuuuauaauacuuccaagccuguccau

SEQ ID NO: 92275 - RNA, 64 nt, Homo Sapiens
accauggugaccagcuguuacaaaagauuuuuuccuguuuuaucugaaacauacuggauuuaua

SEQ ID NO: 92276 - RNA, 64 nt, Homo Sapiens
guaacauuuacaaaugacauauugaaagcaaaggcuguuuuauuuagccaagaugauuaccauu

SEQ ID NO: 92277 - RNA, 64 nt, Homo Sapiens
auauguauagacaacaacaacgacaaaaaauagacuguuuuaaaguuucagggaaaguuggugg

SEQ ID NO: 92278 - RNA, 64 nt, Homo Sapiens
aagcuggaaccuugggacuuaccuguaacugugucuguuuuaccaaauuaguuuauuaaacauu

SEQ ID NO: 92279 - RNA, 64 nt, Homo Sapiens
guaauuagcaaucaaacauuuuuaaucuguagaacuguuuuagauggagaaaggacacacuggu

SEQ ID NO: 92280 - RNA, 64 nt, Homo Sapiens
uaucuuaguaugauaucaaaguuagugaacaggccuguuuuaaagaaaaagaaaugucuuucuu

SEQ ID NO: 92281 - RNA, 64 nt, Homo Sapiens
gagaauggggcagaggcacaugcauguaugggaacuguuuuauacuucagagucaaagggaguc

SEQ ID NO: 92282 - RNA, 64 nt, Homo Sapiens
ggugacuugucaggaguugaaaguucugguuaugcuguuuuaaaaaagauuuuucucuguaaga

SEQ ID NO: 92283 - RNA, 64 nt, Homo Sapiens
guguguuuauucuucucuacgauucagcccaguucuguuuuagaauauggaaaaauaacuuuca

SEQ ID NO: 92284 - RNA, 64 nt, Homo Sapiens
cuugcaaguuuuuuuuuuuuuuaaaucaugguaccuguuuuaaaaugagaaguuauuauucaua

SEQ ID NO: 92285 - RNA, 64 nt, Homo Sapiens
ugccugaugaugagucccaagguacauuguucuacuguuuuauacccagguagaaguuacacag

SEQ ID NO: 92286 - RNA, 64 nt, Homo Sapiens
uuaucugucuaaauagcaaaaucaugaaaaucagcuguuuuauuugcauaggacaacuaaccug

SEQ ID NO: 92287 - RNA, 64 nt, Homo Sapiens
gaauuuuagcaauauauugauucaggaaaaggagcuguuuuauaaaugaucauucacuguuccu

SEQ ID NO: 92288 - RNA, 64 nt, Homo Sapiens
auguuacacauguucauguucaccucucauucaccuguuuuauaugguuuaaaauucucuuuaa

SEQ ID NO: 92289 - RNA, 64 nt, Homo Sapiens
gaauuuuggacagugcccccauauaaggaaguuacuguuuuaaaauaaagcaaacuaacuguuu

SEQ ID NO: 92290 - RNA, 62 nt, Homo Sapiens
aaggaaguuacuguuuuaaaauaaagcaaacuaacuguuuuauuuuccuuggaccauagugc

SEQ ID NO: 92291 - RNA, 64 nt, Homo Sapiens
aauuccacaaccaccuugacgaaugcuugccaagcuguuuuaaagccaagaacacccuuucuuu

SEQ ID NO: 92292 - RNA, 64 nt, Homo Sapiens
aggugcuuuuccuugucugugugccaguugcuggcuguuuuaguugcuugcccuucauuuugcu

SEQ ID NO: 92293 - RNA, 64 nt, Homo Sapiens
cagaugaacuaagaaagucaccaagugucuuaagcuguuuuauauuuguuacgaagaaggcuau

SEQ ID NO: 92294 - RNA, 64 nt, Homo Sapiens
aaaugccaaaugcuaaaugcaguguucuuucacacuguuuuaauuuucuugggaaauugagucc

SEQ ID NO: 92295 - RNA, 64 nt, Homo Sapiens
uucaaaucuucuugucauguaaaaugaagcuagucuguuuuaaaauuuuuaguuuuggauugua

SEQ ID NO: 92296 - RNA, 64 nt, Homo Sapiens
aaugcagaccauucuaucauaccuggcggggcuucuguuuuauuuuguaggcuggaugcuaccc

SEQ ID NO: 92297 - RNA, 64 nt, Homo Sapiens
auucccuuuuaaucauaauaguuaacucuacuuacuguuuuaacauacauuugauuuaacaaau

SEQ ID NO: 92298 - RNA, 64 nt, Homo Sapiens
auuacaggaagcaguccuuacuuacacuucuugucuguuuuagguguacuuguuaauucuuaug

SEQ ID NO: 92299 - RNA, 64 nt, Homo Sapiens
agaacacaacuaauccauacuuuauuguggaaggcuguuuuauaguuuauuuaauuuuuucucu

SEQ ID NO: 92300 - RNA, 64 nt, Homo Sapiens
acagccccuugcaguguguuaguuuuagaucacucuguuuuaguugagagaaauguuuuauauc

SEQ ID NO: 92301 - RNA, 64 nt, Homo Sapiens
auucauuucaaauuggacucgugauguuugugugcuguuuuaaaauauugugcgcugggggcuu

SEQ ID NO: 92302 - RNA, 64 nt, Homo Sapiens
ccauauuuuccuauuauuuaacuaaaauuugcuacuguuuuagaccaugucuuccauuuguggu

SEQ ID NO: 92303 - RNA, 64 nt, Homo Sapiens
ggagacuaacuccaggaguaugccuccuuugugucuguuuuaaauuagaguaauuuuuucucuc

SEQ ID NO: 92304 - RNA, 64 nt, Homo Sapiens
uugguuaaugguauuuagaguguuuaauagaaaacuguuuuacaguuuggcccugcuguccuac

SEQ ID NO: 92305 - RNA, 64 nt, Homo Sapiens
ugaggguagugccacuucuuaguauuuuugaaagcuguuuuagauuuuuuuuuuuuuuccuuuu

SEQ ID NO: 92306 - RNA, 64 nt, Homo Sapiens
cacauuugcuuucuuaugguucaauguacacaaacuguuuuauauagaaaaugauuucaaauau

SEQ ID NO: 92307 - RNA, 64 nt, Homo Sapiens
uacauuucuauuuuuauaauccauaaggauaugccuguuuuaaauaacauacauauuaacaaua

SEQ ID NO: 92308 - RNA, 64 nt, Homo Sapiens
uugacaguauuucucagcaucacuauguagcauucuguuuuagcaucuuugaauuaugaucauu

SEQ ID NO: 92309 - RNA, 64 nt, Homo Sapiens
ucugugguuuugucauauguaaaagucauaacaccuguuuuaaggauugagauuguucauuuac

SEQ ID NO: 92310 - RNA, 64 nt, Homo Sapiens
uugugauagcaaaccauaaaaacaauuuuaguggcuguuuuacuaauuaaaggacauccacaau

SEQ ID NO: 92311 - RNA, 64 nt, Homo Sapiens
guaaguuaaauuguauguugcauuuuuuuccaugcuguuuuaacuuguaaauauauauguauac

SEQ ID NO: 92312 - RNA, 64 nt, Homo Sapiens
uaagagaaagguaagggcucuuuugaauaaacugcuguuuuauuuguggcacaacugaucaauc

SEQ ID NO: 92313 - RNA, 64 nt, Homo Sapiens
uuggagauuucuauuacugccuuuuuuuuucuuacuguuuuauuacaaacuuacaaaaauaugu

SEQ ID NO: 92314 - RNA, 64 nt, Homo Sapiens
guuuuauuacaaacuuacaaaaauauguauaacccuguuuuauacaaacuaguuucguaauaaa

SEQ ID NO: 92315 - RNA, 64 nt, Homo Sapiens
cugggcuccuacuguguuuggagauauccagaaccuguuuuacaacaugggaaguuuaucgugg

SEQ ID NO: 92316 - RNA, 64 nt, Homo Sapiens
uauuugaaucgcuagucacuuuuuaaguuacaaacuguuuuauaugguagucuucacuucuauc

SEQ ID NO: 92317 - RNA, 64 nt, Homo Sapiens
caagcucguuuaguacauuuauuugaaaauuuuacuguuuuauaugugcuuuuucccugggcuu

SEQ ID NO: 92318 - RNA, 64 nt, Homo Sapiens
aucuguagcuucauccuaucgcuuuuauacguagcuguuuuaucucccuauacaaaauccaucu

SEQ ID NO: 92319 - RNA, 64 nt, Homo Sapiens
auagugguuuggccucugauacuugcuagagaaucuguuuuaauguuuaaacugcaagauuuuu

SEQ ID NO: 92320 - RNA, 64 nt, Homo Sapiens
acucuccuuaacaaucucaacaugauuuccuaaacuguuuuagaauggacuguaaaugcauaug

SEQ ID NO: 92321 - RNA, 64 nt, Homo Sapiens
guucauggaagaggcuccucugagggcaagagaccuguuuuagugcugcauucgacauggaaaa

SEQ ID NO: 92322 - RNA, 64 nt, Homo Sapiens
caguagucuaagaugagagaguuuagggacuacucuguuuuagcaagagauauuuugggggucu

SEQ ID NO: 92323 - RNA, 64 nt, Homo Sapiens
gcucagaguggauguuaugggauucuuuuuuucucuguuuuaucuuuucaaguggaauuaguug

SEQ ID NO: 92324 - RNA, 64 nt, Homo Sapiens
uuaaauugcaaagaaagccaugaggucuucaauacuguuuuaccccaucccuugugcauauuuc

SEQ ID NO: 92325 - RNA, 64 nt, Homo Sapiens
ugaagaauuguauuacauuuuugucucauuauuccuguuuuagcauuguacuuuucgaaccauu

SEQ ID NO: 92326 - RNA, 64 nt, Homo Sapiens
aaauauuaaguguucuuugauuuuauauuccuuacuguuuuacucgcuuuuuccccuccuuaau

SEQ ID NO: 92327 - RNA, 64 nt, Homo Sapiens
ugcaguaaaccgaucuccaaggaguguguuuagucuguuuuauuaguauuauuuauguguaucg

SEQ ID NO: 92328 - RNA, 64 nt, Homo Sapiens
uaauuggcaaugccaagucacugggaccaauuuucuguuuuauaauaucuaaguuuagaacaga

SEQ ID NO: 92329 - RNA, 64 nt, Homo Sapiens
gauuaaaguaucauguuauuuagccaaugcaaaucuguuuuaaaacaaauaguuuaaaaaaaga

SEQ ID NO: 92330 - RNA, 64 nt, Homo Sapiens
auggguuuuugucagauccauguuuuacggguugcuguuuuaacuucuaauauaggcagcagac

SEQ ID NO: 92331 - RNA, 64 nt, Homo Sapiens
gguugcuguuuuaacaugggauauaggcagcagacuguuuuacgcaauuacuggguaauuucua

SEQ ID NO: 92332 - RNA, 64 nt, Homo Sapiens
uuucucauugguuucuaagucaguagagacagaucuguuuuaagcaguuggggguucgaguaga

SEQ ID NO: 92333 - RNA, 64 nt, Homo Sapiens
gguggggcuggcugggguauucuuuuaccaaacucuguuuuaccgccagccccuuguacacccc

SEQ ID NO: 92334 - RNA, 64 nt, Homo Sapiens
cacccaccagcuuccgccucuggggaggggcugccuguuuuacuggguucaaggcuagagcugc

SEQ ID NO: 92335 - RNA, 64 nt, Homo Sapiens
cgaguuucucaacuccaguccagcccacuucugccuguuuuaaaccccagccccucagcccucc

SEQ ID NO: 92336 - RNA, 64 nt, Homo Sapiens
ugcauuuuacugucugcuuuccucugugcccgagcuguuuuaucagagacuuuuccuccaccuu

SEQ ID NO: 92337 - RNA, 64 nt, Homo Sapiens
ggggcccauuguaugagggucuuauuaaggcccacuguuuuacuccuggagggaaaggaaugug

SEQ ID NO: 92338 - RNA, 64 nt, Homo Sapiens
aaaguuuaagaagaauaugaccucauuaaaugugcuguuuuauuuggaccagucacacaaaaug

SEQ ID NO: 92339 - RNA, 64 nt, Homo Sapiens
cccauuuggguaaaauaacggaucugauuagaaacuguuuuaaggaggggcugggcucgguggc

SEQ ID NO: 92340 - RNA, 64 nt, Homo Sapiens
aaugguacuuaggcgaguaccauuugcacaaucacuguuuuacuuaugagcagauacagauaua

SEQ ID NO: 92341 - RNA, 64 nt, Homo Sapiens
uccaauaucccccaucuuugucuugaaacaaaaacuguuuuaagacgucuacguugaauuauuc

SEQ ID NO: 92342 - RNA, 64 nt, Homo Sapiens
uggagugcauugugcacaugaaguauuuauccaccuguuuuauuuucaugaaguucuuagacua

SEQ ID NO: 92343 - RNA, 64 nt, Homo Sapiens
ucaacuaucauguuaagaauguacaguuuuuaugcuguuuuauuugacuuaaaggcuggaagac

SEQ ID NO: 92344 - RNA, 64 nt, Homo Sapiens
ucuuuggguguaaagcguuuccacauuuuguaaccuguuuuauuaguuuugccugcuaaauucu

SEQ ID NO: 92345 - RNA, 64 nt, Homo Sapiens
aacaacaucaaaauggcagaguuagguucacacccuguuuuauauuaacacugaaguugugguu

SEQ ID NO: 92346 - RNA, 64 nt, Homo Sapiens
ugagugugccuaauacucuccucgacaagucaugcuguuuuaugcagaauaauccaggcgugag

SEQ ID NO: 92347 - RNA, 64 nt, Homo Sapiens
aacccaugaguccauauguguaauuuuauguugucuguuuuauuauccaggauuucauacucag

SEQ ID NO: 92348 - RNA, 64 nt, Homo Sapiens
cuguguuggcccucacuugggauucucagcaguuacaugaaaguugugcugauaaucucuucuc

SEQ ID NO: 92349 - RNA, 64 nt, Homo Sapiens
uuuuauguguguguguauguguguguguugaguaacaugaaacuuggcaguagcagagagcacu

SEQ ID NO: 92350 - RNA, 64 nt, Homo Sapiens
ucuguugauuuaaauuauuuuuuuccagauuggcacaugaaauauuuaaacuuuuuugugugcc

SEQ ID NO: 92351 - RNA, 64 nt, Homo Sapiens
uguaaauucuaauguuuaccuuguaccauggaaaacaugaaaagagucuuagaaguaaagaaca

SEQ ID NO: 92352 - RNA, 64 nt, Homo Sapiens
ggaugcaagugccuacaguauuaucaggaggagaacaugaaaauauuaagacaaaaauccucag

SEQ ID NO: 92353 - RNA, 64 nt, Homo Sapiens
uaaagaguuuaacuuucuggaacugaaggagaaaacaugaaaauguuuauauugcuucuuguua

SEQ ID NO: 92354 - RNA, 64 nt, Homo Sapiens
uuuugaaauuggcuuuggaguuuacauauacugaacaugaaaguuuauaauaaugaugauacaa

SEQ ID NO: 92355 - RNA, 64 nt, Homo Sapiens
uuuuuuuaacacaaguaagugucaccauuuuaugacaugaaauaaaagguuaugacuguuauug

SEQ ID NO: 92356 - RNA, 64 nt, Homo Sapiens
ugugcaagcaaaaaccgaaguuuuuccuucaaugacaugaaaacucuccucaagcauuuauaaa

SEQ ID NO: 92357 - RNA, 64 nt, Homo Sapiens
gggaauaagugauuuuaaguauguuuauuaguaaacaugaaaugguugacccacuuuaguuuau

SEQ ID NO: 92358 - RNA, 64 nt, Homo Sapiens
agcugauuuuaauggccacaucuaaucucauuucacaugaaagaagaaguauauuuuagaaauu

SEQ ID NO: 92359 - RNA, 64 nt, Homo Sapiens
guacagcugaaauucagaggacccauaagaguucacaugaaaaaaaucaauuuauuugaaaagg

SEQ ID NO: 92360 - RNA, 64 nt, Homo Sapiens
gaaaaaucuguggaauguauuauuuguccucuuuacaugaaacuacucauacuuaagcaaaagu

SEQ ID NO: 92361 - RNA, 64 nt, Homo Sapiens
agaauugagucaauuggaaagacuauccaacuuaacaugaaacuugucaccaugagauagcauu

SEQ ID NO: 92362 - RNA, 64 nt, Homo Sapiens
acgcacugacauuuuuuuuuuugaaaaaacuuuaacaugaaaaaacaaggaacaaaacaaagcu

SEQ ID NO: 92363 - RNA, 64 nt, Homo Sapiens
accagugaucaugcuuuagagaaaaauggcgaauacaugaaacaaguggaauuacuuuugccca

SEQ ID NO: 92364 - RNA, 64 nt, Homo Sapiens
uacuguaacugaucauguaucacuccuuaaauccacaugaaaacguauguacaaagguaaccau

SEQ ID NO: 92365 - RNA, 64 nt, Homo Sapiens
gauuauucugcauuuuauucuuuccauaucuguaacaugaaaauauuuuaaaugcucauagguc

SEQ ID NO: 92366 - RNA, 64 nt, Homo Sapiens
acuuuucaaaagaagaccuacaauuggccaacaaacaugaaaaaaugcucaguaucacuaauca

SEQ ID NO: 92367 - RNA, 64 nt, Homo Sapiens
aaaauuuguaugaugauaauuguauaauaauuauacaugaaagugccaaaacccuacaauuaaa

SEQ ID NO: 92368 - RNA, 64 nt, Homo Sapiens
gcuauucaaagauauuuuaaauaauauuuuaaaaacaugaaauuuuuuuuucauuuuugauuug

SEQ ID NO: 92369 - RNA, 64 nt, Homo Sapiens
uccauagugguuaguacuguaauuucuguuuauuacaugaaauuacauuccauuuauccaaaua

SEQ ID NO: 92370 - RNA, 64 nt, Homo Sapiens
uguuauauuuguacaaucgaguauuuuagaaauuacaugaaacaugaaacaguuuuugcaauuu

SEQ ID NO: 92371 - RNA, 64 nt, Homo Sapiens
uuuguacaaucgaguauuuuagaaauuacaugaaacaugaaacaguuuuugcaauuuuuuuuaa

SEQ ID NO: 92372 - RNA, 64 nt, Homo Sapiens
ucaaaaguaauuuauuuuuacagcuucugguuucacaugaaauuguuugcgcuacugagacugu

SEQ ID NO: 92373 - RNA, 64 nt, Homo Sapiens
gcgcuacugagacuguuacuacaaacuuuuuaagacaugaaaaggcguaaugaaaaccaucccg

SEQ ID NO: 92374 - RNA, 64 nt, Homo Sapiens
aaguauugauuguggucagguuaaauaauuuuguacaugaaacaagguaacucuauacaguauu

SEQ ID NO: 92375 - RNA, 64 nt, Homo Sapiens
cauucauguuuuauauauacggucucaugucuaaacaugaaauucauaaugagguaucuuggua

SEQ ID NO: 92376 - RNA, 64 nt, Homo Sapiens
auuccuuaguagaauguauaaaccagagcuguucacaugaaaaucaguauaaauuaauuuuuca

SEQ ID NO: 92377 - RNA, 64 nt, Homo Sapiens
ucucuuacuuaaauacguuuucuuaauguuuccaacaugaaaauuaauuuuaauuccaugaaag

SEQ ID NO: 92378 - RNA, 64 nt, Homo Sapiens
aaugaaaguucuugcuauaaaguuguaaacgguaacaugaaacaugugugugugugugcauuaa

SEQ ID NO: 92379 - RNA, 64 nt, Homo Sapiens
cccuucuuuuguuauucuuugccugccuuauccaacaugaaauuuuaaaaaaauacuucauaga

SEQ ID NO: 92380 - RNA, 64 nt, Homo Sapiens; identical to SEQ ID NO: 92354

SEQ ID NO: 92381 - RNA, 64 nt, Homo Sapiens; identical to SEQ ID NO: 92355

SEQ ID NO: 92382 - RNA, 64 nt, Homo Sapiens
aaagguuaugacuguuauuggucaccauuuuaugacaugaaauauuuuuuuaacacaaguaagu

SEQ ID NO: 92383 - RNA, 64 nt, Homo Sapiens
uuauaauaaugaugauacaauuuacauauacugaacaugaaaguuuuugaaauuggcuuuggag

SEQ ID NO: 92384 - RNA, 64 nt, Homo Sapiens
gcagucuguuuuugaaaaugaacaauauuaaacaacaugaaacuuggucaaguuaaaaaaaaaa

SEQ ID NO: 92385 - RNA, 64 nt, Homo Sapiens
caugcccuucuucaggggaaaucgcauuucuguaacaugaaaugaauuuauuacaguuuacucu

SEQ ID NO: 92386 - RNA, 64 nt, Homo Sapiens
guaaguacacgguuucaacgggaguaauaaauucacaugaaaaggagacaauaaucaagucaaa

SEQ ID NO: 92387 - RNA, 64 nt, Homo Sapiens
uuaaacuccaaaguuugggacauucaaacaauguacaugaaauuauauguguguggugugugaa

SEQ ID NO: 92388 - RNA, 64 nt, Homo Sapiens
aaacaugcccugaagagaguuguucuuagguuacacaugaaauccuaccgucacuagcccccau

SEQ ID NO: 92389 - RNA, 64 nt, Homo Sapiens
aaacuacaacuugauaaccccuagaaagaagaggacaugaaaggaugcuggcuauauauguuaa

SEQ ID NO: 92390 - RNA, 64 nt, Homo Sapiens
agaguggugccucuguccgaagaauuaggacacgacaugaaaccaugugagaggauggcaugcc

SEQ ID NO: 92391 - RNA, 64 nt, Homo Sapiens
gugaacaucaucaaaaacccuacucugaguuuacacaugaaaagcaugaagcugugucuuaagu

SEQ ID NO: 92392 - RNA, 64 nt, Homo Sapiens
uuuuaaagauauguuuaagauuauuuuauauuguacaugaaaaguuauuuccagauaaauuucu

SEQ ID NO: 92393 - RNA, 64 nt, Homo Sapiens
ugaggcugcuuugguucaugacccugccuugacaacaugaaacugcccucagaaagauucugau

SEQ ID NO: 92394 - RNA, 64 nt, Homo Sapiens
augagugacaaaucuuuaaauuuuuuuuguuguuacaugaaagaugugagguaaacuaccugau

SEQ ID NO: 92395 - RNA, 64 nt, Homo Sapiens
auugccuuaguugaacaguuguacacuuuuuuagacaugaaagacauauauguuguguauaaau

SEQ ID NO: 92396 - RNA, 64 nt, Homo Sapiens
ugaaauaagauaaaauacaauauaguugaugauaacaugaaaacgguacauuccuaaggguauu

SEQ ID NO: 92397 - RNA, 64 nt, Homo Sapiens
gcacuuaaccaaaacuauugacaaaguaguauguacaugaaauucuuaccaaguacauccuuaa

SEQ ID NO: 92398 - RNA, 64 nt, Homo Sapiens
ggaggggcuuuuauucugccaagucauuucaaauacaugaaaaaucuuacacuggagagaaacc

SEQ ID NO: 92399 - RNA, 64 nt, Homo Sapiens
gaaaagcauuccauaauuucucuucuuugcaaauacaugaaaggaugcacagaggagagaagcu

SEQ ID NO: 92400 - RNA, 64 nt, Homo Sapiens
gaaaagcauucagcuugccuacuuccuuucauagacaugaaaagacucacacuggaaggaaaca

SEQ ID NO: 92401 - RNA, 64 nt, Homo Sapiens
ggaaacacuuuuauucugccaaguuauuucaaacacaugaaaaaauucacacuggagagaaacc

SEQ ID NO: 92402 - RNA, 64 nt, Homo Sapiens
gaaaagcguuccauaauuucucuucuuuucaaauacaugaaaguugcacagaggagaggcgccc

SEQ ID NO: 92403 - RNA, 64 nt, Homo Sapiens
aacaagcauucaauuauuuuucuuccuugcauauacaugaaaggacucauacgagagagaaucc

SEQ ID NO: 92404 - RNA, 64 nt, Homo Sapiens
ggaaaggccuuuauucugccaagucauuucgaagacaugaaaaaacucacacuggagagaaacc

SEQ ID NO: 92405 - RNA, 64 nt, Homo Sapiens
ggaaaggcuuuuauucucccacgucauuucaaagacaugaaaaaacucacacugcagagaaacc

SEQ ID NO: 92406 - RNA, 64 nt, Homo Sapiens
ggaaagccuuuauuucuuucacuucuuuucgauaacaugaaaggacucacacuggagagaaacc

SEQ ID NO: 92407 - RNA, 64 nt, Homo Sapiens
gaaagcaugaaauucugucagugccuuuuuuaauacaugaaagaauucuagagagaagccauau

SEQ ID NO: 92408 - RNA, 64 nt, Homo Sapiens
ggaaagcuuucaaucauuuuaguuccuuucaaauacaugaaagaacucaucauggagaaaacca

SEQ ID NO: 92409 - RNA, 64 nt, Homo Sapiens
acccacacuggagagaaaccgcagguuuccagauacaugaaagaggaaaacauacauuacucuu

SEQ ID NO: 92410 - RNA, 64 nt, Homo Sapiens
augcacacugcaaagaaacaaguucugcccgaagacaugaaaggggaaagccuuuuauuguugc

SEQ ID NO: 92411 - RNA, 64 nt, Homo Sapiens
acucauacuggagagaaaccuacucagcucaaagacaugaaagggaaaagcauuuagauacuac

SEQ ID NO: 92412 - RNA, 64 nt, Homo Sapiens
acucacacuggagauaaaccuuagguuuucaagcacaugaaaguggaaaacuuacuugucuccu

SEQ ID NO: 92413 - RNA, 64 nt, Homo Sapiens
acucauacuggagagaaaccaacucugcucaaagacaugaaaagggaaaguguucguauaucac

SEQ ID NO: 92414 - RNA, 64 nt, Homo Sapiens
acucacacuggagaaaaaccguagguuuucaagcacaugaaagagaaaaaccuacauaucuucu

SEQ ID NO: 92415 - RNA, 64 nt, Homo Sapiens
aaucacacuguacagaaacgcauucugcucgagcacaugaaaggggaaacccuucauuuaccgc

SEQ ID NO: 92416 - RNA, 64 nt, Homo Sapiens
gcucauacuggagagaaacccaaucugcucaaaaacaugaaaaggaaaagcauuccgauaccac

SEQ ID NO: 92417 - RNA, 64 nt, Homo Sapiens
acucauaccgcaaagaagcucguuuccuucaaggacaugaaagaguaaagccuucacucauucc

SEQ ID NO: 92418 - RNA, 64 nt, Homo Sapiens
auucacacucgagagaaaccacuugccuucuacaacaugaaagaggaaagcauucucuuggcuc

SEQ ID NO: 92419 - RNA, 64 nt, Homo Sapiens
auucacacuggagagaagccggucacuuaaagcaacaugaaagggaaaagccuucagucauuuu

SEQ ID NO: 92420 - RNA, 64 nt, Homo Sapiens
acucacacuagggagaaaauauuggauuucaaagacaugaaaggggaaagccuuuguuuauuuc

SEQ ID NO: 92421 - RNA, 64 nt, Homo Sapiens
acucacacuggagagaaacuaguucuugucuaagacaugaaaaacuaaagccuucccugauuac

SEQ ID NO: 92422 - RNA, 64 nt, Homo Sapiens
acacguacuggggagaaacuaguucuuaucuaagacaugaaagacuaaagccuuucauuuuuac

SEQ ID NO: 92423 - RNA, 64 nt, Homo Sapiens
uacuguuacguucaauaaacaauuaugggaaacuacaugaaauacaugaguuaguacaugaaaa

SEQ ID NO: 92424 - RNA, 64 nt, Homo Sapiens
auuaugggaaacuacaugaauuacaugaguuaguacaugaaaaagaucucuaaaaaacaaagaa

SEQ ID NO: 92425 - RNA, 64 nt, Homo Sapiens
uagaucaguuauaaguagcacaauuuucuggaauacaugaaauacaaccauuccagacugcuuc

SEQ ID NO: 92426 - RNA, 64 nt, Homo Sapiens
gaaacaaaaacacuaaaaaucagacagaaccccuacaugaaacauuugcucuuagcugucugcu

SEQ ID NO: 92427 - RNA, 64 nt, Homo Sapiens
cacaaaaguaacuuguuuaucucagucuguacaaaaacaguaaggaggcagaaagccaagcacu

SEQ ID NO: 92428 - RNA, 64 nt, Homo Sapiens
agcuuaaccuggucugaggugagacuaaacacaaaaacaguagauaaaucucucccuaaaagau

SEQ ID NO: 92429 - RNA, 64 nt, Homo Sapiens
uguaaauggaacuaaugcuaaagaacuauuuuggaaacaguauuauuuuaccagaccuugguaa

SEQ ID NO: 92430 - RNA, 64 nt, Homo Sapiens
caguacuccuguguucuaaggaaagaauaguagcaaacaguaugucuagacuaaaaauauccuu

SEQ ID NO: 92431 - RNA, 64 nt, Homo Sapiens
cuuuuuucuccuuccccuagaguuacuguauagcaaacaguaucgcagggucaguuaaugcuac

SEQ ID NO: 92432 - RNA, 64 nt, Homo Sapiens
agccugcguuaauugagcacuuccuuuuagugauaaacaguagcuaaaauaaugucccaagccu

SEQ ID NO: 92433 - RNA, 64 nt, Homo Sapiens
uauuuuuucaaaaacagcuauuauaucuaaauuuaaacaguauuaauuuuuauaaggaauacug

SEQ ID NO: 92434 - RNA, 64 nt, Homo Sapiens
agauaggaggauuaaaauauuaucucauacuuauaaacaguaugcagagugaguuugucaaaag

SEQ ID NO: 92435 - RNA, 64 nt, Homo Sapiens
agauacuuaugacaaacucgaguagccuuaugacaaacaguaugauaaaucuagauacucauua

SEQ ID NO: 92436 - RNA, 64 nt, Homo Sapiens
aucucauacaucugugaaaaagauaaugugaaauaaacaguaaaaaaaaaaaguauguugaugg

SEQ ID NO: 92437 - RNA, 64 nt, Homo Sapiens
agaacuugaauuaugcauuuauuggcauuaauguaaacaguaaguccuaagcuuugauggaagg

SEQ ID NO: 92438 - RNA, 64 nt, Homo Sapiens
uuauagacuugcugaguuugcuuacaccauaauuaaacaguaaguaugcuauuguguucagaua

SEQ ID NO: 92439 - RNA, 64 nt, Homo Sapiens
uucaguaguguaaaagaguuuuguaguacacagaaaacaguagucuauuuuuucauaaaggcau

SEQ ID NO: 92440 - RNA, 64 nt, Homo Sapiens
aucccauguuugccuggauaaaguuccucauuucaaacaguauacauacuucuuugcaguucau

SEQ ID NO: 92441 - RNA, 64 nt, Homo Sapiens
ucuuugcaguucauuauaguaaggcuuaaccuguaaacaguaucugauggcccaccuauaaaua

SEQ ID NO: 92442 - RNA, 64 nt, Homo Sapiens
uuguuuucuuauaugugcaaugaaguggaaugauaaacaguaugccuuuaauuuauauguguuc

SEQ ID NO: 92443 - RNA, 64 nt, Homo Sapiens
ucuguucacaguauaugaaaauauggaguaauuuaaacaguaaauaaacauucuguggaugcuu

SEQ ID NO: 92444 - RNA, 64 nt, Homo Sapiens
aauaguuguaaguuugcaugauuucuguguucuuaaacaguauaacccuguuaauaacgcaauu

SEQ ID NO: 92445 - RNA, 64 nt, Homo Sapiens
ccauguguucuguaccaucaaaguuaagggcaagaaacaguauguugacugcugggcaugcaug

SEQ ID NO: 92446 - RNA, 64 nt, Homo Sapiens
uuucaacauacuucuaaggcuaacagcaaaucauaaacaguaguucacuguuuaccuguugguc

SEQ ID NO: 92447 - RNA, 64 nt, Homo Sapiens
agauuuuggucuccauaaucuuaucauaaaaaagaaacaguauuugagauauaauaaaaggugu

SEQ ID NO: 92448 - RNA, 64 nt, Homo Sapiens
guugauuuaaauccuuucugaauaaagaucagauaaacaguaacugaaggagcauguauagcuc

SEQ ID NO: 92449 - RNA, 64 nt, Homo Sapiens
gacugccaaauacauaggaauuuucuuucuuaaaaaacaguaaugaagacuauaucuccuuucc

SEQ ID NO: 92450 - RNA, 64 nt, Homo Sapiens
cucauuaguuuaacucuuaaaacauaguguuguuaaacaguauuuuuugggggcggguggauag

SEQ ID NO: 92451 - RNA, 64 nt, Homo Sapiens
cggguggauagcuuuuuguucuaucuuguacagaaaacaguaauggaaucacucauguucagaa

SEQ ID NO: 92452 - RNA, 64 nt, Homo Sapiens
acuugaugauuuugcauaaagucacuuuaaaagcaaacaguaccauuauaauaaaaaguuacag

SEQ ID NO: 92453 - RNA, 64 nt, Homo Sapiens
cuucuauauacuguaaauaauccaccuaaaaugaaaacaguaacguuccuacugaucagacucu

SEQ ID NO: 92454 - RNA, 64 nt, Homo Sapiens
uggaagggcuguuuuuuaagaaaaaauuuuugguaaacaguauuguguaaaauugcuuuuugua

SEQ ID NO: 92455 - RNA, 64 nt, Homo Sapiens
auacuccuguugauguuaaauuacuauauaauauaaacaguauguguuuuuauauaucauugug

SEQ ID NO: 92456 - RNA, 64 nt, Homo Sapiens
ucuucauaaagcaagacaacauuaugacacuuuaaaacaguagcaaagaagucuauuuauuaac

SEQ ID NO: 92457 - RNA, 64 nt, Homo Sapiens
aauuuucuaaauuuuaguaagagagaagcuuuuaaaacaguacauuccugaauaaaacaacaau

SEQ ID NO: 92458 - RNA, 64 nt, Homo Sapiens
aaguacugcagaauuuaucaaauuagcaauggcuaaacaguaucacaguccacuuaauuaguca

SEQ ID NO: 92459 - RNA, 64 nt, Homo Sapiens
ggaacacaauuuuuuucauuacucuaauuuuuuaaaacaguaauauauagaccaaagauggugu

SEQ ID NO: 92460 - RNA, 64 nt, Homo Sapiens
uuaaaaggaaaagccuguuaacugaccagcuuuaaaacaguacuacagaccugaggaacuuuac

SEQ ID NO: 92461 - RNA, 64 nt, Homo Sapiens
aagcaguauggcagucauaaaaauuuuggaaccaaaacaguaucuuuuuuuaagcuaaaaaaaa

SEQ ID NO: 92462 - RNA, 64 nt, Homo Sapiens
aguggcugcaauuacaggcaaccagccugacuuaaaacaguaucuuaagguagauggugauuag

SEQ ID NO: 92463 - RNA, 64 nt, Homo Sapiens
auauaugaaauaaaauauauucuucuaagcaaagaaacaguacuauucauagaaaacauuaguu

SEQ ID NO: 92464 - RNA, 64 nt, Homo Sapiens
gauuuuuaaaagcaguucaaguugacaacagcagaaacaguaacaaaaaaaucugcucagaaaa

SEQ ID NO: 92465 - RNA, 64 nt, Homo Sapiens
acugucaguagaagugagauaagauccucagaggaaacaguaagaagggauaaucauuaagaua

SEQ ID NO: 92466 - RNA, 64 nt, Homo Sapiens
uacuaacugcccucucccaagauucauuuaguucaaacaguauccguaaacuaggaauaaugcc

SEQ ID NO: 92467 - RNA, 64 nt, Homo Sapiens; identical to SEQ ID NO: 92463

SEQ ID NO: 92468 - RNA, 64 nt, Homo Sapiens; identical to SEQ ID NO: 92464

SEQ ID NO: 92469 - RNA, 64 nt, Homo Sapiens
ccaacaacuccucccccagagaucuggcuggagcccagaaaaagaagcaugugguuuaaaaaau

SEQ ID NO: 92470 - RNA, 64 nt, Homo Sapiens
guuacuccgagcuuuaucauggaccagaggaaaaccagaaaacugaaaacauuccucugucuug

SEQ ID NO: 92471 - RNA, 64 nt, Homo Sapiens
uagucuaggugugagagccccccaagcccuuccaccagaaaagcagcccugcugucugucugug

SEQ ID NO: 92472 - RNA, 64 nt, Homo Sapiens
cccaccccuugcccuuucccuuucaagucagugaccagaaaaauacaaaacucucaaaaaugua

SEQ ID NO: 92473 - RNA, 64 nt, Homo Sapiens
agaaagagcaucuggggagcuuucccacccacccccagaaaaacuagcugucagugugacuucc

SEQ ID NO: 92474 - RNA, 64 nt, Homo Sapiens
ccucccaggcaucccauaccguaaauuuuugucuccagaaaaacuguucucaugcccucaaucu

SEQ ID NO: 92475 - RNA, 63 nt, Homo Sapiens
caccagaaaaaaagaauugaaaauaaucgucacccagaaaauccagaaaacugaagauuucau

SEQ ID NO: 92476 - RNA, 64 nt, Homo Sapiens
aaaaagaauugaaaauaaucgucacccagaaaauccagaaaacugaagauuucaucaguuggaa

SEQ ID NO: 92477 - RNA, 64 nt, Homo Sapiens
cauugugacauggcagaaaaagaaagcuguaagcccagaaaacauggucaccuucagcgagaac

SEQ ID NO: 92478 - RNA, 64 nt, Homo Sapiens
cacauagcucuaaaacuuaauuuaaaauguaauuccagaaaaaaaaagggaauaagcaaagggg

SEQ ID NO: 92479 - RNA, 64 nt, Homo Sapiens
cugacacgucaaaguaaccuaauguggacaccauccagaaaacuccaguucaugcuggaucuua

SEQ ID NO: 92480 - RNA, 64 nt, Homo Sapiens
agaagaagcccugcacacagggcaguguccacagccagaaaacuccugcugggcaccaaccacu

SEQ ID NO: 92481 - RNA, 64 nt, Homo Sapiens
acauucugcuuugugagagcggccaacugaaauaccagaaaaugcaaggacuuccucuccugca

SEQ ID NO: 92482 - RNA, 64 nt, Homo Sapiens
uccgagaugaggauguuuuuacuuuaaguuaugcccagaaaacuccuccccaccccccaggaau

SEQ ID NO: 92483 - RNA, 64 nt, Homo Sapiens
gaauaaguacuccuaaagugaccauuauuagggaccagaaaauuauaucuuggcuaaguaauag

SEQ ID NO: 92484 - RNA, 64 nt, Homo Sapiens
uaccaugguaauauuugcaaaaggucuggccauaccagaaaaguacaguugagauaguuaagau

SEQ ID NO: 92485 - RNA, 64 nt, Homo Sapiens
cuuguacagaauaaugauuuaguaauauuuagggccagaaaaauugaauccaaacaauguguua

SEQ ID NO: 92486 - RNA, 64 nt, Homo Sapiens
caaagaaauauccagaaagguggacaucuggaagccagaaaagaugaagcuggaaagugugcau

SEQ ID NO: 92487 - RNA, 64 nt, Homo Sapiens
gcccagcuugcucagucaaggggcugccaggcccccagaaaacacuuggagccaucggguagcg

SEQ ID NO: 92488 - RNA, 64 nt, Homo Sapiens
aacacgagacaaaacaauccauauguuuagggaaccagaaaaguccccuggucugucccuucuu

SEQ ID NO: 92489 - RNA, 64 nt, Homo Sapiens
ccugaaggaaguaagauguuucaaaauaaaacaaccagaaaaccuuuuuuggcuuugggaaaag

SEQ ID NO: 92490 - RNA, 64 nt, Homo Sapiens
aaaaguaggauacuuacaaugaugcaugguggauccagaaaacaaauuuuugaagaccaaaugu

SEQ ID NO: 92491 - RNA, 64 nt, Homo Sapiens
gaucuggaggcagcagugcucuggguggagagagccagaaaacauagauccgagggcagcagug

SEQ ID NO: 92492 - RNA, 64 nt, Homo Sapiens
uagauccgagggcagcaguggggcgaggagagagccagaaaacagggcuaaauuaauuggagug

SEQ ID NO: 92493 - RNA, 64 nt, Homo Sapiens
gcuuuuuaaaaaaacacuugcaauuuguuggccaccagaaaacccacucaacauaaccacaggc

SEQ ID NO: 92494 - RNA, 64 nt, Homo Sapiens
aaauacaauuagucacucaacuuugcacaaguuuccagaaaagauguuaacacaaaacugccaa

SEQ ID NO: 92495 - RNA, 64 nt, Homo Sapiens
cauucucccaaacuaaugaucccaguuuagggcuccagaaaagcaugaggcucugauuuccuau

SEQ ID NO: 92496 - RNA, 64 nt, Homo Sapiens
agacuaaggggacaggugaaguauuuuaguaaauccagaaaagaauggccaaugauguauacau

SEQ ID NO: 92497 - RNA, 64 nt, Homo Sapiens
aaguagacagaucuuucucuauaagcaagaauugccagaaaauaucacugguggaaacguuagg

SEQ ID NO: 92498 - RNA, 64 nt, Homo Sapiens
agacagaaugaucauucaauccagaaaauguuucccagaaaacuaucauucccagaaacauuuc

SEQ ID NO: 92499 - RNA, 64 nt, Homo Sapiens
uuucccagaaaacuagacagcccagaaacauuucccagaaaaugaacaaggcagaaugaucauu

SEQ ID NO: 92500 - RNA, 64 nt, Homo Sapiens
aggcagaaugaucauucccaaauagucugaauuuccagaaaacaaccauuuacuagauuagcca

SEQ ID NO: 92501 - RNA, 64 nt, Homo Sapiens
gucauaucaaauguucuuucugucuuauuaaucaccagaaaaugcuagcuuauuccaaauuauu

SEQ ID NO: 92502 - RNA, 64 nt, Homo Sapiens
auacuuauaaaucaucccuuuagauuacagucagccagaaaaacuucugcacaguccugccucu

SEQ ID NO: 92503 - RNA, 64 nt, Homo Sapiens
accaaucggcuuucauuuugcugaugacuccuccccagaaaaccaaagugucacaaugcuccuc

SEQ ID NO: 92504 - RNA, 64 nt, Homo Sapiens
gucauuuagcuggcugcagaccaaacaugagagcccagaaaacuuauucuuugucacuugggug

SEQ ID NO: 92505 - RNA, 64 nt, Homo Sapiens
auuuucaacuucaagucauugcaguuucuuuuucccagaaaacaagggguuagauguugcauuu

SEQ ID NO: 92506 - RNA, 64 nt, Homo Sapiens
ucuccugacuuguauuguggcagucugaacgcccccagaaaauugugccaaagaguuuagaaaa

SEQ ID NO: 92507 - RNA, 64 nt, Homo Sapiens
gcauaacaaaggacauggaagaagauuccagaugccagaaaaccucugucagacgcccacuggc

SEQ ID NO: 92508 - RNA, 64 nt, Homo Sapiens
uuuuuuuuuuuuaacgaugcaguauuugugcguuccagaaaagggcccagcucugagccccuca

SEQ ID NO: 92509 - RNA, 64 nt, Homo Sapiens
uuggugccccugaacccaagaagaaaagaaaaagccagaaaaagugucucaaaaaaaaaaagaa

SEQ ID NO: 92510 - RNA, 64 nt, Homo Sapiens
gaagagguggaaacccagagauagagaaagagacccagaaaaagagagggacagagccaaaagg

SEQ ID NO: 92511 - RNA, 64 nt, Homo Sapiens
ggggaaauguugagcucaaauggguaaauugagaccagaaaauuauuuuuucaaccuagagaau

SEQ ID NO: 92512 - RNA, 64 nt, Homo Sapiens
uggauauuauucaagcugcaagucaucaaaagacccagaaaaaaaaaagucuguagguuauuuu

SEQ ID NO: 92513 - RNA, 64 nt, Homo Sapiens
guaucuaugucucgacuuuucugaugaaguuauaccagaaaaguuaauuauuugaugggccugc

SEQ ID NO: 92514 - RNA, 64 nt, Homo Sapiens
aaguuaauuauuugaugggccugccaugugaaaaccagaaaauaaccucguacucacaagccag

SEQ ID NO: 92515 - RNA, 64 nt, Homo Sapiens
gagcuucugacuaguucagacugccacgccaaccccagaaaauaccccacaugccagaaaagug

SEQ ID NO: 92516 - RNA, 64 nt, Homo Sapiens
acugccacgccaaccccagaaaauaccccacaugccagaaaagugaaguccuagguguuuccau

SEQ ID NO: 92517 - RNA, 64 nt, Homo Sapiens
uccauaacauaguaaagacuggacauugccagcuccagaaaacauauuuuccaacugaagucag

SEQ ID NO: 92518 - RNA, 64 nt, Homo Sapiens
uuauuauuuuaugugagccuuuccugaggugcuuccagaaaaccaaguaccagaguugguggaa

SEQ ID NO: 92519 - RNA, 64 nt, Homo Sapiens
aacuagaaauuauauuagaacucaaauucaauguuauacauacuugguaaacauuuauuuaaaa

SEQ ID NO: 92520 - RNA, 64 nt, Homo Sapiens
aaaauguauccaagccauuuaaaaaauauuuauauauacauaguagcaaauaguuuuauagauu

SEQ ID NO: 92521 - RNA, 64 nt, Homo Sapiens
uuuucagcuauuucuguuccuauauacauacacauauacauaaacagauguguguguauauaua

SEQ ID NO: 92522 - RNA, 64 nt, Homo Sapiens
cauauacauaaauuuucagcuguguauauauauauauacauacauguauguauauacagaugug

SEQ ID NO: 92523 - RNA, 64 nt, Homo Sapiens
uuuucuuuucccuccuccauguucuucuaaaacauauacauauauacauacacacauacacaua

SEQ ID NO: 92524 - RNA, 64 nt, Homo Sapiens
ucccuccuccauguucuucuaaaacauauacauauauacauacacacauacacauauucuucag

SEQ ID NO: 92525 - RNA, 64 nt, Homo Sapiens
aauuauguauaauggacagauauauauacauauauauacauaaauaucagauauaguaaauuua

SEQ ID NO: 92526 - RNA, 64 nt, Homo Sapiens
uauacauaaaaauuauguauaguaaauuuauauauauacauauacuaaaggaacuaucagauau

SEQ ID NO: 92527 - RNA, 64 nt, Homo Sapiens
ggccagaagcugucugaggcgcuaguugugauuuuauacauaaagucccucaguaacguuaagu

SEQ ID NO: 92528 - RNA, 64 nt, Homo Sapiens
uaaauauuuauauauagauaagaaaguaucuauauauacauauguuucuucaucuuuuauaaca

SEQ ID NO: 92529 - RNA, 64 nt, Homo Sapiens
guauuaaugauauaguuauuuauaaacuccuauguauacauaaguuuguuacuuaaaugcauua

SEQ ID NO: 92530 - RNA, 64 nt, Homo Sapiens
aguuuacaugaauuuuacaaugaucugacauuuguauacauaaauaauuaauaaaaccugugcu

SEQ ID NO: 92531 - RNA, 64 nt, Homo Sapiens
cacaaaaauggugguuugucuaaaugcaugauuuuauacauaguauugauguuuccagaaaaua

SEQ ID NO: 92532 - RNA, 64 nt, Homo Sapiens
auaaauaaaugccaacauacugcacaagcuuguauauacauauuuaucaauucaacacauuacu

SEQ ID NO: 92533 - RNA, 64 nt, Homo Sapiens
agaaaaguagaauuauaucugcuucaucaauuuuuauacauaucuccuauuuuaaaaccaugca

SEQ ID NO: 92534 - RNA, 64 nt, Homo Sapiens
uacagagugguaaauaucuauguuacauguagauuauacauauauauacacacguguauaugag

SEQ ID NO: 92535 - RNA, 64 nt, Homo Sapiens
uauaucuuauaucuccacaaacacaaauuauauauauacauauccacacacauacauuacauau

SEQ ID NO: 92536 - RNA, 64 nt, Homo Sapiens
accaaucagaccguguggauaaucuguugccugauauacauaacagcaacaaucagaguagaaa

SEQ ID NO: 92537 - RNA, 64 nt, Homo Sapiens
cuagaucuggacacacgcauuauuuaugcaucuauauacauauagguguguguauauauauaua

SEQ ID NO: 92538 - RNA, 64 nt, Homo Sapiens
uaaucuaauaaaggaucauguuaaauuacaaagguauacauaauugcucccuuuaaccauauaa

SEQ ID NO: 92539 - RNA, 64 nt, Homo Sapiens
uaaugugugcguaucaugucuauacauauagauauauacauaugagaauugaaccaagaggcau

SEQ ID NO: 92540 - RNA, 64 nt, Homo Sapiens
gauauauacauauguaaugugaaccaagaggcauuauacauauaugaaacuucauuauagaauu

SEQ ID NO: 92541 - RNA, 64 nt, Homo Sapiens
uauguauauauauacacacacugugauauacauauauacauauauuugggaaauauauauguuu

SEQ ID NO: 92542 - RNA, 64 nt, Homo Sapiens
uacauauauauguauauauaauauguuucugugauauacauauaaagaaaaauuugggaaauau

SEQ ID NO: 92543 - RNA, 64 nt, Homo Sapiens
uacacauacauauauacacauguacauauacauauauacauaucugcuuguguguguaaaugug

SEQ ID NO: 92544 - RNA, 64 nt, Homo Sapiens
uacauaucuacacauacauauaaauguguguacauauacauauagacuuguaugcuugugugug

SEQ ID NO: 92545 - RNA, 64 nt, Homo Sapiens
guccuccuucaccuuacucuucaaguuggaaaaauauacauacaauuuccuuucuaguaucuuc

SEQ ID NO: 92546 - RNA, 64 nt, Homo Sapiens
gguguauacuuaugcaugcaaaauaauaguuauauauacauacaaaauacacagacuaucacua

SEQ ID NO: 92547 - RNA, 64 nt, Homo Sapiens
uauacuugcauacacuaucaaucauuuauaucuauauacauauaaaauaacuccuuuuuacaug

SEQ ID NO: 92548 - RNA, 64 nt, Homo Sapiens
aguuccuacuuguuaaaaaauucuuggauaauucuauacauaaaugcacauuguaaauacauua

SEQ ID NO: 92549 - RNA, 64 nt, Homo Sapiens
uuuaaguauaacagauuuuaccagaaauguacuguauacauaguaagauguauaagguuuuuug

SEQ ID NO: 92550 - RNA, 64 nt, Homo Sapiens
uauaaccgagggcuggcguuauuuguaaucaaguuauacauaauagucacagccaaaugcuucc

SEQ ID NO: 92551 - RNA, 64 nt, Homo Sapiens
uauauauauaaauauaaauauacauaucuguauauauacauauaguuuuauauauauauacgua

SEQ ID NO: 92552 - RNA, 64 nt, Homo Sapiens
uguauauauacauauauauauauauauauauacguauacauauccuguaauuaaacuucuguuu

SEQ ID NO: 92553 - RNA, 64 nt, Homo Sapiens
cacauacauauaauuuuuuuuauauauacauauauauacauacauacauacauacauauauaua

SEQ ID NO: 92554 - RNA, 64 nt, Homo Sapiens
uauacauacacacauacauacauauauauauauauauacauauacacacacacauacauacaua

SEQ ID NO: 92555 - RNA, 64 nt, Homo Sapiens
ugcacguaucuauauguauaugaauauuuguuuauauacauauauacacguauguauagaugug

SEQ ID NO: 92556 - RNA, 64 nt, Homo Sapiens
uguguacuuauuauauguauacauauacauaauauauacauacgccagguuacauuuaaacuau

SEQ ID NO: 92557 - RNA, 64 nt, Homo Sapiens
auauacauacguguguacuuauuuaaacuauacauauacauaauuuuauggaugcccagguuac

SEQ ID NO: 92558 - RNA, 64 nt, Homo Sapiens
cauaauauauacauacgugugguuacauuuaaacuauacauauauaguaauuuauggaugccca

SEQ ID NO: 92559 - RNA, 64 nt, Homo Sapiens
guggcauaucuuuuaaccaguucucacaacuugcuauacauaagaugauucacacuugaaugaa

SEQ ID NO: 92560 - RNA, 64 nt, Homo Sapiens
guggcaaagcuuuuaaccaagucucaacacuuacuauacauaagauaauuuauacuggagcaaa

SEQ ID NO: 92561 - RNA, 64 nt, Homo Sapiens
uuaguuuuuuaaaaguguuuuugguuuguguauauauacauauacaaauacaacauuuacaaua

SEQ ID NO: 92562 - RNA, 64 nt, Homo Sapiens
uuucugaagacagcauguuauuuuaacaaucaaguauacauauuaaaaauugugagcaaucuca

SEQ ID NO: 92563 - RNA, 64 nt, Homo Sapiens
auauauauauauggagagagaauuuugcacauauuauacauauuuugugcuaaucuuguuuucc

SEQ ID NO: 92564 - RNA, 64 nt, Homo Sapiens
guaaauauauauuugaccuguaaguguguguauguauacauauacauauguauguguauggauu

SEQ ID NO: 92565 - RNA, 64 nt, Homo Sapiens
auauauuugaccuguaaguguguguauguauacauauacauauguauguguauggauuuauaua

SEQ ID NO: 92566 - RNA, 64 nt, Homo Sapiens
agguggagcaaguaauaagccaugcugugcaauauauacauaaagcuucugcuucucaugggaa

SEQ ID NO: 92567 - RNA, 64 nt, Homo Sapiens
acuucuggccaaguuuguuuuuuauauaaauauauauacauauauacauauuauguaugguugu

SEQ ID NO: 92568 - RNA, 64 nt, Homo Sapiens
ccaaguuuguuuuuuauauaaauauauauacauauauacauauuauguaugguuguaaauucau

SEQ ID NO: 92569 - RNA, 64 nt, Homo Sapiens
uaaaauauauauauuaaaauaauauauguauacauauacauauaagaaguuucaaggaaccaua

SEQ ID NO: 92570 - RNA, 64 nt, Homo Sapiens
cauauauaaaauauauauauaccauaaauauauguauacauauauuccaaagaaguuucaagga

SEQ ID NO: 92571 - RNA, 64 nt, Homo Sapiens
uacaaacauaggcuaucuuggauaucuauacauauauacauacacauggggaaacacacacaga

SEQ ID NO: 92572 - RNA, 64 nt, Homo Sapiens
uacauacauacaaacauaggcacacagagauaucuauacauauaaccucugccauggggaaaca

SEQ ID NO: 92573 - RNA, 64 nt, Homo Sapiens
cuuaagcguucauaugcucugcuuuuaguucauauauacauacauaauguuuuuccuuucuuaa

SEQ ID NO: 92574 - RNA, 64 nt, Homo Sapiens
gcuguaaauuacuauggcugauuuauuucuacuauauacauauauauuuuuugcuuuuguauau

SEQ ID NO: 92575 - RNA, 64 nt, Homo Sapiens
uguauguauauacacacguacauacauucauauauauacauauauacauaaugugcuuaaccac

SEQ ID NO: 92576 - RNA, 64 nt, Homo Sapiens
uauacacacguacauacauucauauauauacauauauacauaaugugcuuaaccacugccuuuu

SEQ ID NO: 92577 - RNA, 64 nt, Homo Sapiens
uauauacauguguguauguauacauguauauauauauacauacacauauauguauacauauaua

SEQ ID NO: 92578 - RNA, 64 nt, Homo Sapiens
uauacauguauauauauauacauacacauauauguauacauauauacacauauauguauacaua

SEQ ID NO: 92579 - RNA, 64 nt, Homo Sapiens
uacacauauauguauacauauauacacauauauguauacauauauacacauauguauacauaua

SEQ ID NO: 92580 - RNA, 64 nt, Homo Sapiens
uauacacauauauguauacauauauacacauauguauacauauauauauauucuacaguaaaac

SEQ ID NO: 92581 - RNA, 64 nt, Homo Sapiens
agaugaugauauauauaaugagggguauuauauauauacauauaguguacauauaucuauguac

SEQ ID NO: 92582 - RNA, 64 nt, Homo Sapiens
aauauauacauguguacauaccacacuuuaauuuuauacauauaucgacaggaaacuacaaguu

SEQ ID NO: 92583 - RNA, 64 nt, Homo Sapiens
uccacaucuauauagagagacgguucuauacauauauacauauagccugugggguuggaugccg

SEQ ID NO: 92584 - RNA, 64 nt, Homo Sapiens
uacauauauccacaucuauaggaugccgcgguucuauacauauagccccggggccugugggguu

SEQ ID NO: 92585 - RNA, 64 nt, Homo Sapiens
uuuguccuucguauagcaagugugcauuuguuuguauacauauauguauauagacaugcacacg

SEQ ID NO: 92586 - RNA, 64 nt, Homo Sapiens
agaugcuaguucauuugaauuggcaacaaauauuuauacauacacauuguacuuuuuuuuacuu

SEQ ID NO: 92587 - RNA, 64 nt, Homo Sapiens
auucaauguaauuaaauuucauauauauauaauauauacauauauacauaguguaaaauaaaau

SEQ ID NO: 92588 - RNA, 64 nt, Homo Sapiens
uaauuaaauuucauauauauauaauauauacauauauacauaguguaaaauaaaauguuucuug

SEQ ID NO: 92589 - RNA, 64 nt, Homo Sapiens
uauauuuucacuugcuuucaguguauauacaguauauacauauaaaaacaguauauacauaugu

SEQ ID NO: 92590 - RNA, 64 nt, Homo Sapiens
uguguauauacaguauauacauauuaaaacaguauauacauaugauacauauauauuuguuaau

SEQ ID NO: 92591 - RNA, 64 nt, Homo Sapiens
uauuuguuaauauauuaaaaccacuuuuaauauauauacauauagaaucugacaaagaugaaau

SEQ ID NO: 92592 - RNA, 64 nt, Homo Sapiens
augacuauacagaaauuuaaauagaaauaguguauauacauauaaaauacaagcuauguuagga

SEQ ID NO: 92593 - RNA, 64 nt, Homo Sapiens
ccuuuuguuuaugaauggaaagcuuugugcaaaauauacauauaagcagaguaagccuuuuaaa

SEQ ID NO: 92594 - RNA, 64 nt, Homo Sapiens
uauaucuggccucguuauauaguguauauauauguauacauauacauauauauaauauauauga

SEQ ID NO: 92595 - RNA, 64 nt, Homo Sapiens
uggccucguuauauaguguauauauauguauacauauacauauauauaauauauaugaagacug

SEQ ID NO: 92596 - RNA, 64 nt, Homo Sapiens
auauauauauauauauaaaaacaaaacuuuuuuuuauacauaaugccaauuccacuugauguaa

SEQ ID NO: 92597 - RNA, 64 nt, Homo Sapiens
uauauauauaguuauuuaaauacaaauauauauauauacauauauagaaucacaggauaauaua

SEQ ID NO: 92598 - RNA, 64 nt, Homo Sapiens
ggaagguauauauugucucaucauacaaaaggucuauacauacauauuuccuucuuuaagguaa

SEQ ID NO: 92599 - RNA, 64 nt, Homo Sapiens
ugucuauauauauauauagagauaaaaaacaaaguauacauauaauguuuuacaugaacuaaug

SEQ ID NO: 92600 - RNA, 64 nt, Homo Sapiens
aguuuagaaauuuauucaaagcuaaagauguauauauacauauacuuuuguguguauauauaca

SEQ ID NO: 92601 - RNA, 64 nt, Homo Sapiens
gaaagagaaucucagaaguaguuugcugcuaauauauacauauauuguauaaaaagguauauuu

SEQ ID NO: 92602 - RNA, 64 nt, Homo Sapiens
gugggaaagccuuuucucagugcucauuacuuauuauacauaugagaagucauacuggugagaa

SEQ ID NO: 92603 - RNA, 64 nt, Homo Sapiens
gugggaaagcauucucucaaagagcaucccuuucuauacauaagagaggucauacaggugagag

SEQ ID NO: 92604 - RNA, 64 nt, Homo Sapiens
gguguaagacuggaauaaauggaaagaaauaccauauacauagauggaaaaacccaguauuaua

SEQ ID NO: 92605 - RNA, 64 nt, Homo Sapiens
acauauacuauauguguguaugugugauguauacuauacauauccauauaguguauauagugua

SEQ ID NO: 92606 - RNA, 64 nt, Homo Sapiens
guguauauacacauauagugacacacacacacuauauacauauaccaccauaacacacacacac

SEQ ID NO: 92607 - RNA, 64 nt, Homo Sapiens
uacuguaacacaucuaaaaagauacagaauuguauauacauacuuaacaugaaggaauaaaaag

SEQ ID NO: 92608 - RNA, 64 nt, Homo Sapiens
augaaggaauaaaaaggauaggacacugcaucaguauacauaacucacuauaaauuauaauuau

SEQ ID NO: 92609 - RNA, 64 nt, Homo Sapiens
ugugcauguguguauaagugcacacagaaauauauauacauauguagacuauauacaugugugu

SEQ ID NO: 92610 - RNA, 64 nt, Homo Sapiens
guagacuauauacauguguguauauauguguauauauacauacacuuguauaaauguauauaca

SEQ ID NO: 92611 - RNA, 64 nt, Homo Sapiens
uggccucuggcuguagguuuuaaauuuuuauaucuauacauacauauauacauauauauauaau

SEQ ID NO: 92612 - RNA, 64 nt, Homo Sapiens
guagguuuuaaauuuuuauaucuauacauacauauauacauauauauauaauguacaauauaua

SEQ ID NO: 92613 - RNA, 64 nt, Homo Sapiens
cauacauauauacauauauauauaauguacaauauauacauagacuguaacuacuuugcuuuua

SEQ ID NO: 92614 - RNA, 64 nt, Homo Sapiens
caaaguuacuguuguuuacagugaguuuggggaaaaaaaauaaaauaaaaauggcuuucccagu

SEQ ID NO: 92615 - RNA, 64 nt, Homo Sapiens
uuucauaacuguuuuuaaugguaaaaaaaaaaaaaaaaaauacaaaaaaaaauucugaaggaca

SEQ ID NO: 92616 - RNA, 64 nt, Homo Sapiens
cuguccacauuuggggccuauccuuacuuguuugaaaaaauauguuugcuuuuuuugguuuuug

SEQ ID NO: 92617 - RNA, 64 nt, Homo Sapiens
ugggauuacaggcaugagccaccacgccuggccaaaaaaauauguuuuaaaugucccauuucac

SEQ ID NO: 92618 - RNA, 64 nt, Homo Sapiens
agccugggugagaagagcgaaacuccgucucaaaaaaaaauaaaaaugaagaggggaaaccaga

SEQ ID NO: 92619 - RNA, 64 nt, Homo Sapiens
cagccgggccaacauggugaaaccccaucucuacaaaaaauacaaaaauuagccuggcauaugg

SEQ ID NO: 92620 - RNA, 64 nt, Homo Sapiens
guuuuccauugauugugauaucuaucauaccugcaaaaaauauuuuguauauauccaauuuaau

SEQ ID NO: 92621 - RNA, 64 nt, Homo Sapiens
ggaaggucaaaaaaaaggaaaaaagaaaaauaauaaaaaauaauaaaaauccuuaggauaacuu

SEQ ID NO: 92622 - RNA, 64 nt, Homo Sapiens
caggaguuugagaccagugugaccuugucucuguaaaaaauaaaauuaaaagaaaaagaaggga

SEQ ID NO: 92623 - RNA, 64 nt, Homo Sapiens
uucacugguccaucuauauuuaaaacgugcaagaaaaaaauaaaauacucugcucuagcaaguu

SEQ ID NO: 92624 - RNA, 64 nt, Homo Sapiens
guuuucaguaaucaaaaagauuucuaugaauucuaaaaaauauuuuuuucuaugaaauuacuag

SEQ ID NO: 92625 - RNA, 64 nt, Homo Sapiens
aaaagccagcaauaauucuucaagauccaaaagaaaaaaauauacuaccucagauuuucaagaa

SEQ ID NO: 92626 - RNA, 64 nt, Homo Sapiens
gguguacuaacaucaaaauguauccaagccauuuaaaaaauauuuauauauacauaguagcaaa

SEQ ID NO: 92627 - RNA, 64 nt, Homo Sapiens
cccaaaaccaagucaagugaaaaaggaggaagagaaaaaauauuuuccugccaggcaugguggc

SEQ ID NO: 92628 - RNA, 64 nt, Homo Sapiens
ugagacccugucucaaaaaaagaaaaagaaaaagaaaaaauauuuucccuauuagagaagagau

SEQ ID NO: 92629 - RNA, 64 nt, Homo Sapiens
cagaggaaccaggugccaacagucaacugaggaaaaaaaauaauuaaacaggccuaagaagaaa

SEQ ID NO: 92630 - RNA, 64 nt, Homo Sapiens
guuggucaugguaagguuuuuccaucagccucugaaaaaauaguugugcacaacaucugcucac

SEQ ID NO: 92631 - RNA, 64 nt, Homo Sapiens
aaaacuaguguauucacuuacccuaguucauuauaaaaaauaucuaggcauuguggauauaaaa

SEQ ID NO: 92632 - RNA, 64 nt, Homo Sapiens
acauguaauuauuuaauaaaacuuuggaacauuaaaaaaauaaauuggaggcuuaaggauuaga

SEQ ID NO: 92633 - RNA, 64 nt, Homo Sapiens
uccagccuaggagacaaaacgagacuucauuuaaaaaaaauaaaaauaaaaauaaaaauaaagu

SEQ ID NO: 92634 - RNA, 64 nt, Homo Sapiens
uccucaguuccacgagacugcccacccacagacaaaaaaauauauauauuccuaaagucggacc

SEQ ID NO: 92635 - RNA, 64 nt, Homo Sapiens
auucauaaucacaaauauagagaauuccuauuuaaaaaaauagaaaaauagugaagacuacaca

SEQ ID NO: 92636 - RNA, 64 nt, Homo Sapiens
uacauauuaaauauguucuacuuaaauauauuauaaaaaauaaaggcaaaguggaaugauaacc

SEQ ID NO: 92637 - RNA, 64 nt, Homo Sapiens
guucuaauaauccauguucaguuuguagggaaagaaaaaauaauuuuuccuucuacccacuuua

SEQ ID NO: 92638 - RNA, 64 nt, Homo Sapiens
aaugcauuacguguuuuggaaaauagaguaauuuaaaaaauauauuugaaaugaaaaucuccaa

SEQ ID NO: 92639 - RNA, 64 nt, Homo Sapiens
aagcugcaaaagggaucuucgaaacugggcagagaaaaaauaaaguggaauauuaaguaaaagu

SEQ ID NO: 92640 - RNA, 64 nt, Homo Sapiens
uuuuuuucuaucgaaauuacuaaucaguuggggaaaaaaauacuauagcagacagcacuaaugu

SEQ ID NO: 92641 - RNA, 64 nt, Homo Sapiens
uuuauuuuuuucauuuucagcgagacccugucucaaaaaauacacucuagccugggcagcagag

SEQ ID NO: 92642 - RNA, 64 nt, Homo Sapiens
aaaauuagccaggcauggugaaccgcguguuuacaaaaaauacauagccugggcaauguggcaa

SEQ ID NO: 92643 - RNA, 64 nt, Homo Sapiens
uugguuuuauuugucaucuaaauguuuaaaaagaaaaaaauagcguucuuuauacagccuaguu

SEQ ID NO: 92644 - RNA, 64 nt, Homo Sapiens
uauauauauauauauauauauuaacacuguuuauaaaaaauauaaaaugaccccaaacuggcau

SEQ ID NO: 92645 - RNA, 64 nt, Homo Sapiens
uaaaaauuagccgggcguugacuccgucucuaccaaaaaauauaagccugggcaacgugaugag

SEQ ID NO: 92646 - RNA, 64 nt, Homo Sapiens
cucaagaaugauuuuucuaaugucucuuaaagaaaaaaaauaaaugggcaacagaaugagaucc

SEQ ID NO: 92647 - RNA, 64 nt, Homo Sapiens
aaauuuuguauagaaaugaaguaauuauggauauaaaaaauaagggagaaggaagagucuaaua

SEQ ID NO: 92648 - RNA, 64 nt, Homo Sapiens
auaagaaauuaaggucuauuuuuggucuucagcuaaaaaauagggucuacuuccuuuuaacuuu

SEQ ID NO: 92649 - RNA, 64 nt, Homo Sapiens
guuguaauuucugaugacucauauauguauuaugaaaaaauaaacagaacucugauggcaauaa

SEQ ID NO: 92650 - RNA, 64 nt, Homo Sapiens
gugcucauucucauccauccaaauauauauucauaaaaaauauguguagaaaacaaaaaaagaa

SEQ ID NO: 92651 - RNA, 64 nt, Homo Sapiens
aaaguugugccugaaaugaaaaaaacaaaacaaaaaaaaauaaaccgguuucuuuuacugauuu

SEQ ID NO: 92652 - RNA, 64 nt, Homo Sapiens
uaaauuuaagaaaaccauuuucguguuauguuuaaaaaaauaaacaccaguuuuaacaccuucc

SEQ ID NO: 92653 - RNA, 64 nt, Homo Sapiens
ucccuugaaaaaaacugggcgaccuuucacagagaaaaaauauuaaacuagcucuuuuacuacu

SEQ ID NO: 92654 - RNA, 64 nt, Homo Sapiens
aauggugugugccugcagucgaucucauccuuacaaaaaauaauaagccugggaaacauagcaa

SEQ ID NO: 92655 - RNA, 64 nt, Homo Sapiens
uaugcaggaagaguagcacuaaauaauguuaggaaaaaaauauuauucuaaaucuugggagaaa

SEQ ID NO: 92656 - RNA, 64 nt, Homo Sapiens
guuaggaaaaaaauauuuaucuaaaucuugggagaaaaaauaauggaacaugagaugugacauu

SEQ ID NO: 92657 - RNA, 64 nt, Homo Sapiens
uaaauacauuuugucugaaagagacuccgucucaaaaaaauaaauccagccugggcgacagagc

SEQ ID NO: 92658 - RNA, 64 nt, Homo Sapiens
aaaaaauuagccaagcauggaccccgucuccacuaaaaaauacaauccuggcuaacacagugaa

SEQ ID NO: 92659 - RNA, 64 nt, Homo Sapiens
aaccuauuuucauuuguacauccauuuauuuaugaaaaaauauggcuggaacauuugauauuuu

SEQ ID NO: 92660 - RNA, 64 nt, Homo Sapiens
agacaagcacuauuuuauauugcacaguggcacaaaaaaauaucgggccacuuuuuuuuuauac

SEQ ID NO: 92661 - RNA, 64 nt, Homo Sapiens
uuuguuucuuucuuuguaaaggccuuggauauugaaaaaauaccaaggcagaacaguuggacaa

SEQ ID NO: 92662 - RNA, 64 nt, Homo Sapiens
agaggacgaaaugaguauauucacagaggaauccaaaaaauacaguuugggggaaaaugcaaua

SEQ ID NO: 92663 - RNA, 64 nt, Homo Sapiens
uuaaaaaggaauuuuagagauugauuguuuuaaaaaaaaauacgcacauuguccaauccaguga

SEQ ID NO: 92664 - RNA, 64 nt, Homo Sapiens
gaauccuuuuuuuuuuuuuuaaagacuaaaugugaaaaaauaaucacuacuuaagcuaauuaau

SEQ ID NO: 92665 - RNA, 64 nt, Homo Sapiens
uuuaugaauccugucgguauuccuugguaucugaaaaaaauaccaaauaguaccauacaugagu

SEQ ID NO: 92666 - RNA, 64 nt, Homo Sapiens
uugcaucacacuaauuacaaaauacaaguucuggaaaaaauauuuuucuucauuuuaaaacuuu

SEQ ID NO: 92667 - RNA, 64 nt, Homo Sapiens
ugucagauggggguaaaauccauuaaagaacaggaaaaaauaauuauaagaugauaagcaaaug

SEQ ID NO: 92668 - RNA, 64 nt, Homo Sapiens
uguacaaugacaacccuggaaguugcuuuuuuuaaaaaaauaauaaauuucuuaaaucaacucu

SEQ ID NO: 92669 - RNA, 64 nt, Homo Sapiens
aaugaggcaaauccgaagaaaaggaaaaucgaauaaaaaauagucccacaaaauaccuuuugug

SEQ ID NO: 92670 - RNA, 64 nt, Homo Sapiens
auauauuacuuauaugcuucaaauuuuauuuaugaaaaaauauguauaucuguaaucaguuguu

SEQ ID NO: 92671 - RNA, 64 nt, Homo Sapiens
auugauuuugaugcuagauaguuuugcuagguauaaaaaauaaguaaaguuccacuuagagaac

SEQ ID NO: 92672 - RNA, 64 nt, Homo Sapiens
aguacauagugaauuuuaaaauguagaagaaagcaaaaaauaaaauaaguccuaaagugaagaa

SEQ ID NO: 92673 - RNA, 64 nt, Homo Sapiens
uggaaaaaucuaaacauuuuuaucuucauaauuuaaaaaauauauauguauauauugcauauuc

SEQ ID NO: 92674 - RNA, 64 nt, Homo Sapiens
acguuuuuaccuuuuuuaaaaaacauuuuuguagaaaaaauaauuaaauccccuuuuuggaaac

SEQ ID NO: 92675 - RNA, 64 nt, Homo Sapiens
gcggagaaaucaaguuuaaaauuccuucugauuaaaaaaauauaguggaauacaauugucugcc

SEQ ID NO: 92676 - RNA, 64 nt, Homo Sapiens
cccagcacacauuaauguuagcuucuuucugagaaaaaaauaccucuuccaggcccugaaacaa

SEQ ID NO: 92677 - RNA, 64 nt, Homo Sapiens
cugagaaaaaaauaccucuuccaggcccugaaacaaaaaauacauuugcugugaagauugaaaa

SEQ ID NO: 92678 - RNA, 64 nt, Homo Sapiens
cuuuugcacuugaauuugcaacugaauggauuuuaaaaaauaauucuuuaaugggaucaugagc

SEQ ID NO: 92679 - RNA, 64 nt, Homo Sapiens
ugaauguauauuucuauuuaugauaccaauuuauaaaaaauaauuacacagaaaaaauggaaua

SEQ ID NO: 92680 - RNA, 64 nt, Homo Sapiens
acuuguucuugauaagugaaaacugcagggaaauaaaaaauacauaucaaaacauggacaugcu

SEQ ID NO: 92681 - RNA, 64 nt, Homo Sapiens
uuucuauaaacaguuuuaaggauaugauuugguuaaaaaauaauuuguuauaaaaauucuguuu

SEQ ID NO: 92682 - RNA, 64 nt, Homo Sapiens
uuguaauuuguaguucucaaaagacuuuuuuuuaaaaaaauaaaguccauacuuacacuuaggc

SEQ ID NO: 92683 - RNA, 64 nt, Homo Sapiens
uggaauaauuauuaaugaaagauuuuugaaauauaaaaaauaaauuaggcccaauccaagaaau

SEQ ID NO: 92684 - RNA, 64 nt, Homo Sapiens
aaucaaagacuauuaaaggagcuguacagagguaaaaaaauaaauguggaacauuauuaacuua

SEQ ID NO: 92685 - RNA, 64 nt, Homo Sapiens
aaugugaagcuuuuugaugccaucaaaacuuauuaaaaaauaggauuuacuuuuuucuaauucu

SEQ ID NO: 92686 - RNA, 64 nt, Homo Sapiens
uauauaguuuaguuuguuaggugcuuuccuauggaaaaaauacagauauuucugucuucuccuu

SEQ ID NO: 92687 - RNA, 64 nt, Homo Sapiens
gcaagaaauacuaacaucaauaucaucuucagagaaaaaauaaaauuaucaaaaggaauuuugg

SEQ ID NO: 92688 - RNA, 64 nt, Homo Sapiens
cucauagauucagcaaauauuaaaagcuugcaguaaaaaauaaaaaaguugaaacaaaugauuu

SEQ ID NO: 92689 - RNA, 62 nt, Homo Sapiens
caucuguugacaauuugccagucuaaugaaacaaaaaauauuacucccgacauaggcuuuga

SEQ ID NO: 92690 - RNA, 64 nt, Homo Sapiens
ccacgaauuugguguggcugauacaguaaaguuuaaaaaauacaucuauuuaaaaaauaaaaaa

SEQ ID NO: 92691 - RNA, 64 nt, Homo Sapiens
guaaaguuuaaaaaauacaccuauuuaaaaaauaaaaaaauacauauuauuuucuauagcucuu

SEQ ID NO: 92692 - RNA, 64 nt, Homo Sapiens
aaaauacaguaaaguuuaaauagcucuucuauuuaaaaaauaaaaccuuauguauuauuuucua

SEQ ID NO: 92693 - RNA, 64 nt, Homo Sapiens
aaaggaaguaaaaauuuuacucacugagaauuuaaaaaaauaaaaaaaggaaucagaauaagga

SEQ ID NO: 92694 - RNA, 64 nt, Homo Sapiens
aauaauuugaaucauguaauuauuucuuuguaaaaaaaaauaaugcagugauccuuuacagguu

SEQ ID NO: 92695 - RNA, 64 nt, Homo Sapiens
caauaagagauuaggagccuuagcaauuauggaaaaaaaauauuuuggcaacccuuuugaaaag

SEQ ID NO: 92696 - RNA, 64 nt, Homo Sapiens
caggucaaugaaugaaacuaauggauuuuauaggaaaaaauaaaauaauacagugggcuucugg

SEQ ID NO: 92697 - RNA, 64 nt, Homo Sapiens
accccaccuuguugcaaaaggaugucaugcaccaaaaaaauaaaaaugucucguuagaguauuu

SEQ ID NO: 92698 - RNA, 64 nt, Homo Sapiens
aaaaaaaaaagacgaacuauaccaauaaaaauaaaaaaaauaaaggucauuaucacacaaagag

SEQ ID NO: 92699 - RNA, 64 nt, Homo Sapiens
cccucagaauauuaagcacauuauuguagagaaaaaaaaauauguguacacauaugaacgcaca

SEQ ID NO: 92700 - RNA, 64 nt, Homo Sapiens
auucucagaacaccaaguaaaucuaucucuauauaaaaaauauauguaauauauacauauucaa

SEQ ID NO: 92701 - RNA, 64 nt, Homo Sapiens
uauacauauucaaaguauauacagagccuguuuuaaaaaauacaguauuauuuaguaaaauuau

SEQ ID NO: 92702 - RNA, 64 nt, Homo Sapiens
ucagaccuguuucuuguaacuggguucaaaaagaaaaaaauaauaaaaauaaaagagagagaga

SEQ ID NO: 92703 - RNA, 64 nt, Homo Sapiens
gccugggcaacagagcaagacucugucucaaaaaaaaaaauacaauauuuuaacaaugugcccu

SEQ ID NO: 92704 - RNA, 64 nt, Homo Sapiens
aacugugucugauguuucuucucauguaagaaauaaaaaauaaaaauaaaauaaaauauauugg

SEQ ID NO: 92705 - RNA, 64 nt, Homo Sapiens
auaaaauaaaauauauugguauguaacuacaggaaaaaaauaaaaaauauauaguggacaguaa

SEQ ID NO: 92706 - RNA, 64 nt, Homo Sapiens
aaaauauauugguauguaacuacaggaaaaaaauaaaaaauauauaguggacaguaaccuuuca

SEQ ID NO: 92707 - RNA, 64 nt, Homo Sapiens
gaaauggaucacacgauuucuuuaagggaauuaaaaaaaauaaaagaauuacggcuuuuacagc

SEQ ID NO: 92708 - RNA, 64 nt, Homo Sapiens
uauucuggacggacuuauuaaaauacaaacagacaaaaaauaaaacaaaacuugaguucuauuu

SEQ ID NO: 92709 - RNA, 64 nt, Homo Sapiens
agucuucuuugaauaucagggacugagucaauaaaaaaaauaguagaaagguggcuuuuacuau

SEQ ID NO: 92710 - RNA, 64 nt, Homo Sapiens
gaggauagagcugcaucacuuaaauucaugacuuaaaaaauaauacaguuuauauacaacuugu

SEQ ID NO: 92711 - RNA, 64 nt, Homo Sapiens
uuacugucaccacuaguuuuaauauaguacaaugaaaaaauaauauauauauauauaguacaau

SEQ ID NO: 92712 - RNA, 64 nt, Homo Sapiens
agccuggacaacagagcaagacucugucucaaaaaaaaaauaaaaaauaaaaaauaaaaaauaa

SEQ ID NO: 92713 - RNA, 64 nt, Homo Sapiens
acaacagagcaagacucugucucaaaaaaaaaauaaaaaauaaaaaauaaaaaauaaaagaaac

SEQ ID NO: 92714 - RNA, 64 nt, Homo Sapiens
agcaagacucugucucaaaaaaaaaauaaaaaauaaaaaauaaaaaauaaaagaaacauaagau

SEQ ID NO: 92715 - RNA, 64 nt, Homo Sapiens
cucugucucaaaaaaaaaauaaaaaauaaaaaauaaaaaauaaaagaaacauaagauaaguacc

SEQ ID NO: 92716 - RNA, 64 nt, Homo Sapiens
cagucugagcaacauggcaaaacccugugucuacaaaaaauaaaaaauuagcugggcaugacgg

SEQ ID NO: 92717 - RNA, 64 nt, Homo Sapiens
aauuauuucauuucagauagaaauacaaaaaaaaaaaaaauacuuuucuuagaagccagauaug

SEQ ID NO: 92718 - RNA, 64 nt, Homo Sapiens
cagccugggcaacauagugagacuccgucucuacaaaaaauaaauuuagcugggcaugguggug

SEQ ID NO: 92719 - RNA, 64 nt, Homo Sapiens
uagccucaccccuacauguggauagaaggaaaugaaaaaauaauugcuuugacauugucuauau

SEQ ID NO: 92720 - RNA, 64 nt, Homo Sapiens
acuccagccaggugacauagcgagauccugucuaaaaaaauaaaaaauaaauaauggaacacag

SEQ ID NO: 92721 - RNA, 64 nt, Homo Sapiens
ccaggugacauagcgagauccugucuaaaaaaauaaaaaauaaauaauggaacacagcaagucc

SEQ ID NO: 92722 - RNA, 64 nt, Homo Sapiens
gauguaacacuugguaugcucgguugaggauaugaaaaaauacuuccgaaaccaggaauucaau

SEQ ID NO: 92723 - RNA, 64 nt, Homo Sapiens
cuugaucaaaggucauuuguguagaugaguaauuaaaaaauauuuaaaucacauuauaauucua

SEQ ID NO: 92724 - RNA, 64 nt, Homo Sapiens
ugcuugccauccugcaguaguauaaaucaugaauaaaaaauaauuuugcuguuguaguauacau

SEQ ID NO: 92725 - RNA, 64 nt, Homo Sapiens
uaaaaucaguuuuuugauaguguguguauauaagaaaaaauagauacacacauucuuuuuucuc

SEQ ID NO: 92726 - RNA, 64 nt, Homo Sapiens
aauaaacaaaaaaaauucaaaaccaaugaacuuuaaaaaauaaagauuuugagaauguacuaaa

SEQ ID NO: 92727 - RNA, 64 nt, Homo Sapiens
caacauuauuauucauuaggcuacuaagcacaugaaaaaauacucaaagaagauaugcaaaugg

SEQ ID NO: 92728 - RNA, 64 nt, Homo Sapiens
accacaauugagauuugccuaauaucagaaagcaaaaaaauaaaacuugagaacuuuuuuccuu

SEQ ID NO: 92729 - RNA, 64 nt, Homo Sapiens
gaugggcagaagggggggaaaguuaauaggaaccaaaaaauaauuuuuaaaggagagcauccua

SEQ ID NO: 92730 - RNA, 64 nt, Homo Sapiens
uuuggaaaaaaaacuacuguuuaacgauacuaaaaaaaaauagcuuuugugcaacugcuuuaua

SEQ ID NO: 92731 - RNA, 64 nt, Homo Sapiens
uaucccaaacuuuuuaauguuggggggagggguuaaaaaauaaugaaggccuuuguguguguau

SEQ ID NO: 92732 - RNA, 64 nt, Homo Sapiens
uaaauggcuaaguuuacuuggagggaauaacuuaaaaaaauacuaaagcucccucaguuuuuug

SEQ ID NO: 92733 - RNA, 64 nt, Homo Sapiens
aaauuuugaauugaguguguguuauuuaaggaggaaaaaauauucugccucaugacaaguacau

SEQ ID NO: 92734 - RNA, 64 nt, Homo Sapiens
auuuuugagaauaacauagcuuugauuuuauaggaaaaaauaguaaaaguguggccacugagca

SEQ ID NO: 92735 - RNA, 64 nt, Homo Sapiens
uaaaaggaagcuuagaugggcucuuggacauacuaaaaaauaccaaaccugaagcagguguuuu

SEQ ID NO: 92736 - RNA, 64 nt, Homo Sapiens
cauguuugaauuguuuucucuuucaaggacuuuaaaaaaauaauuucucugagaguuuuaauac

SEQ ID NO: 92737 - RNA, 64 nt, Homo Sapiens
aauaaaagcugaccccaaagaaaaauauauauuuaaaaaauaaacagagagagacccugucuca

SEQ ID NO: 92738 - RNA, 64 nt, Homo Sapiens
uauuuaaaaaauaaaaauaaagagacccugucucaaaaaauauacuccagucuggaugacagag

SEQ ID NO: 92739 - RNA, 64 nt, Homo Sapiens
gcuuuuccaaugaugaaauaugacaacaauccaaaaaaaauacguuuuaaaauaaauuauuauu

SEQ ID NO: 92740 - RNA, 64 nt, Homo Sapiens
uaaaagugaugucuuugcacguauuuuaauuaaaaaaaaauaaugcauuccacuggguauaaca

SEQ ID NO: 92741 - RNA, 64 nt, Homo Sapiens
gugaaagaaaaaaaacaacugaggaaaaaaaggcaaaaaauauuuacaaagcaaaaagaaaaaa

SEQ ID NO: 92742 - RNA, 64 nt, Homo Sapiens
uuccauguaaguuaccagaacuugauaaaaauauaaaaaauaauuaaaugccuggaacugacuu

SEQ ID NO: 92743 - RNA, 64 nt, Homo Sapiens
guuagcuagcaaauauggacaaaaacucaguaugaaaaaauacauaaaaaaaaaaaaaacaaaa

SEQ ID NO: 92744 - RNA, 64 nt, Homo Sapiens
aagucuguguucuaaacaauaccacaauaaaugcaaaaaauaaauuuuauguuauguauauuuu

SEQ ID NO: 92745 - RNA, 64 nt, Homo Sapiens
ucuagaaugggcaagaaggauuuuaucauaauuuaaaaaauauagguaaauuuuguuauguaua

SEQ ID NO: 92746 - RNA, 64 nt, Homo Sapiens
ccaguuggcaauaauauugccuuauuaaaucuucaaaaaauauauuuuagucuguuauuuaaga

SEQ ID NO: 92747 - RNA, 64 nt, Homo Sapiens
aggauaccagaaaggaaauggcaugcacacacacaaaaaauaccuaaauuuuggaugagaaaau

SEQ ID NO: 92748 - RNA, 64 nt, Homo Sapiens
aauguguuagguuuaaacgucguuucuuucuucuaaaaaauauuugguuaguaccuucacugag

SEQ ID NO: 92749 - RNA, 64 nt, Homo Sapiens
guuaguaccuucacugagcaauaguggaaaaauaaaaaaauaaguaaacagaaaaaacuaaagu

SEQ ID NO: 92750 - RNA, 64 nt, Homo Sapiens
uguggauucaaccaaccaaggacggaaaaugcuuaaaaaauaauacaacaacaacaaaaaauac

SEQ ID NO: 92751 - RNA, 64 nt, Homo Sapiens
acggaaaaugcuuaaaaaauaauacaacaacaacaaaaaauacauuauaacaacuauuuacuuu

SEQ ID NO: 92752 - RNA, 64 nt, Homo Sapiens
uagguuuaauauuuuuuuaguuagguagaguuuuaaaaaauacuugagccuguccgugauaaag

SEQ ID NO: 92753 - RNA, 64 nt, Homo Sapiens
cuaugagcacuccaggaaacacuauauuuuuuccaaaaaauaugugauuauauauguuaaagua

SEQ ID NO: 92754 - RNA, 64 nt, Homo Sapiens
uggacuuuggcagcuuuuaaaaaaaucaauuuuuaaaaaauagucagauuuuuauuaauguaaa

SEQ ID NO: 92755 - RNA, 64 nt, Homo Sapiens
agucuacugaauuaauuuuuccauguuacacaggaaaaaauagacauuuuagagccaggaauuc

SEQ ID NO: 92756 - RNA, 64 nt, Homo Sapiens
acauuugaaauuauuucauucaaaauuuccuguaaaaaaauacuaguaccuauuuuuacucuua

SEQ ID NO: 92757 - RNA, 64 nt, Homo Sapiens
uagaauacuugagaauuuaguucuaaaaaaaaguaaaaaauacauuuuuguaaacccaaguaag

SEQ ID NO: 92758 - RNA, 64 nt, Homo Sapiens
uuugauuuucucacugguguucuauguaaaagaaaaaaaauagccuuuuccuucugaaccacgu

SEQ ID NO: 92759 - RNA, 64 nt, Homo Sapiens
guaguaauaaagaauaaaauauuuaaggauaaauaaaaaauaaauguuuugaaagugagcauuc

SEQ ID NO: 92760 - RNA, 64 nt, Homo Sapiens
caugaaucaaaugguaaugccauaaacuucuggaaaaaaauaaguauuuuuuuuuucacuugcu

SEQ ID NO: 92761 - RNA, 64 nt, Homo Sapiens
ugucauuaugcaguguguauaacauugcucugauaaaaaauagccugcgcuucuauguuuggga

SEQ ID NO: 92762 - RNA, 64 nt, Homo Sapiens
uuuuucaaagaauguauaaguuugugauauuuuuaaaaaauaaucauauauuauggauauauac

SEQ ID NO: 92763 - RNA, 64 nt, Homo Sapiens
auuuaauuuaaaaaguaucuuucuuaugucgcucaaaaaauaaauaucucccaaauauguucaa

SEQ ID NO: 92764 - RNA, 64 nt, Homo Sapiens
acagaggauacuacaggcuggauaucauagaaguaaaaaauaaaauguggaagcuaaaaaaauu

SEQ ID NO: 92765 - RNA, 64 nt, Homo Sapiens
acagccguggugguucauauauuuucaaaaagacaaaaaauaugucauccuaauuaaggugacu

SEQ ID NO: 92766 - RNA, 64 nt, Homo Sapiens
cuggggaagguaccacaaacaaauauaguagcuaaaaaaauacuccuauucaacagaaauauag

SEQ ID NO: 92767 - RNA, 64 nt, Homo Sapiens
uauauuucaauguauuuuuuccuacauuucaugcaaaaaauauacuugacucagggguucuuaa

SEQ ID NO: 92768 - RNA, 64 nt, Homo Sapiens
uuaaaguugucuacaaaucuacauuguuaacauuaaaaaauauucuacugguaaaauuuugaag

SEQ ID NO: 92769 - RNA, 64 nt, Homo Sapiens
acucacugcccuaucauacauauuguauauacuuaaaaaauagagaagcauuaaacuuucuuuu

SEQ ID NO: 92770 - RNA, 64 nt, Homo Sapiens
cucuuguaguuauaaaauaagucauugugcuuuaaaaaaauaacaauucacuaaaaauaaauau

SEQ ID NO: 92771 - RNA, 64 nt, Homo Sapiens
ccgacucccacuacaucaaguuuuuuuuuaauagaaaaaauaaugagccaccgugcccagccuu

SEQ ID NO: 92772 - RNA, 64 nt, Homo Sapiens
uacuugaagaaccaauccaaaagcuaauguuuggaaaaaauauaaucaucagaacucuucacug

SEQ ID NO: 92773 - RNA, 64 nt, Homo Sapiens
ccaaauauguuuaaguauuaauuuacaaacacguaaaaaauaccguguuuucuuaguacugucu

SEQ ID NO: 92774 - RNA, 64 nt, Homo Sapiens
uguagaguguuuuuuuuacauguauuuaaagaaaaaaaaauagagcagcuauacguggcauaca

SEQ ID NO: 92775 - RNA, 64 nt, Homo Sapiens
ggccucauuuuucucuuuuucaaugagaucugugaaaaaauaauauugagccauguuaaccugc

SEQ ID NO: 92776 - RNA, 64 nt, Homo Sapiens
ccuucaguuuccuggugugauuuuuaagguaaaaaaaaaauacauuguuugguuuuuuuuuuuu

SEQ ID NO: 92777 - RNA, 64 nt, Homo Sapiens
uacagauuccuguuguguaaacaaaaaaauaauaaaaaaauauaucuuuuguuauuaaaaaaac

SEQ ID NO: 92778 - RNA, 64 nt, Homo Sapiens
aaaaaaauauauacagauucauuaaaaaaacacaaaaaaauaauggcauuaauauucuuuuguu

SEQ ID NO: 92779 - RNA, 64 nt, Homo Sapiens
gcuuuuuacuuaaauaaugccagacacugagggaaaaaaauaaagguaaacaauaaagaagauu

SEQ ID NO: 92780 - RNA, 64 nt, Homo Sapiens
aagaaaaaaaaaguuugcacccuccaccccccccaaaaaauagagcaacagagcaagaccccau

SEQ ID NO: 92781 - RNA, 64 nt, Homo Sapiens
uaaaucacuaaggauuggagaucaccaaucaaucaaaaaauaaaaaggacguaacuuagcaugg

SEQ ID NO: 92782 - RNA, 64 nt, Homo Sapiens
augccuuuucccaaaauguugaaauaugauguuaaaaaaauaagaagaaugcuuaaucagauag

SEQ ID NO: 92783 - RNA, 64 nt, Homo Sapiens
aaccuuucuucaccaaaucuugguugaugccaaaaaaaaauacaugcuaagagaaguagaaauc

SEQ ID NO: 92784 - RNA, 64 nt, Homo Sapiens
uucacuucaguuuaaugucuccuuugcucuugccaaaaaauagcacacuuuuccacauuccagu

SEQ ID NO: 92785 - RNA, 64 nt, Homo Sapiens
auuauaauaggaacaaucuuugcuguauacuuuuaaaaaauacucugcuauuucucuugcugga

SEQ ID NO: 92786 - RNA, 64 nt, Homo Sapiens
cagccuggccaauauggugaaacccugucucuacaaaaaauacaaaaauuagcugggcauggug

SEQ ID NO: 92787 - RNA, 64 nt, Homo Sapiens
aaauaauuuuucacauuguauuguugcuauauaaaaaaaauaauagaauugguuggguuucuga

SEQ ID NO: 92788 - RNA, 64 nt, Homo Sapiens
gaugcagaacacagaggaauaaucaccugcuuuaaaaaaauaaaguacuguugaaaagaucauu

SEQ ID NO: 92789 - RNA, 64 nt, Homo Sapiens
gauuuuuuucauuuucuauuuaagaaauaugaagaaaaaauacaccaagauggucaaauuacua

SEQ ID NO: 92790 - RNA, 64 nt, Homo Sapiens
uuaaccuccuaaaaggaauucauauuuuaaaggaaaaaaauacaacuaaugaugcacauuucuu

SEQ ID NO: 92791 - RNA, 64 nt, Homo Sapiens
uuuucagcauuccucaugcauuucagugguaaccaaaaaauaauuugucaauuaauaguugugu

SEQ ID NO: 92792 - RNA, 64 nt, Homo Sapiens
cccugcuaggaaaaaauugcacugaaaugcugacaaaaaauaaugaaaugaaguggcuuccaaa

SEQ ID NO: 92793 - RNA, 64 nt, Homo Sapiens
uucauuaucccucaaaaaguuaccaccacaucagaaaaaauaaaaaaaaaauaguaaaguaggc

SEQ ID NO: 92794 - RNA, 64 nt, Homo Sapiens
ucaaaaaguuaccaccacaucagaaaaaauaaaaaaaaaauaguaaaguaggcagagcuagguu

SEQ ID NO: 92795 - RNA, 64 nt, Homo Sapiens
gagaugucugcucuuuuaaauuauauauaaggaaaaaaaauagccugccuugggacaggugugu

SEQ ID NO: 92796 - RNA, 64 nt, Homo Sapiens
ccgcacccggccugaaaauauuuucuaaaaagauaaaaaauauacauaacgaugaaaaauaaua

SEQ ID NO: 92797 - RNA, 64 nt, Homo Sapiens
aguguagaucauuguauucagagauuguaaaugaaaaaaauauagaaacuauuuaguuuuggua

SEQ ID NO: 92798 - RNA, 64 nt, Homo Sapiens
uugcuuugcaacgagucagacacaacaguaucucaaaaaauaugucugacauucucccggggcu

SEQ ID NO: 92799 - RNA, 64 nt, Homo Sapiens
uauauauaugugugugugugcuagggaaggaaaaaaaaaauauaaaguucuaucacuccuuuac

SEQ ID NO: 92800 - RNA, 64 nt, Homo Sapiens
aagguguauguguauagauuugucuuggaggguuaaaaaauagaaaaauuaaaaaaauaaacau

SEQ ID NO: 92801 - RNA, 64 nt, Homo Sapiens
cauugucuuggaggguuaaauuugcacaaaauuaaaaaaauaaaaaugguagaauauuuagaaa

SEQ ID NO: 92802 - RNA, 64 nt, Homo Sapiens
aagguguaaguauauaaguauugauguaaaaaauaaaaaauagaagcaucaucacauuaccugu

SEQ ID NO: 92803 - RNA, 64 nt, Homo Sapiens
aaauagaaagguguaaguauuaccuguuugauguaaaaaauaaauuguuacagcaucaucacau

SEQ ID NO: 92804 - RNA, 64 nt, Homo Sapiens
ucccugagaaagggaauuaugaaauuuuuaauacaaaaaauaauccauuuaggugcugaguuac

SEQ ID NO: 92805 - RNA, 64 nt, Homo Sapiens
cugggcaacagagcgagacuucaucucagaaaauaaaaaauaggggccaggcacaguggcucau

SEQ ID NO: 92806 - RNA, 64 nt, Homo Sapiens
aacauaacaagaccccaucccuuauuaaaagaaaaaaaaauaauuccucauuucaucauugguc

SEQ ID NO: 92807 - RNA, 64 nt, Homo Sapiens
uccagccugagcaacacagugagacccuaucucaaaaaaauaaugaugauaguacacguuaugu

SEQ ID NO: 92808 - RNA, 64 nt, Homo Sapiens
gcaagaccucaucucuucuaaaaauuaaaaaaaaaaaaaauaggcauggugguacacaccugug

SEQ ID NO: 92809 - RNA, 64 nt, Homo Sapiens
uauugcuuuaauuagagcagcacauugcuaaaauaaaaaauacaccuuaauuuuuaagaaauaa

SEQ ID NO: 92810 - RNA, 64 nt, Homo Sapiens
aauucuuaaauauugaggccccauugugaguaauaaaaaauacgacauaaguagaagacuaaga

SEQ ID NO: 92811 - RNA, 64 nt, Homo Sapiens
uuaauuauuauuuccccgucccuuaaaaagacaaaaaaaauaaggcaaaaggaaagcaacuaag

SEQ ID NO: 92812 - RNA, 64 nt, Homo Sapiens
guuuauuuauuguggauucccaucaggaaagaggaaaaaauacacauguucuuucauauaggca

SEQ ID NO: 92813 - RNA, 64 nt, Homo Sapiens
cuauaugggauguaauuuuuuuguucagucucuuaaaaaauacuuuguuuugguacauuugguu

SEQ ID NO: 92814 - RNA, 64 nt, Homo Sapiens
aaguaaacaaaagaaaaccuuccagcaacaaauuaaaaaauaauaacaaaucaaccccagcacc

SEQ ID NO: 92815 - RNA, 64 nt, Homo Sapiens
cuccucucccugacuggugucagauucaucaaacaaaaaauaaaucucgaagaaaaaaaaugca

SEQ ID NO: 92816 - RNA, 64 nt, Homo Sapiens
acccauauaugcaguuaaaaaaaaguuaauuuucaaaaaauacuguaaaagacuuuaaggaaca

SEQ ID NO: 92817 - RNA, 64 nt, Homo Sapiens
ucucaauuggggacaaaaauugguucuuggggugaaaaaauauuagauauggcuuguggacuuc

SEQ ID NO: 92818 - RNA, 64 nt, Homo Sapiens
gauguauuuuuuucaugcauuaguaugcauuuuuaaaaaauaaugcauguuucuuuaauaauua

SEQ ID NO: 92819 - RNA, 64 nt, Homo Sapiens
acugcugccauguguguacuguauuauuuucagaaaaaaauauaauagucugaguccaaguuau

SEQ ID NO: 92820 - RNA, 64 nt, Homo Sapiens
augguggaauaaccaaaauguguaucauucuacaaaaaaauaggccuggacuauuuaaggagug

SEQ ID NO: 92821 - RNA, 64 nt, Homo Sapiens
uagauccucuugcuguucugaggccuuaaaaccaaaaaaauaauggaaugauugcaucacugcg

SEQ ID NO: 92822 - RNA, 64 nt, Homo Sapiens
cagccuggccaacauggcaaaacuccgucucugcaaaaaauacaaaaaugagcccgguauguug

SEQ ID NO: 92823 - RNA, 64 nt, Homo Sapiens
ccacagugcuacagacaauaagugauaaaaugggaaaaaauagugaagaucuucuuuuaggaaa

SEQ ID NO: 92824 - RNA, 64 nt, Homo Sapiens
uuuucauuagggccauaucuccaaaaaaagaaagaaaaaauacaaaaaacaaaaacaaaaaaaa

SEQ ID NO: 92825 - RNA, 64 nt, Homo Sapiens
augguuaccaguacagucaaaaaagagaaaaugaaaaaaauacaacuaaaaggaagaaacacaa

SEQ ID NO: 92826 - RNA, 64 nt, Homo Sapiens
ucagguaaacauuuuaaccugaaaucuuagccacaaaaaauaaacuaauuaaaaaaauaguuau

SEQ ID NO: 92827 - RNA, 64 nt, Homo Sapiens
uaugaaaucuuagccacaaaucaagggcuaauuaaaaaaauagucacuuauagccuuaaaccau

SEQ ID NO: 92828 - RNA, 64 nt, Homo Sapiens
aauauuuaugaaaauugcacguguguauuucauuaaaaaauauaugcaugugugcuuuuuuuug

SEQ ID NO: 92829 - RNA, 64 nt, Homo Sapiens
uauuugauauacccuucaaucacauuuugaaagcaaaaaauauaccuuauauuuuaguuuguuc

SEQ ID NO: 92830 - RNA, 64 nt, Homo Sapiens
gaggaaauuccuucaucagaggaaaaaaaggcugaaaaaauaggugucuucuuagcuaagagga

SEQ ID NO: 92831 - RNA, 64 nt, Homo Sapiens
auuaaccuauauaaccauuugaauuuugaaaagcaaaaaauacuuaauagacaucaccagcaau

SEQ ID NO: 92832 - RNA, 64 nt, Homo Sapiens
aaaauuagcuggguauggugaacacugucucugcaaaaaauacacagccuggacaacauaguga

SEQ ID NO: 92833 - RNA, 64 nt, Homo Sapiens
uauauauugaaaaucaaaggaacagaguaagacaaaaaaauauacacugcacucuagccugggc

SEQ ID NO: 92834 - RNA, 64 nt, Homo Sapiens
cugggcuuuguagcauaugcaacccuguuucuauaaaaaauaaucagccugggcaacaugguga

SEQ ID NO: 92835 - RNA, 64 nt, Homo Sapiens
gaaaagaugauuuaccuccaaugcaaagaccaagaaaaaauaaaccaucgaggaagccgaaaau

SEQ ID NO: 92836 - RNA, 64 nt, Homo Sapiens
uuuuuuaaaaaagagagaauuaaaacugcucuaaaaaaaauaucucuccauuuugcugugaacu

SEQ ID NO: 92837 - RNA, 64 nt, Homo Sapiens
aaucagccccauucucccauagcaaacauguaggaaaaaauauaaggaaagagaggaagagaga

SEQ ID NO: 92838 - RNA, 64 nt, Homo Sapiens
aaaguaauacucugcaccccaauguaaguguuuuaaaaaauacgguugaccaguauuacuauac

SEQ ID NO: 92839 - RNA, 64 nt, Homo Sapiens
cuacuuucuucagguaaagggcaaauaaugaucgaaaaaauaauuauuuauuacauaauuuagu

SEQ ID NO: 92840 - RNA, 64 nt, Homo Sapiens
uggcaauagaccgagacuccgucuccaaaaaaaaaaaaaauacaauuuuuauuucuuuuacuuu

SEQ ID NO: 92841 - RNA, 64 nt, Homo Sapiens
caaaguuugcuuaguuacaacaaagcaccuuuaaaaaaaauacauuuuaaaaaaacauuccaag

SEQ ID NO: 92842 - RNA, 64 nt, Homo Sapiens
uaggaugugaaaaaaaauguuugcaguacucagcaaaaaauaggguacauaaagcaggguggcu

SEQ ID NO: 92843 - RNA, 64 nt, Homo Sapiens
ccucugcuggucuuguuccaggguuaugaauaugaaaaaauagagaugagacuuuuugugucaa

SEQ ID NO: 92844 - RNA, 64 nt, Homo Sapiens
uccagccuggauaacagagcgagacccugucucaaaaaaauaaaauaaaaaauaaaaacacccu

SEQ ID NO: 92845 - RNA, 64 nt, Homo Sapiens
aacagagcgagacccugucucaaaaaaauaaaauaaaaaauaaaaacacccuugccugcgcucc

SEQ ID NO: 92846 - RNA, 64 nt, Homo Sapiens
guugaacauaauguuccaguugaaugcaaaacaaaaaaaauauggaaaacauuuugauaaaauu

SEQ ID NO: 92847 - RNA, 64 nt, Homo Sapiens
ucaaaggauagcauaauaucugcauuaugcuggaaaaaaauagaccuuuggagaauacuuaaau

SEQ ID NO: 92848 - RNA, 64 nt, Homo Sapiens
uuucccuuuguuauugaccaaguuuuuaccauuaaaaaaauaucuauuuauaaauaguaaauaa

SEQ ID NO: 92849 - RNA, 64 nt, Homo Sapiens
uaucuaagaauguucuagggaguccuacuuguuuaaaaaauauguauuggagaaaauaaggugg

SEQ ID NO: 92850 - RNA, 64 nt, Homo Sapiens
aaagugauuugcucucaaauuguuuuauuugugaaaaaaauauuaaaauauacuauaacaaccg

SEQ ID NO: 92851 - RNA, 64 nt, Homo Sapiens
ucauccaacuucuuugcauuaaaguaaaaaaguaaaaaaauaaauuugaagaauuuauauuugg

SEQ ID NO: 92852 - RNA, 64 nt, Homo Sapiens
aagagcauucauuaaauacuucauucagcuguccaaaaaauaauuuuccaagaacaacuugaua

SEQ ID NO: 92853 - RNA, 64 nt, Homo Sapiens
uaucauacucuguauauuauauuuucucucuuuuaaaaaauauuccaaugauauuucaguauau

SEQ ID NO: 92854 - RNA, 64 nt, Homo Sapiens
uuuauuuauccacaucuuugauugaauauugaauaaaaaauauacauaggcuaauauagauuaa

SEQ ID NO: 92855 - RNA, 64 nt, Homo Sapiens
guaaucauaaacuugaacucagagagaagaguucaaaaaauaaaucccagcucauugcuccagg

SEQ ID NO: 92856 - RNA, 64 nt, Homo Sapiens
augacuuuucaaauuauaaugcauuuuuauuaugaaaaaauaaaaauugcaucagaucauggau

SEQ ID NO: 92857 - RNA, 64 nt, Homo Sapiens
ccuuugcuuuuuuuuuuuuuacaaaagacaaagcaaaaaauaaaauucucaugcuaaaaauaca

SEQ ID NO: 92858 - RNA, 64 nt, Homo Sapiens
auagaaaauauuaguuucagaauuacccuccuuuaaaaaauaagagacuauuuguuuucuuuua

SEQ ID NO: 92859 - RNA, 64 nt, Homo Sapiens
cucuagccugggcaacggugagacccugccucaaaaaaaauaaaaauaaaaauaaaacacuuua

SEQ ID NO: 92860 - RNA, 64 nt, Homo Sapiens
aaaacaaaacaaaaaaaaaaggcaaggcacaacaaaaaaauauccugggcaauaaaaaaaauau

SEQ ID NO: 92861 - RNA, 64 nt, Homo Sapiens
gcaaggcacaacaaaaaaauauccugggcaauaaaaaaaauauuuuaaaccagcuuuggagcca

SEQ ID NO: 92862 - RNA, 64 nt, Homo Sapiens
cauccugggcaacauggcgaaacccuaucucuacaaaaaauacaaaaauuagccagacauggug

SEQ ID NO: 92863 - RNA, 64 nt, Homo Sapiens
uaaaaaaaagagagaguaacuacagaagaacuuuaaaaaauaaaaaauaagcuuaccuuggauu

SEQ ID NO: 92864 - RNA, 64 nt, Homo Sapiens
aagagagaguaacuacagaagaacuuuaaaaaauaaaaaauaagcuuaccuuggauucuuggcu

SEQ ID NO: 92865 - RNA, 64 nt, Homo Sapiens
aguguguaggagugaagacaggaucccgugcuuaaaaaaauaaaaaauaaaaaaauaaaaaaaa

SEQ ID NO: 92866 - RNA, 64 nt, Homo Sapiens
aggagugaagacaggaucccgugcuuaaaaaaauaaaaaauaaaaaaauaaaaaaaaaauaaga

SEQ ID NO: 92867 - RNA, 64 nt, Homo Sapiens
agacaggaucccgugcuuaaaaaaauaaaaaauaaaaaaauaaaaaaaaaauaagacuuuaacu

SEQ ID NO: 92868 - RNA, 64 nt, Homo Sapiens
cgugcuuaaaaaaauaaaaaauaaaaaaauaaaaaaaaaauaagacuuuaacugcaguuccaaa

SEQ ID NO: 92869 - RNA, 64 nt, Homo Sapiens
uauuugcuucucgggaaagcaaagaagcugcuuuaaaaaauaaaaaggggacuaaaaauuuguu

SEQ ID NO: 92870 - RNA, 64 nt, Homo Sapiens
auaauauugugaaaaugaaucuguuaugauaaagaaaaaauaaaguggaaacuuuuagaguauu

SEQ ID NO: 92871 - RNA, 64 nt, Homo Sapiens
caaaguaguaaaauaaaaaaaaauuuaaaaaauuaaaaaauaaaaaaaagaggucacuaaaaga

SEQ ID NO: 92872 - RNA, 64 nt, Homo Sapiens
auaagccccuaccuucuuacuuucugguuuguugaaaaaauacacuggugcucuuugaagugau

SEQ ID NO: 92873 - RNA, 64 nt, Homo Sapiens
cauugucaaccuuuauugacuuuguuuuuacaauaaaaaauauuuuacaacuuacuuucuguuc

SEQ ID NO: 92874 - RNA, 64 nt, Homo Sapiens
aaagaccaagaucaaauaauagcugggguggagaaaaaaauagcucaagacacaguuaaucgag

SEQ ID NO: 92875 - RNA, 64 nt, Homo Sapiens
uccugaguaugcuugguguuugccuucagaaaaaaaaaaauacauuguaaauaaccucagcugg

SEQ ID NO: 92876 - RNA, 64 nt, Homo Sapiens
aaaagcuucauuucugaagaugaauuuuauuuuuaaaaaauacaugcacacucaaaacuuuuag

SEQ ID NO: 92877 - RNA, 64 nt, Homo Sapiens
cauguaaaauuuuguuauuuccagucuguauaugaaaaaauaggucaucaaaaggaaaaaaaau

SEQ ID NO: 92878 - RNA, 64 nt, Homo Sapiens
gucuguauaugaaaaaauaggucaucaaaaggaaaaaaaauaacuuugauuaacuaguguuaaa

SEQ ID NO: 92879 - RNA, 64 nt, Homo Sapiens
gaaaaaaaauaacuuugauuaacuaguguuaaacaaaaaauagguuuacuaaauauguuaaucu

SEQ ID NO: 92880 - RNA, 64 nt, Homo Sapiens
uuauuuacacaggguuuauauaagauucugauaaaaaaaauaaaacuaguguguuaugaaugac

SEQ ID NO: 92881 - RNA, 64 nt, Homo Sapiens
aagcuuucuggaagaagacacacgaauacucugaaaaaaauaaaccuuuuuaaacccccaugaa

SEQ ID NO: 92882 - RNA, 64 nt, Homo Sapiens
uuuuguaauguuugaaaaauuuggcagucaaaaaaaaaaauaccccauaccauagaagaaagaa

SEQ ID NO: 92883 - RNA, 64 nt, Homo Sapiens
uaggaguuucuuagacccuauuuucuuuuuaagaaaaaaauauccgccaugccuggcccuugau

SEQ ID NO: 92884 - RNA, 64 nt, Homo Sapiens
aguucacccaaguugcuucuccaguacguaaguuaaaaaauaccucucaaagcacacugucuuc

SEQ ID NO: 92885 - RNA, 64 nt, Homo Sapiens
gcuuggucaaccucuauacugccaauauuuuuuuaaaaaauagagagcaauacacauauuauag

SEQ ID NO: 92886 - RNA, 64 nt, Homo Sapiens
aauccaugaauccauacugaccaauuccauugggaaaaaauagagaaaaaaauaaaauaaauuc

SEQ ID NO: 92887 - RNA, 64 nt, Homo Sapiens
auaaauucccaauuccauugcaagauaauugagaaaaaaauaaauaauugagaaaaauaaauaa

SEQ ID NO: 92888 - RNA, 64 nt, Homo Sapiens
gguauauugccaaaacauagaguaauguuaaaaaaaaaaauagaaauaucuuguuaugccagaa

SEQ ID NO: 92889 - RNA, 64 nt, Homo Sapiens
aucugaaaagaaaugcuaauuucaaaugaguuuaaaaaaauaacuauuucuaucugcaaauagu

SEQ ID NO: 92890 - RNA, 64 nt, Homo Sapiens
auauucuugcuuucacaaauguacacccaauuuuaaaaaauaacgucuaugcuuaggccaguca

SEQ ID NO: 92891 - RNA, 64 nt, Homo Sapiens
ugugcacuauaagggaguaggauacacuguaucuaaaaaauaacggccgcaaccacuugcuagu

SEQ ID NO: 92892 - RNA, 64 nt, Homo Sapiens
uuccagucauuuugggaauuccugcuuaacuugaaaaaaauaugggaaagacaugcagcuuuca

SEQ ID NO: 92893 - RNA, 64 nt, Homo Sapiens
cagaagaaaagcaaaugacuaguaaacaugugggaaaaaauauuacauuuuaagggggaaaaaa

SEQ ID NO: 92894 - RNA, 64 nt, Homo Sapiens
uuuucuuucaucuuuagguugaauaaagaaacagaaaaaauagaacauacugaaaauaaucuaa

SEQ ID NO: 92895 - RNA, 64 nt, Homo Sapiens
ccagccugggugacagagugagacucugucucaaaaaaaauaaaauaaaaagucaauuuagaau

SEQ ID NO: 92896 - RNA, 64 nt, Homo Sapiens
cuccagccugggugacagagcgacccucugucucaaaaaauaauaauaauaauaaauaaaacaa

SEQ ID NO: 92897 - RNA, 64 nt, Homo Sapiens
aucaaaaaaguaauagcgcucauuugcuaaaugcaaaaaauaaucaccuuugauaccaaugugc

SEQ ID NO: 92898 - RNA, 64 nt, Homo Sapiens
aggagacaauuuuggagagcaagcaaaucuuuuuaaaaaauaguaugaaugugaauacuagaaa

SEQ ID NO: 92899 - RNA, 64 nt, Homo Sapiens
aaaauaguaugaaugugaauacuagaaaagauuuaaaaaauaguaugagugugaguacuaggaa

SEQ ID NO: 92900 - RNA, 64 nt, Homo Sapiens
cugaacaaagcuauaggguugaaaaaagcaaagaaaaaaauauuuuuggucaguaaaacuuaau

SEQ ID NO: 92901 - RNA, 64 nt, Homo Sapiens
cauaauacaaacauacaugcagggagagaggaggaaaaaauacacucucuagagcgagcaagag

SEQ ID NO: 92902 - RNA, 64 nt, Homo Sapiens
gccuccagguaucaagaucucccccagccccucaaaaaaauaagcaucuuugguguuuuuuuaa

SEQ ID NO: 92903 - RNA, 64 nt, Homo Sapiens
gcuguuaaacaggaguugacuugguuuuuguauaaaaaaauaaucuugcaguauaaaugaagau

SEQ ID NO: 92904 - RNA, 64 nt, Homo Sapiens
uuaguuugcuaaccaacugauacaucccauaaauaaaaaauacuguaagacccaauaguuacug

SEQ ID NO: 92905 - RNA, 64 nt, Homo Sapiens
aauagaaacacaacucuacuaaauuaauaaaaguaaaaaauaaagaaaaucuguauuaaaaaua

SEQ ID NO: 92906 - RNA, 64 nt, Homo Sapiens
gaauaaacuucauggugguugugaauagacuuugaaaaaauacaauauauacauguaucuguau

SEQ ID NO: 92907 - RNA, 64 nt, Homo Sapiens
guuuuaacuacucaauuauuacaaaaccuuuuauaaaaaauauuaacaaggguuuaaacuugau

SEQ ID NO: 92908 - RNA, 64 nt, Homo Sapiens
gacaugagggggaaaguccuuuuugcccuucuccaaaaaauaaccuuccacagagacaaacugu

SEQ ID NO: 92909 - RNA, 64 nt, Homo Sapiens
uguuuguuuuuauuaucuuaagugcuaauuaaaaaaaaaauaaaauuuuaaaaaaaccuguagu

SEQ ID NO: 92910 - RNA, 64 nt, Homo Sapiens
uggauuuuguuguuugauggaauuugagccaaaaaaaaaauacgcaggcuuuccuauuucuaca

SEQ ID NO: 92911 - RNA, 64 nt, Homo Sapiens
caacacggugaaaccccgccucuacuaaaaauacaaaaaauagccgggugugguggugggcacc

SEQ ID NO: 92912 - RNA, 64 nt, Homo Sapiens
cuccagucugggugacagagcaagacuccaucucaaaaaauaaauaaauagaaagagagagaga

SEQ ID NO: 92913 - RNA, 64 nt, Homo Sapiens
acgauuuaccaauguuguuuuuuuuuaacaagaaaaaaaauaaaagcacauugucauuuuuuuu

SEQ ID NO: 92914 - RNA, 64 nt, Homo Sapiens
guugcaggauaucuagcaauuuaagaaaauguggaaaaaauauuuuuauugagaaauagcauuu

SEQ ID NO: 92915 - RNA, 64 nt, Homo Sapiens
accagccugggcaacauggcacaauugucucuacaaaaaauacaaaaauuagccaggcauggug

SEQ ID NO: 92916 - RNA, 64 nt, Homo Sapiens
guuggaacauuaagaaaaauguauauucccaaugaaaaaauaguuauaucaucuuauaguaaac

SEQ ID NO: 92917 - RNA, 64 nt, Homo Sapiens
ggauaaaauaauguguuauuuuuauagagaaagaaaaaaauagcaacacaaucuaguuuauuuu

SEQ ID NO: 92918 - RNA, 64 nt, Homo Sapiens
uuuaaaagacugaucacaaaagguugaauuuuuuaaaaaauaucuguccuaaaugugaagacag

SEQ ID NO: 92919 - RNA, 64 nt, Homo Sapiens
auagcagcaaggcccugguugaauuuuaauuagaaaaaaauacaucaacuguguuuaauacucu

SEQ ID NO: 92920 - RNA, 64 nt, Homo Sapiens
uugcccaucaauaaguuugaacuuuugcaauaaaaaaaaauaaauuaaaaaguuuucugaaaaa

SEQ ID NO: 92921 - RNA, 64 nt, Homo Sapiens
agauaaugauuuauugcagacugauuugcuuuaaaaaaaauaaagguuuuuguccuuuccuuca

SEQ ID NO: 92922 - RNA, 64 nt, Homo Sapiens
guuuguuuaaagcaugcauaauucucucauuuaaaaaaaauacuggucagacuuuuuuuguuag

SEQ ID NO: 92923 - RNA, 64 nt, Homo Sapiens
cagguguggggugcaugccuaauuuaaauacaaaaaaaaauagccucaaaaaaaaauuaaaaua

SEQ ID NO: 92924 - RNA, 64 nt, Homo Sapiens
gcugggcgcgguugcucacgucuacuaaaauacaaaaaaauaggcaacguggugaaacgcuguc

SEQ ID NO: 92925 - RNA, 64 nt, Homo Sapiens
gaacuaucaggauugaaaacgcaaauauauuuugaaaaaauaaauugcaaauuagcaucccaug

SEQ ID NO: 92926 - RNA, 64 nt, Homo Sapiens
uaagaaacaacucuuugagaacgcagcgugcuuuaaaaaauaaaaggagaaggccaauuccuau

SEQ ID NO: 92927 - RNA, 64 nt, Homo Sapiens
gccugagggaucuuuacuaggcuauguuauauugaaaaaauagaaaauuaaaauccucaaucca

SEQ ID NO: 92928 - RNA, 64 nt, Homo Sapiens
ugagaaaguguucaucugaguagaaaaaaaaaggaaaaaauaauaaauaucauuugacuuuuua

SEQ ID NO: 92929 - RNA, 64 nt, Homo Sapiens
auuugacuuuuuauagaaaacuuuauaaaaguugaaaaaauauccuuucaccuccccacccaaa

SEQ ID NO: 92930 - RNA, 64 nt, Homo Sapiens
aaaaaaaaagaaaagaaaaauguacuguuuguauaaaaaauagauuguuaugugcaauacuguu

SEQ ID NO: 92931 - RNA, 64 nt, Homo Sapiens
cuccauuuggugcugaaagugaagaauagguuacaaaaaauaaaaaggcaaaaaacauuguccu

SEQ ID NO: 92932 - RNA, 64 nt, Homo Sapiens
uuuucacuucaaaaugaaaaagauguuaucccaaaaaaaauaucuuuuuucuauauauugaauu

SEQ ID NO: 92933 - RNA, 64 nt, Homo Sapiens
cuuuuacaauaugaaugcauuucaucuguacacaaaaaaauacccaguaaaaauauuguuuugc

SEQ ID NO: 92934 - RNA, 64 nt, Homo Sapiens
acauuaaaauggagcuuguguaauagagaacuugaaaaaauaaacugccaaauguuauguaguu

SEQ ID NO: 92935 - RNA, 64 nt, Homo Sapiens
uuguggcaauguaucugugauaucuauggcuuuuaaaaaauauuuagacauuuuuuauuuugac

SEQ ID NO: 92936 - RNA, 64 nt, Homo Sapiens
ucucuacauuuaagaguagcaauagaacaauaaaaaaaaauacgucuuucaaauuaauugcagu

SEQ ID NO: 92937 - RNA, 64 nt, Homo Sapiens
auaaaauauauaccagauuucaaauaccuacuucaaaaaauaauguaaaauaucucacuaauaa

SEQ ID NO: 92938 - RNA, 64 nt, Homo Sapiens
acuuuucauguagcguaucacauaacuuuuuugcaaaaaauauaaaaagaaauaaacuucaaug

SEQ ID NO: 92939 - RNA, 64 nt, Homo Sapiens
aaaaaaaugcaaaucauucuuuaccuuaagaaaaaaaaaauacccuuugcuuugugccucaaag

SEQ ID NO: 92940 - RNA, 64 nt, Homo Sapiens
ggcucccacauuuuaagauuuuaaaaaugaaaccaaaaaauaaauugaagaaaacuguaaacuu

SEQ ID NO: 92941 - RNA, 64 nt, Homo Sapiens
cugcagccuaggugacagucagacccugucucaaaaaaaauaaaaaaaauuuaaaauaaucuug

SEQ ID NO: 92942 - RNA, 64 nt, Homo Sapiens
ugccccuguaaauaguuuuaaauaugaacaaagaaaaaaauauauuuuaugauuuaaaaaauaa

SEQ ID NO: 92943 - RNA, 64 nt, Homo Sapiens
auaugaacaaagaaaaaaauauauuuuaugauuuaaaaaauaaauauaauugggauuuuaaaaa

SEQ ID NO: 92944 - RNA, 64 nt, Homo Sapiens
agccugggcaacacaguaagacccuguuucuacaaaaaaauauaaaaaauagccugguguggug

SEQ ID NO: 92945 - RNA, 62 nt, Homo Sapiens
aacacaguaagacccuguuucuacaaaaaaauauaaaaaauagccuggugugguggugucug

SEQ ID NO: 92946 - RNA, 64 nt, Homo Sapiens
agcaguuugaaggcauacuuuugcauagaaauaaaaaaaauacugauuuggggcaaugaggaau

SEQ ID NO: 92947 - RNA, 64 nt, Homo Sapiens
ucacugaacaccaagaccagaauggauuuuuuuaaaaaaauagauguuccuuuugugaagcacc

SEQ ID NO: 92948 - RNA, 64 nt, Homo Sapiens
uuaaaguaaccuuauauuuaaaagaugauuuugcaaaaaauaaaaaauaaaaaauaugccuucu

SEQ ID NO: 92949 - RNA, 64 nt, Homo Sapiens
aaccuuauauuuaaaagaugauuuugcaaaaaauaaaaaauaaaaaauaugccuucuggaguga

SEQ ID NO: 92950 - RNA, 64 nt, Homo Sapiens
uauuuaaaagaugauuuugcaaaaaauaaaaaauaaaaaauaugccuucuggagugaugucugu

SEQ ID NO: 92951 - RNA, 64 nt, Homo Sapiens
uaaaauguuuauagcauuccgaagcuacuuucuuaaaaaauaaaagauauuuuccucuuuuucu

SEQ ID NO: 92952 - RNA, 64 nt, Homo Sapiens
uauauguauaaauaaaugauuaaagguuuuuauuaaaaaauauacuuuaugcaugaagauaaug

SEQ ID NO: 92953 - RNA, 64 nt, Homo Sapiens
cccaaaaugaagauuauuuugaacagaaaacaacaaaaaauaacagaacagugauuuuuuuuua

SEQ ID NO: 92954 - RNA, 64 nt, Homo Sapiens
aaauugcaugcugcuuuaauacauaaaaaguuaaaaaaaauaaugccguugccaagaacugaaa

SEQ ID NO: 92955 - RNA, 64 nt, Homo Sapiens
uuuaugaacugcauguauaauuauucaguuaagaaaaaaauaauuauauacauaacaggguaaa

SEQ ID NO: 92956 - RNA, 64 nt, Homo Sapiens
agcaccauugaauucugugcucagucuaaaaaauaaaaaauauguggaaaaccuuuucaggccc

SEQ ID NO: 92957 - RNA, 64 nt, Homo Sapiens
aaauaugagcaccauugaaucaggcccucagucuaaaaaauaaaccucaguuggaaaaccuuuu

SEQ ID NO: 92958 - RNA, 64 nt, Homo Sapiens
ggucguguaaauauguacaauauuguaaauacauaaaaaauauacaaauuuuuggcugcuguga

SEQ ID NO: 92959 - RNA, 64 nt, Homo Sapiens
uauauuucuuuaauucugcuuacuauuucauggaaaaaaauaaauuucucaauuuuaauguaaa

SEQ ID NO: 92960 - RNA, 64 nt, Homo Sapiens
aucuugaaugauacgauuaugcccaauauuaaguaaaaaauauaagaaaagguuaucuuaaaua

SEQ ID NO: 92961 - RNA, 64 nt, Homo Sapiens
uaauuaaucacaaaugugaaguuaugcaugauguaaaaaauacaaacauucuaauuaaaggcuu

SEQ ID NO: 92962 - RNA, 64 nt, Homo Sapiens
uauaaccuuaggauuccugaaaagaauuucaaaaaaaaaauaaagacacuguugccaaugugac

SEQ ID NO: 92963 - RNA, 64 nt, Homo Sapiens
aagaacauacuaauggcauauauuuguuacaauuaaaaaauaaauuuacuacuuaauccuaugu

SEQ ID NO: 92964 - RNA, 64 nt, Homo Sapiens
uacaguguucuguuuaauacucauccuuguauaaaaaaaauaguugagccagcagacauuguca

SEQ ID NO: 92965 - RNA, 64 nt, Homo Sapiens
auugccuauuucaguggcacgucaucuaguuuuaaaaaaauaaaacauuuuaaauggacagaga

SEQ ID NO: 92966 - RNA, 64 nt, Homo Sapiens
uaaaaauuucaucuuaaagcaaaaaucagcuuuaaaaaaauacacccccuauuuucaggggguu

SEQ ID NO: 92967 - RNA, 64 nt, Homo Sapiens
gacacacacagagcauuuuaacauuaaaaauacuaaaaaauaaauagauaaagcaagucuauca

SEQ ID NO: 92968 - RNA, 64 nt, Homo Sapiens
caaaaauuagcgggggggugucucuacuaaaaaaaaaaaauagagccaacauggugaaaccccg

SEQ ID NO: 92969 - RNA, 64 nt, Homo Sapiens
uagauaaaaauaaaaacccacaagacuccaucucaaaaaauaaacuccagccugggcaacagag

SEQ ID NO: 92970 - RNA, 64 nt, Homo Sapiens
aaaauuagccgggcguggugccaucucuacuaaaaaaaaauacacuggccaacacggugaaacc

SEQ ID NO: 92971 - RNA, 64 nt, Homo Sapiens
aacucuggugagcagauuucaacagaaaagaaaaaaaaaauagcaauuaagggguaaagcacua

SEQ ID NO: 92972 - RNA, 64 nt, Homo Sapiens
aauuaaauauuagaaugugaagguaauaaaauuuaaaaaauaaauuuuacacaucauaccuagc

SEQ ID NO: 92973 - RNA, 64 nt, Homo Sapiens
aauguuuuuaacuaaugaagucgaagcagcaugcaaaaaauaauggaaaaccagauauuuagag

SEQ ID NO: 92974 - RNA, 64 nt, Homo Sapiens
ucauuuaagaagagaugguguauaaaauagcaauaaaaaauaauuuuaggaaaauauuaagcuu

SEQ ID NO: 92975 - RNA, 64 nt, Homo Sapiens
cguuggugguccuacuaagaaauuuaguaaaagaaaaaaauaauucuugagucuauuauuguau

SEQ ID NO: 92976 - RNA, 64 nt, Homo Sapiens
uucuucaaaaaugcauuuugcauuauguauauuuaaaaaauauauucaguuuggagcuuuuagg

SEQ ID NO: 92977 - RNA, 64 nt, Homo Sapiens
cauaccuaaugaaguauuggaaaagaaaauuaugaaaaaauaugauucucuuaaaaaguaugug

SEQ ID NO: 92978 - RNA, 64 nt, Homo Sapiens
auugcuaugcaaucuugaauaggauaaccauuucaaaaaauaaaugaauuuaaggaaauucuuu

SEQ ID NO: 92979 - RNA, 64 nt, Homo Sapiens
aauaaaauaagugagcugaaucugucucaaaaaaaaaaaauaauccugggcgacagagcaagac

SEQ ID NO: 92980 - RNA, 64 nt, Homo Sapiens
uuuaaaaauacauucaaaauaugucauuauuuugaaaaaauaaagcuauguaaaauuuuuacua

SEQ ID NO: 92981 - RNA, 64 nt, Homo Sapiens
aagaguaugagucuucuguauuuuaauuuccaggaaaaaauaaauauuuaguaaagcuuuucuu

SEQ ID NO: 92982 - RNA, 64 nt, Homo Sapiens
uaaaagcuagauacuggaaauuaaugucauugcuaaaaaauaaauauaaccuggcaaaaucuug

SEQ ID NO: 92983 - RNA, 64 nt, Homo Sapiens
auuuuaauguauauuguucuaauaucauuauagaaaaaaauaaccaaauuauauaaacaguacc

SEQ ID NO: 92984 - RNA, 64 nt, Homo Sapiens
uacaaaaaaaaaaaagaagaauuucuuuuucuagaaaaaauaaaaauaaaauucuauugcaaaa

SEQ ID NO: 92985 - RNA, 64 nt, Homo Sapiens
uauauauauauaucuuagucuauagaaaagaaaaaaaaaauauaaucuuuuaucaauaauguuc

SEQ ID NO: 92986 - RNA, 64 nt, Homo Sapiens
uuugauaacauuuaaaagauuuggaacaccuaccaaaaaauaagcacgaguuaccuguuaaacu

SEQ ID NO: 92987 - RNA, 64 nt, Homo Sapiens
uacaguauagcgcugguacagugaaguucauuuaaaaaaauaacuugaaagaauacaaaaauau

SEQ ID NO: 92988 - RNA, 64 nt, Homo Sapiens
aaaccccuacaaaaaaacuuaagaaaaaaaacacaaaaaauaaaaacccaauucuaagcagaaa

SEQ ID NO: 92989 - RNA, 64 nt, Homo Sapiens
caucgcagugaacuuaaagcaaagaccucuuaguaaaaaauaaaaaaaaauaaaaaauaaaaau

SEQ ID NO: 92990 - RNA, 64 nt, Homo Sapiens
aacuuaaagcaaagaccucuuaguaaaaaauaaaaaaaaauaaaaaauaaaaauaaaaaaaguu

SEQ ID NO: 92991 - RNA, 64 nt, Homo Sapiens
agcaaagaccucuuaguaaaaaauaaaaaaaaauaaaaaauaaaaauaaaaaaaguuaaauuua

SEQ ID NO: 92992 - RNA, 64 nt, Homo Sapiens
ucucuaccaaaaaaaaaaaaaaaaaaaaaaaaaaaaaaaauauauauauauauauacacacaca

SEQ ID NO: 92993 - RNA, 64 nt, Homo Sapiens
gcuuuuccccucccaguaauaaaaaaaaaaaaaaaaaaaauauauauauauauauauauauaua

SEQ ID NO: 92994 - RNA, 64 nt, Homo Sapiens
uugauuagcaaagguuuuugacaaacaguuuaugaaaaaauaaaacuuaaauacauuacacggg

SEQ ID NO: 92995 - RNA, 64 nt, Homo Sapiens
ugugugugaugccccaguauugaguaugcuagcuaaaaaauaucaagugccugauuaaagaauu

SEQ ID NO: 92996 - RNA, 64 nt, Homo Sapiens
gagcuuuauuaagaagcauuucuuuucuucccuuaaaaaauagaugcuuauuuuuauugacaug

SEQ ID NO: 92997 - RNA, 64 nt, Homo Sapiens
uuucaaugugaggaaugaaugauaaauuaagagaaaaaaauaucaggaaggucaauauaugccu

SEQ ID NO: 92998 - RNA, 64 nt, Homo Sapiens
gauagaccuagcaaggagauaagaauagaucauuaaaaaauaaauauaaauggauuggauagaa

SEQ ID NO: 92999 - RNA, 64 nt, Homo Sapiens
ccggagucuuugaagcugaaaauauaaaacaaauaaaaaauaaaaaaauaaaaacccacaaaaa

SEQ ID NO: 93000 - RNA, 64 nt, Homo Sapiens
uuugaagcugaaaauauaaaacaaauaaaaaauaaaaaaauaaaaacccacaaaaauguugaac

SEQ ID NO: 93001 - RNA, 64 nt, Homo Sapiens
uaaguguaacauguuuucauuucuuaaaaauaaaaaaaaauauacuuucacugaagguuuuuuu

SEQ ID NO: 93002 - RNA, 64 nt, Homo Sapiens
guccuuuuaagggaacuuccugggaaaguucagaaaaaaauaaauugcagucagacauucguca

SEQ ID NO: 93003 - RNA, 64 nt, Homo Sapiens
uaauuguaaaacugaguuugggaauuggguuaggaaaaaauacaguuucuuacauccuuaucga

SEQ ID NO: 93004 - RNA, 64 nt, Homo Sapiens
auauaguaaaugcaaacaugguauaugcacauuuaaaaaauaucaguuuguaccaucuguuuga

SEQ ID NO: 93005 - RNA, 64 nt, Homo Sapiens
guuuuacacacauuugcauuguaaaugauaauuaaaaaaauaaguccagguauuuuuuauuaag

SEQ ID NO: 93006 - RNA, 64 nt, Homo Sapiens
cuuacaaaaauguuuacuaugaacacacagaaauaaaaaauaggcuaaauucauauauaucuug

SEQ ID NO: 93007 - RNA, 64 nt, Homo Sapiens
uuaauaaaaaaguucaaaaaaagaaauuuaacaaaaaaaauauaucuugcaggaaaaaaauaca

SEQ ID NO: 93008 - RNA, 64 nt, Homo Sapiens
aagaaauuuaacaaaaaaaacaagucuugcaggaaaaaaauacauacaacagugccgccaacac

SEQ ID NO: 93009 - RNA, 64 nt, Homo Sapiens
auauaugaaaauauguaaagaguuaugagaguuuaaaaaauaaaauuuuacugcuagcuugcaa

SEQ ID NO: 93010 - RNA, 64 nt, Homo Sapiens
ggacuauaaaucaguuauguuuccucauucuuuuaaaaaauaagggaauuuuucauugaguuau

SEQ ID NO: 93011 - RNA, 64 nt, Homo Sapiens
aauaaaaaauuaaaggauugcgaaaucccagggaaaaaaauaaaaggcuaggaguauauugguu

SEQ ID NO: 93012 - RNA, 64 nt, Homo Sapiens
uucuaccaaaauggaaaggaauauaauuuacauuaaaaaauaauuuggaaacaaauagaacaca

SEQ ID NO: 93013 - RNA, 64 nt, Homo Sapiens
aacaaaauaaggaauccuuuaaaaauaaaaaauaaaaaaauaaagagagccagaccuugucuca

SEQ ID NO: 93014 - RNA, 64 nt, Homo Sapiens
aaaauaaaaacaaaauaagguugucucaaaaaauaaaaaauaaagagagagagagagccagacc

SEQ ID NO: 93015 - RNA, 64 nt, Homo Sapiens
aaauaaaaaaauaaaaacaaccagaccuugucucaaaaaauaaagcagccugagagagagagag

SEQ ID NO: 93016 - RNA, 64 nt, Homo Sapiens
aaaaaauuagccggguaugaagccccaucucuacaaaaaauacacagccugggcaacaugguga

SEQ ID NO: 93017 - RNA, 64 nt, Homo Sapiens
aucacucaguguguguuucuuccuuuauauacaaaaaaaauacgauuaaauuggaauuuuuuaa

SEQ ID NO: 93018 - RNA, 64 nt, Homo Sapiens
ccaagugacuccuuucuaguuaagaaaggggaaaaaaaaauaacgccauuggcuugugcugugu

SEQ ID NO: 93019 - RNA, 64 nt, Homo Sapiens
agcuauacuauaucucucuaggguugguucaaaaaaaaaauaaacaguugccaguggaaauguu

SEQ ID NO: 93020 - RNA, 64 nt, Homo Sapiens
uaaaaaagaaacagugcucacacauuuuuuaagaaaaaaauaauaaacaccuguuaauuuuaaa

SEQ ID NO: 93021 - RNA, 64 nt, Homo Sapiens
uaaaauggauagaaaaaaacauuaauaacugaauaaaaaauaaaaaggaucuuuuguccauucc

SEQ ID NO: 93022 - RNA, 64 nt, Homo Sapiens
uauauaaaauauuuuuuucuuauaaugcuauuuuaaaaaauauaaagucccuauaguauaugau

SEQ ID NO: 93023 - RNA, 64 nt, Homo Sapiens
uaaauauuuguaauugugaggugauugaaagaaaaaaaaauacucuccuagagaggagaaaggg

SEQ ID NO: 93024 - RNA, 64 nt, Homo Sapiens
cuuucccccuaggauuauggugauuaucuguguuaaaaaauaaguccuuaaaguuacuguuuug

SEQ ID NO: 93025 - RNA, 64 nt, Homo Sapiens
uaaaaauauauauguauaagaguuauguauuugaaaaaaauauauaaaagaauauacaucacaa

SEQ ID NO: 93026 - RNA, 64 nt, Homo Sapiens
guuuaauugaaugauuuaugaugaaucuugggcaaaaaaauacaacuguaaaaaauuucacagg

SEQ ID NO: 93027 - RNA, 64 nt, Homo Sapiens
ugggcauuauuaaauuuuuguggaagcuaauaguaaaaaauaaaagcuguuuucaccaccuccc

SEQ ID NO: 93028 - RNA, 64 nt, Homo Sapiens
aaggaggaagagaguggaauggaaaaaguauucaaaaaaauaaucacuaaaggccaggugcagu

SEQ ID NO: 93029 - RNA, 64 nt, Homo Sapiens
ggccugagcaacacagggagacucaguuucuccaaaaaaauaaaaaauuagccgaucauggugg

SEQ ID NO: 93030 - RNA, 64 nt, Homo Sapiens
cuccccaaaagaaaccaugacaaaccuagcuuuuaaaaaauauuuuaagaaagagaaugaacug

SEQ ID NO: 93031 - RNA, 64 nt, Homo Sapiens
cuuuguauuauaauuguugauauuuucccuuuuuaaaaaauaccauugaaaucagcaugacaaa

SEQ ID NO: 93032 - RNA, 64 nt, Homo Sapiens
cgauaaauaucuuuaaagagacuuugguuucaugaaaaaauaaauuaguauuguugaaucaauu

SEQ ID NO: 93033 - RNA, 64 nt, Homo Sapiens
aauaauacaaauaaaaauacaucaaaaauauuagaaaaaauaaaguggauuaaaccaauugcag

SEQ ID NO: 93034 - RNA, 64 nt, Homo Sapiens
ugauuauugcuuugugacaacuguaaacgacuuuaaaaaauaaaauccauuugccuauaaauac

SEQ ID NO: 93035 - RNA, 64 nt, Homo Sapiens
caauuuucuugagccuuauugcuuuucuugcuacaaaaaauaagaccauuugccaaaaaaaaaa

SEQ ID NO: 93036 - RNA, 64 nt, Homo Sapiens
caguaguacaucauuuuagcaacucuaaaaaaaaaaaaaauacaaauaaaaaggaaaaaaaauu

SEQ ID NO: 93037 - RNA, 64 nt, Homo Sapiens
ugauaucacugcugacuuuuauauuaugggagggaaaaaauaacauuaauaaaaaggugauaaa

SEQ ID NO: 93038 - RNA, 64 nt, Homo Sapiens
caaggacuuuuacuuuuuauuacauaaaaauauuaaaaaauaaauaaaaaaaauaaaauuuuaa

SEQ ID NO: 93039 - RNA, 64 nt, Homo Sapiens
uuuuuauuacauaaaaauauuaaaaaauaaauaaaaaaaauaaaauuuuaaacuaacuuaaccu

SEQ ID NO: 93040 - RNA, 64 nt, Homo Sapiens
acaauccuggccaacggcgaaacucugucucuacaaaaaauauacaggcguguuagcaugugcc

SEQ ID NO: 93041 - RNA, 64 nt, Homo Sapiens
cagccugggcaacauggcaaaaccccauuucuacaaaaaauacaaaaauuagcugggcauggug

SEQ ID NO: 93042 - RNA, 64 nt, Homo Sapiens
cacagcacucuggugcgggaagaagcagaagcaaaaaaaauaaaaauaaaaaaauaaauaaaaa

SEQ ID NO: 93043 - RNA, 64 nt, Homo Sapiens
gcgggaagaagcagaagcaaaaaaaauaaaaauaaaaaaauaaauaaaaauaaaaaaaauaaaa

SEQ ID NO: 93044 - RNA, 64 nt, Homo Sapiens
aaaaaaauaaaaauaaaaaaauaaauaaaaauaaaaaaaauaaaaaaggaaaaaaaaaaaagaa

SEQ ID NO: 93045 - RNA, 64 nt, Homo Sapiens
ugaaagagaaugacucugugauugucauuucaauaaaaaauauucacuguucuuuuuuuauuuu

SEQ ID NO: 93046 - RNA, 64 nt, Homo Sapiens
agagcaaaggaguuugcuggaaauuugggggaauaaaaaauauuaauacugauaaauucggauc

SEQ ID NO: 93047 - RNA, 64 nt, Homo Sapiens
gauaaauucggaucaaauuuauuuuaaaaacuuuaaaaaauacucagguuaagagaaaaacgaa

SEQ ID NO: 93048 - RNA, 64 nt, Homo Sapiens
accuaggaggaugccuaacagagaguaagcacuuaaaaaauauuugucauaugaaugaaaaaau

SEQ ID NO: 93049 - RNA, 64 nt, Homo Sapiens
aguaagcacuuaaaaaauauuugucauaugaaugaaaaaauaaacgagugaauguugauagaaa

SEQ ID NO: 93050 - RNA, 64 nt, Homo Sapiens
gaauucuacaucuuauaaaaccuaacuggcauuuaaaaaauacuguggccgggcgugguggcuc

SEQ ID NO: 93051 - RNA, 64 nt, Homo Sapiens
agccuggacaacacagugagaccucaucucuaucaaaaaauaaaaauuagcuagaugugguggc

SEQ ID NO: 93052 - RNA, 64 nt, Homo Sapiens
ggcaacagagcaagacccugucuccgaaacaaauaaaaaauacuguaauaaaaguacuuauaaa

SEQ ID NO: 93053 - RNA, 64 nt, Homo Sapiens
ucugcgagaaacacccaagaaugaucaauuaaaaaaaaaauaauauaauaauaauucuuguccu

SEQ ID NO: 93054 - RNA, 64 nt, Homo Sapiens
uuuaaguaaccacucaaaacuuuucauuucacugaaaaaauaugaaaaaccaugacaauagggc

SEQ ID NO: 93055 - RNA, 64 nt, Homo Sapiens
gaaguggucuucauaugucaacuacagaaaaggaaaaaaauagaaauugaaggauuuuuaugaa

SEQ ID NO: 93056 - RNA, 64 nt, Homo Sapiens
guaauuuuacauuacauaaguuccuuuuacaauuaaaaaauagcacuucuucaucuuaugccug

SEQ ID NO: 93057 - RNA, 64 nt, Homo Sapiens
auuaaguucuuagucauugauuuuuguguuuaaaaaaaaauaggaaagagggaaacugcagcuu

SEQ ID NO: 93058 - RNA, 64 nt, Homo Sapiens
aauucuauugaaaaaggaaaaucagcaauucagcaaaaaauaaauaaaaaauaaaaauguaaau

SEQ ID NO: 93059 - RNA, 64 nt, Homo Sapiens
aaaaggaaaaucagcaauucagcaaaaaauaaauaaaaaauaaaaauguaaauaugauaguaau

SEQ ID NO: 93060 - RNA, 64 nt, Homo Sapiens
cuucuuucccuaccuuuuuuuucuuuuuuucuuaaaaaaauauuuuguguuauuaacagaaauu

SEQ ID NO: 93061 - RNA, 64 nt, Homo Sapiens
ugcuuccuugaaacauuuuugugcuauuguuuuaaaaaaauaauuaaaaaacaguuggcguuaa

SEQ ID NO: 93062 - RNA, 64 nt, Homo Sapiens
gagagacccuguaucugaaaguaauaauaaaaauaaaaaauauaaaugaggucucguugauguu

SEQ ID NO: 93063 - RNA, 64 nt, Homo Sapiens
uccagccugggcaacaaagcaagacucugucucaaaaaaauaaaaauaaaaaaaaaaucuuagu

SEQ ID NO: 93064 - RNA, 64 nt, Homo Sapiens
uugucagcuggaacucagaaacaacaacuugaaaaaaaaauaauaauuagaacauauuugcaua

SEQ ID NO: 93065 - RNA, 64 nt, Homo Sapiens
cuccagccugggcgacagagcaagacuccgucucaaaaaauaaaaaaaaaaaaaaaauagguga

SEQ ID NO: 93066 - RNA, 64 nt, Homo Sapiens
gagcaagacuccgucucaaaaaauaaaaaaaaaaaaaaaauaggugaaaauuccuuauaaaucc

SEQ ID NO: 93067 - RNA, 64 nt, Homo Sapiens
agguucuguugcugcugagcacccugucucaacaaaaaaauaacagccugggugacagaguaag

SEQ ID NO: 93068 - RNA, 64 nt, Homo Sapiens
aagagguucugcugccagauucucaaagaaaaaaaaaaaauauuggugacagagccagacucca

SEQ ID NO: 93069 - RNA, 64 nt, Homo Sapiens
aggccgggugcgguggcucacuccaucucaaaaaaaaaaauaaggcccaggugacagugugaga

SEQ ID NO: 93070 - RNA, 64 nt, Homo Sapiens
uaauaaagaauacauauauauuagaaaaacugcaaaaaaauacgcaaaucuuguuucuggcacu

SEQ ID NO: 93071 - RNA, 64 nt, Homo Sapiens
ucacaaggggagagccaguaacccaccuccccccaaaaaauagcggauaaauauuucccauccc

SEQ ID NO: 93072 - RNA, 64 nt, Homo Sapiens
aaaaaaaguuacagaaugcugaaggaaaaauugaaaaaaauaaauagugcuuaaaaaaaaaaaa

SEQ ID NO: 93073 - RNA, 64 nt, Homo Sapiens
auaaugcaccauaucccuauauuguuucuuuaaaaaaaaauacaugcaaguuaaaggguuuguc

SEQ ID NO: 93074 - RNA, 64 nt, Homo Sapiens
guuaaaaacuguauauacaauaaaagaaaaagcuaaaaaauaugacacacccagccugaaguuc

SEQ ID NO: 93075 - RNA, 64 nt, Homo Sapiens
ggcacagugaaguaacuugcccauuugacagacgaaaaaauagauaaaauaguuaauauuaucc

SEQ ID NO: 93076 - RNA, 64 nt, Homo Sapiens
uaaagcauuguuugacagguuuuuuuuuuccuagaaaaaauauuucucauauauuguguuuuuu

SEQ ID NO: 93077 - RNA, 64 nt, Homo Sapiens
ucauugauaugcaucucugcuuuguaaauuuuuaaaaaaauauuuuaaauagaaacuuuaguuu

SEQ ID NO: 93078 - RNA, 64 nt, Homo Sapiens
ugcacugacuuuauaucuuugcacagggaaagaaaaaaaauaacuggggugagagcuaaacauu

SEQ ID NO: 93079 - RNA, 64 nt, Homo Sapiens
accacuaguauucaaaucucuuucagguuuuauuaaaaaauauauaucaauaaacuaaaagguu

SEQ ID NO: 93080 - RNA, 64 nt, Homo Sapiens
uuuucaucucacaguaaagccuauuuccccaggaaaaaaauaaaugccuuugaaugaaaauucu

SEQ ID NO: 93081 - RNA, 64 nt, Homo Sapiens
acuuggcaugcgcaauaaagcagcacauguaaaaaaaaaauacacagugcaaggacuuuauuau

SEQ ID NO: 93082 - RNA, 64 nt, Homo Sapiens
uguauuuggguauuuuucuccucuaccuucuaaaaaaaaauaccauaagaagaaucagaaugua

SEQ ID NO: 93083 - RNA, 64 nt, Homo Sapiens
uuuguuucccuuuaguauuuaauggucuuuggagaaaaaauaauaaaacagaguguuauauaua

SEQ ID NO: 93084 - RNA, 64 nt, Homo Sapiens
gucugugugaaacacacaugaauaaacucuguuuaaaaaauaaguuuuauaauguauuaaauac

SEQ ID NO: 93085 - RNA, 64 nt, Homo Sapiens
uaaauauauauauauaugucuauccucaagguguaaaaaauauagggaacaauuggaauaguga

SEQ ID NO: 93086 - RNA, 64 nt, Homo Sapiens
ugcaucucagcguuuuuuugcgaaagcugcuuuaaaaaaauacauaaugcugugguugauauuu

SEQ ID NO: 93087 - RNA, 64 nt, Homo Sapiens
acacauauaaacaucacacagcaggcuguuuaagaaaaaauaacauguaccaugaaacaaagcu

SEQ ID NO: 93088 - RNA, 64 nt, Homo Sapiens
uuucuacuuuggacuaaucuguccaagagugggcaaaaaauaauuuuuuucugaaugugucuga

SEQ ID NO: 93089 - RNA, 64 nt, Homo Sapiens
uaauucauggucuggacacuuguaaugcauggucaaaaaauauggaacauuuauuaaaaaauaa

SEQ ID NO: 93090 - RNA, 64 nt, Homo Sapiens
guaaugcauggucaaaaaauauugaacauuuauuaaaaaauaauuuuccacuauaaagaauuuu

SEQ ID NO: 93091 - RNA, 64 nt, Homo Sapiens
ccagccugggcgacagagcaagacucugucucaaaaaaaauaaaaaauaaucagggcacagugg

SEQ ID NO: 93092 - RNA, 64 nt, Homo Sapiens
gggcgacagagcaagacucugucucaaaaaaaauaaaaaauaaucagggcacaguggcucaugc

SEQ ID NO: 93093 - RNA, 64 nt, Homo Sapiens
aagggggccgcugcgagaaguucacccacccccgaaaaaauaauuaaacucgcaggccaggcac

SEQ ID NO: 93094 - RNA, 64 nt, Homo Sapiens
agccuggguaacagagggagacuccuccgucucaaaaaaauaaauaaauaaacuugugagcugg

SEQ ID NO: 93095 - RNA, 64 nt, Homo Sapiens
accacaggcugcaccauaagacccacucacaauaaaaaaauaaaaggccgagccgggcaugguu

SEQ ID NO: 93096 - RNA, 64 nt, Homo Sapiens
gccgagccgggcaugguugcucacucccguaauaaaaaaauaaaagaacaggcugagccgggca

SEQ ID NO: 93097 - RNA, 64 nt, Homo Sapiens
ggccaacauggugaaaccccgccucuacuaaaaaaaaaaauacaaaaaauuaggcgugguggug

SEQ ID NO: 93098 - RNA, 64 nt, Homo Sapiens
ggcgacagagcaagacucugucucaagaagaaaaaaaaaauacauauacacauaaauauauaua

SEQ ID NO: 93099 - RNA, 64 nt, Homo Sapiens
gacagagucucaccauguuuuacuuuaaaaaauaaaaaaauagaucagguaucacuucuaguuu

SEQ ID NO: 93100 - RNA, 64 nt, Homo Sapiens
aaaauagagacagagucucaucuaguuuuacuuuaaaaaauaaacguagagcucagguaucacu

SEQ ID NO: 93101 - RNA, 64 nt, Homo Sapiens
aaaucuaagggcucaggaacugugucaaaaaaauaaaaaauaaaugggugacagaaugagacuc

SEQ ID NO: 93102 - RNA, 64 nt, Homo Sapiens
aaauaaaaaaucuaagggcugagacucugugucaaaaaaauaaauucagccugggugacagaau

SEQ ID NO: 93103 - RNA, 64 nt, Homo Sapiens
ccaggugcucuggcucaugcuuaauuuaaaaaaaaaaaaauagacaccaugaccaacguguuuc

SEQ ID NO: 93104 - RNA, 64 nt, Homo Sapiens
uaaauuagcugggcauugugaccaccuucucuacaaaaaauacaagccugggcagaauggugaa

SEQ ID NO: 93105 - RNA, 64 nt, Homo Sapiens
acuacaaaaauacaauuacucaccaaaaagcuuuaaaaaauaaagcugugucuuuagggagacc

SEQ ID NO: 93106 - RNA, 64 nt, Homo Sapiens
auauccucuacgguuauuuccugcuuucuaauuaaaaaaauaauaaccauggcaagagagaaag

SEQ ID NO: 93107 - RNA, 64 nt, Homo Sapiens
gccaacauggugaauuaucucuacuaaaaauacaaaaaaauaauaauaauagccaggcguggug

SEQ ID NO: 93108 - RNA, 64 nt, Homo Sapiens
ucaugugcccccaauuuuucacuauuguuauuugaaaaaauauuuuuauuuguaagaguuuuuc

SEQ ID NO: 93109 - RNA, 64 nt, Homo Sapiens
uuucuugacuuuaaaaaaauuauuaaaaacaaaaaaaaaauaaauuuuuuugcaauccuuuccu

SEQ ID NO: 93110 - RNA, 64 nt, Homo Sapiens
gaaugauauaaaggagauacauguuucuuccuuuaaaaaauaaacggaaguuacauuguuaaug

SEQ ID NO: 93111 - RNA, 64 nt, Homo Sapiens
uucaguuucaaucaaguuuacauuauguugcuuaaaaaaauagaaauuauucuuuaucuugcaa

SEQ ID NO: 93112 - RNA, 64 nt, Homo Sapiens
cagagcuauccugaaacugaacagcugaaacuuuaaaaaauaauugguauuauuuugugccccc

SEQ ID NO: 93113 - RNA, 64 nt, Homo Sapiens
ucagauccauaauccauacucagugaaagcagggaaaaaauauuuucacuuauuuuauuugcuu

SEQ ID NO: 93114 - RNA, 64 nt, Homo Sapiens
aacagacucagcuuugggacaagaaaaaaauagaaaaaaauaugggagaagagaaggcauuagu

SEQ ID NO: 93115 - RNA, 64 nt, Homo Sapiens
aaaaaauaugaacagacucaaggcauuaguaagaaaaaaauagaacaggggcagggagaagaga

SEQ ID NO: 93116 - RNA, 64 nt, Homo Sapiens
aauaaaaaaacauuuuuuucaaaaauaaaaauaaaaaaaauaaaaaacugugcaauccccucaa

SEQ ID NO: 93117 - RNA, 64 nt, Homo Sapiens
aauaaaaaaaauaaaaauaagugcaauccccucaaaaaaauaaaugaguguuuggaaauaaacu

SEQ ID NO: 93118 - RNA, 64 nt, Homo Sapiens
ccaaccauaauccccagugcauaaauacauaaauaaaaaauaaacgagacuccgucucaaaaaa

SEQ ID NO: 93119 - RNA, 64 nt, Homo Sapiens
uacauaaauaaaaaauaaacgagacuccgucucaaaaaaauaaauccaggcugggcgacagagc

SEQ ID NO: 93120 - RNA, 64 nt, Homo Sapiens
aaaaauuagccgggcguugugucucuacuaaaaaaaaaaauacaggcuaacauggugaaacccc

SEQ ID NO: 93121 - RNA, 64 nt, Homo Sapiens
aaacuuaccuacacugaucuuaguucucuuaugaaaaaaauaagauguuaucccaucaaauaaa

SEQ ID NO: 93122 - RNA, 64 nt, Homo Sapiens
uguugccuagcauuuuauagauauuuauuauuuaaaaaaauaaagauauguuuuuaaugaagag

SEQ ID NO: 93123 - RNA, 64 nt, Homo Sapiens
cuauagaaauccaauuaagacucacuuggguaaaaaaaaauaaaaaaauaaacaaaauaaacug

SEQ ID NO: 93124 - RNA, 64 nt, Homo Sapiens
auccaauuaagacucacuuggguaaaaaaaaauaaaaaaauaaacaaaauaaacugcucacuua

SEQ ID NO: 93125 - RNA, 64 nt, Homo Sapiens
gguuuacuuucuaucagcugagcaaccucucaagaaaaaauaaauaaauaaauaaaccucucuu

SEQ ID NO: 93126 - RNA, 64 nt, Homo Sapiens
uccagccugagugacagagugagacuuugcaaccaaaaaauaaaauaauaauaauaaugaaaua

SEQ ID NO: 93127 - RNA, 64 nt, Homo Sapiens
uugaggcaugacaacgcgugauguaguugcaaauaaaaaauaguuaagagaauugugugaaauc

SEQ ID NO: 93128 - RNA, 64 nt, Homo Sapiens
ugcacuuuagauauugauaugaauaaucuuucuuaaaaaauauaauuuuuauagaaguuauuga

SEQ ID NO: 93129 - RNA, 64 nt, Homo Sapiens
cgaggcauaaauguaguuguuucccaacaacauuaaaaaauacuuuuuauuuuuugugguuaua

SEQ ID NO: 93130 - RNA, 64 nt, Homo Sapiens
aaucccagugccauuugucuuaaauaggugagaaaaaaaauaaugggcagaaagcaaaccuagu

SEQ ID NO: 93131 - RNA, 64 nt, Homo Sapiens
uuuucauuuauggcuuuuugaaacuuuaaguuuuaaaaaauaggguucuuuaacacugacuacu

SEQ ID NO: 93132 - RNA, 64 nt, Homo Sapiens
cuuccacucauguaacuauuauuuugguggucaaaaaaaauauggcauuaggcugaaagaguuu

SEQ ID NO: 93133 - RNA, 64 nt, Homo Sapiens
uuugaucuaaacauagguucuaaucaguaaaaaaaaaaaauauuuuuuuuaaaaauaauauugu

SEQ ID NO: 93134 - RNA, 64 nt, Homo Sapiens
cucucucuuuucauucuauuuuaaguuuagaccaaaaaaauacagagucauccccuacccccac

SEQ ID NO: 93135 - RNA, 64 nt, Homo Sapiens
guaggaaagagaggauaaacaaagaaaaaagaaaaaaaaauaagcucauacccaaauucacaaa

SEQ ID NO: 93136 - RNA, 64 nt, Homo Sapiens
cagccuggacaacauggugaaaccccaucucuacaaaaaauacaaaaauuagccaugcauggug

SEQ ID NO: 93137 - RNA, 64 nt, Homo Sapiens
caacauagcaaaauccugucucaaaaaaaaaguuaaaaaauauugcccggcuccuagaauuuau

SEQ ID NO: 93138 - RNA, 64 nt, Homo Sapiens
ggacucucacaaagcugaugagcuguacuucagaaaaaaauaauaauuuccauguuuuguauau

SEQ ID NO: 93139 - RNA, 64 nt, Homo Sapiens
ucugucuuuucccccuucagaauuuuccuuggaaaaaaaauacuagccuagcuggucauuucuu

SEQ ID NO: 93140 - RNA, 64 nt, Homo Sapiens
uugccauguuccaaaauaauaagagagucaacuuaaaaaauaaaugaaagcccucuuuuuggug

SEQ ID NO: 93141 - RNA, 64 nt, Homo Sapiens
guauuucaugaucuaagacugucacuaucuggugaaaaaauaugcuauuagugauaacaaaugg

SEQ ID NO: 93142 - RNA, 64 nt, Homo Sapiens
auacuuguugaaaagccuuuucauagcaacuuguaaaaaauaaauauauauauaaauuuuaauu

SEQ ID NO: 93143 - RNA, 64 nt, Homo Sapiens
ucuguuugucauauuuaagucugcaguugaagaaaaaaaauaagaauuugagggaggcagaagu

SEQ ID NO: 93144 - RNA, 64 nt, Homo Sapiens
uaaauaaaauaaauucuuagugaaacuccaucucaaaaaauaaacacuccagccugggcaacag

SEQ ID NO: 93145 - RNA, 64 nt, Homo Sapiens
auuuucaccauccagacgucccuuaaaugucaaaaaaaaauaauaaaaaacaaaaacaaaaaaa

SEQ ID NO: 93146 - RNA, 64 nt, Homo Sapiens
auuuagaucucugaaaauugucagaaauauuuuuaaaaaauacaagugauccacugaucucuaa

SEQ ID NO: 93147 - RNA, 64 nt, Homo Sapiens
aaaacuacagacaaaaacaauuuucuuuuucuuaaaaaaauaauaaggcuuuuaaaaguuggug

SEQ ID NO: 93148 - RNA, 64 nt, Homo Sapiens
gggaccaaaaaaugcacuugaagauaauauauucaaaaaauauuuaauguaauuccucuggaua

SEQ ID NO: 93149 - RNA, 64 nt, Homo Sapiens
caggguacuccuggacagugaacacauaaguuucaaaaaauaucuauuuuucaaaugaagaagc

SEQ ID NO: 93150 - RNA, 64 nt, Homo Sapiens
auaagaucaucuaccuauaagacagagaaagggaaaaaaauauaaauguaaucacccuauuugu

SEQ ID NO: 93151 - RNA, 64 nt, Homo Sapiens
uugaacgcuuauguggaaaggaauauucuugccaaaaaaauaccgugcuacuaaugucuuggua

SEQ ID NO: 93152 - RNA, 64 nt, Homo Sapiens
auuccauuuccauccacaguguacuuuaagauugucuuaagaaauguaucugcaugaacuccgu

SEQ ID NO: 93153 - RNA, 64 nt, Homo Sapiens
gguaaaugaauuguuugcauuuaaaaaaaaaaacucuuaagaaaacuguacuaaaucugaauca

SEQ ID NO: 93154 - RNA, 64 nt, Homo Sapiens
ugguuacgguaacuaaaaaauaguuuuuaauuaaucuuaagaucggaccuaaaagcacuuuaug

SEQ ID NO: 93155 - RNA, 64 nt, Homo Sapiens
gcuuguaaauguauuuguaauggauauccucaauucuuaagacaucaguaauuaguuaugaaua

SEQ ID NO: 93156 - RNA, 64 nt, Homo Sapiens
agguuaaagacugaacgguuagugaagacaaaugucuuaagaggcugcgaugucuagguugggc

SEQ ID NO: 93157 - RNA, 64 nt, Homo Sapiens
auucuaguuacugaugcaacuaaaauucuguauuucuuaagauggagccacugacgagauguca

SEQ ID NO: 93158 - RNA, 64 nt, Homo Sapiens
auuuauauuauuuuguuaaguccuuuuucuuucuucuuaagaguacuuuccccucuauuugcuc

SEQ ID NO: 93159 - RNA, 64 nt, Homo Sapiens
guuaagcacccucucuuaacaaaucaaugugucuucuuaagaaaagagccucuaaacuuuugag

SEQ ID NO: 93160 - RNA, 64 nt, Homo Sapiens
aaaugauuuuauaaacaauggacaauauauacuuucuuaagaucuaagguacuuucuuaagauc

SEQ ID NO: 93161 - RNA, 64 nt, Homo Sapiens
gacaauauauacuuucuuaagaucuaagguacuuucuuaagaucuaagaauuugcugaaagcau

SEQ ID NO: 93162 - RNA, 64 nt, Homo Sapiens
ucucauaacuuuccaagcuccaccacuuccuaaaucuuaagaacuuuaauugacaguuucaauu

SEQ ID NO: 93163 - RNA, 64 nt, Homo Sapiens
aagcccagccaucaugacaaauccuugaauguucucuuaagaaaaugaugcuggucaucccagc

SEQ ID NO: 93164 - RNA, 64 nt, Homo Sapiens
uauagaggauuuuggagaagaaggaauauuuucuucuuaagauaauuuaaauugucauuuuuua

SEQ ID NO: 93165 - RNA, 64 nt, Homo Sapiens
uacaaggacuucagauccauuugacaagucaagcucuuaagaaagaaagaagauaaacugugau

SEQ ID NO: 93166 - RNA, 64 nt, Homo Sapiens
uuuggcaugagcuaauaauugagggugcuaauuuucuuaagauagugccuaaaacacuaaauuu

SEQ ID NO: 93167 - RNA, 64 nt, Homo Sapiens
gaugcuugcugccugccauuuucaaccuauucucucuuaagagugcuagguaccaaauugugaa

SEQ ID NO: 93168 - RNA, 64 nt, Homo Sapiens
aauaauuuagcauauuuccuuucacacuuaaaguucuuaagaugagacuguguaaaugagagaa

SEQ ID NO: 93169 - RNA, 64 nt, Homo Sapiens
auaaaauguugggagggaauauucccaauaaaggucuuaagagaaaagucacauuacaaguaau

SEQ ID NO: 93170 - RNA, 64 nt, Homo Sapiens
gcccuaaauguacucuugaaaaaguauucauauuucuuaagauacuaauguaauaauggaagcc

SEQ ID NO: 93171 - RNA, 64 nt, Homo Sapiens
uaagugcauaaagaauaguauuagucaagauuucucuuaagauuguaaagauaaauauucuagg

SEQ ID NO: 93172 - RNA, 64 nt, Homo Sapiens
agggcagaccccgccaaugauuucucuucaccugucuuaagauuaaauaaaaaagaguguccug

SEQ ID NO: 93173 - RNA, 64 nt, Homo Sapiens
ugaaacuuacacuacuucuccaagccuuuugcugucuuaagaauaagaccugagauuaacacua

SEQ ID NO: 93174 - RNA, 64 nt, Homo Sapiens
augaugcuggucaucgcagcauccuugaauguucucuuaagaaaaagcccagccaucaugacaa

SEQ ID NO: 93175 - RNA, 64 nt, Homo Sapiens
uuuaauugacaguuucaauucaccacuuccuaaaucuuaagaacucucauaacuuuccaagcuc

SEQ ID NO: 93176 - RNA, 64 nt, Homo Sapiens
uguuaaaauggcuuacacuugcagacuuugcaaaucuuaagacuaacaaauccuugaaaucaca

SEQ ID NO: 93177 - RNA, 64 nt, Homo Sapiens
gaaacuaaaacaugccaagguuuugauauacuugucuuaagauauuaaugaaacacuucugaac

SEQ ID NO: 93178 - RNA, 64 nt, Homo Sapiens
uuugaacuuauuuaagugugaaguagaauaggugaccucuuaguucacagguaauggaaaacau

SEQ ID NO: 93179 - RNA, 64 nt, Homo Sapiens
ugagaggugucuuuuaaaaaagcuagcauacacuaccucuuaccaguuggcagccuguaguccu

SEQ ID NO: 93180 - RNA, 64 nt, Homo Sapiens
aagaggaguuagaaaagagguccuugucauucucaccucuuauggaaaauggaauaagaaauaa

SEQ ID NO: 93181 - RNA, 64 nt, Homo Sapiens
agagauugggguauguccccuguaguacacucuuaccucuuacuuccuagacuuugauuucucc

SEQ ID NO: 93182 - RNA, 64 nt, Homo Sapiens
gggagcagagacugcuuuaaucccugcugacaucacggaaaagcaacagagccuuuucaacuuu

SEQ ID NO: 93183 - RNA, 64 nt, Homo Sapiens
uuuacagggcaguguuucagauggcccugagcccacggaaaaggccagguagaccuccaaacua

SEQ ID NO: 93184 - RNA, 64 nt, Homo Sapiens
caaaaugguggcaguucuuaugaugaagauagcaacggaaaacuauguuuacaggcuuccuguu

SEQ ID NO: 93185 - RNA, 64 nt, Homo Sapiens
uuaacugaaucuaaaagaaagaacaugaauaccaacggaaaaccgagaauucuggaguuguuau

SEQ ID NO: 93186 - RNA, 64 nt, Homo Sapiens
aaaggaagagcagaacaccugaaaaucagcaauuuccugacaacgaaagugaagaguaucacag

SEQ ID NO: 93187 - RNA, 64 nt, Homo Sapiens
caaggaagagcagaacaccugaaagccagcaauuuccugacacugagaaugaagaguaucacag

SEQ ID NO: 93188 - RNA, 64 nt, Homo Sapiens
uugggagucugaggcggguggcuaacgccuguaauccugacacuggagcaggccagguacggug

SEQ ID NO: 93189 - RNA, 64 nt, Homo Sapiens
ucuaggcaaccugggggaugucauaaggccaugcuccugacaggaggauuucauguuuguaucu

SEQ ID NO: 93190 - RNA, 64 nt, Homo Sapiens
auuuucaauccaggagccuugagucuguguuguguccugacaccuccaaguucuagggccguca

SEQ ID NO: 93191 - RNA, 64 nt, Homo Sapiens
aagcgagcagaggcuccacaggcuuacgcugcucuccugacagccacacgcgacccucggugca

SEQ ID NO: 93192 - RNA, 64 nt, Homo Sapiens
cucaccgaagagaggaaccaccacacccagcagcuccugacagacccccaccccuaaagaugug

SEQ ID NO: 93193 - RNA, 64 nt, Homo Sapiens
caccaaguucguaguugguaggugcccagccaaguccugacaucuucaugcccccucugcagag

SEQ ID NO: 93194 - RNA, 64 nt, Homo Sapiens
cggguucuggcccccaaggucagagcaagcaucuuccugacagcauuuugucaucuaaagucca

SEQ ID NO: 93195 - RNA, 64 nt, Homo Sapiens
aaccagauucuagaaacugcggucauccaguucuuccugacaccggaugggugcuugggaaccg

SEQ ID NO: 93196 - RNA, 64 nt, Homo Sapiens
aaacagcaggcuacaaaaccaagaaagaaugauguccugacaugggcaaaacccugucucaaaa

SEQ ID NO: 93197 - RNA, 64 nt, Homo Sapiens
ggccaggcaugguggcucacgauauagaaagauauccugacauuaaggagagaggcuugcuugg

SEQ ID NO: 93198 - RNA, 64 nt, Homo Sapiens
agggucugcccucuugaguggacaccagccaaaauccugacagccugcacccaggaggccuccu

SEQ ID NO: 93199 - RNA, 64 nt, Homo Sapiens
agccaaaauccugacagcaggcacccaggaggccuccugacacccuagccccagagggaucccu

SEQ ID NO: 93200 - RNA, 64 nt, Homo Sapiens
ccuuauaugcacaggcucaaguuguuuuaaaaaucucauuuauuauaauauugaugcucaauua

SEQ ID NO: 93201 - RNA, 64 nt, Homo Sapiens
aagaauucuuucauugcuauauaauauucaguggcucauuuauaccuaauaaaauaaugguauu

SEQ ID NO: 93202 - RNA, 64 nt, Homo Sapiens
agaaaagagauguccugaaaaugaaagguugcaccucauuuaaugaagcuuaacccuauguaga

SEQ ID NO: 93203 - RNA, 64 nt, Homo Sapiens
uagcacuccuugauuaagaagcuaaaauguuucucucauuuacuccuuaaacaaaagacuuaaa

SEQ ID NO: 93204 - RNA, 64 nt, Homo Sapiens
guuagagacagguuucccuguaggaagaugauggcucauuuacacucagcugcucugcaagcag

SEQ ID NO: 93205 - RNA, 64 nt, Homo Sapiens
gaggccuggggaugugaacaaccugcucacaguccucauuuacuggauuugacuucagccaggu

SEQ ID NO: 93206 - RNA, 64 nt, Homo Sapiens
ucaauuuguaaguagcgcaggugccguuucagcccucauuuaauacuacaguacaugcugaagc

SEQ ID NO: 93207 - RNA, 64 nt, Homo Sapiens
ggaaaaauauauaucuaucugccacucauuucaucucauuuaaggccucccuccaccccaggac

SEQ ID NO: 93208 - RNA, 64 nt, Homo Sapiens
gugucacugugcugggccuauuuuauuuauagaacucauuuaagcuguuuuuauuuuaauaugc

SEQ ID NO: 93209 - RNA, 64 nt, Homo Sapiens
augcaccaguauuaaaacacaucgacguaaguagcucauuuagcuuuuucugcuguucuuggcc

SEQ ID NO: 93210 - RNA, 64 nt, Homo Sapiens
uauuuuauaguauaaaguaucaugacuuauaccucucauuuaaaugcaaagacaggaucauaca

SEQ ID NO: 93211 - RNA, 64 nt, Homo Sapiens
aaguaauucagaagaacaguaccagaacaaaucacucauuuaaaaauaauuuuaauaaaaguga

SEQ ID NO: 93212 - RNA, 64 nt, Homo Sapiens
cagggagacccguccauuuggcagggguggcugccucauuuagagaggaaaaguaaccaucacu

SEQ ID NO: 93213 - RNA, 64 nt, Homo Sapiens
auugcaaugaauccccaauaauugcagaacuaaacucauuuauaaagcuaaaauaaccggauau

SEQ ID NO: 93214 - RNA, 64 nt, Homo Sapiens
cgaugggagccuuuaucugucauuagaaaucuuucucauuuaagaacuuaugaauaugcugaag

SEQ ID NO: 93215 - RNA, 64 nt, Homo Sapiens
agugucuuacuuguacuguaucacauuccauacccucauuuaauucuuaauaaaacuguucacu

SEQ ID NO: 93216 - RNA, 64 nt, Homo Sapiens
aagcaaaaagagaugcuggaauuucauccuugaccucauuuacauacaaaggaagaacaucugg

SEQ ID NO: 93217 - RNA, 64 nt, Homo Sapiens
uuaaauaaguuguauaaguuagaaauguaacauacucauuuaaagagaugaaauuaaacagauu

SEQ ID NO: 93218 - RNA, 64 nt, Homo Sapiens
ggguccaccaaaggaaacccaagugguugggaaacucauuuacucaagaagcccuuuuggagca

SEQ ID NO: 93219 - RNA, 64 nt, Homo Sapiens
ucucccuugccaugcccauuguuuuuauuuaagccucauuuauugacauaugucuauguccucu

SEQ ID NO: 93220 - RNA, 64 nt, Homo Sapiens
caacauauuaaaugcauauuuagaauuaaauguacucauuuagaucucuacuccuuacagucuc

SEQ ID NO: 93221 - RNA, 64 nt, Homo Sapiens
gauucguuuauggguaguacguuggaaacuaagucucauuuacuuugucuagucgggaaguaag

SEQ ID NO: 93222 - RNA, 64 nt, Homo Sapiens
aaucaucauguuuggaccuaaauuaaccaaagcacucauuuaaacaaaaaccaagucaaagccu

SEQ ID NO: 93223 - RNA, 64 nt, Homo Sapiens
ugucuuauauauuuacagccauaaaccaugugaccucauuuauuucucuaagaauuugaaaugu

SEQ ID NO: 93224 - RNA, 64 nt, Homo Sapiens
aguagguuaagugaucauggcuuaaaaccaaacacucauuuaaaguuugcacuuuaauaccaaa

SEQ ID NO: 93225 - RNA, 64 nt, Homo Sapiens
gcauugaauugcggcaguaaucacauguguuaaucucauuuacacauucaguuccauuagguuu

SEQ ID NO: 93226 - RNA, 61 nt, Homo Sapiens
acagacauuaaacaauuguuguguucuuuuuaccuuuuauuuuucuauuaccuugcuacca

SEQ ID NO: 93227 - RNA, 61 nt, Homo Sapiens
guuuucugaauuaauaaugacuuagauugugaccuuuuagauucgguguugagcucugugu

SEQ ID NO: 93228 - RNA, 61 nt, Homo Sapiens
aaguuggcaugaaauuuuggccccaauuuuuaccuuuuaguucugccauuuugggugccca

SEQ ID NO: 93229 - RNA, 61 nt, Homo Sapiens
acagauuaacaaucaacugccuuugcgugaaaccuuuuauauuauaguccuuauuuuuuuc

SEQ ID NO: 93230 - RNA, 61 nt, Homo Sapiens
aaugcauuuuugcaaaacaaugacuuuggaaaccuuuuaaagagcacuaugauuaucaagg

SEQ ID NO: 93231 - RNA, 61 nt, Homo Sapiens
aguaagugucaagugagugagaugcauaacaaccuuuuagcaaccucaaccagguauaaaa

SEQ ID NO: 93232 - RNA, 61 nt, Homo Sapiens
gauacugaaagugccuccuuuaggauuaaauaccuuuuacauucucuagguaaguauguuu

SEQ ID NO: 93233 - RNA, 61 nt, Homo Sapiens
caaaaaauucuuuaaaauauauauuuuuuucaccuuuuaaaagugaaucaguuucuuguuu

SEQ ID NO: 93234 - RNA, 61 nt, Homo Sapiens
uugcugugaaauugaagugcauguagaaaaaaccuuuuacuauaugaaacuuuacaacacu

SEQ ID NO: 93235 - RNA, 61 nt, Homo Sapiens
ugacuaguaauauaggcuuucaagaguugguaccuuuuagcuauauuugcagauucucugg

SEQ ID NO: 93236 - RNA, 61 nt, Homo Sapiens
uuuuggucauauuuuuacuuuagugucacucaccuuuuacaaagugacuuuguacucauuu

SEQ ID NO: 93237 - RNA, 61 nt, Homo Sapiens
gaaugauacaggccauaauugaaaugggaauaccuuuuaaguuucauuagggguggggugg

SEQ ID NO: 93238 - RNA, 61 nt, Homo Sapiens
ggagaaaaaucaaaaccccaucuaaauaaguaccuuuuauugucacuaaaaaauuuuacug

SEQ ID NO: 93239 - RNA, 61 nt, Homo Sapiens
caagaaaacguuaaauaacuccaaugggcccaccuuuuaaacugauuuauuuucuuaagug

SEQ ID NO: 93240 - RNA, 61 nt, Homo Sapiens
aggaaagcucuuauaaagucuuauaacagcaaccuuuuaaaaguaauagagucauacuuuu

SEQ ID NO: 93241 - RNA, 61 nt, Homo Sapiens
uguugaugacucacucauaaugaugugugcaaccuuuuaugaccuucacauguccuauuac

SEQ ID NO: 93242 - RNA, 61 nt, Homo Sapiens
aagaguuuguaaauucuagcagcuuaaauacaccuuuuauuuguugucccauaauugagaa

SEQ ID NO: 93243 - RNA, 61 nt, Homo Sapiens
uuaaaauuacuuugaaagauuaaauguuuaaaccuuuuacgugaaaaauauauuggcaaaa

SEQ ID NO: 93244 - RNA, 61 nt, Homo Sapiens
aaaguuucaguguauuuaucuauauacccugaccuuuuaaucaaacaugccuuuuguuuuc

SEQ ID NO: 93245 - RNA, 61 nt, Homo Sapiens
gacauuaaauguaaacuuaagcuuuuaaaagaccuuuuaaaaauuuauaauagaacuuaua

SEQ ID NO: 93246 - RNA, 61 nt, Homo Sapiens
aaucaacaaaauaugcuuucuggagaacuguaccuuuuaugguuugcuugcacaucaguag

SEQ ID NO: 93247 - RNA, 61 nt, Homo Sapiens
gugucaauugaaaguugucaauuaaaagguaaccuuuuaaucucguaggaggaaucucauu

SEQ ID NO: 93248 - RNA, 61 nt, Homo Sapiens
auuuuuuucuggauucaaacaggcaacaaugaccuuuuauuuucuguuuguccccaccucc

SEQ ID NO: 93249 - RNA, 61 nt, Homo Sapiens
guauuuggagagagugacuauugaacuugaaaccuuuuauuccgggcgucuugguaguuuc

SEQ ID NO: 93250 - RNA, 61 nt, Homo Sapiens
gaggcuaaguuaucuuugauaacuuucagcuaccuuuuaaagaaaacaaaaaaagguagug

SEQ ID NO: 93251 - RNA, 61 nt, Homo Sapiens
caaugugagauguaugaaaauguccaauuuuaccuuuuacaugaugcuugacagugugaaa

SEQ ID NO: 93252 - RNA, 61 nt, Homo Sapiens
uaguaauugacaugugccagcauugcguuugaccuuuuauguccugaggcuuuggauuuga

SEQ ID NO: 93253 - RNA, 61 nt, Homo Sapiens
gacacagaaaauguugagaaacuaauuccacaccuuuuauuaacaggucuucaucgaaucu

SEQ ID NO: 93254 - RNA, 64 nt, Homo Sapiens
guaaaaaucagaaaauacaagauuuacauaaaggucauuucaacuuuuaagguuaccagugauu

SEQ ID NO: 93255 - RNA, 64 nt, Homo Sapiens
gauaguguaugagacuuaagccaugaguuuuguaucauuucaauuagaagacuacuagcuguga

SEQ ID NO: 93256 - RNA, 64 nt, Homo Sapiens
cuugcauugcuucacuugauuaaaauuguugauaucauuucaucauaaagguaaguuaccuuaa

SEQ ID NO: 93257 - RNA, 64 nt, Homo Sapiens
agcaugaaugugguucuguacacuuaugcaucagucauuucaacucccugguuuugcuuaauuc

SEQ ID NO: 93258 - RNA, 64 nt, Homo Sapiens
gcugcugucugugacuccacaguguuuaaggccaucauuucacucaguugcuaaccugaguugc

SEQ ID NO: 93259 - RNA, 64 nt, Homo Sapiens
aguuaagcacaugaguagagcuauuucuacagaaucauuucaccagaugcagaaucagaaggau

SEQ ID NO: 93260 - RNA, 64 nt, Homo Sapiens
uagggcacaugugggcuuucucuugaucuuugugucauuucagaauucaaagacugugcuacgg

SEQ ID NO: 93261 - RNA, 64 nt, Homo Sapiens
uaaaacaguagagcuagcaaugacaccuugcauuucauuucaacacugcuucaagguuucuuuu

SEQ ID NO: 93262 - RNA, 64 nt, Homo Sapiens
gcuuaauagugcauuuauuuaagguuccuccaugucauuucaugucacuuaauaauaugcaauu

SEQ ID NO: 93263 - RNA, 64 nt, Homo Sapiens
aguaguacuuuguauguguugauacauuuauaaaucauuucagccucaucugggacauucuuaa

SEQ ID NO: 93264 - RNA, 64 nt, Homo Sapiens
gacucuggccuccucuccugaguauauaguuuagucauuucacacuuucuugguuuucuaaugg

SEQ ID NO: 93265 - RNA, 64 nt, Homo Sapiens
ucauuuaagggaaaaauauaccccaggacgccacucauuucaucccagccagcgccucccucca

SEQ ID NO: 93266 - RNA, 64 nt, Homo Sapiens
caugagaucuaggugaggauugauuaccuaguagucauuucauggguuguugggaggauucuau

SEQ ID NO: 93267 - RNA, 64 nt, Homo Sapiens
ugaaaugaauauaccccuuaguguuuggguauauucauuucaaagggagagagagagguuuuuu

SEQ ID NO: 93268 - RNA, 64 nt, Homo Sapiens
guagggagggauuuuccuucauccuugugacauuucauuucaguaaggaaaagauaacaaagug

SEQ ID NO: 93269 - RNA, 64 nt, Homo Sapiens
uuaucagcauuuuuuuuuccuggcauaaaauuaaucauuucauuuuauaauuuugugauaaaua

SEQ ID NO: 93270 - RNA, 64 nt, Homo Sapiens
gcauagucaaaggcaucauccagacuuagagguuucauuucagguguuuuuguggguauuuugu

SEQ ID NO: 93271 - RNA, 64 nt, Homo Sapiens
augcucuuucaaccagaaguacacccuggccaguucauuucagcgaaaaagguuguuacauaaa

SEQ ID NO: 93272 - RNA, 64 nt, Homo Sapiens
accuuucaaagaacuccugaagcaacuuaacucaucauuucagccucugaguagagguaaaacc

SEQ ID NO: 93273 - RNA, 64 nt, Homo Sapiens
uggccagagauuuagauauguccaauuuccuggcucauuucauugugcucuauggguacguaua

SEQ ID NO: 93274 - RNA, 64 nt, Homo Sapiens
auauucuauauuuuuuuaacuuaugagaauguguucauuucauuuguaacauauaaugggaaac

SEQ ID NO: 93275 - RNA, 64 nt, Homo Sapiens
aauacugagauagacauguuuaguugaaguuauuucauuucagguuauauuaucuugggucaga

SEQ ID NO: 93276 - RNA, 64 nt, Homo Sapiens
ucuucaaauuauuuucagccuccuugucauauaaucauuucaggcaaacugaggcaacacuaac

SEQ ID NO: 93277 - RNA, 64 nt, Homo Sapiens
gaucaggacaaaaguguuagguucccaugauuucucauuucauuuauuaauaguuaaugcugaa

SEQ ID NO: 93278 - RNA, 64 nt, Homo Sapiens
cacgagguuguauaucaugaguuaggguuaacauucauuucaacgaaaagaaacagguaguuaa

SEQ ID NO: 93279 - RNA, 64 nt, Homo Sapiens
agugcaugucuuucuaauaagugucacuagauguucauuucacaucuccuaauaacguuuugcu

SEQ ID NO: 93280 - RNA, 64 nt, Homo Sapiens
auguuauuauuggaaauuaucaacauucagaaauucauuucagcaaagcacauuaaaaagauac

SEQ ID NO: 93281 - RNA, 64 nt, Homo Sapiens
uacucccuuuugacaaaaaaauugaauauuugcuucauuucaaaaauaauuucuguuuaaaaau

SEQ ID NO: 93282 - RNA, 64 nt, Homo Sapiens
guuaaucucugccaucucgcauaguuucauuuaaucauuucaaauguacaauguuuucacauau

SEQ ID NO: 93283 - RNA, 64 nt, Homo Sapiens
gucuuggcugccugugggcuacuuuguguucauuucauuucaggacuaauacuuaccgagucag

SEQ ID NO: 93284 - RNA, 64 nt, Homo Sapiens
ucagggucuuggcugccugugucagacuuuguguucauuucauuuugaaacuaauacuuaccga

SEQ ID NO: 93285 - RNA, 64 nt, Homo Sapiens
aaaguguuugaaaaaaaaaaguauauuucuuuacucauuucaauauacccaguucuaccuacuu

SEQ ID NO: 93286 - RNA, 64 nt, Homo Sapiens
gcaaaggcaguauaaaagaugaaggaauauaguuucauuucauugaugcauguuuauauauaug

SEQ ID NO: 93287 - RNA, 64 nt, Homo Sapiens
aacaaacucugcauuuagaucaaacugcuuuguuucauuucauauauuuuauaguaagaaauga

SEQ ID NO: 93288 - RNA, 64 nt, Homo Sapiens
aguggaauaaauuuauuaauuggauuuuuggcugucauuucaaaccaaaugagaaucaauuagg

SEQ ID NO: 93289 - RNA, 64 nt, Homo Sapiens
uauuauuuuuuuauuuauucauuagaaauuuuccucauuucaaaauaauuuaugacucauggaa

SEQ ID NO: 93290 - RNA, 64 nt, Homo Sapiens
auacaugauaaacaguuuaugguacuucucagaaucauuucauaauaagcaauuuauuuagcuu

SEQ ID NO: 93291 - RNA, 64 nt, Homo Sapiens
uugacgauucuguuguuuuguuaaaugauucauuucauuucaccccacaguuugaagauucuca

SEQ ID NO: 93292 - RNA, 64 nt, Homo Sapiens
ucaccuugacgauucuguugucucauuaaaugauucauuucauucagugccacaguuugaagau

SEQ ID NO: 93293 - RNA, 64 nt, Homo Sapiens
aguaaacaccuguugacugcguaaaucauuauuuucauuucauauuuuagauugaauaaaauuu

SEQ ID NO: 93294 - RNA, 64 nt, Homo Sapiens
uauugguaggucaugauugcggauuccuaaacugucauuucauugugguuuugggggaucagaa

SEQ ID NO: 93295 - RNA, 64 nt, Homo Sapiens
ucgaaauaaaacacagcuccucugguucccaaagucauuucacuucagacaucugcagaaaugu

SEQ ID NO: 93296 - RNA, 64 nt, Homo Sapiens
caguauaagcaagugcaguggcauugauggcuguucauuucaccuaaaggaaaguagcacauua

SEQ ID NO: 93297 - RNA, 64 nt, Homo Sapiens
ugauaauaguaaagcuauuuuugaaucgguaguuucauuucaacuuuaguucacauuccuuaag

SEQ ID NO: 93298 - RNA, 64 nt, Homo Sapiens
guuuaguacagaaauugccugaauuuauuacuacucauuucaguaaaugguagaauaaauuaca

SEQ ID NO: 93299 - RNA, 64 nt, Homo Sapiens
gcuuaagauugaugauuucgugaaauaaagaacaucauuucauuuaagagaucauuucauuaag

SEQ ID NO: 93300 - RNA, 64 nt, Homo Sapiens
ucgugaaauaaagaacaucauuucauuuaagagaucauuucauuaagaucucuaaucuguuuug

SEQ ID NO: 93301 - RNA, 64 nt, Homo Sapiens
auuaaaaugccugcagauugaaaaugggggccacucauuucagaacugcaggaaugguguaguu

SEQ ID NO: 93302 - RNA, 64 nt, Homo Sapiens
agagcagcaguuaaacccguuucuuguagauauuucauuucagguguuucucaaugccugcuac

SEQ ID NO: 93303 - RNA, 64 nt, Homo Sapiens
ugaguucuaaggaaugagaacugagcaaagaagcucauuucaugaccaugcccacagccaccgg

SEQ ID NO: 93304 - RNA, 64 nt, Homo Sapiens
gacugagcaaauacuacaaaauucaacuuaaccuucauuucauugguuuaaaugcguuauuaac

SEQ ID NO: 93305 - RNA, 64 nt, Homo Sapiens
cugaugugacuucccugacuacuaccuucauauuucauuucaaauucaaacuucugagguugca

SEQ ID NO: 93306 - RNA, 64 nt, Homo Sapiens
auguaauuucaguuuggagccugcagccaaguuuucauuucaaauggauuuuaaaaauauuuua

SEQ ID NO: 93307 - RNA, 64 nt, Homo Sapiens
aguccaagaauuucuaguauugcuagcuuuccuuucauuucaaaaaagggcaugaaaaacuaac

SEQ ID NO: 93308 - RNA, 64 nt, Homo Sapiens
aaguaacuggcuccuuacuuuaaauguucugccaucauuucaccugaugagcauucuuggagcc

SEQ ID NO: 93309 - RNA, 64 nt, Homo Sapiens
aagagcaggauuugaaacuuggagagcuguuuucucauuucauguacacuugccccaaauuguc

SEQ ID NO: 93310 - RNA, 64 nt, Homo Sapiens
aguuacacuugccagccccacucacaaaaguuguucauuucauugggucacuggcuuuauuugc

SEQ ID NO: 93311 - RNA, 64 nt, Homo Sapiens
uugauuuacugugcaauuuaacuauauggacucuucauuucauacuuucccuuuuguucauuga

SEQ ID NO: 93312 - RNA, 64 nt, Homo Sapiens
guaagccuuuguucccaagaggcuuuuugacaggucauuucagaaguguuaucuaccuuuguca

SEQ ID NO: 93313 - RNA, 64 nt, Homo Sapiens
auguaaagaaacugaacaguuuaauaccaaguauucauuucauguuuucuugaaauuugggagg

SEQ ID NO: 93314 - RNA, 64 nt, Homo Sapiens; identical to SEQ ID NO: 93313

SEQ ID NO: 93315 - RNA, 64 nt, Homo Sapiens
gugggaucuauagaagguuaccucacaaggcaggucauuucauuucuugacagggagcucacua

SEQ ID NO: 93316 - RNA, 64 nt, Homo Sapiens
uuauggagggucccagaaaaaggacugccuacguucauuucauucaacgcccauuagaagggga

SEQ ID NO: 93317 - RNA, 64 nt, Homo Sapiens
aaaaaauauuugaaagagaauuuuuauuuuauugucauuucaauuuaaagugaucacuguucuu

SEQ ID NO: 93318 - RNA, 64 nt, Homo Sapiens
caguuugcuuuuguucaaauggguuaaacuggacucauuucaaguuauacaucacugauuauuu

SEQ ID NO: 93319 - RNA, 64 nt, Homo Sapiens
uguuugcacaauauaccacugaugguuugcaccgucauuucaaauaggguacaaaucucccaaa

SEQ ID NO: 93320 - RNA, 64 nt, Homo Sapiens
guauuucuuccuccucaauguuucaauucuaacuucauuucauguuauaucacaaauacccaag

SEQ ID NO: 93321 - RNA, 64 nt, Homo Sapiens
aggacagugaacaagcugagagaguaacucagauucauuucaaauuugaugcaauuuuaucaua

SEQ ID NO: 93322 - RNA, 64 nt, Homo Sapiens
uugguuuguaauuauuugauauaaaaguaucuggucauuucaguugcaaaugguuguccugcau

SEQ ID NO: 93323 - RNA, 64 nt, Homo Sapiens
uaagacaugugggaaaggcuuuuauucucccacgucauuucaaagacaugaaaaaacucacacu

SEQ ID NO: 93324 - RNA, 64 nt, Homo Sapiens
uaagauaugugggaaaggcuuuuauucugccaagucauuucaaauaccugaaaaaucuuacacu

SEQ ID NO: 93325 - RNA, 64 nt, Homo Sapiens
ucagacaagaugcacaccuugcucauuagugaguucauuucaggcagccagcucuuccucaccc

SEQ ID NO: 93326 - RNA, 64 nt, Homo Sapiens
uccacuucuuuugguuccccaguccaaaacacagucauuucaccuggacuauuucaaucauuac

SEQ ID NO: 93327 - RNA, 64 nt, Homo Sapiens
cccccgaagggaggggaggcuccacuccaucauuucauuucacacccgaccccagccagcgccu

SEQ ID NO: 93328 - RNA, 64 nt, Homo Sapiens
ucacacccccgaagggagggcgccuuccacuccaucauuucauuuggagcccgaccccagccag

SEQ ID NO: 93329 - RNA, 64 nt, Homo Sapiens
agucaaauuguaucugcugauacauuuaaggaugucauuucaugguuugccuucuugguaaaau

SEQ ID NO: 93330 - RNA, 64 nt, Homo Sapiens
gccucucauacaguuuucucaucuucauuuuuccucauuucauuuaaggaugaauuaccauaac

SEQ ID NO: 93331 - RNA, 60 nt, Homo Sapiens
caauaggacauugugagaaggaauuuuucagggauucaucuacuaguuuaaaaaccccac

SEQ ID NO: 93332 - RNA, 60 nt, Homo Sapiens
ugguucugguuggacagcuaaucugauuuggggauucacuguuucagaggacacagacaa

SEQ ID NO: 93333 - RNA, 60 nt, Homo Sapiens
uccuuugcucucugcagcuguaagccagaggggauucaagguaaauaggcuuuacaggcu

SEQ ID NO: 93334 - RNA, 60 nt, Homo Sapiens
cucuucugagggaagguugguugcaaaagugggauucaugacccucccaggcuacaccau

SEQ ID NO: 93335 - RNA, 60 nt, Homo Sapiens
gcugaaucugcccaguucccgugccccccggggauucaggccaucagagccucuccccag

SEQ ID NO: 93336 - RNA, 60 nt, Homo Sapiens
ccugcccugcccccaccuucggccuccagugggauucacuauccuacuucuacccucacu

SEQ ID NO: 93337 - RNA, 60 nt, Homo Sapiens
guauuuauaaaaacacugccuucauuaugagggauucaaaauucauaaguucuaaaaucc

SEQ ID NO: 93338 - RNA, 60 nt, Homo Sapiens
uuaugccuauugauaucugccuggguacaagggauucaauacacauugauugagugccug

SEQ ID NO: 93339 - RNA, 60 nt, Homo Sapiens
gggggauauuuuuguugcuuaaugauucuagggauucacuagauaccgguuacauuauua

SEQ ID NO: 93340 - RNA, 60 nt, Homo Sapiens
uucccagaacgcuuuaaguggggugcagaagggauucauauggcuggacuggugauucca

SEQ ID NO: 93341 - RNA, 60 nt, Homo Sapiens
ucugcaucuuaacugcucuuguauugaagagggauucacacagagaaccaucccuauuuu

SEQ ID NO: 93342 - RNA, 60 nt, Homo Sapiens
gaguauuugaaaaauguauauuguucaaacgggauucacagccuguuuugucuuuuguug

SEQ ID NO: 93343 - RNA, 64 nt, Homo Sapiens
accagccuggccaauaugaugaaaccccgucucuacuaaaaauacaaaauuagucggguauggu

SEQ ID NO: 93344 - RNA, 64 nt, Homo Sapiens
accagccuggccaacauggugaaaccccgucucuacuaaaaauacaaaaaguagccaggcgugg

SEQ ID NO: 93345 - RNA, 64 nt, Homo Sapiens
aacauccuggcuaacacggugaaacuccaucucuacuaaaaauacaaaaaauuggccgggcgca

SEQ ID NO: 93346 - RNA, 64 nt, Homo Sapiens
aucauccuggccaacauggugacaccccgucucuacuaaaaauacaaaaauuacccaggcauag

SEQ ID NO: 93347 - RNA, 64 nt, Homo Sapiens
gauguaucaguauauugucacaguugugcuguuaacuaaaaaugcugagaccccuuuuuauaga

SEQ ID NO: 93348 - RNA, 64 nt, Homo Sapiens
aaucuacaccaaagugguuuuuuaaaauuacauaacuaaaaauaaaccacacuguggauacauc

SEQ ID NO: 93349 - RNA, 64 nt, Homo Sapiens
caaaaaaaauuagccagccagaaacccugucucuacuaaaaauaaccauccuggcuaacauggu

SEQ ID NO: 93350 - RNA, 64 nt, Homo Sapiens
auacaaaaaaauuagccagggaaaccccgucucuacuaaaaaaaaccauccuggcgaacacggu

SEQ ID NO: 93351 - RNA, 64 nt, Homo Sapiens
caaaaauuagccuggcaugggaaaccccaucucuacuaaaaauaaccagccugaccaacauggc

SEQ ID NO: 93352 - RNA, 64 nt, Homo Sapiens
aaguaauacccuuaaaccaucaguguaguaccugacuaaaaaugucuuuugagcuuucgauuau

SEQ ID NO: 93353 - RNA, 64 nt, Homo Sapiens
caaaaauuauccgggcaugggaaaccccgucucuacuaaaaauaaccagccugaccaacacggu

SEQ ID NO: 93354 - RNA, 64 nt, Homo Sapiens
gauaaugucaguuaucuguuaaacuaagaaucuuacuaaaaaucuguaaaaaacaaaaacaaag

SEQ ID NO: 93355 - RNA, 64 nt, Homo Sapiens
uguauuacaaagccaaacacguuaucuucuggauacuaaaaaguucuuuauugguagagcacug

SEQ ID NO: 93356 - RNA, 64 nt, Homo Sapiens
uuacuauaaugaaagaaauccuggcaauauuauaacuaaaaaucuaugauuuucaucauaaaga

SEQ ID NO: 93357 - RNA, 64 nt, Homo Sapiens
aagauaauguuuccuaguagucaagucaauuuuaacuaaaaacugacaugcacuuuccauauuu

SEQ ID NO: 93358 - RNA, 64 nt, Homo Sapiens
uuccuuuuucugugggaaucacaagaguuuauccacuaaaaaaagauauguaaaaaagauacuu

SEQ ID NO: 93359 - RNA, 64 nt, Homo Sapiens
accauacuggcuaacacggugaaaccccgucucuacuaaaaauacaaaaaaaaaaaaaaaaaaa

SEQ ID NO: 93360 - RNA, 64 nt, Homo Sapiens
accagccuggccaacauggcaaaaccacaucucuacuaaaaauaaaaaaauuagcugggugugg

SEQ ID NO: 93361 - RNA, 64 nt, Homo Sapiens
aaaagaucuaauuugaaaaacuacaaaagcauuaacuaaaaaaguuuauuuuccuuuugucugg

SEQ ID NO: 93362 - RNA, 64 nt, Homo Sapiens
uccuugaaagaauaguagcaagucuccugucuagacuaaaaauacuuucgacaucccugaagcu

SEQ ID NO: 93363 - RNA, 64 nt, Homo Sapiens
aggaaaguguuaacuaucguaugcagucaaauaaacuaaaaacuugaagaucagauauguauga

SEQ ID NO: 93364 - RNA, 64 nt, Homo Sapiens
caaaaauuagccaggugugggaaacccugucucuacuaaaaauaaccagccuggccaacauggu

SEQ ID NO: 93365 - RNA, 64 nt, Homo Sapiens
caaaaaauuagccaggcguggaaaccccgucucuacuaaaaauaaccauccuggcuaacauggu

SEQ ID NO: 93366 - RNA, 64 nt, Homo Sapiens
accagccugacuaacauggugaaaucccgucucuacuaaaaauacaaaaaaaaaaaaaaaaaaa

SEQ ID NO: 93367 - RNA, 64 nt, Homo Sapiens
accauccuggccaacauggugaaauccugccucuacuaaaaauacaaaaaaaaaaaaaaauuag

SEQ ID NO: 93368 - RNA, 64 nt, Homo Sapiens
caauucaaauuuauuagcucuuuuucuuuuuaacacuaaaaauagaaucuuaaauaguuacauu

SEQ ID NO: 93369 - RNA, 64 nt, Homo Sapiens
aaaaaacaaaaacaagcagcuuauuauuguuauaacuaaaaaaaaacaaacagcaauaacaaua

SEQ ID NO: 93370 - RNA, 64 nt, Homo Sapiens
caaaaaauuagcugggcauggaaaccccaucucuacuaaaaauagcugguuuggccagcauggc

SEQ ID NO: 93371 - RNA, 64 nt, Homo Sapiens
aaaccagaagccuuauuuguacuguuuaccucacacuaaaaagauuugccuuaauauugaauau

SEQ ID NO: 93372 - RNA, 64 nt, Homo Sapiens
cacugcuaagacauucaagcugaacauauuagcuacuaaaaaggaaaaaggcauaagauuacac

SEQ ID NO: 93373 - RNA, 64 nt, Homo Sapiens
cauaagauuacacugaacauuuaauauauuaauuacuaaaaaggaaacucagacaagauuauau

SEQ ID NO: 93374 - RNA, 64 nt, Homo Sapiens
uuucaccugaucauauagcguugcaagauuuaacacuaaaaaggauuuaauggccaaaugguuu

SEQ ID NO: 93375 - RNA, 64 nt, Homo Sapiens
gucuauagagaaaaacuuucggauuauagaguauacuaaaaaauucuguauuuucauguggaau

SEQ ID NO: 93376 - RNA, 64 nt, Homo Sapiens
aucagccuggccaacauggugaaaccccaucucuacuaaaaauacaaaaauuagccggacgcag

SEQ ID NO: 93377 - RNA, 64 nt, Homo Sapiens
aucauccuggccaacauggugaaacccugucucuacuaaaaauacaaaaaugagcugggcaugg

SEQ ID NO: 93378 - RNA, 64 nt, Homo Sapiens
accagccuggccagcaugguaaaacccugucuccacuaaaaauacaaaaauuagccaggcaugg

SEQ ID NO: 93379 - RNA, 64 nt, Homo Sapiens
accauccuggccaacauggugaaacccugucucuacuaaaaauacaaaaauuagcugggugugg

SEQ ID NO: 93380 - RNA, 64 nt, Homo Sapiens
uuaggugaggaggauuauuaacuggcacauauguacuaaaaaccccucacuuaaaaauggcagu

SEQ ID NO: 93381 - RNA, 64 nt, Homo Sapiens
caaaaaaugagccgggugcagaaacccugccucuacuaaaaauaaccagccuggccaacauggu

SEQ ID NO: 93382 - RNA, 64 nt, Homo Sapiens
aagaaaugcuauaaguauaacuugaaaaaaaaacacuaaaaaugucacagaucuguuuaaccca

SEQ ID NO: 93383 - RNA, 64 nt, Homo Sapiens
auucauuuuuuuggauuccugagaaaauauccugacuaaaaaaauuuucuuucuuauaacugca

SEQ ID NO: 93384 - RNA, 64 nt, Homo Sapiens
gaugacaucaaacauuuuuauuuacagucgcagcacuaaaaaugauuucuuacucuauuguacg

SEQ ID NO: 93385 - RNA, 64 nt, Homo Sapiens
auauauuuuacagauuuauuggcucuuucugcucacuaaaaauccucacuucaagcacuaauuu

SEQ ID NO: 93386 - RNA, 64 nt, Homo Sapiens
ucuuaaggauaacauuugguauaaaaaagcuauaacuaaaaaaacaucaugguuugaaaaaagg

SEQ ID NO: 93387 - RNA, 64 nt, Homo Sapiens
caaaaauuagccgggcgugagaaaccccgucucuacuaaaaauaaccaggcuggccaacguggu

SEQ ID NO: 93388 - RNA, 64 nt, Homo Sapiens
accaucccggcuaaaacggugaaaccccgucucuacuaaaaauacaaaaaauuagccgggcgua

SEQ ID NO: 93389 - RNA, 64 nt, Homo Sapiens
aaccagaggacauacuagucacauguuauuauacacuaaaaaauaggaagucaucuugaaaggc

SEQ ID NO: 93390 - RNA, 64 nt, Homo Sapiens
ucccuuccuuaucuguuaaauuuaaugucuuuauacuaaaaauauaggcucuugggauuggaga

SEQ ID NO: 93391 - RNA, 64 nt, Homo Sapiens
accagccuggccaacauggcaaaaccccaucuuuacuaaaaauauaaaguacaucucuacuaaa

SEQ ID NO: 93392 - RNA, 64 nt, Homo Sapiens
ccccaucuuuacuaaaaauauaaaguacaucucuacuaaaaauacgaaaaaauuagcugggcau

SEQ ID NO: 93393 - RNA, 64 nt, Homo Sapiens
accagccaggccaacauggugaaacuucaucucuacuaaaaauacaaaaacuagccaggugugg

SEQ ID NO: 93394 - RNA, 64 nt, Homo Sapiens
accaaccuggucuacauggugaaaccccaucucaacuaaaaauacaaaaaauacaaaaaauuag

SEQ ID NO: 93395 - RNA, 64 nt, Homo Sapiens
caaaaauauuagccgggcgugaaaccccgucucuacuaaaaauaaccagccugaccaacaugga

SEQ ID NO: 93396 - RNA, 64 nt, Homo Sapiens
caaaaauuagcugggugugggagaccccaacucuacuaaaaauaaucacccuggcccacauggu

SEQ ID NO: 93397 - RNA, 64 nt, Homo Sapiens
acaugcggcaccuuauuuaugacgauguauggaaacuaaaaagacuucuccucacucugggaca

SEQ ID NO: 93398 - RNA, 64 nt, Homo Sapiens
uacaaaaaauuagcuuggcggaaacccugucucuacuaaaaaaaaccauccuggcuaacacagu

SEQ ID NO: 93399 - RNA, 64 nt, Homo Sapiens
ggcuggucccuaugucaugucuuccauuaagaacacuaaaaaguccuugcaagaauggagauau

SEQ ID NO: 93400 - RNA, 64 nt, Homo Sapiens
accaggcuggccgacauggugaaaccccaucucuacuaaaaaauauaaaaauuagccgggcuuu

SEQ ID NO: 93401 - RNA, 64 nt, Homo Sapiens
auaauugauuuauguugaauauauggacuuagcaacuaaaaauaccacagaugguuaaccugga

SEQ ID NO: 93402 - RNA, 64 nt, Homo Sapiens
accagccuggccaacauggugaaacccugucucuacuaaaaauacaaaaauuagccgggcaugg

SEQ ID NO: 93403 - RNA, 64 nt, Homo Sapiens
agccuaagaguuauaggcuuaaagaugucgaguaacuaaaaacuguauugcuggccgggcgcgg

SEQ ID NO: 93404 - RNA, 64 nt, Homo Sapiens
accauccuggccaacauggugaaacccugucucuacuaaaaauacaaaaaugagcugggugugg

SEQ ID NO: 93405 - RNA, 64 nt, Homo Sapiens
gaagacacuauuuuagcuaaugggguuucuugggacuaaaaaauggcuuuguuuaaauuauaau

SEQ ID NO: 93406 - RNA, 64 nt, Homo Sapiens
accauucuggccaacauggugaaaccccgucucuacuaaaaauacaaaaauuagcugggcaugg

SEQ ID NO: 93407 - RNA, 64 nt, Homo Sapiens
accagccuggcuaacauagugagacccuguuucuacuaaaaauacaaaaauaagccaggugugg

SEQ ID NO: 93408 - RNA, 64 nt, Homo Sapiens
cuugacaaaugcacugauuguuauacuuuaaauaacuaaaaaucugagaauccacagugcuaca

SEQ ID NO: 93409 - RNA, 64 nt, Homo Sapiens
uaucauuaauuuuauaucaggauucauguaagagacuaaaaaugauccauagugguuaguacug

SEQ ID NO: 93410 - RNA, 64 nt, Homo Sapiens
caaaaaaauuagccaggcgugcaaccccgucucuacuaaaaauauuggacuugggaauagaaaa

SEQ ID NO: 93411 - RNA, 64 nt, Homo Sapiens
gcuuuuuaguaaagccauuuuaugauagaucuuuacuaaaaauguuaaaauuguuuauaaauca

SEQ ID NO: 93412 - RNA, 64 nt, Homo Sapiens
caaaaaaaaaauuaaccggggaaaccccgucuccacuaaaaaugaucagccuggccaacauggc

SEQ ID NO: 93413 - RNA, 64 nt, Homo Sapiens
ugauagauaaaagugugauucaaacuauuuccaaacuaaaaauguagaauucuauauugauaag

SEQ ID NO: 93414 - RNA, 64 nt, Homo Sapiens
agaccauccuggccaacauggugaaaccuugucuacuaaaaauacaaaaaauuagcugggcaug

SEQ ID NO: 93415 - RNA, 64 nt, Homo Sapiens
uugguucuauugcauaguacaugaaucuauugucacuaaaaauuagguuacuaaucuuaauuuu

SEQ ID NO: 93416 - RNA, 64 nt, Homo Sapiens
guugucaacuugggcuacugaacuacaugcauaaacuaaaaacuaacagcuacaaacuuuuaag

SEQ ID NO: 93417 - RNA, 64 nt, Homo Sapiens
accauccuggccaacauggugauaccccgucucuacuaaaaauacaaaaaaauuaguugggcau

SEQ ID NO: 93418 - RNA, 64 nt, Homo Sapiens
caaaaauuagccaggcgugggaaaccuugucucuacuaaaaauaaccagccuggccaacauggu

SEQ ID NO: 93419 - RNA, 64 nt, Homo Sapiens
caaaaguagccgggcguggugaaacccuaucucuacuaaaaauaaccagccugaccaacacgga

SEQ ID NO: 93420 - RNA, 64 nt, Homo Sapiens
caaaaauuagccgggcaugggaaaccccgucucuacuaaaaauaacuagccuggccaacauggu

SEQ ID NO: 93421 - RNA, 64 nt, Homo Sapiens
ccaaaaauuagccgagcguaaaacccccaucucuacuaaaaauaccagccuguccaacauggug

SEQ ID NO: 93422 - RNA, 64 nt, Homo Sapiens
caaaaauuagcugggcaugggaaaccccgucucuacuaaaaauaaccauccuggccaacauggu

SEQ ID NO: 93423 - RNA, 64 nt, Homo Sapiens
caaaaauucacaggguguguaaaaucccaucucuacuaaaaauaaccagccuggccaacauggc

SEQ ID NO: 93424 - RNA, 64 nt, Homo Sapiens
gaaaaaucagcugggugugggaaaccccaucucuacuaaaaauaaccauccugaccaacguggu

SEQ ID NO: 93425 - RNA, 64 nt, Homo Sapiens
uccagccugaccaacaugaagaaacccugucuguacuaaaaauacaaaaauuagccggacaugg

SEQ ID NO: 93426 - RNA, 64 nt, Homo Sapiens
agacugggcaacagagggagacuccgucucaaaaacuaaaaaaaaaaaauacauuuaguauagc

SEQ ID NO: 93427 - RNA, 64 nt, Homo Sapiens
caaaauuuagcugagugugggaaaccucgucuguacuaaaaauaaccagccuggccaacauggu

SEQ ID NO: 93428 - RNA, 64 nt, Homo Sapiens
caaaaaaauuagccaggcgugaaacccugucucuacuaaaaauaaccauccuggcuaacacggu

SEQ ID NO: 93429 - RNA, 64 nt, Homo Sapiens
acagaaauuagcugggugugaaaaccccgucucuacuaaaaaauaccagccuggccaacauggc

SEQ ID NO: 93430 - RNA, 64 nt, Homo Sapiens
aaaaaagaagccccuucacucugucuuaaaaaaaacuaaaaagaugggcaauuuuuuuaagacu

SEQ ID NO: 93431 - RNA, 64 nt, Homo Sapiens
caaaaauuagcuuggcaugggaaaccccaucucuacuaaaaauaaccagccugaccaacauggc

SEQ ID NO: 93432 - RNA, 64 nt, Homo Sapiens
accagucuggccaacauggggaaaccccgucucuacuaaaaauacaaaaauuagccgggcaugg

SEQ ID NO: 93433 - RNA, 64 nt, Homo Sapiens
accagccuggccaauguggugaaaccccaucucuacuaaaaauacaaaaauuagcugggcgugg

SEQ ID NO: 93434 - RNA, 64 nt, Homo Sapiens
gcacauuugaguacauuugacucaguuuuuuauuacuaaaaauauuucuauguuuuuuuaauua

SEQ ID NO: 93435 - RNA, 64 nt, Homo Sapiens
acgaaagguugccaaguauuggaggccgcucuaaacuaaaaauauugacuccaaaaugucagag

SEQ ID NO: 93436 - RNA, 64 nt, Homo Sapiens
accagccuggccaacacggugaaaccccgccucuacuaaaaauacaaaaaauagccgggugugg

SEQ ID NO: 93437 - RNA, 64 nt, Homo Sapiens
accagccuggucaacguggugaaacgccguuucuacuaaaaauaugaaaauuaguugggugugg

SEQ ID NO: 93438 - RNA, 64 nt, Homo Sapiens
ccagccugacaaaacauagugaaaccccgucucuacuaaaaauacaaaaauuagcugggcgugg

SEQ ID NO: 93439 - RNA, 64 nt, Homo Sapiens
guacuucaaucucaguuucuuuuuaauauuuuaaacuaaaaacuaauguuaaagguuuuuucau

SEQ ID NO: 93440 - RNA, 64 nt, Homo Sapiens
ugcugcuggagaaggugaaacaaaaggacagagaacuaaaaaaucaguggaggaaacagccucc

SEQ ID NO: 93441 - RNA, 64 nt, Homo Sapiens
aaaaguaaaaauuaguucccgucaaaauaauaaaacuaaaaacaauugcauauuuucauaauca

SEQ ID NO: 93442 - RNA, 64 nt, Homo Sapiens
caguuuauauuuuauauacaucguuauaaacacuacuaaaaaaauuuagcuucaggaauacugc

SEQ ID NO: 93443 - RNA, 64 nt, Homo Sapiens
ugaaaucucugccauuuuagauacugugaaacaaacuaaaaaaaaaaaagcuuuuguuuuguau

SEQ ID NO: 93444 - RNA, 64 nt, Homo Sapiens
accagccuggccaacaaggugaaacccugucucuacuaaaaauacaaaaaauuagccaggcaug

SEQ ID NO: 93445 - RNA, 64 nt, Homo Sapiens
accaaguguccagggaaacccuuguauuuugaugacuaaaaagagcacuuugcccguacuuagg

SEQ ID NO: 93446 - RNA, 64 nt, Homo Sapiens
ucuccccacuuucccucuuccuuuaagaaaacuuacuaaaaaauguuucauugcgaagcagagg

SEQ ID NO: 93447 - RNA, 64 nt, Homo Sapiens
accauccuggccaacauggugaaacccugucucuacuaaaaauacaaaaauagcugggcauggu

SEQ ID NO: 93448 - RNA, 64 nt, Homo Sapiens
accagccuggguaauauggcaagagcccaacucuacuaaaaauacaaaaagaaaagaaaacagc

SEQ ID NO: 93449 - RNA, 64 nt, Homo Sapiens
acccgccuggcuaacaaggcgaaauccugucuguacuaaaaauacaaaaaucagccagacaugg

SEQ ID NO: 93450 - RNA, 64 nt, Homo Sapiens
auuucauuaugaggucagacuaggauaauguccaacuaaaaacaaacccuuuucauccuggcug

SEQ ID NO: 93451 - RNA, 64 nt, Homo Sapiens
aaaggcauugacuuaaacaguugucuucagaaaaacuaaaaauacugugauucuuauaagagcu

SEQ ID NO: 93452 - RNA, 64 nt, Homo Sapiens
gauuuucuaaaauuauuggacaggcaucugggucacuaaaaacuaaauccuggcagcuuuucuc

SEQ ID NO: 93453 - RNA, 64 nt, Homo Sapiens
aaaaauagacaaaaauuagcgaaaccccgucucuacuaaaaaaaaccagacuggccaacauggu

SEQ ID NO: 93454 - RNA, 64 nt, Homo Sapiens
caaaaaauuagccgggcguggaaaccccgucucuacuaaaaauaacccuccuggcuaacaccgu

SEQ ID NO: 93455 - RNA, 64 nt, Homo Sapiens
acuuguuuaaauuguauuugaauuguguacaaacacuaaaaaaaugaauauugaaaaauugaca

SEQ ID NO: 93456 - RNA, 64 nt, Homo Sapiens
uuguuuggggcaagggccagagguuugcccuugaacuaaaaaugcaauuggucaucuggcugua

SEQ ID NO: 93457 - RNA, 64 nt, Homo Sapiens
aauacaaaaauuagccgggcgaaaccccaucucuacuaaaaaaaaccagccuggccaacacggu

SEQ ID NO: 93458 - RNA, 64 nt, Homo Sapiens
aaaaaaaaauuagucgggcggaaaccccaucucuacuaaaaaaaaccagccuggccaacauggu

SEQ ID NO: 93459 - RNA, 64 nt, Homo Sapiens
uagaauuagccaggcauggugaaacccuaucucuacuaaaaauaaucagccugaccaacauggu

SEQ ID NO: 93460 - RNA, 64 nt, Homo Sapiens
uaaaaaauuagcugggcauggaaaccccaucgcuacuaaaaauaaccagccuggccaacauggu

SEQ ID NO: 93461 - RNA, 63 nt, Homo Sapiens
acaaaaaaaaaaaaaaaacagaaaccccgucucuacuaaaaauaccaucauugcuaacauggu

SEQ ID NO: 93462 - RNA, 64 nt, Homo Sapiens
caaaauuagccaggcguggugaaacccugucucuacuaaaaauaaccagccugaccaacaugga

SEQ ID NO: 93463 - RNA, 64 nt, Homo Sapiens
accagccuggccaacauggcgaaaccccaucucuacuaaaaauacaaaaauuagccgggcgugg

SEQ ID NO: 93464 - RNA, 64 nt, Homo Sapiens
accagccuggccaauauggugaaaccccaucucuacuaaaaauauaaaaaucagcaaaaaaaau

SEQ ID NO: 93465 - RNA, 64 nt, Homo Sapiens
agcuaaaauggcuuaacaucaugcuacacuuuacacuaaaaaucuauuacugugaguggucugu

SEQ ID NO: 93466 - RNA, 64 nt, Homo Sapiens
aucugagggaaaacauguucagggcuucuagaacacuaaaaaauuuggcuuaaaccaguguuca

SEQ ID NO: 93467 - RNA, 64 nt, Homo Sapiens
augagccuaaaaccucuuuaaaaacggucaguuaacuaaaaaauaaaaaucaagucuuuaggag

SEQ ID NO: 93468 - RNA, 64 nt, Homo Sapiens
aaucaagucuuuaggagaguagaaaacacaauuaacuaaaaagcagggacaucugaaagagacg

SEQ ID NO: 93469 - RNA, 64 nt, Homo Sapiens
auuuucucagaaaaaaaaacaauacugaauaauuacuaaaaaugcccuaaauacuucagugugu

SEQ ID NO: 93470 - RNA, 64 nt, Homo Sapiens
uauuuguuugaaauucaaauuggaaaauacuuauacuaaaaaauaauauuuuacauggaauauu

SEQ ID NO: 93471 - RNA, 64 nt, Homo Sapiens
ggacuuuuaaagguuugaauuuauuaggacacgaacuaaaaauaaaagugcacuaggggacagu

SEQ ID NO: 93472 - RNA, 64 nt, Homo Sapiens
gauguuaugaagaagaggguauuucuaguuuuguacuaaaaaucaauuggaugaacuaaaucca

SEQ ID NO: 93473 - RNA, 64 nt, Homo Sapiens
auaaaagugaaccauauuuaucugguuauauaaaacuaaaaauggggguguuuauauaaaacua

SEQ ID NO: 93474 - RNA, 64 nt, Homo Sapiens
uauauaaaacuaaaaauggggguguuuauauaaaacuaaaaacuaagaaugauguaaccuuuug

SEQ ID NO: 93475 - RNA, 64 nt, Homo Sapiens
accauccugucuaacacggugaaaccccaucucuacuaaaaauacaaaaaaauuagucggacau

SEQ ID NO: 93476 - RNA, 64 nt, Homo Sapiens
accagccuggccaacauggugaaaccccaucucuacuaaaaauacaaaaauuagcuaggcgggg

SEQ ID NO: 93477 - RNA, 64 nt, Homo Sapiens
caaaaaaauuagucgggcgugaaaccccgucucuacuaaaaauaaccauccuggcuaacacggu

SEQ ID NO: 93478 - RNA, 64 nt, Homo Sapiens
caaaaaacuagccaggcguggaaaccccaucuuuacuaaaaauaaccagccuggccaacauggu

SEQ ID NO: 93479 - RNA, 64 nt, Homo Sapiens
caaaaaaaaaaaacaaaaaagaaaccccgucucuacuaaaaauaaccauccuggcuaacacggu

SEQ ID NO: 93480 - RNA, 64 nt, Homo Sapiens
ggaaaaucagccaggcgugggaaaugcagugucaacuaaaaauaaccagccuggccaaccuggu

SEQ ID NO: 93481 - RNA, 64 nt, Homo Sapiens
caaaaauuagccgggcaugggaaacccuaucucuacuaaaaauaaccauccuggccaacaugau

SEQ ID NO: 93482 - RNA, 64 nt, Homo Sapiens
caaaaaccaaaaaaaauuaggaaaccccaucucuacuaaaaauaaccauccuggcuaacacggu

SEQ ID NO: 93483 - RNA, 64 nt, Homo Sapiens
caaaaguuagccgggggguggaaaccccaucucuacuaaaaauaagcacccuggcuaacauggu

SEQ ID NO: 93484 - RNA, 64 nt, Homo Sapiens
uaaaauauuagccaggcguggaaaccccaucucuacuaaaaauaaccguccuggcuaacacggu

SEQ ID NO: 93485 - RNA, 64 nt, Homo Sapiens
caaacuuagcugggcuuagugaaaccccaucucuacuaaaaauaaccagccuggccagcauagu

SEQ ID NO: 93486 - RNA, 64 nt, Homo Sapiens
caaaauuagccgggcguggugaaaccccaauuguacuaaaaauaaccagccugaccaacaugga

SEQ ID NO: 93487 - RNA, 64 nt, Homo Sapiens
accagccuggccaacauggugaaaccccaucuguacuaaaaauacaaaaauuugccuggugugg

SEQ ID NO: 93488 - RNA, 64 nt, Homo Sapiens
gaaaauggggcuguuaauauacucuaaaagccauacuaaaaaugcucugagggaacuggcuaag

SEQ ID NO: 93489 - RNA, 64 nt, Homo Sapiens
accagccuggccaacguggugaaaccccaucucuacuaaaaauacaaaaauuagccgggugugg

SEQ ID NO: 93490 - RNA, 64 nt, Homo Sapiens
uauggacuuaaaguacuuauucauauaccuuguaacuaaaaauuagaacagcucccuagaauug

SEQ ID NO: 93491 - RNA, 64 nt, Homo Sapiens
accagccuggccaacguggugaaacacugucucuacuaaaaauacaaaaaugagcuggguguga

SEQ ID NO: 93492 - RNA, 64 nt, Homo Sapiens
gaccuccuggcuaacacggugaaaccccgucuuuacuaaaaauacaaaaaaaauuagcugggcg

SEQ ID NO: 93493 - RNA, 64 nt, Homo Sapiens
ugucagguggucugcaaagaugauaaccuugacuacuaaaaacgucuccauggcggggguaaca

SEQ ID NO: 93494 - RNA, 64 nt, Homo Sapiens
accagucuggccaacauagcaaaacccugucucuacuaaaaauacaaaaauuaucugggcaugg

SEQ ID NO: 93495 - RNA, 64 nt, Homo Sapiens
uaaaaauuagcugggugugggaaaccccgucucuacuaaaaauaaccauccuggccaacauggu

SEQ ID NO: 93496 - RNA, 64 nt, Homo Sapiens
ugaaaauuagcugggcuuggaaaaccccgucucuacuaaaaauaaccagccuggccaacaaggc

SEQ ID NO: 93497 - RNA, 64 nt, Homo Sapiens
caagaaacuagccagaugcggaaaccucgugucuacuaaaaauagccuggccaaccaacauggu

SEQ ID NO: 93498 - RNA, 64 nt, Homo Sapiens
caaaaauuagccaggacugagaaaccccgucucuacuaaaaauaaccagccuggccaacauggc

SEQ ID NO: 93499 - RNA, 64 nt, Homo Sapiens
uggaaaagaagaccuggguggaaagcgguuuggaugaaaagauuucaggcaaagacuugcagga

SEQ ID NO: 93500 - RNA, 64 nt, Homo Sapiens
cagaaagacggguguuuuauuuggucuaauacccugaaaagaagugaugacuuguugcuuuuca

SEQ ID NO: 93501 - RNA, 64 nt, Homo Sapiens
cuaacauuauuuacaguagaaaagugguuugagaugaaaagaacacgaguaaguagacaagaau

SEQ ID NO: 93502 - RNA, 64 nt, Homo Sapiens
uuuuuugugugugaauuaucauaauuuaaccaugugaaaagaauacaggagcaagagaaagaag

SEQ ID NO: 93503 - RNA, 64 nt, Homo Sapiens
uaguuuucuuuuuaucuuauuuuuacucguccguugaaaagauaaucaaggccuacauuuuagc

SEQ ID NO: 93504 - RNA, 64 nt, Homo Sapiens
cagaaagacucuuuuagggcauuuuucugacucaugaaaagagcacagaaaaggauguuuggca

SEQ ID NO: 93505 - RNA, 64 nt, Homo Sapiens
accugcagaaugggagaaaacccuaucaagaaggugaaaagauaagcuuuugugauugaaaaga

SEQ ID NO: 93506 - RNA, 64 nt, Homo Sapiens
cuaucaagaaggugaaaagagaagcuuuugugauugaaaagaccauuggacuuaaucaagauuu

SEQ ID NO: 93507 - RNA, 64 nt, Homo Sapiens
aggaaaaugagaaaucaccuaaaagagagagagaugaaaagagugagacuccaucucaaaaaaa

SEQ ID NO: 93508 - RNA, 64 nt, Homo Sapiens
auuuauauuggacuaaucagagauaaagggauugugaaaagagcaaaaaaaaaagaaaagaaaa

SEQ ID NO: 93509 - RNA, 64 nt, Homo Sapiens
gccccgugccuucaguuaauaaagauuuguauugugaaaagauuuuuucuuuuuuuuuugggac

SEQ ID NO: 93510 - RNA, 64 nt, Homo Sapiens
ugggauuacaggcgcgagccacggcgcccagccuugaaaagauguuuuuagaaccagaagaaac

SEQ ID NO: 93511 - RNA, 64 nt, Homo Sapiens
agguacccuaaggcugagggaauaauaauaaagaugaaaagagauaauuaagcuaugauaggag

SEQ ID NO: 93512 - RNA, 64 nt, Homo Sapiens
aaucacagaagagagaaugcaaaaaagguagauaugaaaagaaagaaccaagucuuacauagaa

SEQ ID NO: 93513 - RNA, 64 nt, Homo Sapiens
uuuaaccuaauauaucaagguuuaaugagauaaaugaaaagauacaaguuagagaaaagaugga

SEQ ID NO: 93514 - RNA, 64 nt, Homo Sapiens
aauauauaacucaauuuucauuagcggagaauuuugaaaagagguaucaaaaacaagugcuugu

SEQ ID NO: 93515 - RNA, 64 nt, Homo Sapiens
ggaugaguacccucugaaaaagggaauuugcuggugaaaagaggcuggaucuuguggaagacug

SEQ ID NO: 93516 - RNA, 64 nt, Homo Sapiens
uguugaauuacuguaucuuuuacuuuuuuuuuuuugaaaagauaaacuuguaaauagagugauu

SEQ ID NO: 93517 - RNA, 64 nt, Homo Sapiens
gauauauuguuguuagaaauucuauauaagaaugugaaaagauuauuucauuagauucucugau

SEQ ID NO: 93518 - RNA, 64 nt, Homo Sapiens
agguucccuauguugcccagcuaauuuuauuuuuugaaaagacagcauauaccgccacacccag

SEQ ID NO: 93519 - RNA, 64 nt, Homo Sapiens
gacauugaaacauuuguauuaacaaguugucaaaugaaaagaauauaugacaaaugaaaagaau

SEQ ID NO: 93520 - RNA, 64 nt, Homo Sapiens
aacaaguugucaaaugaaaagcuuauaugacaaaugaaaagaauuuuaguuaugagaaaucuuu

SEQ ID NO: 93521 - RNA, 64 nt, Homo Sapiens
guuugaguugguugauugggguuugauuugcuuuugaaaagauuuuuauuuuuagaggcagggc

SEQ ID NO: 93522 - RNA, 64 nt, Homo Sapiens
aaaauauauuuccucauaaacauuugaguuuuguugaaaagauggaguuuacaaagauaccauu

SEQ ID NO: 93523 - RNA, 64 nt, Homo Sapiens
uuuuuaguccuaggccaguauuugugcuuuggguugaaaagaagguagccuuuguggauuuggg

SEQ ID NO: 93524 - RNA, 64 nt, Homo Sapiens
ggaaggguuugcagaggagaacuucucagagcacugaaaagaaagauuugaggcuuuucuauau

SEQ ID NO: 93525 - RNA, 64 nt, Homo Sapiens
auagaguuaaaacaauauuuagaaguaagagauuugaaaagacgagcaaagaacuguaaccgaa

SEQ ID NO: 93526 - RNA, 64 nt, Homo Sapiens
auaauucuacuuuguuuaaucuggcacaggccuuugaaaagacuaagcaaacuuuuuguguuau

SEQ ID NO: 93527 - RNA, 64 nt, Homo Sapiens
ugcuaauguaaucauuuaucaaaaaaauaacaucugaaaagaaaaaauaguuucaaaugaguuu

SEQ ID NO: 93528 - RNA, 64 nt, Homo Sapiens
aaagucuaugcuuaggccaguguaaccauaugauugaaaagaaguguuuguaauauacaguuuu

SEQ ID NO: 93529 - RNA, 64 nt, Homo Sapiens
uaauaauauccaggucaacauuuuuuccuguuucugaaaagaaaaggagacacagauguucggu

SEQ ID NO: 93530 - RNA, 64 nt, Homo Sapiens
gcagagaauauaacaugaaauuucuuuagagaacugaaaagagauguggauaacaaagauaucu

SEQ ID NO: 93531 - RNA, 64 nt, Homo Sapiens
cguaguaaauuaaauagaagauauuuauugguacugaaaagagacagaaauacagcagacgaac

SEQ ID NO: 93532 - RNA, 64 nt, Homo Sapiens
uuuaguaugcuuugaaaaaaauagaacauuuguaugaaaagacagugauguucuuuugcaaggc

SEQ ID NO: 93533 - RNA, 64 nt, Homo Sapiens
auacuuuuuacuuuuauuuagaauauugugcuuuugaaaagaguauaauguacaguauaaagag

SEQ ID NO: 93534 - RNA, 64 nt, Homo Sapiens
cuuaguaccaaauacacucaaacuagcaaauauaugaaaagaccaucuccacuuuacuuaagaa

SEQ ID NO: 93535 - RNA, 64 nt, Homo Sapiens
acugacacaccagucuggguugacacuuuuucugugaaaagaacaaggauggagcuccgugggu

SEQ ID NO: 93536 - RNA, 64 nt, Homo Sapiens
ugugugcaccugauuuggccaauaggaucaacagugaaaagacagaagaggcaauaccagcagu

SEQ ID NO: 93537 - RNA, 64 nt, Homo Sapiens
aagaaagaaaccuguuuguuuuucuuuugaacuaugaaaagacccuguuugugaauauauuuua

SEQ ID NO: 93538 - RNA, 64 nt, Homo Sapiens
uuuuuaaaggcagagaaguaucugcaucuuuauuugaaaagacgucuuauuaacucuuagcucc

SEQ ID NO: 93539 - RNA, 64 nt, Homo Sapiens
aagcaagaucugucacccacaacaccacauaucuugaaaagaugcuuuucauaauuuucacuau

SEQ ID NO: 93540 - RNA, 64 nt, Homo Sapiens
gauacuucucgggaaaggaucaucgccguugaaaugaaaagagagacagagagaaaaaaaaaaa

SEQ ID NO: 93541 - RNA, 64 nt, Homo Sapiens
acuucacauuggaugacaccauguucuuccucuuugaaaagaaaaggggaaugugucccacuag

SEQ ID NO: 93542 - RNA, 64 nt, Homo Sapiens
uaaaacuagaaauagcacucuugguuucuuuugaugaaaagagugagcuggucaaugcaacauu

SEQ ID NO: 93543 - RNA, 64 nt, Homo Sapiens
uuggugccgagcagggauauaaccugcaguuaagugaaaagaaaauccagccucccccuccaaa

SEQ ID NO: 93544 - RNA, 64 nt, Homo Sapiens
aaugauaaugcuuccaaacuuuaaaagugagagcugaaaagagaaaggaaaauaacugaaaaga

SEQ ID NO: 93545 - RNA, 64 nt, Homo Sapiens
aaaagugagagcugaaaagacuaaggaaaauaacugaaaagauuacuuugguggcuaaguuuua

SEQ ID NO: 93546 - RNA, 64 nt, Homo Sapiens
cuuacauuuuaaauguuauuugacuaauguaaaaugaaaagaggcaaagauucaaaugcuuuua

SEQ ID NO: 93547 - RNA, 64 nt, Homo Sapiens
augucauuuccuaauuuugaaauuacaugccuaaugaaaagaaggucaacacauaguguaaaau

SEQ ID NO: 93548 - RNA, 64 nt, Homo Sapiens
auaaaacaaaauggaauguggacuuuuauuuucaugaaaagacagauguuaccaguuaggggaa

SEQ ID NO: 93549 - RNA, 64 nt, Homo Sapiens
ucacuuccuugaaaauuuuaauccaauggaauacugaaaagaaacacacacauucacccuaagg

SEQ ID NO: 93550 - RNA, 64 nt, Homo Sapiens
gaaaggaaaagaaaaaggagaauacaaagauaagugaaaagagaauucugcauuugguuuuaug

SEQ ID NO: 93551 - RNA, 64 nt, Homo Sapiens
augauuuuuauuuuuccuuugguauuugcuacagugaaaagaaguuuggaaaguagauacauaa

SEQ ID NO: 93552 - RNA, 64 nt, Homo Sapiens
auuuaggcauuaccucagggaaaagccuugacagugaaaagaaacuacuuaaucgcuaauagcu

SEQ ID NO: 93553 - RNA, 64 nt, Homo Sapiens
gaauugaagucguuuuguuucaccgaggcacauuugaaaagauguucaacuuuuuuucuugcag

SEQ ID NO: 93554 - RNA, 64 nt, Homo Sapiens
aaggaacaaagguugagagagagaucuugccuuuugaaaagaugauaaagacuacagaaggaaa

SEQ ID NO: 93555 - RNA, 64 nt, Homo Sapiens
aguucaagaaguucuggagaaagaaagaaaaugaugaaaagaguaucccucuaagaaagaaaug

SEQ ID NO: 93556 - RNA, 64 nt, Homo Sapiens
aaaaauaaagauuuauuuaagcauguauuacuuuugaaaagauguguuuaauuuuugacaacaa

SEQ ID NO: 93557 - RNA, 64 nt, Homo Sapiens
ucguucccagcagcaucaagauuagaaaauauaaugaaaagauuuuuguuuuguaccaacagga

SEQ ID NO: 93558 - RNA, 64 nt, Homo Sapiens
uauacacacacauacacauauauuaugcauguggugaaaagaauuggcuagauaggggauuuuu

SEQ ID NO: 93559 - RNA, 64 nt, Homo Sapiens
aucacuuuugggugucuguauccuaagaaguuucugaaaagaucuaaagccuuuuuaucccaua

SEQ ID NO: 93560 - RNA, 64 nt, Homo Sapiens
gauugggaauuuaaaaacgauaugcuauguuaaaugaaaagaucugauuguugaaaauauaaug

SEQ ID NO: 93561 - RNA, 64 nt, Homo Sapiens
guggggucuuggauaucaccuucuucuauguuuuugaaaagaaggggagacugaagugugcagg

SEQ ID NO: 93562 - RNA, 64 nt, Homo Sapiens
uagcuugagaguaaugucacacccugugauuauuugaaaagaauaccuguuagauuaaagcugc

SEQ ID NO: 93563 - RNA, 64 nt, Homo Sapiens
gugaagauuuuuuacauugcauuaagaugcuacuugaaaagacuuuuauugucccccagaaaag

SEQ ID NO: 93564 - RNA, 64 nt, Homo Sapiens
aguacuuuagcuucuuucuguacuccuuacuguuugaaaagauaaugauagauaacauggcuuu

SEQ ID NO: 93565 - RNA, 64 nt, Homo Sapiens
ccgaaugugcagauuccacacucuaaacucagauugaaaagagauuacacaccugacuuaacau

SEQ ID NO: 93566 - RNA, 64 nt, Homo Sapiens
gaccaacccaguucuguuugacuauguagcaucuugaaaagaaaaauuauaauaaagccccaaa

SEQ ID NO: 93567 - RNA, 64 nt, Homo Sapiens
uucccaugugucccccaguacuuauaaaagggagugaaaagaccgagcuguaaggcaugugccu

SEQ ID NO: 93568 - RNA, 64 nt, Homo Sapiens
agucaccaggguuacucagaagguuuugauaaggugaaaagaauugaugcauuguuuuuagcuc

SEQ ID NO: 93569 - RNA, 64 nt, Homo Sapiens
caucacacaaucaccuugcuaucuaacucaacugugaaaagacacaucauaacugguggggcac

SEQ ID NO: 93570 - RNA, 64 nt, Homo Sapiens
ccagcacaaggcagagcugggaugaaaacagggcugaaaagacucagggccaauuauuggcuga

SEQ ID NO: 93571 - RNA, 64 nt, Homo Sapiens
agggaaagaaggugauuuguauuugucuccccgcugaaaagaacaggauucaaguccagaguuu

SEQ ID NO: 93572 - RNA, 64 nt, Homo Sapiens
auuucuaccauuaaaaucuugaaagcgaaauacuugaaaagaggugaccauaaagaucacacca

SEQ ID NO: 93573 - RNA, 64 nt, Homo Sapiens
uccauaagcagguuauuuuuauuuuuuuacuguuugaaaagaaauaaguagugucauucauaug

SEQ ID NO: 93574 - RNA, 64 nt, Homo Sapiens
caagacucucagguauagaaaaaagagcaaaaugugaaaagacacuuuuuuucuuccuauucag

SEQ ID NO: 93575 - RNA, 64 nt, Homo Sapiens
gucuccaguuucugaaugaagaauaacaacucagugaaaagauguaagcuaagggaagaggaag

SEQ ID NO: 93576 - RNA, 64 nt, Homo Sapiens
guuuugaucauaugcauguaaaauaccccaaacaugaaaagauuuuucuuuuacuauguguaag

SEQ ID NO: 93577 - RNA, 64 nt, Homo Sapiens
ucuauugggaguccgaggcagauagcugugaacaugaaaagacacagcaaugucuaugcuucuc

SEQ ID NO: 93578 - RNA, 64 nt, Homo Sapiens
aaugcaacuuguauauuuugaaaucguguguguuugaaaagaaguacuggaaauugaaaaacga

SEQ ID NO: 93579 - RNA, 64 nt, Homo Sapiens
aaaaguaaaaaguguucugucaaaguuuuuguuuugaaaagagcaaugugggcaaacccuucua

SEQ ID NO: 93580 - RNA, 64 nt, Homo Sapiens
gcauagcuuaaaagaugaaaucccaaagcgccacugaaaagaugaaaaggccuguacauacuuc

SEQ ID NO: 93581 - RNA, 64 nt, Homo Sapiens
cagguguuaauauaauacuauuagaaaauaagugugaaaagaaugucacugcaauaaguggguu

SEQ ID NO: 93582 - RNA, 64 nt, Homo Sapiens
ccugaggcaaacacucucucacagugacugccucugaaaagagcaggcacgugacagugacaac

SEQ ID NO: 93583 - RNA, 64 nt, Homo Sapiens
ucaauugcuaauacccaguuacuuaugauuuaaaaacaaccaacagaaaacaucccacugacug

SEQ ID NO: 93584 - RNA, 64 nt, Homo Sapiens
aaaaauaaaaugaacaucucuugaaaccuguuaaaacaaccaguuaaagccacagauggcuuuc

SEQ ID NO: 93585 - RNA, 64 nt, Homo Sapiens
gauucaccaccuccaggaaaagugucuucucagaaacaaccagcugagaagguaauuaaagucu

SEQ ID NO: 93586 - RNA, 64 nt, Homo Sapiens
gagggaccaauaucugggacagugucuucucagaaacaaccagcugagaagguaauuaaagucu

SEQ ID NO: 93587 - RNA, 64 nt, Homo Sapiens
gguggugggaaaucuggaacagugucuucucagaaacaaccagccucaaagguaauuaaacucu

SEQ ID NO: 93588 - RNA, 64 nt, Homo Sapiens
gauggacuacagugugggacagugucuucucagaaacaaccagccuugaagguaauuaaacucu

SEQ ID NO: 93589 - RNA, 64 nt, Homo Sapiens
gauggagaaaaaucugggacagugucuucucagaaacaaccagccuugaagguaauuaaacucu

SEQ ID NO: 93590 - RNA, 64 nt, Homo Sapiens
gggaauggugagaccugauauuauccaaaggcucaacaaccagacuccauagccauguggauuu

SEQ ID NO: 93591 - RNA, 64 nt, Homo Sapiens
auaacauuaauaauagaaaaaacuuuuauuuuaaaacaaccacauuggucauauauacauucag

SEQ ID NO: 93592 - RNA, 64 nt, Homo Sapiens
aaaugccuugcugauucacuauacuuuuuuaaacaacaaccaaaacuguuucuauaaggaaaua

SEQ ID NO: 93593 - RNA, 64 nt, Homo Sapiens
uuugucacagaaauuuaguuauuuuaaaaacaacaacaaccauaaacuauaucauguucucggu

SEQ ID NO: 93594 - RNA, 64 nt, Homo Sapiens
uaguugguguaaaaaacuuuagcuaguggcugugaacaaccauuuuguaguucauauguacacc

SEQ ID NO: 93595 - RNA, 64 nt, Homo Sapiens
uguaagagauguggagucuucgguguuuaaagucaacaaccaugccagggauugaggaggacua

SEQ ID NO: 93596 - RNA, 64 nt, Homo Sapiens
cuaauuauauaguauaccauacauuaucauucaaaacaaccauccugcucauaacaucuuugaa

SEQ ID NO: 93597 - RNA, 64 nt, Homo Sapiens
uaugauguaccgggagccagcacgaugguccuacacauuccagacauuuuccuuuuugagccgc

SEQ ID NO: 93598 - RNA, 64 nt, Homo Sapiens
gcuucuuauaggcuccacuuugaggcucugaugaacauuccagugcugguguuggaugucaaug

SEQ ID NO: 93599 - RNA, 64 nt, Homo Sapiens
aaagacagaggauuguccuuaagucccugcuaaaacauuccauuguuaaaauuugcacuuugaa

SEQ ID NO: 93600 - RNA, 64 nt, Homo Sapiens
caguuuuguacaaugaaaauuacuaauuuguuugacauuccauguuaaacuacggucauguuca

SEQ ID NO: 93601 - RNA, 64 nt, Homo Sapiens
uucaaggucaaagugcauggccagcuccauugagacauuccauuucaaagcaccgugcugacag

SEQ ID NO: 93602 - RNA, 64 nt, Homo Sapiens
ucuuugacugucuuauuuauuauaaccuuucagcacauuccaagguuuuaguuacucaggaagg

SEQ ID NO: 93603 - RNA, 64 nt, Homo Sapiens
caaagcaccuuuaaaaaaaauacauuuuaaaaaaacauuccaagccaauuggaagacaucauug

SEQ ID NO: 93604 - RNA, 64 nt, Homo Sapiens
ugcuaccuagaaaucuuuuccauuccucuuucauacauuccaacccacuggaagucuuuagagg

SEQ ID NO: 93605 - RNA, 64 nt, Homo Sapiens
gaguugccaguggcacauuacaccaguacagagcacauuccaaaggagacauuggaccaguuaa

SEQ ID NO: 93606 - RNA, 64 nt, Homo Sapiens
uugucauucacaucucacaaaaucuugacaucuuacauuccaauacauuaucaagcaagcacaa

SEQ ID NO: 93607 - RNA, 64 nt, Homo Sapiens
gcccugguuuuccugcuugaucaggcuuauuucaacauuccaaugccacugaaucaaguguauu

SEQ ID NO: 93608 - RNA, 64 nt, Homo Sapiens
cccaugaggggaaagaggauaacuaguaaaccugacauuccaggggggcccccacuuuuuacca

SEQ ID NO: 93609 - RNA, 64 nt, Homo Sapiens
uuaaguccagagaguaaacuugaauggaauaacgacauuccagaaguuaaucauuugaauucug

SEQ ID NO: 93610 - RNA, 64 nt, Homo Sapiens
auuuguaaacuaauaaagguaaucacagccaccaacauuccaagcuacccuggguaccuuugug

SEQ ID NO: 93611 - RNA, 64 nt, Homo Sapiens
cuugaaccuagccgacgguuauggaaacccauugacauuccaaaacaauauauacacauaacua

SEQ ID NO: 93612 - RNA, 64 nt, Homo Sapiens
gcaaaagucuagaagauggguaucaaaacagaagacauuccaggagcuagcaauuuuaagaggu

SEQ ID NO: 93613 - RNA, 64 nt, Homo Sapiens
gauuuaauuugugauaccuuuguauguaugagacacauuccaaagagcucuaacuaugauaggu

SEQ ID NO: 93614 - RNA, 64 nt, Homo Sapiens
auacccaucuucagugucuuacuuguacuguaucacauuccauacccucauuuaauucuuaaua

SEQ ID NO: 93615 - RNA, 64 nt, Homo Sapiens
aagaacucaauuugucucccaccagcgauaggccacauuccaguauuccauuucagauuuguca

SEQ ID NO: 93616 - RNA, 64 nt, Homo Sapiens
ucagauuugucaaccagcgaacugccauuuggagacauuccauugggagggcggaaagggaggc

SEQ ID NO: 93617 - RNA, 64 nt, Homo Sapiens
aucugaacccgcagcgcccccaucugucuucagcacauuccacggcaucgcauccguccugggc

SEQ ID NO: 93618 - RNA, 64 nt, Homo Sapiens
ucacauccuccugcccagcuccucacauacccacacauuccagggcuggggugagccugacugc

SEQ ID NO: 93619 - RNA, 64 nt, Homo Sapiens
uuuuggucuuuuugucuuuuagaucucggaggcuacauuccauuugguaaauuuuuagagaccc

SEQ ID NO: 93620 - RNA, 64 nt, Homo Sapiens
uauguaugcauauauguauuuuccacauauguauacauuccaugacauuccacguguguauaua

SEQ ID NO: 93621 - RNA, 64 nt, Homo Sapiens
uguguauauauuccacauauguccccauauguauacauuccacgacauuccacguguguauaua

SEQ ID NO: 93622 - RNA, 64 nt, Homo Sapiens
uguguauauaguccccauauuuccacauauguauacauuccacgauguauuccacauguauaua

SEQ ID NO: 93623 - RNA, 64 nt, Homo Sapiens
gucugcacugcgccuggugacagcgcccacaugggcaugagacacaucuguacaggaagcaucc

SEQ ID NO: 93624 - RNA, 64 nt, Homo Sapiens
ucuguacaggaagcaucccaauguguaacugaaggcaugagacaaacuguaaacaggaacaccu

SEQ ID NO: 93625 - RNA, 64 nt, Homo Sapiens
cccuggacguuuuucugcucgugucuauaggaaugcaugagagauucuuauuccacccuuucug

SEQ ID NO: 93626 - RNA, 64 nt, Homo Sapiens
uucccgggccauccaagcccggugcuuccguggggcaugagaauuggagaaauguaugcgccag

SEQ ID NO: 93627 - RNA, 64 nt, Homo Sapiens
uucucagauggucccuuccauuccccugaaaccugcaugagagcuccuaacauguuucuccaau

SEQ ID NO: 93628 - RNA, 64 nt, Homo Sapiens
acuguugcuauguguagagggugcucagagcguggcaugagagcaaggagaccauggcuacucu

SEQ ID NO: 93629 - RNA, 64 nt, Homo Sapiens
caguugguuuucaguaaagcacaccaacaugagacaucaguaguauucaaaaagaauuuuaaau

SEQ ID NO: 93630 - RNA, 64 nt, Homo Sapiens
cgaucuugaagaaauucaaguauuccugaaggaacaucaguaccagauuuccccccuuuuguuu

SEQ ID NO: 93631 - RNA, 64 nt, Homo Sapiens
augauuccucuguacuuucccucgcacuacaaugcaucaguauuuuccuuuuuaauuuaaugug

SEQ ID NO: 93632 - RNA, 64 nt, Homo Sapiens
uuuauuauuauuauuguuaucccgcacuaccauacaucaguauuuaauacauuuuaaaaaggug

SEQ ID NO: 93633 - RNA, 64 nt, Homo Sapiens
cuagcuuuuuauuaauccauagcaaugaguauaucaucaguacauucuaguuugacaauuagua

SEQ ID NO: 93634 - RNA, 64 nt, Homo Sapiens
aguugucaaauuuaaaauguuggacucuuccucucaucaguacuccuccacagucuuuccaagu

SEQ ID NO: 93635 - RNA, 64 nt, Homo Sapiens
uuugaagugauuugcaguuacucaucugagacagcaucaguauuugacuaaaucauuguuucac

SEQ ID NO: 93636 - RNA, 64 nt, Homo Sapiens
caaccugaccauacugcuuucaaaagucuuuucucaucaguagaaucuauuuuggucacuucua

SEQ ID NO: 93637 - RNA, 64 nt, Homo Sapiens
aagggccaaagagguauaguagucacagguuuuuacaguccagcuggauaagaggaaauaguuu

SEQ ID NO: 93638 - RNA, 64 nt, Homo Sapiens
uaauuagucaaauuagcaauauucaaaaggugucacaguccacuuauauaaauaaucuauaggg

SEQ ID NO: 93639 - RNA, 64 nt, Homo Sapiens
aggggaagugcccauuguaaaaacacauccacagacaguccaggcacuaaggcugaaugggauc

SEQ ID NO: 93640 - RNA, 64 nt, Homo Sapiens
aacauaauuugaaauuuguccaugguauguaugaacaguccauuuuaaaauuacugagucauau

SEQ ID NO: 93641 - RNA, 64 nt, Homo Sapiens
uggaagagcgggaacgagagauucgccagauuguacaguccauuucugaccugaaugaaauauu

SEQ ID NO: 93642 - RNA, 64 nt, Homo Sapiens
uggggcuguccacauuagggaacuugccucaaaaacaguccacaguggcaauaccggacuucug

SEQ ID NO: 93643 - RNA, 64 nt, Homo Sapiens
ggacuugagcagagggaacgaccugacuuacuugcacugugaucccccuugcuccgcccacugu

SEQ ID NO: 93644 - RNA, 64 nt, Homo Sapiens
gacuuacuugcacugugaucccccuugcuccgcccacugugaccuugaaccccaugcacuguga

SEQ ID NO: 93645 - RNA, 64 nt, Homo Sapiens
ccuugcuccgcccacugugaccuugaaccccaugcacugugaccuccccccuucucccccuucc

SEQ ID NO: 93646 - RNA, 64 nt, Homo Sapiens
caugcacugugaccuccccccuucucccccuucccacugugauuggcacaucgacaagggcugu

SEQ ID NO: 93647 - RNA, 64 nt, Homo Sapiens
cuaugugggugacccuguggaagugagaaggagucacugugaugcuuagcuguccuaaaugaug

SEQ ID NO: 93648 - RNA, 64 nt, Homo Sapiens
cuggagugcugugagcuguccguggugcugaauucacugugacgucacuccugucucucuuugc

SEQ ID NO: 93649 - RNA, 64 nt, Homo Sapiens
uagguuagccagagacagguuuucauuaucaggucacugugaaaucugguaaggcaguccugag

SEQ ID NO: 93650 - RNA, 64 nt, Homo Sapiens
gagcucacugcaaacaacuggaauugagguugcacacugugauuuuuacaccgaaaagccaaaa

SEQ ID NO: 93651 - RNA, 64 nt, Homo Sapiens
uugugccucagaucauccaccugugugaguccaucacugugaaauugacuguguccaugugaug

SEQ ID NO: 93652 - RNA, 64 nt, Homo Sapiens
cagauuucugagucguacuaugguuuugccuugucacugugaggcccuacuagguguaagcauu

SEQ ID NO: 93653 - RNA, 64 nt, Homo Sapiens
uuuuugcauguguucugauaaaaaucaauucuagcacugugaagcuucagacaccuugaaaguc

SEQ ID NO: 93654 - RNA, 64 nt, Homo Sapiens
uaaaucucuccaucugcauuaguauuuuaaggagcacugugagagaaaucacaaaguauuagag

SEQ ID NO: 93655 - RNA, 64 nt, Homo Sapiens
gggugccccugccuccagcagagcccccaccauucacugugacaucuuuccgugucacccugcc

SEQ ID NO: 93656 - RNA, 64 nt, Homo Sapiens
agccuggcggccauggggccugccgugccugccccacugugacccacaggccugggugguguac

SEQ ID NO: 93657 - RNA, 64 nt, Homo Sapiens
caauggaucccuacaggggggcacuggagaggugcacugugagaaggugcaguguccccggcug

SEQ ID NO: 93658 - RNA, 64 nt, Homo Sapiens
cuguaucaccugcagauguggggcaggggugccucacugugagcgggaugacuguucacugcca

SEQ ID NO: 93659 - RNA, 64 nt, Homo Sapiens
ucccaggcuggagugcagugacacaaucucagcucacugugaccuccgccuccuggguucaaga

SEQ ID NO: 93660 - RNA, 64 nt, Homo Sapiens
uucuuguguucuguagacugccaucauugaugaucacugugaaaauugaccaagugauguguuu

SEQ ID NO: 93661 - RNA, 64 nt, Homo Sapiens
uuacagaugucuuuuugucauauuuguaaaauaucacugugaauacccuguguacaauuuaaaa

SEQ ID NO: 93662 - RNA, 64 nt, Homo Sapiens
gcacagcgguuuccuucuucucuuggcucuuuuucacugugacugaccuaaggagcuguccagu

SEQ ID NO: 93663 - RNA, 64 nt, Homo Sapiens
aggccuuugagcucuugucaggccucccgggagccacugugaccgaggacaguggguguguacu

SEQ ID NO: 93664 - RNA, 64 nt, Homo Sapiens
ccuucucagcaggcacauguucuccacaguccugcacugugauucauccuuuucuucagaccac

SEQ ID NO: 93665 - RNA, 64 nt, Homo Sapiens
gcauugcauuuacaaaacaaggaaaaugcuguaaauauugcauauuuuauguauuuggaccaaa

SEQ ID NO: 93666 - RNA, 64 nt, Homo Sapiens
uagcacuuaaauauaucugauagcaacacuuaagauauugcauggggauuacuuuccuaucauc

SEQ ID NO: 93667 - RNA, 64 nt, Homo Sapiens
uuggugccaucagugauuuacaaacaauauuuugauauugcagaugacuugcuuacuguauuug

SEQ ID NO: 93668 - RNA, 64 nt, Homo Sapiens
gauagguaaauauaguuuuauugucacaugcuaaauauugcaugcauauugacuaauuggaaua

SEQ ID NO: 93669 - RNA, 64 nt, Homo Sapiens
cagcuuauugaaauaguauugauuuagaaaaaguauauugcauuucuaaaaaacaucuaccaag

SEQ ID NO: 93670 - RNA, 64 nt, Homo Sapiens
uggcauuaucaaaauauuugaugauguuucagauauauugcaaagucuguauuccagcucuuaa

SEQ ID NO: 93671 - RNA, 64 nt, Homo Sapiens
auacacagaccagcuauaauuugcuaaacauaaaauauugcaguguauuagccggcuguggcuc

SEQ ID NO: 93672 - RNA, 64 nt, Homo Sapiens
guucuguguuuccuacggaaauaagaaacgauaaauauugcacugaauguuugugguuuggagu

SEQ ID NO: 93673 - RNA, 64 nt, Homo Sapiens
auuuuuuuaagauggcaugugcuuugaaaagaagauauugcauuuuuaagaguuuaaaaaucuu

SEQ ID NO: 93674 - RNA, 64 nt, Homo Sapiens
aaaaaaauagaaauugaaggauuuuuaugaaauuauauugcauuacuauuugcagucaaacuuu

SEQ ID NO: 93675 - RNA, 64 nt, Homo Sapiens
guaacaucaccucaauuuuuuauuauccuuaaagauauugcauuuucauauucuuuauuuauaa

SEQ ID NO: 93676 - RNA, 64 nt, Homo Sapiens
aaagcaagucauacacauuuccacaauaaugugaauauugcaaugcaggcuccacuccagauca

SEQ ID NO: 93677 - RNA, 64 nt, Homo Sapiens
cuccacuccagaucaccacagacacaccucagagauauugcaggauaugugaugagcacauaca

SEQ ID NO: 93678 - RNA, 64 nt, Homo Sapiens
uugucuuuuggccauaagugggaaaguuuucuguauauugcauagcauuacacauuuaugccua

SEQ ID NO: 93679 - RNA, 64 nt, Homo Sapiens
cuucaugcagaauuuugaaauguuuucaguuuguauauugcauauucacaugaucauuguucac

SEQ ID NO: 93680 - RNA, 64 nt, Homo Sapiens
caaggcuagcgaggcauacuacuaauucagaggaacagcauagcauuggaaaagccagccauuu

SEQ ID NO: 93681 - RNA, 64 nt, Homo Sapiens
gcacagcgcccuacuucccccagaagcugauuuaacagcauagaugggcuugucugggcagaga

SEQ ID NO: 93682 - RNA, 64 nt, Homo Sapiens
uagaaaaaugcacauuuuucuuuguauuuucuuuacagcauagauaaugccaaaaugcucuggc

SEQ ID NO: 93683 - RNA, 64 nt, Homo Sapiens
uaagucuugugaaacuguauccucccuguuguuuacagcauauuggugugacaggcucuagucu

SEQ ID NO: 93684 - RNA, 64 nt, Homo Sapiens
uuuacaauuuaauaaugugauauuuccuaugucuacagcauaccuuauuagguauaaaaccuac

SEQ ID NO: 93685 - RNA, 64 nt, Homo Sapiens
cucagauguucuaauucucuuuguaugcuuggaaacagcauagauauguugcugugguuuucag

SEQ ID NO: 93686 - RNA, 64 nt, Homo Sapiens
cgggccugaagcagaucagagggcuuugcaaaagacagcauagagccaucuuccugcaacuuua

SEQ ID NO: 93687 - RNA, 64 nt, Homo Sapiens
ccucccggguucaagcgauucuucugcugggauuacagcauaugccaccaugcccagauuauuu

SEQ ID NO: 93688 - RNA, 64 nt, Homo Sapiens
aaguuagcaaaccacuccuuuagagggauccacuacucaagaaauuuccacgugagguuuuguu

SEQ ID NO: 93689 - RNA, 64 nt, Homo Sapiens
cuccguaccuccccugggcggggcuucccaagaaacucaagagccugccuuugcaaggacuacu

SEQ ID NO: 93690 - RNA, 64 nt, Homo Sapiens
ugcugcuuaguuuuuggacugaaaagauauuaaaacucaagaaggaccaagaaguuuucauaug

SEQ ID NO: 93691 - RNA, 64 nt, Homo Sapiens
aacuaguuaaaagcuucuauuuuccucuuugaacacucaagauugcauggcaaagacccaguca

SEQ ID NO: 93692 - RNA, 64 nt, Homo Sapiens
ccauuuauggcaugauuagauugcaaagcaaugaacucaagaaggaauugaaauaaggagggac

SEQ ID NO: 93693 - RNA, 64 nt, Homo Sapiens
uucuuugguacacaguucugguguuccuaccaggacucaagagacaccccuuccugcugacauu

SEQ ID NO: 93694 - RNA, 64 nt, Homo Sapiens
guccauuuuccuuccuggggccauuggggaugacacucaagauacuugccagucucuccagugu

SEQ ID NO: 93695 - RNA, 64 nt, Homo Sapiens
ucccacgugggcaauaccagggacccauggggaaacucaagaaugacagcuucuauauuuugua

SEQ ID NO: 93696 - RNA, 64 nt, Homo Sapiens
agcagguaugugggccagagccacagacuaccccacucaagaacgccuuucuacaaagcaaggc

SEQ ID NO: 93697 - RNA, 64 nt, Homo Sapiens
uucgagagccaguguugucagucggccauugaaaacucaagagcgauagcuuccugggugcaga

SEQ ID NO: 93698 - RNA, 62 nt, Homo Sapiens
ucauuuugagagccuccaacugauccaagugucauccggaggaggagguggcccguaugugc

SEQ ID NO: 93699 - RNA, 54 nt, Homo Sapiens
aagcccuagaaccaagauagaugccauccggaucccugugcucuaucucagugc

SEQ ID NO: 93700 - RNA, 62 nt, Homo Sapiens
aaugcuuuuagaagcuaagcuguggcucaacucauccggacacacaccuggauucagcaaug

SEQ ID NO: 93701 - RNA, 62 nt, Homo Sapiens
ccuggucagcauagccgcccgcccagcuuccacauccggagcguccccugcaaggaggcagg

SEQ ID NO: 93702 - RNA, 62 nt, Homo Sapiens
agaagaaggaaaugaauuucgcuuccauuccacauccggaggcuacuuuuccuucccucaaa

SEQ ID NO: 93703 - RNA, 51 nt, Homo Sapiens
gaagauacaaagucuuauagacauccggaaaaaagauuuuuaccugugcug

SEQ ID NO: 93704 - RNA, 62 nt, Homo Sapiens
ucuucaguuccccagucucgggggccugguaacauccggagccaagacuuguggacagcacu

SEQ ID NO: 93705 - RNA, 62 nt, Homo Sapiens
agggccuucuacauggaggacugcaagacgcccauccggaaccacugcuuuaccugugcugc

SEQ ID NO: 93706 - RNA, 62 nt, Homo Sapiens
uggacucggggccaugggcugcccggaccuggcauccggacuccaguagggccgugggcucg

SEQ ID NO: 93707 - RNA, 62 nt, Homo Sapiens
ucccaacgcaugcuccuggauuaaaccccggucauccggacauaucgagaauaggaaaaccu

SEQ ID NO: 93708 - RNA, 62 nt, Homo Sapiens
uguagagggcuguaacagugaccucgcacggucauccggaguacuaagccccaguaaggugu

SEQ ID NO: 93709 - RNA, 62 nt, Homo Sapiens
uacaacucgcagcaccggucagcaaucagcugcauccggacgguguggaggaccgagggguu

SEQ ID NO: 93710 - RNA, 62 nt, Homo Sapiens
cggcucugugcgggccgcacccuggacggccccauccggacgcugaagcugccguugccgcg

SEQ ID NO: 93711 - RNA, 62 nt, Homo Sapiens
cuuuccccucgacccaguggugugacucuuggcauccggagaccucacccuguucggcccuu

SEQ ID NO: 93712 - RNA, 62 nt, Homo Sapiens
auugccucuaccuggaccuucugcccugccugcauccggagagcacucugcccagugagcac

SEQ ID NO: 93713 - RNA, 62 nt, Homo Sapiens
acucgguggcccaggcaggaggugaaagcagccauccggaaggcccuggggacccuugugcc

SEQ ID NO: 93714 - RNA, 62 nt, Homo Sapiens
uuuucccuaugacuuuauaugguuugggacagcauccggaaguucuaaauugaauauuccac

SEQ ID NO: 93715 - RNA, 62 nt, Homo Sapiens
gaugccagccacccccacauuguuucaucugacauccggauauacuacaguggaacuguuuc

SEQ ID NO: 93716 - RNA, 62 nt, Homo Sapiens
ccugcugcccucucacaggacugccuucagggcauccggagcuuccugaggacacaccagca

SEQ ID NO: 93717 - RNA, 62 nt, Homo Sapiens
ccagcaagcgagcuuuagcaucucugcagaggcauccggaucugaacucugaaccaccuuug

SEQ ID NO: 93718 - RNA, 62 nt, Homo Sapiens
cuucggaccccacgccucuguuguguaucugucauccggauguaggcauauugcugucccuu

SEQ ID NO: 93719 - RNA, 62 nt, Homo Sapiens
ugauaacacgcaaaaucacaccccuuuuagagcauccggaaguuuauugagguuuuuuuccc

SEQ ID NO: 93720 - RNA, 62 nt, Homo Sapiens
ucugguuguggcccagcaauuuucucucccaucauccggauuaucauuauccuaaagaagug

SEQ ID NO: 93721 - RNA, 62 nt, Homo Sapiens
gcccaguuuucugaaacccaguacugcaugaacauccggaugauaguaugguggugaaacuu

SEQ ID NO: 93722 - RNA, 62 nt, Homo Sapiens
uccucuuccagggacuggggcuggugggaugacauccggacauuaguccacgaucauuccaa

SEQ ID NO: 93723 - RNA, 62 nt, Homo Sapiens
ugccuaagaugcauguccagucaucccaccuccauccggagugguaucugccccgggcuccc

SEQ ID NO: 93724 - RNA, 62 nt, Homo Sapiens
ggguguagacgccaagacucacgcaugugugacauccggaguccuggagccgggugucccag

SEQ ID NO: 93725 - RNA, 62 nt, Homo Sapiens
ccggggcucaacacacaggcuguggcucuggacauccggauauuaaaaggagcguugcugga

SEQ ID NO: 93726 - RNA, 62 nt, Homo Sapiens
caccuaacagcaacacuggggagagccuggagcauccggacuugcccuaugggagaggggac

SEQ ID NO: 93727 - RNA, 62 nt, Homo Sapiens
ucgcugugcccugguugagggggagugcgcugcauccggaagcgucgucggagggauuacug

SEQ ID NO: 93728 - RNA, 62 nt, Homo Sapiens
accagcaccucacugcaucuccuguguaaagccauccggaaccuggcggcccucacuuuucu

SEQ ID NO: 93729 - RNA, 62 nt, Homo Sapiens
gaggcgacuguccugcguggguguguccauggcauccggagcgaauagugccguggaggugu

SEQ ID NO: 93730 - RNA, 62 nt, Homo Sapiens
gguguguuuaugaaggauggcaggauaaaggacauccggauaugacaugauucuugaagacc

SEQ ID NO: 93731 - RNA, 62 nt, Homo Sapiens
cuacucccuacuuaagggaauaggccaggcuccauccggaggcagggaccaugccaggagga

SEQ ID NO: 93732 - RNA, 62 nt, Homo Sapiens
cuuuggaggggagucuggcagaaaagcguaggcauccggaggcaaacuuuccucuaugucug

SEQ ID NO: 93733 - RNA, 62 nt, Homo Sapiens
uuguccgccugucugaggggagcccagaggcacauccggacaaguuucagauaacccguggg

SEQ ID NO: 93734 - RNA, 62 nt, Homo Sapiens
aggaugggauuagcgaagcuguggagacugcacauccggaccugcccaugucucaaaacaaa

SEQ ID NO: 93735 - RNA, 62 nt, Homo Sapiens
cgccaaggggaaguaaggcagggagaaaggaacauccggaacagccaaagaaacucagaaga

SEQ ID NO: 93736 - RNA, 62 nt, Homo Sapiens
uucaacaagggugcagccugccacaggcuccucauccggacugaggaagacgaggacaggga

SEQ ID NO: 93737 - RNA, 62 nt, Homo Sapiens
cccauuguauuuauuugccugcuggaaaaucacauccggaaauaaaauagaaauaugucuuu

SEQ ID NO: 93738 - RNA, 62 nt, Homo Sapiens
cuggggcagaucccagagggguuccugcgccacauccggaagcgagccuucaaugccaccuc

SEQ ID NO: 93739 - RNA, 64 nt, Homo Sapiens; identical to SEQ ID NO: 58780

SEQ ID NO: 93740 - RNA, 64 nt, Homo Sapiens; identical to SEQ ID NO: 58781

SEQ ID NO: 93741 - RNA, 64 nt, Homo Sapiens; identical to SEQ ID NO: 58782

SEQ ID NO: 93742 - RNA, 54 nt, Homo Sapiens; identical to SEQ ID NO: 58783

SEQ ID NO: 93743 - RNA, 64 nt, Homo Sapiens; identical to SEQ ID NO: 58784

SEQ ID NO: 93744 - RNA, 64 nt, Homo Sapiens; identical to SEQ ID NO: 58785

SEQ ID NO: 93745 - RNA, 64 nt, Homo Sapiens; identical to SEQ ID NO: 58786

SEQ ID NO: 93746 - RNA, 64 nt, Homo Sapiens; identical to SEQ ID NO: 58787

SEQ ID NO: 93747 - RNA, 64 nt, Homo Sapiens; identical to SEQ ID NO: 58788

SEQ ID NO: 93748 - RNA, 64 nt, Homo Sapiens; identical to SEQ ID NO: 58788

SEQ ID NO: 93749 - RNA, 64 nt, Homo Sapiens; identical to SEQ ID NO: 58790

SEQ ID NO: 93750 - RNA, 64 nt, Homo Sapiens; identical to SEQ ID NO: 58791

SEQ ID NO: 93751 - RNA, 64 nt, Homo Sapiens; identical to SEQ ID NO: 58792

SEQ ID NO: 93752 - RNA, 64 nt, Homo Sapiens; identical to SEQ ID NO: 58793

SEQ ID NO: 93753 - RNA, 64 nt, Homo Sapiens; identical to SEQ ID NO: 58794

SEQ ID NO: 93754 - RNA, 64 nt, Homo Sapiens; identical to SEQ ID NO: 58795

SEQ ID NO: 93755 - RNA, 64 nt, Homo Sapiens; identical to SEQ ID NO: 58796

SEQ ID NO: 93756 - RNA, 63 nt, Homo Sapiens
guaugaaguuuuaaaaaaaacuacagcagccaaagaaacuauauauauauauauauauauaua

SEQ ID NO: 93757 - RNA, 63 nt, Homo Sapiens
gucccauuuucacauuagggcuuuaaaugaauuagaaacuauuugaggcuauaaaaauguccu

SEQ ID NO: 93758 - RNA, 63 nt, Homo Sapiens
acauaaaugaaaagaaacacuuuauuacauugaagaaacuaaauugagauguucauagcaugu

SEQ ID NO: 93759 - RNA, 63 nt, Homo Sapiens
uggaaauauauguaauucucuugcuggcacgaaagaaacuagaugcuugaaaccacaaaaguu

SEQ ID NO: 93760 - RNA, 63 nt, Homo Sapiens
aauagcucuauuucucugccuugcuagauaaauagaaacuaauugauuuuuuguuuuccucug

SEQ ID NO: 93761 - RNA, 63 nt, Homo Sapiens
uuaggguauguuuaguugguagauuuagucaacagaaacuauugacaaugaaugaacuaugaa

SEQ ID NO: 93762 - RNA, 63 nt, Homo Sapiens
uccguaaugaauggaauucaguaaguauuuagcagaaacuaacaggggucugcucuagcauca

SEQ ID NO: 93763 - RNA, 63 nt, Homo Sapiens
acauuugugaaaauuguguuuuuuuuaacaaaaagaaacuaguugaaaccuaauccuaccccc

SEQ ID NO: 93764 - RNA, 63 nt, Homo Sapiens
cauuccauugaacuaagaaguaccuccaaguucagaaacuagaaaaauaaagaaaagaugauu

SEQ ID NO: 93765 - RNA, 63 nt, Homo Sapiens
gggaaagcuuugccugagacugcuguugcuuccagaaacuaaacuugguugcuggaggucugg

SEQ ID NO: 93766 - RNA, 62 nt, Homo Sapiens
aagguauggucgauggauaaauaguuauuuuaagaaacuaauuccacugaaccuaaaaucau

SEQ ID NO: 93767 - RNA, 63 nt, Homo Sapiens
ugaaaauuagagcaaagugcuccuguuuuuuagagaaacuaaaucuugcuguugaacaauuau

SEQ ID NO: 93768 - RNA, 63 nt, Homo Sapiens
cucagauuggcaguuaaaguuccaaauuucugaagaaacuaauaaaggcaacguuuugcagcu

SEQ ID NO: 93769 - RNA, 63 nt, Homo Sapiens
gucauaauugucacuggaguauagauuucuuccagaaacuauuugcuucccaaagcuauaguc

SEQ ID NO: 93770 - RNA, 63 nt, Homo Sapiens
uaauccuuaauaaauaaaucgagauuuuuaugcagaaacuaaaaacccaaugaggaacaauug

SEQ ID NO: 93771 - RNA, 63 nt, Homo Sapiens
uaccguguguauucucuugaauuuuccaaccuaagaaacuaccauuauuuccuucagggacag

SEQ ID NO: 93772 - RNA, 63 nt, Homo Sapiens
guaaggauacauuuggaagaacauacaguauucagaaacuaaccuauauaaaauguaaacaau

SEQ ID NO: 93773 - RNA, 63 nt, Homo Sapiens
gcauuaccucagggaaaagccuugacagugaaaagaaacuacuuaaucgcuaauagcuagucu

SEQ ID NO: 93774 - RNA, 63 nt, Homo Sapiens
gcugcaagaauguauuuuuuuugcagcaguaagagaaacuagugagguuuuguuucaccuguu

SEQ ID NO: 93775 - RNA, 63 nt, Homo Sapiens
uucaucagucacucauuuuuuuuaaucaagucuagaaacuaugucuuugguuuccuguaucuu

SEQ ID NO: 93776 - RNA, 63 nt, Homo Sapiens
aaagccacauuuacuuuaagaaguacauucuuuagaaacuaacuuaaaaaaguaaaacaagaa

SEQ ID NO: 93777 - RNA, 63 nt, Homo Sapiens
gguguucuuuuaggcguuuugacacagaaaggaagaaacuagcgagaugggguggccugcagu

SEQ ID NO: 93778 - RNA, 63 nt, Homo Sapiens
uauuaccucauuuuuaagccuguaugagaauguagaaacuauauauuauauguauauuuauuu

SEQ ID NO: 93779 - RNA, 63 nt, Homo Sapiens
uacaucaucuacagaaaucuugaucaauaaccuagaaacuagguuaucuagguuauugaucaa

SEQ ID NO: 93780 - RNA, 63 nt, Homo Sapiens
aguucugguaaacgguccaguuagggagggaguagaaacuauugacucaaaagaguuucuggc

SEQ ID NO: 93781 - RNA, 63 nt, Homo Sapiens
cgauucguuugaaagagaguaagaugcauuaacagaaacuauccugggauuaggugaaaaaug

SEQ ID NO: 93782 - RNA, 64 nt, Homo Sapiens
agggccugagcagcuggaucugguacaaagcaaucggacauagaguuggagggggaggccccug

SEQ ID NO: 93783 - RNA, 64 nt, Homo Sapiens
gauaaacuugguuaggacucgugucaggcugucacggacauaggacacggcucggugucagaug

SEQ ID NO: 93784 - RNA, 64 nt, Homo Sapiens
ggcauguuacugaaaucuuccuuugcgacuuucucggacauaucaacugccuuucucaugaaga

SEQ ID NO: 93785 - RNA, 64 nt, Homo Sapiens
uaaaagaggaaggguuucuugucccgggaagcaacggacauaaucuguucccagccauggccuu

SEQ ID NO: 93786 - RNA, 64 nt, Homo Sapiens
aaaauggagccaggcuuccaacuuccgcugccuucggacauagggacccaguucccaggagcgg

SEQ ID NO: 93787 - RNA, 64 nt, Homo Sapiens
auauguaaauaaaugacuucuacacauuauauaucggacauauacacugcaguauacauuuauc

SEQ ID NO: 93788 - RNA, 64 nt, Homo Sapiens
uguguuuccuuuggcuguucccuaauacaaaacacggacauauuuuuacucguagcacucaauu

SEQ ID NO: 93789 - RNA, 64 nt, Homo Sapiens
ccuacacugcauuccucaaaauuguuuucuuugucggacauacaacuuauuugucuaccgaauu

SEQ ID NO: 93790 - RNA, 64 nt, Homo Sapiens
uuggagaggaaaugaaccagaagaguggaucccucggacauaccaagauuuagacggucuaccu

SEQ ID NO: 93791 - RNA, 64 nt, Homo Sapiens
acgaaaauguguagacgcacucucaaaaacugcacggacauacaaaaucaaucuuuuccuuuga

SEQ ID NO: 93792 - RNA, 64 nt, Homo Sapiens
cagcaccauacaauauuucacauuugagacuuuccggacauacgaauguuugaacaaagacucc

SEQ ID NO: 93793 - RNA, 64 nt, Homo Sapiens
uuuccauuaaauaauuugcuaauggcucucauguauuuuggaauaacaaaguauauugaaugga

SEQ ID NO: 93794 - RNA, 64 nt, Homo Sapiens
uacauggaauuguuguaacacuacaaagcaucugauuuuggaagcaccauguugccaagcuagu

SEQ ID NO: 93795 - RNA, 64 nt, Homo Sapiens
gaaagcacaacuggguccuucaacuuuguugaggauuuuggaagacauuuucuuggagcacaaa

SEQ ID NO: 93796 - RNA, 64 nt, Homo Sapiens
uauagcacuugacuuuaugagauuucauaggauuauuuuggaaauaaaccuucacaaccuucau

SEQ ID NO: 93797 - RNA, 64 nt, Homo Sapiens
aaaagaaguuuuccauuugauacauuaaguucuuauuuuggauucuagaugaugcuuuguguga

SEQ ID NO: 93798 - RNA, 64 nt, Homo Sapiens
aaccaauugaaaacacacuuuuguugacacgaaaauuuuggagguucugacuuugccaaguaau

SEQ ID NO: 93799 - RNA, 64 nt, Homo Sapiens
uuggauuuuuggauuugggaucagauuuuggagcauuuuggauaucgaugcagugcucaaaauc

SEQ ID NO: 93800 - RNA, 64 nt, Homo Sapiens
auuuuggauauuggauuuuugcucaaaaucucagauuuuggagcuucauugaugucgaugcagu

SEQ ID NO: 93801 - RNA, 64 nt, Homo Sapiens
auuugcauuauauuuagcggcaauuuuuuuucagauuuuggaauauuagaaauguuucagauuu

SEQ ID NO: 93802 - RNA, 64 nt, Homo Sapiens
uuaguuuuguauaaauuauguuucaaaucuuuacauuuuggaaauaaucauugcuggagauucu

SEQ ID NO: 93803 - RNA, 64 nt, Homo Sapiens
uuggaaauaaucauugcuggagauucuguuaaauauuuuggaacucuuuuuuuuuuuaaauuau

SEQ ID NO: 93804 - RNA, 64 nt, Homo Sapiens
gaaaccugccaaucuguguagaucagagcuccaaauuuuggauuaucgggccugugcaagauug

SEQ ID NO: 93805 - RNA, 64 nt, Homo Sapiens
aaauucuuaagggugaaauaggccuauuuuugcuauuuuggacaaauaaaugauucuauaugug

SEQ ID NO: 93806 - RNA, 64 nt, Homo Sapiens
ugagguauuuuaugaguauuuauguauuugaauuauuuuggagauuuaaaaacguucauuuaau

SEQ ID NO: 93807 - RNA, 64 nt, Homo Sapiens
agggauacucagcuuguaccuucuggucccuagcauuuuggauaaaaccugaaauccaaaacac

SEQ ID NO: 93808 - RNA, 64 nt, Homo Sapiens
uccucaaagaugcuacaaaacuugaauauaacacauuuuggaaggcugacuaaccucgauucug

SEQ ID NO: 93809 - RNA, 64 nt, Homo Sapiens
agaaaucuuuguacugauguaaaugauuguaguuauuuuggauaguguuuugcuaacaaaagga

SEQ ID NO: 93810 - RNA, 64 nt, Homo Sapiens
ggacacuuaauuaugacaugagaaugaagaaauuauuuuggaaaaaaaaaaugaccuaauuuac

SEQ ID NO: 93811 - RNA, 64 nt, Homo Sapiens
uaauuacugaguucagccuuuugugaugacuuauauuuuggacuuacauuuuaacuuuaaagaa

SEQ ID NO: 93812 - RNA, 64 nt, Homo Sapiens
uggcuuuuucccauugugaagcauugaauaucacauuuuggaacauguuauagggugagucccu

SEQ ID NO: 93813 - RNA, 64 nt, Homo Sapiens
cucuuacuaacaauuuuuauacagaaaaugagucauuuuggaaaugauucuuauguuuuuuuuu

SEQ ID NO: 93814 - RNA, 64 nt, Homo Sapiens
cucuucuguguuucgauuuuugaucaauucuuuaauuuuggaagccuauaauacaguuuucuau

SEQ ID NO: 93815 - RNA, 64 nt, Homo Sapiens
gccccccucucaaacccccaacccaaaaccaagcauuuuggaaugagucuccuuuaguuucaga

SEQ ID NO: 93816 - RNA, 64 nt, Homo Sapiens
acaaaccaaaacugaauaaagucuuugaggaaacauuuuggaaacuucacaugcauuccgcuug

SEQ ID NO: 93817 - RNA, 64 nt, Homo Sapiens
agacugaggcuugcagaauuaagguucaggggaaauuuuggaaaguugguuguauuuucauuga

SEQ ID NO: 93818 - RNA, 64 nt, Homo Sapiens
cuuaauuuucauguguacacgcaccaguguuaaaauuuuggagucauggaggcacaucuucagg

SEQ ID NO: 93819 - RNA, 64 nt, Homo Sapiens
uggggaauagcgccauauauuuauuaaguaaagcauuuuggaaaaaaaaagggaguaccaggau

SEQ ID NO: 93820 - RNA, 64 nt, Homo Sapiens
gagaauuugaaguuaaaugcucuuuccuugcaauauuuuggaugucugauucaaugugaaucca

SEQ ID NO: 93821 - RNA, 64 nt, Homo Sapiens
auguuaaguugaaguaaaaguacaggaaagcaauauuuuggaguuaauauuuccuuugauauua

SEQ ID NO: 93822 - RNA, 64 nt, Homo Sapiens
uaugguagccagaugauaaauacuacuggaccuuauuuuggaacgagcuugcugugcuucaaac

SEQ ID NO: 93823 - RNA, 64 nt, Homo Sapiens
agaggucagugcuagaauaaaguccuguagguuuauuuuggaagggacuguggccaggguaguu

SEQ ID NO: 93824 - RNA, 64 nt, Homo Sapiens
ugucauuacagcaagggcaguuuggggguaaagcauuuuggaggaauaaccuuaaaaaguuaaa

SEQ ID NO: 93825 - RNA, 64 nt, Homo Sapiens
aggaguucuggugacaagcucaauuaauagugauauuuuggacauuauaggacuuugccucgua

SEQ ID NO: 93826 - RNA, 64 nt, Homo Sapiens
accagauucauagucaugaagauuugggaacccaauuuuggaaaguugaaacauuuagaaacug

SEQ ID NO: 93827 - RNA, 64 nt, Homo Sapiens
auuuggucccaguuggguacauuuuaaaauccugauuuuggagacuuaaaaccagguuaauggc

SEQ ID NO: 93828 - RNA, 64 nt, Homo Sapiens
uuaggugguuuauaguucuuuuggcuaacaaaucauuuuggaaauaaagauuuuuuacuacaaa

SEQ ID NO: 93829 - RNA, 64 nt, Homo Sapiens
ugauuaugcagcauuugaauccaacaaagacuacauuuuggaauccaguggaaucuuuaaucuu

SEQ ID NO: 93830 - RNA, 64 nt, Homo Sapiens
uagugggacauuuuuagacuuugaugcucuagccauuuuggauuguguaaguugcagauguggc

SEQ ID NO: 93831 - RNA, 64 nt, Homo Sapiens
uugcaaggugcauuuuuacuauuuucagugaguaauuuuggauuauaaauauauauucuauuac

SEQ ID NO: 93832 - RNA, 64 nt, Homo Sapiens
uugccugcugggauuccuuauuccaaaaucucccauuuuggaaucuaccccaauuucggauuuu

SEQ ID NO: 93833 - RNA, 64 nt, Homo Sapiens
auguuuuauuaguuuugugagaacaaguauuaacauuuuggaauaaaaguaaccaaccucauug

SEQ ID NO: 93834 - RNA, 64 nt, Homo Sapiens
ggccuuucucggccccagaccaaccugauaauucauuuuggauauaguaaaacaagugucuucc

SEQ ID NO: 93835 - RNA, 64 nt, Homo Sapiens
accuccaaagaaugaaaaccuugcuugaauaaacauuuuggaucacaagagauggcuuuuuccu

SEQ ID NO: 93836 - RNA, 64 nt, Homo Sapiens
cuagcugcuuggacauuaacaaaugcugaacauuauuuuggaugaaaaugcaugaacaauagaa

SEQ ID NO: 93837 - RNA, 64 nt, Homo Sapiens
auaguuuuucaucaagaguuuauuauuguacuuuauuuuggagccaaaaaauugauucuggggg

SEQ ID NO: 93838 - RNA, 64 nt, Homo Sapiens
uauaauagauggggcauauaauaaagaagcuacuauuuuggaaaaugacauuuuacuauuugcc

SEQ ID NO: 93839 - RNA, 64 nt, Homo Sapiens
gccugaaacuuugauauguauuuggccauuuuggauuuuggagauuguccuauuccucaguuca

SEQ ID NO: 93840 - RNA, 64 nt, Homo Sapiens
uuggagagccugaaacuuugcaguucauuuggccauuuuggauuuugagucuuguccuauuccu

SEQ ID NO: 93841 - RNA, 64 nt, Homo Sapiens
gggaaaacaugcgguggucucacaauaccuagccauuuuggaagcgggucugaccacuaccucc

SEQ ID NO: 93842 - RNA, 64 nt, Homo Sapiens
aaauaaugaauuuacuaauuaagaaugacaguauauuuuggaggcaaacauucauuguuaagag

SEQ ID NO: 93843 - RNA, 64 nt, Homo Sapiens
ccucuaaacauuuuuguaucaaacaaaaauuuaaauuuuggaauuacagagugaauuuguauuu

SEQ ID NO: 93844 - RNA, 64 nt, Homo Sapiens
auuuuuuacugggggcggaccauaauugcuuuauauuuuggaucugaguagucaguuauaaaag

SEQ ID NO: 93845 - RNA, 64 nt, Homo Sapiens
ucuuuucuagaaacagaaaaucacuguauuaaauauuuuggaaagauuguucugaaagaagucu

SEQ ID NO: 93846 - RNA, 64 nt, Homo Sapiens
auaagacuaaguugaguuauacuucuugguucacauuuuggaaaucagagauuacagauuacau

SEQ ID NO: 93847 - RNA, 64 nt, Homo Sapiens
acuuuuuuuuuuuuuuuggaguuuucgauuuuggauuuuggaauaaauacuugggacuggaagu

SEQ ID NO: 93848 - RNA, 64 nt, Homo Sapiens
uuggaauacuuuuuuuuuuuuggaaguguuuucgauuuuggauuuuaucugaaauacuugggac

SEQ ID NO: 93849 - RNA, 64 nt, Homo Sapiens
uaagggaaucccgcuucccuacuuugaagaguucauuuuggaagcuaacucuauggcguaaauu

SEQ ID NO: 93850 - RNA, 64 nt, Homo Sapiens
uacuuuuaaucuuaaaauaccaauaugauuagguauuuuggauucuaauguuuuuaucuugagu

SEQ ID NO: 93851 - RNA, 64 nt, Homo Sapiens
gagcugguuagaacauuuuaaguggcagcauagaauuuuggaauuuuggggcuuucuuuucaga

SEQ ID NO: 93852 - RNA, 64 nt, Homo Sapiens
caguuuacaaaaauaagucuuuuugccuuaagucauuuuggaaauaaguaauacugcaucugac

SEQ ID NO: 93853 - RNA, 64 nt, Homo Sapiens
accagaaguguuucaaauuuuagauuauuuucagauuuuggaauguuugcauauacauaaugag

SEQ ID NO: 93854 - RNA, 64 nt, Homo Sapiens
auuuuuugucuuguuggugcucaaaaaguuuuggauuuuggagcauuucggauuuuggauuuuu

SEQ ID NO: 93855 - RNA, 64 nt, Homo Sapiens
ugcucaaaaaguuuuggauuuuggagcauuucggauuuuggauuuuuggauuaggguugcucaa

SEQ ID NO: 93856 - RNA, 64 nt, Homo Sapiens
guaucccuucuccaaaaugccugggaucagaagcauuuuggauuucagauacuuacagauuuug

SEQ ID NO: 93857 - RNA, 64 nt, Homo Sapiens
gaucagaagcauuuuggauuucagauacuuacagauuuuggaauauuugcauuauauuuauugg

SEQ ID NO: 93858 - RNA, 64 nt, Homo Sapiens
ugaauguccuugcaggccgggaguguuguaaaauauuuuggaugcguacuuuguuuugccugua

SEQ ID NO: 93859 - RNA, 64 nt, Homo Sapiens
ucaguguuuuccaugugaccauugacuauagcagauuuuggaaauuuuauuccuauuuaauguu

SEQ ID NO: 93860 - RNA, 64 nt, Homo Sapiens
ucaggugcacucuauucaaguucuuuuuuauuugauuuuggaauugaugagaaguuuuuaauug

SEQ ID NO: 93861 - RNA, 64 nt, Homo Sapiens
aauagagaaauuuugauaagggaacauaggcaggauuuuggauuggcccugaguacagggaagu

SEQ ID NO: 93862 - RNA, 64 nt, Homo Sapiens
guucuaaaucuggggguaaagcaagaaccugaacauuuuggagccuuucugcugagcuagacca

SEQ ID NO: 93863 - RNA, 64 nt, Homo Sapiens
aguuuuaagugcacagcucauaaauucugcugacauuuuggauuaaccuuauguagguugccag

SEQ ID NO: 93864 - RNA, 64 nt, Homo Sapiens
uaaaaauuguuuugaaagaagaacacaauuuacaauuuuggaaccacugacuccuuucucuugu

SEQ ID NO: 93865 - RNA, 64 nt, Homo Sapiens
aagugcuucuuaaaagaaccauaguccauuuacaauuuuggaaggcaaaggcugauuuguuugc

SEQ ID NO: 93866 - RNA, 64 nt, Homo Sapiens
uucagauuagggaugcucaaugaaauuuuggagcauuuuggauuauguuggcauucagaaauuu

SEQ ID NO: 93867 - RNA, 64 nt, Homo Sapiens
auuuuggauuuucagauuagucagaaauuuugaaauuuuggagcuucuagcgucauguuggcau

SEQ ID NO: 93868 - RNA, 64 nt, Homo Sapiens
auuugcauauacaugcgauaguuuugaauuucagauuuuggaauaaaugcuuggggcuagaagu

SEQ ID NO: 93869 - RNA, 64 nt, Homo Sapiens
ucuuggaggaaucaggcaaacaucucaaaaauucucuuuccauccuaccagcagcaguguguaa

SEQ ID NO: 93870 - RNA, 64 nt, Homo Sapiens
cauaguggcuacauuacuucagauuccccuaaugucuuuccagccagacuuggaaucauggagg

SEQ ID NO: 93871 - RNA, 64 nt, Homo Sapiens
ccugggguuccaacaaagcucagcucccagauucucuuuccaguuucauccuaaguuccuagca

SEQ ID NO: 93872 - RNA, 64 nt, Homo Sapiens
acacacuguuaacacuucugccaguuuuuucugaucuuuccagccccacccccuuucucuuucu

SEQ ID NO: 93873 - RNA, 64 nt, Homo Sapiens
auauuuucccuggucugaagcuuggaaagacugaucuuuccaaauucuuggaaaggagcucacu

SEQ ID NO: 93874 - RNA, 64 nt, Homo Sapiens
uuccuugcuucucuuauugcauccucagcuacagucuuuccauuccauuuuuuuuuaauaaaag

SEQ ID NO: 93875 - RNA, 64 nt, Homo Sapiens
cauucucccuuugcaucuuguuccacgucacuguucuuuccaccaggccaguaucccaaaccuc

SEQ ID NO: 93876 - RNA, 64 nt, Homo Sapiens
ucuuccuccauucuggccagcugaggcccacgagucuuuccagccuucagccugcaaugaggga

SEQ ID NO: 93877 - RNA, 64 nt, Homo Sapiens
cuugguucucuugccguagacugauucauaucugucuuuccacuuaaccaaucuuauuugugaa

SEQ ID NO: 93878 - RNA, 64 nt, Homo Sapiens
uucaccuuuuauuuuuuauuguuguuugacaccuucuuuccacuaggaagaaguccuggugugg

SEQ ID NO: 93879 - RNA, 64 nt, Homo Sapiens
guggaaaggcaucagggcuguuugacagugugcgucuuuccaaucccauguuccuccauucgug

SEQ ID NO: 93880 - RNA, 64 nt, Homo Sapiens
guggggccauggccucgaugauggucuccacaggucuuuccaccucugugaguccaagucaggu

SEQ ID NO: 93881 - RNA, 64 nt, Homo Sapiens
caucagcacguuguacaacuacaaagguacuacaucuuuccagcauuguuccuuaucaggaaua

SEQ ID NO: 93882 - RNA, 64 nt, Homo Sapiens
ccugcugauguggcagucaaagcuuuucaagguaucuuuccaauuccuguauccggcacugcua

SEQ ID NO: 93883 - RNA, 64 nt, Homo Sapiens
uguuauaaucuaaaguauuccagucagcuauuggucuuuccagcacugcuuccuuucuucuuuc

SEQ ID NO: 93884 - RNA, 64 nt, Homo Sapiens
cagcuauuggucuuuccagcacugcuuccuuucuucuuuccaguuuucuacauugaaaauagaa

SEQ ID NO: 93885 - RNA, 64 nt, Homo Sapiens
acauucucauuccucuccuccuagaguuuauuccucuuuccaaauagaaagaaagguaaagagu

SEQ ID NO: 93886 - RNA, 64 nt, Homo Sapiens
uaagcagaguugcucuucacgcauuuuguuucacucuuuccagaaagucuuuauuauuuacuuu

SEQ ID NO: 93887 - RNA, 64 nt, Homo Sapiens
uagaguaaguacuucuguggagccauguucauuuucuuuccaguuuuacugcuguuuugaauag

SEQ ID NO: 93888 - RNA, 64 nt, Homo Sapiens
ucauacuuguuuuuaaucaucuuuuagucuaauaucuuuccaguccugcucauuaugauuccuc

SEQ ID NO: 93889 - RNA, 64 nt, Homo Sapiens
uuacuugcccuucuauacuuccacugucauaaucucuuuccaucaaaggggccucuccuuuucu

SEQ ID NO: 93890 - RNA, 64 nt, Homo Sapiens
ccaaaggggccucuccuuuucucccaacaagugcucuuuccaccuguuccuguccagcaggggu

SEQ ID NO: 93891 - RNA, 64 nt, Homo Sapiens
uggguccagaagacguggucuagaccagggcugcucuuuccacuugcccuguguucuuucccca

SEQ ID NO: 93892 - RNA, 64 nt, Homo Sapiens
aaauacccauguuacuucucugaguuuuaguuggucuuuccaucuaucacugcauuaucuugcu

SEQ ID NO: 93893 - RNA, 64 nt, Homo Sapiens
gauuugugucuccguucugagggagugggaggcuucuuuccaggggaggccaccuucgcuagca

SEQ ID NO: 93894 - RNA, 64 nt, Homo Sapiens
uaaauuggaggcuuuggaagaaaucugggaccugucuuuccaacaaucucacuaucagagccac

SEQ ID NO: 93895 - RNA, 64 nt, Homo Sapiens
ggaucucauuggacccuuccuuagauguucuaagucuuuccauuagguugcaccucccccaacc

SEQ ID NO: 93896 - RNA, 64 nt, Homo Sapiens
gagccacuccucugacucaggccuuauuagagugucuuuccacgcuaaggccauuauuguacuu

SEQ ID NO: 93897 - RNA, 64 nt, Homo Sapiens
gauagccaaugauuuuauccuacagaguuuuggaucuuuccaggaaaagugaacagaguuaccu

SEQ ID NO: 93898 - RNA, 64 nt, Homo Sapiens
aaaauauucugaaacaauauuuccauugaaauacucuuuccauuuuccuacuguuucacuguac

SEQ ID NO: 93899 - RNA, 64 nt, Homo Sapiens
ccaccccccuuggaauuauuacucucucucucuuucuuuccaucacccacauacagacacacac

SEQ ID NO: 93900 - RNA, 64 nt, Homo Sapiens
uaccaaauggguguaauaauucucucagcucagcucuuuccaucucuagauggaucaugcagcu

SEQ ID NO: 93901 - RNA, 64 nt, Homo Sapiens
uuaacuccacauugcuuuauugguuaauuuauauucuuuccauguaauucauguaauuguaugu

SEQ ID NO: 93902 - RNA, 64 nt, Homo Sapiens
gggccuggcugggggugcagaagggcaggguaguucuuuccauuuccccuugcagcuacacuua

SEQ ID NO: 93903 - RNA, 64 nt, Homo Sapiens
aauuucuuuaaaaaguuuucuauuuuaucuaaaaucuuuccauuauaucuaaauuagaaugauc

SEQ ID NO: 93904 - RNA, 64 nt, Homo Sapiens
uucugagguuaacacuugauuuagccccuacauaucuuuccauauauccuauuauuucugaaua

SEQ ID NO: 93905 - RNA, 64 nt, Homo Sapiens
aagauagucacgaaaauacugaaaguuugauuuuucuuuccauauuugaauuaauuuuuucugu

SEQ ID NO: 93906 - RNA, 64 nt, Homo Sapiens
guuuuacaagacugaagacccagaguauacuuuuucuuuccagaaauaauuucauaccgccuau

SEQ ID NO: 93907 - RNA, 64 nt, Homo Sapiens
acugaaucagaggaaucagacagaggaggauagcucuuuccagaauccacacuucugaccucag

SEQ ID NO: 93908 - RNA, 64 nt, Homo Sapiens
ggugcaaguugaccaaaucguuuuaagugguaacucuuuccaaccguagcaggguuguuuucug

SEQ ID NO: 93909 - RNA, 64 nt, Homo Sapiens
aaacaagcggaggcgagggccaauucaaccccauucuuuccagcgccccgcaccauagcaccug

SEQ ID NO: 93910 - RNA, 64 nt, Homo Sapiens
aaauggauauauuucuagaauggucuuaauauuaucuuuccacguuuguauauuuggcuugaua

SEQ ID NO: 93911 - RNA, 64 nt, Homo Sapiens
uguguuagcauagacuucucaaggacaauaguccucuuuccaaggguuuuugucaugugcaagg

SEQ ID NO: 93912 - RNA, 64 nt, Homo Sapiens
aguucaucccagcgguaauaacuacacccaguugucuuuccagaccugcucuucaagccaauuu

SEQ ID NO: 93913 - RNA, 64 nt, Homo Sapiens
aguacauguacuugaaauauagaucucuuaguggucuuuccaaaggagggccuagaacauggau

SEQ ID NO: 93914 - RNA, 64 nt, Homo Sapiens
aauuuaggaauguuuaguguuuaaucuuuuucucucuuuccaaacucauuucaagugaauuauu

SEQ ID NO: 93915 - RNA, 64 nt, Homo Sapiens
aggcagcuugaaauguugguucuguuuuuaauuuucuuuccaaacuaauaauuaaccaucuacc

SEQ ID NO: 93916 - RNA, 64 nt, Homo Sapiens
ccguggaggacaaagaaaaggguuguuauuuuugucuuuccagccagccugcuggcucccaaga

SEQ ID NO: 93917 - RNA, 64 nt, Homo Sapiens
agagcgccacacucgcugcuuaagcucccccagcucuuuccagaaaacauuaaacucagaauug

SEQ ID NO: 93918 - RNA, 64 nt, Homo Sapiens
ccuugauaggcgaguauucccacccagcccagcuucuuuccauucugggauuacaggcgcaagc

SEQ ID NO: 93919 - RNA, 64 nt, Homo Sapiens
ugguuuuuauuuuuauuuuuaucaccccaucuuuucuuuccacugcacccccuugcagaugagu

SEQ ID NO: 93920 - RNA, 64 nt, Homo Sapiens
gcugcuugagauugguucugcucuuuucuucauuucuuuccagaacaacucuuucccaccccaa

SEQ ID NO: 93921 - RNA, 64 nt, Homo Sapiens
auuuuuuaacuaauauuuguacauuuucuuagucucuuuccaagucuuugccucuuuuuuuucu

SEQ ID NO: 93922 - RNA, 64 nt, Homo Sapiens
ucacacaguuuguaaugaagacagcuccuucucaucuuuccauaagccugagauacaaguucag

SEQ ID NO: 93923 - RNA, 64 nt, Homo Sapiens
cuaggaggcaaauaucugaagcuugcuaugcuguucuuuccauuccuuuucccucugaaacaca

SEQ ID NO: 93924 - RNA, 64 nt, Homo Sapiens
uuauuucuucccuuaugaaaaaccucccuuaagaucuuuccaggucaucaauuugaugugcaua

SEQ ID NO: 93925 - RNA, 64 nt, Homo Sapiens
cagucuucacugaaguguuuucuuagcuuccagcucuuuccauauaaaggacacccuagguuuu

SEQ ID NO: 93926 - RNA, 64 nt, Homo Sapiens
ccugaggaccuaggccccagugucaucaaaggguucuuuccaggcccucuagaaacauauuggc

SEQ ID NO: 93927 - RNA, 64 nt, Homo Sapiens
cucuggguucuugcaaguuggcagucaagaccauucuuuccaacuugaagcuggggcgauguuu

SEQ ID NO: 93928 - RNA, 64 nt, Homo Sapiens
gaaacauuuagacacaaaccgaagcuaggcacuuucuuuccaugauugcccauaagacccccag

SEQ ID NO: 93929 - RNA, 64 nt, Homo Sapiens
cugaucccagcccuaaaggaaggguagacccgugucuuuccagcccuaaaggaaggguagaccc

SEQ ID NO: 93930 - RNA, 64 nt, Homo Sapiens
gucuuuccagcccuaaaggaaggguagacccgugucuuuccagcccuaaaggaagggcagaccc

SEQ ID NO: 93931 - RNA, 64 nt, Homo Sapiens
gucuuuccagcccuaaaggaagggcagacccgugucuuuccaugcccgagggccacgacgucac

SEQ ID NO: 93932 - RNA, 64 nt, Homo Sapiens
ccagcggggcagcaccuggggcugucucgcucagucuuuccagacugggcugugcugaggcagu

SEQ ID NO: 93933 - RNA, 64 nt, Homo Sapiens
ugggcucugcagcccagcucagcucuucacugugucuuuccaucgagagcuuggaaggagguug

SEQ ID NO: 93934 - RNA, 64 nt, Homo Sapiens
ugccaaguucaguuuuguuucuuugcgugcagugucuuuccauggauaaugcauuugauuuauc

SEQ ID NO: 93935 - RNA, 64 nt, Homo Sapiens
cacacagagucaggccguugcuagucaguucucuucuuuccacccugucccuaucucuaccacu

SEQ ID NO: 93936 - RNA, 64 nt, Homo Sapiens
aguuugucaaacuaugcagaaguguguuuuuaucucuuuccaaaguucaacguacaaacacugg

SEQ ID NO: 93937 - RNA, 64 nt, Homo Sapiens
gcacugccuaguuaacagaaacagcagcuuccuuucuuuccauguuagaagugcugcacacuuu

SEQ ID NO: 93938 - RNA, 64 nt, Homo Sapiens
augaacuugaagauuacauaagaggacauaugauucuuuccaagguggcuaccaacccauucaa

SEQ ID NO: 93939 - RNA, 64 nt, Homo Sapiens
augaacuugaagauuacaucagaagacauaugacucuuuccaagaaagcaguuaccucauucaa

SEQ ID NO: 93940 - RNA, 60 nt, Homo Sapiens
ugucuacagccaacuauucuauuaguuacaaaacucaaucauuuuauucagcaacuggau

SEQ ID NO: 93941 - RNA, 60 nt, Homo Sapiens
aaaaaaauaaaguaaaauagaaaacugagaaaacucaauccaugaccagggagaacuuac

SEQ ID NO: 93942 - RNA, 60 nt, Homo Sapiens
aauggugccaccacucaagcaacaagccucaaacucaaccaugucaucuuuuucuuggau

SEQ ID NO: 93943 - RNA, 60 nt, Homo Sapiens
aaggacaagaugguuaagucaauucuguuaaaacucaaggcuuauauuaagcaaacacuu

SEQ ID NO: 93944 - RNA, 60 nt, Homo Sapiens
uggcaccuacugaauuaaaaaggauuuuauaaacucaaaucugcacaaagaauaaaauua

SEQ ID NO: 93945 - RNA, 60 nt, Homo Sapiens
ccucacagauuauaauagaauaaaacuuaaaaacucaacacuuugauuaaaggccauuuu

SEQ ID NO: 93946 - RNA, 60 nt, Homo Sapiens
ucucuguuugcuugucauagcagcauuuggaaacucaaacaugcuuucauuuacauaaau

SEQ ID NO: 93947 - RNA, 60 nt, Homo Sapiens
gguauuaauuauugaaagucccuuuccccaaaacucaacuccuauggcaauuaugaacuc

SEQ ID NO: 93948 - RNA, 60 nt, Homo Sapiens
gucuuuucagccuuuccaucuuuacaaauaaaacucaaaaaagccguccagcuuauccca

SEQ ID NO: 93949 - RNA, 60 nt, Homo Sapiens
aggauugccugugugcuggaaauauauuugaaacucaaccaguaugcccagccuauugca

SEQ ID NO: 93950 - RNA, 60 nt, Homo Sapiens
cuuugucacgucugauauuaccaggcaaauaaacucaaaugccagacaaacccaaguugu

SEQ ID NO: 93951 - RNA, 60 nt, Homo Sapiens
ugaguuuuaccaauuaauguacaucuuugaaaacucaauuuggugcacuuuaauacuauc

SEQ ID NO: 93952 - RNA, 60 nt, Homo Sapiens
ccaucaucucuuaucucuaugguuccuagaaaacucaauaaaaaaucuuucccagaaguu

SEQ ID NO: 93953 - RNA, 60 nt, Homo Sapiens
cagauaaagauaaauauguguguuuaaaagaaacucaauaaucuguuacuguucuaaaaa

SEQ ID NO: 93954 - RNA, 60 nt, Homo Sapiens
uuuagaaaaacucauucauggaaaaccaauaaacucaaaguuggcaugacuguuugucuc

SEQ ID NO: 93955 - RNA, 60 nt, Homo Sapiens
ucagcgugugaccaauggcucacuuccagcaaacucaaucaugaccagauggagucuuaa

SEQ ID NO: 93956 - RNA, 60 nt, Homo Sapiens
uaguaaaagcaccuagugugaaaaaaaaaaaaacucaagacuauuucucuaaaacucaaa

SEQ ID NO: 93957 - RNA, 60 nt, Homo Sapiens
aaaaaaaaaaaacucaagauuauuucucuaaaacucaaaacuaagucauauuaaaaggac

SEQ ID NO: 93958 - RNA, 60 nt, Homo Sapiens
gacuagaaccuauaggaaacuacuuggagcaaacucaaaggacagauuagggaucgagau

SEQ ID NO: 93959 - RNA, 60 nt, Homo Sapiens
aaagcgugauagaggagagaauuuuugacaaaacucaaaaguuguuugcacagcuguucu

SEQ ID NO: 93960 - RNA, 60 nt, Homo Sapiens
uagauguuuuguguguauuuuuuuaaaugaaaacucaaaauaagacaaguaauuuguuga

SEQ ID NO: 93961 - RNA, 60 nt, Homo Sapiens
agcaagcuacaaagagggugugucacacugaaacucaauaguugaguuuggcuguuguug

SEQ ID NO: 93962 - RNA, 60 nt, Homo Sapiens
caguauggcuuuuaguacugaagccaaaugaaacucaaaaccaucucucuuccagcugcu

SEQ ID NO: 93963 - RNA, 60 nt, Homo Sapiens
gaaucaccaaaggagcuauggagagaauuaaaacucaacauuacuguuaacugugcguua

SEQ ID NO: 93964 - RNA, 60 nt, Homo Sapiens
acuaugaaauuucaccuaauaguguugaguaaacucaacuaacucaguccaucugaugcc

SEQ ID NO: 93965 - RNA, 60 nt, Homo Sapiens
ucaguccaucugaugccaguggcaccacucaaacucaaacccuggagguggccauuaauu

SEQ ID NO: 93966 - RNA, 60 nt, Homo Sapiens
uguaaucccaacaucuaauuuuagucuuagaaacucaaacuauuaauaaguggaaaaagu

SEQ ID NO: 93967 - RNA, 60 nt, Homo Sapiens
cacuuguugcaguacaaucaucggguuaaaaaacucaaugaaaucagcaaacugggaauu

SEQ ID NO: 93968 - RNA, 60 nt, Homo Sapiens
uucaaugucuuuuuuuuuuuuuucauggaaaaacucaaaccucuguuauuugggagcuca

SEQ ID NO: 93969 - RNA, 60 nt, Homo Sapiens
uugcuugacaguuucuaaacaaacaaaaauaaacucaaugaaaggaaagauguuucuuuu

SEQ ID NO: 93970 - RNA, 60 nt, Homo Sapiens
aauaucuuggggccccagaaucacuaaggaaaacucaagcuuagggaaacuucuuagggc

SEQ ID NO: 93971 - RNA, 60 nt, Homo Sapiens
cugauugccuccuuuggaaaggcuaaucagaaacucaaaagaaugcaacuguuugugucu

SEQ ID NO: 93972 - RNA, 60 nt, Homo Sapiens
gaucaauuuggaauauauaaaguguacuaaaaacucaacugaagucaggcaugguagcuc

SEQ ID NO: 93973 - RNA, 60 nt, Homo Sapiens
gccucaucucaaaaaaaaaaaaaggccacaaaacucaacaauaaaaacaaacaguccaau

SEQ ID NO: 93974 - RNA, 60 nt, Homo Sapiens
gcagucaauuauucacgccacuaaaacuccaaacucaaauuugcuuaagucaacagugcc

SEQ ID NO: 93975 - RNA, 60 nt, Homo Sapiens
ugcagcuggacugcaggcuuuaaagcaagaaaacucaagcacagacaguauuggauaggg

SEQ ID NO: 93976 - RNA, 64 nt, Homo Sapiens
gcugugucagugaagauguacgacuaccuguugggaaggacaaagggaugaggcuccagagaga

SEQ ID NO: 93977 - RNA, 64 nt, Homo Sapiens
ucugucacgcacauguguccugugguuauagcuagaaggacaggagucuccugcugaugcguga

SEQ ID NO: 93978 - RNA, 64 nt, Homo Sapiens
guuaucugggauucaccgugaaaacuuggaaggcgaaggacaauucuggcugccaauggaacuc

SEQ ID NO: 93979 - RNA, 64 nt, Homo Sapiens
uacaacugugcuggccugcugugagccaaaaacagaaggacaaguugacuuccagcuuuuacga

SEQ ID NO: 93980 - RNA, 64 nt, Homo Sapiens
uugacuuccagcuuuuacgauguccuuggcagcugaaggacacccaccccacccaccucugccc

SEQ ID NO: 93981 - RNA, 64 nt, Homo Sapiens
ugccuggccguggcuucucuuuggcucccaaagagaaggacaguguugggaguaucugccgugg

SEQ ID NO: 93982 - RNA, 64 nt, Homo Sapiens
guaucugccguggcuucucuuuggcucccaaagagaaggacaguguugggaguaucugccggcg

SEQ ID NO: 93983 - RNA, 64 nt, Homo Sapiens
agcuguugaaauguuuuggccuuuuggagugggggaaggacaaaucugauccuguaaucuuuuu

SEQ ID NO: 93984 - RNA, 64 nt, Homo Sapiens
caauaaaguaguauaugauccucagauacagggagaaggacaaggcauacagcuuauugauuag

SEQ ID NO: 93985 - RNA, 64 nt, Homo Sapiens
gggggagcaucccuagugaauacucacaccacaagaaggacaaacuugugcacauguccaagaa

SEQ ID NO: 93986 - RNA, 64 nt, Homo Sapiens
guagaauguggcaaugccaacuggagaaagggaagaaggacauauuaccuugguuugaaucccu

SEQ ID NO: 93987 - RNA, 64 nt, Homo Sapiens
uucuucaaagugguuacaauagaacuucgucauugaaggacaauuuauauuuucuaucuuugcu

SEQ ID NO: 93988 - RNA, 64 nt, Homo Sapiens
aagacgcauggcucauggcgauccacuuugacaugaaggacaagaaagaucagagcaggugagc

SEQ ID NO: 93989 - RNA, 64 nt, Homo Sapiens
gugaaggcugggaacgugagggcccuuccuaucagaaggacauggggaaggaacagaggcccug

SEQ ID NO: 93990 - RNA, 64 nt, Homo Sapiens
gaugggaaaaaugcccuuaagagauuuccacgccgaaggacagcagauggaccuaguacccacu

SEQ ID NO: 93991 - RNA, 64 nt, Homo Sapiens
gcccguccuccccugccugcuacuauagagcucagaaggacacaaacugcuugaaaucuugcug

SEQ ID NO: 93992 - RNA, 64 nt, Homo Sapiens
aaggggcaugugagcguaaaggugacgugcaggugaaggacaggugggguuggcgggaccugcu

SEQ ID NO: 93993 - RNA, 64 nt, Homo Sapiens
caccuucugugcucauguuuggaaagcugaaagggaaggacagcugugcccuccugggagcuca

SEQ ID NO: 93994 - RNA, 64 nt, Homo Sapiens
ggacgcugugcugguucuguuuucuaaaggagcagaaggacaggucucugagacaggaucguug

SEQ ID NO: 93995 - RNA, 64 nt, Homo Sapiens
accaucaccuuugaaagugcuuguuugggggagggaaggacauacggguaacuagaacuaccca

SEQ ID NO: 93996 - RNA, 64 nt, Homo Sapiens
cagaugcaggcaguggagguggccugagcaggcagaaggacaccaagcgcccuauguugcuugu

SEQ ID NO: 93997 - RNA, 64 nt, Homo Sapiens
uugguguguguagacacacauugcagacucuuaacgcaggaaggacuucaaacuucugcugaga

SEQ ID NO: 93998 - RNA, 64 nt, Homo Sapiens
ugcacucaacugcccaccugaaaauggcgggggucgcaggaaucucccuucuaaguagacagca

SEQ ID NO: 93999 - RNA, 64 nt, Homo Sapiens
cccaacacaugggaccuauacuuugugaaggccucgcaggaagaucagcgaaugacaaaaucau

SEQ ID NO: 94000 - RNA, 64 nt, Homo Sapiens
cgcuggcuaacaucugcucuggaagcagggaugucgcaggaaucacauauuaagaguaugugaa

SEQ ID NO: 94001 - RNA, 64 nt, Homo Sapiens
ucuucggugguaguuucaaaagacacuacuaauacgcaggaagcguuccagcuauuuaaugcug

SEQ ID NO: 94002 - RNA, 64 nt, Homo Sapiens
cuuucccuuauguucacugugccauaaugcugcucgcaggaaauggcauuuuacaaaaaaaaaa

SEQ ID NO: 94003 - RNA, 64 nt, Homo Sapiens
ccgcuuccccuuccugacaggaacaaggcagaaucgcaggaaacgugcggcuucacccagggca

SEQ ID NO: 94004 - RNA, 64 nt, Homo Sapiens
cuacuaggaauuggaaucaaccuucacaauuagacgcaggaauguacagcccauucucaauuau

SEQ ID NO: 94005 - RNA, 64 nt, Homo Sapiens
ggagaccaaaauuugggguauuuauaauagucagcgcaggaaugcacauggaauaucuacuugu

SEQ ID NO: 94006 - RNA, 64 nt, Homo Sapiens
acacauucucuaccugcuccgagccugguccucucgcaggaaugcugcugcugccuccgccgcc

SEQ ID NO: 94007 - RNA, 64 nt, Homo Sapiens
cuaacaggagugggugaggacucuccuuugccugcgcaggaauucccuggaaaggaugcuuuuc

SEQ ID NO: 94008 - RNA, 64 nt, Homo Sapiens
auuugaacuuuggaacaggguuggcauucaaccacgcaggaagccuacuauuuaaauccuuggc

SEQ ID NO: 94009 - RNA, 64 nt, Homo Sapiens
gccuacagcccauuucuccaagagccauggaccacgcaggaaggucagccuguuccaugaaggc

SEQ ID NO: 94010 - RNA, 64 nt, Homo Sapiens
uagaagauugucucuaaaauugugguuuaacucacgcaggaaguaaaauuccuauagcaagaca

SEQ ID NO: 94011 - RNA, 64 nt, Homo Sapiens
ucauugccuugccaaacaggagcuccagcaaaagcgcaggaagagagacuggccuccuuggcug

SEQ ID NO: 94012 - RNA, 64 nt, Homo Sapiens
cuauuccauuagccuguggucugcaggguaggcccgcaggaaaugaggaauggccgagcuggag

SEQ ID NO: 94013 - RNA, 64 nt, Homo Sapiens
agugucccuggccccuuccugccaugggcaggcccgcaggaagagccgguagggguggaaaggg

SEQ ID NO: 94014 - RNA, 64 nt, Homo Sapiens
uagucuuggaaauguuaaaugagggcagaugaggcgcaggaaaacuguggggaucauucucucu

SEQ ID NO: 94015 - RNA, 64 nt, Homo Sapiens
cagaauaaauccuugggaguaagggaggcccagccgcaggaaggccauguagaauaaaugaaga

SEQ ID NO: 94016 - RNA, 64 nt, Homo Sapiens
ugaaaggcugcccuuuguucgaaagagaaccagacgcaggaagaaucaauucuuuucugccuga

SEQ ID NO: 94017 - RNA, 64 nt, Homo Sapiens
caauaaagugcuuugaaaauccgcgccaggauggcgcaggaacuuucccccagugcggccagcu

SEQ ID NO: 94018 - RNA, 64 nt, Homo Sapiens
cccuuaucugcggccggugaagaagcccaagauccgcaggaagaagugaguuggaggcuggggu

SEQ ID NO: 94019 - RNA, 64 nt, Homo Sapiens
ugugggcuuccuuuaaagggagaggaguucggcucgcaggaaaaaaaggucugccauacucuuc

SEQ ID NO: 94020 - RNA, 64 nt, Homo Sapiens
uggagagcuuccaaaaagaguguaaagaaaagaucgcaggaaugaaggccuuaugcuccaagca

SEQ ID NO: 94021 - RNA, 64 nt, Homo Sapiens
uuccaaggaguuccaugaagaccacauccacacacgcaggaacucccagcaacacaagcuggaa

SEQ ID NO: 94022 - RNA, 64 nt, Homo Sapiens
gagagggaauagcucacccccuggaagugacuuccgcaggaauugggaugccauguagccccag

SEQ ID NO: 94023 - RNA, 64 nt, Homo Sapiens
aguuuggguuuugaaagguucccugggcccucaccgcaggaagcccuguccucuccguggagga

SEQ ID NO: 94024 - RNA, 64 nt, Homo Sapiens
aaaaucauaguguuaaugaagcaacagaagaauucgcaggaagauucaugaaaaacugauagaa

SEQ ID NO: 94025 - RNA, 64 nt, Homo Sapiens
uagacacccaaguggaaggugcuacaaccugaagcgcaggaaagaaaggcccauuccccucgca

SEQ ID NO: 94026 - RNA, 64 nt, Homo Sapiens
auauuucaugauucaaauucuucaaagucuuauacgcaggaauguuuauucugcuguauuucug

SEQ ID NO: 94027 - RNA, 64 nt, Homo Sapiens
guaugugcugagaugcuuccgaccuuucaggugacgcaggaacacugggggagucugaaugauu

SEQ ID NO: 94028 - RNA, 64 nt, Homo Sapiens
gaaagcggaguuccuaacaggagcaagacagagacgcaggaauggugauccauccaucuccagg

SEQ ID NO: 94029 - RNA, 64 nt, Homo Sapiens
ugugagcauuucgacccgagaaccaucugagacacgcaggaaaugcccgaccauuuaagaaaac

SEQ ID NO: 94030 - RNA, 64 nt, Homo Sapiens
cggccaggugcugaucggugugcccuugcagcgccgcaggaacugaugccguuggggcggaggc

SEQ ID NO: 94031 - RNA, 64 nt, Homo Sapiens
ccacagaaggcucagcuggucaccuucccagacacgcaggaagccagccucagaccccacccag

SEQ ID NO: 94032 - RNA, 64 nt, Homo Sapiens
gguggguaauucuagagacaggagaaccguagagcgcaggaacgccccaaacuggagggggcau

SEQ ID NO: 94033 - RNA, 64 nt, Homo Sapiens
acacauacaacacagaucauuucccaguuagauccgcaggaaguagguugguggggguggaugu

SEQ ID NO: 94034 - RNA, 64 nt, Homo Sapiens
aaauucugacauaugcgguguaguaccagccuuccgcaggaaggguuccgugcaugcaguggaa

SEQ ID NO: 94035 - RNA, 64 nt, Homo Sapiens
ccgcauccuugucccucugcuggaccgucucccucgcaggaacuaagcacacggucaauccacg

SEQ ID NO: 94036 - RNA, 64 nt, Homo Sapiens
ugauuucuuccagcuuuuccacacucucuuuaugcgcaggaacaaacagcuguugagugagcug

SEQ ID NO: 94037 - RNA, 64 nt, Homo Sapiens
agaagaugccuagcccuggggaccuugugaaauacgcaggaaccagggauaccaucugguccag

SEQ ID NO: 94038 - RNA, 64 nt, Homo Sapiens
cccugcccccgugaggaugucacucagauggaaccgcaggaagcugcuccgugcuuguuugcuc

SEQ ID NO: 94039 - RNA, 64 nt, Homo Sapiens
cccuguauguucagggcuguugcccauguggggccgcaggaaucggggugcugugagaaggcug

SEQ ID NO: 94040 - RNA, 54 nt, Homo Sapiens
gcagccacgccuggaccgcgggcccgcaggaagaaauccuacacccugguguag

SEQ ID NO: 94041 - RNA, 64 nt, Homo Sapiens
gccuggcuuccugguaaggaguuucagccgccuccgcaggaacccccaaagugcagauuccgga

SEQ ID NO: 94042 - RNA, 64 nt, Homo Sapiens
guguguguccuacacaauggcuucaggugccgggcgcaggaacugcccaggccagaagaccucc

SEQ ID NO: 94043 - RNA, 64 nt, Homo Sapiens
aguuaagaacacugaacaucuccaaaagagucaucgcaggaagaugccuuggcagaggggagac

SEQ ID NO: 94044 - RNA, 64 nt, Homo Sapiens
cuggaggaauagagaguaaauugcaaggugugaccgcaggaaucgcagaugagugggagacugg

SEQ ID NO: 94045 - RNA, 64 nt, Homo Sapiens
cuggaggaacagagaguaaauugcaaggugugaccgcaggaaucgcagaugagugggagacugg

SEQ ID NO: 94046 - RNA, 64 nt, Homo Sapiens
uccucgggacacggcugcuuugcuuuguggacaccgcaggaagugccggaggacagccagcggc

SEQ ID NO: 94047 - RNA, 64 nt, Homo Sapiens
agcaguccccugcuaucccucuccaccugcccgccgcaggaaggaugacgaagcugcucagcaa

SEQ ID NO: 94048 - RNA, 64 nt, Homo Sapiens
cuccugccgccucuucccuaccuccuccacuagccgcaggaagggccuccagcacccacaacug

SEQ ID NO: 94049 - RNA, 64 nt, Homo Sapiens
ugggucccggcaacacgcaguugugcugggauagcgcaggaagggcaauggugugguuggagag

SEQ ID NO: 94050 - RNA, 64 nt, Homo Sapiens
accacaugaaggcccaggaggggagguuaggacacgcaggaaagauugguguccuuauaagaag

SEQ ID NO: 94051 - RNA, 64 nt, Homo Sapiens
caucucuuagagcuauggggccuuugccauuggucgcaggaaccgccucccagggaacacaagg

SEQ ID NO: 94052 - RNA, 64 nt, Homo Sapiens
ggggagacuccccucuugcuguguguacuggacacgcaggaagcaugcugucuugcugccucug

SEQ ID NO: 94053 - RNA, 64 nt, Homo Sapiens
agauuguucuaaucuuugaauugcucucugguuucgcaggaaauauguucuuaagaauaaaaug

SEQ ID NO: 94054 - RNA, 64 nt, Homo Sapiens
uuucuuuuucacagaacuggacaugagcuuuucucgcaggaaauuacugaucuucaauaugaag

SEQ ID NO: 94055 - RNA, 64 nt, Homo Sapiens
gggcugggccucgugcgcccguggugcccgugcccgcaggaacuuccuggucugugaagagccg

SEQ ID NO: 94056 - RNA, 64 nt, Homo Sapiens
auuauucaagagaccaccugacaugcaucuccuccgcaggaauacauucguccucucuuagaga

SEQ ID NO: 94057 - RNA, 64 nt, Homo Sapiens
gccugcuuuggacacgggaguccucagaagucagcgcaggaagaauggcagaggacugaacacc

SEQ ID NO: 94058 - RNA, 64 nt, Homo Sapiens
cauagccacacacccagggccugacugaggcccacgcaggaaccgacacucagacacaaggcaa

SEQ ID NO: 94059 - RNA, 64 nt, Homo Sapiens
gaaucuggcucucagggugguucagaccugaagacgcaggaaaauuaauuuuccuagaaaaucc

SEQ ID NO: 94060 - RNA, 64 nt, Homo Sapiens
gaggacuccaggggcugggggcgggcgagaagggcgcaggaaccuggacucgcgagagggugcc

SEQ ID NO: 94061 - RNA, 64 nt, Homo Sapiens
cugugcaucucggccagcacgggagccagugccgcgcaggaaugugggguccccuguguucccu

SEQ ID NO: 94062 - RNA, 64 nt, Homo Sapiens
cgcagaacaacagaaauagcuggagggaucugagcgcaggaagaggcaccuuuccgagugcagc

SEQ ID NO: 94063 - RNA, 64 nt, Homo Sapiens
gggaaggacucacaucauaacuggcuacaugcuucgcaggaaguacucagaggaggcucauuag

SEQ ID NO: 94064 - RNA, 64 nt, Homo Sapiens
aggggaaagugauuuuaaagaauucacuuaggaucgcaggaaucucagcagcaaauuugacuug

SEQ ID NO: 94065 - RNA, 64 nt, Homo Sapiens
ggaaagccugaaaugccuuaauugugaacugauacgcaggaaaaugaaauauguaagcacauug

SEQ ID NO: 94066 - RNA, 64 nt, Homo Sapiens
uucuggguggcgucgaaggaggguuuagaagaaacgcaggaacagauucgaguucucccuggga

SEQ ID NO: 94067 - RNA, 64 nt, Homo Sapiens
auacuguaacccagguucugccugucguguauaaguuuuagauacuuuuguucuuucuugcucu

SEQ ID NO: 94068 - RNA, 64 nt, Homo Sapiens
gaccaaaaccacaaucuagacuacaaaguauauuguuuuagaguacucaaauuguauuauuuau

SEQ ID NO: 94069 - RNA, 64 nt, Homo Sapiens
uugugcccgccugcccccauccccuccaggccacguuuuagauggcccuuguaguugcgggucc

SEQ ID NO: 94070 - RNA, 64 nt, Homo Sapiens
agucuuuuccuuuuuuucuguuccuagcuaugggguuuuagagaagugggaacaggaaggcauu

SEQ ID NO: 94071 - RNA, 64 nt, Homo Sapiens
aguuguuaucauaguauuuuaaaaccuguauaguguuuuagacuuguuaaaacauugcugucua

SEQ ID NO: 94072 - RNA, 64 nt, Homo Sapiens
ccuuuucauugagggaaaauauauuugaauuucuguuuuagauuguaucgggucccaguugauu

SEQ ID NO: 94073 - RNA, 64 nt, Homo Sapiens
gcagaauuggacaaaauuacuuaugaaagagacaguuuuagacaggcauaugaagaucuucgga

SEQ ID NO: 94074 - RNA, 64 nt, Homo Sapiens
aagaguuaauuguuccuuucuucagugggccauuguuuuagauauuuaaaaaauccaacaguuu

SEQ ID NO: 94075 - RNA, 64 nt, Homo Sapiens
ugagaucuagagaacacgucgagaaaaauacagaguuuuagaaagauacuuaaguuuuagaaau

SEQ ID NO: 94076 - RNA, 64 nt, Homo Sapiens
ugagaaaaauacagaguuuugauuggauacuuaaguuuuagaaagauuuuaguaaggucaguuu

SEQ ID NO: 94077 - RNA, 64 nt, Homo Sapiens
augcaggcagcacaauauggccuaaacugccauaguuuuagaaugugaaaaaaaugcauguuua

SEQ ID NO: 94078 - RNA, 64 nt, Homo Sapiens
aaaaucgucuuacauguguacaauaugcaaauuaguuuuagauuagagagugcagccauuuugu

SEQ ID NO: 94079 - RNA, 64 nt, Homo Sapiens
uagacuaugaugcuuuuguuaagaaagguuucauguuuuagauauuuuccguguccuaaauaau

SEQ ID NO: 94080 - RNA, 64 nt, Homo Sapiens
uuucgagauucagguucucaauaauaauauucaaguuuuagaguuucacuuuguacuauuuaaa

SEQ ID NO: 94081 - RNA, 64 nt, Homo Sapiens
uuuacuucucccuugccuuugagggucgucuucaguuuuagagguucuauaguuuucuccuuua

SEQ ID NO: 94082 - RNA, 64 nt, Homo Sapiens
ucauacuguuaauauuuuaugcaguaguaaaccuguuuuagauagaggauguaacuugauguga

SEQ ID NO: 94083 - RNA, 64 nt, Homo Sapiens
cacugcccuguugagagaaaugagauacaaaaagguuuuagaaucaaaauaguucugaaagugg

SEQ ID NO: 94084 - RNA, 64 nt, Homo Sapiens
uuagcaaguagugcauacccaauuaagguuugagguuuuagaaacccauuuuaagaugggggaa

SEQ ID NO: 94085 - RNA, 64 nt, Homo Sapiens
ccaucuucugaaauucugagauucuaacauccuuguuuuagaauucuaaguuuccaacauuccu

SEQ ID NO: 94086 - RNA, 64 nt, Homo Sapiens
acuccugugugacuguggagcacccagggacgugguuuuagagucuaccuaauauguuaaggac

SEQ ID NO: 94087 - RNA, 64 nt, Homo Sapiens
cgagggguuucuuuccauguguuuuccuccuguuguuuuagaacuuuuuuaaaaaaacagaccu

SEQ ID NO: 94088 - RNA, 64 nt, Homo Sapiens
guuguuuuagaacuuuuuuaaaaaaacagaccucguuuuagauuuauagcauugacuuuuacac

SEQ ID NO: 94089 - RNA, 64 nt, Homo Sapiens
uauuuuugaaacagaguuaaagcauugucuuaguguuuuagaauauuuuggaggcaauaggaua

SEQ ID NO: 94090 - RNA, 53 nt, Homo Sapiens
auauuuggcuguagucucaaaagguuuuagaaaaauccacuggagcgucuuga

SEQ ID NO: 94091 - RNA, 64 nt, Homo Sapiens
uuaagucuggggggaaauggccacugcagauggaguuuuagaguaguaaugaaauucuaccuag

SEQ ID NO: 94092 - RNA, 64 nt, Homo Sapiens
uauauauaguaccaauguuaccuuuuuauuuuuuguuuuagauguaagagcaugcucauauguu

SEQ ID NO: 94093 - RNA, 64 nt, Homo Sapiens
aaaagucaacaucuaacuagaaucugaaaauggaguuuuagagguucugcugguugugaggggg

SEQ ID NO: 94094 - RNA, 64 nt, Homo Sapiens
ugauggaaauuaagagagcauuuagacuugcugaguuuuagaagacacgaccuaaguugaagag

SEQ ID NO: 94095 - RNA, 64 nt, Homo Sapiens
aauagaaguuucccaguggcauucacuagugagaguuuuagacaaauuauguuacgaguaaagu

SEQ ID NO: 94096 - RNA, 64 nt, Homo Sapiens
aaaggaagauuuuucuuuuuacaacuagauauuaguuuuagaggaaggaaauagcugaaaaacu

SEQ ID NO: 94097 - RNA, 64 nt, Homo Sapiens
uguaauuauccccaauucuaaaagaaaaaacuuaguuuuagagaguuaguaaucuuugccuaag

SEQ ID NO: 94098 - RNA, 64 nt, Homo Sapiens
ccaaguccaagaaccugagauuuuuaaucauuagguuuuagauuuccuuuagcagcagagacug

SEQ ID NO: 94099 - RNA, 64 nt, Homo Sapiens
acucagguauucuuuccugaaauuagaacuagugguuuuagagauuaccaaaacagcaauuuga

SEQ ID NO: 94100 - RNA, 64 nt, Homo Sapiens
guaggacuuaugauccaauuaauguuuccagaugguuuuagaauauuuucagggcuaccagaaa

SEQ ID NO: 94101 - RNA, 64 nt, Homo Sapiens
agaccaaacuaaacaaaaaguaccuguauguuuuguuuuagacgaacaaaacaaaacauuaaaa

SEQ ID NO: 94102 - RNA, 64 nt, Homo Sapiens
acaaggucuuaaggagaaaucuggccucuaauuaguuuuagaugacugacaauuccucgggaac

SEQ ID NO: 94103 - RNA, 64 nt, Homo Sapiens
uaagcuguguuacuccaaaggacaugaaaaagcucaagaguaaaauuaaaauucucaaaaaaaa

SEQ ID NO: 94104 - RNA, 64 nt, Homo Sapiens
guuugaaagaacuuagggaggaccauuggcuugccaagaguacagaaauucauuaugcugcuaa

SEQ ID NO: 94105 - RNA, 64 nt, Homo Sapiens
ucagcgugggaggcaccuuuucucugguuauagcuggucccagguguaguuucuucccuccugu

SEQ ID NO: 94106 - RNA, 64 nt, Homo Sapiens
uggugggagccucuggcugcucucggucccaggguggucccagcggaccugcgcuccagggugg

SEQ ID NO: 94107 - RNA, 64 nt, Homo Sapiens
cucuacugggcccuuggaggugaucaauagagcuuggucccaaggugaaaacucugggggaugc

SEQ ID NO: 94108 - RNA, 64 nt, Homo Sapiens
ggccugucacagggccaaauugcuuuauaggauguggucccacauucucuugauccugggauua

SEQ ID NO: 94109 - RNA, 64 nt, Homo Sapiens
cccauggagaacccaaagucggggcccgucagccuggucccacccucccgccccagccugccgu

SEQ ID NO: 94110 - RNA, 64 nt, Homo Sapiens
ccuuucuuguccuauacccaccacccacuuucccuggucccaauguagggucuggcugagcuuc

SEQ ID NO: 94111 - RNA, 64 nt, Homo Sapiens
uuccacaagugccucuggagccagccucccacccuggucccaggaagugccucugggggacccc

SEQ ID NO: 94112 - RNA, 64 nt, Homo Sapiens
uucccgcaaagugccucuggccagccucccacccuggucccaguuggcucacuccgcaagcccc

SEQ ID NO: 94113 - RNA, 64 nt, Homo Sapiens
uucuucccagcagcccuucccggccucuaaaguuuggucccagcagcccuucccagccucuaaa

SEQ ID NO: 94114 - RNA, 64 nt, Homo Sapiens
aacaagcaaggcucuuaggggacacuguugagccuggucccagaaucugugaucuccacagggc

SEQ ID NO: 94115 - RNA, 64 nt, Homo Sapiens
cagagcgaguagagagcagcccucauucaccaccuggucccagacgugcuucaguccucguccu

SEQ ID NO: 94116 - RNA, 64 nt, Homo Sapiens
cuuaucuggaagccuuucuggauuaauccagugauggucccaccuuuaguguuugagcuuuguc

SEQ ID NO: 94117 - RNA, 64 nt, Homo Sapiens
uccccacccuggcccugccccugugaauguccaguggucccagccaagcgucuuggcaggggug

SEQ ID NO: 94118 - RNA, 64 nt, Homo Sapiens
ucugcuaaguuuucugagauggggcggugcgguuuggucccaacuucaugggcauguuccugcu

SEQ ID NO: 94119 - RNA, 64 nt, Homo Sapiens
ugcgcaugcuuaaugcuucuggggaggagggggcuggucccagcggagccgcacucuucgcccg

SEQ ID NO: 94120 - RNA, 64 nt, Homo Sapiens
uaggcccccagcugagggccuggaguggugggauuggucccagugccuggcgcacauuggccug

SEQ ID NO: 94121 - RNA, 64 nt, Homo Sapiens
ggcuggccagguuuugcagcuggaauucuccucuuggucccagggcggggcagggaauucuaag

SEQ ID NO: 94122 - RNA, 64 nt, Homo Sapiens
uggauccaggcccaccugugucccugacucaggguggucccaggacuggcaccuacucuuuaga

SEQ ID NO: 94123 - RNA, 64 nt, Homo Sapiens
ucuggaaaucugauucagccaaaauaaauugcucuggucccaccaaaggauguggagcucuuua

SEQ ID NO: 94124 - RNA, 64 nt, Homo Sapiens
uuuuaucacuuacuaguuguacaguuauggguucuggucccacuagcaugagcucuggggacag

SEQ ID NO: 94125 - RNA, 63 nt, Homo Sapiens
cccuuucugcacagcuggugucggcaucauacuaaaagcaauguuuaaaucaaacuaaagauu

SEQ ID NO: 94126 - RNA, 63 nt, Homo Sapiens
uguguguuuuuuuuuuuuuuuuuuuuguuguuuaaaagcaaggcaugcuuguggaugacucug

SEQ ID NO: 94127 - RNA, 63 nt, Homo Sapiens
aaacuuuuuuuagaauugaagucugaaacaaacaaaagcaauucaaugucaauagacauuaag

SEQ ID NO: 94128 - RNA, 63 nt, Homo Sapiens
uuaaucccauuaucucaggaguguguugguuauaaaagcaaguuuggcucccucuuuuccuca

SEQ ID NO: 94129 - RNA, 63 nt, Homo Sapiens
auaaguuccaaauauguuaagggcuuuaauacaaaaagcaaaaauugucaguguuuggaugaa

SEQ ID NO: 94130 - RNA, 63 nt, Homo Sapiens
caauaagaaugaaucucagaaaauauuaaggaaaaaagcaaguuugaagagaccacauggggc

SEQ ID NO: 94131 - RNA, 63 nt, Homo Sapiens
cuuaucaaggauuaauuuaaacuccuaaaaaaaaaaagcaacuaaacuaguggucaaggacua

SEQ ID NO: 94132 - RNA, 63 nt, Homo Sapiens
uauuccauuuuaagcacuuaugggguuauguagaaaagcaauucuaaauaaaacccaucagca

SEQ ID NO: 94133 - RNA, 63 nt, Homo Sapiens
aucucuccauaaauauuaugaguuuguugcuuuaaaagcaaguggaccuauccuugucuugaa

SEQ ID NO: 94134 - RNA, 63 nt, Homo Sapiens
ccccauuuuccuuuuauaaaaagaccuacaaucaaaagcaaaucaggaaccagcggaucugca

SEQ ID NO: 94135 - RNA, 63 nt, Homo Sapiens
agaaaagacagcagcaucaauggaagaagcaggaaaagcaagagagagcagagcaugcaguga

SEQ ID NO: 94136 - RNA, 63 nt, Homo Sapiens
agaagaaaaggcgacaucaagcagaacaucagaaaaagcaagaaagcacccagaacaugcuga

SEQ ID NO: 94137 - RNA, 63 nt, Homo Sapiens
ggauauucacuuucagcgcugugauguuuuuauaaaagcaaaaauaagugauaguuuauugua

SEQ ID NO: 94138 - RNA, 63 nt, Homo Sapiens
gauaauuauguuaaugucauaggcugcgcuuccaaaagcaaaugagcuggagaugcaagcucu

SEQ ID NO: 94139 - RNA, 63 nt, Homo Sapiens
cuauuuucaaauugugcaaugcuuuuguuuaaaaaaagcaaauuuuuaagacaucuauuuuau

SEQ ID NO: 94140 - RNA, 63 nt, Homo Sapiens
gcauuccuccucagcuccacggggaagacagagaaaagcaaacaccugccccgggagggcagc

SEQ ID NO: 94141 - RNA, 63 nt, Homo Sapiens
acacacauuccuuugaaauccacccaguguuuaaaaagcaacuuggaaauuuacacauuagca

SEQ ID NO: 94142 - RNA, 63 nt, Homo Sapiens
uccuuucuuaguuauuugcuccuugcaaauuaaaaaagcaacuaagagaaagaaaaacauugu

SEQ ID NO: 94143 - RNA, 63 nt, Homo Sapiens
gugcucugccuggagcuguuuccauaugauauaaaaagcaaguguaguauuccauuacuaugu

SEQ ID NO: 94144 - RNA, 63 nt, Homo Sapiens
agucccucaggaaaaaaaaaaaauucuguuuuaaaaagcaaucugauucuuagcucuugaaac

SEQ ID NO: 94145 - RNA, 63 nt, Homo Sapiens
guguauuguaaguagcaguuaaauuauuuuuuuaaaagcaauuucaguuuuaaucacugaaca

SEQ ID NO: 94146 - RNA, 63 nt, Homo Sapiens
ccucuuauuuuucaguuuccagucaagauuauaaaaagcaaaugauugauauaauuugauauu

SEQ ID NO: 94147 - RNA, 63 nt, Homo Sapiens
gaaugaagaaggcaaaaaauaucuuuuguacagaaaagcaagaugaaaaggaugugaaauggu

SEQ ID NO: 94148 - RNA, 63 nt, Homo Sapiens
gucuaugauguguuuacuuuaaaaauugcuguuaaaagcaacacguauuaaauauguaauuau

SEQ ID NO: 94149 - RNA, 63 nt, Homo Sapiens
uugauuuuugcagcacuagcaauggucugacacaaaagcaaguaaggggaaggaccauuucgu

SEQ ID NO: 94150 - RNA, 63 nt, Homo Sapiens
agcaugaaguauugcuuaaaaaugcuuuuuauuaaaagcaaguacuugcaguguuacgaucgg

SEQ ID NO: 94151 - RNA, 63 nt, Homo Sapiens
ucacaagcaucuuugucuugcaaauccuaagggaaaagcaagucccugcagugagcacuaggg

SEQ ID NO: 94152 - RNA, 63 nt, Homo Sapiens
cuuccgaauagaauguuuucuuuaagaggcaugaaaagcaacuauuguuguguuacaguguua

SEQ ID NO: 94153 - RNA, 63 nt, Homo Sapiens
ucaguaagcagcuugccaaucacuccaggucugaaaagcaagucccccagccccaccccaggg

SEQ ID NO: 94154 - RNA, 63 nt, Homo Sapiens
aaagugauuuaaaaaugaucuuaccuguaccagaaaagcaaaguuaaaggaaacaaaauuugu

SEQ ID NO: 94155 - RNA, 63 nt, Homo Sapiens
uuuuuaaaacugcauuuuuaagaaauuuaccacaaaagcaaaauuugcauuuaugauuucucc

SEQ ID NO: 94156 - RNA, 63 nt, Homo Sapiens
acugauuuucaaaaaaauguauuuuaaguguuuaaaagcaaauaggauuuuuuaaaaauuggc

SEQ ID NO: 94157 - RNA, 63 nt, Homo Sapiens
cccaguauuuaaagucuauauuaaaagauggagaaaagcaaaaaagggaguuacagaggcugc

SEQ ID NO: 94158 - RNA, 63 nt, Homo Sapiens
accugagccgaggagaggaucauauauuaaaagaaaagcaaagaaugccuacuauuuuauaug

SEQ ID NO: 94159 - RNA, 63 nt, Homo Sapiens
guuugucauagagggaaccuccuaaagcuaaaaaaaagcaaggcaaaagaugucaguguuaua

SEQ ID NO: 94160 - RNA, 63 nt, Homo Sapiens
uccacaggacagcacugcuuguguaguuggugcaaaagcaaucuagaggucaaggaccuuccu

SEQ ID NO: 94161 - RNA, 63 nt, Homo Sapiens
ugaagauuuagaaguuauauaaaaaauuaauuuaaaagcaaaccaaaagagguuuccauuaac

SEQ ID NO: 94162 - RNA, 63 nt, Homo Sapiens
cugagugauugucaguguaaggccuuuuaaaacaaaagcaaguucuuuguuaggaauugguca

SEQ ID NO: 94163 - RNA, 63 nt, Homo Sapiens
guguuuugccaauuaauauuauaugcuuguaauaaaagcaaaagaaaagcuuaagugaaagug

SEQ ID NO: 94164 - RNA, 63 nt, Homo Sapiens
uaucaucauauggacucuauguaacacaaauucaaaagcaaacuaaaagcuauaugcagaguu

SEQ ID NO: 94165 - RNA, 63 nt, Homo Sapiens
aaaauaaaaaauauuugucuccaccuuuuccccaaaagcaacagcaagacauauuuuguuaga

SEQ ID NO: 94166 - RNA, 63 nt, Homo Sapiens
ugaugauuuucuuuuaaagaaauuaguuuauuuaaaagcaagauagccuggguugggaguuag

SEQ ID NO: 94167 - RNA, 63 nt, Homo Sapiens
cugaauagguuuaagucagauaauagauuuuaaaaaagcaaaugaggcaaugugucaaaauuu

SEQ ID NO: 94168 - RNA, 63 nt, Homo Sapiens
gcaagcagcagccugugaagaauuaauauaauuaaaagcaacagcauuaaaauuucaaaguuu

SEQ ID NO: 94169 - RNA, 63 nt, Homo Sapiens
acagcaacaacacgaagaugguguagaagaggaaaaagcaacaacaagaaaguuuguuugaau

SEQ ID NO: 94170 - RNA, 63 nt, Homo Sapiens
aaaagaagaagaaacagcaggaaaaagcaaaagaaaagcaaaaccaagcaaaaaucaggcuga

SEQ ID NO: 94171 - RNA, 63 nt, Homo Sapiens
gaaaagcaaaaaaaagaagaaaucaggcugagaaaaagcaaaaagaaaaagaagccaagcaaa

SEQ ID NO: 94172 - RNA, 63 nt, Homo Sapiens
uguugaaacaagagaggguguuacauuuuuaauaaaagcaacaaugccaagguaauuuuaaau

SEQ ID NO: 94173 - RNA, 63 nt, Homo Sapiens
acaaaaaacaaaaaagaccuguaguaaaacuuaaaaagcaaaauauacagcugucacucauuu

SEQ ID NO: 94174 - RNA, 63 nt, Homo Sapiens
cacuaugcacugcuguaacugguaguguucaguaaaagcaaaaugauaguuuucuagaugaca

SEQ ID NO: 94175 - RNA, 63 nt, Homo Sapiens
ugaauuaaagcaacaaaaagauauugauuggcaaaaagcaagauauaagagauucauuugcuu

SEQ ID NO: 94176 - RNA, 63 nt, Homo Sapiens
agcaucaggcugagauuugcacacaugggauguaaaagcaagcuguguguugcuuagucacuu

SEQ ID NO: 94177 - RNA, 63 nt, Homo Sapiens
gccaucugaaguucauuaaucuuuagaugacaaaaaagcaaaaaguucccagaacguuuuugc

SEQ ID NO: 94178 - RNA, 63 nt, Homo Sapiens
ccuacuuaaauuuuaaguuaugagguuuaugucaaaagcaacauuucacaaauguacuuuuaa

SEQ ID NO: 94179 - RNA, 63 nt, Homo Sapiens
augcccuuacugugccaaaacaaaaaucuuaagaaaagcaaguagacaccuucauaacuauga

SEQ ID NO: 94180 - RNA, 63 nt, Homo Sapiens
uuuuauguuauugaaaauaucuaaauuauaacuaaaagcaacuuagugaaaguauugaaaaua

SEQ ID NO: 94181 - RNA, 63 nt, Homo Sapiens
aaaauugaaauaagacaucgaauacacgucuuuaaaagcaacaagugucccauugcugccaaa

SEQ ID NO: 94182 - RNA, 63 nt, Homo Sapiens
aauaaucugauauaaguccugacacuagaaacuaaaagcaacauccauuucuauacuuuaugg

SEQ ID NO: 94183 - RNA, 63 nt, Homo Sapiens
ggccagugucugggauacugggaaaggauaugaaaaagcaaguagcagugagaagaaaccuca

SEQ ID NO: 94184 - RNA, 63 nt, Homo Sapiens
auacuaauuuuuuaagccaaacugccagcaucaaaaagcaaagacacaacucugagaauaccc

SEQ ID NO: 94185 - RNA, 63 nt, Homo Sapiens
accucccuuuuuaauugccuuccuuucucauuuaaaagcaaaaguaguaccaaaaagguauuu

SEQ ID NO: 94186 - RNA, 63 nt, Homo Sapiens
uggaaaagccagccauuuacuuaguguacggacaaaagcaaaugaccauaacuggcaaaaucc

SEQ ID NO: 94187 - RNA, 63 nt, Homo Sapiens
gaagaaauauuuuaaggaaaccuauuugaaaaaaaaagcaaagaccauuugauaaaagccuga

SEQ ID NO: 94188 - RNA, 63 nt, Homo Sapiens
aauaauagaaaaauucuacuuuaauuuccauuaaaaagcaaauagcauugacacauuuaaagc

SEQ ID NO: 94189 - RNA, 63 nt, Homo Sapiens
agauuuacaaguguaagcuauaugauuucuucaaaaagcaaaagcaauauaccuaauucauuu

SEQ ID NO: 94190 - RNA, 63 nt, Homo Sapiens
acaaguguaagcuauaugauuucuucaaaaagcaaaagcaauauaccuaauucauuuggauca

SEQ ID NO: 94191 - RNA, 63 nt, Homo Sapiens
uguuuauaagaagauguuugucaguguaugaccaaaagcaauauuuaugcuguacauuucagu

SEQ ID NO: 94192 - RNA, 63 nt, Homo Sapiens
caacacuuuauaguuauucugugcagagggcauaaaagcaaauugguguucuaccugcaagau

SEQ ID NO: 94193 - RNA, 63 nt, Homo Sapiens
uguuuuuuccaguuagucuugaauuuuuauacuaaaagcaaaauguaccuuucagcauccuag

SEQ ID NO: 94194 - RNA, 63 nt, Homo Sapiens
ucaacauaugugauguuuauuggaaacaaaacuaaaagcaaacgaacauugguuaagaacugu

SEQ ID NO: 94195 - RNA, 63 nt, Homo Sapiens
cugugaauauaauuuaauuugcaaaaacaaacaaaaagcaagcguguuauaugacaggacaaa

SEQ ID NO: 94196 - RNA, 63 nt, Homo Sapiens
uuuugauugagauuuuuuacacccaugcaaucaaaaagcaaaaguuguuuucuguggguugcg

SEQ ID NO: 94197 - RNA, 63 nt, Homo Sapiens
aacaaaaaaaaaaaaaaaggaguuuacuaugcuaaaagcaaaauggcauuuucauuacaggag

SEQ ID NO: 94198 - RNA, 63 nt, Homo Sapiens
uuuacuauguaacaaugguaucuaagacagaaaaaaagcaauuguuugcauuuuuuaacauaa

SEQ ID NO: 94199 - RNA, 63 nt, Homo Sapiens
gaauaagaaaauaauguuuaaagaaaaaaaaaaaaaagcaaaccuccaaaacguggaccuaac

SEQ ID NO: 94200 - RNA, 63 nt, Homo Sapiens
uaugacuuggauauaugguugaagaaucaaaacaaaagcaaaaaaaaaaagcaaaaaaagaaa

SEQ ID NO: 94201 - RNA, 63 nt, Homo Sapiens
uaugguugaagaaucaaaacaaaagcaaaaaaaaaaagcaaaaaaagaaaagagaaaaaaaga

SEQ ID NO: 94202 - RNA, 63 nt, Homo Sapiens
uuuagcuugucuuauaggaucaacugacuggcaaaaagcaagcgugaagagaugcaagacuuu

SEQ ID NO: 94203 - RNA, 63 nt, Homo Sapiens
uuguuccuuuuuuuugaaaacaguaauacaaugaaaagcaaaaacucaacuaccucagguauu

SEQ ID NO: 94204 - RNA, 63 nt, Homo Sapiens
aaagcaaaacaauaaacuaguauaaaugaacaaaaaagcaagcuauccauggcaagcuuugua

SEQ ID NO: 94205 - RNA, 63 nt, Homo Sapiens
uguuuauuuaccuguaagggaucuucagauagaaaaagcaaucucauaaaacauguaacacug

SEQ ID NO: 94206 - RNA, 63 nt, Homo Sapiens
cagaugaacucugcuguuuagaaguaaccacagaaaagcaaagucaguguacacucugaguga

SEQ ID NO: 94207 - RNA, 63 nt, Homo Sapiens
uaacucauuuccuugagcuuauacaaaacauagaaaagcaaacuguuaaaguagucaauaauu

SEQ ID NO: 94208 - RNA, 63 nt, Homo Sapiens
ggaugaccuggcaaauaagaucuugaauaggccaaaagcaaguaucuugcuguguguagucuc

SEQ ID NO: 94209 - RNA, 63 nt, Homo Sapiens
uuggguauuagaaaucugaaaguacugucaucuaaaagcaauugugauuuuauuguaauuggu

SEQ ID NO: 94210 - RNA, 63 nt, Homo Sapiens
cagaacaaaacaaaaagccaucguuucccagugaaaagcaaacuugccuagcaagaaucacau

SEQ ID NO: 94211 - RNA, 63 nt, Homo Sapiens
gcauaaaccccucccucuuuaaacaaauuuaccaaaagcaaaacugauuauuuguauugaaga

SEQ ID NO: 94212 - RNA, 63 nt, Homo Sapiens
cuucuaccuccuaccuacuucauccagagccacaaaagcaaacuuccuuuuaccuuucuccac

SEQ ID NO: 94213 - RNA, 63 nt, Homo Sapiens
guugcuugaauuaugaucauaagccauagaagaaaaagcaauacagcauauacauuucagcca

SEQ ID NO: 94214 - RNA, 63 nt, Homo Sapiens
uugguaaguugugugugcucgaagagcaagagaaaaagcaaaugaaaucagaagaacaaaaaa

SEQ ID NO: 94215 - RNA, 63 nt, Homo Sapiens
aaagaaaaugcacucuaacuauguuuaaaaaaaaaaagcaacacagauuuuuuauaugucugc

SEQ ID NO: 94216 - RNA, 63 nt, Homo Sapiens
auuuuggucacuuccaagcuugaugauuauuaaaaaagcaaaagcugaauacuuuuuauaaug

SEQ ID NO: 94217 - RNA, 63 nt, Homo Sapiens
uucagugaaggucaccuggcuauguuauggcuuaaaagcaaguauacuucaguaauaauuaug

SEQ ID NO: 94218 - RNA, 63 nt, Homo Sapiens
ucuucauagaugaaugaaacaaaauucaaaaaaaaaagcaacaaauuuagauugguccuuuuc

SEQ ID NO: 94219 - RNA, 63 nt, Homo Sapiens
cccauguaugccuauaugugguaaccaccuuuaaaaagcaaccgauaauaucacaacccagaa

SEQ ID NO: 94220 - RNA, 63 nt, Homo Sapiens
augauuacugauaauaucaccagaaauguauaaaaaagcaaaacauagaaaacuugaaaaaug

SEQ ID NO: 94221 - RNA, 63 nt, Homo Sapiens
cgcauaccugcuuccaagaauaaaacaguucugaaaagcaaccgcaaagccgggcgcgguggc

SEQ ID NO: 94222 - RNA, 63 nt, Homo Sapiens
aaaaaaaagaaagaaagaaagagaaaagaaaagaaaagcaaccacagccagccuuagggaaaa

SEQ ID NO: 94223 - RNA, 63 nt, Homo Sapiens
agaauaguuucugagucuguacaccagugguaaaaaagcaagugauuacaagcugucucucug

SEQ ID NO: 94224 - RNA, 63 nt, Homo Sapiens
aacaaaaacaagucccauguccaaaaaaaaccaaaaagcaaaaaggggccauaucauucaugg

SEQ ID NO: 94225 - RNA, 63 nt, Homo Sapiens
gagaaggaacaggaaugaaauuaaaaacuguucaaaagcaaaaugacuuagcuauuaguauau

SEQ ID NO: 94226 - RNA, 63 nt, Homo Sapiens
aauugucuaauuuacagcaguugugaucccacaaaaagcaaguuuauaccucagauuggggua

SEQ ID NO: 94227 - RNA, 63 nt, Homo Sapiens
aguaaauccaugucuuuguuuguuuuucuauuaaaaagcaaucaagaaagauaaugugaaaaa

SEQ ID NO: 94228 - RNA, 63 nt, Homo Sapiens
ggcccagacaggcucacucaagcucuuuaacugaaaagcaacaagccacuccaggacaagguu

SEQ ID NO: 94229 - RNA, 63 nt, Homo Sapiens
gaguaggagagaggaaacauuugacuuaucuggaaaagcaaaauguacuuaagaauaagaaua

SEQ ID NO: 94230 - RNA, 63 nt, Homo Sapiens
uuagaaguuaaaccacccgauaggccuucgagcaaaagcaaagauccaccgagagaagaagag

SEQ ID NO: 94231 - RNA, 63 nt, Homo Sapiens
uucgucauccaaguccaggucuagaucacacucaaaagcaaagcauucucuucccagugccua

SEQ ID NO: 94232 - RNA, 63 nt, Homo Sapiens
gucuuugguguuggaggacacucuuguucuuaaaaaagcaaguuauucagugaauuacacauc

SEQ ID NO: 94233 - RNA, 63 nt, Homo Sapiens
gguggaucaacccaguuguuggagcuaugguguaaaagcaacacauauauauuuuuggaaaau

SEQ ID NO: 94234 - RNA, 63 nt, Homo Sapiens
cuguauaaaugugaaauuuuaaauacauuauugaaaagcaaauuguucacugaauaaauaagu

SEQ ID NO: 94235 - RNA, 63 nt, Homo Sapiens
cuuaauuugaaauaacagcccagaaaaaguccgaaaagcaaacgauccaacuauuucuuucau

SEQ ID NO: 94236 - RNA, 63 nt, Homo Sapiens
aagagagcugggaauaucugacuuuuuucuuuuaaaagcaacccugcuccagugaaauguggu

SEQ ID NO: 94237 - RNA, 63 nt, Homo Sapiens
ucugguugaccaugauuuuacaucuucccaggcaaaagcaacaucugcaacagaauaugacac

SEQ ID NO: 94238 - RNA, 63 nt, Homo Sapiens
aacuauuccuguguaaaaacaacaaaaacaaacaaaagcaagaaaaccacaacuaaaacugga

SEQ ID NO: 94239 - RNA, 63 nt, Homo Sapiens
gagggaaggaauaaucauucaaaugaacuuuaaaaaagcaaauuucaugcacugauuaaaaua

SEQ ID NO: 94240 - RNA, 63 nt, Homo Sapiens
gagaaaagagaaaccgggagaggaaaaaaagcaaaaagcaagguaagacaugugaggaggaaa

SEQ ID NO: 94241 - RNA, 63 nt, Homo Sapiens
agcaagggagaaaagagaaagaggaaaaggaaaaaaagcaaaagcaggccuaagacaugugag

SEQ ID NO: 94242 - RNA, 63 nt, Homo Sapiens
auguuguuuuaaaagaaaauagcaaaacaacaaaaaagcaaaccuuaaaaugugaagaaagug

SEQ ID NO: 94243 - RNA, 63 nt, Homo Sapiens
acaauaaacugguuguauggccauagcuauccgaaaagcaagagacaaagcaagacaaauauu

SEQ ID NO: 94244 - RNA, 63 nt, Homo Sapiens
cuauuuugugacuaaauauuacuaugugcauacaaaagcaauaaaaagcaaaguaaucuuaca

SEQ ID NO: 94245 - RNA, 63 nt, Homo Sapiens
uaaucuuacaacuaugugcaaguuuuuauugacaaaagcaaagaguuuuaugaaagaugguau

SEQ ID NO: 94246 - RNA, 63 nt, Homo Sapiens
caaguacguauucagcauuaucaacugaagaaaaaaagcaaguguaaaagggaugcuagaaau

SEQ ID NO: 94247 - RNA, 63 nt, Homo Sapiens
auucccucaacaucagaacacagucauuacagaaaaagcaaauaagagcucccaucugaucug

SEQ ID NO: 94248 - RNA, 63 nt, Homo Sapiens
cuuaaaaaaaaaaaaaaagaacauuuuucuuuaaaaagcaaaacaugacuuggaacugaacua

SEQ ID NO: 94249 - RNA, 63 nt, Homo Sapiens
uuucuacugucaugugggauccauucucaggucaaaagcaagagaggguggacggagcggggc

SEQ ID NO: 94250 - RNA, 63 nt, Homo Sapiens
acaagaaaucaaaauccaaaaaaggaaauccaaaaaagcaaacaccggacacaccucugcucc

SEQ ID NO: 94251 - RNA, 63 nt, Homo Sapiens
gaagcauacuugugaacuacaaaguuuuuuuaaaaaagcaaagggcuuuaaguaaaaauccaa

SEQ ID NO: 94252 - RNA, 63 nt, Homo Sapiens
cuuggcauuggaauucuacuggaaaaaaauacaaaaagcaaaacaaaacccucagcacuguua

SEQ ID NO: 94253 - RNA, 63 nt, Homo Sapiens
auagggucacuuugccauuaugcaaauggagauaaaagcaauucugacuguccaggagcuaau

SEQ ID NO: 94254 - RNA, 63 nt, Homo Sapiens
auaugaagaaguaguucagacauccugaaauaaaaaagcaagauuccuggaaguaauuguaag

SEQ ID NO: 94255 - RNA, 63 nt, Homo Sapiens
agccuggcuuagcaaggagcugaauucuguaauaaaagcaaacagaaugaauguagaaaaggc

SEQ ID NO: 94256 - RNA, 63 nt, Homo Sapiens
ccccuaugguugauauuguuaaaaaaaaaaaaaaaaagcaaacuuuugucucauuugccaaaa

SEQ ID NO: 94257 - RNA, 63 nt, Homo Sapiens
uggacauuuccuucuaguccuuuguuccccgugaaaagcaacaccagaaccuuuuugccuuuu

SEQ ID NO: 94258 - RNA, 63 nt, Homo Sapiens
gaggcucuuucuauaaauacauauuguuuaaaaaaaagcaagaaaaaaaggaaaacaaaggaa

SEQ ID NO: 94259 - RNA, 63 nt, Homo Sapiens
caacagagcgagacccugucuccaaaaaaaaaaaaaagcaauguuuauauuauaaaagagugu

SEQ ID NO: 94260 - RNA, 63 nt, Homo Sapiens
uauuuggaaccagaaaagcccaaccuaaauagcaaaagcaauccuaagcaaaaagagcaaugu

SEQ ID NO: 94261 - RNA, 63 nt, Homo Sapiens
aaucaaaacauagaugcuagugaggcugcagagaaaagcaaauacuuauacacugcugguggg

SEQ ID NO: 94262 - RNA, 63 nt, Homo Sapiens
gauguuuccauuaaucuuuuacuaucaagucugaaaagcaauuaaccaccuuuugaagcagca

SEQ ID NO: 94263 - RNA, 63 nt, Homo Sapiens
cauuguguacuaaagguuuuugcauaccgaaauaaaagcaauuacuaaaugcugaaaugugga

SEQ ID NO: 94264 - RNA, 63 nt, Homo Sapiens
cagugaucagaauagauauccuuuuacacgcacaaaagcaauagauucauucaguggacaagu

SEQ ID NO: 94265 - RNA, 63 nt, Homo Sapiens
uuuacauaguaaguuucacacuaccuuauuaccaaaagcaaacaccucuuacuuuaaacuaca

SEQ ID NO: 94266 - RNA, 63 nt, Homo Sapiens
gcacuuuuuaaaacaaacaaacaaacaaaacaaaaaagcaaaccacauuuguuaucucaaauu

SEQ ID NO: 94267 - RNA, 63 nt, Homo Sapiens
cugcugacucacacugcuaacucuguuacugacaaaagcaaaucaauaacucuaaauucuggg

SEQ ID NO: 94268 - RNA, 63 nt, Homo Sapiens
auaaugggcuuuguuagcacuuucaaaaaaaaaaaaagcaaaccauacuuguccacuguccug

SEQ ID NO: 94269 - RNA, 63 nt, Homo Sapiens
ccaccagggggaaggcuggcacaaggagaaaaaaaaagcaagcaucagcgaauaguauagugu

SEQ ID NO: 94270 - RNA, 63 nt, Homo Sapiens
cauguaggguuggugagaaggaaagaugagaacaaaagcaacauuggguuaagggaacucgcu

SEQ ID NO: 94271 - RNA, 63 nt, Homo Sapiens
agaaaagcacacgaacagguggauucacuuaacaaaagcaagauagucuaacuuaaacggaug

SEQ ID NO: 94272 - RNA, 63 nt, Homo Sapiens
acaagaacaaaaacaccaaauuugcuuugaagaaaaagcaaaacuuaaagaccaaaucauuug

SEQ ID NO: 94273 - RNA, 63 nt, Homo Sapiens
aauuuaaaaacaagcccaccauauuuuuacaaaaaaagcaaacgauuucuauucaccuuuaau

SEQ ID NO: 94274 - RNA, 63 nt, Homo Sapiens
uuacccucagaguuaugcuuguuguuuccaaugaaaagcaagucccccuguuuguuguuuugu

SEQ ID NO: 94275 - RNA, 63 nt, Homo Sapiens
ccugcaaccaaacucccaucuuccuuaugcuguaaaagcaaguucuagcauauauguguccau

SEQ ID NO: 94276 - RNA, 63 nt, Homo Sapiens
ggcauuucccacccugaacauucccugguaagaaaaagcaaaacucuccuagguagcccccuc

SEQ ID NO: 94277 - RNA, 63 nt, Homo Sapiens
aaaaugcuguguugaaaugcuagggaaaccuucaaaagcaauacaauagaaugaugucugcuc

SEQ ID NO: 94278 - RNA, 63 nt, Homo Sapiens
gaccccaucccucuaaagccggugaugcacagcaaaagcaaugaaauguaacugcuaaucaag

SEQ ID NO: 94279 - RNA, 64 nt, Homo Sapiens; identical to SEQ ID NO: 81174

SEQ ID NO: 94280 - RNA, 64 nt, Homo Sapiens; identical to SEQ ID NO: 81175

SEQ ID NO: 94281 - RNA, 64 nt, Homo Sapiens; identical to SEQ ID NO: 81176

SEQ ID NO: 94282 - RNA, 64 nt, Homo Sapiens; identical to SEQ ID NO: 81177

SEQ ID NO: 94283 - RNA, 64 nt, Homo Sapiens; identical to SEQ ID NO: 81178

SEQ ID NO: 94284 - RNA, 64 nt, Homo Sapiens; identical to SEQ ID NO: 81179

SEQ ID NO: 94285 - RNA, 64 nt, Homo Sapiens; identical to SEQ ID NO: 81180

SEQ ID NO: 94286 - RNA, 64 nt, Homo Sapiens; identical to SEQ ID NO: 81181

SEQ ID NO: 94287 - RNA, 64 nt, Homo Sapiens; identical to SEQ ID NO: 81182

SEQ ID NO: 94288 - RNA, 64 nt, Homo Sapiens; identical to SEQ ID NO: 81183

SEQ ID NO: 94289 - RNA, 64 nt, Homo Sapiens; identical to SEQ ID NO: 81184

SEQ ID NO: 94290 - RNA, 64 nt, Homo Sapiens; identical to SEQ ID NO: 81185

SEQ ID NO: 94291 - RNA, 64 nt, Homo Sapiens; identical to SEQ ID NO: 81186

SEQ ID NO: 94292 - RNA, 64 nt, Homo Sapiens; identical to SEQ ID NO: 81187

SEQ ID NO: 94293 - RNA, 64 nt, Homo Sapiens; identical to SEQ ID NO: 81188

SEQ ID NO: 94294 - RNA, 64 nt, Homo Sapiens; identical to SEQ ID NO: 81189

SEQ ID NO: 94295 - RNA, 64 nt, Homo Sapiens; identical to SEQ ID NO: 81190

SEQ ID NO: 94296 - RNA, 64 nt, Homo Sapiens; identical to SEQ ID NO: 81191

SEQ ID NO: 94297 - RNA, 64 nt, Homo Sapiens; identical to SEQ ID NO: 81192

SEQ ID NO: 94298 - RNA, 64 nt, Homo Sapiens; identical to SEQ ID NO: 81193

SEQ ID NO: 94299 - RNA, 64 nt, Homo Sapiens; identical to SEQ ID NO: 81194

SEQ ID NO: 94300 - RNA, 64 nt, Homo Sapiens; identical to SEQ ID NO: 81195

SEQ ID NO: 94301 - RNA, 64 nt, Homo Sapiens; identical to SEQ ID NO: 81196

SEQ ID NO: 94302 - RNA, 64 nt, Homo Sapiens; identical to SEQ ID NO: 81197

SEQ ID NO: 94303 - RNA, 64 nt, Homo Sapiens; identical to SEQ ID NO: 81198

SEQ ID NO: 94304 - RNA, 64 nt, Homo Sapiens; identical to SEQ ID NO: 81199

SEQ ID NO: 94305 - RNA, 64 nt, Homo Sapiens; identical to SEQ ID NO: 81200

SEQ ID NO: 94306 - RNA, 64 nt, Homo Sapiens; identical to SEQ ID NO: 81201

SEQ ID NO: 94307 - RNA, 64 nt, Homo Sapiens; identical to SEQ ID NO: 81202

SEQ ID NO: 94308 - RNA, 64 nt, Homo Sapiens; identical to SEQ ID NO: 81203

SEQ ID NO: 94309 - RNA, 64 nt, Homo Sapiens; identical to SEQ ID NO: 81204

SEQ ID NO: 94310 - RNA, 64 nt, Homo Sapiens; identical to SEQ ID NO: 81205

SEQ ID NO: 94311 - RNA, 64 nt, Homo Sapiens; identical to SEQ ID NO: 81206

SEQ ID NO: 94312 - RNA, 64 nt, Homo Sapiens; identical to SEQ ID NO: 81207

SEQ ID NO: 94313 - RNA, 64 nt, Homo Sapiens; identical to SEQ ID NO: 81208

SEQ ID NO: 94314 - RNA, 64 nt, Homo Sapiens; identical to SEQ ID NO: 81209

SEQ ID NO: 94315 - RNA, 64 nt, Homo Sapiens; identical to SEQ ID NO: 81210

SEQ ID NO: 94316 - RNA, 64 nt, Homo Sapiens; identical to SEQ ID NO: 81211

SEQ ID NO: 94317 - RNA, 64 nt, Homo Sapiens; identical to SEQ ID NO: 81212

SEQ ID NO: 94318 - RNA, 64 nt, Homo Sapiens; identical to SEQ ID NO: 81213

SEQ ID NO: 94319 - RNA, 64 nt, Homo Sapiens; identical to SEQ ID NO: 81214

SEQ ID NO: 94320 - RNA, 64 nt, Homo Sapiens; identical to SEQ ID NO: 81215

SEQ ID NO: 94321 - RNA, 64 nt, Homo Sapiens; identical to SEQ ID NO: 81216

SEQ ID NO: 94322 - RNA, 64 nt, Homo Sapiens; identical to SEQ ID NO: 81217

SEQ ID NO: 94323 - RNA, 64 nt, Homo Sapiens; identical to SEQ ID NO: 81218

SEQ ID NO: 94324 - RNA, 64 nt, Homo Sapiens; identical to SEQ ID NO: 81219

SEQ ID NO: 94325 - RNA, 64 nt, Homo Sapiens; identical to SEQ ID NO: 81220

SEQ ID NO: 94326 - RNA, 64 nt, Homo Sapiens; identical to SEQ ID NO: 81221

SEQ ID NO: 94327 - RNA, 64 nt, Homo Sapiens; identical to SEQ ID NO: 81222

SEQ ID NO: 94328 - RNA, 64 nt, Homo Sapiens; identical to SEQ ID NO: 81223

SEQ ID NO: 94329 - RNA, 64 nt, Homo Sapiens; identical to SEQ ID NO: 81224

SEQ ID NO: 94330 - RNA, 64 nt, Homo Sapiens; identical to SEQ ID NO: 81225

SEQ ID NO: 94331 - RNA, 64 nt, Homo Sapiens; identical to SEQ ID NO: 81226

SEQ ID NO: 94332 - RNA, 64 nt, Homo Sapiens; identical to SEQ ID NO: 81227

SEQ ID NO: 94333 - RNA, 64 nt, Homo Sapiens; identical to SEQ ID NO: 81228

SEQ ID NO: 94334 - RNA, 64 nt, Homo Sapiens; identical to SEQ ID NO: 81229

SEQ ID NO: 94335 - RNA, 64 nt, Homo Sapiens; identical to SEQ ID NO: 81230

SEQ ID NO: 94336 - RNA, 64 nt, Homo Sapiens; identical to SEQ ID NO: 81231

SEQ ID NO: 94337 - RNA, 64 nt, Homo Sapiens; identical to SEQ ID NO: 81232

SEQ ID NO: 94338 - RNA, 64 nt, Homo Sapiens; identical to SEQ ID NO: 81233

SEQ ID NO: 94339 - RNA, 64 nt, Homo Sapiens; identical to SEQ ID NO: 81234

SEQ ID NO: 94340 - RNA, 64 nt, Homo Sapiens; identical to SEQ ID NO: 81235

SEQ ID NO: 94341 - RNA, 64 nt, Homo Sapiens; identical to SEQ ID NO: 81236

SEQ ID NO: 94342 - RNA, 64 nt, Homo Sapiens; identical to SEQ ID NO: 81237

SEQ ID NO: 94343 - RNA, 64 nt, Homo Sapiens; identical to SEQ ID NO: 81238

SEQ ID NO: 94344 - RNA, 64 nt, Homo Sapiens; identical to SEQ ID NO: 81239

SEQ ID NO: 94345 - RNA, 64 nt, Homo Sapiens; identical to SEQ ID NO: 81240

SEQ ID NO: 94346 - RNA, 64 nt, Homo Sapiens; identical to SEQ ID NO: 81241

SEQ ID NO: 94347 - RNA, 64 nt, Homo Sapiens; identical to SEQ ID NO: 81242

SEQ ID NO: 94348 - RNA, 64 nt, Homo Sapiens; identical to SEQ ID NO: 81243

SEQ ID NO: 94349 - RNA, 64 nt, Homo Sapiens; identical to SEQ ID NO: 81244

SEQ ID NO: 94350 - RNA, 64 nt, Homo Sapiens; identical to SEQ ID NO: 81245

SEQ ID NO: 94351 - RNA, 64 nt, Homo Sapiens; identical to SEQ ID NO: 81246

SEQ ID NO: 94352 - RNA, 64 nt, Homo Sapiens; identical to SEQ ID NO: 81247

SEQ ID NO: 94353 - RNA, 64 nt, Homo Sapiens; identical to SEQ ID NO: 81248

SEQ ID NO: 94354 - RNA, 64 nt, Homo Sapiens; identical to SEQ ID NO: 81249

SEQ ID NO: 94355 - RNA, 64 nt, Homo Sapiens; identical to SEQ ID NO: 81250

SEQ ID NO: 94356 - RNA, 64 nt, Homo Sapiens; identical to SEQ ID NO: 81251

SEQ ID NO: 94357 - RNA, 64 nt, Homo Sapiens; identical to SEQ ID NO: 81252

SEQ ID NO: 94358 - RNA, 64 nt, Homo Sapiens; identical to SEQ ID NO: 81253

SEQ ID NO: 94359 - RNA, 64 nt, Homo Sapiens; identical to SEQ ID NO: 81254

SEQ ID NO: 94360 - RNA, 64 nt, Homo Sapiens; identical to SEQ ID NO: 81255

SEQ ID NO: 94361 - RNA, 64 nt, Homo Sapiens; identical to SEQ ID NO: 81256

SEQ ID NO: 94362 - RNA, 64 nt, Homo Sapiens; identical to SEQ ID NO: 81257

SEQ ID NO: 94363 - RNA, 64 nt, Homo Sapiens; identical to SEQ ID NO: 81258

SEQ ID NO: 94364 - RNA, 64 nt, Homo Sapiens; identical to SEQ ID NO: 81259

SEQ ID NO: 94365 - RNA, 64 nt, Homo Sapiens; identical to SEQ ID NO: 81260

SEQ ID NO: 94366 - RNA, 64 nt, Homo Sapiens; identical to SEQ ID NO: 81261

SEQ ID NO: 94367 - RNA, 64 nt, Homo Sapiens; identical to SEQ ID NO: 81262

SEQ ID NO: 94368 - RNA, 64 nt, Homo Sapiens; identical to SEQ ID NO: 81263

SEQ ID NO: 94369 - RNA, 64 nt, Homo Sapiens; identical to SEQ ID NO: 81264

SEQ ID NO: 94370 - RNA, 64 nt, Homo Sapiens; identical to SEQ ID NO: 81265

SEQ ID NO: 94371 - RNA, 64 nt, Homo Sapiens; identical to SEQ ID NO: 81266

SEQ ID NO: 94372 - RNA, 64 nt, Homo Sapiens; identical to SEQ ID NO: 81267

SEQ ID NO: 94373 - RNA, 64 nt, Homo Sapiens; identical to SEQ ID NO: 81268

SEQ ID NO: 94374 - RNA, 64 nt, Homo Sapiens; identical to SEQ ID NO: 81269

SEQ ID NO: 94375 - RNA, 64 nt, Homo Sapiens; identical to SEQ ID NO: 81270

SEQ ID NO: 94376 - RNA, 64 nt, Homo Sapiens; identical to SEQ ID NO: 81271

SEQ ID NO: 94377 - RNA, 64 nt, Homo Sapiens; identical to SEQ ID NO: 81272

SEQ ID NO: 94378 - RNA, 64 nt, Homo Sapiens; identical to SEQ ID NO: 81273

SEQ ID NO: 94379 - RNA, 64 nt, Homo Sapiens; identical to SEQ ID NO: 81274

SEQ ID NO: 94380 - RNA, 64 nt, Homo Sapiens; identical to SEQ ID NO: 81275

SEQ ID NO: 94381 - RNA, 64 nt, Homo Sapiens; identical to SEQ ID NO: 81276

SEQ ID NO: 94382 - RNA, 64 nt, Homo Sapiens; identical to SEQ ID NO: 81277

SEQ ID NO: 94383 - RNA, 64 nt, Homo Sapiens; identical to SEQ ID NO: 81278

SEQ ID NO: 94384 - RNA, 64 nt, Homo Sapiens; identical to SEQ ID NO: 81279

SEQ ID NO: 94385 - RNA, 64 nt, Homo Sapiens; identical to SEQ ID NO: 81280

SEQ ID NO: 94386 - RNA, 64 nt, Homo Sapiens; identical to SEQ ID NO: 81281

SEQ ID NO: 94387 - RNA, 51 nt, Homo Sapiens; identical to SEQ ID NO: 81282

SEQ ID NO: 94388 - RNA, 64 nt, Homo Sapiens; identical to SEQ ID NO: 81283

SEQ ID NO: 94389 - RNA, 64 nt, Homo Sapiens; identical to SEQ ID NO: 81284

SEQ ID NO: 94390 - RNA, 64 nt, Homo Sapiens; identical to SEQ ID NO: 81285

SEQ ID NO: 94391 - RNA, 64 nt, Homo Sapiens; identical to SEQ ID NO: 81286

SEQ ID NO: 94392 - RNA, 64 nt, Homo Sapiens; identical to SEQ ID NO: 81287

SEQ ID NO: 94393 - RNA, 64 nt, Homo Sapiens; identical to SEQ ID NO: 81288

SEQ ID NO: 94394 - RNA, 64 nt, Homo Sapiens; identical to SEQ ID NO: 81289

SEQ ID NO: 94395 - RNA, 64 nt, Homo Sapiens; identical to SEQ ID NO: 81290

SEQ ID NO: 94396 - RNA, 64 nt, Homo Sapiens; identical to SEQ ID NO: 81291

SEQ ID NO: 94397 - RNA, 64 nt, Homo Sapiens; identical to SEQ ID NO: 81292

SEQ ID NO: 94398 - RNA, 64 nt, Homo Sapiens; identical to SEQ ID NO: 81293

SEQ ID NO: 94399 - RNA, 64 nt, Homo Sapiens; identical to SEQ ID NO: 81294

SEQ ID NO: 94400 - RNA, 64 nt, Homo Sapiens; identical to SEQ ID NO: 81295

SEQ ID NO: 94401 - RNA, 64 nt, Homo Sapiens; identical to SEQ ID NO: 81296

SEQ ID NO: 94402 - RNA, 64 nt, Homo Sapiens; identical to SEQ ID NO: 81297

SEQ ID NO: 94403 - RNA, 64 nt, Homo Sapiens; identical to SEQ ID NO: 81298

SEQ ID NO: 94404 - RNA, 64 nt, Homo Sapiens; identical to SEQ ID NO: 81299

SEQ ID NO: 94405 - RNA, 64 nt, Homo Sapiens; identical to SEQ ID NO: 81300

SEQ ID NO: 94406 - RNA, 64 nt, Homo Sapiens; identical to SEQ ID NO: 81301

SEQ ID NO: 94407 - RNA, 64 nt, Homo Sapiens; identical to SEQ ID NO: 81302

SEQ ID NO: 94408 - RNA, 64 nt, Homo Sapiens; identical to SEQ ID NO: 81303

SEQ ID NO: 94409 - RNA, 64 nt, Homo Sapiens; identical to SEQ ID NO: 81304

SEQ ID NO: 94410 - RNA, 64 nt, Homo Sapiens; identical to SEQ ID NO: 81305

SEQ ID NO: 94411 - RNA, 64 nt, Homo Sapiens; identical to SEQ ID NO: 81306

SEQ ID NO: 94412 - RNA, 64 nt, Homo Sapiens; identical to SEQ ID NO: 81307

SEQ ID NO: 94413 - RNA, 64 nt, Homo Sapiens; identical to SEQ ID NO: 81308

SEQ ID NO: 94414 - RNA, 64 nt, Homo Sapiens; identical to SEQ ID NO: 81309

SEQ ID NO: 94415 - RNA, 64 nt, Homo Sapiens; identical to SEQ ID NO: 81310

SEQ ID NO: 94416 - RNA, 64 nt, Homo Sapiens; identical to SEQ ID NO: 81311

SEQ ID NO: 94417 - RNA, 64 nt, Homo Sapiens; identical to SEQ ID NO: 81312

SEQ ID NO: 94418 - RNA, 64 nt, Homo Sapiens; identical to SEQ ID NO: 81313

SEQ ID NO: 94419 - RNA, 64 nt, Homo Sapiens; identical to SEQ ID NO: 81314

SEQ ID NO: 94420 - RNA, 64 nt, Homo Sapiens; identical to SEQ ID NO: 81315

SEQ ID NO: 94421 - RNA, 64 nt, Homo Sapiens; identical to SEQ ID NO: 81316

SEQ ID NO: 94422 - RNA, 64 nt, Homo Sapiens; identical to SEQ ID NO: 81317

SEQ ID NO: 94423 - RNA, 64 nt, Homo Sapiens; identical to SEQ ID NO: 81318

SEQ ID NO: 94424 - RNA, 64 nt, Homo Sapiens; identical to SEQ ID NO: 81319

SEQ ID NO: 94425 - RNA, 64 nt, Homo Sapiens; identical to SEQ ID NO: 81320

SEQ ID NO: 94426 - RNA, 64 nt, Homo Sapiens; identical to SEQ ID NO: 81321

SEQ ID NO: 94427 - RNA, 64 nt, Homo Sapiens; identical to SEQ ID NO: 81322

SEQ ID NO: 94428 - RNA, 64 nt, Homo Sapiens; identical to SEQ ID NO: 81323

SEQ ID NO: 94429 - RNA, 64 nt, Homo Sapiens; identical to SEQ ID NO: 81324

SEQ ID NO: 94430 - RNA, 64 nt, Homo Sapiens; identical to SEQ ID NO: 81325

SEQ ID NO: 94431 - RNA, 64 nt, Homo Sapiens; identical to SEQ ID NO: 81326

SEQ ID NO: 94432 - RNA, 64 nt, Homo Sapiens; identical to SEQ ID NO: 81327

SEQ ID NO: 94433 - RNA, 64 nt, Homo Sapiens; identical to SEQ ID NO: 81328

SEQ ID NO: 94434 - RNA, 64 nt, Homo Sapiens; identical to SEQ ID NO: 81329

SEQ ID NO: 94435 - RNA, 64 nt, Homo Sapiens; identical to SEQ ID NO: 81330

SEQ ID NO: 94436 - RNA, 64 nt, Homo Sapiens; identical to SEQ ID NO: 81331

SEQ ID NO: 94437 - RNA, 64 nt, Homo Sapiens; identical to SEQ ID NO: 81332

SEQ ID NO: 94438 - RNA, 64 nt, Homo Sapiens; identical to SEQ ID NO: 81333

SEQ ID NO: 94439 - RNA, 64 nt, Homo Sapiens; identical to SEQ ID NO: 81334

SEQ ID NO: 94440 - RNA, 64 nt, Homo Sapiens; identical to SEQ ID NO: 81335

SEQ ID NO: 94441 - RNA, 64 nt, Homo Sapiens; identical to SEQ ID NO: 81336

SEQ ID NO: 94442 - RNA, 64 nt, Homo Sapiens; identical to SEQ ID NO: 81337

SEQ ID NO: 94443 - RNA, 64 nt, Homo Sapiens; identical to SEQ ID NO: 81338

SEQ ID NO: 94444 - RNA, 64 nt, Homo Sapiens; identical to SEQ ID NO: 81339

SEQ ID NO: 94445 - RNA, 64 nt, Homo Sapiens; identical to SEQ ID NO: 81340

SEQ ID NO: 94446 - RNA, 64 nt, Homo Sapiens; identical to SEQ ID NO: 81341

SEQ ID NO: 94447 - RNA, 64 nt, Homo Sapiens; identical to SEQ ID NO: 81342

SEQ ID NO: 94448 - RNA, 64 nt, Homo Sapiens; identical to SEQ ID NO: 81343

SEQ ID NO: 94449 - RNA, 64 nt, Homo Sapiens; identical to SEQ ID NO: 81344

SEQ ID NO: 94450 - RNA, 64 nt, Homo Sapiens; identical to SEQ ID NO: 81345

SEQ ID NO: 94451 - RNA, 64 nt, Homo Sapiens; identical to SEQ ID NO: 81346

SEQ ID NO: 94452 - RNA, 64 nt, Homo Sapiens; identical to SEQ ID NO: 81347

SEQ ID NO: 94453 - RNA, 64 nt, Homo Sapiens; identical to SEQ ID NO: 81348

SEQ ID NO: 94454 - RNA, 64 nt, Homo Sapiens; identical to SEQ ID NO: 81349

SEQ ID NO: 94455 - RNA, 64 nt, Homo Sapiens; identical to SEQ ID NO: 81350

SEQ ID NO: 94456 - RNA, 64 nt, Homo Sapiens; identical to SEQ ID NO: 81351

SEQ ID NO: 94457 - RNA, 64 nt, Homo Sapiens; identical to SEQ ID NO: 81352

SEQ ID NO: 94458 - RNA, 64 nt, Homo Sapiens; identical to SEQ ID NO: 81353

SEQ ID NO: 94459 - RNA, 64 nt, Homo Sapiens; identical to SEQ ID NO: 81354

SEQ ID NO: 94460 - RNA, 64 nt, Homo Sapiens; identical to SEQ ID NO: 81355

SEQ ID NO: 94461 - RNA, 64 nt, Homo Sapiens; identical to SEQ ID NO: 81356

SEQ ID NO: 94462 - RNA, 64 nt, Homo Sapiens; identical to SEQ ID NO: 81357

SEQ ID NO: 94463 - RNA, 64 nt, Homo Sapiens; identical to SEQ ID NO: 81358

SEQ ID NO: 94464 - RNA, 64 nt, Homo Sapiens; identical to SEQ ID NO: 81359

SEQ ID NO: 94465 - RNA, 64 nt, Homo Sapiens; identical to SEQ ID NO: 81360

SEQ ID NO: 94466 - RNA, 64 nt, Homo Sapiens; identical to SEQ ID NO: 81361

SEQ ID NO: 94467 - RNA, 64 nt, Homo Sapiens; identical to SEQ ID NO: 81362

SEQ ID NO: 94468 - RNA, 64 nt, Homo Sapiens; identical to SEQ ID NO: 81363

SEQ ID NO: 94469 - RNA, 64 nt, Homo Sapiens; identical to SEQ ID NO: 81364

SEQ ID NO: 94470 - RNA, 64 nt, Homo Sapiens; identical to SEQ ID NO: 81365

SEQ ID NO: 94471 - RNA, 64 nt, Homo Sapiens; identical to SEQ ID NO: 81366

SEQ ID NO: 94472 - RNA, 64 nt, Homo Sapiens; identical to SEQ ID NO: 81367

SEQ ID NO: 94473 - RNA, 64 nt, Homo Sapiens; identical to SEQ ID NO: 81368

SEQ ID NO: 94474 - RNA, 64 nt, Homo Sapiens; identical to SEQ ID NO: 81369

SEQ ID NO: 94475 - RNA, 64 nt, Homo Sapiens; identical to SEQ ID NO: 81370

SEQ ID NO: 94476 - RNA, 64 nt, Homo Sapiens; identical to SEQ ID NO: 81371

SEQ ID NO: 94477 - RNA, 64 nt, Homo Sapiens; identical to SEQ ID NO: 81372

SEQ ID NO: 94478 - RNA, 64 nt, Homo Sapiens; identical to SEQ ID NO: 81373

SEQ ID NO: 94479 - RNA, 64 nt, Homo Sapiens; identical to SEQ ID NO: 81374

SEQ ID NO: 94480 - RNA, 64 nt, Homo Sapiens; identical to SEQ ID NO: 81375

SEQ ID NO: 94481 - RNA, 64 nt, Homo Sapiens; identical to SEQ ID NO: 81376

SEQ ID NO: 94482 - RNA, 64 nt, Homo Sapiens; identical to SEQ ID NO: 81377

SEQ ID NO: 94483 - RNA, 64 nt, Homo Sapiens; identical to SEQ ID NO: 81378

SEQ ID NO: 94484 - RNA, 64 nt, Homo Sapiens; identical to SEQ ID NO: 81379

SEQ ID NO: 94485 - RNA, 64 nt, Homo Sapiens; identical to SEQ ID NO: 81380

SEQ ID NO: 94486 - RNA, 64 nt, Homo Sapiens; identical to SEQ ID NO: 81381

SEQ ID NO: 94487 - RNA, 64 nt, Homo Sapiens; identical to SEQ ID NO: 81382

SEQ ID NO: 94488 - RNA, 64 nt, Homo Sapiens; identical to SEQ ID NO: 81383

SEQ ID NO: 94489 - RNA, 64 nt, Homo Sapiens; identical to SEQ ID NO: 81384

SEQ ID NO: 94490 - RNA, 64 nt, Homo Sapiens; identical to SEQ ID NO: 81385

SEQ ID NO: 94491 - RNA, 64 nt, Homo Sapiens; identical to SEQ ID NO: 81386

SEQ ID NO: 94492 - RNA, 64 nt, Homo Sapiens; identical to SEQ ID NO: 81387

SEQ ID NO: 94493 - RNA, 64 nt, Homo Sapiens; identical to SEQ ID NO: 81388

SEQ ID NO: 94494 - RNA, 64 nt, Homo Sapiens; identical to SEQ ID NO: 81389

SEQ ID NO: 94495 - RNA, 64 nt, Homo Sapiens; identical to SEQ ID NO: 81390

SEQ ID NO: 94496 - RNA, 64 nt, Homo Sapiens; identical to SEQ ID NO: 81391

SEQ ID NO: 94497 - RNA, 64 nt, Homo Sapiens; identical to SEQ ID NO: 81392

SEQ ID NO: 94498 - RNA, 64 nt, Homo Sapiens; identical to SEQ ID NO: 81393

SEQ ID NO: 94499 - RNA, 64 nt, Homo Sapiens; identical to SEQ ID NO: 81394

SEQ ID NO: 94500 - RNA, 64 nt, Homo Sapiens; identical to SEQ ID NO: 81395

SEQ ID NO: 94501 - RNA, 64 nt, Homo Sapiens; identical to SEQ ID NO: 81396

SEQ ID NO: 94502 - RNA, 64 nt, Homo Sapiens; identical to SEQ ID NO: 81397

SEQ ID NO: 94503 - RNA, 64 nt, Homo Sapiens; identical to SEQ ID NO: 81398

SEQ ID NO: 94504 - RNA, 64 nt, Homo Sapiens; identical to SEQ ID NO: 81399

SEQ ID NO: 94505 - RNA, 64 nt, Homo Sapiens; identical to SEQ ID NO: 81400

SEQ ID NO: 94506 - RNA, 64 nt, Homo Sapiens; identical to SEQ ID NO: 81401

SEQ ID NO: 94507 - RNA, 64 nt, Homo Sapiens; identical to SEQ ID NO: 81402

SEQ ID NO: 94508 - RNA, 64 nt, Homo Sapiens; identical to SEQ ID NO: 81403

SEQ ID NO: 94509 - RNA, 64 nt, Homo Sapiens; identical to SEQ ID NO: 81404

SEQ ID NO: 94510 - RNA, 64 nt, Homo Sapiens; identical to SEQ ID NO: 81405

SEQ ID NO: 94511 - RNA, 64 nt, Homo Sapiens; identical to SEQ ID NO: 81406

SEQ ID NO: 94512 - RNA, 64 nt, Homo Sapiens; identical to SEQ ID NO: 81407

SEQ ID NO: 94513 - RNA, 64 nt, Homo Sapiens; identical to SEQ ID NO: 81408

SEQ ID NO: 94514 - RNA, 64 nt, Homo Sapiens; identical to SEQ ID NO: 81409

SEQ ID NO: 94515 - RNA, 64 nt, Homo Sapiens; identical to SEQ ID NO: 81410

SEQ ID NO: 94516 - RNA, 64 nt, Homo Sapiens; identical to SEQ ID NO: 81411

SEQ ID NO: 94517 - RNA, 64 nt, Homo Sapiens; identical to SEQ ID NO: 81412

SEQ ID NO: 94518 - RNA, 64 nt, Homo Sapiens; identical to SEQ ID NO: 81413

SEQ ID NO: 94519 - RNA, 64 nt, Homo Sapiens; identical to SEQ ID NO: 81414

SEQ ID NO: 94520 - RNA, 64 nt, Homo Sapiens; identical to SEQ ID NO: 81415

SEQ ID NO: 94521 - RNA, 64 nt, Homo Sapiens; identical to SEQ ID NO: 81416

SEQ ID NO: 94522 - RNA, 64 nt, Homo Sapiens; identical to SEQ ID NO: 81417

SEQ ID NO: 94523 - RNA, 64 nt, Homo Sapiens; identical to SEQ ID NO: 81418

SEQ ID NO: 94524 - RNA, 64 nt, Homo Sapiens; identical to SEQ ID NO: 81419

SEQ ID NO: 94525 - RNA, 64 nt, Homo Sapiens; identical to SEQ ID NO: 81420

SEQ ID NO: 94526 - RNA, 64 nt, Homo Sapiens; identical to SEQ ID NO: 81421

SEQ ID NO: 94527 - RNA, 64 nt, Homo Sapiens; identical to SEQ ID NO: 81422

SEQ ID NO: 94528 - RNA, 64 nt, Homo Sapiens; identical to SEQ ID NO: 81423

SEQ ID NO: 94529 - RNA, 64 nt, Homo Sapiens; identical to SEQ ID NO: 81424

SEQ ID NO: 94530 - RNA, 64 nt, Homo Sapiens; identical to SEQ ID NO: 81425

SEQ ID NO: 94531 - RNA, 64 nt, Homo Sapiens; identical to SEQ ID NO: 81426

SEQ ID NO: 94532 - RNA, 64 nt, Homo Sapiens; identical to SEQ ID NO: 81427

SEQ ID NO: 94533 - RNA, 64 nt, Homo Sapiens; identical to SEQ ID NO: 81428

SEQ ID NO: 94534 - RNA, 64 nt, Homo Sapiens; identical to SEQ ID NO: 81429

SEQ ID NO: 94535 - RNA, 64 nt, Homo Sapiens; identical to SEQ ID NO: 81430

SEQ ID NO: 94536 - RNA, 64 nt, Homo Sapiens; identical to SEQ ID NO: 81431

SEQ ID NO: 94537 - RNA, 64 nt, Homo Sapiens; identical to SEQ ID NO: 81432

SEQ ID NO: 94538 - RNA, 64 nt, Homo Sapiens; identical to SEQ ID NO: 81433

SEQ ID NO: 94539 - RNA, 64 nt, Homo Sapiens; identical to SEQ ID NO: 81434

SEQ ID NO: 94540 - RNA, 64 nt, Homo Sapiens; identical to SEQ ID NO: 81435

SEQ ID NO: 94541 - RNA, 64 nt, Homo Sapiens; identical to SEQ ID NO: 81436

SEQ ID NO: 94542 - RNA, 64 nt, Homo Sapiens; identical to SEQ ID NO: 81437

SEQ ID NO: 94543 - RNA, 64 nt, Homo Sapiens; identical to SEQ ID NO: 81438

SEQ ID NO: 94544 - RNA, 64 nt, Homo Sapiens; identical to SEQ ID NO: 81439

SEQ ID NO: 94545 - RNA, 64 nt, Homo Sapiens; identical to SEQ ID NO: 81440

SEQ ID NO: 94546 - RNA, 64 nt, Homo Sapiens; identical to SEQ ID NO: 81441

SEQ ID NO: 94547 - RNA, 64 nt, Homo Sapiens; identical to SEQ ID NO: 81442

SEQ ID NO: 94548 - RNA, 64 nt, Homo Sapiens; identical to SEQ ID NO: 81443

SEQ ID NO: 94549 - RNA, 64 nt, Homo Sapiens; identical to SEQ ID NO: 81444

SEQ ID NO: 94550 - RNA, 64 nt, Homo Sapiens; identical to SEQ ID NO: 81445

SEQ ID NO: 94551 - RNA, 64 nt, Homo Sapiens; identical to SEQ ID NO: 81446

SEQ ID NO: 94552 - RNA, 64 nt, Homo Sapiens; identical to SEQ ID NO: 81447

SEQ ID NO: 94553 - RNA, 64 nt, Homo Sapiens; identical to SEQ ID NO: 81448

SEQ ID NO: 94554 - RNA, 64 nt, Homo Sapiens; identical to SEQ ID NO: 81449

SEQ ID NO: 94555 - RNA, 64 nt, Homo Sapiens; identical to SEQ ID NO: 81450

SEQ ID NO: 94556 - RNA, 64 nt, Homo Sapiens; identical to SEQ ID NO: 81451

SEQ ID NO: 94557 - RNA, 64 nt, Homo Sapiens; identical to SEQ ID NO: 81452

SEQ ID NO: 94558 - RNA, 64 nt, Homo Sapiens; identical to SEQ ID NO: 81453

SEQ ID NO: 94559 - RNA, 64 nt, Homo Sapiens; identical to SEQ ID NO: 81454

SEQ ID NO: 94560 - RNA, 64 nt, Homo Sapiens; identical to SEQ ID NO: 81455

SEQ ID NO: 94561 - RNA, 64 nt, Homo Sapiens; identical to SEQ ID NO: 81456

SEQ ID NO: 94562 - RNA, 64 nt, Homo Sapiens; identical to SEQ ID NO: 81457

SEQ ID NO: 94563 - RNA, 64 nt, Homo Sapiens; identical to SEQ ID NO: 81458

SEQ ID NO: 94564 - RNA, 64 nt, Homo Sapiens; identical to SEQ ID NO: 81459

SEQ ID NO: 94565 - RNA, 64 nt, Homo Sapiens; identical to SEQ ID NO: 81460

SEQ ID NO: 94566 - RNA, 64 nt, Homo Sapiens; identical to SEQ ID NO: 81461

SEQ ID NO: 94567 - RNA, 64 nt, Homo Sapiens; identical to SEQ ID NO: 81462

SEQ ID NO: 94568 - RNA, 64 nt, Homo Sapiens; identical to SEQ ID NO: 81463

SEQ ID NO: 94569 - RNA, 64 nt, Homo Sapiens; identical to SEQ ID NO: 81464

SEQ ID NO: 94570 - RNA, 64 nt, Homo Sapiens; identical to SEQ ID NO: 81465

SEQ ID NO: 94571 - RNA, 64 nt, Homo Sapiens; identical to SEQ ID NO: 81466

SEQ ID NO: 94572 - RNA, 64 nt, Homo Sapiens; identical to SEQ ID NO: 81467

SEQ ID NO: 94573 - RNA, 64 nt, Homo Sapiens; identical to SEQ ID NO: 81468

SEQ ID NO: 94574 - RNA, 64 nt, Homo Sapiens; identical to SEQ ID NO: 81468

SEQ ID NO: 94575 - RNA, 64 nt, Homo Sapiens; identical to SEQ ID NO: 81470

SEQ ID NO: 94576 - RNA, 64 nt, Homo Sapiens; identical to SEQ ID NO: 81471

SEQ ID NO: 94577 - RNA, 64 nt, Homo Sapiens; identical to SEQ ID NO: 81472

SEQ ID NO: 94578 - RNA, 64 nt, Homo Sapiens; identical to SEQ ID NO: 81473

SEQ ID NO: 94579 - RNA, 64 nt, Homo Sapiens; identical to SEQ ID NO: 81474

SEQ ID NO: 94580 - RNA, 64 nt, Homo Sapiens; identical to SEQ ID NO: 81475

SEQ ID NO: 94581 - RNA, 64 nt, Homo Sapiens; identical to SEQ ID NO: 81476

SEQ ID NO: 94582 - RNA, 64 nt, Homo Sapiens; identical to SEQ ID NO: 81477

SEQ ID NO: 94583 - RNA, 64 nt, Homo Sapiens; identical to SEQ ID NO: 81478

SEQ ID NO: 94584 - RNA, 64 nt, Homo Sapiens; identical to SEQ ID NO: 81479

SEQ ID NO: 94585 - RNA, 64 nt, Homo Sapiens; identical to SEQ ID NO: 81480

SEQ ID NO: 94586 - RNA, 64 nt, Homo Sapiens; identical to SEQ ID NO: 81481

SEQ ID NO: 94587 - RNA, 64 nt, Homo Sapiens; identical to SEQ ID NO: 81482

SEQ ID NO: 94588 - RNA, 64 nt, Homo Sapiens; identical to SEQ ID NO: 81483

SEQ ID NO: 94589 - RNA, 64 nt, Homo Sapiens; identical to SEQ ID NO: 81484

SEQ ID NO: 94590 - RNA, 64 nt, Homo Sapiens; identical to SEQ ID NO: 81485

SEQ ID NO: 94591 - RNA, 64 nt, Homo Sapiens; identical to SEQ ID NO: 81486

SEQ ID NO: 94592 - RNA, 64 nt, Homo Sapiens; identical to SEQ ID NO: 81487

SEQ ID NO: 94593 - RNA, 64 nt, Homo Sapiens; identical to SEQ ID NO: 81488

SEQ ID NO: 94594 - RNA, 64 nt, Homo Sapiens; identical to SEQ ID NO: 81489

SEQ ID NO: 94595 - RNA, 64 nt, Homo Sapiens; identical to SEQ ID NO: 81490

SEQ ID NO: 94596 - RNA, 64 nt, Homo Sapiens; identical to SEQ ID NO: 81491

SEQ ID NO: 94597 - RNA, 64 nt, Homo Sapiens; identical to SEQ ID NO: 81492

SEQ ID NO: 94598 - RNA, 64 nt, Homo Sapiens; identical to SEQ ID NO: 81493

SEQ ID NO: 94599 - RNA, 64 nt, Homo Sapiens; identical to SEQ ID NO: 81494

SEQ ID NO: 94600 - RNA, 64 nt, Homo Sapiens; identical to SEQ ID NO: 81495

SEQ ID NO: 94601 - RNA, 64 nt, Homo Sapiens; identical to SEQ ID NO: 81496

SEQ ID NO: 94602 - RNA, 64 nt, Homo Sapiens; identical to SEQ ID NO: 81497

SEQ ID NO: 94603 - RNA, 64 nt, Homo Sapiens; identical to SEQ ID NO: 81498

SEQ ID NO: 94604 - RNA, 64 nt, Homo Sapiens; identical to SEQ ID NO: 81499

SEQ ID NO: 94605 - RNA, 64 nt, Homo Sapiens; identical to SEQ ID NO: 81500

SEQ ID NO: 94606 - RNA, 64 nt, Homo Sapiens; identical to SEQ ID NO: 81501

SEQ ID NO: 94607 - RNA, 64 nt, Homo Sapiens; identical to SEQ ID NO: 81502

SEQ ID NO: 94608 - RNA, 64 nt, Homo Sapiens; identical to SEQ ID NO: 81503

SEQ ID NO: 94609 - RNA, 64 nt, Homo Sapiens; identical to SEQ ID NO: 81504

SEQ ID NO: 94610 - RNA, 64 nt, Homo Sapiens; identical to SEQ ID NO: 81505

SEQ ID NO: 94611 - RNA, 64 nt, Homo Sapiens; identical to SEQ ID NO: 81506

SEQ ID NO: 94612 - RNA, 64 nt, Homo Sapiens; identical to SEQ ID NO: 81507

SEQ ID NO: 94613 - RNA, 64 nt, Homo Sapiens; identical to SEQ ID NO: 81508

SEQ ID NO: 94614 - RNA, 64 nt, Homo Sapiens; identical to SEQ ID NO: 81509

SEQ ID NO: 94615 - RNA, 64 nt, Homo Sapiens; identical to SEQ ID NO: 81510

SEQ ID NO: 94616 - RNA, 64 nt, Homo Sapiens; identical to SEQ ID NO: 81511

SEQ ID NO: 94617 - RNA, 64 nt, Homo Sapiens; identical to SEQ ID NO: 81512

SEQ ID NO: 94618 - RNA, 64 nt, Homo Sapiens; identical to SEQ ID NO: 81513

SEQ ID NO: 94619 - RNA, 64 nt, Homo Sapiens; identical to SEQ ID NO: 81514

SEQ ID NO: 94620 - RNA, 64 nt, Homo Sapiens; identical to SEQ ID NO: 81515

SEQ ID NO: 94621 - RNA, 64 nt, Homo Sapiens; identical to SEQ ID NO: 81516

SEQ ID NO: 94622 - RNA, 64 nt, Homo Sapiens; identical to SEQ ID NO: 81517

SEQ ID NO: 94623 - RNA, 64 nt, Homo Sapiens; identical to SEQ ID NO: 81518

SEQ ID NO: 94624 - RNA, 64 nt, Homo Sapiens; identical to SEQ ID NO: 81519

SEQ ID NO: 94625 - RNA, 64 nt, Homo Sapiens; identical to SEQ ID NO: 81520

SEQ ID NO: 94626 - RNA, 64 nt, Homo Sapiens; identical to SEQ ID NO: 81521

SEQ ID NO: 94627 - RNA, 64 nt, Homo Sapiens; identical to SEQ ID NO: 81522

SEQ ID NO: 94628 - RNA, 64 nt, Homo Sapiens; identical to SEQ ID NO: 81523

SEQ ID NO: 94629 - RNA, 64 nt, Homo Sapiens; identical to SEQ ID NO: 81524

SEQ ID NO: 94630 - RNA, 64 nt, Homo Sapiens; identical to SEQ ID NO: 81525

SEQ ID NO: 94631 - RNA, 64 nt, Homo Sapiens; identical to SEQ ID NO: 81526

SEQ ID NO: 94632 - RNA, 64 nt, Homo Sapiens; identical to SEQ ID NO: 81527

SEQ ID NO: 94633 - RNA, 64 nt, Homo Sapiens; identical to SEQ ID NO: 81528

SEQ ID NO: 94634 - RNA, 64 nt, Homo Sapiens; identical to SEQ ID NO: 81529

SEQ ID NO: 94635 - RNA, 64 nt, Homo Sapiens; identical to SEQ ID NO: 81530

SEQ ID NO: 94636 - RNA, 64 nt, Homo Sapiens; identical to SEQ ID NO: 81531

SEQ ID NO: 94637 - RNA, 64 nt, Homo Sapiens; identical to SEQ ID NO: 81532

SEQ ID NO: 94638 - RNA, 64 nt, Homo Sapiens; identical to SEQ ID NO: 81533

SEQ ID NO: 94639 - RNA, 64 nt, Homo Sapiens; identical to SEQ ID NO: 81534

SEQ ID NO: 94640 - RNA, 64 nt, Homo Sapiens; identical to SEQ ID NO: 81535

SEQ ID NO: 94641 - RNA, 64 nt, Homo Sapiens; identical to SEQ ID NO: 81536

SEQ ID NO: 94642 - RNA, 64 nt, Homo Sapiens; identical to SEQ ID NO: 81537

SEQ ID NO: 94643 - RNA, 64 nt, Homo Sapiens; identical to SEQ ID NO: 81538

SEQ ID NO: 94644 - RNA, 64 nt, Homo Sapiens; identical to SEQ ID NO: 81539

SEQ ID NO: 94645 - RNA, 64 nt, Homo Sapiens; identical to SEQ ID NO: 81540

SEQ ID NO: 94646 - RNA, 64 nt, Homo Sapiens; identical to SEQ ID NO: 81541

SEQ ID NO: 94647 - RNA, 64 nt, Homo Sapiens; identical to SEQ ID NO: 81542

SEQ ID NO: 94648 - RNA, 64 nt, Homo Sapiens; identical to SEQ ID NO: 81543

SEQ ID NO: 94649 - RNA, 64 nt, Homo Sapiens; identical to SEQ ID NO: 81544

SEQ ID NO: 94650 - RNA, 64 nt, Homo Sapiens; identical to SEQ ID NO: 81545

SEQ ID NO: 94651 - RNA, 64 nt, Homo Sapiens; identical to SEQ ID NO: 81546

SEQ ID NO: 94652 - RNA, 64 nt, Homo Sapiens; identical to SEQ ID NO: 81547

SEQ ID NO: 94653 - RNA, 64 nt, Homo Sapiens; identical to SEQ ID NO: 81548

SEQ ID NO: 94654 - RNA, 64 nt, Homo Sapiens; identical to SEQ ID NO: 81549

SEQ ID NO: 94655 - RNA, 64 nt, Homo Sapiens; identical to SEQ ID NO: 81550

SEQ ID NO: 94656 - RNA, 64 nt, Homo Sapiens; identical to SEQ ID NO: 81551

SEQ ID NO: 94657 - RNA, 64 nt, Homo Sapiens; identical to SEQ ID NO: 81552

SEQ ID NO: 94658 - RNA, 64 nt, Homo Sapiens; identical to SEQ ID NO: 81553

SEQ ID NO: 94659 - RNA, 64 nt, Homo Sapiens; identical to SEQ ID NO: 81554

SEQ ID NO: 94660 - RNA, 64 nt, Homo Sapiens; identical to SEQ ID NO: 81555

SEQ ID NO: 94661 - RNA, 64 nt, Homo Sapiens; identical to SEQ ID NO: 81556

SEQ ID NO: 94662 - RNA, 64 nt, Homo Sapiens; identical to SEQ ID NO: 81557

SEQ ID NO: 94663 - RNA, 60 nt, Homo Sapiens; identical to SEQ ID NO: 81558

SEQ ID NO: 94664 - RNA, 64 nt, Homo Sapiens; identical to SEQ ID NO: 81559

SEQ ID NO: 94665 - RNA, 64 nt, Homo Sapiens; identical to SEQ ID NO: 81560

SEQ ID NO: 94666 - RNA, 64 nt, Homo Sapiens; identical to SEQ ID NO: 81561

SEQ ID NO: 94667 - RNA, 64 nt, Homo Sapiens; identical to SEQ ID NO: 81562

SEQ ID NO: 94668 - RNA, 64 nt, Homo Sapiens; identical to SEQ ID NO: 81563

SEQ ID NO: 94669 - RNA, 64 nt, Homo Sapiens; identical to SEQ ID NO: 81564

SEQ ID NO: 94670 - RNA, 64 nt, Homo Sapiens; identical to SEQ ID NO: 81565

SEQ ID NO: 94671 - RNA, 64 nt, Homo Sapiens; identical to SEQ ID NO: 81566

SEQ ID NO: 94672 - RNA, 64 nt, Homo Sapiens; identical to SEQ ID NO: 81567

SEQ ID NO: 94673 - RNA, 64 nt, Homo Sapiens; identical to SEQ ID NO: 81568

SEQ ID NO: 94674 - RNA, 64 nt, Homo Sapiens; identical to SEQ ID NO: 81569

SEQ ID NO: 94675 - RNA, 64 nt, Homo Sapiens; identical to SEQ ID NO: 81570

SEQ ID NO: 94676 - RNA, 64 nt, Homo Sapiens; identical to SEQ ID NO: 81571

SEQ ID NO: 94677 - RNA, 64 nt, Homo Sapiens; identical to SEQ ID NO: 81572

SEQ ID NO: 94678 - RNA, 64 nt, Homo Sapiens; identical to SEQ ID NO: 81573

SEQ ID NO: 94679 - RNA, 64 nt, Homo Sapiens; identical to SEQ ID NO: 81574

SEQ ID NO: 94680 - RNA, 64 nt, Homo Sapiens; identical to SEQ ID NO: 81575

SEQ ID NO: 94681 - RNA, 64 nt, Homo Sapiens; identical to SEQ ID NO: 81576

SEQ ID NO: 94682 - RNA, 64 nt, Homo Sapiens; identical to SEQ ID NO: 81577

SEQ ID NO: 94683 - RNA, 64 nt, Homo Sapiens; identical to SEQ ID NO: 81578

SEQ ID NO: 94684 - RNA, 64 nt, Homo Sapiens; identical to SEQ ID NO: 81579

SEQ ID NO: 94685 - RNA, 64 nt, Homo Sapiens; identical to SEQ ID NO: 81580

SEQ ID NO: 94686 - RNA, 64 nt, Homo Sapiens; identical to SEQ ID NO: 81581

SEQ ID NO: 94687 - RNA, 64 nt, Homo Sapiens; identical to SEQ ID NO: 81582

SEQ ID NO: 94688 - RNA, 64 nt, Homo Sapiens; identical to SEQ ID NO: 81583

SEQ ID NO: 94689 - RNA, 64 nt, Homo Sapiens; identical to SEQ ID NO: 81584

SEQ ID NO: 94690 - RNA, 64 nt, Homo Sapiens; identical to SEQ ID NO: 81585

SEQ ID NO: 94691 - RNA, 64 nt, Homo Sapiens; identical to SEQ ID NO: 81586

SEQ ID NO: 94692 - RNA, 64 nt, Homo Sapiens; identical to SEQ ID NO: 81587

SEQ ID NO: 94693 - RNA, 64 nt, Homo Sapiens; identical to SEQ ID NO: 81588

SEQ ID NO: 94694 - RNA, 64 nt, Homo Sapiens; identical to SEQ ID NO: 81589

SEQ ID NO: 94695 - RNA, 64 nt, Homo Sapiens; identical to SEQ ID NO: 81590

SEQ ID NO: 94696 - RNA, 64 nt, Homo Sapiens; identical to SEQ ID NO: 81591

SEQ ID NO: 94697 - RNA, 64 nt, Homo Sapiens; identical to SEQ ID NO: 81592

SEQ ID NO: 94698 - RNA, 64 nt, Homo Sapiens; identical to SEQ ID NO: 81593

SEQ ID NO: 94699 - RNA, 64 nt, Homo Sapiens; identical to SEQ ID NO: 81594

SEQ ID NO: 94700 - RNA, 64 nt, Homo Sapiens; identical to SEQ ID NO: 81595

SEQ ID NO: 94701 - RNA, 64 nt, Homo Sapiens; identical to SEQ ID NO: 81596

SEQ ID NO: 94702 - RNA, 64 nt, Homo Sapiens; identical to SEQ ID NO: 81597

SEQ ID NO: 94703 - RNA, 64 nt, Homo Sapiens; identical to SEQ ID NO: 81598

SEQ ID NO: 94704 - RNA, 64 nt, Homo Sapiens; identical to SEQ ID NO: 81599

SEQ ID NO: 94705 - RNA, 64 nt, Homo Sapiens; identical to SEQ ID NO: 81600

SEQ ID NO: 94706 - RNA, 64 nt, Homo Sapiens; identical to SEQ ID NO: 81601

SEQ ID NO: 94707 - RNA, 64 nt, Homo Sapiens; identical to SEQ ID NO: 81602

SEQ ID NO: 94708 - RNA, 64 nt, Homo Sapiens; identical to SEQ ID NO: 81603

SEQ ID NO: 94709 - RNA, 64 nt, Homo Sapiens; identical to SEQ ID NO: 81603

SEQ ID NO: 94710 - RNA, 64 nt, Homo Sapiens; identical to SEQ ID NO: 81605

SEQ ID NO: 94711 - RNA, 64 nt, Homo Sapiens
accauacuaccaaggaccaguccaccugaaccacacacucuaaagaaauauuuuuuaagauaac

SEQ ID NO: 94712 - RNA, 64 nt, Homo Sapiens
agacuugcucauuuuucgaguuuuuaacuagacuacacucuauugaguuuaauuuuguccucua

SEQ ID NO: 94713 - RNA, 64 nt, Homo Sapiens
caaauccuucaagccaaccuauacuaaaaauuaguuccauaaucacaaauggcucuuuugugua

SEQ ID NO: 94714 - RNA, 64 nt, Homo Sapiens
cuuauucauaguuaauucucauuaacacuuacauuuccauaaagaaaacucaaguauuaauaaa

SEQ ID NO: 94715 - RNA, 64 nt, Homo Sapiens
ucuuuucacaauauuacuccaagguaugaagucuuuccauaaaaagaaacauugacucagaaaa

SEQ ID NO: 94716 - RNA, 64 nt, Homo Sapiens
agacauuuugacuggcugggccaguccauugcauuuccauaagaguuuguuuuauauuugucau

SEQ ID NO: 94717 - RNA, 64 nt, Homo Sapiens
uucuagucacuucuguuggcguugaacaguacuuuuccauaaagccuuuguuuguagauuuaau

SEQ ID NO: 94718 - RNA, 64 nt, Homo Sapiens
cuuuguuuguagauuuaauguuugacauucccucuuccauaaacauaugauaaaaauacauaaa

SEQ ID NO: 94719 - RNA, 64 nt, Homo Sapiens
uguuacacaaaauauaaaccuuuucauuucaguuuuccauaaacuuuuagucagaaaaaauaau

SEQ ID NO: 94720 - RNA, 64 nt, Homo Sapiens
uaucugcuauuauuaguuucgccuuuuauuuucuuuccauaacuuucauuagucaaugugauug

SEQ ID NO: 94721 - RNA, 64 nt, Homo Sapiens
uggccaaacugcaugcaugucauuacagaaaagguuccauaauuauuauauugaaauaaguuca

SEQ ID NO: 94722 - RNA, 64 nt, Homo Sapiens
uauaaagaacaagguaguuuucgggagcagugucuuccauaauggucacaauccuaacacauua

SEQ ID NO: 94723 - RNA, 64 nt, Homo Sapiens
augacaguuauacugucgguucggaagcagugccuuccauaauuuuuuuaauagaauauaauua

SEQ ID NO: 94724 - RNA, 64 nt, Homo Sapiens
aauguagcugguuuccucauugagaucuaagccuuuccauaaggguugaaagaccuucuccaaa

SEQ ID NO: 94725 - RNA, 64 nt, Homo Sapiens
uuaucagaagacucacuuuuaaaacacaaaauuuuuccauaaaccaagucucaaaccuugauga

SEQ ID NO: 94726 - RNA, 64 nt, Homo Sapiens
uaccaauaucacugauucagguuuuuaaucuacuuuccauaaaucuaugaauaaggauucaggg

SEQ ID NO: 94727 - RNA, 64 nt, Homo Sapiens
uuaugguauuacacagggaaaguugaggaagaucuuccauaauuaugucuaaauccuauacucu

SEQ ID NO: 94728 - RNA, 64 nt, Homo Sapiens
ugaaauagauuauucaauaaacagaaagauaugcuuccauaauaaauauauaucagugagucuu

SEQ ID NO: 94729 - RNA, 64 nt, Homo Sapiens
agaaauggagaaaaaaauauuccuggcuucuggcuuccauaagauuuucaaaacagggugcucc

SEQ ID NO: 94730 - RNA, 64 nt, Homo Sapiens
gacgacaaaagaauuggacuaacagagaaaagacuuccauaaagcaauuacugaaaguggcugc

SEQ ID NO: 94731 - RNA, 64 nt, Homo Sapiens
agaacugacguuaaaauaugaaaacagacccaaauuccauaaacaaguacacuuccacaccagg

SEQ ID NO: 94732 - RNA, 64 nt, Homo Sapiens
aaagaaccuggugggugugccagaaagaccaucuuuccauaauuucagauguuuucucuggaug

SEQ ID NO: 94733 - RNA, 64 nt, Homo Sapiens
aguacuuuauauuuauaaauaaauagcuucauguuuccauaauccuuuaggggaaaaaaccccu

SEQ ID NO: 94734 - RNA, 64 nt, Homo Sapiens
aagauuacuuuccauuccuuaaauaauugucuuuuuccauaaaacagaaaacaauuuauuuuuu

SEQ ID NO: 94735 - RNA, 64 nt, Homo Sapiens
aaacuguuuccaaagcaucugcaucguguuuaauuuccauaaguaacguaugagaauucuaggu

SEQ ID NO: 94736 - RNA, 64 nt, Homo Sapiens
uuaaaaguuuuauaguuucagaguuuacauguaauuccauaaucuccauuuaguuaaauuuugu

SEQ ID NO: 94737 - RNA, 64 nt, Homo Sapiens
uuucucagauguggccauguuacaguagaggguauuccauaagcacauauuccauaaagugcuc

SEQ ID NO: 94738 - RNA, 64 nt, Homo Sapiens
cauguuacaguagaggguauuccauaagcacauauuccauaaagugcucagagucacagguuuu

SEQ ID NO: 94739 - RNA, 64 nt, Homo Sapiens; identical to SEQ ID NO: 84879

SEQ ID NO: 94740 - RNA, 56 nt, Homo Sapiens; identical to SEQ ID NO: 84880

SEQ ID NO: 94741 - RNA, 64 nt, Homo Sapiens; identical to SEQ ID NO: 84881

SEQ ID NO: 94742 - RNA, 64 nt, Homo Sapiens; identical to SEQ ID NO: 84882

SEQ ID NO: 94743 - RNA, 64 nt, Homo Sapiens; identical to SEQ ID NO: 84883

SEQ ID NO: 94744 - RNA, 64 nt, Homo Sapiens; identical to SEQ ID NO: 84884

SEQ ID NO: 94745 - RNA, 64 nt, Homo Sapiens; identical to SEQ ID NO: 84885

SEQ ID NO: 94746 - RNA, 64 nt, Homo Sapiens; identical to SEQ ID NO: 84886

SEQ ID NO: 94747 - RNA, 64 nt, Homo Sapiens; identical to SEQ ID NO: 84887

SEQ ID NO: 94748 - RNA, 64 nt, Homo Sapiens; identical to SEQ ID NO: 84888

SEQ ID NO: 94749 - RNA, 64 nt, Homo Sapiens; identical to SEQ ID NO: 84889

SEQ ID NO: 94750 - RNA, 64 nt, Homo Sapiens
aaaaaauauaucugaaguuucuuguguuuuuuuuuuuccccacaaaguguguuuccacuuggag

SEQ ID NO: 94751 - RNA, 64 nt, Homo Sapiens
cugucacuucauuuccuguauuauaugugauguuuuuccccauuaaaauaccagagauaaugga

SEQ ID NO: 94752 - RNA, 64 nt, Homo Sapiens
aauuacaucagagaaaaggauugggcucuggagcuuuccccaagagguguuugacucccauucc

SEQ ID NO: 94753 - RNA, 64 nt, Homo Sapiens
guggugggggcugggacucuggcuacauccuugguuuccccacuguuuccaagggaggggccca

SEQ ID NO: 94754 - RNA, 64 nt, Homo Sapiens
agucaucuugccuuguggcauuuuuuaaaaauguuuuccccacacuuccacaaaauuggaagcu

SEQ ID NO: 94755 - RNA, 64 nt, Homo Sapiens
uuuauuuuuuaaaauuaagugucaccugaggaaguuuccccacuuuaauauuuugcccuugaaa

SEQ ID NO: 94756 - RNA, 64 nt, Homo Sapiens
cauaccuuaguucccugaucucauuugggugggguuuccccaggcaagggcugucuggcauggc

SEQ ID NO: 94757 - RNA, 64 nt, Homo Sapiens
ggggaggguggaagggaggguuccccaacaguuuuuuccccagugauaccaguucucuagcaga

SEQ ID NO: 94758 - RNA, 64 nt, Homo Sapiens
ccaaaaagcuuaaauauugaaaguguuagccuuuuuuccccagacuuguuggcguaggcuacag

SEQ ID NO: 94759 - RNA, 64 nt, Homo Sapiens
ucacccaacgcuccaaagucauaauugcauugacuuuccccaccagaugcugaaaauguccuug

SEQ ID NO: 94760 - RNA, 64 nt, Homo Sapiens
ucccccagaucagggccauuggugacaaugcuuguuuccccaggguuccuuccugacaggcauc

SEQ ID NO: 94761 - RNA, 64 nt, Homo Sapiens
caggcaucugggguugguguagggauggagcugcuuuccccauuucuacagagagccaugcccc

SEQ ID NO: 94762 - RNA, 64 nt, Homo Sapiens
cccuuagaguauggaggcugagccaggccuuggguuuccccagcacagccuccugucgcugcau

SEQ ID NO: 94763 - RNA, 64 nt, Homo Sapiens
gugguuguauguuaccuuuuccaccucucauuguuuuccccagaacauuguagauggggguugg

SEQ ID NO: 94764 - RNA, 64 nt, Homo Sapiens
aguuucuguccuagcaaguagagaauccaguuucuuuccccagcauaugauggugucugaaauu

SEQ ID NO: 94765 - RNA, 64 nt, Homo Sapiens
ccccucucuuucucugguggcacaccugcuccaauuuccccaccugguuuuuuagguggagaga

SEQ ID NO: 94766 - RNA, 64 nt, Homo Sapiens
cgucuuggguuauaauuuucuccacauaaauauuuuuccccauguucuaauauggauuaaaaac

SEQ ID NO: 94767 - RNA, 64 nt, Homo Sapiens
ucuucaguguugauguaaauauuguuggauuucauuuccccaggauacagcucauuacaauaaa

SEQ ID NO: 94768 - RNA, 64 nt, Homo Sapiens
acuuugguuuuguuuacauuaagcaagaugccauuuuccccauguaacuuucaguugaagauua

SEQ ID NO: 94769 - RNA, 64 nt, Homo Sapiens
aauaaauuaucagguuaaacucaaaacuagcuuuuuuccccacaaaggacugaacuuuuucuca

SEQ ID NO: 94770 - RNA, 64 nt, Homo Sapiens
accagccaggccagaccaccauggugaaggcuucuuuccccacugcaggacccacuuugagaag

SEQ ID NO: 94771 - RNA, 64 nt, Homo Sapiens
uucuggccgugcuuggcuugaguaacugucucucuuuccccacccccaucacagggcuuucagu

SEQ ID NO: 94772 - RNA, 64 nt, Homo Sapiens
ccccauuuuuucuugucuuucccagaagccccaauuuccccaaguucagcaugcuccuuaaaac

SEQ ID NO: 94773 - RNA, 64 nt, Homo Sapiens
cuggcuccaugacccaccccuucuggcccaccucuuuccccaccuccaucaaggucucuaguag

SEQ ID NO: 94774 - RNA, 64 nt, Homo Sapiens
ugucuaacuuggaaagguaggauuuaggaaguucuuuccccaaccccucugccuucaaccuuaa

SEQ ID NO: 94775 - RNA, 64 nt, Homo Sapiens
aguaucuuuuucucaaaugcgcauguaugugaucuuuccccauuuuuuuaacguaucacccaaa

SEQ ID NO: 94776 - RNA, 64 nt, Homo Sapiens
aagauuguuaccaccuugauuuaauaacuucuuguuuccccauacauguguuuuguuuauagau

SEQ ID NO: 94777 - RNA, 64 nt, Homo Sapiens
uacaaaauggcguagaaugaaaugccucucacccuuuccccacagcgacuacuucccacucaga

SEQ ID NO: 94778 - RNA, 64 nt, Homo Sapiens
gaggguuagaguccugccaauacagcuguugcauuuuccccaccacuagccccacuuaaacuac

SEQ ID NO: 94779 - RNA, 64 nt, Homo Sapiens
uccuaaaucauuaagauuuucagguauucaccaauuuccccauguaagguacuguguuguaccu

SEQ ID NO: 94780 - RNA, 64 nt, Homo Sapiens
acccuugaauucaguguaguaauauuuucagacguuuccccaauaaguguguugaagcauacau

SEQ ID NO: 94781 - RNA, 64 nt, Homo Sapiens
aaccaacaugucauugacaccucucuucuuuacuuuuccccauaucuaaucauuccucaagucu

SEQ ID NO: 94782 - RNA, 64 nt, Homo Sapiens
cucuggcaaccaccauucugugucuauucccucuuuuccccagcuguauucauuaaacaauaac

SEQ ID NO: 94783 - RNA, 64 nt, Homo Sapiens
aauuaucauggaaugucagacaaaagagacuuccuuuccccaaguugacuccaucuauauuuca

SEQ ID NO: 94784 - RNA, 64 nt, Homo Sapiens
gagggcuaaauugggaucucagccugcccuaaucuuuccccaucugaggcagguuucuaggagg

SEQ ID NO: 94785 - RNA, 64 nt, Homo Sapiens
cuaagaacagguuugcagcuacccucucugaccuuuuccccauaucuugugcuguccagggccu

SEQ ID NO: 94786 - RNA, 64 nt, Homo Sapiens
auguaauaagguugaacacugguuuuaaucuguauuuccccaacguaaagugauauuuccccau

SEQ ID NO: 94787 - RNA, 64 nt, Homo Sapiens
guuuuaaucuguauuuccccgauguaaagugauauuuccccaugugauuuucauuauuccugug

SEQ ID NO: 94788 - RNA, 64 nt, Homo Sapiens
ugaaucuucaggaaguaaccuuuccccauuuauguuuccccaugagaccccaaauuccugccau

SEQ ID NO: 94789 - RNA, 64 nt, Homo Sapiens
uauguuuccccaugugaauccaaauuccugccauuuuccccauuacuagagguucaagagaccc

SEQ ID NO: 94790 - RNA, 64 nt, Homo Sapiens
ccacuucagacuuuagccugugccaugacuccauuuuccccauauuaauuuugaagugaauauu

SEQ ID NO: 94791 - RNA, 64 nt, Homo Sapiens
gcacaaaauguauaauggagaauauuuggauuuuuuuccccaaggauacagguucauaaacuac

SEQ ID NO: 94792 - RNA, 64 nt, Homo Sapiens
caucugccagagaacuccuaccucagccugaaaguuuccccaaccaugucugcuugagauauuu

SEQ ID NO: 94793 - RNA, 64 nt, Homo Sapiens
caacugcggcuaagucucuuucugaacacucugguuuccccacccuguaccccuugguacugcc

SEQ ID NO: 94794 - RNA, 64 nt, Homo Sapiens
uuggccugcuuucccaaaaacagcccacucauccuuuccccagcccucuucagcccuccccagu

SEQ ID NO: 94795 - RNA, 64 nt, Homo Sapiens
acacugugucuuuccggucauuggauccucucccuuuccccaggcagcucgccuggccacaccg

SEQ ID NO: 94796 - RNA, 64 nt, Homo Sapiens
ugaguggaaacagguucuugcauguggauguguguuuccccaggcagacggccccucucuuccc

SEQ ID NO: 94797 - RNA, 64 nt, Homo Sapiens
gaccaaagcccucauugugguccgaggacagccuuuuccccaggccucagagcauugcucaucc

SEQ ID NO: 94798 - RNA, 64 nt, Homo Sapiens
gagagaauguuuugaaaggccagaggguggccuuuuuccccaaacaguuugguuccuuuuaugu

SEQ ID NO: 94799 - RNA, 64 nt, Homo Sapiens
aguuugagcucuuaaaaguugaugaacagccucauuuccccagcuucccugauuucuuccagau

SEQ ID NO: 94800 - RNA, 64 nt, Homo Sapiens
aggaggggaacaaggaguucucuuccgcagccccuuuccccacgcccacccccagucuccaggg

SEQ ID NO: 94801 - RNA, 64 nt, Homo Sapiens
cgguggaggaaggcucugucacuccaggcauauguuuccccaucucugucuggggcuacagaau

SEQ ID NO: 94802 - RNA, 64 nt, Homo Sapiens
ccuccacuccggaucgaggccuguauagggcucguuuccccacacaugccuauuucugaagagg

SEQ ID NO: 94803 - RNA, 64 nt, Homo Sapiens
agaagccuaggggagucccugugguccugaauucuuuccccaaagacgaccagcauuuaaccaa

SEQ ID NO: 94804 - RNA, 64 nt, Homo Sapiens
ccagaucaccaucuucaaauuggcacaacugaaauuuccccacucuguuggggcuuccccacca

SEQ ID NO: 94805 - RNA, 64 nt, Homo Sapiens
gggcaacuccuugcccuccugcucagcaccuccauuuccccauccuuggugagauaacaagcua

SEQ ID NO: 94806 - RNA, 64 nt, Homo Sapiens
uucccugggaagacggguggcaguucgugcccucuuuccccaugugaaaaugaucaagucuugu

SEQ ID NO: 94807 - RNA, 64 nt, Homo Sapiens
uacuguuuuuggggccaagacaaaauggcagccuuuuccccagcaaaggaaaaguugcugucau

SEQ ID NO: 94808 - RNA, 64 nt, Homo Sapiens
gucagaauugcucaaagaaaauuuccuuucuuuuuuuccccaaacuccugcuuauuuauaaauc

SEQ ID NO: 94809 - RNA, 64 nt, Homo Sapiens
uauuaaacucuaauguaccacaaaaccacuuuuuuuuccccaaggaaucccagauaugguugca

SEQ ID NO: 94810 - RNA, 64 nt, Homo Sapiens
cugaacgggcucaggaaaugugcaaagggccaaauuuccccaaaccuuuugagaaacugaauuu

SEQ ID NO: 94811 - RNA, 64 nt, Homo Sapiens
uuucguguaaggugcuacugcugcgcccggccuauuuccccaccgggauuacaggcgugagcca

SEQ ID NO: 94812 - RNA, 64 nt, Homo Sapiens
gggugucugacccaccagcagugcaaugggcagguuuccccacucuauuccugcucuugggaaa

SEQ ID NO: 94813 - RNA, 64 nt, Homo Sapiens
ggagcucugguuucagagcagugccgggauugccuuuccccaggaucugugucggccauccagg

SEQ ID NO: 94814 - RNA, 64 nt, Homo Sapiens
agaccugucuucacccuugggccuccgcucucuuuuuccccaacggucuaggccccuuuaggaa

SEQ ID NO: 94815 - RNA, 64 nt, Homo Sapiens
gccccccagccccucagccccuuuucccuuccucuuuccccacacccuccugcccccucuccca

SEQ ID NO: 94816 - RNA, 64 nt, Homo Sapiens
ucuuucuggcugucucuaugugucuccaacacucuuuccccaugcccuugccuuccccuuucuc

SEQ ID NO: 94817 - RNA, 64 nt, Homo Sapiens
gguggccccuccaccucugcccccugcauugccguuuccccagacccaggccacccuagcccag

SEQ ID NO: 94818 - RNA, 64 nt, Homo Sapiens
uccucucccagagggcacugcuuggaaauuguguuuuccccauuuauggugcucuguauucugg

SEQ ID NO: 94819 - RNA, 64 nt, Homo Sapiens
aguagggagcuaguuuguugauaaauaguucccauuuccccauggagaauuugacauacccugg

SEQ ID NO: 94820 - RNA, 64 nt, Homo Sapiens
uauaagucauacuguguagaauuucuauuuucuuuuuccccauuaaaagaggaccaaacaauuc

SEQ ID NO: 94821 - RNA, 64 nt, Homo Sapiens
acaacuuuauuaagcagaauacacuguagaugcuuuuccccaacguaucuggcuggcagucuuu

SEQ ID NO: 94822 - RNA, 64 nt, Homo Sapiens
ugaagguuccugaggaucuagcuucaugccucaguuuccccauugacuugcacaucucugcagu

SEQ ID NO: 94823 - RNA, 64 nt, Homo Sapiens
gugucauugcuguaggaaugaccacgggccucaguuuccccauuuguauaaugggaagccugua

SEQ ID NO: 94824 - RNA, 64 nt, Homo Sapiens
caucauuaggggccagcaucccaggaacuggaccuuuccccagagccuccgccuguggcuguga

SEQ ID NO: 94825 - RNA, 64 nt, Homo Sapiens
aaggccagggccccuguucuagggguuaggguucuuuccccaaaggaacuuaaaaagacaagcg

SEQ ID NO: 94826 - RNA, 64 nt, Homo Sapiens
cuugucccagcacugccgcuuguaugggaaacccuuuccccaggggaagaucucgcagccucag

SEQ ID NO: 94827 - RNA, 64 nt, Homo Sapiens
accccagagccagucgggacccgccccacagugcuuuccccagcgcaggcaguggacagggugc

SEQ ID NO: 94828 - RNA, 64 nt, Homo Sapiens
ugauuagugucuaaggaauguugccaaugaacucuuuccccagcccauucuugggaggacacuu

SEQ ID NO: 94829 - RNA, 64 nt, Homo Sapiens
cagugacauguccucucugcauacggggguucccuuuccccauugaugcuuacagugacugugg

SEQ ID NO: 94830 - RNA, 64 nt, Homo Sapiens
auaggcgcagacaguugggauaccaggcaagguguuuccccagcucaagggagcagggcagcuc

SEQ ID NO: 94831 - RNA, 64 nt, Homo Sapiens
gcaaagcuuaugaccaauggggaggguggcucuguuuccccaagcagccagaagugggggcaga

SEQ ID NO: 94832 - RNA, 64 nt, Homo Sapiens
auguaaagugcaaucauuucuucagauauaagacuuuccccaacaaugugauuggauuccuuua

SEQ ID NO: 94833 - RNA, 64 nt, Homo Sapiens
gggcauacuauugggcugggaggauuugacagcauuuccccaguugcccuuuaaguucuucuau

SEQ ID NO: 94834 - RNA, 64 nt, Homo Sapiens
acuuuuagccaaccuuaccaguguaaguuuucuauuuccccaguuuucccucauucugccuagu

SEQ ID NO: 94835 - RNA, 64 nt, Homo Sapiens
gcuuuccuguaccugcaagcaugugaacccaacuuuuccccaggagcuggccaaggcuuauuaa

SEQ ID NO: 94836 - RNA, 64 nt, Homo Sapiens
uggcaucugcuuuuaauggauguauaauacauccauucuacauccguagcgguuggugacuugu

SEQ ID NO: 94837 - RNA, 64 nt, Homo Sapiens
gcuguuuuauuacuguuucuaaacuaggauugacauucuacaguugugauaauagcauuuuugu

SEQ ID NO: 94838 - RNA, 64 nt, Homo Sapiens
guagaaaaugaggaaaugccuauuuacacucuugauucuacaauugaagacaucgauauacauu

SEQ ID NO: 94839 - RNA, 64 nt, Homo Sapiens
gaugauugaauucuaaaaauaauuacagacucugauucuacaguaccacucuaaucaagaaaag

SEQ ID NO: 94840 - RNA, 64 nt, Homo Sapiens
auugaaaacuccucaaucaagcuuacuuacacacauucuacagaguuauuuaaggcauacauua

SEQ ID NO: 94841 - RNA, 64 nt, Homo Sapiens
aaugaauaagucacccuuuaaauauaagacacaaauucuacaguauugaaauaaggauuuaaag

SEQ ID NO: 94842 - RNA, 64 nt, Homo Sapiens
cugcuuacuuucucuauaaauuuaccuggggaauauucuacauaaaaagccauucacuccagau

SEQ ID NO: 94843 - RNA, 52 nt, Homo Sapiens
aagaaaaaugcauuauugacacauucuacagaaaacugacucauccaacuag

SEQ ID NO: 94844 - RNA, 64 nt, Homo Sapiens
aggguuaaucuauuaucaagaaaggcaacauagcauucuacagcuaauaauugaauugguuuuu

SEQ ID NO: 94845 - RNA, 64 nt, Homo Sapiens
ggccaacucuacauauuuggguguugaaggucugauucuacaaaccuagcuaauuuauuagauu

SEQ ID NO: 94846 - RNA, 64 nt, Homo Sapiens
uaauuuugcacagacaucucagcaucccaagaucauucuacaagugcuucaaaaauuaaaaucc

SEQ ID NO: 94847 - RNA, 64 nt, Homo Sapiens
ugauaggcagcacugaaauacugaaccacccuuuauucuacauaauuaauuucauugucucuau

SEQ ID NO: 94848 - RNA, 64 nt, Homo Sapiens
uucuugaaauuugggagguuauacaucuguaguuauucuacauugacaguuaaaugcuaauuau

SEQ ID NO: 94849 - RNA, 64 nt, Homo Sapiens
uucuugaaauuugggagguuauacaucuguaguuauucuacauuacaguuaaaugcuaauuaau

SEQ ID NO: 94850 - RNA, 64 nt, Homo Sapiens
caguguuuuaugucuuucacgacuaaucugugccaccucugauuagaaacguuaccuuaucaaa

SEQ ID NO: 94851 - RNA, 64 nt, Homo Sapiens
aaagguucaagcaccuuuucacuggggaaauaaaaccucugagaaaggccccagugaaaaacau

SEQ ID NO: 94852 - RNA, 64 nt, Homo Sapiens
cuucagcagcugaagauuaaccacuccugccuccaccucugacuacccagccccaggagccaga

SEQ ID NO: 94853 - RNA, 64 nt, Homo Sapiens
cccagccccaggagccagacugcccugcccucucaccucugacaaggagcucacuuggccugcu

SEQ ID NO: 94854 - RNA, 54 nt, Homo Sapiens
ccauccagccaagcuggugagacaaccucugauccugaggaccggccgcccacc

SEQ ID NO: 94855 - RNA, 64 nt, Homo Sapiens
gaggaggcuggggacaggcaguuuuuggucuuuuaccucugaucuuguccccaaccuaagccag

SEQ ID NO: 94856 - RNA, 64 nt, Homo Sapiens
uaaauuuccauccauugugagaauauuuucacugaccucugauggcacuuguugacaaaucauu

SEQ ID NO: 94857 - RNA, 64 nt, Homo Sapiens
caaaagccuucucuagaaucugaaggccaggcuuaccucugauucugauucauccauacuucau

SEQ ID NO: 94858 - RNA, 64 nt, Homo Sapiens
gacuuugugaaucugaacugccuggcccgcccucaccucugauacugcccugcccagguggccu

SEQ ID NO: 94859 - RNA, 64 nt, Homo Sapiens
acauaguguccugcccacccagacggccggccggaccucugagccagcuuuuucuguggaggac

SEQ ID NO: 94860 - RNA, 64 nt, Homo Sapiens
ccagcuucucucugauuccccagcgucagcuccuaccucugacccuuucaccccccacccccca

SEQ ID NO: 94861 - RNA, 64 nt, Homo Sapiens
ccaacuucucuuugaucucugagccccagcuccuaccucugaccucaccuuuaaccccccaccu

SEQ ID NO: 94862 - RNA, 64 nt, Homo Sapiens
acucucgaugguggucuccgcucuugcccgaaggaccucugaaguacgcuggagcuguguugua

SEQ ID NO: 94863 - RNA, 64 nt, Homo Sapiens
cacgaagcuaacaacacuaauauacguauuuagcaccucugaggcuuugccauggagacccauu

SEQ ID NO: 94864 - RNA, 64 nt, Homo Sapiens
gaaaaugaaaagccacaaauuuuaaauaaaauuagagcuguaagucauuuguguauucaggcuu

SEQ ID NO: 94865 - RNA, 64 nt, Homo Sapiens
caugguuuaaaaaauaguacuuaaucuugcuguugagcuguauauauguguguauuauaacuua

SEQ ID NO: 94866 - RNA, 64 nt, Homo Sapiens
uggguaaauugguugaauuauuguauugaagcuugagcuguagcuaaaaguaauuuagguuucc

SEQ ID NO: 94867 - RNA, 64 nt, Homo Sapiens
uaaguuguauaauaugcuuguaaaggcugagggugagcuguaucuggaugccuuuuuacaauuu

SEQ ID NO: 94868 - RNA, 62 nt, Homo Sapiens
gcugaagagucuugagaggggcugucaucuguagcugccaucacagugaguuggcagaagug

SEQ ID NO: 94869 - RNA, 62 nt, Homo Sapiens
ccagccccugugccaggcuaagcugguacaagagcugccaaccucacagaguguuugcuagg

SEQ ID NO: 94870 - RNA, 62 nt, Homo Sapiens
cgagauagccaaggccaaagguggguuucuaaagcugccagcucauccuccucagaucuucu

SEQ ID NO: 94871 - RNA, 62 nt, Homo Sapiens
ugccuguugggccaggagcccuuggggaccagagcugccaccuccccuguccccgcacuggg

SEQ ID NO: 94872 - RNA, 62 nt, Homo Sapiens
gugcacuggggggaauguucucuggcuccagaagcugccagaaguguacacccaccugccuc

SEQ ID NO: 94873 - RNA, 62 nt, Homo Sapiens
uaggacaugacuaggaguguaguaggggucccagcugccaagauacgagcauugcagauugc

SEQ ID NO: 94874 - RNA, 62 nt, Homo Sapiens
uuuaaacaacauaaaggaauuaaagaaagagcagcugccacuacucauugauuaaaauggaa

SEQ ID NO: 94875 - RNA, 62 nt, Homo Sapiens
auagacagcuacauuuuuauauucugcaauauagcugccaaagauuaaaagauagucaagaa

SEQ ID NO: 94876 - RNA, 62 nt, Homo Sapiens
cacucccucccuggcuucaggugugcccaggcagcugccaaguggcaacuggacugagggga

SEQ ID NO: 94877 - RNA, 62 nt, Homo Sapiens
cacuguauaauuucgccugggcaucucuguggagcugccauccacuuagaccucaaacuuua

SEQ ID NO: 94878 - RNA, 62 nt, Homo Sapiens
cucccuggaggccagcucugccccaggggcugagcugccaccagagguccugggacccucac

SEQ ID NO: 94879 - RNA, 62 nt, Homo Sapiens
ucuguggcugucggccagagggaauguucuggagcugccaaggagggaggagacucggguug

SEQ ID NO: 94880 - RNA, 62 nt, Homo Sapiens
gcugcucucucaggaccauccgaucaagcugcagcugccacccucaccuagaaacaugccuu

SEQ ID NO: 94881 - RNA, 62 nt, Homo Sapiens
cuuuuggaauguccuggucacagggucaugucagcugccaguucucgucucccguccuggag

SEQ ID NO: 94882 - RNA, 62 nt, Homo Sapiens
ggaccccacgauuuaggguaacuguuaucaucagcugccauuucugauagggucuaccacau

SEQ ID NO: 94883 - RNA, 62 nt, Homo Sapiens
aguccugugucaucacugcagcgguccucaggagcugccagggccaauugcuacagaguguc

SEQ ID NO: 94884 - RNA, 62 nt, Homo Sapiens
cccccgacacuccugcugucgggacccaggccagcugccacaugagggcagacacagcucca

SEQ ID NO: 94885 - RNA, 62 nt, Homo Sapiens
ccagccccaucuggaaggagggcaaucgcuguagcugccaggcuggauguucugggggagga

SEQ ID NO: 94886 - RNA, 62 nt, Homo Sapiens
ggccuaaggcugagugaggucacccgccaggcagcugccacacauccucucacucacuucuc

SEQ ID NO: 94887 - RNA, 62 nt, Homo Sapiens
ccagccuguggccaggucacagauauaaaacuagcugccaaccccugcgcuccugcgagacc

SEQ ID NO: 94888 - RNA, 62 nt, Homo Sapiens
caggagucgguaggacugugcugggcuccuccagcugccaggagacuccuuugugcuggaac

SEQ ID NO: 94889 - RNA, 62 nt, Homo Sapiens
ugggaugguggcucaggcgcugcuacgccagcagcugccacaacgaugccagcccgaggcac

SEQ ID NO: 94890 - RNA, 62 nt, Homo Sapiens
ggcucccagaaagccuuauuuuccaucccaccagcugccaguugcccuuuuccaccuccccc

SEQ ID NO: 94891 - RNA, 62 nt, Homo Sapiens
cuuggagcacauugauuuuuacagagcauuugagcugccacuaagccaagauggcuguaaac

SEQ ID NO: 94892 - RNA, 62 nt, Homo Sapiens
uccagagauggccccuccucaccugggacggaagcugccagcucgcuucccccaagcugccu

SEQ ID NO: 94893 - RNA, 62 nt, Homo Sapiens
uucucugugucucagauggcgauuuugcugacagcugccaagaaaaugcuucacucaacagu

SEQ ID NO: 94894 - RNA, 62 nt, Homo Sapiens
aagaccccugggcaugauuucauugcagagcaagcugccacgugguuuggugugguguuugc

SEQ ID NO: 94895 - RNA, 62 nt, Homo Sapiens
augccuaugugcccaagagcgagcccuggcauagcugccaccgcugaagaaggcaugggaug

SEQ ID NO: 94896 - RNA, 62 nt, Homo Sapiens
cucaaacagcaaagucagcauuugcuguauagagcugccacccaacucuaagcaggagaaac

SEQ ID NO: 94897 - RNA, 62 nt, Homo Sapiens
cagaauuugaccucccagagccaguuuccauuagcugccaugcucugcugccucuaauucac

SEQ ID NO: 94898 - RNA, 62 nt, Homo Sapiens
ggccuggcccccucagccaucucagggugaggagcugccagucauguccagauggaaugacu

SEQ ID NO: 94899 - RNA, 62 nt, Homo Sapiens
gaugggaagaugugcauccguggucaaaagucagcugccagcccugcggaaccagagccuca

SEQ ID NO: 94900 - RNA, 62 nt, Homo Sapiens
gugugguauucgaggauuauuaugaugccaaaagcugccacucuucaguuaugucccauuuu

SEQ ID NO: 94901 - RNA, 62 nt, Homo Sapiens
acccaccuggcccuccuccuguggugcaggacagcugccagcaacuccacccgaccccagca

SEQ ID NO: 94902 - RNA, 62 nt, Homo Sapiens
cucaaggugugugaaagauguuauacaccaggagcugccacugcaugucccaaccagacugu

SEQ ID NO: 94903 - RNA, 62 nt, Homo Sapiens
guaucuucaguucauuccacuuuaggaaacagagcugccaauugaaacagaagaagaaaaaa

SEQ ID NO: 94904 - RNA, 62 nt, Homo Sapiens
aaacacccugaaauugugacccccugggggacagcugccagacacagcuggcggcagcacca

SEQ ID NO: 94905 - RNA, 62 nt, Homo Sapiens
uccagaggucaugaagggaccucuguggcuccagcugccaacccuggagcccagaccgaggu

SEQ ID NO: 94906 - RNA, 62 nt, Homo Sapiens
aaaaguuuccuuuuuuauucucucaagccaccagcugccagccaccagcagccagcugccag

SEQ ID NO: 94907 - RNA, 62 nt, Homo Sapiens
cucaagccaccagcugccagccaccagcagccagcugccagccuagcuuuuuuuuuuuuuuu

SEQ ID NO: 94908 - RNA, 64 nt, Homo Sapiens
cccugaacauuucaugguguucaucaacagugagagacuccauaguuugggcuuguaccacuuu

SEQ ID NO: 94909 - RNA, 64 nt, Homo Sapiens
cgcgccacugugcuccagccugggcaacagagcaagacuccaucucaaaaaauaaaaauaaaua

SEQ ID NO: 94910 - RNA, 64 nt, Homo Sapiens
aacaaaaagauaauuuagagauuugugaauuuacagacuccaaaacuuaguauugguggaaacc

SEQ ID NO: 94911 - RNA, 64 nt, Homo Sapiens
ucaaaaaaaaaaaaaaaucccugguggcacagugagacuccaccucaugccacugugcuccagc

SEQ ID NO: 94912 - RNA, 64 nt, Homo Sapiens
ucaaaaaaaaaaaagagagaugggucacagagugagacuccauccgcaccacugcacuccagcc

SEQ ID NO: 94913 - RNA, 64 nt, Homo Sapiens
ucuuuaaaaacaaacaaaaaugagugacagagcgagacuccaucuuucccacugcacuccagcc

SEQ ID NO: 94914 - RNA, 64 nt, Homo Sapiens
ggcgccacuguacuccaaccugggcgacagagcaagacuccaucucauaaauuaaaaggaaagu

SEQ ID NO: 94915 - RNA, 64 nt, Homo Sapiens
ccugccacugcacuccagucugggugacagagcaagacuccaucucaaaaaauaaauaaauaga

SEQ ID NO: 94916 - RNA, 64 nt, Homo Sapiens
cacgccacugcauuccagccugggcgacagagcaagacuccaucucaaaaauaaaauaaaaaaa

SEQ ID NO: 94917 - RNA, 64 nt, Homo Sapiens
ugugccauugcacuccaaccugggcgacagagugagacuccaucucaaaaaaaaaaaaaaaaaa

SEQ ID NO: 94918 - RNA, 64 nt, Homo Sapiens
uaacagucccuauggaaagauuugguaagacuccagacuccagcaacuaaacucuuaccauaug

SEQ ID NO: 94919 - RNA, 64 nt, Homo Sapiens
cuccagcuaacagucccuauccauauguuugguaagacuccagaggacagaaacuaaacucuua

SEQ ID NO: 94920 - RNA, 64 nt, Homo Sapiens
ugcaccacuguacuccagccugggcaacagagggagacuccaucuagacuccaucucaaaaaaa

SEQ ID NO: 94921 - RNA, 64 nt, Homo Sapiens
acuccagccugggcaacagagggagacuccaucuagacuccaucucaaaaaaaaaaaaaaaaaa

SEQ ID NO: 94922 - RNA, 64 nt, Homo Sapiens
ucugccuugaccucaagguccugcucagaaggucagacuccaugauucaaaaaagugugaugug

SEQ ID NO: 94923 - RNA, 64 nt, Homo Sapiens
gugugcaugugcaucaaugucaccccaggucaucagacuccaccuugccacgugcagcugugcu

SEQ ID NO: 94924 - RNA, 64 nt, Homo Sapiens
cagcaggcucuaggggaauccugugguuauguagagacuccauguccuggugugaugagcagga

SEQ ID NO: 94925 - RNA, 64 nt, Homo Sapiens
uccuacuuucuuucucuggaaaggaaagccuccaagacuccaugugcuugggcagcuugagaag

SEQ ID NO: 94926 - RNA, 64 nt, Homo Sapiens
ucuuggcugcuuuuguuacuauacauuuucucugagacuccagcagaguuggggcuggaacuug

SEQ ID NO: 94927 - RNA, 64 nt, Homo Sapiens
ccaggaguuuuagacuagccuggacaacuaagugagacuccaucucuacaaaaaauuaaaaaau

SEQ ID NO: 94928 - RNA, 64 nt, Homo Sapiens
ucaaagaaaaaaaaaaaauaugggugacagagccagacuccauccgcgccacugcacuccagcc

SEQ ID NO: 94929 - RNA, 64 nt, Homo Sapiens
ucaaaaaaaaaaauaagaggcaggugacagugugagacuccauccgcuccacugcacuccagcc

SEQ ID NO: 94930 - RNA, 64 nt, Homo Sapiens
ucaaaaaaaaaaaaaaaaacugggcgacagagugagacuccauccgugccacugcacuccagcc

SEQ ID NO: 94931 - RNA, 64 nt, Homo Sapiens
uuuaaaaaaaaacaagacggugggcgacagagcgagacuccaucugcgccaccgcacuccagcc

SEQ ID NO: 94932 - RNA, 64 nt, Homo Sapiens
cgggccuuugguucccucccccagccccagcuuucuccuacagggcuuuuccugaguccccaga

SEQ ID NO: 94933 - RNA, 64 nt, Homo Sapiens
gggagccucugccuccucagccacagagaacucccuccuacaaagggggagacugaaacccgag

SEQ ID NO: 94934 - RNA, 64 nt, Homo Sapiens
caugcaugcacacaaacguguacacaagugugagcuccuacacgcauacacacacacacgugua

SEQ ID NO: 94935 - RNA, 64 nt, Homo Sapiens
acguguacacauaccacagacacgcgugugcaugcuccuacacaauacauaugcacauaucaug

SEQ ID NO: 94936 - RNA, 64 nt, Homo Sapiens
cacaugcauguacagguaagcacacauguacaagcuccuacaggcuugcucucacacacgugua

SEQ ID NO: 94937 - RNA, 64 nt, Homo Sapiens
agaugcacauggacacaccccaaacacgcacaggcuccuacacacaugcacacacguguacacc

SEQ ID NO: 94938 - RNA, 64 nt, Homo Sapiens
gaaggacaaacuguccaggugagcugcacucacacuccuacaacgccuacccaucugggcccaa

SEQ ID NO: 94939 - RNA, 64 nt, Homo Sapiens
ggccuacccaucugggcccagaacccagccucuccuccuacaccugcgcaugcugaaauaacug

SEQ ID NO: 94940 - RNA, 64 nt, Homo Sapiens
agcagccagcccccuccgauacaccucccguccucuccuacagaccugcaccccuccccccuuu

SEQ ID NO: 94941 - RNA, 64 nt, Homo Sapiens
cccaaguggcauagccccuuuuccgguauggggucuccuacacccacgcgcaccaccucuccgg

SEQ ID NO: 94942 - RNA, 64 nt, Homo Sapiens
cugugagugaccgcugggaagcccugggcgucaucuccuacaucggaaggccguagaugugugg

SEQ ID NO: 94943 - RNA, 64 nt, Homo Sapiens
gagaaggaugccagccaucuaucauggagcgcggcuccuacacaguggcgagcuguuugaccgc

SEQ ID NO: 94944 - RNA, 64 nt, Homo Sapiens
cuccuagggcauccccugccugaacgaagacuuccgccgcgaagcccgauagaucgggggaaaa

SEQ ID NO: 94945 - RNA, 64 nt, Homo Sapiens
guucgcacagaagggcgaccuugcagggacucgccgccgcgaccucaguguggcuuuuacagga

SEQ ID NO: 94946 - RNA, 64 nt, Homo Sapiens
cuugggggagguguugaaaugagaucacgcgccgcgccgcgaggcggacccgggcagugaacca

SEQ ID NO: 94947 - RNA, 64 nt, Homo Sapiens
ccucugggguggguucgccacagggcgccagcgucgccgcgaggccacguggccgggagacgca

SEQ ID NO: 94948 - RNA, 64 nt, Homo Sapiens
ggagcccccuuccuguguucucccuuuguuccagcgccgcgauggugagaucacuguuccaagc

SEQ ID NO: 94949 - RNA, 64 nt, Homo Sapiens
ucucacuccugccagggaccagcuuaaugcccugcgccgcgagaagcagaagcucguggagaag

SEQ ID NO: 94950 - RNA, 64 nt, Homo Sapiens
ccgaagccgaagccgaagcauccgccgccugcaccgccgcgaaggaagagccugcgccuccgcc

SEQ ID NO: 94951 - RNA, 59 nt, Homo Sapiens
cuuccggcccaucuaucggggccgggccucgccgcgaccaagucuaccggggcaacuga

SEQ ID NO: 94952 - RNA, 64 nt, Homo Sapiens
aaccaccccaggucagcgcugcgccugcuguggccgccgcgagccacgcccucugggaucucug

SEQ ID NO: 94953 - RNA, 64 nt, Homo Sapiens
caaggguuccaccccuaccgacgcuagcccgcggcgccgcgacgucugcacggcccagacccag

SEQ ID NO: 94954 - RNA, 62 nt, Homo Sapiens
cugggguggugcucgccuacgccggcucggcucgccgcgacucuuacaucacccucaccuag

SEQ ID NO: 94955 - RNA, 64 nt, Homo Sapiens
uugccuuugguuccccgcgagccggcgccccggacgccgcgauugcgcgggacaggacuugugc

SEQ ID NO: 94956 - RNA, 63 nt, Homo Sapiens
guaaggauuaagcagauagggagaagggaaaaggggccucacuuuagaaugaaugagucaccu

SEQ ID NO: 94957 - RNA, 63 nt, Homo Sapiens
gcuccagggccacuuuguuuguaaguaugaucugggccucaaaauaccauaguagcugcuuga

SEQ ID NO: 94958 - RNA, 63 nt, Homo Sapiens
uucucuuccccacacaguuucuuuauuccuguugggccucaguggagcugggucuuggggcag

SEQ ID NO: 94959 - RNA, 63 nt, Homo Sapiens
gcugccaucuguacaaugguccagagccucuccgggccucagucugagccuuucucccaaguu

SEQ ID NO: 94960 - RNA, 63 nt, Homo Sapiens
gcccacaggaagccugcaguccuggaagcgcgagggccucaaaggcccgcucuacaucuucug

SEQ ID NO: 94961 - RNA, 63 nt, Homo Sapiens
ucauuugagaaguaaacagauggcacuuugaaggggccucaccgagugggggcaucaucaaaa

SEQ ID NO: 94962 - RNA, 63 nt, Homo Sapiens
gugccuaggaggagauaaaggauguuugugguggggccucauguguguguagaaagccagcug

SEQ ID NO: 94963 - RNA, 63 nt, Homo Sapiens
aggcccagacugcugcugcugcuuuuugucugagggccucauuacgccacaggccucaggaug

SEQ ID NO: 94964 - RNA, 63 nt, Homo Sapiens
acuaccccuacaguuucuccacuaccccuuccagggccucagagcacccccgggggccucaga

SEQ ID NO: 94965 - RNA, 63 nt, Homo Sapiens
acuaccccuuccagggccucuccgcacccccgggggccucagacuccucccuggaccugcagc

SEQ ID NO: 94966 - RNA, 63 nt, Homo Sapiens
ucccgcccagcauccucccugaguccccacacagggccucacucugcaccccaccaggguccc

SEQ ID NO: 94967 - RNA, 63 nt, Homo Sapiens
ugucccccaaggagucauggaacucaggguacugggccucaacgggaaccugagacagcucca

SEQ ID NO: 94968 - RNA, 63 nt, Homo Sapiens
guggggaacggaggaggacauggggagguuguggggccucaggcuccgggcaccaggggccaa

SEQ ID NO: 94969 - RNA, 63 nt, Homo Sapiens
gagggccgguucuaaggcucagacugggcacuggggccucagccugcuuuccugcagcagucg

SEQ ID NO: 94970 - RNA, 63 nt, Homo Sapiens
caaggccaaacuccaaacacagaccccuugcucgggccucaccacgugccacgcuguagccac

SEQ ID NO: 94971 - RNA, 63 nt, Homo Sapiens
guggacagaggagucaggccgcucugcgccucugggccucacugggaaccuggaagcugcgcu

SEQ ID NO: 94972 - RNA, 63 nt, Homo Sapiens
ugcuggagucuucgguggccccucacuuuccuggggccucaccggggauucaccuaccugggu

SEQ ID NO: 94973 - RNA, 63 nt, Homo Sapiens
uaccuaaggacucguuugcccucaccugagugggggccucaucgaaccucauuuuccuggggc

SEQ ID NO: 94974 - RNA, 63 nt, Homo Sapiens
ugagugggggccucaucuacccucauuuuccuggggccucaccggggccugggcugccaggaa

SEQ ID NO: 94975 - RNA, 63 nt, Homo Sapiens
ugcuggagucuuugguggccucucaccugccuggggccucaccggggccucggcugccugggg

SEQ ID NO: 94976 - RNA, 63 nt, Homo Sapiens
uaccuagggucucacuagucccucacuuucccagggccucaccuggggccugggcugccggga

SEQ ID NO: 94977 - RNA, 63 nt, Homo Sapiens
gccgaggcugucaagggucccccgccugcgucggggccucaaaguucuccuuucccaaguucu

SEQ ID NO: 94978 - RNA, 63 nt, Homo Sapiens
uuccccaucucuagaaugaguguuucucucccugggccucaguugaguggcccuggacaaagu

SEQ ID NO: 94979 - RNA, 63 nt, Homo Sapiens
caccccaaaagcagcuccaacagaauggccagagggccucagggagcugcaaaacucauccag

SEQ ID NO: 94980 - RNA, 63 nt, Homo Sapiens
ccucuggggaaagagcacaggaacugaguugcugggccucaaaacaaaaggcugcaggcacau

SEQ ID NO: 94981 - RNA, 64 nt, Homo Sapiens; identical to SEQ ID NO: 84377

SEQ ID NO: 94982 - RNA, 64 nt, Homo Sapiens; identical to SEQ ID NO: 84378

SEQ ID NO: 94983 - RNA, 64 nt, Homo Sapiens; identical to SEQ ID NO: 84379

SEQ ID NO: 94984 - RNA, 64 nt, Homo Sapiens; identical to SEQ ID NO: 84380

SEQ ID NO: 94985 - RNA, 64 nt, Homo Sapiens; identical to SEQ ID NO: 84381

SEQ ID NO: 94986 - RNA, 64 nt, Homo Sapiens; identical to SEQ ID NO: 84382

SEQ ID NO: 94987 - RNA, 64 nt, Homo Sapiens; identical to SEQ ID NO: 84383

SEQ ID NO: 94988 - RNA, 64 nt, Homo Sapiens; identical to SEQ ID NO: 84384

SEQ ID NO: 94989 - RNA, 64 nt, Homo Sapiens; identical to SEQ ID NO: 84385

SEQ ID NO: 94990 - RNA, 64 nt, Homo Sapiens; identical to SEQ ID NO: 84386

SEQ ID NO: 94991 - RNA, 64 nt, Homo Sapiens; identical to SEQ ID NO: 84387

SEQ ID NO: 94992 - RNA, 64 nt, Homo Sapiens; identical to SEQ ID NO: 84388

SEQ ID NO: 94993 - RNA, 64 nt, Homo Sapiens; identical to SEQ ID NO: 84389

SEQ ID NO: 94994 - RNA, 64 nt, Homo Sapiens; identical to SEQ ID NO: 84390

SEQ ID NO: 94995 - RNA, 64 nt, Homo Sapiens; identical to SEQ ID NO: 84391

SEQ ID NO: 94996 - RNA, 64 nt, Homo Sapiens; identical to SEQ ID NO: 84392

SEQ ID NO: 94997 - RNA, 64 nt, Homo Sapiens; identical to SEQ ID NO: 84393

SEQ ID NO: 94998 - RNA, 64 nt, Homo Sapiens; identical to SEQ ID NO: 84394

SEQ ID NO: 94999 - RNA, 64 nt, Homo Sapiens; identical to SEQ ID NO: 84395

SEQ ID NO: 95000 - RNA, 64 nt, Homo Sapiens; identical to SEQ ID NO: 84396

SEQ ID NO: 95001 - RNA, 64 nt, Homo Sapiens; identical to SEQ ID NO: 84397

SEQ ID NO: 95002 - RNA, 64 nt, Homo Sapiens; identical to SEQ ID NO: 84398

SEQ ID NO: 95003 - RNA, 64 nt, Homo Sapiens; identical to SEQ ID NO: 84399

SEQ ID NO: 95004 - RNA, 64 nt, Homo Sapiens; identical to SEQ ID NO: 84400

SEQ ID NO: 95005 - RNA, 64 nt, Homo Sapiens; identical to SEQ ID NO: 84401

SEQ ID NO: 95006 - RNA, 64 nt, Homo Sapiens; identical to SEQ ID NO: 84402

SEQ ID NO: 95007 - RNA, 64 nt, Homo Sapiens; identical to SEQ ID NO: 84403

SEQ ID NO: 95008 - RNA, 64 nt, Homo Sapiens; identical to SEQ ID NO: 84404

SEQ ID NO: 95009 - RNA, 64 nt, Homo Sapiens; identical to SEQ ID NO: 84405

SEQ ID NO: 95010 - RNA, 64 nt, Homo Sapiens; identical to SEQ ID NO: 84406

SEQ ID NO: 95011 - RNA, 64 nt, Homo Sapiens; identical to SEQ ID NO: 84407

SEQ ID NO: 95012 - RNA, 64 nt, Homo Sapiens; identical to SEQ ID NO: 84408

SEQ ID NO: 95013 - RNA, 64 nt, Homo Sapiens; identical to SEQ ID NO: 84409

SEQ ID NO: 95014 - RNA, 64 nt, Homo Sapiens; identical to SEQ ID NO: 84410

SEQ ID NO: 95015 - RNA, 64 nt, Homo Sapiens; identical to SEQ ID NO: 84411

SEQ ID NO: 95016 - RNA, 64 nt, Homo Sapiens; identical to SEQ ID NO: 84412

SEQ ID NO: 95017 - RNA, 64 nt, Homo Sapiens; identical to SEQ ID NO: 84413

SEQ ID NO: 95018 - RNA, 64 nt, Homo Sapiens; identical to SEQ ID NO: 84414

SEQ ID NO: 95019 - RNA, 64 nt, Homo Sapiens; identical to SEQ ID NO: 84415

SEQ ID NO: 95020 - RNA, 64 nt, Homo Sapiens; identical to SEQ ID NO: 84416

SEQ ID NO: 95021 - RNA, 64 nt, Homo Sapiens; identical to SEQ ID NO: 84417

SEQ ID NO: 95022 - RNA, 64 nt, Homo Sapiens; identical to SEQ ID NO: 84418

SEQ ID NO: 95023 - RNA, 64 nt, Homo Sapiens; identical to SEQ ID NO: 84419

SEQ ID NO: 95024 - RNA, 64 nt, Homo Sapiens; identical to SEQ ID NO: 84420

SEQ ID NO: 95025 - RNA, 64 nt, Homo Sapiens
uuuguacaagagcucauggcggaguuuuauuuaucucuucaaacgcaugguguucaauaggcug

SEQ ID NO: 95026 - RNA, 64 nt, Homo Sapiens
acuggacguggauucucucuacugugcacagauacucuucaagcacuauuuuuaaaaagugcuu

SEQ ID NO: 95027 - RNA, 64 nt, Homo Sapiens
uuuuuguuuaggauaaauagguaagcacaaagagcucuucaaaaucagaaaaaacaauaggagu

SEQ ID NO: 95028 - RNA, 64 nt, Homo Sapiens
uacaguaaauauugaugacaaugacagcuuuuaacucuucaagucaccuaaagcuauuaugcag

SEQ ID NO: 95029 - RNA, 64 nt, Homo Sapiens
ucccagcaacaucagcucugucagcuccuugcugcucuucaacaccaccgagaaccuguauggc

SEQ ID NO: 95030 - RNA, 64 nt, Homo Sapiens
agccacgagccaaggugggcacuugaugucggaucucuucaacaagcuggucaugaggcgcaag

SEQ ID NO: 95031 - RNA, 64 nt, Homo Sapiens
aaaaaaucgaauugguggcucuaucacacacuuucucuucaauguauccucucucucucuauga

SEQ ID NO: 95032 - RNA, 64 nt, Homo Sapiens
auccucagaagccucgacugccuccugacaacgucucuucaagccuaaugauuccgcgcggaga

SEQ ID NO: 95033 - RNA, 64 nt, Homo Sapiens
cguuugcaguuucucucuguguugugauucccuucucuucaacguuuucaguacguguuucucu

SEQ ID NO: 95034 - RNA, 64 nt, Homo Sapiens
auucccuucucuucaacguuuucaguacguguuucucuucaauaaacuucauucaguguuccag

SEQ ID NO: 95035 - RNA, 64 nt, Homo Sapiens
uucuccuaaggucuggccuugccccuuugcucugccccugaagucuaucugcaggauggucuuc

SEQ ID NO: 95036 - RNA, 64 nt, Homo Sapiens
cucaugucugcuaaaacagccaucuucaagacagccccugaaaagagaccaguucagguccugc

SEQ ID NO: 95037 - RNA, 64 nt, Homo Sapiens
cccugccucuggcuuccuaaggccuguuucuuuuccccugaaauaagaauuagagaauaaacca

SEQ ID NO: 95038 - RNA, 64 nt, Homo Sapiens
caucgcuggcccccaccuccuauuggaaauaucaccccugaagcgagugcccagggcugauaua

SEQ ID NO: 95039 - RNA, 64 nt, Homo Sapiens
aaaagcaggggccagggagggggcgacuugccugccccugaagcccuuguucccauuggcccca

SEQ ID NO: 95040 - RNA, 64 nt, Homo Sapiens
ugccuggggggaggggaggagcacccccucagccccccugaaccugaccaaaagccauggcugu

SEQ ID NO: 95041 - RNA, 64 nt, Homo Sapiens
caggagcgccuccagggccccgcccacucucccaccccugaagcugcacucccacccaccuagc

SEQ ID NO: 95042 - RNA, 64 nt, Homo Sapiens
gaggcuuccuuggggcggggggagggcaccucagccccugaagacaagcagcacugcaguggca

SEQ ID NO: 95043 - RNA, 64 nt, Homo Sapiens
guauagaauccauuugucauuauuacaccuuuccccccugaaauaaguuuuaaacucacaucca

SEQ ID NO: 95044 - RNA, 64 nt, Homo Sapiens
uccucuccggagcuugacuugacucugggcacuuccccugaagcguagccgguuccccggccac

SEQ ID NO: 95045 - RNA, 64 nt, Homo Sapiens
gaacuaaaaacuccuuaacuuacuguugcuuacaccccugaaagucuguuuuuaagcaaauggg

SEQ ID NO: 95046 - RNA, 64 nt, Homo Sapiens
uuuuaacccuuuuaaaagagaccuauguugaaaaccccugaaaauucacugaagaaaaaucauu

SEQ ID NO: 95047 - RNA, 64 nt, Homo Sapiens
ccugaguuuaaguggcuugaauaucucuucuaacccccugaaauugaaggauuuuagaaaucau

SEQ ID NO: 95048 - RNA, 64 nt, Homo Sapiens
agggaaggacaagucaccucuuuuugcuuucuuaccccugaaagcagcuuccugcucuuucucc

SEQ ID NO: 95049 - RNA, 64 nt, Homo Sapiens
uagcuucaucaguccuuccuuccuaaucucuaauccccugaagccuaacacaguuccuaaugug

SEQ ID NO: 95050 - RNA, 64 nt, Homo Sapiens
uggaggguagggcugugguuuacuccugucuaaaccccugaagccuaacacaguuccuggcaca

SEQ ID NO: 95051 - RNA, 64 nt, Homo Sapiens
agcugacagaaguuauaccuuacuccuuuccuuuccccugaacaaaccugcuaaucccacuaau

SEQ ID NO: 95052 - RNA, 64 nt, Homo Sapiens
ggaaggagggaggaaauaugucccuugcacaccaccccugaagcacauggcaguaggaaacagc

SEQ ID NO: 95053 - RNA, 64 nt, Homo Sapiens
ggaugugcaaaugaaaauugaaggaaagaauaugaacugagaaauguucuuuggcagugauaua

SEQ ID NO: 95054 - RNA, 64 nt, Homo Sapiens
uucuucagcuaagguuaauuugacgcuaugauaaaacugagagaugucaaaaagccucuuagaa

SEQ ID NO: 95055 - RNA, 64 nt, Homo Sapiens
ccauccuaugcaguauuugggaaaguucacaagaaacugagaagaaaccuaaaaacuguggaua

SEQ ID NO: 95056 - RNA, 64 nt, Homo Sapiens
aggcuggaaaacacugauguggacucaguaugauaacugagaugggggacgccagacaugugag

SEQ ID NO: 95057 - RNA, 64 nt, Homo Sapiens
cucugacccaggccugucacuuugagaggggcaaaacugagaggggcuuuuccuagagaaagag

SEQ ID NO: 95058 - RNA, 64 nt, Homo Sapiens
cucuuucuuauucuacuacacaagccgccaacucaacugagagcuaaagagacuagaaaagaga

SEQ ID NO: 95059 - RNA, 64 nt, Homo Sapiens
uaaagagacuagaaaagagauaagcugccaacucaacugagaacaagaaacuagaagagauuua

SEQ ID NO: 95060 - RNA, 64 nt, Homo Sapiens
ucaggaaauaugcuacugguugccacugacuucaaacugagagcacuugggaaauagcacaugc

SEQ ID NO: 95061 - RNA, 64 nt, Homo Sapiens
ccauccccaagaaucucaucaaccagggaagaggaacugagaucacagggaaggagauuggagg

SEQ ID NO: 95062 - RNA, 64 nt, Homo Sapiens
cuguaucuggauuuagcacuuggcaaugaccuugaacugagagcgauaguuaccuaaggcuuug

SEQ ID NO: 95063 - RNA, 64 nt, Homo Sapiens
ucucucauuccaggaagccuaggccuagaagagaaacugagagcgauuuugaaaaucagaucug

SEQ ID NO: 95064 - RNA, 64 nt, Homo Sapiens
gcuucgagucuuccuucugguguguagaacuguuaacugagaugaggcaaaaacuagugggaaa

SEQ ID NO: 95065 - RNA, 64 nt, Homo Sapiens
uuguaaucaaauaguuaacauaguuuaggucgggaacugagauauaugugaaaacagacaauau

SEQ ID NO: 95066 - RNA, 64 nt, Homo Sapiens
gcccucugugacucgacugcuggaaggggagagaaacugagauggagagguuggaagggguggu

SEQ ID NO: 95067 - RNA, 64 nt, Homo Sapiens
gugauagugccacugcaauucagagguugcagugaacugagauaaaucgcuugagcccgggaag

SEQ ID NO: 95068 - RNA, 64 nt, Homo Sapiens
ugaauuugaaaauuugucuguauuuaauggccugaacugagaguugauauggccaaagggagag

SEQ ID NO: 95069 - RNA, 64 nt, Homo Sapiens
gaucacuugagccugggagguugaggcugcagugaacugagaucacgacacugcacuccagccu

SEQ ID NO: 95070 - RNA, 64 nt, Homo Sapiens
ccgugaugguguugauuucuuacacguguaagccaacugagauagcucuuugaaaauuucuuuu

SEQ ID NO: 95071 - RNA, 64 nt, Homo Sapiens
gcugaccaagcaaagaaacaaggacugcuacuauaacugagaguaggcugacauaaaguuuacg

SEQ ID NO: 95072 - RNA, 64 nt, Homo Sapiens
gaaugaguucauggggagauucuguaaagugaugaacugagaugaaagcagccaacagcccagg

SEQ ID NO: 95073 - RNA, 64 nt, Homo Sapiens
ugugaagauggagcagagucaaaucugugcuucuaacugagaugagaguguauuaaucacguau

SEQ ID NO: 95074 - RNA, 64 nt, Homo Sapiens
ugaggugacuugccuggggcuucauagaugagaaaacugagaggagaaggaggguugugcccac

SEQ ID NO: 95075 - RNA, 64 nt, Homo Sapiens
gcgccacggcacuccagccuuggagguugcagugaacugagacuaauugcuugaacccaggagg

SEQ ID NO: 95076 - RNA, 64 nt, Homo Sapiens
uaauggagaaaauaauuuuuaaguuaugaaauaaaacugagagagccgacaaugguagcuucuc

SEQ ID NO: 95077 - RNA, 64 nt, Homo Sapiens
ggugggaaaccuccucucauuuuuggacauuaucaacugagauaugaugcauggggaaggaugu

SEQ ID NO: 95078 - RNA, 64 nt, Homo Sapiens
cugccugagaaccuaaauuucagcaacagugaaaaacugagaugaaagauguauaauguagaga

SEQ ID NO: 95079 - RNA, 64 nt, Homo Sapiens
gaaaacuaauucaauuuuuuuuugaacaaaguauaacugagacuauuuuuggagcuuaagauuu

SEQ ID NO: 95080 - RNA, 64 nt, Homo Sapiens
acuaccaaggaccaguccaccugaaccacacacucuaaagaaauauuuuuuaagauaacuuuua

SEQ ID NO: 95081 - RNA, 64 nt, Homo Sapiens
ugaaauagaaguucaggguuccucacucuagucacuaaagaaggauuuuacucucccagcccag

SEQ ID NO: 95082 - RNA, 64 nt, Homo Sapiens
gcgaaaggguuaugcaaaucucaggguguugccucuaaagaaucuaaagaauagacaugcuuug

SEQ ID NO: 95083 - RNA, 64 nt, Homo Sapiens
uuaugcaaaucucaggguguugccucuaaagaaucuaaagaauagacaugcuuugggcuuacuc

SEQ ID NO: 95084 - RNA, 64 nt, Homo Sapiens
aaauaaaaaaaguuguauuuaaaaguuauauuuucuaaagaaaauuguagauggcaucuuuuua

SEQ ID NO: 95085 - RNA, 64 nt, Homo Sapiens
gcuuugaguugguauuuuucuggcaucaugauuucuaaagaagaaaaggaugagcaauuauuau

SEQ ID NO: 95086 - RNA, 64 nt, Homo Sapiens
cuaugauaccauacccaucuuggaaaaaggaaagcuaaagaagaagaaaaauaauuaaucucuc

SEQ ID NO: 95087 - RNA, 64 nt, Homo Sapiens
ccuauuaaauauuuggaauuuuguauuaugauuucuaaagaaaaaaccacagguauucaguuuc

SEQ ID NO: 95088 - RNA, 64 nt, Homo Sapiens
cuuauuagaaacgauuccggauggcauuggaaaacuaaagaaacugucaaucuugaagguggau

SEQ ID NO: 95089 - RNA, 64 nt, Homo Sapiens
auuuuaacagacccugccuaaaagcauuggaaaacuaaagaaguugagcaacuugaaugcagac

SEQ ID NO: 95090 - RNA, 51 nt, Homo Sapiens
guuugauggccugcauuugagcuaaagaaugaacuucugucugccucgugg

SEQ ID NO: 95091 - RNA, 64 nt, Homo Sapiens
uaggaagauguugcuauucacguuaguaaacagccuaaagaaacucuuagguuuacugcuacau

SEQ ID NO: 95092 - RNA, 64 nt, Homo Sapiens
cuuguuauuuaauaucaaaucaaauacuucaucacuaaagaauuagaauggguauggaaugaau

SEQ ID NO: 95093 - RNA, 64 nt, Homo Sapiens
caauuacauucuuauacaauauagcuuauuaacacuaaagaaaaguuuuauuuuggucucuucc

SEQ ID NO: 95094 - RNA, 64 nt, Homo Sapiens
gggaaagagaagcgguugucauaacacuauuugucuaaagaaugguugcauaacagcauguaac

SEQ ID NO: 95095 - RNA, 64 nt, Homo Sapiens
uauucaguagcugaauccgcaaggcuuuauacgucuaaagaaaaguugaugagaaaggggagcc

SEQ ID NO: 95096 - RNA, 64 nt, Homo Sapiens
aaaugcuacaauaguuuuuuaucuauaaaauuaucuaaagaaucauugucuuucagagacucau

SEQ ID NO: 95097 - RNA, 64 nt, Homo Sapiens
uuuguauauuaagagaggagcucauuucagauuccuaaagaaauagacauuuuacuguuauuuu

SEQ ID NO: 95098 - RNA, 64 nt, Homo Sapiens
ccuuuucuaaaaagucaauucaucuaguuaagucgcugaacaauuaccugccaaaugcuauacu

SEQ ID NO: 95099 - RNA, 64 nt, Homo Sapiens
auuccugcaaaauuaccuaccccaguucaucucugcugaacauuuggaaaccaugcacuagcca

SEQ ID NO: 95100 - RNA, 64 nt, Homo Sapiens
ggcccugguguugcauuuagcccuggggcauggagcugaacaguacuugugcaggauuguugug

SEQ ID NO: 95101 - RNA, 64 nt, Homo Sapiens
uguuuaaccaagccauagcccaugccuuuugagggcugaacaaauaagggacuuacugauaauu

SEQ ID NO: 95102 - RNA, 64 nt, Homo Sapiens
ugcggaaggagcuggagaauagcuacaagcagaggcugaacaccgcccuccgagguggagcagc

SEQ ID NO: 95103 - RNA, 64 nt, Homo Sapiens
ugcggaaggagcuggagaauagcuacaagcagaggcugaacaccgcccuccgagguggaacagc

SEQ ID NO: 95104 - RNA, 64 nt, Homo Sapiens
uuucuuuuuaaaaaaaggagagaaacaaacaaaagcugaacacaagcuuccugucaagcaauca

SEQ ID NO: 95105 - RNA, 64 nt, Homo Sapiens
ggagaaucucaacaugucucgaauagaaauguuugcugaacauuugcuuaccuugguuggaagg

SEQ ID NO: 95106 - RNA, 64 nt, Homo Sapiens
accuguccauuggcaugcuucagcaccugggcacacacccgagcgccacggaguuugggggcca

SEQ ID NO: 95107 - RNA, 64 nt, Homo Sapiens
ugagccacuucuggggcuccagaaccucguggagacacccgagagggggauuuuccaggccagg

SEQ ID NO: 95108 - RNA, 64 nt, Homo Sapiens
agcccaagggggaagggcaaacauuuuuuuaaauacacccgaggauaaacacugagcugccaaa

SEQ ID NO: 95109 - RNA, 64 nt, Homo Sapiens
acauacauauauguucacuuagcauuugaacaugacacccgaacgauuuauacauaaaccuaaa

SEQ ID NO: 95110 - RNA, 64 nt, Homo Sapiens
guuagcccuaggcuccuguaugucccgaugucuuacacccgagucgucccgacgucacgacgcc

SEQ ID NO: 95111 - RNA, 64 nt, Homo Sapiens
aauucuuaaaaggcccauagcagccaguucaaaaacacccgacgucauguauuugagcauauca

SEQ ID NO: 95112 - RNA, 64 nt, Homo Sapiens
acaccagagcgugggagacgggggugcggcagggacacccgaccaagguggcacggugguacug

SEQ ID NO: 95113 - RNA, 64 nt, Homo Sapiens
gcuccaggagccccgugaacggguggcacacgggacacccgagaggcaugcacgcaaggaauug

SEQ ID NO: 95114 - RNA, 64 nt, Homo Sapiens
caguguaaacagccaaacaacaccaagcaaacuaacacccgacuuuccaccauuuagguuccag

SEQ ID NO: 95115 - RNA, 64 nt, Homo Sapiens
aggcacagcacagcagugacucggugaggggaggacacccgacugugcacacuuccaggccucc

SEQ ID NO: 95116 - RNA, 64 nt, Homo Sapiens
agcguaugaaauucuaagcugggugggguggcucacacccgacguaaucccagcacguugggag

SEQ ID NO: 95117 - RNA, 64 nt, Homo Sapiens
ccgucugauuuuagguuccaggaacuuccugagaacacccgaucgcagaggguaauuuucugga

SEQ ID NO: 95118 - RNA, 64 nt, Homo Sapiens
aauuauuagaccccggggcagucaggugcuccggacacccgaaggcaauaaaacaggagccgug

SEQ ID NO: 95119 - RNA, 64 nt, Homo Sapiens
ccucaaaagcaaaugagaucgaccgugaccaggaacacccgacucuggauucgugacaacaugc

SEQ ID NO: 95120 - RNA, 64 nt, Homo Sapiens
cuuaccagcggggacaccaaguucacuuacucuuacacccgacgauguagacagacuuuguaua

SEQ ID NO: 95121 - RNA, 64 nt, Homo Sapiens
uagccugauguggaguggaggguuccugcacccuacacccgagcccauccagccucugggccau

SEQ ID NO: 95122 - RNA, 64 nt, Homo Sapiens
gugggagggaggacugguacgaagguggcgaugaacacccgaaggagaggugccagcaauugcu

SEQ ID NO: 95123 - RNA, 64 nt, Homo Sapiens
gcaggugccuaggggguguggcuuccuccaaaggacacccgaugcucgggcaggaggggaggug

SEQ ID NO: 95124 - RNA, 64 nt, Homo Sapiens
caggcguccaucuguguccucagccucucccuccacacccgaagaacacccccgugcucugcac

SEQ ID NO: 95125 - RNA, 64 nt, Homo Sapiens
gggaggcccagcgcggacauccccugcuggccggacacccgacuccaguccaagucucgcuaca

SEQ ID NO: 95126 - RNA, 64 nt, Homo Sapiens
uaauggcuuuuuugaaaguuccuuuuucaugaacacacccgagaaaucuuaaauagacacuuug

SEQ ID NO: 95127 - RNA, 64 nt, Homo Sapiens
cugccacuggaaugucuucuugugaacugaguggacacccgagggggcaggugaaaccagaaua

SEQ ID NO: 95128 - RNA, 64 nt, Homo Sapiens
ugcacguuccuauacggccccagaagguggugggacacccgagcacaagggccgcacggugcug

SEQ ID NO: 95129 - RNA, 64 nt, Homo Sapiens
ggauuguaaauaucuuuuauguccucuagauaaaacacccgauuaacagauguuaaaccuuuua

SEQ ID NO: 95130 - RNA, 64 nt, Homo Sapiens
uucuagcauuguuugcaagagugaaagaguggaaacacccgaaguguccaucaguaagggacag

SEQ ID NO: 95131 - RNA, 64 nt, Homo Sapiens
gaauucaccguguguacugagugcaguuuuuuucacacccgaaagucuuuacuggcuuucauag

SEQ ID NO: 95132 - RNA, 60 nt, Homo Sapiens
ccagcccugcugcuuccuaaagcccggcccacacccgacaucaugccugcccagaaauga

SEQ ID NO: 95133 - RNA, 64 nt, Homo Sapiens
gcugugaaccagccccgcucaccugccagccccaacacccgacgggggccgaggccaggcugcc

SEQ ID NO: 95134 - RNA, 64 nt, Homo Sapiens
cugccucucggagcagggagaccgucuuugcguuacacccgaguggaccuuauugaugaaagaa

SEQ ID NO: 95135 - RNA, 64 nt, Homo Sapiens
gcugcgagaucugugcaagucuggaagaggccacacacccgagacagugggaagugguaggacu

SEQ ID NO: 95136 - RNA, 64 nt, Homo Sapiens
ccgaugguugagggauugucacgggaggaacaugacacccgaagggacucuaggugcccucgga

SEQ ID NO: 95137 - RNA, 64 nt, Homo Sapiens
ucccgcaggccggaggcgcagaccuguggugaggacacccgaggccuccugggagaccugcaga

SEQ ID NO: 95138 - RNA, 64 nt, Homo Sapiens
auggccaugcccuagacccuccccaaggaugaccacacccgaaguccugucacugagcacaguc

SEQ ID NO: 95139 - RNA, 64 nt, Homo Sapiens
ccuggcuucaggagggagcgucuaucuccccgucacacccgaggccuuucugugccccccaggu

SEQ ID NO: 95140 - RNA, 62 nt, Homo Sapiens
ccuccauugcucuccaaaagccaauaaagugauuacacccgaugcaccuggcucuguggugg

SEQ ID NO: 95141 - RNA, 64 nt, Homo Sapiens
uccugcccuguggaaugggcucaagguuccugagacacccgauuccugcccaaacagcuguauu

SEQ ID NO: 95142 - RNA, 53 nt, Homo Sapiens
gcguggcgaagcugagcugacggacacccgacggccgccugcugcugccgcuc

SEQ ID NO: 95143 - RNA, 52 nt, Homo Sapiens
cugcaguccgccgggccugagcacacccgaggcucccaccugcggagccgcu

SEQ ID NO: 95144 - RNA, 64 nt, Homo Sapiens
ugacauaaauaaaaaaauaagagcucaagaucccacacccgacaaaguaccaucaucacugcca

SEQ ID NO: 95145 - RNA, 64 nt, Homo Sapiens
agcccugagucacccugagaacuagcaucuccugacacccgagggacaaagagacagagucccc

SEQ ID NO: 95146 - RNA, 64 nt, Homo Sapiens
ugcucugggaccugccccucacguucucuuggggacacccgagccaggacacuacgcaucccug

SEQ ID NO: 95147 - RNA, 50 nt, Homo Sapiens
cuacgugucccaaaggaaacacacccgauggccaggcacaugccccuuga

SEQ ID NO: 95148 - RNA, 64 nt, Homo Sapiens
gguagaaagaucucaggguuaucaggagcgagccacacccgaauaaaguucauuuccaagggga

SEQ ID NO: 95149 - RNA, 64 nt, Homo Sapiens
ugacuauucugagaugacuaccuaaugggccaacugggaugagggaagaugaagcacacaggaa

SEQ ID NO: 95150 - RNA, 64 nt, Homo Sapiens
uggugucuaauguguagugcggauaaauauugguugggaugacuuucaguuuaucuguucauau

SEQ ID NO: 95151 - RNA, 64 nt, Homo Sapiens
auuaaagcugcaaucuacuagacuggauguuuaaugggaugagcuguaaagcagaacuaaugcu

SEQ ID NO: 95152 - RNA, 64 nt, Homo Sapiens
gcccuaacaagaacuguuuuccugucccuuuuccugggaugacaauuuucagucccugaucucu

SEQ ID NO: 95153 - RNA, 64 nt, Homo Sapiens
uucgauuaugcuuuguuuugcaaccacuuucaccugggaugacucugugugaccucccccaagc

SEQ ID NO: 95154 - RNA, 64 nt, Homo Sapiens
uuggucaaaugaccuagaaauucccuaaggagccugggaugaugugcuucugcccccuccugau

SEQ ID NO: 95155 - RNA, 64 nt, Homo Sapiens
ucagauucugcuggccaagguacuuccuggucucugggaugacuccuucaugauacuagguuug

SEQ ID NO: 95156 - RNA, 64 nt, Homo Sapiens
aaaggaaaaucagguagauguguagaugggauauugggaugagguugcuucuagggaguuagca

SEQ ID NO: 95157 - RNA, 64 nt, Homo Sapiens
uuuaaaccagauacgauuuacauaaccugagacuugggaugaaaacuuaguauagcuccucagc

SEQ ID NO: 95158 - RNA, 64 nt, Homo Sapiens
uuaaucuugaaguaguagguacauuucagaacucugggaugauuuaguuacuuaacuaaugaag

SEQ ID NO: 95159 - RNA, 64 nt, Homo Sapiens
ggagaaccucauccagcuccccuucugaaucagcugggaugacuggcuuugagaaggaagggaa

SEQ ID NO: 95160 - RNA, 64 nt, Homo Sapiens
ugaguccccugugagauuuugcuuuuccacugccugggaugaugcaguuugaagaggcccuugg

SEQ ID NO: 95161 - RNA, 64 nt, Homo Sapiens
cuacucuaggauuuucaacuaagagacagugauuugggaugaguaccuacucaagaaaagacag

SEQ ID NO: 95162 - RNA, 64 nt, Homo Sapiens
cuauucuuggauuuugaaugaagaggaaaugcuuugggaugaguaucuguugaagaaaggacag

SEQ ID NO: 95163 - RNA, 64 nt, Homo Sapiens
auugugugacuccuuguaguuucguucuuauuuaaagcaauauguuaauuuugcuucuuuuagg

SEQ ID NO: 95164 - RNA, 64 nt, Homo Sapiens
ugaagggaaggugcauauuaaauuuaacuuacucaagcaauagucagccauuuauuaauauggg

SEQ ID NO: 95165 - RNA, 64 nt, Homo Sapiens
gcaauuuucaaucaagccugucccauggagacacaagcaauagugacaugagcacuugacucgc

SEQ ID NO: 95166 - RNA, 64 nt, Homo Sapiens
cuugaaaaaugaaaguauuuggacauacagacagaagcaauauuauucaggucuuccuuguugc

SEQ ID NO: 95167 - RNA, 64 nt, Homo Sapiens
uaaaugugucuuuauagauauguuagaauuucauaagcaauaauaccauauuauuugauuacug

SEQ ID NO: 95168 - RNA, 64 nt, Homo Sapiens
gauccauacauacuauaaggcuuuucaaugaaaaaagcaauaauaagaucagacaacacacuau

SEQ ID NO: 95169 - RNA, 64 nt, Homo Sapiens
uccauuuuuacccuuugaaaccuuuuuuauauugaagcaauaauuaguucucaaaugggcuagg

SEQ ID NO: 95170 - RNA, 64 nt, Homo Sapiens
ggcaguaguucucaaauggguuuuucaaauaggaaagcaauaauuuccuugauuuccaggauag

SEQ ID NO: 95171 - RNA, 64 nt, Homo Sapiens
augaggucuuaaaaugcuggguuuuuuuuuuuucaagcaauauaauaggucuuagaucugaaaa

SEQ ID NO: 95172 - RNA, 64 nt, Homo Sapiens
gaauuuuuagugauaaaauacauuuguaaguguaaagcaauacagcauaauagaauagaauaua

SEQ ID NO: 95173 - RNA, 64 nt, Homo Sapiens
uagaggaugccagcuuuaaucuuucugucauuuaaagcaauaugauaaggguauucaauaauug

SEQ ID NO: 95174 - RNA, 64 nt, Homo Sapiens
uuuuccuuuguuuuaaaacugugguuuuuuaaaaaagcaauaauuaacucagaccucacuaaaa

SEQ ID NO: 95175 - RNA, 64 nt, Homo Sapiens
ucaccaacgagcauucuuuccauauacaguaaacaagcaauacaaaccuuuuugcaacuaggaa

SEQ ID NO: 95176 - RNA, 64 nt, Homo Sapiens
gaauaaaaggacuuuccuacccucuugaggagaaaagcaauaaugcagagauggaaauaaugcg

SEQ ID NO: 95177 - RNA, 64 nt, Homo Sapiens
ucuagucuugaagucccucauuuaaacagaggucaagcaauaggcgccuggcagugucaagccu

SEQ ID NO: 95178 - RNA, 64 nt, Homo Sapiens
gcaauaggcgccuggcagugucaagccugaaaccaagcaauaccgucauguuucagccaagccc

SEQ ID NO: 95179 - RNA, 64 nt, Homo Sapiens
aaugaaguagguuccaguacaaagaagccagcucaagcaauauuacauuagagaaaauguuuuu

SEQ ID NO: 95180 - RNA, 64 nt, Homo Sapiens
gaacucgaauuaaauauccaauaagcagcaguauaagcaauaugucaaaacgaaagcugaaccu

SEQ ID NO: 95181 - RNA, 64 nt, Homo Sapiens
uauagaauuucuauuaaggauuuuuuaaauggacaagcaauaggggguugaaguguuuaucuga

SEQ ID NO: 95182 - RNA, 64 nt, Homo Sapiens
uuuaagacuuuugaccauaguguuuuccaguuuaaagcaauaacuuucauaguuucuuucaaag

SEQ ID NO: 95183 - RNA, 64 nt, Homo Sapiens
ugccaucccccucccucccugggcccggcccuggacccgucaggugccuguccccagccccaac

SEQ ID NO: 95184 - RNA, 64 nt, Homo Sapiens
uauaagccgagggcucagggagccuaacugcgggacccgucagggccccgugacccauccccgu

SEQ ID NO: 95185 - RNA, 64 nt, Homo Sapiens
guacuaggauacugcugcgugcaggacaggaaaaacccgucaauuaacugcccagcggacagug

SEQ ID NO: 95186 - RNA, 64 nt, Homo Sapiens
uaaacaaacauuauuugaacuuaucgagcuuaaaacccgucaaugugcaaagggcuuagcuaag

SEQ ID NO: 95187 - RNA, 64 nt, Homo Sapiens
cccuggccgcaauggacaagugagcccacucuucacccgucagguuacaggagugagagucugg

SEQ ID NO: 95188 - RNA, 64 nt, Homo Sapiens
ccuugucgagggaaagagacccagaaaggacacaacccgucagagaccugggagcaggggcaau

SEQ ID NO: 95189 - RNA, 64 nt, Homo Sapiens
ugcuccacacccuaaaacaagccucagccaggcaacccgucagucugucuccauccuuucaccc

SEQ ID NO: 95190 - RNA, 64 nt, Homo Sapiens
guucacaguuccaaagagaauucuguuggaccacacccgucacaccaugacucuccaguguuuu

SEQ ID NO: 95191 - RNA, 64 nt, Homo Sapiens
auaauuaaacaacccauauuaugcaauugacaggacccgucaucuaugugaccaauuuuacugg

SEQ ID NO: 95192 - RNA, 64 nt, Homo Sapiens
auaggugacaccuccuucccgacuuacgauuccaacccgucagcccuggcagcagggacgacgg

SEQ ID NO: 95193 - RNA, 64 nt, Homo Sapiens
ggccagcgguggaugcugcagagacacaccuggcacccgucaucugacgugggccagccuccuu

SEQ ID NO: 95194 - RNA, 64 nt, Homo Sapiens
ccugccaggagcugagggcagcccagcggccaccacccgucaacgcggaccaucggcuggcaga

SEQ ID NO: 95195 - RNA, 64 nt, Homo Sapiens
cuaccagcugagaugguggucuaauggugucuacacccgucauaccauagauucaccauugccu

SEQ ID NO: 95196 - RNA, 64 nt, Homo Sapiens
auggaauacacagcccacauagucugaucuccagacccgucagacucuccuaaagacaaagguu

SEQ ID NO: 95197 - RNA, 64 nt, Homo Sapiens
guugccgcacacauuccucucagcuccgccccauacccgucacuacagccucaccucccacccc

SEQ ID NO: 95198 - RNA, 64 nt, Homo Sapiens
acgggguucaguaugacacagaaucauggacuuaacccgucauguucugguuugagauuuagug

SEQ ID NO: 95199 - RNA, 64 nt, Homo Sapiens
uggaugcaaugcaggcccuggaggacugugcgucacccgucaaccagagcgugccuccgggcca

SEQ ID NO: 95200 - RNA, 64 nt, Homo Sapiens
gccgugggguucacuuacgguagcgacuauuacgacccgucagagccgacggaggaggaggagc

SEQ ID NO: 95201 - RNA, 64 nt, Homo Sapiens
uuuuuuuuuuuuuuaaauaaagcacugaagucuuacccgucaacuaauucagcugcuacaucca

SEQ ID NO: 95202 - RNA, 64 nt, Homo Sapiens
cacaaucuuuguaaagcuagucugcucucauuuaacccgucaaacgucaaguuucugguuuuuc

SEQ ID NO: 95203 - RNA, 64 nt, Homo Sapiens
cuuuugcugagaguugggggagacggacgcgggcacccgucaugaaacggugaaaaguacuccc

SEQ ID NO: 95204 - RNA, 64 nt, Homo Sapiens
acgcggcugcuucggaagcacuuccucagcagaaacccgucaugauggggcccugccaacacca

SEQ ID NO: 95205 - RNA, 64 nt, Homo Sapiens
gaaucuuuguaauuacuuaauauguuaguuaagaacccgucaagcuuauauuugcuagacuuac

SEQ ID NO: 95206 - RNA, 64 nt, Homo Sapiens
auuugaccaugagcaccacaccaccauuguggccacccgucacuaucgcccgccugaggugauc

SEQ ID NO: 95207 - RNA, 64 nt, Homo Sapiens
cggccuuuuccuucagguucucaguggcaucagcacccgucagccccgguguguucuuguauag

SEQ ID NO: 95208 - RNA, 64 nt, Homo Sapiens
aaccuguggcuaaaaauuuuauuuucuauccuuuacccgucauuaucauuaguugcuaugauuc

SEQ ID NO: 95209 - RNA, 64 nt, Homo Sapiens
agacgcggacaugcaggucugcggcuucccacacacccgucacagaagcaagaugcacaggcgg

SEQ ID NO: 95210 - RNA, 64 nt, Homo Sapiens
guuuucauagugcuuucaaauaucauauguuuguacccgucacaaauuauuucccaguuaguau

SEQ ID NO: 95211 - RNA, 64 nt, Homo Sapiens
uuuucuuucgcuggaaagagggacaggggcccccacccgucaccacgccccaacacuccccccg

SEQ ID NO: 95212 - RNA, 64 nt, Homo Sapiens
gcgcccagccuggaguggccuuuuaugagaggggacccgucaaaucugugccuuauggaggggu

SEQ ID NO: 95213 - RNA, 64 nt, Homo Sapiens
aggccugccgaggggaggagccuggccucuguccacccgucagcagugugaagucuguuguguu

SEQ ID NO: 95214 - RNA, 64 nt, Homo Sapiens
agcucagagccuucuuggacgagagccuucccgcacccgucagaauuagcugugagaugccugu

SEQ ID NO: 95215 - RNA, 64 nt, Homo Sapiens
cugcauaggucggguuggaugucagggcguggucacccgucauuggguucaaguguguggcugg

SEQ ID NO: 95216 - RNA, 64 nt, Homo Sapiens
accagagguuggagaacaaacuugggcagccggaacccgucacuauucuagacuucccuggcau

SEQ ID NO: 95217 - RNA, 64 nt, Homo Sapiens
uuuccccagaaaagcuguguucccuaugcugaacacaccauacacauucucaucuggaaucuaa

SEQ ID NO: 95218 - RNA, 64 nt, Homo Sapiens
acccaugguugagaugggcaccguuuugcaggaaacaccauauuaauagacauccucaccaucu

SEQ ID NO: 95219 - RNA, 64 nt, Homo Sapiens
cuccuggugugugugagcaugcccuuugcuugccacaccauauccuuuccccagauccaccugu

SEQ ID NO: 95220 - RNA, 64 nt, Homo Sapiens
acauccaucccaggacacagcccagccccuccccacaccauacaagguaucagaaaagucuagg

SEQ ID NO: 95221 - RNA, 64 nt, Homo Sapiens
acuuaguauauuuguaauugguuuuaaaaccaauacaccauacuuucuuucugcaaacagccau

SEQ ID NO: 95222 - RNA, 64 nt, Homo Sapiens
ggaagccauagaauugcucuggucaaaaccaagcacaccauagccuuaacugaauauuuaggaa

SEQ ID NO: 95223 - RNA, 64 nt, Homo Sapiens
auaaauauaaaauaugguaauuggaauuaacuccacaccauaguaugcauuguuauacauacug

SEQ ID NO: 95224 - RNA, 64 nt, Homo Sapiens
uguuuuauaaacgauccuguuaauuaaaccacagacaccauauauccuucugcauccuuuggcc

SEQ ID NO: 95225 - RNA, 64 nt, Homo Sapiens
gaguacccucucuggucaaguaccuuugguaaauacaccauaccauaauaucugcuuggagaac

SEQ ID NO: 95226 - RNA, 64 nt, Homo Sapiens
aguugggcacacacaucuucccacaccuauucacacaccauaguuagagacucugccuaaauug

SEQ ID NO: 95227 - RNA, 64 nt, Homo Sapiens
ggaaaguuuggggaugaagguuuuucuaucauagacaccauaggacauauaugagagagaagug

SEQ ID NO: 95228 - RNA, 62 nt, Homo Sapiens
cauucaccccaaaggcucuuuuaagaggcuugacaccauacuagccuggcaagaacaaguaa

SEQ ID NO: 95229 - RNA, 64 nt, Homo Sapiens
ccacucucuccuggggccgacacguugggacagcacaccauagcauaaagcuaggggaugcaug

SEQ ID NO: 95230 - RNA, 64 nt, Homo Sapiens
uucuuucuuaaaaaaauaauacuaugcaggcaagacaccauaaaaguuuaauuccuuacagaag

SEQ ID NO: 95231 - RNA, 64 nt, Homo Sapiens
aacagggaucacuuuuccuuuagcauucagaaugacaccauauucuuaaauauacuccuucccu

SEQ ID NO: 95232 - RNA, 64 nt, Homo Sapiens
acaggaucaauuguaaagugagggcuucuccaugacaccauaguucugcccaauacugcauuug

SEQ ID NO: 95233 - RNA, 64 nt, Homo Sapiens
uugcucucagauccuuguucguucagagcaggcaacaccauaagagaacuggguuuuuguggag

SEQ ID NO: 95234 - RNA, 64 nt, Homo Sapiens
uacauacauauauauauacaaagacuauguacccacaccauacacacauuacuggguaauuuuu

SEQ ID NO: 95235 - RNA, 64 nt, Homo Sapiens
uccuauacacacaaaaauggucuagauauaaaaaacaccauagaaauuauuaucuacguuucuc

SEQ ID NO: 95236 - RNA, 64 nt, Homo Sapiens
ucucauauauauaaaauggacacguggcuauaaaacaccauauaagagaugaguagugcguuuu

SEQ ID NO: 95237 - RNA, 64 nt, Homo Sapiens
uucaagcuuauuuugaaaucuuaaaaaucagguuacaccauagcuacucaaaaguuuuacacac

SEQ ID NO: 95238 - RNA, 64 nt, Homo Sapiens
ggcugugguuuccaucugaaaguagagguuguauacaccauauacuguucuucauuuuauuaau

SEQ ID NO: 95239 - RNA, 64 nt, Homo Sapiens
acaagggaggggaggccgagagucagacugauagacaccauaggagccgacucuuugauaugcc

SEQ ID NO: 95240 - RNA, 64 nt, Homo Sapiens
ugcuagcuugaaaucugcggcaauuggaguauuuacaccauagaaaugcuauaagugaagaccu

SEQ ID NO: 95241 - RNA, 64 nt, Homo Sapiens
uuucuauaaggaauacacauacacccacaugcacacaccauaguuuuuauacaaacagcaauaa

SEQ ID NO: 95242 - RNA, 64 nt, Homo Sapiens
aggaaagccuugauaaaucgggaguccaaaggagacaccauauuuauggagaacauuaggacaa

SEQ ID NO: 95243 - RNA, 64 nt, Homo Sapiens
ccuggaacuggcggguauucuggucauugaggagacaccauaguggaaacuggggcuuaugcug

SEQ ID NO: 95244 - RNA, 64 nt, Homo Sapiens
uaugauaucgcauuaguccauuguaacugaagacacaccauaucuauaauucaaacagagcauc

SEQ ID NO: 95245 - RNA, 64 nt, Homo Sapiens
uuacaauauuauguuuccuauauugaaacacuguacaccauaguucuuuuuuaaaugaauuaaa

SEQ ID NO: 95246 - RNA, 64 nt, Homo Sapiens
uuuguaaaauguagcuuaauauuauugccaucuuacaccauauuaauccaggauguugaauggg

SEQ ID NO: 95247 - RNA, 64 nt, Homo Sapiens
gauuucuuauguuaagucccuuuuaacguuggcaacaccauaagaugaaagugcucaauagaau

SEQ ID NO: 95248 - RNA, 64 nt, Homo Sapiens
uucccauuucaagcacugcccaaggcaucccaagacaccauaucaugcuguuuuggaaucaucc

SEQ ID NO: 95249 - RNA, 64 nt, Homo Sapiens
aaugugaaaaaaaugcauguuuacuuaccuguauacaccauaugcaugcacuagaauuauuaac

SEQ ID NO: 95250 - RNA, 64 nt, Homo Sapiens
auaaauuguccguguucauacauuugaggggaaaacaccauaagguuucguuucuguauacaac

SEQ ID NO: 95251 - RNA, 64 nt, Homo Sapiens
agaguaaaagacauguccucuucugaugcauggcacaccauagucaccaagcaaauaacagagc

SEQ ID NO: 95252 - RNA, 64 nt, Homo Sapiens
uaaguauuuuaaauaauuaaaacauuaaauggcaacaccauagaauauagguguucucuggacc

SEQ ID NO: 95253 - RNA, 64 nt, Homo Sapiens
aaguacagugauaaagcaucguauagugaacaagacaccauauuuaugaguggugcauuuuuaa

SEQ ID NO: 95254 - RNA, 64 nt, Homo Sapiens
cacuuuacucacagccuggcuugagucaacaggaacaccauagcacccacaaauacuucuacuu

SEQ ID NO: 95255 - RNA, 64 nt, Homo Sapiens
auaaagcaagacauuuuauagguacuucccucccacaccauacggguaauugagaauguacuac

SEQ ID NO: 95256 - RNA, 64 nt, Homo Sapiens
uucaugacgagauuccuggcuuguugcgcugagaacaccauaugguucaagaagagaugucuuc

SEQ ID NO: 95257 - RNA, 64 nt, Homo Sapiens
uaaaacagccuuucuggcuguuuaugaguaacacacaccauauaauuagagaaaggacaggcuu

SEQ ID NO: 95258 - RNA, 64 nt, Homo Sapiens
ugaugugugaaaauaauggacuucaaaaaaccaaacaccauaucuagauaguacccccucccuc

SEQ ID NO: 95259 - RNA, 64 nt, Homo Sapiens
guuaagaguccuuuugaauuaaaaucugaguuuuacaccauacugagcaauuugucuggacuag

SEQ ID NO: 95260 - RNA, 64 nt, Homo Sapiens
agugguaguauauuuaagugagguuaaaagaaaaacaccauaaaaggaaaacaaaguucuagau

SEQ ID NO: 95261 - RNA, 64 nt, Homo Sapiens
uaaacaguaaguuauagacuguguucagauacuuacaccauaaugguugccucucuaugcuauu

SEQ ID NO: 95262 - RNA, 64 nt, Homo Sapiens
ccucauuuuaucauagccuaaauacuguaguuauacaccauauguuuuuuuuagaauuuucauu

SEQ ID NO: 95263 - RNA, 64 nt, Homo Sapiens
ugagauggacuguggguacugggagugaucacuaacaccauaguaaugucuaauauucacaggc

SEQ ID NO: 95264 - RNA, 64 nt, Homo Sapiens
ucccuccucagugugcacccgaccuauuucugggacaccauauuuaggucaccccagauuccuu

SEQ ID NO: 95265 - RNA, 64 nt, Homo Sapiens
ucuguugaaauuccuggagguauugugagucaauacaccauagcacaagucuggguauauucac

SEQ ID NO: 95266 - RNA, 64 nt, Homo Sapiens
ucaaauauagaagagucaugcugagaaucagcacacaccauauuauccagacauacagucaaca

SEQ ID NO: 95267 - RNA, 64 nt, Homo Sapiens
uagaauguaaagcuugucuggccucaauuucugaacaccauagggcuuugauauuucaauguua

SEQ ID NO: 95268 - RNA, 64 nt, Homo Sapiens
guaugaaaugagaguuagaccauaugggcugacaacaccauaaauaacaagaaaagggagugcu

SEQ ID NO: 95269 - RNA, 64 nt, Homo Sapiens
ucagacggugaaaaaagcaaauuaacucauuuggacaccauaacucaugcaauaaaacugauug

SEQ ID NO: 95270 - RNA, 64 nt, Homo Sapiens
uguucugcauucccugccacucagaaauuuacagacaccauauuaaauguauuuucuuuuaugu

SEQ ID NO: 95271 - RNA, 64 nt, Homo Sapiens
uucagaucaguauauucugaaauguuuguuagauacaccauaauuccaguuucggaagauaaua

SEQ ID NO: 95272 - RNA, 64 nt, Homo Sapiens
agcuaccuuuucaauggagauuuuuuuuuuuuuuacaccauauuuuugcaugguuuaaucagau

SEQ ID NO: 95273 - RNA, 64 nt, Homo Sapiens
uaacacuauaucucagugauauaagcagcugaagacaccauauucuuguauuuaacccuuuuuu

SEQ ID NO: 95274 - RNA, 64 nt, Homo Sapiens
ccuuguuuaucugcuucuuaaagaaucagccgagacaccauaaaagaaauaggcuuuuugugcc

SEQ ID NO: 95275 - RNA, 64 nt, Homo Sapiens
gucacagagagcuuggcaauugccuugggcaaggacaccauaguaggauaaaaggggaaauaac

SEQ ID NO: 95276 - RNA, 64 nt, Homo Sapiens
cagcaaucacaagagcccgcucaccuuugagaagacaccauacuagaccccacagggaccucag

SEQ ID NO: 95277 - RNA, 64 nt, Homo Sapiens
gcagcuucgcuuuuuugcaaaugcauucacuuugacaccauauaauggaacagaagcucuggua

SEQ ID NO: 95278 - RNA, 64 nt, Homo Sapiens
cuucagggaacugcauagauugaucaaaguguaaacaccauagggacccauucuacacagagca

SEQ ID NO: 95279 - RNA, 64 nt, Homo Sapiens
aaacacacacaugcguauagacauacauacauguacaccauacauagacaagcaucauaaaggc

SEQ ID NO: 95280 - RNA, 64 nt, Homo Sapiens
agucaaauauguauuuaacaauauauuuauauaaacaccauauauuguggauucuaaaauauau

SEQ ID NO: 95281 - RNA, 64 nt, Homo Sapiens
uacuaguguucuguuuguuauuguuuuguuaauuacaccauaaugcuaauuuaaagagacucca

SEQ ID NO: 95282 - RNA, 64 nt, Homo Sapiens
uccugucaauccagaacugcccaccuguguggccacaccauaugacuaugggaucacugucccc

SEQ ID NO: 95283 - RNA, 64 nt, Homo Sapiens
uuugcuacuacuaugugcaguuagaguuccaugaacaccauaccggcuguuuuuguuccugccu

SEQ ID NO: 95284 - RNA, 64 nt, Homo Sapiens
guucuaauuauauauaaucuccagugcuuaaauuacaccauacacuuuaagagccaaguauuug

SEQ ID NO: 95285 - RNA, 64 nt, Homo Sapiens
aguagggaauaaacugugucgaagggcaaauguaacaccauaacacacgggaaaugcuucucgu

SEQ ID NO: 95286 - RNA, 64 nt, Homo Sapiens
ugaauaaacaguuuccaaaaguuauuauguauguacaccauauaauaaaacauuccugcuuuua

SEQ ID NO: 95287 - RNA, 64 nt, Homo Sapiens
ggccacaaagaacagcucagaugcacaaagauucacaccauacaggccaaauuauagaaucccc

SEQ ID NO: 95288 - RNA, 64 nt, Homo Sapiens
agagagaagagagguaauuugaaauagaaaauaaacaccauaaauaaaauacaacuguucaaug

SEQ ID NO: 95289 - RNA, 64 nt, Homo Sapiens
uuacuucugguaugguuuaucucaagcauccuuuacaccauacuuagggagcaaaacuauucuu

SEQ ID NO: 95290 - RNA, 64 nt, Homo Sapiens
ggaugacaaacacuauccacaucugaaaacuaccacaccauaucagggaucauaaauuaugcau

SEQ ID NO: 95291 - RNA, 64 nt, Homo Sapiens
cauuccauucaccuaacuuuagacauucguuuagacaccauaacuggagugauugugcuucuag

SEQ ID NO: 95292 - RNA, 64 nt, Homo Sapiens
ccauugcuagagacccacauccuacaaaauccugacaccauaaccuuaagccaugccuuuccuu

SEQ ID NO: 95293 - RNA, 64 nt, Homo Sapiens
gucuggaaaacaaacaugaagcaaagaaggcacaacaccauauggaaaagcaagacagaaauau

SEQ ID NO: 95294 - RNA, 64 nt, Homo Sapiens
cacaugaauaaauuugcaaaaccaagaucacaguacaccauaugcacucugguaccuuaauuuu

SEQ ID NO: 95295 - RNA, 64 nt, Homo Sapiens
aagggagaugauggccauucgaauucaacuccagacaccauacaugguguuuucuuauugcacu

SEQ ID NO: 95296 - RNA, 64 nt, Homo Sapiens
auugcagaaaagauuuucaggugccaaacucacuacaccauauaggaaauuucauuacaaugaa

SEQ ID NO: 95297 - RNA, 64 nt, Homo Sapiens
gauucuauuuauaaaucaccaauaauuaauucacacaccauaugggccagaaagaaagagcaau

SEQ ID NO: 95298 - RNA, 64 nt, Homo Sapiens
aaaaaaagaaagccuuuugacagcuacaugacuuacaccauacagaacaguacuggacaaaagg

SEQ ID NO: 95299 - RNA, 64 nt, Homo Sapiens
ucagaagaaggcuuaaucucaugggaaaguguucacaccauauuauuaaagagaaaaaacagau

SEQ ID NO: 95300 - RNA, 64 nt, Homo Sapiens
cacugcccccuccccuggauucucacucucugggacaccauagcuaaugaggcaucauauaucc

SEQ ID NO: 95301 - RNA, 64 nt, Homo Sapiens
uuucccucccaguuuuucucaucacaggacuuuaacaccauauauuuuaauuuucuaaguauuu

SEQ ID NO: 95302 - RNA, 64 nt, Homo Sapiens
aaaauugugucauugaggacauuacagguaagguacaccauacaauccucccauaggaaauaga

SEQ ID NO: 95303 - RNA, 64 nt, Homo Sapiens
guauuacacuuuuaguauucguguuuuuauuuuuacaccauauucauguuauguauauugucuc

SEQ ID NO: 95304 - RNA, 64 nt, Homo Sapiens
ucucauuaucuugaaauuuuuuuaauguuugagaacaccauaagcagaauauucuaacaccuuu

SEQ ID NO: 95305 - RNA, 58 nt, Homo Sapiens
auaaagacagaucagacugauaaccuuaacaccauaggugcaaaaugaguuguucuga

SEQ ID NO: 95306 - RNA, 64 nt, Homo Sapiens
aggauccuggucccuguacgaccucauugaagaaacaccauaaguggcguggacuaucuaccuc

SEQ ID NO: 95307 - RNA, 64 nt, Homo Sapiens
uggcuaaauuaaaaaaauggacuacaggcauguaacaccauacucagccucccaaguagcuggg

SEQ ID NO: 95308 - RNA, 64 nt, Homo Sapiens
cuggguggauuauaaacaacauaacugucuuaguacaccauaaaccuaguuauucauuguuaau

SEQ ID NO: 95309 - RNA, 64 nt, Homo Sapiens
cuggggcuucuaugccuaagaccaacugcguuggacaccauaagccacagccucacaggaagug

SEQ ID NO: 95310 - RNA, 64 nt, Homo Sapiens
cuguccugccuaaggcugaacuuguuuucugggaacaccauaggucaccuuuauucuggcagag

SEQ ID NO: 95311 - RNA, 64 nt, Homo Sapiens
guaggaauagccuuuccucaaggaggucuuacggacaccauaggcuuccauaccccuaugucag

SEQ ID NO: 95312 - RNA, 64 nt, Homo Sapiens
cauaugcagaggauugaaacugaaccacuuccuuacaccauaugcaaaaaucaacucaagaugg

SEQ ID NO: 95313 - RNA, 64 nt, Homo Sapiens
cccacagccccaucugcgggggcagugcucacccacaccauaagcuacugccauccuggcccag

SEQ ID NO: 95314 - RNA, 64 nt, Homo Sapiens
accuuugguccuaagucccugcccccuccccuucacaccauaacuagguaacaguuugauaacu

SEQ ID NO: 95315 - RNA, 64 nt, Homo Sapiens
acagacucuuucagauggaggugccauaucacguacaccauaugcaaguuucccgccaggaggu

SEQ ID NO: 95316 - RNA, 64 nt, Homo Sapiens
gggcguccgggcagcugcagcugagaggacuuucacaccauaaggagauuucuguuuuucuuuu

SEQ ID NO: 95317 - RNA, 64 nt, Homo Sapiens
gguugguuucaccuccucagggugccgugcugggacaccauacgcccacccucccuccuuagca

SEQ ID NO: 95318 - RNA, 64 nt, Homo Sapiens
gguggcuugagaagauguccuucuacuugucuugacaccauagaucaagugggaagggaaggag

SEQ ID NO: 95319 - RNA, 64 nt, Homo Sapiens
uccacuguucuguucucauaggggaagacaaagcacaccauaugugcuauaaagauaaagguga

SEQ ID NO: 95320 - RNA, 64 nt, Homo Sapiens
agaaccuuuguauaaaauauguaacugacagcugacaccauauguuggcaguuaauuugcagaa

SEQ ID NO: 95321 - RNA, 64 nt, Homo Sapiens
uagagacacucaaauugccaaaccaaaauguucaacaccauaacgaugugggccacucagagcu

SEQ ID NO: 95322 - RNA, 64 nt, Homo Sapiens
aacagcugcucaaacuguaacaccaaaauguucaacaccauaacugucugagccacucagaacu

SEQ ID NO: 95323 - RNA, 64 nt, Homo Sapiens
aacagcuacucaaacuguaacaccaaaauguucgacaccauaaccaugugagccacucagaacu

SEQ ID NO: 95324 - RNA, 64 nt, Homo Sapiens
agaauucacacuggagagaagauucacaccuggcacaccauacuguaacaaggcuuuugggagu

SEQ ID NO: 95325 - RNA, 64 nt, Homo Sapiens
gaauuguuucugcagauuccggauauuauaauucacaccauaaagauugugaagugguuauugg

SEQ ID NO: 95326 - RNA, 64 nt, Homo Sapiens
cauguggcuuuaugugaggggacugaaugcagacacaccauagcccccuucuacuacuuucccu

SEQ ID NO: 95327 - RNA, 64 nt, Homo Sapiens
uggugauuccuggaugaucauacacagaggacuuacaccauacaaaaauauugggcaccgcagu

SEQ ID NO: 95328 - RNA, 64 nt, Homo Sapiens
caauaauuucuuaauuuaaaauaagacuguuuccacaccauaggccaaaaagugguuaauauua

SEQ ID NO: 95329 - RNA, 64 nt, Homo Sapiens
ggagcuuucuuuuauguaaauuggauaaauacacacaccauacacuauccacagauauagccaa

SEQ ID NO: 95330 - RNA, 64 nt, Homo Sapiens
uaucaccacccuccucuuuuaggcccugcccccuacaccauacuaauggguaggagaucugggg

SEQ ID NO: 95331 - RNA, 64 nt, Homo Sapiens
ggagaaaacuugauagauuacagagcacucuggcacaccauaucggauggaaaaggauucuuca

SEQ ID NO: 95332 - RNA, 64 nt, Homo Sapiens
ugcuaaccucgaggcuuuagcuacuaccucauugacaccauacccacugaucacaaaacccaua

SEQ ID NO: 95333 - RNA, 64 nt, Homo Sapiens
gcauuauuuuuauaggaaauacacugaauaaaguacaccauauauaugaauaccaccuaaaaau

SEQ ID NO: 95334 - RNA, 64 nt, Homo Sapiens
aggguucugguucccuaaauaagcuguuuaaaugacaccauaucuugugaaaacaaaagauugg

SEQ ID NO: 95335 - RNA, 64 nt, Homo Sapiens
agaggagcaaaggaaauuaccuuuaaauuuucccacaccauaagggcuccuuuuucauguugau

SEQ ID NO: 95336 - RNA, 64 nt, Homo Sapiens
aauuuaagaaauugguuuaagacaaaaguaccuuugaauaaaacuagaagaauaggggcaagac

SEQ ID NO: 95337 - RNA, 64 nt, Homo Sapiens
aauguauagauguuuggaugagcaucugguucugugaauaaagguauguauuuuuaguaacaga

SEQ ID NO: 95338 - RNA, 64 nt, Homo Sapiens
uuuaccaaggcuucucaguucaccaaaucuuaagugaauaaaacaacugggcaucuaacuguua

SEQ ID NO: 95339 - RNA, 64 nt, Homo Sapiens
uuauuucaaauugaauuuguaaugcuucuuccauugaauaaaagcucuaguuuugccaauagaa

SEQ ID NO: 95340 - RNA, 64 nt, Homo Sapiens
caaaagccaagguguaugcuaauaaauaaauaaaugaauaaagaagaagggcacaaaaugaaug

SEQ ID NO: 95341 - RNA, 64 nt, Homo Sapiens
aauaaaugaauaaagacaaagggcacaaaaugaaugaauaaauaguccugguucauucccagaa

SEQ ID NO: 95342 - RNA, 64 nt, Homo Sapiens
uuauaccuggaugauucaggagaguguauaugaaugaauaaagcauccaaguauauaugaauga

SEQ ID NO: 95343 - RNA, 64 nt, Homo Sapiens
auaugaaugaauaaagcauccaaguauauaugaaugaauaaaguauguaaguaucaccagaaaa

SEQ ID NO: 95344 - RNA, 64 nt, Homo Sapiens
guaauuuugugauuugucuauauuguugcauuuaugaauaaaucauuuaucugcugcugaguag

SEQ ID NO: 95345 - RNA, 64 nt, Homo Sapiens
uuugaugauggacauuaauaguucuaggcuauuaugaauaaaguuuccaugaacaucuauguac

SEQ ID NO: 95346 - RNA, 64 nt, Homo Sapiens
ccaagagcuucagugcuggaguuuuuaauucauuugaauaaauagcagguuuuucuaugggcau

SEQ ID NO: 95347 - RNA, 64 nt, Homo Sapiens
uguuguaaacaucuuugugcaguuuuggcaauuaugaauaaagcagacuucuuggugguuucca

SEQ ID NO: 95348 - RNA, 64 nt, Homo Sapiens
cauaaaauauuuagccccucgagaacacaguaaaugaauaaaacagaaaagaaaaacacagcau

SEQ ID NO: 95349 - RNA, 64 nt, Homo Sapiens
cagccugacugaauuuucagucgguaaagcauucugaauaaauuugugcaaauaaugaaagagc

SEQ ID NO: 95350 - RNA, 64 nt, Homo Sapiens
ccuuaaguauacuucaagacacuuaaaaaucagcugaauaaauuuugacuaacugagcuccuuc

SEQ ID NO: 95351 - RNA, 64 nt, Homo Sapiens
cacacuucugacuauaauuuaggaucauggacaaugaauaaauguagugucauuuguaugagag

SEQ ID NO: 95352 - RNA, 64 nt, Homo Sapiens
caauucacuuaacuucuccauggcugcuuccugcugaauaaauagggacaggcauaauggauag

SEQ ID NO: 95353 - RNA, 64 nt, Homo Sapiens
caugguuuucuuuuucuuaguaugggaguguccaugaauaaauucaugggcauccucauaacuc

SEQ ID NO: 95354 - RNA, 64 nt, Homo Sapiens
gcuuguaaagaaguuuuuccuacucugugugugcugaauaaauguaaggaugugcugguccccc

SEQ ID NO: 95355 - RNA, 64 nt, Homo Sapiens
ggaugguccgcuuucuauugccaguccuugugguugaauaaaaacaguggagucuucuuuagug

SEQ ID NO: 95356 - RNA, 64 nt, Homo Sapiens
cuaucucuguugcucacaaagaucucucugcguuugaauaaagagucaguguuuccauguuaug

SEQ ID NO: 95357 - RNA, 64 nt, Homo Sapiens
gggcgguuucggaagcgucaggccacuugagaagugaauaaaugcgagggcgcauccaagcggg

SEQ ID NO: 95358 - RNA, 64 nt, Homo Sapiens
ucaaugcuauuggauuguuuugacuuaacaugaaugaauaaaaggcaacagauaucauuucagg

SEQ ID NO: 95359 - RNA, 64 nt, Homo Sapiens
augcaaguugucaauggaugguuuaauauagcacugaauaaaugaaucuaucuuccaauacacu

SEQ ID NO: 95360 - RNA, 64 nt, Homo Sapiens
uuuuaagaguuggggggaguaucuauaguaaacuugaauaaaggggacaaagcuagaacuuauu

SEQ ID NO: 95361 - RNA, 64 nt, Homo Sapiens
cacaguuuuaagcacauaauguaauucuaaaagaugaauaaacuagagagguucacuuugugcc

SEQ ID NO: 95362 - RNA, 64 nt, Homo Sapiens
gugauuauagagaaugauuauaugauguuuguaaugaauaaaauaguaguuucauuauuuggca

SEQ ID NO: 95363 - RNA, 64 nt, Homo Sapiens
uucuuuuucugugauuaugaaaugcaauaaaaucugaauaaagggcaaaguuucuuccugauca

SEQ ID NO: 95364 - RNA, 64 nt, Homo Sapiens
uaccuuaguagaauacagagcuuugguaauuacaugaauaaaauuaagaaaauagccauauaca

SEQ ID NO: 95365 - RNA, 64 nt, Homo Sapiens
uucacuuuauaguuugggagacagaaucaggucuugaauaaaauaauuguaaugagugcuaaau

SEQ ID NO: 95366 - RNA, 64 nt, Homo Sapiens
ugggguuuuguuauugguuuuuuuuuguaaagugugaauaaaagguauguuuacucauuuuucc

SEQ ID NO: 95367 - RNA, 64 nt, Homo Sapiens
gcccagacagcucuuugaugagggugaugggaacugaauaaaccauacggacuggcaguaacaa

SEQ ID NO: 95368 - RNA, 64 nt, Homo Sapiens
guuuuuuucugcauuuugaauuuuguguaauuugugaauaaauauugaguaauggauguuuguu

SEQ ID NO: 95369 - RNA, 64 nt, Homo Sapiens
acuuaagcacaaaauacauauauuagagugccaaugaauaaauaaaauaaaaaaguagggcugu

SEQ ID NO: 95370 - RNA, 64 nt, Homo Sapiens
gcaugaaguacgugugugugaacagucugagaaaugaauaaaaaauguuuuguuucuuagggaa

SEQ ID NO: 95371 - RNA, 64 nt, Homo Sapiens
acguucaugagaaaucgacuaaugaacugaaaggugaauaaagggcuggguuucagcauccacc

SEQ ID NO: 95372 - RNA, 64 nt, Homo Sapiens
accuacuagauugaauuuauuuagugaaugcuccugaauaaaugugcauuccucuuuuagagua

SEQ ID NO: 95373 - RNA, 64 nt, Homo Sapiens
gcagugcauguuucuaauugacuuacugggaaacugaauaaaauaugccucuuauuaucauauu

SEQ ID NO: 95374 - RNA, 64 nt, Homo Sapiens
gggcccagauggaccaaguggggccggggagggaugaauaaacacccuaccccgugcccugucu

SEQ ID NO: 95375 - RNA, 64 nt, Homo Sapiens
ugggcuuggaccgauguccccauauguacagaacugaauaaagugggucucugagaagucugau

SEQ ID NO: 95376 - RNA, 64 nt, Homo Sapiens
cugcuagugguauauguugauuaauauuugguaaugaauaaauucauagugcuggucucacagc

SEQ ID NO: 95377 - RNA, 64 nt, Homo Sapiens
uuuucagugauaugaaaaggcuacauacaauagaugaauaaaugucaguuuuuaaaagaucgau

SEQ ID NO: 95378 - RNA, 64 nt, Homo Sapiens
guauugggugauuuauuaaaaaugucuuuucuuuugaauaaacacacuagcuuucguuccuuag

SEQ ID NO: 95379 - RNA, 64 nt, Homo Sapiens
uuagcucuucucauugugaacagcauuuguugauugaauaaaugaucuggccauggcggacacu

SEQ ID NO: 95380 - RNA, 64 nt, Homo Sapiens
gugaagaacugguuuugguugugauuaaaaaaaaugaauaaauugcauugaaaccauauggugu

SEQ ID NO: 95381 - RNA, 64 nt, Homo Sapiens
aaugcauugaaaccauauggaaauucuuuugaauugaauaaaaauuaggaaaaguuaacuuguu

SEQ ID NO: 95382 - RNA, 64 nt, Homo Sapiens
auugauuucaugaaaucauuagaugcuuugacacugaauaaaauuuacuuacacaauucaguua

SEQ ID NO: 95383 - RNA, 64 nt, Homo Sapiens
cagaauuaacuccuucaauagauaacugcauaaaugaauaaauuuuuguaccuaaguggauaua

SEQ ID NO: 95384 - RNA, 64 nt, Homo Sapiens
aaacuagcaaucuauaaagugcaccaggucaacuugaauaaaaacacuaugacagacagguuug

SEQ ID NO: 95385 - RNA, 64 nt, Homo Sapiens
guaaaucugauggcucacugauuuuugaaaagccugaauaaaauuggaaagacuggaaaguuag

SEQ ID NO: 95386 - RNA, 64 nt, Homo Sapiens
accuucuguugauuuuuuaagccacaugcuaugaugaauaaacugauuuauuuucuaccauuac

SEQ ID NO: 95387 - RNA, 64 nt, Homo Sapiens
gaaaaacuuuuuuaaagauguuagucuuguagcgugaauaaauuugccaucaccuuuugugugg

SEQ ID NO: 95388 - RNA, 64 nt, Homo Sapiens
auuauuucugcccuagaguugaaagauguaaagcugaauaaagcuuggugcuguaguauaugau

SEQ ID NO: 95389 - RNA, 64 nt, Homo Sapiens
gaaagaaauuuuggguuuuuguguauuuuuauuuugaauaaacacuauauuuucauaauucuau

SEQ ID NO: 95390 - RNA, 64 nt, Homo Sapiens
uuguaaaucauuauuuucauuuuuuuuuuuagauugaauaaaauguauggucuacacauucuga

SEQ ID NO: 95391 - RNA, 64 nt, Homo Sapiens
aaaaaccugccaccaaauuagucucaaaaauaaaugaauaaaaugggcaacacagcaagacucu

SEQ ID NO: 95392 - RNA, 64 nt, Homo Sapiens
cucuaaaccuagguuauauauugcuuaguuuauuugaauaaaaguaggaaaaaaaaauaugcau

SEQ ID NO: 95393 - RNA, 64 nt, Homo Sapiens
uguuucgggcccuguaagugaagcucugaagcagugaauaaaggucaugugggcugaugcaggg

SEQ ID NO: 95394 - RNA, 64 nt, Homo Sapiens
ucuaggaaggccccagcccuaguccuaggcgacuugaauaaagugggaggucaaacaugggccu

SEQ ID NO: 95395 - RNA, 64 nt, Homo Sapiens
agcaagaacgaagcaggauguugucacucccgucugaauaaagcuccaugagcuggguuggaaa

SEQ ID NO: 95396 - RNA, 64 nt, Homo Sapiens
aaaccagcauuagagcuuuaauacuuguaguguuugaauaaaugcaguguccagcauaugguag

SEQ ID NO: 95397 - RNA, 64 nt, Homo Sapiens
caagggcaauuuauucauuugauagugauugccuugaauaaauuuaccuggguguuccacagcu

SEQ ID NO: 95398 - RNA, 64 nt, Homo Sapiens
uauguuuaugaauuuucuaaguaauuguauuuccugaauaaauguugaaauaucaaggauucua

SEQ ID NO: 95399 - RNA, 64 nt, Homo Sapiens
uagguacauaguaaguguauaaauggaugauucgugaauaaaacgaugggaauuuuuaucuuag

SEQ ID NO: 95400 - RNA, 64 nt, Homo Sapiens
uuuuaggaaaauaagagaaagguaagggcucuuuugaauaaacugcuguuuuauuuguggcaca

SEQ ID NO: 95401 - RNA, 64 nt, Homo Sapiens
uuuuuguuuauaccagucuuaaagauccagguucugaauaaaaaaauuaauugauacaauugau

SEQ ID NO: 95402 - RNA, 64 nt, Homo Sapiens
ugggauauaaaauggacucucuauucagaaaaggugaauaaaauccaguagauuaauguuguga

SEQ ID NO: 95403 - RNA, 64 nt, Homo Sapiens
aaucauauaagaauguauagaaguaauaguuaucugaauaaaucccauugguaauaauguuggc

SEQ ID NO: 95404 - RNA, 64 nt, Homo Sapiens
uuuuggaucaccuccaaagacuuuuuccuuugcuugaauaaacaaccauuuacacaagagaugg

SEQ ID NO: 95405 - RNA, 64 nt, Homo Sapiens
gcaugaacaauagaaaaauguaaaacacuaaaguugaauaaaauuuacauggauugccaauuuu

SEQ ID NO: 95406 - RNA, 64 nt, Homo Sapiens
uaugaauucccuguuaguugauuuaaauccuuucugaauaaagaucagauaaacaguaacugaa

SEQ ID NO: 95407 - RNA, 64 nt, Homo Sapiens
ugcauauaaaagguagacagcugauauguuuucaugaauaaauauugucagccagaaaagguug

SEQ ID NO: 95408 - RNA, 64 nt, Homo Sapiens
aaucuuuuuuuuuuuuuuuggucaagcuugaggcugaauaaagccuuugaugcacaaaauggga

SEQ ID NO: 95409 - RNA, 64 nt, Homo Sapiens
aauuuucagacacauuuuuggauuucugugaaguugaauaaacauaaaagcuaauacaguugua

SEQ ID NO: 95410 - RNA, 64 nt, Homo Sapiens
uuguauggugagagugaugaauuguuggaucauuugaauaaaaucuuuuacuaaccccaugaua

SEQ ID NO: 95411 - RNA, 64 nt, Homo Sapiens
guguaugcagaggcagcccucaauaugcagugguugaauaaaugaaugaagaaaccacuaucaa

SEQ ID NO: 95412 - RNA, 64 nt, Homo Sapiens
acugaaaacacuugguguuugagaaaaaaaaaugugaauaaacuggugcauauuaaaauaagca

SEQ ID NO: 95413 - RNA, 64 nt, Homo Sapiens
guggaaugugaccagucaagugagugaucuaugcugaauaaacacagcacaucacuguagaauu

SEQ ID NO: 95414 - RNA, 64 nt, Homo Sapiens
acuggcaagacaauuccaugcaauaaguuuucagugaauaaacccacaauccagaauguucuaa

SEQ ID NO: 95415 - RNA, 64 nt, Homo Sapiens
uggugaggugaggccuucaaaccaaagcugcaacugaauaaaucguacuugauuuauuauacuu

SEQ ID NO: 95416 - RNA, 64 nt, Homo Sapiens
gacuuuccuacaauaacuucgagaaaagcaauaaugaauaaaaggaaauaaugcgccucuugag

SEQ ID NO: 95417 - RNA, 64 nt, Homo Sapiens
uguauguauugguaaugaugucauuaaaaguauaugaauaaaaauaugaguaacaucauaaaaa

SEQ ID NO: 95418 - RNA, 64 nt, Homo Sapiens
auuuuguaucauuuguuuuccucaucuaaaaaguugaauaaaaucuguuugauucaguucuccu

SEQ ID NO: 95419 - RNA, 64 nt, Homo Sapiens
cagucuccuacauuagcauucaguaaauacuuguugaauaaacuccgggaacauaguaagggcu

SEQ ID NO: 95420 - RNA, 64 nt, Homo Sapiens
uggcaacacaauuuuuucucaaauaaugacuuucugaauaaagaccucagccccauuuugcuga

SEQ ID NO: 95421 - RNA, 64 nt, Homo Sapiens
gagaaagugccagcccugaagcuggagccguuugugaauaaacuguucuucaucauugacacug

SEQ ID NO: 95422 - RNA, 64 nt, Homo Sapiens
ccaggagauggauuuaguuauucaauuuuguggaugaauaaauugaggcacagaaagauuaagu

SEQ ID NO: 95423 - RNA, 64 nt, Homo Sapiens
auucaccaauuuuaauccuuccugcuugaauacuugaauaaaccuacuugguuucuuuuacuua

SEQ ID NO: 95424 - RNA, 64 nt, Homo Sapiens
uaccuuagaacuaggauaaucaguuuggacuuggugaauaaauggagcaagaguguuuggcucc

SEQ ID NO: 95425 - RNA, 64 nt, Homo Sapiens
guuuuuguuaaacccuuuguaauuuucagaaauaugaauaaauacaaucauuuuuaaaauuccu

SEQ ID NO: 95426 - RNA, 64 nt, Homo Sapiens
aacauccaacccaggucauuauaaacuacucuccugaauaaaaccuuccuauggucuugucuga

SEQ ID NO: 95427 - RNA, 64 nt, Homo Sapiens
acucuccugaauaaaacaacccuauggucuugucugaauaaacucuuuuuuucuuuucuuucuu

SEQ ID NO: 95428 - RNA, 64 nt, Homo Sapiens
gcugcuuuugcccaacccguauguuuguaagacaugaauaaauuuguaugauguuuguaagacc

SEQ ID NO: 95429 - RNA, 64 nt, Homo Sapiens
aauaaacuucaacuagaaauguugaauuaguuagugaauaaagacuauguaccuuugugaaauu

SEQ ID NO: 95430 - RNA, 64 nt, Homo Sapiens
caacacuaaccagcccuaguugcuucugugaauuugaauaaaauugaugaacauauuguaauga

SEQ ID NO: 95431 - RNA, 64 nt, Homo Sapiens
gugauaguaacauaguagagucuugugaaauagaugaauaaaauguugggaaacaaaugcuguc

SEQ ID NO: 95432 - RNA, 64 nt, Homo Sapiens
gacacuuagaggggagagaugaaagccaaacaaaugaauaaacauaaaugauaccaucagugcu

SEQ ID NO: 95433 - RNA, 64 nt, Homo Sapiens
aauaaggaaaaggagagaaaaaagaaauugguuaugaauaaaagugacaauaaaacaugagaua

SEQ ID NO: 95434 - RNA, 64 nt, Homo Sapiens
acuaaaggaaaucuugaggucauauacugaaauaugaauaaauuaaaauaaugaauucagaucu

SEQ ID NO: 95435 - RNA, 64 nt, Homo Sapiens
acacuuuuucuuaaaagaaaaauauuuugggguuugaauaaaauggaccaccauuucucauugg

SEQ ID NO: 95436 - RNA, 64 nt, Homo Sapiens
gaaaaccagcaugguuugacaccacaugggaacaugaauaaaucugucucaugauuugaaaagu

SEQ ID NO: 95437 - RNA, 64 nt, Homo Sapiens
agaucaagugcauugaggggcaguuuuguuugccugaauaaacguaaaggacaaguaaacaauu

SEQ ID NO: 95438 - RNA, 64 nt, Homo Sapiens
ugauuuguauuuaugucuugagacaguaacuuuuugaauaaaaauaaaccuacaguauguugua

SEQ ID NO: 95439 - RNA, 64 nt, Homo Sapiens
ggagccaaaguugaucagaauaguguaugcuuccugaauaaaaaaaaaaauguauaaaaagaau

SEQ ID NO: 95440 - RNA, 64 nt, Homo Sapiens
ugccaagagagauauugaacggauguagagagggugaauaaaauaagcgggaagggcuuggucu

SEQ ID NO: 95441 - RNA, 64 nt, Homo Sapiens
aguaauaagguucuuccuaacaguaguauauucuauuccuuaccuacaauuccucaggagacua

SEQ ID NO: 95442 - RNA, 64 nt, Homo Sapiens
uguuuuuucaagucuuccagguuacagccauuugauuccuuaauuugcuuuuccaucuagauca

SEQ ID NO: 95443 - RNA, 64 nt, Homo Sapiens
aacauuuaaaagcagauuuuauuguaauuuuguuauuccuuaaauuauuccuuaaaagauuguu

SEQ ID NO: 95444 - RNA, 64 nt, Homo Sapiens
agauuguuauuguaauuuuggcuuaacuuuuguuauuccuuaaaaaaaugaaaaugucacucaa

SEQ ID NO: 95445 - RNA, 64 nt, Homo Sapiens
auuaaucuguuagcucauuaauuauuaguuucuuauuccuuauucuuuccauaacuuaucugcu

SEQ ID NO: 95446 - RNA, 64 nt, Homo Sapiens
agacucuugccuccuguggcugguugugaaggcaauuccuuauggaucaccucuggaaucucug

SEQ ID NO: 95447 - RNA, 64 nt, Homo Sapiens
cuucauccuauagagucaaccaccacagauaggaauuccuuauucuuuuuuuaauuuuuuuaag

SEQ ID NO: 95448 - RNA, 64 nt, Homo Sapiens
agguagauuaguuugaagcauugaccuuuuauuuauuccuuauuucucuuucaucaaaacaaaa

SEQ ID NO: 95449 - RNA, 64 nt, Homo Sapiens
aggacucucagguaauaguuuaaggaaacccuugauuccuuauauauguuuaagaagguuaguu

SEQ ID NO: 95450 - RNA, 64 nt, Homo Sapiens
cuaaacaaacuuuuugaaaagcuguuucuaaaagauuccuuaaauucagauaugacagcuaauu

SEQ ID NO: 95451 - RNA, 64 nt, Homo Sapiens
uaacaucaaaugacucucaucaucaacaaauuguauuccuuauugugaaauuaauacccucagg

SEQ ID NO: 95452 - RNA, 64 nt, Homo Sapiens
ccccugaccugucaugaguuuucucugcucugacauuccuuauacauccagugaacaaagcugg

SEQ ID NO: 95453 - RNA, 64 nt, Homo Sapiens
cacgagaguuuaccaguugcuucucccaagugcuauuccuuaaaaucaugccuugaguguucuu

SEQ ID NO: 95454 - RNA, 64 nt, Homo Sapiens
uuuuuccucaccgacaguacucuacaucuggaccauuccuuaagaauacgaccuauuagaguaa

SEQ ID NO: 95455 - RNA, 64 nt, Homo Sapiens
agaauguauauuuaagaaauguucacaugaaaauauuccuuaguuaauuuuucaaaccagagcu

SEQ ID NO: 95456 - RNA, 64 nt, Homo Sapiens
aacaacagaagaguguuuaucagcuuucaugcuuauuccuuaaagugccaguuuccuugagaag

SEQ ID NO: 95457 - RNA, 64 nt, Homo Sapiens
aauuggaugagccuugagauagaugccaguuaaaauuccuuagaagcauaugguaaccaagguu

SEQ ID NO: 95458 - RNA, 64 nt, Homo Sapiens
uucugugagaaauaauagauauuacugggcccuuauuccuuauucucuguacuucugccuuuua

SEQ ID NO: 95459 - RNA, 64 nt, Homo Sapiens
guguuugcccaagccuuucucggcaucaucuuguauuccuuaucagauaguaaguaaccuguaa

SEQ ID NO: 95460 - RNA, 64 nt, Homo Sapiens
gaguauuacuguuuucucagcaugcauuaaaaauauuccuuaacuucaauuguaaauaaacuuu

SEQ ID NO: 95461 - RNA, 64 nt, Homo Sapiens
gcagucagcugccaguuuuugcaaagugcagccuacaagcuauuaugaucuggaccagggguca

SEQ ID NO: 95462 - RNA, 64 nt, Homo Sapiens
aaguagcagagccaagauuuacuuaucugugguuacaagcuaguuaaauucuggugguuaaaua

SEQ ID NO: 95463 - RNA, 64 nt, Homo Sapiens
ucccacguacuuauaaagaagguuggugaauuucacaagcuauuuuuggaauauuuuuagaaua

SEQ ID NO: 95464 - RNA, 64 nt, Homo Sapiens
uuuuggaauauuuuuagaauauuuuaagaauuucacaagcuauucccucaaaucugagggagcu

SEQ ID NO: 95465 - RNA, 64 nt, Homo Sapiens
agcccacugugcuugcaaaggccccuccugagugugucacuaacguggaaggcugcugucacua

SEQ ID NO: 95466 - RNA, 64 nt, Homo Sapiens
cccuccugagugugucacuacuguggaaggcugcugucacuagcucuaggucugugcacucucu

SEQ ID NO: 95467 - RNA, 64 nt, Homo Sapiens
aaggacaucucuagcauuuccuucagcaagaaugugucacuaguucacuuccagagaacuuguu

SEQ ID NO: 95468 - RNA, 64 nt, Homo Sapiens
uucuccuuaaagcuccagccucauggggcuucagugucacuauucagguauacuugugauauag

SEQ ID NO: 95469 - RNA, 64 nt, Homo Sapiens
cucucuugccuucagacagauggggcuacaggucugucacuauguggggagaaacagccugggc

SEQ ID NO: 95470 - RNA, 64 nt, Homo Sapiens
gccaugugaauguuguauacgauuguaaggcuuaugucacuaaagauuuuuauucugauuuuuu

SEQ ID NO: 95471 - RNA, 64 nt, Homo Sapiens
uguuucuuaggagaaaaugauucuguaauuccagugucacuaauuuauauuguucuuuccucug

SEQ ID NO: 95472 - RNA, 64 nt, Homo Sapiens
ccauacccgucacuacagccucaccucccaccccugucacuacggccucaccucccaccccugu

SEQ ID NO: 95473 - RNA, 64 nt, Homo Sapiens
ccaccccugucacuacggccucaccucccaccccugucacuacagccucaccuccuacagccuu

SEQ ID NO: 95474 - RNA, 64 nt, Homo Sapiens
cauagcaaauugugcugcacaugaggaaauaggcugucacuaucacauuguccugaaaacagca

SEQ ID NO: 95475 - RNA, 64 nt, Homo Sapiens
cagcgucuuuuccuagagcuggucaccacuaggcugucacuauaaauuccuugaauauaaguaa

SEQ ID NO: 95476 - RNA, 64 nt, Homo Sapiens
guaggcucacuggauuggucguguggagggggcuugucacuauuaccuuuacucucaaagccau

SEQ ID NO: 95477 - RNA, 64 nt, Homo Sapiens
guccguggcuacaauucaaaacaggaaagauucaugucacuacuuuuaccugugcaccagugug

SEQ ID NO: 95478 - RNA, 64 nt, Homo Sapiens
ugcccugaggaugggcuuccuuguccuguggccucugcuccaggggcaguguccuuucccugug

SEQ ID NO: 95479 - RNA, 64 nt, Homo Sapiens
guguguaagaugggcuauuuguucuuuggaaugacugcuccacuccacacucacaccucuauuc

SEQ ID NO: 95480 - RNA, 64 nt, Homo Sapiens
guucccuuccaaaaugcacaaaucauacccuugucugcuccaauucagucuccaaaccuggugc

SEQ ID NO: 95481 - RNA, 64 nt, Homo Sapiens
gcuugccgaaaccagcaugaugcuucaaagagcccugcuccaccccucauggcauggauccuuu

SEQ ID NO: 95482 - RNA, 64 nt, Homo Sapiens
guccccaaggaauaaguuugcccaggaggucuuucugcuccaucagaaggaaggauguccccag

SEQ ID NO: 95483 - RNA, 64 nt, Homo Sapiens
cacuacaagaaggaaggaugcccuggacaaccuccugcuccaucaggagcgagcaugugacagu

SEQ ID NO: 95484 - RNA, 64 nt, Homo Sapiens
ucuggcuguguccaggcggugugaucucguugcacugcuccaaggaacuggggucauucggucu

SEQ ID NO: 95485 - RNA, 64 nt, Homo Sapiens
ggcagccauggggaaggcagcaaccucccuuucacugcuccaguccuguugcccugggaaaggg

SEQ ID NO: 95486 - RNA, 64 nt, Homo Sapiens
uggcuuaagccuuccagcugaggccaggaaucuucugcuccauggcuccaguggccuugauuuu

SEQ ID NO: 95487 - RNA, 64 nt, Homo Sapiens
ggccuugauuuuaggccaggugcagucugcccuccugcuccaguauccugccauuaaggcuaug

SEQ ID NO: 95488 - RNA, 64 nt, Homo Sapiens
auucucagcacauagggugcgcagucauaggagacugcuccaucgcuuggcaguuauaccccau

SEQ ID NO: 95489 - RNA, 64 nt, Homo Sapiens
gauauacucauagaauggaaacucuaauguccagcugcuccaucccuuuggucaaagagaaaga

SEQ ID NO: 95490 - RNA, 64 nt, Homo Sapiens
acucagcaguguuggaggggcaguaagcuggaggcugcuccagagcucuugucccucacugccc

SEQ ID NO: 95491 - RNA, 64 nt, Homo Sapiens
aucaucaacucagccccugguuuuaaaaagucagcugcuccaaaaccugucacauaaagcauuu

SEQ ID NO: 95492 - RNA, 64 nt, Homo Sapiens
cucagccugggcagcuucccaagcacacuccuagcugcuccagugaucucagcucccguucccc

SEQ ID NO: 95493 - RNA, 64 nt, Homo Sapiens
gcacggcugaccauuucugcuggcuccgacaggccugcuccagaugcuagucccggcauccuga

SEQ ID NO: 95494 - RNA, 64 nt, Homo Sapiens
uuuagucuggguccaugucccagaccccucuauucugcuccaggacagcaggacuucaggucuu

SEQ ID NO: 95495 - RNA, 64 nt, Homo Sapiens
ccagcuggcaggguugcccaccccugcuguccaccugcuccauccucuaggguuccacaggccc

SEQ ID NO: 95496 - RNA, 64 nt, Homo Sapiens
caggccugaggacaugccucccaccaaauguccccugcuccagucccacuccugucaccccacg

SEQ ID NO: 95497 - RNA, 64 nt, Homo Sapiens
gagagcugguaacuagguagauguccuuguguggcugcuccagcguucaucccgccccugcucc

SEQ ID NO: 95498 - RNA, 64 nt, Homo Sapiens
uccuuguguggcugcuccaguguucaucccgccccugcuccaugaugggagauuaucagucuag

SEQ ID NO: 95499 - RNA, 64 nt, Homo Sapiens
aaccaaaggaggugaugggaggcuuuucaagacgcugcuccaaacucaucaacuccugugagua

SEQ ID NO: 95500 - RNA, 64 nt, Homo Sapiens
ucugcccuuccaacgcaucacccgccucaaacugcugcuccagaacauucugaagagaacacag

SEQ ID NO: 95501 - RNA, 64 nt, Homo Sapiens
gcguaccguggcccagacugugcagugcaagcugcugcuccagaguccugggagguggucgccc

SEQ ID NO: 95502 - RNA, 64 nt, Homo Sapiens
gcauaccguggcccagguggugcggugcaagcugcugcuccagauggcagggaggcagucgccc

SEQ ID NO: 95503 - RNA, 64 nt, Homo Sapiens
ggguggaggugguguucuauaccuaaaggaugaccugcuccagaaacagcaccagcacagcaug

SEQ ID NO: 95504 - RNA, 64 nt, Homo Sapiens
aaaaugggcucccugguaucuccugucuucccuacugcuccaaacccuaaauuuugguuguaca

SEQ ID NO: 95505 - RNA, 64 nt, Homo Sapiens
ugaagaaagccaucgagagaggcucccucaugggcugcuccauugauguaagucuggggugugg

SEQ ID NO: 95506 - RNA, 64 nt, Homo Sapiens
gauugcacggaugguaaggaauauggauaacucacugcuccaggacucagaccucgaccccaga

SEQ ID NO: 95507 - RNA, 64 nt, Homo Sapiens
agcacuagcaccucacuccaucggccccggcacccugcuccaucggcacuggcgcccugcucca

SEQ ID NO: 95508 - RNA, 64 nt, Homo Sapiens
ggccccggcacccugcuccaucggcacuggcgcccugcuccaucggcacuaaugcuccacucgg

SEQ ID NO: 95509 - RNA, 64 nt, Homo Sapiens
gacauuggugccccacuccaucagcacuaacgcccugcuccaucggcacuggugucccacucca

SEQ ID NO: 95510 - RNA, 64 nt, Homo Sapiens
caucacuauguccagcuccgucggcacuaccacccugcuccaucaucacuacguccagcuccaa

SEQ ID NO: 95511 - RNA, 64 nt, Homo Sapiens
ggcaccaacgcccagcuccaccgguacuggcucccugcuccaucggcacuaacgcccugcuuca

SEQ ID NO: 95512 - RNA, 64 nt, Homo Sapiens
cccuuugccucuguccucccuagggcugcugcuucugcuccagcacagaacagagggccagagc

SEQ ID NO: 95513 - RNA, 64 nt, Homo Sapiens
ggacaggugggccuggcggccugagugcugggcacugcuccaagccccugaucucugaccucug

SEQ ID NO: 95514 - RNA, 64 nt, Homo Sapiens
ugagauaaccaacucccuccucaaccaggcuuuccugcuccaccgucccauccuggugugagaa

SEQ ID NO: 95515 - RNA, 64 nt, Homo Sapiens
ggggaacuguugacacucgggagagauggaugagcugcuccaaacugccggaggacccccaccu

SEQ ID NO: 95516 - RNA, 64 nt, Homo Sapiens
aaaagggcuugcgaaaggaauagcagccuccugccugcuccaaggugcccaugaggacaaagug

SEQ ID NO: 95517 - RNA, 64 nt, Homo Sapiens
augcuugauugagugcuccuaacugaccgaguaccugcuccaucugcagcaaugaguugggaaa

SEQ ID NO: 95518 - RNA, 64 nt, Homo Sapiens
gcuuuugguaugcugaguguaggugugccauaagcugcuccagagaagagauggcaccagggaa

SEQ ID NO: 95519 - RNA, 64 nt, Homo Sapiens
gggccaaguugggcaggaccacugaaggggucagcugcuccagugucgccucauuuccugcuac

SEQ ID NO: 95520 - RNA, 64 nt, Homo Sapiens
cuuggccugucucauccccaccucccucucucuucugcuccacccuggccaggagcucuucagg

SEQ ID NO: 95521 - RNA, 64 nt, Homo Sapiens
acauccuccguccagccgccucccacccccuucucugcuccaccacugaccauccacucuaccc

SEQ ID NO: 95522 - RNA, 64 nt, Homo Sapiens
aagccuuaagccauaggcccacaagguccacucccugcuccacggcccagccuuguaaauaacc

SEQ ID NO: 95523 - RNA, 64 nt, Homo Sapiens
uauaaccccagccugaccugugacucugaguccacugcuccauuaagagcagagucugggccuc

SEQ ID NO: 95524 - RNA, 64 nt, Homo Sapiens
aacugcccuuccagguggguuuucccaaaguccucugcuccagcugcuguccacaugaccucca

SEQ ID NO: 95525 - RNA, 64 nt, Homo Sapiens
aaggggcucuugaaccccuuccuggcccuucagucugcuccaccacccugcauuuuccucuugu

SEQ ID NO: 95526 - RNA, 64 nt, Homo Sapiens
gggaguuguauggaaaaauaguagaauuacacagcaugaaaagcagcccaugguuuaaauuauu

SEQ ID NO: 95527 - RNA, 64 nt, Homo Sapiens
gccuaaugaggugauuaggugaagucucugcccucaugaaaagauuaaucccauuaucucagga

SEQ ID NO: 95528 - RNA, 64 nt, Homo Sapiens
gcacuuuauugcaaguuagugauggcuaaguuugcaugaaaacucuaucuaaaagaagaaaacu

SEQ ID NO: 95529 - RNA, 64 nt, Homo Sapiens
ggagauuaaugagcuuuauuggcaaugucaaacccaugaaaaugaaguagcaaaucugaagaua

SEQ ID NO: 95530 - RNA, 64 nt, Homo Sapiens
auaugaaauucaaauugcaggauauuuugugucacaugaaaauuggaaaaaaauuccaaagacu

SEQ ID NO: 95531 - RNA, 64 nt, Homo Sapiens
auuggugggccacugaaaguuauuuuuauuuuuucaugaaaauuucugggagguuuuuuuuuuc

SEQ ID NO: 95532 - RNA, 64 nt, Homo Sapiens
cuuagugaauauauucuuaaaagacucccaaauccaugaaaacgaugaaagcuaauauaggaac

SEQ ID NO: 95533 - RNA, 64 nt, Homo Sapiens
uagcugcaucuuuugaaauaauuaugucugucaccaugaaaacuaaaauacaagaugcugcuuu

SEQ ID NO: 95534 - RNA, 64 nt, Homo Sapiens
cuauuaaguaggcacccuguucugccgugcuccccaugaaaaguuuaccaaaaugcucaagagc

SEQ ID NO: 95535 - RNA, 64 nt, Homo Sapiens
uccacagcaacaucgaaaccauuuuuuaauggaacaugaaaaccuuggucuguggauuuuuaau

SEQ ID NO: 95536 - RNA, 64 nt, Homo Sapiens
cuuauaagaauuuuaagaacuaaguggcaaauuccaugaaaauauuucucaguucuguaugcac

SEQ ID NO: 95537 - RNA, 64 nt, Homo Sapiens
uuuagaaaaacauauuacuuugaauucaaauugucaugaaaaccagaacaguguuuguccaugu

SEQ ID NO: 95538 - RNA, 64 nt, Homo Sapiens
gaugcaagugccuacaguauuaucaggaggagaacaugaaaauauuaagacaaaaauccucagc

SEQ ID NO: 95539 - RNA, 64 nt, Homo Sapiens
aaagaguuuaacuuucuggaacugaaggagaaaacaugaaaauguuuauauugcuucuuguuaa

SEQ ID NO: 95540 - RNA, 64 nt, Homo Sapiens
cuuguaaaaaccaugugggguaaacugggaauaacaugaaaagauuucuguggagguggggugg

SEQ ID NO: 95541 - RNA, 64 nt, Homo Sapiens
uacaaucaaaaucccagaugcuggucucuauucccaugaaaaagugcucaugacauauugagaa

SEQ ID NO: 95542 - RNA, 64 nt, Homo Sapiens
aucauaaauuucccucaaaauguguagauuuuugcaugaaaaaaccauaucaucaaaacuaauu

SEQ ID NO: 95543 - RNA, 64 nt, Homo Sapiens
aagacugguuuagcagcagauaauguacacuggacaugaaaacacaaaaugagaucauaagugu

SEQ ID NO: 95544 - RNA, 64 nt, Homo Sapiens
cuauuuuuauccaaaaguauaaauuuugcuuuggcaugaaaagugguccucuugacugcauuau

SEQ ID NO: 95545 - RNA, 64 nt, Homo Sapiens
cuaggagcaaucuaagcuguguuacuccaaaggacaugaaaaagcucaagaguaaaauuaaaau

SEQ ID NO: 95546 - RNA, 50 nt, Homo Sapiens
agccucagcuucugaagugacaugaaaagagccucuggaugcauuuccau

SEQ ID NO: 95547 - RNA, 64 nt, Homo Sapiens
auagaauuuccuguaauauauuuauauacuuuuucaugaaaauggaguuaucaguuaucuguuu

SEQ ID NO: 95548 - RNA, 64 nt, Homo Sapiens
ucuguagucugaaucacuaacuaaaauguaauggcaugaaaaucuauaauguaaauuaaaucca

SEQ ID NO: 95549 - RNA, 64 nt, Homo Sapiens
aucacucaucuacauaaagguuuucaugaugacccaugaaaaauacccaaagaauuauagauau

SEQ ID NO: 95550 - RNA, 64 nt, Homo Sapiens
cgacuuuauuccaaaaguaacaagcuugguauggcaugaaaacuuguaccuuugcugucuugcu

SEQ ID NO: 95551 - RNA, 64 nt, Homo Sapiens
cgcacugacauuuuuuuuuaugaaaaaacuuuaacaugaaaaaacaaggaacaaaacaaagcuu

SEQ ID NO: 95552 - RNA, 64 nt, Homo Sapiens
acuguaacugaucauguauuacuccuuaaauccacaugaaaacuuauguacaaagguaaccauc

SEQ ID NO: 95553 - RNA, 64 nt, Homo Sapiens
auuauucugcauuuuauucauuccauaucuguaacaugaaaauguuuuaaaugcucauaggucu

SEQ ID NO: 95554 - RNA, 64 nt, Homo Sapiens
agggcuucagugucgauugaccaaaaauguucagcaugaaaaaaucuaaauacauugcccacuu

SEQ ID NO: 95555 - RNA, 64 nt, Homo Sapiens
auauauuauuaacaugaauaaaccauuuuucuuucaugaaaauaacuuguguuucuacacagca

SEQ ID NO: 95556 - RNA, 64 nt, Homo Sapiens
gauauucucaugggcuuugccaugaggauuuacacaugaaaauuagcguaucaaauuugcacuu

SEQ ID NO: 95557 - RNA, 64 nt, Homo Sapiens
ucuggucagcuacaguuuaauuuauagaagggaucaugaaaaggccacaaugcuuugagcuucu

SEQ ID NO: 95558 - RNA, 64 nt, Homo Sapiens
augaugguuagcagaagcuguuguauacaaucuucaugaaaauuucaguguguauuuuucuuuu

SEQ ID NO: 95559 - RNA, 64 nt, Homo Sapiens
cugccuaacacuuuaguaggugcuauagaggauacaugaaaaguaugagaucugguuccaucca

SEQ ID NO: 95560 - RNA, 64 nt, Homo Sapiens
aaaauaagacaguuuauuagggaaaagaaggaaacaugaaaauaucaugaaaacugcaaugcug

SEQ ID NO: 95561 - RNA, 64 nt, Homo Sapiens
gcaaugcugggaaaagaagguaaaaagcagaguucaugaaaacucauugucuaaaaguaacuuu

SEQ ID NO: 95562 - RNA, 64 nt, Homo Sapiens
gcuccacauuuaaaggacauaguucaauaugaugcaugaaaaauuuauuuccucugcaggauac

SEQ ID NO: 95563 - RNA, 64 nt, Homo Sapiens
auagcacauccuccaacguuaaaagacaguggaucaugaaaagugcuguuuuguccuuugagaa

SEQ ID NO: 95564 - RNA, 64 nt, Homo Sapiens
acuuccagugcgucucuuuuguuccuggcuuugacaugaaaagauagguuugaguucaaauuuu

SEQ ID NO: 95565 - RNA, 64 nt, Homo Sapiens
uuccuuaguagaauguauauaccagagcuguucacaugaaaauaaguauaaauuaauuuuucaa

SEQ ID NO: 95566 - RNA, 64 nt, Homo Sapiens
cucuuacuuaaauacguuugcuuaauguuuccaacaugaaaauuaauuuuaauuccaugaaagu

SEQ ID NO: 95567 - RNA, 64 nt, Homo Sapiens
aaauauaaguaaggaucaaaacucuaaaauuuugcaugaaaauuacauccaaauugugaaaauc

SEQ ID NO: 95568 - RNA, 64 nt, Homo Sapiens
aaaucuauaaaaugaugucuuaaaacagccauaucaugaaaaauucuacuuagcuauauuauua

SEQ ID NO: 95569 - RNA, 64 nt, Homo Sapiens
aaaagcgaauguuugugugugcagacaaucuuagcaugaaaaugguuuaaauaggcugguccua

SEQ ID NO: 95570 - RNA, 64 nt, Homo Sapiens
uagcugaagucagccacggugggaguguuuauaccaugaaaaucagcaagugcuguaaaucagg

SEQ ID NO: 95571 - RNA, 64 nt, Homo Sapiens
uucauauauuugugacaauuuuugaguaauauugcaugaaaaugucccuauguuacauccauuc

SEQ ID NO: 95572 - RNA, 64 nt, Homo Sapiens
uucgcuuucuccuguuuuuuuuuuaaaaaaaaagcaugaaaaaggaagagaaaaaguuugauau

SEQ ID NO: 95573 - RNA, 64 nt, Homo Sapiens
acaugggccaaaacaugaauugaguauguggucacaugaaaacacggaugaaugaauaaaacac

SEQ ID NO: 95574 - RNA, 64 nt, Homo Sapiens
auuccuugguuaugugcagguccaauguugugugcaugaaaaggagugacugcacaaguaaaag

SEQ ID NO: 95575 - RNA, 64 nt, Homo Sapiens
gccccuuuaccugccaagacaaaacaagaugugucaugaaaacaacauuucacaugcacauuuc

SEQ ID NO: 95576 - RNA, 64 nt, Homo Sapiens
cugcacuuuaaguuucucaaauuauuugcugauacaugaaaauaugagcuuauaugacacaauu

SEQ ID NO: 95577 - RNA, 64 nt, Homo Sapiens
cuguuuuucccccuaauaaauucuauuuucuuuucaugaaaacaaaagggagaaaugacauguu

SEQ ID NO: 95578 - RNA, 64 nt, Homo Sapiens
guagaaucuacaucaccauccauugcuuuaauuacaugaaaaugcucuaguguugugaugcacu

SEQ ID NO: 95579 - RNA, 64 nt, Homo Sapiens
gcccauccaggagaaguggguaguaauucuucaucaugaaaaugauauauuacauauuuaguau

SEQ ID NO: 95580 - RNA, 64 nt, Homo Sapiens
aaaauguuugucuuugcaaagcuacagcuccuaucaugaaaaaucagaggcccccauauacucu

SEQ ID NO: 95581 - RNA, 64 nt, Homo Sapiens
accuccaaggacccucugacucugaagaccccugcaugaaaauagauucugaagcaugcacacc

SEQ ID NO: 95582 - RNA, 64 nt, Homo Sapiens
gaggggcuuuuauucugccaagucauuucaaauacaugaaaaaucuuacacuggagagaaaccc

SEQ ID NO: 95583 - RNA, 64 nt, Homo Sapiens
aaaagcauucagcuugccuacuuccuuucauagacaugaaaagacucacacuggaaggaaacac

SEQ ID NO: 95584 - RNA, 64 nt, Homo Sapiens
gaaaggccuuuauucugccaagucauuucgaagacaugaaaaaacucacacuggagagaaaccc

SEQ ID NO: 95585 - RNA, 64 nt, Homo Sapiens
gaaaggcuuuuauucucccacgucauuucaaagacaugaaaaaacucacacugcagagaaaccc

SEQ ID NO: 95586 - RNA, 64 nt, Homo Sapiens
cucauacuggagagaaacccacucugcucaaagacaugaaaagagaaaguguucguauaucaca

SEQ ID NO: 95587 - RNA, 64 nt, Homo Sapiens
cucauacuggagagaaacccaaucugcucaaaaacaugaaaaggaaaagcauuccgauaccacc

SEQ ID NO: 95588 - RNA, 64 nt, Homo Sapiens
cuuuaagccugcuguaguugaguugcagacagugcaugaaaaaguauuccgcugggaauugagc

SEQ ID NO: 95589 - RNA, 64 nt, Homo Sapiens
gaguuagacuacauaucuuuuggcacuaacaucucaugaaaaauuaugguuaauaaaauaucac

SEQ ID NO: 95590 - RNA, 64 nt, Homo Sapiens
aaauuuuaucuuuuacaugggauagaugagagaucaugaaaaccauaaacaauacagaaggaga

SEQ ID NO: 95591 - RNA, 64 nt, Homo Sapiens
cuugccuuacaaggcucuaaguaaguguccuugucaugaaaacagaccacaugaguucugguug

SEQ ID NO: 95592 - RNA, 64 nt, Homo Sapiens
aaacguuuccuacauucuuuuccauguguaaaaucaugaaaaagccugucaccggacuugcauu

SEQ ID NO: 95593 - RNA, 64 nt, Homo Sapiens
aaaaaaacaccucguuuuuaccuugucuucuagacaugaaaaggcaguugcauuccacucugca

SEQ ID NO: 95594 - RNA, 64 nt, Homo Sapiens
auggaagacuauucugccacuaaagaaaccaaaucaugaaaauuggaauuugcuuuagccagaa

SEQ ID NO: 95595 - RNA, 64 nt, Homo Sapiens
acuuggccagggucaaggacaguaaacuaagagccaugaaaaucuuugccccauuuuacagaau

SEQ ID NO: 95596 - RNA, 64 nt, Homo Sapiens
gaaaaugggugcugggccuggaaggcacugggaagcucaucagacccucagggaacuuggucua

SEQ ID NO: 95597 - RNA, 64 nt, Homo Sapiens
aucugcagggcauugacccugccucugccugccagcucaucacgucgcccucggcgcucugucu

SEQ ID NO: 95598 - RNA, 64 nt, Homo Sapiens
uuagggcccugagcccugccuggagagcagcacagcucaucaguccccaaagcccccuggcucu

SEQ ID NO: 95599 - RNA, 64 nt, Homo Sapiens
acacaggaccugaagcccuaaagaaaggcccucugcucaucaagaaaguggcuaccaaccaggg

SEQ ID NO: 95600 - RNA, 64 nt, Homo Sapiens
gagcuacgacuuuggguacuugggcuacaucauagcucaucacggagccgucacugaguguggc

SEQ ID NO: 95601 - RNA, 64 nt, Homo Sapiens
ucagagcccagggucaggagaccuucuggagccagcucaucagcccugagugaugaugauuaac

SEQ ID NO: 95602 - RNA, 64 nt, Homo Sapiens
uagcugcuggauguugacgagcccacuggagggcgcucaucaagcgccggcauagggaccuaag

SEQ ID NO: 95603 - RNA, 64 nt, Homo Sapiens
cacagggcuauuccuuuccugaccuccucucaaugcucaucacagcccuagauggugcucgcca

SEQ ID NO: 95604 - RNA, 64 nt, Homo Sapiens
ucagcgugccugcgauggcguucauguccgucucgcucaucaucaccgacauguccuucuuauc

SEQ ID NO: 95605 - RNA, 64 nt, Homo Sapiens
aaaagaaaagaaagaagaagccauucccaacguugcucaucaaauuaugaccauaaauuuccag

SEQ ID NO: 95606 - RNA, 64 nt, Homo Sapiens
guuuuuggaaagauauuuacucaaaauaacuaugcuuuagaacuuuuuuuuuuuuuuuuuuuuu

SEQ ID NO: 95607 - RNA, 64 nt, Homo Sapiens
uugguuaaacagcagcacuuuuuaguucccuaaacuuuagaagaaaugcuaucagaaauagauu

SEQ ID NO: 95608 - RNA, 64 nt, Homo Sapiens
gaauuucgguagaacugagugaccuguggaacugcuuuagaaucuaaccugcugucuucgugcu

SEQ ID NO: 95609 - RNA, 64 nt, Homo Sapiens
auucugguagauuugacuuguuuauaauucugcacuuuagaagaaaaacaguguuaaucuguag

SEQ ID NO: 95610 - RNA, 64 nt, Homo Sapiens
ucacucuaucuuuggagguuaaaaauaaauauuccuuuagaagagauguaucauauuuuuaaau

SEQ ID NO: 95611 - RNA, 64 nt, Homo Sapiens
uggggaucugccauauuuguauaaagauauauuucuuuagaaaauaagaaaauggaaaagguca

SEQ ID NO: 95612 - RNA, 64 nt, Homo Sapiens
uaaauucuacaagaauuuuacuuguuuuuuuaaucuuuagaacuuauuuuauuaacauggaacu

SEQ ID NO: 95613 - RNA, 64 nt, Homo Sapiens
uuaaaacaagguguaaaugaaguugaauaugcugcuuuagaacugaucuuuuuuuugccuuaag

SEQ ID NO: 95614 - RNA, 64 nt, Homo Sapiens
uagcuuaaccuguagguacauccucccuaaagagcuuuagaagagggaaagcaaaaaguagcug

SEQ ID NO: 95615 - RNA, 64 nt, Homo Sapiens
aggcccacccccugcacaaguacacauuuguguucuuuagaaaaugucaggacugucauuuauc

SEQ ID NO: 95616 - RNA, 64 nt, Homo Sapiens
cccagcccucagauggcucuccuacaugauggugcuuuagaaacaaagguaaaauuugccuguu

SEQ ID NO: 95617 - RNA, 64 nt, Homo Sapiens
gaucccaguguccuuuuccaaaugagugcuguagcuuuagaaguggcccucuauagaaagaagu

SEQ ID NO: 95618 - RNA, 64 nt, Homo Sapiens
cuaguguguaucuaucauguauucuugucuccugcuuuagaaugggguagaauacacucuugac

SEQ ID NO: 95619 - RNA, 64 nt, Homo Sapiens
uggcacacaacaaaagugccugcuuacaucuggacuuuagaaucguccugucucagggguaacc

SEQ ID NO: 95620 - RNA, 64 nt, Homo Sapiens
ugggcagaagcucugcauucauaguagauuguuucuuuagaaaccaguuuucugguaacuuaug

SEQ ID NO: 95621 - RNA, 64 nt, Homo Sapiens
aauauuagauugauauagcuggaagcauuuugcccuuuagaauagcauuacauaauaauuuugu

SEQ ID NO: 95622 - RNA, 64 nt, Homo Sapiens
guaucugauggagcuccugaugaccuaauguauccuuuagaaauuuaaaauagcauuagagcaa

SEQ ID NO: 95623 - RNA, 64 nt, Homo Sapiens
guguauguacacacacacacacaccugccauacacuuuagaagaacgcuucucuucuauuccaa

SEQ ID NO: 95624 - RNA, 64 nt, Homo Sapiens
gauuuucagcaccugggaaguaaucccaauaauacuuuagaaaaucuaagacaguucuuucugc

SEQ ID NO: 95625 - RNA, 64 nt, Homo Sapiens
gaaaaaugauuguuucaaggaagugacaguucuacuuuagaaguacuaauuggagaugacuuuu

SEQ ID NO: 95626 - RNA, 64 nt, Homo Sapiens
caugagauguuccuaucuuaaauaaaaaugaaagcuuuagaaggagaaucucagcauuguguua

SEQ ID NO: 95627 - RNA, 64 nt, Homo Sapiens
uuaaaugaguagagagcucaaauuuuucagcauucuuuagaauuaugcagcuguucugaacugg

SEQ ID NO: 95628 - RNA, 64 nt, Homo Sapiens
aaauuuuuuucuuguuuuuguguuaaggcagugacuuuagaaacgaugaauuacuucuucaggg

SEQ ID NO: 95629 - RNA, 64 nt, Homo Sapiens
ccaguacucacccagggacuguuagcucacgugucuuuagaacuagaagacacaggggagcagg

SEQ ID NO: 95630 - RNA, 64 nt, Homo Sapiens
guggucuuuauucagguuuuaaguuuuuuagaaccuuuagaaggaaaaccaacccaaaccagug

SEQ ID NO: 95631 - RNA, 64 nt, Homo Sapiens
cccuggaaauauauuuaaguuuuuuuuuuuuuuccuuuagaauguuauuuuuccuacauuucuu

SEQ ID NO: 95632 - RNA, 64 nt, Homo Sapiens
ccaccacuguauuuugaccaaauaaugacaacuucuuuagaaauuugaauggcuuggugaggaa

SEQ ID NO: 95633 - RNA, 64 nt, Homo Sapiens
aagugguuucauguuaaaaaacaaacuccuaguccuuuagaaauaacagauucucugcacaaaa

SEQ ID NO: 95634 - RNA, 64 nt, Homo Sapiens
ugccgacuucuuccaucuaucuaaagauuuagaacuuuagaaaauagcugauuguauuuuaucu

SEQ ID NO: 95635 - RNA, 64 nt, Homo Sapiens
guuagcacaugcuuuugaaacuaauuuauuuccacuuuagaaaauacuaguccaaaggccaaag

SEQ ID NO: 95636 - RNA, 64 nt, Homo Sapiens
cuguuuaaacaccauuuaccugcuuuaauccuuucuuuagaauguagcccaugggccuuuagaa

SEQ ID NO: 95637 - RNA, 64 nt, Homo Sapiens
cuuuaauccuuucuuuagaaaguagcccaugggccuuuagaaugagcucugaaauuugggaaaa

SEQ ID NO: 95638 - RNA, 64 nt, Homo Sapiens
uaaaucauuguguuuuuuauuaauaauauaagugcuuuagaaaucugucuccaaaaccaugcca

SEQ ID NO: 95639 - RNA, 64 nt, Homo Sapiens
uuuaggagauaaauuuauuuuauaugaaacaugucuuuagaaaacaaaauaagggauggucaaa

SEQ ID NO: 95640 - RNA, 64 nt, Homo Sapiens
aacucagaacagguuauguaaaaauauagucuggcuuuagaauuuguuaauucaccugcuuugc

SEQ ID NO: 95641 - RNA, 64 nt, Homo Sapiens
ugaguuuugauuccucuaacuucucagaaugauucuuuagaauucuauaauucauagcaauuuu

SEQ ID NO: 95642 - RNA, 64 nt, Homo Sapiens
aaagaucaguucauauuguuguaauuauucuauacuuuagaagaauuucucucugaucuauccu

SEQ ID NO: 95643 - RNA, 64 nt, Homo Sapiens
cugucuuguuucuagccaagggacauuauggcagcuuuagaaggacuucuuucagagcauuuua

SEQ ID NO: 95644 - RNA, 64 nt, Homo Sapiens
aguccuaugcauaauguaaagagaauacgauggccuuuagaaaaugcccuuuagcagagaauuu

SEQ ID NO: 95645 - RNA, 64 nt, Homo Sapiens
cgaaagacuauagcaucacucagucccuguuagacuuuagaagauugauacugaugcacugcau

SEQ ID NO: 95646 - RNA, 64 nt, Homo Sapiens
cuuugugaaaguaacuuuucaaguaaaugcacaacuuuagaauuucuacaaauaaguucuuuua

SEQ ID NO: 95647 - RNA, 64 nt, Homo Sapiens
uaaauaaacuuuauuuccucucacuauaguguggcuuuagaauauaucaaguacaaccugaaug

SEQ ID NO: 95648 - RNA, 64 nt, Homo Sapiens
auuucugucuuuuccaggguaaaagagugcaucgcuuuagaagaaguuuggcaguauuuaaauc

SEQ ID NO: 95649 - RNA, 64 nt, Homo Sapiens
uuucauucggaauccgaaggauacagucuuuaaacuuuagaauucccaagaaggcuuuauuaca

SEQ ID NO: 95650 - RNA, 64 nt, Homo Sapiens; identical to SEQ ID NO: 95648

SEQ ID NO: 95651 - RNA, 64 nt, Homo Sapiens; identical to SEQ ID NO: 95649

SEQ ID NO: 95652 - RNA, 64 nt, Homo Sapiens
guuaacacauauuucuggcugagauuuuggaacuagcuaguaacuggcuuguguucuuuaagca

SEQ ID NO: 95653 - RNA, 64 nt, Homo Sapiens
uuagaaaggcuaagugaucuuucucuggcuauccagcuaguaguaaugaagucaggucuugaac

SEQ ID NO: 95654 - RNA, 64 nt, Homo Sapiens
gggaaauuuugcaauguuuggaggauguugucacagcuaguagcgggugcucugggaucuggug

SEQ ID NO: 95655 - RNA, 64 nt, Homo Sapiens
acauccaggauuuccgccacccugaauuuaguagagcuaguaggcccuggucgucacucugggc

SEQ ID NO: 95656 - RNA, 64 nt, Homo Sapiens
ccuauaauuagugcagucuuauguuauaaaagaaagaaguuaacuauauuuggggacaaaaaaa

SEQ ID NO: 95657 - RNA, 64 nt, Homo Sapiens
gcaaaggcaaaucuaagcaaucauuuuuccccccagaaguuacuuagaaggagaacugggaaca

SEQ ID NO: 95658 - RNA, 64 nt, Homo Sapiens
ucaaguuaaaauguauuguguuguuuguaaaguaagaaguuacuggccaggagcggcggcucau

SEQ ID NO: 95659 - RNA, 64 nt, Homo Sapiens
aaaaacaaacaaacaaaacaaaacaaaaaaaaacagaaguuacaaaugaauacucacggauaug

SEQ ID NO: 95660 - RNA, 64 nt, Homo Sapiens
guuaaggagaggugaugccauuaaaggguuugcaagaaguuaggacauuucccaaguccaugcu

SEQ ID NO: 95661 - RNA, 64 nt, Homo Sapiens
guggucacaccucaucuauuuagaaaguuggucaagaaguuauaggauguguguaguuucaaga

SEQ ID NO: 95662 - RNA, 64 nt, Homo Sapiens
uagcagaggcccugucuucugaagucucaggcuuagaaguuaccaaagugggcucagaaacugu

SEQ ID NO: 95663 - RNA, 64 nt, Homo Sapiens
uggcaggacuugagguuggcuuccacucugccuuagaaguuaauuuuccaaaguacauuacaaa

SEQ ID NO: 95664 - RNA, 64 nt, Homo Sapiens
aaauuauuaaguuagcuuuucagaguuuuaauauagaaguuacuagcacugacacacugauuuu

SEQ ID NO: 95665 - RNA, 64 nt, Homo Sapiens
ucagagugaaacgccuuuacauuugugcggauagagaaguuaacucucccucauaugucacugu

SEQ ID NO: 95666 - RNA, 64 nt, Homo Sapiens
aaaaccuuuacuuagaauugcaaguaacagugauagaaguuagauaauagaaaaccucagggcc

SEQ ID NO: 95667 - RNA, 64 nt, Homo Sapiens
uggggggaucugaagauuugcuugguuuucuuccagaaguuaaagggcccaagccaggagaucg

SEQ ID NO: 95668 - RNA, 64 nt, Homo Sapiens
uuuuuuuuuaaaucaugguaccuguuuuaaaaugagaaguuauuauucauacuguguugcucau

SEQ ID NO: 95669 - RNA, 64 nt, Homo Sapiens
caagguacauuguucuacuguuuuauacccagguagaaguuacacagcaauuuagcaauguugu

SEQ ID NO: 95670 - RNA, 64 nt, Homo Sapiens
cagagaguaaacuugaauggaauaacgacauuccagaaguuaaucauuugaauucugaacacug

SEQ ID NO: 95671 - RNA, 64 nt, Homo Sapiens
ucaugaaugcuccacaauuucaacauaccacaagagaaguuaauuucuuaacauuguguucuau

SEQ ID NO: 95672 - RNA, 64 nt, Homo Sapiens
ugggaugcaaaguaccuaaagaucucugauccuaagaaguuacuucuggccaggcgcgguggcu

SEQ ID NO: 95673 - RNA, 64 nt, Homo Sapiens
ugggcaacagagggagacucugucucaaaaaaaaagaaguuacuuccaagacagacuuuuaaga

SEQ ID NO: 95674 - RNA, 64 nt, Homo Sapiens
aaaguaugccccauuccugugugguuuccaauguagaaguuaacccccuccuagcuugacuuua

SEQ ID NO: 95675 - RNA, 64 nt, Homo Sapiens
ucuucaagagcugcaccucuagucccauccuggaagaaguuauuaauggccuagccauucucua

SEQ ID NO: 95676 - RNA, 64 nt, Homo Sapiens
auacccuuaaggucuuuaagguucaagcagagugagaaguuaaaguuaaaauacccuuaaggag

SEQ ID NO: 95677 - RNA, 64 nt, Homo Sapiens
auacccuuaaggagguucaaguucaagcagagugagaaguuaaauugcgucccgaaggacggag

SEQ ID NO: 95678 - RNA, 64 nt, Homo Sapiens
guuaaggucuuggaaugugaaaacuuccuuucugagaaguuaguuugauuuuuagagguaauga

SEQ ID NO: 95679 - RNA, 64 nt, Homo Sapiens
cugaauuuaacuguauuuuuaaaacgggauuuucagaaguuagcgguaccacagugaggugaau

SEQ ID NO: 95680 - RNA, 64 nt, Homo Sapiens
ugaugguuaacauguuuuaaaaaaucuuuaauggagaaguuaaauauuuggugagauuuuaguc

SEQ ID NO: 95681 - RNA, 64 nt, Homo Sapiens
cacagagauuuauaguauucuuaauaguaugugcagaaguuacaucauuuaaaaaacccuugcu

SEQ ID NO: 95682 - RNA, 64 nt, Homo Sapiens
uagcacuuuuagagccaaaaaaacucaggcacaaagaaguuaaauaacuugccgggugcggugg

SEQ ID NO: 95683 - RNA, 64 nt, Homo Sapiens
aaaaacaaaaacaaaacaaaacaacaacaaaaaaagaaguuaaauaacuuguuuaagaucacac

SEQ ID NO: 95684 - RNA, 64 nt, Homo Sapiens
cuugugaucuucacugaggaauuagaacuaugauagaaguuaggcuguggcaaaugggacauuc

SEQ ID NO: 95685 - RNA, 64 nt, Homo Sapiens
gauuugccuggacuucccuucccagggagggaacagaaguuaggaggcaacuuugggauggugc

SEQ ID NO: 95686 - RNA, 64 nt, Homo Sapiens
aauaauuuaaaaauuaauuauuuuacauaauuaaagaaguuaaaaacuauuaacauuaaauaau

SEQ ID NO: 95687 - RNA, 64 nt, Homo Sapiens
aaaguaggguaagggaaugccagucugaggaguuagaaguuaccguuuuauguaagguaauuau

SEQ ID NO: 95688 - RNA, 64 nt, Homo Sapiens
cugguggacugaauguagguugagagaggaagcgagaaguuaaggaugccuucaaaauuuuugu

SEQ ID NO: 95689 - RNA, 58 nt, Homo Sapiens
acugcauagauacggguauuuauuuuacccuaagaagauuuugaaguuuaaaaguacu

SEQ ID NO: 95690 - RNA, 58 nt, Homo Sapiens
uuguaaaagagaugucuucaugucuuccccuaagaauacgcuuuuccuaacaggcuac

SEQ ID NO: 95691 - RNA, 58 nt, Homo Sapiens
guggggugugauggaacaggccaguuggccuaagaauuaguacuugcucuaauaaugg

SEQ ID NO: 95692 - RNA, 58 nt, Homo Sapiens
uuguuacucaaaguaaaguacuaggaguccuaagaaauguucuguucuuguacauuau

SEQ ID NO: 95693 - RNA, 58 nt, Homo Sapiens
augaaggccagugacaugacaacugugaccuaagaaaugggaagauuaucuuucaaga

SEQ ID NO: 95694 - RNA, 58 nt, Homo Sapiens
aaaauggacuuuguaauuguacagcauaccuaagaaacucagaaggugcauuuaagag

SEQ ID NO: 95695 - RNA, 58 nt, Homo Sapiens
augaucaagugaagagccccagauucccccuaagaagcaaaggaucgucuuuuaugcc

SEQ ID NO: 95696 - RNA, 58 nt, Homo Sapiens
cccucauaguaccaagaauggacugcccccuaagaaaccuguuugagaaucacugaau

SEQ ID NO: 95697 - RNA, 58 nt, Homo Sapiens
ugcaugaguucucgaaaauggugggaaaccuaagaaaggaggagggcuguauucacug

SEQ ID NO: 95698 - RNA, 58 nt, Homo Sapiens
caagagguggggaccaaaaccaugcauuccuaagaaguccccaggucaugcugcuguu

SEQ ID NO: 95699 - RNA, 58 nt, Homo Sapiens
aacugaggaaaaaaaauaauuaaacaggccuaagaagaaaucaaaaaccauaagacac

SEQ ID NO: 95700 - RNA, 58 nt, Homo Sapiens
uagaacugugccacuaauuaaaggaaauccuaagaaggugcauuucuuuacagagcug

SEQ ID NO: 95701 - RNA, 58 nt, Homo Sapiens
accauuaaucagaaacaucauggcaaccccuaagaauagacuaaguuuguguuggcug

SEQ ID NO: 95702 - RNA, 58 nt, Homo Sapiens
agcagagugugguuaucuccuguaccagccuaagaauguuugcugaaacugcuuccua

SEQ ID NO: 95703 - RNA, 58 nt, Homo Sapiens
ugacaagaaauucuuaugcagccuuuuaccuaagaaauuuucugucagugccuuaucu

SEQ ID NO: 95704 - RNA, 58 nt, Homo Sapiens
agagaaggguuucaucuucuaagauaucccuaagaaauucuucaaaaguaacggaauc

SEQ ID NO: 95705 - RNA, 58 nt, Homo Sapiens
agcgacauaaaaauauacuuaucaauaaccuaagaaaaugaagagauucuggaaaugc

SEQ ID NO: 95706 - RNA, 58 nt, Homo Sapiens
uugagaaucccaauuauuuauuauuugcccuaagaacuuuuuccugucuguauauaac

SEQ ID NO: 95707 - RNA, 58 nt, Homo Sapiens
agcaucgaugcgagcucgugucaacagaccuaagaaauagagccucuguacgcgcaga

SEQ ID NO: 95708 - RNA, 58 nt, Homo Sapiens
agaaaaggcauuuuuaaagggacuuccuccuaagaaggaaagaaucucaggaagaaca

SEQ ID NO: 95709 - RNA, 55 nt, Homo Sapiens
caugguacucugacaaagguggacaccuaagaagguuauuacaguuccuaauuga

SEQ ID NO: 95710 - RNA, 58 nt, Homo Sapiens
uaucuuuucuuucuacccaaggcagaaaccuaagaaguuuuuuucccccaagugaaga

SEQ ID NO: 95711 - RNA, 58 nt, Homo Sapiens
ucccaagaauccaauggcucugcucccuccuaagaagaagagaagcaaaugcggagcc

SEQ ID NO: 95712 - RNA, 58 nt, Homo Sapiens
aauggaagagaaggagcuugcuggcuucccuaagaaacuaggaaauccgggagguauu

SEQ ID NO: 95713 - RNA, 58 nt, Homo Sapiens
uugaaagugaagcaacuauggguuauuuccuaagaauauauuuguagcucauuuauuu

SEQ ID NO: 95714 - RNA, 58 nt, Homo Sapiens
aaguacuucugugacauauaauauacuaccuaagaaaaauuauaacugaaagguuuaa

SEQ ID NO: 95715 - RNA, 58 nt, Homo Sapiens
auccgcugugggcagagaacccaguucuccuaagaaaaaaagaagcagcaguccugcc

SEQ ID NO: 95716 - RNA, 58 nt, Homo Sapiens
aauuaagucaauguaaaucaggcuagacccuaagaaguugcuuuuucuccauggauga

SEQ ID NO: 95717 - RNA, 58 nt, Homo Sapiens
acuugugcauuuguuauggauaucccugccuaagaauauaccaugggauaaaaauaug

SEQ ID NO: 95718 - RNA, 54 nt, Homo Sapiens
cccagacccaagagcugugagcugccuaagaaaucauggcauucacacagccca

SEQ ID NO: 95719 - RNA, 58 nt, Homo Sapiens
gccgaagaguugaugucaaucuuuuuuuccuaagaaaaaaaguccgcgaguauuaaau

SEQ ID NO: 95720 - RNA, 58 nt, Homo Sapiens
gguuguaaaagagaacccuuguucccuuccuaagaaacugccuuccacaauuaaagaa

SEQ ID NO: 95721 - RNA, 58 nt, Homo Sapiens
cuacaaaggguuuuagugccuuagaaguccuaagaagcccaaucuguaucaaagcaga

SEQ ID NO: 95722 - RNA, 58 nt, Homo Sapiens
agucaagggaaggacaaucccaggaaguccuaagaaguggggcagauggcagggcuga

SEQ ID NO: 95723 - RNA, 58 nt, Homo Sapiens
uugcuacuaaaaguagggcauaugaccgccuaagaaacagaacuucgagaaguccuaa

SEQ ID NO: 95724 - RNA, 58 nt, Homo Sapiens
ucaccccaggaauuagucacuaagaauuccuaagaacuuucuaucaaaagcauuggau

SEQ ID NO: 95725 - RNA, 58 nt, Homo Sapiens
augauaaaaggaaguagaugugaaaaagccuaagaaaaaggaaauuggacaguuuuga

SEQ ID NO: 95726 - RNA, 58 nt, Homo Sapiens
gugguuaagugaacgagaacucugccuaccuaagaaguucauuguguucuaaguggaa

SEQ ID NO: 95727 - RNA, 58 nt, Homo Sapiens
auaaaagagcaaagagcuuugggaaauaccuaagaagcaccuuaagauuaggguggca

SEQ ID NO: 95728 - RNA, 58 nt, Homo Sapiens
accugcccaaggauuuauucauagcuuaccuaagaauuucaaauuucuaccauaacac

SEQ ID NO: 95729 - RNA, 58 nt, Homo Sapiens
gguagauuaaauauagauuagaaaaauuccuaagaaucagaguagaaauaaaagugaa

SEQ ID NO: 95730 - RNA, 58 nt, Homo Sapiens
uauguauaaaaauuaaacugggcaauagccuaagaaggggggaauauuguaacacaaa

SEQ ID NO: 95731 - RNA, 58 nt, Homo Sapiens
aauaggauuuacuuuuuucuaauucugaccuaagaaaaauaaugagaacaagcuguug

SEQ ID NO: 95732 - RNA, 58 nt, Homo Sapiens
gcaaagccauuuuucagacagagccauuccuaagaacacugaagggcuggaaugcugg

SEQ ID NO: 95733 - RNA, 58 nt, Homo Sapiens
auaucuaaaauauuauuuuauuauauugccuaagaauaaacauuuguuaaauuggagc

SEQ ID NO: 95734 - RNA, 58 nt, Homo Sapiens
ccugcacuucuuguuccaugcuugggguccuaagaacaagccaucugaugccucuacu

SEQ ID NO: 95735 - RNA, 58 nt, Homo Sapiens
guucucugaaaauuauuuggcagaaaccccuaagaaaguuucuaagauaagccuuaaa

SEQ ID NO: 95736 - RNA, 58 nt, Homo Sapiens
aaagccacuuucuuccaaucccuuaccuccuaagaagacgauugccaaagagcaucua

SEQ ID NO: 95737 - RNA, 58 nt, Homo Sapiens
uuucuaaaaauuuuguaaagguuaaaugccuaagaaguuugcacucuuuguauuuguu

SEQ ID NO: 95738 - RNA, 58 nt, Homo Sapiens
guuucacuuaaucauucaaaacacuuaaccuaagaagaugauuuuagcguggacuagg

SEQ ID NO: 95739 - RNA, 58 nt, Homo Sapiens
cuaagcucuugagggacagccuggucucccuaagaaaaagucaggaucugaugucuuu

SEQ ID NO: 95740 - RNA, 58 nt, Homo Sapiens
gugggcagcauuagcagaugucugauuuccuaagaaagaaggcagugcagucacuaac

SEQ ID NO: 95741 - RNA, 58 nt, Homo Sapiens
uaauacauuugcuagugacaauuguugaccuaagaauauucauuucaaucuuuucaua

SEQ ID NO: 95742 - RNA, 58 nt, Homo Sapiens
uaauuacuguuucuguugccauuuguucccuaagaaaggucaauucuuaaaauuuuuu

SEQ ID NO: 95743 - RNA, 58 nt, Homo Sapiens
uggauguccucaaaagagaacucccuccccuaagaagaccagguccaccuaacacccc

SEQ ID NO: 95744 - RNA, 58 nt, Homo Sapiens
caccucucuggguugaagggcagcaccuccuaagaagguuccugcaguagaauggggg

SEQ ID NO: 95745 - RNA, 58 nt, Homo Sapiens
gcagcuccaccaaaugaagucguccacaccuaagaacacugaucugagagcugggcgg

SEQ ID NO: 95746 - RNA, 58 nt, Homo Sapiens
uugcacuauucugagggaaaaucugacaccuaagaaauuuacugugaaaaagcauuuu

SEQ ID NO: 95747 - RNA, 58 nt, Homo Sapiens
agacuaccuuagcaugaagaugcucaugccuaagaaugaaaauuguugagguuaucuc

SEQ ID NO: 95748 - RNA, 58 nt, Homo Sapiens
agccaauguguuaaccugucucugucaaccuaagaauguuggccuuacugacacaccu

SEQ ID NO: 95749 - RNA, 58 nt, Homo Sapiens
ggugaugugagccuacaucaggguggguccuaagaaacauggcaaaccaggcugucuc

SEQ ID NO: 95750 - RNA, 58 nt, Homo Sapiens
uguuaccagcauccuccauaucaaagacccuaagaaucagguggggaaggaggugauc

SEQ ID NO: 95751 - RNA, 58 nt, Homo Sapiens
aauuauacuuuauauaaggcauuccacaccuaagaacuaguuuugggaaauguagccc

SEQ ID NO: 95752 - RNA, 58 nt, Homo Sapiens
caauguccuucgaaaccucaacacgaggccuaagaauuuccuaagccaugucuuguac

SEQ ID NO: 95753 - RNA, 58 nt, Homo Sapiens
ccaaggauguuuugcaggaugcccugauccuaagaagggggccugggggugcgugcag

SEQ ID NO: 95754 - RNA, 58 nt, Homo Sapiens
uucaaggaacagccacaaaauacacaccccuaagaaaaggcaagacuugaacguucug

SEQ ID NO: 95755 - RNA, 58 nt, Homo Sapiens
uuuucuuaaucauuucaguguucgaccaccuaagaaaaguuggaaaaagaucuucaac

SEQ ID NO: 95756 - RNA, 58 nt, Homo Sapiens
agaaguaaagauaauccaagagcauugcccuaagaauccagaccucuccacagcucaa

SEQ ID NO: 95757 - RNA, 58 nt, Homo Sapiens
uuuugcacugacagugggagggcuuggcccuaagaaugcagugugcaggggacucagg

SEQ ID NO: 95758 - RNA, 58 nt, Homo Sapiens
ccacucccucccaccccacuuucccuugccuaagaaggaaacagccucucucaccaag

SEQ ID NO: 95759 - RNA, 58 nt, Homo Sapiens
uccugagaaaugaacccuccaaaacucuccuaagaaucuacuggaucaaugaaugaau

SEQ ID NO: 95760 - RNA, 58 nt, Homo Sapiens
uacguuugggucugucuuccucagauguccuaagaauauguggcuucucaauaaauau

SEQ ID NO: 95761 - RNA, 58 nt, Homo Sapiens
gugccucggguuuuucaauagggugucuccuaagaacugucugcuucugaaucacugg

SEQ ID NO: 95762 - RNA, 58 nt, Homo Sapiens
ucagaauuaaaauaacaggguuuaaaucccuaagaauggaaacuccagguccauucug

SEQ ID NO: 95763 - RNA, 58 nt, Homo Sapiens
gacacaaaucucauauuuuaugaguaacccuaagaauuguggaaccaaaccaccuuag

SEQ ID NO: 95764 - RNA, 58 nt, Homo Sapiens
aaugggaaaagaaucucuggguggcuguccuaagaaauguacagguugaaauaguucu

SEQ ID NO: 95765 - RNA, 58 nt, Homo Sapiens
auaaauauauaaaaaagccauuguccuuccuaagaagguuuaauuuaaaaaauuuaau

SEQ ID NO: 95766 - RNA, 58 nt, Homo Sapiens
ugaccuagggguguguguguaacugagaccuaagaaauuuaaaagugaauuuaaccac

SEQ ID NO: 95767 - RNA, 58 nt, Homo Sapiens
agaaacucugcagggcacuccccuguuuccuaagaacgaaaaagugcaauaaaggcca

SEQ ID NO: 95768 - RNA, 58 nt, Homo Sapiens
gaauuacuuuguuguagugaggaaaaaaccuaagaaauuuccccuuuuuuuaaaaaau

SEQ ID NO: 95769 - RNA, 58 nt, Homo Sapiens
auuuggggaaacacaacguugaaaacuuccuaagaaaaggaaucuugcccuugaaucu

SEQ ID NO: 95770 - RNA, 58 nt, Homo Sapiens
aauauuuuguuucuuggaacccaaugauccuaagaaaauuauguacuuuuaccugaaa

SEQ ID NO: 95771 - RNA, 58 nt, Homo Sapiens
ugccaagacggcuauuagcaucagcuguccuaagaagcaguugucacauaaaggaguc

SEQ ID NO: 95772 - RNA, 58 nt, Homo Sapiens
agucuggguccauuauuuuggcagaacuccuaagaauuuaugggagccuauauaaaca

SEQ ID NO: 95773 - RNA, 58 nt, Homo Sapiens
uuuuaggcuacaauauuuguuuaaccucccuaagaacuuucaaggcaucuguccugaa

SEQ ID NO: 95774 - RNA, 58 nt, Homo Sapiens
cugagcugcuuuucaccaucucaagaagccuaagaaguuauauauuuaaucagguaga

SEQ ID NO: 95775 - RNA, 58 nt, Homo Sapiens
gauuauaaccuuauuaacuaugcauaggccuaagaaagguggcaaugaacugugcaug

SEQ ID NO: 95776 - RNA, 58 nt, Homo Sapiens
uaucuguaacauauuuugcaaaaugaagccuaagaaacuuguauaaaaugcuguguuu

SEQ ID NO: 95777 - RNA, 58 nt, Homo Sapiens
ugagaaucaaacaaaacagauaaacuuaccuaagaagaaagaugaacaaagguuaauu

SEQ ID NO: 95778 - RNA, 58 nt, Homo Sapiens
cucucuuacugaguaaaccauuuucaagccuaagaaguggugaaagugugcuauggcc

SEQ ID NO: 95779 - RNA, 58 nt, Homo Sapiens
uuagauauuuuaguuuuccacuucucucccuaagaacaauauccuuuagcuauagguu

SEQ ID NO: 95780 - RNA, 58 nt, Homo Sapiens
gauguaaauggaauuauaaauacugugaccuaagaaaagacccacuagaaaguaauug

SEQ ID NO: 95781 - RNA, 58 nt, Homo Sapiens
ggccugcuucuagugaguuauuaccuuuccuaagaagccagguaucgcacuucagcag

SEQ ID NO: 95782 - RNA, 58 nt, Homo Sapiens
uggaaguguucccugagaaacccaccagccuaagaagcucuggccccaggcuugucac

SEQ ID NO: 95783 - RNA, 58 nt, Homo Sapiens
uguacuuucaaugaaauugugaucauuuccuaagaaaagguaaaauucacuaucauau

SEQ ID NO: 95784 - RNA, 58 nt, Homo Sapiens
agaaccauggggauuuuuuuuuaaugugccuaagaaauuuucucugaggcuuuagcaa

SEQ ID NO: 95785 - RNA, 58 nt, Homo Sapiens
cuuugccauaaccacauuuauuuauuacccuaagaaugguccaaaguuuauuuauuua

SEQ ID NO: 95786 - RNA, 58 nt, Homo Sapiens
augcuucaaaggucaaacauuccgagcuccuaagaaauauagugcaaggagcuccauu

SEQ ID NO: 95787 - RNA, 58 nt, Homo Sapiens
gacuuguuauuggguuuuggcugcucauccuaagaaggaacaccagagauccaccuaa

SEQ ID NO: 95788 - RNA, 58 nt, Homo Sapiens
auacauuuuauaagcuauauuuuaaaggccuaagaacauggcaaguauuuacuuuuau

SEQ ID NO: 95789 - RNA, 58 nt, Homo Sapiens
aauaucuuccgccuggugcugggcauauccuaagaacuuacaacuuuccuguauuauc

SEQ ID NO: 95790 - RNA, 58 nt, Homo Sapiens
guugcccuuccccucccucgggaagccaccuaagaauguuuacaugccaaacagaaug

SEQ ID NO: 95791 - RNA, 58 nt, Homo Sapiens
cuccacuugcagggacuccuuuuauuucccuaagaaagagcugaaaugacugagaacu

SEQ ID NO: 95792 - RNA, 58 nt, Homo Sapiens
auaagggcuuuuucuccccgcaaacaccccuaagaaugguucuguguaugugaaugag

SEQ ID NO: 95793 - RNA, 58 nt, Homo Sapiens
ggaagaagauauuuuaagaaccaguuauccuaagaauucugagcacgccucuucugag

SEQ ID NO: 95794 - RNA, 58 nt, Homo Sapiens
cuaaaacuguaaaaauccuggaauauaaccuaagaaauaccaauguggacauagggcc

SEQ ID NO: 95795 - RNA, 58 nt, Homo Sapiens
acucaugggaaugcauuuggucccucagccuaagaaacgauugagcauggcucucuau

SEQ ID NO: 95796 - RNA, 58 nt, Homo Sapiens
ucaguguagagaaaauaagaucugcuguccuaagaacuuuuggacugaguuuggguuc

SEQ ID NO: 95797 - RNA, 58 nt, Homo Sapiens
ccugaagcuuggggugggugccugggacccuaagaaccuccuucucuugaccggaaac

SEQ ID NO: 95798 - RNA, 58 nt, Homo Sapiens
uuaagauaauuuuagguuaaauugugauccuaagaauauucaaauugcccaaggaaau

SEQ ID NO: 95799 - RNA, 58 nt, Homo Sapiens
aaauggaaguaugugccacuaccuuuggccuaagaagauaaaauauaaugaagcugaa

SEQ ID NO: 95800 - RNA, 58 nt, Homo Sapiens
guuaauaaaaaacugagugugaacuguaccuaagaauaugaauauaaucaacacuauu

SEQ ID NO: 95801 - RNA, 58 nt, Homo Sapiens
uguuauuuuguuggguuuugagguuuucccuaagaagaggugcccgcuggccacagcc

SEQ ID NO: 95802 - RNA, 58 nt, Homo Sapiens
cagcugaaugguuuaaucugacuggcuuccuaagaaauguuuaagacucagcuuuaaa

SEQ ID NO: 95803 - RNA, 58 nt, Homo Sapiens
auuauuauuauucacaacagacacuuucccuaagaaucucaaacugauuuuuaaaaau

SEQ ID NO: 95804 - RNA, 58 nt, Homo Sapiens
auguguacuuucuaacaggggauugguaccuaagaaaugugguagcauuauucagaaa

SEQ ID NO: 95805 - RNA, 58 nt, Homo Sapiens
auuuuuuuacaguuguguuucauuggugccuaagaaagcuccaacaagacaugcauac

SEQ ID NO: 95806 - RNA, 58 nt, Homo Sapiens
accacccuaccacuaacaaaaaaaaauuccuaagaaauuuguuuaaauuuaaugaaac

SEQ ID NO: 95807 - RNA, 58 nt, Homo Sapiens
gaaucucagcauuguguuaaauuauucaccuaagaauacuuacuaaaaauaguugaaa

SEQ ID NO: 95808 - RNA, 58 nt, Homo Sapiens
aauuuaaagcuccccagagcagccaggcccuaagaaaaagggaauucagauucugacc

SEQ ID NO: 95809 - RNA, 58 nt, Homo Sapiens
uuuacccagggccugucuucggugcuguccuaagaauuaggcaggccucucaacucca

SEQ ID NO: 95810 - RNA, 58 nt, Homo Sapiens
uuaugguuuagguaacaguuagauguuuccuaagaaugcaaacugccuuuuccacaca

SEQ ID NO: 95811 - RNA, 58 nt, Homo Sapiens
aaaucaaaacccagugaaucucauuacuccuaagaaacgaaagauuccuucaaagccu

SEQ ID NO: 95812 - RNA, 58 nt, Homo Sapiens
uagaacucauccuguuucaagggaaguaccuaagaagauauagaguguuucuagggua

SEQ ID NO: 95813 - RNA, 58 nt, Homo Sapiens
aguccauugcaauacguguuucuaacuuccuaagaaauugucacacagcccucuguag

SEQ ID NO: 95814 - RNA, 58 nt, Homo Sapiens
auaucuauuaagcacuuguugacauuaaccuaagaaacuuuuucuaagggucaguugg

SEQ ID NO: 95815 - RNA, 58 nt, Homo Sapiens
aauuuaauucuaaauauuuuuaugccuuccuaagaacuauuuagcaauuugaagacac

SEQ ID NO: 95816 - RNA, 58 nt, Homo Sapiens
aauguaaaaguaaagaugcauuaggcaaccuaagaacauuuauuuguauuuaaauguu

SEQ ID NO: 95817 - RNA, 58 nt, Homo Sapiens
auuugucaaagaggccuuugaagagaccccuaagaaacacagagaguguuuaguuaag

SEQ ID NO: 95818 - RNA, 58 nt, Homo Sapiens
aauagacuuaaaucucauugcuuacaagccuaagaaucuuuagagaaguauacauaag

SEQ ID NO: 95819 - RNA, 58 nt, Homo Sapiens
acugugaagacuaauuuauaaaugugaaccuaagaaaacuccaccucugaaggaaauc

SEQ ID NO: 95820 - RNA, 58 nt, Homo Sapiens
auugucgcaugaaguguuugguguuugaccuaagaauguuucaaaauaguucguucuu

SEQ ID NO: 95821 - RNA, 58 nt, Homo Sapiens
augugagauuuuuuauugcucuuagcauccuaagaaauagauggggauaaaaugacua

SEQ ID NO: 95822 - RNA, 58 nt, Homo Sapiens
cuagcaggagaauacagucugcuuuugaccuaagaaccacgggagggacccgagccug

SEQ ID NO: 95823 - RNA, 54 nt, Homo Sapiens
acaaauuuaguuuggguguuccaaccuaagaagcugcaucgggauucagaauga

SEQ ID NO: 95824 - RNA, 58 nt, Homo Sapiens
cauggcagagaugugagggccacguuucccuaagaaauucugcuuauuuuacaauaua

SEQ ID NO: 95825 - RNA, 58 nt, Homo Sapiens
uuuauuuacgucuuaagagcuuuuccccccuaagaacaggggaggacuggauaauugg

SEQ ID NO: 95826 - RNA, 58 nt, Homo Sapiens
gaaccugcuuccucucccuuaggugcagccuaagaaggucuacaggcaggguaggcac

SEQ ID NO: 95827 - RNA, 58 nt, Homo Sapiens
guggucugguguuccagcuggcuagaagccuaagaacucaagugcuccugaaagaaac

SEQ ID NO: 95828 - RNA, 58 nt, Homo Sapiens
agggugguuuauaaagccuguaaacacaccuaagaaaauaaacauuuuacaaaugagc

SEQ ID NO: 95829 - RNA, 58 nt, Homo Sapiens
uaguaaacuuuaaaaaauagauuuuuucccuaagaaagaauguuuguagaauuuaaag

SEQ ID NO: 95830 - RNA, 58 nt, Homo Sapiens
ccugaucauaguauucugucagauaaugccuaagaaugaccgcugaagaacguugacc

SEQ ID NO: 95831 - RNA, 58 nt, Homo Sapiens
acucuaaaagauccuuuuuaaauucaguccuaagaaagaggagugcuuguccccuaag

SEQ ID NO: 95832 - RNA, 58 nt, Homo Sapiens
uuuuagauauucuuuuagcaguguagagccuaagaaacuugguucuacuaccaugauc

SEQ ID NO: 95833 - RNA, 58 nt, Homo Sapiens
auguuacaauuguguuucuuaaauugagccuaagaauggaguuaauuggaaauauaca

SEQ ID NO: 95834 - RNA, 58 nt, Homo Sapiens
agccccucucugugugcagccggaggguccuaagaauggcucccggagcuaacugagg

SEQ ID NO: 95835 - RNA, 58 nt, Homo Sapiens
uauuucccaguauaaugauacaucguagccuaagaaauauuuucucaauguaauuccc

SEQ ID NO: 95836 - RNA, 58 nt, Homo Sapiens
ggagaaggguuggucuucugccagggucccuaagaacagguuugcagcuacccucucu

SEQ ID NO: 95837 - RNA, 58 nt, Homo Sapiens
uaauuacaauguaaauagcuuuuuauuuccuaagaaauaauuuaauguuuaguaaaaa

SEQ ID NO: 95838 - RNA, 58 nt, Homo Sapiens
ucugcuccaguaugauaauuuuuaauugccuaagaaucauuggaucagaccuaaauga

SEQ ID NO: 95839 - RNA, 58 nt, Homo Sapiens
acggccugucuccuccugcagggcccacccuaagaauguauuuuuaaacacaugaaau

SEQ ID NO: 95840 - RNA, 58 nt, Homo Sapiens
uguguuaaagcugcucucaccagugaaaccuaagaaaugagcagguuggcagcuaggg

SEQ ID NO: 95841 - RNA, 58 nt, Homo Sapiens
acaggcccuggugcuaucugaccuucggccuaagaaaccccaccuuccuggaggcagg

SEQ ID NO: 95842 - RNA, 58 nt, Homo Sapiens
ucaucuuggccacuuuaauauuccagagccuaagaaaaaguggaugcauuccugaguc

SEQ ID NO: 95843 - RNA, 58 nt, Homo Sapiens
auacaucauuucacuuaaaguugcaguuccuaagaaccuauugaugauguucagugca

SEQ ID NO: 95844 - RNA, 58 nt, Homo Sapiens
gggagaggccaggcgcagcucacugcggccuaagaaggugaagcaacaugggaacaca

SEQ ID NO: 95845 - RNA, 58 nt, Homo Sapiens
ucucgagggcagcacugacaaauguguuccuaagaagacauucagacccagguguuau

SEQ ID NO: 95846 - RNA, 58 nt, Homo Sapiens
ucuugcugaaauuaugauaguuaagauuccuaagaacuugacaaugcuccccuggcuu

SEQ ID NO: 95847 - RNA, 58 nt, Homo Sapiens
aagaaggagaccacauaccccaaagugaccuaagaacacuuuaaaaagcaacauguaa

SEQ ID NO: 95848 - RNA, 58 nt, Homo Sapiens
ggaugcaaaguaccuaaagaucucugauccuaagaaguuacuucuggccaggcgcggu

SEQ ID NO: 95849 - RNA, 58 nt, Homo Sapiens
guccacccuaauuaauguccugccuuuuccuaagaagaagaacgaugccauaucuggc

SEQ ID NO: 95850 - RNA, 58 nt, Homo Sapiens
acauuguuaccucuauauacuuaacauaccuaagaaguauuauaaccuuaauuuauua

SEQ ID NO: 95851 - RNA, 58 nt, Homo Sapiens
uuauucccaaaauaagccagaauuuccuccuaagaaccagugacuuugacugcugggg

SEQ ID NO: 95852 - RNA, 58 nt, Homo Sapiens
cuaauuugugcuuaggaaucucucagccccuaagaaacugagaccaaguuuuuucuaa

SEQ ID NO: 95853 - RNA, 58 nt, Homo Sapiens
uccacucuggacagcgccaggcagggguccuaagaaacgauuuggacuuggcuggcuu

SEQ ID NO: 95854 - RNA, 58 nt, Homo Sapiens
uuaaaaaacuugaaaugcucccaucccuccuaagaaucuguauuaugcuuugaaaacu

SEQ ID NO: 95855 - RNA, 58 nt, Homo Sapiens
uaggauugcauuuaauaauacuucuauaccuaagaauaguagaaagguauaucaucaa

SEQ ID NO: 95856 - RNA, 58 nt, Homo Sapiens
cuccuaccggcuccagccuuucaauaaaccuaagaaccgcccuuuucucagagaucac

SEQ ID NO: 95857 - RNA, 58 nt, Homo Sapiens
aaguccugaaugcaugucguccucagguccuaagaaaucuguaugcaugggcauuacc

SEQ ID NO: 95858 - RNA, 58 nt, Homo Sapiens
ugggaaugcugcugcuucaaccccagagccuaagaauggcagccguuucuuaacaugu

SEQ ID NO: 95859 - RNA, 52 nt, Homo Sapiens
auuccaauaaaaguguuugauuccuaagaaagaaaauauuuuuguggacaug

SEQ ID NO: 95860 - RNA, 58 nt, Homo Sapiens
aauuagguuuggagggaacuuugaucuuccuaagaauuaaaguugccaaauuauucug

SEQ ID NO: 95861 - RNA, 58 nt, Homo Sapiens
acaggagucaggaaaaugaggcacuaagccuaagaaguucccugguuuuucccagggg

SEQ ID NO: 95862 - RNA, 58 nt, Homo Sapiens
cagcuaaauuugcaauuccaacuuucauccuaagaauaauaacuguaauggcaaagcg

SEQ ID NO: 95863 - RNA, 58 nt, Homo Sapiens
gugcuguucuucuggauaacuguucacgccuaagaaauuaaaagacagaacaaaacug

SEQ ID NO: 95864 - RNA, 58 nt, Homo Sapiens
agaaaccugaaaaccgaauuguaggaguccuaagaauguuaucuaccuugugccugua

SEQ ID NO: 95865 - RNA, 58 nt, Homo Sapiens
gagguuaaggaacuguguuaccuuuuguccuaagaaaaaggcuugaauuuauguaaau

SEQ ID NO: 95866 - RNA, 58 nt, Homo Sapiens
accuagauauaccauuaucccuuuuauaccuaagaagggcaugcuaauaauuaccacu

SEQ ID NO: 95867 - RNA, 58 nt, Homo Sapiens
aaagugaagaccaaguccagaacugaauccuaagaaaugcaggacugcaaagaaauug

SEQ ID NO: 95868 - RNA, 58 nt, Homo Sapiens
ccccaccucgggccucacgacggugcuaccuaagaaagucuucccucccaccccccgc

SEQ ID NO: 95869 - RNA, 58 nt, Homo Sapiens
cuucccuuuuaaagguuaaaguuucuaaccuaagaauuaaguacgcguucaggaagcu

SEQ ID NO: 95870 - RNA, 58 nt, Homo Sapiens
cgcugauaaccaggacaaaaggaacuuuccuaagaaacgaaacuuggagcuuugacaa

SEQ ID NO: 95871 - RNA, 58 nt, Homo Sapiens
gcauucagacuugaauuuuagauuggggccuaagaaggaaguggcuuuuggauauccu

SEQ ID NO: 95872 - RNA, 58 nt, Homo Sapiens
uacuccucugaugcauuuagccaaaaugccuaagaaaaaccuacugcaaaaagauugu

SEQ ID NO: 95873 - RNA, 58 nt, Homo Sapiens
ccuaaaguccugagaacuuuauaacaguccuaagaacucaguaauaaauagcucugaa

SEQ ID NO: 95874 - RNA, 58 nt, Homo Sapiens
gugaauuuccuuuaacaccgcucaugccccuaagaaaacacugcccuuacuuuaggcu

SEQ ID NO: 95875 - RNA, 58 nt, Homo Sapiens
gcagcaucuauuuccucuuuuaaauauuccuaagaaugagaugucguggcucagggug

SEQ ID NO: 95876 - RNA, 58 nt, Homo Sapiens
gcuucugugugcccuguuuuuucuguucccuaagaacuucacacugggcuccaugaua

SEQ ID NO: 95877 - RNA, 58 nt, Homo Sapiens
cuaugauuucacgugcaggucuucagccccuaagaaugaaaugcuuuguaauuauuga

SEQ ID NO: 95878 - RNA, 58 nt, Homo Sapiens
uaccuaccguguguauucucuuuuccaaccuaagaaacuuauuuccuucagggacaga

SEQ ID NO: 95879 - RNA, 58 nt, Homo Sapiens
gaaaucacaucuugcccacaugcuguaaccuaagaaacugcuaugcaaggcugggugc

SEQ ID NO: 95880 - RNA, 58 nt, Homo Sapiens
gugaaggucagcaguuuucuaacuugugccuaagaauuauugggaaaugaaaaugcau

SEQ ID NO: 95881 - RNA, 58 nt, Homo Sapiens
uugucucacccgcagugccaauaacacuccuaagaaauguugauggcuauuuuguggu

SEQ ID NO: 95882 - RNA, 58 nt, Homo Sapiens
ucuauacacauguguagugugucaagacccuaagaacauguauuugaaggaaggucua

SEQ ID NO: 95883 - RNA, 58 nt, Homo Sapiens
guuugugugugcauguguguuuauuguuccuaagaauuuggcacaagucagagauaau

SEQ ID NO: 95884 - RNA, 58 nt, Homo Sapiens
aagcaguaaauccauaauuucauaucuaccuaagaaggaccuagaaauuuuucauucc

SEQ ID NO: 95885 - RNA, 58 nt, Homo Sapiens
gcacucccacuaacuagcuaagcaucagccuaagaaugcagaagcaggauaguauaaa

SEQ ID NO: 95886 - RNA, 58 nt, Homo Sapiens
uauuuuagguuuccuguaaauuuccugaccuaagaauuuguaauuaaucgaagucaca

SEQ ID NO: 95887 - RNA, 58 nt, Homo Sapiens
ucucugaaauguucguuuuuacucagugccuaagaaaggcaaccuucacugguuuuga

SEQ ID NO: 95888 - RNA, 58 nt, Homo Sapiens
cuagaggguugcugccuuucaagcggugccuaagaaguuauuuucuuguuuaacauau

SEQ ID NO: 95889 - RNA, 58 nt, Homo Sapiens
aagcugauauuuuaggugcucuaaagcaccuaagaaaagaacugcaaagucugagaaa

SEQ ID NO: 95890 - RNA, 58 nt, Homo Sapiens
ugucuggauuaucuuccuuuucucauggccuaagaaauaaggaucaauaaggaaugau

SEQ ID NO: 95891 - RNA, 58 nt, Homo Sapiens
ucuucaacuugaggacgagggugauuuuccuaagaaaucagcaaagagggaaggcagg

SEQ ID NO: 95892 - RNA, 58 nt, Homo Sapiens
cuuguagaaggcaguuuccuugccacuuccuaagaauucuugccuuugggugucugcu

SEQ ID NO: 95893 - RNA, 58 nt, Homo Sapiens
uucuaauaaauuauacaaauauauaguuccuaagaagcuauguagauauuuggcuuaa

SEQ ID NO: 95894 - RNA, 58 nt, Homo Sapiens
gaagaaaaauucuuauucaaguaaguaaccuaagaaacuuauuaaagggcgacucugu

SEQ ID NO: 95895 - RNA, 58 nt, Homo Sapiens
ucacugguuguaaaauuuacuuuuuuggccuaagaauuuugauuuguguggcuauuua

SEQ ID NO: 95896 - RNA, 58 nt, Homo Sapiens
aucaccaccacucagccaauagcccccuccuaagaaccagcuuggggacugacuccag

SEQ ID NO: 95897 - RNA, 58 nt, Homo Sapiens
uuucuuuaauggcgggggcguaccuuugccuaagaaauagcccagaaacuccuguugu

SEQ ID NO: 95898 - RNA, 58 nt, Homo Sapiens
ugaucaguccagaggccuuuggcugccuccuaagaaagucaugugccucuguccuaug

SEQ ID NO: 95899 - RNA, 58 nt, Homo Sapiens
uagacaauaaaacugccuaccuguaaaaccuaagaaucaacugaagaccuguuaagag

SEQ ID NO: 95900 - RNA, 58 nt, Homo Sapiens
ggcgacccuggguucuuuuggaaaaugcccuaagaaauguuugaaguaacgcugucac

SEQ ID NO: 95901 - RNA, 58 nt, Homo Sapiens
acauuguauagccccacagacuauuacuccuaagaauuugaccuggaaaugaaugaaa

SEQ ID NO: 95902 - RNA, 58 nt, Homo Sapiens
uuaggggcaagguucauucucagauacaccuaagaagcauggagcuuguggcuggccu

SEQ ID NO: 95903 - RNA, 58 nt, Homo Sapiens
ccaauugcaccuucuguuucgucaccaaccuaagaaucuguggauccagugcuauucu

SEQ ID NO: 95904 - RNA, 58 nt, Homo Sapiens
uucuuuaauaaacucauuuuguugccuuccuaagaaccuuuuuuuaaggacaaaaguu

SEQ ID NO: 95905 - RNA, 58 nt, Homo Sapiens
gccacugcaccuggccuaggacugguguccuaagaagaggaagagacacuuaggugga

SEQ ID NO: 95906 - RNA, 58 nt, Homo Sapiens
uuaacugugcugaaaaacuaauaaagaaccuaagaagaauuccaguguggugaugcca

SEQ ID NO: 95907 - RNA, 58 nt, Homo Sapiens
uagucuccauuuauuccuaguacucuguccuaagaaucuuuuuaaaacuauaucauga

SEQ ID NO: 95908 - RNA, 58 nt, Homo Sapiens
ccugcugcacuuccuguucauguacgacccuaagaaaaggugcugaucucugcacggg

SEQ ID NO: 95909 - RNA, 58 nt, Homo Sapiens
acugcugccauuguaguuugcaugcugcccuaagaaucgcaaaauacuggauuuugca

SEQ ID NO: 95910 - RNA, 58 nt, Homo Sapiens
auuagcaccggggcggaauugugccuccccuaagaauaacaauaaaugauguuuuuau

SEQ ID NO: 95911 - RNA, 58 nt, Homo Sapiens
aaccugggcuggcauuggucacaccaggccuaagaaggcagaaguugaaucaauugaa

SEQ ID NO: 95912 - RNA, 58 nt, Homo Sapiens
ucugccacuugucaaagaaggugcugauccuaagaauuuuucauucucagaauucggu

SEQ ID NO: 95913 - RNA, 58 nt, Homo Sapiens
uccccuguaaccucacuucuuauugauuccuaagaagauagaccaacuuuuuaugucg

SEQ ID NO: 95914 - RNA, 58 nt, Homo Sapiens
uucaguuaucacuuuugggugucuguauccuaagaaguuucugaaaagaucuaaagcc

SEQ ID NO: 95915 - RNA, 58 nt, Homo Sapiens
aaggcuucugugugacaggaaacccaagccuaagaaacaauuaagugguucucaucuc

SEQ ID NO: 95916 - RNA, 58 nt, Homo Sapiens
uggggagggggggcaggggaaauguugcccuaagaaugcuucucauuccucuguucuu

SEQ ID NO: 95917 - RNA, 58 nt, Homo Sapiens
uacuaguggacguaggauauuuucccuaccuaagaauuucacugucuuuuaaaaaaca

SEQ ID NO: 95918 - RNA, 58 nt, Homo Sapiens
cuuccaaaaugcccaggcaggcuccaacccuaagaaggucgaccucaucaucugggag

SEQ ID NO: 95919 - RNA, 58 nt, Homo Sapiens
uuagaaguauugaaggaaaaaaugaagaccuaagaaaaaaauauuucaugaucauuuc

SEQ ID NO: 95920 - RNA, 58 nt, Homo Sapiens
cuaagaacacuacuagaagcuuucagauccuaagaauugcgugugacucauucugaca

SEQ ID NO: 95921 - RNA, 58 nt, Homo Sapiens
uacuuaaggauuuaguuagugaauuuauccuaagaaaaccuacgaauucuaucuuugg

SEQ ID NO: 95922 - RNA, 58 nt, Homo Sapiens
uacaccaugcuuugcuauuuuucuucugccuaagaaguuugcuacuccuaagggaagu

SEQ ID NO: 95923 - RNA, 58 nt, Homo Sapiens
ccaaggucuuugggagcguccacuugguccuaagaaucggaggcucugagacuggccc

SEQ ID NO: 95924 - RNA, 58 nt, Homo Sapiens
acuugaauguuaucaguacugacuggugccuaagaaugaagugacuucauauacguaa

SEQ ID NO: 95925 - RNA, 58 nt, Homo Sapiens
caaaagcuggauagaauuuucuaaguaaccuaagaauuuccaugggacuuuuuaucau

SEQ ID NO: 95926 - RNA, 58 nt, Homo Sapiens
ugaugggccacaaggaaagaaguugguuccuaagaauguugauuuagaagauagaaau

SEQ ID NO: 95927 - RNA, 58 nt, Homo Sapiens
uacaguugagcucagguuagaaagugauccuaagaaugccuuucccaccucucucccc

SEQ ID NO: 95928 - RNA, 58 nt, Homo Sapiens
uaacaugucauauuuuugaagauacuuuccuaagaauuguaugauacuuuguaaaguu

SEQ ID NO: 95929 - RNA, 58 nt, Homo Sapiens
guucucauuggaggcugaggauuugcuuccuaagaauaaagccccuucuccaccagau

SEQ ID NO: 95930 - RNA, 58 nt, Homo Sapiens
uguggagguucuuuugaccaauuuuauuccuaagaauaaacaaaccccuacaguuaaa

SEQ ID NO: 95931 - RNA, 58 nt, Homo Sapiens
uucacugcaggcagugcuauuucuugugccuaagaauguuuccaaaagucgcaucgcu

SEQ ID NO: 95932 - RNA, 58 nt, Homo Sapiens
caauccaguuuuagaauauuuccaugacccuaagaaguuuccucaugucuauuaauau

SEQ ID NO: 95933 - RNA, 58 nt, Homo Sapiens
gugcugucauuauuuccucuagggucuuccuaagaagauauugacacucucuaccaag

SEQ ID NO: 95934 - RNA, 58 nt, Homo Sapiens
auuguuuaaauuguuuaaaucuuacugaccuaagaaacaucagauuuuuuuugugagu

SEQ ID NO: 95935 - RNA, 58 nt, Homo Sapiens
accuggaugucacuggccaccucagcuaccuaagaaaaaggugagauaagcccugagu

SEQ ID NO: 95936 - RNA, 58 nt, Homo Sapiens
acaugaaaguugcacagaggagaggcgcccuaagaauguaagcauugugggaaagcau

SEQ ID NO: 95937 - RNA, 58 nt, Homo Sapiens
gggaagucauaacccacagauagaucaaccuaagaauccuggcccuucuccacucucc

SEQ ID NO: 95938 - RNA, 58 nt, Homo Sapiens
ucuuacaaguaugaauaaugugccaaagccuaagaaaacccucaauucuuaauagaua

SEQ ID NO: 95939 - RNA, 58 nt, Homo Sapiens
uuccccuuuccaauuccaaaauuccaucccuaagaauucccagauagucccagcagcc

SEQ ID NO: 95940 - RNA, 58 nt, Homo Sapiens
gcugcaugaucgugaccuugaacaaguaccuaagaaauaguggcuucccuggaauugu

SEQ ID NO: 95941 - RNA, 58 nt, Homo Sapiens
auggcagccuuccuuauuugauuaugcaccuaagaauaaaugguauuugggcauguau

SEQ ID NO: 95942 - RNA, 58 nt, Homo Sapiens
uccacaucauugucuuucuuuuugguccccuaagaauccaguuuccuucauggccugu

SEQ ID NO: 95943 - RNA, 58 nt, Homo Sapiens
aucguauuaaguuaacgauaaaauucuuccuaagaaaguacaauagaauacuguuacc

SEQ ID NO: 95944 - RNA, 58 nt, Homo Sapiens
aacacaacaaugaguuagguauagaaaaccuaagaauaaauaauuagaaaauguguug

SEQ ID NO: 95945 - RNA, 58 nt, Homo Sapiens
acucucccuuguucccaguggccucaggccuaagaagcacccugcuccucucuguccu

SEQ ID NO: 95946 - RNA, 58 nt, Homo Sapiens
acccuguggucuaagaagagaagcacacccuaagaaugauaucugacagcaguaacuc

SEQ ID NO: 95947 - RNA, 58 nt, Homo Sapiens
guggacaaaguacuugguuugcuaagaaccuaagaacguguaugcuuugcugaauuag

SEQ ID NO: 95948 - RNA, 58 nt, Homo Sapiens
uucaacaauaugccccaucuuuauauauccuaagaaacacuaauccuagguuauugcu

SEQ ID NO: 95949 - RNA, 58 nt, Homo Sapiens
caggccucugacaugucccugaggggccccuaagaaagaaaguggaggggacacucca

SEQ ID NO: 95950 - RNA, 58 nt, Homo Sapiens
ugaucagaaauuuuggaaggucucacguccuaagaaccugcccucuugagaggucauu

SEQ ID NO: 95951 - RNA, 58 nt, Homo Sapiens
agguuugggguagaaaugaaaauuuucuccuaagaacucucauaccucucuuccugcg

SEQ ID NO: 95952 - RNA, 58 nt, Homo Sapiens
aaaguaugcaugcagucuuguacugugaccuaagaacaaaacuguaacugcauuagaa

SEQ ID NO: 95953 - RNA, 58 nt, Homo Sapiens
augccaacaaagcuuacaacaccauuguccuaagaacacauccuuaaccuuuauuaaa

SEQ ID NO: 95954 - RNA, 58 nt, Homo Sapiens
gcccauccaguugggaagccaugauuuuccuaagaauccagggccaugggagauacaa

SEQ ID NO: 95955 - RNA, 58 nt, Homo Sapiens
gcaguccuacuacagucuggagugggguccuaagaagaagggucccaccucaaccccu

SEQ ID NO: 95956 - RNA, 58 nt, Homo Sapiens
aacgcagccacugaggaagagugguuuuccuaagaagacauugcuggaguugacuuuc

SEQ ID NO: 95957 - RNA, 58 nt, Homo Sapiens
auuaaguuugacuuggaaguuagaguuaccuaagaauuucuguuacuuaagauuuauu

SEQ ID NO: 95958 - RNA, 58 nt, Homo Sapiens
uauauuuucauuccugcaaagucuguucccuaagaaaauccgccugggauuuuguuuu

SEQ ID NO: 95959 - RNA, 58 nt, Homo Sapiens
ggaggcugccuuccuucccaccuuugguccuaagaaugggccgaucagaacccuagcg

SEQ ID NO: 95960 - RNA, 58 nt, Homo Sapiens
aucauuucagcuaagauuaaauuuaaagccuaagaauguauagagcuaguuuuaaaau

SEQ ID NO: 95961 - RNA, 58 nt, Homo Sapiens
gggguggagugggaagggagcauugcagccuaagaagaaggccagagagggaaaaggc

SEQ ID NO: 95962 - RNA, 58 nt, Homo Sapiens
agcugguuccugcuagaaaugggaaaugccuaagaagaugacuucccaacugcaaguc

SEQ ID NO: 95963 - RNA, 58 nt, Homo Sapiens
uauaccuaaagaccucuauauccuggugccuaagaaacuucugccucccacagacaac

SEQ ID NO: 95964 - RNA, 58 nt, Homo Sapiens
uaucgauugucagaauuguuuuugaaagccuaagaacccagcuuuuuagaaaggauuu

SEQ ID NO: 95965 - RNA, 58 nt, Homo Sapiens
aaaauugaaaugguguuaauuagaguugccuaagaauaguuucacuggaaagugucaa

SEQ ID NO: 95966 - RNA, 58 nt, Homo Sapiens
agaguugagauuuccuccucagcucuagccuaagaaggaagcuuugauccgacaucug

SEQ ID NO: 95967 - RNA, 58 nt, Homo Sapiens
gaauuccuuuuucuucuuuaaaguauagccuaagaagaagcauuguauaaacagccuu

SEQ ID NO: 95968 - RNA, 58 nt, Homo Sapiens
ggcuguaaacugagauuacaauuaaaaaccuaagaaauggcaaaauaaaauaaaggua

SEQ ID NO: 95969 - RNA, 58 nt, Homo Sapiens
gcaaaucgcuuugagauauauaggaaggccuaagaaugguuucucauauccaucguga

SEQ ID NO: 95970 - RNA, 64 nt, Homo Sapiens
aagucacagaugauguggaaggagcucaaacagacgacuucagcagacucaucucuggaggguc

SEQ ID NO: 95971 - RNA, 64 nt, Homo Sapiens
auguaaccgcaucccucaggcauggccaggaggccgacuucauccuccuucccacuaucaccuc

SEQ ID NO: 95972 - RNA, 64 nt, Homo Sapiens
cuccaaguggaacccgguccagacagggcugccucgacuucaccuuucccccuaacuuccucca

SEQ ID NO: 95973 - RNA, 64 nt, Homo Sapiens
ugguugacuucuugcuugugcuucccacucuccccgacuucauucacucaaacuucuuuaaaug

SEQ ID NO: 95974 - RNA, 64 nt, Homo Sapiens
cuugugauggcuacaauggcuccuagacacucaacgacuucaucuguggcagggagagaggagg

SEQ ID NO: 95975 - RNA, 64 nt, Homo Sapiens
auggugcuuucaaacagcgaacuacuguacaacccgacuucauaauauauaaaagguacuguua

SEQ ID NO: 95976 - RNA, 64 nt, Homo Sapiens
aauaugggaacacaguuaguaucccauuguaaagcgacuucaaaagcaagaucaugugcauauc

SEQ ID NO: 95977 - RNA, 64 nt, Homo Sapiens
caugguguucugugcuugcaaaguuuaaauaguccgacuucaccuguaugaaaugggcuuucug

SEQ ID NO: 95978 - RNA, 64 nt, Homo Sapiens
auacuuagugaauauccuuuccuggguggaaugacgacuucacuuuuaguuucaaaccuagcuc

SEQ ID NO: 95979 - RNA, 64 nt, Homo Sapiens
ugguuuuuuucuaguaaggauuuuaaauaacugccgacuucaaaaguguucuuaaaacgaaaga

SEQ ID NO: 95980 - RNA, 64 nt, Homo Sapiens
uggaccaguuugguauuagaaguaggaggcuggacgacuucacccccaaaggguccugaagccc

SEQ ID NO: 95981 - RNA, 64 nt, Homo Sapiens
agccuuuuuuuuaguuaauuuuugucaaaugaaacgacuucaggcaagucucuuuuauaauggu

SEQ ID NO: 95982 - RNA, 64 nt, Homo Sapiens
cuggcccucggcgcgggcuccuucccgcuucccccgacuucacacggcggcuucggaccaacuc

SEQ ID NO: 95983 - RNA, 64 nt, Homo Sapiens
ugcaaggucacuuacauagcguucuugcagguggcgacuucauccccucuguucucaccuguga

SEQ ID NO: 95984 - RNA, 64 nt, Homo Sapiens
augcccaauggcuccaccauaacaauccagaggacgacuucagggucccucaggggucuggaau

SEQ ID NO: 95985 - RNA, 64 nt, Homo Sapiens
cugauuucauauaguagaaaacaaacauuggguccgacuucaaaauguguuguauuguccuaca

SEQ ID NO: 95986 - RNA, 64 nt, Homo Sapiens
acgguaacauccaaaagcaaccacaaaccuaguacgacuucauuccuuccacuaacucauaguu

SEQ ID NO: 95987 - RNA, 64 nt, Homo Sapiens
auuguguuauguuuuacagcuuccuguuaaauagcgacuucaguagcuauuaugaacaaaauuu

SEQ ID NO: 95988 - RNA, 64 nt, Homo Sapiens
uaaaguucugugacugugaugcaugugaguguuccgacuucaucuguuccucuuaacuacggug

SEQ ID NO: 95989 - RNA, 64 nt, Homo Sapiens
agcucuuuugguacaccagaaggccagaauggaacgacuucaaagagaacuugagauucaaaag

SEQ ID NO: 95990 - RNA, 64 nt, Homo Sapiens
uggauaacaauauuuauaaguuccuucaucagaacgacuucaagcugaaaaaauagggaggaaa

SEQ ID NO: 95991 - RNA, 64 nt, Homo Sapiens
ccugcaggagccaggugagaauuucaaggauuaucgacuucauauugcacauuaaaguuacaaa

SEQ ID NO: 95992 - RNA, 52 nt, Homo Sapiens
gaauggguccuucccuucagaccgacuucaagucacagaggcugugggguga

SEQ ID NO: 95993 - RNA, 64 nt, Homo Sapiens
ucagguggcugugggauuuuaaugagaaugaaagcgacuucagguugaucggucuccuaggcua

SEQ ID NO: 95994 - RNA, 64 nt, Homo Sapiens
cucacugccucauguggcccacagcagagggggacgacuucacagguguggacgcaaaccugug

SEQ ID NO: 95995 - RNA, 64 nt, Homo Sapiens
gcuauggaucuggagucucuccugucccuagaggcgacuucauucuuaccacuuaauagaagaa

SEQ ID NO: 95996 - RNA, 64 nt, Homo Sapiens
uggacaaaugaccacuauguuagacccccaggcucgacuucaggggucaguguuccugucccaa

SEQ ID NO: 95997 - RNA, 64 nt, Homo Sapiens
ugauacuauaugauaugaacacacagucguuguccgacuucacucuacauuguaagauccaucu

SEQ ID NO: 95998 - RNA, 64 nt, Homo Sapiens
ccagaucugugucuugaagcagcugcccucauuccgacuucagaaaaucgaagcagcuggcucc

SEQ ID NO: 95999 - RNA, 64 nt, Homo Sapiens
ucugguuauuaugguguuaguuaucgaauaaaaacgacuucagaaugcagcuucccuacugagc

SEQ ID NO: 96000 - RNA, 64 nt, Homo Sapiens
acaagcauuuugugaacuagccuccggaagcugucgacuucaugauuucuugcgagccucgcag

SEQ ID NO: 96001 - RNA, 64 nt, Homo Sapiens
aaaccuauacuuaauauaguuagguauacacuuacgacuucacaaagaauagcaagaaacuaua

SEQ ID NO: 96002 - RNA, 64 nt, Homo Sapiens
acccaauguuacuaguuagcuuugaugaaaaaaccgacuucauauuucaagaaugcaggucucg

SEQ ID NO: 96003 - RNA, 64 nt, Homo Sapiens
acauaucaccucuacuuaaauccguccuguuuagcgacuucagucaacuacagcugaguccaua

SEQ ID NO: 96004 - RNA, 64 nt, Homo Sapiens
gcccccuacugagaaacuuccuuugagaauugugcgacuucacaaaaugcaaggugaacaccac

SEQ ID NO: 96005 - RNA, 64 nt, Homo Sapiens
ucaaauaucccaagacagauuaugcuaaauacaucgacuucaucuucuaacaugauauauucag

SEQ ID NO: 96006 - RNA, 64 nt, Homo Sapiens
gugggagcagcgguuuggggagcagagacacuaacgacuucagggcagggcucugauauuccau

SEQ ID NO: 96007 - RNA, 64 nt, Homo Sapiens
aagcuacagcuaagcccaucucucuccugcuuggcgacuucaguacacaucgccucugguuaaa

SEQ ID NO: 96008 - RNA, 64 nt, Homo Sapiens
uuccauacugagaucguucccugugcugacaaggcgacuucagaucuggggaccccagaggugu

SEQ ID NO: 96009 - RNA, 64 nt, Homo Sapiens
cucuucuccaaucagagcguggaggcgaguugggcgacuucaagggccuggcauggcagaggcc

SEQ ID NO: 96010 - RNA, 64 nt, Homo Sapiens
cauuuccucuaaacacaacagggcacagcaaauacgacuucauuuggcuucgaguuccccaggc

SEQ ID NO: 96011 - RNA, 64 nt, Homo Sapiens
gucuucuuccaaggucaguggacacccccaucuucgacuucagagccugcugccucggaacugu

SEQ ID NO: 96012 - RNA, 64 nt, Homo Sapiens
augagaaagaaagcauguguaugucuguuuauggcgacuucagguggggccugugcgugugccg

SEQ ID NO: 96013 - RNA, 64 nt, Homo Sapiens
aggaaaaugcaacaucucgcaagcgcugcuguaacgacuucaggagucacugauucagcacuaa

SEQ ID NO: 96014 - RNA, 64 nt, Homo Sapiens
gagucaucaucuggcucugggauauucuggccuccgacuucacaccggaugagagagcuauguu

SEQ ID NO: 96015 - RNA, 64 nt, Homo Sapiens
cuuugcacucaggagguucuaaauuuuaaaauuucgacuucagcguagagaauucacuuuucuc

SEQ ID NO: 96016 - RNA, 64 nt, Homo Sapiens
aacaaacaggugcuccaggcuuugauuauagauacgacuucaaaaauaugcuaagacgcuugac

SEQ ID NO: 96017 - RNA, 64 nt, Homo Sapiens
uggauuguguacccuuuaguuaaauuucaccucccgacuucagcauagaucacaggaaaucaca

SEQ ID NO: 96018 - RNA, 64 nt, Homo Sapiens
aauacuauaugaugauaguuauuauauuauaugacgacuucauucacuucccaaaucacagggu

SEQ ID NO: 96019 - RNA, 64 nt, Homo Sapiens
uuaugaugcgccuccuucugugcgaccaaugagacgacuucagcaucuuuuuaaaauaaucuaa

SEQ ID NO: 96020 - RNA, 64 nt, Homo Sapiens
gcaucugggaccuggccacccugcagcagcuauacgacuucacaucaucagaggacgccccgug

SEQ ID NO: 96021 - RNA, 64 nt, Homo Sapiens
ggcucuccuacuuggcagaaugaucuuggggaaacgacuucaucugaacuucagauauuucaca

SEQ ID NO: 96022 - RNA, 64 nt, Homo Sapiens
cacagcucccaugccucagcgccagccaggagggcgacuucaguaagcagagguagaagacgag

SEQ ID NO: 96023 - RNA, 64 nt, Homo Sapiens
ggcauugugaggaaagagcauuuggauggauuuacgacuucacaaccacucaagggggagcaaa

SEQ ID NO: 96024 - RNA, 64 nt, Homo Sapiens
uguugacccuuccugaaaauccucuagcagcccccgacuucagcaguuucuuucuuuguuuuuu

SEQ ID NO: 96025 - RNA, 57 nt, Homo Sapiens
uucccacccaucuccaguagcucgcaccgacuucaaucgccguguauccagccuuag

SEQ ID NO: 96026 - RNA, 64 nt, Homo Sapiens
uuucauuauuggauuuggauuuuagugaggugaacgacuucagaguuauucaaauuucuuguaa

SEQ ID NO: 96027 - RNA, 64 nt, Homo Sapiens
gacaggcaaacugcaaaccauggugagaaauugacgacuucacacuauggacagcuuuucccaa

SEQ ID NO: 96028 - RNA, 64 nt, Homo Sapiens
uuuugugauaaagaaugugacagggcgucuuuuccgacuucaguuauuagcccuugcaaguuuu

SEQ ID NO: 96029 - RNA, 64 nt, Homo Sapiens
ggcugggaaucccagcugauucccugacaggagccgacuucacacacaggugacucucaggcau

SEQ ID NO: 96030 - RNA, 64 nt, Homo Sapiens
gccuucaccuucaccuucauccauguccaacccccgacuucaucccaaaggacagccgccugga

SEQ ID NO: 96031 - RNA, 64 nt, Homo Sapiens
agcugacagagccagaggcagggacaauucuucucgacuucaggggcucaaggggacuggugau

SEQ ID NO: 96032 - RNA, 64 nt, Homo Sapiens
uccucacuuggacuccucuuucaacccccucauacgacuucagcccuuuguuugccaaaauuau

SEQ ID NO: 96033 - RNA, 64 nt, Homo Sapiens
uuggagaaagcaugaagagguuacgaaauuagaacgacuucacguuuaaugaagaaacucauuc

SEQ ID NO: 96034 - RNA, 64 nt, Homo Sapiens
caagcuucaaccucauuggugacagccugucuuucgacuucaaagauacugacaugaagcggcu

SEQ ID NO: 96035 - RNA, 64 nt, Homo Sapiens
ccuuccuaaacccagaccugcuucacaccucccccgacuucagcgaacguggccaccugcccag

SEQ ID NO: 96036 - RNA, 64 nt, Homo Sapiens
guauuuaggaaaaauuuuuacaaaggucuucuaccgacuucaugucaaagaacauggucugaug

SEQ ID NO: 96037 - RNA, 64 nt, Homo Sapiens
agcacaccugccccugcauuauuuucauagggaccgacuucaguaccaggcaaaauugagcagc

SEQ ID NO: 96038 - RNA, 64 nt, Homo Sapiens
cuucuccagaacuugugucuccagaggaguacgccgacuucagcagcuuccugcugcuagucga

SEQ ID NO: 96039 - RNA, 62 nt, Homo Sapiens
agugcugccaacccugauauaggggaguuguauggaaaaauaguagaauuacacagcaugaa

SEQ ID NO: 96040 - RNA, 62 nt, Homo Sapiens
ccacauuuccuauauuuugacagagauacugcuggaaaaauuaaaauuaaaaugccauaaua

SEQ ID NO: 96041 - RNA, 62 nt, Homo Sapiens
ugcaauaacauuuaggauaaucuuugacauuuuggaaaaauaagaauugaggaaaaaaagug

SEQ ID NO: 96042 - RNA, 62 nt, Homo Sapiens
gccuggaugacauaaugagauucugucucuacuggaaaaaaaaaaaauuagcuggacauggu

SEQ ID NO: 96043 - RNA, 62 nt, Homo Sapiens
acuugaaagauaacacaauuuuacaaauuuguuggaaaaacaugaauucauaaauucaggaa

SEQ ID NO: 96044 - RNA, 62 nt, Homo Sapiens
auguaaccaaaagggaagagauucacuguauguggaaaaauaaacgaccccuuguuaccuug

SEQ ID NO: 96045 - RNA, 62 nt, Homo Sapiens
accccuuguuaccuugauuccagaaaacaaaauggaaaaacgaaaaguguaaauaaccaauu

SEQ ID NO: 96046 - RNA, 62 nt, Homo Sapiens
aucggcauuguccaaaauauuuuauucuuuaauggaaaaagccauuaauauucaaaugaagg

SEQ ID NO: 96047 - RNA, 62 nt, Homo Sapiens
ucaucugaguguagagaaugucccuucacugcuggaaaaauccacuggcucccaagaaaaga

SEQ ID NO: 96048 - RNA, 62 nt, Homo Sapiens
uuccaggaauuuuuuucaaauggggcuguuucuggaaaaaugaaaaauucuauuggacaaug

SEQ ID NO: 96049 - RNA, 62 nt, Homo Sapiens
ugcucagaaccauucacauuuaauucaauucuuggaaaaaauuaaagcuuuuugcccacaau

SEQ ID NO: 96050 - RNA, 62 nt, Homo Sapiens
ugcuuuuauuuuaugggccaagguucuguaaguggaaaaaugcucuuacuaaaaugaguuuu

SEQ ID NO: 96051 - RNA, 62 nt, Homo Sapiens
aucgugucaaucuggaugaugcacugaagagguggaaaaauauguauguugcguaucccaag

SEQ ID NO: 96052 - RNA, 62 nt, Homo Sapiens
acugucuguguuuuuuuggcguuaaguucuauuggaaaaaccuguauuuguuucuggucuuu

SEQ ID NO: 96053 - RNA, 62 nt, Homo Sapiens
aaagacaggcugccacaguacuuuuuugguaguggaaaaaaacuuaaaagguaucaauguac

SEQ ID NO: 96054 - RNA, 62 nt, Homo Sapiens
accucaauugauuuuuccauuuuuuuucaugauggaaaaaucgacagaugacuuuaaagaaa

SEQ ID NO: 96055 - RNA, 62 nt, Homo Sapiens
ugaauauauuguaggauuugucaaaagauaauuggaaaaaauuauauuuugcaaauuguugu

SEQ ID NO: 96056 - RNA, 62 nt, Homo Sapiens
gggauuugaauauaggcaaaauaccugguaaguggaaaaagagcaacuuugcuuaaaauugu

SEQ ID NO: 96057 - RNA, 62 nt, Homo Sapiens
gugucucagugcuaauucuuuuaaggauuaacuggaaaaaauaauuggauuuaauauuugua

SEQ ID NO: 96058 - RNA, 62 nt, Homo Sapiens
aaacacuuaacuagaauucuuuuacauguauguggaaaaacaauccuauugaucuuaaggua

SEQ ID NO: 96059 - RNA, 62 nt, Homo Sapiens
auuggaaaagaaaaacucaguauguugaggcauggaaaaaaaauuaacugauuaauuucccu

SEQ ID NO: 96060 - RNA, 62 nt, Homo Sapiens
uuuuaggaaacucaccuuccuaaaagauuuguuggaaaaaauuggugaucuaauccuaaauu

SEQ ID NO: 96061 - RNA, 62 nt, Homo Sapiens
auauucaauaagagauuaggaaguagcaauuauggaaaaaaaacuuuggcaacccuuuugaa

SEQ ID NO: 96062 - RNA, 62 nt, Homo Sapiens
uagagcccuauucucucagacgguggaauauuuggaaaaauuuuaaaacaauuaaaauuuua

SEQ ID NO: 96063 - RNA, 62 nt, Homo Sapiens
ucguuaaucuugcugcuuaugugccaauuuaguggaaaaaaacaacccuugcugaaaaauuc

SEQ ID NO: 96064 - RNA, 62 nt, Homo Sapiens
ucugaagauacaugucuuucuccagggacauguggaaaaaaaaaagauguuauacaaccauc

SEQ ID NO: 96065 - RNA, 62 nt, Homo Sapiens
aaaaggguaucccaaaaauaaaacuauccuuuuggaaaaaaaaagauuuaaaauaauuccug

SEQ ID NO: 96066 - RNA, 62 nt, Homo Sapiens
agcuugacacccaccaagcaaaaguuucagccuggaaaaaaaaugggggggaaggguggaug

SEQ ID NO: 96067 - RNA, 62 nt, Homo Sapiens
guggggugccagaaagugucugcugauauuuguggaaaaaaaaucuauuuuguuuaccuacu

SEQ ID NO: 96068 - RNA, 62 nt, Homo Sapiens
acuacuguauguaacggaauaaaaaauagcuuuggaaaaaaauuuauauuaacgauacuaaa

SEQ ID NO: 96069 - RNA, 62 nt, Homo Sapiens
aaaaaaaaaaaaacacgucagagaaugaagauuggaaaaagguaucggggcgggccaacccc

SEQ ID NO: 96070 - RNA, 62 nt, Homo Sapiens
uuucaaccugacuaaaauuuucuuucaguuaguggaaaaacaauggcugcucauuuaucuua

SEQ ID NO: 96071 - RNA, 62 nt, Homo Sapiens
aauucucauuauuugcaaaguaggacaauuaauggaaaaaaagaaaauucuccuugauaaca

SEQ ID NO: 96072 - RNA, 62 nt, Homo Sapiens
cacugugccuugguuucuccuuuauuucuaaguggaaaaaguauuagccaccaucuuaccuc

SEQ ID NO: 96073 - RNA, 62 nt, Homo Sapiens
uuauuuaagcaucaaauauuugugcaagaauuuggaaaaauagaagaugaaucauugauuga

SEQ ID NO: 96074 - RNA, 62 nt, Homo Sapiens
uuuaaaaccuucuuaacaaaacuucuuaaaacuggaaaaaauauauauuauguaucuaugua

SEQ ID NO: 96075 - RNA, 62 nt, Homo Sapiens
agagucucauuagacaaugauuuuuaaagcauuggaaaaauauuuugccuguaaaaguuagu

SEQ ID NO: 96076 - RNA, 62 nt, Homo Sapiens
uuguucuauuuuuacaucuugcacauucagaguggaaaaaauaaaguacauugguaauuugg

SEQ ID NO: 96077 - RNA, 62 nt, Homo Sapiens
aaaucuguauauuaaagagacaauaccauuacuggaaaaaggagaacuaucauaugauccag

SEQ ID NO: 96078 - RNA, 62 nt, Homo Sapiens
ccauauagcuuaauauguuuauuaguucucuuuggaaaaaaacuaccacuguggucuuaaaa

SEQ ID NO: 96079 - RNA, 62 nt, Homo Sapiens
auaauuauaucagaaacucacaaaccuagacauggaaaaacagauuacugucuauugucagc

SEQ ID NO: 96080 - RNA, 58 nt, Homo Sapiens
auaccaauaagucagccugaugcucuaauggaaaaauggcccucuucaagccugguga

SEQ ID NO: 96081 - RNA, 62 nt, Homo Sapiens
gaggcuccaccuuguuaaauaaauuggauguauggaaaaauagacugcagaaaaggggaacu

SEQ ID NO: 96082 - RNA, 62 nt, Homo Sapiens
cugguagagucauggaggaaguaaguuaaauguggaaaaaaugcuuuaaaaguacuuacuau

SEQ ID NO: 96083 - RNA, 62 nt, Homo Sapiens
aaguacuuacuauaaccacaucauaagaauucuggaaaaauagagaacaaaaggaaaagauu

SEQ ID NO: 96084 - RNA, 62 nt, Homo Sapiens
gacuggguucgaucagcccuccuaaagcuggcuggaaaaagaagccccagcccagccugccu

SEQ ID NO: 96085 - RNA, 62 nt, Homo Sapiens
acaccaucugcaaccauaugcuauuaauaaaauggaaaaaaacaaaauggucauuuugcaua

SEQ ID NO: 96086 - RNA, 62 nt, Homo Sapiens
aaaaaaauuaaaaaguaaauugccauuuuagauggaaaaauaucaaaaguaaauguucucuu

SEQ ID NO: 96087 - RNA, 62 nt, Homo Sapiens
auugcccuguggacuccuuuugagaccucugguggaaaaauugugcuuuucagaauguagag

SEQ ID NO: 96088 - RNA, 62 nt, Homo Sapiens
aacagaaaagagauauuaaaucucuauuucuguggaaaaaaccugugagauugaauaaacag

SEQ ID NO: 96089 - RNA, 62 nt, Homo Sapiens
uaccuauucuugaaguaguuaucaagguauaauggaaaaauaaauugcaucuuuacauaaug

SEQ ID NO: 96090 - RNA, 62 nt, Homo Sapiens
ugccuuaauguuugaaauguguacuguuuaguuggaaaaagugugacaucuauuuuuauaaa

SEQ ID NO: 96091 - RNA, 62 nt, Homo Sapiens
aauacuacuguaggaguaucugcuuguuaaaauggaaaaaugugucuuuagagcucaguauu

SEQ ID NO: 96092 - RNA, 62 nt, Homo Sapiens
uacagucugucuguauuuagauauuuuauuucuggaaaaaaugaaauguacauaaaaauaaa

SEQ ID NO: 96093 - RNA, 62 nt, Homo Sapiens
guuuuuggauuaaauuaguuugugaaggauuauggaaaaauaaaacugucacuguuggacgu

SEQ ID NO: 96094 - RNA, 62 nt, Homo Sapiens
aaacuuuaaaccuguagaaucaauuuaaguguuggaaaaaauuugucugaaacauuucauaa

SEQ ID NO: 96095 - RNA, 62 nt, Homo Sapiens
auuggagaaaaacccuaugaguguaaugaauuuggaaaaauauuuuuuucaacaacagcuua

SEQ ID NO: 96096 - RNA, 62 nt, Homo Sapiens
agguauauuuacauucagaguacacuuuucuuuggaaaaaauuacagguuuuuugaaaagug

SEQ ID NO: 96097 - RNA, 62 nt, Homo Sapiens
uagauuuuaagugccuuuucacugggagaaucuggaaaaaccuccauaagguauauagcaau

SEQ ID NO: 96098 - RNA, 62 nt, Homo Sapiens
uuauaauaaauuauauuaguaaaagucuuaacuggaaaaaagaaucuaaaucagaauaguga

SEQ ID NO: 96099 - RNA, 62 nt, Homo Sapiens
aaagaaggcaggaaggaaaggagaagaagaaauggaaaaaugaguugcgcugauuacucuua

SEQ ID NO: 96100 - RNA, 62 nt, Homo Sapiens
aguguuagggaaagaaaucaaaauuaguagauuggaaaaacuacuuugcuuuguuuauaaau

SEQ ID NO: 96101 - RNA, 62 nt, Homo Sapiens
guggcuccucucugguugaggagagggaaaauuggaaaaacuggucgaguaauuaucaauaa

SEQ ID NO: 96102 - RNA, 62 nt, Homo Sapiens
uauauuuuuauauacugaacugccauagaugcuggaaaaaaggaacugauguuuucagcaua

SEQ ID NO: 96103 - RNA, 62 nt, Homo Sapiens
cuaaaaccuuuuagugacaaaauccuaauauguggaaaaaagcauaugcauaaaggaauaau

SEQ ID NO: 96104 - RNA, 62 nt, Homo Sapiens
aaguuaaauauaucaagaaagaagagacuguuuggaaaaaugugguucaaguuuuaugcuau

SEQ ID NO: 96105 - RNA, 62 nt, Homo Sapiens
ugcacuuaaaguugcauugccuacuguuauacuggaaaaaauagaguucaagaauaauauga

SEQ ID NO: 96106 - RNA, 62 nt, Homo Sapiens
aaagugugauagcgauauuagugccaaucaaauggaaaaaagguaguuuuaauaaacaagac

SEQ ID NO: 96107 - RNA, 62 nt, Homo Sapiens
aguagcucucuguagcauuauaaccuacuuccuggaaaaaguuccuuuuucuuucuagcugu

SEQ ID NO: 96108 - RNA, 62 nt, Homo Sapiens
gauuuguaaaaucaccggaaagacuuuacaccuggaaaaaaauaauuuuuuggaauuuuugu

SEQ ID NO: 96109 - RNA, 62 nt, Homo Sapiens
uggacaaccucuugacuaggguaaccaugcaauggaaaaaaauaguuucuggggaaagaaua

SEQ ID NO: 96110 - RNA, 62 nt, Homo Sapiens
gaugauuccaaagcaagggcaccaaggcuacuuggaaaaaugauaguuugccacuaaaagga

SEQ ID NO: 96111 - RNA, 62 nt, Homo Sapiens
aauauacaaauaugaaaugaggauguucacuauggaaaaacaguugauguugaugggaguca

SEQ ID NO: 96112 - RNA, 62 nt, Homo Sapiens
cuggaauaugugguguacacuagaauguuacuuggaaaaaguguagcucuaaacuguuaaca

SEQ ID NO: 96113 - RNA, 62 nt, Homo Sapiens
caugucuguaacuaacccauugagauuauauuuggaaaaauugagggauuaaauuagaccug

SEQ ID NO: 96114 - RNA, 62 nt, Homo Sapiens
gauaguagguugaaaugggagaauuucucuuuuggaaaaaaagguagauaacuguuuaaaaa

SEQ ID NO: 96115 - RNA, 62 nt, Homo Sapiens
agguaauuauuaguuguaauagcuuuaaugcauggaaaaacuucaguuacugaccagucaag

SEQ ID NO: 96116 - RNA, 62 nt, Homo Sapiens
uuggaccauacacuauguuacaaaacuaaaaguggaaaaaacuuauuggugaaugaauauag

SEQ ID NO: 96117 - RNA, 62 nt, Homo Sapiens
aguugcaggauaucuagcaauuuaagaaaauguggaaaaaauauuuuuauugagaaauagca

SEQ ID NO: 96118 - RNA, 62 nt, Homo Sapiens
aaucuaauagucaccuaaaauaucuuuuuuguuggaaaaaaguuuauaauaaaaaaguuugu

SEQ ID NO: 96119 - RNA, 62 nt, Homo Sapiens
aaauguuuauuaaguagcuagaaauaauuauguggaaaaaaaugaauaauggaaaauaguga

SEQ ID NO: 96120 - RNA, 62 nt, Homo Sapiens
ccauugggaaauugggagaaaugauaaacaaauggaaaaagaagaugucccuaaccuacacc

SEQ ID NO: 96121 - RNA, 62 nt, Homo Sapiens
ucuuuaagcaagaaguuaaagagugaacaugguggaaaaaauauaauuauuuucaucagacu

SEQ ID NO: 96122 - RNA, 62 nt, Homo Sapiens
caggggacugccauuuuauaaaugucagcaguuggaaaaaucgucacgaauugacuuagagc

SEQ ID NO: 96123 - RNA, 62 nt, Homo Sapiens
auuagaguauuucccuuccaaagagggauguuuggaaaaaacucugaaggagaggaggaauu

SEQ ID NO: 96124 - RNA, 62 nt, Homo Sapiens
uacagccuagggcagacaauaguauagaagucuggaaaaaaacaaaaacagaauuugagaac

SEQ ID NO: 96125 - RNA, 62 nt, Homo Sapiens
ccaaggagaacaaauauucagaauauucauauuggaaaaaucacaauuuuuaauggcagcag

SEQ ID NO: 96126 - RNA, 62 nt, Homo Sapiens
uauccauaaaaaaaaauagaugucuuuuauaguggaaaaacacauggggaaaaaaaucaucu

SEQ ID NO: 96127 - RNA, 62 nt, Homo Sapiens
cagaggccuaaaguuuaaaaaacuguguuuacuggaaaaauuuugacuuugccacauagcug

SEQ ID NO: 96128 - RNA, 62 nt, Homo Sapiens
gaugacuauaugaugaggaggagccaucagacuggaaaaaagaaagagggccaaggagguau

SEQ ID NO: 96129 - RNA, 62 nt, Homo Sapiens
gcccugagucaaaaggauagccaaggguggaguggaaaaagauauggugaaggcagaacugc

SEQ ID NO: 96130 - RNA, 62 nt, Homo Sapiens
caauuucuccuuggaacucuaacaggacuaacuggaaaaauacuuugaccauagcucuagua

SEQ ID NO: 96131 - RNA, 62 nt, Homo Sapiens
cugguacucaaagcugcuuaccgaauguguccuggaaaaaaaagauccccaccugcaucauu

SEQ ID NO: 96132 - RNA, 62 nt, Homo Sapiens
gucuccuaauuuggggagaugacuuuuacucauggaaaaauuaugacuccacuuuuaaugug

SEQ ID NO: 96133 - RNA, 62 nt, Homo Sapiens
auuuuuucaggaccuuaguuccagcagcagaauggaaaaauccuugaagcccaggcugaugc

SEQ ID NO: 96134 - RNA, 62 nt, Homo Sapiens
cuuguuagagagcuuuucacugugaggaaguguggaaaaauagcucugugugugugugugug

SEQ ID NO: 96135 - RNA, 62 nt, Homo Sapiens
uccuugaggcauuuagcaacaguuugaugcauuggaaaaauuaaaauaaaaaggauucuaaa

SEQ ID NO: 96136 - RNA, 62 nt, Homo Sapiens
gucuuccacaaaacuggucccccugcagucuguggaaaaauucauccugaaaccacccuuca

SEQ ID NO: 96137 - RNA, 62 nt, Homo Sapiens
uuauuugaagaaagaaaaaacagauuuuaggguggaaaaaacagucaacucacacaaagaau

SEQ ID NO: 96138 - RNA, 62 nt, Homo Sapiens
ggguggaaaaaacagucaacucacacaaagaauggaaaaaaauacugaguuaaauuaagcaa

SEQ ID NO: 96139 - RNA, 62 nt, Homo Sapiens
uagacaagucuaguggaaccaaaauaugagauuggaaaaaauuucaccuaucuggaaaaaaa

SEQ ID NO: 96140 - RNA, 62 nt, Homo Sapiens
aaaauaugagauuggaaaaauuuucaccuaucuggaaaaaaauggaaggcacacugagcaag

SEQ ID NO: 96141 - RNA, 62 nt, Homo Sapiens
aggguuaggguuuaaagaaaggagaaagccauuggaaaaaugaugggcuccauuaaggagac

SEQ ID NO: 96142 - RNA, 62 nt, Homo Sapiens
auaaagcuucaaugucuuuuuuuuuuuuuucauggaaaaacucaaaccucuguuauuuggga

SEQ ID NO: 96143 - RNA, 62 nt, Homo Sapiens
uuugcauaggaauucaugaaggcgacccaaccuggaaaaagaacuauucacuuuggccaugg

SEQ ID NO: 96144 - RNA, 62 nt, Homo Sapiens
uuaauaccagaccaaagacauuuucuguuuccuggaaaaaaaaaaugaaucauguuaggcuu

SEQ ID NO: 96145 - RNA, 62 nt, Homo Sapiens
aaaauuauuuucauugauggaacuggaguuguuggaaaaacauagauuuaaaaugauuuuug

SEQ ID NO: 96146 - RNA, 62 nt, Homo Sapiens
gccaagugcucuugauaauuucuucagauuuuuggaaaaaaacacuauauaaaugcaaucca

SEQ ID NO: 96147 - RNA, 62 nt, Homo Sapiens
uagaucacauacguuaucaaaaacuacucccuuggaaaaaauaucuuucgaaaaucaaauuu

SEQ ID NO: 96148 - RNA, 62 nt, Homo Sapiens
ugggaaagcaaagcagaaaacagugccccaaauggaaaaaagauacucacacagaacaaaac

SEQ ID NO: 96149 - RNA, 62 nt, Homo Sapiens
uacauuagcugugguuguaagacugggaacaauggaaaaaaucacacaauggguuuggagcu

SEQ ID NO: 96150 - RNA, 62 nt, Homo Sapiens
ugggcuuugcacacaaugggcauuuagaugcauggaaaaaaaauuucauagccuguaucuau

SEQ ID NO: 96151 - RNA, 62 nt, Homo Sapiens
ucagaguuugaaaugaaauguugucaggguguuggaaaaauuuuggugaguucugcacauuu

SEQ ID NO: 96152 - RNA, 62 nt, Homo Sapiens
ugacucacugaugaaucagcauuugcauuuuauggaaaaauauaaauccaaagaaauaauuu

SEQ ID NO: 96153 - RNA, 62 nt, Homo Sapiens
ccuuggcgcugccaccugccccacccaguuucuggaaaaaguugaugcuaaugaggccaacc

SEQ ID NO: 96154 - RNA, 62 nt, Homo Sapiens
ggugcuggggcuggccugcaggcugcagucccuggaaaaacagucacugacucaagacacug

SEQ ID NO: 96155 - RNA, 62 nt, Homo Sapiens
aaagcuuuuaaacuggagaguuaaaaaaaaaauggaaaaaaaacuacuaaguguguguuuuu

SEQ ID NO: 96156 - RNA, 62 nt, Homo Sapiens
cugagcucaguuacacuugaauccauacuguuuggaaaaacagcucagagggaauaucagug

SEQ ID NO: 96157 - RNA, 62 nt, Homo Sapiens
uuggcauaagcucaaaaaagccaggaucuuuauggaaaaauuuuaauacuuuguuaaaaggu

SEQ ID NO: 96158 - RNA, 62 nt, Homo Sapiens
gaauaaauggaaagaaauaccauauacauagauggaaaaacccaguauuauaaaaaccucaa

SEQ ID NO: 96159 - RNA, 62 nt, Homo Sapiens
uucaaccucauucaacaccagaaaguucacaguggaaaaaaucuugaagguaacagauggaa

SEQ ID NO: 96160 - RNA, 62 nt, Homo Sapiens
gacaguuuacaauguggacaauguagugaauauggaaaaagguuucagccaaaggccuaacc

SEQ ID NO: 96161 - RNA, 62 nt, Homo Sapiens
uauauaaaacaguaucagugacuuuacuguuguggaaaaaucgguucaugacagacccuugg

SEQ ID NO: 96162 - RNA, 62 nt, Homo Sapiens
cauauuaugagaaaauugugucaggaaguucauggaaaaauauucgcuaguacaaggggucu

SEQ ID NO: 96163 - RNA, 62 nt, Homo Sapiens
auuaaggaaugauugaauuuugugggucuugauggaaaaacgcuggucuucuuuuaaugugg

SEQ ID NO: 96164 - RNA, 62 nt, Homo Sapiens
cuugauggaaaaacgcuggucuucuuuuaauguggaaaaacagcuagugcuucaguccuagg

SEQ ID NO: 96165 - RNA, 62 nt, Homo Sapiens
uguacuguuauugaaaauauauuuaauaccuuuggaaaaaucuugggcaagaugaccuacua

SEQ ID NO: 96166 - RNA, 62 nt, Homo Sapiens
cauaauugcaauauuucccccuuacuacuucuuggaaaaaaauuacaaaaugaaguuuuaua

SEQ ID NO: 96167 - RNA, 62 nt, Homo Sapiens
aaaugcaagguaauuuuguagguguucugauguggaaaaaagaauuuauagaaauaguaucg

SEQ ID NO: 96168 - RNA, 62 nt, Homo Sapiens
ucgaauuucaaaagaauccgcuaauuucaaucuggaaaaagaagaaacuucuacagauauua

SEQ ID NO: 96169 - RNA, 62 nt, Homo Sapiens
caacucauuuucaucuguuuuuugaagaaaaauggaaaaauguaaaaggcagccccucccca

SEQ ID NO: 96170 - RNA, 62 nt, Homo Sapiens
ucuguugccauuuguguaaauacuagucuuuuuggaaaaaaaauaauguaaagauguuuugu

SEQ ID NO: 96171 - RNA, 64 nt, Homo Sapiens
aaauugcgauuuaucacuccuuacacagugauaugguaaugauagauuuuguaacaagggcuug

SEQ ID NO: 96172 - RNA, 64 nt, Homo Sapiens
aagauccuuaccacaguuuuagggaagacagccugguaaugaauguaguccggaaaacaaaagg

SEQ ID NO: 96173 - RNA, 64 nt, Homo Sapiens
uuaacagcuguggagucugggagguaaugaagaugguaaugaccgccagugcuaugcugagauu

SEQ ID NO: 96174 - RNA, 64 nt, Homo Sapiens
augguaaugaccuuaacagcuaugcugagauugagguaaugaagauguguuugccggccagugc

SEQ ID NO: 96175 - RNA, 60 nt, Homo Sapiens
agcacaacagaugccacgucuucgugcauucgccaacacgugcccucacagggccagcgu

SEQ ID NO: 96176 - RNA, 60 nt, Homo Sapiens
gccugugucuucaccuguccuguccaccagcgccaacagccguggggaagccaaggagac

SEQ ID NO: 96177 - RNA, 64 nt, Homo Sapiens; identical to SEQ ID NO: 45477

SEQ ID NO: 96178 - RNA, 64 nt, Homo Sapiens; identical to SEQ ID NO: 45478

SEQ ID NO: 96179 - RNA, 64 nt, Homo Sapiens; identical to SEQ ID NO: 45479

SEQ ID NO: 96180 - RNA, 64 nt, Homo Sapiens; identical to SEQ ID NO: 45480

SEQ ID NO: 96181 - RNA, 64 nt, Homo Sapiens; identical to SEQ ID NO: 45481

SEQ ID NO: 96182 - RNA, 64 nt, Homo Sapiens; identical to SEQ ID NO: 45482

SEQ ID NO: 96183 - RNA, 64 nt, Homo Sapiens; identical to SEQ ID NO: 45483

SEQ ID NO: 96184 - RNA, 64 nt, Homo Sapiens; identical to SEQ ID NO: 45484

SEQ ID NO: 96185 - RNA, 64 nt, Homo Sapiens; identical to SEQ ID NO: 45485

SEQ ID NO: 96186 - RNA, 64 nt, Homo Sapiens; identical to SEQ ID NO: 45486

SEQ ID NO: 96187 - RNA, 64 nt, Homo Sapiens; identical to SEQ ID NO: 45487

SEQ ID NO: 96188 - RNA, 56 nt, Homo Sapiens; identical to SEQ ID NO: 45488

SEQ ID NO: 96189 - RNA, 64 nt, Homo Sapiens; identical to SEQ ID NO: 45489

SEQ ID NO: 96190 - RNA, 64 nt, Homo Sapiens; identical to SEQ ID NO: 45490

SEQ ID NO: 96191 - RNA, 64 nt, Homo Sapiens; identical to SEQ ID NO: 45491

SEQ ID NO: 96192 - RNA, 64 nt, Homo Sapiens; identical to SEQ ID NO: 45492

SEQ ID NO: 96193 - RNA, 64 nt, Homo Sapiens; identical to SEQ ID NO: 45493

SEQ ID NO: 96194 - RNA, 64 nt, Homo Sapiens; identical to SEQ ID NO: 45494

SEQ ID NO: 96195 - RNA, 64 nt, Homo Sapiens; identical to SEQ ID NO: 45495

SEQ ID NO: 96196 - RNA, 64 nt, Homo Sapiens; identical to SEQ ID NO: 45496

SEQ ID NO: 96197 - RNA, 64 nt, Homo Sapiens; identical to SEQ ID NO: 45497

SEQ ID NO: 96198 - RNA, 64 nt, Homo Sapiens; identical to SEQ ID NO: 45498

SEQ ID NO: 96199 - RNA, 64 nt, Homo Sapiens; identical to SEQ ID NO: 45499

SEQ ID NO: 96200 - RNA, 64 nt, Homo Sapiens; identical to SEQ ID NO: 45500

SEQ ID NO: 96201 - RNA, 64 nt, Homo Sapiens; identical to SEQ ID NO: 45501

SEQ ID NO: 96202 - RNA, 64 nt, Homo Sapiens; identical to SEQ ID NO: 45502

SEQ ID NO: 96203 - RNA, 64 nt, Homo Sapiens; identical to SEQ ID NO: 45503

SEQ ID NO: 96204 - RNA, 64 nt, Homo Sapiens; identical to SEQ ID NO: 45504

SEQ ID NO: 96205 - RNA, 64 nt, Homo Sapiens; identical to SEQ ID NO: 45505

SEQ ID NO: 96206 - RNA, 64 nt, Homo Sapiens; identical to SEQ ID NO: 45506

SEQ ID NO: 96207 - RNA, 64 nt, Homo Sapiens; identical to SEQ ID NO: 45507

SEQ ID NO: 96208 - RNA, 64 nt, Homo Sapiens; identical to SEQ ID NO: 45508

SEQ ID NO: 96209 - RNA, 64 nt, Homo Sapiens; identical to SEQ ID NO: 45509

SEQ ID NO: 96210 - RNA, 64 nt, Homo Sapiens; identical to SEQ ID NO: 45510

SEQ ID NO: 96211 - RNA, 64 nt, Homo Sapiens; identical to SEQ ID NO: 45511

SEQ ID NO: 96212 - RNA, 64 nt, Homo Sapiens; identical to SEQ ID NO: 45512

SEQ ID NO: 96213 - RNA, 64 nt, Homo Sapiens; identical to SEQ ID NO: 45513

SEQ ID NO: 96214 - RNA, 64 nt, Homo Sapiens; identical to SEQ ID NO: 45514

SEQ ID NO: 96215 - RNA, 64 nt, Homo Sapiens; identical to SEQ ID NO: 45515

SEQ ID NO: 96216 - RNA, 64 nt, Homo Sapiens; identical to SEQ ID NO: 45516

SEQ ID NO: 96217 - RNA, 64 nt, Homo Sapiens; identical to SEQ ID NO: 45517

SEQ ID NO: 96218 - RNA, 64 nt, Homo Sapiens; identical to SEQ ID NO: 45518

SEQ ID NO: 96219 - RNA, 64 nt, Homo Sapiens; identical to SEQ ID NO: 45519

SEQ ID NO: 96220 - RNA, 64 nt, Homo Sapiens; identical to SEQ ID NO: 45520

SEQ ID NO: 96221 - RNA, 64 nt, Homo Sapiens; identical to SEQ ID NO: 45521

SEQ ID NO: 96222 - RNA, 64 nt, Homo Sapiens; identical to SEQ ID NO: 45522

SEQ ID NO: 96223 - RNA, 64 nt, Homo Sapiens; identical to SEQ ID NO: 45523

SEQ ID NO: 96224 - RNA, 64 nt, Homo Sapiens; identical to SEQ ID NO: 45524

SEQ ID NO: 96225 - RNA, 64 nt, Homo Sapiens; identical to SEQ ID NO: 45525

SEQ ID NO: 96226 - RNA, 64 nt, Homo Sapiens; identical to SEQ ID NO: 45526

SEQ ID NO: 96227 - RNA, 64 nt, Homo Sapiens; identical to SEQ ID NO: 45527

SEQ ID NO: 96228 - RNA, 64 nt, Homo Sapiens; identical to SEQ ID NO: 45528

SEQ ID NO: 96229 - RNA, 64 nt, Homo Sapiens; identical to SEQ ID NO: 45529

SEQ ID NO: 96230 - RNA, 64 nt, Homo Sapiens; identical to SEQ ID NO: 45530

SEQ ID NO: 96231 - RNA, 64 nt, Homo Sapiens; identical to SEQ ID NO: 45531

SEQ ID NO: 96232 - RNA, 64 nt, Homo Sapiens; identical to SEQ ID NO: 45532

SEQ ID NO: 96233 - RNA, 64 nt, Homo Sapiens; identical to SEQ ID NO: 45533

SEQ ID NO: 96234 - RNA, 64 nt, Homo Sapiens; identical to SEQ ID NO: 45534

SEQ ID NO: 96235 - RNA, 64 nt, Homo Sapiens; identical to SEQ ID NO: 45535

SEQ ID NO: 96236 - RNA, 64 nt, Homo Sapiens; identical to SEQ ID NO: 45536

SEQ ID NO: 96237 - RNA, 64 nt, Homo Sapiens; identical to SEQ ID NO: 45537

SEQ ID NO: 96238 - RNA, 64 nt, Homo Sapiens; identical to SEQ ID NO: 45538

SEQ ID NO: 96239 - RNA, 64 nt, Homo Sapiens; identical to SEQ ID NO: 45539

SEQ ID NO: 96240 - RNA, 64 nt, Homo Sapiens; identical to SEQ ID NO: 45540

SEQ ID NO: 96241 - RNA, 64 nt, Homo Sapiens; identical to SEQ ID NO: 45541

SEQ ID NO: 96242 - RNA, 64 nt, Homo Sapiens; identical to SEQ ID NO: 45542

SEQ ID NO: 96243 - RNA, 64 nt, Homo Sapiens; identical to SEQ ID NO: 45543

SEQ ID NO: 96244 - RNA, 64 nt, Homo Sapiens; identical to SEQ ID NO: 45544

SEQ ID NO: 96245 - RNA, 64 nt, Homo Sapiens; identical to SEQ ID NO: 45545

SEQ ID NO: 96246 - RNA, 64 nt, Homo Sapiens; identical to SEQ ID NO: 45546

SEQ ID NO: 96247 - RNA, 64 nt, Homo Sapiens; identical to SEQ ID NO: 45547

SEQ ID NO: 96248 - RNA, 64 nt, Homo Sapiens; identical to SEQ ID NO: 45548

SEQ ID NO: 96249 - RNA, 64 nt, Homo Sapiens; identical to SEQ ID NO: 45549

SEQ ID NO: 96250 - RNA, 64 nt, Homo Sapiens; identical to SEQ ID NO: 45550

SEQ ID NO: 96251 - RNA, 64 nt, Homo Sapiens; identical to SEQ ID NO: 45551

SEQ ID NO: 96252 - RNA, 64 nt, Homo Sapiens; identical to SEQ ID NO: 45552

SEQ ID NO: 96253 - RNA, 64 nt, Homo Sapiens; identical to SEQ ID NO: 45553

SEQ ID NO: 96254 - RNA, 64 nt, Homo Sapiens; identical to SEQ ID NO: 45554

SEQ ID NO: 96255 - RNA, 64 nt, Homo Sapiens; identical to SEQ ID NO: 45555

SEQ ID NO: 96256 - RNA, 64 nt, Homo Sapiens; identical to SEQ ID NO: 45556

SEQ ID NO: 96257 - RNA, 64 nt, Homo Sapiens; identical to SEQ ID NO: 45557

SEQ ID NO: 96258 - RNA, 64 nt, Homo Sapiens; identical to SEQ ID NO: 45558

SEQ ID NO: 96259 - RNA, 64 nt, Homo Sapiens; identical to SEQ ID NO: 45559

SEQ ID NO: 96260 - RNA, 64 nt, Homo Sapiens; identical to SEQ ID NO: 45560

SEQ ID NO: 96261 - RNA, 64 nt, Homo Sapiens; identical to SEQ ID NO: 45561

SEQ ID NO: 96262 - RNA, 64 nt, Homo Sapiens; identical to SEQ ID NO: 45562

SEQ ID NO: 96263 - RNA, 64 nt, Homo Sapiens; identical to SEQ ID NO: 45563

SEQ ID NO: 96264 - RNA, 64 nt, Homo Sapiens; identical to SEQ ID NO: 45564

SEQ ID NO: 96265 - RNA, 64 nt, Homo Sapiens; identical to SEQ ID NO: 45565

SEQ ID NO: 96266 - RNA, 64 nt, Homo Sapiens; identical to SEQ ID NO: 45566

SEQ ID NO: 96267 - RNA, 64 nt, Homo Sapiens; identical to SEQ ID NO: 45567

SEQ ID NO: 96268 - RNA, 64 nt, Homo Sapiens; identical to SEQ ID NO: 45568

SEQ ID NO: 96269 - RNA, 64 nt, Homo Sapiens; identical to SEQ ID NO: 45569

SEQ ID NO: 96270 - RNA, 64 nt, Homo Sapiens; identical to SEQ ID NO: 45570

SEQ ID NO: 96271 - RNA, 64 nt, Homo Sapiens; identical to SEQ ID NO: 45571

SEQ ID NO: 96272 - RNA, 64 nt, Homo Sapiens; identical to SEQ ID NO: 45572

SEQ ID NO: 96273 - RNA, 64 nt, Homo Sapiens; identical to SEQ ID NO: 45573

SEQ ID NO: 96274 - RNA, 64 nt, Homo Sapiens; identical to SEQ ID NO: 45574

SEQ ID NO: 96275 - RNA, 64 nt, Homo Sapiens; identical to SEQ ID NO: 45575

SEQ ID NO: 96276 - RNA, 64 nt, Homo Sapiens; identical to SEQ ID NO: 45576

SEQ ID NO: 96277 - RNA, 64 nt, Homo Sapiens; identical to SEQ ID NO: 45577

SEQ ID NO: 96278 - RNA, 64 nt, Homo Sapiens; identical to SEQ ID NO: 45578

SEQ ID NO: 96279 - RNA, 64 nt, Homo Sapiens; identical to SEQ ID NO: 45579

SEQ ID NO: 96280 - RNA, 64 nt, Homo Sapiens; identical to SEQ ID NO: 45580

SEQ ID NO: 96281 - RNA, 64 nt, Homo Sapiens; identical to SEQ ID NO: 45581

SEQ ID NO: 96282 - RNA, 64 nt, Homo Sapiens; identical to SEQ ID NO: 45582

SEQ ID NO: 96283 - RNA, 64 nt, Homo Sapiens; identical to SEQ ID NO: 45583

SEQ ID NO: 96284 - RNA, 64 nt, Homo Sapiens; identical to SEQ ID NO: 45584

SEQ ID NO: 96285 - RNA, 64 nt, Homo Sapiens; identical to SEQ ID NO: 45585

SEQ ID NO: 96286 - RNA, 64 nt, Homo Sapiens; identical to SEQ ID NO: 45586

SEQ ID NO: 96287 - RNA, 64 nt, Homo Sapiens; identical to SEQ ID NO: 45587

SEQ ID NO: 96288 - RNA, 64 nt, Homo Sapiens; identical to SEQ ID NO: 45588

SEQ ID NO: 96289 - RNA, 64 nt, Homo Sapiens; identical to SEQ ID NO: 45589

SEQ ID NO: 96290 - RNA, 64 nt, Homo Sapiens; identical to SEQ ID NO: 45590

SEQ ID NO: 96291 - RNA, 64 nt, Homo Sapiens; identical to SEQ ID NO: 45591

SEQ ID NO: 96292 - RNA, 64 nt, Homo Sapiens; identical to SEQ ID NO: 45592

SEQ ID NO: 96293 - RNA, 64 nt, Homo Sapiens; identical to SEQ ID NO: 45593

SEQ ID NO: 96294 - RNA, 64 nt, Homo Sapiens; identical to SEQ ID NO: 45594

SEQ ID NO: 96295 - RNA, 64 nt, Homo Sapiens; identical to SEQ ID NO: 45595

SEQ ID NO: 96296 - RNA, 64 nt, Homo Sapiens; identical to SEQ ID NO: 45596

SEQ ID NO: 96297 - RNA, 64 nt, Homo Sapiens; identical to SEQ ID NO: 45597

SEQ ID NO: 96298 - RNA, 64 nt, Homo Sapiens; identical to SEQ ID NO: 45598

SEQ ID NO: 96299 - RNA, 64 nt, Homo Sapiens; identical to SEQ ID NO: 45599

SEQ ID NO: 96300 - RNA, 64 nt, Homo Sapiens; identical to SEQ ID NO: 45600

SEQ ID NO: 96301 - RNA, 64 nt, Homo Sapiens; identical to SEQ ID NO: 45601

SEQ ID NO: 96302 - RNA, 64 nt, Homo Sapiens; identical to SEQ ID NO: 45602

SEQ ID NO: 96303 - RNA, 64 nt, Homo Sapiens; identical to SEQ ID NO: 45603

SEQ ID NO: 96304 - RNA, 64 nt, Homo Sapiens; identical to SEQ ID NO: 45604

SEQ ID NO: 96305 - RNA, 64 nt, Homo Sapiens; identical to SEQ ID NO: 45605

SEQ ID NO: 96306 - RNA, 64 nt, Homo Sapiens; identical to SEQ ID NO: 45606

SEQ ID NO: 96307 - RNA, 64 nt, Homo Sapiens; identical to SEQ ID NO: 45607

SEQ ID NO: 96308 - RNA, 64 nt, Homo Sapiens; identical to SEQ ID NO: 45608

SEQ ID NO: 96309 - RNA, 64 nt, Homo Sapiens; identical to SEQ ID NO: 45609

SEQ ID NO: 96310 - RNA, 64 nt, Homo Sapiens; identical to SEQ ID NO: 45610

SEQ ID NO: 96311 - RNA, 64 nt, Homo Sapiens; identical to SEQ ID NO: 45611

SEQ ID NO: 96312 - RNA, 64 nt, Homo Sapiens; identical to SEQ ID NO: 45612

SEQ ID NO: 96313 - RNA, 64 nt, Homo Sapiens; identical to SEQ ID NO: 45613

SEQ ID NO: 96314 - RNA, 64 nt, Homo Sapiens; identical to SEQ ID NO: 45614

SEQ ID NO: 96315 - RNA, 64 nt, Homo Sapiens; identical to SEQ ID NO: 45615

SEQ ID NO: 96316 - RNA, 64 nt, Homo Sapiens; identical to SEQ ID NO: 45616

SEQ ID NO: 96317 - RNA, 64 nt, Homo Sapiens; identical to SEQ ID NO: 45617

SEQ ID NO: 96318 - RNA, 64 nt, Homo Sapiens; identical to SEQ ID NO: 45618

SEQ ID NO: 96319 - RNA, 64 nt, Homo Sapiens; identical to SEQ ID NO: 45619

SEQ ID NO: 96320 - RNA, 64 nt, Homo Sapiens; identical to SEQ ID NO: 45620

SEQ ID NO: 96321 - RNA, 64 nt, Homo Sapiens; identical to SEQ ID NO: 45621

SEQ ID NO: 96322 - RNA, 64 nt, Homo Sapiens; identical to SEQ ID NO: 45622

SEQ ID NO: 96323 - RNA, 64 nt, Homo Sapiens; identical to SEQ ID NO: 45623

SEQ ID NO: 96324 - RNA, 64 nt, Homo Sapiens; identical to SEQ ID NO: 45624

SEQ ID NO: 96325 - RNA, 64 nt, Homo Sapiens; identical to SEQ ID NO: 45625

SEQ ID NO: 96326 - RNA, 64 nt, Homo Sapiens; identical to SEQ ID NO: 45626

SEQ ID NO: 96327 - RNA, 64 nt, Homo Sapiens; identical to SEQ ID NO: 45627

SEQ ID NO: 96328 - RNA, 64 nt, Homo Sapiens; identical to SEQ ID NO: 45628

SEQ ID NO: 96329 - RNA, 64 nt, Homo Sapiens; identical to SEQ ID NO: 45629

SEQ ID NO: 96330 - RNA, 64 nt, Homo Sapiens; identical to SEQ ID NO: 45630

SEQ ID NO: 96331 - RNA, 64 nt, Homo Sapiens; identical to SEQ ID NO: 45631

SEQ ID NO: 96332 - RNA, 64 nt, Homo Sapiens; identical to SEQ ID NO: 45632

SEQ ID NO: 96333 - RNA, 64 nt, Homo Sapiens; identical to SEQ ID NO: 45633

SEQ ID NO: 96334 - RNA, 64 nt, Homo Sapiens; identical to SEQ ID NO: 45634

SEQ ID NO: 96335 - RNA, 64 nt, Homo Sapiens; identical to SEQ ID NO: 45635

SEQ ID NO: 96336 - RNA, 64 nt, Homo Sapiens; identical to SEQ ID NO: 45636

SEQ ID NO: 96337 - RNA, 64 nt, Homo Sapiens; identical to SEQ ID NO: 45637

SEQ ID NO: 96338 - RNA, 64 nt, Homo Sapiens; identical to SEQ ID NO: 45638

SEQ ID NO: 96339 - RNA, 64 nt, Homo Sapiens; identical to SEQ ID NO: 45639

SEQ ID NO: 96340 - RNA, 64 nt, Homo Sapiens; identical to SEQ ID NO: 45640

SEQ ID NO: 96341 - RNA, 64 nt, Homo Sapiens; identical to SEQ ID NO: 45641

SEQ ID NO: 96342 - RNA, 64 nt, Homo Sapiens; identical to SEQ ID NO: 45642

SEQ ID NO: 96343 - RNA, 64 nt, Homo Sapiens; identical to SEQ ID NO: 45643

SEQ ID NO: 96344 - RNA, 64 nt, Homo Sapiens; identical to SEQ ID NO: 45644

SEQ ID NO: 96345 - RNA, 64 nt, Homo Sapiens; identical to SEQ ID NO: 45645

SEQ ID NO: 96346 - RNA, 64 nt, Homo Sapiens; identical to SEQ ID NO: 45646

SEQ ID NO: 96347 - RNA, 64 nt, Homo Sapiens; identical to SEQ ID NO: 45647

SEQ ID NO: 96348 - RNA, 64 nt, Homo Sapiens; identical to SEQ ID NO: 45648

SEQ ID NO: 96349 - RNA, 64 nt, Homo Sapiens; identical to SEQ ID NO: 45649

SEQ ID NO: 96350 - RNA, 64 nt, Homo Sapiens; identical to SEQ ID NO: 45650

SEQ ID NO: 96351 - RNA, 64 nt, Homo Sapiens; identical to SEQ ID NO: 45651

SEQ ID NO: 96352 - RNA, 64 nt, Homo Sapiens; identical to SEQ ID NO: 45652

SEQ ID NO: 96353 - RNA, 64 nt, Homo Sapiens; identical to SEQ ID NO: 45653

SEQ ID NO: 96354 - RNA, 64 nt, Homo Sapiens; identical to SEQ ID NO: 45654

SEQ ID NO: 96355 - RNA, 64 nt, Homo Sapiens; identical to SEQ ID NO: 45655

SEQ ID NO: 96356 - RNA, 64 nt, Homo Sapiens; identical to SEQ ID NO: 83364

SEQ ID NO: 96357 - RNA, 64 nt, Homo Sapiens; identical to SEQ ID NO: 83365

SEQ ID NO: 96358 - RNA, 64 nt, Homo Sapiens
uaaucucugcaguucaucucauuucaaauguuuauggaagaagcacuucauugaaaguagugcu

SEQ ID NO: 96359 - RNA, 64 nt, Homo Sapiens
acuaauucugugagaguugagcucauuuucuaguuggaagaaugugauauuuguuguguuggua

SEQ ID NO: 96360 - RNA, 64 nt, Homo Sapiens
aguaaaacuuuaaugggaggggagggcuggcugcuggaagaaggaagaagccagacugguuaga

SEQ ID NO: 96361 - RNA, 64 nt, Homo Sapiens
uuagagugagagagagaauaaggagccuuucuuauggaagaaaugggagaagagagacaggguu

SEQ ID NO: 96362 - RNA, 64 nt, Homo Sapiens
auuuuaaugaucaacaauuuaaagacaagcacuuuggaagaauuuuaaaguaaagaaaugcaua

SEQ ID NO: 96363 - RNA, 64 nt, Homo Sapiens
uauuaggcuauaaauguccuuuuagcaacuuugauggaagaaaagugguauucuggugaugggg

SEQ ID NO: 96364 - RNA, 64 nt, Homo Sapiens
gccucgggguugcagggcugaguguucuuccucauggaagaagucugccaaagaagggucacaa

SEQ ID NO: 96365 - RNA, 64 nt, Homo Sapiens
ccagcuuguuuuuaaaacuuauguacaaacauacuggaagaaaaaugauuggaggccauggccu

SEQ ID NO: 96366 - RNA, 64 nt, Homo Sapiens
cauuaauaaggaacuuuuaaaaacauaguccaaguggaagaauucaugaacacaccgguaaaua

SEQ ID NO: 96367 - RNA, 64 nt, Homo Sapiens
cauguacaggaauaauaugcgauguuccacaaucuggaagaaauuucuaauguugagacccacu

SEQ ID NO: 96368 - RNA, 64 nt, Homo Sapiens
gcaggggaaagaaaggcaacucgcaaagaugagauggaagaaggcacgugagcagaggaggcag

SEQ ID NO: 96369 - RNA, 64 nt, Homo Sapiens
ugcuugagaaggaaggacaaacacauuauuaucuuggaagaauugcauaaggcuuaugacuuaa

SEQ ID NO: 96370 - RNA, 64 nt, Homo Sapiens
auggaguuaguguaaaaacauggauuacaccaaguggaagaaacgucuucuugccaagcucauu

SEQ ID NO: 96371 - RNA, 64 nt, Homo Sapiens
uuccacuuuggcagugaggucguagccuuuuagguggaagaagugagggugcagcgugucagac

SEQ ID NO: 96372 - RNA, 64 nt, Homo Sapiens
uguggccacugagcggcuccaucugaagguuugauggaagaagggcucuugaaacagaguuaag

SEQ ID NO: 96373 - RNA, 64 nt, Homo Sapiens
uuugcuuccuaaagauuugaauuuuuuguucccauggaagaaguaaagaagaggucacuagaug

SEQ ID NO: 96374 - RNA, 64 nt, Homo Sapiens
caccaaagauuauuacaaaauuaccagaauucauuggaagaaauuuuguucugcauugacucau

SEQ ID NO: 96375 - RNA, 64 nt, Homo Sapiens
gaaagugcuggcucacuuucauuuuaucuguaauuggaagaacaucucuauagaucgucagcuc

SEQ ID NO: 96376 - RNA, 64 nt, Homo Sapiens
cugaauagaagagagaaaucugggucccucucuguggaagaauauuccuugaagguaaugacua

SEQ ID NO: 96377 - RNA, 64 nt, Homo Sapiens
ggaauaguuccacaacaucccuaguggcuacuuauggaagaauaucuugguuucagccgugguc

SEQ ID NO: 96378 - RNA, 64 nt, Homo Sapiens
uagcugcccaagagaaaagaguguauguuuggaguggaagaaaaucgguuuugaaucucaugaa

SEQ ID NO: 96379 - RNA, 64 nt, Homo Sapiens
aacuacuguuuuucagaaggaagaaagaaucaaauggaagaagaaucaaguccaugcccaagcc

SEQ ID NO: 96380 - RNA, 64 nt, Homo Sapiens
auuuaauuuuagcuuuaaaauauuggauuggcuuuggaagaauuauauuagguagaauacacau

SEQ ID NO: 96381 - RNA, 64 nt, Homo Sapiens
cauaagacuaaacaugagaaaaacgcuaacuuauuggaagaaaaucggagaaacguugguguca

SEQ ID NO: 96382 - RNA, 64 nt, Homo Sapiens
ucuggcaggcuuacuuuuaguuuggaaauaaacauggaagaauaccugcuaacccacaaaccug

SEQ ID NO: 96383 - RNA, 64 nt, Homo Sapiens
guucaucucuuaggcuuccaugaaauggaaaacuuggaagaauuaaaaacaccagaaagcuugc

SEQ ID NO: 96384 - RNA, 64 nt, Homo Sapiens
aaauuuaaaaauuaacugggcaugguggcugagguggaagaauggaagaaucacuugagcccag

SEQ ID NO: 96385 - RNA, 64 nt, Homo Sapiens
aaauuaacugggcaugguggcugagguggaagaauggaagaaucacuugagcccaggaguuuga

SEQ ID NO: 96386 - RNA, 64 nt, Homo Sapiens
gaaagggaagcaucuaaaaaauugaacuaggggcuggaagaaguaauccagaaagcauuuaaga

SEQ ID NO: 96387 - RNA, 64 nt, Homo Sapiens
agucaugcuucuuuauuauuugggucacccacucuggaagaaaucuuaggaccauuugagcuug

SEQ ID NO: 96388 - RNA, 64 nt, Homo Sapiens
uggcccagcaaggcaaagaacugaaguuccaggauggaagaaccuguguucuccucauaauagu

SEQ ID NO: 96389 - RNA, 64 nt, Homo Sapiens
gauaggcaagaaggacagcaguaaaugaagaccauggaagaaaagaaggaaugccaaagaucga

SEQ ID NO: 96390 - RNA, 64 nt, Homo Sapiens
uuugagagguuucuuaaucaagagccagguuaaguggaagaaacuuccaaagacccagagucuc

SEQ ID NO: 96391 - RNA, 64 nt, Homo Sapiens
uccuccugcuuauauuguuacuuuuuaagcuucuuggaagaauucucaauuuaaaaauccaaau

SEQ ID NO: 96392 - RNA, 64 nt, Homo Sapiens
gaaagcuguuuccuccugguuccaccucacccuuuggaagaaaggcaggaugugucacuaaugc

SEQ ID NO: 96393 - RNA, 64 nt, Homo Sapiens
uuugguggcaguuguuuguuuuaaacugaccacuuggaagaaacaccuugguuaucugugguuu

SEQ ID NO: 96394 - RNA, 64 nt, Homo Sapiens
acgaugaugauauucagacgaagcauugauguuauggaagaaagaaagaaacaaacaaaauaua

SEQ ID NO: 96395 - RNA, 64 nt, Homo Sapiens
gaagaaguuuuuccuugauugugcuauguuucaguggaagaaauucuuugaaguagaugugagu

SEQ ID NO: 96396 - RNA, 64 nt, Homo Sapiens
aagacaaaucaacuuugaagacacaaaaguuaauuggaagaaauaaaaacugugaacgaagaau

SEQ ID NO: 96397 - RNA, 64 nt, Homo Sapiens
ggaucacauacucagucuauggaagcaacgucccuggaagaagaggcugccuauugaaaagguu

SEQ ID NO: 96398 - RNA, 64 nt, Homo Sapiens
caacauguaugaacuuaaaauauggagaauguuauggaagaaauaguuuauaaguuuguuaagu

SEQ ID NO: 96399 - RNA, 64 nt, Homo Sapiens
ugugacuucugacaugggugucauauucuuuauuuggaagaagugauucaauauggcagauggg

SEQ ID NO: 96400 - RNA, 64 nt, Homo Sapiens
uaaauuuggcgcuacgaucauccagaagaaccaguggaagaauucuguaaaaguuuuaauuccu

SEQ ID NO: 96401 - RNA, 64 nt, Homo Sapiens
gagacacuuucucauuuuuucaauguuucuguauuggaagaagaacuuaaagcuuccuaaucua

SEQ ID NO: 96402 - RNA, 64 nt, Homo Sapiens
aauuuuuaaauguucacucuggcuuaccuguuaauggaagaauuugcauaauaucuacuuagaa

SEQ ID NO: 96403 - RNA, 64 nt, Homo Sapiens
gugcuugggugaucucugcuucauuagucauggguggaagaaaaaccacaccccccgcaccccu

SEQ ID NO: 96404 - RNA, 64 nt, Homo Sapiens
ccuaggagggagaacaaguuccaaaggugccgacuggaagaaggggguaaaaguuugcuuuggu

SEQ ID NO: 96405 - RNA, 64 nt, Homo Sapiens
cauuuuuguguagggagaauaaugucuaguaauguggaagaauagcuaucauuccugucucugu

SEQ ID NO: 96406 - RNA, 64 nt, Homo Sapiens
gauaaacugauacuuuugguucguauguacauacuggaagaaucuucauaauaaaugagacuac

SEQ ID NO: 96407 - RNA, 64 nt, Homo Sapiens
cagagacuuugguuccccacgcagcccuggggcuuggaagaagcacaugaccguacucugcgug

SEQ ID NO: 96408 - RNA, 64 nt, Homo Sapiens
ggcaucuuaggacuggaggggcuccuuggaaaacuggaagaagucucaacacuguuucuuuuuc

SEQ ID NO: 96409 - RNA, 64 nt, Homo Sapiens
uaaucaagaagagcaaagcaaagaggaacgggcuuggaagaaaauugguuucagaugaugaaga

SEQ ID NO: 96410 - RNA, 64 nt, Homo Sapiens
ugaacuugaugcucaguauuaacaagcauagaaauggaagaaaggaaguuaaccacagucggga

SEQ ID NO: 96411 - RNA, 64 nt, Homo Sapiens
cccaauaguacuuauaauauaaaagaaugaucuauggaagaaaagaaaucaagucaguuuuuuu

SEQ ID NO: 96412 - RNA, 64 nt, Homo Sapiens
cacagcuuucuuaggcuuuacucagccuuuuguguggaagaaguacuaguuuugagcuuuagac

SEQ ID NO: 96413 - RNA, 64 nt, Homo Sapiens
auugggaaggaaucauuguuccaggcauccaucuuggaagaaaggaccagcuuugagcuccauc

SEQ ID NO: 96414 - RNA, 64 nt, Homo Sapiens
ucucuuaaauacacguaggugggccagagaacauuggaagaaucaagagagauuagaauaucug

SEQ ID NO: 96415 - RNA, 64 nt, Homo Sapiens
uucuaaaacucuaccgagugaugcuucacuuacauggaagaaaccaaguccugagugacucaag

SEQ ID NO: 96416 - RNA, 64 nt, Homo Sapiens
aguucacugaaaacuuaucugacaccuucccggguggaagaaggagacugugaagaggcugaaa

SEQ ID NO: 96417 - RNA, 64 nt, Homo Sapiens
gccugauccgcaucaaggugcugggaucaacuccuggaagaaacccugaaacacgucuaccugu

SEQ ID NO: 96418 - RNA, 64 nt, Homo Sapiens
uuugcugguagaagucagucggagcagagaaaacuggaagaagaggugagacccucucccaaga

SEQ ID NO: 96419 - RNA, 64 nt, Homo Sapiens
acugagcaguuucuguguauauauagaagguagaaaugaaaagugagaaaauauuugaaaggga

SEQ ID NO: 96420 - RNA, 64 nt, Homo Sapiens
aucagaaaauauaauaaaauugcacaaaaaaaaaaaugaaaaagaugcagacuggucuuuuaga

SEQ ID NO: 96421 - RNA, 64 nt, Homo Sapiens
agaugacuugugaaccccacaguguggaugugcaaaugaaaauugaaggaaagaauaugaacug

SEQ ID NO: 96422 - RNA, 64 nt, Homo Sapiens
uuuuaacaaauaaaaggcauuuaaguaaaacuaaaaugaaaaaaguaggccuucugacauugug

SEQ ID NO: 96423 - RNA, 64 nt, Homo Sapiens
ccaugaaccugggcuaaugggagacuguagagaaaaugaaaaaagauccaccagaggacaucuu

SEQ ID NO: 96424 - RNA, 64 nt, Homo Sapiens
auguugcuacucccauggcaaagaaaaaaaaaagaaugaaaaaaagaaaaaaauuuggaaaaaa

SEQ ID NO: 96425 - RNA, 64 nt, Homo Sapiens
aaagaaaaaucaugucaucuucuauuuguacagaaaugaaaauaaaauaugaaaauaaugaaag

SEQ ID NO: 96426 - RNA, 64 nt, Homo Sapiens
agaaaugaaaauaaaauaugaaaauaaugaaagaaaugaaaagauagcuuuuaauugugguaua

SEQ ID NO: 96427 - RNA, 52 nt, Homo Sapiens
agauaagcaugaaaacuugaacaaugaaaagcagaaugaaaaugagucauug

SEQ ID NO: 96428 - RNA, 64 nt, Homo Sapiens
agauaagcaugaaaacuugaacaaugaaaagcagaaugaaaaugagucauugcaacgacuuuca

SEQ ID NO: 96429 - RNA, 64 nt, Homo Sapiens
auaaaaugauucaguguuucuuuucuauauugucaaugaaaaccuugaguucuaauaauccaug

SEQ ID NO: 96430 - RNA, 64 nt, Homo Sapiens
uuggaaaauagaguaauuuaaaaaauauauuugaaaugaaaaucuccaacacauuagaagauga

SEQ ID NO: 96431 - RNA, 64 nt, Homo Sapiens
gguuuaacuagcaaaagccuaaacaaaaugauccaaugaaaacuuuggucaaaacacacauaga

SEQ ID NO: 96432 - RNA, 64 nt, Homo Sapiens
gguuuuguaugacuugaauaucaguuugaaagacaaugaaaaaucgugcugaauaggauucuuc

SEQ ID NO: 96433 - RNA, 64 nt, Homo Sapiens
cccuucacuucugccugcacggcacugugcaaacaaugaaaagcuaacugugaguggcugcaca

SEQ ID NO: 96434 - RNA, 53 nt, Homo Sapiens
uacgagaacguccuacucaugagaaugaaaagucuaaggaugaagaaaguuaa

SEQ ID NO: 96435 - RNA, 64 nt, Homo Sapiens
cauuaguuaauuacugcuuuauuggggaaagaaaaaugaaaauuuauaauuaucccuuuuuaau

SEQ ID NO: 96436 - RNA, 64 nt, Homo Sapiens
auuuucgugacaagugagcucaauuuuuuuuaauaaugaaaaaucagaagaaauaacuuuauaa

SEQ ID NO: 96437 - RNA, 64 nt, Homo Sapiens
gcccuuuaucaauacagugcauucuuucccugguaaugaaaagaggaggaaggaaggacauuaa

SEQ ID NO: 96438 - RNA, 64 nt, Homo Sapiens
cuguuccauuuaaaguacauguuggcuuuucuuaaaugaaaacaauuuugauguuuuuuugcca

SEQ ID NO: 96439 - RNA, 64 nt, Homo Sapiens
aaaauccucuuguuggaaacggagauaauucuagaaugaaaaagauaucugaucaaguuaucaa

SEQ ID NO: 96440 - RNA, 64 nt, Homo Sapiens
ccacuuguggcacacgauggcgggugcuuuacauaaugaaaaaaaacaaauucuuuuaauucaa

SEQ ID NO: 96441 - RNA, 64 nt, Homo Sapiens
uccugggagccaggaagacuccgcagugggugagaaugaaaacuugagacucccaaguucuggg

SEQ ID NO: 96442 - RNA, 64 nt, Homo Sapiens
ggagaaaggaccacauugcuuacuugaaacagacaaugaaaacaaccaaagugauauauaaaau

SEQ ID NO: 96443 - RNA, 64 nt, Homo Sapiens
aaauuguggagcaaaauaguaaauaaaauauaaaaaugaaaaugaagauacgugaaauucaaau

SEQ ID NO: 96444 - RNA, 64 nt, Homo Sapiens
augagaugagcagaucaaauauuccccgugaguuaaugaaaacugauucaaccaaauggcgaag

SEQ ID NO: 96445 - RNA, 64 nt, Homo Sapiens
ggcuuaggacucugugccaaaaaucucuauuuuaaaugaaaauauuuauauaaaaauacauuua

SEQ ID NO: 96446 - RNA, 64 nt, Homo Sapiens
ugguuguaacaaaauuugauuugaacuaccuauaaaugaaaagucgggguuuauuacuuuauau

SEQ ID NO: 96447 - RNA, 64 nt, Homo Sapiens
uauuuaaaugcugcuggcuauuccuuuguauauaaaugaaaaauaccauucauuaaaauuaagu

SEQ ID NO: 96448 - RNA, 64 nt, Homo Sapiens
agacucugucucaaaaaaaaaaaaaaaaaagaugaaugaaaauaugaaauauauaaacuaguau

SEQ ID NO: 96449 - RNA, 64 nt, Homo Sapiens
aaauauuuaauuuguuuuauaaagguagugaaaaaaugaaaauuugcuauuuauuaaaaaacau

SEQ ID NO: 96450 - RNA, 64 nt, Homo Sapiens
gguucaucacauuauaagauaaauaaauuaaauuaaugaaaaugugacuuagaguagggguagc

SEQ ID NO: 96451 - RNA, 64 nt, Homo Sapiens
gugugaauaacauuguaugauguauaaauuagaaaaugaaaaaucuucacuucuuuguauauua

SEQ ID NO: 96452 - RNA, 64 nt, Homo Sapiens
uaagucacuuauuaacuuuuaauuaagugcacuaaaugaaaaguaaaaucauggugacacuucc

SEQ ID NO: 96453 - RNA, 64 nt, Homo Sapiens
ccuuaaaaggaaugcauaugugagauauuuggacaaugaaaaugauaaaccuugauguacaugu

SEQ ID NO: 96454 - RNA, 64 nt, Homo Sapiens
auacuguaccaaaucuggaagguuuaugucaggaaaugaaaaagacagccugugcugucuuaau

SEQ ID NO: 96455 - RNA, 64 nt, Homo Sapiens
gaaagccuccuuuuauccuaugguacagaaagagaaugaaaaauuuaaaacaaaaauaaguuaa

SEQ ID NO: 96456 - RNA, 64 nt, Homo Sapiens
uuaaauauuugguuucaaaauauugaaacaauuuaaugaaaauauuggcauuugccugaaguug

SEQ ID NO: 96457 - RNA, 64 nt, Homo Sapiens
guauauuuaaccuuuucuggcauuuucugaaaacaaugaaaagauuacaaauuggaccuuuaua

SEQ ID NO: 96458 - RNA, 64 nt, Homo Sapiens
cagaucuuuccuuuuuggcauuauuuuguuuuuuaaugaaaaccguuugcgcuuuuaauuguuu

SEQ ID NO: 96459 - RNA, 64 nt, Homo Sapiens
uucuggagaucaguugugcauuucaguuuugcaaaaugaaaaagguucuuuaaugggugaagag

SEQ ID NO: 96460 - RNA, 64 nt, Homo Sapiens
auuuuaaaaauguaaaaccuugcaaauaagcaaaaaugaaaacaaugauagaaaauuuggaaag

SEQ ID NO: 96461 - RNA, 64 nt, Homo Sapiens
accagagaucagaaauucaaaaacucagaauaaaaaugaaaaagcuacaagcauauaugagaag

SEQ ID NO: 96462 - RNA, 64 nt, Homo Sapiens
aaucuucacagauaugaauacuaaauuauaucuuaaugaaaauagauauggucacaaguacauu

SEQ ID NO: 96463 - RNA, 64 nt, Homo Sapiens
guuuguucuaagucacucugagaggagugauaccaaugaaaaaaggucaguugauuccagugcu

SEQ ID NO: 96464 - RNA, 64 nt, Homo Sapiens
uaaaacagaaccuuuaagagcaaccauggcacaaaaugaaaauguaguaguacaaccaguugua

SEQ ID NO: 96465 - RNA, 64 nt, Homo Sapiens
aaaaucauuguaaaguaucaagacaauacgaguaaaugaaaaggcuguuaaaguagaugacauc

SEQ ID NO: 96466 - RNA, 64 nt, Homo Sapiens
uagaugaccaagcaaaaagacuuuaaaaaaugguaaugaaaauggaaugcagcuacugcagcua

SEQ ID NO: 96467 - RNA, 64 nt, Homo Sapiens
gaaauuacugucaccacuaguuuuaauauaguacaaugaaaaaauaauauauauauauauagua

SEQ ID NO: 96468 - RNA, 64 nt, Homo Sapiens
aaaaaauaaaagaaacauaagauaaguaccucucaaugaaaaauguaaaaguaccuagaaauuc

SEQ ID NO: 96469 - RNA, 64 nt, Homo Sapiens
caucuuuagagaccauuggcccacugaugaauggaaugaaaaagcgagcagauacuguuggucu

SEQ ID NO: 96470 - RNA, 64 nt, Homo Sapiens
cacauuaguauguauaacuggcuuuaccaaauugaaugaaaaggagcuugugcaaaaaaauuua

SEQ ID NO: 96471 - RNA, 64 nt, Homo Sapiens
gcauccuucuguuguuuauuuuaaauauauuuuuaaugaaaagggacuuaaaaaguaaacauga

SEQ ID NO: 96472 - RNA, 64 nt, Homo Sapiens
cucucuuuccuucaaauaacauaagucugaaagcaaugaaaacgucaaaggaaaauguuuauau

SEQ ID NO: 96473 - RNA, 64 nt, Homo Sapiens
aaagacugggauuaaucucuguugcauuuauuguaaugaaaaagacugaucaaugccccugcag

SEQ ID NO: 96474 - RNA, 64 nt, Homo Sapiens
aaggugucagcagagcugugaauggaugucccugaaugaaaaucccuggggaucagaauuccaa

SEQ ID NO: 96475 - RNA, 64 nt, Homo Sapiens
gguuggaaacuaaagguucaccgggucugcagagaaugaaaacuaguuuuuauaaaaagaaagc

SEQ ID NO: 96476 - RNA, 64 nt, Homo Sapiens
cacaugcuuuuauccgugacacaucccagagaagaaugaaaagguagagcguguugcuguugua

SEQ ID NO: 96477 - RNA, 64 nt, Homo Sapiens
uccuguuauuuucuuagggauuggcuugaacauaaaugaaaauagauuuuuuuguuuggggagg

SEQ ID NO: 96478 - RNA, 64 nt, Homo Sapiens
ugcacaucugcucuguuuugguuuuucuacaggaaaugaaaaucaacuuguuuuuuuaauauga

SEQ ID NO: 96479 - RNA, 64 nt, Homo Sapiens
ucuagauucacaaauuuaaauaaauuacucaaaaaaugaaaauugauuuuguaaacuuuuauuu

SEQ ID NO: 96480 - RNA, 64 nt, Homo Sapiens
gcugaugauuuugcaaaaugaguugugaugaaucaaugaaaaauguaauuuagaaacugauuuc

SEQ ID NO: 96481 - RNA, 64 nt, Homo Sapiens
ucagaauuagauggcuuauuuuuuaaaauauuugaaugaaaacauuuuauuuuuaaaauauuac

SEQ ID NO: 96482 - RNA, 64 nt, Homo Sapiens
auagcuaauguuuuuuccucugcucuuuaaugaaaaugaaaauuugauuauucucagagggugc

SEQ ID NO: 96483 - RNA, 64 nt, Homo Sapiens
aaaauuauagcuaauguuuugggugcugcucuuuaaugaaaaugucaguuugauuauucucaga

SEQ ID NO: 96484 - RNA, 64 nt, Homo Sapiens
gaacauuucaaucaaacauuuauaagcuuggugaaaugaaaaugaguuuguauaaacagguugc

SEQ ID NO: 96485 - RNA, 64 nt, Homo Sapiens
uggagcauuguuaauuuacaauugcuaaacaagaaaugaaaacacaauagguucuaaaaauaaa

SEQ ID NO: 96486 - RNA, 64 nt, Homo Sapiens
cacaaaugcaagacuguucuagagcuguaaggaaaaugaaaagccaggcuuuuuaaauaaaauu

SEQ ID NO: 96487 - RNA, 64 nt, Homo Sapiens
guuggagaaauauuuaaacaucauaauguaauucaaugaaaacuuggcuugaagccuaguguuu

SEQ ID NO: 96488 - RNA, 64 nt, Homo Sapiens
cacuuuccugcuuuccauugcaauuauuagagugaaugaaaaacuucucuagcuuaucccugca

SEQ ID NO: 96489 - RNA, 64 nt, Homo Sapiens
aauuuaagaggacagaagacuguaauauaaucagaaugaaaaauaccuccacagcucauuucuu

SEQ ID NO: 96490 - RNA, 64 nt, Homo Sapiens
ccuuuuguagcagucuguaacuuaacuauaguauaaugaaaagaaugaccuauaauauaggugu

SEQ ID NO: 96491 - RNA, 64 nt, Homo Sapiens
uuuggguauccuguaauuuaguuguaacauagaaaaugaaaaaacaguuaaaaaaagugaagua

SEQ ID NO: 96492 - RNA, 64 nt, Homo Sapiens
aauuuaagaaauagucuauguaaagucacaaauuaaugaaaaaaauucgcaugaaaaugacaga

SEQ ID NO: 96493 - RNA, 64 nt, Homo Sapiens
ucauuguaacacuugauggacugcuuguaaugaaaaugaaaaaacuuguccuacauucauucuc

SEQ ID NO: 96494 - RNA, 64 nt, Homo Sapiens
aaaaaaucauuguaacacuuauucuccugcuuguaaugaaaaugcuaacacuuguccuacauuc

SEQ ID NO: 96495 - RNA, 64 nt, Homo Sapiens
gguacuuguuuauauuaauaacagcaagacuuagaaugaaaaagccuggucaucaaaagacucg

SEQ ID NO: 96496 - RNA, 64 nt, Homo Sapiens
aguacauguauguguugugacauguuccucugucaaugaaaaaaaauaaaauauuuuugaaagg

SEQ ID NO: 96497 - RNA, 64 nt, Homo Sapiens
cauuacuuuuccauucccaacaauaaagaguuagaaugaaaacuuuagauuggcccggaaaggc

SEQ ID NO: 96498 - RNA, 64 nt, Homo Sapiens
augacauugaaacauuuguaauaacaaguugucaaaugaaaagauuauaugacaaaugaaaaga

SEQ ID NO: 96499 - RNA, 64 nt, Homo Sapiens
auaacaaguugucaaaugaauugcuuauaugacaaaugaaaagauuuuuaguuaugagaaaucu

SEQ ID NO: 96500 - RNA, 64 nt, Homo Sapiens
agcagacauucucuguagaagguaauggucugagaaugaaaagguguuugauggacauguugug

SEQ ID NO: 96501 - RNA, 64 nt, Homo Sapiens
uucucaggacccuugcccccacccccauuuuuuuaaugaaaaaaaaaaacaaaaaaaacggauc

SEQ ID NO: 96502 - RNA, 64 nt, Homo Sapiens
gaaauagaucuggugcacccgaacauuaggagaaaaugaaaaauauacaaccaaccguucguga

SEQ ID NO: 96503 - RNA, 64 nt, Homo Sapiens
ugcaagggucaaaacuagauuggaucuugguuugaaugaaaaaaagcauaaaauauucuugcaa

SEQ ID NO: 96504 - RNA, 64 nt, Homo Sapiens
gaaaaauguuugaauaugaucuuuagggacuucuaaugaaaaggguauaugaaaugggaacaau

SEQ ID NO: 96505 - RNA, 64 nt, Homo Sapiens
auuauccauuuccuaugcguuuuacuccucagagaaugaaaaaaacugcaucccaucacccaaa

SEQ ID NO: 96506 - RNA, 64 nt, Homo Sapiens
agaaaaugguuaccaguacagucaaaaaagagaaaaugaaaaaaauacaacuaaaaggaagaaa

SEQ ID NO: 96507 - RNA, 64 nt, Homo Sapiens
auguaacaguguuaguauuugaauaugcccugagaaugaaaagaaggacaguacaucucuagua

SEQ ID NO: 96508 - RNA, 64 nt, Homo Sapiens
cuuaucuuuaggagaaaggauaaacaugauacauaaugaaaaugguguguucaugccuauacga

SEQ ID NO: 96509 - RNA, 64 nt, Homo Sapiens
ucagcuuacugguuuguaguauuuauagacucaaaaugaaaacacaaaaccaccacaaaauuag

SEQ ID NO: 96510 - RNA, 64 nt, Homo Sapiens
ggcauggcccaauugauauaaacauuuagaaggaaaugaaaagcuaaaauaggaaguaauuauu

SEQ ID NO: 96511 - RNA, 64 nt, Homo Sapiens
aguuaccaggagaaaugugugacaccuauauuauaaugaaaacaaucucauuacuuauaguuua

SEQ ID NO: 96512 - RNA, 64 nt, Homo Sapiens
ucaucaguagaaucuauuuuggucacuucuagucaaugaaaaauguaaacuuuuaggagagaau

SEQ ID NO: 96513 - RNA, 64 nt, Homo Sapiens
aauaugggaucccguguguguguguguguguuugaaugaaaaaugcuuauguauugacagaaca

SEQ ID NO: 96514 - RNA, 64 nt, Homo Sapiens
gugaacauguagauguuuuguguguauuuuuuuaaaugaaaacucaaaauaagacaaguaauuu

SEQ ID NO: 96515 - RNA, 64 nt, Homo Sapiens
uguuuuauguuaagcaaaacauacuuuagaaacaaaugaaaaaggcaauugaaaaucccagcua

SEQ ID NO: 96516 - RNA, 64 nt, Homo Sapiens
caguuuguguagacaaucuuacugagcaaaaggcaaugaaaagucuugguucccacacugcgau

SEQ ID NO: 96517 - RNA, 64 nt, Homo Sapiens
aacuuuggaaugacccccuuauauauuuucugaaaaugaaaacaguuacaugaaaaaaauuucc

SEQ ID NO: 96518 - RNA, 64 nt, Homo Sapiens
caaaaagcaaaccaaaagaacccaugucuacaaaaaugaaaaacugggcaacauagcaacaccc

SEQ ID NO: 96519 - RNA, 64 nt, Homo Sapiens
uccgcuauauugugauuuggcaggggccauggaaaaugaaaaagagagaugacaaaacuaaguu

SEQ ID NO: 96520 - RNA, 64 nt, Homo Sapiens
aaaaacccuuagaccuguagauauuucuacuaaaaaugaaaaaauuugugcaccugcuuuuuaa

SEQ ID NO: 96521 - RNA, 64 nt, Homo Sapiens
cauuccccugaaauauuuaguuuagaaaacucagaaugaaaauuaucauuuuucuuuuuucuuu

SEQ ID NO: 96522 - RNA, 64 nt, Homo Sapiens
agagauacauaaaugugugaacagauauauauuuaaugaaaagaagucuaacauuuuuugccaa

SEQ ID NO: 96523 - RNA, 64 nt, Homo Sapiens
cacccacgccuuggaaccguuaacaggagagaggaaugaaaacaccaaaacuggaacaccuagc

SEQ ID NO: 96524 - RNA, 64 nt, Homo Sapiens
cucuccauuaccuucugcuuucacuaaauaagcaaaugaaaacugagugauuuuccucuguuuu

SEQ ID NO: 96525 - RNA, 64 nt, Homo Sapiens
aauaagucacauugguuccauuuuuagggaaaaaaaugaaaaagcaguccuuuauccaccugga

SEQ ID NO: 96526 - RNA, 64 nt, Homo Sapiens
aaaaguauaguuaaugguuuauuugccuuaaaauaaugaaaaagaccacugacuauuuuaucaa

SEQ ID NO: 96527 - RNA, 64 nt, Homo Sapiens
uagucacuuccucacauggaccuuuauagugugaaaugaaaaauucuguuuugccuuuucacgc

SEQ ID NO: 96528 - RNA, 64 nt, Homo Sapiens
acauuggagauguuuaguaaacauguuucuuuguaaugaaaaccuuaugaagcuuuuaugugaa

SEQ ID NO: 96529 - RNA, 64 nt, Homo Sapiens
uauauaucaaauauauucagaaaacacugggagaaaugaaaaaagugcauauuuauaaaaauaa

SEQ ID NO: 96530 - RNA, 64 nt, Homo Sapiens
uacauauauuuuuggaaaaguguuaauuguguggaaugaaaaaauagauuaaauuggagaaacg

SEQ ID NO: 96531 - RNA, 64 nt, Homo Sapiens
acuuuccccuuuguguuuugaugucauuuuuuugaaugaaaaauuuguguugugugacauucaa

SEQ ID NO: 96532 - RNA, 64 nt, Homo Sapiens
gcugacguauuacaaaacaggaaaaaagaauaagaaugaaaacugaaaaaaugaaaaaaagaag

SEQ ID NO: 96533 - RNA, 64 nt, Homo Sapiens
agaaggaaaaaagaauaagacauugcaaugaaaaaaugaaaaaaacauaacucugguguguuaa

SEQ ID NO: 96534 - RNA, 64 nt, Homo Sapiens
ugaaaaaaagaaggaaaaaauguguuaacauugcaaugaaaaaagaaaaaucacauaacucugg

SEQ ID NO: 96535 - RNA, 64 nt, Homo Sapiens
aguguuaggguaaagacaaagugggggacacuagaaugaaaaccaggaaaaugaaacuagacgg

SEQ ID NO: 96536 - RNA, 64 nt, Homo Sapiens
agaugaauuucauuauguaaaagaagaaauuuauaaugaaaagacuuauuaaggagaaauagaa

SEQ ID NO: 96537 - RNA, 64 nt, Homo Sapiens
ugugaaauucacaaaaaguaaaccaaacaaaacgaaugaaaaacuggaaauaauucguuuccau

SEQ ID NO: 96538 - RNA, 64 nt, Homo Sapiens
acugguagguaagcaugaguuaaggaaagucaaaaaugaaaauauauuuugcuguguauaaauu

SEQ ID NO: 96539 - RNA, 64 nt, Homo Sapiens
uguaaugugaugaagaaagagaucuuucuuuuuuaaugaaaacauuaauguguuaauacccugu

SEQ ID NO: 96540 - RNA, 64 nt, Homo Sapiens
uaaagaaagaaaaaaagauuuuuuuauuuguauuaaugaaaagcuuuaguuuaaaauaaggaga

SEQ ID NO: 96541 - RNA, 64 nt, Homo Sapiens
ggucugcagucuggaagcuugucugcucuauagaaaugaaaaugcagcaugaaguugacauugu

SEQ ID NO: 96542 - RNA, 64 nt, Homo Sapiens
gagaaacugguauguuuccucaggacaucaaguuaaugaaaaugagaaugagaaacugcaucaa

SEQ ID NO: 96543 - RNA, 64 nt, Homo Sapiens
ugaaaucagaagaacaaaaaaaaaugaugcuuuaaaugaaaaauaaucaaugaucugaagagug

SEQ ID NO: 96544 - RNA, 64 nt, Homo Sapiens
aauacaacuuuaccauaaagcacaucuccagaaaaaugaaaagcccuggugggaggagagaggg

SEQ ID NO: 96545 - RNA, 64 nt, Homo Sapiens
aaaaagcuaacaucuuuacgaucuucuugcaucuaaugaaaaaccaaccagacuuugagccugc

SEQ ID NO: 96546 - RNA, 64 nt, Homo Sapiens
aauacucaacaguaauuccacuguuaccugcacaaaugaaaaacgauguauuccacuguuauua

SEQ ID NO: 96547 - RNA, 64 nt, Homo Sapiens
uuuguagauaccauauccccuacaaacacauccaaaugaaaaauguagauuuguacuuagcaaa

SEQ ID NO: 96548 - RNA, 64 nt, Homo Sapiens
agaguaaacuuuuccuaaaacacuuuauauuauaaaugaaaauaaauugcuaguuuauauuuua

SEQ ID NO: 96549 - RNA, 64 nt, Homo Sapiens
uucaucuacauguaauguguuauuaauuuuauuaaaugaaaacuaaucaccuucauguggaaau

SEQ ID NO: 96550 - RNA, 64 nt, Homo Sapiens
gguggugaccuuauagaacauaaauauugugaauaaugaaaauccacugaaucuaauaagggac

SEQ ID NO: 96551 - RNA, 64 nt, Homo Sapiens
cagcaauucuacucauagguauauacuuaaaagaaaugaaaaauccacacaaaaaccucugcau

SEQ ID NO: 96552 - RNA, 64 nt, Homo Sapiens
gcaaagaaaaaaauauucugggucaguaaaacuuaaugaaaaaaguucuuuuuuccaccuuuuu

SEQ ID NO: 96553 - RNA, 64 nt, Homo Sapiens
agacguagaaaaauguuuaguagcuguuuuaacaaaugaaaaaauucugaaaauguauuuaaca

SEQ ID NO: 96554 - RNA, 64 nt, Homo Sapiens
gggcauucaggaaagcaccuagccucacuuguggaaugaaaaugaaaaugaaaaggacccagca

SEQ ID NO: 96555 - RNA, 64 nt, Homo Sapiens
acccagcaagccucacuuguucaacaacuaacaaaaugaaaaggaggaguuugucgucuuggac

SEQ ID NO: 96556 - RNA, 64 nt, Homo Sapiens
uggaguuguauuuugacaaagaauuaaucuagaaaaugaaaagauguauuauuucuggcuuuuu

SEQ ID NO: 96557 - RNA, 64 nt, Homo Sapiens
aaauuccauuacaggggcagaugcaauucaaugcaaugaaaacauacugauacuauucaaugca

SEQ ID NO: 96558 - RNA, 64 nt, Homo Sapiens
gagaaaauguugaccuuuuacuuccuuuuacaaaaaugaaaauaauaaacauguuuucguauaa

SEQ ID NO: 96559 - RNA, 64 nt, Homo Sapiens
agauguuggaacauuaagaaaaauguauauucccaaugaaaaaauaguuauaucaucuuauagu

SEQ ID NO: 96560 - RNA, 64 nt, Homo Sapiens
uuuaugguccuaaaagcaaaauaaaaacuauucgaaugaaaagacaagaaaaucagguauuaau

SEQ ID NO: 96561 - RNA, 64 nt, Homo Sapiens
ucagaacuugcuacguuucaggugcuagggacuuaaugaaaaacaggacaaaacaauuccuuuu

SEQ ID NO: 96562 - RNA, 64 nt, Homo Sapiens
uacagcauuuucaacauauuggcaacauauuuuaaaugaaaacacuaaaacaauucuuaguaug

SEQ ID NO: 96563 - RNA, 64 nt, Homo Sapiens
auuaacauaaaauaucaaacacacaaagucauaaaaugaaaauuuacaguuuuaccuguucaua

SEQ ID NO: 96564 - RNA, 64 nt, Homo Sapiens
uguauaugcacuuauaauuuuuugaagucauaccaaugaaaaaaugagaaacaacaauuucuac

SEQ ID NO: 96565 - RNA, 64 nt, Homo Sapiens
ucuuguguuaccugaaaacaugcaccaagcaggaaaugaaaaugcaaagcuuucauguaaacug

SEQ ID NO: 96566 - RNA, 64 nt, Homo Sapiens
uuggaaauuguuugcccugaauccuucuguacaaaaugaaaagucccaugagcuguaguuauuc

SEQ ID NO: 96567 - RNA, 64 nt, Homo Sapiens
gaagcacuuuagugguaguaaguaguuuugacacaaugaaaauguuccucugccauccuugcua

SEQ ID NO: 96568 - RNA, 64 nt, Homo Sapiens
agugucccauuuuuaauaacuacaagauaccaaaaaugaaaaaaaagaggauggaaaaacugaa

SEQ ID NO: 96569 - RNA, 64 nt, Homo Sapiens
cuaguucagugaucagcauuugucaggauaaucaaaugaaaauaaugggcucaauuauuauguu

SEQ ID NO: 96570 - RNA, 64 nt, Homo Sapiens
aaaaauaaagcaaaugguaaauugaccugggaaaaaugaaaaaauuuguuaauguugcugccuc

SEQ ID NO: 96571 - RNA, 64 nt, Homo Sapiens
ucuuaggauuaucuguggagauuaggcuaaauguaaugaaaaccuagaaugccagaucuuccag

SEQ ID NO: 96572 - RNA, 64 nt, Homo Sapiens
gcaagcauaucaaccaggcaagucuugcuguaaaaaugaaaacaaaacaaacccaugagguuac

SEQ ID NO: 96573 - RNA, 64 nt, Homo Sapiens
gugauguaaugugaucacagcuuuuguuguguugaaugaaaauauguggacugucauuuuguug

SEQ ID NO: 96574 - RNA, 64 nt, Homo Sapiens
ugaacuucuaaagcaagaggauaaaagaagcaugaaugaaaagaaugacauuucaaaaaaaugg

SEQ ID NO: 96575 - RNA, 64 nt, Homo Sapiens
gaaugaaaagaaugacauuucaaaaaaaugguucaaugaaaaacuauagcuaaaauauguaaac

SEQ ID NO: 96576 - RNA, 64 nt, Homo Sapiens
auaaaauagguguugccuauugcugugcuuauaaaaugaaaaaggaaauugaggacacuuuugc

SEQ ID NO: 96577 - RNA, 64 nt, Homo Sapiens
aacugcucaacaggaaaugaaccuagaaacagaaaaugaaaagguugauugaaauaaaacuuga

SEQ ID NO: 96578 - RNA, 64 nt, Homo Sapiens
uucagaggaagacaucuguauuugggagagcaggaaugaaaacacugcauuugcucuuggaggc

SEQ ID NO: 96579 - RNA, 64 nt, Homo Sapiens
uaugucaguauuuuaauaugcauuucuauuucauaaugaaaaacaaaauaaagcuaccauuuua

SEQ ID NO: 96580 - RNA, 64 nt, Homo Sapiens
uuacaagcuaagaguuuacacaagauacaggaaaaaugaaaauguaauggcacugagaaacaug

SEQ ID NO: 96581 - RNA, 64 nt, Homo Sapiens
aaauagaaacugagccauugccaaaugguaaagaaaugaaaaguuuucacagugacuacugaau

SEQ ID NO: 96582 - RNA, 64 nt, Homo Sapiens
uaacuuguuuaaguguaagaaauaccauuucaggaaugaaaaagaaggaauacuacuuucuaag

SEQ ID NO: 96583 - RNA, 64 nt, Homo Sapiens
auaaaacacaggaaaggggaauucugugauggcaaaugaaaaaaauguuaacauuugguagaca

SEQ ID NO: 96584 - RNA, 64 nt, Homo Sapiens
guauuauuuuuuucuuaacagaaauauuuuuaaaaaugaaaaaguacucaaaagugagaagagu

SEQ ID NO: 96585 - RNA, 64 nt, Homo Sapiens
gauuuccauucaguguagggaagacauuuguaauaaugaaaacugaaaauggaguaauugugag

SEQ ID NO: 96586 - RNA, 64 nt, Homo Sapiens
auaauauagcaguaguuauacagagaaauacuacaaugaaaacauuuggggcaauuagaccuac

SEQ ID NO: 96587 - RNA, 64 nt, Homo Sapiens
auuacuuugaaacuuggcuucaaucccaguuagaaaugaaaauagcaugucaacccuuccauuu

SEQ ID NO: 96588 - RNA, 64 nt, Homo Sapiens
uguaccaugaauuaggagcaagagaaaaugauguaaugaaaaauuuuuacccaaaauaauuuuu

SEQ ID NO: 96589 - RNA, 64 nt, Homo Sapiens
ggcuuacauuuuaaauguuauaugacuaauguaaaaugaaaagauacaaagauucaaaugcuuu

SEQ ID NO: 96590 - RNA, 64 nt, Homo Sapiens
agaugucauuuccuaauuuuauaauuacaugccuaaugaaaagaaagucaacacauaguguaaa

SEQ ID NO: 96591 - RNA, 64 nt, Homo Sapiens
auuauuuuucuuauacuuauuuuuuauuaaacaaaaugaaaaagauccuuuucaaaaaggugau

SEQ ID NO: 96592 - RNA, 64 nt, Homo Sapiens
gaaaggagggaaaauaauagcccagugagagcugaaugaaaagggacugaauuuaaauauuugu

SEQ ID NO: 96593 - RNA, 64 nt, Homo Sapiens
auuuuuguaauguuuggucuuaaaggcuuaaauaaaugaaaaugauuaaaugaauauuuuauuu

SEQ ID NO: 96594 - RNA, 64 nt, Homo Sapiens
ucuuuaacaccaaaacugaauagggaacaccgagaaugaaaacauucucagacuaaaccugaca

SEQ ID NO: 96595 - RNA, 64 nt, Homo Sapiens
caaauugaaucuuuuacuuaccucuugcaaaaaaaaugaaaaaugaaaaaacaaauucaaaacc

SEQ ID NO: 96596 - RNA, 64 nt, Homo Sapiens
aaucuuuuacuuaccucuugcaaaaaaaaugaaaaaugaaaaaacaaauucaaaaccuauucaa

SEQ ID NO: 96597 - RNA, 64 nt, Homo Sapiens
aaaacaaaaacaauucaggaaguugauaucguugaaugaaaagccucaagugacacaaguuaca

SEQ ID NO: 96598 - RNA, 64 nt, Homo Sapiens
cuuuuuaaaaaaguaaaacaaacuuuuuuuuugaaaugaaaagagucucuugagacaaaugcaa

SEQ ID NO: 96599 - RNA, 64 nt, Homo Sapiens
ggauaauuuccacuguguggaaugugaauaguuaaaugaaaaguuaugguuauuuaauguaauu

SEQ ID NO: 96600 - RNA, 64 nt, Homo Sapiens
ucacacauaaaguccuuuuaaggagaaaaucuaaaaugaaaaguggauaaacagaacauuuaua

SEQ ID NO: 96601 - RNA, 64 nt, Homo Sapiens
gauugggacaauagagacugccauaaauaacaugaaugaaaaaaccaaucugguuuucuuuuac

SEQ ID NO: 96602 - RNA, 64 nt, Homo Sapiens
ccaggagcugguacacuacauagagucagaccagaaugaaaaugaaacaugaaaugguuuuagc

SEQ ID NO: 96603 - RNA, 64 nt, Homo Sapiens
aaugcccaaaaauaagucuugguuuauggagauuaaugaaaauggaaauguuagguuacuguau

SEQ ID NO: 96604 - RNA, 64 nt, Homo Sapiens
gauaaugcaaaaauuauguaucauuuagauguauaaugaaaaagcuuuuaucaguagaaugauu

SEQ ID NO: 96605 - RNA, 64 nt, Homo Sapiens
aauacauauaugcagugcuuguuguccaaauagaaaugaaaauaaguggaagagagaggaagaa

SEQ ID NO: 96606 - RNA, 64 nt, Homo Sapiens
caaccuuuuuuccuugaauuaacagcaauaaaaaaaugaaaaacagcuuaagaauugugccuca

SEQ ID NO: 96607 - RNA, 64 nt, Homo Sapiens
cagaggaaauaggaaaaucuucagaguugaauuuaaugaaaacuaugaaauaaaaaggccauau

SEQ ID NO: 96608 - RNA, 64 nt, Homo Sapiens
aaaaugaguuacacugagaagaagaguuacagaaaaugaaaaaguauguggaguaauagggaaa

SEQ ID NO: 96609 - RNA, 64 nt, Homo Sapiens
auacaugaaucuuggccacaaugagaaaaauaaaaaugaaaaaagagcaggcauccauuuccau

SEQ ID NO: 96610 - RNA, 64 nt, Homo Sapiens
cucaaucaauguaauucaguauuuuaacaaaaggaaugaaaaauuaucaucucaauagacaaag

SEQ ID NO: 96611 - RNA, 64 nt, Homo Sapiens
uaggaaaguagcaaauauguugagauccaaaaaaaaugaaaaccgugaucccagauuagauuuu

SEQ ID NO: 96612 - RNA, 64 nt, Homo Sapiens
cauuuuaagacugaaagugauagaaagccuacucaaugaaaacaaagagaaauaaauguuguuu

SEQ ID NO: 96613 - RNA, 64 nt, Homo Sapiens
aacuugguaauaaucuuuuugaagaccuugagacaaugaaaauacagccuagauccagaguuca

SEQ ID NO: 96614 - RNA, 64 nt, Homo Sapiens
acuguaggaggcagagacggaaaaaaacaaaauaaaugaaaaggcaagacucugccucuauuau

SEQ ID NO: 96615 - RNA, 64 nt, Homo Sapiens
cguccacaggggaucugucaguuuggguccuccaaaugaaaaaugucaagacagaauuggacau

SEQ ID NO: 96616 - RNA, 64 nt, Homo Sapiens
guuuuccauauaauauuauuuaaaaugcugagaaaaugaaaaaaucuaaauggugaaauauaua

SEQ ID NO: 96617 - RNA, 64 nt, Homo Sapiens
gaccccauauguagcaaaaaguguuuuugcaaagaaugaaaaggccguguucucagaaagccca

SEQ ID NO: 96618 - RNA, 64 nt, Homo Sapiens
aacuguuaccgaaggaauuauugccuuucccaaaaaugaaaauaccgaguuccagguagugguu

SEQ ID NO: 96619 - RNA, 64 nt, Homo Sapiens
guagcccuaccaaaaauagccaguaguaucugaaaaugaaaaauaaaugaaguaucucuaggaa

SEQ ID NO: 96620 - RNA, 64 nt, Homo Sapiens
uuuaaagcuaaaaacauuacuuuuagaucccuagaaugaaaauuuuuuucucaucuaugcaauu

SEQ ID NO: 96621 - RNA, 64 nt, Homo Sapiens
aauaacucuuccugcuauucagaauaaguaggagaaugaaaacugcagcauaucagacagcaau

SEQ ID NO: 96622 - RNA, 64 nt, Homo Sapiens
uguaauaaacuauucuuugaaacuuguuggguagaaugaaaauuaaagccauaaugguagaaga

SEQ ID NO: 96623 - RNA, 64 nt, Homo Sapiens
acuuuuaaauuauaucgcuuauacauuuauuucuaaugaaaaaaauaauaacauauuuauuuuu

SEQ ID NO: 96624 - RNA, 64 nt, Homo Sapiens
aggagaaaagugagauuuuacauggggguugggaaaugaaaaguacuuaucaaauacuuaguau

SEQ ID NO: 96625 - RNA, 64 nt, Homo Sapiens
ugugcugaauguuguggauugacuaaaguugcuuaaugaaaacagcauuugcacuuuuuuuagu

SEQ ID NO: 96626 - RNA, 64 nt, Homo Sapiens
uuaacuggaauugucugauauucuuuguuugucaaaugaaaauuaaacaaaaaugcgcaucucu

SEQ ID NO: 96627 - RNA, 64 nt, Homo Sapiens
gcuuuacuggggcuggggaaagugccucaagaggaaugaaaaaaaucggagaacaugaaucaaa

SEQ ID NO: 96628 - RNA, 64 nt, Homo Sapiens
uccacucaaaauagggacuaacauaccccuuacaaaugaaaaauaagcaagaaucagagaagga

SEQ ID NO: 96629 - RNA, 64 nt, Homo Sapiens
uccauuuacacguauuugaacauuaauauacuugaaugaaaaugaacccacuuuaaaauaucua

SEQ ID NO: 96630 - RNA, 64 nt, Homo Sapiens
ugagaaugugccucucaguaucuuaaaauugguuaaugaaaaaucugaauuucuaaaacccuug

SEQ ID NO: 96631 - RNA, 64 nt, Homo Sapiens
augaagcagaaugagaugauuuaauucuuaccgaaaugaaaauggcugaagaaacacagcaugc

SEQ ID NO: 96632 - RNA, 64 nt, Homo Sapiens
accuucgcaguguggucucugggggcaaaaaacuaaugaaaacaaucucuguaauggcagauag

SEQ ID NO: 96633 - RNA, 64 nt, Homo Sapiens
acuugaaauaguaauuuguuaaaagauaugacaaaaugaaaaugcuuaaacuacagaaauuuaa

SEQ ID NO: 96634 - RNA, 64 nt, Homo Sapiens
uuaugucccuuaguucuuuauuaccuuacauaaaaaugaaaauugcggcaggaugcaugucugu

SEQ ID NO: 96635 - RNA, 64 nt, Homo Sapiens
uguuaagagcauuguuuccauuaaaaucaauaacaaugaaaaacgguuguuugcuuugugauaa

SEQ ID NO: 96636 - RNA, 64 nt, Homo Sapiens
cagcaguugugcuccuggacauucauuccagagaaaugaaaaccuauauuguacuuguacucaa

SEQ ID NO: 96637 - RNA, 64 nt, Homo Sapiens
aacaaaccauccauaacuuggaauacugcucuggaaugaaaaggaacuaacuguugauacaaga

SEQ ID NO: 96638 - RNA, 64 nt, Homo Sapiens
ucccaacuauugagcauguuaacuucuugcuucaaaugaaaaaacaccaucugaaaauucacaa

SEQ ID NO: 96639 - RNA, 64 nt, Homo Sapiens
auuucuuggggaugccuuuuuuuuaccuuggagaaaugaaaauugaaauaagcugcuaaucaga

SEQ ID NO: 96640 - RNA, 64 nt, Homo Sapiens
uguaaucuaaaauauaccagcuaggugauuuuuaaaugaaaauguuccuaagaucauuuuuauc

SEQ ID NO: 96641 - RNA, 64 nt, Homo Sapiens
agggagggaaaguuguauuaaaaaguaaaaugcaaaugaaaacauuauuaaagcaaaaauaaau

SEQ ID NO: 96642 - RNA, 64 nt, Homo Sapiens
caggcaguuuaguccauaguagaucucaaugcgaaaugaaaacucuaaaggcuuuucuacucug

SEQ ID NO: 96643 - RNA, 64 nt, Homo Sapiens
cuuuuaaauuaguacaacuguuuuuuccuucuucaaugaaaaggcuuuucucacuguagacaga

SEQ ID NO: 96644 - RNA, 64 nt, Homo Sapiens
aaacauaugcacgcacuuuuagcaaaaagaaaaaaaugaaaagcaauuauagaucauaauagga

SEQ ID NO: 96645 - RNA, 64 nt, Homo Sapiens
aaggcaaaugacugaacaguucccucaggacucacguacugaucucccaaaagaagagaggguc

SEQ ID NO: 96646 - RNA, 64 nt, Homo Sapiens
ugacaacuggauuuaaaaguacaguacagauagucguacugaucaugagagacuggcugauacu

SEQ ID NO: 96647 - RNA, 64 nt, Homo Sapiens
cuguaaggcccaaaguggguaaagugacggcagccguacugagucaucccccauccccugacaa

SEQ ID NO: 96648 - RNA, 64 nt, Homo Sapiens
agagagccaaacaggcuguuuauggcucuagcugcguacugacuauaaaauagaugcuggacuc

SEQ ID NO: 96649 - RNA, 64 nt, Homo Sapiens
ucugaucuuuaauaucugauauuuuccugguacucguacugauaagggauuauuggaagucagu

SEQ ID NO: 96650 - RNA, 64 nt, Homo Sapiens
aguuaguugacaacgggcauccauuauugaaagccguacugaucguuuaccuacuuguucauca

SEQ ID NO: 96651 - RNA, 64 nt, Homo Sapiens
ccaguaaauugcagauucucagaauguuuauugacguacugauuauucauucuguuauacucua

SEQ ID NO: 96652 - RNA, 64 nt, Homo Sapiens
ccaguaaacugcagauucucagaauguuuauugacguacugauuauucauucuguuauacucua

SEQ ID NO: 96653 - RNA, 64 nt, Homo Sapiens
ugcuguguccacgcgcuaaggcgacccccucccccguacugacuucuccuauaagcgcuucucu

SEQ ID NO: 96654 - RNA, 64 nt, Homo Sapiens
aagcaacauacugugaugauaagcccauuaacuucguacugaaaaaagcaguuaaacagcagga

SEQ ID NO: 96655 - RNA, 64 nt, Homo Sapiens
gaacaccugcaacugcaaauguuuuuugauccgacguacugaaauaggaagucaugcucuuccc

SEQ ID NO: 96656 - RNA, 64 nt, Homo Sapiens
auaaaugcucuagaguuaacauguaaaauauauacguacugagguuuguaaacuguccuuuuua

SEQ ID NO: 96657 - RNA, 64 nt, Homo Sapiens
cgcgucuggcggcugcugucguuguguucuaccccguacugacccaacaccacaagggcuuucu

SEQ ID NO: 96658 - RNA, 64 nt, Homo Sapiens
gaaacugauuuugguuccacuucuauaucccaaacguacugaauauaaaacucagccagucuca

SEQ ID NO: 96659 - RNA, 64 nt, Homo Sapiens
ggaggugauaccggguccuacuuaggggcaaccucguacugagagaaaauggggcuaugccugg

SEQ ID NO: 96660 - RNA, 64 nt, Homo Sapiens
cuuuuggugcagugggugccuguaacucauuagacguacugaggcagcacuucugcagggugca

SEQ ID NO: 96661 - RNA, 64 nt, Homo Sapiens
auacaaccagaggucucaucucugaacuuucuugcguacugauuacaugagucuuuggagucgg

SEQ ID NO: 96662 - RNA, 64 nt, Homo Sapiens
caaccugcauuuguaugugucccgaauccacagucguacugauucuaauggggacacagaucau

SEQ ID NO: 96663 - RNA, 64 nt, Homo Sapiens
gagaugaagcgcugauccuguagucaccuauuuucguacugaaacaucgucuuuacccacuucu

SEQ ID NO: 96664 - RNA, 64 nt, Homo Sapiens
gaaauauuuuacuaagcguuucagaaaaacaagacguacugaauacccucugccguugccucuc

SEQ ID NO: 96665 - RNA, 64 nt, Homo Sapiens
augcccauuaguuuuauauaacauuuauuugacacguacugacuucuaucugagaagaacaaac

SEQ ID NO: 96666 - RNA, 64 nt, Homo Sapiens
gggguauucuggcaggaugaaucgcaggauggcgcguacugaagccacgauguucauccaggcc

SEQ ID NO: 96667 - RNA, 63 nt, Homo Sapiens
guguaaagccaacucgaggggaaucugaauaagcuuccaaaauuuuuuuuuuuaagaaauaaa

SEQ ID NO: 96668 - RNA, 63 nt, Homo Sapiens
aggccacuacuuuauacuuucucucuucuguaacuuccaaagcaucccucucaguucucaugc

SEQ ID NO: 96669 - RNA, 63 nt, Homo Sapiens
uuuuauuugcaacauuuacaguccuucaaaauccuuccaaagaauucuuauacacauuggggc

SEQ ID NO: 96670 - RNA, 63 nt, Homo Sapiens
auuacuugauuaagauuuuacaaaagaggagcacuuccaaaauucuuauuuuuccuaacaaaa

SEQ ID NO: 96671 - RNA, 63 nt, Homo Sapiens
cuugagccuuuaauggacuuauuucuucaaauccuuccaaaaauuauuauaagcauugaaauu

SEQ ID NO: 96672 - RNA, 63 nt, Homo Sapiens
uuguuuuuacuguagaagacugguaucauguugcuuccaaauuuaugagcuugcuguauuucu

SEQ ID NO: 96673 - RNA, 63 nt, Homo Sapiens
aagcuagauucuugguuuuauuuuagacugcuacuuccaaacuugaucagguaccugcuuuca

SEQ ID NO: 96674 - RNA, 63 nt, Homo Sapiens
agguaagaagucuguggccaagccuagaggauccuuccaaaccugacuguuaucccgguucca

SEQ ID NO: 96675 - RNA, 63 nt, Homo Sapiens
agguaagaagucuguggccaagacgagaggauacuuccaaacaugacuauuaucccgguucca

SEQ ID NO: 96676 - RNA, 63 nt, Homo Sapiens
gcaagaagaggacaguggaccagcuccugggaccuuccaaaacauuggcuuugacaucugcca

SEQ ID NO: 96677 - RNA, 63 nt, Homo Sapiens
auacaaguaucuaucuggacuucccugcuagcacuuccaaacaagcucagagauguuccuccc

SEQ ID NO: 96678 - RNA, 63 nt, Homo Sapiens
caagcagcuggucagucuuugcucaguguccagcuuccaaagccuagacaaccuuucuguagc

SEQ ID NO: 96679 - RNA, 63 nt, Homo Sapiens
uugcuuagaacguuaaacuauuagaguauuucccuuccaaagagggauguuuggaaaaaacuc

SEQ ID NO: 96680 - RNA, 63 nt, Homo Sapiens
gagccuuaggauccaaugaguggagaauggggacuuccaaaacccaagguuggcuauaaucuc

SEQ ID NO: 96681 - RNA, 63 nt, Homo Sapiens
ucaccauuccucaaaccuguaaguuucucacuucuuccaaauuggcuuuggcucuuucugcaa

SEQ ID NO: 96682 - RNA, 63 nt, Homo Sapiens
aucugccacaggccauauuuguggcccgugcagcuuccaaaucucauacacaacuguucccga

SEQ ID NO: 96683 - RNA, 63 nt, Homo Sapiens
aguccuucucuuuagggcucuuacaaucuaucacuuccaaaaaguaaauggugacugauaaaa

SEQ ID NO: 96684 - RNA, 63 nt, Homo Sapiens
ggggcuugggggucaacuccccccaggacuuaccuuccaaaacaaacuuucuucacuuuguau

SEQ ID NO: 96685 - RNA, 63 nt, Homo Sapiens
uuuccccuaaucguggggguuggaccccagagucuuccaaagaauuuucacugguugccugca

SEQ ID NO: 96686 - RNA, 63 nt, Homo Sapiens
acgacccgucagagccgacggaggaggaggagccuuccaaacagagaggugaguggggagcug

SEQ ID NO: 96687 - RNA, 63 nt, Homo Sapiens
aucucauggccaaagucagagcgaugcuugcagcuuccaaaaaccugcaaaccagcgcuuccu

SEQ ID NO: 96688 - RNA, 63 nt, Homo Sapiens
ugccauuuaaaaaguuguagcagauuguuuccucuuccaaaguaaaauugcugugcuuuaugg

SEQ ID NO: 96689 - RNA, 63 nt, Homo Sapiens
caugaacacccuuagaaaauguguccuaucuaucuuccaaaugcaauuugauugacugcccau

SEQ ID NO: 96690 - RNA, 63 nt, Homo Sapiens
uuauuacauugacuucucccaagaugaaucuuccuuccaaauguguuuucuccacacaagccu

SEQ ID NO: 96691 - RNA, 63 nt, Homo Sapiens
caucugguucugaaaaaguauagcauguagcagcuuccaaacauauucauauugcuuaagagg

SEQ ID NO: 96692 - RNA, 63 nt, Homo Sapiens
acagcccuggcagcccauggcaacucaaagugccuuccaaaccaaacugccccucaugagguu

SEQ ID NO: 96693 - RNA, 63 nt, Homo Sapiens
aagacagaaacugauguuccaugcaugucccugcuuccaaagccugaccuuccaaagcuugcu

SEQ ID NO: 96694 - RNA, 63 nt, Homo Sapiens
guuccaugcaugucccugcuuccaaagccugaccuuccaaagcuugcuuccuuccuccuggcu

SEQ ID NO: 96695 - RNA, 63 nt, Homo Sapiens
ucccagagaugaagcucccucccagaagugcagcuuccaaaaggccgugcccgaugugcaccu

SEQ ID NO: 96696 - RNA, 63 nt, Homo Sapiens
ugccugagaugaaacuuccucccugagaugaagcuuccaaaggaaagugccagagaugaaagu

SEQ ID NO: 96697 - RNA, 63 nt, Homo Sapiens
ugcccgaggcagcccuuccauccugaggucaagcuuccaaaaggaagugaagcuccccaaggc

SEQ ID NO: 96698 - RNA, 63 nt, Homo Sapiens
gggauuuuuuuuuugguugaccacucccccacacuuccaaaauuaaacaguguuuucuuagca

SEQ ID NO: 96699 - RNA, 63 nt, Homo Sapiens
ucauuaggucaguuaagggaaauauuuguaccacuuccaaacuuuucagcguuggauaaaaug

SEQ ID NO: 96700 - RNA, 63 nt, Homo Sapiens
uguguguuuccaacaucaugguagcagcacacacuuccaaagcucagccagggacacuuaaua

SEQ ID NO: 96701 - RNA, 63 nt, Homo Sapiens
aaagaaaacuguuuuuagaaauacauaaaaucacuuccaaauccuguugcuuauguuggguua

SEQ ID NO: 96702 - RNA, 64 nt, Homo Sapiens
ugccugaagucuuacaggacgcagcgugcugauggaaguggaagugucuccuuuuccaggcuca

SEQ ID NO: 96703 - RNA, 64 nt, Homo Sapiens
aagaccaagacccaucaugcuugaaaaguaccaagaaguggaaggucugaacuuauugcagaaa

SEQ ID NO: 96704 - RNA, 64 nt, Homo Sapiens
gcauucaauaaaauuggggugccuaaugcuacuggaaguggaacuugagauagggccuaauuug

SEQ ID NO: 96705 - RNA, 64 nt, Homo Sapiens
uuucaggaaauauaauuugagaauacuuuaaagggaaguggaaguauaagugaaugauauuuuu

SEQ ID NO: 96706 - RNA, 64 nt, Homo Sapiens
uuccauaauuaugucaguguuggauuugcauauugaaguggagaagccuaauguuacuuugaag

SEQ ID NO: 96707 - RNA, 59 nt, Homo Sapiens
ugcauauugaaguggagauuuguuacuuugaaguggauuaaccauuauuacaagccuaa

SEQ ID NO: 96708 - RNA, 64 nt, Homo Sapiens
uuagguaagucauuuauuuuaguuaugcaguucagaaguggacucagacugaaaccuuuauagg

SEQ ID NO: 96709 - RNA, 64 nt, Homo Sapiens
cuuguggugaacaguaccuugauucaagcaaagggaaguggaaugguuuucucaaaggcccaag

SEQ ID NO: 96710 - RNA, 64 nt, Homo Sapiens
gaacuuucagcccagcguuucugcaaugcagagugaaguggauacugggcaguucgagacaggu

SEQ ID NO: 96711 - RNA, 64 nt, Homo Sapiens
ccaucaauugauggggaaggcuggcacccaccaagaaguggaaguccucagaaauucucggcac

SEQ ID NO: 96712 - RNA, 64 nt, Homo Sapiens
gaagaacaguuaauuuaagaugagucacacaagggaaguggaaggaacuuucuuauuuugcuac

SEQ ID NO: 96713 - RNA, 64 nt, Homo Sapiens
gacgggagugagcuggggagacagucaaaggacggaaguggaagaggcagacagagaugaaaag

SEQ ID NO: 96714 - RNA, 64 nt, Homo Sapiens
cuuggacaacccagcagggaguuccggggaguccgaaguggagaaaggcuggugggaacaugga

SEQ ID NO: 96715 - RNA, 64 nt, Homo Sapiens
agaauuguguucgggaggugggggaucugagaccgaaguggacagugguuaagauuguggggcc

SEQ ID NO: 96716 - RNA, 64 nt, Homo Sapiens
gguaaguggcuguuugaggucguauaugaaagaggaaguggauaugauggcagcaguuauacua

SEQ ID NO: 96717 - RNA, 64 nt, Homo Sapiens
ugccuagaggguugaagauauacucgugggauaugaaguggagguguauccucagacuuugaaa

SEQ ID NO: 96718 - RNA, 64 nt, Homo Sapiens
acccagggcacugcgacuuuccuggggcaucguggaaguggaaaaguucggggucgacucuacc

SEQ ID NO: 96719 - RNA, 64 nt, Homo Sapiens
acaagaaacgcaaagugaggcacugacaccucccgaaguggaccuauccuggcuaaggcagaca

SEQ ID NO: 96720 - RNA, 64 nt, Homo Sapiens
uaucagauggugagaaaacagaaaaaugagaucagaaguggagauguuggggccaggcacagug

SEQ ID NO: 96721 - RNA, 64 nt, Homo Sapiens
cuugguucauggagacccuguuuuuuuaaaaaaagaaguggagguguuuacaccagcaaaauac

SEQ ID NO: 96722 - RNA, 64 nt, Homo Sapiens
auaguaguuuauacuuuugcuuaacucuguuaugucucuuaagcagguuugguuuuuauuaaaa

SEQ ID NO: 96723 - RNA, 64 nt, Homo Sapiens
acauuaaccuagaaaacuacauagguuauuuugaucucuuaagauuaauguagcagaaauuucu

SEQ ID NO: 96724 - RNA, 64 nt, Homo Sapiens
aaaguccaaaguccaaggggcccuuguugaguuuucucuuaaguguuuugaauugggcuuucug

SEQ ID NO: 96725 - RNA, 64 nt, Homo Sapiens
gacagaaacuaggguuuagucuccaaguggcuccucucuuaaaaauuagguuuacuucuugucu

SEQ ID NO: 96726 - RNA, 64 nt, Homo Sapiens
acucggcauuuguccacaguugccuacuucaccaucucuuaaggucuaccuuuacuaucuacua

SEQ ID NO: 96727 - RNA, 64 nt, Homo Sapiens
ugaaaagaucaagaaacgugugaaaacucccuauucucuuaagcgguggcgccccuccaccugg

SEQ ID NO: 96728 - RNA, 64 nt, Homo Sapiens
cacauacugaaugcugaaguauacauaugcuauuucucuuaaaccucagagcaaccauaugagc

SEQ ID NO: 96729 - RNA, 64 nt, Homo Sapiens
acccgguggcccuccgaggccaccccccucacauucucuuaagccgcgcugcgccaccugcacu

SEQ ID NO: 96730 - RNA, 64 nt, Homo Sapiens
uugaagaggugcugccaagggcgcccggccugauucucuuaaaagauuacaggcgugagccacc

SEQ ID NO: 96731 - RNA, 64 nt, Homo Sapiens
aagaguauuuucaguaauaaacgugccaucucuaucucuuaaacauuuauuacaacaauuguuu

SEQ ID NO: 96732 - RNA, 64 nt, Homo Sapiens
cuguggcggcagugguggguaagcacuccaguguucucuuaaugaggcacuuugccugucacuc

SEQ ID NO: 96733 - RNA, 64 nt, Homo Sapiens
uaaaauccauuauucuuaauauccauuuccuauuucucuuaaaaccuguuucucuuaaaauaaa

SEQ ID NO: 96734 - RNA, 64 nt, Homo Sapiens
uaaaauccauuuccuauuucagcuguuuccuguuucucuuaaaaaaaaugugauuaugcuuaac

SEQ ID NO: 96735 - RNA, 64 nt, Homo Sapiens
agauuuuauggggcuacugcagaccaaaacucauucucuuaaagcuuuuuguguaccucuacag

SEQ ID NO: 96736 - RNA, 64 nt, Homo Sapiens
gucaacaucaguguuguaaaacuugggauuuuccucucuuaaccauuggauggacuuguuuggu

SEQ ID NO: 96737 - RNA, 64 nt, Homo Sapiens
uuauuguuuucagauuucaacuuguauguguuugucucuuaaagcauuggugaaaucacauauu

SEQ ID NO: 96738 - RNA, 64 nt, Homo Sapiens
aauggaguguuuguucccugccauuuuucacaccucucuuaauuuuaguucuguuuaguugaga

SEQ ID NO: 96739 - RNA, 64 nt, Homo Sapiens
gacaacauaacuuuuuauguugagcuagaauuauucucuuaaaaacuuuaugaacacagguguc

SEQ ID NO: 96740 - RNA, 64 nt, Homo Sapiens
gauaagcuauuuaaccccaacagcacuacuauucucucuuaaaacugucaaaaagaaguaaccu

SEQ ID NO: 96741 - RNA, 64 nt, Homo Sapiens
uuuuuaagaguaagccaugaaaucuuguaacaugucucuuaacuauuuauaaugaaaaguggca

SEQ ID NO: 96742 - RNA, 64 nt, Homo Sapiens
aucacagguugucucaagcacaaccaacugaaugucucuuaacuguggggaccaaaagggagag

SEQ ID NO: 96743 - RNA, 64 nt, Homo Sapiens
cccugcgggccaggcacugcccuuuucaggaagcucucuuaaaauacccauugccccagaccug

SEQ ID NO: 96744 - RNA, 64 nt, Homo Sapiens
gguggaaggaugggauggguuccagagguauuccucucuuaaaugcaagugccuagauuaggua

SEQ ID NO: 96745 - RNA, 64 nt, Homo Sapiens
auuuugugugcaucuuuaauaacaauuaucuuuuucucuuaaugaauacaguauucacucuaga

SEQ ID NO: 96746 - RNA, 64 nt, Homo Sapiens
aacucgaucuguacccagcucaaggugguuuucuucucuuaaauuuuuagacguuuuuuuccuc

SEQ ID NO: 96747 - RNA, 64 nt, Homo Sapiens
ggugggguucuuguugcuuuuuucucuuuuuuccucucuuaaaaaauguacuugcacaaggaag

SEQ ID NO: 96748 - RNA, 64 nt, Homo Sapiens
gaaaucuccugcucugauauaguuauguaacugaucucuuaaucuguagcauagaaguauuuug

SEQ ID NO: 96749 - RNA, 64 nt, Homo Sapiens
aauaacagauaaguccauugguggacagccuucuucucuuaaucacaagauuauuuucagaauu

SEQ ID NO: 96750 - RNA, 64 nt, Homo Sapiens
augauauaucagcuuuugccuuucaauuuaucaaucucuuaaagagaauccaacuuuauuacga

SEQ ID NO: 96751 - RNA, 64 nt, Homo Sapiens
auucucggccucugugggauuccauaggucugaaucucuuaagaacuaaauauuuuaaggcaag

SEQ ID NO: 96752 - RNA, 64 nt, Homo Sapiens
ucucuucuuccauuagaaugugcugucucuuaaaucucuuaaacacuuccagcaaaauccaaac

SEQ ID NO: 96753 - RNA, 64 nt, Homo Sapiens
cucuuaaacucucuucuuccaauccaaacugcugucucuuaaauaaaauccuuacuuccagcaa

SEQ ID NO: 96754 - RNA, 64 nt, Homo Sapiens
cuguaacuggccuuucucuuucgaaaauugcacuucucuuaaaagggguacccccagcagccuc

SEQ ID NO: 96755 - RNA, 64 nt, Homo Sapiens
uucaacaucucucuucuuggcuucucugucuuccucucuuaaauaagguauccaguggauuuuu

SEQ ID NO: 96756 - RNA, 64 nt, Homo Sapiens
aauaaacacucccacuguuuucugcaguuuauucucucuuaaggcucgaaggaaacuuuuaauc

SEQ ID NO: 96757 - RNA, 64 nt, Homo Sapiens
ucucacugaacauaaguccuaagguugccaccugucucuuaacauuaaguccaguguuugagcc

SEQ ID NO: 96758 - RNA, 64 nt, Homo Sapiens
ccguagcaguugccaacucauaaauaacuacaauucucuuaacuaaaacuaggacuguguggug

SEQ ID NO: 96759 - RNA, 64 nt, Homo Sapiens
cccacccuacauacacagacuagggauaugaaaaucucuuaacauccaucagaauccacucuuc

SEQ ID NO: 96760 - RNA, 64 nt, Homo Sapiens
cacuuuucaaaauaugugggagcuaacagcucaaucucuuaaaacuggccaacuaguuguuaaa

SEQ ID NO: 96761 - RNA, 64 nt, Homo Sapiens
ugcuaacauguaguuggggcaccuauaauuggguucucuuaauaaccuuucuuugcaguuaaga

SEQ ID NO: 96762 - RNA, 64 nt, Homo Sapiens
ggcuucucucuuugauguuaccuguuagugcugaucucuuaaagcagacauuucuuguuuguug

SEQ ID NO: 96763 - RNA, 64 nt, Homo Sapiens
ccuaggcucaagugauccucguugcccaggcuggucucuuaacuauuuuuuguguggagucuau

SEQ ID NO: 96764 - RNA, 64 nt, Homo Sapiens
ccucccauaggaaauagaauguguuccuaagauaucucuuaaauucaguaaaucccuuuaaaua

SEQ ID NO: 96765 - RNA, 64 nt, Homo Sapiens
uaucacucuaaaauuugucauuaaaauuuaucauucucuuaaagcuacucacccaguaagucuc

SEQ ID NO: 96766 - RNA, 64 nt, Homo Sapiens
uuuaucauucucuuaaaguaacucacccaguaagucucuuaaaauuuaaauauuugauaaaacu

SEQ ID NO: 96767 - RNA, 64 nt, Homo Sapiens
ucuguuuuuagacuucauggauucaguaucucccucucuuaaaguuuaauagguaaucaaggca

SEQ ID NO: 96768 - RNA, 64 nt, Homo Sapiens
uuugugucacuuuuuucugccuugcuagccaaaaucucuuaaauacacguaggugggccagaga

SEQ ID NO: 96769 - RNA, 64 nt, Homo Sapiens
caccccccagccuuagaugccucgcucuuuucaaucucuuaaucuaaaugcuuuuuaaagagau

SEQ ID NO: 96770 - RNA, 64 nt, Homo Sapiens
cguuaaugcuuuuggaaacagauguucaagacagucucuuaaucugaauuucucaaauguuuga

SEQ ID NO: 96771 - RNA, 64 nt, Homo Sapiens
gaguauggauaacuauauuuaauugagguacaacucucuuaaaacaaauacucuaaaaugauaa

SEQ ID NO: 96772 - RNA, 64 nt, Homo Sapiens
uggacagggaaauggucuaagaagaugaauguugucucuuaacuuuguagagccaugacucugu

SEQ ID NO: 96773 - RNA, 64 nt, Homo Sapiens
auuuaccauuauuguaaguaaaauaccaaaugauucucuuaagcuucacaauaaauguucauua

SEQ ID NO: 96774 - RNA, 64 nt, Homo Sapiens
aaggucaauaagauccuugcauccucugcaacacuugcagaacaugcuucaggugucuaggggu

SEQ ID NO: 96775 - RNA, 64 nt, Homo Sapiens
uagguuuaacugaaugaagcguaacaggaauauuuugcagaauaauccaguuguacuuaagugu

SEQ ID NO: 96776 - RNA, 64 nt, Homo Sapiens
gcaguucauuccaaauccagcacugcuguuuaccuugcagaaggaggcacugcuacaaccaugg

SEQ ID NO: 96777 - RNA, 64 nt, Homo Sapiens
aaaucauuucacuucacuccuaacauuucuuacauugcagaacuaaugguaaaguaaauuuuac

SEQ ID NO: 96778 - RNA, 64 nt, Homo Sapiens
accugcuccggcauccagcgugcagaacagcuucuugcagaagcaagaugcagcaaggagagga

SEQ ID NO: 96779 - RNA, 64 nt, Homo Sapiens
ugcucugguggaacaaguugcgugucaguucuucuugcagaaugugcucccagcagaggcugug

SEQ ID NO: 96780 - RNA, 64 nt, Homo Sapiens
cuauucuguaauuaaaauauaaccugaauucagcuugcagaauggaagcugaaucuguucauug

SEQ ID NO: 96781 - RNA, 64 nt, Homo Sapiens
auuguauucuauugauugucaauuuaauuagcuguugcagaauaaguaauauauuuuaaaaacc

SEQ ID NO: 96782 - RNA, 64 nt, Homo Sapiens
uacguccuugauuaaaucaccccaauaugccccuuugcagaaaguauuggcuuuucccugaauu

SEQ ID NO: 96783 - RNA, 64 nt, Homo Sapiens
uaugguaaaaaaaaucuugggauugagagucuucuugcagaaacuucucagccaaaguaaaaag

SEQ ID NO: 96784 - RNA, 64 nt, Homo Sapiens
ugcugcacauguauuuuauuuguauguaacggaauugcagaauaagcuuuggaaaaaaaacuac

SEQ ID NO: 96785 - RNA, 64 nt, Homo Sapiens
accaacugaaaaaaaaauuccagguaucacagccuugcagaagauuagauuuuacauaucuuug

SEQ ID NO: 96786 - RNA, 64 nt, Homo Sapiens
ucauuugucauuuuucuagaucuuuaaaaaucaauugcagaagugcugugaaagucguucucug

SEQ ID NO: 96787 - RNA, 64 nt, Homo Sapiens
aaauuaaagucaccucuacuagacucaguuguaguugcagaaaaacuaaagucuuaaacaucua

SEQ ID NO: 96788 - RNA, 64 nt, Homo Sapiens
caauaucuguuucuugguggacuuuuauacuauauugcagaaacuaagacuggauugauugugg

SEQ ID NO: 96789 - RNA, 64 nt, Homo Sapiens
ugugcuauuauguaacugugcugauguucaacaguugcagaaauuucaauucuaauaaauaaug

SEQ ID NO: 96790 - RNA, 64 nt, Homo Sapiens
guggucagaugaccaguguaauaccuucuuagcauugcagaaaggacugcuguuuggucaaaga

SEQ ID NO: 96791 - RNA, 64 nt, Homo Sapiens
uuuaccuaauaguuucuuaauauuucagugccccuugcagaaaaaauauuacaugcuaaauaaa

SEQ ID NO: 96792 - RNA, 64 nt, Homo Sapiens
ugcuguguuuugaaagucuuuaacuaaauuaagauugcagaaugauagugauuauucaauuaga

SEQ ID NO: 96793 - RNA, 64 nt, Homo Sapiens
gacuuauuguaagauguuggcugaaagcaugaacuugcagaacucccucggagacgcagguugc

SEQ ID NO: 96794 - RNA, 64 nt, Homo Sapiens
acaauuagaauuauuuuagaaauaguaggaaguauugcagaagucaauacacaaaugugccagg

SEQ ID NO: 96795 - RNA, 64 nt, Homo Sapiens
ggaaagggaauauugcaaaaauuccaaagcacgauugcagaaggcuuagggaaggagagaccuu

SEQ ID NO: 96796 - RNA, 64 nt, Homo Sapiens
cauccauucacuccugggguggccagcacuucgcuugcagaagccaaggccagcaagccccuca

SEQ ID NO: 96797 - RNA, 64 nt, Homo Sapiens
cuguggauuaauuguagcauccacugcaggaagauugcagaaggaugguucauggccucucuuc

SEQ ID NO: 96798 - RNA, 64 nt, Homo Sapiens
uauuuaaguuucaacucugaagcuagcauuagguuugcagaaacuuuuaguaaaggagcugaga

SEQ ID NO: 96799 - RNA, 64 nt, Homo Sapiens
gaauacuuuggcugcuaaggaaacuuccucuccauugcagaauagcugagccaagugagugagu

SEQ ID NO: 96800 - RNA, 64 nt, Homo Sapiens
uccauugcagaauagcugagccaagugagugaguuugcagaaagcagguggugagcuccugccu

SEQ ID NO: 96801 - RNA, 64 nt, Homo Sapiens
aagcuagggaaacacuaaccauugucuuucuccauugcagaaauuuuuuuuuuuuugguaugaa

SEQ ID NO: 96802 - RNA, 64 nt, Homo Sapiens
uggucucucaggcuguuugguuuaaaauuuccauuugcagaauugaaaaauguauucagugggc

SEQ ID NO: 96803 - RNA, 64 nt, Homo Sapiens
ggugauagaaaacucgccuacuccacugcagaacuugcagaaugcgugguguuaaucuacagag

SEQ ID NO: 96804 - RNA, 64 nt, Homo Sapiens
aagaugaagccauguugcauccacauguucccguuugcagaaaccucacaggacaguacgaaua

SEQ ID NO: 96805 - RNA, 64 nt, Homo Sapiens
cuggagagccacaagcaggaagagcagcgcuguguugcagaauggaguuuccauggauuucuac

SEQ ID NO: 96806 - RNA, 64 nt, Homo Sapiens
uaauuuaaauuauuacuacacuuuauuacuacacuugcagaaaagaaacauguuaaaaucaugg

SEQ ID NO: 96807 - RNA, 64 nt, Homo Sapiens
caguguguugccuuacccagucugacugucuuuauugcagaagaauacacacacacacacacac

SEQ ID NO: 96808 - RNA, 64 nt, Homo Sapiens
caguguguugccuuaccagaacacacagucuuuauugcagaagaacacacacacacacacacac

SEQ ID NO: 96809 - RNA, 64 nt, Homo Sapiens
caguguguugccuuauaggcacacagagucuuuauugcagaagaacauacacacacauacacac

SEQ ID NO: 96810 - RNA, 64 nt, Homo Sapiens
guuaucauacuccauuuacauuacagaauuuacuuugcagaagcuguaaaaccugcccaggaac

SEQ ID NO: 96811 - RNA, 64 nt, Homo Sapiens
auaauuuagcaaccauuuauuuaugggauuacuuuugcagaaucaaauuuaccuagaugucuau

SEQ ID NO: 96812 - RNA, 64 nt, Homo Sapiens
ugaaaugaaguacccuuuuguaaauagcauuuuuuugcagaaggugaaaauuccacucucuacc

SEQ ID NO: 96813 - RNA, 64 nt, Homo Sapiens
ugucugcaagauaaauuagaucgcccugugggguuugcagaauuagugaaggguccaggacgau

SEQ ID NO: 96814 - RNA, 64 nt, Homo Sapiens
cgaguggggggagggcagggacuggguuagaggauugcagaagagccccuuucagagauuagaa

SEQ ID NO: 96815 - RNA, 64 nt, Homo Sapiens
aaggccagcauuuacgaugcuccaaaaucauaauuugcagaaggccucugcauggguuggauuu

SEQ ID NO: 96816 - RNA, 64 nt, Homo Sapiens
ccugaaagaaaaaaaauaccuuaaaaaauucauuuugcagaaagaaaucuuuuuuuuguuguuu

SEQ ID NO: 96817 - RNA, 64 nt, Homo Sapiens
ucuguaggaauaagcauauagggugaucccuaucuugcagaauguccauugaagacccuauuuu

SEQ ID NO: 96818 - RNA, 64 nt, Homo Sapiens
gcaucaaucuguguucagguccaggguuacauaauugcagaagcacaagccauacaucgcaggu

SEQ ID NO: 96819 - RNA, 64 nt, Homo Sapiens
caguauauuuuguaaauauaaguacuaguccuaauugcagaaagagcgucaguuucaccucccc

SEQ ID NO: 96820 - RNA, 64 nt, Homo Sapiens
uucgauuuacuuccuaauuauaaaagcugcuuuuuugcagaacauuccuugaaaauauaagguu

SEQ ID NO: 96821 - RNA, 64 nt, Homo Sapiens
accuccaggaacugucauggauguccaaauggcuuugcagaaaggaaaugagaugacaguauuu

SEQ ID NO: 96822 - RNA, 64 nt, Homo Sapiens
aguuacauguaugccugcccaguucccuuuuuauuugcagaagcugugaguuuuguucacaauu

SEQ ID NO: 96823 - RNA, 64 nt, Homo Sapiens
uaguaacugcagcucaccuaugugugcuuuucauuugcagaagugguuuuuauuugauuuuagu

SEQ ID NO: 96824 - RNA, 64 nt, Homo Sapiens
gagccuugguaaaccugucucuuuacaaccuggguugcagaacuacagaugcugcuuuggagaa

SEQ ID NO: 96825 - RNA, 64 nt, Homo Sapiens
gcugcgggcugcccugugggcuggugcuucaggaggaauccagagaaguguucagaugcccccc

SEQ ID NO: 96826 - RNA, 64 nt, Homo Sapiens
acauuugcaccuuaggagaggcagauguuaaaauggaauccaaagaccaccuagggcggggcug

SEQ ID NO: 96827 - RNA, 64 nt, Homo Sapiens
cuauggaccucccaaguccccagccgggcagaagggaauccaggcacccaucccagccccuggg

SEQ ID NO: 96828 - RNA, 64 nt, Homo Sapiens
uccucaggaaccccuccaaauugcgagcaagcucggaauccaguccuccacggaacgucucgcc

SEQ ID NO: 96829 - RNA, 64 nt, Homo Sapiens
ugccgauacaggcccuugguaaugaacuacugcaggaauccagaggaauuuccaguggccugac

SEQ ID NO: 96830 - RNA, 64 nt, Homo Sapiens
uucugggaaacaacccuggucaggaacuacugcaggaauccagaggaauuugcaguggccugac

SEQ ID NO: 96831 - RNA, 64 nt, Homo Sapiens
uccuguggaaggcccuuggucaugaacuacugcaggaauccagaggaauuuccagugacuugau

SEQ ID NO: 96832 - RNA, 64 nt, Homo Sapiens
ucucuuacauauaagagggcucuacuaucuccuuggaauccacauuuggguuaacuccucagau

SEQ ID NO: 96833 - RNA, 64 nt, Homo Sapiens
aaacuuguagaaagcacauuauagagcuuauguuggaauccaucuuggaggauuuuuguuuuaa

SEQ ID NO: 96834 - RNA, 64 nt, Homo Sapiens
uugugggucccugggaggccggcagccaggccacggaauccacacguggaccauuguggguccc

SEQ ID NO: 96835 - RNA, 64 nt, Homo Sapiens
ugugggucccuugggaggccagcagccagacuacggaauccacauguggaccaugggaagucag

SEQ ID NO: 96836 - RNA, 64 nt, Homo Sapiens
guauagauguuuguggauguggguuguuagugacccacaggacaucuacaccuuugggaugaua

SEQ ID NO: 96837 - RNA, 64 nt, Homo Sapiens
agaaguggguaagggcaggacccaccuggccugcccacaggacaauaggggaagaagccagaac

SEQ ID NO: 96838 - RNA, 64 nt, Homo Sapiens
aaauaaacucuuccaucccucaaaagcuuuguaaccacaggaaaucacuugguaccauauagau

SEQ ID NO: 96839 - RNA, 64 nt, Homo Sapiens
acgugcugaccaguuuucccgacauccuccagggccacaggagcccgcuccacaagacaccugu

SEQ ID NO: 96840 - RNA, 64 nt, Homo Sapiens
guagcugccagcguagaaacccaugaaaaggaggccacaggagauuccugggagcacugggugu

SEQ ID NO: 96841 - RNA, 64 nt, Homo Sapiens
acucaagggugugcauucauuuuaggugggaucgccacaggauuucauguuauuuuccuuacgg

SEQ ID NO: 96842 - RNA, 64 nt, Homo Sapiens
guguacuaccccaggacgcaugcaugcagggcccccacaggagcgagcguguacuaccccagga

SEQ ID NO: 96843 - RNA, 64 nt, Homo Sapiens
guguacuaccccaggaugcacgcaugcagggcccccacaggagcgagcguguacuaccccagga

SEQ ID NO: 96844 - RNA, 64 nt, Homo Sapiens
guguacuaccccaggacgcacgcaugcagggcccccacaggagcuguccuauccccggaccgga

SEQ ID NO: 96845 - RNA, 64 nt, Homo Sapiens
guguccuauccccggaccggcgcaugcagggcccccacaggagcgagcguguacuaccccagga

SEQ ID NO: 96846 - RNA, 64 nt, Homo Sapiens
guguacuaccccaggacgcacgcaugcagggcccccacaggagcgagcguguacuaccccagaa

SEQ ID NO: 96847 - RNA, 64 nt, Homo Sapiens
guguacuaccccagaacgcacgcaugcagggcccccacaggagcgagcauguccuaucccugga

SEQ ID NO: 96848 - RNA, 64 nt, Homo Sapiens
auguccuaucccuggacgcacgcaugcagggcccccacaggagcgagcguguccuauccccgga

SEQ ID NO: 96849 - RNA, 64 nt, Homo Sapiens
guguccuauccccggacgcacgcaugcagggcccccacaggagcgagcguguccuauccccgga

SEQ ID NO: 96850 - RNA, 64 nt, Homo Sapiens
ccccaccaagugacuuugguugacuugugggcucccacaggagucauggugauggaugauaucc

SEQ ID NO: 96851 - RNA, 64 nt, Homo Sapiens
aggcaaaucuuacugcuuaauguauaaacucucaccacaggaagcaucgcuguuuccaauaaau

SEQ ID NO: 96852 - RNA, 64 nt, Homo Sapiens
aucauuuaaaaaaaaagaaugaaguaaaggcauuccacaggaucuacaauauuaggugaauaug

SEQ ID NO: 96853 - RNA, 64 nt, Homo Sapiens
aaugcauauucaacacacuguguggugguucauuccacaggacguaugguaucauguaucucuc

SEQ ID NO: 96854 - RNA, 64 nt, Homo Sapiens
agacagcacacccaagcccgaccugccugacaggccacaggagccuucccuugugucucccugg

SEQ ID NO: 96855 - RNA, 64 nt, Homo Sapiens
ggugaugaccuguggccacgcaggcucgccagggccacaggacagggugcccggcgugagggau

SEQ ID NO: 96856 - RNA, 64 nt, Homo Sapiens
auagguuuuucauaaagaaaugggaacccuaguuccacaggauaauuucccaaaaguaugcucc

SEQ ID NO: 96857 - RNA, 64 nt, Homo Sapiens
gaagacaaaguguuucauuucagaagccaacuuuccacaggacuuucucucagccuuacacuca

SEQ ID NO: 96858 - RNA, 64 nt, Homo Sapiens
ucccacagccagcucuuggcuccaagaugagcacccacaggaagccgacccaggccugaggggc

SEQ ID NO: 96859 - RNA, 64 nt, Homo Sapiens
augagauucuugucugcccucauaucacgcugccccacaggaaugcugcugggaaaagcagggc

SEQ ID NO: 96860 - RNA, 64 nt, Homo Sapiens
uugccucaugggcagggccaugcaaccccacccuccacaggaaaggccagcagaucacugagag

SEQ ID NO: 96861 - RNA, 64 nt, Homo Sapiens
aaaccauagaacaauuucacagauuucuuagacuccacaggacccaaaaugaccaaagacuguc

SEQ ID NO: 96862 - RNA, 64 nt, Homo Sapiens
gaaccuggcugcgaacugugcaguuacguugcauccacaggauuccaguugcgugucuguuucc

SEQ ID NO: 96863 - RNA, 64 nt, Homo Sapiens
uggcugugaaaauuacacccaugcacagaacaagccacaggaauaauaguucaggauuugguuu

SEQ ID NO: 96864 - RNA, 64 nt, Homo Sapiens
cuccuucaggacugguguggggccaggcccggcuccacaggagucguggagacauggccuaggg

SEQ ID NO: 96865 - RNA, 64 nt, Homo Sapiens
ccagcucagggcggaaggucggccgggccuugggccacaggagacauggcaggacagagcggga

SEQ ID NO: 96866 - RNA, 64 nt, Homo Sapiens
acggauucccuguaccucaaucccaacaccccaaccacaggagccacacaaaucagugaaugga

SEQ ID NO: 96867 - RNA, 64 nt, Homo Sapiens
ccuacucuuuggccacgagagacugaugauccaaccacaggauccccacaccucagccacugga

SEQ ID NO: 96868 - RNA, 64 nt, Homo Sapiens
gaaaaagaaaagaaagcaagaacagaaaacgaagccacaggaagggaaguagacauuguaugcu

SEQ ID NO: 96869 - RNA, 64 nt, Homo Sapiens
aacucugagcuugugcccagaaauuaccccaagaccacaggaacccuucaagaagcucccauca

SEQ ID NO: 96870 - RNA, 64 nt, Homo Sapiens
gagaagcuggccgggaccagccaggagcugggagccacaggaagcaaaagucagccuuuucuuc

SEQ ID NO: 96871 - RNA, 64 nt, Homo Sapiens
cggguuccuugaaccccacaaaaucccucuccaaccacaggacccuucggcucaccaagaacag

SEQ ID NO: 96872 - RNA, 64 nt, Homo Sapiens
cacucaugugugugcccacacucccgcccggaagccacaggaccccugaacgcucccaaccugc

SEQ ID NO: 96873 - RNA, 64 nt, Homo Sapiens
ggacuggugaugggcugucuucacugccagucacccacaggaagagugagugggcuccccgcug

SEQ ID NO: 96874 - RNA, 64 nt, Homo Sapiens
gccaguggccucccaacuugagacuucucuggucccacaggacaggcccugcuaggguggcacc

SEQ ID NO: 96875 - RNA, 64 nt, Homo Sapiens
ucagcugucccuccuucuacccaggccuucuccaccacaggacccuccuuggucacccucugcu

SEQ ID NO: 96876 - RNA, 64 nt, Homo Sapiens
cacggacuccugcaucguggcacuccucucgcaugguguggagggcgccaucuaugguguggau

SEQ ID NO: 96877 - RNA, 64 nt, Homo Sapiens
acuccucucgcaugguguggagggcgccaucuaugguguggaugggaaacugcuccaggugcgg

SEQ ID NO: 96878 - RNA, 64 nt, Homo Sapiens
ugaaggcuacauuccaguagccgagcucgggccugguguggaauuccagauccgaauccgacug

SEQ ID NO: 96879 - RNA, 64 nt, Homo Sapiens
ugcccuugcucagguucuuggaccccaggcagcugguguggagccccuuggccagggccauggg

SEQ ID NO: 96880 - RNA, 64 nt, Homo Sapiens
auauugaauggcucagaagcccugauuccaaacagguguggagauugaaacuaauguagagaug

SEQ ID NO: 96881 - RNA, 51 nt, Homo Sapiens
acgucagugugcaugccucuugguguggauagcuugucaguuggcaaauga

SEQ ID NO: 96882 - RNA, 64 nt, Homo Sapiens
acuaagccccgucugaccccagcccagacagcaagguguggaggcuccugugguaguccuccca

SEQ ID NO: 96883 - RNA, 64 nt, Homo Sapiens
ggaguggggugguuauguuuccaugguuaccauggguguggauggcaguguggggagggcaggu

SEQ ID NO: 96884 - RNA, 64 nt, Homo Sapiens
cgcugcugcuucugacuuugccucuguccugccugguguggagggcucugucuguugcugagga

SEQ ID NO: 96885 - RNA, 64 nt, Homo Sapiens
cuugggcagaguaaaaggugccaggaggagcauggguguggaaguccugucagccaagaaauaa

SEQ ID NO: 96886 - RNA, 64 nt, Homo Sapiens
cuuugaagacggagcugccccagcuguggcuggggguguggaggcagugggaugaacuggggga

SEQ ID NO: 96887 - RNA, 64 nt, Homo Sapiens
gggccccauggcuuuggcuggccacugaggguaggguguggagguguggaggcccccugaggag

SEQ ID NO: 96888 - RNA, 64 nt, Homo Sapiens
uggcuuuggcuggccacugaggguaggguguggagguguggaggcccccugaggagcugcggcg

SEQ ID NO: 96889 - RNA, 64 nt, Homo Sapiens
uacuaagguuuacacaggaauuccaccugaagacuuguguuaaaguucuacagcgcgcacuguu

SEQ ID NO: 96890 - RNA, 64 nt, Homo Sapiens
acagcaauaaaguacaguaauuuuacuuuuuuucuuguguuacaucuaaauuacaacccuuaau

SEQ ID NO: 96891 - RNA, 64 nt, Homo Sapiens
ugacugagaagauguuaauucagaguguccugauuuguguuaagccuacaccguggugagcaua

SEQ ID NO: 96892 - RNA, 64 nt, Homo Sapiens
uagguuguuagaaugagccuaauuggaaaggacuuuguguuauugcaaaaaagaacaguguuga

SEQ ID NO: 96893 - RNA, 64 nt, Homo Sapiens
cuagaauuauauucacuuggccugacuugcaauguuguguuaaauuguuaguaaaaugugcaca

SEQ ID NO: 96894 - RNA, 64 nt, Homo Sapiens
ucaguaaaaguuauggaguuagccuaaacugaauuuguguuauuaugucaggauuuagagaagg

SEQ ID NO: 96895 - RNA, 64 nt, Homo Sapiens
aaagguccuaaaaggaauuguuaggcggcaggcuuuguguuacguguuacauggagugagggua

SEQ ID NO: 96896 - RNA, 64 nt, Homo Sapiens
auuuccuugguuuuuuaaaggugauaauuuugcuuuguguuacuuuuuugcucuugaauguauc

SEQ ID NO: 96897 - RNA, 64 nt, Homo Sapiens
gagcuagaaaauuuuauguagauuaaaaauugcauuguguuacaggguugaacuuacuugaaug

SEQ ID NO: 96898 - RNA, 64 nt, Homo Sapiens
ugcuuuggcugaacuugauuagcucaccuguuuuuuguguuagguugaagaacagacugaccaa

SEQ ID NO: 96899 - RNA, 64 nt, Homo Sapiens
caugucauucauauaaacuguaguucuauauaguuuguguuaagacuucaaacuguguacugug

SEQ ID NO: 96900 - RNA, 64 nt, Homo Sapiens
gucauugauggacucuauuuccacauacacauuuuuguguuacacucugaagauggacucggcc

SEQ ID NO: 96901 - RNA, 64 nt, Homo Sapiens
uuaauuacauaaauuaaaccuuaccaugaccaaauuguguuaggacggccugcuaucuacagca

SEQ ID NO: 96902 - RNA, 64 nt, Homo Sapiens
uuaguauaucuugucgaucuuuaaguuguuacuauuguguuauucaugucuuuaaaucagauac

SEQ ID NO: 96903 - RNA, 64 nt, Homo Sapiens
aauguugugagcaacagauuucuacaguugguucuuguguuauacucaccucuacucuguauuu

SEQ ID NO: 96904 - RNA, 64 nt, Homo Sapiens
acuucagaaagauucaaacuguacagugggcuuauuguguuaaccaacguuuuaucuuuaugca

SEQ ID NO: 96905 - RNA, 64 nt, Homo Sapiens
agcuguacuuuuuugaguauuuuucuaauaaaaguuguguuauagaugcuauguuauguauaac

SEQ ID NO: 96906 - RNA, 64 nt, Homo Sapiens
acugauagccuucagcuacaagguguacgcgaaauuguguuauguguaauuccauaaugagcag

SEQ ID NO: 96907 - RNA, 64 nt, Homo Sapiens
aaugcacaucucucagauguuauggauugacauauuguguuaugaucacuggcuuucucaagag

SEQ ID NO: 96908 - RNA, 64 nt, Homo Sapiens
gaaaaugcaacauuagcaaaugcaguauucucaauuguguuacuauugacucuguuccuaacaa

SEQ ID NO: 96909 - RNA, 64 nt, Homo Sapiens
aauauuugucuaguacaaugcuugacauacagcauuguguuaugcccauuggggacacagaggu

SEQ ID NO: 96910 - RNA, 64 nt, Homo Sapiens
uauuucaaauuagaaaaguucaaaugaaguuuaauuguguuauuuuauaaaaccuucuaaaauu

SEQ ID NO: 96911 - RNA, 64 nt, Homo Sapiens
uaagauugauuauucauuuccucucaucuuucuuuuguguuauggucaguuugucuuuuugugc

SEQ ID NO: 96912 - RNA, 64 nt, Homo Sapiens
gaauguggcauuucaggguucuuuuguuuuguuguuguguuacuugguggcuugcugcuguaau

SEQ ID NO: 96913 - RNA, 64 nt, Homo Sapiens
augcaaauuuuuuaaauaggagaaaauuaagaaauuguguuaaaggccuaaaguucaggagugu

SEQ ID NO: 96914 - RNA, 64 nt, Homo Sapiens
accaguguguuagguucuaaugucaugacccaauuuguguuauucaucuuuaauccuguuuuca

SEQ ID NO: 96915 - RNA, 64 nt, Homo Sapiens
uagccaauauaacuaucucuaaacaccacuuuacuuguguuauaaaugaauggaggaacuuucc

SEQ ID NO: 96916 - RNA, 64 nt, Homo Sapiens
uguagauucagguaauacaaugugcuacaauucauuguguuaccuuaugccucagccacuugcc

SEQ ID NO: 96917 - RNA, 64 nt, Homo Sapiens
gcugcugccaugaucccuuugagagguggcucaaaagcuacagggaacuccagguccuuuauua

SEQ ID NO: 96918 - RNA, 64 nt, Homo Sapiens
caauauauacuguuguggguuggagaaaaguggaaagcuacacugggaagaaacucccuuccuu

SEQ ID NO: 96919 - RNA, 64 nt, Homo Sapiens
aaauauaagaucugagauugaauauuuucauuaaaagcuacaguuuugugaaucuuugugcuuc

SEQ ID NO: 96920 - RNA, 64 nt, Homo Sapiens
aaaaaaaaacucauuuauaccuguguauuuuuuaaagcuacaaucuguucaauguuuuuaaaaa

SEQ ID NO: 96921 - RNA, 64 nt, Homo Sapiens
uauuuuaugauagcacacuuuacucaagauguugaagcuacaguacuaucugccaggaaacugg

SEQ ID NO: 96922 - RNA, 64 nt, Homo Sapiens
auugaauauuuugauaaacuacagagaguggggaaagcuacauccuuguuagcaagcgugugug

SEQ ID NO: 96923 - RNA, 64 nt, Homo Sapiens
uuguuuuagcugguuucucuauuguuuauuuuaaaagcuacaaugauaauaaauaacgggcuuu

SEQ ID NO: 96924 - RNA, 64 nt, Homo Sapiens
auguccacaucuuauaucccggugccaucuccucaagcuacaaaacuuaauucucuuuucccua

SEQ ID NO: 96925 - RNA, 64 nt, Homo Sapiens
ugagaaauaaaauaaaauguguuucugaaugaaaaagcuacagccagugaaaagauggucucca

SEQ ID NO: 96926 - RNA, 64 nt, Homo Sapiens
uuugagugcuuuauaaacacagucauauacauguaagcuacaaugugugauuuuuauuuucaga

SEQ ID NO: 96927 - RNA, 64 nt, Homo Sapiens
guucacagggccaaauauucgcaugucuggugaaaagcuacaagaccccaccuucuccuuuuug

SEQ ID NO: 96928 - RNA, 64 nt, Homo Sapiens
uccauccuuauuucuuauucaagaacuuauaaugaagcuacaaaaggggagaacauuucugaaa

SEQ ID NO: 96929 - RNA, 64 nt, Homo Sapiens
acgggcucagcaaaagaugcuucucacugccaugccagcuuaucucaggggugugcggccuuug

SEQ ID NO: 96930 - RNA, 64 nt, Homo Sapiens
cugguugagguuucaaaccucccuuuccaaaugcccagcuuaaaggggcuagagugaacuuggg

SEQ ID NO: 96931 - RNA, 64 nt, Homo Sapiens
caggcauuaacucuccucaaaaacagaucaccagccagcuuacagccacccuggcaugccccac

SEQ ID NO: 96932 - RNA, 64 nt, Homo Sapiens
uuucucacacuucuggggaaccaaaaggaacugaccagcuuauaaugcccaguauucccacucu

SEQ ID NO: 96933 - RNA, 64 nt, Homo Sapiens
uuauaaugaaugggcauuguguaagaaacuaggaccagcuuaacuucaaggaaauaagagauuu

SEQ ID NO: 96934 - RNA, 64 nt, Homo Sapiens
aguuaaagggcaucacagugcaggcugggcaggcccagcuuauacugaagaggggcuuuauaag

SEQ ID NO: 96935 - RNA, 64 nt, Homo Sapiens
gcagugugaacaauagaugguaaaauuuggucuuccagcuuaauagcaauaguggagaaaaaug

SEQ ID NO: 96936 - RNA, 64 nt, Homo Sapiens
cagcacacuaaggugggcuucacuaacuauccaaccagcuuauauuuuaauauuauggggaaac

SEQ ID NO: 96937 - RNA, 62 nt, Homo Sapiens
uuuucuagcucagacaaacuuccuuuguuuuacagguacaagaguuucaguccucaaugcug

SEQ ID NO: 96938 - RNA, 62 nt, Homo Sapiens
aguucuuuuugauaugaaaauuuagaggguggcagguacaucgcaggguaauucuuaaacuu

SEQ ID NO: 96939 - RNA, 64 nt, Homo Sapiens
gaguaccuacuauaauacaguagcuaacauguauugagcacagauuuuuuuugguaaaacugug

SEQ ID NO: 96940 - RNA, 64 nt, Homo Sapiens
gcugcaagcuuuaccaaguaauuggcaugacaucugagcacagaaauuaaggcaaaaaaccaaa

SEQ ID NO: 96941 - RNA, 64 nt, Homo Sapiens
ccugcaagccaaacacgugaaucgguuugccuguugagcacacuagccuccaaucuuuaaaagu

SEQ ID NO: 96942 - RNA, 64 nt, Homo Sapiens
uaaaacuaaggcuucagccaaugaauauuccugaugagcacaagcuuucccucugugggagacu

SEQ ID NO: 96943 - RNA, 64 nt, Homo Sapiens
ggauucuuuuccuaguucuacaccuuuuguuguuugagcacaagaagcauaguucuuccauaac

SEQ ID NO: 96944 - RNA, 64 nt, Homo Sapiens
aagagacucuuguagcaguggaaaauucuguaucugagcacaucaugaaccauuuuccucuucu

SEQ ID NO: 96945 - RNA, 64 nt, Homo Sapiens
aguccauugccuguuuuuuuaaauaagguuuuacugagcacagccacacucauuuguuuaugca

SEQ ID NO: 96946 - RNA, 64 nt, Homo Sapiens
uguaauuuaacaagucaaauaaaauaaucauugcugagcacaaucacauguugaaacaagugug

SEQ ID NO: 96947 - RNA, 64 nt, Homo Sapiens
guggucagaggggagcaaugggcuuugcugcuuaugagcacagaggaauucaguccccaggcag

SEQ ID NO: 96948 - RNA, 64 nt, Homo Sapiens
ccuuagggccucauuugcucuucauccagggaacugagcacagggggccuccaggagacccuag

SEQ ID NO: 96949 - RNA, 64 nt, Homo Sapiens
cuugcuuuuuugccccucggaagcauggggcuuuugagcacacuuaaaaaaagaaaaaucugua

SEQ ID NO: 96950 - RNA, 64 nt, Homo Sapiens
auuuguuaccuuccugaggccucaguauuagucgugagcacaaaguuuugagaccuuuggcguu

SEQ ID NO: 96951 - RNA, 64 nt, Homo Sapiens
cgaccucauucaucgccugcccccuacccaauucugagcacacgguacuguagcccccaguucc

SEQ ID NO: 96952 - RNA, 64 nt, Homo Sapiens
gacccacccccaagcagggcuccucuccccagggugagcacaggaccucuguaagcugcuugug

SEQ ID NO: 96953 - RNA, 64 nt, Homo Sapiens
uucuuccagcaaaaugcuuauuagaguuuuugucugagcacaguagccuggcccugcauaucuu

SEQ ID NO: 96954 - RNA, 64 nt, Homo Sapiens
acacacacacacacacacacacacacacacacucugagcacauuaucugugauucuuucauccu

SEQ ID NO: 96955 - RNA, 64 nt, Homo Sapiens
cugggugaagucacagcucaauuuguaacaacucugagcacaugagcuuaauuuggcagagaaa

SEQ ID NO: 96956 - RNA, 64 nt, Homo Sapiens
augcgggggccaagaugauggccuccagcuuuacugagcacaggccaacucccaaagccagccu

SEQ ID NO: 96957 - RNA, 64 nt, Homo Sapiens
gggugccccaggcuagcucuucuaccucuggggcaccacggacuccccuuggccacucuuggga

SEQ ID NO: 96958 - RNA, 62 nt, Homo Sapiens
cuaccuggccguccaaauagaucccccaggguaccacggaggcgaaggaguuggagguguuu

SEQ ID NO: 96959 - RNA, 64 nt, Homo Sapiens
ccuggguggcgcccuggcgagcaggccaaccggcaccacggacuccaaaccucgcagggcucca

SEQ ID NO: 96960 - RNA, 64 nt, Homo Sapiens
ggaagagcagcucuggcuauggccugagccauucaccacggacaguagaagcugcuggaaggca

SEQ ID NO: 96961 - RNA, 64 nt, Homo Sapiens
cccacagggccugggcaguugcccugcgccuguuaccacggauggucaagcuugggcucucaaa

SEQ ID NO: 96962 - RNA, 64 nt, Homo Sapiens
auuuggcaaucaaggccccaaggccaguccaaacaccacggagcuguccgugcacaugguuuaa

SEQ ID NO: 96963 - RNA, 64 nt, Homo Sapiens
aagucuuaacaaaacucagguagcugucugagugaccacggacagcuauugaagugucuuugga

SEQ ID NO: 96964 - RNA, 64 nt, Homo Sapiens
ucaacuugaagugcaagauucucuuauuuccgggaccacggagagucugacuuaacuacauaca

SEQ ID NO: 96965 - RNA, 64 nt, Homo Sapiens
cucuuuaauauuguacaguuaaaagguuauacguaccacggauuuaaguuguucauguugcaga

SEQ ID NO: 96966 - RNA, 64 nt, Homo Sapiens
gcacacucccuuacccccggucacccauguggggaccacggaaggcacugguccuaugccagcc

SEQ ID NO: 96967 - RNA, 64 nt, Homo Sapiens
gugcggagcuguuagggacgggcccagcuccugcaccacggacacagaaugucuggagagggcc

SEQ ID NO: 96968 - RNA, 64 nt, Homo Sapiens
ccuagaaacucagccaaggagaaggaccaguuggaccacggaccaauaaguuuaauuauaaagu

SEQ ID NO: 96969 - RNA, 64 nt, Homo Sapiens
uuugccuucauguguagaauuguaauuucugucaaccacggacgggacuggggauucuggccag

SEQ ID NO: 96970 - RNA, 64 nt, Homo Sapiens
aggguggaggaauagacuucgaguucuggaagugaccacggaccucaccuccugagccacuuca

SEQ ID NO: 96971 - RNA, 64 nt, Homo Sapiens
uuuuuucucaguggcccaugaccucuaggccccaaccacggauuucacagggauagacuacaac

SEQ ID NO: 96972 - RNA, 64 nt, Homo Sapiens
gaugucucuaaguggaccucagugccucugcgugaccacggaaacucacugguacaguggggag

SEQ ID NO: 96973 - RNA, 64 nt, Homo Sapiens
uuggacucacuguggcuggaagugcggcuggaggaccacggacauucaagcauaaaccuuagcg

SEQ ID NO: 96974 - RNA, 64 nt, Homo Sapiens
gaagggcacugugaagcagucuuggccacacaguaccacggaaggagucaucagaaguguacuu

SEQ ID NO: 96975 - RNA, 64 nt, Homo Sapiens
gaucgccagcccgaggacuuaccauccacaaugcaccacggaagaggccguucuaugaaaaacu

SEQ ID NO: 96976 - RNA, 64 nt, Homo Sapiens
gccuccgguugggucugcauuuuggagaguccacaccacggaccagguuuucccccaaggcuug

SEQ ID NO: 96977 - RNA, 64 nt, Homo Sapiens
gggcugcggggucaggggcuaagggugggaagcuaccacggauuaggagacaaagcaagaccag

SEQ ID NO: 96978 - RNA, 64 nt, Homo Sapiens
uagccacucacccuucacaaacugaaguccauggaccacggaagucgagaauuaauguacaccu

SEQ ID NO: 96979 - RNA, 64 nt, Homo Sapiens
ugugaugaccaguuguccuccaaaaaccucacucaccacggagucacccugagggccccgggca

SEQ ID NO: 96980 - RNA, 64 nt, Homo Sapiens
ccaccagaccccaggccucaccggaggcccggugaccacggaacucaccgucugggggaggagg

SEQ ID NO: 96981 - RNA, 64 nt, Homo Sapiens
ccagccacucucgggggcagacccgcccagcagcaccacggaccgcauggguggcaggguuugg

SEQ ID NO: 96982 - RNA, 64 nt, Homo Sapiens
cacagggguccugcuccugagcaaacagggcaagaccacggaggugcagggccacaugcugccu

SEQ ID NO: 96983 - RNA, 64 nt, Homo Sapiens
caauccacgcuucuccggaucgcggugcgccggaaccacggaggaugaugccaguuacuugcuu

SEQ ID NO: 96984 - RNA, 64 nt, Homo Sapiens
ggagccauuagcucuuaaauuauucacagaagucaccacggaagguuguuuaagaugcagauuc

SEQ ID NO: 96985 - RNA, 64 nt, Homo Sapiens
agagcgcaucaggccuggcaacugguagaacguaaccacggaaaggagaagggauggaggucac

SEQ ID NO: 96986 - RNA, 64 nt, Homo Sapiens
gaggcaggcauugucucauuuuucaaugucacaaaccacggagcacucaucuacaaguucucug

SEQ ID NO: 96987 - RNA, 64 nt, Homo Sapiens
cacguggggagggcugccucagcagguuucucagaccacggagaagugacuuuugggcccgggg

SEQ ID NO: 96988 - RNA, 64 nt, Homo Sapiens
uuuccaucagguuccaucccgcagccuccuccugaccacggacgcagcccggcgccaccauccu

SEQ ID NO: 96989 - RNA, 64 nt, Homo Sapiens
ugacuggacuguggcucugaaccuugagcauaguaccacggacuccgugggcgcucaauaaaca

SEQ ID NO: 96990 - RNA, 64 nt, Homo Sapiens
ugggaaugcaucuugugggagcagcuucacucccaccacggaccaaugccuuucccccauaggc

SEQ ID NO: 96991 - RNA, 64 nt, Homo Sapiens
aacugacucuggucuugggaggugaggcuucccaaccacggaagacuacuuuaaaugaaaaaaa

SEQ ID NO: 96992 - RNA, 64 nt, Homo Sapiens
aaggauugauuugcaaccagaaagggagcugaaaaccacggagcuccauggcucuucauucaaa

SEQ ID NO: 96993 - RNA, 64 nt, Homo Sapiens
cuuccaucuaagauuucuucugccauuucuccccaccacggaacuacacagcugcaucagacaa

SEQ ID NO: 96994 - RNA, 64 nt, Homo Sapiens
uaucugagcagcuucaaagaccccugagcugccaaccacggagaugugccaagcaucucaucuc

SEQ ID NO: 96995 - RNA, 64 nt, Homo Sapiens
cccugccaccauggggccucccgauacggcaaccaccacggaccuguggggaccaaugaggaaa

SEQ ID NO: 96996 - RNA, 64 nt, Homo Sapiens
gugagaccaucugaggccgcccugcuccacugccaccacggagucauccgcugugacugcggag

SEQ ID NO: 96997 - RNA, 64 nt, Homo Sapiens
ggacagcgccucuugggcuggcuccguccacagcaccacggagaagagccgggagagagccgca

SEQ ID NO: 96998 - RNA, 64 nt, Homo Sapiens
uaucugcacucacccaggccuucacccagacuuuaccacggaggcggcugagugcagcuacagc

SEQ ID NO: 96999 - RNA, 64 nt, Homo Sapiens
ucccucucuggagaaagggcccugggccugccucaccacggaccaaagggagucugccagggcc

SEQ ID NO: 97000 - RNA, 64 nt, Homo Sapiens
uuuaccuccugccuuuggauugacucugcauuugaccacggacuccagucuguguguagggaga

SEQ ID NO: 97001 - RNA, 64 nt, Homo Sapiens
ccagccucagaaggccccagagagacccugcaagaccacggagggagcgacacuugaauguaga

SEQ ID NO: 97002 - RNA, 64 nt, Homo Sapiens
aacuggaaaaccaucagccauucacaaaggauaaaccacggagccucugauugucacuugcauc

SEQ ID NO: 97003 - RNA, 64 nt, Homo Sapiens
ucuccuugcccuagaugagcgcuggccaguuggaaccacggagagcagugagggguauaucugg

SEQ ID NO: 97004 - RNA, 64 nt, Homo Sapiens
gguaacggucauacauuagguuugauuguuacuaaccacggauguugcuguaagaaguguugcc

SEQ ID NO: 97005 - RNA, 64 nt, Homo Sapiens
ggguggauggagcucagaaggaaaccccagccccaccacggaugacaccaucccucccguccca

SEQ ID NO: 97006 - RNA, 64 nt, Homo Sapiens
caaagcuccaccaggaggcugguucacguccccuaccacggaagcgaggucccagaaggccagc

SEQ ID NO: 97007 - RNA, 64 nt, Homo Sapiens
uccucaagucacugguggcuugcugccguucauuaccacggagaagaggacuacgaugagugug

SEQ ID NO: 97008 - RNA, 64 nt, Homo Sapiens
uucgggggccucuggcugcugaaggauucggucuaccacggagggcugugcuguuaggcugcau

SEQ ID NO: 97009 - RNA, 64 nt, Homo Sapiens
auauauuagcuucaacuuuagcacuuaaaucauuaccacggaagaagaaagccaagcaucacuu

SEQ ID NO: 97010 - RNA, 64 nt, Homo Sapiens
agggucaccaacccagaucuagggucucugcuuuaccacggagcucagauucuaugagaaaccc

SEQ ID NO: 97011 - RNA, 64 nt, Homo Sapiens
gugccccuugcgcgccaucgggcuggggcgcggcaccacggacgccacggacggcccagacccg

SEQ ID NO: 97012 - RNA, 64 nt, Homo Sapiens
caccgaguuccagguaguggaaauaggaaaguuaaccacggaggcagccuuuaaaucacaagca

SEQ ID NO: 97013 - RNA, 64 nt, Homo Sapiens
uccggcauccccuccccagacugccugcugucaaaccacggagcagcuggagccugcccugucc

SEQ ID NO: 97014 - RNA, 64 nt, Homo Sapiens
cggacagaggaccaccucccgggcacagccccucaccacggacacuccucucuaggcagcgggu

SEQ ID NO: 97015 - RNA, 64 nt, Homo Sapiens
gcgucugugugcgcaucuugucauuccccauaaaaccacggacaggagaacugaccagcccuca

SEQ ID NO: 97016 - RNA, 64 nt, Homo Sapiens
cuuucucacagcccagccugcucuuuugcuucugaccacggaggcucccggcuugucccagccc

SEQ ID NO: 97017 - RNA, 64 nt, Homo Sapiens
gguccacguggauugucucagggaagccuugaaaaccacggagguggaugccaggaaagggccc

SEQ ID NO: 97018 - RNA, 64 nt, Homo Sapiens
cauguauggugauagguaucuagagcuuaaugcuacaugugagugacgaugauguacagauucu

SEQ ID NO: 97019 - RNA, 64 nt, Homo Sapiens
uauaugcuuuauuaauguuuucaaaagguauuauacaugugauacauuuuuuaagcuucaguug

SEQ ID NO: 97020 - RNA, 64 nt, Homo Sapiens
uauucaaugaaagugaaaaaaaaacaaacuaaagacaugugacugugaaaaguaagaccaagaa

SEQ ID NO: 97021 - RNA, 64 nt, Homo Sapiens
aaagcaaauuagaacauucuaaaauguagcaacuacaugugauauauuuaaaucauguuuuccu

SEQ ID NO: 97022 - RNA, 64 nt, Homo Sapiens
aucuucaugccauuacagcuuucuagaugcuaauacaugugacuaucguccaauuugcuuucuu

SEQ ID NO: 97023 - RNA, 64 nt, Homo Sapiens
uagugacauuaaauuuggcuauaaaagauggacuacaugugauacuccuauggacguuaauuga

SEQ ID NO: 97024 - RNA, 64 nt, Homo Sapiens
ugcacaugugugaagugcauuacgagacauagcuacaugugaugcaugugacaugugaaagaca

SEQ ID NO: 97025 - RNA, 64 nt, Homo Sapiens
gacauacgagacauagcuacgugauacacaugugacaugugaaaucacuccccccauacucuuu

SEQ ID NO: 97026 - RNA, 64 nt, Homo Sapiens
ugugaaagacauacgagacaacucuuugugauacacaugugacaggauuauucacuccccccau

SEQ ID NO: 97027 - RNA, 64 nt, Homo Sapiens
aauaggaucccaugagaacauuauacuggaaguuacaugugauacccagcuaaagaauacauau

SEQ ID NO: 97028 - RNA, 64 nt, Homo Sapiens
gccacaaaacacaagugguaugcuuuagaucugcacaugugaauuuagcauaaucacugggaau

SEQ ID NO: 97029 - RNA, 64 nt, Homo Sapiens
aggggggcggugguuauuauaaggaauuggcucacgugauuauggaggcgguuaaaucccaaga

SEQ ID NO: 97030 - RNA, 64 nt, Homo Sapiens
gaggaaggcuguuuucacaaaugacuuguaaugucgugauuaaaaaaauuccuauauucuucug

SEQ ID NO: 97031 - RNA, 64 nt, Homo Sapiens
uuagcaacugagaucaaagcacucuuccacuuuacgugauuaaaaucaaaccuguaucagcaag

SEQ ID NO: 97032 - RNA, 64 nt, Homo Sapiens
auagcucugugauuauaagcuacagguauaguuccgugauuauguuuucaaacacaaggucucu

SEQ ID NO: 97033 - RNA, 64 nt, Homo Sapiens
agcauuggauccaagccauauauugaaauacaagcgugauuaaucaguaauucacauugccgau

SEQ ID NO: 97034 - RNA, 64 nt, Homo Sapiens
ugucaaagugcacacuguacuuucuucuuaaaaacgugauuaaagagaucacuuuguccggaug

SEQ ID NO: 97035 - RNA, 64 nt, Homo Sapiens
cgaguucuucccgcauuacugcuguuuaauagaacgugauuagucaucgccgagaagaaagcau

SEQ ID NO: 97036 - RNA, 64 nt, Homo Sapiens
acccuacuccaaauuguagaagcuuugcuuuucacgugauuaagcagguucacuaaaugugaac

SEQ ID NO: 97037 - RNA, 64 nt, Homo Sapiens
ucaaaagagaugaaagguauguagaacagguucacgugauuaccuuuuucuuuuggcuuggauu

SEQ ID NO: 97038 - RNA, 64 nt, Homo Sapiens
agauaaaaguuguuauugauguauaaacucguugcgugauuagugauguuggaagcauuuuagc

SEQ ID NO: 97039 - RNA, 64 nt, Homo Sapiens
cuaucacgagaacagcaugggaaagaccugcccccgugauuaaauuauuucccaccaggccccu

SEQ ID NO: 97040 - RNA, 64 nt, Homo Sapiens
uucaucuacuuagaaauuguagcuguauaaacaucgugauuauagcuuccaaauuaugcuuuau

SEQ ID NO: 97041 - RNA, 64 nt, Homo Sapiens
augcaagugaacaaagugaguacuuuaggaaauacgugauuaauugguguggucuacuaaauaa

SEQ ID NO: 97042 - RNA, 64 nt, Homo Sapiens
ucaauccuguucuuuguuuaagagcaauacuugucgugauuacagggagauccuuuaguaaaau

SEQ ID NO: 97043 - RNA, 64 nt, Homo Sapiens
acugugcuguuguuaugaugugcuuaacagggaacgugauuagugaaaggaagauaaacgugga

SEQ ID NO: 97044 - RNA, 64 nt, Homo Sapiens
cgcaaaugcaaacaguuucagggucaugaccuuucgugauuaucgguaggagagauggauucug

SEQ ID NO: 97045 - RNA, 64 nt, Homo Sapiens
agaggaaaauuauuuuggggaggaacuacacagucgugauuagaauuuaucugaugguuuugua

SEQ ID NO: 97046 - RNA, 64 nt, Homo Sapiens
ccagcagcuuaauggauuucauggaaugaaauaccgugauuaacucauagcuacauaucauugc

SEQ ID NO: 97047 - RNA, 64 nt, Homo Sapiens
acugaucaaagggaguccagucaacgugagcaagcgugauuaugaugaggaagcccccucugcu

SEQ ID NO: 97048 - RNA, 64 nt, Homo Sapiens
gugauaaaaccccauaucugcugaaauggccagucgugauuaaaguuuggcugguuuucucuca

SEQ ID NO: 97049 - RNA, 64 nt, Homo Sapiens
ucaacgcagaagaauggacgaaaugaccauccaacgugauuaaggauaggaaucgguaguuugg

SEQ ID NO: 97050 - RNA, 63 nt, Homo Sapiens
aaaauuuauuguaugaaaauuaagccucaauaaacgugauuauaaaaaacaagucugcaagga

SEQ ID NO: 97051 - RNA, 64 nt, Homo Sapiens
aacaagaagggaucagaugccacaucguuuuugucgugauuaauuuaacuuaaacuaaaauuuu

SEQ ID NO: 97052 - RNA, 64 nt, Homo Sapiens
ugguauugcaguguggagacuauugagguagcuacgugauuaaaaauguggagacauggaguuu

SEQ ID NO: 97053 - RNA, 64 nt, Homo Sapiens
ugggggucuguccacccuggaacucugagucagacgugauuaucgccaguuuccacugugcggg

SEQ ID NO: 97054 - RNA, 64 nt, Homo Sapiens
acccugaccuccaucaucauaauggccaauguuccgugauuauucacagaucagucugucaaua

SEQ ID NO: 97055 - RNA, 64 nt, Homo Sapiens
ccucuuucugucucugaucagagccgacaccagacgugauuagcaggcgcagcaaauucaauuu

SEQ ID NO: 97056 - RNA, 64 nt, Homo Sapiens
uuaagagagguaaauuuaguauuuuuagauaacucgugauuaucuguaacaagggugccauggu

SEQ ID NO: 97057 - RNA, 64 nt, Homo Sapiens
agcccguaugaucacguagaccgcauggagcccccgugauuagucccccccaccaguccugccc

SEQ ID NO: 97058 - RNA, 64 nt, Homo Sapiens
gucuguaaaggugugacuuuccacuccacucgcacgugauuacacucccaccauccugugaacc

SEQ ID NO: 97059 - RNA, 64 nt, Homo Sapiens
caugcacaccaacaugcauguagaucgcagcaggcgugauuacacccccccccguccccgcacg

SEQ ID NO: 97060 - RNA, 64 nt, Homo Sapiens
gucucugcguaaucaggacuggagaugcaugaaacgugauuaaccagauuagaacaugaugauu

SEQ ID NO: 97061 - RNA, 64 nt, Homo Sapiens
gauuacaggcaugagccacugcacucggcuguaccgugauuauuaguucaagguucucuuucac

SEQ ID NO: 97062 - RNA, 64 nt, Homo Sapiens
uccaaugugaaaacaguuguaccuauugauuccucgugauuauucaaucagucaguuagccuaa

SEQ ID NO: 97063 - RNA, 64 nt, Homo Sapiens
acagcuuccccaucgccuucgccuucuggggagggacacagaggcagagagcggcuuccccauu

SEQ ID NO: 97064 - RNA, 64 nt, Homo Sapiens
acggcuuccccaucgccuucgccuucuggggagggacacagaggcagaggauggcuuccccauu

SEQ ID NO: 97065 - RNA, 64 nt, Homo Sapiens
uaacuaaaaacagucucaccuuucuuaaugaauagacacagaaugacuuucuaauuugaccaga

SEQ ID NO: 97066 - RNA, 64 nt, Homo Sapiens
guccauacgcugagccacgucagccuuuucccuggacacagaugaacugcuaacuccuaggaaa

SEQ ID NO: 97067 - RNA, 64 nt, Homo Sapiens
gaaagggcaucucagccucugauuaucuucugaugacacagaaucuggcauucaaucguuggca

SEQ ID NO: 97068 - RNA, 64 nt, Homo Sapiens
guaucuuuuggaaaguuuagucuaguaaccagaggacacagaaaugguuuagugcucaguuggc

SEQ ID NO: 97069 - RNA, 64 nt, Homo Sapiens
ucggucauaaagaauguaagcagucaugaggaaagacacagauuccaaauugggagauaauuau

SEQ ID NO: 97070 - RNA, 64 nt, Homo Sapiens
ucccuaggagggaaggagcucaaagugggggguggacacagaagcuagccacaguucuaagacc

SEQ ID NO: 97071 - RNA, 64 nt, Homo Sapiens
ccucguucugccagcuggagccaagaagcacagagacacagaggcgccugccccucagcuccgc

SEQ ID NO: 97072 - RNA, 64 nt, Homo Sapiens
ggucuguacagugacaacccgggccggcagcaaggacacagaugcagccacaguaaggcuccau

SEQ ID NO: 97073 - RNA, 64 nt, Homo Sapiens
gacccaugccuacuccaugccaggcccagugcuggacacagagacaugaagcucugucuguggg

SEQ ID NO: 97074 - RNA, 64 nt, Homo Sapiens
acaugaagcucugucugugggagacagggauucugacacagacaccggacaaaccauugucuug

SEQ ID NO: 97075 - RNA, 64 nt, Homo Sapiens
uggugagagccugaggcugguguucagggcccuggacacagacacagagcagccgcaucucaaa

SEQ ID NO: 97076 - RNA, 64 nt, Homo Sapiens
gagccugaggcugguguucagggcccuggacacagacacagagcagccgcaucucaaaggcaga

SEQ ID NO: 97077 - RNA, 64 nt, Homo Sapiens
ugcacaggggaggccgagcaaggggacacuuacggacacagaaauuguggacacagaaaugcac

SEQ ID NO: 97078 - RNA, 64 nt, Homo Sapiens
ugcacaggggacacuuacggauaguagucuuguggacacagaaagugaggugucuacaggguuu

SEQ ID NO: 97079 - RNA, 64 nt, Homo Sapiens
cggccuccuugaagauccugauaaaugaagaaaagacacagagaaggaugugacaugccugggc

SEQ ID NO: 97080 - RNA, 64 nt, Homo Sapiens
cugccgugcaguuggggguggggcgugguguuuagacacagauaggaguccaggguaugacuga

SEQ ID NO: 97081 - RNA, 64 nt, Homo Sapiens
ucuucccuuugcccuucuccuccaauacauaaaggacacagacaaggaacuugcugaaaggcca

SEQ ID NO: 97082 - RNA, 64 nt, Homo Sapiens
acccacauggggacauaagcuaauuuuuuuacaggacacagaauucuguucaaugcuguuaaau

SEQ ID NO: 97083 - RNA, 64 nt, Homo Sapiens
uaaaguaauuuccccaagguggccaggaaaccgagacacagagguccaaauuucucauucuuca

SEQ ID NO: 97084 - RNA, 64 nt, Homo Sapiens
ucuuucacuugucuuuaacauauuucauacugaagacacagaaacuuuuuaucuauaauccuaa

SEQ ID NO: 97085 - RNA, 64 nt, Homo Sapiens
aggaggacacguggagacaggaagaggagacacagacacagagcagguguccuuccaagagaca

SEQ ID NO: 97086 - RNA, 64 nt, Homo Sapiens
cagagcaggaggacacgugggagacagaagaggagacacagacacaugacagguguccuuccaa

SEQ ID NO: 97087 - RNA, 64 nt, Homo Sapiens
caaagcaggaggccacauaagagacggaagaggagacacagacaccaauccagugucccuauga

SEQ ID NO: 97088 - RNA, 64 nt, Homo Sapiens
uauagccaagacugaagaaaccaaauauauguguuuacuguagcaugucuucaaauuaguggaa

SEQ ID NO: 97089 - RNA, 64 nt, Homo Sapiens
uagagugugaagucaguuacuuguugauguuuucuuacuguaucaaugaaauacauauugucau

SEQ ID NO: 97090 - RNA, 64 nt, Homo Sapiens
guuaagagaagcacuaagaaccgaauucauuaauuuacuguagugucauagaauugauuacccg

SEQ ID NO: 97091 - RNA, 52 nt, Homo Sapiens
ugcaauaguugacuuuuaacccuuacuguaaguggcauaucuaauaagauag

SEQ ID NO: 97092 - RNA, 64 nt, Homo Sapiens
aauauaagaauugguuauuugggggcuuuuuuacuuacuguauuuaaaaauacaaggguauuga

SEQ ID NO: 97093 - RNA, 64 nt, Homo Sapiens
uucaugucagacuaguuacuuuguugauucucaguuacuguaggcaucaaaaggcaaaaaucaa

SEQ ID NO: 97094 - RNA, 64 nt, Homo Sapiens
cuuaguugcuguguagcuaaggagaaauuaaauauuacuguacuucacuggauuaucauaaaag

SEQ ID NO: 97095 - RNA, 64 nt, Homo Sapiens
gacucaaaagguauuuaagauuggauuuaucucuuuacuguaauuauguucucccuuuuccauu

SEQ ID NO: 97096 - RNA, 64 nt, Homo Sapiens
gaagauuggaagacuuauauugagaccaguaacuuuacuguaaauuuacuuuguuucauugaaa

SEQ ID NO: 97097 - RNA, 64 nt, Homo Sapiens
cacuaugagaacuaccguguuagugguuuuucacuuacuguauauuacccuuguaggaauaguu

SEQ ID NO: 97098 - RNA, 64 nt, Homo Sapiens
uuguuuacaucuggauuuucuguauucuauucuuuuacuguacacuauuuugggaauuuuuagu

SEQ ID NO: 97099 - RNA, 64 nt, Homo Sapiens
gauuauuucaucacccagguugugucauggggguuuacuguacaguuuguuacauagguaaacu

SEQ ID NO: 97100 - RNA, 64 nt, Homo Sapiens
auauucuaaaacacugucaauacagaaaucuuguuuacuguaugacuauggauaaauuaacuuu

SEQ ID NO: 97101 - RNA, 64 nt, Homo Sapiens
uacacauauuaaaaggcaaauuagccauugguacuuacuguagcaaaauguuagcuucaauuaa

SEQ ID NO: 97102 - RNA, 64 nt, Homo Sapiens
uucuuuguuagcucacuuuauaauuuguauuuuuuuacuguauagacuaaauauauucuauuua

SEQ ID NO: 97103 - RNA, 64 nt, Homo Sapiens
auaggcaauauuauauugacaccuuuuacagaucuuacuguagcuuuuuccauauaaauaaaau

SEQ ID NO: 97104 - RNA, 64 nt, Homo Sapiens
acuguauuauccucacaugacuuuuuuucuugucuuacuguaccuuaaaaggugauagaguaau

SEQ ID NO: 97105 - RNA, 64 nt, Homo Sapiens
guugcauucccuauauuuauuuacuuccaauauuuuacuguaaaaguagggagaaauauuaugu

SEQ ID NO: 97106 - RNA, 64 nt, Homo Sapiens
uaugaauaauuaugcuauaaaaugguuuagaguuuuacuguaacugcugaaauauucuaaauaa

SEQ ID NO: 97107 - RNA, 64 nt, Homo Sapiens
uuauaaaauacgaacuauugucaucaaauuuauauuacuguauuauuaaaaaaauccauguguu

SEQ ID NO: 97108 - RNA, 64 nt, Homo Sapiens
auguccaaaacauuccuuucagccuuuuuauuucuuacuguacugucucuuacuguacugucua

SEQ ID NO: 97109 - RNA, 64 nt, Homo Sapiens
cuuucagccuuuuuauuucuuacuguacugucucuuacuguacugucuaucugcaguaauugag

SEQ ID NO: 97110 - RNA, 64 nt, Homo Sapiens
agcagcuugcugagccccucacuguagaaguggcuuacuguagauauuuccuguuugaaggcuu

SEQ ID NO: 97111 - RNA, 64 nt, Homo Sapiens
aguggcuuacuguagaagcauccuguuugaaggcuuacuguagaccuucauuuuaugcuuuauu

SEQ ID NO: 97112 - RNA, 64 nt, Homo Sapiens
cgguuguaacacagugcuaauauuacuguacugauuacuguaggaccuacaaaccuguauggca

SEQ ID NO: 97113 - RNA, 64 nt, Homo Sapiens
gauuacuguaggcgguuguaaccuguauggcauauuacuguacucuauugcuccuaaccuacaa

SEQ ID NO: 97114 - RNA, 64 nt, Homo Sapiens
uacaaguuuauuuaucaaggauauuuuguacaucuuacuguauuuggcauccuaucacuaugug

SEQ ID NO: 97115 - RNA, 64 nt, Homo Sapiens
uugugggacaaagaaaaaaguaaguuaacuguaauuacuguauucaucuuaaugucaagcucau

SEQ ID NO: 97116 - RNA, 64 nt, Homo Sapiens
gggaauuucuaguguuucccuaaaguaaggcccauuacuguaucaugcuuguuccugcugcuaa

SEQ ID NO: 97117 - RNA, 64 nt, Homo Sapiens
uuuuagauucuaagguucaaugguugguuuuaaauuacuguaaggaaaaauuaggaugugauuu

SEQ ID NO: 97118 - RNA, 64 nt, Homo Sapiens
acugugagccagaagaagauggauuugaacucaguuacuguacauaaacuagugaaugaaccca

SEQ ID NO: 97119 - RNA, 64 nt, Homo Sapiens
ugucccaggcaaugugcuaaauggugggaagcaguuacuguauauugggcuuuucaguaucugu

SEQ ID NO: 97120 - RNA, 64 nt, Homo Sapiens
aauauuaaaaagcuguuuccccaucacaucuucuuuacuguaaaaguuacauuuucauuaugcc

SEQ ID NO: 97121 - RNA, 64 nt, Homo Sapiens
gaauacaguauaaugacuacaauguuugcaauuguuacuguauugaggcccaccuugcucuuac

SEQ ID NO: 97122 - RNA, 64 nt, Homo Sapiens
agcccaucugaugcuucuauuguuaccucaauucuuacuguagugaaacaaaaagguauuuugc

SEQ ID NO: 97123 - RNA, 64 nt, Homo Sapiens
guuuauggagauuaaugaaaauggaaauguuagguuacuguaugaugaaauaguucauguucag

SEQ ID NO: 97124 - RNA, 64 nt, Homo Sapiens
gcugacuguguacucagguaugauaucugucauuuuacuguauauccugaaaauuuuaagacug

SEQ ID NO: 97125 - RNA, 64 nt, Homo Sapiens
aaaucauuguuguaucaucaguaaagaccaauccuuacuguaggagcccuaucucaguugguca

SEQ ID NO: 97126 - RNA, 64 nt, Homo Sapiens
uucuguggcuuauaguucuguuguauugaauuuauuacuguacaaagaaaauguauucucugcu

SEQ ID NO: 97127 - RNA, 64 nt, Homo Sapiens
cguuuuguauuagaggaaacuuguaucacagaucuuacuguacauagaauuguaauauguuuac

SEQ ID NO: 97128 - RNA, 64 nt, Homo Sapiens
gauaugauaggcaacagacugaaaaccauaaucuuuacuguauucuaugcauucaaaugugguc

SEQ ID NO: 97129 - RNA, 64 nt, Homo Sapiens
uuaauacgugucggucauauacaguauugaauuuuuacuguauaguaauucuggaaagagcaaa

SEQ ID NO: 97130 - RNA, 64 nt, Homo Sapiens
auauuaucuuguuagauuuguuaccaguaaaauauuacuguaauuucauauacacagucuauac

SEQ ID NO: 97131 - RNA, 64 nt, Homo Sapiens
auauauucuuacaagaguguaagggcucacacauuuacuguacucagaucugaaagacaauguu

SEQ ID NO: 97132 - RNA, 64 nt, Homo Sapiens
gcacaagaaagaagugacauucuguuacauuuuauuacuguaugaaauuuaauagauaucuauu

SEQ ID NO: 97133 - RNA, 64 nt, Homo Sapiens
gaauaacugaguuuccuauaauuuuucaaaaacauuacuguaauacauuggugguauugcagga

SEQ ID NO: 97134 - RNA, 64 nt, Homo Sapiens
auuuugucuuucuuuccuuuuugacuuuaguagcauccuccacacauuugugugccugauuuga

SEQ ID NO: 97135 - RNA, 64 nt, Homo Sapiens
acgauguuuaacugaagaauuggcuaauguuuugauccuccagugugacuguuguuuuuguuug

SEQ ID NO: 97136 - RNA, 64 nt, Homo Sapiens
ccccaagcucaacccauaaccucaaccacaucuuauccuccaccccacaucccaccacauccac

SEQ ID NO: 97137 - RNA, 64 nt, Homo Sapiens
aucaucccccugagcucacccuuaacuccaauuuauccuccaagccuaucucucaccauccagc

SEQ ID NO: 97138 - RNA, 64 nt, Homo Sapiens
uccuggguucaagugauucuucucggcucacugcauccuccaccacuggaguccaguggcacaa

SEQ ID NO: 97139 - RNA, 64 nt, Homo Sapiens
cucggccucccaaagugcugccuggccuccagugauccuccaucgacaggggucucgcugaacu

SEQ ID NO: 97140 - RNA, 64 nt, Homo Sapiens
guucacaagaggagacgugacguggugggcugagguuaaucagggaagguuuccugggggaggu

SEQ ID NO: 97141 - RNA, 64 nt, Homo Sapiens
caaaucuucuaauuccaagauccaauaggaucucguuaaucaucaguuccuuugaucucgcugu

SEQ ID NO: 97142 - RNA, 64 nt, Homo Sapiens
cuguccaguacauuagacacuaggcacauuggcuguuaaucacuuggaauguguuuagcuugac

SEQ ID NO: 97143 - RNA, 64 nt, Homo Sapiens
uuauaugcccucaaguaaaagaaaagccgaaaggguuaaucauauuugaaaaccauauuuuauu

SEQ ID NO: 97144 - RNA, 64 nt, Homo Sapiens
acuugauuaauuaauacuauuugaguuauuaaauguuaaucaaaaugaguauaucauuuccugu

SEQ ID NO: 97145 - RNA, 64 nt, Homo Sapiens
cuagagaauucugaaacugaggaggggauccucuguuaaucagugagcacuuuuugaugagcug

SEQ ID NO: 97146 - RNA, 64 nt, Homo Sapiens
gcauaugcaacagugaauaaaagcuucuuuuuuuguuaaucagucaauaaauuuggcuaauuag

SEQ ID NO: 97147 - RNA, 64 nt, Homo Sapiens
uuuuauuuugauaguagcuuccuccucuggugguguuaaucauuucauuuuuacccuuacuugg

SEQ ID NO: 97148 - RNA, 64 nt, Homo Sapiens
accagagagucuagggcagccuuuguguucaacaguuaaucaaauuccuuuuuaaaauguauuc

SEQ ID NO: 97149 - RNA, 64 nt, Homo Sapiens
aagagaauuuggggcuuccauuuugggaguuguaguuaaucaucccuuuugccgaccccaagag

SEQ ID NO: 97150 - RNA, 64 nt, Homo Sapiens
gagaguagccuuuaaucaugacuaguuggaccugguuaaucauauuccuuaaagacucuucuga

SEQ ID NO: 97151 - RNA, 64 nt, Homo Sapiens
caguggucuucuguuaauguagugucuuuuacaaguuaaucauuaaauuuguuagaucuuguua

SEQ ID NO: 97152 - RNA, 64 nt, Homo Sapiens
aacugaauuggcuaggaaaaaagaaaaacugcauguuaaucauuuuccuaagcuguccuuuuga

SEQ ID NO: 97153 - RNA, 64 nt, Homo Sapiens
aaaucaaaaauuggauaauuuguaauauuuauguguuaaucacacaguaugcucucugaaguuc

SEQ ID NO: 97154 - RNA, 64 nt, Homo Sapiens
ccaaaguugcuagcaucauuuugcuguugugccaguuaaucauaggaucccauuaaauaagugu

SEQ ID NO: 97155 - RNA, 64 nt, Homo Sapiens
ccaguauaagacuacugaaucugcuaccaaaacaguuaaucagugagucgauguucuauuuuuu

SEQ ID NO: 97156 - RNA, 64 nt, Homo Sapiens
agcacuuuaaaacaaacugguguguuguuuuuaaguuaaucauauguuuaauaaaugcgugguu

SEQ ID NO: 97157 - RNA, 64 nt, Homo Sapiens
auuuuuccuuuaguuuaauucccauuauguccuaguuaaucaucauggcuaccuaaaaagauga

SEQ ID NO: 97158 - RNA, 64 nt, Homo Sapiens
ugucugcugccauuaacagauccaaaucucaguaguuaaucaagcaccuuggaucuccugcaug

SEQ ID NO: 97159 - RNA, 64 nt, Homo Sapiens
uuuauuguacuaugacuaaauaaauugggauuuuguuaaucaaaauuuauuuacuucuguuuug

SEQ ID NO: 97160 - RNA, 64 nt, Homo Sapiens
uccucugacccagauuuauucucuucuuuccucaguuaaucaaacucaaaggccccaguauucu

SEQ ID NO: 97161 - RNA, 64 nt, Homo Sapiens
aagagaauucuguaucaguguaacugccaguucaguuaaucaaaugucauuuguucaauuguua

SEQ ID NO: 97162 - RNA, 64 nt, Homo Sapiens
aacauacagugcuugaauauacagccuuaacaauguuaaucaucuccuuggaucauuauauuga

SEQ ID NO: 97163 - RNA, 64 nt, Homo Sapiens
uggaaaauuggaaaugaaauauguugcugggugcguuaaucaccuccgcccaggauuuagucac

SEQ ID NO: 97164 - RNA, 64 nt, Homo Sapiens
guaucugaagggaauuguuuuaugucucuuagagguuaaucagaaaagaaugcugcaacuuuuu

SEQ ID NO: 97165 - RNA, 64 nt, Homo Sapiens
gcuaugcauuucauauagcuaacuguaucuuuagguuaaucaaauggaguuuuacaaagaagga

SEQ ID NO: 97166 - RNA, 64 nt, Homo Sapiens
cucuguacuuguuucccuuugccuuucucacccaguuaaucaguuuuuaacuaaauuguuacuu

SEQ ID NO: 97167 - RNA, 64 nt, Homo Sapiens
cuuuugggcuucauuagucauauaagaaaucuuaguuaaucaugcugugaauuauucagugcau

SEQ ID NO: 97168 - RNA, 64 nt, Homo Sapiens
aauuggugucacauuuguaaaaguaauuuuaauaguuaaucaucucugagaguaaccuguauuu

SEQ ID NO: 97169 - RNA, 64 nt, Homo Sapiens
cauaaucuccaguuuuuucacagugccucacagaguuaaucaugccuuuuggagcuagaaggac

SEQ ID NO: 97170 - RNA, 64 nt, Homo Sapiens
acuauauauuuguuaaaaauagauagagugauuaguuaaucaaauuaaugaauuauauauagau

SEQ ID NO: 97171 - RNA, 64 nt, Homo Sapiens
acccaagucugcuucugugaccaucagugacaaaguuaaucagggauuaaagaacagauccuag

SEQ ID NO: 97172 - RNA, 64 nt, Homo Sapiens
uguuaaugaaaauaagcucuaucaucuccuuccuguuaaucacaguuacgaagaaaacucacca

SEQ ID NO: 97173 - RNA, 64 nt, Homo Sapiens
ucucgguaaguccuuuaaacauuuuaaaaacuggguuaaucaagaauuuauaauuugauuuuuu

SEQ ID NO: 97174 - RNA, 64 nt, Homo Sapiens
uucuauauuuuccgaggcaguauuuucuuuguauguuaaucauaguuauaguaaagucagacuc

SEQ ID NO: 97175 - RNA, 64 nt, Homo Sapiens
aucuguuagauauuaaaggugagaauuagggcagguuaaucaaaaauggggaaggggaaauggu

SEQ ID NO: 97176 - RNA, 64 nt, Homo Sapiens
aauagaguaccaaugucauuaauugauuuuucuuguuaaucagaauuccuauucuguaccuuuc

SEQ ID NO: 97177 - RNA, 64 nt, Homo Sapiens
ugugaaaaaguggaguaguguuuuuuuaaccauuguuaaucagcuuuuguguaugaaagacaca

SEQ ID NO: 97178 - RNA, 64 nt, Homo Sapiens
aauuauacugagaaccugaucucguuuacuccauguuaaucacauuccuaccaaccuaaauuuc

SEQ ID NO: 97179 - RNA, 64 nt, Homo Sapiens
uauguuuuuagagcaugcaauugggcauccaacaguuaaucacuaaaggaaacaaagagugcuu

SEQ ID NO: 97180 - RNA, 64 nt, Homo Sapiens
cccucaaagggagagaaaagggauuaaugucaauguuaaucagcaguccuugucuuguaauugu

SEQ ID NO: 97181 - RNA, 64 nt, Homo Sapiens
agcuacacugcuucccacuuguguacauagugugguuaaucauuccuuaagguguuugcuaguu

SEQ ID NO: 97182 - RNA, 64 nt, Homo Sapiens
aucaugggggagaacauacauaauagagcauccuguuaaucagaaccagggagggagguuauaa

SEQ ID NO: 97183 - RNA, 64 nt, Homo Sapiens
gauguuagagcucaaacgggccaacccagagacuguuaaucaugauuuaagccaacagaguuac

SEQ ID NO: 97184 - RNA, 64 nt, Homo Sapiens
caacuuauuuuacuacugauauuugaccuggaaaguuaaucauggcaacaaauacauacaggau

SEQ ID NO: 97185 - RNA, 64 nt, Homo Sapiens
aucauggaucaaccaaguuacacgggguuacacuguuaaucauggguuccucccuucuucugag

SEQ ID NO: 97186 - RNA, 64 nt, Homo Sapiens
uacuauagauaaaauccuauuuaagacaaauucuguuaaucaacaagggcucuguauuuuuuua

SEQ ID NO: 97187 - RNA, 64 nt, Homo Sapiens
uugcaaauaggggcuaucaaguuauuguauaauuguuaaucacucugagccaaagcagauagaa

SEQ ID NO: 97188 - RNA, 64 nt, Homo Sapiens
guugauucuagaugaucaacgcuuucagaguuugguuaaucagucucuggaguuggggcucuug

SEQ ID NO: 97189 - RNA, 64 nt, Homo Sapiens
guugaauauaaaaauccaccuaaaguccauuuauguuaaucaaauaaaucucaaggguuucuug

SEQ ID NO: 97190 - RNA, 64 nt, Homo Sapiens
gauaugcuuuagucaauaauuauuuuuaccuuauguuaaucaguucaagaauaugaguggauau

SEQ ID NO: 97191 - RNA, 64 nt, Homo Sapiens
uuuauuuugaaaagacguacugaauuuuugggugguuaaucagucuuggauguugguggguuuu

SEQ ID NO: 97192 - RNA, 64 nt, Homo Sapiens
auauuugauggaaagaaaaaaggaaaauuaucuaguuaaucauaugaauguuucuuaggauugu

SEQ ID NO: 97193 - RNA, 64 nt, Homo Sapiens
aguaagauuugauguuuaaauaauacuuaaauuuguuaaucaccauauuccuuuucuguuaaga

SEQ ID NO: 97194 - RNA, 64 nt, Homo Sapiens
auauucuuauccucuuaaauaaaacugcucaacaguuaaucagcagugaaucaucuugcagcua

SEQ ID NO: 97195 - RNA, 64 nt, Homo Sapiens
guaccuguugcuucccagaggauggagaaguguaguuaaucacaccucuuaguuuaaucugaaa

SEQ ID NO: 97196 - RNA, 64 nt, Homo Sapiens
auuauccuggaaaaagaagaacccauuuuuguaaguuaaucauggaagugcuuugaagaugugu

SEQ ID NO: 97197 - RNA, 64 nt, Homo Sapiens
ucucuaugcucagaugucagagcaaccacagucuguuaaucauuauauuuuguggacucaguca

SEQ ID NO: 97198 - RNA, 64 nt, Homo Sapiens
uaauuuaauucugguauuguugucagaugcccuaguuaaucauguuuugggaaagggcaaaaug

SEQ ID NO: 97199 - RNA, 64 nt, Homo Sapiens
cuacagcuguuaucuuuccuagacacuaaaaacuguuaaucagaauuauuuauuuuucauugug

SEQ ID NO: 97200 - RNA, 64 nt, Homo Sapiens
gaguagcaucccuucaaucacggucauacugucgguuaaucagauguagcugacccuaauguga

SEQ ID NO: 97201 - RNA, 64 nt, Homo Sapiens
aggagcccccugccauagcauuuuccuguucuggguuaaucauaucggucagcugacacuaagu

SEQ ID NO: 97202 - RNA, 64 nt, Homo Sapiens
ggagggugagacagaacaauuaacuucugugccuguuaaucaugccucugccuaugcaaguguc

SEQ ID NO: 97203 - RNA, 64 nt, Homo Sapiens
cucuagguuuaacauuuuguacaaaauggaaccuguuaaucauauuaaagcacauauguauaua

SEQ ID NO: 97204 - RNA, 64 nt, Homo Sapiens
gaguaaacuugaauggaauaacgacauuccagaaguuaaucauuugaauucugaacacuggaga

SEQ ID NO: 97205 - RNA, 64 nt, Homo Sapiens
caucugauuuuuaaacucacgauaccaguuaucuguuaaucaaaauugcauuuuacaauuuaau

SEQ ID NO: 97206 - RNA, 59 nt, Homo Sapiens
auggcguuggaaagaaaugaaaaacccugguuaaucaaagauguuccagagugccuaga

SEQ ID NO: 97207 - RNA, 64 nt, Homo Sapiens
cugucuucccucucuaucggggucacuugcaauuguuaaucaaagauugaacacugcguaggag

SEQ ID NO: 97208 - RNA, 64 nt, Homo Sapiens
ccaaauuuaaguugaugaccuaauccauuuuauaguuaaucauaguuguaaauuuuuucuucag

SEQ ID NO: 97209 - RNA, 64 nt, Homo Sapiens
aagagcaauuauguggucucuuaagggccagaggguuaaucacaaauuuucugacuuuacuauu

SEQ ID NO: 97210 - RNA, 64 nt, Homo Sapiens
cuauuauuguucccuggugaaacugaggagaaaaguuaaucaaccagguuacucccacaguuug

SEQ ID NO: 97211 - RNA, 64 nt, Homo Sapiens
gagcgguaauuccaaauuauuuuucaguaagacaguuaaucagcauuauugugagagggacuga

SEQ ID NO: 97212 - RNA, 64 nt, Homo Sapiens
cacaaaaccagaaguuucuacauucucuauuuuuguuaaucaucuucucuuuuuccagaauuug

SEQ ID NO: 97213 - RNA, 64 nt, Homo Sapiens
ugaccaagaccaaggcccaccaaggcagcagacuguuaaucagacaaacagaucucugagaagg

SEQ ID NO: 97214 - RNA, 64 nt, Homo Sapiens
ggugucuuucuugugcagucugggagucuaugcgguuaaucaggcuguuggcgaaucagggauu

SEQ ID NO: 97215 - RNA, 64 nt, Homo Sapiens
ucugggguuucugauauggggauuucagccccugguuaaucagucuugucccuacaagucccug

SEQ ID NO: 97216 - RNA, 64 nt, Homo Sapiens
caugucuuauucuugcccuucccccaaccaguuuguuaaucaaacaauaaaaacauguuuuuuu

SEQ ID NO: 97217 - RNA, 64 nt, Homo Sapiens
auauagauguggucauguuugacuuguacagaauguuaaucauacagagaauccuugauggaau

SEQ ID NO: 97218 - RNA, 64 nt, Homo Sapiens
uuaaaagaacucacauuaagcgguuacucagacaguuaaucauagaaaagauuauuugcuucau

SEQ ID NO: 97219 - RNA, 64 nt, Homo Sapiens
ugcuagaaaaucauguuccuuguccugaguaagaguuaaucagaguaaaugcauuucuggaguu

SEQ ID NO: 97220 - RNA, 64 nt, Homo Sapiens
uuuagaaagccaacauuuuauguuauaauaugcuguuaaucaggacuuuauuaaauaaaaacau

SEQ ID NO: 97221 - RNA, 64 nt, Homo Sapiens
cuauaaucaugauacucuucuaauagacuuaaaaguuaaucauugacaacgaaaaauaaaaugu

SEQ ID NO: 97222 - RNA, 64 nt, Homo Sapiens
agacguccuuuuccauuuuuagccaccaaaacggguuaaucaaaaaauucuggaauggaaaucu

SEQ ID NO: 97223 - RNA, 64 nt, Homo Sapiens
uauuaaaacugauuuuuagcugaugagaguuucuguuaaucaugaauaguuaaaguaaugagca

SEQ ID NO: 97224 - RNA, 64 nt, Homo Sapiens
acauguagagugucuccuuccuuuucagagaacaguuaaucaaggcaaaucagcaagcccccaa

SEQ ID NO: 97225 - RNA, 59 nt, Homo Sapiens
cauacguuucuagguaagguuuuuugucuguuaaucauuuuuuccccauuuagguguaa

SEQ ID NO: 97226 - RNA, 64 nt, Homo Sapiens
aauguaguaauauuucaugagccuuuuggguaauguuaaucacgaauucaacauuugaagaugu

SEQ ID NO: 97227 - RNA, 64 nt, Homo Sapiens
aaaugagcaacgacuucggcccucagaggauacuguuaaucauacggugagggugggcgggagg

SEQ ID NO: 97228 - RNA, 64 nt, Homo Sapiens
uuacauaugaccauacaaugcacugaauugacagguuaaucauaagacauggaaagagaagugu

SEQ ID NO: 97229 - RNA, 64 nt, Homo Sapiens
uuccuucuuuccuuucucuucuuuuaucuccaagguuaaucaggaaaaauagcuuuugacaggg

SEQ ID NO: 97230 - RNA, 64 nt, Homo Sapiens
uuuauuuuuguaaagguauguaaguuauuaaaugguuaaucauggccuuuuaaaaauaaaauaa

SEQ ID NO: 97231 - RNA, 64 nt, Homo Sapiens
aaacuugaaauaucgaccauacuggaaaaaauggguuaaucaaauaccaaacaaggugaaauuu

SEQ ID NO: 97232 - RNA, 64 nt, Homo Sapiens
uuagaaauauuccaguucuccguaacaguguaaaguuaaucagaaagaaaaaauuuuauugaug

SEQ ID NO: 97233 - RNA, 64 nt, Homo Sapiens
ggacgagcuauagaaaagcuauugagaguaucuaguuaaucagugcaguaguuggaaaccuugc

SEQ ID NO: 97234 - RNA, 64 nt, Homo Sapiens
auaaaguuguagcaguuaaguccagucacauuugguuaaucaguguuugauauaauugaaagag

SEQ ID NO: 97235 - RNA, 64 nt, Homo Sapiens
agcaacuugcaaacggacgaagagccugccguguguuaaucauuugccuuacaagauguaccag

SEQ ID NO: 97236 - RNA, 64 nt, Homo Sapiens
uuaaaguuaagacuuagacuaaaaccauaauacuguuaaucaugaaaaacucaaaacauaaaga

SEQ ID NO: 97237 - RNA, 64 nt, Homo Sapiens
gcuaugggugcuacaggcuucuugaugcuuucagguuaaucagagguagaaaaagagggaguca

SEQ ID NO: 97238 - RNA, 64 nt, Homo Sapiens
gcaggauaugacaacucuuacuacuuguuuuuuuguuaaucauaaaauacacucucuuauuuuu

SEQ ID NO: 97239 - RNA, 64 nt, Homo Sapiens
gccuaugaaauuguuaaaccuggaacaugacauuguuaaucauauaauaaugauucuuaaaugc

SEQ ID NO: 97240 - RNA, 64 nt, Homo Sapiens
auguaguaucaaauauuagaugugauuuaauaguguuaaucaauuuaaacccauuuuagucacu

SEQ ID NO: 97241 - RNA, 64 nt, Homo Sapiens
uuauuuuagguuuucguaaauuucagcaucaauuguuaaucagauccucaguuuuuaaugaccu

SEQ ID NO: 97242 - RNA, 64 nt, Homo Sapiens
ggacucuaucuguggccuuguucuucauuucaguguuaaucagcuaaacagaaguuguugcuua

SEQ ID NO: 97243 - RNA, 64 nt, Homo Sapiens
auguugcaaaauuuaguauccauaugcauaagaaguuaaucaccuugccagugggguggucaca

SEQ ID NO: 97244 - RNA, 64 nt, Homo Sapiens
gggacagugaggaggacacaccagcccauuaguuguuaaucaucaaucacaucugauuguugaa

SEQ ID NO: 97245 - RNA, 64 nt, Homo Sapiens
aggugugacugaauuucuuucaccacuacauucuguuaaucauucgauuucuguuuagauaaua

SEQ ID NO: 97246 - RNA, 64 nt, Homo Sapiens
caucacuucccauuuuaugggccagccaugcauuguuaaucaucuccucugaacaaaauguaaa

SEQ ID NO: 97247 - RNA, 64 nt, Homo Sapiens
acucauguuuggaaucguaggggaacaucuggcuguuaaucacuugcacaguugagaacauuuc

SEQ ID NO: 97248 - RNA, 64 nt, Homo Sapiens
caaguguuuuggguuguggacugaagcucagccuguuaaucagaccagcccaugaguguauaac

SEQ ID NO: 97249 - RNA, 64 nt, Homo Sapiens
aauuuggucaaggaggugggcaggcugcaaaccgguuaaucaaggcaaccaccccgaggaccuu

SEQ ID NO: 97250 - RNA, 64 nt, Homo Sapiens
aaaccaacccucacuucacaaaaaacagaaaaagguuaaucacaggcaauuacauuuuaaaaag

SEQ ID NO: 97251 - RNA, 64 nt, Homo Sapiens
auaaagcggaagcaccaugaguguguaaccaaaaguuaaucagacucuuaggucauuuuucaau

SEQ ID NO: 97252 - RNA, 64 nt, Homo Sapiens
uguucuuuccuuuccauaucccaguauaaucucuguuaaucaacaggacuaccccaagaaccca

SEQ ID NO: 97253 - RNA, 64 nt, Homo Sapiens
uuuccacuggagucugggauuugcaauucuggagguuaaucaugcuuguacuguaauuuuacua

SEQ ID NO: 97254 - RNA, 64 nt, Homo Sapiens
ccagucuuauuagauaaauuaguccauaugguugguuaaucaagagccuucuggguuugguuug

SEQ ID NO: 97255 - RNA, 64 nt, Homo Sapiens
ugcccccagcugcuccucgcaguucgguuaauugguuaaucacuuaaccugcuuuugucacucg

SEQ ID NO: 97256 - RNA, 64 nt, Homo Sapiens
auaucuuaagacuuccccucaacaugcugccccaguuaaucagcaaccugacucagguaacccu

SEQ ID NO: 97257 - RNA, 64 nt, Homo Sapiens
auauauuuaauauaggaccuauuuugaauauucaguuaaucauaugguuccuagcuuacaaggg

SEQ ID NO: 97258 - RNA, 64 nt, Homo Sapiens
gauaaaguuguauacucuacuuucauguuaaaauguuaaucaugauuacuuuaagcccacaucc

SEQ ID NO: 97259 - RNA, 64 nt, Homo Sapiens
cuauagaggcauaagugguacaucuaagagagagguuaaucacaagacuuauaggugaugcaag

SEQ ID NO: 97260 - RNA, 64 nt, Homo Sapiens
uccuaaacuauaaaagcagauuuugcuuuuguuuguuaaucauaggcauggccgagcauugugg

SEQ ID NO: 97261 - RNA, 64 nt, Homo Sapiens
ucuuaaaggacauuaggauuggugcucagaaaugguuaaucaugcugugugcuagccagggcca

SEQ ID NO: 97262 - RNA, 64 nt, Homo Sapiens
ugaguguacacaaaguuucucauauccuguucaaguuaaucaacaucaagcacauggggaugcu

SEQ ID NO: 97263 - RNA, 64 nt, Homo Sapiens
augcaaauagaaauuuauaagcauuuuacuacaaguuaaucauauccuucaguagcuuauuucu

SEQ ID NO: 97264 - RNA, 64 nt, Homo Sapiens
cucggccucccaaagugcugggaucaaauccacuguuaaucauuaggcugaacugucucuuaua

SEQ ID NO: 97265 - RNA, 64 nt, Homo Sapiens
uggccaagccuuuaguuaucaccaauccccuacuguuaaucagagaugucccacuggauaaaaa

SEQ ID NO: 97266 - RNA, 64 nt, Homo Sapiens
uagccguugcaauaaauguaaaguugugaauguuguuaaucauuucuguuuuuuaagaucuaag

SEQ ID NO: 97267 - RNA, 64 nt, Homo Sapiens
aaaucauucuacuuuugcacuuugaaagaaaggcguuaaucauaaagaagcaagaauggucaaa

SEQ ID NO: 97268 - RNA, 64 nt, Homo Sapiens
aaauuacucaguuuggauaacauuauuuugugcaguuaaucaaauuugccaaagucuuuaucug

SEQ ID NO: 97269 - RNA, 64 nt, Homo Sapiens
aggagguaagaccagcugggaugaccuucccuggguuaaucaauuucccucuagacaacacaaa

SEQ ID NO: 97270 - RNA, 64 nt, Homo Sapiens
cuuagggaccacugaaugccccgaucccaaucagguuaaucagaaucacuuagagaacuuaaaa

SEQ ID NO: 97271 - RNA, 64 nt, Homo Sapiens
aauuaauuaaaagugaaacguaauuguacaagcaguuaaucacccaccauagggcaugauuaac

SEQ ID NO: 97272 - RNA, 64 nt, Homo Sapiens
auuucaagaaugaccaaaauggccucuaaaagauguuaaucaucucaaaugaccuuuugucuuu

SEQ ID NO: 97273 - RNA, 64 nt, Homo Sapiens
ucucuuuauaguuaggcuucaagacuuaagucucguuaaucaaaaauuugggaaauucuggacu

SEQ ID NO: 97274 - RNA, 64 nt, Homo Sapiens
uuuggaccuggagaugauuugugaaauaaagaauguuaaucaacgacuucugaucaaaaauacu

SEQ ID NO: 97275 - RNA, 64 nt, Homo Sapiens
uguguuacuagccucaaaauacaucaaaaaauaaguuaaucaggaacuguacggaauauauuuu

SEQ ID NO: 97276 - RNA, 64 nt, Homo Sapiens
aaagguugguucuugacucugaagggacuuuugaguuaaucagcguaaggggauuucuaaagca

SEQ ID NO: 97277 - RNA, 64 nt, Homo Sapiens
caagugaguagcucacgcagaaacucccuuucauguuaaucaaaccagaaguauuguuuacauu

SEQ ID NO: 97278 - RNA, 64 nt, Homo Sapiens
augcauauuugaaauaaaagaauccuuauuccugguuaaucacuuaacaggcagaacaugggag

SEQ ID NO: 97279 - RNA, 64 nt, Homo Sapiens
aaaaaaaaaaaauauuuuuguuaaaaauaauauuguuaaucagugcuacauuuucgaagauuuu

SEQ ID NO: 97280 - RNA, 64 nt, Homo Sapiens
cacguguauagaaaaaaaauccauuaauuauauuguuaaucaauucaggguauaaaaugacauc

SEQ ID NO: 97281 - RNA, 64 nt, Homo Sapiens
uuaugcucaauggucugauuuuaacucacccgauguuaaucaaugcacauugcuuuagaucaca

SEQ ID NO: 97282 - RNA, 64 nt, Homo Sapiens
ggaucccacgaauuuaggcuuccccaacucccucguuaaucacauguugcaggggggcaguaac

SEQ ID NO: 97283 - RNA, 64 nt, Homo Sapiens
aauuuuguagauaacacuuauuguguguguuuugguuaaucacauauauaacauuugaacacaa

SEQ ID NO: 97284 - RNA, 64 nt, Homo Sapiens
uggauuuuuagcuguagguauucagcaaugauagguuaaucacuggcaaaagcaucagaucuuu

SEQ ID NO: 97285 - RNA, 64 nt, Homo Sapiens
ggaggaaagagcuagaaaaaaaaaccucaaaaaaguuaaucauugguagaugccccacaauuaa

SEQ ID NO: 97286 - RNA, 64 nt, Homo Sapiens
ugcauacauacacauauauacacacacaaagagaguuaaucaacugaaaguguuuccuucauuu

SEQ ID NO: 97287 - RNA, 64 nt, Homo Sapiens
uucuuacacuacuauauuugccuguagcuucccuguuaaucagcucaugcuguaugugcccgug

SEQ ID NO: 97288 - RNA, 64 nt, Homo Sapiens
uaaccaaagaagauguguagaagugauuuaaauaguuaaucauuuuguauuaccucuuuuuuuc

SEQ ID NO: 97289 - RNA, 64 nt, Homo Sapiens; identical to SEQ ID NO: 80001

SEQ ID NO: 97290 - RNA, 64 nt, Homo Sapiens; identical to SEQ ID NO: 80002

SEQ ID NO: 97291 - RNA, 64 nt, Homo Sapiens; identical to SEQ ID NO: 80003

SEQ ID NO: 97292 - RNA, 64 nt, Homo Sapiens; identical to SEQ ID NO: 80004

SEQ ID NO: 97293 - RNA, 64 nt, Homo Sapiens; identical to SEQ ID NO: 80005

SEQ ID NO: 97294 - RNA, 64 nt, Homo Sapiens; identical to SEQ ID NO: 80006

SEQ ID NO: 97295 - RNA, 64 nt, Homo Sapiens; identical to SEQ ID NO: 80007

SEQ ID NO: 97296 - RNA, 64 nt, Homo Sapiens; identical to SEQ ID NO: 80008

SEQ ID NO: 97297 - RNA, 64 nt, Homo Sapiens; identical to SEQ ID NO: 80009

SEQ ID NO: 97298 - RNA, 64 nt, Homo Sapiens; identical to SEQ ID NO: 80010

SEQ ID NO: 97299 - RNA, 64 nt, Homo Sapiens; identical to SEQ ID NO: 80011

SEQ ID NO: 97300 - RNA, 64 nt, Homo Sapiens; identical to SEQ ID NO: 80012

SEQ ID NO: 97301 - RNA, 64 nt, Homo Sapiens; identical to SEQ ID NO: 80013

SEQ ID NO: 97302 - RNA, 64 nt, Homo Sapiens; identical to SEQ ID NO: 80014

SEQ ID NO: 97303 - RNA, 64 nt, Homo Sapiens; identical to SEQ ID NO: 80015

SEQ ID NO: 97304 - RNA, 64 nt, Homo Sapiens; identical to SEQ ID NO: 80016

SEQ ID NO: 97305 - RNA, 64 nt, Homo Sapiens
gcugcagcccucucagaacagagggguagggagggugcaccagugcaccaggaaggcugugugg

SEQ ID NO: 97306 - RNA, 64 nt, Homo Sapiens
ccucucagaacagagggguagggagggugcaccagugcaccaggaaggcugugugggucuggag

SEQ ID NO: 97307 - RNA, 64 nt, Homo Sapiens
agcugcccccggcugcagcccaggccauggacaugugcaccaguauguaccugcaggcaugggg

SEQ ID NO: 97308 - RNA, 64 nt, Homo Sapiens
guugaccccagaggauugcucaagggaauucggugugcaccaggguggguccaugggcagagcc

SEQ ID NO: 97309 - RNA, 64 nt, Homo Sapiens
caggaaaugaaaaugucuugcuuucauguaaacugugcaccaagaaggacucucaggaccaaag

SEQ ID NO: 97310 - RNA, 64 nt, Homo Sapiens
acgccuggcuaaauuuuguacugggauuacaggugugcaccaccugccucggccucuccaguag

SEQ ID NO: 97311 - RNA, 64 nt, Homo Sapiens
auuauuccucauuuuacauacucucaaaauuucugugcaccagucugaaauuccugaguucuuc

SEQ ID NO: 97312 - RNA, 64 nt, Homo Sapiens
accaccaccaccaccaugcucaaggcugccugccgugcaccaccggucccacgagcugccaggc

SEQ ID NO: 97313 - RNA, 64 nt, Homo Sapiens
ugguccugcagaacuggaugugcagaacgcacaggugcaccagucaugguggagcugcugcugc

SEQ ID NO: 97314 - RNA, 64 nt, Homo Sapiens
uucuuaccauuuuauuccccucaauucucaauauauucaguaaugaagaauggugccaccacuc

SEQ ID NO: 97315 - RNA, 64 nt, Homo Sapiens
uaauuagauauauauauucauucuacgggauauuauucaguaguggaaaugagugaacuacagc

SEQ ID NO: 97316 - RNA, 64 nt, Homo Sapiens
cuuuguccuuaaugcugcuuagcuguuucaauauauucaguauaucuuggcuucauuuccauga

SEQ ID NO: 97317 - RNA, 64 nt, Homo Sapiens
ucuccaaguugcuaucuacuaacugcucacauuuauucaguauucaaaugcauuacuguuuuca

SEQ ID NO: 97318 - RNA, 64 nt, Homo Sapiens
uuccuacaagcagcaccccaugauagcaguugucauucaguaauaaaggauaugaaaucacagg

SEQ ID NO: 97319 - RNA, 64 nt, Homo Sapiens
uguuuauuggcuguuuuuugcccagcagaauguaauucaguauuagucuagagccuuuaaaaaa

SEQ ID NO: 97320 - RNA, 64 nt, Homo Sapiens
ggcaugaauucauuauggugauacacauaugugaauucaguacauuuugagacaguauucuacc

SEQ ID NO: 97321 - RNA, 64 nt, Homo Sapiens
gugaauucaguacauuuugagacaguauucuaccauucaguaauuuugguuaaugauuuuaaca

SEQ ID NO: 97322 - RNA, 64 nt, Homo Sapiens
auuaaaugggaagaaagcaagcagaaauaguaaaauucaguagguuuaaaacaaucuauaaaug

SEQ ID NO: 97323 - RNA, 64 nt, Homo Sapiens
cuggaagcuuugaaauuuaucagagaaugaagucauucaguacaucugauaaaguuuuguuguu

SEQ ID NO: 97324 - RNA, 64 nt, Homo Sapiens
uucucacucauuaaacuuugcagaagugauucauauucaguacuguuuuuaaucacuuuuuaaa

SEQ ID NO: 97325 - RNA, 64 nt, Homo Sapiens
gucugugaauguaaccaguacuucuuuaagcucuauucaguaggguuccagccacugcuuuuuu

SEQ ID NO: 97326 - RNA, 64 nt, Homo Sapiens
cucauuugccauuugagaaaaugcagucugguguauucaguaauauauaguaaaguaauaauga

SEQ ID NO: 97327 - RNA, 64 nt, Homo Sapiens
uuuaggacuuuuccauagugccaaagccauacauauucaguagaacaucaauaaauuacaucag

SEQ ID NO: 97328 - RNA, 64 nt, Homo Sapiens
cuguuaagugucauauucuuauuuacauucacaaauucaguaucacugccauauuauauaacaa

SEQ ID NO: 97329 - RNA, 64 nt, Homo Sapiens
ugccauauuauauaacaaaugcugcauacguaauauucaguaacuagcaguauuauuagcauaa

SEQ ID NO: 97330 - RNA, 64 nt, Homo Sapiens
guuuuuuaagaauguuuaucauguuaauuacuuuauucaguaaagaaguaaaauaaugaaagau

SEQ ID NO: 97331 - RNA, 64 nt, Homo Sapiens
ccaggaccuaaaccuuuaugucuuggcauuauaaauucaguaucuaauuccaugauacagagua

SEQ ID NO: 97332 - RNA, 64 nt, Homo Sapiens
agcaaguggagcagggcuuagcaggagcaguuucuggccagaagcaccagccugcugccagcgg

SEQ ID NO: 97333 - RNA, 64 nt, Homo Sapiens
acacucacucccaccucucaagccuccaaccucuuggccagauugggcucauuaaugucguugc

SEQ ID NO: 97334 - RNA, 64 nt, Homo Sapiens
uggaaggcagggcagagggauguccaggccacuguggccagagcggccugggacccagcuacuc

SEQ ID NO: 97335 - RNA, 64 nt, Homo Sapiens
gggcccagcuguagccaugggcaggaacgagcacuggccagagagccugcuuuuccaggauccu

SEQ ID NO: 97336 - RNA, 64 nt, Homo Sapiens
cuagcucacucaaggcugccuucuccuggcuuacuggccagaaaccaagaucucuuacugcugc

SEQ ID NO: 97337 - RNA, 64 nt, Homo Sapiens
gaaucagagacuacaagcuguaauuuuugccauuuggccagagggagccgggcuguggcucagg

SEQ ID NO: 97338 - RNA, 64 nt, Homo Sapiens
caauguccauugggcauaggccccaccucccacuuggccagaacuccaguacccugucuucuag

SEQ ID NO: 97339 - RNA, 64 nt, Homo Sapiens
gggcauggccaccucccaacaggggcagggucccuggccagaagugcagaaguagaagcuggug

SEQ ID NO: 97340 - RNA, 64 nt, Homo Sapiens
gaugaauacuuggauauuacguagccaguuucuuuggccagaaguuuucuuuagaaucagaauu

SEQ ID NO: 97341 - RNA, 64 nt, Homo Sapiens
ugccagcagccucugucgccagccacugggacgguggccagagacagugaagccuccaacccua

SEQ ID NO: 97342 - RNA, 64 nt, Homo Sapiens
cccaccuucggagacggcuucuggaggaacggcuuggccagaagacagggugugagugagacag

SEQ ID NO: 97343 - RNA, 64 nt, Homo Sapiens
gcagggccuugacaggaauccagggaguagcuccuggccagaaccagccucugcggggcuugug

SEQ ID NO: 97344 - RNA, 64 nt, Homo Sapiens
uuguauuuuuguuggagacgggguuucaccauauuggccagacuggucucaaacuccugggguc

SEQ ID NO: 97345 - RNA, 64 nt, Homo Sapiens
acccgugggagagacacacucaggaguggccguuuggccagaaaagaaggucauggccccuggc

SEQ ID NO: 97346 - RNA, 64 nt, Homo Sapiens
agggcccugggccucugcuuuccauauucacguuuggccagaguuguagucccaaagaagagca

SEQ ID NO: 97347 - RNA, 64 nt, Homo Sapiens
guuugugguccgagauccuguacuaaggagggucuggccagaggaacagaccagcuuuugcaca

SEQ ID NO: 97348 - RNA, 64 nt, Homo Sapiens
uggccuccgaacugugcagccgcaucccauccucuggccagaaaggaagccuuccuggauuuca

SEQ ID NO: 97349 - RNA, 64 nt, Homo Sapiens
aguucuauugcaucucucacgccagcugcaaaccuggccagagguacagagugagcuuggccaa

SEQ ID NO: 97350 - RNA, 64 nt, Homo Sapiens
aguuucaguaucucuggcaaucugaggggagcaauggccagacccauucagucauguucccagg

SEQ ID NO: 97351 - RNA, 64 nt, Homo Sapiens
gggucgucaaccucguguggcucuugucuuuccauggccagagucucugaaaagguagcucuga

SEQ ID NO: 97352 - RNA, 64 nt, Homo Sapiens
uuguauuuuuaguagaaacagggugucaccauguuggccagacuggucucaaacuccugaccuc

SEQ ID NO: 97353 - RNA, 64 nt, Homo Sapiens
aagugcugggauuauagucgugagccaccacgccuggccagaguuuuuuauuuuuaucaccacc

SEQ ID NO: 97354 - RNA, 64 nt, Homo Sapiens
ggucucaauuacuguugucgggguuucuccauguuggccagaauuugcauuuuuaguagagaug

SEQ ID NO: 97355 - RNA, 64 nt, Homo Sapiens
gaauucugacucccaugcacaaggggcaauuagauggccagaaaccauuagacuaugccuuugg

SEQ ID NO: 97356 - RNA, 64 nt, Homo Sapiens
uuuauaauaagagacuugaacgagccacugugcguggccagaacaagugcugagauuacaguug

SEQ ID NO: 97357 - RNA, 64 nt, Homo Sapiens
ggucucgaacuccugaccucgaguuucuccauguuggccagacuuuguauuuuuaguagagacg

SEQ ID NO: 97358 - RNA, 64 nt, Homo Sapiens
cagauaugauggcauuuauaagguggugaaauacuggccagagauuucaucaagccauggauuc

SEQ ID NO: 97359 - RNA, 64 nt, Homo Sapiens
agguuuucuccugcccugcuugccggcaugaucuuggccagaauuacaucaugauucccaauga

SEQ ID NO: 97360 - RNA, 64 nt, Homo Sapiens
uugguccuuagugcagagccgcuuuccaagugccuggccagaccuuucauuuuucaugagaaaa

SEQ ID NO: 97361 - RNA, 64 nt, Homo Sapiens
cacauggcacagacacagcuccccuguauucugcuggccagacacagagaagagcagcccugag

SEQ ID NO: 97362 - RNA, 64 nt, Homo Sapiens
ugucucccuguuaacugcaggaaugccaagcaccuggccagagcagcccagccccaauaugcuu

SEQ ID NO: 97363 - RNA, 64 nt, Homo Sapiens
acugguaaggcucagccuacagaaagauuugaaauggccagagccaaucgcuuggugcauucug

SEQ ID NO: 97364 - RNA, 64 nt, Homo Sapiens
gaagcgggcagcucuagcccugccuugggcccucuggccagagggguuggagaacccagggggc

SEQ ID NO: 97365 - RNA, 64 nt, Homo Sapiens
uccuccuggaagccccuccuacuugcuggccuucuggccagagggcggugugacuggucauggc

SEQ ID NO: 97366 - RNA, 64 nt, Homo Sapiens
ucugggcccaucccaggccuuugccaggacauguuggccagaggauuagauucauucaucucau

SEQ ID NO: 97367 - RNA, 64 nt, Homo Sapiens
uuuuccugaugggugagucguccuuccaaccuucuggccagaggaucaguaucucacaguccca

SEQ ID NO: 97368 - RNA, 64 nt, Homo Sapiens
cagcggguggccauggcccggcccagcugucagguggccagaagcagagacaggggagaagggc

SEQ ID NO: 97369 - RNA, 64 nt, Homo Sapiens
gagcaacacggcggaggagagguccagaaugcccuggccagagcccauagaggcucuccaaaga

SEQ ID NO: 97370 - RNA, 64 nt, Homo Sapiens
acugugggauagugcuccugggagccauauggcuuggccagacugcugggguugcugggugagc

SEQ ID NO: 97371 - RNA, 64 nt, Homo Sapiens
cuggugcuccaggauguggcuucucaugaagcucuggccagaggaggggaacuuauugggggag

SEQ ID NO: 97372 - RNA, 64 nt, Homo Sapiens
guggccucuggcugccucagugcacccagaccuguggccagauucuacuagacugccagucuca

SEQ ID NO: 97373 - RNA, 64 nt, Homo Sapiens
augggacucuaucagcuuuauugggaguauuugcuggccagagagccacucuuaggaaagacua

SEQ ID NO: 97374 - RNA, 64 nt, Homo Sapiens
cuaguaaaaauguuuuuuucuuuuagcuuugaauuggccagaguuuauccuagauuauuuuauu

SEQ ID NO: 97375 - RNA, 64 nt, Homo Sapiens
ccgagguugagacugcccuguccugcaaggucguuggccagagguagaggaaacuggucaaagu

SEQ ID NO: 97376 - RNA, 64 nt, Homo Sapiens
uggcuggcucagcuccacucggguggaguggaaguggccagaccauuuagacggacaggguccu

SEQ ID NO: 97377 - RNA, 64 nt, Homo Sapiens
cugccugggggaggcagacaugggagugccaagguggccagaugguuccaggacuacaaugucu

SEQ ID NO: 97378 - RNA, 64 nt, Homo Sapiens
uagggaugcucuaaagcugggcucaagcaagcccuggccagagguccuaaagaugcugacuggg

SEQ ID NO: 97379 - RNA, 64 nt, Homo Sapiens
gugacagaacaugcagcaaggggacaucuuaggcuggccagacuucagcuguuccuuugaaggu

SEQ ID NO: 97380 - RNA, 64 nt, Homo Sapiens
gaugggguuccagccauggggccaucuuucuuccuggccagaguccagaccccagagcccuugu

SEQ ID NO: 97381 - RNA, 64 nt, Homo Sapiens
ccagagcccuugugccaucucgagugcuguagccuggccagaccgugccaacccuguacagaau

SEQ ID NO: 97382 - RNA, 64 nt, Homo Sapiens
ucagcaugggcagggguucuccucccuauggcccuggccagagcuucucugugcaucuguccau

SEQ ID NO: 97383 - RNA, 64 nt, Homo Sapiens
acugggccuugcagacccccaguuacuucccaguuggccagaaaccuagagagggugggggugu

SEQ ID NO: 97384 - RNA, 64 nt, Homo Sapiens
ucaccguuucuccuuccuguggaguggcuggggcuggccagaggcucgcagggugagaaccacu

SEQ ID NO: 97385 - RNA, 64 nt, Homo Sapiens
guugccaaaccagccagggaaccaaccugggaaguggccagaacugccugggguccaagaacuc

SEQ ID NO: 97386 - RNA, 64 nt, Homo Sapiens
agcucgggcugauucccccucugucccagaagguuggccagagggugugacccaguuacccuuu

SEQ ID NO: 97387 - RNA, 64 nt, Homo Sapiens
aauuagcugagccaacagaccauguggacagcuuuggccagagcucccguguggcaucugggag

SEQ ID NO: 97388 - RNA, 64 nt, Homo Sapiens
aaucaauggaaaggcagggaaugugccucuucuguggccagauucuguuauuugcaauuaaagc

SEQ ID NO: 97389 - RNA, 64 nt, Homo Sapiens
cucucuuucuuuuuuaaacaaagaacuuugcacuuggccagagaggaggagaaagcccauuuuc

SEQ ID NO: 97390 - RNA, 64 nt, Homo Sapiens
cuauugcuuaccagucuagcuugaugaagccuuuuggccagaagucaauuuguuuuggaucaga

SEQ ID NO: 97391 - RNA, 64 nt, Homo Sapiens
gaaucacuuuuaugagggcuaaagauaaagaauuuggccagaaaaugcagccauccuuguguga

SEQ ID NO: 97392 - RNA, 64 nt, Homo Sapiens
uccagggacccuugggaucuggggcuuccuggccuggccagagcuggagcccccacaggguaag

SEQ ID NO: 97393 - RNA, 64 nt, Homo Sapiens
gaacuaagcaaauccaauagcaugggaccagcucuggccagagguucuugcuguuaggggcuac

SEQ ID NO: 97394 - RNA, 64 nt, Homo Sapiens
ggcuccaggggcuagacuccgguggaccaggugguggccagagauuagacagcccaggggacca

SEQ ID NO: 97395 - RNA, 64 nt, Homo Sapiens
aguccugaguucuggugugugcucccgccuccuggguauacagagagaaggcaggaaucaggag

SEQ ID NO: 97396 - RNA, 64 nt, Homo Sapiens
gcagaacuguaaaaugcacaacuuuuguaaaugugguauacaggacaaacuagacggccguaga

SEQ ID NO: 97397 - RNA, 64 nt, Homo Sapiens
gguaacaauaguucauuucucauaacauauaugagguauacaaaauuuucuaacuccagauugu

SEQ ID NO: 97398 - RNA, 64 nt, Homo Sapiens
auaaaauauaagcacauauuuauuauauaucuaagguauacaaaucugucuacaugaaguuuac

SEQ ID NO: 97399 - RNA, 64 nt, Homo Sapiens
auuucuauuuuuguagaaguaggaagugaaaauagguauacaguggauuaauuaaaugcagcga

SEQ ID NO: 97400 - RNA, 64 nt, Homo Sapiens
agaucagccuugcccaugaagguugcauaugugugguauacaguuuuuaccugaaagccugagc

SEQ ID NO: 97401 - RNA, 64 nt, Homo Sapiens
uacugugagcuuuugccugcuaggccccuguucugguauacauucagacaaauucaccuucacu

SEQ ID NO: 97402 - RNA, 64 nt, Homo Sapiens
uaguauuuaagauaccauuucuuagacauuaugagguauacaacuuuagaaauauaauagcugc

SEQ ID NO: 97403 - RNA, 64 nt, Homo Sapiens
uuucuaggaaaaaaaaaaaauguuguguuucccugguauacaucauuuaacaaguaacaaauuc

SEQ ID NO: 97404 - RNA, 64 nt, Homo Sapiens
cucugugggaaggguggggacgaggcgucgggaggguauacagggagccccucccgugcauggc

SEQ ID NO: 97405 - RNA, 64 nt, Homo Sapiens
cauuuuggcagguguagcuuuuucuguuaaaaaugguauacaugaagucacauacuuuuuuaaa

SEQ ID NO: 97406 - RNA, 64 nt, Homo Sapiens
guucagcugauuuguugguaagccgcacuagaaagguauacauaguaauguauauuuauuuaca

SEQ ID NO: 97407 - RNA, 64 nt, Homo Sapiens
gaguauuuaaugaaaguauacauaaccaauguuggguauacagaugcuucucaacuuaugaugg

SEQ ID NO: 97408 - RNA, 64 nt, Homo Sapiens
uuuaacccauuauuccucaccuacccucaaaguagguauacaaaagacuaguuuguuauuaauc

SEQ ID NO: 97409 - RNA, 64 nt, Homo Sapiens
aauauauucguaaaauaggagcacauuuaguugagguauacaagguaggacucuagacaaaacc

SEQ ID NO: 97410 - RNA, 64 nt, Homo Sapiens
ccguuuuuuaauugccaugagccaaauacuucuugguauacaauugauccauuuauuuuaaugg

SEQ ID NO: 97411 - RNA, 64 nt, Homo Sapiens
auaaaaaauaaagacccugaaugaaaucaacuuagguauacaauuucguuuggcuuguauguug

SEQ ID NO: 97412 - RNA, 64 nt, Homo Sapiens
guucuguuguaaagaguggaggaugugggauggagguauacaauuuacagcacaucuuuuuuuu

SEQ ID NO: 97413 - RNA, 64 nt, Homo Sapiens
ugcuacuugguggguuuuucuccguaugcacauugguauacagucucugagaacuggcuuggug

SEQ ID NO: 97414 - RNA, 64 nt, Homo Sapiens
uuauagccuuauuaguugugugguugacccuugggguauacaaaugucagucugaguggugucu

SEQ ID NO: 97415 - RNA, 64 nt, Homo Sapiens
gaaugaggagcagcaagucauaaccacucccuuggguauacaauuugcuguguagugaagugga

SEQ ID NO: 97416 - RNA, 64 nt, Homo Sapiens
uuugaagaacucgacuuuaugugaucaugguauugguauacaugugggguggagaacuuauuuu

SEQ ID NO: 97417 - RNA, 64 nt, Homo Sapiens
uuauuaagcaccgauaauagguagccugcugugggguauacagcauugacucagauauagaucc

SEQ ID NO: 97418 - RNA, 64 nt, Homo Sapiens
aaucagugcaaacacaucuucuguuaaacccauugguauacacagaauauuccugugcccacac

SEQ ID NO: 97419 - RNA, 64 nt, Homo Sapiens
cuuucuagaaaauuugaagccauuacuuccagcugguauacaggauaaacuacauacacugauc

SEQ ID NO: 97420 - RNA, 64 nt, Homo Sapiens
auuaaucuaauaaaggaucaaauuaaauuacaaagguauacauaaaugcucccuuuaaccauau

SEQ ID NO: 97421 - RNA, 64 nt, Homo Sapiens
gccuaugucuuuauuccaauauuauugcuauggugguauacacuuuaacaccaucuuacuaacc

SEQ ID NO: 97422 - RNA, 64 nt, Homo Sapiens
aaaacaaagauauucaaacugcuuggguucaaaugguauacaauuugccagcuguuacugaacc

SEQ ID NO: 97423 - RNA, 64 nt, Homo Sapiens
accuagaucugucagcuaagcuaauuuuauauuugguauacaugcaugucaaauaaaguuaauu

SEQ ID NO: 97424 - RNA, 64 nt, Homo Sapiens
aauaagccuauaaauguguuaaauuaccaauuaugguauacaaauaaaaguauugagggggcaa

SEQ ID NO: 97425 - RNA, 64 nt, Homo Sapiens
cucguuagcguccauuucuuucuucugcaucacugguauacacagagcccucgcucguccacgg

SEQ ID NO: 97426 - RNA, 64 nt, Homo Sapiens
ugaugaccauuguauuaaaaauaugugugcgugugguauacaaaugccauagguguguaugugu

SEQ ID NO: 97427 - RNA, 64 nt, Homo Sapiens
ggugaucacaucaggcccuaucuaagaagcucaugguauacaagggucacccaaauagcugagu

SEQ ID NO: 97428 - RNA, 64 nt, Homo Sapiens
uuaauccccauauucuucuacugcccuuaacucugguauacaccaaaaagaaaucuuuacuuuc

SEQ ID NO: 97429 - RNA, 64 nt, Homo Sapiens
cauuugugcaauuucauuucgugauaugcaaccugguauacagauacaugugauguuaguaggu

SEQ ID NO: 97430 - RNA, 64 nt, Homo Sapiens
gaguucucgaagaaaauaaaugacuuuaggaagagguauacauuuuuuaagucgcucugccucc

SEQ ID NO: 97431 - RNA, 64 nt, Homo Sapiens
agaguaaaagaaaaacuaagagaucaaacugagagguauacaugaggcuaguguuugcauuccu

SEQ ID NO: 97432 - RNA, 64 nt, Homo Sapiens
cuugccuccccaggaaagaaggaauugcauccaagguauacauacauauucaucgauguuucgu

SEQ ID NO: 97433 - RNA, 64 nt, Homo Sapiens
ucaaccaaaaugaccucauucuucgaaaauuguugguauacauuucucuuuuuucuuccucuga

SEQ ID NO: 97434 - RNA, 64 nt, Homo Sapiens
gacauguccugggugacaugauucugcccaauaggguauacagaugggugcagcuauaugauua

SEQ ID NO: 97435 - RNA, 64 nt, Homo Sapiens
cacacacacacacacauacacaguuacauauuuagguauacacacauuugcagaaaccauuaag

SEQ ID NO: 97436 - RNA, 64 nt, Homo Sapiens
uuacauauggaaauauaggcuacuuacaaacugcgguauacauuuccucaaacacacaaacuau

SEQ ID NO: 97437 - RNA, 64 nt, Homo Sapiens
gaaagaucuucaucaacaucuguaucuuuccagagguauacagaauuaaaauuugaucuucaag

SEQ ID NO: 97438 - RNA, 64 nt, Homo Sapiens
aaugccuguucagggcugguuuucugcaugcacggguauacacauaaugcagugccaugcacau

SEQ ID NO: 97439 - RNA, 64 nt, Homo Sapiens
gucauacgcuaaaaugauauuggucuuugaauuugguauacauuuauucuguucacuaucacaa

SEQ ID NO: 97440 - RNA, 64 nt, Homo Sapiens
uuguuugauuuuuuuuuacaagcuaacuguuagagguauacauuuauuuaucuguuguacagau

SEQ ID NO: 97441 - RNA, 64 nt, Homo Sapiens
uauuuugaagagaaaugguuugugguuguccagugguauacaacugacaggcauuucauuaagc

SEQ ID NO: 97442 - RNA, 64 nt, Homo Sapiens
aauuuuuauucuuaugugugauuuguuauucauugguauacaaccaaacacagaauuugauugg

SEQ ID NO: 97443 - RNA, 64 nt, Homo Sapiens
ugaagaauuuucuagcaaaauguuuuccaugaaagguauacaaaucuacagaccacacucuagu

SEQ ID NO: 97444 - RNA, 64 nt, Homo Sapiens
cacaucgccgccacacccagccugcugaguagcugguauacaggaaacgauucuuguaccucag

SEQ ID NO: 97445 - RNA, 64 nt, Homo Sapiens
ucaccauguauguggugaauuucguaagguacuugguauacauaucugccuauguuucuuuuca

SEQ ID NO: 97446 - RNA, 64 nt, Homo Sapiens
caauuucccaaaauaaaauccuuuuuuguaugaugguauacaguuuucaguaaugauguauaca

SEQ ID NO: 97447 - RNA, 64 nt, Homo Sapiens
guaaaauguuauaaaugugaugucauuuauuggcgguauacaaaauuuaugaaaauaguuucau

SEQ ID NO: 97448 - RNA, 64 nt, Homo Sapiens
gcaggaaagagaggaauaaacuucuuaugccguugguauacagggauuuuucucuuugugcagg

SEQ ID NO: 97449 - RNA, 64 nt, Homo Sapiens
uuguggaauugacucaaaaauauaauuuuugugagguauacauagaacuuauguguuuuaauug

SEQ ID NO: 97450 - RNA, 64 nt, Homo Sapiens
uacgacuucacaaaaccuaucaagaaacuauauagguauacacuauuaugaaaaucaagaauag

SEQ ID NO: 97451 - RNA, 64 nt, Homo Sapiens
ucagggaaagucaucgaugagaugaagccugcuggguauacagcugucggugagaugguguggu

SEQ ID NO: 97452 - RNA, 64 nt, Homo Sapiens
uauauaacucuuugagccuuuauugguaaauucugguauacauugaauucauuauaauuugggu

SEQ ID NO: 97453 - RNA, 64 nt, Homo Sapiens
uaacauaaggcauguagccauauuuucauauagugguauacaacacaguaucauugcaaaugca

SEQ ID NO: 97454 - RNA, 64 nt, Homo Sapiens
uugcaguggcuaggaccucccaagauauaaaauugguauacaaauaauaaguuuggcaagguug

SEQ ID NO: 97455 - RNA, 64 nt, Homo Sapiens
uauaauuaguuuuaauaaaacaugcugcaaccaugguauacaacaaaaauacauuucuuuggug

SEQ ID NO: 97456 - RNA, 64 nt, Homo Sapiens
gaucaggggguugcaacaauuggguuaaacuuuggguauacauuggaagcaccagggcauguuu

SEQ ID NO: 97457 - RNA, 64 nt, Homo Sapiens
auuuaugauauagcuuauaugauuuuuuugccuugguauacauuuuaaaauaugaauuuaaaaa

SEQ ID NO: 97458 - RNA, 64 nt, Homo Sapiens
cuggaauuucccaccuuccgugguguggguaaaugguauacauaaacauuaaaccuuaaccaaa

SEQ ID NO: 97459 - RNA, 64 nt, Homo Sapiens
uuccccuaaugccuaucugaaggcacaagaccaagguauacaucauagggauaagauuuuuugu

SEQ ID NO: 97460 - RNA, 64 nt, Homo Sapiens
uugugaaccuuugaacuauauguauguguauaaggguauacacauacauauauggcauauaaca

SEQ ID NO: 97461 - RNA, 64 nt, Homo Sapiens
cagguuaagacuagaaagucugaguuauguuuuagguauacaugaucgucugaguggucauaac

SEQ ID NO: 97462 - RNA, 64 nt, Homo Sapiens
augcaugguuucucaaauuuggauuauuaaauaagguauacagugaaagugcaaacaauucuuu

SEQ ID NO: 97463 - RNA, 64 nt, Homo Sapiens
gggccaaaacccacuaagaucugcugacacugcugguauacacauuguguuugugguuuaggag

SEQ ID NO: 97464 - RNA, 64 nt, Homo Sapiens
uaaauaaggccaugucugacgugccuauauuaaagguauacaaauuacucuuuguaccucuauu

SEQ ID NO: 97465 - RNA, 64 nt, Homo Sapiens
uguacauauauguauaauaugugagugggugcgugguauacaugcaaagugcguguguguaugu

SEQ ID NO: 97466 - RNA, 64 nt, Homo Sapiens
uugaagagucuacauucagaacauaaaagcacuagguauacaaguuugaaauaugauuuaagca

SEQ ID NO: 97467 - RNA, 64 nt, Homo Sapiens
aaguagaacaaauguggcaaguaggacuccuaucgguauacaaauuccauuucuuuuuauaaga

SEQ ID NO: 97468 - RNA, 64 nt, Homo Sapiens
acccuagaguuaaucucuuuugggaacauaaggagguauacagaacugcagaccucuaaacaua

SEQ ID NO: 97469 - RNA, 64 nt, Homo Sapiens
gacucuacacucaacacacucuaaucuacuuaaagguauacaaaauaugcugaucuuuuuuaaa

SEQ ID NO: 97470 - RNA, 64 nt, Homo Sapiens
aaagacagcagggacaagauacauaugaggacaagguauacacccaguucugaauaacuugaag

SEQ ID NO: 97471 - RNA, 64 nt, Homo Sapiens
ccacccucuagaaguauuuuugcagguccagguugguauacauuaauauuguuaauacugaacu

SEQ ID NO: 97472 - RNA, 64 nt, Homo Sapiens
uuacugcacuuauguguaaucagaucuuuauuuagguauacauauccuccuauaccgcacauaa

SEQ ID NO: 97473 - RNA, 64 nt, Homo Sapiens
aauuuacaugauucauauucauuaugcauuacuugguauacagacuuauuuucauaaugcaaau

SEQ ID NO: 97474 - RNA, 64 nt, Homo Sapiens
ugcaauuucugauuugcugugaaaucagaaagcagguauacacuuuuggguuuucuguuuguuu

SEQ ID NO: 97475 - RNA, 64 nt, Homo Sapiens
caugaucccaugcucccaagguguuuucuuuccugguauacauaagcaauagaauaaagaaugu

SEQ ID NO: 97476 - RNA, 64 nt, Homo Sapiens
aguaaucuccuauuuuggugauuugguuuuguaagguauacagcuaccaagauaauguaauuac

SEQ ID NO: 97477 - RNA, 64 nt, Homo Sapiens
ggcuauuuaaccaaaugaggguguagaacucucugguauacacuaagugauauaauuuugaccu

SEQ ID NO: 97478 - RNA, 64 nt, Homo Sapiens
aaggcuacagcagagugauuucagcuuccaaacugguauacauuccaaacugauaguacauugc

SEQ ID NO: 97479 - RNA, 64 nt, Homo Sapiens
acaguugauuauucaccacgcucacugguauuuagguauacaaauuacaagucucgcuuauuau

SEQ ID NO: 97480 - RNA, 64 nt, Homo Sapiens
auucauugauucucuuuuccuuccacaauaaaaugguauacaagaacaggagugugugugacgu

SEQ ID NO: 97481 - RNA, 64 nt, Homo Sapiens
gcuauucagucuuaauuucacuaguaguauaauggguauacauuuuuguaaauagcauccccaa

SEQ ID NO: 97482 - RNA, 64 nt, Homo Sapiens
uguuucucuguaucuguagcauagcauagaacccgguauacagggguuucugcugacacaucaa

SEQ ID NO: 97483 - RNA, 55 nt, Homo Sapiens
aaaauguugaagagccccagcagcagguauacagguccuuuucagugguguguag

SEQ ID NO: 97484 - RNA, 64 nt, Homo Sapiens
cggcuucauugccaauaaaugacuaggggagccugguauacaugggauggggcaaggugguggg

SEQ ID NO: 97485 - RNA, 64 nt, Homo Sapiens
gagcuucucccccucacccauuccuagugcucuugguauacacuugggaaaauaauguccucca

SEQ ID NO: 97486 - RNA, 64 nt, Homo Sapiens
gugaagagacugcaugauuaaacuagauagaccugguauacagucacugaacuaguagauguca

SEQ ID NO: 97487 - RNA, 64 nt, Homo Sapiens
gguuucaggcaagguauuaaugauacaauuccgugguauacagcuccugugacauuugaaguuu

SEQ ID NO: 97488 - RNA, 64 nt, Homo Sapiens
cagguuugggcaaaauuaauccacaggacugaaagguauacaucugugaguuuuguucucacuu

SEQ ID NO: 97489 - RNA, 64 nt, Homo Sapiens
uuugaagaacuguguaacuccacccaaauggggagguauacauggucugauuagccaaucucac

SEQ ID NO: 97490 - RNA, 64 nt, Homo Sapiens
guauaucacaauuuuaagugucuuuggcauucuugguauacaaauuucuguacaucaccaagua

SEQ ID NO: 97491 - RNA, 64 nt, Homo Sapiens
gucaugaggaugaaagaauggcauuaaagcauuugguauacaguaggugcucaauaaauugcua

SEQ ID NO: 97492 - RNA, 64 nt, Homo Sapiens
uccuuacauauuuuugcauauuaacccuuuaucagguauacagcuugcaacuauuuucucccau

SEQ ID NO: 97493 - RNA, 64 nt, Homo Sapiens
gagguggguaguuguagauauaauagugguguaggguauacagauuuguggcagucugugugug

SEQ ID NO: 97494 - RNA, 64 nt, Homo Sapiens
auuaaaaccuuagacugauuugauuaugaaaauggguauacagccccggccugauguuuuugaa

SEQ ID NO: 97495 - RNA, 64 nt, Homo Sapiens
caauaaauggagguguugagagugaggaagucaggguauacaugagagcaggcacagaaggacc

SEQ ID NO: 97496 - RNA, 64 nt, Homo Sapiens
uucucauucaaucuucuccuggcaagcucuccuggguauacauuaggcccagacaccccagaag

SEQ ID NO: 97497 - RNA, 64 nt, Homo Sapiens
ucuuuuuccuucuacagcaugcuacuucaaaugugguauacaauuggugcauauacgcccuuga

SEQ ID NO: 97498 - RNA, 64 nt, Homo Sapiens
ucaccuguucuuucccuuuugcaagugggaccuugguauacacaugcagccucuuuuugccuga

SEQ ID NO: 97499 - RNA, 64 nt, Homo Sapiens
guuaaaguggaaugagguaaucacaaaucaauacgguauacagaucucauaauaaaucaucuca

SEQ ID NO: 97500 - RNA, 64 nt, Homo Sapiens
uuuagcuuaauauggacacugacacauuuugggggguauacauuagacauaucagagcagugua

SEQ ID NO: 97501 - RNA, 64 nt, Homo Sapiens
uaaaguuugauauguauagaauauaauugaaggagguauacacauauugauguuguuuugauua

SEQ ID NO: 97502 - RNA, 64 nt, Homo Sapiens
uuucuccaaauacaauagaggagaauauguaaaggguauacauuaauugguacguagcauuuaa

SEQ ID NO: 97503 - RNA, 64 nt, Homo Sapiens
ugcuuuuuuaaaaaaagcgcugaaguuagaccaagguauacaguuuuguucuaacagacauuua

SEQ ID NO: 97504 - RNA, 64 nt, Homo Sapiens
guccugcagugagauaguagucucagagaugugggguauacacuaaacacuggcuuuacagggu

SEQ ID NO: 97505 - RNA, 64 nt, Homo Sapiens
agguaacugugaauugcagaggguauggagagaugguauacagcgucaauaaugacccuuuuga

SEQ ID NO: 97506 - RNA, 64 nt, Homo Sapiens; identical to SEQ ID NO: 83525

SEQ ID NO: 97507 - RNA, 64 nt, Homo Sapiens; identical to SEQ ID NO: 83526

SEQ ID NO: 97508 - RNA, 64 nt, Homo Sapiens; identical to SEQ ID NO: 83527

SEQ ID NO: 97509 - RNA, 64 nt, Homo Sapiens; identical to SEQ ID NO: 83528

SEQ ID NO: 97510 - RNA, 64 nt, Homo Sapiens; identical to SEQ ID NO: 83529

SEQ ID NO: 97511 - RNA, 64 nt, Homo Sapiens; identical to SEQ ID NO: 83530

SEQ ID NO: 97512 - RNA, 64 nt, Homo Sapiens; identical to SEQ ID NO: 83531

SEQ ID NO: 97513 - RNA, 64 nt, Homo Sapiens; identical to SEQ ID NO: 83532

SEQ ID NO: 97514 - RNA, 64 nt, Homo Sapiens; identical to SEQ ID NO: 83533

SEQ ID NO: 97515 - RNA, 64 nt, Homo Sapiens; identical to SEQ ID NO: 83534

SEQ ID NO: 97516 - RNA, 64 nt, Homo Sapiens; identical to SEQ ID NO: 83535

SEQ ID NO: 97517 - RNA, 64 nt, Homo Sapiens; identical to SEQ ID NO: 83536

SEQ ID NO: 97518 - RNA, 64 nt, Homo Sapiens; identical to SEQ ID NO: 83537

SEQ ID NO: 97519 - RNA, 64 nt, Homo Sapiens; identical to SEQ ID NO: 83538

SEQ ID NO: 97520 - RNA, 64 nt, Homo Sapiens; identical to SEQ ID NO: 83539

SEQ ID NO: 97521 - RNA, 64 nt, Homo Sapiens; identical to SEQ ID NO: 83540

SEQ ID NO: 97522 - RNA, 64 nt, Homo Sapiens; identical to SEQ ID NO: 83541

SEQ ID NO: 97523 - RNA, 64 nt, Homo Sapiens; identical to SEQ ID NO: 83542

SEQ ID NO: 97524 - RNA, 64 nt, Homo Sapiens; identical to SEQ ID NO: 83543

SEQ ID NO: 97525 - RNA, 64 nt, Homo Sapiens; identical to SEQ ID NO: 83544

SEQ ID NO: 97526 - RNA, 64 nt, Homo Sapiens; identical to SEQ ID NO: 83545

SEQ ID NO: 97527 - RNA, 64 nt, Homo Sapiens; identical to SEQ ID NO: 83546

SEQ ID NO: 97528 - RNA, 64 nt, Homo Sapiens; identical to SEQ ID NO: 83547

SEQ ID NO: 97529 - RNA, 64 nt, Homo Sapiens; identical to SEQ ID NO: 83548

SEQ ID NO: 97530 - RNA, 64 nt, Homo Sapiens; identical to SEQ ID NO: 83549

SEQ ID NO: 97531 - RNA, 64 nt, Homo Sapiens; identical to SEQ ID NO: 83550

SEQ ID NO: 97532 - RNA, 64 nt, Homo Sapiens; identical to SEQ ID NO: 83551

SEQ ID NO: 97533 - RNA, 64 nt, Homo Sapiens; identical to SEQ ID NO: 83552

SEQ ID NO: 97534 - RNA, 64 nt, Homo Sapiens; identical to SEQ ID NO: 83553

SEQ ID NO: 97535 - RNA, 64 nt, Homo Sapiens; identical to SEQ ID NO: 83554

SEQ ID NO: 97536 - RNA, 64 nt, Homo Sapiens; identical to SEQ ID NO: 83555

SEQ ID NO: 97537 - RNA, 64 nt, Homo Sapiens; identical to SEQ ID NO: 83556

SEQ ID NO: 97538 - RNA, 64 nt, Homo Sapiens; identical to SEQ ID NO: 83557

SEQ ID NO: 97539 - RNA, 64 nt, Homo Sapiens; identical to SEQ ID NO: 83558

SEQ ID NO: 97540 - RNA, 64 nt, Homo Sapiens; identical to SEQ ID NO: 83559

SEQ ID NO: 97541 - RNA, 64 nt, Homo Sapiens; identical to SEQ ID NO: 83560

SEQ ID NO: 97542 - RNA, 64 nt, Homo Sapiens; identical to SEQ ID NO: 83561

SEQ ID NO: 97543 - RNA, 64 nt, Homo Sapiens
uagcuggaugcugucagaggcgauggagaaacgcaaaggcuacuagacgcaacaauagaauuac

SEQ ID NO: 97544 - RNA, 64 nt, Homo Sapiens
uugaaauucuacuaaguuuucccauauucuugauaaaggcuaaauuugaaauaauuuauuuaga

SEQ ID NO: 97545 - RNA, 64 nt, Homo Sapiens
ugugaugaugacacuuuggucauaagccccucagaaaggcuaaccauauccuucacauauuucc

SEQ ID NO: 97546 - RNA, 64 nt, Homo Sapiens
uacuuucuuuuccuuuuccuaaguguuagccacaaaaggcuacuaauguauuugucauguuaaa

SEQ ID NO: 97547 - RNA, 64 nt, Homo Sapiens
ugcauaagaaagaguaaacaguauaggauuucauaaaggcuaauuaaauauagaaguguugcau

SEQ ID NO: 97548 - RNA, 61 nt, Homo Sapiens
ggcgaccugcugaucaggaaggaaaacccccaaaggcuacagggcacaguaugcaauuuaa

SEQ ID NO: 97549 - RNA, 64 nt, Homo Sapiens
ucaagacgaggugcgguggcgaggugaacauuuaaaaggcuauuuuaccacugugaggcaagcu

SEQ ID NO: 97550 - RNA, 64 nt, Homo Sapiens
ccagaaauauuucccacaacagcuucgaguagagaaaggcuauccuacuggcgccucaaccagc

SEQ ID NO: 97551 - RNA, 64 nt, Homo Sapiens
cgauaugaauuucagaaaugaguagaaaaaggcuaaaggcuaugacugguuggguugaccagua

SEQ ID NO: 97552 - RNA, 64 nt, Homo Sapiens
ggcuaugcgauaugaauuucaccaguaaguagaaaaaggcuaaacaacaguacugguuggguug

SEQ ID NO: 97553 - RNA, 64 nt, Homo Sapiens
guccggcuccaucggcacuaccaccccgcuccaucaucacuauguccagcuccgucggcacuac

SEQ ID NO: 97554 - RNA, 64 nt, Homo Sapiens
guccagcuccgucggcacuaccacccugcuccaucaucacuacguccagcuccaacggcacugg

SEQ ID NO: 97555 - RNA, 64 nt, Homo Sapiens
guuuccaaauggaugaauuuucauuuggacauuacaucacuaaauucauuagauuuugucugca

SEQ ID NO: 97556 - RNA, 64 nt, Homo Sapiens
cucaguaaagcaaugaacugcuugcuuagagaagcaucacuauccccauugagaaaaaugugug

SEQ ID NO: 97557 - RNA, 64 nt, Homo Sapiens
guauauaggcuuuugacaaacucauggauuugggcaaacugaauaauuuuacaauugugaaaac

SEQ ID NO: 97558 - RNA, 64 nt, Homo Sapiens
auguguuacaagaaaaauauggcauuaaauuauacaaacugaaagaaaggcaaacauaggucug

SEQ ID NO: 97559 - RNA, 64 nt, Homo Sapiens
aggaagggcugcuaucaaaccuaccuuuuuugagcaaacugagacuaaacuucucucuuuucaa

SEQ ID NO: 97560 - RNA, 64 nt, Homo Sapiens
uuuuucuaaacagaaauuauuuucuauuaauuugcaaacugaugauuucacuuuuuuuuacuuu

SEQ ID NO: 97561 - RNA, 64 nt, Homo Sapiens
gaauacuagauaggagagacaaguacaagcugggcaaacugacaaccauuagaagcaaaauuaa

SEQ ID NO: 97562 - RNA, 64 nt, Homo Sapiens
acaauuaaaauucugacaguaaguaccagccguccaaacugaucuuggauugugagaaaguacc

SEQ ID NO: 97563 - RNA, 64 nt, Homo Sapiens
aagcaggccgggcaugguggggagcuuaaagauccaaacugagaacuuucaugcuucugggguu

SEQ ID NO: 97564 - RNA, 64 nt, Homo Sapiens
ugguugaaugauagcauuucugccccgggggcagcaaacugacauagaaagguuugguuugaaa

SEQ ID NO: 97565 - RNA, 64 nt, Homo Sapiens
acauguuaaggcuauaguuuuuucuucccaggaucaaacugaaaccuucauucagggcauauuu

SEQ ID NO: 97566 - RNA, 64 nt, Homo Sapiens
caauuuaacaauccugacauggagauaaacaagacaaacugaguaaagauuuagaagauauuuu

SEQ ID NO: 97567 - RNA, 62 nt, Homo Sapiens
aaaaaaaaaaacaaaaaaagucaagugacacgcacaaacugaacauguguuugguuucugau

SEQ ID NO: 97568 - RNA, 64 nt, Homo Sapiens
auaagaaaacaaaaaucaaaaguaaagaaacugacaaacugaaaggcuagaaaaaaauaauggu

SEQ ID NO: 97569 - RNA, 64 nt, Homo Sapiens
aaaaauuaaaagaagaggaagaaagagaaauaaucaaacugaccaugaaguaagcagcacuuaa

SEQ ID NO: 97570 - RNA, 64 nt, Homo Sapiens
caucagucaugugaaguauuugucuaaaacagagcaaacugaagaccaaauuauucuccuguug

SEQ ID NO: 97571 - RNA, 64 nt, Homo Sapiens
agcacucagagggacuuauguccucacccaccuccaaacugacucuuuuaaguacccccuuucc

SEQ ID NO: 97572 - RNA, 64 nt, Homo Sapiens
uucuaggcagacaguugucuuaucuugaaagaaacaaacugacaggggaaguccagaugcgggu

SEQ ID NO: 97573 - RNA, 64 nt, Homo Sapiens
cacuguggcuuuccacgugaagccucacugugcccugauucacaccucccacuuucaccagagc

SEQ ID NO: 97574 - RNA, 64 nt, Homo Sapiens
gguccccuaguuaggcccagcagggcucagccuccugauucauggccacugaacucccccaucc

SEQ ID NO: 97575 - RNA, 64 nt, Homo Sapiens
acugacucuccaccauaaaaaauugccccagggccugauucaggagaaacagcacucugguuau

SEQ ID NO: 97576 - RNA, 64 nt, Homo Sapiens
auagccauaguccuuugaagaaagauaauggcuucugauucaacggaagugcauccucugggaa

SEQ ID NO: 97577 - RNA, 64 nt, Homo Sapiens
ucagacgugucauuagaacaugaguccucugcuucugauucaggcauacuuuugggauucuucc

SEQ ID NO: 97578 - RNA, 64 nt, Homo Sapiens
cauagaaaacuguaaaagauaaaucaggagauggcugauucauaauggguaauaaaauaaauag

SEQ ID NO: 97579 - RNA, 64 nt, Homo Sapiens
agaaaaguuauuaaaauuauuaauauauuuggaacugauucauaagaacaugaugguuggucuc

SEQ ID NO: 97580 - RNA, 64 nt, Homo Sapiens
uggggagaauguucacagcaaaagaccugcgggacugauucacgaucagucaagagaguaacug

SEQ ID NO: 97581 - RNA, 64 nt, Homo Sapiens
gugaauccaucuuuccuugcccgauguuaucuuucugauucaauacaaaaacaacaguccuacu

SEQ ID NO: 97582 - RNA, 64 nt, Homo Sapiens
gccaauugucacauuuuaagcuggguauuuuguccugauucacuuuguguucaguuaaguuuac

SEQ ID NO: 97583 - RNA, 64 nt, Homo Sapiens
ggcaugcauuuacauauguuaacacugcaugaaucugauucagacauaaauuauucagauaauu

SEQ ID NO: 97584 - RNA, 64 nt, Homo Sapiens
gaccaaaagucaguguugcaaauaauuuaggacucugauucacuuucaucuguuugaagccuga

SEQ ID NO: 97585 - RNA, 64 nt, Homo Sapiens
caagauguauguuugcuauggugcucgcagugggcugauucaauggcugauucaaucaagaucc

SEQ ID NO: 97586 - RNA, 64 nt, Homo Sapiens
caagauccgugcucgcagugacuacaccaauaggcugauucaauaagauguauguagaccuaaa

SEQ ID NO: 97587 - RNA, 64 nt, Homo Sapiens
ggcuggggcucuccgugguguucuggacccagccccuggagacaccauucacuuuuacugcuuu

SEQ ID NO: 97588 - RNA, 64 nt, Homo Sapiens
cuccauggcuggucaugagagcaaaccguaguccccuggagacagcgacuccagagaaccucuu

SEQ ID NO: 97589 - RNA, 64 nt, Homo Sapiens
cccaugguggguaggugguuccaaaugaccgagcccuggagagcugucaugaagugcacaggag

SEQ ID NO: 97590 - RNA, 64 nt, Homo Sapiens
acauuugcuuuaaugagugcggccugaggguccaccuggagaguccccucugcugccggcucug

SEQ ID NO: 97591 - RNA, 64 nt, Homo Sapiens
gggggcccagcagagccugccaccacagccaaggccuggagacucacaggacagacccuuucuc

SEQ ID NO: 97592 - RNA, 64 nt, Homo Sapiens
guaacugagcaggggcuacaugucugccucgcuuccuggagauagccaagaggcuggaacauag

SEQ ID NO: 97593 - RNA, 64 nt, Homo Sapiens
gcauuccaggguugaaucuugagugcccuguguuccuggagaaggccaccacugaguccacucg

SEQ ID NO: 97594 - RNA, 61 nt, Homo Sapiens
cagacacgugugaguggucagcuggagcccgccuggagagagcaaggccgccaggcacuga

SEQ ID NO: 97595 - RNA, 64 nt, Homo Sapiens
uaaacaauaaagacuuuaccugucuaauggaaaaccuggagaagucgucaggaaccagacuaca

SEQ ID NO: 97596 - RNA, 64 nt, Homo Sapiens
uggagaagucgucaggaaccagacuacaguggacccuggagaaccuugaagaacauuuuuccuu

SEQ ID NO: 97597 - RNA, 64 nt, Homo Sapiens
cuccugcagaccacgcccgugagggcggcaggggccuggagauccagacagagaggacuguagg

SEQ ID NO: 97598 - RNA, 64 nt, Homo Sapiens
uagggcaccagggguuucucuucucugacuucugccuggagacuugcugggagcuccacucugc

SEQ ID NO: 97599 - RNA, 64 nt, Homo Sapiens
auccccuuggaaagacaacccaugauacaguggaccuggagaccaguuucaagaugaagaacua

SEQ ID NO: 97600 - RNA, 64 nt, Homo Sapiens
ucugguuuuccaccaguuucuguggaaugcuacaccuggagaguuuaggacuacccaugaaugu

SEQ ID NO: 97601 - RNA, 64 nt, Homo Sapiens
cuucacacaccacagccaggaggggccuuucccaccuggagagaaacuuccagaccagccccuc

SEQ ID NO: 97602 - RNA, 64 nt, Homo Sapiens
ccccucauaccacagccaagaggggccuuucucaccuggagagaaauuuccagaccauccccuc

SEQ ID NO: 97603 - RNA, 64 nt, Homo Sapiens
ccccucacaccacagccaagagaagccuuuccagccuggagagaaacuuccagaccagcccucu

SEQ ID NO: 97604 - RNA, 64 nt, Homo Sapiens
ccccucucaccacagccaggagaggccuuuaccaccuggagagaagcuuccagaccagccccuc

SEQ ID NO: 97605 - RNA, 64 nt, Homo Sapiens
ccccucacaccacagccaggagaggccuuucccaccuggagagaaacuuccagaccagccccuc

SEQ ID NO: 97606 - RNA, 64 nt, Homo Sapiens
ccccucauaccacagccaagaggggccuuucucaccuggagagaaacuuccagaccagccccuc

SEQ ID NO: 97607 - RNA, 64 nt, Homo Sapiens
ccccucacaccacagccaggagaggccuuucccgccuggagagaagcuucaggccagcuccuca

SEQ ID NO: 97608 - RNA, 64 nt, Homo Sapiens
cuccucacaccacagccaggagagaccuuuucugccuggagagaaacuuucagaccagccccac

SEQ ID NO: 97609 - RNA, 64 nt, Homo Sapiens
ccccacacaccacagccaggagaggccguuccugccuggagagaagcuuccagaccagcccuuc

SEQ ID NO: 97610 - RNA, 64 nt, Homo Sapiens
cccuucacaccacagccaggagaggccuuucccaccuggagagaaacuuccagaccagccccuc

SEQ ID NO: 97611 - RNA, 64 nt, Homo Sapiens
aucuucuggauuuuugccuggacccuucugcaagccuggagacuggaccugccacauguuccaa

SEQ ID NO: 97612 - RNA, 64 nt, Homo Sapiens
uagagcaagagcucugggggggccggaaagucucccuggagaaggccguaauaucugggccuug

SEQ ID NO: 97613 - RNA, 64 nt, Homo Sapiens
cucugugcauuuaagcuacuuguagagacccaggccuggagaguagacauuuugccucugauaa

SEQ ID NO: 97614 - RNA, 64 nt, Homo Sapiens
gugugcaccaggguucaguagaguccacuucugcccuggagaccacaaaucaacuagcuccauu

SEQ ID NO: 97615 - RNA, 64 nt, Homo Sapiens
uggagagcuuuuuaaaaagagguggacagaagcaccuggagaguaccggugcccaaaucuggcu

SEQ ID NO: 97616 - RNA, 64 nt, Homo Sapiens
gcuguugggggcccucagggcuacugauacaaggccuggagaggaauuaaugcauuuucauuuc

SEQ ID NO: 97617 - RNA, 64 nt, Homo Sapiens
uuucagggggguugugaggccuggccaggcacccccuggagagaaguuucuggcccuggcugac

SEQ ID NO: 97618 - RNA, 64 nt, Homo Sapiens
agagaaguuucuggcccuggcugaccccaaagagccuggagaagcugaugcuuugcuucaaauc

SEQ ID NO: 97619 - RNA, 64 nt, Homo Sapiens
agcaggccauggaggcagguaggauuaugguuaaccuggagaggugugaacccgcgaaggccuc

SEQ ID NO: 97620 - RNA, 64 nt, Homo Sapiens
uuuuggugacaugcacugagcagacuaugaaaucccuggagaauacuguugccacucuccuccc

SEQ ID NO: 97621 - RNA, 64 nt, Homo Sapiens
guaacauuucauuaaccaaaaugacagcuacuaaccuggagacauuuugccaccuuuccuguuc

SEQ ID NO: 97622 - RNA, 64 nt, Homo Sapiens
ggauggcagccucagggcuucaguaucaaggcugccuggagaaaggcucuaacauuacugccuu

SEQ ID NO: 97623 - RNA, 64 nt, Homo Sapiens
cuggggagaugcgguucacagauucuuggaaaagccuggagaagcaacaggcuacagugucccu

SEQ ID NO: 97624 - RNA, 64 nt, Homo Sapiens
gugauuaaagauacggaguccagcaggaagauagccuggagaagcgcuucccuuucuacuccag

SEQ ID NO: 97625 - RNA, 64 nt, Homo Sapiens
cuucauuguaauggaaguuucaguugggcaugagccuggagagaugugacugucuacaguucua

SEQ ID NO: 97626 - RNA, 64 nt, Homo Sapiens
ugguagucaccuucaugucaucuauaauaguacuccuggagagcccuggcugccuacaccagug

SEQ ID NO: 97627 - RNA, 64 nt, Homo Sapiens
uuuauugcucagaaaugaggcauauccuaaaaauccuggagagcuguauuuaaugcauuuuugc

SEQ ID NO: 97628 - RNA, 64 nt, Homo Sapiens
uuggauuacuggauuuuuuuuuuuuuuaaacacaccuggagaggacauuugaaaacacuguucu

SEQ ID NO: 97629 - RNA, 64 nt, Homo Sapiens
uaaagguuaagcccugaggggucccugauaacaaccuggagaccaggauuuuauggcuccccuc

SEQ ID NO: 97630 - RNA, 64 nt, Homo Sapiens
aaugaauauuuauuagcugguuggagagcuagaaccuggagagcuagaaccuggagaacuagaa

SEQ ID NO: 97631 - RNA, 64 nt, Homo Sapiens
gcugguuggagagcuagaaccuggagagcuagaaccuggagaacuagaaccuggagggcuagaa

SEQ ID NO: 97632 - RNA, 64 nt, Homo Sapiens
agaaucuggagagcuagaaccuggagggcuagaaccuggagagcuagaaccuagaagggcuaga

SEQ ID NO: 97633 - RNA, 64 nt, Homo Sapiens
gaaccuggcagguuagaaccuagaagggcuagaaccuggagagccagaaccuggagggcuagaa

SEQ ID NO: 97634 - RNA, 64 nt, Homo Sapiens
agaaccuggagggaaugaaccuggagggcuagaaccuggagaaugagaaaaauuuacauggcaa

SEQ ID NO: 97635 - RNA, 64 nt, Homo Sapiens
ugggaccagagagucugccccacugucagcaaagccuggagaaaacaaucaucuaaaagccagc

SEQ ID NO: 97636 - RNA, 64 nt, Homo Sapiens
ugggagaccaugaugagccuagcauccuggaggaccuggagagcaggagccuugguccaugcug

SEQ ID NO: 97637 - RNA, 64 nt, Homo Sapiens
ugcaggggccaagguggaggcagcucacuccgagccuggagaacucaagagcuggaaccucccu

SEQ ID NO: 97638 - RNA, 64 nt, Homo Sapiens
ccagggguggaggguccuggcagagcaagagagaccuggagacauggugcugucugaguauccc

SEQ ID NO: 97639 - RNA, 64 nt, Homo Sapiens
cguucaucgggaaccaggacacuuacgagacccaccuggagacuugccgcuucgagggccugaa

SEQ ID NO: 97640 - RNA, 64 nt, Homo Sapiens
acuccacugggguggaugggcugccugcacagccccuggagagggggccaggcacacccucaga

SEQ ID NO: 97641 - RNA, 64 nt, Homo Sapiens
cugaaaauucugauuaagccucugggcccuacagccuggagaaccuggagaauccuacacccac

SEQ ID NO: 97642 - RNA, 64 nt, Homo Sapiens
cugauuaagccucugggcccuacagccuggagaaccuggagaauccuacacccacagaacccgg

SEQ ID NO: 97643 - RNA, 64 nt, Homo Sapiens
ggcccagggccucuggcuucccugcccaauccucccuggagaagggacaugggaaugaauugaa

SEQ ID NO: 97644 - RNA, 64 nt, Homo Sapiens
caccacugggaaccaagggcccucacucaggaacccuggagacagaagucaggugucaucauca

SEQ ID NO: 97645 - RNA, 64 nt, Homo Sapiens
agcagacucuggaggccugugccuugcuagcugaccuggagaugcugccugguggggaucagac

SEQ ID NO: 97646 - RNA, 64 nt, Homo Sapiens
uccugguuuuagacgaggccacagcugccaucgaccuggagacugacaaccucauccaggcuac

SEQ ID NO: 97647 - RNA, 64 nt, Homo Sapiens
ucaucgaccugagggggcccaucccugcccaccuccuggagaacacguuggcucaguccugggu

SEQ ID NO: 97648 - RNA, 64 nt, Homo Sapiens
cagaggaugaggucaauuuccugaugcauauugcccuggagaagaucgccuucauccccuuugg

SEQ ID NO: 97649 - RNA, 64 nt, Homo Sapiens
agaggcuauuuggggucggauagcucucaacuguccuggagagcgugcaccccuuccuugugag

SEQ ID NO: 97650 - RNA, 64 nt, Homo Sapiens
aggcgucccuucccgggagcuuguucugcagccuccuggagacaucugucaggacuaccguggu

SEQ ID NO: 97651 - RNA, 64 nt, Homo Sapiens
uugagaggaguugguagacagcaagggaagggucccuggagacccccagccaaacgggucagug

SEQ ID NO: 97652 - RNA, 64 nt, Homo Sapiens
ggcacugauaagggaacuagcacaggggauugugccuggagacaugcccauggcugcacagaua

SEQ ID NO: 97653 - RNA, 64 nt, Homo Sapiens
acccagccccgcgcauccagggcuuccugagucgccuggagaacuucacgggacugucgcuggu

SEQ ID NO: 97654 - RNA, 64 nt, Homo Sapiens
cugguggcacucagcuuggggcugggccugcuggccuggagaccagggugccugcgggccuugg

SEQ ID NO: 97655 - RNA, 64 nt, Homo Sapiens
cccauucucccccucucccuauggugaccugaguccuggagacucgaggcgcuuauuuucccuu

SEQ ID NO: 97656 - RNA, 64 nt, Homo Sapiens
cuacaggaacuucagggucacccccuccuccucaccuggagagagacacugggcgccuccuccu

SEQ ID NO: 97657 - RNA, 64 nt, Homo Sapiens
caagaaugggcaagaaggaucaggucagccacucccuggagacacagccuucuggcugggacug

SEQ ID NO: 97658 - RNA, 64 nt, Homo Sapiens
aggaagauguauagcuuuagcuuuagccuggcaaccuggagaauccacauaccuuguguauuga

SEQ ID NO: 97659 - RNA, 64 nt, Homo Sapiens
ugugaggauccauucagccucaucuccacccgauccuggagagcucugggcagggcccucggga

SEQ ID NO: 97660 - RNA, 58 nt, Homo Sapiens
gaggccaggagccagccacugccuggacccuggagaaguucgagggccacggagauga

SEQ ID NO: 97661 - RNA, 64 nt, Homo Sapiens
gggacguccauuccugcuggucggccucgggcuuccuggagaagcuaggagcaagaaagucucu

SEQ ID NO: 97662 - RNA, 64 nt, Homo Sapiens
uagggucuuguccaaaguguccaagagaaucaggccuggagaucauacuuugauuuaaaauagg

SEQ ID NO: 97663 - RNA, 64 nt, Homo Sapiens
aagcugaaauggaauaucugaagauagcucaggaccuggagauguacggugugaacuacuuugc

SEQ ID NO: 97664 - RNA, 64 nt, Homo Sapiens
cacgcgaggcggagcgaagagccaagcagaagcuccuggagauugccaccaagcccacguaccc

SEQ ID NO: 97665 - RNA, 64 nt, Homo Sapiens
ggagaggacccucaggccucugagggcaccaggcccuggagaagaggugcaauucagggugugu

SEQ ID NO: 97666 - RNA, 64 nt, Homo Sapiens
ggagggguugucaagcccacccgggaaacugagcccuggagaggggaagcagccagcccaggau

SEQ ID NO: 97667 - RNA, 64 nt, Homo Sapiens
gugcaugcaggggugagguauuuucacugcccucccuggagagucccuuguaaguuuggcuccu

SEQ ID NO: 97668 - RNA, 64 nt, Homo Sapiens
gugccuggcaccccugaaccaugaucugagccucccuggagaagguauuuuauaugucugcugc

SEQ ID NO: 97669 - RNA, 64 nt, Homo Sapiens
ucggcuccuccugcuccugauucaacacugagggccuggagaccauuuucuuggaaccuuugau

SEQ ID NO: 97670 - RNA, 64 nt, Homo Sapiens
uuccucuuuaaaugaacaagcaugauguguauuuccuggagaaaacgguucuuaauacugaagu

SEQ ID NO: 97671 - RNA, 59 nt, Homo Sapiens
ccaagcugcuugagcccacugcuguggagagggccaaaacauaagccuuugccccacaa

SEQ ID NO: 97672 - RNA, 59 nt, Homo Sapiens
guccagagaagugauaacuugagaacuacagggccaaggccugagagcuggacagagca

SEQ ID NO: 97673 - RNA, 59 nt, Homo Sapiens
acaaagguuccagugagcgcgcgcugccgagggccaagcccucacacgggaccacagcc

SEQ ID NO: 97674 - RNA, 59 nt, Homo Sapiens
cacccccgccucacacacgccccuacuccagggccaauggugcuggugaugggcccugg

SEQ ID NO: 97675 - RNA, 64 nt, Homo Sapiens
gagugcaacuguggcuuagcuaauauugcaauguggcuugaauguagguagcauccuuugaugc

SEQ ID NO: 97676 - RNA, 64 nt, Homo Sapiens
cacaaugaaauuauauuuucuuuguaaagaaaguggcuugaaaucuuuuuuguucaaagauuaa

SEQ ID NO: 97677 - RNA, 64 nt, Homo Sapiens
cuuuuacuuuucagugucuucugagaaaccaccaggcuugaagugucuucucggaaaaaaccau

SEQ ID NO: 97678 - RNA, 64 nt, Homo Sapiens
cuuuuacuuuucagugucuucugagaaaccaccaggcuugaaggcuacaagugaugagaaagau

SEQ ID NO: 97679 - RNA, 64 nt, Homo Sapiens
ccugggugagucugccaacucacaggugcuuuuaggcuugaaaucuccauccuaucauuuccgu

SEQ ID NO: 97680 - RNA, 64 nt, Homo Sapiens
cugacuauuugacaauagggcugauaauguaaucggcuugaauuuugacuuaguaacuuuuuau

SEQ ID NO: 97681 - RNA, 64 nt, Homo Sapiens
ccuccucgcgagugccuucuagaaauagaagaggggcuugaaguaucccccugauuuuauauga

SEQ ID NO: 97682 - RNA, 64 nt, Homo Sapiens
cggggcuuccuuacagccccggagaagagaugggggcuugaacaaacuucguaccagcuagaag

SEQ ID NO: 97683 - RNA, 64 nt, Homo Sapiens
ccugaaauagggacuuagcucuugggggugggccuggaaggacugaaaggugggauuagaguca

SEQ ID NO: 97684 - RNA, 64 nt, Homo Sapiens
auuccagaaucuccuacccccagaaaaggggugcuggaaggaggccccaguggacucuuuguac

SEQ ID NO: 97685 - RNA, 64 nt, Homo Sapiens
gcucucacuguggaagaguuauuccuaccuacacuggaaggagcuaagccgaccaggaaaccuc

SEQ ID NO: 97686 - RNA, 64 nt, Homo Sapiens
gcagcagggaagggaauauucagaguuaguguucuggaaggaaagaaugugccccuucuuucau

SEQ ID NO: 97687 - RNA, 64 nt, Homo Sapiens
ugaaauuauaccuucugaucucauuaggcaaugcuggaaggaaaucugaaaagugccagcuauu

SEQ ID NO: 97688 - RNA, 64 nt, Homo Sapiens
caagccaauauguuccuuugcuguguccugugaauggaaggacccccagagaagaucuguuucc

SEQ ID NO: 97689 - RNA, 64 nt, Homo Sapiens
gacugcccccuaccucccacgaggaccaugugguuggaaggauaugcuuggauacucacauuag

SEQ ID NO: 97690 - RNA, 64 nt, Homo Sapiens
uguuugcaguuguaugcacaaggcgugaauccucuggaaggaacgaugacccucugcgguuguc

SEQ ID NO: 97691 - RNA, 64 nt, Homo Sapiens
gggaagcagcaggacacauuagagauccucagaguggaaggaggagagagagagagagagagag

SEQ ID NO: 97692 - RNA, 64 nt, Homo Sapiens
uccugcuaaggggaggugcacaguccuuugccaguggaaggaguguugagucagauggcagugg

SEQ ID NO: 97693 - RNA, 56 nt, Homo Sapiens
agagcgaaagggcccagagacugugauggaaggacuacgacgacgaggaggaauag

SEQ ID NO: 97694 - RNA, 64 nt, Homo Sapiens
guuccuuagagcuucucugccugaugcuuugaaauggaaggauugaauugagcuccuggcccuu

SEQ ID NO: 97695 - RNA, 64 nt, Homo Sapiens
uaaaauauaauauuuagagggcugaagaggaagguggaaggagaugggccaugaagaaguaggg

SEQ ID NO: 97696 - RNA, 64 nt, Homo Sapiens
agucucccuggagaaggccguaauaucugggccuuggaaggaaggacacagggcucuggaagga

SEQ ID NO: 97697 - RNA, 64 nt, Homo Sapiens
auaucugggccuuggaaggaaggacacagggcucuggaaggaggaggcugcaugccugaaggcu

SEQ ID NO: 97698 - RNA, 64 nt, Homo Sapiens
aauccaacugaccuagugaagguucagaugcaaauggaaggaaaaaggaaacuggaaggaaaac

SEQ ID NO: 97699 - RNA, 64 nt, Homo Sapiens
aagguucagaugcaaauggaaggaaaaaggaaacuggaaggaaaaccauugcgguaaguucucc

SEQ ID NO: 97700 - RNA, 64 nt, Homo Sapiens
caccugaauuauaucugcaagcuugacauucaaauggaaggaacuuuuauagcuucaaagugug

SEQ ID NO: 97701 - RNA, 64 nt, Homo Sapiens
aacgugguguugcagaacaaucuagagcagugacuggaaggacaguuugaguggaggaauguuu

SEQ ID NO: 97702 - RNA, 64 nt, Homo Sapiens
gagaaaaacagacugugggagaaagaggugaggauggaaggaugggaagagaaaguuaucaaga

SEQ ID NO: 97703 - RNA, 64 nt, Homo Sapiens
aacuuuucugugcccugcugucacauauucccccuggaaggagcgugcuugggguagaucuucu

SEQ ID NO: 97704 - RNA, 64 nt, Homo Sapiens
cagaauauugcauggagcacagugcuuccaaaacuggaaggaauuggccuggauuaggagucuu

SEQ ID NO: 97705 - RNA, 64 nt, Homo Sapiens
cccauuuucacuaaacaauaaaaucuaaauaaauuggaaggaauaacaaccacaaaggaaagaa

SEQ ID NO: 97706 - RNA, 64 nt, Homo Sapiens
uacgguaucagauaccaauaagaagaggaaaugauggaaggacuaaggaaguggaaccagaugc

SEQ ID NO: 97707 - RNA, 64 nt, Homo Sapiens
uggaaccagaugcagaagaguuauaaaagauacauggaaggaagauuauaauuugauaagguga

SEQ ID NO: 97708 - RNA, 64 nt, Homo Sapiens
auuugguuugguuuuauucuguuggaaacucaaguggaaggaagagagaguaagguguccuuau

SEQ ID NO: 97709 - RNA, 64 nt, Homo Sapiens
uuuauuaaaaagaagcuaauuuauuuauuuucaguggaaggauuuaguucaguaauuuaaaugc

SEQ ID NO: 97710 - RNA, 64 nt, Homo Sapiens
ggggcucauuuaacccucagguggaccuggggguuggaaggaugacccccagaggccuugggcu

SEQ ID NO: 97711 - RNA, 64 nt, Homo Sapiens
aacaguuaauuuaagaaugaucacacaagggaaguggaaggaaguuucuuauuuugcuacugag

SEQ ID NO: 97712 - RNA, 64 nt, Homo Sapiens
ggagugagcuggggagcuguucaaaggacggaaguggaaggacgagacagagaugaaaagacag

SEQ ID NO: 97713 - RNA, 64 nt, Homo Sapiens
ggcaaacugggacaugcagauaagugcaaaucaguggaaggagcugaagagaacgucaugagug

SEQ ID NO: 97714 - RNA, 64 nt, Homo Sapiens
gugauucugugaaaaggacaaggaaaggaaacaauggaaggaaaaagggaaggcauguagggac

SEQ ID NO: 97715 - RNA, 64 nt, Homo Sapiens
auagacugucucaucaaccccucauggaagaugguggaaggaaaacagaacccuuuuccugacu

SEQ ID NO: 97716 - RNA, 64 nt, Homo Sapiens
agacugggaaccacagaggagcugauguagcucauggaaggauccuucauggaaagguguuggc

SEQ ID NO: 97717 - RNA, 64 nt, Homo Sapiens
aaggccaccagguccagagaagagacaugaguucuggaaggagcaacugaaagcuucuguuuga

SEQ ID NO: 97718 - RNA, 64 nt, Homo Sapiens
aacagcugcaggaggggggaugccuggggaaagguggaaggagaucuaugccaauagcugggcc

SEQ ID NO: 97719 - RNA, 64 nt, Homo Sapiens
gagaaguaugugcccuaucucauggaugugauaguggaaggaauuguggauggaagacaagcag

SEQ ID NO: 97720 - RNA, 64 nt, Homo Sapiens
uguacugcucucugggagccucccugcuugaggauggaaggaugaaauuugacgaauauaucaa

SEQ ID NO: 97721 - RNA, 64 nt, Homo Sapiens
accaccuucauguuuugaaaguacuucaaacucauggaaggauagacaccgugagccugccuuu

SEQ ID NO: 97722 - RNA, 64 nt, Homo Sapiens
agguucuuucacaccugcugcaccagccccagccuggaaggaccccagugugcgcagcucgagc

SEQ ID NO: 97723 - RNA, 64 nt, Homo Sapiens
aggguuucuugggcugguugcuuccccucagggauggaaggaagauguaguucccaccaguugc

SEQ ID NO: 97724 - RNA, 64 nt, Homo Sapiens
uaaccccuucccucuccaccgauuuggugggguauggaaggaaccuucuaaaaugagagauagg

SEQ ID NO: 97725 - RNA, 64 nt, Homo Sapiens
cuacuuccuuucauagacaugaaaagacucacacuggaaggaaacacuaugaaugcaagcaaug

SEQ ID NO: 97726 - RNA, 64 nt, Homo Sapiens
aagccuucagaucagccucgcaccuucaaaugcauggaaggacucacacuggagaaaaacccua

SEQ ID NO: 97727 - RNA, 64 nt, Homo Sapiens
augccugugauccuggcuacuucagaggcugagguggaaggaucacuugaggccaggaguuuga

SEQ ID NO: 97728 - RNA, 64 nt, Homo Sapiens
gagagagaaagaaagaaagaaagaaagggaaagauggaaggaaggaaggaaaaagaaagagaaa

SEQ ID NO: 97729 - RNA, 64 nt, Homo Sapiens
agggcucuggagggauucgccccaaggcuggggguggaaggagcgggaccgcgguggguggaau

SEQ ID NO: 97730 - RNA, 64 nt, Homo Sapiens
uuugccgcagccuguccgagccucugccugcccguggaaggagcugaagaggagcuugagcuuc

SEQ ID NO: 97731 - RNA, 64 nt, Homo Sapiens
gcuugcaucucugaccaaauuucacauaaaacauuggaaggaggcugggugcgguggcucaugc

SEQ ID NO: 97732 - RNA, 64 nt, Homo Sapiens
uucaaauagucuugaaggggaaucagcuucaggauggaaggacccaggagaggccccgaggugg

SEQ ID NO: 97733 - RNA, 64 nt, Homo Sapiens
cuuaagaucacaucaucuacuagcguuuucuagcuggaaggaacuauuagccuagauugaauua

SEQ ID NO: 97734 - RNA, 64 nt, Homo Sapiens
gcaaggcagcuccccagccuaugguggaggacccuggaaggacacuuuucucuggaucucaaga

SEQ ID NO: 97735 - RNA, 64 nt, Homo Sapiens
cccaggggagagacaccacagagaggcugcgggcuggcggcagucuuugauaccuggggucguc

SEQ ID NO: 97736 - RNA, 64 nt, Homo Sapiens
uugacugcccccuguuguccggaggggugguggguggcggcaucauggccugggagcuuggaag

SEQ ID NO: 97737 - RNA, 64 nt, Homo Sapiens
ggaggagggcagcagcugaggagaaugaaggugguggcggcagaagcucuccuaacccaaggcg

SEQ ID NO: 97738 - RNA, 64 nt, Homo Sapiens
gcuaaaaacucauuuuuguuguuaaagccuuauuucacauaauuuggcauuaagucuugcuuug

SEQ ID NO: 97739 - RNA, 64 nt, Homo Sapiens
uuaggauuuucgaaaguuguuugacuaauuuuuuucacauaacuaucagauuuacagauuuucu

SEQ ID NO: 97740 - RNA, 64 nt, Homo Sapiens
caauagauguuucucuagaaaugggacuuuauuuucacauaaguuaaguauagauuuuaaagau

SEQ ID NO: 97741 - RNA, 64 nt, Homo Sapiens
auauuuucaauuguguacaauaacuuguaaaauuucacauaaauuagcaugccccuguucuucc

SEQ ID NO: 97742 - RNA, 64 nt, Homo Sapiens
guauuuuagcaggguacauaaaauuuuaugugcuucacauaauuucauauuuucacaugacgua

SEQ ID NO: 97743 - RNA, 64 nt, Homo Sapiens
acauacauugccaauuuuccuguuguggguuuuuucacauaaacaccacccccuucuuuuuugu

SEQ ID NO: 97744 - RNA, 64 nt, Homo Sapiens
ugccagcucagcuauggacacaucugagccagccaaggaggaggaugauuacgacgugaugcag

SEQ ID NO: 97745 - RNA, 64 nt, Homo Sapiens
cucccaggccaccaaggacggcaagaaggacaagaaggaggaagacaagaagugagacuggagg

SEQ ID NO: 97746 - RNA, 64 nt, Homo Sapiens
augccuguucucccugucugggaaauuccaggguaaggaggaagacuuuuuggugggaacuguu

SEQ ID NO: 97747 - RNA, 64 nt, Homo Sapiens
aggugaaacaggugguaauuaauuucuugcucugaaggaggagcccuagcccaaccaaugcuag

SEQ ID NO: 97748 - RNA, 64 nt, Homo Sapiens
aggcaaggaggcugcaggcagggggucuuggaggaaggaggaaacaccaugaagaggagaagau

SEQ ID NO: 97749 - RNA, 64 nt, Homo Sapiens
cugcaggaacaagugggcuucuaaagggaaugagaaggaggacgagaugaaagagaggguacaa

SEQ ID NO: 97750 - RNA, 64 nt, Homo Sapiens
uaccaugcccuuucgguuguauaggaaugaaucaaaggaggauuauaucacuauaacauaacug

SEQ ID NO: 97751 - RNA, 64 nt, Homo Sapiens
ucuuaggaauuccuaaggagguucugaaauuccuaaggaggaaugaagauacuucagaagggcu

SEQ ID NO: 97752 - RNA, 64 nt, Homo Sapiens
aggaggaaggccagacuggcaggggugggaggagaaggaggaagaguugguuggguggggaguc

SEQ ID NO: 97753 - RNA, 64 nt, Homo Sapiens
agucccaccaacuaccagacgaucucugagccuaaaggaggaaaucagccccugacagaaaaag

SEQ ID NO: 97754 - RNA, 64 nt, Homo Sapiens
acuuugaaaagaccgcuguucauaaggagagagaaaggaggaagagaugagaaaggaagacaga

SEQ ID NO: 97755 - RNA, 64 nt, Homo Sapiens
caguguauccccagcaccuaauacagaagguaauaaggaggaggcaucugcuaaacgcuuguug

SEQ ID NO: 97756 - RNA, 64 nt, Homo Sapiens
ucuaagagaagguaagacagauuaggacaucgaaaaggaggauggagccaggugccauggcuug

SEQ ID NO: 97757 - RNA, 64 nt, Homo Sapiens
gugagacucugucucaauuaauuuuuuuuuuuuaaaggaggaggaucuccauggguaagugguu

SEQ ID NO: 97758 - RNA, 64 nt, Homo Sapiens
gaacuuuauuccaaugcuaauggcagacaccaggaaggaggagaggaaccauuugugcagauca

SEQ ID NO: 97759 - RNA, 64 nt, Homo Sapiens
uuuguauguuacuuuaaagaggauguguguucuaaaggaggacaugagcuguguguuuucaaga

SEQ ID NO: 97760 - RNA, 64 nt, Homo Sapiens
agagugaggagaaaggaaacacagcagcucccucaaggaggagacgggggcaggucuguccggc

SEQ ID NO: 97761 - RNA, 64 nt, Homo Sapiens
uaauuccaucauauauacucuggugagugcagggaaggaggaugcguagcgggaugaucucggu

SEQ ID NO: 97762 - RNA, 64 nt, Homo Sapiens
agaauguuuuaggcagguggggugaauuuaauucaaggaggagggccuccuaugaugcagacau

SEQ ID NO: 97763 - RNA, 64 nt, Homo Sapiens
ucaguuaggucucccauuugcugaguggggaaggaaggaggauuggauuguaguagcagcugac

SEQ ID NO: 97764 - RNA, 64 nt, Homo Sapiens
gguggcuuuuauggacuuccccaguugaaaggauaaggaggaggcucccucacucuauaguugc

SEQ ID NO: 97765 - RNA, 64 nt, Homo Sapiens
auugacuugguucuuucuuauggaagggagaucgaaggaggaaguaggagcacuguugaagucc

SEQ ID NO: 97766 - RNA, 64 nt, Homo Sapiens
cauugucauccauuucccaguuagggcaacaaugaaggaggacccagccaagcuagaaggaauu

SEQ ID NO: 97767 - RNA, 64 nt, Homo Sapiens
gcccugggccacugccauuggguuagucaagaugaaggaggaggacuggcugccuccauuuugc

SEQ ID NO: 97768 - RNA, 64 nt, Homo Sapiens
ggagucugcaggcccuucacugucacaagcuguaaaggaggaagggaaaccgcagcugagcagg

SEQ ID NO: 97769 - RNA, 64 nt, Homo Sapiens
agccuagcaggauuucagauaggguccaagggacaaggaggagaugaaggcuccucuggguuug

SEQ ID NO: 97770 - RNA, 64 nt, Homo Sapiens
aagcugcuuucacgguaaaauuauguugguuugaaaggaggaaauagcaagguuaagaugugug

SEQ ID NO: 97771 - RNA, 64 nt, Homo Sapiens
auagaagcgcaaugagagaagcagcaguggguacaaggaggaagaaaaagggcuugcagagagu

SEQ ID NO: 97772 - RNA, 64 nt, Homo Sapiens
aaggcugaugccaggguuggcacauggaggguacaaggaggacucgccuggaguaucuuaagga

SEQ ID NO: 97773 - RNA, 64 nt, Homo Sapiens
agugcuaacauucaugauuagggucucagaagguaaggaggaagagaguggaauggaaaaagua

SEQ ID NO: 97774 - RNA, 64 nt, Homo Sapiens
uggaauugauuuucccugaguggagugcugggggaaggaggagguccaggccgguaguggccau

SEQ ID NO: 97775 - RNA, 64 nt, Homo Sapiens
caagugccagcagcugcagcaagaauacagccgcaaggaggaggagugccaggcaggggcugcc

SEQ ID NO: 97776 - RNA, 64 nt, Homo Sapiens
ccgggaccggcggaggcgcucacggagucgcgacaaggaggagcggaggcgcuccagggagcgg

SEQ ID NO: 97777 - RNA, 64 nt, Homo Sapiens
gagucgggagcgggcccggcgggagcgggagcgcaaggaggagcugcguggcggcgguggcgac

SEQ ID NO: 97778 - RNA, 64 nt, Homo Sapiens
ccagggcugggaaagaaacuaggaagaggcagagaaggaggagacagaggggugaagaaggagg

SEQ ID NO: 97779 - RNA, 64 nt, Homo Sapiens
aagaggcagagaaggaggagacagaggggugaagaaggaggagggagugagcgugugauuguag

SEQ ID NO: 97780 - RNA, 64 nt, Homo Sapiens
guggguggagaagggaggguggccagcacuaguaaaggaggaauagugcuugcuggccacaagg

SEQ ID NO: 97781 - RNA, 64 nt, Homo Sapiens
uaaaggaggaauagugcuugcuggccacaaggaaaaggaggaggugucuggggugagggaguua

SEQ ID NO: 97782 - RNA, 64 nt, Homo Sapiens
ccggacugaggaagacgaggacagggaggaggaaaaggaggaagaggaggacaaaaagggggag

SEQ ID NO: 97783 - RNA, 64 nt, Homo Sapiens
ggacaaaaagggggaggagaagguucuucguccaaaggaggaaggagaagaaguagaaagugcg

SEQ ID NO: 97784 - RNA, 64 nt, Homo Sapiens
agucagaugaggcccugcaccccuguaaucaggcaaggaggagggagaugugaucaggccccac

SEQ ID NO: 97785 - RNA, 64 nt, Homo Sapiens
agucaggaugaggccccgccuuucccacccaggaaaggaggaccccucaccccuccccugggac

SEQ ID NO: 97786 - RNA, 64 nt, Homo Sapiens
auccuuucuucuguuaauaugucagaauguaagauuuggcaacucgauaaauuuuuuucauuuu

SEQ ID NO: 97787 - RNA, 64 nt, Homo Sapiens
uuuuaagagacaaauuuuaacuuuuaauuuuuauuuuggcaaaacugucaaaugagaaaaauga

SEQ ID NO: 97788 - RNA, 64 nt, Homo Sapiens
augaauaaagcuguuguaaaggugguuuccaaguuuuggcaauucaccuauugaaagacuucuu

SEQ ID NO: 97789 - RNA, 64 nt, Homo Sapiens
acuuuuuacugucgccauagggacaugaucuuucuuuggcaacccccauccauguuccugcaaa

SEQ ID NO: 97790 - RNA, 64 nt, Homo Sapiens
aaaaauuuccuuucgcuuucauuauuuuucuuuuuuuggcaaaggcuugguacccaaggugcgg

SEQ ID NO: 97791 - RNA, 64 nt, Homo Sapiens
uuaaaaaagauauaaacuauaacuguccguuacuuuuggcaaaagauacaaccacauaauguau

SEQ ID NO: 97792 - RNA, 64 nt, Homo Sapiens
guuuauaaagugauguucuguguuuaagugguaauuuggcaacaauucuguauuuggauauuag

SEQ ID NO: 97793 - RNA, 64 nt, Homo Sapiens
caagggucucccucagcaggugugagcaaagugcuuuggcaaggauacucuuugaaacugccuu

SEQ ID NO: 97794 - RNA, 64 nt, Homo Sapiens
uguuuaaaaaaugucucuuucacucauaaguaaguuuggcaaguacaaaguuguuuuuaaaaca

SEQ ID NO: 97795 - RNA, 64 nt, Homo Sapiens
aacaacacagucuacucuuuaaguauaaacaguuuuuggcaaaaagcaauacuucagugagauu

SEQ ID NO: 97796 - RNA, 64 nt, Homo Sapiens
cucucuuuccccacccccaucacagggcuuucaguuuggcaaaggaaaagcagauaaaaacaga

SEQ ID NO: 97797 - RNA, 64 nt, Homo Sapiens
uuugccuuuaagccuuuuuuuucuuuuuuuuuuuuuuggcaaaugaauguaccauuucaacuuu

SEQ ID NO: 97798 - RNA, 64 nt, Homo Sapiens
guuacuccuguauugaguaauaagugacuuuuuguuuggcaaauugugggccuauuggguuaca

SEQ ID NO: 97799 - RNA, 64 nt, Homo Sapiens
gaaacaguuuauuaauguuuuaguuaggggcuaauuuggcaagaauacaugcacaaagauguuc

SEQ ID NO: 97800 - RNA, 64 nt, Homo Sapiens
cuugauugugauaagcccccaugccuggcuguuuuuuggcaaaugacugcaggcacaagccacc

SEQ ID NO: 97801 - RNA, 64 nt, Homo Sapiens
cuuuuuucuuuuuugagacacugaagguuuguguuuuggcaaauggaauccugugagcacuacu

SEQ ID NO: 97802 - RNA, 64 nt, Homo Sapiens
ccuaucuguaugagaagacagauugauagcaguauuuggcaauaguuaauuucauaugcuccug

SEQ ID NO: 97803 - RNA, 64 nt, Homo Sapiens
acaguugcuuaaagaguuaauaagauuacuggccuuuggcaagaauauccagagaaaauaaacu

SEQ ID NO: 97804 - RNA, 64 nt, Homo Sapiens
gguagcugagguuugugaaacaguaggauucucuuuuggcaauggagaauugcaucugaugguu

SEQ ID NO: 97805 - RNA, 64 nt, Homo Sapiens
gcauuuuuaaagucucucuucuguaacuggauguuuuggcaacuuuguggggagagacugcugg

SEQ ID NO: 97806 - RNA, 64 nt, Homo Sapiens
ccuaugcuuaaaauacuguaaauaugcagugagguuuggcaaaaucuauuccaugugugauuug

SEQ ID NO: 97807 - RNA, 64 nt, Homo Sapiens
uuuaacugcccccccagcccugacauguucuuuuuuuggcaaacauacauaauguuacaucaua

SEQ ID NO: 97808 - RNA, 64 nt, Homo Sapiens
ugucucguuguucagaacaacccugugaaguaguuuuggcaaugucuguguuacauuucaugua

SEQ ID NO: 97809 - RNA, 64 nt, Homo Sapiens
agucaagguuggagagucuccuuccagccagugaccuacccaaaccuuuuguucuguaaaacug

SEQ ID NO: 97810 - RNA, 64 nt, Homo Sapiens
guugaauuuucuuuccagccaguuacccuuucaaccuacccauacuuuguacaacucuuacaca

SEQ ID NO: 97811 - RNA, 64 nt, Homo Sapiens
ccacgcccuggaugccacccagugcagccuggcaccuacccacccacccuucagcuuaagccac

SEQ ID NO: 97812 - RNA, 64 nt, Homo Sapiens
aaauaguccuuuuucuuggaagcagugacgucucccuacccaaucuuucccauccuaucaaccc

SEQ ID NO: 97813 - RNA, 64 nt, Homo Sapiens
ccccucucaggagccaucaucggcuuuccccauuccuacccacuuaggcuuuguagcaagauga

SEQ ID NO: 97814 - RNA, 64 nt, Homo Sapiens
guggguucccaucauuuccugugucagcgccuggccuacccagauuguaucaugugcuagauug

SEQ ID NO: 97815 - RNA, 64 nt, Homo Sapiens
auugaauuuaaaaaggcauaauaaucaaauacuuaauagcaaauaaaugauguaucaggguauu

SEQ ID NO: 97816 - RNA, 64 nt, Homo Sapiens
guccugaggggcagggggaucugugauauaacaaaauagcaaaagcgguaauuuccuuaauguu

SEQ ID NO: 97817 - RNA, 64 nt, Homo Sapiens
agaaaugugcaggagcggagaugucacauauugaaauagcaaaucaugcuggccucagagauuc

SEQ ID NO: 97818 - RNA, 64 nt, Homo Sapiens
caacuuguggaucuguguguguuuauggauuuaaaauagcaaaggcugcagacagaggaagaaa

SEQ ID NO: 97819 - RNA, 64 nt, Homo Sapiens
uagcauaacuuuuuacauuuaauuuuucauaugaaauagcaauuaguuacugcuguguuacauu

SEQ ID NO: 97820 - RNA, 64 nt, Homo Sapiens
guuuuaaaugucuagguucuguauuuuuuucuuaaauagcaagaaaauacagauugcuaguaua

SEQ ID NO: 97821 - RNA, 64 nt, Homo Sapiens
gaauaaacuuacauauuuauuuuuaggacaugaaaauagcaauauucuuggagauugauaacca

SEQ ID NO: 97822 - RNA, 64 nt, Homo Sapiens
uugaauggaauuucucaguagcagccuacaacugaauagcaaguggcauaaagcauauccauuc

SEQ ID NO: 97823 - RNA, 64 nt, Homo Sapiens
uuuaauaaaccuuuuuauuaaaaauugcauaaagaauagcaaucacauaaauccuuaguauaga

SEQ ID NO: 97824 - RNA, 64 nt, Homo Sapiens
ggcuauugccaauacuagggguuuuaauuauauaaauagcaaagcaauugaaauuuaaagaaaa

SEQ ID NO: 97825 - RNA, 64 nt, Homo Sapiens
agccuuucuuugguuucccaagagcuacguauuuaauagcaaagaauugacuggggcaauaacg

SEQ ID NO: 97826 - RNA, 64 nt, Homo Sapiens
cuuucucacuaaaucuuuuauaggauuuauuuaaaauagcaaaagaagaaguuucaucauuuuu

SEQ ID NO: 97827 - RNA, 64 nt, Homo Sapiens
uauuauguagaaaucuucaaagguagcauuauuaaauagcaaagaauaauuagaacccacauau

SEQ ID NO: 97828 - RNA, 64 nt, Homo Sapiens
acuggauguuuguuuguauaauuuugaacacuauaauagcaauucagagacagacauuguuaaa

SEQ ID NO: 97829 - RNA, 64 nt, Homo Sapiens
ucagagucuccugagucgaggaaucuguauuauuaauagcaaccagggccgggugucguggcuc

SEQ ID NO: 97830 - RNA, 64 nt, Homo Sapiens
cagagugagacuccuucucaaaaguaaauaaauaaauagcaaccaguacuccaggugauuccag

SEQ ID NO: 97831 - RNA, 64 nt, Homo Sapiens
cuggauuggucucaaaaacauaaugcucagugaaaauagcaaguuguagaaaguuauauacaaa

SEQ ID NO: 97832 - RNA, 64 nt, Homo Sapiens
acuuuggcaugaaauguuaagcauccgacaucuaaauagcaauauuuugaauacuggaaacuca

SEQ ID NO: 97833 - RNA, 64 nt, Homo Sapiens
uaauuucaguaguacaguauggaauaguuaaauaaauagcaaaucacugaauucagaaucucac

SEQ ID NO: 97834 - RNA, 64 nt, Homo Sapiens
gaauaagaggugauggaccaguuuacugcuuagaaauagcaagaggcacugcaguaaaacuugu

SEQ ID NO: 97835 - RNA, 64 nt, Homo Sapiens
aaaaguuuuacuuccuugcauucuucuaccuuuaaauagcaaaguaccacuaccaccaccaccu

SEQ ID NO: 97836 - RNA, 64 nt, Homo Sapiens
uguguuuugccugaaacgauaccagguuccccugaauagcaacuuuacaagguccaugugggag

SEQ ID NO: 97837 - RNA, 64 nt, Homo Sapiens
uuacaaucauauagaauauauagaguuacauuuuaauagcaacuguguacaugucacgaaacca

SEQ ID NO: 97838 - RNA, 64 nt, Homo Sapiens
aaaauaauguguuauuuuuauagagaaagaaaaaaauagcaacacaaucuaguuuauuuuaggg

SEQ ID NO: 97839 - RNA, 64 nt, Homo Sapiens
ugaaauuuauuuggaaccagaaaagcccaaccuaaauagcaaaagcaauccuaagcaaaaagag

SEQ ID NO: 97840 - RNA, 64 nt, Homo Sapiens
caaacacuuguauguucauugcagcacuauucucaauagcaaagauguggaaucaacguaaaug

SEQ ID NO: 97841 - RNA, 64 nt, Homo Sapiens
ggacuguugugaggcuuggcguaauaauacuuaccuaccucacauuuccaucuaccaaaugggu

SEQ ID NO: 97842 - RNA, 64 nt, Homo Sapiens
gcucucccugucaaaaagcaagagaguuuggggucuaccucagagaggaguagcccccuuuuuc

SEQ ID NO: 97843 - RNA, 64 nt, Homo Sapiens
uauuuaccuuuuacaagguuagaaaagucucauacuaccucaucuuuauuguggcgcuuuugua

SEQ ID NO: 97844 - RNA, 64 nt, Homo Sapiens
ugcaaccucugccuuccagguuccagcaauucuccuaccucagcucccaaguagcugagaugac

SEQ ID NO: 97845 - RNA, 64 nt, Homo Sapiens
uguaaaaucuuaagccaauggaacccuugauuuccuaccucaguguacacccaacuauugguug

SEQ ID NO: 97846 - RNA, 64 nt, Homo Sapiens
uuuaaauagccagcauguaauacaaguaacuacacuaccucauaucuacaugauuuucaaguug

SEQ ID NO: 97847 - RNA, 64 nt, Homo Sapiens
ggauaaaaaggauuacaugacagauaacuaaccccuaccucacaagccagcauggauaauaacc

SEQ ID NO: 97848 - RNA, 64 nt, Homo Sapiens
ggauuuaaugaugucaagcugcuaacaauauuaccuaccucauauuccucaucuguaaaauggg

SEQ ID NO: 97849 - RNA, 64 nt, Homo Sapiens
ccugcaccuacccacaugcacucgugugagacaaggcccauagguauggccccccccuuccccc

SEQ ID NO: 97850 - RNA, 64 nt, Homo Sapiens
augcugggaagggagcggcagcccagccaggccuggcccauaaaaggcucccaugcugagcagc

SEQ ID NO: 97851 - RNA, 64 nt, Homo Sapiens
gagcucucuguguuuggccucucacacacacacaggcccauagacagaugggcagaugcaccca

SEQ ID NO: 97852 - RNA, 64 nt, Homo Sapiens
agaugggcagccaagggugcacugacuauuagcuggcccauaggauaucuguaaggcugguggg

SEQ ID NO: 97853 - RNA, 64 nt, Homo Sapiens
gagcuguuauuuuuaggcauaagaugacuuaggaggcccauagaaacauucucguuuaaacaac

SEQ ID NO: 97854 - RNA, 64 nt, Homo Sapiens
uccuuccuggaccccauucuguccggaggcucauggcccauauuucccacauuucuaauaccac

SEQ ID NO: 97855 - RNA, 64 nt, Homo Sapiens
uuuaacuuuuuaaggaacagauguggaauacacuggcccauauuucaaccuuaacagcugaagc

SEQ ID NO: 97856 - RNA, 64 nt, Homo Sapiens
uguaguuggauuguuuguauuaggauucaagcaaggcccauauauugcauuuauuugaaauguc

SEQ ID NO: 97857 - RNA, 64 nt, Homo Sapiens
ccgggaaugaauggggaggccgcugaacccacccggcccauaucccugguugccucauggccag

SEQ ID NO: 97858 - RNA, 64 nt, Homo Sapiens
cgccugaggcuugcugucuguucucggcaccccgggcccauacaggaccagggcagcagcauug

SEQ ID NO: 97859 - RNA, 64 nt, Homo Sapiens
aguuagcccucagucaguucccaacaauggggugggcccauaaucccauguggcugaagacauu

SEQ ID NO: 97860 - RNA, 64 nt, Homo Sapiens
uugccuacccucaaugccacacuguuuuugaaguggcccauaacuugaaggaaaaguuuaaaga

SEQ ID NO: 97861 - RNA, 64 nt, Homo Sapiens
agggccuaacaguguuucuuccccucggccccacggcccauacucaccccuucaccugaggcuu

SEQ ID NO: 97862 - RNA, 64 nt, Homo Sapiens
ggagcgauccgcagcugcucacuccaccuugcgcggcccauacugggcgugugcaucugaaucc

SEQ ID NO: 97863 - RNA, 64 nt, Homo Sapiens
gaccaggggaccuugccuugcccaugggcgggggggcccauaugacuauaaggaccagcccaac

SEQ ID NO: 97864 - RNA, 64 nt, Homo Sapiens
acacagacugcucuccaaucagacuauaggaacgggcccauacccucacagccacccugaagau

SEQ ID NO: 97865 - RNA, 64 nt, Homo Sapiens
cagcaguggggcccagcagccugcaacccaagcuggcccauaaugagaguuuggacccacauag

SEQ ID NO: 97866 - RNA, 64 nt, Homo Sapiens
cagcugcacacaagcaguugagaguugaugaccaggcccauagggcucccacagcugguuccca

SEQ ID NO: 97867 - RNA, 64 nt, Homo Sapiens
ucccuuuggccuguuuuagauuuuggcaaagccaggcccauagugcuugcugggcucucucuuc

SEQ ID NO: 97868 - RNA, 64 nt, Homo Sapiens
ggccuuuagccauuugucucuccucacacuccagggcccauauggcccagguucugacaguuug

SEQ ID NO: 97869 - RNA, 64 nt, Homo Sapiens
augaaugaugaaagccugacgccgugccccuccuggcccauacgccuugccagggcggcaggau

SEQ ID NO: 97870 - RNA, 64 nt, Homo Sapiens
accagugaucaaggcuaauuggaaaagaguuaucggcccauagcuaauaaguagugacagacaa

SEQ ID NO: 97871 - RNA, 64 nt, Homo Sapiens
aguuuuugguugggaaugaggaaaauucuuaaaaggcccauagcagccaguucaaaaacacccg

SEQ ID NO: 97872 - RNA, 64 nt, Homo Sapiens
aacugcgaaugaagcaauauugggagaacuuaaaggcccauagugggauuugcagggacuuuuc

SEQ ID NO: 97873 - RNA, 64 nt, Homo Sapiens
cuucagcugugagcgggucggaauaaacucuguuggcccauaaccaggcuggggccacaacccu

SEQ ID NO: 97874 - RNA, 64 nt, Homo Sapiens
ccuccagacaggaagcauggaacaggggcaucccggcccauaccggccugcugugccuggugcc

SEQ ID NO: 97875 - RNA, 64 nt, Homo Sapiens
auagugaauugauaaucuacuuguuaauauauucggcccauauuuuguguguuuggacaaguac

SEQ ID NO: 97876 - RNA, 64 nt, Homo Sapiens
gucuaaggcccuugccucaucagggauuagaacuggcccauaugccagaaccuguacuaaaugc

SEQ ID NO: 97877 - RNA, 64 nt, Homo Sapiens
aaugagccagaagccaaggcccugaguuggcaguggcccauaaguguaaaauaaaaguuuacag

SEQ ID NO: 97878 - RNA, 64 nt, Homo Sapiens
aaagugauggaauuuauuccauuugucuuaggaaggcccauaauacuuguuuuucuuacaugug

SEQ ID NO: 97879 - RNA, 64 nt, Homo Sapiens
agugccugccgugccucuggcuguccuuggggcuggcccauagcccuuuccuuccugacguccu

SEQ ID NO: 97880 - RNA, 64 nt, Homo Sapiens
ucagucaguccaaucauaguaaucuauauucacaggcccauacugcauuucuuuuuuauuuuuc

SEQ ID NO: 97881 - RNA, 64 nt, Homo Sapiens
uuaucuaggauguugguggcuucuacccacuacaggcccauaucauaucuuuugggggacacaa

SEQ ID NO: 97882 - RNA, 64 nt, Homo Sapiens
uugccauguccuauugaucagugacacugccagaggcccauaccggcaagaggaagaggacguc

SEQ ID NO: 97883 - RNA, 64 nt, Homo Sapiens
auuaaggauuuauuugaaaauggugggauucauuggcccauagguacauuggaaaauguauauc

SEQ ID NO: 97884 - RNA, 64 nt, Homo Sapiens
uguuggugacagggcaaccaugggacuaggagguggcccauacacauggcuggcugguccugag

SEQ ID NO: 97885 - RNA, 64 nt, Homo Sapiens
ggugggaagccaguuggccacaugggcagugcgaggcccauagugccaggccccucaggcccgg

SEQ ID NO: 97886 - RNA, 64 nt, Homo Sapiens
uaaauauugggauuggggggaaagagggagcaacggcccauagccuugggguuggacaucucua

SEQ ID NO: 97887 - RNA, 64 nt, Homo Sapiens
gacuugacaacaucccacaguggcacggagagaaggcccauaccuucugguugcuucagaccug

SEQ ID NO: 97888 - RNA, 64 nt, Homo Sapiens
agugcugggauuacagacgugagccaccacucccggcccauagaagguuuuuugcuggauaauu

SEQ ID NO: 97889 - RNA, 64 nt, Homo Sapiens
uaacacauuuugugauuuugcauaaguauaaaugggcccauauuuauagucucacacccuuccc

SEQ ID NO: 97890 - RNA, 64 nt, Homo Sapiens
acaagugauuauuaugauucauaaauuuuuuaaaggcccauaagaaaaaaguggaagaguaagg

SEQ ID NO: 97891 - RNA, 64 nt, Homo Sapiens
cacccuguagguucuugauaugaaggcauaugcuggcccauaaaucagcuauuuucaacauaac

SEQ ID NO: 97892 - RNA, 64 nt, Homo Sapiens
cauauuuugagaagaaauucugcugagcaauuguggcccauagcuugugaaaacuaaccuucuc

SEQ ID NO: 97893 - RNA, 64 nt, Homo Sapiens
caaccacauuuuccuuuggggauucugagagucuggcccauagcaacagucacugauuugccua

SEQ ID NO: 97894 - RNA, 64 nt, Homo Sapiens
uuuucagcugaaggguaaaaaaguuugccaggagggcccauauugaaggagagagaagaagaug

SEQ ID NO: 97895 - RNA, 64 nt, Homo Sapiens
auagaagaaagaauuggcagaauagaccagaauuggcccauaccauuuucuuuaaauaauccca

SEQ ID NO: 97896 - RNA, 64 nt, Homo Sapiens
uacugguuaaacucuguuaauuuuuauuuuauaaggcccauaaaaauguuacuuuaaaauuauc

SEQ ID NO: 97897 - RNA, 64 nt, Homo Sapiens
ccaaucacugcccaucugagagaugauuuccucuggcccauauuugaauuuauuggaguaacuc

SEQ ID NO: 97898 - RNA, 64 nt, Homo Sapiens
ggagcgacccgcagcugcucacuccaccuugcgcggcccauacugggcgugugcaucugaaucc

SEQ ID NO: 97899 - RNA, 64 nt, Homo Sapiens
caaaugaugugugugguguuucuaagagaaacagggcccauaaccagugggcagcuuuaggagg

SEQ ID NO: 97900 - RNA, 64 nt, Homo Sapiens
ggcccccaucugaacccaccugcaggacccacaaggcccauacugcaaggacagagaagguacc

SEQ ID NO: 97901 - RNA, 64 nt, Homo Sapiens
aggcaggagaagaacaagaaauggauguaagccuggcccauaaugugaacauaaguaaucacua

SEQ ID NO: 97902 - RNA, 64 nt, Homo Sapiens
agugcugggauuacaggcgugagccaccaugcccggcccauaaguaccguuuuugagguucagu

SEQ ID NO: 97903 - RNA, 64 nt, Homo Sapiens
ugcagggugaggucaagagaguucugaccuggauggcccauagaccugacgucccagaauccau

SEQ ID NO: 97904 - RNA, 64 nt, Homo Sapiens
uguauguuauguggaagaagcccacccaugggcuggcccauaacuucuacaaggcugcaguggg

SEQ ID NO: 97905 - RNA, 64 nt, Homo Sapiens
agaguucauggauauguuauuaugauuguccguaggcccauacuuuagaaagucugauuguagc

SEQ ID NO: 97906 - RNA, 64 nt, Homo Sapiens
aaaggaggcaugccucugauaugggacugagccuggcccauagaaacaugacacugaccuugga

SEQ ID NO: 97907 - RNA, 64 nt, Homo Sapiens
gaacuggacccccaugccagugcugcugcaggagggcccauauacuagggucugcugagcuguu

SEQ ID NO: 97908 - RNA, 64 nt, Homo Sapiens
ggguaggguuacagauccagguuauaacuacucuggcccauaccuuuccugguugugguuuuuc

SEQ ID NO: 97909 - RNA, 64 nt, Homo Sapiens
agugcuaggauuacaggugugagccaccacaccuggcccauaguuguauuuuuuuuaggucacu

SEQ ID NO: 97910 - RNA, 64 nt, Homo Sapiens
gcugaguggggucgggugagggugugagaggagaggcccauaggaggcaggguuggaggccggg

SEQ ID NO: 97911 - RNA, 64 nt, Homo Sapiens
cugcuaacaagccuucaggagccccuuuguugugggcccauaacaggaauuucgcccuacucug

SEQ ID NO: 97912 - RNA, 64 nt, Homo Sapiens
agaaucuguguagaggaaacuuggcugagauccuggcccauaguccagccucuggcuccacugc

SEQ ID NO: 97913 - RNA, 64 nt, Homo Sapiens
ggggaaaggaucugguucauggaauucugaucuuggcccauaggugaaccaccaaaauagugcu

SEQ ID NO: 97914 - RNA, 64 nt, Homo Sapiens
uucuggaaaauguuuauuccaaaacagcuuuaauggcccauauguacacuucguaaucucaagg

SEQ ID NO: 97915 - RNA, 64 nt, Homo Sapiens
acacaucugcuagcacuuuauguugaaaaauauaggcccauaaaugcaucuuuugaggacuauu

SEQ ID NO: 97916 - RNA, 64 nt, Homo Sapiens
aauaguggaauuuuauuuuuuaaauuuuuuuauaggcccauaugcucuaucucaagaaacaaga

SEQ ID NO: 97917 - RNA, 64 nt, Homo Sapiens
cagagccugugcccuucagcccuuucaccuaacaggcccauauucgggccuuugccugaccaaa

SEQ ID NO: 97918 - RNA, 64 nt, Homo Sapiens
cguuuccacuuagaucuuuuauuuuuaauaagcaggcccauaaaaauuguugacaagaauuaau

SEQ ID NO: 97919 - RNA, 64 nt, Homo Sapiens
uccuggggagcuuuggucuaguuuccaggauagaggcccauauaggucaguuagacauacguug

SEQ ID NO: 97920 - RNA, 64 nt, Homo Sapiens
cuuuguccucccagccuggcuagaaauucaguguggcccauaccacuuucuaagucauuuugcu

SEQ ID NO: 97921 - RNA, 64 nt, Homo Sapiens
gaccuccaacaggugcuccccaguuuccaggccuggcccauacaaagugaccagaagaggugug

SEQ ID NO: 97922 - RNA, 64 nt, Homo Sapiens
aaucccucguguguccauaaagaaacgugucccuggcccauauuauugaagacccucaaugcca

SEQ ID NO: 97923 - RNA, 64 nt, Homo Sapiens
uuacucucuauuuugagaagguagaagguaagagggcccauauucauucuuugccaugaaauga

SEQ ID NO: 97924 - RNA, 64 nt, Homo Sapiens
gugccacugucacucagaagggcaagcuaggcagggcccauacaacagcaggggucugcagguu

SEQ ID NO: 97925 - RNA, 64 nt, Homo Sapiens
guauauuacuguugugugauagauacaguggaauggcccauacauguaugaucaacauauaaca

SEQ ID NO: 97926 - RNA, 64 nt, Homo Sapiens
caaguggcgcugggguuuccaugcacgccgucccggcccauagacgcagagccggcaaagugag

SEQ ID NO: 97927 - RNA, 64 nt, Homo Sapiens
aaggagcuggaaggccuccggagcuggugcugcaggcccauaggagucauucacgcgucugaca

SEQ ID NO: 97928 - RNA, 64 nt, Homo Sapiens
gguuuguguuuaaaugcuguauuagaauguggcuggcccauauuuugcuuucucugggucuuca

SEQ ID NO: 97929 - RNA, 64 nt, Homo Sapiens
uuuauguaaccuguuacaaaauaaugcauuuauuggcccauauugcagugcuguuucugcauuc

SEQ ID NO: 97930 - RNA, 64 nt, Homo Sapiens
aucucacagccuucucaugcugccggcucaucugggcccauagagugggcuuugccaguugcug

SEQ ID NO: 97931 - RNA, 64 nt, Homo Sapiens
gacuggugcccuccucacucccaccugcaucuggggcccauacugguuggcucccgcggugcca

SEQ ID NO: 97932 - RNA, 64 nt, Homo Sapiens
cuugguuacguccucauaaccuuagaccugaaagggcccauaaauauacuauguucacgaucag

SEQ ID NO: 97933 - RNA, 64 nt, Homo Sapiens
gaaagcauuuauuaagaauuuacucaggcaugauggcccauacuuguaaucccagcuauuggga

SEQ ID NO: 97934 - RNA, 64 nt, Homo Sapiens
ugucaggucagccucacuugucccuuucacaguuggcccauaaagucauguuucucucccuuua

SEQ ID NO: 97935 - RNA, 64 nt, Homo Sapiens
gaauuccagaccaauauuucacagaauuaaagauggcccauaaggauaccuuuaccaugaacuu

SEQ ID NO: 97936 - RNA, 64 nt, Homo Sapiens
aagacucuguuccugcccuacacgggucacccgaggcccauaccaggccuagcaggggugggca

SEQ ID NO: 97937 - RNA, 64 nt, Homo Sapiens
aaucauguguuuauaggauaguacacguuccccaggcccauaacagaggacuaaaaucucugaa

SEQ ID NO: 97938 - RNA, 64 nt, Homo Sapiens
uucgauuagggaaguggagagcacaucccuguaaggcccauaagagaaagaggaguuuguuaca

SEQ ID NO: 97939 - RNA, 64 nt, Homo Sapiens
ugugaaaugcuggcauuugcuucucuaacuucaaggcccauauccugucccucacuguugaauu

SEQ ID NO: 97940 - RNA, 64 nt, Homo Sapiens
caauucgaauuucagaaauucaccagacccucacggcccauauccaagauuuuaaucaccuggu

SEQ ID NO: 97941 - RNA, 64 nt, Homo Sapiens
augcugucaagcauacuguacugcccagaacaguggcccauagcagggaccugcccuaucaaaa

SEQ ID NO: 97942 - RNA, 64 nt, Homo Sapiens
cggacccuggggccucccaccccagccucccugaggcccauacuccacggagaggagccccaug

SEQ ID NO: 97943 - RNA, 64 nt, Homo Sapiens
ggggggccccucuccccaggacgucaggggguggggcccauaaauaaauggaagcugguuuugg

SEQ ID NO: 97944 - RNA, 64 nt, Homo Sapiens
gcucauggguaggaagaaucaauaucaugaaaauggcccauacugcccaagguaauuuauagau

SEQ ID NO: 97945 - RNA, 64 nt, Homo Sapiens
gagggccugucccggugcugcugcauugaccuuaggcccauagaugggcccagcgagcccccac

SEQ ID NO: 97946 - RNA, 64 nt, Homo Sapiens
uuggucacucugaagcacaaggacggccagcuguggcccauaucucaucaaacucucagcauau

SEQ ID NO: 97947 - RNA, 64 nt, Homo Sapiens
aguuuugaauucuuuuagcaacuuggauuagaggggcccauaugucagaagcucccagcaccuc

SEQ ID NO: 97948 - RNA, 64 nt, Homo Sapiens
gggcaaggacagcucagcugcuggcagccugccuggcccauagacaucccccaaguagucucag

SEQ ID NO: 97949 - RNA, 64 nt, Homo Sapiens
ucuggcccggcuggaugaagggcuuuuugagaauggcccauacugaguggcuccaaagagcagu

SEQ ID NO: 97950 - RNA, 64 nt, Homo Sapiens
gauaucagagcagacggaaacaccagaucucucuggcccauacaacaucucuggucuuuagagc

SEQ ID NO: 97951 - RNA, 64 nt, Homo Sapiens
uccagggcacaggcugccuuuuggagggagggcuggcccauaggugcugcuggcuccccgccac

SEQ ID NO: 97952 - RNA, 64 nt, Homo Sapiens
auuuacguaguuuacgcuaccaaucugaauucgaggcccauaugagaggagcuuagaaacgacc

SEQ ID NO: 97953 - RNA, 64 nt, Homo Sapiens
agacauucauguacagucuggaauguauauauggggcccauaaaaauucccaguaugcauguuu

SEQ ID NO: 97954 - RNA, 64 nt, Homo Sapiens
accgugauggggccaacagcaagggagggguaggggcccauacaggaguccuccuuucugagcu

SEQ ID NO: 97955 - RNA, 64 nt, Homo Sapiens
uuuaucagcuauuuacaaccuuugcacauuaagaggcccauaagacuuuuaggaauuacuuggu

SEQ ID NO: 97956 - RNA, 64 nt, Homo Sapiens
uuguuucagguaaaggacccugaggggcaggggaggcccauaucgccuaaggagcuguaggguc

SEQ ID NO: 97957 - RNA, 64 nt, Homo Sapiens
cagggcuaagacuugaaccaagaucacauagucaggaggugacagaggaagcaucccuugugca

SEQ ID NO: 97958 - RNA, 64 nt, Homo Sapiens
auuuucacuucuuuucucuauacucacaucccauggaggugaggaugugccccaucucauucua

SEQ ID NO: 97959 - RNA, 64 nt, Homo Sapiens
uuaaggaguugggggccugguggcuuuugccccaggaggugagguccauugggcauaggggagu

SEQ ID NO: 97960 - RNA, 64 nt, Homo Sapiens
gauugaagagcagguuccuguucauggagaaaggggaggugaaagugugaauguugacguucgu

SEQ ID NO: 97961 - RNA, 64 nt, Homo Sapiens
cauggccagacaugacuccugcaaauacaagcuuggaggugagauggguggguggugugggcuu

SEQ ID NO: 97962 - RNA, 64 nt, Homo Sapiens
gagcaggagcaauuggcugccugcaaagccagcuggaggugaagugcaggaaaggaaaggucac

SEQ ID NO: 97963 - RNA, 64 nt, Homo Sapiens
gagagcagacguggcuuuuuaugugucuuguuggggaggugacuugcaugguggggacaaggcu

SEQ ID NO: 97964 - RNA, 64 nt, Homo Sapiens
ggggagcaccucugcccggccgcgaccccauuugggaggugaggagcaacucugcccagccgcc

SEQ ID NO: 97965 - RNA, 64 nt, Homo Sapiens
ggucagucccccguccggccagccgccccguccgggaggugaggggcgccucugcccagcugcc

SEQ ID NO: 97966 - RNA, 64 nt, Homo Sapiens
gucacaaaaguaaauguuccuaagaugguagaauggaggugauaacuaaugacaaaccucuuuu

SEQ ID NO: 97967 - RNA, 64 nt, Homo Sapiens
gccaguuaaucugcugaacuauacagcaguguguggaggugaugagggaucacaauucacugaa

SEQ ID NO: 97968 - RNA, 64 nt, Homo Sapiens
gccuucauuaauugagaucaugauugaagggcuaggaggugaggcaguugcuggugaguggaga

SEQ ID NO: 97969 - RNA, 64 nt, Homo Sapiens
uacuggaagagacagggcaauggaggaagucuggggaggugagcauucucacuggggugauuag

SEQ ID NO: 97970 - RNA, 64 nt, Homo Sapiens
auuccaaaaacauuuuauuuuagaagauagcaugggaggugaggaagaauauuuguaguuaucu

SEQ ID NO: 97971 - RNA, 64 nt, Homo Sapiens
aaccauuuccaacagcaacagccacugcacaggaggaggugacaauccgcaauguggagcagca

SEQ ID NO: 97972 - RNA, 64 nt, Homo Sapiens
gagcaucguggcacggcaguacaggaggaucaaaggaggugacguguucucuccagcccagcau

SEQ ID NO: 97973 - RNA, 64 nt, Homo Sapiens
aagcaaacccagacggcuccccaggcucgucauuggaggugaacccaguuugaaugcagucugu

SEQ ID NO: 97974 - RNA, 64 nt, Homo Sapiens
auaggguuucuaaugguuauucacuuccccucuaggaggugaugaacuaaaaaaauuaagaaau

SEQ ID NO: 97975 - RNA, 64 nt, Homo Sapiens
cuugauggggguguguucuguggggcgccuuccuggaggugacacagaaaacggaggauggggg

SEQ ID NO: 97976 - RNA, 64 nt, Homo Sapiens
uacagugaaagacacaaauaaaaaaaaaaagauuggaggugauuaccaagacuucauccccccc

SEQ ID NO: 97977 - RNA, 64 nt, Homo Sapiens
ggccgggcgcaguggcucacuuuuaguaaaaccuggaggugauggagaggaccaacucuuuaau

SEQ ID NO: 97978 - RNA, 64 nt, Homo Sapiens
uugcagugagcugagauugcaucgcuugaacccaggaggugaggggggaggcugaggcagaaga

SEQ ID NO: 97979 - RNA, 64 nt, Homo Sapiens
auaaacgcagaguucacugugaugggagguugggggaggugagcucucuguuaacucagaaaga

SEQ ID NO: 97980 - RNA, 64 nt, Homo Sapiens
gauggggucuuauccuggccucugaggguucagcggaggugaggaaggcagcagagcuccagca

SEQ ID NO: 97981 - RNA, 64 nt, Homo Sapiens
gaagccccuccuccuucccccacagauggggacaggaggugauggggugcucagaacccugcag

SEQ ID NO: 97982 - RNA, 64 nt, Homo Sapiens
cguugucccggagaucaaaaucugaaggacucugggaggugagauuccaugaucuuggagugac

SEQ ID NO: 97983 - RNA, 64 nt, Homo Sapiens
ucaugaaguuuuuuggaaauugagauggggggcgggaggugacauuuuuaaguagagguaaaau

SEQ ID NO: 97984 - RNA, 64 nt, Homo Sapiens
ucgcccgguggcaauaguucgccgagggggaaagggaggugacucguuucaauuguggaccggc

SEQ ID NO: 97985 - RNA, 64 nt, Homo Sapiens
uugggaaaaaggccucugucccggaagagucaugggaggugaaaggggcacguuugaagaugcg

SEQ ID NO: 97986 - RNA, 64 nt, Homo Sapiens
augcaauucaucccagaggaaccugaggccugaaggaggugagagaagaccucugugaggaaag

SEQ ID NO: 97987 - RNA, 64 nt, Homo Sapiens
gggcagcagaggccccugggcagcccagccaggggagccacagccccaaggauggucuugcucu

SEQ ID NO: 97988 - RNA, 64 nt, Homo Sapiens
uggcgacaguuucccuuaggggucugccuggcaggagccacagcucaggagaguugugagggau

SEQ ID NO: 97989 - RNA, 64 nt, Homo Sapiens
caggaaagcacuugaggcagauuggcugguauaggagccacaguccucaccccaguuccaugac

SEQ ID NO: 97990 - RNA, 64 nt, Homo Sapiens
gggaugaaccagccggggccugucaagcugcucugagccacagucaaugcaguucugagcaccg

SEQ ID NO: 97991 - RNA, 64 nt, Homo Sapiens
ugucugugccaugggcugagcugguucuugcccugagccacauaccugugcagagccccaucca

SEQ ID NO: 97992 - RNA, 64 nt, Homo Sapiens
uauccagagccagcaugaccauuggccaugcugggagccacagcuaaaauacuccuuucugccc

SEQ ID NO: 97993 - RNA, 64 nt, Homo Sapiens
gauauccuagaaaauauuccuccagcagcuccaugagccacacauccagggcaucuuaaguuca

SEQ ID NO: 97994 - RNA, 64 nt, Homo Sapiens
uucccugaccacagggaagcguaggaaccauguggagccacacauuguuucugaauaucucagg

SEQ ID NO: 97995 - RNA, 64 nt, Homo Sapiens
agcuagaggcagggcugucccacagaaauagugugagccacauaugugacuuuaaauuuucuga

SEQ ID NO: 97996 - RNA, 64 nt, Homo Sapiens
uucagcuccugcuuggccaguguggagaggaaaggagccacaggagcgggugcuacacccggca

SEQ ID NO: 97997 - RNA, 64 nt, Homo Sapiens
aucgguaguguuguguguaggccauucuucuggagagccacaagcaggaagagcagcgcugugu

SEQ ID NO: 97998 - RNA, 64 nt, Homo Sapiens
cuuaguguuuucauugcaaauuauaauugcuguagagccacacacaacuuuugaacuuuuaauu

SEQ ID NO: 97999 - RNA, 64 nt, Homo Sapiens
gguccugugcaggaccccuauagaucccgugcaggagccacaugucgagcucagguucgccaca

SEQ ID NO: 98000 - RNA, 64 nt, Homo Sapiens
guggcgggucggcggcccucggcuuuuggaaggagagccacacuucaaaguggaaugaagcucu

SEQ ID NO: 98001 - RNA, 64 nt, Homo Sapiens
gcuaaggagccucauagccuggcgggggcuggcagagccacaccccaagugccugugcccagag

SEQ ID NO: 98002 - RNA, 64 nt, Homo Sapiens
aaauguuuucucauucagucuccagucauugguugagccacagccuagggguuggaggaagacu

SEQ ID NO: 98003 - RNA, 64 nt, Homo Sapiens
aacccuccuguccuggacgugacuucauccugaggagccacagcacaggccgugcuggcacuuu

SEQ ID NO: 98004 - RNA, 64 nt, Homo Sapiens
caugucuuaggugcagcugugccacgggucagcugagccacagucccagaaccaagcucucggu

SEQ ID NO: 98005 - RNA, 64 nt, Homo Sapiens
aggguaauaacagaauuggaaccaugccacucuugagccacaauaccugucaccagccuguugu

SEQ ID NO: 98006 - RNA, 64 nt, Homo Sapiens
guucuguuggagaaacgcuugguuuccggauccagagccacagaaagaaauguaggugugaagu

SEQ ID NO: 98007 - RNA, 64 nt, Homo Sapiens
uuuucagacacuuguuaccaccgggagacaaauugagccacauaagggggagagggaaaaguaa

SEQ ID NO: 98008 - RNA, 64 nt, Homo Sapiens
caucugggccugggcgacguacggggcacucaaagagccacacaaguuaugagacugggaaaga

SEQ ID NO: 98009 - RNA, 53 nt, Homo Sapiens
aagagcugacaauuacauaacaggagccacauuccccauugaucaacccccaa

SEQ ID NO: 98010 - RNA, 64 nt, Homo Sapiens
ugaucaacccccaaagccaugagggauccaaguagagccacagaaaaagaagaauuccaggaga

SEQ ID NO: 98011 - RNA, 64 nt, Homo Sapiens; identical to SEQ ID NO: 53673

SEQ ID NO: 98012 - RNA, 64 nt, Homo Sapiens; identical to SEQ ID NO: 53674

SEQ ID NO: 98013 - RNA, 64 nt, Homo Sapiens; identical to SEQ ID NO: 53675

SEQ ID NO: 98014 - RNA, 64 nt, Homo Sapiens; identical to SEQ ID NO: 53676

SEQ ID NO: 98015 - RNA, 64 nt, Homo Sapiens; identical to SEQ ID NO: 53677

SEQ ID NO: 98016 - RNA, 64 nt, Homo Sapiens; identical to SEQ ID NO: 53678

SEQ ID NO: 98017 - RNA, 64 nt, Homo Sapiens; identical to SEQ ID NO: 53679

SEQ ID NO: 98018 - RNA, 64 nt, Homo Sapiens; identical to SEQ ID NO: 53680

SEQ ID NO: 98019 - RNA, 64 nt, Homo Sapiens; identical to SEQ ID NO: 53681

SEQ ID NO: 98020 - RNA, 64 nt, Homo Sapiens; identical to SEQ ID NO: 53682

SEQ ID NO: 98021 - RNA, 64 nt, Homo Sapiens; identical to SEQ ID NO: 53683

SEQ ID NO: 98022 - RNA, 64 nt, Homo Sapiens; identical to SEQ ID NO: 53684

SEQ ID NO: 98023 - RNA, 64 nt, Homo Sapiens
cucugaggauaaaguugccaguccuuuuaauggucagccuaaucauucugucagccuaaucggg

SEQ ID NO: 98024 - RNA, 64 nt, Homo Sapiens
ccaguccuuuuaauggucagccuaaucauucugucagccuaaucggguaauugcuuuuuuuaau

SEQ ID NO: 98025 - RNA, 64 nt, Homo Sapiens
ccuggaggcggaucaucuaauucucuguggaaugaauacacacauauauauuacaagggauaau

SEQ ID NO: 98026 - RNA, 64 nt, Homo Sapiens
accucugucuucagcacccucauaagucgucacuaauacacaguuuuguacauguaacauuaaa

SEQ ID NO: 98027 - RNA, 64 nt, Homo Sapiens
cuguguaugaauaaauauuaccugucuaccucaaaauacacauacugcugaagcauucuguaca

SEQ ID NO: 98028 - RNA, 64 nt, Homo Sapiens
uugacuuugcaauggugcuaagcugauagauuuaaauacacagacgggcgaguggcgcccgugu

SEQ ID NO: 98029 - RNA, 64 nt, Homo Sapiens
gagguugguaagagugacuaaccagccuaacuuuaauacacauguauaaagauguucacagaga

SEQ ID NO: 98030 - RNA, 64 nt, Homo Sapiens
aauauauuuuucuuuuaauuuccagugacuuuagaauacacacaguuuuuccgacuuuucaaaa

SEQ ID NO: 98031 - RNA, 64 nt, Homo Sapiens
agccauugcuuaaaauauaacauguuuuggauccaauacacacauuguuacaacuaacacaaau

SEQ ID NO: 98032 - RNA, 64 nt, Homo Sapiens
uucccacagucuuuuauauaauuaaauauaugucaauacacauuagaaucagauuugaaaaagu

SEQ ID NO: 98033 - RNA, 64 nt, Homo Sapiens
uuauaggccaauauuuuuuuuucaucuagugagcaauacacauaaguacauauuuucaggaucg

SEQ ID NO: 98034 - RNA, 64 nt, Homo Sapiens
cacacacacaugcacacauacaauauauauauauaauacacacaaauaauguaaaugggggcuu

SEQ ID NO: 98035 - RNA, 64 nt, Homo Sapiens
aaaguauuuugagguaaaggcccuauucuuggaaaauacacaauuuugauuaaguaaaaaaaau

SEQ ID NO: 98036 - RNA, 64 nt, Homo Sapiens
cauuuaugugcguguguguauauaugugugugauaauacacaugcauacacaugccuccaugca

SEQ ID NO: 98037 - RNA, 64 nt, Homo Sapiens
cacaacccccuauaccuggauuguguguguguguaauacacacaaaaaaaaauuuauauauaca

SEQ ID NO: 98038 - RNA, 64 nt, Homo Sapiens
auacaaacauacaugcaugcagagaggaggaaaaaauacacauacuagagcgagcaagagaggg

SEQ ID NO: 98039 - RNA, 64 nt, Homo Sapiens
gaucucccuuguaagcuccuuaaaaaaaagcagaaauacacaaucacaugaagauaacuuuuuu

SEQ ID NO: 98040 - RNA, 64 nt, Homo Sapiens
ucuuuacuucucuaccaauuguacauuugaguugaauacacaaaguggagacuuauaagaagga

SEQ ID NO: 98041 - RNA, 64 nt, Homo Sapiens
cuuauucuugaaccuucugaucuuucucacuguaaauacacauuaccgcaccugccucacauuu

SEQ ID NO: 98042 - RNA, 64 nt, Homo Sapiens
uaccagaugggaaugcagcagucccagccucugcaauacacaguacagaaacaagagccccuaa

SEQ ID NO: 98043 - RNA, 64 nt, Homo Sapiens
aaguauuuagggauaaaguaugaaguuuuuaggaaauacacacuuguuuuaaggaaauacacag

SEQ ID NO: 98044 - RNA, 64 nt, Homo Sapiens
gaaguuuuuaggaaauacaccauuguuuuaaggaaauacacagucuauguaagagaauaaaugc

SEQ ID NO: 98045 - RNA, 64 nt, Homo Sapiens
uauuuuuacauagcuaugauuagcuuucucaaugaauacacacaaucccucuaaauuaguuccc

SEQ ID NO: 98046 - RNA, 64 nt, Homo Sapiens
ucuuauaaagucuuuaacaucauuuacacugauaaauacacagaauucuuuauugcugguuuuu

SEQ ID NO: 98047 - RNA, 64 nt, Homo Sapiens
cauuuugaccaguguuuuacaacauguacauaagaauacacauaauucaacuagagauuugaag

SEQ ID NO: 98048 - RNA, 64 nt, Homo Sapiens
aagaguauuuggagcaagaagcugcaaugcgccaaauacacaauaggccuuuucuuuaucauuc

SEQ ID NO: 98049 - RNA, 64 nt, Homo Sapiens
uucuguuuagagagauagaaguuaugacauauguaauacacaucuguguacacagaaaccggca

SEQ ID NO: 98050 - RNA, 64 nt, Homo Sapiens
gaaaagccaccaauucuagaucuugauuugaauuaauacacacaauaucugagacacuuacacu

SEQ ID NO: 98051 - RNA, 64 nt, Homo Sapiens
gaugccagauaucccauacagaauuagcagagaaaauacacacaggcuucuauucaaauuuucu

SEQ ID NO: 98052 - RNA, 64 nt, Homo Sapiens
uaagacuuuaaaauguaagcauuguaauucugaaaauacacauuuuaagaagaaacuauuuugc

SEQ ID NO: 98053 - RNA, 64 nt, Homo Sapiens
guuuuuuuguuguuguuagugagucucccuucaaaauacacaguagguaguguaaauacugcuu

SEQ ID NO: 98054 - RNA, 64 nt, Homo Sapiens
uuucaugguauuacugaagguguguauacucccuaauacacauuuaugaaaaucuacuuguuua

SEQ ID NO: 98055 - RNA, 64 nt, Homo Sapiens
guucauauaaucucgggauacacacacacacacacauauauauacacacacauacguauacaca

SEQ ID NO: 98056 - RNA, 64 nt, Homo Sapiens
uauauauacacacacauacguauacacacacauacauauauauaaauauaccugaugccagauu

SEQ ID NO: 98057 - RNA, 64 nt, Homo Sapiens
acacguuagaaagcaacacuguuuuuauguaguucauauauauuaccaugacauuuaacaucaa

SEQ ID NO: 98058 - RNA, 64 nt, Homo Sapiens
ucguauauguugaaggagguauaauaaacucagucauauauagugaacaguucaaaugggaaag

SEQ ID NO: 98059 - RNA, 64 nt, Homo Sapiens
gaacuaugaacuucauccauuugcacuguucagacauauauauguauguauguaaaaauuauau

SEQ ID NO: 98060 - RNA, 64 nt, Homo Sapiens
aauuauauauacacaaauuagcugcacguauauacauauauauauuucuuuuuaaauuucauau

SEQ ID NO: 98061 - RNA, 64 nt, Homo Sapiens
cuguauaguguacaugguaauguguacauauauacauauauaaauguaccuuuauauauaugug

SEQ ID NO: 98062 - RNA, 64 nt, Homo Sapiens
uauauaaacuguauaguguauauauguguguguacauauauacaaacuaaucuguaccuuuaua

SEQ ID NO: 98063 - RNA, 64 nt, Homo Sapiens
aauauaacauuccagagaauuguggaaaauacugcauauauauguauagacucugacacauauu

SEQ ID NO: 98064 - RNA, 64 nt, Homo Sapiens
ugcauauauauguauagacucugacacauauuuacauauauaucaagugugcuuagaaaaaugu

SEQ ID NO: 98065 - RNA, 64 nt, Homo Sapiens
acccaggaaacagaacuuuaagauauauacagcacauauauauauauauacauauauauauaca

SEQ ID NO: 98066 - RNA, 64 nt, Homo Sapiens
uuuaagauauauacagcacauauauauauauauacauauauauauacacauauauaaaaaacaa

SEQ ID NO: 98067 - RNA, 64 nt, Homo Sapiens
agcacauauauauauauauacauauauauauacacauauauaaaaaacaaaagcaaaaaauauu

SEQ ID NO: 98068 - RNA, 64 nt, Homo Sapiens
ucuguguguguguguguauguauacacacauauacauauauauauacacauacauacacauaca

SEQ ID NO: 98069 - RNA, 64 nt, Homo Sapiens
uauauacacauacauacacauacauacauacauacauauauaucugauaaaauugugauguuuu

SEQ ID NO: 98070 - RNA, 64 nt, Homo Sapiens
uauguuuuagccagugaugcuaaagguuguauugcauauauacauauauauauauauauauaua

SEQ ID NO: 98071 - RNA, 64 nt, Homo Sapiens
agccagugaugcuaaagguuguauugcauauauacauauauauauauauauauauauauauaua

SEQ ID NO: 98072 - RNA, 64 nt, Homo Sapiens
cuccuuuuuccuuuaaucuuauuuuugaugaacacauauauaggagaacaucuauccuaugaau

SEQ ID NO: 98073 - RNA, 64 nt, Homo Sapiens
cucuuucaaaauuuuacagaauguuaucauacuacauauauacuuuuuauguaagcuuuuucac

SEQ ID NO: 98074 - RNA, 64 nt, Homo Sapiens
aaaauuagcugggcaucauguacauaaaaaaauacauauauacaacaucaugaaacaucaucuc

SEQ ID NO: 98075 - RNA, 64 nt, Homo Sapiens
ccuauaucuaaacguuuucccuguuacauauaaucauauauaugaaagucgagaauuccaagaa

SEQ ID NO: 98076 - RNA, 64 nt, Homo Sapiens
aguuugguaacacagcuuuaacuaugucaugcaacauauauauguugguaggauguuauuagag

SEQ ID NO: 98077 - RNA, 64 nt, Homo Sapiens
auguugguaggauguuauuagagagauaugugugcauauauauuuuuuugcaccugaaucaccc

SEQ ID NO: 98078 - RNA, 64 nt, Homo Sapiens
acuaaagggaaguucaaguucucauguaaugccacauauauacuugagguguagagauguuauu

SEQ ID NO: 98079 - RNA, 64 nt, Homo Sapiens
uaguugauugauuaaugauguauugccuuuugcccauauauacccuguguaucuauacuuggaa

SEQ ID NO: 98080 - RNA, 64 nt, Homo Sapiens
uauauauauacacacacauagauauacauauauacauauauaugggaaauauauauguuucugu

SEQ ID NO: 98081 - RNA, 64 nt, Homo Sapiens
uauauauguauauauauacaguuucugugauauacauauauacaaaaauuugggaaauauauau

SEQ ID NO: 98082 - RNA, 64 nt, Homo Sapiens
uauauauaauucaaagcacauauacacacacacacauauauauaaaauuauauauauauauaua

SEQ ID NO: 98083 - RNA, 64 nt, Homo Sapiens
aauauaaauauaaauauaucuauauauauauauacauauauauaaaagucuuuuguacauaaca

SEQ ID NO: 98084 - RNA, 64 nt, Homo Sapiens
uauauacauauauauaaauaucuuuuguacauaacauauauauauggugccugauaucucaaag

SEQ ID NO: 98085 - RNA, 64 nt, Homo Sapiens
cauauauguguguauguagacauaucuacacauacauauauacauguguacauauacauauaua

SEQ ID NO: 98086 - RNA, 64 nt, Homo Sapiens
uaucuacacauacauauauauguguguacauauacauauauacauguaugcuuguguguguaaa

SEQ ID NO: 98087 - RNA, 64 nt, Homo Sapiens
ugguuuaaaagaacuauaucuauauguauauuuucauauauaugacagaacaagaauauguauu

SEQ ID NO: 98088 - RNA, 64 nt, Homo Sapiens
cuuauaauagcagaggucuugguaaaauaacuaccauauauaacguguuauugccaucuagaag

SEQ ID NO: 98089 - RNA, 64 nt, Homo Sapiens
uguuuauauauauauauauauguauauauauauacauauauauauauauauaaacaugaaauau

SEQ ID NO: 98090 - RNA, 64 nt, Homo Sapiens
auauuuccucuuuuggauaggucuuuaaccaguucauauauauacuuugucaaauauauggaug

SEQ ID NO: 98091 - RNA, 64 nt, Homo Sapiens
agauugcuuuaauuugaugggaaaauaguacacacauauauauaacaaauaauauauuaaaaaa

SEQ ID NO: 98092 - RNA, 64 nt, Homo Sapiens
uauuuccaaguuuguguauauauuauaaaaauuacauauauaaaacuaaggcuuuuauuucugu

SEQ ID NO: 98093 - RNA, 64 nt, Homo Sapiens
ucacaaagagaugaccuauaucuaugugagcaugcauauauacuuguguguguguguaugaguu

SEQ ID NO: 98094 - RNA, 64 nt, Homo Sapiens
cacauacacaaauauaugcauguauauauauacacauauauauauguguguacguguguauaug

SEQ ID NO: 98095 - RNA, 64 nt, Homo Sapiens
cucccaggucugugucugauagcauacacacacacauauauauacacacacacacacacacaca

SEQ ID NO: 98096 - RNA, 64 nt, Homo Sapiens
cacacacacacacacacacauacauacacacacacauauauauacacacacacacacacacaca

SEQ ID NO: 98097 - RNA, 64 nt, Homo Sapiens
uuuuuagauucaucaacagaccaguuuuugugggcauauauauauacacgugcaaauaucagaa

SEQ ID NO: 98098 - RNA, 64 nt, Homo Sapiens
aacugacuaaaaaucaauauagauauuuuauauacauauauauauauaaaaauacaaaauucag

SEQ ID NO: 98099 - RNA, 64 nt, Homo Sapiens
guacagaauaaaaauguuuuuauauuuaaauacacauauauauuuauauauauacauauguaua

SEQ ID NO: 98100 - RNA, 64 nt, Homo Sapiens
uauauacauauguauauauaaagguuucucugugcauauauauagacucagggauuuguuggcu

SEQ ID NO: 98101 - RNA, 64 nt, Homo Sapiens
cauacacacauacauauaauuauauauauauauacauauauauacacacauacauacauacaua

SEQ ID NO: 98102 - RNA, 64 nt, Homo Sapiens
uauauauacauauauauacacacauacauacauacauauauauacacacacacacacacacaca

SEQ ID NO: 98103 - RNA, 64 nt, Homo Sapiens
cacacacacacacacacacacucaaacuuuauuccauauauacaaacaugaaaaagcagggaau

SEQ ID NO: 98104 - RNA, 64 nt, Homo Sapiens
uauguauauguguacauauggacauacacauuuacauauauauaaaguauauauauacauauau

SEQ ID NO: 98105 - RNA, 64 nt, Homo Sapiens
auacacauuuacauauauauaaaguauauauauacauauauauauauauauauguaugaaaccc

SEQ ID NO: 98106 - RNA, 64 nt, Homo Sapiens
uaugugaaugugugugaguguguauucacauacacauauauacuggaaccuauaguagaaaagg

SEQ ID NO: 98107 - RNA, 64 nt, Homo Sapiens
ggaauuaaaagcuuaaacccaaaaauuguucauccauauauaagaaauuaucgaauuaaaacuu

SEQ ID NO: 98108 - RNA, 64 nt, Homo Sapiens
gaaggaacuuuaaaagcaacaagcaauuauguaccauauauacacuguagcaaauauuuuauau

SEQ ID NO: 98109 - RNA, 64 nt, Homo Sapiens
uauaaaucacuuauuacagacaaccuuuauuuagcauauauaaccuucuaggauccagcugugu

SEQ ID NO: 98110 - RNA, 64 nt, Homo Sapiens
gaacuuggcuaccucugccucuuuuugccuuccccauauauaugcuccugcaauguuuuucuug

SEQ ID NO: 98111 - RNA, 64 nt, Homo Sapiens
aaugacauauaagccguauauagaucaauguccacauauauauacacacacacauauauauaua

SEQ ID NO: 98112 - RNA, 64 nt, Homo Sapiens
uauagaucaauguccacauauauauacacacacacauauauauauauaaaguguaacaaggaac

SEQ ID NO: 98113 - RNA, 64 nt, Homo Sapiens
uuugccuuagauaccuaaaugauauaucuagauccauauauagguuuagauauacaucacaugu

SEQ ID NO: 98114 - RNA, 64 nt, Homo Sapiens
cauuuagauauacaucacauguauguguauaccacauauauauguaugagccucccuugugcac

SEQ ID NO: 98115 - RNA, 64 nt, Homo Sapiens
aaaauaaugggcaaaaauuuuuguugcaacuuuucauauauauuuuccccuuaccaauuguuuu

SEQ ID NO: 98116 - RNA, 64 nt, Homo Sapiens
aggugcguucuagaugucauccuaaaaaacacuucauauauaauuaaucacuauuuuguauaau

SEQ ID NO: 98117 - RNA, 64 nt, Homo Sapiens
uugcacuacacaaacgauaauguacauauauacacauauauauuuuguccaguaguuuaguuug

SEQ ID NO: 98118 - RNA, 64 nt, Homo Sapiens
cauauauauuuugcacuacaguuuaguuuguguacauauauacauugcuuuuuguuguccagua

SEQ ID NO: 98119 - RNA, 64 nt, Homo Sapiens
uguugagugaauuaaugaaugcuccauauauauucauauauauugauaaagcugucucaugggu

SEQ ID NO: 98120 - RNA, 64 nt, Homo Sapiens
cauauauauuuguugagugaucucaugggugcuccauauauauuaagugccugggauaaagcug

SEQ ID NO: 98121 - RNA, 64 nt, Homo Sapiens
uauuuuuuugcauugacugcuugccuuaagauuucauauauauaaugugcaaagucaacaguau

SEQ ID NO: 98122 - RNA, 64 nt, Homo Sapiens
uauauaacaaaacaucagccuuuguauguguguacauauauauacaaagaaagaguagcaggcc

SEQ ID NO: 98123 - RNA, 64 nt, Homo Sapiens
uauuuuuuuuuggaugaagguauauauauauauacauauauauauuuuuuucuggguucauaua

SEQ ID NO: 98124 - RNA, 64 nt, Homo Sapiens
uauauauauacauauauauauuuuuuucuggguucauauauauaguauaacuuuguaaauaagu

SEQ ID NO: 98125 - RNA, 64 nt, Homo Sapiens
ccagcuuaagcguucauaugcucugcuuuuaguucauauauacauacauaauguuuuuccuuuc

SEQ ID NO: 98126 - RNA, 64 nt, Homo Sapiens
uaaauuacuauggcugauuuauuucuacuauauacauauauauuuuuugcuuuuguauauccua

SEQ ID NO: 98127 - RNA, 64 nt, Homo Sapiens
cgacagagcaagacacugucucucucucucucuccauauauauauguguguguguguauauaua

SEQ ID NO: 98128 - RNA, 64 nt, Homo Sapiens
uauauauauauauguguguguguguguguguauacauauauacacauauauacacacacacaua

SEQ ID NO: 98129 - RNA, 64 nt, Homo Sapiens
uauguguguguguguguguguauacauauauacacauauauacacacacacauacauauacaug

SEQ ID NO: 98130 - RNA, 64 nt, Homo Sapiens
cacauacauauacauguguauauauauaccaucccauauauaugugggauauauauauauauau

SEQ ID NO: 98131 - RNA, 64 nt, Homo Sapiens
gacuaguaaaucacagugguucaaaauauauauccauauauauauauauccauauauauaucuc

SEQ ID NO: 98132 - RNA, 64 nt, Homo Sapiens
ugguucaaaauauauauccauauauauauauauccauauauauaucucaugucaucacauuaca

SEQ ID NO: 98133 - RNA, 64 nt, Homo Sapiens
uauauauguauguauauacacacguacauacauucauauauauacauauauacauaaugugcuu

SEQ ID NO: 98134 - RNA, 64 nt, Homo Sapiens
uguauauacacacguacauacauucauauauauacauauauacauaaugugcuuaaccacugcc

SEQ ID NO: 98135 - RNA, 64 nt, Homo Sapiens
gagagaggccuuuuaaaauauauauauauauacacauauauauguauauauacacauauaugua

SEQ ID NO: 98136 - RNA, 64 nt, Homo Sapiens
cauguauauauauauacauacacauauauguauacauauauacacauauauguauacauauaua

SEQ ID NO: 98137 - RNA, 64 nt, Homo Sapiens
cauauauguauacauauauacacauauauguauacauauauacacauauguauacauauauaua

SEQ ID NO: 98138 - RNA, 64 nt, Homo Sapiens
cacauauauguauacauauauacacauauguauacauauauauauauucuacaguaaaacugua

SEQ ID NO: 98139 - RNA, 64 nt, Homo Sapiens
uagcuagaagugggccaggagugacucacccaagcauauauaacgaaaacugacagaggagggc

SEQ ID NO: 98140 - RNA, 64 nt, Homo Sapiens
gcuuaaucuuaaauuuauuauuacugcagaauagcauauauaucacaucugaaagccacguucc

SEQ ID NO: 98141 - RNA, 64 nt, Homo Sapiens
uauauauauguauguauaaauauauauacacauacauauauauaauuucauauauauauacaua

SEQ ID NO: 98142 - RNA, 64 nt, Homo Sapiens
uacacauacauauauauauauucauauauauauacauauauauauguuucuaaccacagagaau

SEQ ID NO: 98143 - RNA, 64 nt, Homo Sapiens
uacauauauauauacacauaaccacagagaauuucauauauauacuaguuuaaauauguuucua

SEQ ID NO: 98144 - RNA, 64 nt, Homo Sapiens
ugacuugaaaauuaagauuuuauauauauauacacauauauauauugugagucauauauauaca

SEQ ID NO: 98145 - RNA, 64 nt, Homo Sapiens
uauacacauauauauaugacgagucauauauauacauauauauaacuuauuucauugguuuugu

SEQ ID NO: 98146 - RNA, 64 nt, Homo Sapiens
cauauauauauauacacauauugguuuugugagucauauauauacaaguaugauacuuauuuca

SEQ ID NO: 98147 - RNA, 64 nt, Homo Sapiens
uauauacacacacacacacacauauguacacauacauauauauacauauauauguauauauaga

SEQ ID NO: 98148 - RNA, 64 nt, Homo Sapiens
cacacacacacauauguacacauacauauauauacauauauauguauauauagaacacauggca

SEQ ID NO: 98149 - RNA, 64 nt, Homo Sapiens
aagugaacuaaauauauauguguauauguauacacauauauauacacacacacauauauauauu

SEQ ID NO: 98150 - RNA, 64 nt, Homo Sapiens
uguguauauguauacacauauauauacacacacacauauauauauuuagaaacgugaguguuaa

SEQ ID NO: 98151 - RNA, 64 nt, Homo Sapiens
uucuucauuacaggaaauguuagauuuauacauacauauauauauguuauuauuacaagggaaa

SEQ ID NO: 98152 - RNA, 64 nt, Homo Sapiens
gugaaagagaaggcauuaaauuaccucauaagugcauauauaguacuuguaaacagaauguuua

SEQ ID NO: 98153 - RNA, 64 nt, Homo Sapiens
ucuguauauaugggaccuacuuucaaaccagagccauauauaugcuagacaaaauugucuucuc

SEQ ID NO: 98154 - RNA, 64 nt, Homo Sapiens
cauuuuacaugaaucauuuacaagcuguauauaccauauauaaaauucuuagacucaugugauc

SEQ ID NO: 98155 - RNA, 64 nt, Homo Sapiens
aguauuuacagcuaaccuaucuauucauauuuuacauauauauauauauauauacaugcacaca

SEQ ID NO: 98156 - RNA, 64 nt, Homo Sapiens
uuuugaagaguuuuucuugugcuugcuucggcagcauauauacugaaauuagaaaaagaaaacu

SEQ ID NO: 98157 - RNA, 64 nt, Homo Sapiens
caagcggugccuaagaaguuauuuucuuguuuaacauauauauuuauuaauuuauuugucgugu

SEQ ID NO: 98158 - RNA, 64 nt, Homo Sapiens
guggaaaguccugaacuccuggcuuuccaggagacauauauaggggaacaucacccuauauaua

SEQ ID NO: 98159 - RNA, 64 nt, Homo Sapiens
gcuuuuuacucuaaaauucaauguaauuaaauuucauauauauauaauauauacauauauacau

SEQ ID NO: 98160 - RNA, 64 nt, Homo Sapiens
aauguaauuaaauuucauauauauauaauauauacauauauacauaguguaaaauaaaauguuu

SEQ ID NO: 98161 - RNA, 64 nt, Homo Sapiens
uuuucacuugcuuucaagauauauacaguauauacauauauauacaguauauacauaugugugu

SEQ ID NO: 98162 - RNA, 64 nt, Homo Sapiens
uguuaauauauuaaaacaguuuuuaauauauauacauauauauucugacaaagaugaaauccac

SEQ ID NO: 98163 - RNA, 64 nt, Homo Sapiens
cucaaaaaaaaaaacaaacaaacaaaaaaaaaaccauauauauacauauauauauagcagcuuu

SEQ ID NO: 98164 - RNA, 64 nt, Homo Sapiens
aaaacaaacaaacaaaaaaaaaaccauauauauacauauauauauagcagcuuuauggagauau

SEQ ID NO: 98165 - RNA, 64 nt, Homo Sapiens
aaggacaugaguuaaauauauuuauauguacauacauauauauaucccuuuacauauauaugua

SEQ ID NO: 98166 - RNA, 64 nt, Homo Sapiens
uauuuauauguacauacauauauauaucccuuuacauauauauguaugugggugugagugugua

SEQ ID NO: 98167 - RNA, 64 nt, Homo Sapiens
aaagauaaccaguuuuugcagagaaacguguacccauauauaauucucccacacuagcuugcag

SEQ ID NO: 98168 - RNA, 64 nt, Homo Sapiens
uauauuuaccaagauuuuguauuugcauaauaugcauauauauguguauguuaauagaaaauau

SEQ ID NO: 98169 - RNA, 64 nt, Homo Sapiens
uuuugcagcuauggacaauugacaaauacacauacauauauacacagugcccauguguauggaa

SEQ ID NO: 98170 - RNA, 64 nt, Homo Sapiens
aaauacacguguauaugagggugaacuuucucagcauauauauaauacgcaauuguauauauau

SEQ ID NO: 98171 - RNA, 64 nt, Homo Sapiens
uacgcaauuguauauauaugcaagcagacacacacauauauacaccuguacacacacagacaca

SEQ ID NO: 98172 - RNA, 64 nt, Homo Sapiens
uacaaagagguguacagguaccaucuuguauacacauauauacccacauguacagacauacauu

SEQ ID NO: 98173 - RNA, 64 nt, Homo Sapiens
gacauacauuuaugcacauucacgcuguuuguuucauauauacaggcauaaaauagaguaaaua

SEQ ID NO: 98174 - RNA, 64 nt, Homo Sapiens
guaucaggcuaggacgcucugagcugugcauguacauauauacauauauagauacauuuauaau

SEQ ID NO: 98175 - RNA, 64 nt, Homo Sapiens
cuaggacgcucugagcugugcauguacauauauacauauauagauacauuuauaauauauacac

SEQ ID NO: 98176 - RNA, 64 nt, Homo Sapiens
uacacacauacauaucuagauaaauauauauauacauauauauauucuauauacgagcuauaua

SEQ ID NO: 98177 - RNA, 64 nt, Homo Sapiens
gauauauucuauauacgagcacgcacacaucuaccauauauacaacaucaccaucuagaguauc

SEQ ID NO: 98178 - RNA, 64 nt, Homo Sapiens
uacaguuuuauuccucuucagacaugaaagggaacauauauauuccauauauauguucaacucu

SEQ ID NO: 98179 - RNA, 64 nt, Homo Sapiens
uccucuucagacaugaaagggaacauauauauuccauauauauguucaacucuucauagauugu

SEQ ID NO: 98180 - RNA, 64 nt, Homo Sapiens
uaugugaauucuaccuaaacaugcuauuacagcucauauauacuuuuuccaucuggauucuuca

SEQ ID NO: 98181 - RNA, 64 nt, Homo Sapiens
caguuuuauuuuuggugaauuauguuuauacugccauauauaggaacucuuugcuuaacuggag

SEQ ID NO: 98182 - RNA, 64 nt, Homo Sapiens
uauauauauuuuuuuuuuuucacacacacacacacauauauauacacacacacacacacacaca

SEQ ID NO: 98183 - RNA, 64 nt, Homo Sapiens
uauacacacacacacacacacacacacacacacacauauauacauauauauauacacacacaca

SEQ ID NO: 98184 - RNA, 64 nt, Homo Sapiens
uuccauauguauauguguguccacauauguauuccauauauauaauaccauauauguauauauu

SEQ ID NO: 98185 - RNA, 64 nt, Homo Sapiens
cauauauuccacauguguguggccaagguaguuccauauauauagaauuucuuaacaaaaugau

SEQ ID NO: 98186 - RNA, 64 nt, Homo Sapiens
ggcuguagguuuuaaauuuuuauaucuauacauacauauauacauauauauauaauguacaaua

SEQ ID NO: 98187 - RNA, 64 nt, Homo Sapiens
guuuuaaauuuuuauaucuauacauacauauauacauauauauauaauguacaauauauacaua

SEQ ID NO: 98188 - RNA, 64 nt, Homo Sapiens
uggcccaugguggcccuuccagugcauauacauacauauauauauauauaugcauauauauaua

SEQ ID NO: 98189 - RNA, 64 nt, Homo Sapiens
ccagugcauauacauacauauauauauauauaugcauauauauauauauauauauauauaugug

SEQ ID NO: 98190 - RNA, 64 nt, Homo Sapiens
uauauauauguguauacacacacacauagacagacauauauauauauauuuauuuuuuuuacug

SEQ ID NO: 98191 - RNA, 64 nt, Homo Sapiens
uguguguguauauguguuuauagagauacacacacauauauauguguguauauauauacacaua

SEQ ID NO: 98192 - RNA, 64 nt, Homo Sapiens
cacacauauauauguguguauauauauacacauacauauauauacacacacgcauuugcacaga

SEQ ID NO: 98193 - RNA, 64 nt, Homo Sapiens
cuuccuuuccuaccccuuuucucuuuuauccuuucauauauacacaugcaaaguuuacaaccuu

SEQ ID NO: 98194 - RNA, 64 nt, Homo Sapiens
auuuuauaaauguguauuucuguguauucacauacauauauauauacacacauauauauguaca

SEQ ID NO: 98195 - RNA, 64 nt, Homo Sapiens
uuucuguguauucacauacauauauauauacacacauauauauguacauacacauacauacaua

SEQ ID NO: 98196 - RNA, 64 nt, Homo Sapiens
aaucagauggaaauggaguuuuaaggcaagaggccauauauagggcuacaucuuguuaauugca

SEQ ID NO: 98197 - RNA, 64 nt, Homo Sapiens
gacugagaagcuggauuuaaucaucccugcccuacauauauaaacauaagguaaccuacugaau

SEQ ID NO: 98198 - RNA, 64 nt, Homo Sapiens
caguugcaugcuagcauggguauauauaugcacacauauauagguacacacacacagacauaua

SEQ ID NO: 98199 - RNA, 64 nt, Homo Sapiens
uauaugcacacauauauagguacacacacacagacauauauauaauugacauugaauggaucaa

SEQ ID NO: 98200 - RNA, 64 nt, Homo Sapiens
uauacgaacaaaacacacgcgcgcacacacacacauacacgaaagagagagaaacaaacuuuuc

SEQ ID NO: 98201 - RNA, 64 nt, Homo Sapiens
cuauuuggugucguggaaccucuuacugcuuucaauacacgauuaguaaucaacuguuuuguau

SEQ ID NO: 98202 - RNA, 64 nt, Homo Sapiens
cugucaccucugaucccuucagauaaauguagaaauacacgauuuauuguauuuuaucuuccgc

SEQ ID NO: 98203 - RNA, 64 nt, Homo Sapiens
cugaggggucuccaggaggagacuagauuuaugaauacacgagguaugaggucuaggaacauac

SEQ ID NO: 98204 - RNA, 64 nt, Homo Sapiens
caaaauaccaaucuggcuucauuuucaaacaagcauacacgauguauuuacuucaggagcaaag

SEQ ID NO: 98205 - RNA, 64 nt, Homo Sapiens
gaaagucuuaaagggagcauuagagauccuuuuaauacacgacugagugccagcuuauuuguga

SEQ ID NO: 98206 - RNA, 64 nt, Homo Sapiens
uuagauacaagcuuuaaaacaauagauguugaaaauacacgaaucuggaacuucaugaucacua

SEQ ID NO: 98207 - RNA, 64 nt, Homo Sapiens
ggcguguggccaucgugucaugaggaguggagucauacacgaagguacacagccccgugaaccc

SEQ ID NO: 98208 - RNA, 64 nt, Homo Sapiens
uguuuuauuuguaaagcuuucagugaaacacuacauacacgaagaaaaggaacaagguuuaacu

SEQ ID NO: 98209 - RNA, 64 nt, Homo Sapiens
aaaugcuaacggaaggauuuaaguaggaacaugcauacacgaagacagcauauguuugaacagg

SEQ ID NO: 98210 - RNA, 64 nt, Homo Sapiens
cauaaaauuauaugauuaauuauaaaauaagaacauacacgauuguauauccugguuaaguuuc

SEQ ID NO: 98211 - RNA, 61 nt, Homo Sapiens
augaaguagaggauauggaagagccuugaagauacacgaggugcagucaaagaaaugguga

SEQ ID NO: 98212 - RNA, 64 nt, Homo Sapiens
aaaaggaaagagucucagaggucaguguaucuggauacacgaggacuuuuaaaaucauccguau

SEQ ID NO: 98213 - RNA, 64 nt, Homo Sapiens
ggcagauaacccugguuggccacagaagcuauuaauacacgacagcauguggggaaggacuuau

SEQ ID NO: 98214 - RNA, 64 nt, Homo Sapiens
gucucuuccuuguccuucucuggaaaaugccaaaauacacgaugugaauaaaaguacaacggcu

SEQ ID NO: 98215 - RNA, 64 nt, Homo Sapiens
ccccacuuuaauauauguaagcaacuuccuacuuauacacgacguguuccuaaaacauguuuga

SEQ ID NO: 98216 - RNA, 64 nt, Homo Sapiens
ugccuuaugggcccuccucauagguugucucugcauacacgaaccuaacccaaauuugcuuugg

SEQ ID NO: 98217 - RNA, 64 nt, Homo Sapiens
agacaucaaacucaaugcuuaagaacacacacauauacacgaauaggcaggccuauuucaucac

SEQ ID NO: 98218 - RNA, 64 nt, Homo Sapiens
accacuuauggcucuuuuucuaccaaggaagaaaauacacgacaucuacaaacugcucucaagu

SEQ ID NO: 98219 - RNA, 64 nt, Homo Sapiens
ggaacuguauaaagacauacuuauaucaguguauauacacgagguaguggcuuuuaaauuguag

SEQ ID NO: 98220 - RNA, 64 nt, Homo Sapiens
auaaacuguauuaauaaaauccauuuacuguguaauacacgaguuuaaaaauuaagagcgauua

SEQ ID NO: 98221 - RNA, 64 nt, Homo Sapiens
gagucuggcccagugaaucccagccuuccacugaauacacgauuauggcguacauugguucagu

SEQ ID NO: 98222 - RNA, 64 nt, Homo Sapiens
guguguguguguguguguguguguguguguguguauacacgagcauguauguauuuggagagca

SEQ ID NO: 98223 - RNA, 64 nt, Homo Sapiens
aagaagaugcggucagcaguagcaccccaaccacauacacgaggcaaagacgaauugggugcac

SEQ ID NO: 98224 - RNA, 64 nt, Homo Sapiens
cuauuuauucucgugguuuucuagcuuguucuugauacacgaaccuauuuagcuggugaaaucc

SEQ ID NO: 98225 - RNA, 64 nt, Homo Sapiens
uggauccaaaaaaccauucaaccaacgucugcagauacacgaacaggagaagccaggagucuac

SEQ ID NO: 98226 - RNA, 64 nt, Homo Sapiens
gcaggcaguggccuugucacucucuugccgcagcauacacgaggcccuccagggugcgcuuccc

SEQ ID NO: 98227 - RNA, 64 nt, Homo Sapiens
uguuauuuccaugacugcuuugugcccaugaauaauacacgaccuccccagccaugagucaguu

SEQ ID NO: 98228 - RNA, 64 nt, Homo Sapiens
ugugcccagauuauucuaaaaucuuaaaaaaagaugcauauagugaaauuuuuuaaauggauau

SEQ ID NO: 98229 - RNA, 64 nt, Homo Sapiens
uauguagguucauuuaaauuuuaagacaguucagugcauauauaguagaagccuuaagaaaaaa

SEQ ID NO: 98230 - RNA, 64 nt, Homo Sapiens
cucucauuuuaauuucacuggccaccaucaucuuugcauauaaugcacaaucuaucaucugucc

SEQ ID NO: 98231 - RNA, 64 nt, Homo Sapiens
cgaguguaugucucacaauauauauacacaagugugcauauacaguuaaugaaacuaucuuuaa

SEQ ID NO: 98232 - RNA, 64 nt, Homo Sapiens
aagauuuucugaaauaggacuuuuggugacauuuugcauauaugaauugaggcaaauguauuua

SEQ ID NO: 98233 - RNA, 64 nt, Homo Sapiens
uuguggcugcagaauauuguguuucuucauacucugcauauaauauuacacuaucugauuaaua

SEQ ID NO: 98234 - RNA, 64 nt, Homo Sapiens
auauguugguaggauguuauuagagagauaugugugcauauauauuuuuuugcaccugaaucac

SEQ ID NO: 98235 - RNA, 64 nt, Homo Sapiens
uaagauuucuuuuuauaaguauucauuuugaaugugcauauaguuauuugaccccuuccaaaua

SEQ ID NO: 98236 - RNA, 64 nt, Homo Sapiens
aagauaucauugguagcaaacaucucugguaaggugcauauauucauauuaaauucccauucau

SEQ ID NO: 98237 - RNA, 64 nt, Homo Sapiens
augaaacaaaaauguuucucaaaaucuagaaaagugcauauaaauuuuuguucauuuagaacug

SEQ ID NO: 98238 - RNA, 64 nt, Homo Sapiens
ggcauauuuuuauaugaaucuaagaaggaaaauaugcauauaguaaacaagcagcuuuugugac

SEQ ID NO: 98239 - RNA, 64 nt, Homo Sapiens
uuuuuccaaauaaugcacauuuuccagguucauuugcauauacuaauugguuuguauauugaua

SEQ ID NO: 98240 - RNA, 64 nt, Homo Sapiens
uguuuguuuguguauguauaguuaugcauauauaugcauauauguauauguauagauacagcua

SEQ ID NO: 98241 - RNA, 64 nt, Homo Sapiens
ugcauauauguguuuguuuggauacagcuaguuaugcauauauaucuauaccuauauauguaua

SEQ ID NO: 98242 - RNA, 64 nt, Homo Sapiens
guagauaaaucauauuauuuuacaagagcugaguugcauauacuacacaaaauguucuuuuugu

SEQ ID NO: 98243 - RNA, 64 nt, Homo Sapiens
gguuaugaaacauaucaugguuuuaagcuccaugugcauauaaauauuuauuguuaaauuacau

SEQ ID NO: 98244 - RNA, 64 nt, Homo Sapiens
uuuaguuuuguaacuuagcuuauaauaacuuuauugcauauagaucugcuuaaacaaagcagua

SEQ ID NO: 98245 - RNA, 64 nt, Homo Sapiens
uacuaauccuaucugccaaauguguguauacacaugcauauauuuacacaugcauuuaugugcg

SEQ ID NO: 98246 - RNA, 64 nt, Homo Sapiens
ugugugauaauacacaugcauacacaugccuccaugcauauauguuauauguauuauaauugca

SEQ ID NO: 98247 - RNA, 64 nt, Homo Sapiens
agcgagaugaauguggcaauugcucauuuuauuuugcauauauuaaauugaguagguucagcuc

SEQ ID NO: 98248 - RNA, 64 nt, Homo Sapiens
aaacguuuuuccagggaguaaauauuuuacgcuuugcauauauaauuuauggagguguugagag

SEQ ID NO: 98249 - RNA, 64 nt, Homo Sapiens
guuuuucauugauaauuuuugggggugcucaauaugcauauaguuguuaaaaaugacuaauacu

SEQ ID NO: 98250 - RNA, 64 nt, Homo Sapiens
aauccaaggaauaguucaguuaaaaguauauuguugcauauaugaucuuauuaaacaaagaucc

SEQ ID NO: 98251 - RNA, 64 nt, Homo Sapiens
uaaauauauacagaauaauacacacaguugugugugcauauaaaauacauauuuacgccaggcg

SEQ ID NO: 98252 - RNA, 64 nt, Homo Sapiens
gauuauaaaaguguugucaaauguuuuauuuaucugcauauagcagugguuggcuuuuuugaau

SEQ ID NO: 98253 - RNA, 64 nt, Homo Sapiens
uauggcuauaaagaccuauagcuuuugcacuuuaugcauauauaaucaauccuuucuaguucag

SEQ ID NO: 98254 - RNA, 64 nt, Homo Sapiens
auauaucacagauauaucauuggaagauauaauuugcauauauguucauuaucaguguuccuaa

SEQ ID NO: 98255 - RNA, 64 nt, Homo Sapiens
guagcuuuacuaagguauaauugauguaauaaacugcauauauuuaaaguguauacuuugacaa

SEQ ID NO: 98256 - RNA, 64 nt, Homo Sapiens
uccaaagacaagaacucuguguuugaauucauucugcauauaauuauuuauaaguauagauugu

SEQ ID NO: 98257 - RNA, 64 nt, Homo Sapiens
uuuucaaccuagagaaucuccucuuacagggggaugcauauaacagaucauguauguguaguua

SEQ ID NO: 98258 - RNA, 64 nt, Homo Sapiens
auucuuuugauguagucaugaguuuuucuuuguuugcauauaauuaaaaugccucuacuuaaug

SEQ ID NO: 98259 - RNA, 64 nt, Homo Sapiens
gguagcugaaaaucuucaagcaaaugugaccuugugcauauauuuuaaaaaaaaaaacaggaac

SEQ ID NO: 98260 - RNA, 64 nt, Homo Sapiens
aauaaagaccccccuccaccccuuuguuuuauggugcauauagcacagaaguucauuugguuuu

SEQ ID NO: 98261 - RNA, 64 nt, Homo Sapiens
gccaggccugcguggcccaugguggcccuuccagugcauauacauacauauauauauauauaug

SEQ ID NO: 98262 - RNA, 64 nt, Homo Sapiens
uuccagugcauauacauacauauauauauauauaugcauauauauauauauauauauauauaug

SEQ ID NO: 98263 - RNA, 64 nt, Homo Sapiens
uuagguuuacauaacuacucugacauacuggaauugcauauagagauguucaguggucguuuuu

SEQ ID NO: 98264 - RNA, 64 nt, Homo Sapiens
ucccuuacagagaagaacaaugguaacuaaaagcugcauauaacuagcaauaacuacauugaac

SEQ ID NO: 98265 - RNA, 63 nt, Homo Sapiens
uuagcuaccaucguccaugaugccaaagguugagagaggaaucaacauggcugcuuugcugcu

SEQ ID NO: 98266 - RNA, 64 nt, Homo Sapiens
acagcaauacaguccucuugaggcacucaagccugagaggaagcucaggaucugacauguucuu

SEQ ID NO: 98267 - RNA, 64 nt, Homo Sapiens
guuguagcuaaauguugauugaugcuggacccaagagaggaaaaucaugaauaucaaaucuuuu

SEQ ID NO: 98268 - RNA, 64 nt, Homo Sapiens
uuuuaccucucaaagggugaguaccuguuuaggagagaggaagaaguucccaaaucaauuauag

SEQ ID NO: 98269 - RNA, 64 nt, Homo Sapiens
aauugaggaagugaaagaagaggaagggagaagggagaggaaugaaggaaaaaaaggaagagag

SEQ ID NO: 98270 - RNA, 64 nt, Homo Sapiens
gagaagggagaggaaugaaugaaaaaaaggaagagagaggaagggaaaagggaaaagcagaaag

SEQ ID NO: 98271 - RNA, 64 nt, Homo Sapiens
uccugcugaagccaggagggucuucccaagauaggagaggaaccgcagguggugagcggcuggg

SEQ ID NO: 98272 - RNA, 64 nt, Homo Sapiens
auugauucuucaaauuaaaaguucuugagagaaggagaggaagauacagcagacauaggacuga

SEQ ID NO: 98273 - RNA, 64 nt, Homo Sapiens
ugggggaauggguugcaaaagauuugagaggaaagagaggaaaaccaccauauguauuuucuag

SEQ ID NO: 98274 - RNA, 64 nt, Homo Sapiens
agaggaaaaugggggaauggauuuucuaggauuugagaggaaaguuagcuuccccaccauaugu

SEQ ID NO: 98275 - RNA, 64 nt, Homo Sapiens
gaagggaaggaaguguuuguaagagaggaagaacgagaggaagaguuggaugaacagagaaggg

SEQ ID NO: 98276 - RNA, 64 nt, Homo Sapiens
acgagaggaagagaagggaaaacagagaagggaagagaggaagauuuuugaggcaaguuggaug

SEQ ID NO: 98277 - RNA, 64 nt, Homo Sapiens
gucuuuauacuaaaaauauaggcucuugggauuggagaggaaaaauuagaggugauuuucagau

SEQ ID NO: 98278 - RNA, 64 nt, Homo Sapiens
auuaagaaaaagcaagauaauuuugaagaaggacgagaggaagaggcaugaacuuguccuaaca

SEQ ID NO: 98279 - RNA, 64 nt, Homo Sapiens
ugaguggacugugggggucuguagagacaguguugagaggaaaggggagguccugcugauuccu

SEQ ID NO: 98280 - RNA, 64 nt, Homo Sapiens
ugaggccuacaggguucaccaggauguaagaggagagaggaauccacaggaccaccagagagga

SEQ ID NO: 98281 - RNA, 64 nt, Homo Sapiens
aaaggaauuuaugcuguacauuugugccauucaggagaggaaaacccuaccaucaagccauugu

SEQ ID NO: 98282 - RNA, 64 nt, Homo Sapiens
uuuacagcaguuucaaaaaugaggcuguuccauugagaggaaugagaacuuuauuuguugggca

SEQ ID NO: 98283 - RNA, 64 nt, Homo Sapiens
cagugcccccuucccggacggguggcaggcccuggagaggaacugagugucacccugaucucag

SEQ ID NO: 98284 - RNA, 64 nt, Homo Sapiens
uuguuuguuuguuucaggaaaaaagaaagggagagagaggaaaauagaggguuguccacuccuc

SEQ ID NO: 98285 - RNA, 64 nt, Homo Sapiens
cugcuggcagggaaaucgagccagaagaaugagagagaggaagacucccugguucugcagaggg

SEQ ID NO: 98286 - RNA, 64 nt, Homo Sapiens
aaaagcuguguccuggcagagcaagccugagagggagaggaaacuggagagaacuucuguaugg

SEQ ID NO: 98287 - RNA, 64 nt, Homo Sapiens
aguuaauuguuucugaauauuaugcaggaugugugagaggaagcguugggauacaaaugaaacu

SEQ ID NO: 98288 - RNA, 64 nt, Homo Sapiens
augccaagcugcuucuuaauggguuuuguacuuggagaggaaagggaacaggguugaaaaccca

SEQ ID NO: 98289 - RNA, 64 nt, Homo Sapiens
accccuggccaucacucauguguaguccagguuugagaggaacuggaaggggggugaggguggg

SEQ ID NO: 98290 - RNA, 64 nt, Homo Sapiens
cugugauucucccagcccuugcaguccgcuaggugagaggaaaagcucuuuacuuccgccccug

SEQ ID NO: 98291 - RNA, 64 nt, Homo Sapiens
acgggggaggccgaggcaggggcugggcagaggggagaggaagcacaagaagugggagugggag

SEQ ID NO: 98292 - RNA, 64 nt, Homo Sapiens
cagaggggagaggaagcacaagaagugggagugggagaggaagccacgugcuggagaguagaca

SEQ ID NO: 98293 - RNA, 64 nt, Homo Sapiens
gagggaggggagaagcccagcauggggugggggagagaggaaagaaacacauuuugauucugau

SEQ ID NO: 98294 - RNA, 64 nt, Homo Sapiens
aguuguucucccacuggaagcucacaggggaagggagaggaaaggauuccuuccucccccucau

SEQ ID NO: 98295 - RNA, 64 nt, Homo Sapiens
ccucacucacccacugcgucgaaagcagagacaggagaggaaggcagcgucgccaggcaaugag

SEQ ID NO: 98296 - RNA, 64 nt, Homo Sapiens
uuuucauauuaaugacaaaacuuuugggcaacaugagaggaaccguagaaaccuaaggaaaaug

SEQ ID NO: 98297 - RNA, 64 nt, Homo Sapiens
ucacccaaggaacauuugaucuagcagcagggaugagaggaaagcagaaaugaaugaacuguga

SEQ ID NO: 98298 - RNA, 64 nt, Homo Sapiens
aaacacccugccuacaaggagauguuuugaaauggagaggaaaauuggcaccucaucuuuuaaa

SEQ ID NO: 98299 - RNA, 64 nt, Homo Sapiens
uaauuucagagccauacaaauacugaggcauagggagaggaaguuucugccccugccccuuagc

SEQ ID NO: 98300 - RNA, 64 nt, Homo Sapiens
gccaaaacaaaucacgagaaucugcagaaccaaagagaggaauccgggcaggugggucacgugg

SEQ ID NO: 98301 - RNA, 64 nt, Homo Sapiens
gccauuuuccugaaucaaauucugcaguggaauggagaggaaaauacuucuaggcaagcagcua

SEQ ID NO: 98302 - RNA, 64 nt, Homo Sapiens
gugacaacaacuuccaaauuggcucuuuggaggcgagaggaaggggagaacuuggagaauaguu

SEQ ID NO: 98303 - RNA, 64 nt, Homo Sapiens
gucuccaugggaaacuugacuucccagggccccucccucaaauuuuucugcgaggccucagaac

SEQ ID NO: 98304 - RNA, 64 nt, Homo Sapiens
cguagcaacucuuucucucacccucucccgacagcccucaaagauucugugcacagccacacca

SEQ ID NO: 98305 - RNA, 64 nt, Homo Sapiens
gacagagugggggucuccaucuguuuucucuucucccucaaauacaggcuguuuucaucguguc

SEQ ID NO: 98306 - RNA, 64 nt, Homo Sapiens
cuaauauuauauguuacaauaagccuccauuagucccucaaaacgaugauauaaauaagucugu

SEQ ID NO: 98307 - RNA, 64 nt, Homo Sapiens
gaagcccuugccagugggggugcaucauuugguucccucaaaggguugaaauuuuuaaagagcc

SEQ ID NO: 98308 - RNA, 64 nt, Homo Sapiens
cuguuuaucuguucucugacacacacuccacacccccucaaacuaccccugugccugugucucu

SEQ ID NO: 98309 - RNA, 64 nt, Homo Sapiens
uugcacggcuuuaucacagcauuuuuaaagcuuucccucaaaaauccugaucugcaugaucuca

SEQ ID NO: 98310 - RNA, 64 nt, Homo Sapiens
guugaauugaagcaaaucagauuuucuguggggacccucaaaugcaacugaagaaauagauugu

SEQ ID NO: 98311 - RNA, 64 nt, Homo Sapiens
ccucaggugauccgcccaccucagccucccaaagugcugggaugacaggugugagccacugcgc

SEQ ID NO: 98312 - RNA, 64 nt, Homo Sapiens
ccucaggugaucugcccgccucggucucccaaagugcugggauuacaggcaugagccacugcac

SEQ ID NO: 98313 - RNA, 64 nt, Homo Sapiens
ccucaggugauccacccgccugagccucccaaagugcugggauuacaggcaugagccaccgcgc

SEQ ID NO: 98314 - RNA, 64 nt, Homo Sapiens
gcugagguaccagaagugugagaacgagggggcgugcugggaucuuucucucugacuauacuua

SEQ ID NO: 98315 - RNA, 64 nt, Homo Sapiens
ccucaggugauccccccgucucagccucccaaagugcugggauuacaggcaugagccagcaugc

SEQ ID NO: 98316 - RNA, 64 nt, Homo Sapiens
uuugucuggagacaccaagagugguuuccaugccugcugggaauaggcugagcaugcaaugaca

SEQ ID NO: 98317 - RNA, 64 nt, Homo Sapiens
ggaaacugaucugcugggugacuuucauuccaguugcugggacggaaggcugaauguaggguca

SEQ ID NO: 98318 - RNA, 64 nt, Homo Sapiens
ggauggaagaggcuuaccugacagccagccugccugcugggagccaggagagucagcucauuaa

SEQ ID NO: 98319 - RNA, 64 nt, Homo Sapiens
ccugggcauggccacauguugacuucaggauagaugcugggaugcuuaaggaugucuuuacacu

SEQ ID NO: 98320 - RNA, 64 nt, Homo Sapiens
gccgaggaugggggcccagcuccagcaccugcugugcugggaagcgcuugggucauggucaucu

SEQ ID NO: 98321 - RNA, 64 nt, Homo Sapiens
acaggcgugagccaccgcgcucggccucccaaagugcugggauuccucaggugauccgcccgcc

SEQ ID NO: 98322 - RNA, 64 nt, Homo Sapiens
gcagcccugaggaggaagagagacacugaccuucugcugggaaagggacccccaguuucucuuc

SEQ ID NO: 98323 - RNA, 64 nt, Homo Sapiens
acuagacguaagccaccacauugaccucccaaagugcugggauuccucaggugauccacccacu

SEQ ID NO: 98324 - RNA, 64 nt, Homo Sapiens
acaggugugagccacugcacucagccucccaaagugcugggauuccucaagugauccacccgcc

SEQ ID NO: 98325 - RNA, 64 nt, Homo Sapiens
acaggugugagccaccacgcucggccucccaaagugcugggauuccucagguaaucgaccugcc

SEQ ID NO: 98326 - RNA, 64 nt, Homo Sapiens
acaggcgugagccaccgugcuucaucucccaaagugcugggauuccuuaggugauccacucgcc

SEQ ID NO: 98327 - RNA, 64 nt, Homo Sapiens
uucuaggguugucuaugacaagucgcacaucugcugcugggauuaaaaacaaaaaacaaagaug

SEQ ID NO: 98328 - RNA, 64 nt, Homo Sapiens
cuuggaaccuucccaggcagagggaacuggugcuugcugggaaacacuauaggacacacuccca

SEQ ID NO: 98329 - RNA, 64 nt, Homo Sapiens
gaccucgugauccgcccgccucggccucccaaagugcugggauuacaggcgugagccaccgugc

SEQ ID NO: 98330 - RNA, 64 nt, Homo Sapiens
ccucaggugaucugcccaccucauccuccaaaagugcugggauuacaggcaugagccacugcgc

SEQ ID NO: 98331 - RNA, 64 nt, Homo Sapiens
ccucaagcaauccucucuccucagccucccaaagugcugggauuacaagugugagccaccacac

SEQ ID NO: 98332 - RNA, 64 nt, Homo Sapiens
guucaagcaauccucccaccucggccucccaaagugcugggauugcaggcaugagccaccgugc

SEQ ID NO: 98333 - RNA, 64 nt, Homo Sapiens
gaccucacgauuugcccgccucggcuucccagagugcugggauuacaggcgugagccaccgcgc

SEQ ID NO: 98334 - RNA, 64 nt, Homo Sapiens
ggucaaaugauccgccugcgucggcuucccagagugcugggauuacaggugucagccacugcgc

SEQ ID NO: 98335 - RNA, 64 nt, Homo Sapiens
ccugaagugauccacccgccucgaccucccaaagugcugggaugacaggcaugagccaccgcac

SEQ ID NO: 98336 - RNA, 64 nt, Homo Sapiens
agcagcugugcagacugguggcggugggaggguuugcugggacugauggggacaccggccagcu

SEQ ID NO: 98337 - RNA, 64 nt, Homo Sapiens
cagccuucagacagagaggagugugagaagugaaugcugggacucugccacguuggagaagccc

SEQ ID NO: 98338 - RNA, 64 nt, Homo Sapiens
uccacucugcuucucugacuggagucguggggugugcugggagccucuggucgcuccugcccac

SEQ ID NO: 98339 - RNA, 64 nt, Homo Sapiens
gaccuugggauccacccgccuuggccucccaaagugcugggauuacaggugugagccaccaugc

SEQ ID NO: 98340 - RNA, 64 nt, Homo Sapiens
gcucaagcaauuugccugccucagccucccaaagugcugggauuacaggcgugagccacugcac

SEQ ID NO: 98341 - RNA, 64 nt, Homo Sapiens
gccuaggugauccacccgccucgaccucccaaagugcugggauuacaggcaugagccaccaugc

SEQ ID NO: 98342 - RNA, 64 nt, Homo Sapiens
gacuuugugauccacccgccucggccucccaaagugcugggauuacaggcaugagccaucacac

SEQ ID NO: 98343 - RNA, 64 nt, Homo Sapiens
acaggugugagccacugugcucggccucccaaaaugcugggauugacgucgugauccacccgcc

SEQ ID NO: 98344 - RNA, 64 nt, Homo Sapiens
acaggcgugagccacugugcucugccucccaaagugcugggauugcucaagcaauccacccacc

SEQ ID NO: 98345 - RNA, 64 nt, Homo Sapiens
ucagcuggucaaggcagaggccugcggugcugucugcugggaggcgcccugagaagccuuccag

SEQ ID NO: 98346 - RNA, 64 nt, Homo Sapiens
ccugccccuccugagaggacccccaggccaggguugcugggaugcucacagccugacuucccuu

SEQ ID NO: 98347 - RNA, 64 nt, Homo Sapiens
gugaggauuugggauuucuggcaggucaacccuaugcugggaaaggcaaacuucgagcccauca

SEQ ID NO: 98348 - RNA, 64 nt, Homo Sapiens
acaggugugagccacugggcucggccucccgaagugcugggauugaccuugugaucugcccgcc

SEQ ID NO: 98349 - RNA, 64 nt, Homo Sapiens
uuaauagaacuuacagcucaccauugaaaaacccugcugggauuucagggucagcaugucaacu

SEQ ID NO: 98350 - RNA, 64 nt, Homo Sapiens
acaggcguaagccacuacacuuggccucccaaagugcugggauuccacaagugaucugcccgcc

SEQ ID NO: 98351 - RNA, 64 nt, Homo Sapiens
ccucaggugaucugcccaccuuggccucccaaagugcugggauuacaggcaugagccacugugc

SEQ ID NO: 98352 - RNA, 64 nt, Homo Sapiens
accucaacugauccgcccaccuuggccucccaagugcugggauuacaggcgcgagccacggcgc

SEQ ID NO: 98353 - RNA, 64 nt, Homo Sapiens
acucaaaugauccaccugccucugcuucccaaagugcugggauuacaggcacgagccaccacac

SEQ ID NO: 98354 - RNA, 64 nt, Homo Sapiens
gcucaagugauccuccugccuuggccucccaaaaugcugggauuacaggcaugagccacugugc

SEQ ID NO: 98355 - RNA, 64 nt, Homo Sapiens
ccucaggugauccacccgccucagccucccaaagugcugggauuacaggcaaaagccaacacac

SEQ ID NO: 98356 - RNA, 64 nt, Homo Sapiens
gaccuugugaugcucccaccucggccucccaaagugcugggauuaaagcugugagccacugugc

SEQ ID NO: 98357 - RNA, 64 nt, Homo Sapiens
gaccucaugauccucccgccucagccucccaaaaugcugggauuacaggcgugagccaccgcgc

SEQ ID NO: 98358 - RNA, 64 nt, Homo Sapiens
acaggugugagccaccgcagucagccucccaaagugcugggauuccucagguuauccacccacc

SEQ ID NO: 98359 - RNA, 64 nt, Homo Sapiens
acaggcgugagccaccgugcuuggccucccaaagugcugggauugaccucgugauccacccgcc

SEQ ID NO: 98360 - RNA, 64 nt, Homo Sapiens
cucagaugauccuccuguccucagccucccaaaaugcugggagccaccaggcaccaggugugau

SEQ ID NO: 98361 - RNA, 64 nt, Homo Sapiens
cuggucucaagcuccuggccucggccuccuaaagugcugggauuacaagugugagccacugugc

SEQ ID NO: 98362 - RNA, 64 nt, Homo Sapiens
uccagaccccucucuaggaccaagucacccgucgugcugggaguguggauucuagcaaaagagc

SEQ ID NO: 98363 - RNA, 64 nt, Homo Sapiens
ccucaggugauccgccagccucagccucccaaagugcugggauuacaggcgugagccacugcac

SEQ ID NO: 98364 - RNA, 64 nt, Homo Sapiens
caaaucaccaaacugcuggaacucuccagccaaaugcugggagaaggaccuggagggugagucu

SEQ ID NO: 98365 - RNA, 64 nt, Homo Sapiens
acaggcgugagccaccgcgcucggccucccaaagugcugggauugaccuugugaucugcccgcc

SEQ ID NO: 98366 - RNA, 64 nt, Homo Sapiens
acaggcgugagccaccacacucagccucccaaagugcugggauuccucaggugaucugcccacc

SEQ ID NO: 98367 - RNA, 64 nt, Homo Sapiens
aaaccuguuuuaaaagcacaauuauuuucuguaaugcugggaacaguaaugcauguguuuggag

SEQ ID NO: 98368 - RNA, 64 nt, Homo Sapiens
acaggcgugagccaccgcgcuuggccucccagagugcugggauugaccucgugauccgcccacc

SEQ ID NO: 98369 - RNA, 64 nt, Homo Sapiens
acaggcgugagccacuuaguucggccucccaaagugcugggauuccacagguaaucagcccgcc

SEQ ID NO: 98370 - RNA, 64 nt, Homo Sapiens
acaggcuugagccacugcucucagccucccaaaaugcugggauugaccucaugauccaccugcc

SEQ ID NO: 98371 - RNA, 64 nt, Homo Sapiens
acaggcgugagccacugcgcuuggccucccaaagugcugggauuccucaggugguccuucugcc

SEQ ID NO: 98372 - RNA, 64 nt, Homo Sapiens
acaggagugagccaccgcucucagccucccaaagugcugggauugaccucgugaucugcccgcc

SEQ ID NO: 98373 - RNA, 64 nt, Homo Sapiens
gcagggagagggcugugagggaagccggccuuggugcugggacuagaggagguggccugcccgg

SEQ ID NO: 98374 - RNA, 64 nt, Homo Sapiens
acaggcgugagccaccacgcucggccucccaaagugcugggauucgucaggugaucuaccugcc

SEQ ID NO: 98375 - RNA, 64 nt, Homo Sapiens
acaggcgugagccaccaggcuuggcuccccaaagugcugggauuaagcaauccguccacuugcc

SEQ ID NO: 98376 - RNA, 64 nt, Homo Sapiens
gcaggcaugagccacugcucccagccucccaaagugcugggauuaccucaggcugucugcccgu

SEQ ID NO: 98377 - RNA, 64 nt, Homo Sapiens
cgaaggaacuguacucccccugauagucuaccuuugcugggaucgccucugaacccuuggccau

SEQ ID NO: 98378 - RNA, 64 nt, Homo Sapiens
gacaggggagcuccuaguaggggaggggaggggaugcugggaucuaggugacaugccugucccu

SEQ ID NO: 98379 - RNA, 64 nt, Homo Sapiens
uggccuagagcugggggaggacacuccccacgugugcugggagccgcaggcccagggccgcaug

SEQ ID NO: 98380 - RNA, 64 nt, Homo Sapiens
acaggugugagccaccaugcucggccucccaaagugcugggauuccucaagugauccacucacc

SEQ ID NO: 98381 - RNA, 64 nt, Homo Sapiens
acaggcaugaaccgccaugcucggccucccaaagugcugggauugcucaaaugaugugcccaac

SEQ ID NO: 98382 - RNA, 64 nt, Homo Sapiens
acaggcgugagccaccgcgcucggccucccaaagugcugggauugaccucgugaucugcccgcc

SEQ ID NO: 98383 - RNA, 64 nt, Homo Sapiens
acagacaugagccacugugcucggccuuucaaagugcugggauuccucaggugauucgccugcc

SEQ ID NO: 98384 - RNA, 64 nt, Homo Sapiens
gcauuagaagagggucuuuuagccuguugguagaugcugggacaggacacgggcagcucagguc

SEQ ID NO: 98385 - RNA, 64 nt, Homo Sapiens
agcagaaaaggccagacccugcugaguuagaggcugcugggauccacuguuuccacacagcggg

SEQ ID NO: 98386 - RNA, 64 nt, Homo Sapiens
gcugggauccacuguuuccacacagcgggaaggcugcugggaacagguggcagagaagugccau

SEQ ID NO: 98387 - RNA, 64 nt, Homo Sapiens
ccucaggugauccaccugccucagccucccaaauugcugggauuacaggcgugagccaccuugc

SEQ ID NO: 98388 - RNA, 64 nt, Homo Sapiens
ccucaagagauccccccaaccuuggccuccaaagugcugggauuacaggcaugagccaccgcgc

SEQ ID NO: 98389 - RNA, 64 nt, Homo Sapiens
gaucaagccauccucccgcuuuggccuccuaaagugcugggauuacaugagccaccacaugcag

SEQ ID NO: 98390 - RNA, 64 nt, Homo Sapiens
gaccucauauuccacccgccucggccucccaaagugcugggauuacaggcguuagccacugcgc

SEQ ID NO: 98391 - RNA, 64 nt, Homo Sapiens
ccuuaggugaucagcccgccucggccucccagagugcugggauuacaggcgugagccacugugg

SEQ ID NO: 98392 - RNA, 64 nt, Homo Sapiens
ccucaagugaucugccugccuuggucucccaaagugcugggaauacaggcaugagccaccgcac

SEQ ID NO: 98393 - RNA, 64 nt, Homo Sapiens
acaggcgugagccaccacgcucggccucccaaagugcugggauugaccucaugaucuacccgcc

SEQ ID NO: 98394 - RNA, 64 nt, Homo Sapiens
acaggcaugagucaccgcacucagccucccaaagugcugggauuccucaggugauccaccugcc

SEQ ID NO: 98395 - RNA, 64 nt, Homo Sapiens
ggggagagggcccuugagggaaaacuccagcugaugcugggaauugggcagauuuguaagugac

SEQ ID NO: 98396 - RNA, 64 nt, Homo Sapiens
ccaggcgugagccacugcgguuggccucucgaagugcugggauuccucaggugauccauucguc

SEQ ID NO: 98397 - RNA, 64 nt, Homo Sapiens
ggaaguucgguaaggaaaugacaaauaggauucuugcugggaaacuuuuuuuaaaaguccccca

SEQ ID NO: 98398 - RNA, 64 nt, Homo Sapiens
ccaaggucgguuuccgcccugcagcuguggggccugcugggaaacuccagccuccagagaccga

SEQ ID NO: 98399 - RNA, 64 nt, Homo Sapiens
ucgcauggaacaggagggcacgagcucugugacaugcugggaacucaggcacagagaaauuucc

SEQ ID NO: 98400 - RNA, 64 nt, Homo Sapiens
guuauuucaagaguaugacuccgugggaccccuuugcugggacagcccuguaguauuucaggga

SEQ ID NO: 98401 - RNA, 64 nt, Homo Sapiens
agcaugccuuucugauagccuuuggugaugucacugcugggagguggcuauccuguggaccacc

SEQ ID NO: 98402 - RNA, 64 nt, Homo Sapiens
gaccucaugaucugcccgccucaaccucccaaagugcugggauuauaggcgugagccaccgccc

SEQ ID NO: 98403 - RNA, 64 nt, Homo Sapiens
ccaggcgugagccacugcacucggccucccaaagugcugggauugaccucaugauccacccacc

SEQ ID NO: 98404 - RNA, 64 nt, Homo Sapiens
gagcagcugagcucuuugguccuccccucuugauugcugggaauggcugguagcaggggccagu

SEQ ID NO: 98405 - RNA, 64 nt, Homo Sapiens
aaaggcgugagccaccaugcuuggccuuaaaaagugcugggauuccccaggugaucugcccacc

SEQ ID NO: 98406 - RNA, 64 nt, Homo Sapiens
acaggcuugagccaccgugcucagccucccaaagugcugggauugaccucgugauccacccgcc

SEQ ID NO: 98407 - RNA, 64 nt, Homo Sapiens
acaggcaugagccaccgcgcuccaccucccgcagugcugggauugaccucgugauccgcccauc

SEQ ID NO: 98408 - RNA, 64 nt, Homo Sapiens
aacucaagaccuuguuuugcgggaagaauggacgugcugggacccauggagucaugagcugucu

SEQ ID NO: 98409 - RNA, 64 nt, Homo Sapiens
ugagauacauucccgcccuccugggcacugggaaugcugggaaaauuuugugccacacccugcu

SEQ ID NO: 98410 - RNA, 64 nt, Homo Sapiens
uccaacucgaaucugugugaacagauauuugucaugcugggauugccugcauguacuguauauu

SEQ ID NO: 98411 - RNA, 64 nt, Homo Sapiens
ccuuagacucuuuuccuuccuuuuggaauuugccugcugggauuauuuuuuccaaaaucuccca

SEQ ID NO: 98412 - RNA, 64 nt, Homo Sapiens
uucuggaaggggaagcaguccuuagguuuugcugugcugggacaguggcaggggacccacaggg

SEQ ID NO: 98413 - RNA, 64 nt, Homo Sapiens
cuccccgccagccuugcucagcuguggguugcccugcugggaaggagggaaucacguccaccug

SEQ ID NO: 98414 - RNA, 64 nt, Homo Sapiens
auaaaaaauaaagaaagacagagagaaacaaauuugcugggagagggaaagacauucagaccca

SEQ ID NO: 98415 - RNA, 64 nt, Homo Sapiens
ggaauuuaugaaguuauggcaaugaacugcagcaugcugggacaauuauuugacuacuuuuuuu

SEQ ID NO: 98416 - RNA, 64 nt, Homo Sapiens
acaggcgugagccacugcaccucggccucccaagugcugggauuaccucaagugaucugccugc

SEQ ID NO: 98417 - RNA, 64 nt, Homo Sapiens
acagaugugagccaccacacuuggccucccaaagugcugggauugcuuaagugaucugcccgcc

SEQ ID NO: 98418 - RNA, 64 nt, Homo Sapiens
gagugcucccucuguucccuguuuauaaguggccugcugggaguucacccaccugucucauagu

SEQ ID NO: 98419 - RNA, 64 nt, Homo Sapiens
cuggaguacuggcuauacccaggugcaccugugcugcugggagccuccuuccucucuccuugua

SEQ ID NO: 98420 - RNA, 64 nt, Homo Sapiens
acaggcgugagccacuguucucggccucccagagugcugggauuccucaagugaucuguccacc

SEQ ID NO: 98421 - RNA, 64 nt, Homo Sapiens
auaggcaugagccacugugcuuggccucccaaagugcugggauugcucaagugauccucacgcc

SEQ ID NO: 98422 - RNA, 64 nt, Homo Sapiens
uauagggguccugggggcaggaggcugccugcugugcugggagguaggucuaaauaggauccug

SEQ ID NO: 98423 - RNA, 64 nt, Homo Sapiens
acgggugugagccaccgugcucggccucccaaagugcugggauuccucaggugauccaccuuuc

SEQ ID NO: 98424 - RNA, 64 nt, Homo Sapiens
acaggcaugagccaccacgcucggccucccagagugcugggauugaccuugugauccacccacc

SEQ ID NO: 98425 - RNA, 64 nt, Homo Sapiens
uccuuccuguucuccaagccagugaagaguuaucugcugggaaaguguccaagagccuguuuuu

SEQ ID NO: 98426 - RNA, 64 nt, Homo Sapiens
gaccucaugauccgcccgccuugaccucccaaagugcugggauuacaggcaugagccaccgcac

SEQ ID NO: 98427 - RNA, 64 nt, Homo Sapiens
ccucaggugaucugcccacuuuggccucccaaagugcugggauuacaggcaugagccaucgccc

SEQ ID NO: 98428 - RNA, 64 nt, Homo Sapiens
cuggauaugcuccuugagacuucuggcaaacuucugcugggaauuaguuugagggugaggguac

SEQ ID NO: 98429 - RNA, 64 nt, Homo Sapiens
ccucagaugaucugcccgccucagccucccaaagugcugggauuacaggcaugagccaccacgc

SEQ ID NO: 98430 - RNA, 64 nt, Homo Sapiens
ccucagguaauccgcccgccucggccucccaaaaugcugggauuagaggugugagccacugugc

SEQ ID NO: 98431 - RNA, 64 nt, Homo Sapiens
ccucaagcgauccacccaccuaggccucccaaagugcugggauuacaggcaugaaucaccacaa

SEQ ID NO: 98432 - RNA, 64 nt, Homo Sapiens
ccucaggugauccgcccgccugggccucccaaagugcugggauuacaggcgugagccacugcuc

SEQ ID NO: 98433 - RNA, 64 nt, Homo Sapiens
uggggacucuggccucuccagggaaucugcguggugcugggauggguagaugagagacagggca

SEQ ID NO: 98434 - RNA, 64 nt, Homo Sapiens
gcccaugggaaccuugcuuaugcauucuccuggcugcugggagaggccuggagggcaaggcaga

SEQ ID NO: 98435 - RNA, 64 nt, Homo Sapiens
uggcuuuccuccuuugcccugcaguagcaacuggugcugggacaaguugacccaccucucacag

SEQ ID NO: 98436 - RNA, 64 nt, Homo Sapiens
ugugggguuugucauaucugggagggaagaugggugcugggagaggguugggggcagggggcaa

SEQ ID NO: 98437 - RNA, 64 nt, Homo Sapiens
agagggaguggagugcaguguggcuugggccuggugcugggaaccugcuagcugagcacuucca

SEQ ID NO: 98438 - RNA, 64 nt, Homo Sapiens
gaccucgugauccgccugccucagccucccaaagugcugggauuacaggugugagccaccacgc

SEQ ID NO: 98439 - RNA, 64 nt, Homo Sapiens
ccucaggugauccuccugccucggccucccaaagugcugggauuacaggcaugagccaccgugc

SEQ ID NO: 98440 - RNA, 64 nt, Homo Sapiens
ccucaggugauccacccaccucagccucccaaagugcugggauuacaagcgugagccacugcac

SEQ ID NO: 98441 - RNA, 64 nt, Homo Sapiens
ccucaagugauucuccugccucagccucccaaagugcugggauuacaggugugaaccaccacac

SEQ ID NO: 98442 - RNA, 64 nt, Homo Sapiens
ccucagguaauccgcccaccucagccucccaaagugcugggauuacaggcgugagccacagugc

SEQ ID NO: 98443 - RNA, 64 nt, Homo Sapiens
gcucaagcgauccuccuggcucagccucccaaagugcugggauuacaggcgugagucacugcgc

SEQ ID NO: 98444 - RNA, 64 nt, Homo Sapiens
aggggacucgagagaggcgggccccagacccaugugcugggaaaugcagaaaucacguugcugg

SEQ ID NO: 98445 - RNA, 64 nt, Homo Sapiens
ccucaagcaauccuucugccuuggccccccaaagugcugggauugugggcaugagcugcugugc

SEQ ID NO: 98446 - RNA, 64 nt, Homo Sapiens
gcaggcugauggggcacaccgauggucugugaccugcugggaaguccaggccagccagaguggg

SEQ ID NO: 98447 - RNA, 64 nt, Homo Sapiens
ggccugggcugugcagccacugguucaugccuucugcugggacaaaaagagacucauuugcuga

SEQ ID NO: 98448 - RNA, 64 nt, Homo Sapiens
cagggcuccgcugcgccucagggauuuuagucugugcugggagggccggugggccuguguugcu

SEQ ID NO: 98449 - RNA, 64 nt, Homo Sapiens
uuagucugugcugggaggcacggugggccuguguugcugggauugcaaggcaggcuggaggugc

SEQ ID NO: 98450 - RNA, 64 nt, Homo Sapiens
ucucaagcaguccucccaccucagccucccaaggugcugggauuacaggugugagccaccacac

SEQ ID NO: 98451 - RNA, 64 nt, Homo Sapiens
acucugugcacacaucauuguagccacacaucauugcugggagaauuaagcauuauccugaaga

SEQ ID NO: 98452 - RNA, 64 nt, Homo Sapiens
gaccuugugauccacccaccucagccucccaaagugcugggauuacaggcaugagccaccacac

SEQ ID NO: 98453 - RNA, 64 nt, Homo Sapiens
ccuaaagugaucugcccgccuuggccucccaaagugcugggauuacagacaugagccaccacgc

SEQ ID NO: 98454 - RNA, 64 nt, Homo Sapiens
ugugucugucugcccggcaagaguccauucucacugcugggacacucaugaaaaucuccacguc

SEQ ID NO: 98455 - RNA, 64 nt, Homo Sapiens
aaccuugugauucgcccgccuuggccucccaaagugcugggauuccaggcgugagccacugcgc

SEQ ID NO: 98456 - RNA, 64 nt, Homo Sapiens
aacuuccaggcguggacagcacccucggcuccugugcugggagaucucccacccagggccuucc

SEQ ID NO: 98457 - RNA, 64 nt, Homo Sapiens
cuccugggcugccaggauuugaucgggcggaagcugcugggacccucacagagccccucccaag

SEQ ID NO: 98458 - RNA, 64 nt, Homo Sapiens
acaggugugagccgcugcgcuuggccucccaaagugcugggauuccucaggugaucugcccgcc

SEQ ID NO: 98459 - RNA, 64 nt, Homo Sapiens
acaggugugagccuccacacucggccucccaaagugcugggauuccucaggugauccgcccacc

SEQ ID NO: 98460 - RNA, 64 nt, Homo Sapiens
ccauacggguugguuucacccuuagcaggugccgugcugggacagggcuuucccacccucccuc

SEQ ID NO: 98461 - RNA, 64 nt, Homo Sapiens
aaaggugugagccaccaugccaggccucccaaagugcugggauugaccuggugaucugcccacc

SEQ ID NO: 98462 - RNA, 64 nt, Homo Sapiens
uuaauccaguacauuguagaaugcgcucaccuucugcugggaagaggaaaaugacccaucggug

SEQ ID NO: 98463 - RNA, 64 nt, Homo Sapiens
guggaauaccuguacagccaguggguuaugugagugcugggacucggugaaacuugccaaaaug

SEQ ID NO: 98464 - RNA, 64 nt, Homo Sapiens
ccacagcauuaucacagcaucgcucccaccucccugcugggaaaucaggcugcagcccccuccc

SEQ ID NO: 98465 - RNA, 64 nt, Homo Sapiens
agccacaugcucuugccccccucccauuuucccuugcugggaguuuccuccccuuucuacugcu

SEQ ID NO: 98466 - RNA, 64 nt, Homo Sapiens
cccuuugggagaccugaccugacucugaagugacugcugggaaauugauggugacucugcagga

SEQ ID NO: 98467 - RNA, 64 nt, Homo Sapiens
ugcaccaggucugccuaacuaaggagcaagugacugcugggauucagagaccuagacggggugg

SEQ ID NO: 98468 - RNA, 64 nt, Homo Sapiens
uggaucccaggggcuuaucugguggcaccaaccuugcugggacucagcaucuuucaccaagaug

SEQ ID NO: 98469 - RNA, 64 nt, Homo Sapiens
aucgcccaggcuggagcugggcuucccucucagcugcugggacguacccacuggucugcuuaaa

SEQ ID NO: 98470 - RNA, 64 nt, Homo Sapiens
ccaggugggagccacugcacucagucuugcaaagugcugggauuccucaagcaacccuccugcc

SEQ ID NO: 98471 - RNA, 64 nt, Homo Sapiens
acaggugugagccaccacguuuagucucccaaagugcugggauuccucaagugauccaccuacc

SEQ ID NO: 98472 - RNA, 64 nt, Homo Sapiens
cuguguuuagagggguggccugaaggaccuuuucugcugggacaagacacuguacugcccucug

SEQ ID NO: 98473 - RNA, 64 nt, Homo Sapiens
cuuuucugcugggacaagacacuguacugcccucugcugggaagggguuuuaauaaacagaccc

SEQ ID NO: 98474 - RNA, 64 nt, Homo Sapiens
acaggcgugagccacugugcucagccucccaaagugcugggauugaccuugugauccaccagcc

SEQ ID NO: 98475 - RNA, 64 nt, Homo Sapiens
acaggcaugagcuacugcacuuggccuccaaaagugcugggauucuucaggugauccgccuacc

SEQ ID NO: 98476 - RNA, 64 nt, Homo Sapiens
acaggccugagccaccgcgcgcguccucccaaagugcugggauugaccucgugauucgcccgcc

SEQ ID NO: 98477 - RNA, 64 nt, Homo Sapiens
acaggugugagccaccgcgccggccucccaaaauugcugggauucucagaugaucugcccgccu

SEQ ID NO: 98478 - RNA, 64 nt, Homo Sapiens
acaggcgugagccacucugccggucuccccaaagugcugggauuaccuugugauccacccaccu

SEQ ID NO: 98479 - RNA, 64 nt, Homo Sapiens
auaggcgugagccaccgcgcucggccucccaaagugcugggauugaccucgugauccgcccucc

SEQ ID NO: 98480 - RNA, 64 nt, Homo Sapiens
acaggcgugagccaccacacuuggccucccaaagugcugggauuccucagguaauccaccugcc

SEQ ID NO: 98481 - RNA, 64 nt, Homo Sapiens
acaggugugagccacagcacucggccucccaaagugcugggauuccucaggugaucugccugcc

SEQ ID NO: 98482 - RNA, 64 nt, Homo Sapiens
acaggcaugagccaccacgcucggccucccaaagugcugggauugaccuugugaucccccugcc

SEQ ID NO: 98483 - RNA, 64 nt, Homo Sapiens
acaggcaugagccaccgcacucagccucccaaagugcugggauuccucaggugauccacccgcc

SEQ ID NO: 98484 - RNA, 64 nt, Homo Sapiens
acaggcaugagccaccgugcucggccuuccaaagugcugggauugaccucaugauccacccgcc

SEQ ID NO: 98485 - RNA, 64 nt, Homo Sapiens
acaggccacuacaccuggcaucagccucccaaagugcugggauuccucaagugauccacccacc

SEQ ID NO: 98486 - RNA, 64 nt, Homo Sapiens
accggcgugagccaccaugcucggccucccacagugcugggauugaccucgugaucugcccacc

SEQ ID NO: 98487 - RNA, 64 nt, Homo Sapiens
acuggcaugagccacugugcuuggccucccaaagugcugggauugaccuugucauccaccuguc

SEQ ID NO: 98488 - RNA, 64 nt, Homo Sapiens
ccucaggugauccacccaccugggccucccauagugcugggauucaauuuuuuuuuuuuuuuuu

SEQ ID NO: 98489 - RNA, 64 nt, Homo Sapiens
caucaggugauccaccugccucggccucccaaagugcugggauuacaggugugagccaccacgc

SEQ ID NO: 98490 - RNA, 64 nt, Homo Sapiens
gcaaccuccgccucccggguucaagcgauucuucugcugggauuacagcauaugccaccaugcc

SEQ ID NO: 98491 - RNA, 64 nt, Homo Sapiens
ccucaggugauccacccgccucagccucccacacugcugggauuacaggcaugagccaccgcuc

SEQ ID NO: 98492 - RNA, 64 nt, Homo Sapiens
gaccuugugauccacccgccucggccucccaaagugcugggauuacaggcgugagccaccuugc

SEQ ID NO: 98493 - RNA, 64 nt, Homo Sapiens
ccaucucucggagaaacccucagugugcucuggcugcugggagccaccagcagcuugacaccca

SEQ ID NO: 98494 - RNA, 64 nt, Homo Sapiens
agcugagggggaacaggagcuggaggagacccauugcugggaggucugagugacugaccuccac

SEQ ID NO: 98495 - RNA, 64 nt, Homo Sapiens
augggcgggugugagccauuuugacuucccaaagugcugggauuacucaagcaauccgcccacc

SEQ ID NO: 98496 - RNA, 64 nt, Homo Sapiens
uggcuucugucccuuucuucaacccgaccuuuauugcugggagcaugucacaaaagaacaaaau

SEQ ID NO: 98497 - RNA, 64 nt, Homo Sapiens
ucucaggugaccugcccaccucggccucccgaagugcugggauuacaagggugagccaccaugc

SEQ ID NO: 98498 - RNA, 64 nt, Homo Sapiens
gaccucgugaucugcccgccucggccucccaaagugcugggauuacaggccugagccaccgcgu

SEQ ID NO: 98499 - RNA, 64 nt, Homo Sapiens
uccggaucguuccugcagggcuccagugcgcucuugcugggaggcccacgccgcagguagguuu

SEQ ID NO: 98500 - RNA, 64 nt, Homo Sapiens
cagcgcagccauagaggaagggcugaggagccgcugcugggagagggcuggugcugucccugcu

SEQ ID NO: 98501 - RNA, 64 nt, Homo Sapiens
ccucaagugauccacucgcuucggccucccaaagugcugggauuauaggcgugagccacugugc

SEQ ID NO: 98502 - RNA, 64 nt, Homo Sapiens
ccucaaaagauccacccaccucggccucccaaagugcugggauuauaggcaugaaccaccgugu

SEQ ID NO: 98503 - RNA, 64 nt, Homo Sapiens
acaggugugagccaccgugcucagccucccaaagugcugggauucuucaagcaauucuccugcc

SEQ ID NO: 98504 - RNA, 64 nt, Homo Sapiens
acaggcgugugagccaccaccccaccucaggaagugcugggauuacuccugaccucgugaucca

SEQ ID NO: 98505 - RNA, 61 nt, Homo Sapiens
aagggaggccugaggggcagccacucugcugaggccagaggcuucacccagcacccaugcc

SEQ ID NO: 98506 - RNA, 61 nt, Homo Sapiens
ugaacauucauguguaggaaaggggagacuuaggccagaggucccccggggucuccaccuc

SEQ ID NO: 98507 - RNA, 61 nt, Homo Sapiens
uccagggcugcacugugguggagaaggaaguaggccagaagcagagagagucaugcuggag

SEQ ID NO: 98508 - RNA, 61 nt, Homo Sapiens
uuuagugcuaggggaagaugauccugggccaaggccagaacuucucccacugggcuccccc

SEQ ID NO: 98509 - RNA, 61 nt, Homo Sapiens
cugugggcaggcaggcagggugcuguggcccaggccagagccuggaccaguuucccugcug

SEQ ID NO: 98510 - RNA, 61 nt, Homo Sapiens
gaaagggcagugcaggggagcagcugccuggaggccagaagcucaacaucacauacagcuu

SEQ ID NO: 98511 - RNA, 61 nt, Homo Sapiens
uauagucauacucacacaaauagaaaacaccaggccagaacgacaucuaaaacuaaauaaa

SEQ ID NO: 98512 - RNA, 61 nt, Homo Sapiens
ccaagaaaccaagcguaucuaaggcaaccugaggccagacacaacucaucagcucuuccuc

SEQ ID NO: 98513 - RNA, 61 nt, Homo Sapiens
ugcuuagcagggcauuugacuacuuuaucugaggccagaacucucacacacagcuaucaag

SEQ ID NO: 98514 - RNA, 61 nt, Homo Sapiens
auaaaggaacuuuuauuaaagccugagacucaggccagaauuaggagggagcuuuuugaag

SEQ ID NO: 98515 - RNA, 61 nt, Homo Sapiens
ccacaaguaugaugacuaggagcugcacaggaggccagaaagguaaacugugguuucccca

SEQ ID NO: 98516 - RNA, 61 nt, Homo Sapiens
ggauuauuccuccuuugcugucccgugggagaggccagacucaguagguuuucuguugugg

SEQ ID NO: 98517 - RNA, 61 nt, Homo Sapiens
ucgggccagcugccccauuccagggaagaggaggccagagggguaaauauuuacauucagc

SEQ ID NO: 98518 - RNA, 61 nt, Homo Sapiens
caauuuuggagggcaagacaucaaaggaaucaggccagacuaugauuguaaaauuugcucc

SEQ ID NO: 98519 - RNA, 61 nt, Homo Sapiens
cuggacuccugcaaugaggggggaaguccccaggccagacguuggucaacagaucugguga

SEQ ID NO: 98520 - RNA, 61 nt, Homo Sapiens
ggcaugcucuggaacccagcagcuuccagcuaggccagaagcacauuuccuaucuuccucc

SEQ ID NO: 98521 - RNA, 61 nt, Homo Sapiens
ugguggccuugccccgcucugcagcacagacaggccagaugcauuuguccuuugccuagcu

SEQ ID NO: 98522 - RNA, 61 nt, Homo Sapiens
cacaggugacucagcagugacccugugugccaggccagauccaaacugagagggaaggugu

SEQ ID NO: 98523 - RNA, 61 nt, Homo Sapiens
auggcauagaauugugagagaauguuuugaaaggccagaggguggccuuuuuccccaaaca

SEQ ID NO: 98524 - RNA, 61 nt, Homo Sapiens
caggguugacaaggggccguccuuuccacacaggccagaagaggucuucaggcgaaccgac

SEQ ID NO: 98525 - RNA, 61 nt, Homo Sapiens
cgaauugaagggcuaagagucccagauagcuaggccagagcuggaagcagacaguaagggg

SEQ ID NO: 98526 - RNA, 61 nt, Homo Sapiens
aaugaggaugucugucccugucugccugggcaggccagauuccuccccagcagccgggucu

SEQ ID NO: 98527 - RNA, 61 nt, Homo Sapiens
uaauugugaaaggagacuuugcagauaaaugaggccagaauggcauguuuuauaauuaacu

SEQ ID NO: 98528 - RNA, 61 nt, Homo Sapiens
cucuggugcagagcacuucaaauauguccucaggccagauacugauugcuaguagagagac

SEQ ID NO: 98529 - RNA, 61 nt, Homo Sapiens
agccgagagccccuucuguuggaggccagagaggccagacacgcccucccacaccugcuug

SEQ ID NO: 98530 - RNA, 61 nt, Homo Sapiens
ggccagacaagccgagagccaccugcuugggaggccagagacacuugccccgcccucccac

SEQ ID NO: 98531 - RNA, 61 nt, Homo Sapiens
gcaaauaccucuucuagcccuuagaagucugaggccagacugacugagggggccugaagcu

SEQ ID NO: 98532 - RNA, 61 nt, Homo Sapiens
gggaagcaaccccagagcaggcagacaucagaggccagagugccuagcccgacaugaagcu

SEQ ID NO: 98533 - RNA, 61 nt, Homo Sapiens
uuguugcacuaaaaugaggauccagggcagcaggccagagaaagcaaaggugcacuccaga

SEQ ID NO: 98534 - RNA, 61 nt, Homo Sapiens
agugggaagggagcauugcagccuaagaagaaggccagagagggaaaaggcaggugcuuuu

SEQ ID NO: 98535 - RNA, 61 nt, Homo Sapiens
agggaagaccugaaagagaggacugguucugaggccagaaaggugugaggagagaggagga

SEQ ID NO: 98536 - RNA, 61 nt, Homo Sapiens
gagacuccgucucaaaacaacuccagccuggaggccagagugccaagacuacgccacugca

SEQ ID NO: 98537 - RNA, 61 nt, Homo Sapiens
aucgcuugaaccugggagguucuggaggcugaggccagagaaugugccuguaaucccagcu

SEQ ID NO: 98538 - RNA, 64 nt, Homo Sapiens
ucuuuggccauugugggaagucauuauucuggagacaagaaaaucaucacucuggugccuuggu

SEQ ID NO: 98539 - RNA, 64 nt, Homo Sapiens
agcugacuuuucuugccagaaaguuuuccuugugacaagaaauuugcaagcuuuucaaucucag

SEQ ID NO: 98540 - RNA, 64 nt, Homo Sapiens
uacucaaaaacauugacucugcaucaagaaagaaacaagaaagcaauaaaacaagaaauaauuc

SEQ ID NO: 98541 - RNA, 64 nt, Homo Sapiens
cucugcaucaagaaagaaacaagaaagcaauaaaacaagaaauaauucaugcucacauuuuuau

SEQ ID NO: 98542 - RNA, 64 nt, Homo Sapiens
uaauacacugauguucuucacuaaauggauggccacaagaaaaauaaaguaaaugucuuaaaua

SEQ ID NO: 98543 - RNA, 64 nt, Homo Sapiens
ucaaagaguuuuuuaugaaagacuuuccuccuuuacaagaaagaaauggggugcugccuuucug

SEQ ID NO: 98544 - RNA, 64 nt, Homo Sapiens
uaauagagcguuauuccacaauuaugcacucgggacaagaaaauuucgaagacaccuuucuuuc

SEQ ID NO: 98545 - RNA, 64 nt, Homo Sapiens
uuguuugaauguguagaagaagacuaugguuuguacaagaaaguaaagaggaacauugaccugc

SEQ ID NO: 98546 - RNA, 64 nt, Homo Sapiens
uggacaaaguucuguauauaguauaaagucauuaacaagaaacaggauaugcuuuaagacagaa

SEQ ID NO: 98547 - RNA, 64 nt, Homo Sapiens
ggaaccguuuuacacuggauguuucucauguagaacaagaaaucuuucuggaauugauguuuac

SEQ ID NO: 98548 - RNA, 64 nt, Homo Sapiens
uaauggauggaacuccugcacaaguuuuaacugaacaagaaaucccagcaaaaggcauuuuuuu

SEQ ID NO: 98549 - RNA, 64 nt, Homo Sapiens
auagauacgauggaaaacuaugcagccaugaaacacaagaaaaucauguccuuuucagcaacau

SEQ ID NO: 98550 - RNA, 64 nt, Homo Sapiens
guaugaucaaucauuuucuucagggaacaagaaaacaagaaagggaacaaaaguggggagguau

SEQ ID NO: 98551 - RNA, 64 nt, Homo Sapiens
aagaaaggguaugaucaaucggagguaucagggaacaagaaaaccugcuaaagaacaaaagugg

SEQ ID NO: 98552 - RNA, 64 nt, Homo Sapiens
auuauucacauaaauuuuguuuaauauugguugaacaagaaaucugacuuuaaaagauuauuaa

SEQ ID NO: 98553 - RNA, 64 nt, Homo Sapiens
caugacauucacaauaccagggaccaugggagacacaagaaaugugugucugcugucauaacuu

SEQ ID NO: 98554 - RNA, 64 nt, Homo Sapiens
ugcaguccuuuuacuacagcuaugaagaaacgcaacaagaaacucaaugcacaacaaaggauua

SEQ ID NO: 98555 - RNA, 64 nt, Homo Sapiens
aacuauuaccuggguauuuauccacuaaugagucacaagaaaaggaguggauuugguaagaaua

SEQ ID NO: 98556 - RNA, 64 nt, Homo Sapiens
ccagaccagcuguaagcugaaaccucaaugaauaacaagaaaagacuccaggccgacucaugau

SEQ ID NO: 98557 - RNA, 64 nt, Homo Sapiens
uugagcuggcagccuaugagauuguggacauauaacaagaaacagaaaugcccucaugcuuauu

SEQ ID NO: 98558 - RNA, 64 nt, Homo Sapiens
aaacauaaaaaccccaaaacuaaauuaccaaaaaacaagaaacauguguacuaguacauaucuu

SEQ ID NO: 98559 - RNA, 64 nt, Homo Sapiens
gauuauugugaggauggucugcaaugauugcaguacaagaaaagagacucauagaguuuuuucu

SEQ ID NO: 98560 - RNA, 64 nt, Homo Sapiens
aaauacccuuuucuuuuccugggcauuuuacaaaacaagaaaaauguaauaaucgagaaugccu

SEQ ID NO: 98561 - RNA, 64 nt, Homo Sapiens
uacauucuuuagaaacuaacuuuaaaaaaguaaaacaagaaaaguuuuugaaaugaaaagacuu

SEQ ID NO: 98562 - RNA, 64 nt, Homo Sapiens
gcagcauauucuucucuuuguaaauggcuucuaaacaagaaauugcuuuuguuugcauuuaaau

SEQ ID NO: 98563 - RNA, 64 nt, Homo Sapiens
uccuuuuuguggguguugcaugcaaaucaaguggacaagaaaaaauaacaaaacaaaaaacaag

SEQ ID NO: 98564 - RNA, 64 nt, Homo Sapiens
aucaaguggacaagaaaaaauaacaaaacaaaaaacaagaaaaaaaaaacacaaaaccccguaa

SEQ ID NO: 98565 - RNA, 64 nt, Homo Sapiens
uuacuaccauuuguguugccauuagugaauuuuuacaagaaaacucccugugggugcaaugagu

SEQ ID NO: 98566 - RNA, 64 nt, Homo Sapiens
guucaucaaaugaugcuguuaagauagggaaaagacaagaaacaggacuggaagaagauguuug

SEQ ID NO: 98567 - RNA, 64 nt, Homo Sapiens
uuagggaaaauugauaaauaucugucaccaaaccacaagaaauccaaaaucauuuuagguuuac

SEQ ID NO: 98568 - RNA, 64 nt, Homo Sapiens
ucucuccaugauuuuauuauaauuuugacacuagacaagaaaaaaaaauauuauuugucuuucc

SEQ ID NO: 98569 - RNA, 64 nt, Homo Sapiens
auuuccccauugguuggagucuaauuugugaacaacaagaaaucacuggcaucaccugaugcca

SEQ ID NO: 98570 - RNA, 64 nt, Homo Sapiens
acagggaugggaauggaaaggauaguaaccuuuuacaagaaagaccuggacaggguccaagucu

SEQ ID NO: 98571 - RNA, 64 nt, Homo Sapiens
agaagaacuaguagaagaagagucccaguuaagugaagccuaccccuccucacgcuagaguaaa

SEQ ID NO: 98572 - RNA, 64 nt, Homo Sapiens
gguagaaaaacccaaaaggaaaauucaggugcuagaagccuacugucuguggugcaguguguga

SEQ ID NO: 98573 - RNA, 64 nt, Homo Sapiens
ucaucaguccuuccuuccuaaucucuaauccccugaagccuaacacaguuccuaauguguuuug

SEQ ID NO: 98574 - RNA, 64 nt, Homo Sapiens
gguagggcugugguuuacuccugucuaaaccccugaagccuaacacaguuccuggcacacaaca

SEQ ID NO: 98575 - RNA, 64 nt, Homo Sapiens
ccaggaucgguccagcucagauauugagggcucugaagccuaguucugucuucucuggagcagc

SEQ ID NO: 98576 - RNA, 64 nt, Homo Sapiens
uaauuugguugguauuucacuauuuaauuuuuaagaagccuauuuuacuaguguuuuauaugaa

SEQ ID NO: 98577 - RNA, 55 nt, Homo Sapiens
ucauagugauugaggcauaacuaucaaucacaaaaguauauucaaaaauuauauu

SEQ ID NO: 98578 - RNA, 64 nt, Homo Sapiens
aacaacucgaaucacucauuuauuuccauauuaaaaucacaaacucauccauuaauguagauaa

SEQ ID NO: 98579 - RNA, 64 nt, Homo Sapiens
uacaguaaguaauauauauaaccucuuccucgacaaucacaaauacuaucacaccaacagccac

SEQ ID NO: 98580 - RNA, 64 nt, Homo Sapiens
ccaaccacagagaguccucaacagccacucuugaaaucacaagucuccagaccauguacaaaac

SEQ ID NO: 98581 - RNA, 64 nt, Homo Sapiens
aaaaaccccaguucaaaaugucuuuuuuuuuuuuaaucacaaaauuuaugcagcaaaaagaagc

SEQ ID NO: 98582 - RNA, 64 nt, Homo Sapiens
uuuuuacugcuuuaauucuaguauacagcuaaaaaaucacaauuaaaucuggugacccccuaau

SEQ ID NO: 98583 - RNA, 64 nt, Homo Sapiens
aagggggccacagccuggguggaaggcagaccugaaucacaacgggccagcucuaguaauacga

SEQ ID NO: 98584 - RNA, 64 nt, Homo Sapiens
acauuugugcuguuuucaauuuugugcuaucgcaaaucacaaaaaaacuguuaucaauucacau

SEQ ID NO: 98585 - RNA, 64 nt, Homo Sapiens
ugaaugacuugacuucaaaaggguuuuaaacacuaaucacaaacuucuguauuaaauauuuuca

SEQ ID NO: 98586 - RNA, 64 nt, Homo Sapiens
uuccuguggaauaaagaugggcugcuuuugcagaaaucacaauugcuaugugugguacuuugca

SEQ ID NO: 98587 - RNA, 64 nt, Homo Sapiens
cacuccaaccacauuccaagcugagauaaaaucaaaucacaaauguuuaaccacuuugcugcug

SEQ ID NO: 98588 - RNA, 64 nt, Homo Sapiens
acaaaguaguccauuccugaucucacuuaaaauaaaucacaaguaaauuugaauuuucgguuua

SEQ ID NO: 98589 - RNA, 64 nt, Homo Sapiens
cucuuaauauuuauaaacuauugugaucaaguuuaaucacaaauaauuuuauucugagggugau

SEQ ID NO: 98590 - RNA, 64 nt, Homo Sapiens
gugcuuuaaugaugacauuuuucugcuuuguuuaaaucacaagaaucuuaucuucuuuccucac

SEQ ID NO: 98591 - RNA, 64 nt, Homo Sapiens
aaauugucauuuaggauaaaacuuuuaugacccaaaucacaauacauauaaacaauuauuuauc

SEQ ID NO: 98592 - RNA, 64 nt, Homo Sapiens
aaaaaggagaucuguauucguaucaucauacaaaaaucacaaacuguagaggcagaggcaaagu

SEQ ID NO: 98593 - RNA, 64 nt, Homo Sapiens
cucugauuuugagcucaaucucaaauaaucacaaaaucacaauugaccccaguuugggaacuca

SEQ ID NO: 98594 - RNA, 64 nt, Homo Sapiens
ucacaauucucugauuuugaggaacucaucaaauaaucacaaaagaucuaaggaccccaguuug

SEQ ID NO: 98595 - RNA, 64 nt, Homo Sapiens
cggggaggugccugagcuggggccuggagaggggccugggaaaggaaaaccagggauagcuauu

SEQ ID NO: 98596 - RNA, 64 nt, Homo Sapiens
aaaaaccugguuccuguccucaaaauaaggggcaccugggaaaacagaggaaucuaccuguggu

SEQ ID NO: 98597 - RNA, 64 nt, Homo Sapiens
guauggacuauggaaaaacaaauuugcacaauggccugggaaguugaggucacuuuuuacaggg

SEQ ID NO: 98598 - RNA, 64 nt, Homo Sapiens
cuagucucguauauucugaguaaauggaaucaguccugggaauagagaguguccuuugugccag

SEQ ID NO: 98599 - RNA, 64 nt, Homo Sapiens
gacccacccaucuuccugcuggaagagggcaguaccugggaaaggcuggcugaguggaaugcag

SEQ ID NO: 98600 - RNA, 64 nt, Homo Sapiens
cuaaguucaguucuguuuuuggcaugguuccuucccugggaaggaucacucccuggaugugugg

SEQ ID NO: 98601 - RNA, 64 nt, Homo Sapiens
uucucccaccuccucccuuucuucaguugucaccccugggaagacauuccacacugguuagaua

SEQ ID NO: 98602 - RNA, 64 nt, Homo Sapiens
cugucugccccuucccaccucuacaaagaggucuccugggaaccagauaguaacugagcagggg

SEQ ID NO: 98603 - RNA, 64 nt, Homo Sapiens
ccuuguucuccccucugcuggaggagacauggagccugggaacuguuuaggcuuucgcggaggg

SEQ ID NO: 98604 - RNA, 64 nt, Homo Sapiens
cagaccucagaugaggacuucagaugaaugggucccugggaaccgguaggggcuccugggcggc

SEQ ID NO: 98605 - RNA, 64 nt, Homo Sapiens
ugaggcuggagacagggguuggccgggaaggcagccugggaaucugggugcuggcugagcuuug

SEQ ID NO: 98606 - RNA, 64 nt, Homo Sapiens
auuuauugaguaccuacugugugcuaggcauugaccugggaacuagagauacuucacagaauaa

SEQ ID NO: 98607 - RNA, 64 nt, Homo Sapiens
cagcguuugggaaacaagacuuuuccugcaauagccugggaaggaauaaaaggauagaguguuu

SEQ ID NO: 98608 - RNA, 64 nt, Homo Sapiens
ccaacauaugaugaaaacccgaagcugagauggaccugggaacuaugaugccagccuugagcau

SEQ ID NO: 98609 - RNA, 64 nt, Homo Sapiens
acaucaccacugcccuaugacaacagaugcagaaccugggaauggggaggcucagaaacaacag

SEQ ID NO: 98610 - RNA, 64 nt, Homo Sapiens
agugcaggcccggggcccacgggcaacauggaacccugggaacugcccucccccuuagcucaca

SEQ ID NO: 98611 - RNA, 64 nt, Homo Sapiens
uauuaagaacauguugggcauguggacccaagcaccugggaaggagguggcaucugagacagcc

SEQ ID NO: 98612 - RNA, 64 nt, Homo Sapiens
gucugcauaucugauguucagguagaccugggcgccugggaacgaggccaucagcugccaugca

SEQ ID NO: 98613 - RNA, 64 nt, Homo Sapiens
guacccaaguggccugaaacaguguagggaaagaccugggaaacacuggaccaaaaaagccuga

SEQ ID NO: 98614 - RNA, 64 nt, Homo Sapiens
uuugugaugccccuucccagaccagguuaggauuccugggaaggccgcggauuccggcccugga

SEQ ID NO: 98615 - RNA, 64 nt, Homo Sapiens
acuggacugucacgggguucacucugccccuggaccugggaacgaucaccucaccaaggaucgg

SEQ ID NO: 98616 - RNA, 57 nt, Homo Sapiens
cgagucuggggaccuggcacggggcugccugggaaggucauagccacugagaucuga

SEQ ID NO: 98617 - RNA, 64 nt, Homo Sapiens
uauccuuuauucuccgcacauggaggcugcccuaccugggaaggcaccccagcaccugugaagg

SEQ ID NO: 98618 - RNA, 64 nt, Homo Sapiens
gcgggcagugcuaaagguggagcugggggauuuuccugggaaugauuugagggcucuugaaagc

SEQ ID NO: 98619 - RNA, 64 nt, Homo Sapiens
gcccacucagcuuaauugcugcaggcuucucugcccugggaagaaggaugguggcuggagacag

SEQ ID NO: 98620 - RNA, 64 nt, Homo Sapiens
gagaggugccagcaauugcuacacacucagcaucccugggaacuggcgguucaagugaaaacca

SEQ ID NO: 98621 - RNA, 64 nt, Homo Sapiens
cuggggucugaagaucagggucaguguggcugugccugggaauuccagaccugagguugggaaa

SEQ ID NO: 98622 - RNA, 64 nt, Homo Sapiens
cuuucucaaguauuuauuuauuuauugcaugguuccugggaacauguggcacaaguaaugggau

SEQ ID NO: 98623 - RNA, 64 nt, Homo Sapiens
gaaccuuaaccccuucucguaagugcauaagucuccugggaaaacuauaacaagaaaagaaaug

SEQ ID NO: 98624 - RNA, 64 nt, Homo Sapiens
gguucaagagacacugcuuggaauuugccuucucccugggaacugccccuccagagacaggaaa

SEQ ID NO: 98625 - RNA, 64 nt, Homo Sapiens
augaaaaaaaaaaauaaagcugcugccucauugaccugggaaaagucucacuuuuuguuaaugu

SEQ ID NO: 98626 - RNA, 64 nt, Homo Sapiens
agagagagaaggagaaggagacucagcaagccaaccugggaaucaagcugaugggagugagaga

SEQ ID NO: 98627 - RNA, 64 nt, Homo Sapiens
aggucaccagccugacugcacacagcuaggcaugccugggaauccugcugccagagaaccauuc

SEQ ID NO: 98628 - RNA, 64 nt, Homo Sapiens
ccauucaucucaugcucucugaacagaagguauaccugggaagauaccagcuuuuucucucagg

SEQ ID NO: 98629 - RNA, 64 nt, Homo Sapiens
uucaguaguugcuuuugaauaaugguuuugguuaccugggaaggcaggcccagaacccauuucc

SEQ ID NO: 98630 - RNA, 64 nt, Homo Sapiens
auguaauuggaguaagugacaaaauaagaacuacccugggaaacccugcauucaauguagcugu

SEQ ID NO: 98631 - RNA, 64 nt, Homo Sapiens
cuuagcuggcaggucugggugccccuuuuccuccccugggaagggcuggaauaggauagaaagc

SEQ ID NO: 98632 - RNA, 64 nt, Homo Sapiens
guggauuccuucagggcaugguaccuuucuaggaccugggaaugggguggagaggacauccucu

SEQ ID NO: 98633 - RNA, 64 nt, Homo Sapiens
gacucaguuuggacaagggggaaagggggacuucccugggaagguccagcuaaaaguggcaaca

SEQ ID NO: 98634 - RNA, 64 nt, Homo Sapiens
uaaaaguggcaacauuugcccccagaauugggggccugggaacacuggaccugcuccuucuccc

SEQ ID NO: 98635 - RNA, 64 nt, Homo Sapiens
agggugcuguggagggggcugggagccccaugggccugggaaggggagccacgggauggggugg

SEQ ID NO: 98636 - RNA, 64 nt, Homo Sapiens
accgaguuuaacaccaggaucagggaucaagugaccugggaagaaccucauuccccucccacua

SEQ ID NO: 98637 - RNA, 64 nt, Homo Sapiens
uagcaagaaaaugugcagccuuuugggcaaagccccugggaacgaggccuauccacuauggacu

SEQ ID NO: 98638 - RNA, 64 nt, Homo Sapiens
guuggcaguggggagauuuccacuguggaaaccgccugggaauuccggccagcagcuuccuccu

SEQ ID NO: 98639 - RNA, 64 nt, Homo Sapiens
caucuggcugcacaggcugaggaaagcagagccuccugggaacagccaggccuuacaucuggcu

SEQ ID NO: 98640 - RNA, 64 nt, Homo Sapiens
caguucugggcaaagaggauaggcucgucagccaccugggaacagcgcagggcuggcacgugac

SEQ ID NO: 98641 - RNA, 64 nt, Homo Sapiens
ugcuuugcccguggccagaagcucagcagcggcuccugggaaaggccuggaaaggaugagggaa

SEQ ID NO: 98642 - RNA, 64 nt, Homo Sapiens
uuugucaggcaauaugcccuugagcaggucacccccugggaaugggggguacucacgcaccccg

SEQ ID NO: 98643 - RNA, 64 nt, Homo Sapiens
cauaaccucaccagccaccucugaggucauggaaccugggaacagaagccucaacccccacaag

SEQ ID NO: 98644 - RNA, 64 nt, Homo Sapiens
ggggaagagccgggaagggacagucaggcuucucccugggaagguggggccagcaggagaugac

SEQ ID NO: 98645 - RNA, 64 nt, Homo Sapiens
cuucagcuagagcuucaagucugugccuggagcuccugggaaggcuacucaccuugaacaccac

SEQ ID NO: 98646 - RNA, 64 nt, Homo Sapiens
gaugcgguggcuaaaggucccaaggcaaggggugccugggaaccuuccugucuucauccuuagc

SEQ ID NO: 98647 - RNA, 64 nt, Homo Sapiens
ucucucugaguuccucugggcugccgcaggcuccccugggaauagagcaagacgugaguccuaa

SEQ ID NO: 98648 - RNA, 64 nt, Homo Sapiens
ugagcccagcguccccuccuuggcuuccaggagcccugggaagcauuuuuaacuggguagaauc

SEQ ID NO: 98649 - RNA, 64 nt, Homo Sapiens
gcggugaacuugagucuaaaaggagcccuugcucccugggaaagugccugugagcagcuuagca

SEQ ID NO: 98650 - RNA, 64 nt, Homo Sapiens
aaaggcacaggcccacggugacgguccuccaggaccugggaagccuccacagccaagcacugcc

SEQ ID NO: 98651 - RNA, 64 nt, Homo Sapiens
cgggugguggcagagugagacuuuccccauguucccugggaagagucuugucaguucgugcccu

SEQ ID NO: 98652 - RNA, 64 nt, Homo Sapiens
gaucuuucgagguuccccucuaguuuucccaucuccugggaaggaggcugcuuugugugagaug

SEQ ID NO: 98653 - RNA, 64 nt, Homo Sapiens
cuggagaggcagacgguggggaaccuggcugcagccugggaaggcccacccucuggaggccugg

SEQ ID NO: 98654 - RNA, 64 nt, Homo Sapiens
uggcugcagccugggaaggcccacccucuggaggccugggaaccuaccugcaccugcugugguc

SEQ ID NO: 98655 - RNA, 64 nt, Homo Sapiens
uuugaaaucuuuuagaaguuauaaacuauguacuccugggaagauuuccauuuaaaacuaauuu

SEQ ID NO: 98656 - RNA, 64 nt, Homo Sapiens
gaauccaccuaaccaugaauccgcugauagcucaccugggaacuaguuagguucccuaacacua

SEQ ID NO: 98657 - RNA, 64 nt, Homo Sapiens
ccucuguggucacagcuggagcacagagagggacccugggaacuuggccugggaagcccagagc

SEQ ID NO: 98658 - RNA, 64 nt, Homo Sapiens
agcuggagcacagagagggacccugggaacuuggccugggaagcccagagcaggaagccacagc

SEQ ID NO: 98659 - RNA, 64 nt, Homo Sapiens
cuccgggcaaaagcgggggcgaguguagagcgauccugggaaauccuuugauccgggagcccua

SEQ ID NO: 98660 - RNA, 64 nt, Homo Sapiens
ggacaggaucccugcugcaccuuccccacccccuccugggaagugcccccucaccucagggcac

SEQ ID NO: 98661 - RNA, 64 nt, Homo Sapiens
gggaaggugcacguccugggggaagucucugggcccugggaagaaacgugugguguguccccug

SEQ ID NO: 98662 - RNA, 64 nt, Homo Sapiens
cucugggcccugggaagaggcgugugguguguccccugggaagugacucauguccagcaaggaa

SEQ ID NO: 98663 - RNA, 64 nt, Homo Sapiens
ugauggguugccugugcgccagagugacucacacccugggaaaaguucccgugggugggggcgg

SEQ ID NO: 98664 - RNA, 64 nt, Homo Sapiens
gcagccaguccagcucuugcuuccucuggcccguccugggaaggggggugucuagagcccagga

SEQ ID NO: 98665 - RNA, 64 nt, Homo Sapiens
ccucuugcagccccccaaacugggaccgaaugacccugggaaggggaacuuggguagguugggg

SEQ ID NO: 98666 - RNA, 64 nt, Homo Sapiens
gugggggcugaccccugccuuugauugucauucuccugggaagcccagucucagucccuccccc

SEQ ID NO: 98667 - RNA, 64 nt, Homo Sapiens
uuauucuccccagccagagcccgagcuccugcucccugggaaaaguggcguauggcccugagcu

SEQ ID NO: 98668 - RNA, 64 nt, Homo Sapiens
cggggauagaaugguuuccacugaggacauucagccugggaaggaggaagucaccagcucgagg

SEQ ID NO: 98669 - RNA, 64 nt, Homo Sapiens
guucacagugaccgagagucagguccagcacacaccugggaaagggaugcugccccaaggggga

SEQ ID NO: 98670 - RNA, 64 nt, Homo Sapiens
cuccuggccuucuaggaaugacccagccccuuccccugggaacuggaacagaagugaggaugag

SEQ ID NO: 98671 - RNA, 64 nt, Homo Sapiens
ggagaugucaggauguugcuuccuagccaggucuccugggaaagacccuguccccuagggacug

SEQ ID NO: 98672 - RNA, 64 nt, Homo Sapiens
ugacaucuaauuuaccaucaaguuguaaaauuauuuggaaaaauacagaacucguuuuauuugu

SEQ ID NO: 98673 - RNA, 64 nt, Homo Sapiens
ugggguuuuuuuguuuguuuguuucuuuuguuuuuuggaaaauccgugucuuuaucuuuuuuuc

SEQ ID NO: 98674 - RNA, 64 nt, Homo Sapiens
agccagugcaaaauaaucugcuuaccuacucacauuggaaaaacccucugagcugaauaauucu

SEQ ID NO: 98675 - RNA, 64 nt, Homo Sapiens
aggcagaccuagauaagaaaagcagagaacuacuuuggaaaacaguuuaucugcuguaauugaa

SEQ ID NO: 98676 - RNA, 64 nt, Homo Sapiens
ucccuggagaaaaaaauugcucuguguauaucucuuggaaaauaagacaauaguauuucuccuu

SEQ ID NO: 98677 - RNA, 64 nt, Homo Sapiens
ucauuauauucuaauuaaaauugugcauaaugcuuuggaaaaaugggucuuuuauaggaaaaaa

SEQ ID NO: 98678 - RNA, 64 nt, Homo Sapiens
auuuguaauauggaaugggcucaguaagaagagcuuggaaaaugcagaaaguuaugaaaaauaa

SEQ ID NO: 98679 - RNA, 64 nt, Homo Sapiens
gggaagagugguuaagacuacugaagagaaauauuuggaaaauaagauuucgauaucuucuuuu

SEQ ID NO: 98680 - RNA, 64 nt, Homo Sapiens
ugcacaaacuuggcuucuuuaaccaagaauauuauuggaaaauucucuaaaaguuaauagggua

SEQ ID NO: 98681 - RNA, 64 nt, Homo Sapiens
gggccaaagaaacauugccuugaggaagauaugauuggaaaaucaagaguguagaagaauaaau

SEQ ID NO: 98682 - RNA, 64 nt, Homo Sapiens
guuuggcaguuucucaaaggaugguacaaccaguuuggaaaacaacugaugguggggauguaaa

SEQ ID NO: 98683 - RNA, 64 nt, Homo Sapiens
accuaacaguagagucaccaagggauggaaguauuuggaaaaaaaacugccucacuaaauucuu

SEQ ID NO: 98684 - RNA, 64 nt, Homo Sapiens
cuacacacucccuuucuccuuuugcucaaaaagcuuggaaaauaguuccaugagaaaaggauug

SEQ ID NO: 98685 - RNA, 64 nt, Homo Sapiens
cuugcuuggcuauuucugcagauuuaaccagugcuuggaaaaauaaaugcuuuguuuugcuggu

SEQ ID NO: 98686 - RNA, 64 nt, Homo Sapiens
aggaacuauauagcagccuugcccuauaagaagguuggaaaaggguuuucuaugauccaaaaca

SEQ ID NO: 98687 - RNA, 64 nt, Homo Sapiens
gacauacuguauuguguucuaguauguuguuucuuuggaaaauguucucagcacaaaccuuuca

SEQ ID NO: 98688 - RNA, 64 nt, Homo Sapiens
guuccccaugggauucuaacucuuucauuggauuuuggaaaauuuauuugaaaauaaugagaca

SEQ ID NO: 98689 - RNA, 64 nt, Homo Sapiens
auauuuauagggcuuaaagccaaaacuuauuuucuuggaaaacagaguugucauuuugcacuuu

SEQ ID NO: 98690 - RNA, 64 nt, Homo Sapiens
uauuauuaauuuuaaguccugucuuuacauccuuuuggaaaacuuguauuaccauggguuugga

SEQ ID NO: 98691 - RNA, 64 nt, Homo Sapiens
uacauccuuuuggaaaacuuguauuaccauggguuuggaaaaaggacaacgaaaggcuuuucau

SEQ ID NO: 98692 - RNA, 64 nt, Homo Sapiens
gccccugcacaaaaugaaauaaaggaaguggaaauuggaaaaaacgcaaaccuaacuugcucug

SEQ ID NO: 98693 - RNA, 64 nt, Homo Sapiens
ggaaaaaacgcaaaccuaacuugcucugcuuguuuuggaaaaggcacucaguucuuggcugccg

SEQ ID NO: 98694 - RNA, 64 nt, Homo Sapiens
gaacaugugaggucagauuugagccucucuacuuuuggaaaaaugguuugagaggcuagaaacu

SEQ ID NO: 98695 - RNA, 64 nt, Homo Sapiens
guauucauacuuaguuuuuuguguaugugcguguuuggaaaaguuugggauuccauuguaagcu

SEQ ID NO: 98696 - RNA, 64 nt, Homo Sapiens
uugaauauauuguaggauuuuguucaaaagauaauuggaaaaaaaaauauauuuugcaaauugu

SEQ ID NO: 98697 - RNA, 60 nt, Homo Sapiens
cuaaaauuuuaauauaguuaauaaacuuuauuggaaaaugcacuaauuaaagaagauuga

SEQ ID NO: 98698 - RNA, 64 nt, Homo Sapiens
caggaaggcugagaggagagagacuccagcuggguuggaaaacaguauuuuccaaacuaccuuc

SEQ ID NO: 98699 - RNA, 64 nt, Homo Sapiens
augaaauguaaauacuguuuuuaacaacuaugauuuggaaaauaaaucaaugcuauaacuaugu

SEQ ID NO: 98700 - RNA, 64 nt, Homo Sapiens
gacuuuagucugcugggcugauuccagaguccuuuuggaaaacuccuuccauucauuuugcuga

SEQ ID NO: 98701 - RNA, 64 nt, Homo Sapiens
uuuucuggggaggaggaggcgacugagaacaggcuuggaaaaggaauugaauugggcaaaugau

SEQ ID NO: 98702 - RNA, 64 nt, Homo Sapiens
aacuacuguauguaacggaaaaaaaaaaauagcuuuggaaaaaaugcuuuauauuaacgauacu

SEQ ID NO: 98703 - RNA, 64 nt, Homo Sapiens
gaaaaaaaaaaaaacacguccccgagaaugaagauuggaaaaaggacuaucggggcgggccaac

SEQ ID NO: 98704 - RNA, 64 nt, Homo Sapiens
uuuaaacaaccaagcuaaagauugcuguauuauauuggaaaaguuuuaaaaagaaauuauucuc

SEQ ID NO: 98705 - RNA, 64 nt, Homo Sapiens
aguuuauaaacugauuuuuguuuuggugguuguuuuggaaaaacugauuugggggauuguuuug

SEQ ID NO: 98706 - RNA, 64 nt, Homo Sapiens
ggaaucaguaaccauucaaucuuuuguccuaggauuggaaaaaaauguuaaagguuuaggacac

SEQ ID NO: 98707 - RNA, 64 nt, Homo Sapiens
auugaaaauaaauaauuaaaauaucagacauguuuuggaaaagucuuaauuugagaacaccaaa

SEQ ID NO: 98708 - RNA, 64 nt, Homo Sapiens
uauuagaaagcagaacagggccugaaacauaagcuuggaaaauccagguaguccuggcuuuuuc

SEQ ID NO: 98709 - RNA, 64 nt, Homo Sapiens
acucucugguauuauuaagauuuaauauauuugauuggaaaagaaacccucaagccaguugauu

SEQ ID NO: 98710 - RNA, 64 nt, Homo Sapiens
aguuaacuuuucauacuaacuucacucuuuuauuuuggaaaaaauuuuaacuuaacaugaaaaa

SEQ ID NO: 98711 - RNA, 64 nt, Homo Sapiens
caucaagaaggccaaaccaguccaccagugggccuuggaaaauguguauaaaaacucaugcugc

SEQ ID NO: 98712 - RNA, 64 nt, Homo Sapiens
acuuuaccuugaaccacauauaccaauuauaauuuuggaaaaggaauuaagccucacggaacaa

SEQ ID NO: 98713 - RNA, 64 nt, Homo Sapiens
gaggaguauuauagccaaguuuucuuugaaaguauuggaaaacuaaaauuaaaugacaaggacu

SEQ ID NO: 98714 - RNA, 64 nt, Homo Sapiens
ucccagaacuuauuagaaacgauuccggauggcauuggaaaacuaaagaaacugucaaucuuga

SEQ ID NO: 98715 - RNA, 64 nt, Homo Sapiens
aaauuguuauuuuaacagacccugccuaaaagcauuggaaaacuaaagaaguugagcaacuuga

SEQ ID NO: 98716 - RNA, 64 nt, Homo Sapiens
ucuaaaaaccuucuuuuagaucuuccuugggccuuuggaaaaauaugugacaagugaauguaag

SEQ ID NO: 98717 - RNA, 64 nt, Homo Sapiens
aaaauaauuuuacuauuucuuuuaaaaguauguuuuggaaaaucaaugauuuuaaugcauagca

SEQ ID NO: 98718 - RNA, 64 nt, Homo Sapiens
gagauuuauuuuaucucacagguuuguguaauuguuggaaaauuuuuaaacuucuaagugaaag

SEQ ID NO: 98719 - RNA, 64 nt, Homo Sapiens
guuucucauuguaaagcuucaugucuuuuguuuguuggaaaauuuuuacuuauagaaacuuaau

SEQ ID NO: 98720 - RNA, 64 nt, Homo Sapiens
uauauuggagaaaaacccuaugaguguaaugaauuuggaaaaauauuuuuuucaacaacagcuu

SEQ ID NO: 98721 - RNA, 64 nt, Homo Sapiens
cagagguauauuuacauucagaguacacuuuucuuuggaaaaaauuacagguuuuuugaaaagu

SEQ ID NO: 98722 - RNA, 64 nt, Homo Sapiens
gcaguggcuccucucugguugaggagagggaaaauuggaaaaacuggucgaguaauuaucaaua

SEQ ID NO: 98723 - RNA, 64 nt, Homo Sapiens
aucacucuggggacuaggugucagcaugugaauuuuggaaaacacaaaaauucagaacauagca

SEQ ID NO: 98724 - RNA, 64 nt, Homo Sapiens
cacaauaaaguauuuugaggaaaaaucccuauucuuggaaaauaguauacuuugauuaaguaaa

SEQ ID NO: 98725 - RNA, 64 nt, Homo Sapiens
aucauuuuucaaccaucacaaaggaguucuggaauuggaaaaccccaguguuaaaugugagugg

SEQ ID NO: 98726 - RNA, 64 nt, Homo Sapiens
ggaugauuccaaagcaagggggaaccaaggcuacuuggaaaaauaauauaguuugccacuaaaa

SEQ ID NO: 98727 - RNA, 64 nt, Homo Sapiens
ucauugucucuagagauuguauacaggugauucguuggaaaaauguguacaggagaagaaguuc

SEQ ID NO: 98728 - RNA, 64 nt, Homo Sapiens
guccccaucuaauauguauagccuucaaggguuguuggaaaauauucucagguugucagguucu

SEQ ID NO: 98729 - RNA, 64 nt, Homo Sapiens
ucuggaauaugugguguacaacauagaauguuacuuggaaaaaguuaguagcucuaaacuguua

SEQ ID NO: 98730 - RNA, 64 nt, Homo Sapiens
ucaugucuguaacuaacccacugugagauuauauuuggaaaaaugcagagggauuaaauuagac

SEQ ID NO: 98731 - RNA, 64 nt, Homo Sapiens
cuuccccugugaugaaaaugaggaauuuucucucuuggaaaagggaggaauuucaugaugauuu

SEQ ID NO: 98732 - RNA, 64 nt, Homo Sapiens
cauaucacuauucuuggaauaguaucaacuagcauuggaaaauauuuucucagacagacauagu

SEQ ID NO: 98733 - RNA, 64 nt, Homo Sapiens
cuggccuaucggcuguaauaccaaagaacguaguuuggaaaacagcucguaguucaauaacauu

SEQ ID NO: 98734 - RNA, 64 nt, Homo Sapiens
uuuuuuugaaaugcuuccugauaaaaucauagaguuggaaaauaauugauuuuaugcucccaga

SEQ ID NO: 98735 - RNA, 64 nt, Homo Sapiens
uuaaagaaaaauaauccuaccaaguaauaugaucuuggaaaauuucaaaaugacacuuauuugu

SEQ ID NO: 98736 - RNA, 64 nt, Homo Sapiens
gcagugucucagcugucccccuuuuuaagacuauuuggaaaaauuaaauaaugccuaucuuuaa

SEQ ID NO: 98737 - RNA, 64 nt, Homo Sapiens
uuauuuuauggaaugucugcuaugcauaauuaauuuggaaaaugucaauuagcagauguauaug

SEQ ID NO: 98738 - RNA, 64 nt, Homo Sapiens
cuauggagguucgucacaaaugguucagcugcuguuggaaaacguugcuugugggaacguaaaa

SEQ ID NO: 98739 - RNA, 64 nt, Homo Sapiens
auauguauaaaaccaaagugucucaggagaaauauuggaaaauugcuugucaggauguuaagca

SEQ ID NO: 98740 - RNA, 64 nt, Homo Sapiens
guauucaaauucuggaauggucugguaucuucuuuuggaaaaugccaauuccauacagagauga

SEQ ID NO: 98741 - RNA, 64 nt, Homo Sapiens
aaaagaggcucacucaaaccuggaagacaaaguguuggaaaaucggagucucccaaauuuaaug

SEQ ID NO: 98742 - RNA, 64 nt, Homo Sapiens
aagcauagagaugaauugugccuggccauguacuuuggaaaagauauaugcaaaguaauucaaa

SEQ ID NO: 98743 - RNA, 64 nt, Homo Sapiens
uguauguagccaguguggauucagaaaacuuaauuuggaaaacaagauggcaaaugaugagcca

SEQ ID NO: 98744 - RNA, 64 nt, Homo Sapiens
gaaaagaaucacugaauggaucaggaauaacuuauuggaaaacuauaagguaucuccccucccu

SEQ ID NO: 98745 - RNA, 64 nt, Homo Sapiens
uccuuccucuuuauucgagcauacuggcaaugcauuggaaaacagacagcucccacuaagauca

SEQ ID NO: 98746 - RNA, 64 nt, Homo Sapiens
ucagguuaguggugucugucagcugucuaagagguuggaaaaugaacuacucaagauagucacg

SEQ ID NO: 98747 - RNA, 64 nt, Homo Sapiens
ccgcaaguugcuuacuccgaaaacuuagugugccuuggaaaagguagaguauuuucuaagcugg

SEQ ID NO: 98748 - RNA, 64 nt, Homo Sapiens
gcacuuuucacuucugugugaaaaauuguacuuuuuggaaaauauguugauauaaaguagggaa

SEQ ID NO: 98749 - RNA, 64 nt, Homo Sapiens
caauacauuuuuuauuauacauguuaaaaaaaaauuggaaaaugaugauucuuaaccaggcuau

SEQ ID NO: 98750 - RNA, 64 nt, Homo Sapiens
cuuuguuucauguguauuuggacucaaccguugguuggaaaagaguugcacagacuguguuuau

SEQ ID NO: 98751 - RNA, 64 nt, Homo Sapiens
acaaauguaauuaauaacuuucucugugaaagcuuuggaaaaaucuuuuuuuuuuuuuuugguc

SEQ ID NO: 98752 - RNA, 64 nt, Homo Sapiens
aauagauggggcauauaauaaagaagcuacuauuuuggaaaaugacauuuuacuauuugccaau

SEQ ID NO: 98753 - RNA, 64 nt, Homo Sapiens
auauaaaaguuuuuuuccccaaucuguuugugcuuuggaaaaaucacugauggagaggcauagu

SEQ ID NO: 98754 - RNA, 64 nt, Homo Sapiens
cuaaaauuuguccuugucuagugaaugauguucauuggaaaauuacaaaacagcaucauacaua

SEQ ID NO: 98755 - RNA, 64 nt, Homo Sapiens
uucugacagcauuucagcuguacaaaaugugugcuuggaaaaugugaaaagcgggguucaaugc

SEQ ID NO: 98756 - RNA, 64 nt, Homo Sapiens
uuagacaagucuaguggaacaaaaaaauaugagauuggaaaaaaguuuucaccuaucuggaaaa

SEQ ID NO: 98757 - RNA, 64 nt, Homo Sapiens
uuuaacauauauauuuauuaauuuauuugucguguuggaaaaugugucucugcuuuccuuuucu

SEQ ID NO: 98758 - RNA, 64 nt, Homo Sapiens
cugucccuuaauaaaaauauauauuacuacuccuuuggaaaauagauuuuuaaugguuaagaac

SEQ ID NO: 98759 - RNA, 64 nt, Homo Sapiens
uuuaaaauuauuuucauugauggaacuggaguuguuggaaaaacauagauuuaaaaugauuuuu

SEQ ID NO: 98760 - RNA, 64 nt, Homo Sapiens
ucugccaagugcucuugauaauuucuucagauuuuuggaaaaaaacacuauauaaaugcaaucc

SEQ ID NO: 98761 - RNA, 64 nt, Homo Sapiens
caacaugauauuuagaccaacaggugaucaauguuuggaaaauacaacaaugacuuauuuaaaa

SEQ ID NO: 98762 - RNA, 64 nt, Homo Sapiens
cuauagaucacauacguuaucaaaaacuacucccuuggaaaaaauaucuuucgaaaaucaaauu

SEQ ID NO: 98763 - RNA, 64 nt, Homo Sapiens
acuuuaauuaggaucauaugcucugacugaugguuuggaaaauaggacauuuguuccacccgac

SEQ ID NO: 98764 - RNA, 64 nt, Homo Sapiens
cacagaguuucacccuuaagggaggcagaaagauuuggaaaauuaauugacaagcuaggaaaga

SEQ ID NO: 98765 - RNA, 64 nt, Homo Sapiens
cccaaauauuacaacaagucuggauggagcccaguuggaaaauuugccuuggcucuauuuggca

SEQ ID NO: 98766 - RNA, 64 nt, Homo Sapiens
ugaauuugcccuacaaggcauauagcagugucauuuggaaaagugaggaugagauguaguaacu

SEQ ID NO: 98767 - RNA, 64 nt, Homo Sapiens
caaaaacugcauugaaauguugcuuuugugaguguuggaaaaacugaggggacccccaugaggc

SEQ ID NO: 98768 - RNA, 64 nt, Homo Sapiens
uuuauucgagggaaggaucaaugcuuauuaccauuuggaaaaacgaagaucagaagguaaauga

SEQ ID NO: 98769 - RNA, 64 nt, Homo Sapiens
ccuucugacacagugugugcacuucaggcaauuuuuggaaaauauaaaaaauuccaaauucugc

SEQ ID NO: 98770 - RNA, 64 nt, Homo Sapiens
aagacuaacuaguuauaaucauucccuuaaaaaguuggaaaaucauuacagauuaaaauuucuu

SEQ ID NO: 98771 - RNA, 64 nt, Homo Sapiens
uuauugcuucuuugccucuccaugaauggccaauuuggaaaagcagagaugggcuuucagcaga

SEQ ID NO: 98772 - RNA, 64 nt, Homo Sapiens
uacauuacuucuaguuuuagaugagaccaugagauuggaaaaugcgauuuuauuaucuuggggg

SEQ ID NO: 98773 - RNA, 64 nt, Homo Sapiens
acugagcucaguuacacuuggugauccauacuguuuggaaaaacugggcucagagggaauauca

SEQ ID NO: 98774 - RNA, 64 nt, Homo Sapiens
aagauccuuaucuauauucauuccuucauuacuuuuggaaaauucuuacuugugaauguuaaaa

SEQ ID NO: 98775 - RNA, 64 nt, Homo Sapiens
aaucauuuauuauauuuugccucaacuuuaaacauuggaaaacucauuucuggguuaauccuac

SEQ ID NO: 98776 - RNA, 64 nt, Homo Sapiens
guauguacuguuauugaaaauauauuuaauaccuuuggaaaaaucuugggcaagaugaccuacu

SEQ ID NO: 98777 - RNA, 64 nt, Homo Sapiens
uuacauaauugcaauauuucccccuuacuacuucuuggaaaaaaauuacaaaaugaaguuuuau

SEQ ID NO: 98778 - RNA, 64 nt, Homo Sapiens
aaucuuccacugaaacauuugaaccagcucauguuuggaaaagguuuauaauuaaaaacccaaa

SEQ ID NO: 98779 - RNA, 64 nt, Homo Sapiens
uuuuuaaccuugaccauguauccuuauguggugcuuggaaaauggauagaauuuuuauuucaua

SEQ ID NO: 98780 - RNA, 64 nt, Homo Sapiens
gccggguaggaaccacgguuccuucguccauuaguuggaaaaaguaacagaccuaaaacucuac

SEQ ID NO: 98781 - RNA, 64 nt, Homo Sapiens
ggcuuuuuuaugaacacucucauuucaguagaauuuggaaaacuaagcgugguuggaauuucuu

SEQ ID NO: 98782 - RNA, 64 nt, Homo Sapiens
guagcagaaaccaacaagaaccacuccuucauguuuggaaaauaauuucucuuguauuaucucc

SEQ ID NO: 98783 - RNA, 64 nt, Homo Sapiens
aggggcucuguggcaaaaagagucagacauuucuuuggaaaacagcgaacagccuuagagcucu

SEQ ID NO: 98784 - RNA, 64 nt, Homo Sapiens
aaaauacuaguaguuuuauauuuggaugacauaauuggaaaagcagauuagcugcuacuacuuu

SEQ ID NO: 98785 - RNA, 64 nt, Homo Sapiens
uuugcaucccggagguugaaguuggaguuugagguuggaaaauaucuuugaaggcagaaucagu

SEQ ID NO: 98786 - RNA, 64 nt, Homo Sapiens; identical to SEQ ID NO: 81180

SEQ ID NO: 98787 - RNA, 64 nt, Homo Sapiens; identical to SEQ ID NO: 81181

SEQ ID NO: 98788 - RNA, 64 nt, Homo Sapiens; identical to SEQ ID NO: 81204

SEQ ID NO: 98789 - RNA, 64 nt, Homo Sapiens; identical to SEQ ID NO: 81205

SEQ ID NO: 98790 - RNA, 64 nt, Homo Sapiens; identical to SEQ ID NO: 81232

SEQ ID NO: 98791 - RNA, 64 nt, Homo Sapiens; identical to SEQ ID NO: 81233

SEQ ID NO: 98792 - RNA, 64 nt, Homo Sapiens; identical to SEQ ID NO: 81241

SEQ ID NO: 98793 - RNA, 64 nt, Homo Sapiens; identical to SEQ ID NO: 81242

SEQ ID NO: 98794 - RNA, 64 nt, Homo Sapiens; identical to SEQ ID NO: 81294

SEQ ID NO: 98795 - RNA, 64 nt, Homo Sapiens; identical to SEQ ID NO: 81295

SEQ ID NO: 98796 - RNA, 64 nt, Homo Sapiens; identical to SEQ ID NO: 81311

SEQ ID NO: 98797 - RNA, 64 nt, Homo Sapiens; identical to SEQ ID NO: 81312

SEQ ID NO: 98798 - RNA, 64 nt, Homo Sapiens; identical to SEQ ID NO: 81313

SEQ ID NO: 98799 - RNA, 64 nt, Homo Sapiens; identical to SEQ ID NO: 81314

SEQ ID NO: 98800 - RNA, 64 nt, Homo Sapiens; identical to SEQ ID NO: 81315

SEQ ID NO: 98801 - RNA, 64 nt, Homo Sapiens; identical to SEQ ID NO: 81413

SEQ ID NO: 98802 - RNA, 64 nt, Homo Sapiens; identical to SEQ ID NO: 81414

SEQ ID NO: 98803 - RNA, 64 nt, Homo Sapiens; identical to SEQ ID NO: 81424

SEQ ID NO: 98804 - RNA, 64 nt, Homo Sapiens; identical to SEQ ID NO: 81425

SEQ ID NO: 98805 - RNA, 64 nt, Homo Sapiens; identical to SEQ ID NO: 81444

SEQ ID NO: 98806 - RNA, 64 nt, Homo Sapiens; identical to SEQ ID NO: 81445

SEQ ID NO: 98807 - RNA, 64 nt, Homo Sapiens; identical to SEQ ID NO: 81449

SEQ ID NO: 98808 - RNA, 64 nt, Homo Sapiens; identical to SEQ ID NO: 81450

SEQ ID NO: 98809 - RNA, 64 nt, Homo Sapiens; identical to SEQ ID NO: 81554

SEQ ID NO: 98810 - RNA, 64 nt, Homo Sapiens; identical to SEQ ID NO: 81555

SEQ ID NO: 98811 - RNA, 64 nt, Homo Sapiens; identical to SEQ ID NO: 81577

SEQ ID NO: 98812 - RNA, 64 nt, Homo Sapiens; identical to SEQ ID NO: 81578

SEQ ID NO: 98813 - RNA, 64 nt, Homo Sapiens
gaaaaaaaaaugggaagauuaaaaagcacagggggaagaagaagagauuucggaggccauccug

SEQ ID NO: 98814 - RNA, 64 nt, Homo Sapiens
aaaaaaaugggaagauuaaaaagcacagggggaagaagaagagauuucggaggccauccugcca

SEQ ID NO: 98815 - RNA, 64 nt, Homo Sapiens
caaggugucuaguccagcucccauggaggguggggaagaagaagaagaacuucuagguccuaaa

SEQ ID NO: 98816 - RNA, 64 nt, Homo Sapiens
ggugucuaguccagcucccauggaggguggggaagaagaagaagaacuucuagguccuaaacua

SEQ ID NO: 98817 - RNA, 64 nt, Homo Sapiens
gucuaguccagcucccauggaggguggggaagaagaagaagaacuucuagguccuaaacuagaa

SEQ ID NO: 98818 - RNA, 64 nt, Homo Sapiens
agaagaagaacuucuagguccuaaacuagaagaggaagaagaagaggaaguaguugaaaaugau

SEQ ID NO: 98819 - RNA, 64 nt, Homo Sapiens
agaagaacuucuagguccuaaacuagaagaggaagaagaagaggaaguaguugaaaaugaugag

SEQ ID NO: 98820 - RNA, 64 nt, Homo Sapiens
gaaaagaaggguaguaaaaaauguagaaagggaagaagaagagauuuaaggaaggggcuucuua

SEQ ID NO: 98821 - RNA, 64 nt, Homo Sapiens
agagaaaagaaggguaguaauuaauguagaaagggaagaagaagggauuuaaggaaggggcuuc

SEQ ID NO: 98822 - RNA, 64 nt, Homo Sapiens
aaaacccaccaugccccagggaagaaaagaaggggaagaagaucaaagaagaaaagaagaaggg

SEQ ID NO: 98823 - RNA, 64 nt, Homo Sapiens
aaagaagaaaagaagaaggggaagaaaagaaggggaagaagaucauugaaaagaaggggaaggg

SEQ ID NO: 98824 - RNA, 64 nt, Homo Sapiens
aaggcccaccgugccccaggaggaccaagaagaggaagaagaccauguauugcaggaauuaaaa

SEQ ID NO: 98825 - RNA, 64 nt, Homo Sapiens
aagacccaucaugccccaggaguaccaagaaguggaagaagaccacuuauugcagaaauugaaa

SEQ ID NO: 98826 - RNA, 64 nt, Homo Sapiens
gacuaaaggucugguaaagggccaaaaagaaacagaagaagagagagucagcacuguccagaaa

SEQ ID NO: 98827 - RNA, 64 nt, Homo Sapiens
aggcgacaucaagaaggaaaaucagaaaaagcaagaagaagaaacagaacaugcugagcagaac

SEQ ID NO: 98828 - RNA, 64 nt, Homo Sapiens
uuauuccccaucuuccaaggguugaauucuggaggaagaagacacauuccuaguuccccgugaa

SEQ ID NO: 98829 - RNA, 64 nt, Homo Sapiens
uuuauggcauuuuuuuaaagaugcccuaaguguugaagaagaguuugcaaaugcaacaaaauau

SEQ ID NO: 98830 - RNA, 64 nt, Homo Sapiens
aucuagcuuguauccccacaucaugagaaagagggaagaagaagaagggaugaugugugguaga

SEQ ID NO: 98831 - RNA, 64 nt, Homo Sapiens
uagcuuguauccccacaucaugagaaagagggaagaagaagaagggaugaugugugguagagaa

SEQ ID NO: 98832 - RNA, 64 nt, Homo Sapiens
gcuccagccccagugggguacuguacaguuaacugaagaagaauuuuaaagacgauuugaacaa

SEQ ID NO: 98833 - RNA, 64 nt, Homo Sapiens
uagcuguccuuuaacaccgcagaacccccucccagaagaagagcgaucccucggacgguccggg

SEQ ID NO: 98834 - RNA, 64 nt, Homo Sapiens
gaaacaaagccagagaaaaggggaaggggaagaggaagaagaguaacgauggaggaaggugaag

SEQ ID NO: 98835 - RNA, 64 nt, Homo Sapiens
ugucccaagcuuuccuugagaaaaacuagaaucugaagaagaugaaccagcccgcucaaugcag

SEQ ID NO: 98836 - RNA, 64 nt, Homo Sapiens
ucauggcauugccucagcacuguuaggugcucuugaagaagaugguuaagguuccauaauaaac

SEQ ID NO: 98837 - RNA, 64 nt, Homo Sapiens
ggaagcaggaucccacugagauuuaucuucaggugaagaagagagagcucaucucuagcaagga

SEQ ID NO: 98838 - RNA, 64 nt, Homo Sapiens
aaaguuucaguugugguagaaguccuguaaagaagaagaagaaauucauuuuuagauuuuguug

SEQ ID NO: 98839 - RNA, 64 nt, Homo Sapiens
aaaaaaguuucaguugugguuugaguccuguaaagaagaagaaguaguucauuuuuagauuuug

SEQ ID NO: 98840 - RNA, 64 nt, Homo Sapiens
ggguaggaggaggucagguuccccuggcugggaagaagaagauggccugugaguggacagagca

SEQ ID NO: 98841 - RNA, 64 nt, Homo Sapiens
augggguaggaggaggucaggcaccccuggcugggaagaagaagagggccugugaguggacaga

SEQ ID NO: 98842 - RNA, 64 nt, Homo Sapiens
gcgaugggucuccaggcaaguccccguccaaaaagaagaagaaguuccguaccccguccuuucu

SEQ ID NO: 98843 - RNA, 64 nt, Homo Sapiens
aaaagaagaagaaguuccguaccccguccuuucugaagaagagcaagaagaagagugacuccug

SEQ ID NO: 98844 - RNA, 64 nt, Homo Sapiens
aguuccguaccccguccuuucugaagaagagcaagaagaagagugacuccugaaagcccugcgc

SEQ ID NO: 98845 - RNA, 64 nt, Homo Sapiens
aggaaaagagaugaaguggccugaagggucgucggaagaagaacuagaagcuuuugaaaacaga

SEQ ID NO: 98846 - RNA, 64 nt, Homo Sapiens
aacgaagacaacagguaaccccaaagcugcucuugaagaagaaaacagauaaaagaagcagaag

SEQ ID NO: 98847 - RNA, 64 nt, Homo Sapiens
gagagcaagaaggaaagauuaaaaaaaaaaagaagaagaagaagugcuccaggaucuuugacug

SEQ ID NO: 98848 - RNA, 64 nt, Homo Sapiens
aaggagagcaagaaggaaagcugaaaaaaaaaaagaagaagaagauaugcuccaggaucuuuga

SEQ ID NO: 98849 - RNA, 64 nt, Homo Sapiens
gaaacgccuguauauccugguuaagagcgcccgagaagaagaauauacucauccugauaaucuc

SEQ ID NO: 98850 - RNA, 64 nt, Homo Sapiens
uggaaacuuaaauucuagccgugucagcuaaaaggaagaagaaagcccucaccuguggaauuug

SEQ ID NO: 98851 - RNA, 64 nt, Homo Sapiens
agaagagagacaaagaucacuacagaccaaaacagaagaagaagaaaaaaaagaaaaagaaauc

SEQ ID NO: 98852 - RNA, 64 nt, Homo Sapiens
agagagacaaagaucacuacagaccaaaacagaagaagaagaaaaaaaagaaaaagaaaucuaa

SEQ ID NO: 98853 - RNA, 64 nt, Homo Sapiens
ugggagcucagaugaugaugauguuaguaguuuggaagaagaacaagaauuccacaugagaagu

SEQ ID NO: 98854 - RNA, 64 nt, Homo Sapiens
uccccuguaagaugucacugauacaaugggggaagaagaagaaguaaacauaaaaggaggagac

SEQ ID NO: 98855 - RNA, 64 nt, Homo Sapiens
aaguccccuguaagaugucagacauacaaugggggaagaagaagagauaaacauaaaaggagga

SEQ ID NO: 98856 - RNA, 64 nt, Homo Sapiens
aaaacaaaacaaacaaaugaaaaacguuuaaaaagaagaagaagaaaaaaaacaagaacaagca

SEQ ID NO: 98857 - RNA, 64 nt, Homo Sapiens
acaaaacaaacaaaugaaaaacguuuaaaaagaagaagaagaaaaaaaacaagaacaagcagca

SEQ ID NO: 98858 - RNA, 64 nt, Homo Sapiens
accuucccacauccacgaggacuuuuacucucucgaagaagagguuuacuuuucuuuuuuuuua

SEQ ID NO: 98859 - RNA, 64 nt, Homo Sapiens
uauaucuuccagauuuuguuuguguuaauauuuagaagaagauguuuuuaguuacagaagcagu

SEQ ID NO: 98860 - RNA, 64 nt, Homo Sapiens
cucaaaaauaaaauaaaaaaagaaagaaagaaaagaagaagaaaagagaagaaggagaaggaga

SEQ ID NO: 98861 - RNA, 64 nt, Homo Sapiens
agaaggagaugaaggaggaggaggaggagaaggagaagaagaagaagaagaagaccacaaaaga

SEQ ID NO: 98862 - RNA, 64 nt, Homo Sapiens
aggagaugaaggaggaggaggaggagaaggagaagaagaagaagaagaagaccacaaaagacau

SEQ ID NO: 98863 - RNA, 64 nt, Homo Sapiens
agaugaaggaggaggaggaggagaaggagaagaagaagaagaagaagaccacaaaagacaugac

SEQ ID NO: 98864 - RNA, 64 nt, Homo Sapiens
ugaaggaggaggaggaggagaaggagaagaagaagaagaagaagaccacaaaagacaugacuau

SEQ ID NO: 98865 - RNA, 64 nt, Homo Sapiens
aggaggaggaggaggagaaggagaagaagaagaagaagaagaccacaaaagacaugacuaucca

SEQ ID NO: 98866 - RNA, 64 nt, Homo Sapiens
uugguagagaaggagcagaaagauguguuuuugggaagaagaagaccucuaggaggagcuagua

SEQ ID NO: 98867 - RNA, 64 nt, Homo Sapiens
guagagaaggagcagaaagauguguuuuugggaagaagaagaccucuaggaggagcuaguagga

SEQ ID NO: 98868 - RNA, 64 nt, Homo Sapiens
aagaagguagaguagaggccaggaagaagaaagagaagaagaaaaagaggauccugaacggaaa

SEQ ID NO: 98869 - RNA, 64 nt, Homo Sapiens
gagaagaagaaaaagaagguccugaacggaaaaggaagaagaaaaaaagaaaaaagaagaggau

SEQ ID NO: 98870 - RNA, 64 nt, Homo Sapiens
aagaaaaaagaagaggauccgauucagaucacaagaagaagaaacuccuacagaaacaccaucu

SEQ ID NO: 98871 - RNA, 64 nt, Homo Sapiens
ccaauguacuguggucucuuuccuaaauuccccugaagaagaaauuccguauggagcucuggac

SEQ ID NO: 98872 - RNA, 64 nt, Homo Sapiens
cacacucccagcuggcccaguuugugcaugaggugaagaagagccccuuuggcaaggauguucg

SEQ ID NO: 98873 - RNA, 64 nt, Homo Sapiens
caacgaccgcuguguggacaugcagagaagcagagaagaagaaaggagcugaggaggagaagcc

SEQ ID NO: 98874 - RNA, 64 nt, Homo Sapiens
agaaggguggccugcugggccgucuggcugccaggaagaagauauuccaggaaccuaagagcgc

SEQ ID NO: 98875 - RNA, 64 nt, Homo Sapiens
uugggagggggagaaaaggaaaagaaaaaaaaaagaagaagaagaagaaaagagaagaagaaaa

SEQ ID NO: 98876 - RNA, 64 nt, Homo Sapiens
ggagggggagaaaaggaaaagaaaaaaaaaagaagaagaagaagaaaagagaagaagaaaaaaa

SEQ ID NO: 98877 - RNA, 64 nt, Homo Sapiens
gggggagaaaaggaaaagaaaaaaaaaagaagaagaagaagaaaagagaagaagaaaaaaacga

SEQ ID NO: 98878 - RNA, 64 nt, Homo Sapiens
aaaagaaaaaaaaaagaagaagaagaagaaaagagaagaagaaaaaaacgaaaacagucaacca

SEQ ID NO: 98879 - RNA, 64 nt, Homo Sapiens
aggagucagcucugacaaugaagaugaugaugaugaagaagaugggaauuaccuucaucccucu

SEQ ID NO: 98880 - RNA, 64 nt, Homo Sapiens
uaggccuucgagcaaaagcaaagauccaccgagagaagaagagaaagaaaagaaaaagaaaaag

SEQ ID NO: 98881 - RNA, 64 nt, Homo Sapiens
guaggaagcggacccgcuccagaaguccccacgagaagaagaagaagaggcggucccggucgcg

SEQ ID NO: 98882 - RNA, 64 nt, Homo Sapiens
agaaacucuugccuuucagaaguccccacgagaagaagaagaagaggcggucccggucgcggac

SEQ ID NO: 98883 - RNA, 64 nt, Homo Sapiens
aacucuugccuuucagaaguccccacgagaagaagaagaagaggcggucccggucgcggaccaa

SEQ ID NO: 98884 - RNA, 64 nt, Homo Sapiens
agaaaaaagucaauuguucagguacaccaaagaggaagaagagcuguggaggccacccucuaca

SEQ ID NO: 98885 - RNA, 64 nt, Homo Sapiens
gugggauucagagugcuuagucugcucacugggagaagaagaguuccugcgcaugcaagcccug

SEQ ID NO: 98886 - RNA, 64 nt, Homo Sapiens
cagaagccuuugauauugccaugaaggggguggggaagaagacagaacaucauuacuuaugaug

SEQ ID NO: 98887 - RNA, 64 nt, Homo Sapiens
uccgugagaacaucauuacuucauugucuuugaggaagaagaugaaggcaaaagaaagaaccac

SEQ ID NO: 98888 - RNA, 64 nt, Homo Sapiens
ucucaaaugaggaacugaugugcugcagucccaugaagaagaucugaggcugcuguggaccagu

SEQ ID NO: 98889 - RNA, 64 nt, Homo Sapiens
uggccugaguguguucaggcaugaacagcauguggaagaagauuaggagcucaaaccagcacua

SEQ ID NO: 98890 - RNA, 64 nt, Homo Sapiens
uuuguccuuucauguaacuuuuuuauuuuaagaggaagaagaagaaaggggcacacacacacaa

SEQ ID NO: 98891 - RNA, 64 nt, Homo Sapiens
guccuuucauguaacuuuuuuauuuuaagaggaagaagaagaaaggggcacacacacacaauac

SEQ ID NO: 98892 - RNA, 64 nt, Homo Sapiens
cacaaaucucuaccucccauagagagaagaagaagaagaagagaaaaaaaaaaaaaagagagag

SEQ ID NO: 98893 - RNA, 64 nt, Homo Sapiens
agacacaaaucucuaccuccgagagagagaagaagaagaagaagggaaaaaaaaaaaaaagaga

SEQ ID NO: 98894 - RNA, 64 nt, Homo Sapiens
aagagacacaaaucucuaccagagagagagagaagaagaagaagauuggaaaaaaaaaaaaaag

SEQ ID NO: 98895 - RNA, 64 nt, Homo Sapiens
aagaagagacacaaaucucuaagagagagagagagaagaagaagcugauuggaaaaaaaaaaaa

SEQ ID NO: 98896 - RNA, 64 nt, Homo Sapiens
cacacacucaggaggaaaagaaaaaacaaaggcagaagaagaagaagaagaaauaaaaacccac

SEQ ID NO: 98897 - RNA, 64 nt, Homo Sapiens
acacucaggaggaaaagaaaaaacaaaggcagaagaagaagaagaagaaauaaaaacccaccca

SEQ ID NO: 98898 - RNA, 64 nt, Homo Sapiens
cucaggaggaaaagaaaaaacaaaggcagaagaagaagaagaagaaauaaaaacccacccaagc

SEQ ID NO: 98899 - RNA, 64 nt, Homo Sapiens
aggaggaaaagaaaaaacaaaggcagaagaagaagaagaagaaauaaaaacccacccaagcaag

SEQ ID NO: 98900 - RNA, 64 nt, Homo Sapiens
cucucaucucauuagacauuggagaguuuacacugaagaagagucuuuucaauaaaguagaaag

SEQ ID NO: 98901 - RNA, 64 nt, Homo Sapiens
ucauuaugacucugacuauucuugguacuucucagaagaagaaucuuagaguguuuuucauuau

SEQ ID NO: 98902 - RNA, 64 nt, Homo Sapiens
cuccagccaguucugcugcagauguccuuccugggaagaagaagucacgcuggcauaucaggaa

SEQ ID NO: 98903 - RNA, 64 nt, Homo Sapiens
caccagccacaggggcagguauguccuuccuggggaagaagaagcacagugacaccucaggaag

SEQ ID NO: 98904 - RNA, 64 nt, Homo Sapiens
gugccuggggcucuggggguuccccugugaagaagaagaagaugcccagaacauccagagucug

SEQ ID NO: 98905 - RNA, 64 nt, Homo Sapiens
auggugccuggggcucugggcuguccccugugaagaagaagaagcuccccagaacauccagagu

SEQ ID NO: 98906 - RNA, 64 nt, Homo Sapiens
aagauggugccuggggcucuagucuguccccugugaagaagaagucucuccccagaacauccag

SEQ ID NO: 98907 - RNA, 64 nt, Homo Sapiens
gaccagaaaauggcaaugauaggagacugacauagaagaagaaugcuucccuaggaaaaagguc

SEQ ID NO: 98908 - RNA, 64 nt, Homo Sapiens
ccuaggaaaaaggucgcuggcuuuggugcaagaggaagaagaauguuccacuggaagccugagc

SEQ ID NO: 98909 - RNA, 64 nt, Homo Sapiens
agagugagacccuauuucaaaaaaauaaaaauuggaagaagagcuuaaaaaagauaagauuuua

SEQ ID NO: 98910 - RNA, 64 nt, Homo Sapiens
aaacugcggaauacaauguccuuccauagcaugggaagaagaaaauaaacaucuccuuuccaac

SEQ ID NO: 98911 - RNA, 64 nt, Homo Sapiens
uauauuuuucaaauccuugaaucuuuuuuggguugaagaagaagaaagcauagcuuuagaauag

SEQ ID NO: 98912 - RNA, 64 nt, Homo Sapiens
auuuuucaaauccuugaaucuuuuuuggguugaagaagaagaaagcauagcuuuagaauagaga

SEQ ID NO: 98913 - RNA, 64 nt, Homo Sapiens; identical to SEQ ID NO: 88200

SEQ ID NO: 98914 - RNA, 64 nt, Homo Sapiens; identical to SEQ ID NO: 88201

SEQ ID NO: 98915 - RNA, 64 nt, Homo Sapiens; identical to SEQ ID NO: 88202

SEQ ID NO: 98916 - RNA, 64 nt, Homo Sapiens; identical to SEQ ID NO: 88203

SEQ ID NO: 98917 - RNA, 64 nt, Homo Sapiens; identical to SEQ ID NO: 88204

SEQ ID NO: 98918 - RNA, 64 nt, Homo Sapiens; identical to SEQ ID NO: 88205

SEQ ID NO: 98919 - RNA, 64 nt, Homo Sapiens; identical to SEQ ID NO: 88206

SEQ ID NO: 98920 - RNA, 64 nt, Homo Sapiens; identical to SEQ ID NO: 88207

SEQ ID NO: 98921 - RNA, 64 nt, Homo Sapiens; identical to SEQ ID NO: 88208

SEQ ID NO: 98922 - RNA, 64 nt, Homo Sapiens; identical to SEQ ID NO: 88209

SEQ ID NO: 98923 - RNA, 64 nt, Homo Sapiens; identical to SEQ ID NO: 88210

SEQ ID NO: 98924 - RNA, 64 nt, Homo Sapiens; identical to SEQ ID NO: 88211

SEQ ID NO: 98925 - RNA, 64 nt, Homo Sapiens; identical to SEQ ID NO: 88212

SEQ ID NO: 98926 - RNA, 64 nt, Homo Sapiens; identical to SEQ ID NO: 88213

SEQ ID NO: 98927 - RNA, 64 nt, Homo Sapiens; identical to SEQ ID NO: 88214

SEQ ID NO: 98928 - RNA, 64 nt, Homo Sapiens; identical to SEQ ID NO: 88215

SEQ ID NO: 98929 - RNA, 64 nt, Homo Sapiens; identical to SEQ ID NO: 88216

SEQ ID NO: 98930 - RNA, 64 nt, Homo Sapiens; identical to SEQ ID NO: 88217

SEQ ID NO: 98931 - RNA, 64 nt, Homo Sapiens; identical to SEQ ID NO: 88218

SEQ ID NO: 98932 - RNA, 64 nt, Homo Sapiens; identical to SEQ ID NO: 88219

SEQ ID NO: 98933 - RNA, 64 nt, Homo Sapiens; identical to SEQ ID NO: 88220

SEQ ID NO: 98934 - RNA, 64 nt, Homo Sapiens; identical to SEQ ID NO: 88221

SEQ ID NO: 98935 - RNA, 64 nt, Homo Sapiens; identical to SEQ ID NO: 88222

SEQ ID NO: 98936 - RNA, 64 nt, Homo Sapiens; identical to SEQ ID NO: 88223

SEQ ID NO: 98937 - RNA, 64 nt, Homo Sapiens; identical to SEQ ID NO: 88224

SEQ ID NO: 98938 - RNA, 64 nt, Homo Sapiens; identical to SEQ ID NO: 88225

SEQ ID NO: 98939 - RNA, 64 nt, Homo Sapiens; identical to SEQ ID NO: 88226

SEQ ID NO: 98940 - RNA, 64 nt, Homo Sapiens; identical to SEQ ID NO: 88227

SEQ ID NO: 98941 - RNA, 64 nt, Homo Sapiens; identical to SEQ ID NO: 88228

SEQ ID NO: 98942 - RNA, 64 nt, Homo Sapiens; identical to SEQ ID NO: 88229

SEQ ID NO: 98943 - RNA, 64 nt, Homo Sapiens; identical to SEQ ID NO: 88230

SEQ ID NO: 98944 - RNA, 64 nt, Homo Sapiens; identical to SEQ ID NO: 88231

SEQ ID NO: 98945 - RNA, 64 nt, Homo Sapiens; identical to SEQ ID NO: 88232

SEQ ID NO: 98946 - RNA, 64 nt, Homo Sapiens; identical to SEQ ID NO: 88233

SEQ ID NO: 98947 - RNA, 64 nt, Homo Sapiens; identical to SEQ ID NO: 88234

SEQ ID NO: 98948 - RNA, 64 nt, Homo Sapiens; identical to SEQ ID NO: 88235

SEQ ID NO: 98949 - RNA, 64 nt, Homo Sapiens; identical to SEQ ID NO: 88236

SEQ ID NO: 98950 - RNA, 64 nt, Homo Sapiens; identical to SEQ ID NO: 88237

SEQ ID NO: 98951 - RNA, 64 nt, Homo Sapiens; identical to SEQ ID NO: 88238

SEQ ID NO: 98952 - RNA, 64 nt, Homo Sapiens; identical to SEQ ID NO: 88239

SEQ ID NO: 98953 - RNA, 64 nt, Homo Sapiens; identical to SEQ ID NO: 88240

SEQ ID NO: 98954 - RNA, 64 nt, Homo Sapiens; identical to SEQ ID NO: 88241

SEQ ID NO: 98955 - RNA, 64 nt, Homo Sapiens; identical to SEQ ID NO: 88242

SEQ ID NO: 98956 - RNA, 64 nt, Homo Sapiens; identical to SEQ ID NO: 88243

SEQ ID NO: 98957 - RNA, 64 nt, Homo Sapiens; identical to SEQ ID NO: 88244

SEQ ID NO: 98958 - RNA, 64 nt, Homo Sapiens; identical to SEQ ID NO: 88245

SEQ ID NO: 98959 - RNA, 64 nt, Homo Sapiens; identical to SEQ ID NO: 88246

SEQ ID NO: 98960 - RNA, 64 nt, Homo Sapiens; identical to SEQ ID NO: 88247

SEQ ID NO: 98961 - RNA, 64 nt, Homo Sapiens; identical to SEQ ID NO: 88248

SEQ ID NO: 98962 - RNA, 61 nt, Homo Sapiens; identical to SEQ ID NO: 88249

SEQ ID NO: 98963 - RNA, 64 nt, Homo Sapiens; identical to SEQ ID NO: 88250

SEQ ID NO: 98964 - RNA, 64 nt, Homo Sapiens; identical to SEQ ID NO: 88251

SEQ ID NO: 98965 - RNA, 64 nt, Homo Sapiens; identical to SEQ ID NO: 88252

SEQ ID NO: 98966 - RNA, 64 nt, Homo Sapiens; identical to SEQ ID NO: 88253

SEQ ID NO: 98967 - RNA, 64 nt, Homo Sapiens; identical to SEQ ID NO: 88254

SEQ ID NO: 98968 - RNA, 64 nt, Homo Sapiens; identical to SEQ ID NO: 88255

SEQ ID NO: 98969 - RNA, 64 nt, Homo Sapiens; identical to SEQ ID NO: 88256

SEQ ID NO: 98970 - RNA, 64 nt, Homo Sapiens; identical to SEQ ID NO: 45833

SEQ ID NO: 98971 - RNA, 64 nt, Homo Sapiens; identical to SEQ ID NO: 45834

SEQ ID NO: 98972 - RNA, 64 nt, Homo Sapiens; identical to SEQ ID NO: 45835

SEQ ID NO: 98973 - RNA, 64 nt, Homo Sapiens; identical to SEQ ID NO: 45836

SEQ ID NO: 98974 - RNA, 64 nt, Homo Sapiens; identical to SEQ ID NO: 45837

SEQ ID NO: 98975 - RNA, 64 nt, Homo Sapiens; identical to SEQ ID NO: 45838

SEQ ID NO: 98976 - RNA, 64 nt, Homo Sapiens; identical to SEQ ID NO: 45839

SEQ ID NO: 98977 - RNA, 64 nt, Homo Sapiens; identical to SEQ ID NO: 45840

SEQ ID NO: 98978 - RNA, 64 nt, Homo Sapiens; identical to SEQ ID NO: 38934

SEQ ID NO: 98979 - RNA, 64 nt, Homo Sapiens; identical to SEQ ID NO: 38935

SEQ ID NO: 98980 - RNA, 64 nt, Homo Sapiens; identical to SEQ ID NO: 38936

SEQ ID NO: 98981 - RNA, 64 nt, Homo Sapiens; identical to SEQ ID NO: 38937

SEQ ID NO: 98982 - RNA, 64 nt, Homo Sapiens; identical to SEQ ID NO: 38938

SEQ ID NO: 98983 - RNA, 64 nt, Homo Sapiens; identical to SEQ ID NO: 38939

SEQ ID NO: 98984 - RNA, 64 nt, Homo Sapiens; identical to SEQ ID NO: 38940

SEQ ID NO: 98985 - RNA, 64 nt, Homo Sapiens; identical to SEQ ID NO: 38941

SEQ ID NO: 98986 - RNA, 64 nt, Homo Sapiens; identical to SEQ ID NO: 38942

SEQ ID NO: 98987 - RNA, 64 nt, Homo Sapiens; identical to SEQ ID NO: 38943

SEQ ID NO: 98988 - RNA, 64 nt, Homo Sapiens; identical to SEQ ID NO: 38944

SEQ ID NO: 98989 - RNA, 64 nt, Homo Sapiens; identical to SEQ ID NO: 38945

SEQ ID NO: 98990 - RNA, 64 nt, Homo Sapiens; identical to SEQ ID NO: 38946

SEQ ID NO: 98991 - RNA, 64 nt, Homo Sapiens; identical to SEQ ID NO: 38947

SEQ ID NO: 98992 - RNA, 64 nt, Homo Sapiens; identical to SEQ ID NO: 38948

SEQ ID NO: 98993 - RNA, 64 nt, Homo Sapiens; identical to SEQ ID NO: 38949

SEQ ID NO: 98994 - RNA, 64 nt, Homo Sapiens; identical to SEQ ID NO: 38950

SEQ ID NO: 98995 - RNA, 64 nt, Homo Sapiens; identical to SEQ ID NO: 38951

SEQ ID NO: 98996 - RNA, 64 nt, Homo Sapiens; identical to SEQ ID NO: 38952

SEQ ID NO: 98997 - RNA, 64 nt, Homo Sapiens; identical to SEQ ID NO: 38953

SEQ ID NO: 98998 - RNA, 64 nt, Homo Sapiens; identical to SEQ ID NO: 38954

SEQ ID NO: 98999 - RNA, 64 nt, Homo Sapiens; identical to SEQ ID NO: 38955

SEQ ID NO: 99000 - RNA, 64 nt, Homo Sapiens; identical to SEQ ID NO: 38956

SEQ ID NO: 99001 - RNA, 64 nt, Homo Sapiens; identical to SEQ ID NO: 38957

SEQ ID NO: 99002 - RNA, 64 nt, Homo Sapiens; identical to SEQ ID NO: 38958

SEQ ID NO: 99003 - RNA, 64 nt, Homo Sapiens; identical to SEQ ID NO: 38959

SEQ ID NO: 99004 - RNA, 64 nt, Homo Sapiens; identical to SEQ ID NO: 38960

SEQ ID NO: 99005 - RNA, 64 nt, Homo Sapiens; identical to SEQ ID NO: 38961

SEQ ID NO: 99006 - RNA, 64 nt, Homo Sapiens; identical to SEQ ID NO: 38962

SEQ ID NO: 99007 - RNA, 64 nt, Homo Sapiens; identical to SEQ ID NO: 38963

SEQ ID NO: 99008 - RNA, 64 nt, Homo Sapiens; identical to SEQ ID NO: 38964

SEQ ID NO: 99009 - RNA, 64 nt, Homo Sapiens; identical to SEQ ID NO: 38965

SEQ ID NO: 99010 - RNA, 64 nt, Homo Sapiens; identical to SEQ ID NO: 38966

SEQ ID NO: 99011 - RNA, 64 nt, Homo Sapiens; identical to SEQ ID NO: 38967

SEQ ID NO: 99012 - RNA, 64 nt, Homo Sapiens; identical to SEQ ID NO: 38968

SEQ ID NO: 99013 - RNA, 64 nt, Homo Sapiens; identical to SEQ ID NO: 38969

SEQ ID NO: 99014 - RNA, 64 nt, Homo Sapiens; identical to SEQ ID NO: 38970

SEQ ID NO: 99015 - RNA, 64 nt, Homo Sapiens; identical to SEQ ID NO: 38971

SEQ ID NO: 99016 - RNA, 64 nt, Homo Sapiens; identical to SEQ ID NO: 38972

SEQ ID NO: 99017 - RNA, 64 nt, Homo Sapiens; identical to SEQ ID NO: 38973

SEQ ID NO: 99018 - RNA, 64 nt, Homo Sapiens
ggcggcucuggugccccucccauccucccagcaugcucuagagaggggaggcggcucuggugcc

SEQ ID NO: 99019 - RNA, 64 nt, Homo Sapiens
ggcggcucuggugcccauccccgucucccagcaugcucuagagaccuuggagauguacuggugu

SEQ ID NO: 99020 - RNA, 64 nt, Homo Sapiens
auggcuugguaaccuguuugguuuggacaguauagcucuagagcccacgugucuagcggcuacc

SEQ ID NO: 99021 - RNA, 64 nt, Homo Sapiens
cgggcaguccaauaacuuuuuccugagcagguaggcucuagaguuucugaaggcuugccaggac

SEQ ID NO: 99022 - RNA, 64 nt, Homo Sapiens
auuccagagccuccugcagagccagcgaaggaaagcucuagagggagacgacuccaccgccucu

SEQ ID NO: 99023 - RNA, 64 nt, Homo Sapiens
uuggggcuguugugagucgguggcaggaacgugggcucuagacugugcauucaggcucuccuac

SEQ ID NO: 99024 - RNA, 64 nt, Homo Sapiens
aaggcucugagagucuagauucucuggcuguaaggcucuagaucauaaggcuucaaaauguuau

SEQ ID NO: 99025 - RNA, 64 nt, Homo Sapiens
ucuuguauaagauccuagauccuaagggucgaaagcucuagaaucugcaauucaaaaguuccaa

SEQ ID NO: 99026 - RNA, 64 nt, Homo Sapiens
cugccacacagggucugcaaaggcuagguacacagcucuagacagcuuugcucuuugguagaaa

SEQ ID NO: 99027 - RNA, 64 nt, Homo Sapiens
gagagaagagacaaacaccuauguucagaagguugcucuagauuuauuuuugacaguguugaaa

SEQ ID NO: 99028 - RNA, 64 nt, Homo Sapiens; identical to SEQ ID NO: 98813

SEQ ID NO: 99029 - RNA, 64 nt, Homo Sapiens; identical to SEQ ID NO: 98814

SEQ ID NO: 99030 - RNA, 64 nt, Homo Sapiens; identical to SEQ ID NO: 98815

SEQ ID NO: 99031 - RNA, 64 nt, Homo Sapiens; identical to SEQ ID NO: 98816

SEQ ID NO: 99032 - RNA, 64 nt, Homo Sapiens; identical to SEQ ID NO: 98817

SEQ ID NO: 99033 - RNA, 64 nt, Homo Sapiens; identical to SEQ ID NO: 98818

SEQ ID NO: 99034 - RNA, 64 nt, Homo Sapiens; identical to SEQ ID NO: 98819

SEQ ID NO: 99035 - RNA, 64 nt, Homo Sapiens; identical to SEQ ID NO: 98820

SEQ ID NO: 99036 - RNA, 64 nt, Homo Sapiens; identical to SEQ ID NO: 98821

SEQ ID NO: 99037 - RNA, 64 nt, Homo Sapiens; identical to SEQ ID NO: 98822

SEQ ID NO: 99038 - RNA, 64 nt, Homo Sapiens; identical to SEQ ID NO: 98823

SEQ ID NO: 99039 - RNA, 64 nt, Homo Sapiens; identical to SEQ ID NO: 98824

SEQ ID NO: 99040 - RNA, 64 nt, Homo Sapiens; identical to SEQ ID NO: 98825

SEQ ID NO: 99041 - RNA, 64 nt, Homo Sapiens; identical to SEQ ID NO: 98826

SEQ ID NO: 99042 - RNA, 64 nt, Homo Sapiens; identical to SEQ ID NO: 98827

SEQ ID NO: 99043 - RNA, 64 nt, Homo Sapiens; identical to SEQ ID NO: 98828

SEQ ID NO: 99044 - RNA, 64 nt, Homo Sapiens; identical to SEQ ID NO: 98829

SEQ ID NO: 99045 - RNA, 64 nt, Homo Sapiens; identical to SEQ ID NO: 98830

SEQ ID NO: 99046 - RNA, 64 nt, Homo Sapiens; identical to SEQ ID NO: 98831

SEQ ID NO: 99047 - RNA, 64 nt, Homo Sapiens; identical to SEQ ID NO: 98832

SEQ ID NO: 99048 - RNA, 64 nt, Homo Sapiens; identical to SEQ ID NO: 98833

SEQ ID NO: 99049 - RNA, 64 nt, Homo Sapiens; identical to SEQ ID NO: 98834

SEQ ID NO: 99050 - RNA, 64 nt, Homo Sapiens; identical to SEQ ID NO: 98835

SEQ ID NO: 99051 - RNA, 64 nt, Homo Sapiens; identical to SEQ ID NO: 98836

SEQ ID NO: 99052 - RNA, 64 nt, Homo Sapiens; identical to SEQ ID NO: 98837

SEQ ID NO: 99053 - RNA, 64 nt, Homo Sapiens; identical to SEQ ID NO: 98838

SEQ ID NO: 99054 - RNA, 64 nt, Homo Sapiens; identical to SEQ ID NO: 98839

SEQ ID NO: 99055 - RNA, 64 nt, Homo Sapiens; identical to SEQ ID NO: 98840

SEQ ID NO: 99056 - RNA, 64 nt, Homo Sapiens; identical to SEQ ID NO: 98841

SEQ ID NO: 99057 - RNA, 64 nt, Homo Sapiens; identical to SEQ ID NO: 98842

SEQ ID NO: 99058 - RNA, 64 nt, Homo Sapiens; identical to SEQ ID NO: 98843

SEQ ID NO: 99059 - RNA, 64 nt, Homo Sapiens; identical to SEQ ID NO: 98844

SEQ ID NO: 99060 - RNA, 64 nt, Homo Sapiens; identical to SEQ ID NO: 98845

SEQ ID NO: 99061 - RNA, 64 nt, Homo Sapiens; identical to SEQ ID NO: 98846

SEQ ID NO: 99062 - RNA, 64 nt, Homo Sapiens; identical to SEQ ID NO: 98847

SEQ ID NO: 99063 - RNA, 64 nt, Homo Sapiens; identical to SEQ ID NO: 98848

SEQ ID NO: 99064 - RNA, 64 nt, Homo Sapiens; identical to SEQ ID NO: 98849

SEQ ID NO: 99065 - RNA, 64 nt, Homo Sapiens; identical to SEQ ID NO: 98850

SEQ ID NO: 99066 - RNA, 64 nt, Homo Sapiens; identical to SEQ ID NO: 98851

SEQ ID NO: 99067 - RNA, 64 nt, Homo Sapiens; identical to SEQ ID NO: 98852

SEQ ID NO: 99068 - RNA, 64 nt, Homo Sapiens; identical to SEQ ID NO: 98853

SEQ ID NO: 99069 - RNA, 64 nt, Homo Sapiens; identical to SEQ ID NO: 98854

SEQ ID NO: 99070 - RNA, 64 nt, Homo Sapiens; identical to SEQ ID NO: 98855

SEQ ID NO: 99071 - RNA, 64 nt, Homo Sapiens; identical to SEQ ID NO: 98856

SEQ ID NO: 99072 - RNA, 64 nt, Homo Sapiens; identical to SEQ ID NO: 98857

SEQ ID NO: 99073 - RNA, 64 nt, Homo Sapiens; identical to SEQ ID NO: 98858

SEQ ID NO: 99074 - RNA, 64 nt, Homo Sapiens; identical to SEQ ID NO: 98859

SEQ ID NO: 99075 - RNA, 64 nt, Homo Sapiens; identical to SEQ ID NO: 98860

SEQ ID NO: 99076 - RNA, 64 nt, Homo Sapiens; identical to SEQ ID NO: 98861

SEQ ID NO: 99077 - RNA, 64 nt, Homo Sapiens; identical to SEQ ID NO: 98862

SEQ ID NO: 99078 - RNA, 64 nt, Homo Sapiens; identical to SEQ ID NO: 98863

SEQ ID NO: 99079 - RNA, 64 nt, Homo Sapiens; identical to SEQ ID NO: 98864

SEQ ID NO: 99080 - RNA, 64 nt, Homo Sapiens; identical to SEQ ID NO: 98865

SEQ ID NO: 99081 - RNA, 64 nt, Homo Sapiens; identical to SEQ ID NO: 98866

SEQ ID NO: 99082 - RNA, 64 nt, Homo Sapiens; identical to SEQ ID NO: 98867

SEQ ID NO: 99083 - RNA, 64 nt, Homo Sapiens; identical to SEQ ID NO: 98868

SEQ ID NO: 99084 - RNA, 64 nt, Homo Sapiens; identical to SEQ ID NO: 98869

SEQ ID NO: 99085 - RNA, 64 nt, Homo Sapiens; identical to SEQ ID NO: 98870

SEQ ID NO: 99086 - RNA, 64 nt, Homo Sapiens; identical to SEQ ID NO: 98871

SEQ ID NO: 99087 - RNA, 64 nt, Homo Sapiens; identical to SEQ ID NO: 98872

SEQ ID NO: 99088 - RNA, 64 nt, Homo Sapiens; identical to SEQ ID NO: 98873

SEQ ID NO: 99089 - RNA, 64 nt, Homo Sapiens; identical to SEQ ID NO: 98874

SEQ ID NO: 99090 - RNA, 64 nt, Homo Sapiens; identical to SEQ ID NO: 98875

SEQ ID NO: 99091 - RNA, 64 nt, Homo Sapiens; identical to SEQ ID NO: 98876

SEQ ID NO: 99092 - RNA, 64 nt, Homo Sapiens; identical to SEQ ID NO: 98877

SEQ ID NO: 99093 - RNA, 64 nt, Homo Sapiens; identical to SEQ ID NO: 98878

SEQ ID NO: 99094 - RNA, 64 nt, Homo Sapiens; identical to SEQ ID NO: 98879

SEQ ID NO: 99095 - RNA, 64 nt, Homo Sapiens; identical to SEQ ID NO: 98880

SEQ ID NO: 99096 - RNA, 64 nt, Homo Sapiens; identical to SEQ ID NO: 98881

SEQ ID NO: 99097 - RNA, 64 nt, Homo Sapiens; identical to SEQ ID NO: 98882

SEQ ID NO: 99098 - RNA, 64 nt, Homo Sapiens; identical to SEQ ID NO: 98883

SEQ ID NO: 99099 - RNA, 64 nt, Homo Sapiens; identical to SEQ ID NO: 98884

SEQ ID NO: 99100 - RNA, 64 nt, Homo Sapiens; identical to SEQ ID NO: 98885

SEQ ID NO: 99101 - RNA, 64 nt, Homo Sapiens; identical to SEQ ID NO: 98886

SEQ ID NO: 99102 - RNA, 64 nt, Homo Sapiens; identical to SEQ ID NO: 98887

SEQ ID NO: 99103 - RNA, 64 nt, Homo Sapiens; identical to SEQ ID NO: 98888

SEQ ID NO: 99104 - RNA, 64 nt, Homo Sapiens; identical to SEQ ID NO: 98889

SEQ ID NO: 99105 - RNA, 64 nt, Homo Sapiens; identical to SEQ ID NO: 98890

SEQ ID NO: 99106 - RNA, 64 nt, Homo Sapiens; identical to SEQ ID NO: 98891

SEQ ID NO: 99107 - RNA, 64 nt, Homo Sapiens; identical to SEQ ID NO: 98892

SEQ ID NO: 99108 - RNA, 64 nt, Homo Sapiens; identical to SEQ ID NO: 98893

SEQ ID NO: 99109 - RNA, 64 nt, Homo Sapiens; identical to SEQ ID NO: 98894

SEQ ID NO: 99110 - RNA, 64 nt, Homo Sapiens; identical to SEQ ID NO: 98895

SEQ ID NO: 99111 - RNA, 64 nt, Homo Sapiens; identical to SEQ ID NO: 98896

SEQ ID NO: 99112 - RNA, 64 nt, Homo Sapiens; identical to SEQ ID NO: 98897

SEQ ID NO: 99113 - RNA, 64 nt, Homo Sapiens; identical to SEQ ID NO: 98898

SEQ ID NO: 99114 - RNA, 64 nt, Homo Sapiens; identical to SEQ ID NO: 98899

SEQ ID NO: 99115 - RNA, 64 nt, Homo Sapiens; identical to SEQ ID NO: 98900

SEQ ID NO: 99116 - RNA, 64 nt, Homo Sapiens; identical to SEQ ID NO: 98901

SEQ ID NO: 99117 - RNA, 64 nt, Homo Sapiens; identical to SEQ ID NO: 98902

SEQ ID NO: 99118 - RNA, 64 nt, Homo Sapiens; identical to SEQ ID NO: 98903

SEQ ID NO: 99119 - RNA, 64 nt, Homo Sapiens; identical to SEQ ID NO: 98904

SEQ ID NO: 99120 - RNA, 64 nt, Homo Sapiens; identical to SEQ ID NO: 98905

SEQ ID NO: 99121 - RNA, 64 nt, Homo Sapiens; identical to SEQ ID NO: 98906

SEQ ID NO: 99122 - RNA, 64 nt, Homo Sapiens; identical to SEQ ID NO: 98907

SEQ ID NO: 99123 - RNA, 64 nt, Homo Sapiens; identical to SEQ ID NO: 98908

SEQ ID NO: 99124 - RNA, 64 nt, Homo Sapiens; identical to SEQ ID NO: 98909

SEQ ID NO: 99125 - RNA, 64 nt, Homo Sapiens; identical to SEQ ID NO: 98910

SEQ ID NO: 99126 - RNA, 64 nt, Homo Sapiens; identical to SEQ ID NO: 98911

SEQ ID NO: 99127 - RNA, 64 nt, Homo Sapiens; identical to SEQ ID NO: 98912

SEQ ID NO: 99128 - RNA, 64 nt, Homo Sapiens
gacaccucuuuccuuuagccagagaaugguucaaaugucuuacagaacuaagaucuuuuucaga

SEQ ID NO: 99129 - RNA, 64 nt, Homo Sapiens
accuguucgcauugguaaccugcugcuguauuucaugucuuaacggcuauuuugagguucauua

SEQ ID NO: 99130 - RNA, 64 nt, Homo Sapiens
uugugcaucugccucuuuugacguuggaagacacaugucuuaccccccaaagggagcccagcac

SEQ ID NO: 99131 - RNA, 64 nt, Homo Sapiens
aaauauauuuugcauuaaaugcauuucaaguuaaaugucuuaaauguauacauuagaugugugu

SEQ ID NO: 99132 - RNA, 64 nt, Homo Sapiens
cuuaauguaucaaacuguauaacuuggccgcuguaugucuuaaaaccugcuuuucaauguguug

SEQ ID NO: 99133 - RNA, 64 nt, Homo Sapiens
auucacuuaacaaacaaauuuuucugcuuuaaaaaugucuuauugucccaaguguacuauagcg

SEQ ID NO: 99134 - RNA, 64 nt, Homo Sapiens
ggcugugugacacacguaaggcgaucaaacuaaaaugucuuaauggacugaaagguuuaaggag

SEQ ID NO: 99135 - RNA, 64 nt, Homo Sapiens
gggacugaaagguuuaaggauuuguuuuauaaugaugucuuagagauaaaacuaaaggacuaaa

SEQ ID NO: 99136 - RNA, 64 nt, Homo Sapiens
agacuguacggugguguguuggagcuggcuuguaaugucuuaugagugacaaucguuaguuuga

SEQ ID NO: 99137 - RNA, 64 nt, Homo Sapiens
gauggcagucaucuagacauguaaaaugccaagaaugucuuagaauugcacaauuuagaauuua

SEQ ID NO: 99138 - RNA, 64 nt, Homo Sapiens
gauacuuguuucuguucaagucccacuuuaaauuaugucuuaggagacugaaaguggaaucuuc

SEQ ID NO: 99139 - RNA, 64 nt, Homo Sapiens
cacuaaauggauggccacaagaaaaauaaaguaaaugucuuaaauaauuuaaccauaaauuuuc

SEQ ID NO: 99140 - RNA, 64 nt, Homo Sapiens
agauuguucugcuuuuucuaccuacuucugguagaugucuuaugaaaacagauuuuacauaaug

SEQ ID NO: 99141 - RNA, 64 nt, Homo Sapiens
uuugaguuugaaaauguuaauggcuuuuauuaauaugucuuaaugguuugauuuuaaauauuuc

SEQ ID NO: 99142 - RNA, 64 nt, Homo Sapiens
ggacaggggucugaaguacacugggggaucauauaugucuuaguuucaacaguuugcccaggaa

SEQ ID NO: 99143 - RNA, 64 nt, Homo Sapiens
ggaaaugacaaguuuuugcuggacaggaauguaaaugucuuacugauggccaaguuuuuucucu

SEQ ID NO: 99144 - RNA, 64 nt, Homo Sapiens
auuaaccaauacuggaacugguaucuagcuacugaugucuuacuuugaguuuauuuaugcuuca

SEQ ID NO: 99145 - RNA, 64 nt, Homo Sapiens
guugaacaaaaauuauggcauuuaagaauuuaacaugucuuagcuguaaaaaugagaaaguguu

SEQ ID NO: 99146 - RNA, 64 nt, Homo Sapiens
aauuucuccuauuugcucuauuauuuucuagaaaaugucuuauguaaguuuuuuuauauuaguu

SEQ ID NO: 99147 - RNA, 64 nt, Homo Sapiens
gugaugagucucgacugucaaaaaggagagaucaaugucuuauucgcugacauacagaaugacg

SEQ ID NO: 99148 - RNA, 64 nt, Homo Sapiens
uagaaaccagauuaauagaaguagagguuuugggaugucuuaguguguuagguaaggguugggg

SEQ ID NO: 99149 - RNA, 64 nt, Homo Sapiens
aggcauuuuugacuaucacccaaauucuaagcauaugucuuaaaaaauaacuuguuuuguuugu

SEQ ID NO: 99150 - RNA, 64 nt, Homo Sapiens
uugggacuaacaacaugaucuucuuugaguuaaaccuaccuaaguagauuuuagguggguuccu

SEQ ID NO: 99151 - RNA, 64 nt, Homo Sapiens
cuuacuggcuucucaauuuucuuccuucucugccccuaccuaaaacauucuccucggaaauuac

SEQ ID NO: 99152 - RNA, 64 nt, Homo Sapiens
cgcuaaucgcaggugcaaacgagggaccuaagugccuaccuacuuaaugagagccuacaaaugg

SEQ ID NO: 99153 - RNA, 64 nt, Homo Sapiens
uaaauguuugaauggaggacgcacaaaagaaaucccuaccuaugcauaguugcugagaaucaaa

SEQ ID NO: 99154 - RNA, 64 nt, Homo Sapiens
uuaguuuuuuuuaaaaaaaaaaacaaagcaacaaauuaacuagauacagaauaauggagaacaa

SEQ ID NO: 99155 - RNA, 64 nt, Homo Sapiens
uguuuuugcauaacugguuuuguuuuuuugcagaauuaacuauaacaaucacuggcuaccgaag

SEQ ID NO: 99156 - RNA, 64 nt, Homo Sapiens
uuuguggcuugaguuuacaaccuuaaccaugauuauuaacuaagaguugcucuuuggcaauguc

SEQ ID NO: 99157 - RNA, 64 nt, Homo Sapiens
uguguacagaaaugaacguggucccagguucuaaauuaacuaaauuggggaaucgauuguaaaa

SEQ ID NO: 99158 - RNA, 64 nt, Homo Sapiens
guauuuuacaucccaguguacccuuuauuuuauuauuaacuaauuaacuaugagauuuuuaaaa

SEQ ID NO: 99159 - RNA, 64 nt, Homo Sapiens
caucccaguguacccuuuauuuuauuauuaacuaauuaacuaugagauuuuuaaaaaauggggc

SEQ ID NO: 99160 - RNA, 64 nt, Homo Sapiens
aagacacuuuuuauuaugaaucagauuccaaaucauuaacuauuuuugcaaaacuggcacaagu

SEQ ID NO: 99161 - RNA, 64 nt, Homo Sapiens
cacaucacaguaucagcucuuucagugaguuuuuauuaacuagauaacacauguaauacauagu

SEQ ID NO: 99162 - RNA, 64 nt, Homo Sapiens
cauacagaaaugcaaaucaauuaaaaugcucaacauuaacuauucauggucaauaaguauauuu

SEQ ID NO: 99163 - RNA, 64 nt, Homo Sapiens
aacagcucugaauguauuugaaauuauaaaugcaauuaacuaagcacaugguaauaaaaaguau

SEQ ID NO: 99164 - RNA, 64 nt, Homo Sapiens
gacaauaaauuaaacaaagcaguacaggagugacauuaacuaauuucuuuuagcaauucaguuu

SEQ ID NO: 99165 - RNA, 64 nt, Homo Sapiens
gggcuauucgaaaucuugacuuuuuuuuuuacacauuaacuaaauaggaauugccucaggcauu

SEQ ID NO: 99166 - RNA, 64 nt, Homo Sapiens
caaaucuuugaaaagcaaucuuggaaaggaauucauuaacuaaaugggguaaaagguuucuuuu

SEQ ID NO: 99167 - RNA, 64 nt, Homo Sapiens
gaauuuaauauaccagauuauuaaaauauuguccauuaacuaguucauagauuuuaaaaguaaa

SEQ ID NO: 99168 - RNA, 64 nt, Homo Sapiens
aguauuauuaacacuaauaauguuaacuguuaguauuaacuauuucaauaguauuaacuauuag

SEQ ID NO: 99169 - RNA, 64 nt, Homo Sapiens
aguguuaacuguuaguauuaggguugucaauaguauuaacuauuugucugaaaucagugccuau

SEQ ID NO: 99170 - RNA, 64 nt, Homo Sapiens
uaaggauuaauagcaaaagacuagcccuuuaaggauuaacuaguagggacuaguuaaggauuaa

SEQ ID NO: 99171 - RNA, 64 nt, Homo Sapiens
ccuuuaaggauuaacuaguugggacuaguuaaggauuaacuagcaagauaaugcacaaaaugaa

SEQ ID NO: 99172 - RNA, 64 nt, Homo Sapiens
uuugcaguuuuaauccuguauacauauucuacugauuaacuacuaucuggauuuuuugugugca

SEQ ID NO: 99173 - RNA, 64 nt, Homo Sapiens
uguaauauaguuuugugaaucaauucuuaaacugauuaacuagcaaaaaugugacugacgggaa

SEQ ID NO: 99174 - RNA, 64 nt, Homo Sapiens
uuuuuaauucaugaacuagcggaaaauuuauuaaauuaacuauuaacuacauucaccuuguaaa

SEQ ID NO: 99175 - RNA, 64 nt, Homo Sapiens
uucaugaacuagcggaaaauuuauuaaauuaacuauuaacuacauucaccuuguaaauuacugu

SEQ ID NO: 99176 - RNA, 64 nt, Homo Sapiens
uucaccuuguaaauuacuguuuauuaaauuaacuauuaacuacauucaugaacuagcagaaaau

SEQ ID NO: 99177 - RNA, 64 nt, Homo Sapiens
aacuacauucaccuuguaaaagaaaauuuauuaaauuaacuauuuuuuuaauucaugaacuagc

SEQ ID NO: 99178 - RNA, 64 nt, Homo Sapiens
ggaaugacggacacguacuauccaaguguaugggauuaacuaaucauugaaggcauucauccgu

SEQ ID NO: 99179 - RNA, 64 nt, Homo Sapiens
ccauucuuggaguaguuuuaguguaugucuuuacauuaacuacuaacaguauaaauaacuugac

SEQ ID NO: 99180 - RNA, 64 nt, Homo Sapiens
gaaaaucauguagaauaaaaauuuuaaaucucacuucacuuagccgacauuccaugcccugacc

SEQ ID NO: 99181 - RNA, 64 nt, Homo Sapiens
agaugugaucauuccuauauuguuauugauuuuuuucacuuaauaaaaauucaccuuauuccuu

SEQ ID NO: 99182 - RNA, 64 nt, Homo Sapiens
gagaaugaaagugaaggggaacaguaauagggaauucacuuauuuaaagauuuuuuaggcaaua

SEQ ID NO: 99183 - RNA, 64 nt, Homo Sapiens
auacuauucauacuauacauauauuauguuauauuucacuuaaauaaaauaauguuuccacauu

SEQ ID NO: 99184 - RNA, 64 nt, Homo Sapiens
ugaaaaguagagaaauggauauuuugugaccccuuucacuuacccccuccacacaaaccuaaaa

SEQ ID NO: 99185 - RNA, 64 nt, Homo Sapiens
uuuuuccaaaaccucaguuaaaacaucagcugaauucacuuaaguaaauguagacagauauuuc

SEQ ID NO: 99186 - RNA, 64 nt, Homo Sapiens
gccauuuuuacaucuaaacuaagaugugcagcauuucacuuauuuagauucacuuaacaaacaa

SEQ ID NO: 99187 - RNA, 64 nt, Homo Sapiens
uaaacuaagaugugcagcauuucacuuauuuagauucacuuaacaaacaaauuuuucugcuuua

SEQ ID NO: 99188 - RNA, 64 nt, Homo Sapiens
aaauacacuugugauuauaaaauuaaucacaaauuucacuuauaccugcuaucagcagcuagaa

SEQ ID NO: 99189 - RNA, 64 nt, Homo Sapiens
uaaacuaauagaaguugaggauuguugaaucuauuucacuuauuuuggcugugguuuccaucug

SEQ ID NO: 99190 - RNA, 64 nt, Homo Sapiens
acugccaagccauacuuauuaaguucgaacauguuucacuuaaggagagacaccuagcuuaguc

SEQ ID NO: 99191 - RNA, 64 nt, Homo Sapiens
ucguauauuucucauaaugugaaauaugaugagauucacuuaggggcagcauguuaguuuuggg

SEQ ID NO: 99192 - RNA, 64 nt, Homo Sapiens
cugauuuaaugacaguuuccgaacagaucuguuuuucacuuaucuuauaguccugcgagucugg

SEQ ID NO: 99193 - RNA, 64 nt, Homo Sapiens
auuguuuuguauauuucuggggacuuuguauuauuucacuuauacuccaggaucaaaacacaag

SEQ ID NO: 99194 - RNA, 64 nt, Homo Sapiens
gguaauacugucugugaaauaauguaagaagcuuuucacuuaaaaaaaaugcauuacuuucacu

SEQ ID NO: 99195 - RNA, 64 nt, Homo Sapiens
uaagaagcuuuucacuuaaaaaaaaugcauuacuuucacuuaacacuagacaccaggucgaaaa

SEQ ID NO: 99196 - RNA, 64 nt, Homo Sapiens
uuuuuccaaguuaugauucuucucucaaugccuuuucacuuauuaacuuaacaaaucuuagcaa

SEQ ID NO: 99197 - RNA, 64 nt, Homo Sapiens
cuuuuuauuagucagcuuuugauggaagaguucuuucacuuaccggaagugaggaagggucaag

SEQ ID NO: 99198 - RNA, 64 nt, Homo Sapiens
gauagagaacccaaaguuuuguaccugguuauuuuucacuuaaguuuguagacgaaaugugcca

SEQ ID NO: 99199 - RNA, 64 nt, Homo Sapiens
cccuugaagcagcaugucuuugccauagcagcacuucacuuaaaaggaagaaauugccucucug

SEQ ID NO: 99200 - RNA, 64 nt, Homo Sapiens
agcaggcuuaggaauuuagaugagauguguaagauucacuuacaggcaguagcugcuucuagca

SEQ ID NO: 99201 - RNA, 64 nt, Homo Sapiens
uuuaauaucuugcucucugacaggaaagaaacaauucacuuaccagccuccucaccccauccuc

SEQ ID NO: 99202 - RNA, 64 nt, Homo Sapiens
uugauaacuaaugaucacagugauuauuagcucauucacuuauucacaauuauuauucuaacaa

SEQ ID NO: 99203 - RNA, 64 nt, Homo Sapiens
cugagaaauagcagauagucauuuuauuaaauuuuucacuuaguuuccuccuaucaaggcagcu

SEQ ID NO: 99204 - RNA, 64 nt, Homo Sapiens
aacaccaggaaaccacagggcuaacuggagcacauucacuuacgucccccaacauccuguugcu

SEQ ID NO: 99205 - RNA, 64 nt, Homo Sapiens
cuagucuaagacccagauucggcccuccccagacuucacuuauguuucuucugccuuggaguuc

SEQ ID NO: 99206 - RNA, 64 nt, Homo Sapiens
gccugaggcuuauaaagcuuaugcagaaagcaaguucacuuacacaauggcacauggcuggaaa

SEQ ID NO: 99207 - RNA, 64 nt, Homo Sapiens
uuggaaaaccagccucuaaacagggugaauuucuuucacuuaagugcgucauaauugcuaaaaa

SEQ ID NO: 99208 - RNA, 64 nt, Homo Sapiens
ggaggcgcuuuauagcuucuagaaccuucacccuuucacuuaaagcauacuuuuauuucucuug

SEQ ID NO: 99209 - RNA, 64 nt, Homo Sapiens
aggaaggucauuuggagaugacagggaagggaauuucacuuaaaaaugaggauuugcuaugcag

SEQ ID NO: 99210 - RNA, 64 nt, Homo Sapiens
acagaauaguuucaccacccucaaaauccugugcuucacuuauuuaucccucccgccgugcccu

SEQ ID NO: 99211 - RNA, 64 nt, Homo Sapiens
uuaugcaguauguagacuuuuuagacuggcuucuuucacuuagcaauaugcauuuaagguuccu

SEQ ID NO: 99212 - RNA, 64 nt, Homo Sapiens
aaacuuuuguaucuucuuuguucauuaaacucuuuucacuuacuuucccuuaaacccuugaggc

SEQ ID NO: 99213 - RNA, 64 nt, Homo Sapiens
ucaggguaaguuuauuuuaauagcagcuaguaacuucacuuauugcuuuugagugacauuuauu

SEQ ID NO: 99214 - RNA, 64 nt, Homo Sapiens
aauccauacucagugaaagcagggaaaaaauauuuucacuuauuuuauuugcuucuaaaaugca

SEQ ID NO: 99215 - RNA, 64 nt, Homo Sapiens
ucuaagagugaguuacagaauucuuuuugguacuuucacuuauucuuucagaauacaucaagga

SEQ ID NO: 99216 - RNA, 64 nt, Homo Sapiens
aaaacauaugugaugcaauuaacaucugcauaauuucacuuaaaauuauuaugcaaaaaugaau

SEQ ID NO: 99217 - RNA, 64 nt, Homo Sapiens
guaaaauuuaaauaauuacuuuuuuauaauaugauucacuuaugccacagauucaacauuagaa

SEQ ID NO: 99218 - RNA, 64 nt, Homo Sapiens
aaaauccucaaaaugaguuauuuuugcugugaaaugcacugaaauuuaaugauucccuuguuca

SEQ ID NO: 99219 - RNA, 64 nt, Homo Sapiens
gaccugcuuccugauugcgccagaauggagucauugcacugagucuguuuacccuaaauccucc

SEQ ID NO: 99220 - RNA, 64 nt, Homo Sapiens
acagauaugacaagcaguaguguaugcucaucccugcacugagccugacuucgccucuuccugc

SEQ ID NO: 99221 - RNA, 64 nt, Homo Sapiens
uuuuaauuauuuaaaacucuuuguuuucacucucugcacugacuacuugauuccaaaugccaug

SEQ ID NO: 99222 - RNA, 64 nt, Homo Sapiens
cucagacacacuugaaacucgauucaaacguugcugcacugaagaccgugggaaugagugcacu

SEQ ID NO: 99223 - RNA, 64 nt, Homo Sapiens
caaacguugcugcacugaagaccgugggaaugagugcacugauuaaugcugucuccgauaucuc

SEQ ID NO: 99224 - RNA, 64 nt, Homo Sapiens
uauugugauuuucuuuccccugcuaggaaaaaauugcacugaaaugcugacaaaaaauaaugaa

SEQ ID NO: 99225 - RNA, 64 nt, Homo Sapiens
caaaaaauaaugaaaugaaguggcuuccaaaauaugcacugauguuauccuuuguauuuauagg

SEQ ID NO: 99226 - RNA, 64 nt, Homo Sapiens
auuaaauugcuaucaagaauuauuugcuuuugcuugcacugaaauguguauuacagugggcagg

SEQ ID NO: 99227 - RNA, 64 nt, Homo Sapiens
auuaaauugcuaucaagagcuguuugcuuuugcuugcacugaaauauggcagugagcagguaug

SEQ ID NO: 99228 - RNA, 64 nt, Homo Sapiens
aggggccguggggguugaggcagggcaaaugacaugcacugacccuuccagacauacgaaacac

SEQ ID NO: 99229 - RNA, 64 nt, Homo Sapiens
gccuaaucucauaccucugaccaacaggcuguucugcacugaaaagguucuucaucccuuucca

SEQ ID NO: 99230 - RNA, 64 nt, Homo Sapiens
cagcugccacaacaccagccccacuucugggucaugcacugagguccacagaccuacugcacug

SEQ ID NO: 99231 - RNA, 64 nt, Homo Sapiens
cuucugggucaugcacugagguccacagaccuacugcacugaguuaaaauagcgguacaaguuc

SEQ ID NO: 99232 - RNA, 64 nt, Homo Sapiens
uuuucauaauguuuaagggaaacagacuacacaaugcacugauggagaccucaguuuauagcgu

SEQ ID NO: 99233 - RNA, 64 nt, Homo Sapiens
uagagcaguaagcuugugauuucuaggcuggugcugcacugaaaucuguucauguuuuugugaa

SEQ ID NO: 99234 - RNA, 64 nt, Homo Sapiens
acuuagccagaguuagguugcuccucuaguaagaugcacugaaacucugagcccauacuuuugg

SEQ ID NO: 99235 - RNA, 64 nt, Homo Sapiens
acccaaugcaucacguacccuuugauugaggagcugcacugauccucagggcacgcaggaccag

SEQ ID NO: 99236 - RNA, 64 nt, Homo Sapiens
agugaagguggcuuccggcauugcaaaagaucugugcacugaacuccgaugcuuugcacugaag

SEQ ID NO: 99237 - RNA, 64 nt, Homo Sapiens
uugcaaaagaucugugcacuuagcuccgaugcuuugcacugaagaaagacguuuuggucucgau

SEQ ID NO: 99238 - RNA, 64 nt, Homo Sapiens
aaaauaccaaaauaaaagugaaaaggauuuaaguugcacugacauuuuuuuucugcaggucagu

SEQ ID NO: 99239 - RNA, 64 nt, Homo Sapiens
caacugcuaugcucagaaugugguaagcagacacugcacugaaccccugacccuggcagugcac

SEQ ID NO: 99240 - RNA, 64 nt, Homo Sapiens
auugauuucauucuguuuaaugaauuuggaaauaugcacugaaagaaauguaaaacauuuagaa

SEQ ID NO: 99241 - RNA, 64 nt, Homo Sapiens
aaacauuuagaauagcucguguuauggaaaaaagugcacugaauuuauuagacaaacuuacgaa

SEQ ID NO: 99242 - RNA, 64 nt, Homo Sapiens
ugacuagguuggaguucuggguucaugauagcuugucuacaacuaucugugcacacuguauguu

SEQ ID NO: 99243 - RNA, 64 nt, Homo Sapiens
cuaaccagacgacuuuuuccagccaguguugugggucuacaacauaaauguuugucagaaaugc

SEQ ID NO: 99244 - RNA, 64 nt, Homo Sapiens
ucugucauguguugauauccacacagaauuaggcccuaaugagagccuuagacccucaaccaug

SEQ ID NO: 99245 - RNA, 64 nt, Homo Sapiens
auuauuaccauguauuaaauugugggcuuugaaaccuaaugaaaccuguuagccacuucucugu

SEQ ID NO: 99246 - RNA, 64 nt, Homo Sapiens
uuuugaugagaugucucuggggacacgaggaugcccuaaugaugcugacuugucaugguugcag

SEQ ID NO: 99247 - RNA, 64 nt, Homo Sapiens
ucccugcguguggccacuccucagcauccuccccacccaccaugguucauuccgacuuuuccaa

SEQ ID NO: 99248 - RNA, 64 nt, Homo Sapiens
uucucacgcguuuccacaacauccccugggucagacccaccagguaccccguaggaauuuccag

SEQ ID NO: 99249 - RNA, 64 nt, Homo Sapiens
agaggaaguaaaggacaaucagaacaccagucaaacccaccaaauugcuuuauuccccuuugca

SEQ ID NO: 99250 - RNA, 64 nt, Homo Sapiens
cugagagggcagaacacacauauccaaguaggcuacccaccacuggguagggauuucuguaaag

SEQ ID NO: 99251 - RNA, 64 nt, Homo Sapiens
ggagcacaugcagccucaguucaucccuaggaggacccaccaguucuccucugcuccucccacc

SEQ ID NO: 99252 - RNA, 64 nt, Homo Sapiens
cccagcccuggagccaucaccucaguguccacacacccaccaugugccagaggaccguggauac

SEQ ID NO: 99253 - RNA, 64 nt, Homo Sapiens
agcccucuccacccagaggucucccuauaccgagacccaccauccuuccauccugaggaccgcc

SEQ ID NO: 99254 - RNA, 64 nt, Homo Sapiens
ugggggguugccucgaguccccccaccccuccccacccaccaccgcucccgcgggaagccagcc

SEQ ID NO: 99255 - RNA, 64 nt, Homo Sapiens
gagcacuggcaguugguggcagugagaccagcccacccaccaccacccaccacagaaaagcaca

SEQ ID NO: 99256 - RNA, 64 nt, Homo Sapiens
aguugguggcagugagaccagcccacccaccaccacccaccacagaaaagcacaaaccucuggg

SEQ ID NO: 99257 - RNA, 64 nt, Homo Sapiens
aucacaggugauucacacguacacacauaaacacacccaccagugcagccugaaguaacuccca

SEQ ID NO: 99258 - RNA, 64 nt, Homo Sapiens
aagucccuccaacagcaauauuuuauaauauuuaacccaccaaauauugaccagaaaacaauga

SEQ ID NO: 99259 - RNA, 64 nt, Homo Sapiens
augcuccuauccaacaauuacaagucugugcaaaacccaccaaaucacauucugacacaagaug

SEQ ID NO: 99260 - RNA, 64 nt, Homo Sapiens
aaacaaaaaaaacacaaaaauuucaaaaaacaccacccaccaaauugcacaauagauacaccca

SEQ ID NO: 99261 - RNA, 64 nt, Homo Sapiens
ccagauagaaaguugcgggcaacacuuuucucagacccaccauguccccaacucagacuuagca

SEQ ID NO: 99262 - RNA, 64 nt, Homo Sapiens
cacccacacaugccagagguuaauagggagagggacccaccacacaugcccaacacauuucugc

SEQ ID NO: 99263 - RNA, 64 nt, Homo Sapiens
augcccagcuaauuguuguacugggauuacaggcacccaccaccugucucagccuccccaguag

SEQ ID NO: 99264 - RNA, 64 nt, Homo Sapiens
ucucuccccaucccgcuucuaggcagacggugggacccaccagcgcagccugggaaggcuggag

SEQ ID NO: 99265 - RNA, 64 nt, Homo Sapiens
acuaccugcaccugcuguggucugcaaggccagcacccaccaucugaguccccuccccguaacc

SEQ ID NO: 99266 - RNA, 64 nt, Homo Sapiens
acaaaacugcgcccgucuuaggccugggugucugacccaccagcagugcaaugggcagguuucc

SEQ ID NO: 99267 - RNA, 64 nt, Homo Sapiens
gugaccaccaccacguucagguuucugaaugcagacccaccacgagggauggauuccacccgcc

SEQ ID NO: 99268 - RNA, 64 nt, Homo Sapiens
uccugguggcagcaccaggggacacaccugccaaacccaccagauggaggggcccucccugguc

SEQ ID NO: 99269 - RNA, 64 nt, Homo Sapiens
cacgagaugcugucacucagccagaucaguauugacccaccaggggaggugggguuuggugaga

SEQ ID NO: 99270 - RNA, 64 nt, Homo Sapiens
aacguagaauccacuucuguuaauaaaaaaaaaaacccaccacacgauuuauuuuuguacaaaa

SEQ ID NO: 99271 - RNA, 64 nt, Homo Sapiens
cccccaaaaacacaaaaaaaagagaaaaaaaaucacccaccaccagaaagagagagacagagag

SEQ ID NO: 99272 - RNA, 64 nt, Homo Sapiens; identical to SEQ ID NO: 81841

SEQ ID NO: 99273 - RNA, 64 nt, Homo Sapiens; identical to SEQ ID NO: 81842

SEQ ID NO: 99274 - RNA, 64 nt, Homo Sapiens; identical to SEQ ID NO: 81843

SEQ ID NO: 99275 - RNA, 64 nt, Homo Sapiens; identical to SEQ ID NO: 81844

SEQ ID NO: 99276 - RNA, 64 nt, Homo Sapiens; identical to SEQ ID NO: 81845

SEQ ID NO: 99277 - RNA, 64 nt, Homo Sapiens; identical to SEQ ID NO: 81846

SEQ ID NO: 99278 - RNA, 64 nt, Homo Sapiens; identical to SEQ ID NO: 81847

SEQ ID NO: 99279 - RNA, 64 nt, Homo Sapiens; identical to SEQ ID NO: 81848

SEQ ID NO: 99280 - RNA, 64 nt, Homo Sapiens; identical to SEQ ID NO: 81849

SEQ ID NO: 99281 - RNA, 64 nt, Homo Sapiens; identical to SEQ ID NO: 81850

SEQ ID NO: 99282 - RNA, 64 nt, Homo Sapiens; identical to SEQ ID NO: 81851

SEQ ID NO: 99283 - RNA, 61 nt, Homo Sapiens; identical to SEQ ID NO: 81852

SEQ ID NO: 99284 - RNA, 64 nt, Homo Sapiens; identical to SEQ ID NO: 81853

SEQ ID NO: 99285 - RNA, 51 nt, Homo Sapiens; identical to SEQ ID NO: 81854

SEQ ID NO: 99286 - RNA, 64 nt, Homo Sapiens; identical to SEQ ID NO: 81855

SEQ ID NO: 99287 - RNA, 64 nt, Homo Sapiens; identical to SEQ ID NO: 81856

SEQ ID NO: 99288 - RNA, 64 nt, Homo Sapiens; identical to SEQ ID NO: 81857

SEQ ID NO: 99289 - RNA, 64 nt, Homo Sapiens; identical to SEQ ID NO: 81858

SEQ ID NO: 99290 - RNA, 64 nt, Homo Sapiens; identical to SEQ ID NO: 81859

SEQ ID NO: 99291 - RNA, 64 nt, Homo Sapiens; identical to SEQ ID NO: 81860

SEQ ID NO: 99292 - RNA, 64 nt, Homo Sapiens; identical to SEQ ID NO: 81861

SEQ ID NO: 99293 - RNA, 64 nt, Homo Sapiens; identical to SEQ ID NO: 81862

SEQ ID NO: 99294 - RNA, 64 nt, Homo Sapiens; identical to SEQ ID NO: 81863

SEQ ID NO: 99295 - RNA, 64 nt, Homo Sapiens; identical to SEQ ID NO: 81864

SEQ ID NO: 99296 - RNA, 64 nt, Homo Sapiens; identical to SEQ ID NO: 81865

SEQ ID NO: 99297 - RNA, 64 nt, Homo Sapiens; identical to SEQ ID NO: 81866

SEQ ID NO: 99298 - RNA, 64 nt, Homo Sapiens; identical to SEQ ID NO: 81867

SEQ ID NO: 99299 - RNA, 64 nt, Homo Sapiens; identical to SEQ ID NO: 81868

SEQ ID NO: 99300 - RNA, 64 nt, Homo Sapiens; identical to SEQ ID NO: 81869

SEQ ID NO: 99301 - RNA, 64 nt, Homo Sapiens; identical to SEQ ID NO: 81870

SEQ ID NO: 99302 - RNA, 64 nt, Homo Sapiens; identical to SEQ ID NO: 81871

SEQ ID NO: 99303 - RNA, 64 nt, Homo Sapiens; identical to SEQ ID NO: 81872

SEQ ID NO: 99304 - RNA, 64 nt, Homo Sapiens; identical to SEQ ID NO: 81873

SEQ ID NO: 99305 - RNA, 64 nt, Homo Sapiens; identical to SEQ ID NO: 81874

SEQ ID NO: 99306 - RNA, 64 nt, Homo Sapiens; identical to SEQ ID NO: 81875

SEQ ID NO: 99307 - RNA, 64 nt, Homo Sapiens; identical to SEQ ID NO: 81876

SEQ ID NO: 99308 - RNA, 64 nt, Homo Sapiens; identical to SEQ ID NO: 81877

SEQ ID NO: 99309 - RNA, 64 nt, Homo Sapiens; identical to SEQ ID NO: 81878

SEQ ID NO: 99310 - RNA, 64 nt, Homo Sapiens; identical to SEQ ID NO: 81879

SEQ ID NO: 99311 - RNA, 64 nt, Homo Sapiens; identical to SEQ ID NO: 81880

SEQ ID NO: 99312 - RNA, 64 nt, Homo Sapiens; identical to SEQ ID NO: 81881

SEQ ID NO: 99313 - RNA, 64 nt, Homo Sapiens; identical to SEQ ID NO: 81882

SEQ ID NO: 99314 - RNA, 64 nt, Homo Sapiens; identical to SEQ ID NO: 81883

SEQ ID NO: 99315 - RNA, 64 nt, Homo Sapiens; identical to SEQ ID NO: 81884

SEQ ID NO: 99316 - RNA, 64 nt, Homo Sapiens; identical to SEQ ID NO: 81885

SEQ ID NO: 99317 - RNA, 64 nt, Homo Sapiens; identical to SEQ ID NO: 81886

SEQ ID NO: 99318 - RNA, 64 nt, Homo Sapiens; identical to SEQ ID NO: 81887

SEQ ID NO: 99319 - RNA, 64 nt, Homo Sapiens; identical to SEQ ID NO: 81888

SEQ ID NO: 99320 - RNA, 64 nt, Homo Sapiens; identical to SEQ ID NO: 81889

SEQ ID NO: 99321 - RNA, 64 nt, Homo Sapiens; identical to SEQ ID NO: 81890

SEQ ID NO: 99322 - RNA, 64 nt, Homo Sapiens; identical to SEQ ID NO: 81891

SEQ ID NO: 99323 - RNA, 64 nt, Homo Sapiens; identical to SEQ ID NO: 81892

SEQ ID NO: 99324 - RNA, 64 nt, Homo Sapiens; identical to SEQ ID NO: 81893

SEQ ID NO: 99325 - RNA, 64 nt, Homo Sapiens; identical to SEQ ID NO: 81894

SEQ ID NO: 99326 - RNA, 64 nt, Homo Sapiens; identical to SEQ ID NO: 81895

SEQ ID NO: 99327 - RNA, 64 nt, Homo Sapiens; identical to SEQ ID NO: 81896

SEQ ID NO: 99328 - RNA, 64 nt, Homo Sapiens; identical to SEQ ID NO: 81897

SEQ ID NO: 99329 - RNA, 64 nt, Homo Sapiens; identical to SEQ ID NO: 81898

SEQ ID NO: 99330 - RNA, 64 nt, Homo Sapiens; identical to SEQ ID NO: 81899

SEQ ID NO: 99331 - RNA, 64 nt, Homo Sapiens; identical to SEQ ID NO: 81900

SEQ ID NO: 99332 - RNA, 64 nt, Homo Sapiens; identical to SEQ ID NO: 81901

SEQ ID NO: 99333 - RNA, 64 nt, Homo Sapiens; identical to SEQ ID NO: 81902

SEQ ID NO: 99334 - RNA, 64 nt, Homo Sapiens; identical to SEQ ID NO: 81903

SEQ ID NO: 99335 - RNA, 64 nt, Homo Sapiens; identical to SEQ ID NO: 81904

SEQ ID NO: 99336 - RNA, 64 nt, Homo Sapiens; identical to SEQ ID NO: 81905

SEQ ID NO: 99337 - RNA, 64 nt, Homo Sapiens; identical to SEQ ID NO: 81906

SEQ ID NO: 99338 - RNA, 64 nt, Homo Sapiens; identical to SEQ ID NO: 81907

SEQ ID NO: 99339 - RNA, 64 nt, Homo Sapiens; identical to SEQ ID NO: 81908

SEQ ID NO: 99340 - RNA, 64 nt, Homo Sapiens; identical to SEQ ID NO: 81909

SEQ ID NO: 99341 - RNA, 64 nt, Homo Sapiens; identical to SEQ ID NO: 81910

SEQ ID NO: 99342 - RNA, 64 nt, Homo Sapiens; identical to SEQ ID NO: 81911

SEQ ID NO: 99343 - RNA, 64 nt, Homo Sapiens; identical to SEQ ID NO: 81912

SEQ ID NO: 99344 - RNA, 64 nt, Homo Sapiens; identical to SEQ ID NO: 81913

SEQ ID NO: 99345 - RNA, 64 nt, Homo Sapiens; identical to SEQ ID NO: 81914

SEQ ID NO: 99346 - RNA, 64 nt, Homo Sapiens; identical to SEQ ID NO: 81915

SEQ ID NO: 99347 - RNA, 64 nt, Homo Sapiens; identical to SEQ ID NO: 81916

SEQ ID NO: 99348 - RNA, 64 nt, Homo Sapiens; identical to SEQ ID NO: 81917

SEQ ID NO: 99349 - RNA, 64 nt, Homo Sapiens; identical to SEQ ID NO: 81918

SEQ ID NO: 99350 - RNA, 64 nt, Homo Sapiens; identical to SEQ ID NO: 81919

SEQ ID NO: 99351 - RNA, 64 nt, Homo Sapiens; identical to SEQ ID NO: 81920

SEQ ID NO: 99352 - RNA, 64 nt, Homo Sapiens; identical to SEQ ID NO: 81921

SEQ ID NO: 99353 - RNA, 64 nt, Homo Sapiens; identical to SEQ ID NO: 81922

SEQ ID NO: 99354 - RNA, 64 nt, Homo Sapiens; identical to SEQ ID NO: 81923

SEQ ID NO: 99355 - RNA, 64 nt, Homo Sapiens; identical to SEQ ID NO: 81924

SEQ ID NO: 99356 - RNA, 64 nt, Homo Sapiens; identical to SEQ ID NO: 81925

SEQ ID NO: 99357 - RNA, 64 nt, Homo Sapiens; identical to SEQ ID NO: 81926

SEQ ID NO: 99358 - RNA, 64 nt, Homo Sapiens; identical to SEQ ID NO: 81927

SEQ ID NO: 99359 - RNA, 64 nt, Homo Sapiens; identical to SEQ ID NO: 81928

SEQ ID NO: 99360 - RNA, 64 nt, Homo Sapiens; identical to SEQ ID NO: 81929

SEQ ID NO: 99361 - RNA, 64 nt, Homo Sapiens; identical to SEQ ID NO: 81930

SEQ ID NO: 99362 - RNA, 64 nt, Homo Sapiens; identical to SEQ ID NO: 81931

SEQ ID NO: 99363 - RNA, 64 nt, Homo Sapiens; identical to SEQ ID NO: 81932

SEQ ID NO: 99364 - RNA, 64 nt, Homo Sapiens; identical to SEQ ID NO: 81933

SEQ ID NO: 99365 - RNA, 64 nt, Homo Sapiens; identical to SEQ ID NO: 81934

SEQ ID NO: 99366 - RNA, 64 nt, Homo Sapiens; identical to SEQ ID NO: 81935

SEQ ID NO: 99367 - RNA, 64 nt, Homo Sapiens; identical to SEQ ID NO: 81936

SEQ ID NO: 99368 - RNA, 64 nt, Homo Sapiens; identical to SEQ ID NO: 81937

SEQ ID NO: 99369 - RNA, 64 nt, Homo Sapiens; identical to SEQ ID NO: 81938

SEQ ID NO: 99370 - RNA, 64 nt, Homo Sapiens; identical to SEQ ID NO: 81939

SEQ ID NO: 99371 - RNA, 64 nt, Homo Sapiens; identical to SEQ ID NO: 81940

SEQ ID NO: 99372 - RNA, 64 nt, Homo Sapiens; identical to SEQ ID NO: 81941

SEQ ID NO: 99373 - RNA, 64 nt, Homo Sapiens; identical to SEQ ID NO: 81942

SEQ ID NO: 99374 - RNA, 64 nt, Homo Sapiens; identical to SEQ ID NO: 81943

SEQ ID NO: 99375 - RNA, 64 nt, Homo Sapiens; identical to SEQ ID NO: 81944

SEQ ID NO: 99376 - RNA, 64 nt, Homo Sapiens
cuuugaggagaagugcucuacacugaagucaaaagcccauuaacgagaaagugccugcccacug

SEQ ID NO: 99377 - RNA, 64 nt, Homo Sapiens
caaaaccaaacuggacucucgugcagaaaauguagcccauuaccacauguagccuuggagaccc

SEQ ID NO: 99378 - RNA, 64 nt, Homo Sapiens
cuaaaagcaacugcaggacaaaagcugaugcagagcccauuagcgacagggugaggguauaccc

SEQ ID NO: 99379 - RNA, 64 nt, Homo Sapiens
uuuccugugcuuccccagcuguguuggucuuguagcccauuauucacuuaugugagucaucaug

SEQ ID NO: 99380 - RNA, 64 nt, Homo Sapiens
uuuucaucuguauuugccauucauuaauaaauuagcccauuauacuuagugaauauauucuuaa

SEQ ID NO: 99381 - RNA, 64 nt, Homo Sapiens
cucugcuuuuagccagaguuaaacuugguaacuugcccauuauucacgccagagcugaaggggg

SEQ ID NO: 99382 - RNA, 64 nt, Homo Sapiens
ggugguuucaaagcucggacaguaacuaucuugagcccauuagagagucuguguccauauuugc

SEQ ID NO: 99383 - RNA, 64 nt, Homo Sapiens
ccuguaaaccuucaucccuggcccccuaucuugggcccauuaguuuuggggauggggcacaggg

SEQ ID NO: 99384 - RNA, 64 nt, Homo Sapiens
ugccuccaucagcuucuuauuuaguauuucauaugcccauuagcccuaugcuucagaugacacg

SEQ ID NO: 99385 - RNA, 64 nt, Homo Sapiens
agguucauggauuuuccaggacuguuucaaacaugcccauuacuaacggcaaaagggggauucc

SEQ ID NO: 99386 - RNA, 64 nt, Homo Sapiens
caggaaaaguugauauuuaagaaaaugaaccucagcccauuaggacccuuaccuugaggaaugg

SEQ ID NO: 99387 - RNA, 64 nt, Homo Sapiens
cuaggaaaguaauuuucaaaccauugaugcacaugcccauuaacacuugcuuauacuauucucu

SEQ ID NO: 99388 - RNA, 64 nt, Homo Sapiens
ggaaggaccaggacuagaccucagggucaccauagcccauuagucuagaaguggaauaaugugc

SEQ ID NO: 99389 - RNA, 64 nt, Homo Sapiens
agcucuguuuugguuaugaaccuuucaauuuauggcccauuaaauuccaaguggcagacauuuc

SEQ ID NO: 99390 - RNA, 64 nt, Homo Sapiens
uuuaagguaugugcuguccuauguguaagaaaaggcccauuacuuaaccaauaccuuuguuuuc

SEQ ID NO: 99391 - RNA, 64 nt, Homo Sapiens
aggggcaaacaucacaaaauguaauuuaaugccugcccauuagagaaguauuuaucaggagaag

SEQ ID NO: 99392 - RNA, 64 nt, Homo Sapiens
aaggcgcaaaggaagcaagagguuaaagauaauggcccauuagauacaacagcaagcccaagau

SEQ ID NO: 99393 - RNA, 64 nt, Homo Sapiens
uauucuuggagauugauaaccauagcauuaauacgcccauuauggucauuuaaauugggguuua

SEQ ID NO: 99394 - RNA, 64 nt, Homo Sapiens
uuuuccucuuuuccccacccaucuccccaauauugcccauuauuaauuaaccucuuucuuuggu

SEQ ID NO: 99395 - RNA, 64 nt, Homo Sapiens
auacacaauuauuugguuuaggaugguuauuagggcccauuagaaacaggagaaguauuuuacc

SEQ ID NO: 99396 - RNA, 64 nt, Homo Sapiens
ucauuuuauguaggaguuuuguaguuucggcucugcccauuagcccgucucuucacacagagcu

SEQ ID NO: 99397 - RNA, 64 nt, Homo Sapiens
cccacuguggagacuucugguucagcgucccugggcccauuaaucgggaagguggcuccugcag

SEQ ID NO: 99398 - RNA, 64 nt, Homo Sapiens
ucccucacuccacagagugaaauagguaaauggggcccauuagggcccuuuaacuuucagaggc

SEQ ID NO: 99399 - RNA, 64 nt, Homo Sapiens
auaaaguuauccuguaacauauagacaagcccaugcccauuaaaaaauauacauaccuuugugu

SEQ ID NO: 99400 - RNA, 64 nt, Homo Sapiens
ugcaugcaggcaccagagcagaaguacagucucugcccauuaccucuggaugcugccauguugg

SEQ ID NO: 99401 - RNA, 64 nt, Homo Sapiens
ucaucccuaaaucuucagcauaugucaguuuuuugcccauuacuuaccuguguagugucgauua

SEQ ID NO: 99402 - RNA, 64 nt, Homo Sapiens
uacucuugccugccucuuacccaagacccucaaugcccauuaaaccacuccccuggugggacug

SEQ ID NO: 99403 - RNA, 64 nt, Homo Sapiens
gugaaugcuaauuuguagagcgaacuuccauuuggcccauuauuuguaacuguguaacugcucc

SEQ ID NO: 99404 - RNA, 64 nt, Homo Sapiens
uugaauuaguuuuuugcuuccuugaauuaauaaagcccauuaaugcaaaucuaagccuucauag

SEQ ID NO: 99405 - RNA, 64 nt, Homo Sapiens
ccuuguuuuauaagaagaugaucaagguuugugugcccauuaccuuuccucugccugaaagacg

SEQ ID NO: 99406 - RNA, 64 nt, Homo Sapiens
aguuacucagaugaccugagggaggaaggggauggcccauuaagcuuccucucuugacaucaag

SEQ ID NO: 99407 - RNA, 64 nt, Homo Sapiens
auucucaccugaaguuauggugauacauucuucugcccauuauaauggccuugaguauuuuagu

SEQ ID NO: 99408 - RNA, 64 nt, Homo Sapiens
uucauucugcaagggaaagggucacgguuugucugcccauuaucuguuuuaugcugucaucauu

SEQ ID NO: 99409 - RNA, 64 nt, Homo Sapiens
cguugaaaucccucauuuauuuucuucucaaaaugcccauuauccaaaugcagaaccucugcau

SEQ ID NO: 99410 - RNA, 64 nt, Homo Sapiens
uaaauuucugccaagucaguucucuuuggaggaagcccauuacuccguaacugacuggaugguc

SEQ ID NO: 99411 - RNA, 64 nt, Homo Sapiens
uguuuugacuuggugaaaaugggauugucaaacagcccauuaaguucccugguauuucaccuuc

SEQ ID NO: 99412 - RNA, 64 nt, Homo Sapiens
uucguacugaaaaagcaacauaaacagcaggaaagcccauuaacuuuuaaaaucucaaagcagu

SEQ ID NO: 99413 - RNA, 64 nt, Homo Sapiens
cucaaacuugaaguuucguuggucaggucaguaagcccauuaucguuaguuacgugaaaucaaa

SEQ ID NO: 99414 - RNA, 64 nt, Homo Sapiens
uaaaaucauuuugcugcuuggguuaucugcuacugcccauuagcacaaugaugaauccacaguu

SEQ ID NO: 99415 - RNA, 64 nt, Homo Sapiens
aauuugaaguuaagugauagaaagauaauuuggugcccauuauggacaggcauaaacccaaauc

SEQ ID NO: 99416 - RNA, 64 nt, Homo Sapiens
cacuguaggcucuaagaaccacgugcagucuucagcccauuaaauuaucgauuauuuuuuaaug

SEQ ID NO: 99417 - RNA, 64 nt, Homo Sapiens
aaaccuuacaaagaauguauacucaucuuuuuuggcccauuacaauacugcuuucucagguucu

SEQ ID NO: 99418 - RNA, 64 nt, Homo Sapiens
agcagcaaccugguucuuaaacacaaaguaaguugcccauuaacaaauggcuuuuaucuuuagc

SEQ ID NO: 99419 - RNA, 64 nt, Homo Sapiens
acucaagaagacacuucacgaauaacuacagggugcccauuaccugugugagugguucugagca

SEQ ID NO: 99420 - RNA, 64 nt, Homo Sapiens
aggaaaagggauacuuugauaauuaaggccagaggcccauuaguugagaaagucacagauauau

SEQ ID NO: 99421 - RNA, 64 nt, Homo Sapiens
uaugauuaaaauucucaccuaaagcgagugaguugcccauuaauugugaugacuaaaaugcugg

SEQ ID NO: 99422 - RNA, 64 nt, Homo Sapiens
uuuucgcgucuggucuuagacagacaguacuugggcccauuagguggguauguguugauguuca

SEQ ID NO: 99423 - RNA, 64 nt, Homo Sapiens
caccacuagcuggauauuucaacucuuuccaacagcccauuagauguaggggugcaguuugucc

SEQ ID NO: 99424 - RNA, 64 nt, Homo Sapiens
aaagaugaaauaaaguauucgcuaguauguuucugcccauuaugaagcugaaauauuauuaaau

SEQ ID NO: 99425 - RNA, 64 nt, Homo Sapiens
gcucuauuuauguuauuauuccugggagcuuauagcccauuauuuuuacuuuuuuuuuuuaauu

SEQ ID NO: 99426 - RNA, 64 nt, Homo Sapiens
gcaggacuggguagcagagccgggaagguggguggcccauuacagggggguccccagggugucc

SEQ ID NO: 99427 - RNA, 64 nt, Homo Sapiens
uaucuaggcaacuaaaaacaucauauagcaccuggcccauuacauuuguuuuauucuucagugu

SEQ ID NO: 99428 - RNA, 64 nt, Homo Sapiens
uggguuccccauuaaaucguuaguggagauggaagcccauuaauaugcaacaaaauggaugacu

SEQ ID NO: 99429 - RNA, 64 nt, Homo Sapiens
uuauuguuuauuuaauuauacuaugugacaaaccgcccauuauuggacucugcuacacuuaaac

SEQ ID NO: 99430 - RNA, 64 nt, Homo Sapiens
gguucagaacgugcaccggggguaagcaaacauagcccauuacaagucagcgagagcuagcccu

SEQ ID NO: 99431 - RNA, 64 nt, Homo Sapiens
gcuuuuauccccucucagaaagacaucacuaaaggcccauuaaaaaucuggcccuaaaaguuca

SEQ ID NO: 99432 - RNA, 64 nt, Homo Sapiens
cucgcugggggggaagggggggacacagcuacacgcccauuaaagcacagcacguccuggggga

SEQ ID NO: 99433 - RNA, 64 nt, Homo Sapiens
auggguauaauuuccuggcugccucccuuccucagcccauuagguuaaacaccaaagaaagacu

SEQ ID NO: 99434 - RNA, 64 nt, Homo Sapiens
uuugguucagugauucucaagaaaaagaucucuugcccauuaagaaguguaucaaaaucucaua

SEQ ID NO: 99435 - RNA, 64 nt, Homo Sapiens
gacaggcagucauccugccucugaugugaaucaggcccauuaaagacgucuggguuugaagccg

SEQ ID NO: 99436 - RNA, 64 nt, Homo Sapiens
gguuugcacuucuuggaaaaagugccuaaagugugcccauuaauaugaggauagauuuaggcuc

SEQ ID NO: 99437 - RNA, 64 nt, Homo Sapiens
ugcuguuuuguggagaaacuugcauucaugaagagcccauuaucaacuuuuaaaagugaauuug

SEQ ID NO: 99438 - RNA, 64 nt, Homo Sapiens
gaacaagcaguaccgucaguacccacuugcuuuagcccauuaugggaaucucugaugccuuugu

SEQ ID NO: 99439 - RNA, 64 nt, Homo Sapiens
uuguuuucuccuuucugggugcaguguccuggaugcccauuauaucuacaggucaagaaauagc

SEQ ID NO: 99440 - RNA, 64 nt, Homo Sapiens
caggcugcacaacacagaaguuaggacagauuucgcccauuauuaggacagaugcagcaagaua

SEQ ID NO: 99441 - RNA, 64 nt, Homo Sapiens
uuggaaaauaaauucagaucaaaaugccuuucaggcccauuaccuagaaaucuaucuuaaaacc

SEQ ID NO: 99442 - RNA, 64 nt, Homo Sapiens
cuauuaaagaagacuguggaaucuguuuaucggugcccauuauauccuuaaguuuggauauuua

SEQ ID NO: 99443 - RNA, 64 nt, Homo Sapiens
ugugaggcagaagaguuuucugugaaggaaaaaagcccauuagaguucuucaauucaaugcacg

SEQ ID NO: 99444 - RNA, 64 nt, Homo Sapiens
gcagaccaggcucugugugggcuagaggaaugucgcccauuacuccucaggccuggcccucggg

SEQ ID NO: 99445 - RNA, 64 nt, Homo Sapiens
uuuauuaaaacugaaaaaauggauuugcuucuaggcccauuauuugcaaaccugagugagcaca

SEQ ID NO: 99446 - RNA, 64 nt, Homo Sapiens
uuuuuaacuaguaaaagcaaaacuuuguaagaaugcccauuacuuguauauuucuauauuguuu

SEQ ID NO: 99447 - RNA, 64 nt, Homo Sapiens
gauuuuguuucaggagaggugaagggaagcauaugcccauuaauccuugaaauauaaaugaaag

SEQ ID NO: 99448 - RNA, 64 nt, Homo Sapiens
guggggcauccuuuugccuacucgcaguugagaagcccauuaucagccaggcuccucaugugac

SEQ ID NO: 99449 - RNA, 64 nt, Homo Sapiens
gcuacacucaggaguucucauugcuaaccauccugcccauuauaaugaggaguccucucuuuaa

SEQ ID NO: 99450 - RNA, 64 nt, Homo Sapiens
auaguuacaagcauugaacuucuuuaagucagaagcccauuaaauauuguaccuaaguaaauuu

SEQ ID NO: 99451 - RNA, 64 nt, Homo Sapiens
aguguuuacacuguucaucgcuguuaaacuuggugcccauuaacagaagcaaauauugucugcc

SEQ ID NO: 99452 - RNA, 64 nt, Homo Sapiens
aguaucuaugcaaaucuugaaagacgaaaucaaagcccauuaaugauucagaaucagugcuuga

SEQ ID NO: 99453 - RNA, 64 nt, Homo Sapiens
uuauuugugucauagaguaagauauuccuugaaagcccauuaaguggaauagacuuucugaaaa

SEQ ID NO: 99454 - RNA, 64 nt, Homo Sapiens
gaaaaugcuucauuacuuuaaauagcagcauuaagcccauuauagccucugaauugucccuucc

SEQ ID NO: 99455 - RNA, 64 nt, Homo Sapiens
uguaaagcaaacuuaauuguaauuaauuuauucagcccauuaagaaaguacuaaaguuuuaucu

SEQ ID NO: 99456 - RNA, 64 nt, Homo Sapiens
acuuugguucaaggggcccauccuugcuuuaugagcccauuagccacuaaaggggugaccuugu

SEQ ID NO: 99457 - RNA, 64 nt, Homo Sapiens
ugggagagguacuuucgccuccuuucuccaguuugcccauuaaccuacaguuuccaggugaggc

SEQ ID NO: 99458 - RNA, 64 nt, Homo Sapiens
aguggggcugcagcccuagggaaaucccagaacagcccauuaccgcccugucugcugauucuga

SEQ ID NO: 99459 - RNA, 64 nt, Homo Sapiens
ccaucggucagcagggccacugaguagucauuuugcccauuagcccacugccuggaaagcccuu

SEQ ID NO: 99460 - RNA, 64 nt, Homo Sapiens
ggaauggaugggggacagugaggaggacacaccagcccauuaguuguuaaucaucaaucacauc

SEQ ID NO: 99461 - RNA, 64 nt, Homo Sapiens
ccacugccuggaaagcccuuugaguagucauuuugcccauuagcccaucggucagcagggccac

SEQ ID NO: 99462 - RNA, 64 nt, Homo Sapiens
guaucgggaauuucuagugugcuaauaaaguaaggcccauuacucugguaugcuuguuccugcu

SEQ ID NO: 99463 - RNA, 64 nt, Homo Sapiens
cgucucccugugaugggcccuuaggccuggcugggcccauuacauaucccugugguggcucugg

SEQ ID NO: 99464 - RNA, 64 nt, Homo Sapiens
gaaaaaccuagaucaguggaucuccucucuggcugcccauuagaauguccuguggagauuaaac

SEQ ID NO: 99465 - RNA, 64 nt, Homo Sapiens
gaguggucugcucugcucgggcaaaacaagagaugcccauuacugugagggacccuugaagucu

SEQ ID NO: 99466 - RNA, 64 nt, Homo Sapiens
agaaggaaaaagagcagaauugcaagguuuccuugcccauuaucaaaugccuuaggauggaguu

SEQ ID NO: 99467 - RNA, 64 nt, Homo Sapiens
ccuccccucagagacaggccucaguucgagggcagcccauuaucugucgcagacaucugccaug

SEQ ID NO: 99468 - RNA, 64 nt, Homo Sapiens
ucacccuguggcaaaugccaggacagcugcaggugcccauuagcaacgccugccuucugggcaa

SEQ ID NO: 99469 - RNA, 64 nt, Homo Sapiens
uuguauggauauagcauaguauguuuauccauucgcccauuaaaggaaaucuugauugcuucca

SEQ ID NO: 99470 - RNA, 64 nt, Homo Sapiens
ugaaggaagagauguucccucuaauuucucucuagcccauuauaaccugcuaucuuggggcaac

SEQ ID NO: 99471 - RNA, 64 nt, Homo Sapiens
agggaacugguuagauaaaucaaacaaagugaaugcccauuaauggggggcaaagccccaacug

SEQ ID NO: 99472 - RNA, 64 nt, Homo Sapiens
gaacaggguccucaggcccuugagcccuguuguggcccauuaaagcaaaaguucugagaggagc

SEQ ID NO: 99473 - RNA, 64 nt, Homo Sapiens
agacccagccagagaagcagggauuccagaagcugcccauuaagggagaaggagaggauccggu

SEQ ID NO: 99474 - RNA, 64 nt, Homo Sapiens
agauaaucaacacucaggaccuucagccuugaacgcccauuagugcuauguuauagaaccuaca

SEQ ID NO: 99475 - RNA, 64 nt, Homo Sapiens
ccuugucgugcggucaaggagcggguucagguccgcccauuacuuuggcccccagccccucguc

SEQ ID NO: 99476 - RNA, 64 nt, Homo Sapiens
agaauuaugcauaaauuuccucuuacaguucgaugcccauuaguuuuauauaacauuuauuuga

SEQ ID NO: 99477 - RNA, 64 nt, Homo Sapiens
gucacaauuuuccagauauuagaucaagaauacugcccauuacuuguucaauuuacuuuuacaa

SEQ ID NO: 99478 - RNA, 64 nt, Homo Sapiens
aagggugaaggcuggagggaggaauaacacacuggcccauuaguagccuccuaugguuugggaa

SEQ ID NO: 99479 - RNA, 64 nt, Homo Sapiens
cuuugauuuaaaauaggccaaaggccauuguggagcccauuauaacccagcagccaccuugaaa

SEQ ID NO: 99480 - RNA, 64 nt, Homo Sapiens
acaauacauccuaugcuuuccgacuuugucucuagcccauuaaugcccuggaggggcucuggga

SEQ ID NO: 99481 - RNA, 64 nt, Homo Sapiens
auucuuuuuaauuaaaaauaguuauaccauaugugcccauuaaaauuaauguuauuauuugauu

SEQ ID NO: 99482 - RNA, 64 nt, Homo Sapiens
aacugagagcccagggauguucauuucuucagcagcccauuagcgggucucgauuugaggacau

SEQ ID NO: 99483 - RNA, 64 nt, Homo Sapiens
ucuggcaugcccccuccugcaggcagagucccgugcccauuaggcgccugacauucacacagag

SEQ ID NO: 99484 - RNA, 64 nt, Homo Sapiens
cuggggaaaccauggcaaaguggauccaguuagagcccauuaaucuugaucauuccgguuuuuu

SEQ ID NO: 99485 - RNA, 64 nt, Homo Sapiens
agaacguuccuugccaggccaggcaaaagccaaggcccauuagccaguuuagcauuuacuuuaa

SEQ ID NO: 99486 - RNA, 64 nt, Homo Sapiens
cgagaugaucaucacaaccacagaccaccagguggcccauuacuacagccuuguugccgcuggc

SEQ ID NO: 99487 - RNA, 64 nt, Homo Sapiens
uucuuauuucaguuagauggggaacauuuugcuagcccauuagaagcacacagaauuauccuug

SEQ ID NO: 99488 - RNA, 64 nt, Homo Sapiens
ggcaucauccucccaacuacguuucauuucagggcauagucaaaguauuuugucagacuuagag

SEQ ID NO: 99489 - RNA, 64 nt, Homo Sapiens
aaaacauuccccuugggcugccaagcuauaaguccauagucaguacuuccuauguuaauuucca

SEQ ID NO: 99490 - RNA, 64 nt, Homo Sapiens
auguuuauagaugcugcugcucuuuucccugaagcauagucaaguaagaacugcucuacagaag

SEQ ID NO: 99491 - RNA, 64 nt, Homo Sapiens
uaugagaggcuuauagugcccuccauuguaaauccauagucaucuuuuuaagcuuauuguguuu

SEQ ID NO: 99492 - RNA, 64 nt, Homo Sapiens
uauagcaaguagucaggaccccagcucacuuuuucauagucauugugguuuagauccaauuccc

SEQ ID NO: 99493 - RNA, 64 nt, Homo Sapiens
uacaaggguuaaccauuuuuuuuaaguuugacuacauagucaaguccacaagccaucaagcacu

SEQ ID NO: 99494 - RNA, 64 nt, Homo Sapiens
ucuuccagggcaaagccagccacaugaaggcccacauagucaaggagaagaaaaauccucuaga

SEQ ID NO: 99495 - RNA, 64 nt, Homo Sapiens
uucauagacacagaaucaagaauaguucagaguucauagucauacuuuaccuuccaauggauaa

SEQ ID NO: 99496 - RNA, 64 nt, Homo Sapiens
uggcaaggucuuuaagaaguccucaacucuuacugcacauaagaucauucauacuggagagaaa

SEQ ID NO: 99497 - RNA, 64 nt, Homo Sapiens
ugguaaauucuuuaacaagucuucaacccuuucugcacauaauauaauucauacuggagagaaa

SEQ ID NO: 99498 - RNA, 64 nt, Homo Sapiens
gcucucccggcacaccucauaguugggaagagaugcacauaaucacugaaugcacugaacucag

SEQ ID NO: 99499 - RNA, 64 nt, Homo Sapiens
guuagccagcagcuccagaaucugcccuggcucugcacauaagucuccuugggagcugggcucu

SEQ ID NO: 99500 - RNA, 64 nt, Homo Sapiens
aaaaaaaaaagguguaaauuaaguuuguacaguaccaaaaaagaagauauauuuuuauuauaca

SEQ ID NO: 99501 - RNA, 64 nt, Homo Sapiens
auggcuaucauguacugggggccugccccaguacccaaaaaacauugagagaacaggggagcaa

SEQ ID NO: 99502 - RNA, 64 nt, Homo Sapiens
auggaacugauggauuccucucccacugccucacccaaaaaaaacggucuuggcggccuagggg

SEQ ID NO: 99503 - RNA, 64 nt, Homo Sapiens
caagccauucaguuucuuguuuguaccuaaaacaccaaaaaagaaacacucaaauccagcugcu

SEQ ID NO: 99504 - RNA, 64 nt, Homo Sapiens
uuagauucaacauuaaugguagaguggcauuuuaccaaaaaaauggguguauuugauuugggug

SEQ ID NO: 99505 - RNA, 64 nt, Homo Sapiens
agugaaaacccaucucaaaaaaaaaaaaaaaaaaccaaaaaaacuguccagcuguggacuuuca

SEQ ID NO: 99506 - RNA, 64 nt, Homo Sapiens
aaggauggcuacauaccaauacucauauaauuagccaaaaaaaaguuaacccauccuuucauuu

SEQ ID NO: 99507 - RNA, 64 nt, Homo Sapiens
aaccccuugugucguuguuacuguuccccuaaaaccaaaaaaugcaauuaacuuuugaugcuuu

SEQ ID NO: 99508 - RNA, 64 nt, Homo Sapiens
uguucugcagugagagauuuugucuuaucaggccccaaaaaaccaaaccuuugguagaagcucc

SEQ ID NO: 99509 - RNA, 64 nt, Homo Sapiens
aaacccaaucugaggaaagaacuuggguuugcacccaaaaaaaaagcauucguuggagagccuu

SEQ ID NO: 99510 - RNA, 64 nt, Homo Sapiens
aaagggggcauaaacuuuaucaccuccccaccccccaaaaaauacuugugugaaauucccucuu

SEQ ID NO: 99511 - RNA, 64 nt, Homo Sapiens
uguguuguuuguuccuccucugggugucugaguuccaaaaaaugucugccugccuguuucuguc

SEQ ID NO: 99512 - RNA, 64 nt, Homo Sapiens
auacacuuccuguaaacaaauggggacaaugcauccaaaaaaucuuuuuaaacagauuacacaa

SEQ ID NO: 99513 - RNA, 64 nt, Homo Sapiens
uuuuuucuuuucaccacccuguugagcaauuuucccaaaaaaagggcagcaauuauuaaauuga

SEQ ID NO: 99514 - RNA, 64 nt, Homo Sapiens
aaaaagauauuugaaguguuaauuuagaaacaaaccaaaaaaaauaaccuuauugggaauggau

SEQ ID NO: 99515 - RNA, 64 nt, Homo Sapiens
auaagagcauucauuaaauauaucauucagcuguccaaaaaauaaauuuccaagaacaacuuga

SEQ ID NO: 99516 - RNA, 64 nt, Homo Sapiens
guuggggaaucuauacauuagaaauugcaaaggaccaaaaaaauuucuucaaccaaaaaagaaa

SEQ ID NO: 99517 - RNA, 64 nt, Homo Sapiens
aagaaauugcaaaggaccaauuugguuucuucaaccaaaaaagaacaaaaaccugguuuucuuu

SEQ ID NO: 99518 - RNA, 64 nt, Homo Sapiens
agacguaaaaauaaaggcauuuugauuacagccaccaaaaaaauugaggaauuuuaaacacaca

SEQ ID NO: 99519 - RNA, 64 nt, Homo Sapiens
caaggugcaucauuaauauuaagauacuucaaaaccaaaaaaacacagucaucacaagcauagg

SEQ ID NO: 99520 - RNA, 64 nt, Homo Sapiens; identical to SEQ ID NO: 99508

SEQ ID NO: 99521 - RNA, 64 nt, Homo Sapiens
aaacccaaucugaggaaagaacuuggguuugcacccaaaaaaaaagcauucauuggagagccuu

SEQ ID NO: 99522 - RNA, 64 nt, Homo Sapiens
aggacaugagggggaaaguccuuuuugcccuucuccaaaaaauaaccuuccacagagacaaacu

SEQ ID NO: 99523 - RNA, 64 nt, Homo Sapiens
ugcauuuggauuuuguuguuugauggaauuugagccaaaaaaaaaauacgcaggcuuuccuauu

SEQ ID NO: 99524 - RNA, 64 nt, Homo Sapiens
ggguaggguggaguggggagggauuaaaacccauccaaaaaauaaauaaaaacuauauaggugc

SEQ ID NO: 99525 - RNA, 64 nt, Homo Sapiens
ccuauuugaacuagcuucuugucuuaggccugaaccaaaaaacaacaaacaaacaaaaaacaag

SEQ ID NO: 99526 - RNA, 64 nt, Homo Sapiens
aaaagacauuucaucuaagcggguuaucugauaaccaaaaaaaaaaggaaaauauuuucacaaa

SEQ ID NO: 99527 - RNA, 64 nt, Homo Sapiens
aaaaaaaaaaaaagaauuccgcaagacuccgucuccaaaaaaaaacuccagccugggcaacaga

SEQ ID NO: 99528 - RNA, 64 nt, Homo Sapiens
aggaaauaaaaugcacauaacuaaugcagugauaccaaaaaaaacauuguacuggaagugcuau

SEQ ID NO: 99529 - RNA, 64 nt, Homo Sapiens
ugccgggaccaaauggauucaauaauaaaaccuuccaaaaaaaguccaucucaauaaaauuaau

SEQ ID NO: 99530 - RNA, 64 nt, Homo Sapiens
ugugcccuuguaccgaugcagugucaacuuuugaccaaaaaaauugggagagggaauuuaaaag

SEQ ID NO: 99531 - RNA, 64 nt, Homo Sapiens
acaagcucaucuauuuggaaugcacgguacaaacccaaaaaagauuaacaacuguagcaagaac

SEQ ID NO: 99532 - RNA, 64 nt, Homo Sapiens
uugaaaaaaaaaaaaaaaaagcugucuugcccuuccaaaaaaaaagcuguauuguucuuuaaug

SEQ ID NO: 99533 - RNA, 64 nt, Homo Sapiens
ugugguuuuuucccauguguccaauuucucaugaccaaaaaauggcagggcgcggauuuaaagu

SEQ ID NO: 99534 - RNA, 64 nt, Homo Sapiens
cuuuauuguaugagagcuuaacaucuuuuucagaccaaaaaaaauauauuaguuuugaauauaa

SEQ ID NO: 99535 - RNA, 64 nt, Homo Sapiens
agaaacaaaacauaaaaaccauaucuuuaaauuaccaaaaaacauuuauucuguguacuaguac

SEQ ID NO: 99536 - RNA, 64 nt, Homo Sapiens
aagagcgagagagaguacguaaacugaaacacaaccaaaaaagccaaaguucuuucaaaaaaaa

SEQ ID NO: 99537 - RNA, 64 nt, Homo Sapiens
uugaaaaagaagauaaaaagccacugagaaaacaccaaaaaauuacacguuaucccaugauguu

SEQ ID NO: 99538 - RNA, 64 nt, Homo Sapiens
accaugccacugcacuccagccugggugacacagccaaaaaaaaaaccacuaaguuagaucucu

SEQ ID NO: 99539 - RNA, 64 nt, Homo Sapiens
auauaauaagggaaaagauaagcagauuucgcaaccaaaaaauaucgaaagucucugugugaug

SEQ ID NO: 99540 - RNA, 64 nt, Homo Sapiens
cuuagcuuuuauuuuaauaguacauaauuuaauaccaaaaaaggcgccuggauccccaaaaaac

SEQ ID NO: 99541 - RNA, 64 nt, Homo Sapiens
acauaauuuaauaccaaaaaaggcgccuggauccccaaaaaaccgaggcugggagcuaguggcc

SEQ ID NO: 99542 - RNA, 64 nt, Homo Sapiens
aaaaaaaaaaagaauaaauaugcauucaaccuuaccaaaaaaaaacaugaccaaaaaccaaaag

SEQ ID NO: 99543 - RNA, 64 nt, Homo Sapiens
ggagacaauuucacauggacaacccccucaaaagccaaaaaaugcagacaagcaacccaaacug

SEQ ID NO: 99544 - RNA, 64 nt, Homo Sapiens
aucuuccuguuaccaaagcugggcagagacaaaaccaaaaaagagaauuuuagaccaauauccu

SEQ ID NO: 99545 - RNA, 64 nt, Homo Sapiens
aauugaaaaacacuacuuuaaaguucauauggaaccaaaaaagagcccacauugccaagucaau

SEQ ID NO: 99546 - RNA, 64 nt, Homo Sapiens
ugucuggccucacgugucucagauuuucuaagaaccaaaaaaaaaaaaggaaaaaaaacacaaa

SEQ ID NO: 99547 - RNA, 64 nt, Homo Sapiens
aaaaaaaaggaaaaaaaacacaaaacaacaaaaaccaaaaaaaaaaaaaaucacaaaaacaaaa

SEQ ID NO: 99548 - RNA, 64 nt, Homo Sapiens
aaaaaacccacaaaaucaaaaaaccaaaaacaaaccaaaaaaaaggugaaaaacaaacaaaaaa

SEQ ID NO: 99549 - RNA, 64 nt, Homo Sapiens
aaaaaaaaaggaaagaaacuaaaaaaacaaccaaccaaaaaaaagugacaagggaggaaagacc

SEQ ID NO: 99550 - RNA, 64 nt, Homo Sapiens
aaccaaccaaaaaaaaaaaacaagggaggaaagaccaaaaaaacgguccucagagcaggaguga

SEQ ID NO: 99551 - RNA, 64 nt, Homo Sapiens
acuccagccugggcaacauagcgagaccucaucuccaaaaaagaaaacaaaaaacaaaaaaagg

SEQ ID NO: 99552 - RNA, 64 nt, Homo Sapiens
gaaaagaaaaauuuaugcacugauuuaaaacaaaccaaaaaaaaagaaaaaaacaaaaaaaaaa

SEQ ID NO: 99553 - RNA, 64 nt, Homo Sapiens
aauaauaaguuagcucugaaaguuuuguuuuugaccaaaaaaaucagacuguggaaggaucugc

SEQ ID NO: 99554 - RNA, 64 nt, Homo Sapiens
gaggaaaagaaaaauguacaagagaaaggaaaggccaaaaaaaaagcacccaagaccacagaaa

SEQ ID NO: 99555 - RNA, 64 nt, Homo Sapiens
gaacugcugcuaaagugauuuuuuuuuuauuugaccaaaaaaaaaaaggcccaagaagaagaaa

SEQ ID NO: 99556 - RNA, 64 nt, Homo Sapiens
uuuaaaauaaugcuauuacacaaagcugcauuuaccaaaaaauacaguaaaaucauaauacaga

SEQ ID NO: 99557 - RNA, 64 nt, Homo Sapiens
cccuccagccugggugacagagugagacccuguuccaaaaaaaaaaaaaaacccaaaaaaccuc

SEQ ID NO: 99558 - RNA, 64 nt, Homo Sapiens
agagugagacccuguuccaaaaaaaaaaaaaaacccaaaaaaccucaauggcuuuuugcuuuug

SEQ ID NO: 99559 - RNA, 64 nt, Homo Sapiens; identical to SEQ ID NO: 22114

SEQ ID NO: 99560 - RNA, 64 nt, Homo Sapiens; identical to SEQ ID NO: 22115

SEQ ID NO: 99561 - RNA, 64 nt, Homo Sapiens; identical to SEQ ID NO: 22116

SEQ ID NO: 99562 - RNA, 64 nt, Homo Sapiens; identical to SEQ ID NO: 22117

SEQ ID NO: 99563 - RNA, 64 nt, Homo Sapiens; identical to SEQ ID NO: 22118

SEQ ID NO: 99564 - RNA, 64 nt, Homo Sapiens; identical to SEQ ID NO: 22119

SEQ ID NO: 99565 - RNA, 64 nt, Homo Sapiens; identical to SEQ ID NO: 22120

SEQ ID NO: 99566 - RNA, 64 nt, Homo Sapiens; identical to SEQ ID NO: 22121

SEQ ID NO: 99567 - RNA, 64 nt, Homo Sapiens; identical to SEQ ID NO: 22122

SEQ ID NO: 99568 - RNA, 64 nt, Homo Sapiens; identical to SEQ ID NO: 22123

SEQ ID NO: 99569 - RNA, 64 nt, Homo Sapiens; identical to SEQ ID NO: 22124

SEQ ID NO: 99570 - RNA, 64 nt, Homo Sapiens; identical to SEQ ID NO: 22125

SEQ ID NO: 99571 - RNA, 64 nt, Homo Sapiens; identical to SEQ ID NO: 22126

SEQ ID NO: 99572 - RNA, 64 nt, Homo Sapiens; identical to SEQ ID NO: 22127

SEQ ID NO: 99573 - RNA, 64 nt, Homo Sapiens; identical to SEQ ID NO: 22128

SEQ ID NO: 99574 - RNA, 64 nt, Homo Sapiens; identical to SEQ ID NO: 22129

SEQ ID NO: 99575 - RNA, 64 nt, Homo Sapiens; identical to SEQ ID NO: 22130

SEQ ID NO: 99576 - RNA, 64 nt, Homo Sapiens; identical to SEQ ID NO: 22131

SEQ ID NO: 99577 - RNA, 64 nt, Homo Sapiens; identical to SEQ ID NO: 22132

SEQ ID NO: 99578 - RNA, 64 nt, Homo Sapiens; identical to SEQ ID NO: 22133

SEQ ID NO: 99579 - RNA, 64 nt, Homo Sapiens; identical to SEQ ID NO: 22134

SEQ ID NO: 99580 - RNA, 64 nt, Homo Sapiens; identical to SEQ ID NO: 22135

SEQ ID NO: 99581 - RNA, 64 nt, Homo Sapiens; identical to SEQ ID NO: 22136

SEQ ID NO: 99582 - RNA, 64 nt, Homo Sapiens; identical to SEQ ID NO: 22137

SEQ ID NO: 99583 - RNA, 64 nt, Homo Sapiens; identical to SEQ ID NO: 22138

SEQ ID NO: 99584 - RNA, 64 nt, Homo Sapiens; identical to SEQ ID NO: 22139

SEQ ID NO: 99585 - RNA, 64 nt, Homo Sapiens; identical to SEQ ID NO: 22140

SEQ ID NO: 99586 - RNA, 64 nt, Homo Sapiens; identical to SEQ ID NO: 22141

SEQ ID NO: 99587 - RNA, 64 nt, Homo Sapiens; identical to SEQ ID NO: 22142

SEQ ID NO: 99588 - RNA, 64 nt, Homo Sapiens; identical to SEQ ID NO: 22143

SEQ ID NO: 99589 - RNA, 64 nt, Homo Sapiens; identical to SEQ ID NO: 22144

SEQ ID NO: 99590 - RNA, 64 nt, Homo Sapiens; identical to SEQ ID NO: 22145

SEQ ID NO: 99591 - RNA, 64 nt, Homo Sapiens; identical to SEQ ID NO: 22146

SEQ ID NO: 99592 - RNA, 64 nt, Homo Sapiens; identical to SEQ ID NO: 22147

SEQ ID NO: 99593 - RNA, 64 nt, Homo Sapiens; identical to SEQ ID NO: 22148

SEQ ID NO: 99594 - RNA, 64 nt, Homo Sapiens; identical to SEQ ID NO: 22149

SEQ ID NO: 99595 - RNA, 64 nt, Homo Sapiens; identical to SEQ ID NO: 22150

SEQ ID NO: 99596 - RNA, 64 nt, Homo Sapiens; identical to SEQ ID NO: 22151

SEQ ID NO: 99597 - RNA, 64 nt, Homo Sapiens; identical to SEQ ID NO: 22152

SEQ ID NO: 99598 - RNA, 64 nt, Homo Sapiens; identical to SEQ ID NO: 22153

SEQ ID NO: 99599 - RNA, 64 nt, Homo Sapiens; identical to SEQ ID NO: 22154

SEQ ID NO: 99600 - RNA, 64 nt, Homo Sapiens; identical to SEQ ID NO: 22155

SEQ ID NO: 99601 - RNA, 64 nt, Homo Sapiens; identical to SEQ ID NO: 22156

SEQ ID NO: 99602 - RNA, 64 nt, Homo Sapiens; identical to SEQ ID NO: 22157

SEQ ID NO: 99603 - RNA, 64 nt, Homo Sapiens; identical to SEQ ID NO: 22158

SEQ ID NO: 99604 - RNA, 64 nt, Homo Sapiens; identical to SEQ ID NO: 22159

SEQ ID NO: 99605 - RNA, 64 nt, Homo Sapiens; identical to SEQ ID NO: 22160

SEQ ID NO: 99606 - RNA, 64 nt, Homo Sapiens; identical to SEQ ID NO: 22161

SEQ ID NO: 99607 - RNA, 64 nt, Homo Sapiens; identical to SEQ ID NO: 22162

SEQ ID NO: 99608 - RNA, 64 nt, Homo Sapiens; identical to SEQ ID NO: 22163

SEQ ID NO: 99609 - RNA, 64 nt, Homo Sapiens; identical to SEQ ID NO: 22164

SEQ ID NO: 99610 - RNA, 64 nt, Homo Sapiens; identical to SEQ ID NO: 22165

SEQ ID NO: 99611 - RNA, 64 nt, Homo Sapiens; identical to SEQ ID NO: 22166

SEQ ID NO: 99612 - RNA, 64 nt, Homo Sapiens; identical to SEQ ID NO: 22167

SEQ ID NO: 99613 - RNA, 64 nt, Homo Sapiens; identical to SEQ ID NO: 22168

SEQ ID NO: 99614 - RNA, 64 nt, Homo Sapiens; identical to SEQ ID NO: 22169

SEQ ID NO: 99615 - RNA, 64 nt, Homo Sapiens; identical to SEQ ID NO: 22170

SEQ ID NO: 99616 - RNA, 64 nt, Homo Sapiens; identical to SEQ ID NO: 22171

SEQ ID NO: 99617 - RNA, 64 nt, Homo Sapiens; identical to SEQ ID NO: 22172

SEQ ID NO: 99618 - RNA, 64 nt, Homo Sapiens; identical to SEQ ID NO: 22173

SEQ ID NO: 99619 - RNA, 64 nt, Homo Sapiens; identical to SEQ ID NO: 22174

SEQ ID NO: 99620 - RNA, 64 nt, Homo Sapiens; identical to SEQ ID NO: 22175

SEQ ID NO: 99621 - RNA, 64 nt, Homo Sapiens; identical to SEQ ID NO: 22176

SEQ ID NO: 99622 - RNA, 64 nt, Homo Sapiens; identical to SEQ ID NO: 22177

SEQ ID NO: 99623 - RNA, 64 nt, Homo Sapiens; identical to SEQ ID NO: 22178

SEQ ID NO: 99624 - RNA, 64 nt, Homo Sapiens; identical to SEQ ID NO: 22179

SEQ ID NO: 99625 - RNA, 64 nt, Homo Sapiens; identical to SEQ ID NO: 22180

SEQ ID NO: 99626 - RNA, 64 nt, Homo Sapiens; identical to SEQ ID NO: 22181

SEQ ID NO: 99627 - RNA, 64 nt, Homo Sapiens; identical to SEQ ID NO: 22182

SEQ ID NO: 99628 - RNA, 64 nt, Homo Sapiens; identical to SEQ ID NO: 22183

SEQ ID NO: 99629 - RNA, 64 nt, Homo Sapiens; identical to SEQ ID NO: 22133

SEQ ID NO: 99630 - RNA, 64 nt, Homo Sapiens; identical to SEQ ID NO: 22134

SEQ ID NO: 99631 - RNA, 64 nt, Homo Sapiens; identical to SEQ ID NO: 22186

SEQ ID NO: 99632 - RNA, 64 nt, Homo Sapiens; identical to SEQ ID NO: 22187

SEQ ID NO: 99633 - RNA, 64 nt, Homo Sapiens; identical to SEQ ID NO: 22188

SEQ ID NO: 99634 - RNA, 64 nt, Homo Sapiens; identical to SEQ ID NO: 22189

SEQ ID NO: 99635 - RNA, 64 nt, Homo Sapiens; identical to SEQ ID NO: 22190

SEQ ID NO: 99636 - RNA, 64 nt, Homo Sapiens; identical to SEQ ID NO: 22191

SEQ ID NO: 99637 - RNA, 64 nt, Homo Sapiens; identical to SEQ ID NO: 22192

SEQ ID NO: 99638 - RNA, 64 nt, Homo Sapiens; identical to SEQ ID NO: 22193

SEQ ID NO: 99639 - RNA, 64 nt, Homo Sapiens; identical to SEQ ID NO: 22194

SEQ ID NO: 99640 - RNA, 64 nt, Homo Sapiens; identical to SEQ ID NO: 22195

SEQ ID NO: 99641 - RNA, 64 nt, Homo Sapiens; identical to SEQ ID NO: 22196

SEQ ID NO: 99642 - RNA, 64 nt, Homo Sapiens; identical to SEQ ID NO: 22197

SEQ ID NO: 99643 - RNA, 64 nt, Homo Sapiens; identical to SEQ ID NO: 22198

SEQ ID NO: 99644 - RNA, 64 nt, Homo Sapiens; identical to SEQ ID NO: 22199

SEQ ID NO: 99645 - RNA, 64 nt, Homo Sapiens; identical to SEQ ID NO: 22200

SEQ ID NO: 99646 - RNA, 64 nt, Homo Sapiens; identical to SEQ ID NO: 22201

SEQ ID NO: 99647 - RNA, 64 nt, Homo Sapiens; identical to SEQ ID NO: 22202

SEQ ID NO: 99648 - RNA, 64 nt, Homo Sapiens; identical to SEQ ID NO: 22203

SEQ ID NO: 99649 - RNA, 64 nt, Homo Sapiens; identical to SEQ ID NO: 22204

SEQ ID NO: 99650 - RNA, 64 nt, Homo Sapiens; identical to SEQ ID NO: 22205

SEQ ID NO: 99651 - RNA, 64 nt, Homo Sapiens; identical to SEQ ID NO: 22206

SEQ ID NO: 99652 - RNA, 64 nt, Homo Sapiens; identical to SEQ ID NO: 22207

SEQ ID NO: 99653 - RNA, 64 nt, Homo Sapiens; identical to SEQ ID NO: 22208

SEQ ID NO: 99654 - RNA, 64 nt, Homo Sapiens; identical to SEQ ID NO: 22209

SEQ ID NO: 99655 - RNA, 64 nt, Homo Sapiens; identical to SEQ ID NO: 22210

SEQ ID NO: 99656 - RNA, 64 nt, Homo Sapiens; identical to SEQ ID NO: 22211

SEQ ID NO: 99657 - RNA, 64 nt, Homo Sapiens; identical to SEQ ID NO: 22212

SEQ ID NO: 99658 - RNA, 64 nt, Homo Sapiens; identical to SEQ ID NO: 22213

SEQ ID NO: 99659 - RNA, 64 nt, Homo Sapiens; identical to SEQ ID NO: 22214

SEQ ID NO: 99660 - RNA, 64 nt, Homo Sapiens; identical to SEQ ID NO: 22215

SEQ ID NO: 99661 - RNA, 64 nt, Homo Sapiens; identical to SEQ ID NO: 22216

SEQ ID NO: 99662 - RNA, 64 nt, Homo Sapiens; identical to SEQ ID NO: 22217

SEQ ID NO: 99663 - RNA, 64 nt, Homo Sapiens; identical to SEQ ID NO: 22218

SEQ ID NO: 99664 - RNA, 64 nt, Homo Sapiens; identical to SEQ ID NO: 22219

SEQ ID NO: 99665 - RNA, 64 nt, Homo Sapiens; identical to SEQ ID NO: 22220

SEQ ID NO: 99666 - RNA, 64 nt, Homo Sapiens; identical to SEQ ID NO: 22221

SEQ ID NO: 99667 - RNA, 64 nt, Homo Sapiens; identical to SEQ ID NO: 22222

SEQ ID NO: 99668 - RNA, 64 nt, Homo Sapiens; identical to SEQ ID NO: 22223

SEQ ID NO: 99669 - RNA, 64 nt, Homo Sapiens; identical to SEQ ID NO: 22224

SEQ ID NO: 99670 - RNA, 64 nt, Homo Sapiens; identical to SEQ ID NO: 22225

SEQ ID NO: 99671 - RNA, 64 nt, Homo Sapiens; identical to SEQ ID NO: 22226

SEQ ID NO: 99672 - RNA, 64 nt, Homo Sapiens; identical to SEQ ID NO: 22227

SEQ ID NO: 99673 - RNA, 64 nt, Homo Sapiens; identical to SEQ ID NO: 22228

SEQ ID NO: 99674 - RNA, 64 nt, Homo Sapiens; identical to SEQ ID NO: 22229

SEQ ID NO: 99675 - RNA, 64 nt, Homo Sapiens; identical to SEQ ID NO: 22230

SEQ ID NO: 99676 - RNA, 64 nt, Homo Sapiens; identical to SEQ ID NO: 22231

SEQ ID NO: 99677 - RNA, 64 nt, Homo Sapiens; identical to SEQ ID NO: 22232

SEQ ID NO: 99678 - RNA, 64 nt, Homo Sapiens; identical to SEQ ID NO: 22233

SEQ ID NO: 99679 - RNA, 64 nt, Homo Sapiens; identical to SEQ ID NO: 22234

SEQ ID NO: 99680 - RNA, 64 nt, Homo Sapiens; identical to SEQ ID NO: 22235

SEQ ID NO: 99681 - RNA, 64 nt, Homo Sapiens; identical to SEQ ID NO: 22236

SEQ ID NO: 99682 - RNA, 64 nt, Homo Sapiens; identical to SEQ ID NO: 22237

SEQ ID NO: 99683 - RNA, 64 nt, Homo Sapiens; identical to SEQ ID NO: 22238

SEQ ID NO: 99684 - RNA, 64 nt, Homo Sapiens; identical to SEQ ID NO: 22239

SEQ ID NO: 99685 - RNA, 64 nt, Homo Sapiens; identical to SEQ ID NO: 22240

SEQ ID NO: 99686 - RNA, 64 nt, Homo Sapiens; identical to SEQ ID NO: 22241

SEQ ID NO: 99687 - RNA, 64 nt, Homo Sapiens; identical to SEQ ID NO: 22242

SEQ ID NO: 99688 - RNA, 64 nt, Homo Sapiens; identical to SEQ ID NO: 22243

SEQ ID NO: 99689 - RNA, 64 nt, Homo Sapiens; identical to SEQ ID NO: 22244

SEQ ID NO: 99690 - RNA, 64 nt, Homo Sapiens; identical to SEQ ID NO: 22245

SEQ ID NO: 99691 - RNA, 64 nt, Homo Sapiens; identical to SEQ ID NO: 22246

SEQ ID NO: 99692 - RNA, 64 nt, Homo Sapiens; identical to SEQ ID NO: 22247

SEQ ID NO: 99693 - RNA, 64 nt, Homo Sapiens; identical to SEQ ID NO: 22248

SEQ ID NO: 99694 - RNA, 64 nt, Homo Sapiens; identical to SEQ ID NO: 22249

SEQ ID NO: 99695 - RNA, 64 nt, Homo Sapiens; identical to SEQ ID NO: 22250

SEQ ID NO: 99696 - RNA, 64 nt, Homo Sapiens; identical to SEQ ID NO: 22251

SEQ ID NO: 99697 - RNA, 64 nt, Homo Sapiens; identical to SEQ ID NO: 22252

SEQ ID NO: 99698 - RNA, 64 nt, Homo Sapiens; identical to SEQ ID NO: 22253

SEQ ID NO: 99699 - RNA, 64 nt, Homo Sapiens; identical to SEQ ID NO: 22254

SEQ ID NO: 99700 - RNA, 64 nt, Homo Sapiens; identical to SEQ ID NO: 22255

SEQ ID NO: 99701 - RNA, 64 nt, Homo Sapiens; identical to SEQ ID NO: 45477

SEQ ID NO: 99702 - RNA, 64 nt, Homo Sapiens; identical to SEQ ID NO: 45478

SEQ ID NO: 99703 - RNA, 64 nt, Homo Sapiens; identical to SEQ ID NO: 45479

SEQ ID NO: 99704 - RNA, 64 nt, Homo Sapiens; identical to SEQ ID NO: 45480

SEQ ID NO: 99705 - RNA, 64 nt, Homo Sapiens; identical to SEQ ID NO: 45481

SEQ ID NO: 99706 - RNA, 64 nt, Homo Sapiens; identical to SEQ ID NO: 45482

SEQ ID NO: 99707 - RNA, 64 nt, Homo Sapiens; identical to SEQ ID NO: 45483

SEQ ID NO: 99708 - RNA, 64 nt, Homo Sapiens; identical to SEQ ID NO: 45484

SEQ ID NO: 99709 - RNA, 64 nt, Homo Sapiens; identical to SEQ ID NO: 45485

SEQ ID NO: 99710 - RNA, 64 nt, Homo Sapiens; identical to SEQ ID NO: 45486

SEQ ID NO: 99711 - RNA, 64 nt, Homo Sapiens; identical to SEQ ID NO: 45487

SEQ ID NO: 99712 - RNA, 56 nt, Homo Sapiens; identical to SEQ ID NO: 45488

SEQ ID NO: 99713 - RNA, 64 nt, Homo Sapiens; identical to SEQ ID NO: 45489

SEQ ID NO: 99714 - RNA, 64 nt, Homo Sapiens; identical to SEQ ID NO: 45490

SEQ ID NO: 99715 - RNA, 64 nt, Homo Sapiens; identical to SEQ ID NO: 45491

SEQ ID NO: 99716 - RNA, 64 nt, Homo Sapiens; identical to SEQ ID NO: 45492

SEQ ID NO: 99717 - RNA, 64 nt, Homo Sapiens; identical to SEQ ID NO: 45493

SEQ ID NO: 99718 - RNA, 64 nt, Homo Sapiens; identical to SEQ ID NO: 45494

SEQ ID NO: 99719 - RNA, 64 nt, Homo Sapiens; identical to SEQ ID NO: 45495

SEQ ID NO: 99720 - RNA, 64 nt, Homo Sapiens; identical to SEQ ID NO: 45496

SEQ ID NO: 99721 - RNA, 64 nt, Homo Sapiens; identical to SEQ ID NO: 45497

SEQ ID NO: 99722 - RNA, 64 nt, Homo Sapiens; identical to SEQ ID NO: 45498

SEQ ID NO: 99723 - RNA, 64 nt, Homo Sapiens; identical to SEQ ID NO: 45499

SEQ ID NO: 99724 - RNA, 64 nt, Homo Sapiens; identical to SEQ ID NO: 45500

SEQ ID NO: 99725 - RNA, 64 nt, Homo Sapiens; identical to SEQ ID NO: 45501

SEQ ID NO: 99726 - RNA, 64 nt, Homo Sapiens; identical to SEQ ID NO: 45502

SEQ ID NO: 99727 - RNA, 64 nt, Homo Sapiens; identical to SEQ ID NO: 45503

SEQ ID NO: 99728 - RNA, 64 nt, Homo Sapiens; identical to SEQ ID NO: 45504

SEQ ID NO: 99729 - RNA, 64 nt, Homo Sapiens; identical to SEQ ID NO: 45505

SEQ ID NO: 99730 - RNA, 64 nt, Homo Sapiens; identical to SEQ ID NO: 45506

SEQ ID NO: 99731 - RNA, 64 nt, Homo Sapiens; identical to SEQ ID NO: 45507

SEQ ID NO: 99732 - RNA, 64 nt, Homo Sapiens; identical to SEQ ID NO: 45508

SEQ ID NO: 99733 - RNA, 64 nt, Homo Sapiens; identical to SEQ ID NO: 45509

SEQ ID NO: 99734 - RNA, 64 nt, Homo Sapiens; identical to SEQ ID NO: 45510

SEQ ID NO: 99735 - RNA, 64 nt, Homo Sapiens; identical to SEQ ID NO: 45511

SEQ ID NO: 99736 - RNA, 64 nt, Homo Sapiens; identical to SEQ ID NO: 45512

SEQ ID NO: 99737 - RNA, 64 nt, Homo Sapiens; identical to SEQ ID NO: 45513

SEQ ID NO: 99738 - RNA, 64 nt, Homo Sapiens; identical to SEQ ID NO: 45514

SEQ ID NO: 99739 - RNA, 64 nt, Homo Sapiens; identical to SEQ ID NO: 45515

SEQ ID NO: 99740 - RNA, 64 nt, Homo Sapiens; identical to SEQ ID NO: 45516

SEQ ID NO: 99741 - RNA, 64 nt, Homo Sapiens; identical to SEQ ID NO: 45517

SEQ ID NO: 99742 - RNA, 64 nt, Homo Sapiens; identical to SEQ ID NO: 45518

SEQ ID NO: 99743 - RNA, 64 nt, Homo Sapiens; identical to SEQ ID NO: 45519

SEQ ID NO: 99744 - RNA, 64 nt, Homo Sapiens; identical to SEQ ID NO: 45520

SEQ ID NO: 99745 - RNA, 64 nt, Homo Sapiens; identical to SEQ ID NO: 45521

SEQ ID NO: 99746 - RNA, 64 nt, Homo Sapiens; identical to SEQ ID NO: 45522

SEQ ID NO: 99747 - RNA, 64 nt, Homo Sapiens; identical to SEQ ID NO: 45523

SEQ ID NO: 99748 - RNA, 64 nt, Homo Sapiens; identical to SEQ ID NO: 45524

SEQ ID NO: 99749 - RNA, 64 nt, Homo Sapiens; identical to SEQ ID NO: 45525

SEQ ID NO: 99750 - RNA, 64 nt, Homo Sapiens; identical to SEQ ID NO: 45526

SEQ ID NO: 99751 - RNA, 64 nt, Homo Sapiens; identical to SEQ ID NO: 45527

SEQ ID NO: 99752 - RNA, 64 nt, Homo Sapiens; identical to SEQ ID NO: 45528

SEQ ID NO: 99753 - RNA, 64 nt, Homo Sapiens; identical to SEQ ID NO: 45529

SEQ ID NO: 99754 - RNA, 64 nt, Homo Sapiens; identical to SEQ ID NO: 45530

SEQ ID NO: 99755 - RNA, 64 nt, Homo Sapiens; identical to SEQ ID NO: 45531

SEQ ID NO: 99756 - RNA, 64 nt, Homo Sapiens; identical to SEQ ID NO: 45532

SEQ ID NO: 99757 - RNA, 64 nt, Homo Sapiens; identical to SEQ ID NO: 45533

SEQ ID NO: 99758 - RNA, 64 nt, Homo Sapiens; identical to SEQ ID NO: 45534

SEQ ID NO: 99759 - RNA, 64 nt, Homo Sapiens; identical to SEQ ID NO: 45535

SEQ ID NO: 99760 - RNA, 64 nt, Homo Sapiens; identical to SEQ ID NO: 45536

SEQ ID NO: 99761 - RNA, 64 nt, Homo Sapiens; identical to SEQ ID NO: 45537

SEQ ID NO: 99762 - RNA, 64 nt, Homo Sapiens; identical to SEQ ID NO: 45538

SEQ ID NO: 99763 - RNA, 64 nt, Homo Sapiens; identical to SEQ ID NO: 45539

SEQ ID NO: 99764 - RNA, 64 nt, Homo Sapiens; identical to SEQ ID NO: 45540

SEQ ID NO: 99765 - RNA, 64 nt, Homo Sapiens; identical to SEQ ID NO: 45541

SEQ ID NO: 99766 - RNA, 64 nt, Homo Sapiens; identical to SEQ ID NO: 45542

SEQ ID NO: 99767 - RNA, 64 nt, Homo Sapiens; identical to SEQ ID NO: 45543

SEQ ID NO: 99768 - RNA, 64 nt, Homo Sapiens; identical to SEQ ID NO: 45544

SEQ ID NO: 99769 - RNA, 64 nt, Homo Sapiens; identical to SEQ ID NO: 45545

SEQ ID NO: 99770 - RNA, 64 nt, Homo Sapiens; identical to SEQ ID NO: 45546

SEQ ID NO: 99771 - RNA, 64 nt, Homo Sapiens; identical to SEQ ID NO: 45547

SEQ ID NO: 99772 - RNA, 64 nt, Homo Sapiens; identical to SEQ ID NO: 45548

SEQ ID NO: 99773 - RNA, 64 nt, Homo Sapiens; identical to SEQ ID NO: 45549

SEQ ID NO: 99774 - RNA, 64 nt, Homo Sapiens; identical to SEQ ID NO: 45550

SEQ ID NO: 99775 - RNA, 64 nt, Homo Sapiens; identical to SEQ ID NO: 45551

SEQ ID NO: 99776 - RNA, 64 nt, Homo Sapiens; identical to SEQ ID NO: 45552

SEQ ID NO: 99777 - RNA, 64 nt, Homo Sapiens; identical to SEQ ID NO: 45553

SEQ ID NO: 99778 - RNA, 64 nt, Homo Sapiens; identical to SEQ ID NO: 45554

SEQ ID NO: 99779 - RNA, 64 nt, Homo Sapiens; identical to SEQ ID NO: 45555

SEQ ID NO: 99780 - RNA, 64 nt, Homo Sapiens; identical to SEQ ID NO: 45556

SEQ ID NO: 99781 - RNA, 64 nt, Homo Sapiens; identical to SEQ ID NO: 45557

SEQ ID NO: 99782 - RNA, 64 nt, Homo Sapiens; identical to SEQ ID NO: 45558

SEQ ID NO: 99783 - RNA, 64 nt, Homo Sapiens; identical to SEQ ID NO: 45559

SEQ ID NO: 99784 - RNA, 64 nt, Homo Sapiens; identical to SEQ ID NO: 45560

SEQ ID NO: 99785 - RNA, 64 nt, Homo Sapiens; identical to SEQ ID NO: 45561

SEQ ID NO: 99786 - RNA, 64 nt, Homo Sapiens; identical to SEQ ID NO: 45562

SEQ ID NO: 99787 - RNA, 64 nt, Homo Sapiens; identical to SEQ ID NO: 45563

SEQ ID NO: 99788 - RNA, 64 nt, Homo Sapiens; identical to SEQ ID NO: 45564

SEQ ID NO: 99789 - RNA, 64 nt, Homo Sapiens; identical to SEQ ID NO: 45565

SEQ ID NO: 99790 - RNA, 64 nt, Homo Sapiens; identical to SEQ ID NO: 45566

SEQ ID NO: 99791 - RNA, 64 nt, Homo Sapiens; identical to SEQ ID NO: 45567

SEQ ID NO: 99792 - RNA, 64 nt, Homo Sapiens; identical to SEQ ID NO: 45568

SEQ ID NO: 99793 - RNA, 64 nt, Homo Sapiens; identical to SEQ ID NO: 45569

SEQ ID NO: 99794 - RNA, 64 nt, Homo Sapiens; identical to SEQ ID NO: 45570

SEQ ID NO: 99795 - RNA, 64 nt, Homo Sapiens; identical to SEQ ID NO: 45571

SEQ ID NO: 99796 - RNA, 64 nt, Homo Sapiens; identical to SEQ ID NO: 45572

SEQ ID NO: 99797 - RNA, 64 nt, Homo Sapiens; identical to SEQ ID NO: 45573

SEQ ID NO: 99798 - RNA, 64 nt, Homo Sapiens; identical to SEQ ID NO: 45574

SEQ ID NO: 99799 - RNA, 64 nt, Homo Sapiens; identical to SEQ ID NO: 45575

SEQ ID NO: 99800 - RNA, 64 nt, Homo Sapiens; identical to SEQ ID NO: 45576

SEQ ID NO: 99801 - RNA, 64 nt, Homo Sapiens; identical to SEQ ID NO: 45577

SEQ ID NO: 99802 - RNA, 64 nt, Homo Sapiens; identical to SEQ ID NO: 45578

SEQ ID NO: 99803 - RNA, 64 nt, Homo Sapiens; identical to SEQ ID NO: 45579

SEQ ID NO: 99804 - RNA, 64 nt, Homo Sapiens; identical to SEQ ID NO: 45580

SEQ ID NO: 99805 - RNA, 64 nt, Homo Sapiens; identical to SEQ ID NO: 45581

SEQ ID NO: 99806 - RNA, 64 nt, Homo Sapiens; identical to SEQ ID NO: 45582

SEQ ID NO: 99807 - RNA, 64 nt, Homo Sapiens; identical to SEQ ID NO: 45583

SEQ ID NO: 99808 - RNA, 64 nt, Homo Sapiens; identical to SEQ ID NO: 45584

SEQ ID NO: 99809 - RNA, 64 nt, Homo Sapiens; identical to SEQ ID NO: 45585

SEQ ID NO: 99810 - RNA, 64 nt, Homo Sapiens; identical to SEQ ID NO: 45586

SEQ ID NO: 99811 - RNA, 64 nt, Homo Sapiens; identical to SEQ ID NO: 45587

SEQ ID NO: 99812 - RNA, 64 nt, Homo Sapiens; identical to SEQ ID NO: 45588

SEQ ID NO: 99813 - RNA, 64 nt, Homo Sapiens; identical to SEQ ID NO: 45589

SEQ ID NO: 99814 - RNA, 64 nt, Homo Sapiens; identical to SEQ ID NO: 45590

SEQ ID NO: 99815 - RNA, 64 nt, Homo Sapiens; identical to SEQ ID NO: 45591

SEQ ID NO: 99816 - RNA, 64 nt, Homo Sapiens; identical to SEQ ID NO: 45592

SEQ ID NO: 99817 - RNA, 64 nt, Homo Sapiens; identical to SEQ ID NO: 45593

SEQ ID NO: 99818 - RNA, 64 nt, Homo Sapiens; identical to SEQ ID NO: 45594

SEQ ID NO: 99819 - RNA, 64 nt, Homo Sapiens; identical to SEQ ID NO: 45595

SEQ ID NO: 99820 - RNA, 64 nt, Homo Sapiens; identical to SEQ ID NO: 45596

SEQ ID NO: 99821 - RNA, 64 nt, Homo Sapiens; identical to SEQ ID NO: 45597

SEQ ID NO: 99822 - RNA, 64 nt, Homo Sapiens; identical to SEQ ID NO: 45598

SEQ ID NO: 99823 - RNA, 64 nt, Homo Sapiens; identical to SEQ ID NO: 45599

SEQ ID NO: 99824 - RNA, 64 nt, Homo Sapiens; identical to SEQ ID NO: 45600

SEQ ID NO: 99825 - RNA, 64 nt, Homo Sapiens; identical to SEQ ID NO: 45601

SEQ ID NO: 99826 - RNA, 64 nt, Homo Sapiens; identical to SEQ ID NO: 45602

SEQ ID NO: 99827 - RNA, 64 nt, Homo Sapiens; identical to SEQ ID NO: 45603

SEQ ID NO: 99828 - RNA, 64 nt, Homo Sapiens; identical to SEQ ID NO: 45604

SEQ ID NO: 99829 - RNA, 64 nt, Homo Sapiens; identical to SEQ ID NO: 45605

SEQ ID NO: 99830 - RNA, 64 nt, Homo Sapiens; identical to SEQ ID NO: 45606

SEQ ID NO: 99831 - RNA, 64 nt, Homo Sapiens; identical to SEQ ID NO: 45607

SEQ ID NO: 99832 - RNA, 64 nt, Homo Sapiens; identical to SEQ ID NO: 45608

SEQ ID NO: 99833 - RNA, 64 nt, Homo Sapiens; identical to SEQ ID NO: 45609

SEQ ID NO: 99834 - RNA, 64 nt, Homo Sapiens; identical to SEQ ID NO: 45610

SEQ ID NO: 99835 - RNA, 64 nt, Homo Sapiens; identical to SEQ ID NO: 45611

SEQ ID NO: 99836 - RNA, 64 nt, Homo Sapiens; identical to SEQ ID NO: 45612

SEQ ID NO: 99837 - RNA, 64 nt, Homo Sapiens; identical to SEQ ID NO: 45613

SEQ ID NO: 99838 - RNA, 64 nt, Homo Sapiens; identical to SEQ ID NO: 45614

SEQ ID NO: 99839 - RNA, 64 nt, Homo Sapiens; identical to SEQ ID NO: 45615

SEQ ID NO: 99840 - RNA, 64 nt, Homo Sapiens; identical to SEQ ID NO: 45616

SEQ ID NO: 99841 - RNA, 64 nt, Homo Sapiens; identical to SEQ ID NO: 45617

SEQ ID NO: 99842 - RNA, 64 nt, Homo Sapiens; identical to SEQ ID NO: 45618

SEQ ID NO: 99843 - RNA, 64 nt, Homo Sapiens; identical to SEQ ID NO: 45619

SEQ ID NO: 99844 - RNA, 64 nt, Homo Sapiens; identical to SEQ ID NO: 45620

SEQ ID NO: 99845 - RNA, 64 nt, Homo Sapiens; identical to SEQ ID NO: 45621

SEQ ID NO: 99846 - RNA, 64 nt, Homo Sapiens; identical to SEQ ID NO: 45622

SEQ ID NO: 99847 - RNA, 64 nt, Homo Sapiens; identical to SEQ ID NO: 45623

SEQ ID NO: 99848 - RNA, 64 nt, Homo Sapiens; identical to SEQ ID NO: 45624

SEQ ID NO: 99849 - RNA, 64 nt, Homo Sapiens; identical to SEQ ID NO: 45625

SEQ ID NO: 99850 - RNA, 64 nt, Homo Sapiens; identical to SEQ ID NO: 45626

SEQ ID NO: 99851 - RNA, 64 nt, Homo Sapiens; identical to SEQ ID NO: 45627

SEQ ID NO: 99852 - RNA, 64 nt, Homo Sapiens; identical to SEQ ID NO: 45628

SEQ ID NO: 99853 - RNA, 64 nt, Homo Sapiens; identical to SEQ ID NO: 45629

SEQ ID NO: 99854 - RNA, 64 nt, Homo Sapiens; identical to SEQ ID NO: 45630

SEQ ID NO: 99855 - RNA, 64 nt, Homo Sapiens; identical to SEQ ID NO: 45631

SEQ ID NO: 99856 - RNA, 64 nt, Homo Sapiens; identical to SEQ ID NO: 45632

SEQ ID NO: 99857 - RNA, 64 nt, Homo Sapiens; identical to SEQ ID NO: 45633

SEQ ID NO: 99858 - RNA, 64 nt, Homo Sapiens; identical to SEQ ID NO: 45634

SEQ ID NO: 99859 - RNA, 64 nt, Homo Sapiens; identical to SEQ ID NO: 45635

SEQ ID NO: 99860 - RNA, 64 nt, Homo Sapiens; identical to SEQ ID NO: 45636

SEQ ID NO: 99861 - RNA, 64 nt, Homo Sapiens; identical to SEQ ID NO: 45637

SEQ ID NO: 99862 - RNA, 64 nt, Homo Sapiens; identical to SEQ ID NO: 45638

SEQ ID NO: 99863 - RNA, 64 nt, Homo Sapiens; identical to SEQ ID NO: 45639

SEQ ID NO: 99864 - RNA, 64 nt, Homo Sapiens; identical to SEQ ID NO: 45640

SEQ ID NO: 99865 - RNA, 64 nt, Homo Sapiens; identical to SEQ ID NO: 45641

SEQ ID NO: 99866 - RNA, 64 nt, Homo Sapiens; identical to SEQ ID NO: 45642

SEQ ID NO: 99867 - RNA, 64 nt, Homo Sapiens; identical to SEQ ID NO: 45643

SEQ ID NO: 99868 - RNA, 64 nt, Homo Sapiens; identical to SEQ ID NO: 45644

SEQ ID NO: 99869 - RNA, 64 nt, Homo Sapiens; identical to SEQ ID NO: 45645

SEQ ID NO: 99870 - RNA, 64 nt, Homo Sapiens; identical to SEQ ID NO: 45646

SEQ ID NO: 99871 - RNA, 64 nt, Homo Sapiens; identical to SEQ ID NO: 45647

SEQ ID NO: 99872 - RNA, 64 nt, Homo Sapiens; identical to SEQ ID NO: 45648

SEQ ID NO: 99873 - RNA, 64 nt, Homo Sapiens; identical to SEQ ID NO: 45649

SEQ ID NO: 99874 - RNA, 64 nt, Homo Sapiens; identical to SEQ ID NO: 45650

SEQ ID NO: 99875 - RNA, 64 nt, Homo Sapiens; identical to SEQ ID NO: 45651

SEQ ID NO: 99876 - RNA, 64 nt, Homo Sapiens; identical to SEQ ID NO: 45652

SEQ ID NO: 99877 - RNA, 64 nt, Homo Sapiens; identical to SEQ ID NO: 45653

SEQ ID NO: 99878 - RNA, 64 nt, Homo Sapiens; identical to SEQ ID NO: 45654

SEQ ID NO: 99879 - RNA, 64 nt, Homo Sapiens; identical to SEQ ID NO: 45655

SEQ ID NO: 99880 - RNA, 64 nt, Homo Sapiens
uauccaggcuccaggagaccugguggccgguagaauucuccaucuguccugggugcucucuacg

SEQ ID NO: 99881 - RNA, 64 nt, Homo Sapiens
gacucggguuuccuggaagacucccaccaccugaauucuccaaggggaugggcaccaagaaucu

SEQ ID NO: 99882 - RNA, 64 nt, Homo Sapiens
ggugauucucuugaugccaccuucagauccuuuuauucuccagaauaauucuuaacagugguuc

SEQ ID NO: 99883 - RNA, 64 nt, Homo Sapiens
uuucauaccuugaaguauguguuuaguagccucaauucuccauuaauuaaaagugugggcuggg

SEQ ID NO: 99884 - RNA, 64 nt, Homo Sapiens
auuaauguguucugaaaauauaugaauaaguguuauucuccauuaggaaaaguuauauucagua

SEQ ID NO: 99885 - RNA, 64 nt, Homo Sapiens
uccaaacaagcucuagagugaaaagccuggcaguauucuccaaccaaagaccaaagagauuagg

SEQ ID NO: 99886 - RNA, 64 nt, Homo Sapiens
cacugcauuuggggccuuucaaaaugacugucccauucuccacuuuuuuaaauucugcuccuga

SEQ ID NO: 99887 - RNA, 64 nt, Homo Sapiens
ccaaaguauucuucuuuucucaccauuccuuuaaauucuccaacuucagcccugaaccuuuguc

SEQ ID NO: 99888 - RNA, 64 nt, Homo Sapiens
acugaaacagaggacuauaaaacauccuucucuuauucuccauacugucuucuacaccuuuaaa

SEQ ID NO: 99889 - RNA, 64 nt, Homo Sapiens
uggaauacugaccuaauguauaaaacuuaaaacaauucuccaauccccucuccuuugguccagu

SEQ ID NO: 99890 - RNA, 64 nt, Homo Sapiens
cuuaaguaagaucuuaggacaucuuaaaggcauuauucuccagcugccccagugggccaugauu

SEQ ID NO: 99891 - RNA, 64 nt, Homo Sapiens
acaaaagaagagagauccuaugcaaacaugcaugauucuccaagaaaccauagaacaauuucac

SEQ ID NO: 99892 - RNA, 64 nt, Homo Sapiens
ucgacugagaagaguauaaucucugcucuccucuauucuccauguguauguaagaugggcauuc

SEQ ID NO: 99893 - RNA, 64 nt, Homo Sapiens
augucagucuaaagagucuaaccacagcaaacacauucuccaccauuacuuucucccuuucucu

SEQ ID NO: 99894 - RNA, 64 nt, Homo Sapiens
aacauaacuccaucuacaccuuggauuuggacugauucuccauuuuaucaccugaaggcuuggg

SEQ ID NO: 99895 - RNA, 64 nt, Homo Sapiens
gaccucacauccaucugaggcuucauggacaaagauucuccacuuggccaaacuuuagccaagc

SEQ ID NO: 99896 - RNA, 64 nt, Homo Sapiens
aaucugucugaaacuuguacagguuguauucuuuauucuccaaggagaaaaacaaguuccuuag

SEQ ID NO: 99897 - RNA, 64 nt, Homo Sapiens
ucacaaggacugaucuggagccaccagaggauugauucuccauuggggcauauccuaucccauc

SEQ ID NO: 99898 - RNA, 64 nt, Homo Sapiens
caaaacaaaauaaugcuuuuucucuccucucccaucccagaaaacuaaacgcaaaucuguagau

SEQ ID NO: 99899 - RNA, 64 nt, Homo Sapiens
uugucuucuaaaagggaggaaagcuaagugguuaucccagaaaccuucucuucccuaaccaaug

SEQ ID NO: 99900 - RNA, 64 nt, Homo Sapiens
ggacuccaucaauccaagaacagcuuggaagaaaucccagaagcuagaaauaaagagaucucag

SEQ ID NO: 99901 - RNA, 64 nt, Homo Sapiens
gagaucugggaggggucaggauaggggaguggguucccagaaggugucugagaaaaucucccua

SEQ ID NO: 99902 - RNA, 64 nt, Homo Sapiens
caaacuacuucagugaguaagaguuugaaaucucucccagaagaaauaggaaaugaguaauuuu

SEQ ID NO: 99903 - RNA, 64 nt, Homo Sapiens
caucagcaagcauguuugaguucauccaaaaccuucccagaaucuuccucccauaucuccgucc

SEQ ID NO: 99904 - RNA, 64 nt, Homo Sapiens
auuacuggccauuucuaaaucuguaucuuacucaucccagaauuuugccaggcuuaaccuuccc

SEQ ID NO: 99905 - RNA, 64 nt, Homo Sapiens
ugcggggaacuggggcaaggcgauggcucccucuucccagaaucgaccugggcacaggcauggg

SEQ ID NO: 99906 - RNA, 64 nt, Homo Sapiens
gccagugcccagcccagcggcucugggaagggguucccagaaucccuccugagcugugccauuu

SEQ ID NO: 99907 - RNA, 64 nt, Homo Sapiens
gugagcuuaaagaacaaccaaacucugccaggggucccagaaagcccaggguccagcagucuca

SEQ ID NO: 99908 - RNA, 64 nt, Homo Sapiens
cuagacagaaugaucauucaucccagaaaauguuucccagaaaaugaucauucccagaaacauu

SEQ ID NO: 99909 - RNA, 64 nt, Homo Sapiens
uguuucccagaaaacuagacuucccagaaacauuucccagaaaaaaaacaaggcagaaugauca

SEQ ID NO: 99910 - RNA, 64 nt, Homo Sapiens
auuucccagaaaauguuuccggcagaaugaucauucccagaaacucugaauuuccagaaaacaa

SEQ ID NO: 99911 - RNA, 64 nt, Homo Sapiens
auaucccagaugagugguacagggagugucccccucccagaagcccuucugcugcagcccaagc

SEQ ID NO: 99912 - RNA, 64 nt, Homo Sapiens
uuaagacuuucuccccacugggggcuagccugacucccagaacucaaugaggacaccugcagga

SEQ ID NO: 99913 - RNA, 64 nt, Homo Sapiens
cuuccugcccuuuuggcuugcagacugccuucuaucccagaacagcugagaaaucuaugaagcu

SEQ ID NO: 99914 - RNA, 64 nt, Homo Sapiens
auggcccugaaacacacacauuucccccuuccuuucccagaagccacuggccccccauagcacc

SEQ ID NO: 99915 - RNA, 64 nt, Homo Sapiens
agacaagaaauccuaguggcuagugucaggcaguucccagaaagcuuuuuuaaauacuacaaau

SEQ ID NO: 99916 - RNA, 64 nt, Homo Sapiens
ugcugcauuuagauuuugauaaugaaagaggcauucccagaauugauuaaaggggcugucuccc

SEQ ID NO: 99917 - RNA, 64 nt, Homo Sapiens
agaggagaaaaugaagaggcauguuuaacuggagucccagaaggccauuacaguaguguaauau

SEQ ID NO: 99918 - RNA, 64 nt, Homo Sapiens
cacuacucguuacauauugguaaaaaaagucaucucccagaagauuuuuaaaaagcaaacagug

SEQ ID NO: 99919 - RNA, 64 nt, Homo Sapiens
ccucaucugccagaaaacuuccuucaugcuuuuuucccagaaucugucaguauguuuauacuaa

SEQ ID NO: 99920 - RNA, 64 nt, Homo Sapiens
ggcacggcacaaggaagcaugaucaguggucaccucccagaagagcauuugauuuaggaccuug

SEQ ID NO: 99921 - RNA, 64 nt, Homo Sapiens
augacucuucccaaguuuaacaacaugugaaacaucccagaauucuguagaagguuaaagcuga

SEQ ID NO: 99922 - RNA, 64 nt, Homo Sapiens
uccucacuagggcugagcaccaggcccaccugcuucccagaaccggguuagggacugcauugag

SEQ ID NO: 99923 - RNA, 64 nt, Homo Sapiens
auguguccugauaagcugagcuccuuagccuuugucccagaaugccuccugcagggauucuucc

SEQ ID NO: 99924 - RNA, 64 nt, Homo Sapiens
ggaccuuuccugaggaagagggacuguucuuuugucccagaaaagcaguggcuccauugguguu

SEQ ID NO: 99925 - RNA, 64 nt, Homo Sapiens
uacagaugccuuaaagacuuaaaaacccugaaauucccagaaguugagagcugacuggcaagau

SEQ ID NO: 99926 - RNA, 64 nt, Homo Sapiens
acuaccugaagcaccaaagcucccuugggacaagucccagaagauuccaugacagacacuugcu

SEQ ID NO: 99927 - RNA, 64 nt, Homo Sapiens
ggguguuccuggguuauuuacagccuuuucagacucccagaauuccaugccaaggaguuugugc

SEQ ID NO: 99928 - RNA, 64 nt, Homo Sapiens
uuguuugccaguaucucaaccugugagacugaaaucccagaacagugacugaaagcugauuucu

SEQ ID NO: 99929 - RNA, 64 nt, Homo Sapiens
gaagauccuaucaugaauaagaggcaucuccauaucccagaaaaugguaucccucaucccagaa

SEQ ID NO: 99930 - RNA, 64 nt, Homo Sapiens
ggcaucuccauaucccagaacuugguaucccucaucccagaagacacacauuuggcacuguuau

SEQ ID NO: 99931 - RNA, 64 nt, Homo Sapiens
gaauggagugagcucuuccagcacagcugacaagucccagaagcagucccugacccccagcuuu

SEQ ID NO: 99932 - RNA, 64 nt, Homo Sapiens
gauccuauccaaagcggccuacagucuccugggcucccagaagaguggcaagcugccauccucc

SEQ ID NO: 99933 - RNA, 64 nt, Homo Sapiens
gaucuuugugucgcucggguucucccugggugggucccagaaguauccacccucguaacaacag

SEQ ID NO: 99934 - RNA, 64 nt, Homo Sapiens
ugccuuuuaaguuuccaucaagaagugagaagacucccagaaucgcucucacacaugacuggag

SEQ ID NO: 99935 - RNA, 64 nt, Homo Sapiens
acuacaucuggcuuugggcagucugucccugaacucccagaacccgugcucauugcuaaccacu

SEQ ID NO: 99936 - RNA, 64 nt, Homo Sapiens
cuggguuuauagaugugagccucccaccuuggccucccagaaugacuccugggcucaagcaguc

SEQ ID NO: 99937 - RNA, 64 nt, Homo Sapiens
auuuucuuacagcgaagacuugaguuccuccaagucccagaaccccaagaaugggcaagaagga

SEQ ID NO: 99938 - RNA, 64 nt, Homo Sapiens
ugcagcugugaagcucgggcugauucccccucugucccagaagguuggccagagggugugaccc

SEQ ID NO: 99939 - RNA, 64 nt, Homo Sapiens
agcccccaccccacacaugaggcgucuuccuacgucccagaagccagaagguaccccugagguu

SEQ ID NO: 99940 - RNA, 64 nt, Homo Sapiens
uaccccugagguuggcgucucccuggcuuguccuucccagaagggggaugggcgggcacccaag

SEQ ID NO: 99941 - RNA, 64 nt, Homo Sapiens
cgaggagcagaaggagcuguuauuucuaguugcuucccagaagcgaaagagcugggcucucagc

SEQ ID NO: 99942 - RNA, 64 nt, Homo Sapiens
uggccgcccagcaggagggagccaaucccuucccucccagaagccugcaggaugaggaagacag

SEQ ID NO: 99943 - RNA, 64 nt, Homo Sapiens
cacauuucugguuuauaaucacuugaaacuugguucccagaaaauaauaaaacuuaucugaguc

SEQ ID NO: 99944 - RNA, 64 nt, Homo Sapiens
uauuuaaaugcaaaguuacaugugcccagcaguuucccagaauaagauuacaggugugagccac

SEQ ID NO: 99945 - RNA, 64 nt, Homo Sapiens
gggaccggggccccgcuggcaaugaggguguuggucccagaauugggucuguguucuccaggag

SEQ ID NO: 99946 - RNA, 64 nt, Homo Sapiens
ccggggguaggggccacccucuggguaguuggggucccagaaagguguugacccagggaugggg

SEQ ID NO: 99947 - RNA, 64 nt, Homo Sapiens
gaaggagcccaugugguuggauaaaaucaagaaaaggcugaaugagcacgguuacccccaagug

SEQ ID NO: 99948 - RNA, 64 nt, Homo Sapiens
uauaaggauuuuggccaaaugggacuuagacuggaggcugaauuugagaaggauuucaaggaag

SEQ ID NO: 99949 - RNA, 64 nt, Homo Sapiens
uguuguauaacugaccuguguguacucucaauaaaggcugaaaaaugaauuuuggcaugaugac

SEQ ID NO: 99950 - RNA, 64 nt, Homo Sapiens
uauagguacaucuguuuucaaguaugcuaucuguaggcugaaauaaugaauaaugaccuuauga

SEQ ID NO: 99951 - RNA, 64 nt, Homo Sapiens
uauccaggaaagggggcuuggugacuguucuuuaaggcugaagacucaaccaauggguggccuu

SEQ ID NO: 99952 - RNA, 64 nt, Homo Sapiens
aaaaaagugggcucguauuucugugggggaggauaggcugaaaauguaaguagcgcagcagccu

SEQ ID NO: 99953 - RNA, 64 nt, Homo Sapiens
uucacuauucacaggacauuggcauuaucuacuaaggcugaaaaugugcauauuccaugacuca

SEQ ID NO: 99954 - RNA, 64 nt, Homo Sapiens
gaaauaauaacagacaaggucaaaaaauagaugcaggcugaaaagaaaaggaagugggcuaaga

SEQ ID NO: 99955 - RNA, 64 nt, Homo Sapiens
aauuugaaagcagcaauuugaucaauagauuuuuaggcugaauuuuacgacgcaauaaaauaac

SEQ ID NO: 99956 - RNA, 64 nt, Homo Sapiens
gaauguaauuuuuauuuucuaugcauauggagguaggcugaaaaacucuaccccacccuacaaa

SEQ ID NO: 99957 - RNA, 64 nt, Homo Sapiens
gucucaagauuccccacacugccgcauagugcauaggcugaaauaaucaguuaucaguacaagu

SEQ ID NO: 99958 - RNA, 64 nt, Homo Sapiens
auuccuggaacucaugcaggcacuggaaagcagcaggcugaacaacugaggccaggaaaagaag

SEQ ID NO: 99959 - RNA, 64 nt, Homo Sapiens
cacgaauuacucaaaaaguacacucucaaaacauaggcugaaaggagauugugaugucauauuu

SEQ ID NO: 99960 - RNA, 64 nt, Homo Sapiens
aagggcgcagugugauauuuccagucuaucagggaggcugaagcauuaauauugcacacccaaa

SEQ ID NO: 99961 - RNA, 64 nt, Homo Sapiens
ccugcggaaggagcuggagagcagcuacaagcagaggcugaacagggcccuccgagguggagca

SEQ ID NO: 99962 - RNA, 64 nt, Homo Sapiens
ccugcggaaggagcuggagagcagcuacaagcagaggcugaacagggcccuccgagguggaaca

SEQ ID NO: 99963 - RNA, 64 nt, Homo Sapiens
ggcagccucuucaaaaugagcccuguccugccuaaggcugaacuuguuuucugggaacaccaua

SEQ ID NO: 99964 - RNA, 64 nt, Homo Sapiens
uccuccuggacuccugcacacgcuccuuccucugaggcugaaauucagaauauuagugaccuca

SEQ ID NO: 99965 - RNA, 64 nt, Homo Sapiens
ugguggcaugagccuguguucccagcugcuuaggaggcugaagcaggaggauugauugagccug

SEQ ID NO: 99966 - RNA, 64 nt, Homo Sapiens
uggucacaaccugagguacucugcugagugggcaaggcugaagaagaggccuguggaaugcagc

SEQ ID NO: 99967 - RNA, 64 nt, Homo Sapiens
gaagcaggguggccuccagagccuugccauaaaaaggcugaaggcagccgggcgcaguggcuca

SEQ ID NO: 99968 - RNA, 64 nt, Homo Sapiens
agacuccgucucaaaaaaaaaaaaaaaacaaaaaaggcugaaggcagcuguagcuccacacaga

SEQ ID NO: 99969 - RNA, 64 nt, Homo Sapiens
guuaagagguuuguauauaaaucuguuauagaacaggcugaaauuucuuguucauaagauuaug

SEQ ID NO: 99970 - RNA, 64 nt, Homo Sapiens
acaccuaacauuauacuucauggugauagacugaaggcugaauguuuuccccuuaagauuggga

SEQ ID NO: 99971 - RNA, 64 nt, Homo Sapiens
cacuagaauccugaccuguaagguugcugucggcaggcugaagaagacacagggcccagcaccc

SEQ ID NO: 99972 - RNA, 64 nt, Homo Sapiens
ggcugacaggucggggggcuggaggaggcugaggaggcugaagaucaggccuggugguggcagu

SEQ ID NO: 99973 - RNA, 64 nt, Homo Sapiens
uggauggauagauggauggauggguuggggaguggggguggauggauggauagauggauggaug

SEQ ID NO: 99974 - RNA, 64 nt, Homo Sapiens
uggauggauggauggauggauggguugggggguggggguggauggauagauggauggauggaug

SEQ ID NO: 99975 - RNA, 64 nt, Homo Sapiens
caucauguaaucugggaccugccaggcagggguggggguggaggcuuccugcguccuccucacc

SEQ ID NO: 99976 - RNA, 64 nt, Homo Sapiens
ugcuggcacccaccguggaggaggaaggcaagaggggguggagggguguggcagugguuuuggc

SEQ ID NO: 99977 - RNA, 64 nt, Homo Sapiens
agugcccuggcuuggucaccacuggggccaaggugggguggagagaggccuaggagccagaaag

SEQ ID NO: 99978 - RNA, 64 nt, Homo Sapiens
ccccaaacugagacagacugggagcugggagccugggguggacaggaccauacccucuuugagc

SEQ ID NO: 99979 - RNA, 64 nt, Homo Sapiens
gagcacgucugcagggcccuggcucaggugacucgggguggaguuuggaaggcauugccccaug

SEQ ID NO: 99980 - RNA, 64 nt, Homo Sapiens
ugcacacgggcuggggcucaacccagcugggccugggguggaggaggaaagggcugcgugaaaa

SEQ ID NO: 99981 - RNA, 64 nt, Homo Sapiens
cagggugggcugaggucagagcugagcuauaagagggguggacacugugacccgcccucuuuag

SEQ ID NO: 99982 - RNA, 64 nt, Homo Sapiens
cagggaggcccagggcuccuacucggaggcuggugggguggacuagagcaccaggcuccagggc

SEQ ID NO: 99983 - RNA, 64 nt, Homo Sapiens
ggaggaagagauacuaguuauucccaagucucuggggguggaaaugagguucccguucuuuccc

SEQ ID NO: 99984 - RNA, 64 nt, Homo Sapiens
uguuucucuuucacuuucaugcccuucagagggagggguggacccccuuguccagaccuggugg

SEQ ID NO: 99985 - RNA, 64 nt, Homo Sapiens
gagacggccggcucagccuucccuugcacugguugggguggaaccugcagaggccagcccgggg

SEQ ID NO: 99986 - RNA, 64 nt, Homo Sapiens
ccccccaauacuagaauggguuugagcuuggggugggguggauggggaagacuuacucugaaug

SEQ ID NO: 99987 - RNA, 64 nt, Homo Sapiens
uuaaauuuacucccuccccacccagaacccagaugggguggagggggccaccggggcagggagg

SEQ ID NO: 99988 - RNA, 64 nt, Homo Sapiens
ggcuuaugccccccccucccccaguguguugggugggguggaauugagguuagggugagggguc

SEQ ID NO: 99989 - RNA, 64 nt, Homo Sapiens
gauccagcggggcuucugggcgccgguuccacgugggguggaauuauuagcaccagcuugcuuc

SEQ ID NO: 99990 - RNA, 64 nt, Homo Sapiens
cuucucugccgguggggccagcgcugaacagaccgggguggagucagggcugugcuuuccgcgu

SEQ ID NO: 99991 - RNA, 64 nt, Homo Sapiens
aaaacguauccugaggacuucuuccggagagggugggguggagcagcgggggagccuuggccga

SEQ ID NO: 99992 - RNA, 64 nt, Homo Sapiens
cuggauguugagucucaucagaauauguggguaggggguggacgugcacgggugcaugauugug

SEQ ID NO: 99993 - RNA, 64 nt, Homo Sapiens
ugggagugugcagugggacaggggugcuccucgcgggguggacuugauacauggccuuuuucag

SEQ ID NO: 99994 - RNA, 64 nt, Homo Sapiens
ugcaggagccccaggaccuguggcgaugggcgcugggguggagggcccugccugggggaguccg

SEQ ID NO: 99995 - RNA, 64 nt, Homo Sapiens
ggaacccagagccacccgcuaugagcacaggccggggguggaaggcccaguagagcugcccuuc

SEQ ID NO: 99996 - RNA, 64 nt, Homo Sapiens
uugggaauucauaugaucugccagagccucuccagggguggaauacauguccuggacuaagcca

SEQ ID NO: 99997 - RNA, 64 nt, Homo Sapiens
gguggaagucagaaugcuccuggaggcugcagaggggguggaggacucuccccugccucugggg

SEQ ID NO: 99998 - RNA, 64 nt, Homo Sapiens
agugcaaggcugaaauggacaagggcuccucacggggguggagggagccggagccugccuugug

SEQ ID NO: 99999 - RNA, 64 nt, Homo Sapiens
uuguuaaccacagcuguggcucguuugagggauugggguggaccugggguuuauuuucaguaac

SEQ ID NO: 100000 - RNA, 64 nt, Homo Sapiens
acuauuuuuuaagauagaagauaauuugugggcagggguggaggaugcauguaugauacuccau

SEQ ID NO: 100001 - RNA, 64 nt, Homo Sapiens
ggcugcugcccagaaacugcaagacauaaaguuggggguggagagaaagcaugauaagaggagg

SEQ ID NO: 100002 - RNA, 64 nt, Homo Sapiens
uaaagcuggggauuggagaugaagcagauucggagggguggagagguuucuuaauugagggaag

SEQ ID NO: 100003 - RNA, 64 nt, Homo Sapiens
gggaggcagcuugugaauuuaggggagggaggcggggguggacacaaugccgaagaccgagggc

SEQ ID NO: 100004 - RNA, 64 nt, Homo Sapiens
aaagggaaccaaugccgaaggugucucugugagugggguggagcuuuucucaguuggaugcccu

SEQ ID NO: 100005 - RNA, 64 nt, Homo Sapiens
aggcucugugcucccaccacguucuucuggugcugggguggagcuacugccgcagccccuccug

SEQ ID NO: 100006 - RNA, 64 nt, Homo Sapiens
cuggccugucuuccuccaacucccagcucauccagggguggagcgguggggguacugacgcccu

SEQ ID NO: 100007 - RNA, 64 nt, Homo Sapiens
aaacuaaggcaguggcaaagguagaacucaggcagggguggagaaaaggcguuggucgcaguga

SEQ ID NO: 100008 - RNA, 64 nt, Homo Sapiens
gggugcggaggaauuuggguaaaggcagagggaagggguggaggagggccagcucaguugccga

SEQ ID NO: 100009 - RNA, 64 nt, Homo Sapiens
ggugccuccugacagcuuccuuuuucuaaacugggggguggaggugcaaaaauacagaugucua

SEQ ID NO: 100010 - RNA, 64 nt, Homo Sapiens
gcggcugugacucagggcccuggaaagguggugggggguggaugggcugaaugaagccaugacu

SEQ ID NO: 100011 - RNA, 64 nt, Homo Sapiens
ugcccaugccaggagccagcugugugaccauccagggguggagggggaaaaccaggcaauuucg

SEQ ID NO: 100012 - RNA, 64 nt, Homo Sapiens
caccccaaugccaggauagauguauucuagaguagggguggaggcggcccaggaggcugaagac

SEQ ID NO: 100013 - RNA, 64 nt, Homo Sapiens
gccuuuccuugggaaucugccucccuccauggcagggguggauucgggagcugggaguaaccag

SEQ ID NO: 100014 - RNA, 64 nt, Homo Sapiens
agcugggggcuggagcccuggcucaccuccuggagggguggagcuguuuguucugugaaauccc

SEQ ID NO: 100015 - RNA, 64 nt, Homo Sapiens
gagcagggcucuggagggaugaaucccaaggcuggggguggaaguccugggaccgcggugggug

SEQ ID NO: 100016 - RNA, 64 nt, Homo Sapiens
ggagccucaaguacauuccagagucccaggaccggggguggagagcucaugcauaguccuuaca

SEQ ID NO: 100017 - RNA, 64 nt, Homo Sapiens
cggcaggaaggggcggcccugcucccucagcacugggguggagggaaggggccccagggccuuc

SEQ ID NO: 100018 - RNA, 64 nt, Homo Sapiens
gaacacgugcagugccguggggcaggaggggagcgggguggaggggggcgugucugggggcggg

SEQ ID NO: 100019 - RNA, 64 nt, Homo Sapiens
ggccagagaaagcaaaggugcacuccagacucuggggguggacaucugaccccaagggggcugc

SEQ ID NO: 100020 - RNA, 64 nt, Homo Sapiens
ggcugcugcuccucucuuggguaggguaguggcugggguggagugggaagggagcauugcagcc

SEQ ID NO: 100021 - RNA, 63 nt, Homo Sapiens
uugagacaauucuauuuuucauauacucguugcucauuaaauaguaaaggguugauuugcugc

SEQ ID NO: 100022 - RNA, 63 nt, Homo Sapiens
gucuuuacuagugcuaaguauuauggugagcuaucauuaaagugugccaucuuggauaaaggc

SEQ ID NO: 100023 - RNA, 63 nt, Homo Sapiens
auuagguuuuguacaauugaacuuaaauaaaugucauuaaaauaaauaaaugcaauauguauu

SEQ ID NO: 100024 - RNA, 63 nt, Homo Sapiens
cauaguucccauguuaaaucccauucauaacuuucauuaaagcauuuacuuugaauuucucca

SEQ ID NO: 100025 - RNA, 63 nt, Homo Sapiens
caccauugcuuucuguacuguuugaaagaaguuucauuaaaagacagcuagcauguucacaga

SEQ ID NO: 100026 - RNA, 63 nt, Homo Sapiens
uaacuacuaaggaaagguuaauucuucuucaguucauuaaaagacuaggccuuugaugcuuua

SEQ ID NO: 100027 - RNA, 63 nt, Homo Sapiens
ugacauuagcauugugguuugcucauuauaaugucauuaaacaaaugucccuaauuuaaccca

SEQ ID NO: 100028 - RNA, 63 nt, Homo Sapiens
uaauagagccccacuugacagacaauugcuuacucauuaaaaagggcuagccaauagaguugg

SEQ ID NO: 100029 - RNA, 63 nt, Homo Sapiens
gcauaaaagucuuccucuugaauuucaugguauucauuaaaaacuaacuuaguaaaguagaau

SEQ ID NO: 100030 - RNA, 63 nt, Homo Sapiens
auuugguuugguggagugagcaauuuuucuaaaucauuaaauuuuuagugauacaaaugauug

SEQ ID NO: 100031 - RNA, 63 nt, Homo Sapiens
ugacgggcaaggguuuucucgccugugggucuuucauuaaagggacauccccaaagcuugucu

SEQ ID NO: 100032 - RNA, 63 nt, Homo Sapiens
cccaguuuccuggucauuuccaucacaccuucuucauuaaaaaguguguacaguguccacagg

SEQ ID NO: 100033 - RNA, 63 nt, Homo Sapiens
uuuaugcuaauucugcuuauuuuagaguauuuuucauuaaaaggugagcaaagugaaagauac

SEQ ID NO: 100034 - RNA, 63 nt, Homo Sapiens
ugauguagaguagggcaaaucuguguguguaugucauuaaaaaaauucuaccaucuuucuuua

SEQ ID NO: 100035 - RNA, 63 nt, Homo Sapiens
gaaggauuauuaagcaaccuuaaagcaauaaguucauuaaacagaagguaauaggaagaacag

SEQ ID NO: 100036 - RNA, 63 nt, Homo Sapiens
cauuugaugucuagauaacauucaugagauuggucauuaaauacuauuuugcuccuuuucugg

SEQ ID NO: 100037 - RNA, 63 nt, Homo Sapiens
aauugucucaaagcaucaaauaauacaucuuuaucauuaaacaugaauuuaaugucuaggaua

SEQ ID NO: 100038 - RNA, 63 nt, Homo Sapiens
uauugauugaaaaaagagaaaggggcaagaaauucauuaaagaaaaaccacagauacugaaac

SEQ ID NO: 100039 - RNA, 63 nt, Homo Sapiens
guuauguuguucuccuugcaauugaagacagcaucauuaaacauaaacagaauuagguaguau

SEQ ID NO: 100040 - RNA, 63 nt, Homo Sapiens
aucuugaagggaguagggagaagguaacugaauucauuaaaaaaauuuuuuucucacaguguc

SEQ ID NO: 100041 - RNA, 63 nt, Homo Sapiens
ucacugcugcuucaaaggacgguuccauuuagcucauuaaagguagguuugcguuuauaguca

SEQ ID NO: 100042 - RNA, 63 nt, Homo Sapiens
cuauaaaggguugagcuguccuaagaccucugaucauuaaaacauggaccuauguauauauau

SEQ ID NO: 100043 - RNA, 63 nt, Homo Sapiens
gaaaggaguagcuuugacaugcagccauggcagucauuaaagacauagcccuucucuauguaa

SEQ ID NO: 100044 - RNA, 63 nt, Homo Sapiens
aacauugaugagagaagauguuuauuucacuuuucauuaaaugagcaucugauaaucuguugg

SEQ ID NO: 100045 - RNA, 63 nt, Homo Sapiens
gugguaaauugcucaauguauucauugugauugucauuaaaaaucagucugaugguucuguuc

SEQ ID NO: 100046 - RNA, 63 nt, Homo Sapiens
ggaaauuguaucaggacccaucuuucuagcucaucauuaaaaacuagaggaugugaucuaauu

SEQ ID NO: 100047 - RNA, 63 nt, Homo Sapiens
agggggaagaaaggagggcugugaggagauaccucauuaaacuuggcuuagugaagaagagag

SEQ ID NO: 100048 - RNA, 63 nt, Homo Sapiens
ccacucucagccugggagacuccugccaagcccucauuaaagaugccacccugggcugcccug

SEQ ID NO: 100049 - RNA, 63 nt, Homo Sapiens
augauaacugguaccuuaucuacuguaaauauuucauuaaaaaugaugcacacauagauauau

SEQ ID NO: 100050 - RNA, 63 nt, Homo Sapiens
uuuaauguuuuauuggcaacguaugcugcuuuuucauuaaaauaugcuauuaaaauuaaaugg

SEQ ID NO: 100051 - RNA, 63 nt, Homo Sapiens
gaaacuaaaucuguguucaaagaugaagaccccucauuaaaagccaaggacguucuuaagauu

SEQ ID NO: 100052 - RNA, 63 nt, Homo Sapiens
gauuggaacugacauaauuagucuugacuuacuucauuaaagcaagauucaauuccuuguuca

SEQ ID NO: 100053 - RNA, 63 nt, Homo Sapiens
aauugucuauuaaaugcaagaguaaaguuaguaucauuaaacagagaaagucaauuaagugug

SEQ ID NO: 100054 - RNA, 63 nt, Homo Sapiens
caugaauuuagaauugauuucaaaacauaguauucauuaaagaaucaguuuuuauacagguug

SEQ ID NO: 100055 - RNA, 63 nt, Homo Sapiens
ggaauuucaguauacuguacuauccuuuauaagucauuaaaauaauguuucaucaaaugguua

SEQ ID NO: 100056 - RNA, 63 nt, Homo Sapiens
uguacagagguuacugcaauaaaggaaguggauucauuaaaccuauuuaauguccauucuuau

SEQ ID NO: 100057 - RNA, 63 nt, Homo Sapiens
uaacacuugaaaaccaauuuaguuguuagucauucauuaaacauuaacaucacuaucauuuau

SEQ ID NO: 100058 - RNA, 63 nt, Homo Sapiens
ucuuucaaaacuugaguggucucugagcuccugucauuaaaccuaucuauaucugucuaucag

SEQ ID NO: 100059 - RNA, 63 nt, Homo Sapiens
caauguugaacugcuuuuucaacauuaaaauguucauuaaaaucauaauguucuguuauacau

SEQ ID NO: 100060 - RNA, 63 nt, Homo Sapiens
uggaugaucaguuuuuuauauccauauaugaaaucauuaaagucuuuuacuaccacucuugag

SEQ ID NO: 100061 - RNA, 63 nt, Homo Sapiens
uacacccucuacuugggcuuguaagcaaaguagucauuaaaaaacauuugcacaaucuaaaau

SEQ ID NO: 100062 - RNA, 63 nt, Homo Sapiens
ucucagcaguggguuucuugagagugaggauuuucauuaaaagacuaaaaauacgaggaaagg

SEQ ID NO: 100063 - RNA, 63 nt, Homo Sapiens
cagcucaaaggggguuuaaacaaagcaacugggucauuaaaaccuaaauaaauggcuuucaaa

SEQ ID NO: 100064 - RNA, 63 nt, Homo Sapiens
uuuagaucucuguuuucauaggcuauuuuuaaaucauuaaauuuuugccgucuuguauguaga

SEQ ID NO: 100065 - RNA, 63 nt, Homo Sapiens
aaaaaccaugaauuacgaagugucugaugcauuucauuaaaaacauguuuguuuguagauguu

SEQ ID NO: 100066 - RNA, 63 nt, Homo Sapiens
uaugagaacugguucuugccuuccccuugaaccucauuaaauggugauuucuugcuaagcucc

SEQ ID NO: 100067 - RNA, 63 nt, Homo Sapiens
ucauguaccaagugcuuggcacauagugggccuucauuaaauguuuguugaauaaaagaggga

SEQ ID NO: 100068 - RNA, 63 nt, Homo Sapiens
gcauagaauaaugaagaucuuuguuuuuuguuuucauuaaagagccauucuggcacuuuaaug

SEQ ID NO: 100069 - RNA, 63 nt, Homo Sapiens
uuuugagaacauucccuggaauugccacauaauucauuaaaaacauuuuuuuaagcaacacuu

SEQ ID NO: 100070 - RNA, 63 nt, Homo Sapiens
aguugggagaacaaauaggaagauuaacuuauuucauuaaagaaagcuacuggaugcacuguc

SEQ ID NO: 100071 - RNA, 63 nt, Homo Sapiens
uauacagauuuaguuaaguaccagccaaucccuucauuaaaugacugacaguugguauaugua

SEQ ID NO: 100072 - RNA, 63 nt, Homo Sapiens
gcuuucugaacucuaaugugccuucauugauuaucauuaaaauuaucauuaaaauugccuuau

SEQ ID NO: 100073 - RNA, 63 nt, Homo Sapiens
cuaaugugccuucauugauuaucauuaaaauuaucauuaaaauugccuuauuucuauggacuc

SEQ ID NO: 100074 - RNA, 63 nt, Homo Sapiens
uuucucauaguucagaaaaaggugcuuuauguaucauuaaauuagaggacuugcuauuugcca

SEQ ID NO: 100075 - RNA, 63 nt, Homo Sapiens
uaguucuaucauuugguacuuaucauuaauuuaucauuaaauuuuuccuuuuaaauuuaguuc

SEQ ID NO: 100076 - RNA, 63 nt, Homo Sapiens
auguggauuuauugauguguagaacggaugguuucauuaaagaccuaacauaugucucuaccu

SEQ ID NO: 100077 - RNA, 63 nt, Homo Sapiens
gauugcugggagcaaaaacuagaggacugugucucauuaaaguacagaucagaauguggcacc

SEQ ID NO: 100078 - RNA, 63 nt, Homo Sapiens
gcacuuuggcauaccgaaaaaacaugaaauuuuucauuaaaaugccaugaaucaagccagggc

SEQ ID NO: 100079 - RNA, 63 nt, Homo Sapiens
uucauguaauuuacccuuugcaauaaaaaugauucauuaaauauauaacuaaaugugauuugg

SEQ ID NO: 100080 - RNA, 63 nt, Homo Sapiens
aaauguauugugguuuaugcugggaauaaucauucauuaaaaauuucuuuucugguuuuaguu

SEQ ID NO: 100081 - RNA, 63 nt, Homo Sapiens
ggcaacuacagccaaaaucaagcccccauuuguucauuaaagacauaauacaaggaaccucag

SEQ ID NO: 100082 - RNA, 63 nt, Homo Sapiens
cuaauugauuguuuaaaagauacagacacuaauucauuaaauaaacuaccuuauuuuucacug

SEQ ID NO: 100083 - RNA, 63 nt, Homo Sapiens
aaaaugaaacauuugccaaauauuggaccgaagucauuaaaacacuguauuucauuuucuuua

SEQ ID NO: 100084 - RNA, 63 nt, Homo Sapiens
uuuuuugaauauugcaggguucagucuagauugucauuaaauugaagagucuacauucagaac

SEQ ID NO: 100085 - RNA, 61 nt, Homo Sapiens
auccuaagcacaaaauaaaccuuucuaaccacuucauuaaagcugaagaccaguaugauuu

SEQ ID NO: 100086 - RNA, 63 nt, Homo Sapiens
gcauuuauuuaagggcuuuuucuuaaauaagaaucauuaaagucauuaaaaaaauuuacugaa

SEQ ID NO: 100087 - RNA, 63 nt, Homo Sapiens
uaagggcuuuuucuuaaauaagaaucauuaaagucauuaaaaaaauuuacugaaaugcccauc

SEQ ID NO: 100088 - RNA, 63 nt, Homo Sapiens
cuacauuucugaauuuuugaaaaauguauuuuaucauuaaauggcauuauuuuaaagggugaa

SEQ ID NO: 100089 - RNA, 63 nt, Homo Sapiens
gaguguguuuaaauuguuacaaacaauaaugcgucauuaaaggccaugcugaucuugcauaac

SEQ ID NO: 100090 - RNA, 63 nt, Homo Sapiens
aauaucuggcaaauuaaaaaucuuuuauaauucucauuaaaaguuugcaaaaaauguuuuugg

SEQ ID NO: 100091 - RNA, 63 nt, Homo Sapiens
aauuugacuuuucuguaauuuaauuuuaguuuuucauuaaauaguguauuugcuaauuuuuau

SEQ ID NO: 100092 - RNA, 63 nt, Homo Sapiens
uaugcuguauuucuuuguagaauaaaugguuucucauuaaacucuaaagauuagggaaaaugg

SEQ ID NO: 100093 - RNA, 63 nt, Homo Sapiens
uccuucagcugacuccaguauaaucuccucugcucauuaaacugauuccaggagauuggauuu

SEQ ID NO: 100094 - RNA, 63 nt, Homo Sapiens
aaaaaaauaaaucuugcucuuacaccuuuuugaucauuaaaauguuuucauagugcuuucaaa

SEQ ID NO: 100095 - RNA, 63 nt, Homo Sapiens
uuuucagaaaaucuugagguuaagcaucaguugucauuaaaagauauacccagucauaaagua

SEQ ID NO: 100096 - RNA, 63 nt, Homo Sapiens
uauuaauguauauaugaaaaagauacaaagaaaucauuaaaauaaauauuaccuaaauugguu

SEQ ID NO: 100097 - RNA, 63 nt, Homo Sapiens
auaauaaacgaugcuauuuuaugagcucaugacucauuaaaaaugcuuuaugaagcuuuagaa

SEQ ID NO: 100098 - RNA, 63 nt, Homo Sapiens
ggcggggagcugggccuggaggauccuggagucucauuaaaugccugauugugaaccaugucc

SEQ ID NO: 100099 - RNA, 63 nt, Homo Sapiens
cagccuuguuucucauguaaugcagugacgcugucauuaaacacguggauucauguguggccg

SEQ ID NO: 100100 - RNA, 64 nt, Homo Sapiens; identical to SEQ ID NO: 87364

SEQ ID NO: 100101 - RNA, 64 nt, Homo Sapiens; identical to SEQ ID NO: 87365

SEQ ID NO: 100102 - RNA, 64 nt, Homo Sapiens; identical to SEQ ID NO: 87366

SEQ ID NO: 100103 - RNA, 64 nt, Homo Sapiens; identical to SEQ ID NO: 87367

SEQ ID NO: 100104 - RNA, 64 nt, Homo Sapiens; identical to SEQ ID NO: 87368

SEQ ID NO: 100105 - RNA, 64 nt, Homo Sapiens; identical to SEQ ID NO: 87369

SEQ ID NO: 100106 - RNA, 64 nt, Homo Sapiens; identical to SEQ ID NO: 87370

SEQ ID NO: 100107 - RNA, 64 nt, Homo Sapiens; identical to SEQ ID NO: 87371

SEQ ID NO: 100108 - RNA, 64 nt, Homo Sapiens; identical to SEQ ID NO: 87372

SEQ ID NO: 100109 - RNA, 64 nt, Homo Sapiens; identical to SEQ ID NO: 87373

SEQ ID NO: 100110 - RNA, 64 nt, Homo Sapiens; identical to SEQ ID NO: 87374

SEQ ID NO: 100111 - RNA, 64 nt, Homo Sapiens; identical to SEQ ID NO: 87375

SEQ ID NO: 100112 - RNA, 64 nt, Homo Sapiens; identical to SEQ ID NO: 87376

SEQ ID NO: 100113 - RNA, 64 nt, Homo Sapiens; identical to SEQ ID NO: 87377

SEQ ID NO: 100114 - RNA, 64 nt, Homo Sapiens; identical to SEQ ID NO: 87378

SEQ ID NO: 100115 - RNA, 64 nt, Homo Sapiens; identical to SEQ ID NO: 87379

SEQ ID NO: 100116 - RNA, 64 nt, Homo Sapiens; identical to SEQ ID NO: 87380

SEQ ID NO: 100117 - RNA, 64 nt, Homo Sapiens; identical to SEQ ID NO: 87381

SEQ ID NO: 100118 - RNA, 64 nt, Homo Sapiens; identical to SEQ ID NO: 87382

SEQ ID NO: 100119 - RNA, 64 nt, Homo Sapiens; identical to SEQ ID NO: 87383

SEQ ID NO: 100120 - RNA, 64 nt, Homo Sapiens; identical to SEQ ID NO: 87384

SEQ ID NO: 100121 - RNA, 64 nt, Homo Sapiens; identical to SEQ ID NO: 87385

SEQ ID NO: 100122 - RNA, 64 nt, Homo Sapiens; identical to SEQ ID NO: 87386

SEQ ID NO: 100123 - RNA, 64 nt, Homo Sapiens; identical to SEQ ID NO: 87387

SEQ ID NO: 100124 - RNA, 64 nt, Homo Sapiens; identical to SEQ ID NO: 87388

SEQ ID NO: 100125 - RNA, 64 nt, Homo Sapiens; identical to SEQ ID NO: 87389

SEQ ID NO: 100126 - RNA, 64 nt, Homo Sapiens; identical to SEQ ID NO: 87390

SEQ ID NO: 100127 - RNA, 64 nt, Homo Sapiens; identical to SEQ ID NO: 87391

SEQ ID NO: 100128 - RNA, 64 nt, Homo Sapiens; identical to SEQ ID NO: 87392

SEQ ID NO: 100129 - RNA, 64 nt, Homo Sapiens; identical to SEQ ID NO: 87393

SEQ ID NO: 100130 - RNA, 64 nt, Homo Sapiens; identical to SEQ ID NO: 87394

SEQ ID NO: 100131 - RNA, 64 nt, Homo Sapiens; identical to SEQ ID NO: 87395

SEQ ID NO: 100132 - RNA, 64 nt, Homo Sapiens; identical to SEQ ID NO: 87396

SEQ ID NO: 100133 - RNA, 64 nt, Homo Sapiens; identical to SEQ ID NO: 87397

SEQ ID NO: 100134 - RNA, 64 nt, Homo Sapiens; identical to SEQ ID NO: 87398

SEQ ID NO: 100135 - RNA, 64 nt, Homo Sapiens; identical to SEQ ID NO: 87399

SEQ ID NO: 100136 - RNA, 64 nt, Homo Sapiens; identical to SEQ ID NO: 87400

SEQ ID NO: 100137 - RNA, 64 nt, Homo Sapiens; identical to SEQ ID NO: 87401

SEQ ID NO: 100138 - RNA, 64 nt, Homo Sapiens; identical to SEQ ID NO: 87402

SEQ ID NO: 100139 - RNA, 64 nt, Homo Sapiens; identical to SEQ ID NO: 87403

SEQ ID NO: 100140 - RNA, 64 nt, Homo Sapiens; identical to SEQ ID NO: 87404

SEQ ID NO: 100141 - RNA, 64 nt, Homo Sapiens; identical to SEQ ID NO: 87405

SEQ ID NO: 100142 - RNA, 64 nt, Homo Sapiens; identical to SEQ ID NO: 87406

SEQ ID NO: 100143 - RNA, 61 nt, Homo Sapiens
uaguccauaucaccacaaauaacugaccugucuccuucacauguagaacacugagcaggac

SEQ ID NO: 100144 - RNA, 61 nt, Homo Sapiens
uuaucuugaacugccugacuauguuauucgacuccuucagguugcaggacucacuggauag

SEQ ID NO: 100145 - RNA, 61 nt, Homo Sapiens
uuaucuuggacugacugacuauguuauucaacuccuucaguuugcaggacucacuggauag

SEQ ID NO: 100146 - RNA, 61 nt, Homo Sapiens
aagccucucugucaucuccccuucccagccccuccuucauccccugccuccuucaccagcc

SEQ ID NO: 100147 - RNA, 61 nt, Homo Sapiens
uccccuucccagccccuccuucauccccugccuccuucaccagccuggcuuuugccuggag

SEQ ID NO: 100148 - RNA, 54 nt, Homo Sapiens
cugggaaugaggagucgugacgugcuccuucagugccccuguacugcccugcca

SEQ ID NO: 100149 - RNA, 61 nt, Homo Sapiens
agggacuuugugcuaagccugaugaaaugugcuccuucaaucuccaugaaaccaucguaac

SEQ ID NO: 100150 - RNA, 61 nt, Homo Sapiens
gaaaacacuguucucugcccuccaagaccuucuccuucaccuuuguccccaccgcagacag

SEQ ID NO: 100151 - RNA, 61 nt, Homo Sapiens
ugggcuggguucuacccaggugcuaggaacacuccuucacagaugggugcuuggaggaagg

SEQ ID NO: 100152 - RNA, 61 nt, Homo Sapiens
ucuagaauuuauuuuccuagcacuucaccaccuccuucaucuucuccuucaacaauaaacc

SEQ ID NO: 100153 - RNA, 61 nt, Homo Sapiens
uuuccuagcacuucaccaccuccuucaucuucuccuucaacaauaaacccugagaucuuug

SEQ ID NO: 100154 - RNA, 61 nt, Homo Sapiens
ucuuuauaaggcaaaaagaucuguauuuacacuccuucaccuagggauguguuuguugccc

SEQ ID NO: 100155 - RNA, 61 nt, Homo Sapiens
cagcaggacugacucugggcucuacaaccagcuccuucacauaaaggguuuagagacuccc

SEQ ID NO: 100156 - RNA, 64 nt, Homo Sapiens
ccugcugcucagagugcagggcugaggcccugggcccagucagcaggaguguacaccugcaagg

SEQ ID NO: 100157 - RNA, 64 nt, Homo Sapiens
ccugcugcacauggcacagggcugaaucccugggcccagucagcaugggccuacaccugccaag

SEQ ID NO: 100158 - RNA, 64 nt, Homo Sapiens
uuauuuuggggggacagugccaaguccaucuuugcccagucaauucagugauugauagcaauuu

SEQ ID NO: 100159 - RNA, 64 nt, Homo Sapiens
aagugagcuuaucuguuugaugcuguggcagggucccagucacugggcauauccuccuucuccu

SEQ ID NO: 100160 - RNA, 64 nt, Homo Sapiens
cuguuauaauuucugaacuguucugagaccuguucccagucacugauugcaauuucuuuuacac

SEQ ID NO: 100161 - RNA, 64 nt, Homo Sapiens
augugacaguccccaggcaugcccacaggccaggcccagucacagcugggcuuccacaggucag

SEQ ID NO: 100162 - RNA, 64 nt, Homo Sapiens
ugugguuccuucucagccgaaacagguccaguaucccagucauuucuucaaaugcugauagggg

SEQ ID NO: 100163 - RNA, 64 nt, Homo Sapiens
ugccccaggacaagagcaagaaggacaucaguugcccagucaugugauccccugccaucuugcc

SEQ ID NO: 100164 - RNA, 64 nt, Homo Sapiens
gggagcagaaagagcaaguggaagcagaggguaucccagucauauggcugcccaugaggcucau

SEQ ID NO: 100165 - RNA, 64 nt, Homo Sapiens
ucaacccaguccugcuucaggcuuggggcacagccccagucagcugugaaccaaagcgucaggg

SEQ ID NO: 100166 - RNA, 64 nt, Homo Sapiens
augaccccuaaagcuuccuucucacuuccccugccccagucacgguuuuucuugaguccuugca

SEQ ID NO: 100167 - RNA, 64 nt, Homo Sapiens
cucuuuuacacaugugggucgcccccaguucagccccagucaccccaauucuggcagauaucag

SEQ ID NO: 100168 - RNA, 64 nt, Homo Sapiens
uacaaggacaaauuauuagcaagaaauaagaauaguauuagaagaauugauccuauuuugaacc

SEQ ID NO: 100169 - RNA, 64 nt, Homo Sapiens
aaggcccuaaaacacugaagguucugcaucugaaguauuagauuguuagcagcaaaauaugaaa

SEQ ID NO: 100170 - RNA, 64 nt, Homo Sapiens
ugcuuagagagaaaugcaucacuuccaaacccauguauuagagaagaagggcgugaaauuuauc

SEQ ID NO: 100171 - RNA, 64 nt, Homo Sapiens
cugauagugaucaauuuuuuuauuuauaucucuuguauuagaguuuuaguaauaucuuuuaaua

SEQ ID NO: 100172 - RNA, 64 nt, Homo Sapiens
uguuuuuucuaaaguuauguacaggaguuaacuuguauuagaauguguccauuugcucaaccag

SEQ ID NO: 100173 - RNA, 64 nt, Homo Sapiens
uguuuuuuucuaaaguuaugauaagguuacacuuguauuagaauuuugaaacagaguuaacagg

SEQ ID NO: 100174 - RNA, 64 nt, Homo Sapiens
aggguauaagggcacuguuugguaggugucuacaguauuagaagaggggaaaucaaaucugguu

SEQ ID NO: 100175 - RNA, 64 nt, Homo Sapiens
uuugugaugaagagcuuccacauacuccaagauuguauuagauuuuugauaccauucuugggca

SEQ ID NO: 100176 - RNA, 64 nt, Homo Sapiens
auauauuaaaugguuauauuaaauuaauaauauuguauuagagaaucagaaccauuuuacuuua

SEQ ID NO: 100177 - RNA, 64 nt, Homo Sapiens
cauauucguauugcccuuuucucauacuuuuuauguauuagaauguaacuaaauucuugcugcc

SEQ ID NO: 100178 - RNA, 64 nt, Homo Sapiens
acccucgagguuuuuuuccauaacugacuaguuaguauuagaagaggucuuuugauguucagag

SEQ ID NO: 100179 - RNA, 64 nt, Homo Sapiens
cacacagccuuggagagaccugaauaauucaaaaguauuagaccaguuaaggcuugagaagcuc

SEQ ID NO: 100180 - RNA, 64 nt, Homo Sapiens
uagaaaauauauauaaauauaguuaaaaacugaauguacugauuuguuugugaagaaaaaaaca

SEQ ID NO: 100181 - RNA, 64 nt, Homo Sapiens
ggacuggagaugguuuuccugaauguaucagaaguguacugaaggccaaccacuuauaugaauu

SEQ ID NO: 100182 - RNA, 64 nt, Homo Sapiens
cauauuaagaaugaucugauugaccguguuggucuguacugauucaauuugauguggugaaaag

SEQ ID NO: 100183 - RNA, 64 nt, Homo Sapiens
aaacagauguccaucagaugacaagaaaggcugcuguacugaaguaaaacaaacaauaccugaa

SEQ ID NO: 100184 - RNA, 64 nt, Homo Sapiens
ugauuuucaaugacuguaaauugcgauaaggaaauguacugauugccaauacaccccacccuca

SEQ ID NO: 100185 - RNA, 64 nt, Homo Sapiens
auagugcagagacuuaccagaagacacaaggaauuguacugaagagcuauuacaauccaaauau

SEQ ID NO: 100186 - RNA, 64 nt, Homo Sapiens
gcaaaugcuuugugacuauuuguauuucauuaucuguacugaaaacaaccaaaccucacacuac

SEQ ID NO: 100187 - RNA, 64 nt, Homo Sapiens
cuauucaaugcaaugcaauuaguaaacuggauacuguacugauacagaaguugaugugggaaga

SEQ ID NO: 100188 - RNA, 64 nt, Homo Sapiens
cugcggugcauggcucaggcgcuacagcaucuaguguacugagccugugggcauuaacuauauu

SEQ ID NO: 100189 - RNA, 64 nt, Homo Sapiens
acgccccagaaaugcugcuuucuccacaugaagauguacugaugagauggugccccccaaauug

SEQ ID NO: 100190 - RNA, 64 nt, Homo Sapiens
ugauuuuuuuuuuuuaauaguaaaaauaagaaucuguacugacuuuucacuuggccauucuggu

SEQ ID NO: 100191 - RNA, 64 nt, Homo Sapiens
gguuuuaaaggacaagcuacaagcucuguguuucuguacugaugugucacuuauuaaauacuuu

SEQ ID NO: 100192 - RNA, 64 nt, Homo Sapiens; identical to SEQ ID NO: 51765

SEQ ID NO: 100193 - RNA, 64 nt, Homo Sapiens; identical to SEQ ID NO: 51766

SEQ ID NO: 100194 - RNA, 64 nt, Homo Sapiens; identical to SEQ ID NO: 51767

SEQ ID NO: 100195 - RNA, 64 nt, Homo Sapiens; identical to SEQ ID NO: 51768

SEQ ID NO: 100196 - RNA, 64 nt, Homo Sapiens; identical to SEQ ID NO: 51769

SEQ ID NO: 100197 - RNA, 64 nt, Homo Sapiens; identical to SEQ ID NO: 51770

SEQ ID NO: 100198 - RNA, 64 nt, Homo Sapiens; identical to SEQ ID NO: 51771

SEQ ID NO: 100199 - RNA, 64 nt, Homo Sapiens; identical to SEQ ID NO: 51772

SEQ ID NO: 100200 - RNA, 64 nt, Homo Sapiens; identical to SEQ ID NO: 51773

SEQ ID NO: 100201 - RNA, 64 nt, Homo Sapiens; identical to SEQ ID NO: 51774

SEQ ID NO: 100202 - RNA, 64 nt, Homo Sapiens; identical to SEQ ID NO: 51775

SEQ ID NO: 100203 - RNA, 64 nt, Homo Sapiens; identical to SEQ ID NO: 51776

SEQ ID NO: 100204 - RNA, 64 nt, Homo Sapiens; identical to SEQ ID NO: 51777

SEQ ID NO: 100205 - RNA, 64 nt, Homo Sapiens; identical to SEQ ID NO: 51778

SEQ ID NO: 100206 - RNA, 64 nt, Homo Sapiens; identical to SEQ ID NO: 51779

SEQ ID NO: 100207 - RNA, 64 nt, Homo Sapiens; identical to SEQ ID NO: 51780

SEQ ID NO: 100208 - RNA, 64 nt, Homo Sapiens; identical to SEQ ID NO: 51781

SEQ ID NO: 100209 - RNA, 64 nt, Homo Sapiens; identical to SEQ ID NO: 51782

SEQ ID NO: 100210 - RNA, 64 nt, Homo Sapiens; identical to SEQ ID NO: 51783

SEQ ID NO: 100211 - RNA, 64 nt, Homo Sapiens; identical to SEQ ID NO: 51784

SEQ ID NO: 100212 - RNA, 64 nt, Homo Sapiens; identical to SEQ ID NO: 51785

SEQ ID NO: 100213 - RNA, 64 nt, Homo Sapiens; identical to SEQ ID NO: 51786

SEQ ID NO: 100214 - RNA, 64 nt, Homo Sapiens; identical to SEQ ID NO: 51787

SEQ ID NO: 100215 - RNA, 64 nt, Homo Sapiens; identical to SEQ ID NO: 51788

SEQ ID NO: 100216 - RNA, 64 nt, Homo Sapiens; identical to SEQ ID NO: 51789

SEQ ID NO: 100217 - RNA, 64 nt, Homo Sapiens; identical to SEQ ID NO: 51790

SEQ ID NO: 100218 - RNA, 64 nt, Homo Sapiens; identical to SEQ ID NO: 51791

SEQ ID NO: 100219 - RNA, 64 nt, Homo Sapiens; identical to SEQ ID NO: 51792

SEQ ID NO: 100220 - RNA, 64 nt, Homo Sapiens; identical to SEQ ID NO: 51793

SEQ ID NO: 100221 - RNA, 64 nt, Homo Sapiens; identical to SEQ ID NO: 51794

SEQ ID NO: 100222 - RNA, 64 nt, Homo Sapiens; identical to SEQ ID NO: 51795

SEQ ID NO: 100223 - RNA, 64 nt, Homo Sapiens; identical to SEQ ID NO: 51796

SEQ ID NO: 100224 - RNA, 64 nt, Homo Sapiens; identical to SEQ ID NO: 51797

SEQ ID NO: 100225 - RNA, 64 nt, Homo Sapiens; identical to SEQ ID NO: 51798

SEQ ID NO: 100226 - RNA, 64 nt, Homo Sapiens; identical to SEQ ID NO: 51799

SEQ ID NO: 100227 - RNA, 64 nt, Homo Sapiens; identical to SEQ ID NO: 51800

SEQ ID NO: 100228 - RNA, 64 nt, Homo Sapiens; identical to SEQ ID NO: 51801

SEQ ID NO: 100229 - RNA, 64 nt, Homo Sapiens; identical to SEQ ID NO: 51802

SEQ ID NO: 100230 - RNA, 64 nt, Homo Sapiens; identical to SEQ ID NO: 51803

SEQ ID NO: 100231 - RNA, 64 nt, Homo Sapiens; identical to SEQ ID NO: 51804

SEQ ID NO: 100232 - RNA, 64 nt, Homo Sapiens; identical to SEQ ID NO: 51805

SEQ ID NO: 100233 - RNA, 64 nt, Homo Sapiens; identical to SEQ ID NO: 51806

SEQ ID NO: 100234 - RNA, 64 nt, Homo Sapiens; identical to SEQ ID NO: 51807

SEQ ID NO: 100235 - RNA, 64 nt, Homo Sapiens; identical to SEQ ID NO: 51808

SEQ ID NO: 100236 - RNA, 64 nt, Homo Sapiens; identical to SEQ ID NO: 51809

SEQ ID NO: 100237 - RNA, 64 nt, Homo Sapiens; identical to SEQ ID NO: 51810

SEQ ID NO: 100238 - RNA, 64 nt, Homo Sapiens; identical to SEQ ID NO: 51811

SEQ ID NO: 100239 - RNA, 64 nt, Homo Sapiens; identical to SEQ ID NO: 51812

SEQ ID NO: 100240 - RNA, 64 nt, Homo Sapiens; identical to SEQ ID NO: 51813

SEQ ID NO: 100241 - RNA, 64 nt, Homo Sapiens; identical to SEQ ID NO: 51814

SEQ ID NO: 100242 - RNA, 64 nt, Homo Sapiens; identical to SEQ ID NO: 51815

SEQ ID NO: 100243 - RNA, 64 nt, Homo Sapiens; identical to SEQ ID NO: 51816

SEQ ID NO: 100244 - RNA, 64 nt, Homo Sapiens; identical to SEQ ID NO: 51817

SEQ ID NO: 100245 - RNA, 64 nt, Homo Sapiens; identical to SEQ ID NO: 51818

SEQ ID NO: 100246 - RNA, 64 nt, Homo Sapiens; identical to SEQ ID NO: 51819

SEQ ID NO: 100247 - RNA, 64 nt, Homo Sapiens; identical to SEQ ID NO: 51820

SEQ ID NO: 100248 - RNA, 64 nt, Homo Sapiens; identical to SEQ ID NO: 51821

SEQ ID NO: 100249 - RNA, 64 nt, Homo Sapiens; identical to SEQ ID NO: 51822

SEQ ID NO: 100250 - RNA, 64 nt, Homo Sapiens; identical to SEQ ID NO: 51823

SEQ ID NO: 100251 - RNA, 64 nt, Homo Sapiens
ugcccuccgccacagacuuugcccggccucaucugccuggcacgcaccaccagucacaaccuau

SEQ ID NO: 100252 - RNA, 64 nt, Homo Sapiens
cccaggacacccgggccaugccccuggcugggcagccuggcacaagugaagaagaaggcagugg

SEQ ID NO: 100253 - RNA, 64 nt, Homo Sapiens
gggaggcacguuucaucugucgcccucugcaaaggccuggcagguaaucucauucaaauggaga

SEQ ID NO: 100254 - RNA, 64 nt, Homo Sapiens
gcuggcaccgcgagcuggcccuguggccagccgagccuggcaguggaaucggugggacaguuuc

SEQ ID NO: 100255 - RNA, 64 nt, Homo Sapiens
uagacugcccccugccacccuggcacuucccagggccuggcaguauggucugaugggcaguaug

SEQ ID NO: 100256 - RNA, 64 nt, Homo Sapiens
acuguugucuagagauggagccagcaggcugguagccuggcagccuacaucuccccucagccuc

SEQ ID NO: 100257 - RNA, 64 nt, Homo Sapiens
ucaauaaauguuuggacaaagugcuuagcacaaugccuggcauuuguucacuguuauaucucua

SEQ ID NO: 100258 - RNA, 64 nt, Homo Sapiens
augaagaauuagcccucccacagugcaugggacagccuggcacaccuaaagacacucaccccug

SEQ ID NO: 100259 - RNA, 64 nt, Homo Sapiens
aggggauucagugagugugaaggugaacaggauggccuggcagcagggauguuuccgugagcca

SEQ ID NO: 100260 - RNA, 64 nt, Homo Sapiens
agccaggacacgccuggaugagaaagccugaggugccuggcaugcccaccggugccacucugca

SEQ ID NO: 100261 - RNA, 64 nt, Homo Sapiens
uuuaccaaguaccaacaguagaaguaacaggaaagccuggcagaguuaaauaucuuggacauuu

SEQ ID NO: 100262 - RNA, 64 nt, Homo Sapiens
ugguaacaaagcauagcaguucucuaggggagaggccuggcauugcacaugguguuacauggcu

SEQ ID NO: 100263 - RNA, 64 nt, Homo Sapiens
aggaggcuugcacccgccuugcuggguggugcaggccuggcaccagccaaugaagacugugcuc

SEQ ID NO: 100264 - RNA, 64 nt, Homo Sapiens
gcccgcuugccggucagggcgcugcugcugggcugccuggcacugugccauucuggaagcucca

SEQ ID NO: 100265 - RNA, 64 nt, Homo Sapiens
aagcaaaggagggccuugaggaagcagcccccaggccuggcagccacgcagcggcugagcucau

SEQ ID NO: 100266 - RNA, 64 nt, Homo Sapiens
gcucaccccugagcccacagccccugcuugggcugccuggcacccucaggguggcccggccucc

SEQ ID NO: 100267 - RNA, 64 nt, Homo Sapiens
cugucaugcuuaguccuucacagcugggcucuaagccuggcaucaaugggucagaaacccaggc

SEQ ID NO: 100268 - RNA, 64 nt, Homo Sapiens
ucagcuuccccaacacgcagaccugccacccugggccuggcagcacugaccugguccacagggc

SEQ ID NO: 100269 - RNA, 64 nt, Homo Sapiens
aaugaauuaaauuccagagaacaauggaagcauugccuggcagaugucacaacagaauaaccac

SEQ ID NO: 100270 - RNA, 64 nt, Homo Sapiens
gcagaugucacaacagaauaaccacuuguuuggagccuggcacaguccuccagccugaucaaaa

SEQ ID NO: 100271 - RNA, 64 nt, Homo Sapiens
gcugugcuccuccccugcucucaggagggccuuggccuggcacgccugugcugacagcgcuccc

SEQ ID NO: 100272 - RNA, 64 nt, Homo Sapiens
ggcuucagagaggaccuggucugcccagugcuuggccuggcaguaggagggggccgcuguccac

SEQ ID NO: 100273 - RNA, 64 nt, Homo Sapiens
uuuaggaagggaaauggcuacuuggccagccauugccuggcauuugguaguauaguaugauucu

SEQ ID NO: 100274 - RNA, 64 nt, Homo Sapiens
cauuucugggccaccucagggaacccaugcaucugccuggcauuuaggcagcagagccccugac

SEQ ID NO: 100275 - RNA, 64 nt, Homo Sapiens
ggguaaaacaccaaacuugauuguuuuaugagaggccuggcaauauacauggcaaaucugaaua

SEQ ID NO: 100276 - RNA, 64 nt, Homo Sapiens
uggcauuucagaauauguucguaucugguauggcgccuggcauauuuucauauuuaugucccua

SEQ ID NO: 100277 - RNA, 64 nt, Homo Sapiens
aagugcucaauauuaugacugcauuaagcauagcgccuggcaguaaugauuaagugcauguaaa

SEQ ID NO: 100278 - RNA, 64 nt, Homo Sapiens
uuuuauuuaaucauuuguagccgcaccccgcccagccuggcagauggauuacagguguaagcca

SEQ ID NO: 100279 - RNA, 64 nt, Homo Sapiens
gcccugauaagcaaaagcaguccccacagccacagccuggcagcucugaucaggaaagugagga

SEQ ID NO: 100280 - RNA, 64 nt, Homo Sapiens
gcaggaguuccaccaccucuggaacaagauuaaggccuggcagaaaauuuucaaacacuaugac

SEQ ID NO: 100281 - RNA, 64 nt, Homo Sapiens
ccgggccuggagaacuagagaaggacccggaggggccuggcagccgugccuucagcucuacagc

SEQ ID NO: 100282 - RNA, 64 nt, Homo Sapiens
gagacugucucaagagggcacugguggcccgacagccuggcacagggcagugggacagggcaug

SEQ ID NO: 100283 - RNA, 64 nt, Homo Sapiens
ccgugagcucaggcaggccugacccggcggcacagccuggcagggaccucguccccaagccugg

SEQ ID NO: 100284 - RNA, 64 nt, Homo Sapiens
cggcggcacagccuggcagggaccucguccccaagccuggcagaaugagagggguugagguccc

SEQ ID NO: 100285 - RNA, 64 nt, Homo Sapiens
gggccagagcaagcgcuguaaacccugacggugggccuggcacacgccuguauucccacaccag

SEQ ID NO: 100286 - RNA, 64 nt, Homo Sapiens
ccgugcauggguuggcuguggggaccccaggugggccuggcaggacuccagaugaggacaagag

SEQ ID NO: 100287 - RNA, 64 nt, Homo Sapiens
ugugugcguggcuaucaggauggcguggcccguggccuggcaucuggccuggcaucugugcgcg

SEQ ID NO: 100288 - RNA, 64 nt, Homo Sapiens
ugugcgcguggcguggcccguggcguggcccguggccuggcaucuggccuggcaucugugugug

SEQ ID NO: 100289 - RNA, 64 nt, Homo Sapiens
uguguguguggcguggcccguggcguggcccguggccuggcaucuggccuggcaucugugugcg

SEQ ID NO: 100290 - RNA, 64 nt, Homo Sapiens
ugugugcguggcguggcccgugguguggcccguggccuggcaucuggcuuggcaucugugugcg

SEQ ID NO: 100291 - RNA, 64 nt, Homo Sapiens
ugugcguguggcguggcccgaggcacggcccgcagccuggcauccgaguacaaggacagacagc

SEQ ID NO: 100292 - RNA, 64 nt, Homo Sapiens
ugugagcauccuggcucgcuagcauuagggguaugccuggcaggcauuaugcugcuauugaaga

SEQ ID NO: 100293 - RNA, 64 nt, Homo Sapiens
cagcacagacugaacucagauggguuagaggcgagccuggcaggccuggagccuacaagugguc

SEQ ID NO: 100294 - RNA, 64 nt, Homo Sapiens
ugaugucaucauugacagccuuugcuucgugggggccuggcagggccccugccuccccgacccc

SEQ ID NO: 100295 - RNA, 64 nt, Homo Sapiens
ugguggggaagggacuugagcugggcaaguccuggccuggcacccgcagccgucucccuuccgu

SEQ ID NO: 100296 - RNA, 64 nt, Homo Sapiens
uggucacuuuugugcuugaggaggcccauuuucugccuggcagggggcaggucugugcccuccc

SEQ ID NO: 100297 - RNA, 64 nt, Homo Sapiens
ggaggaacccauuugugcucugcuuggacagcaggccuggcacugggaggugggggugagcccc

SEQ ID NO: 100298 - RNA, 64 nt, Homo Sapiens
caggcagccuucugaucaguacugcucuccuagggccuggcacacugcagcugcccuguaaaug

SEQ ID NO: 100299 - RNA, 64 nt, Homo Sapiens
guuuucaccagagugagcuccuucuggacauacugccuggcagccugccuuccuagggagcugg

SEQ ID NO: 100300 - RNA, 64 nt, Homo Sapiens
gauuugacugccuuaaaaacacaaggcccucuaggccuggcagggaugucccugugcccagcac

SEQ ID NO: 100301 - RNA, 64 nt, Homo Sapiens
ccuggcagggaugucccugugcccagcacagggugccuggcagggggagaccacagguaugcag

SEQ ID NO: 100302 - RNA, 64 nt, Homo Sapiens
uggcucugaagcugccuucaccggauaguucucagccuggcaagcagauaggagagcacugagc

SEQ ID NO: 100303 - RNA, 64 nt, Homo Sapiens
agggcgagacuccgucucaagccacugcacuccagccuggcaauuugcagugagccaagaucgc

SEQ ID NO: 100304 - RNA, 51 nt, Homo Sapiens
cuaucuacucucuggccuaacggagcccacccaggcacagccaccacuuug

SEQ ID NO: 100305 - RNA, 64 nt, Homo Sapiens
gccccuuuggggaagaggagggugcauuuuccauggagcccaugucagaguccacuccagcuca

SEQ ID NO: 100306 - RNA, 64 nt, Homo Sapiens
gugcugggauggcuauauuaugcuggggcagaguggagcccagggccagaguuguucucagggg

SEQ ID NO: 100307 - RNA, 64 nt, Homo Sapiens
gggcaaagcugcugggccagauucaggccucugaggagcccacgcacugcccuccagggccagg

SEQ ID NO: 100308 - RNA, 64 nt, Homo Sapiens
gcaaccggccccagcagcagguccuggugcuggcggagcccaggcgcaagccaucuaccuucug

SEQ ID NO: 100309 - RNA, 64 nt, Homo Sapiens
ccaggagcagagccagggccuggcgagcuggcguggagcccacaggauucagcagcauggacag

SEQ ID NO: 100310 - RNA, 64 nt, Homo Sapiens
ggcgggagccucucagcuguccagauucagaacuggagcccacuccuccucccucucguugccu

SEQ ID NO: 100311 - RNA, 64 nt, Homo Sapiens
cacagaugaacugccucuccuccucccugccuggggagcccaguggccagggaggggaguggug

SEQ ID NO: 100312 - RNA, 64 nt, Homo Sapiens
gcaugaagcccaaggcagcucuggcccugguggaggagcccagggaacuaaagaccuauugggg

SEQ ID NO: 100313 - RNA, 64 nt, Homo Sapiens
uaugcgguccaugaaacagauguauuacaggaugggagcccauauccuuugucuuucucaggua

SEQ ID NO: 100314 - RNA, 64 nt, Homo Sapiens
cccgugggugugaggccgggcgaaagugggcaugggagcccaucgcuggacuuaagguaggagc

SEQ ID NO: 100315 - RNA, 64 nt, Homo Sapiens
agauggccucagcguggccacggcagagggcgcaggagcccaggcgugcggguccccuccuggc

SEQ ID NO: 100316 - RNA, 51 nt, Homo Sapiens
cagcugggaaggaggcuuaguggagcccacgugggccucuggggugcacau

SEQ ID NO: 100317 - RNA, 64 nt, Homo Sapiens
aagcagauucgccccagagccuccaggcgugaguggagcccaguccagcgacaccuugguuugg

SEQ ID NO: 100318 - RNA, 64 nt, Homo Sapiens
gcugucggucagaaccuccugugcgguacaaucuggagcccacaggcccagagcugagauggga

SEQ ID NO: 100319 - RNA, 64 nt, Homo Sapiens
caccuuuuuucuuuuucuuucauaaacacuccccggagcccacuucugcuuuuagaaauguaga

SEQ ID NO: 100320 - RNA, 64 nt, Homo Sapiens
ggguggcaagaacagugggccggagcccagccugggagcccagacaggggagacaggagccuag

SEQ ID NO: 100321 - RNA, 64 nt, Homo Sapiens
cugggagcccagaggguggcgacaggagccuagcggagcccagcccuaacuaacuggcagggga

SEQ ID NO: 100322 - RNA, 64 nt, Homo Sapiens
gaagccucugagggauugaguccauccacccgggggagcccagucagugagcaugccgggcccc

SEQ ID NO: 100323 - RNA, 64 nt, Homo Sapiens
ccugagggcugcaucucuguuugucagcuuagggggagcccagucucaagacaagcccacgccc

SEQ ID NO: 100324 - RNA, 64 nt, Homo Sapiens
ugcugccugggggagagccucgggucccagagagggagcccaccgaaagcuuccugaguggugu

SEQ ID NO: 100325 - RNA, 64 nt, Homo Sapiens
ucgugggccugaugaaagcuugggcccuugaaggggagcccaaccccccacucugggcacuagg

SEQ ID NO: 100326 - RNA, 64 nt, Homo Sapiens
uuccucuuccugaagcccuacagaguuagggaauggagcccaggcaccaggggucuaaagugug

SEQ ID NO: 100327 - RNA, 64 nt, Homo Sapiens
uuuuaccgugcacguaaauuggucagcagaaaagggagcccagaaaaggcagcagauggaccau

SEQ ID NO: 100328 - RNA, 64 nt, Homo Sapiens
gcccggcacagcacaggggccagcaccugcauggggagcccaguagcacagagccgggcagacg

SEQ ID NO: 100329 - RNA, 64 nt, Homo Sapiens
gagcauguggcaggcaguggccuccaggcuuccgggagcccagaugccaaggggaggagcgaca

SEQ ID NO: 100330 - RNA, 64 nt, Homo Sapiens
aggaagccccgcccagacgguguucagggaacccggagcccaagcgcuccggcggagcccaaaa

SEQ ID NO: 100331 - RNA, 64 nt, Homo Sapiens
guguucagggaacccggagcccaagcgcuccggcggagcccaaaagggugggggugggaggggc

SEQ ID NO: 100332 - RNA, 64 nt, Homo Sapiens
cacaugcccacagcagccucggugacgagagcacggagcccaagagguggggugucguggcucu

SEQ ID NO: 100333 - RNA, 64 nt, Homo Sapiens
ccgcagguuugggccgacacgcggaaggccggguggagcccauccaugcugugguguugccucg

SEQ ID NO: 100334 - RNA, 64 nt, Homo Sapiens
cguggcgucagcccagcugcaggagaagcuggcaggagcccagcgccagcuggggcagcuccgg

SEQ ID NO: 100335 - RNA, 64 nt, Homo Sapiens
cccagugcuucccaaggcccuuccaccagggcugggagcccauuaauuaauucccaauccccca

SEQ ID NO: 100336 - RNA, 64 nt, Homo Sapiens
gccugucuggaagggcuguccagcugccgaagguggagcccagacccgggugggcugcucaggg

SEQ ID NO: 100337 - RNA, 64 nt, Homo Sapiens
uggucgcugagacagagauggaagccaggacaagggagcccaccgggcccagauagguacagag

SEQ ID NO: 100338 - RNA, 64 nt, Homo Sapiens
ccuugggcaacuccugccaccacccccuccccagggagcccaaggcaggggaggcucagcaugg

SEQ ID NO: 100339 - RNA, 64 nt, Homo Sapiens
uguagugauuacacuugaauuguguacuuaguguguaugugauccuccaguguuaucccggaga

SEQ ID NO: 100340 - RNA, 64 nt, Homo Sapiens
auuuaaaccaaaaugaacugauacuuguuggaauguaugugaacuaauugcaauuauauuagag

SEQ ID NO: 100341 - RNA, 64 nt, Homo Sapiens
gccuugauuguuauguaauaaguggaaaucauuaguaugugagggagguuggcaauauagacaa

SEQ ID NO: 100342 - RNA, 64 nt, Homo Sapiens
gaauuuuuuuaaaauuauaaauuuagacuauguaguaugugacauuuauucugaagguaauuaa

SEQ ID NO: 100343 - RNA, 64 nt, Homo Sapiens
gaggcagugcugacuccgugcuacacuguuccucguaugugaagacuuaguacauuaagaauga

SEQ ID NO: 100344 - RNA, 64 nt, Homo Sapiens
aucugcaucgaucauggacucaaaacgggacauaguaugugacacuuguucagguuaguacccg

SEQ ID NO: 100345 - RNA, 64 nt, Homo Sapiens
uccagcacccuaaccccgacauuccugggcaguaguaugugauguugauucagacugucagucu

SEQ ID NO: 100346 - RNA, 64 nt, Homo Sapiens
guuuaugauaaacgcuuaaauuacagagauaaauguaugugaauauaacuguucuugggccacu

SEQ ID NO: 100347 - RNA, 64 nt, Homo Sapiens
gcuauauuguauuacaaagucuacuagagccauuguaugugacacauugcaauuugauuuaagc

SEQ ID NO: 100348 - RNA, 64 nt, Homo Sapiens
uuagggauggaaacuuuuuuacuuaacuuguuguguaugugaauuaaaacuagcuuauaguuua

SEQ ID NO: 100349 - RNA, 64 nt, Homo Sapiens
guggggugagguucccuggugaaacguaggguguguaugugaaagauaauagguuuuucauaaa

SEQ ID NO: 100350 - RNA, 64 nt, Homo Sapiens
gcuguagcauuccacugcacucccuuagugcuguguaugugacuacccccuuucagccacuggg

SEQ ID NO: 100351 - RNA, 64 nt, Homo Sapiens
gaaugagacauauucccaaaaaauucuuaucucuguaugugauuggaaaagaaaagaucacauu

SEQ ID NO: 100352 - RNA, 64 nt, Homo Sapiens
ccucuccaaaauucauguacuuccuggagccucaguaugugaccuuauuuggaaauacuguggu

SEQ ID NO: 100353 - RNA, 63 nt, Homo Sapiens
ugaaaagaugcuggauaggcuaccaaaguucccaagugguagauaauucagaagacuuguuug

SEQ ID NO: 100354 - RNA, 63 nt, Homo Sapiens
aacuacuuuggaagcgucaguggauauauuugaaagugguaauccugaaucucuuuuaaacua

SEQ ID NO: 100355 - RNA, 63 nt, Homo Sapiens
ugaacauagaacuuggguauguuuuccuuguuuaagugguaguacagaaugauauuagaaaau

SEQ ID NO: 100356 - RNA, 63 nt, Homo Sapiens
ucuaucuggugaagugucuuaaaugauggauauaagugguagcgaacuuaagaugaauuauaa

SEQ ID NO: 100357 - RNA, 63 nt, Homo Sapiens
uugagcagaucugauuauucuuggauaguauucaagugguaucuugacuauuaaacuacguau

SEQ ID NO: 100358 - RNA, 63 nt, Homo Sapiens
agcagauuuuucuuuagucaugaaaaauaucucaagugguaaguuguuugugcuuuaggcaaa

SEQ ID NO: 100359 - RNA, 63 nt, Homo Sapiens
uucucauuaaaucuguaaaucaccucuauaaguaagugguaauaauaaagcagauauuuuugu

SEQ ID NO: 100360 - RNA, 63 nt, Homo Sapiens
cuuaauagggugguacccuggaaaggaucugggaagugguagaauuucuggucuguacuuuua

SEQ ID NO: 100361 - RNA, 63 nt, Homo Sapiens
agauggagagagcacuuccccguaacgaaagcaaagugguaagcacagggugagacccuuuua

SEQ ID NO: 100362 - RNA, 63 nt, Homo Sapiens
agaucuucuuuucuaauagccauuugccaccccaagugguaugucggccauuucuccuuaaaa

SEQ ID NO: 100363 - RNA, 63 nt, Homo Sapiens
caugggaugucugaaaucagacuacuuaugcguaagugguaugugguauauguaugcugauuu

SEQ ID NO: 100364 - RNA, 63 nt, Homo Sapiens
cucacagccguccaacuuaaacacauaauaaccaagugguagaucauauucugaagucucacc

SEQ ID NO: 100365 - RNA, 63 nt, Homo Sapiens
uaucccugaaguucaaaagacuuauauauguauaagugguaugugauauaaaucguguguuuc

SEQ ID NO: 100366 - RNA, 63 nt, Homo Sapiens
ggguacauaugugaacauuccagccuucagcauaagugguaguccaaauuuucuuuaagcagc

SEQ ID NO: 100367 - RNA, 64 nt, Homo Sapiens; identical to SEQ ID NO: 53427

SEQ ID NO: 100368 - RNA, 64 nt, Homo Sapiens; identical to SEQ ID NO: 53428

SEQ ID NO: 100369 - RNA, 64 nt, Homo Sapiens; identical to SEQ ID NO: 53429

SEQ ID NO: 100370 - RNA, 64 nt, Homo Sapiens; identical to SEQ ID NO: 53430

SEQ ID NO: 100371 - RNA, 64 nt, Homo Sapiens; identical to SEQ ID NO: 53431

SEQ ID NO: 100372 - RNA, 64 nt, Homo Sapiens; identical to SEQ ID NO: 53432

SEQ ID NO: 100373 - RNA, 64 nt, Homo Sapiens; identical to SEQ ID NO: 53433

SEQ ID NO: 100374 - RNA, 64 nt, Homo Sapiens; identical to SEQ ID NO: 53434

SEQ ID NO: 100375 - RNA, 63 nt, Homo Sapiens
uucauuuuugauguuuugugaagaauuuaaauuuaaacgaauguucuuaaaucaagugugauu

SEQ ID NO: 100376 - RNA, 63 nt, Homo Sapiens
gaggcgucucacauuuuuacuugguguaauuaauaaacgaagauaaaucauaguguaugugua

SEQ ID NO: 100377 - RNA, 63 nt, Homo Sapiens
acaagcaauaacucucuacaggaauauauuuuuuaaacgaagagacagaacuguccacaucug

SEQ ID NO: 100378 - RNA, 59 nt, Homo Sapiens
cugacuugauugugccauuuaaggaaauguaaacgaaggggcauugcuguguucaguag

SEQ ID NO: 100379 - RNA, 63 nt, Homo Sapiens
cagugaccuaaggauuuucuggcuuaauuuugauaaacgaaucgggcugaaucauaaucacaa

SEQ ID NO: 100380 - RNA, 63 nt, Homo Sapiens
gagucuuucuuaugccuuccgggaucaacuaaauaaacgaagaacuauuaggaauugagaagg

SEQ ID NO: 100381 - RNA, 63 nt, Homo Sapiens
ccuagcauagagaaaauacuucuauuauucuccuaaacgaaugagcauacuauaaagcaaaua

SEQ ID NO: 100382 - RNA, 63 nt, Homo Sapiens
guuaaaacagggucaauccaugcuuugaaggaauaaacgaaaucauaaauggaaagauacaaa

SEQ ID NO: 100383 - RNA, 63 nt, Homo Sapiens
auuuucaaaaucugcccucagaugaaaauaaaauaaacgaaacauuuagacaauggcuauauu

SEQ ID NO: 100384 - RNA, 63 nt, Homo Sapiens
uauuaacaucuauugcuuuuuucuaccccucgcuaaacgaagaagugggaggagucaauguca

SEQ ID NO: 100385 - RNA, 63 nt, Homo Sapiens
ugauuaaauguaugagaaaugcaugacaggaacuaaacgaaacccacugaugugucuaaauga

SEQ ID NO: 100386 - RNA, 63 nt, Homo Sapiens
aaagacaauuuauaauuugaauggcacuaucuuuaaacgaaacgguuaccccaucaggaggac

SEQ ID NO: 100387 - RNA, 63 nt, Homo Sapiens
caaaguguucucacacgucaguccaacaaauuuuaaacgaaucaucccguuggagguuuugaa

SEQ ID NO: 100388 - RNA, 63 nt, Homo Sapiens
uguguaauaaugcucaaccuucaugucuccguauaaacgaaacuuuccaugagagcucaugac

SEQ ID NO: 100389 - RNA, 63 nt, Homo Sapiens
ggggcagggagcuggggacauuuuaaucaucaauaaacgaagcacuuuauucuguacagauuu

SEQ ID NO: 100390 - RNA, 63 nt, Homo Sapiens
gauuuuagucuuucuuacacauaugugugauuuuaaacgaauauucucagaccacaggaaacu

SEQ ID NO: 100391 - RNA, 63 nt, Homo Sapiens
aagucuuucauggcugcuguugcuuaaaccacuuaaacgaagaguucccuugaaacuuuggga

SEQ ID NO: 100392 - RNA, 63 nt, Homo Sapiens
uccagcugcguacagucuaguaaccagcaacuguaaacgaaccugugccucuaacaagcgauu

SEQ ID NO: 100393 - RNA, 63 nt, Homo Sapiens
cugugucuuacuugauuuauaugcauguuuagguaaacgaaagguuuauauucagguuggauu

SEQ ID NO: 100394 - RNA, 63 nt, Homo Sapiens
acugacaugagaaaagaggagcuguuuugguauuaaacgaauaaaaucuuaagcaaauauagg

SEQ ID NO: 100395 - RNA, 63 nt, Homo Sapiens
cuuccucuacguuuauccuggcaugugcuaggguaaacgaaggcauaauaagccauggcugac

SEQ ID NO: 100396 - RNA, 63 nt, Homo Sapiens
ugagaaaaacuuugccccggacgaagcugcuguuaaacgaaacgcuuuuuuuguuuguuucca

SEQ ID NO: 100397 - RNA, 63 nt, Homo Sapiens
uccgagcgacggcuccucccuucuauguguuuuuaaacgaagagucugcgcggauguagcaug

SEQ ID NO: 100398 - RNA, 63 nt, Homo Sapiens
aaacacuguaagcuuuuaagaaaaacaaaguuuuaaacgaaauacugcucuguccagaggcuu

SEQ ID NO: 100399 - RNA, 63 nt, Homo Sapiens
gguagaggcaggcccuccuccacuucuugguacuaaacgaagaucucgacaccuugcaguuuu

SEQ ID NO: 100400 - RNA, 63 nt, Homo Sapiens
cauuccugcauucaggauguauuaauguuuauuuaaacgaacauucagaauucaacauuaaag

SEQ ID NO: 100401 - RNA, 63 nt, Homo Sapiens
ugccauuuuaguaaaggcaguaauugguugauguaaacgaaagacuuagaagcaaguagaaaa

SEQ ID NO: 100402 - RNA, 63 nt, Homo Sapiens
aucagggaccggauauuucuguugaacaggacuuaaacgaauccggguggaagcuuucaucga

SEQ ID NO: 100403 - RNA, 63 nt, Homo Sapiens
cuccucuuguccuacaaugaacaguuacaaaaauaaacgaacuaacuaaucggaacauguaaa

SEQ ID NO: 100404 - RNA, 63 nt, Homo Sapiens
gaugcaggagaaguugggcaaaagcccucaggauaaacgaauaagucauucagaguaggugcu

SEQ ID NO: 100405 - RNA, 63 nt, Homo Sapiens
cucuagggucugaugcuguuuuuguuccaaauauaaacgaaaggcacuagucagccgccugca

SEQ ID NO: 100406 - RNA, 63 nt, Homo Sapiens
aucgaauaacagcuaaacaaaucgaauaacagcuaaacgaaucgaauaacagcuuuuguacau

SEQ ID NO: 100407 - RNA, 63 nt, Homo Sapiens
uauuaugcaaaguaccaacugagccaaaaacaauaaacgaaacacagaacucagccuuaagaa

SEQ ID NO: 100408 - RNA, 63 nt, Homo Sapiens
uucaacaguauugcguugucagacuaggaaagcuaaacgaacaaaaugguuuuaguuuugcug

SEQ ID NO: 100409 - RNA, 63 nt, Homo Sapiens
cguuuuauugguaacagauauacuuacauugaauaaacgaaugauuguuaaaauuagauaacu

SEQ ID NO: 100410 - RNA, 63 nt, Homo Sapiens
auuaaacugcacuguugaucgccaagaguuuaguaaacgaagaaucuuuaaaguuaaugucua

SEQ ID NO: 100411 - RNA, 63 nt, Homo Sapiens
uuuugacugaaaaauuuuggcuuuuuaaaguuuuaaacgaauagauggaaauggaauagauuu

SEQ ID NO: 100412 - RNA, 63 nt, Homo Sapiens
cagccugggagacugcaucucaaaaaagaaaaauaaacgaaguaaaagauauuuaucagagcu

SEQ ID NO: 100413 - RNA, 63 nt, Homo Sapiens
accagcugaggguguauuauaugcagaauuacauaaacgaagcucucaaagguaaggagcccu

SEQ ID NO: 100414 - RNA, 63 nt, Homo Sapiens
gauaaagauaaaaccauauuugauuuaugcgauuaaacgaaaucuuggcuagaaauguuuuug

SEQ ID NO: 100415 - RNA, 63 nt, Homo Sapiens
caccaaaaggaggcgcucuuucauuuuuauuuguaaacgaauauaaaaaugcaaauaaauauu

SEQ ID NO: 100416 - RNA, 63 nt, Homo Sapiens
acccucucucaugaacucuuugaugaggauuuguaaacgaaaacagacucgaacuauugugua

SEQ ID NO: 100417 - RNA, 63 nt, Homo Sapiens
uccccagaaauuaguaguaauagauaaaacgaguaaacgaaauaaauguugauuuuuuaauau

SEQ ID NO: 100418 - RNA, 63 nt, Homo Sapiens
ucaaagaaaaacucuucauuucucccugauucuuaaacgaaggugguuaauagaaacucaggc

SEQ ID NO: 100419 - RNA, 63 nt, Homo Sapiens
agaagagaaauugcuggguuuagaacaagauuauaaacgaauucggugcucagugaucacuug

SEQ ID NO: 100420 - RNA, 63 nt, Homo Sapiens
cugucuccccgugccaugugccagugaucccaauaaacgaauuaguucuuccuccaccuccac

SEQ ID NO: 100421 - RNA, 63 nt, Homo Sapiens
ugcggguaacagacaauauaauagccccgaccuuaaacgaagcuuuuguacugcagaauacau

SEQ ID NO: 100422 - RNA, 63 nt, Homo Sapiens
uaacauaaacugaaugcauuaauguuacaacaauaaacgaacaguguuugauguucaaaacaa

SEQ ID NO: 100423 - RNA, 63 nt, Homo Sapiens
aauaaaauacugcaaaauguaguuauagcuucuuaaacgaaaguuguuucugaagaugguuua

SEQ ID NO: 100424 - RNA, 63 nt, Homo Sapiens
uuuauggaacacuuaccacauugccacuuuuucuaaacgaagaguuuacuagcagccuggaau

SEQ ID NO: 100425 - RNA, 63 nt, Homo Sapiens
gaaggaacuuaaccgcuagugccgaggacacguuaaacgaacaggaugggccgggcacggugg

SEQ ID NO: 100426 - RNA, 63 nt, Homo Sapiens
agcagaauuaugucuguagaguuggaagagaauuaaacgaaaaucauuguuaauugcugaggc

SEQ ID NO: 100427 - RNA, 63 nt, Homo Sapiens
cacuucuuuggaagguuauguaagcccuguaaauaaacgaaggguagagcuuuuuuccuuucc

SEQ ID NO: 100428 - RNA, 63 nt, Homo Sapiens
gucacagguuuuauaauaaauuauguuauuauguaaacgaauugcaugcauguugaaauuuuu

SEQ ID NO: 100429 - RNA, 63 nt, Homo Sapiens
ucaaagauuagaaauacaucuuguaauguguauuaaacgaagugguuuauggcagguaauuuu

SEQ ID NO: 100430 - RNA, 63 nt, Homo Sapiens
cuuuauuugaagcaaagcuauccacacucacauuaaacgaaagcacacacacacacacgcacg

SEQ ID NO: 100431 - RNA, 64 nt, Homo Sapiens
uaggacugacuggguucuuccucccuccccgaagcccagacaguucaguugggcuggggguugc

SEQ ID NO: 100432 - RNA, 64 nt, Homo Sapiens
agacauaacugagcugaaguaauuccauaaagggcccagacagccuccuccaccauucccuuca

SEQ ID NO: 100433 - RNA, 64 nt, Homo Sapiens
ccucuccuugccugcaggcuuggcugccccaaaccccagacacugacccagagguaaggcugcc

SEQ ID NO: 100434 - RNA, 64 nt, Homo Sapiens
uuauaccacccaguguucagccuuuuuuccacugcccagacagcugcucauuauaccccaaaga

SEQ ID NO: 100435 - RNA, 64 nt, Homo Sapiens
ccuucccagccacugacucacaguucucuggaugcccagacaccucucuucagggaagaugagu

SEQ ID NO: 100436 - RNA, 64 nt, Homo Sapiens
acuggaaaucaucacagcagugggauaucagagccccagacagcacugccucuuccuccccacc

SEQ ID NO: 100437 - RNA, 64 nt, Homo Sapiens
ugcuucuugugaaaccacaggcccuugggguucccccagacagagccgcaaaucaaccccagac

SEQ ID NO: 100438 - RNA, 64 nt, Homo Sapiens
uuuuaaauggugggaacccuccccaaaaccuuuccccagacacauucuccugugccccucagag

SEQ ID NO: 100439 - RNA, 64 nt, Homo Sapiens
ucccgaaguuucgauuugauuagucugggguggacccagacauguuaaguauuuuuuaaguucc

SEQ ID NO: 100440 - RNA, 64 nt, Homo Sapiens
ggucagacagugacuaauccagggccguggcauucccagacagcacaccacugugguccccucc

SEQ ID NO: 100441 - RNA, 64 nt, Homo Sapiens
ugacuguagccaucaccagaacacuuaguuucuucccagacaugaauuuccugacaggcucuga

SEQ ID NO: 100442 - RNA, 64 nt, Homo Sapiens
gacgguugaagaaucaagcucauaauaugauacacccagacagacccagaaaucuuuugauuuc

SEQ ID NO: 100443 - RNA, 64 nt, Homo Sapiens
caggguucucuauuucucuuccuagacccaaaggcccagacacgcauagaucauaguccaaucc

SEQ ID NO: 100444 - RNA, 64 nt, Homo Sapiens
uucagccagcgcugaggaaauggaggccccaguccccagacaguucagagaaggagacaccucc

SEQ ID NO: 100445 - RNA, 64 nt, Homo Sapiens
ugacacccuaaaagccauccguucccuccgucuccccagacaucaaguaucuucgcagugcucu

SEQ ID NO: 100446 - RNA, 64 nt, Homo Sapiens
cuaucgccacaaugccauguuaggaaaggccagccccagacaucaggaggaagcgaugccgagg

SEQ ID NO: 100447 - RNA, 64 nt, Homo Sapiens
ccuggcuguguuccugagcccccgucgugccucucccagacagcagcugucuggcccuugcugg

SEQ ID NO: 100448 - RNA, 64 nt, Homo Sapiens
caaguggucacaaagaggguggcugugaggugaccccagacacugcagaacgaugugcacccuc

SEQ ID NO: 100449 - RNA, 64 nt, Homo Sapiens
ggcaguccccccacgcccgagaaagccugggggacccagacaccuguccccacagucaaagccu

SEQ ID NO: 100450 - RNA, 64 nt, Homo Sapiens
ccagacaccuguccccacagucaaagccuggggacccagacauccuguccccacagucagccuc

SEQ ID NO: 100451 - RNA, 64 nt, Homo Sapiens
cagacccggacagacagacacagccugaaacagacccagacaaacagacagacagacacagccu

SEQ ID NO: 100452 - RNA, 64 nt, Homo Sapiens
gacaaacagacagacagacacagccugaaacagacccagacagacagacagacagccugaaaca

SEQ ID NO: 100453 - RNA, 64 nt, Homo Sapiens
gacccagacagacagacagacagccugaaacagacccagacacagccugaaacagauccggaca

SEQ ID NO: 100454 - RNA, 64 nt, Homo Sapiens
uccggacagacagacagaaacagccugaaacagacccagacagacagacagacacagccugaaa

SEQ ID NO: 100455 - RNA, 64 nt, Homo Sapiens
cagaccuagacagacagacacagauugaaacagacccagacaaacagacagacacagccugaaa

SEQ ID NO: 100456 - RNA, 64 nt, Homo Sapiens
cccagacaaacagacagacacagccugaaacagacccagacacagccugaaacagacccggaca

SEQ ID NO: 100457 - RNA, 64 nt, Homo Sapiens
cccggacagacagacagacacagccugaaacagacccagacagacagacagacacagccugaaa

SEQ ID NO: 100458 - RNA, 64 nt, Homo Sapiens
cccagacagacagacagacacagccugaaacagacccagacagacagaccgacgcagccugaaa

SEQ ID NO: 100459 - RNA, 64 nt, Homo Sapiens
cccagacagacagaccgacgcagccugaaagagacccagacagagagacaggcagacacagccu

SEQ ID NO: 100460 - RNA, 64 nt, Homo Sapiens
acugauggcucugacaccguguugguggcgaugucccagacaaucccaccaggacggcccagac

SEQ ID NO: 100461 - RNA, 64 nt, Homo Sapiens
gguggcgaugucccagacaaucccaccaggacggcccagacaucccuacuggcuucgcuggugg

SEQ ID NO: 100462 - RNA, 64 nt, Homo Sapiens
gagcagagguuggccucccuggaggagcagguggcccagacagcccaagcccugcacuggaucg

SEQ ID NO: 100463 - RNA, 64 nt, Homo Sapiens
gacugucaggauaaacuccguggggguacaggagcccagacaaagcccaggccugucaagagac

SEQ ID NO: 100464 - RNA, 64 nt, Homo Sapiens
uuucuuggggacccaguauguccucuccucuagacccagacauacaguuauaaccgucuguccu

SEQ ID NO: 100465 - RNA, 64 nt, Homo Sapiens
caucaaccagggcagauccaccgugcccugguuccccagacauuccagaaugccccacaucauu

SEQ ID NO: 100466 - RNA, 64 nt, Homo Sapiens
gaauguuggagcaaaagcucugguugaugucagacccagacauaaacacacaggaacagagaaa

SEQ ID NO: 100467 - RNA, 64 nt, Homo Sapiens
gaauguuugaacaaagacucuggucgauuccagacccagacauaaacccguagauacagagaag

SEQ ID NO: 100468 - RNA, 64 nt, Homo Sapiens
agugaguguauuuuccuuguguauauauuaaacacacccauacaaacauugguaaaguugauua

SEQ ID NO: 100469 - RNA, 64 nt, Homo Sapiens
acucucuucugcaauuuugacaccucaauauucacacccauaaacauuacuaagccccaguucu

SEQ ID NO: 100470 - RNA, 64 nt, Homo Sapiens
agaaaauuuggaaacuauaaauuuagaaacguaucacccauacguccaacaucgaaagaaaacc

SEQ ID NO: 100471 - RNA, 64 nt, Homo Sapiens
uuacuuuuuauuucuaaaguuguagugaagcucucacccauaauaaagguugugaauguucugu

SEQ ID NO: 100472 - RNA, 64 nt, Homo Sapiens
ugagguuuuaccuccuccauuccugaccaauaaccacccauaacuacggcauucucugugacuu

SEQ ID NO: 100473 - RNA, 64 nt, Homo Sapiens
gagagaagggagaaaaaaaaaaaaaaaccacacacacccauacacacauaccagaaaaagaaag

SEQ ID NO: 100474 - RNA, 64 nt, Homo Sapiens
gcccguaugugcaggaccucagggugccagcccucacccauacaccuccagggcugcaggucau

SEQ ID NO: 100475 - RNA, 64 nt, Homo Sapiens
uaucuuauuuucucaaucuccucucucuuuccuccacccauaauaagagaauguuccuacucac

SEQ ID NO: 100476 - RNA, 64 nt, Homo Sapiens
uccuuguguguuaacuucuacuuggauucugccacacccauaaaucugucuaugggaccagugg

SEQ ID NO: 100477 - RNA, 64 nt, Homo Sapiens
gcucauccucuguggaaucagcuccaagaaaggccacccauagaggcugaggcagaacccagga

SEQ ID NO: 100478 - RNA, 64 nt, Homo Sapiens
ucaggucaacgugaccaacccaccuaucaccccucacccauaacgccuggcagcccccaccucc

SEQ ID NO: 100479 - RNA, 64 nt, Homo Sapiens
uauccuggauucugaacucucauaaacauauaaccacccauaucauuggaguuggcccaagaaa

SEQ ID NO: 100480 - RNA, 64 nt, Homo Sapiens
ugugugcccuagggcucagauauuuggagaauagcacccauaucaggcagagaaguggagugac

SEQ ID NO: 100481 - RNA, 64 nt, Homo Sapiens
cacagucuagauuagaaguguuuuaauuucuacacacccauagugcacacuuguauauugaaaa

SEQ ID NO: 100482 - RNA, 64 nt, Homo Sapiens
uuauaaauuaaaaaaggcugggugugguggcucacacccauaaucccaacacuuuggcucagca

SEQ ID NO: 100483 - RNA, 64 nt, Homo Sapiens
uggcagauuccccagauaaccaaggaaaaggggccacccauaccuggaaauaggccauagggcc

SEQ ID NO: 100484 - RNA, 64 nt, Homo Sapiens
guaugugguuguugaucuuuuuuuuccuuacagacacccauaauaaaauaucauauuaaaauuc

SEQ ID NO: 100485 - RNA, 64 nt, Homo Sapiens
gggggaccccagagggaggccuaggaggggacugcacccauacugcuucccuaccacaaaucag

SEQ ID NO: 100486 - RNA, 64 nt, Homo Sapiens
ggaucaggcaggcucucuccccggggacaugaggcacccauaccuaggacccccugcgccuuuu

SEQ ID NO: 100487 - RNA, 64 nt, Homo Sapiens
ccagcaaaugccacucauccccuuaucaacuuuacacccauaucuaucuguugaaccuucauga

SEQ ID NO: 100488 - RNA, 64 nt, Homo Sapiens
ucaaacaauuacaccauggucuauacuguacacucacccauaauuaucuagugcaucuacaucu

SEQ ID NO: 100489 - RNA, 64 nt, Homo Sapiens
cacacacacagugcuuuaagcacacacaugcacacacccauaaauccccaaaugcaaacacagg

SEQ ID NO: 100490 - RNA, 64 nt, Homo Sapiens
uguggguuagaguuaguaaguauaguuugaggggcacccauauuuagucuucugccugcaguuu

SEQ ID NO: 100491 - RNA, 64 nt, Homo Sapiens
aaagagggacauggacuauauacuuugaaauuaucacccauauauccugggacucuggcuauag

SEQ ID NO: 100492 - RNA, 64 nt, Homo Sapiens
ugaaaagaauaaaugugugacacugaugaaacaacacccauacccaccaguucuggggcaaaga

SEQ ID NO: 100493 - RNA, 64 nt, Homo Sapiens
uuuacucugaagcaguaacagaaaaaauuaaaaccacccauaacaggauuaaaucuaaaggaaa

SEQ ID NO: 100494 - RNA, 64 nt, Homo Sapiens
acaugucuacuauggcaaaaaacauuaccauccccacccauaccacagcauccccuagagagag

SEQ ID NO: 100495 - RNA, 64 nt, Homo Sapiens
aacuaggcugcugguuuuaauuacccucagauuucacccauaaaaacgcacaauuguauuauuu

SEQ ID NO: 100496 - RNA, 64 nt, Homo Sapiens
auuuauaacuucugaauuuaauuugauaauuaagcacccauaccgacaaguaaaauugcaggug

SEQ ID NO: 100497 - RNA, 64 nt, Homo Sapiens
gagaguugaaaggggauggaggauguucuuaucccacccauaauaauaguuaccuugccuuuua

SEQ ID NO: 100498 - RNA, 64 nt, Homo Sapiens
uagugugaucaugacuuugucaaaggcaagucuccacccauaaccguucucuuguauuccuguu

SEQ ID NO: 100499 - RNA, 64 nt, Homo Sapiens
cucugccaucaacuacuauucaaaaccucaaauccacccauauguuaaaauucucauuacucuu

SEQ ID NO: 100500 - RNA, 64 nt, Homo Sapiens
uucuuagagaaauuucucuguggcucaguuuuaccacccauaaagcggagacaguaauuuacgg

SEQ ID NO: 100501 - RNA, 64 nt, Homo Sapiens
cauuagaccuuuacagguaauggaacaugagcuucacccauauuaaauauuuuggccccuuuaa

SEQ ID NO: 100502 - RNA, 64 nt, Homo Sapiens
aauuauuuucuucauauuguagauuuucugcagucacccauacuuaacauuuguaauacauuuu

SEQ ID NO: 100503 - RNA, 64 nt, Homo Sapiens
cuguguuucgccaaagcucauaagggcugugacccacccauauggccccaguuuuuucugucuc

SEQ ID NO: 100504 - RNA, 64 nt, Homo Sapiens
agaaauuuuauuuccauuguuucccucaucuucucacccauaauaauuuuuuccccuuaauucu

SEQ ID NO: 100505 - RNA, 64 nt, Homo Sapiens
gauguuuuuaggauguaaguuuuccauuuuuaggcacccauaggaaggccaugaacucacugga

SEQ ID NO: 100506 - RNA, 64 nt, Homo Sapiens
ucucagaaaaaguguuuggggugccuugcacacacacccauaccuacagaaagacuguaugugu

SEQ ID NO: 100507 - RNA, 64 nt, Homo Sapiens
ccuuucugccgaccccuagugagccaauguuuuccacccauaaucagcaucacuccccaaggaa

SEQ ID NO: 100508 - RNA, 64 nt, Homo Sapiens
gcugagccucaccccggcuuuuuauuuaacagcucacccauaaaaggcccuuuucagggccacc

SEQ ID NO: 100509 - RNA, 64 nt, Homo Sapiens
gagcuugaguggcucugccccacccugaaucaugcacccauaaaugcaguuauggguggaugug

SEQ ID NO: 100510 - RNA, 64 nt, Homo Sapiens
aaagcugauuugaaguguuaaacccuaaaucugucacccauaaucacugcuaucgcuauuuaag

SEQ ID NO: 100511 - RNA, 64 nt, Homo Sapiens
cauggugagcuccugcucuccuuuuugauauagucacccauaagaggugagccuuauugcagau

SEQ ID NO: 100512 - RNA, 64 nt, Homo Sapiens
augcacacaauuagauuucuuccauaaaagagaccacccauaucuuaauuucugccauuucaug

SEQ ID NO: 100513 - RNA, 64 nt, Homo Sapiens
aaaccucuucuguaaugccaaccugucacccugccacccauaaaagccugggugacagagcaag

SEQ ID NO: 100514 - RNA, 64 nt, Homo Sapiens
uccuuauugauauuauugguaugagaagagauaucacccauauuuaauccauugaugcucuuuc

SEQ ID NO: 100515 - RNA, 59 nt, Homo Sapiens
cucuggaagaaaacuccuaaagagaugcccacccauaaucagaagcaaaauucacagaa

SEQ ID NO: 100516 - RNA, 64 nt, Homo Sapiens
guuagggaucaagggcaacauaguacuucuccuucacccauaguaauccuccuggggcagaaac

SEQ ID NO: 100517 - RNA, 64 nt, Homo Sapiens
agaaggucaggagguuuugaguaccuauccuugccacccauacaggaaauccaaaguuuggugu

SEQ ID NO: 100518 - RNA, 64 nt, Homo Sapiens
aaaucaagccugaggcuggugaacaguagcuacacacccauauuguguguucugugaaugcuag

SEQ ID NO: 100519 - RNA, 64 nt, Homo Sapiens
aauugagaauugggagugggcuuagaugauaccgcacccauagguauucaagaaugcuuauucu

SEQ ID NO: 100520 - RNA, 64 nt, Homo Sapiens
ucccuccuuuaccauaguacuuguugguggcucccacccauauagggagggggaugggggacuu

SEQ ID NO: 100521 - RNA, 64 nt, Homo Sapiens
uauugaaaugcaaacuuaaauauuuuuaagaaaacacccauauaucaaauauuucaaccuuuca

SEQ ID NO: 100522 - RNA, 64 nt, Homo Sapiens
aaaaaauuguuuucaccugauugguaaauacaaucacccauaugucuguagacauuugcucaug

SEQ ID NO: 100523 - RNA, 64 nt, Homo Sapiens
gaacucuaacugucccaggaaucuugugaauuuucacccauaauggucuuucacuugucauucu

SEQ ID NO: 100524 - RNA, 64 nt, Homo Sapiens
uguuuaaaauaaaagguguccuugaauuacugaccacccauagaugucuacuguuaccagguuu

SEQ ID NO: 100525 - RNA, 64 nt, Homo Sapiens
ccccaucuauggacaggcugggcagucucauuugcacccauagcguguggcuggucccuaccug

SEQ ID NO: 100526 - RNA, 64 nt, Homo Sapiens
ccccucgcacucugguggcagucuguuuugccuucacccauaagagcuuucuccugucgguuug

SEQ ID NO: 100527 - RNA, 64 nt, Homo Sapiens
acaauuaauauuaggcuggauuuuauuuuuucagcacccauaccauuaguaaaauuaugucuca

SEQ ID NO: 100528 - RNA, 64 nt, Homo Sapiens
gcccaucuguguuuaguacacaugcaugcauacacacccauacaaacaucugugugagggcagu

SEQ ID NO: 100529 - RNA, 64 nt, Homo Sapiens
uggauugaugaucacugaggaucuguaugugaggcacccauaacaguaguuuugccugugaguc

SEQ ID NO: 100530 - RNA, 64 nt, Homo Sapiens
cauccauguucacuguaacagcacacuaccuucccacccauacagaauauucuguggugccagu

SEQ ID NO: 100531 - RNA, 64 nt, Homo Sapiens
gccuuagagaugaggcucagacaaacgaccuuagcacccauagccuaugccaugagcacuggcu

SEQ ID NO: 100532 - RNA, 64 nt, Homo Sapiens
uaaacaaauggaaaaagaagaugucccuaaccuacacccauagauuaccaagguuucaguguac

SEQ ID NO: 100533 - RNA, 64 nt, Homo Sapiens
agguuucauuuugcuguuuucaggaauguaagaacacccauauuggcuacuggaaauucuagaa

SEQ ID NO: 100534 - RNA, 64 nt, Homo Sapiens
uaggccaaccaagcacuucauguguccagccugccacccauacgacccagaaagacgauucagc

SEQ ID NO: 100535 - RNA, 64 nt, Homo Sapiens
uccagcuacucgggaagcuggcugugguguugcucacccauaguaaaacuuaaaaaauuagcug

SEQ ID NO: 100536 - RNA, 64 nt, Homo Sapiens
ccuccacagaucucucuuccuuuccaggcuucuccacccauauuuuccuggaucucugucuuua

SEQ ID NO: 100537 - RNA, 64 nt, Homo Sapiens
uaguucuuaaaccaggugaauuucagagccuucccacccauagggcuucauuuguauauaacac

SEQ ID NO: 100538 - RNA, 64 nt, Homo Sapiens
cuccgaccagaacccuucuuccuguggcacuccccacccauagaccuucagaucaucucccaca

SEQ ID NO: 100539 - RNA, 64 nt, Homo Sapiens
uuaauaguuacaguugggcaugauuuguaccauccacccauacccacacagucacagucacaca

SEQ ID NO: 100540 - RNA, 64 nt, Homo Sapiens
agugcagugacucacccccugcccccgcaccaaccacccauauucaggagaagaggacagacac

SEQ ID NO: 100541 - RNA, 64 nt, Homo Sapiens
cuuggcuuuucacaaaggcugaugucuuaacugucacccauauggucccugggccaccgggcag

SEQ ID NO: 100542 - RNA, 64 nt, Homo Sapiens
uucacaaguagauguaauuuacuaaagaaugauacacccauaugcuauauacagcuuaacucac

SEQ ID NO: 100543 - RNA, 64 nt, Homo Sapiens
uugguaccaguuucuccucaaccccccgacuccccacccauauucuuugcgcuugccuucucac

SEQ ID NO: 100544 - RNA, 64 nt, Homo Sapiens
cauuucuuacaaaauaaguuguggccccucuugucacccauacccucugcugcagggguggaag

SEQ ID NO: 100545 - RNA, 64 nt, Homo Sapiens
ucauguuucugguuuggugaguccuuugugccaccacccauaaugcuuugcauugcugcauccu

SEQ ID NO: 100546 - RNA, 64 nt, Homo Sapiens
ugaaagcugggaaguuaugaaugaagauaacauucacccauaaccaagagaacucagguagcug

SEQ ID NO: 100547 - RNA, 64 nt, Homo Sapiens
auucauauuaacauauucauucucucuucuccaucacccauacccacacauacaucuaguaugu

SEQ ID NO: 100548 - RNA, 64 nt, Homo Sapiens
uaaagcucucagcucaugcaccccaucuccucuucacccauauuaugccuucuuucucuugucc

SEQ ID NO: 100549 - RNA, 64 nt, Homo Sapiens
aaggggccucaggagcaggaaagaaguccgcuggcacccauagggugggaaaggccacccuaga

SEQ ID NO: 100550 - RNA, 64 nt, Homo Sapiens
ccacuauacaaaugcaaaugauguaaaccaugcucacccauauccugauuucgaucucuuccug

SEQ ID NO: 100551 - RNA, 64 nt, Homo Sapiens
agcuagaaucacuugacuuuccccuccccaaacccacccauaccauccaauggauugugcaaau

SEQ ID NO: 100552 - RNA, 64 nt, Homo Sapiens
aucugggauuuuguucauauguaaucaccguaaacacccauauguguacauggcuuagauaaau

SEQ ID NO: 100553 - RNA, 64 nt, Homo Sapiens
ugguucccagcaccugccugagaccugccccaggcacccauaaccuggaauucccuguuuccuu

SEQ ID NO: 100554 - RNA, 64 nt, Homo Sapiens
ccacccuggugagaaggccauacuguuuucagagcacccauauccacccccuuuuuaaagcacu

SEQ ID NO: 100555 - RNA, 64 nt, Homo Sapiens
gggagagaccucaugcagaucucucuuccacucacacccauagcccccagguaaaaaagucucc

SEQ ID NO: 100556 - RNA, 64 nt, Homo Sapiens
ucaagguaacaagaguauguggcaaaacauauaccacccauagugcuucacaaaaugcacuucu

SEQ ID NO: 100557 - RNA, 64 nt, Homo Sapiens
cugcggccagagugaggcuccugcuguacagugccacccauacugugaugucgaugcccaugug

SEQ ID NO: 100558 - RNA, 64 nt, Homo Sapiens
gggaacacauuugacuuuuuaaucaugguggcaucacccauaaaugauuaugcuugugugaggc

SEQ ID NO: 100559 - RNA, 64 nt, Homo Sapiens
agguaaaauuacccuugaaaaaaaucccuuggaccacccauaaaugacagugacuuuuucaaua

SEQ ID NO: 100560 - RNA, 64 nt, Homo Sapiens
accuuugccuugucgcccaggaaguggggcucggcacccauaacuaacaccucccacccuugga

SEQ ID NO: 100561 - RNA, 64 nt, Homo Sapiens
aacaugcauaugaaaaacaucacuuacguucucccacccauagacauaaaaaagggugaccugu

SEQ ID NO: 100562 - RNA, 64 nt, Homo Sapiens
gcuggcucacauccagucacggcggugccauccccacccauagguucaacucucucggcgguag

SEQ ID NO: 100563 - RNA, 64 nt, Homo Sapiens
gacuuggaaucaaucuugccuuguucuuguuauccacccauaugcucucugagcagagaccccu

SEQ ID NO: 100564 - RNA, 64 nt, Homo Sapiens
cacugaagaaacuacuuuucaggcacuguagggucacccauaugccuccagcucaguugacgcu

SEQ ID NO: 100565 - RNA, 64 nt, Homo Sapiens
ggcuguaucuccgcgauuacugguacuggugcuccacccauaggggcccuguucucucuggggu

SEQ ID NO: 100566 - RNA, 64 nt, Homo Sapiens
cuaagccaaggccaguguguucagaggugacugccacccauacuaggacaaacacagcucagau

SEQ ID NO: 100567 - RNA, 64 nt, Homo Sapiens
auggaggagaaaaagaaaaggaagaaaaaaaugucacccauagucucaccagagacuaucauua

SEQ ID NO: 100568 - RNA, 64 nt, Homo Sapiens
cauuuggcucaggguuaccgaguccuagcccuuucacccauacaagaaaggagagcuuagcagg

SEQ ID NO: 100569 - RNA, 64 nt, Homo Sapiens
uucuccccacagccucugcugaccuucucaccuccacccauacccuuccaccggagagacuacu

SEQ ID NO: 100570 - RNA, 64 nt, Homo Sapiens
cuggcugaggcggaagccuugguguccuccugaccacccauaacucguuaaaaacacagagaga

SEQ ID NO: 100571 - RNA, 64 nt, Homo Sapiens
ccgaccuuucuugccucgguucucauuacacuuucacccauagcagaaaacacuuugugcggcu

SEQ ID NO: 100572 - RNA, 64 nt, Homo Sapiens
caguaaugacucucugacccgguuuuauuacucucacccauaaaaacuuguacuuguuucaucu

SEQ ID NO: 100573 - RNA, 64 nt, Homo Sapiens
ccaaaagcaaguagccaaagccguugccaaaccccacccauaaaucaaugggcccuuuauuuau

SEQ ID NO: 100574 - RNA, 64 nt, Homo Sapiens
uagaacccugggguguggcuaacggccccuccagcacccauagccaggucuuccuggcccuuga

SEQ ID NO: 100575 - RNA, 64 nt, Homo Sapiens
cacuugacucaugcugcuaagaugcacaaccgcacacccauacacaacuacaagggccacaaag

SEQ ID NO: 100576 - RNA, 60 nt, Homo Sapiens
gaggaguugaaagaacaaggucugggggaccacccauacucagaauccagaaagguuuga

SEQ ID NO: 100577 - RNA, 64 nt, Homo Sapiens
acaguaagcaggucauuguauagguaaaugccugcacccauaauuuucuaguaauagccacgac

SEQ ID NO: 100578 - RNA, 64 nt, Homo Sapiens
cagagaugcucaugcaccugugcacacucacauccacccauacacacacacacacacacacaca

SEQ ID NO: 100579 - RNA, 64 nt, Homo Sapiens
cccuguccauacccauguaauugcugccuugccccacccauaggugacuucacugaggcuguca

SEQ ID NO: 100580 - RNA, 64 nt, Homo Sapiens
acacaguagcuucuucuuacaucauaaucauuuucacccauaaugauagaaugucuuuaauggu

SEQ ID NO: 100581 - RNA, 64 nt, Homo Sapiens
gcuagggaccuggggggaggagacccauggacuucacccauacucagugagggggcuccugccg

SEQ ID NO: 100582 - RNA, 64 nt, Homo Sapiens
cggugcggggggccuggcuguccuguggcccggacacccauagacgacacagcagggaagcucc

SEQ ID NO: 100583 - RNA, 64 nt, Homo Sapiens
ucuccccacagcugauacggaagaauggaacccacacccauagcggggggugaaguggcccccg

SEQ ID NO: 100584 - RNA, 64 nt, Homo Sapiens
gauggccacugguauagucaucaccccuugugcucacccauaguaggaggccaaagggcugcag

SEQ ID NO: 100585 - RNA, 64 nt, Homo Sapiens
ccugacucuauggguuacugucccaauugcgaaacacccauacuccucuucacccuguagcagg

SEQ ID NO: 100586 - RNA, 64 nt, Homo Sapiens
gcaggaugcaugucugucuguucuaucuagagaucacccauauaccuauauauguuuguaucua

SEQ ID NO: 100587 - RNA, 64 nt, Homo Sapiens
cuuucaaaucuaguauaucuauuugcauuuaauucacccauaugauugauagagaaggacaguu

SEQ ID NO: 100588 - RNA, 64 nt, Homo Sapiens
gcaugcccccccgccauuccgcacugcccucccucacccauauuucaggucugggaugagaagg

SEQ ID NO: 100589 - RNA, 64 nt, Homo Sapiens
cgugggccccuugggccucuuuccucccccucaucacccauaauuguucaucacacacaccccc

SEQ ID NO: 100590 - RNA, 64 nt, Homo Sapiens
cucacuuuaggucucauuuaacccccaaugacuccacccauaguauuuuaaacuucaggccaga

SEQ ID NO: 100591 - RNA, 64 nt, Homo Sapiens
ccugcugcugccaccugccccaaacugcgcagaccacccauagcuauuggccaggccccuguua

SEQ ID NO: 100592 - RNA, 64 nt, Homo Sapiens
acccagcugagucuggguguucccauuggguugggccaggcaaggccucuggugcccgcugccg

SEQ ID NO: 100593 - RNA, 64 nt, Homo Sapiens
uuauugucaugguuuauaaacaauaaacugugaugccaggcacaucucugccuucccugagcgc

SEQ ID NO: 100594 - RNA, 64 nt, Homo Sapiens
ccgcugcccccuggcgacagggcagaccaaugaugccaggcagcugucacacgcuaguauuggc

SEQ ID NO: 100595 - RNA, 64 nt, Homo Sapiens
caguccugcacaccugcuggccuggggagcuccagccaggcagcgaguccugccccgcccgcag

SEQ ID NO: 100596 - RNA, 64 nt, Homo Sapiens
guggugggugccuguaauccaaauacaaaaauuagccaggcauccaaaaccucgucucuacuaa

SEQ ID NO: 100597 - RNA, 64 nt, Homo Sapiens
guggcucaugccuguaauccaagauaaagucuaggccaggcauggaaccuaaaacugccauaua

SEQ ID NO: 100598 - RNA, 64 nt, Homo Sapiens
guggcucacaccuauaacccuaacauggaaccuggccaggcaugcacgaagcagaguuggcaca

SEQ ID NO: 100599 - RNA, 64 nt, Homo Sapiens
ugugugacuguccuguuuccgcuccccuugcccugccaggcauuccuucaugccaggcuccuau

SEQ ID NO: 100600 - RNA, 64 nt, Homo Sapiens
cccagaagacucuggagugaaucucuggaauuuggccaggcagucagucacucgccccuuccuc

SEQ ID NO: 100601 - RNA, 64 nt, Homo Sapiens
gauaagccagugguaagggaguguuagguacugugccaggcacuauuuauugagugccuacuau

SEQ ID NO: 100602 - RNA, 64 nt, Homo Sapiens
aaccccaucucuacaaaaaauuuuuaaaaaguuggccaggcaugguaaugcgcgccuguggucc

SEQ ID NO: 100603 - RNA, 64 nt, Homo Sapiens
ugaaacccugucuuuacuaaaaauacaaaaauuagccaggcaugguggcgugugccaguaaucc

SEQ ID NO: 100604 - RNA, 64 nt, Homo Sapiens
aagaugugaccccauaaaaauuuuuccugaguuggccaggcaugguggcucacgccuguaaucc

SEQ ID NO: 100605 - RNA, 64 nt, Homo Sapiens
ccacauaccuggcccaaccagacuucucccgugagccaggcaaaggaaauugucaucugccaac

SEQ ID NO: 100606 - RNA, 64 nt, Homo Sapiens
ugauaagagauguugacucuaaaguugauuuaaggccaggcauggugguuuacgccuauaaucc

SEQ ID NO: 100607 - RNA, 64 nt, Homo Sapiens
auaaaaacaaaguugauuaagaaaggaaguauaggccaggcacaguggcucacaccuguaaucc

SEQ ID NO: 100608 - RNA, 64 nt, Homo Sapiens
uggucccuaugggcuuccgcacaugccgcgggcggccaggcaacgugcgugucucugccaugug

SEQ ID NO: 100609 - RNA, 64 nt, Homo Sapiens
cugccauguggcagaagugcucuuuguggcaguggccaggcagggagugucugcaguccuggug

SEQ ID NO: 100610 - RNA, 64 nt, Homo Sapiens
ggcaggggcucugcuuccucagcccuagaggcgagccaggcaagguuggcgacugucauguggc

SEQ ID NO: 100611 - RNA, 64 nt, Homo Sapiens
cccucuggaagggaaggggccccugcugcuggcugccaggcagggaacaggugcuccccaaaca

SEQ ID NO: 100612 - RNA, 64 nt, Homo Sapiens
agcccuccccaagccuucagugccaggcccacuugccaggcagggggccucugcccucuacucg

SEQ ID NO: 100613 - RNA, 64 nt, Homo Sapiens
ggcaaaaccaucucuacuaaaaauagaaaaauuagccaggcacguuccaggcaccugugauccc

SEQ ID NO: 100614 - RNA, 64 nt, Homo Sapiens
agcgagacuucaucucagaaaauaaaaaauaggggccaggcacaguggcucauaccuguaaugc

SEQ ID NO: 100615 - RNA, 64 nt, Homo Sapiens
ccuagaggugcguauacacacccaaguacacgcagccaggcauucagggguguguuugccacau

SEQ ID NO: 100616 - RNA, 64 nt, Homo Sapiens
guguuugccacauggagcaucccuuccuggucuugccaggcaccugcacagagcgucuccagcc

SEQ ID NO: 100617 - RNA, 64 nt, Homo Sapiens
aauuaaguaugucaacaguaaaaaauaaccaguggccaggcaugguggcucaugccuguaaucc

SEQ ID NO: 100618 - RNA, 64 nt, Homo Sapiens
gaaaccccgucucuacuaaaaauauaaaaaauuagccaggcauaguggcgcaugccuguuguag

SEQ ID NO: 100619 - RNA, 64 nt, Homo Sapiens
aacagcuggagggaagaugcaggggugggaagcggccaggcagaaagagcuccaggcucuugug

SEQ ID NO: 100620 - RNA, 64 nt, Homo Sapiens
ccuccaggccacgaaaugggaauuccagcacuaagccaggcaccgggcagaagcugggccuucc

SEQ ID NO: 100621 - RNA, 64 nt, Homo Sapiens
aaucugucuugaccugcaggaauacacgggcggcgccaggcauuaccucacagcgggacuacac

SEQ ID NO: 100622 - RNA, 64 nt, Homo Sapiens
uugcuuccuuuucuugcccaugccgcuucuagaagccaggcacagguugccaagaggugacacg

SEQ ID NO: 100623 - RNA, 64 nt, Homo Sapiens
ugacccugaaagagagaugaaauucaagcugugagccaggcaggagcucaguauggcaaagguu

SEQ ID NO: 100624 - RNA, 64 nt, Homo Sapiens
ugucacucuccaauaaagguucuggcacuucaaugccaggcaggucuccuaaaugaacagaaug

SEQ ID NO: 100625 - RNA, 64 nt, Homo Sapiens
uugguuugaacccugugagccugagacagagagggccaggcaccaaccacaaggcgggaaaguc

SEQ ID NO: 100626 - RNA, 64 nt, Homo Sapiens
agucacuauccuagaggcugcuuggcccagaagagccaggcacagagcugcaguugggcacgcc

SEQ ID NO: 100627 - RNA, 64 nt, Homo Sapiens
guccagaaaccaccucggggugacugagcggaaggccaggcagggccuuccuccucuuccuccu

SEQ ID NO: 100628 - RNA, 64 nt, Homo Sapiens
agcucccugcuggagccugggacccauggcacaggccaggcagcccggaggcuggguggggccu

SEQ ID NO: 100629 - RNA, 64 nt, Homo Sapiens
guggcucaugccuguaauccuaaaaaagaaaaaggccaggcacgugacagagcaagacccuguu

SEQ ID NO: 100630 - RNA, 64 nt, Homo Sapiens
guggugggcuacucuggaggaaaaaaaaaaaaaagccaggcauggucucuacuuacaaaaaaaa

SEQ ID NO: 100631 - RNA, 64 nt, Homo Sapiens
gguggggaggagaagguuguaggcauggaagagagccaggcagccccgaaagaagagccugggc

SEQ ID NO: 100632 - RNA, 64 nt, Homo Sapiens
uguccucucccaguucauuccuggaaccagccaggccaggcaaccaguggcccccaaaggcagg

SEQ ID NO: 100633 - RNA, 64 nt, Homo Sapiens
ggagagccaggagcauuuaaaaaucagcaucugggccaggcaagauggcucacgccugugaucc

SEQ ID NO: 100634 - RNA, 64 nt, Homo Sapiens
gaaaccccgucucuacugaaaauacaaaaaauuagccaggcaugguggcaggugccuguagucc

SEQ ID NO: 100635 - RNA, 64 nt, Homo Sapiens
uguacguugccucauuucaugggucagcugugcugccaggcacaacugaggauugagcugugug

SEQ ID NO: 100636 - RNA, 64 nt, Homo Sapiens
ccagugggccuaagccagaacccagggagcucacgccaggcaggaagguuugcaagcucccugc

SEQ ID NO: 100637 - RNA, 64 nt, Homo Sapiens
gugggugcagagugggggauucaagggugcagaggccaggcagaagaggggcaauacaacaggg

SEQ ID NO: 100638 - RNA, 64 nt, Homo Sapiens
gugccgggcacuggggauauagcaucuauuaugugccaggcacuaauucagcaaccauuuauug

SEQ ID NO: 100639 - RNA, 64 nt, Homo Sapiens
guggcucacgccuguaauccagugacaauuguaggccaggcacaacucccuucguggggacaaa

SEQ ID NO: 100640 - RNA, 64 nt, Homo Sapiens
gccaaaccacagugggagcuggggcagggggagagccaggcaaucgggggccaaagaugggggu

SEQ ID NO: 100641 - RNA, 64 nt, Homo Sapiens
ccccucccaggggccuguaacuaagucggguccugccaggcagggggccuguguucugugcccc

SEQ ID NO: 100642 - RNA, 64 nt, Homo Sapiens
guggcucaugccuguaauucaaaucaagcucuuggccaggcauguaaccuugagcuaauguuaa

SEQ ID NO: 100643 - RNA, 64 nt, Homo Sapiens
ccgggcgucagagcucaagccacguggucucugcgccaggcagcacacagccuuccuccccaag

SEQ ID NO: 100644 - RNA, 64 nt, Homo Sapiens
auugcaggugcccccuccaggccugacuggcuccgccaggcacuaaccugccauaacccuuugu

SEQ ID NO: 100645 - RNA, 64 nt, Homo Sapiens
acuaaccugccauaacccuuugugcuggccugcggccaggcagaggaagagaggucgacugugg

SEQ ID NO: 100646 - RNA, 64 nt, Homo Sapiens
gcacaccacugccaggggucagccucgcacccaggccaggcagaagcugugcucugaagcuagg

SEQ ID NO: 100647 - RNA, 64 nt, Homo Sapiens
cuaaugaugguggcccagcugugcccagaggacagccaggcaggcccugggagggaguuuagaa

SEQ ID NO: 100648 - RNA, 64 nt, Homo Sapiens
auccagccaaggccucucccgcaugcugagcugugccaggcaggcacccugcugccacagcuuu

SEQ ID NO: 100649 - RNA, 64 nt, Homo Sapiens
uacagcucucugauccucaggccaggaagaguuugccaggcagcaggccggagucgaaugauca

SEQ ID NO: 100650 - RNA, 64 nt, Homo Sapiens
uuuuucuuaaacuacugagacuuguauaguaucugccaggcaguuuuguccuuaacauuuaccu

SEQ ID NO: 100651 - RNA, 64 nt, Homo Sapiens
accacaccuggcuuuagaguggugccugccuaaagccaggcaccucaugcugucuuuagaguua

SEQ ID NO: 100652 - RNA, 64 nt, Homo Sapiens
caucucccccaacacaugugcccccaaaaagugagccaggcaccucuguuuccugcuguuuauu

SEQ ID NO: 100653 - RNA, 64 nt, Homo Sapiens
uggaugggcugccugcacagccccuggagagggggccaggcacacccucagaggagcugcaagc

SEQ ID NO: 100654 - RNA, 64 nt, Homo Sapiens
cgugaucacaggugacgaccggccggcagggggcgccaggcagcgcgaggaagggcugaggugg

SEQ ID NO: 100655 - RNA, 64 nt, Homo Sapiens
aucaggcccacuggguugccuggggccucgaggugccaggcagcgagcgucugcucacuggcuc

SEQ ID NO: 100656 - RNA, 64 nt, Homo Sapiens
cucaucaccccagaggccuugggcacagcugucugccaggcacuuggccuugggccggugcugg

SEQ ID NO: 100657 - RNA, 64 nt, Homo Sapiens
auggcugcacguagguucccugucaaggccgagggccaggcagaucaguauuacuuucugccgc

SEQ ID NO: 100658 - RNA, 64 nt, Homo Sapiens
guggcaaacgccuguaauccaaauacaaaaauuagccaggcaugugaaacccugucucugcuaa

SEQ ID NO: 100659 - RNA, 63 nt, Homo Sapiens
gugcuggacaucagaaaugcucacucacugugugccaggcaccauucaacaaauguuuauuaa

SEQ ID NO: 100660 - RNA, 64 nt, Homo Sapiens
uuggacaugggggauacacugaugccagcucugugccaggcacaucagcugauaaauauugacu

SEQ ID NO: 100661 - RNA, 64 nt, Homo Sapiens
ggaacagguccucccaagggggucugcuccgccugccaggcaaguuaacucugccuguccccag

SEQ ID NO: 100662 - RNA, 64 nt, Homo Sapiens
agccucuccuucucagugcagggacgucaccccugccaggcaagcccagggcacagaugccagg

SEQ ID NO: 100663 - RNA, 64 nt, Homo Sapiens
uggcuucucccucucagugcgaggcuucaccccugccaggcaagcccagggcauagaugcugag

SEQ ID NO: 100664 - RNA, 64 nt, Homo Sapiens
agccucucccucucagugcagggacgucaccccugccaggcaagcccagggcacagaggccggg

SEQ ID NO: 100665 - RNA, 64 nt, Homo Sapiens
ggccccucccucucagugcgggaacgucaccccugccaggcaagcccagggcacagaugcugcg

SEQ ID NO: 100666 - RNA, 64 nt, Homo Sapiens
gucucccccaccagaaugggagccaggagucccagccaggcacaggaccgagccuggcucucgg

SEQ ID NO: 100667 - RNA, 64 nt, Homo Sapiens
agcuccuuggccagaggcuuacaggcaacaagcggccaggcagggucuggccccgggcugcugg

SEQ ID NO: 100668 - RNA, 64 nt, Homo Sapiens
uuauaaaauuauuauuaggaauuauuuaaguggggccaggcaucuugcaacauuuucugauuuu

SEQ ID NO: 100669 - RNA, 64 nt, Homo Sapiens
gggagacccugucucuacaagaaauuaaaaauuagccaggcauaguuggcacgugccuguagca

SEQ ID NO: 100670 - RNA, 54 nt, Homo Sapiens
acgagggcgccgacuccuaaccccgccaggcagccucguucugcacaggcacuu

SEQ ID NO: 100671 - RNA, 64 nt, Homo Sapiens
ggcagccucguucugcacaggcacuuuagcccgagccaggcacaccugcgagggggcaggugug

SEQ ID NO: 100672 - RNA, 64 nt, Homo Sapiens
guggcaccugccuguaauccuaaaacaaaaauuagccaggcauguggugaaaccccaucucuac

SEQ ID NO: 100673 - RNA, 64 nt, Homo Sapiens
guggcucacaccuguaauccaacaaaguuccccggccaggcacauuuguuuguaaacguuuaaa

SEQ ID NO: 100674 - RNA, 64 nt, Homo Sapiens
guggugcaugccuguaauccaagauacaaaauuagccaggcauggagaaaccccaucucuauua

SEQ ID NO: 100675 - RNA, 64 nt, Homo Sapiens
guggcacacaccuguaguccaaauacaaaauuuagccaggcaugugaaacccugucuguacuaa

SEQ ID NO: 100676 - RNA, 64 nt, Homo Sapiens
agauucuagaaaaacuggcugcuaacuggccugagccaggcaacacugauuccaaucccuccuc

SEQ ID NO: 100677 - RNA, 64 nt, Homo Sapiens
ggccccaguuaaacaaacuacccauccaugagcugccaggcagucaaaaacagaagcuuccccg

SEQ ID NO: 100678 - RNA, 64 nt, Homo Sapiens
caggaccuugaggaaucagagcaucuacaguacagccaggcagggguggugguggugaguguca

SEQ ID NO: 100679 - RNA, 57 nt, Homo Sapiens
uauuuuggcagguggugaguuauauaugccaggcaccugaaugucuugagaaccuga

SEQ ID NO: 100680 - RNA, 64 nt, Homo Sapiens
cccagagcucgugacgagcaagugcuggguccccgccaggcaccccgaggcggcgcucuggcug

SEQ ID NO: 100681 - RNA, 64 nt, Homo Sapiens
cgcucaccuaggcugucacaggacccaccuccaugccaggcaacagagggccacagaaccaccc

SEQ ID NO: 100682 - RNA, 64 nt, Homo Sapiens
gugggagcaggggcuggcguagaggcacgaggcagccaggcaggccuaccuacccagcugggcc

SEQ ID NO: 100683 - RNA, 64 nt, Homo Sapiens
cccuuccucccuuggcccaaaggcuguuccuucugccaggcaggccaucuuggggccuuugccc

SEQ ID NO: 100684 - RNA, 64 nt, Homo Sapiens
uagaagccaugggaccuccucccucauucaucuugcaagcaaaucccauuucuugaaaagccuu

SEQ ID NO: 100685 - RNA, 64 nt, Homo Sapiens
guccccaccccagugcacucuucuggcccaggcagcaagcaagcugugaacagcuggccugagc

SEQ ID NO: 100686 - RNA, 64 nt, Homo Sapiens
aguccuuuagcucaauugauagggucagcgucucgcaagcaaaaaaucucaugaccucauauuu

SEQ ID NO: 100687 - RNA, 64 nt, Homo Sapiens
cuaaagcauuccucagaacugucccauuugaagggcaagcaaaccugggguauuuauccacuga

SEQ ID NO: 100688 - RNA, 64 nt, Homo Sapiens
uuaaaauuuuaaucaauaaaguaugucuguugaagcaagcaagcaaacaaauccauaacaacca

SEQ ID NO: 100689 - RNA, 64 nt, Homo Sapiens
aauuuuaaucaauaaaguaugucuguugaagcaagcaagcaaacaaauccauaacaaccacaac

SEQ ID NO: 100690 - RNA, 64 nt, Homo Sapiens
uuuugaauauuuuagcuauauuuaguggcuuucugcaagcaacuagaacagagaaguaaugggu

SEQ ID NO: 100691 - RNA, 64 nt, Homo Sapiens
uuugaaugucauaguacauugugugcuaaccauggcaagcaaacauuuacauuuguuuuuuaca

SEQ ID NO: 100692 - RNA, 64 nt, Homo Sapiens
ugugaucacggauguuggcucccccucgcccuaugcaagcaaacacacucucaccuccucuccc

SEQ ID NO: 100693 - RNA, 64 nt, Homo Sapiens
gcaucccaagguucaauaaggccuuauuuaacaagcaagcaaaaugcaaaccaaaccauuauuc

SEQ ID NO: 100694 - RNA, 64 nt, Homo Sapiens
ggcuuaaaauucccuuucuuaauucaacaggccagcaagcaaucugagagguagaaguacuuca

SEQ ID NO: 100695 - RNA, 64 nt, Homo Sapiens
gaccuuaaacauacaggaaaccaggccuugguuugcaagcaacaccaguacauuuuauaaccau

SEQ ID NO: 100696 - RNA, 64 nt, Homo Sapiens
gauuguccccuucugcauauguaaaaugucucaggcaagcaaaagggccuuguaaaaggccagg

SEQ ID NO: 100697 - RNA, 64 nt, Homo Sapiens
gugaccuccaguggcccacuuaauccaauaugcagcaagcaaggaaucaaauaauucuuuucug

SEQ ID NO: 100698 - RNA, 64 nt, Homo Sapiens
guuuucguaaucuucaucaagaaguuuuuaaaaggcaagcaaaaacagaagcaaaucauaucaa

SEQ ID NO: 100699 - RNA, 64 nt, Homo Sapiens
uaacaacugugggauggcgauggugggaugugucgcaagcaauucacuagacaaucuucacaug

SEQ ID NO: 100700 - RNA, 64 nt, Homo Sapiens
caggcuccaucccuggcuuccccagccugcggccgcaagcaaaaccaagcgcgagaugcagcua

SEQ ID NO: 100701 - RNA, 64 nt, Homo Sapiens
acucagauaacaaacuucucuucuaaacugguucugcuucuaagacaagcaucuccugcccucu

SEQ ID NO: 100702 - RNA, 64 nt, Homo Sapiens
uagagaugcagccaaaauuuuaggccuuuuauccugcuucuagcagaaaaaugcagggagaguc

SEQ ID NO: 100703 - RNA, 64 nt, Homo Sapiens
auguaaaauguaugacuuggaguacugcugcuacugcuucuacacauauuuaaauacugaguau

SEQ ID NO: 100704 - RNA, 64 nt, Homo Sapiens
cugggacauauuuaaauacuauuaauugaaguuaugcuucuauauaagaaguuagugucagcaa

SEQ ID NO: 100705 - RNA, 64 nt, Homo Sapiens
ccuuuuuuuuucuuuuucuaugagcacacucugcugcuucuaaacuuuacaugccugauggcac

SEQ ID NO: 100706 - RNA, 64 nt, Homo Sapiens
uucuuccuggggauuacacagcuaugaauguauuugcuucuaaaaccucccaaagugaaucuaa

SEQ ID NO: 100707 - RNA, 52 nt, Homo Sapiens
aagaagaugaugauaaauaaguugcuucuagugcaguuuuuuucuugucuau

SEQ ID NO: 100708 - RNA, 64 nt, Homo Sapiens
aaaacaguugcagcuguuuuguugacauucugaaugcuucuaaguaaauacaauuuuuaaaaaa

SEQ ID NO: 100709 - RNA, 64 nt, Homo Sapiens
uaaucagguuauguacaccaaccucugcaucaguugcuucuauagagcaucagcccucauguuu

SEQ ID NO: 100710 - RNA, 64 nt, Homo Sapiens
ugagagccauugggccaucaagccuuuauauaucugcuucuaaaauugccccaccugcucuaga

SEQ ID NO: 100711 - RNA, 64 nt, Homo Sapiens
cagaaucucccagaguguggccucugucuagacuugcuucuagaauaauuugcuucuagaccag

SEQ ID NO: 100712 - RNA, 64 nt, Homo Sapiens
ccagccucugucuagacuugacacauaaauaauuugcuucuagaauuuuacuuauacaguggaa

SEQ ID NO: 100713 - RNA, 64 nt, Homo Sapiens
agucaacuggcuggccaguccagagggaccaaauugcuucuagguaccccugcacaguuuagaa

SEQ ID NO: 100714 - RNA, 64 nt, Homo Sapiens
ugcccaguucacuucuuugcauuuguaagcaacuugcuucuaaaccccagcccacagagccuga

SEQ ID NO: 100715 - RNA, 64 nt, Homo Sapiens
uccauuguggaauacagaaaauuuucaugaguccugcuucuagcaugcaaaacauauaguuacu

SEQ ID NO: 100716 - RNA, 64 nt, Homo Sapiens
ugcucauucuaccagauacaguauacauguauuaugcuucuaaauagaaaauuaaacacaaagu

SEQ ID NO: 100717 - RNA, 64 nt, Homo Sapiens
cuguguccacaccacagaugaccacaucuaauccugcuucuacucucagcuuuaggacaaaagc

SEQ ID NO: 100718 - RNA, 64 nt, Homo Sapiens
uacuuagucucugugcuccaagaggucaaauuuuugcuucuagaauuuccuuggggucuuucag

SEQ ID NO: 100719 - RNA, 64 nt, Homo Sapiens
agucuuuacuggcuuucauagcuuuucuauuuuuugcuucuauuauuucucucucccuuauauu

SEQ ID NO: 100720 - RNA, 64 nt, Homo Sapiens
ggguccuaggcuggaauguuccuuucgaaagcaaugcuucuaucaaauacuaguauuaauuuau

SEQ ID NO: 100721 - RNA, 64 nt, Homo Sapiens
uugugggguuuuucuguauuagcuuaugaacuguugcuucuacuuagcccuuuuauagaaacuc

SEQ ID NO: 100722 - RNA, 64 nt, Homo Sapiens
auuucuugaugcuaguuuagcuauauuaggaaacugcuucuaccuagauugaaagaaauuugac

SEQ ID NO: 100723 - RNA, 64 nt, Homo Sapiens
ucagccacugugaaccauuauuguucauuuaggaugcuucuaauccccaccacuaccuccaugg

SEQ ID NO: 100724 - RNA, 64 nt, Homo Sapiens
agaugugguuuguugcuuuaaagauggaaagggcugcuucuaacgacugaaacaagcuugugcu

SEQ ID NO: 100725 - RNA, 64 nt, Homo Sapiens
acaauaaagauucuuuuauuuguuugcucaaaauugcuucuaaaucuuuagauauuugccuguc

SEQ ID NO: 100726 - RNA, 64 nt, Homo Sapiens
agaacuuuuuuggugugugucaaauauuucuugcugcuucuaggcagcuugguaguuaacacau

SEQ ID NO: 100727 - RNA, 64 nt, Homo Sapiens
ggcagauggccagaugcacuuuaaguaaaguccaaaguccaaggugcccuuguugaguuuucuc

SEQ ID NO: 100728 - RNA, 64 nt, Homo Sapiens
uccaaggggcagauggccaguuuucucuuaaguaaaguccaaagggcuuucugcccuuguugag

SEQ ID NO: 100729 - RNA, 64 nt, Homo Sapiens
ccucuaccgaagaccucaugccauaacaccaguaaaguccaaaaaaccauccuccaaaacgccu

SEQ ID NO: 100730 - RNA, 64 nt, Homo Sapiens
acagagaguccucacucuuaacucuugaaaucacaaguccaaccaccauguacaaaacacagcc

SEQ ID NO: 100731 - RNA, 64 nt, Homo Sapiens
aggaguugguuuguuuugccaugauugaaguuuuaaguccaaguugcugagaaugaaaaucuaa

SEQ ID NO: 100732 - RNA, 64 nt, Homo Sapiens
gcaaacauagugggggcugcagccaaucauuuuuaaguccaaugaaauggaggcuuuagagaaa

SEQ ID NO: 100733 - RNA, 64 nt, Homo Sapiens
guaaauaaugcaaaauaccugguaguaaaauaaaugcugaaaauuuuccuuuaaaauagaauca

SEQ ID NO: 100734 - RNA, 64 nt, Homo Sapiens
ugaggucaggaguucgaguccagccuggccaauaugcugaaacccugucucuacuaaaauuaca

SEQ ID NO: 100735 - RNA, 64 nt, Homo Sapiens
gcggggcgucaacggcacugcuucaggacgcgcuugcugaaacgacuccaacagcuaguucaca

SEQ ID NO: 100736 - RNA, 64 nt, Homo Sapiens
gaggaggguggggcagggaaagggcuggccccccugcugaaaucuugauucugcauuugaggaa

SEQ ID NO: 100737 - RNA, 64 nt, Homo Sapiens
ccaaaauacagaauggcuucugugauacuggccuugcugaaacgcaucucacugucauucuauu

SEQ ID NO: 100738 - RNA, 64 nt, Homo Sapiens
uaaggcaaaaaaccaaagcaaaacaaauacauggugcugaaauuaacuugaugccaagcccaag

SEQ ID NO: 100739 - RNA, 64 nt, Homo Sapiens
ugagcucagauccagcaccagaauccuucaccuuugcugaaaaggucucaaaugcgugaucaga

SEQ ID NO: 100740 - RNA, 64 nt, Homo Sapiens
aagagcacaauucccauugauuuccuucacuuauugcugaaaccuucaaaagggcaagaucuuu

SEQ ID NO: 100741 - RNA, 64 nt, Homo Sapiens
auacugaugcauugaccucacccucuccucauagugcugaaaagguagaccuugaauacaggag

SEQ ID NO: 100742 - RNA, 64 nt, Homo Sapiens
guaauuuucaugauauaauagaaaacugucaagcugcugaaacuagagcucccacaaugcugau

SEQ ID NO: 100743 - RNA, 64 nt, Homo Sapiens
guagagaguauagccaaaacucucuuuaaaaugcugcugaaauucauuguacauagacacauug

SEQ ID NO: 100744 - RNA, 64 nt, Homo Sapiens
aaaguaagaacugaaugacauuuggcaguuaaucugcugaaaccccuggauacauucuucagca

SEQ ID NO: 100745 - RNA, 64 nt, Homo Sapiens
caugaacauguacuguucucuucuugaacacucaugcugaaagcccaaguagggggucuaaaau

SEQ ID NO: 100746 - RNA, 64 nt, Homo Sapiens
uuuuuaaggacuuuccuuccuccaucuccaagaaugcugaaaccaagggggaugacaugugacu

SEQ ID NO: 100747 - RNA, 64 nt, Homo Sapiens
ugcagccagggguugaaaggcucuugaaguccauugcugaaaacaagaaaaaaaaaacgcccaa

SEQ ID NO: 100748 - RNA, 64 nt, Homo Sapiens
aaaaaaaaacgcccaacucuuaaauguagauaugugcugaaagaacuacugcuuuugugccccu

SEQ ID NO: 100749 - RNA, 64 nt, Homo Sapiens
uggaaaggaccaaauugcuuaauucagucucagcugcugaaauucacucccaucugauuuacuu

SEQ ID NO: 100750 - RNA, 64 nt, Homo Sapiens
augccuacagcugucuucacguucgaugccugcaugcugaaacauauagauuuagcuauuuauu

SEQ ID NO: 100751 - RNA, 64 nt, Homo Sapiens
agacauuuuaauaccaugccagagaagaguauucugcugaaaccaacagguuuuacuggucaaa

SEQ ID NO: 100752 - RNA, 64 nt, Homo Sapiens
gcugaaaccaacagguuuuacuggucaaaaugacugcugaaaauaauuuucaaguugaaagauc

SEQ ID NO: 100753 - RNA, 64 nt, Homo Sapiens
cgauuucguuuaaugacaaaauaaucucuuaauaugcugaaaucaagcacgugagaguuuuugu

SEQ ID NO: 100754 - RNA, 64 nt, Homo Sapiens
ugagcaguugaaauucaucacaugaaaaguaaucugcugaaagacuugguugcccacugccuaa

SEQ ID NO: 100755 - RNA, 64 nt, Homo Sapiens
auuauaugagugcuuagaauggggcuaagggaagugcugaaauagagcaaaggauggaagauaa

SEQ ID NO: 100756 - RNA, 64 nt, Homo Sapiens
gaaaaaaaugauuguuuuagauuauauaacccacugcugaaaaaauuuuuuaaauuuacagaau

SEQ ID NO: 100757 - RNA, 64 nt, Homo Sapiens
cacaacuuguguuuauggcacuagcuugaaaacuugcugaaaaauucuucaacagggaaaacag

SEQ ID NO: 100758 - RNA, 64 nt, Homo Sapiens
uuauuuagcuuaucauaaucuacuuuguaaaacaugcugaaaccucacuguggagaaccagaau

SEQ ID NO: 100759 - RNA, 64 nt, Homo Sapiens
ugguccgaauaucugggccugcccccccaaauuaugcugaaaccuaaucaccagugugauggua

SEQ ID NO: 100760 - RNA, 64 nt, Homo Sapiens
agguaguuacccugauuugacccugugugggaaaugcugaaagcaccaggaggaagccgguucc

SEQ ID NO: 100761 - RNA, 64 nt, Homo Sapiens
uauuguauguuuaacccccagugggauuucuggcugcugaaaccacuuugggccaggaagaaca

SEQ ID NO: 100762 - RNA, 64 nt, Homo Sapiens
gacauuaaggaaaguucugcgaagauacuaguuuugcugaaaauuagaugauggugaaauaaag

SEQ ID NO: 100763 - RNA, 64 nt, Homo Sapiens
ucucaaccagaagaaagggcgggacuauuuugcaugcugaaacuccucagucucccaaguagcu

SEQ ID NO: 100764 - RNA, 64 nt, Homo Sapiens
ccauugccauuugguacaaaaaguauuaaguuugugcugaaaaucuauugcuguaguguuagga

SEQ ID NO: 100765 - RNA, 64 nt, Homo Sapiens
agaugauuacuauugcuguaaaaggagucccucuugcugaaagugugagucuuuuuccuuguuu

SEQ ID NO: 100766 - RNA, 64 nt, Homo Sapiens
caccuggucugcauguaugcuuguucuuugaacaugcugaaaacuaaaaccucuaaccaucucu

SEQ ID NO: 100767 - RNA, 64 nt, Homo Sapiens
uccugcuguauccagaagccucuguaagccuaguugcugaaauuuuggucugagaauggaauuc

SEQ ID NO: 100768 - RNA, 64 nt, Homo Sapiens
uguucccugccacuaaguggcucagucacaccuuugcugaaacacaguagucuuaugaaaagca

SEQ ID NO: 100769 - RNA, 64 nt, Homo Sapiens
ggacacauacuuugaauaccuuucauauuuuaggugcugaaaauggugagggagugagugcucu

SEQ ID NO: 100770 - RNA, 64 nt, Homo Sapiens
auuaagaaaacaggcaggcucaccauaguaaaaaugcugaaagccaaagacaaaauugggagaa

SEQ ID NO: 100771 - RNA, 64 nt, Homo Sapiens
aaaccaggcccaggcaguggggacacauccagagugcugaaagaaccucccccaggucauccua

SEQ ID NO: 100772 - RNA, 64 nt, Homo Sapiens
guaguuucuugccagcaagggucauugcacuuucugcugaaaugccagucccugugcagacacu

SEQ ID NO: 100773 - RNA, 64 nt, Homo Sapiens
ucccgucucauuaaacacaguaugggaaaucguuugcugaaacaggccuuaugagugcagugaa

SEQ ID NO: 100774 - RNA, 64 nt, Homo Sapiens
gaaaacgauuucauuguucaacaucuuagauaaaugcugaaaaggcaacuacuuuguuauuucu

SEQ ID NO: 100775 - RNA, 64 nt, Homo Sapiens
agaaguuggcuacucucagagugcucuugccagcugcugaaaaugucaguagaacucauugagg

SEQ ID NO: 100776 - RNA, 64 nt, Homo Sapiens
auacagcugugaagacuugccauccagcuuuggcugcugaaaucauaguaauguuucaguccau

SEQ ID NO: 100777 - RNA, 64 nt, Homo Sapiens
auuacugguaaaauuucagguuuucaguuauaugugcugaaauaaguccuucugccauuuuuua

SEQ ID NO: 100778 - RNA, 64 nt, Homo Sapiens
acugccuacuuuaccuaguucaccuuaacauguaaauccacaggguagauuucuuucuagaugu

SEQ ID NO: 100779 - RNA, 64 nt, Homo Sapiens
cugcccacaguuuaaugguguggccuuuccacauaauccacauuaaguucuguguuccuguguu

SEQ ID NO: 100780 - RNA, 64 nt, Homo Sapiens
uuucaugcucauuuuuauuguuucaugcucuaauaauccacacaucuuucuaauaauccacaca

SEQ ID NO: 100781 - RNA, 64 nt, Homo Sapiens
uuucaugcucuaauaauccacaugucuuucuaauaauccacacaagauguucauuucacaagug

SEQ ID NO: 100782 - RNA, 64 nt, Homo Sapiens
acugugauaaauaauaaagaagaauuguacagauaauccacagaucaggcugacacagaccaua

SEQ ID NO: 100783 - RNA, 64 nt, Homo Sapiens
ccagaaaguugugcacggcuaagggugggcacauaauccacaagcuguucaaaaagcaaacauu

SEQ ID NO: 100784 - RNA, 64 nt, Homo Sapiens
ucuuacauauaagagggcucuacuaucuccuuggaauccacauuuggguuaacuccucagauuu

SEQ ID NO: 100785 - RNA, 64 nt, Homo Sapiens
uacauuaggaggcagugauauuguggaagauugaaauccacagauaauucaugacccucaucuu

SEQ ID NO: 100786 - RNA, 64 nt, Homo Sapiens
uugggucccugggaggccggcagccaggccacagaauccacacguggaccauugugggucccug

SEQ ID NO: 100787 - RNA, 64 nt, Homo Sapiens
gugggucccugggaggccggcagccaggccacggaauccacacguggaccauugugggucccuu

SEQ ID NO: 100788 - RNA, 64 nt, Homo Sapiens
ugggucccuugggaggccagcagccagacuacggaauccacauguggaccaugggaagucaguc

SEQ ID NO: 100789 - RNA, 64 nt, Homo Sapiens
gaguuggggcgacugugaaaagcugacggcaguaaauccacagugagggcgccuggguccuccc

SEQ ID NO: 100790 - RNA, 64 nt, Homo Sapiens
aguccacgccgggucgccuggcucucccaggugaaauccacaccaagcgacacaggcugccgcu

SEQ ID NO: 100791 - RNA, 62 nt, Homo Sapiens
aguagguucuguuacaguuuuucuuuugaucgugcacuuauagucuucauuuaauuccucau

SEQ ID NO: 100792 - RNA, 62 nt, Homo Sapiens
uauuuguggaaauugguauuaucucuguuuuaugcacuuacauuuaucccuuacauuuuguu

SEQ ID NO: 100793 - RNA, 62 nt, Homo Sapiens
gcaauuuucaaauguacucagcugucuagucaugcacuuaaaauaugcaaucacucguuuau

SEQ ID NO: 100794 - RNA, 62 nt, Homo Sapiens
uuucaguaguagucuugacuucuugauagaacugcacuuaaugcgugcaguucauuucuagu

SEQ ID NO: 100795 - RNA, 62 nt, Homo Sapiens
ccagcucugcccuuggggggcagaagagcuggugcacuuaauagaucuggggcugcagagaa

SEQ ID NO: 100796 - RNA, 62 nt, Homo Sapiens
cguacucaagggagcgcgccccuggugaauucugcacuuacagccguggggucucaggggug

SEQ ID NO: 100797 - RNA, 62 nt, Homo Sapiens
uuuuuuccuauuuuucuucuuuuugcuuuuuuugcacuuaucagaaauauuugaugugugca

SEQ ID NO: 100798 - RNA, 62 nt, Homo Sapiens
gauuuagaagagacucuuugcugaaauugaauugcacuuauacauguaaauugucaacaugu

SEQ ID NO: 100799 - RNA, 62 nt, Homo Sapiens
aucaaaguaguucaacaugcacuaucuauauuugcacuuaaagcaagugacaaucagaggug

SEQ ID NO: 100800 - RNA, 62 nt, Homo Sapiens
uuuuuuuuuuuuuuuuuaguuccaagaguaguugcacuuaacuugacuccccuuauucccuc

SEQ ID NO: 100801 - RNA, 62 nt, Homo Sapiens
auauaaaugaagauauuuuaccaugaagagauugcacuuauccuugagaacagucuaaauau

SEQ ID NO: 100802 - RNA, 62 nt, Homo Sapiens
auauaaaugaagauauuuuaccaugaagagauugcacuuauccuugagaacagucuaaugau

SEQ ID NO: 100803 - RNA, 62 nt, Homo Sapiens
gucgguguggaaugucacucauccggggacugugcacuuacaugagggugaugacaagagac

SEQ ID NO: 100804 - RNA, 62 nt, Homo Sapiens
cucuccucucuucuccuaucgagggagguaggugcacuuaccggagaccagcaguuaacggu

SEQ ID NO: 100805 - RNA, 63 nt, Homo Sapiens
cgggacugaggcugccucacguguugcaagaacaguuuugagccauuguuaacaaugccuuuu

SEQ ID NO: 100806 - RNA, 63 nt, Homo Sapiens
uuuccuaccagcccagagccuuguggcuuguacaguuuugaaacucccguucuauuuuaugau

SEQ ID NO: 100807 - RNA, 63 nt, Homo Sapiens
aaagugaaaauuuuuuuuuuucuuuugaaaucuaguuuugaauaagucugggugaccgcaccu

SEQ ID NO: 100808 - RNA, 63 nt, Homo Sapiens
acguuucuacccagauccuuuuucauuuccuuaaguuuugaucuccgucuuccugaugaagca

SEQ ID NO: 100809 - RNA, 63 nt, Homo Sapiens
caaugggugggggcuauucuuuugcuaucaggaaguuuugaggagcaggcagaguggagaaag

SEQ ID NO: 100810 - RNA, 63 nt, Homo Sapiens
uggauugauguggagaaaacaccuuucccuucuaguuuugagagacuuccucuuggcucccag

SEQ ID NO: 100811 - RNA, 63 nt, Homo Sapiens
gcaacuuguacaguggcugagaaaauaggauauaguuuugauuuuuuuaauuguaaaauauuu

SEQ ID NO: 100812 - RNA, 63 nt, Homo Sapiens
aaaguuaaugagguuuuuaaaauaagguuuucuaguuuugagagugugcacuucacacagggg

SEQ ID NO: 100813 - RNA, 63 nt, Homo Sapiens
gguucugaaguaaaggcuuguuaaguuucucuuaguuuugauuugaggcaucccguaaaguug

SEQ ID NO: 100814 - RNA, 63 nt, Homo Sapiens
auauuuauagugagauugugaaagcaaccuuaaaguuuugaagaagacugaugagacuaggug

SEQ ID NO: 100815 - RNA, 63 nt, Homo Sapiens
aagugguaauaaacaugaaaacugguuuguagcaguuuugaaagaauagaaugcauucaaaug

SEQ ID NO: 100816 - RNA, 63 nt, Homo Sapiens
gacuuuggacaguggccucuugaguuccucugcaguuuugacauuuaggauuuugugucuuuu

SEQ ID NO: 100817 - RNA, 63 nt, Homo Sapiens
caaacuacuacuacuacuguucaguuuuuuaaaaguuuugaaaugcugcacuuacauuuaaaa

SEQ ID NO: 100818 - RNA, 63 nt, Homo Sapiens
uggccauaugcuagggccccugugaaaauaaguaguuuugagaaguuuuucuauauacguaua

SEQ ID NO: 100819 - RNA, 63 nt, Homo Sapiens
ggucugauaccuaaggagccugguucaguagaaaguuuugaauuuaaaccagaaccuucuaaa

SEQ ID NO: 100820 - RNA, 63 nt, Homo Sapiens
gaguacagaaugacaacauugagcccacacugcaguuuugaagauaguaacugauggcuggug

SEQ ID NO: 100821 - RNA, 63 nt, Homo Sapiens
uuucuucuuuggguauaggguugaggggaaauaaguuuugagugagaaauaaacguuuuagcu

SEQ ID NO: 100822 - RNA, 63 nt, Homo Sapiens
uccauuugucccauuaguugcuguggauuaucaaguuuugaaggaacuguacaucccaacaga

SEQ ID NO: 100823 - RNA, 63 nt, Homo Sapiens
gcucaugucauuuuucucauggucacauuuaacaguuuugacauguuauacuugcgcauagau

SEQ ID NO: 100824 - RNA, 63 nt, Homo Sapiens
agucugucuagucauuguaaauauuuaucugucaguuuugacagauuggggccagcuugaugu

SEQ ID NO: 100825 - RNA, 63 nt, Homo Sapiens
uuuuaaaucuugcaauuguaugugugauuauggaguuuugaaaacguuacauuuuuuaaaucu

SEQ ID NO: 100826 - RNA, 63 nt, Homo Sapiens
gggucacagaccucccucccaucugggugccugaguuuugacuccaaucagugauaccagacc

SEQ ID NO: 100827 - RNA, 63 nt, Homo Sapiens
aaccaaugacuacuuaggauggguuguggaauaaguuuugauguggaauugcacaucuaccuu

SEQ ID NO: 100828 - RNA, 63 nt, Homo Sapiens
gucuaauguaugugcacauauaaguaauacaaaaguuuugagcucuuccaaguauaccauuua

SEQ ID NO: 100829 - RNA, 63 nt, Homo Sapiens
auuguguacagugguuauuuuccccaguuguauaguuuugagacauucaauuaucacugucuu

SEQ ID NO: 100830 - RNA, 63 nt, Homo Sapiens
agucuagcauuuacuuuuaaauaauuauaaugaaguuuugaaauacuaaguuaauccagaccu

SEQ ID NO: 100831 - RNA, 63 nt, Homo Sapiens
caugacaaccagacauuuccaguugguuuuguaaguuuugagaaucuagauacuggguuuuau

SEQ ID NO: 100832 - RNA, 63 nt, Homo Sapiens
gcccggccgcgccccgcgccagcgugcacgaggaguuuugagcagcugguggacuacgcgcgc

SEQ ID NO: 100833 - RNA, 63 nt, Homo Sapiens
auauuuucuauuaaaguggcacucuuguaaucgaguuuugaucgguuuucuaugucuuuuuga

SEQ ID NO: 100834 - RNA, 63 nt, Homo Sapiens
uuuaacuaaacgcaaaucuguuuccuaugcuggaguuuugauuccggcuaugugaacugccua

SEQ ID NO: 100835 - RNA, 63 nt, Homo Sapiens
acguaaagaacuuuuucuuucaugaaaguagacaguuuugagaugguguggacugaaugggau

SEQ ID NO: 100836 - RNA, 63 nt, Homo Sapiens
aaggaugguauagaaaacaaugugccacaugcaaguuuugaauuuggugccaccaacccauuu

SEQ ID NO: 100837 - RNA, 63 nt, Homo Sapiens
agcaaauaaacagcauucuuaauuuuucccacaaguuuugaucucccaauauuuuuuuacuuu

SEQ ID NO: 100838 - RNA, 63 nt, Homo Sapiens
ugaagcuguacuccccauuugcuccuucaucccaguuuugagagggcagggacuacagggaag

SEQ ID NO: 100839 - RNA, 63 nt, Homo Sapiens
gcacuuaaccggaggagggcuguuaggggcagaaguuuugaauaaguaggacaugacuaggag

SEQ ID NO: 100840 - RNA, 63 nt, Homo Sapiens
uauuucuaagccuuuuggguugggccucuuucuaguuuugaauccauagguagccuuacuacu

SEQ ID NO: 100841 - RNA, 63 nt, Homo Sapiens
ccugcuaaaugaagagacuuagaaaauaaggcaaguuuugaagccagagaagcucauuuaguu

SEQ ID NO: 100842 - RNA, 63 nt, Homo Sapiens
auacucugcacuuuucaauuacaguaggaugacaguuuugaguuugcagggaagacugagaaa

SEQ ID NO: 100843 - RNA, 63 nt, Homo Sapiens
aauuuuuuuuuccaguaaugauucauuacuaaaaguuuugagacaauugcugcuuguacacuc

SEQ ID NO: 100844 - RNA, 63 nt, Homo Sapiens
ucuuuuuacuugaauuucaaccagagagaaaugaguuuugacguuuuuauucuguuuuauaaa

SEQ ID NO: 100845 - RNA, 63 nt, Homo Sapiens
uuauuuaaguguggggaugauaggugaccucuuaguuuugaacaauggaaaacauaaguagaa

SEQ ID NO: 100846 - RNA, 63 nt, Homo Sapiens
cuaguuucucauaaaauucuucauauauuuuauaguuuugaaacuugaaccaauguuuuuauu

SEQ ID NO: 100847 - RNA, 63 nt, Homo Sapiens
uuggaaagauguuaagcauuaguguucgucuuuaguuuugauucacuuccacccuuuuuucua

SEQ ID NO: 100848 - RNA, 63 nt, Homo Sapiens
gauaggcaaaaaaaaaaaagauacccagugcucaguuuugaaaugacauggcuuauguuaaaa

SEQ ID NO: 100849 - RNA, 63 nt, Homo Sapiens
uacuuauauuuucguaugaaaaugaguugugaaaguuuugaguagauauuacuuuaucacuuu

SEQ ID NO: 100850 - RNA, 63 nt, Homo Sapiens
uuuugugauuuuauuugugcaggucaugcacacaguuuugauaaagggcaguaacaaguauug

SEQ ID NO: 100851 - RNA, 63 nt, Homo Sapiens
cugaaaccugaauuggauacugccagaauagguaguuuugaaacaaguuaaggacaugguaua

SEQ ID NO: 100852 - RNA, 63 nt, Homo Sapiens
ugaaguagaaauagcaauuaagaaauuaauucaaguuuugacgguuaacauuuagcagaaaaa

SEQ ID NO: 100853 - RNA, 52 nt, Homo Sapiens
gugaaggggacaucccauaaguaguuuugagaggguggauggguuacuugcc

SEQ ID NO: 100854 - RNA, 63 nt, Homo Sapiens
gcuguacaagugaagacaagggcuuuuuaugcaaguuuugaaagauagguauuuauuuuuucu

SEQ ID NO: 100855 - RNA, 63 nt, Homo Sapiens
agcaggauaugugauacugugugguugguguggaguuuugaagaaggggcuguguuugggcca

SEQ ID NO: 100856 - RNA, 63 nt, Homo Sapiens
caugaaucaaggugguggcagcaaacuucuaguaguuuugauauguccuugauagaacaaaua

SEQ ID NO: 100857 - RNA, 63 nt, Homo Sapiens
uucaaugaacaaagggauucuccaggauuccaaaguuuugaagucaucuuagcuuuccacagg

SEQ ID NO: 100858 - RNA, 63 nt, Homo Sapiens
gcagggaagggaagcagaucuagggaggaaggcaguuuugauuugaggagguuugcacaugua

SEQ ID NO: 100859 - RNA, 63 nt, Homo Sapiens
uauucuaacauugcacaaguugaugagauaucaaguuuugaauauuauucaggaagcacuuug

SEQ ID NO: 100860 - RNA, 63 nt, Homo Sapiens
augugaaaaagccuaagaaaaaggaaauuggacaguuuugauacaaacuuuguuugcuaaugc

SEQ ID NO: 100861 - RNA, 63 nt, Homo Sapiens
uuagucccccuggucugaacuaguugagagaguaguuuugaacagucguaaccguggcuggug

SEQ ID NO: 100862 - RNA, 63 nt, Homo Sapiens
guauuucaggcuggaaaugaauuauucuuuaccaguuuugaaacacuuugaaauauccuaagg

SEQ ID NO: 100863 - RNA, 63 nt, Homo Sapiens
ccuuuugaagauacacaaaacacugaggauuuuaguuuugaaaucaaagacuauuaaaggagc

SEQ ID NO: 100864 - RNA, 63 nt, Homo Sapiens
accaauaucaauagacuucuugaggcuacuauaaguuuugagaaauaagguucaaaaaauaag

SEQ ID NO: 100865 - RNA, 63 nt, Homo Sapiens
uccagggggaaaugcuggaagucaauaaaacugaguuuugagagcuuggugguguguuguguu

SEQ ID NO: 100866 - RNA, 63 nt, Homo Sapiens
agaguguuguaguuuuaagguuagcgugacuucaguuuugacuaaggaugacacuaauuguua

SEQ ID NO: 100867 - RNA, 63 nt, Homo Sapiens
ugucuuuguaagaguagggucuuaauuacugcuaguuuugaaagauuuggggggaccauguaa

SEQ ID NO: 100868 - RNA, 63 nt, Homo Sapiens
uuguuggaacauucaaaggaauucagaaaaugaaguuuugaauaguucgcauuuauguaaaac

SEQ ID NO: 100869 - RNA, 63 nt, Homo Sapiens
ucaacuaucauaagugaaaauuuggccucacaaaguuuugauuaauugaagauuauucauugc

SEQ ID NO: 100870 - RNA, 63 nt, Homo Sapiens
guugugcucuuucauacagaugaauuuuguuguaguuuugaauuuagcuaaggaacucauguc

SEQ ID NO: 100871 - RNA, 63 nt, Homo Sapiens
cuagaacaaggucgcuucucaacuuuggaaaacaguuuugacacuguuaaauugaacguaaau

SEQ ID NO: 100872 - RNA, 63 nt, Homo Sapiens
augaggauucaccuagacuuguuuucaauaugcaguuuugaaacuugaauaaguaguuuucau

SEQ ID NO: 100873 - RNA, 63 nt, Homo Sapiens
uucaaauguucugcuucaugaaucuuguauuuaaguuuugauuaaauugccauucacuuuuag

SEQ ID NO: 100874 - RNA, 63 nt, Homo Sapiens
acagauuugguaucauucuauauauuguauuacaguuuugaaaauaguuugcaagcagauuuc

SEQ ID NO: 100875 - RNA, 63 nt, Homo Sapiens
gacauuguaucgcagaggccacuucuugcugcuaguuuugaaguucuuuuauuuucucuagug

SEQ ID NO: 100876 - RNA, 63 nt, Homo Sapiens
auauauuuugaggagaaaaacuucugaauucugaguuuugaaagaauuucugaaaguaucagu

SEQ ID NO: 100877 - RNA, 63 nt, Homo Sapiens
ccacaaagaauuaaaaacuggcccuucuacuucaguuuugaaucguguuguuugacucagaag

SEQ ID NO: 100878 - RNA, 63 nt, Homo Sapiens
gcagggaccccgcauucccaauucugucacuggaguuuugaauagcagcugguuggggacuau

SEQ ID NO: 100879 - RNA, 63 nt, Homo Sapiens
aaauagucucccuucaauuacuguuuaauuuagaguuuugaaguaaacuuaauugauaaagcu

SEQ ID NO: 100880 - RNA, 63 nt, Homo Sapiens
ccuagauuauagucuuaguagguuaucacuuuaaguuuugacauuaagaaaacauugcuuugu

SEQ ID NO: 100881 - RNA, 63 nt, Homo Sapiens
uaacugcauucauuaggggcaaagaaaggaguuaguuuugagggugcaacagaaccauuaaua

SEQ ID NO: 100882 - RNA, 63 nt, Homo Sapiens
cuaacuguugguaggagaaaauuuuacaauguaaguuuugaaauguaccauuuauuuuaugac

SEQ ID NO: 100883 - RNA, 63 nt, Homo Sapiens
auacuuugaaaaagagaaguauuugaauagugaaguuuugaaauuauuaaaauauccuauuua

SEQ ID NO: 100884 - RNA, 63 nt, Homo Sapiens
ggauuuuaaauucaggcaaauuaagagcaaaaaaguuuugauggcuauuuguuguauuuaugc

SEQ ID NO: 100885 - RNA, 63 nt, Homo Sapiens
cuucccaguggaagauacagccccaaggccaguaguuuugacacucugguggucuuccuucua

SEQ ID NO: 100886 - RNA, 63 nt, Homo Sapiens
acuggcauuuuauagacaccacuguuuuuccauaguuuugauguuauuuuucuaaacguaagc

SEQ ID NO: 100887 - RNA, 63 nt, Homo Sapiens
cuguauuugcugccagacacaacacugccucugaguuuugaugacauguaccuauagaaauag

SEQ ID NO: 100888 - RNA, 63 nt, Homo Sapiens
uuauauuguuucaucccaugacccuuaucuguaaguuuugaauagaguugagugauagagcua

SEQ ID NO: 100889 - RNA, 63 nt, Homo Sapiens
uuauuucaguaaccuacauauggauugacgcaaaguuuugaguauugcaguaugaguugccac

SEQ ID NO: 100890 - RNA, 63 nt, Homo Sapiens
aaacgacuaaaggauuuguuggguuuuugcuuaaguuuugaaccaaauccuagagccagcuga

SEQ ID NO: 100891 - RNA, 63 nt, Homo Sapiens
gacugucaguaggcuggaagaaguggauauugaaguuuugacaucaaugaugaggcuccaguu

SEQ ID NO: 100892 - RNA, 63 nt, Homo Sapiens
auagagaggcaaaggacacagaguagcuaaccuaguuuugaagaacaagaugggggguuuuau

SEQ ID NO: 100893 - RNA, 63 nt, Homo Sapiens
uggagacuaauucuaauguggaccuuagaauacaguuuugaguagaguugaucaaaaucaauu

SEQ ID NO: 100894 - RNA, 63 nt, Homo Sapiens
acacaccaaguuuggaaauacaauuguacauggaguuuugaucaacggacuuaucucagcucu

SEQ ID NO: 100895 - RNA, 63 nt, Homo Sapiens
acaauaacccaguuacuuuuuuacacugauaaaaguuuugauauuuauuuuuugccauuuuau

SEQ ID NO: 100896 - RNA, 63 nt, Homo Sapiens
uuuuuuuuuuuaagaagaaagaaaaugcaagcuaguuuugagaaaggaaggccaaauuggguc

SEQ ID NO: 100897 - RNA, 63 nt, Homo Sapiens
aaaaccaagaaauguaaagauaacaggaaaauaaguuuugauugcauuguuuuuaaaauaagc

SEQ ID NO: 100898 - RNA, 63 nt, Homo Sapiens
aaaaaaaaguaguuuuuccuucauaacauacucaguuuugaauuacauguagugucacaugaa

SEQ ID NO: 100899 - RNA, 63 nt, Homo Sapiens
caaaaaauaaauagccaugcauuugauuuguuuaguuuugauuguuuuaacaguuaguaaugg

SEQ ID NO: 100900 - RNA, 63 nt, Homo Sapiens
ucuaaaauauuggagaugaggaaaauguacuugaguuuugaaauauuuugguaagccucucuu

SEQ ID NO: 100901 - RNA, 63 nt, Homo Sapiens
auauauacuugagguguagagauguuauuaagaaguuuugauguuagaauaauugcuuuugga

SEQ ID NO: 100902 - RNA, 63 nt, Homo Sapiens
ugugucggcugcccccugauccuuccauuaucaaguuuugaaggguguuggggaaauuauggc

SEQ ID NO: 100903 - RNA, 63 nt, Homo Sapiens
ugggacucuaguguuaagauauccuccuccuagaguuuugacuucacagacuagaccuuucuu

SEQ ID NO: 100904 - RNA, 63 nt, Homo Sapiens
ugccuaagaugaccuauuuggauccauuuaaggaguuuugaaguuagaggacaaauauuuuua

SEQ ID NO: 100905 - RNA, 63 nt, Homo Sapiens
uauucuguacaguacguuccuuuucuugguagcaguuuugaaacuagguagaauuuguacuug

SEQ ID NO: 100906 - RNA, 63 nt, Homo Sapiens
acaaaaaaaaaaaaaaaaaaggucucuuggaccaguuuugacuagagguucagucugcuucau

SEQ ID NO: 100907 - RNA, 63 nt, Homo Sapiens
uaaaccauguccaucuucuagguuucugguccaaguuuugaccgagcuguuucaaaggaaguu

SEQ ID NO: 100908 - RNA, 63 nt, Homo Sapiens
uaacuauauauauauaaauaacuauguacuaucaguuuugauauaguucuuucuuccaguuau

SEQ ID NO: 100909 - RNA, 63 nt, Homo Sapiens
gagggauaaauagaaagcagguauauauguuagaguuuugaauuaagugguggaaaaaggaaa

SEQ ID NO: 100910 - RNA, 63 nt, Homo Sapiens
uauauguauagcuugaaaagugcuagcucaauuaguuuugaauucaguaaagauuuaauucca

SEQ ID NO: 100911 - RNA, 63 nt, Homo Sapiens
aaaggagggaaaagcagauguacuuuaaaaaucaguuuugaugauuuugcuaaccuaguuugu

SEQ ID NO: 100912 - RNA, 63 nt, Homo Sapiens
uguuggguuuccagagagagagaugaaaugugcaguuuugaaaagaacuuuagugcuagggga

SEQ ID NO: 100913 - RNA, 63 nt, Homo Sapiens
accugaaauuguaaucacugaugacccuucuugaguuuugaacuucugcuucagaguauaaug

SEQ ID NO: 100914 - RNA, 63 nt, Homo Sapiens
uucacagccuucugcauugcuucuuugucacauaguuuugaauccugugguacgcacugaauu

SEQ ID NO: 100915 - RNA, 63 nt, Homo Sapiens
uuaugcacacuaaauuaaauggaauaauaccucaguuuugagggcaagugguuuuuauaaauu

SEQ ID NO: 100916 - RNA, 63 nt, Homo Sapiens
uaaagggggggaaacaaguuuuuuuauaguuguaguuuugauuuuuauuuucaguaacuauuu

SEQ ID NO: 100917 - RNA, 63 nt, Homo Sapiens
ggucagauuuucauauguaucuacugcaaaaccaguuuugacacacauauaucucaaaucugg

SEQ ID NO: 100918 - RNA, 63 nt, Homo Sapiens
acuacacuaauuuccaacauaagaggcaggaagaguuuugauucuauccuuuuuuacuaaaca

SEQ ID NO: 100919 - RNA, 63 nt, Homo Sapiens
ucauuuucuuggcauguuaaaucaagcuuaaaaaguuuugagaaaauuuuacugcgcuguguu

SEQ ID NO: 100920 - RNA, 63 nt, Homo Sapiens
agaaaaugaauuuuuuccugcagcaggaaacauaguuuugaguaguucuaccucuuauuugua

SEQ ID NO: 100921 - RNA, 63 nt, Homo Sapiens
aaaagcaaaauuaacaaugaucugugcucugaaaguuuugaaaauauauuugaacaauuugaa

SEQ ID NO: 100922 - RNA, 63 nt, Homo Sapiens
aggagaagucuucuauuuauuuauuuauucauuaguuuugaagauucuauguuaauauuuuag

SEQ ID NO: 100923 - RNA, 63 nt, Homo Sapiens
agacacacucacacacaagagccaggaugguggaguuuugauuggguggguuguuugaggggg

SEQ ID NO: 100924 - RNA, 63 nt, Homo Sapiens
uaaaauccauuuuaggugauaaaauuuuuuaaaaguuuugaaggaaaccucuggauaaaugga

SEQ ID NO: 100925 - RNA, 63 nt, Homo Sapiens
uguuuaucaaaucguguacuaaaauggaaagcuaguuuugagaaauuauucagaagccuuguu

SEQ ID NO: 100926 - RNA, 63 nt, Homo Sapiens
auguuuguuuauucuaccucaaacagaggcuuaaguuuugaaguguaaccaguuuauacuuca

SEQ ID NO: 100927 - RNA, 63 nt, Homo Sapiens
caauuauguucauuuuaagcaaaauuuuaagaaaguuuugaaauucauaaagcauuugguuuu

SEQ ID NO: 100928 - RNA, 63 nt, Homo Sapiens
acuaauuaauuuuuagauucaauauuuauauggaguuuugaaaaauaauaguggcccugaagg

SEQ ID NO: 100929 - RNA, 63 nt, Homo Sapiens
aaguuuuucuauuuagcaaaauaauuaguaauaaguuuugacuaggucuaaagaaugaacaca

SEQ ID NO: 100930 - RNA, 63 nt, Homo Sapiens
uagcagcugacugaaaaucagcacugccugaguaguuuugaucaguuuaacuugaaucacuaa

SEQ ID NO: 100931 - RNA, 63 nt, Homo Sapiens
ucuuaaccacuuuugucauuuguuuuuuggaguaguuuugaaaaguguuuuauauugagugca

SEQ ID NO: 100932 - RNA, 63 nt, Homo Sapiens
ucugucuguaaucacuaaagucaacuuuaauagaguuuugaaacaguacugugcaauccgaug

SEQ ID NO: 100933 - RNA, 63 nt, Homo Sapiens
uuucucuugcucaccaagaaguaacaaaaguauaguuuugacagaguugguguucauaauuuc

SEQ ID NO: 100934 - RNA, 63 nt, Homo Sapiens
acuauuuuaagagauucagcaugcauggauauuaguuuugauuaauguguacaauaauuuaca

SEQ ID NO: 100935 - RNA, 63 nt, Homo Sapiens
cacugaucuugacaucaagucuaacaaagaaaaaguuuugaguuuuguauuuucuuuuuucuu

SEQ ID NO: 100936 - RNA, 63 nt, Homo Sapiens
gaaaaaugguaaauggauuuucuguaaguuaccaguuuugaaugagaaaaauacuaugugguu

SEQ ID NO: 100937 - RNA, 63 nt, Homo Sapiens
cuagaagucaaaaaucuuuucucuaucaacaguaguuuugaaauuaagaaauguuuuuauuuu

SEQ ID NO: 100938 - RNA, 63 nt, Homo Sapiens
uuaaacauuauguagcuaagggauugucuggugaguuuugauaccaucaguuucuuuaaaauu

SEQ ID NO: 100939 - RNA, 63 nt, Homo Sapiens
uugggacucuuucaaguguaacuaucaugagacaguuuugauucauguuugaagcuauagcuu

SEQ ID NO: 100940 - RNA, 63 nt, Homo Sapiens
uuaugaauucuagaaacuaaaacuuaugugaacaguuuugaguaaacaagaacaaauacucua

SEQ ID NO: 100941 - RNA, 63 nt, Homo Sapiens
uuuuaauguaacucagauuggucaauuaaaaaaaguuuugaucccugguacaucacccaugau

SEQ ID NO: 100942 - RNA, 63 nt, Homo Sapiens
ucuuuuuaaggagaggcacuuaccuggaaggugaguuuugaucgaaacuuacgcaguaaucac

SEQ ID NO: 100943 - RNA, 63 nt, Homo Sapiens
gaaauauaaagcuuucuuuucuuuguggguaugaguuuugauuguaacagcaaccccugugga

SEQ ID NO: 100944 - RNA, 63 nt, Homo Sapiens
ccuuaguaccuuuuuaacagcgguuuccguagcaguuuugaaaaccaucuugaagucauuguc

SEQ ID NO: 100945 - RNA, 63 nt, Homo Sapiens
gcauauuuuguuauaguucauuagguggcugggaguuuugauuaggauuugcacugcuuuauu

SEQ ID NO: 100946 - RNA, 63 nt, Homo Sapiens
uuuuuuuuuuuucugaaaaggcuuauguuuauaaguuuugagagguacaauguaaaaugccau

SEQ ID NO: 100947 - RNA, 63 nt, Homo Sapiens
uuuaaauuacuugaaucucaaaauauuuuuuaaaguuuugacaaaguaucugauuuuuaaagu

SEQ ID NO: 100948 - RNA, 63 nt, Homo Sapiens
ccuuuauuaauacuacuuuuaaaauuacuuuggaguuuugaagguacuugaaauucuuaccag

SEQ ID NO: 100949 - RNA, 63 nt, Homo Sapiens
uguguuuauggaguuuaagauuugggacccagcaguuuugaaacuagaguucauagauggacu

SEQ ID NO: 100950 - RNA, 63 nt, Homo Sapiens
ucuugcucauuuucagaauaaugauaauaggcuaguuuugauucuuggugccuaauuuucuag

SEQ ID NO: 100951 - RNA, 63 nt, Homo Sapiens
uauaauaguuuguauauucaaauaccaguguucaguuuugaacuaguugaaguuuaugaggga

SEQ ID NO: 100952 - RNA, 63 nt, Homo Sapiens
aggugcaacugugacuugggucacuuuaaagcuaguuuugaauuuaugaaguuuaaaaauagc

SEQ ID NO: 100953 - RNA, 63 nt, Homo Sapiens
guucgauaaaagccauuaaagucacuuuucuauaguuuugagacuugacuaauucauuguuac

SEQ ID NO: 100954 - RNA, 63 nt, Homo Sapiens
agacaucuuugaagugcuuugucuucuggaaauaguuuugacccaaaaggugugggcuuuggg

SEQ ID NO: 100955 - RNA, 63 nt, Homo Sapiens
gauguuugagcuuuuguauacuucaauaguccaaguuuugaagaauugaaauuuaauuguaga

SEQ ID NO: 100956 - RNA, 63 nt, Homo Sapiens
ugcuacuauaauaaguuuuuucagacaaaauaaaguuuugaagaaaauacauaugcagucuag

SEQ ID NO: 100957 - RNA, 63 nt, Homo Sapiens
ucgguaacuaguuuaacuacuuuuauacuuuuuaguuuugauuguuuugaaaagaaaauagcu

SEQ ID NO: 100958 - RNA, 63 nt, Homo Sapiens
ucaagucugugguuuugaugcagagaagaaaauaguuuugauuuuugaguuuuuaacagaagu

SEQ ID NO: 100959 - RNA, 63 nt, Homo Sapiens
uauuuacacuuuauugucucccgcuucucagauaguuuugauguguuguacaguggaauaucu

SEQ ID NO: 100960 - RNA, 63 nt, Homo Sapiens
ucaccucugaaggcaaauauaagcugggaaaaaaguuuugaugaaauucuugaaguucauggu

SEQ ID NO: 100961 - RNA, 63 nt, Homo Sapiens
agacugggaccuuagaaaucauuguagaaacacaguuuugaaagaaaaauaccaugucucuaa

SEQ ID NO: 100962 - RNA, 63 nt, Homo Sapiens
gaauacauauugaaauagugugcuggcuuuuguaguuuugauaaagaccauugcaggcaaugg

SEQ ID NO: 100963 - RNA, 63 nt, Homo Sapiens
uagguacauggacuauaucgcacaacaggugcuaguuuugagaaggcccaacaggaguuugca

SEQ ID NO: 100964 - RNA, 63 nt, Homo Sapiens
ucugucaaauuguauuucaguggcacaaaaaccaguuuugaggucuuagacuuauaauucuuu

SEQ ID NO: 100965 - RNA, 63 nt, Homo Sapiens
acuccgucgugguuuuauuuuuaauauagagagaguuuugaauucuacacuguugucuuuccu

SEQ ID NO: 100966 - RNA, 63 nt, Homo Sapiens
cugucuugaugacacuugcagggcaggcugaaaaguuuugagauugagcagcuugggaguuug

SEQ ID NO: 100967 - RNA, 63 nt, Homo Sapiens
gagggaugcccauuccaugguccuccagagaauaguuuugacuuaacaugucuguuuagccca

SEQ ID NO: 100968 - RNA, 62 nt, Homo Sapiens
aaaaaucucauguuugaaucauaugaguuuuucaguuuugaagugggaguaaaauacugaau

SEQ ID NO: 100969 - RNA, 63 nt, Homo Sapiens
uagagacauuuacucuggaggauugccucuugaaguuuugacauuauuugaaucugucuuuuu

SEQ ID NO: 100970 - RNA, 63 nt, Homo Sapiens
acuuaauuuuuuguaaaacauggacuucaaaagaguuuugaaggggggauguucugcacccag

SEQ ID NO: 100971 - RNA, 63 nt, Homo Sapiens
ucaucuauuuuuuauuuguuauugguaaauguuaguuuugacuaguuucaguuucucauggaa

SEQ ID NO: 100972 - RNA, 63 nt, Homo Sapiens
cuuguggcaagagacuuaacgacagcucugaaaaguuuugaugaaauggauuuucacggaaga

SEQ ID NO: 100973 - RNA, 63 nt, Homo Sapiens
uggauagugaaaaaguggaggacugacaaugacaguuuugaguuuaaaaagaauucaaaaaaa

SEQ ID NO: 100974 - RNA, 63 nt, Homo Sapiens
uuguucuuuuuauuuucaggccuucuacuugugaguuuugaaaaaaauaauuaccaaggccuc

SEQ ID NO: 100975 - RNA, 63 nt, Homo Sapiens
cucuccaggugauuccaaugcacaggcauugguaguuuugaagcacaaucuuuggugacgggu

SEQ ID NO: 100976 - RNA, 63 nt, Homo Sapiens
gugaaccacacuuuauccaagaugucuggagcuaguuuugaggguauacauucucuagucugu

SEQ ID NO: 100977 - RNA, 63 nt, Homo Sapiens
augaagagcgaaaucaaauucuuauuuuuguacaguuuugaaguuuauacuuagaacugacca

SEQ ID NO: 100978 - RNA, 63 nt, Homo Sapiens
gugcugagauauaccuguacuauuuaugguuuaaguuuugauucuuagguauuuucuccagcu

SEQ ID NO: 100979 - RNA, 63 nt, Homo Sapiens
ccaucagcauagacuugacuuccuuaaaccgagaguuuugauguggccuuggcaacccuaaaa

SEQ ID NO: 100980 - RNA, 63 nt, Homo Sapiens
ucuaagcaauagagagcuucaugacugaguaagaguuuugaagucagcagugaaucaagugcc

SEQ ID NO: 100981 - RNA, 63 nt, Homo Sapiens
uuguuuucugugaaaacagcagugaacagguucaguuuugaacuggcccugaggaaauggguc

SEQ ID NO: 100982 - RNA, 63 nt, Homo Sapiens
acugggcuuucuccccacuaagggcaaggccccaguuuugaccaaucgcaugguucuccuggc

SEQ ID NO: 100983 - RNA, 63 nt, Homo Sapiens
cgugagacaagcaguuaauaguaugaucuuuaaaguuuugacaauauaaaauaaacuugguaa

SEQ ID NO: 100984 - RNA, 63 nt, Homo Sapiens
auaaaggaaauucagauuguuuaaaugccuaaaaguuuugagauaaguuuuguuucaauuaga

SEQ ID NO: 100985 - RNA, 63 nt, Homo Sapiens
aaaaugaaagcaacagugauguauugaaaucuuaguuuugauauuuuaaagaaaugacuuucu

SEQ ID NO: 100986 - RNA, 63 nt, Homo Sapiens
acgaaaguaggcgguacgaacccuaauggaggcaguuuugaggagguccucagcuccacggcc

SEQ ID NO: 100987 - RNA, 63 nt, Homo Sapiens
agauuucaaaucuuuccaauuuacccuggaaucaguuuugagggagcugauaaagacuuuagc

SEQ ID NO: 100988 - RNA, 63 nt, Homo Sapiens
uuuuuuuuuaccaaacuucagggacacucugcuaguuuugaauaaguaaccaucaaaguuacu

SEQ ID NO: 100989 - RNA, 63 nt, Homo Sapiens
augaccagguuggacuguuugcccaacguauauaguuuugacacaccuggucuucaguucugu

SEQ ID NO: 100990 - RNA, 63 nt, Homo Sapiens
acauguuaauuuuuuucccuacagaaagguuguaguuuugagcaaacaaaaauuauuuugccu

SEQ ID NO: 100991 - RNA, 63 nt, Homo Sapiens
aaacucaguaugcaugugugagcagaacagacuaguuuugaguaucccggaagaagaggaaga

SEQ ID NO: 100992 - RNA, 63 nt, Homo Sapiens
acucuuaaagcaucauuugcuuauuuuuuaaaaaguuuugauaggaggcuccauauuaaugca

SEQ ID NO: 100993 - RNA, 63 nt, Homo Sapiens
uuuuaauuugaguagauuuaaugcagaucacacaguuuugaaauagucuguagguggacaaga

SEQ ID NO: 100994 - RNA, 63 nt, Homo Sapiens
gaggugcauaauaaaacuaccaugaggagccucaguuuugaaaaaaaaguuccaacacacagc

SEQ ID NO: 100995 - RNA, 63 nt, Homo Sapiens
cacugcaaccuccgccuccuagugcaauggugcaguuuugacugcucuuguugcccaggcugg

SEQ ID NO: 100996 - RNA, 63 nt, Homo Sapiens
ggguaauguuucuguucuucuuuguauuuuuacaguuuugauuaaaaauauguuugaugcuau

SEQ ID NO: 100997 - RNA, 63 nt, Homo Sapiens
aauccuauucaauuuucucacacuuugcaucuuaguuuugaacuaucuugcaagcuccaccuu

SEQ ID NO: 100998 - RNA, 63 nt, Homo Sapiens
auaugcaguacuguuuauauguguuuauuuaaaaguuuugaaauguauaccuauauauucuuu

SEQ ID NO: 100999 - RNA, 63 nt, Homo Sapiens
aaauguuauuuuuacugaaaaaucagauugaaaaguuuugagaaaaaaguacaagcuauuaaa

SEQ ID NO: 101000 - RNA, 63 nt, Homo Sapiens
cucaaccgagguccagggcaagaucaagacccaaguuuugaauagagagagagagcgcgagag

SEQ ID NO: 101001 - RNA, 63 nt, Homo Sapiens
uuuguuagccugacacucccaaugucaaugcccaguuuugacuaacaucaguaaacuaccauu

SEQ ID NO: 101002 - RNA, 63 nt, Homo Sapiens
acauuuaccuucagccuccaucagaauggaacgaguuuugaguaaucaggaaguauaucuaua

SEQ ID NO: 101003 - RNA, 63 nt, Homo Sapiens
uuauuucugucacaguaaaaauaaaauacuuugaguuuugagcuacuggauucuuauuaguuc

SEQ ID NO: 101004 - RNA, 63 nt, Homo Sapiens
uuaagaaguaccacuugaaacauuuuauguauuaguuuugaaauaauaauggaaaguggcuau

SEQ ID NO: 101005 - RNA, 63 nt, Homo Sapiens
guauuugaguucacacuauuucuguuuuacagcaguuuugaaaaacacauacuaugccaccaa

SEQ ID NO: 101006 - RNA, 63 nt, Homo Sapiens
aagagcccucaauugccugccuguauuaauuuuaguuuugagucaggauuuguaauggagugg

SEQ ID NO: 101007 - RNA, 63 nt, Homo Sapiens
guuagcccugccuuccaggaagguuggggugggaguuuugagugggaaagaggaugacaugug

SEQ ID NO: 101008 - RNA, 63 nt, Homo Sapiens
gaggccgaggugagcggaucaccugaggucaggaguuuugagaccagccuggccaacauggua

SEQ ID NO: 101009 - RNA, 63 nt, Homo Sapiens
auacuguucuggacugugccuguuaaguugcucaguuuugagcugucuucagacaagaagauu

SEQ ID NO: 101010 - RNA, 63 nt, Homo Sapiens
ccuuuguagaaauucuugccugaauucucaccaaguuuugaauuccuaagguagccccgaucu

SEQ ID NO: 101011 - RNA, 63 nt, Homo Sapiens
gcugccagucuuccugccccacuggacuguuccaguuuugacagcccgggccugcacauacuc

SEQ ID NO: 101012 - RNA, 63 nt, Homo Sapiens
augaugaaacuauaucauguaugggguccuacaaguuuugaguacuuuuuacuuaggcuuggg

SEQ ID NO: 101013 - RNA, 63 nt, Homo Sapiens
agucagaucuggccauuuguucacaaugugaguaguuuugaaauagauuuguuccugcuuuuu

SEQ ID NO: 101014 - RNA, 63 nt, Homo Sapiens
agcuauuagccaggaucaugagauuuuucucaaaguuuugaaagacaugugaaaccuuuuuua

SEQ ID NO: 101015 - RNA, 63 nt, Homo Sapiens
caguauuguuacacucaaacugucuuccauuucaguuuugaauaaaguauucuagggagaaac

SEQ ID NO: 101016 - RNA, 63 nt, Homo Sapiens
gggcagauuucaaacugaauauaauacagaaagaguuuugaaugauguggcguuucaacucau

SEQ ID NO: 101017 - RNA, 63 nt, Homo Sapiens
uaaaacaaugcccauucaccuguggauagacuuaguuuugacacuuuguuacaggagaggacc

SEQ ID NO: 101018 - RNA, 63 nt, Homo Sapiens
auaaauucuuuggaacuuuagaaguuuuguuuuaguuuugauauuauuacuuuauguacaacu

SEQ ID NO: 101019 - RNA, 63 nt, Homo Sapiens
uaauguuuucagcccaucucuuauuauauuauuaguuuugauuguaacaaagaacugaagcuc

SEQ ID NO: 101020 - RNA, 63 nt, Homo Sapiens
gcuuggaacuggaauccuuuccacuaacgguugaguuuugacuucuaccaggucaaaauagug

SEQ ID NO: 101021 - RNA, 63 nt, Homo Sapiens
aauacgagucugucagagcgucuucugaauguaaguuuugagaucaaauaguggcagacagug

SEQ ID NO: 101022 - RNA, 63 nt, Homo Sapiens
uuacuuucucagaauuaccuaaauguuuuguagaguuuugacuaguaaucaaucaaaauuaua

SEQ ID NO: 101023 - RNA, 63 nt, Homo Sapiens
agcuggcuaucuuuaagaaagaugauauauccuaguuuugaaaguaauuuucuuuuuucuuuc

SEQ ID NO: 101024 - RNA, 63 nt, Homo Sapiens
ucuuucuguuucaggcuugaaaaacccuugcccaguuuugaucccuucaagacuuugucacag

SEQ ID NO: 101025 - RNA, 63 nt, Homo Sapiens
gcacaauggcuuuuuguuaauaaagaacagauuaguuuugaagaaggcaaaaauuucaguuuu

SEQ ID NO: 101026 - RNA, 63 nt, Homo Sapiens
uuucuaauauguggccagggcguucagauuuccaguuuugaaaacaauuguauagauuucaca

SEQ ID NO: 101027 - RNA, 63 nt, Homo Sapiens
ucuuucaacacacuuccacugccugcguaaugaaguuuugauucauuuuuaaccacuggaauu

SEQ ID NO: 101028 - RNA, 63 nt, Homo Sapiens
acuaagaagcuuaaauguugauaaaauaugacuaguuuugaauuuacaccaagaacuucucaa

SEQ ID NO: 101029 - RNA, 63 nt, Homo Sapiens
aacacguuacaauuaccacauauccuugcuauaaguuuugaaguuucuuagcaauuaaaguuu

SEQ ID NO: 101030 - RNA, 63 nt, Homo Sapiens
ucauucuuuuuuucugaaagagguaauaauucuaguuuugauagacucugaggauuaugugaa

SEQ ID NO: 101031 - RNA, 63 nt, Homo Sapiens
uccagcaaacuaggguaauuggugccuuuuuacaguuuugaauaaaagcauuuacaauuucua

SEQ ID NO: 101032 - RNA, 63 nt, Homo Sapiens
uuuuaggucucucaaauaauuaagaauagagccaguuuugaauaaagucuagcagaacuaugc

SEQ ID NO: 101033 - RNA, 63 nt, Homo Sapiens
uuuaagauaggauuauugggggguucgacuuagaguuuugagcaugagcauauggacuuacga

SEQ ID NO: 101034 - RNA, 63 nt, Homo Sapiens
guacugugccugguuugauuguguugacacaccaguuuugaguaaacuaguaucauuuuaggg

SEQ ID NO: 101035 - RNA, 63 nt, Homo Sapiens
agucacuuuuauuuuuaauuucacagacuguagaguuuugaaauggccaccucacgcauuuga

SEQ ID NO: 101036 - RNA, 63 nt, Homo Sapiens
uuaccuugauuuuuuuaauugacgcuuuuuagaaguuuugaaaaugcugcagucugcacauua

SEQ ID NO: 101037 - RNA, 63 nt, Homo Sapiens
uuuuaugauagauuugcucuuuuauucucuucuaguuuugacaucuagguuuuuuccuuucau

SEQ ID NO: 101038 - RNA, 63 nt, Homo Sapiens
uaaaaucucguuuguauacuuuuuacaauaaacaguuuugauuaaaaacaauuuucaaguuuu

SEQ ID NO: 101039 - RNA, 63 nt, Homo Sapiens
aagaacagcauagagcuucaauaauaaaauaagaguuuugauuuagaacuaguguaauucuug

SEQ ID NO: 101040 - RNA, 63 nt, Homo Sapiens
ucagccagcugcccuaaauauuagcauucuggcaguuuugacagagacucagccugcaguuaa

SEQ ID NO: 101041 - RNA, 63 nt, Homo Sapiens
uccguuaugugauucugcuuaugugaacuauuuaguuuugaugauauuuaauuuaaacuaaug

SEQ ID NO: 101042 - RNA, 63 nt, Homo Sapiens
uagauguguauauggacuguagcuagcaaagguaguuuugaaaaaaacuuugggaaaggggcu

SEQ ID NO: 101043 - RNA, 63 nt, Homo Sapiens
ugacaaggcaaaacaugacaaacaagcuauuugaguuuugacuuucuggaauaauuuuaccaa

SEQ ID NO: 101044 - RNA, 63 nt, Homo Sapiens
aauuacaugguggauucugacuuuuaguuucccaguuuugaauuuuaguugauuuuuuuuaac

SEQ ID NO: 101045 - RNA, 63 nt, Homo Sapiens
uaaagugguuaauucaggaaauugacagaauccaguuuugagaaaagaacacagauauuugcu

SEQ ID NO: 101046 - RNA, 63 nt, Homo Sapiens
uuuagugucucaccagugguuuuacaucugcagaguuuugagggcugugcugaccuuugagag

SEQ ID NO: 101047 - RNA, 63 nt, Homo Sapiens
aauuagaguuuaaauaaauaugcuuugaugcauaguuuugaacuaauguaacaugauuuuucu

SEQ ID NO: 101048 - RNA, 63 nt, Homo Sapiens
ucccuacauguauugcacauuguaaaaaguuuuaguuuugaugaguugugaguuuaccuugua

SEQ ID NO: 101049 - RNA, 63 nt, Homo Sapiens
auuuuggugucaauuuuguggacauuuggcaggaguuuugacugggguaggagaaacccauga

SEQ ID NO: 101050 - RNA, 63 nt, Homo Sapiens
gcacggauggcugguccgaagcacgugcauuucaguuuugaggcuccuguccucaggcagugu

SEQ ID NO: 101051 - RNA, 63 nt, Homo Sapiens
aaggcaauuuuaaauaggcagagagaaguuuauaguuuugaaaacagcugcugaagucaggaa

SEQ ID NO: 101052 - RNA, 63 nt, Homo Sapiens
aaaccaccaagaacauuuccuggggcauguuccaguuuugaggggugauauaucugccagaua

SEQ ID NO: 101053 - RNA, 63 nt, Homo Sapiens
aagaucagcuggcuuucuuguuaaaguuauuuaaguuuugaaugcucuacuacuucaagucuu

SEQ ID NO: 101054 - RNA, 63 nt, Homo Sapiens
cuaggauuaauuaucagaagacagcucaggccaaguuuugaucguuccauacaguaccuuguu

SEQ ID NO: 101055 - RNA, 63 nt, Homo Sapiens
cuaacaagguauuugcaugagucacaauuacaaaguuuugagcgguuuuguaauuugacauuu

SEQ ID NO: 101056 - RNA, 63 nt, Homo Sapiens
aaccuuuuaaggaaauacaguccuugggaaaugaguuuugauggugaauugggguguuaagga

SEQ ID NO: 101057 - RNA, 63 nt, Homo Sapiens
gaaagagaaaggaaauuauaaggucaaguuaacaguuuugagguuuuguguuuuuuucuggaa

SEQ ID NO: 101058 - RNA, 63 nt, Homo Sapiens
auuauguuauagccaucauaaaaccauuuugguaguuuugacugaacuggguguucacuuuuu

SEQ ID NO: 101059 - RNA, 63 nt, Homo Sapiens
cuuaaugcuuguaauuuaaacauuuguuccuggaguuuugauuugguggaugugaugguuggu

SEQ ID NO: 101060 - RNA, 63 nt, Homo Sapiens
guuguggagaggagacgccuccagacucucagaaguuuugaggacugaacugggucacucggg

SEQ ID NO: 101061 - RNA, 63 nt, Homo Sapiens
uacugcaguggaugugggaucuguuacuaggagaguuuugagauuuguggugaugggaggaug

SEQ ID NO: 101062 - RNA, 63 nt, Homo Sapiens
guaaggaacaauaccugggauuuccuuuuagcuaguuuugaaauucauaaaccaugcuaacau

SEQ ID NO: 101063 - RNA, 63 nt, Homo Sapiens
gaauaauucuuggucuucccugcaacuagccccaguuuugacaacacacacacacacacagug

SEQ ID NO: 101064 - RNA, 63 nt, Homo Sapiens
uuuggcuguuuauuuuuguccauuuuucauucuaguuuugauauucacuauuugagguaacuu

SEQ ID NO: 101065 - RNA, 63 nt, Homo Sapiens
ccaaaaaagaaaccuagaauggauuguagacccaguuuugaaauccauuaaugucauuuuuau

SEQ ID NO: 101066 - RNA, 63 nt, Homo Sapiens
gggcacugucaacuuggguuauuauuuaugaaaaguuuugagauuuuuaaaugaaauuagguc

SEQ ID NO: 101067 - RNA, 63 nt, Homo Sapiens
ucuucagcaccaggaaggaacccuagaggagacaguuuugaccagggacaguuuugaccugac

SEQ ID NO: 101068 - RNA, 63 nt, Homo Sapiens
ugaccccuagaggagacaguccuauggagggacaguuuugaccccauggaccccuggaggaga

SEQ ID NO: 101069 - RNA, 63 nt, Homo Sapiens
guaucuguacguuaauguuucuugcugaguuacaguuuugauaaagaggcucucauuuccugu

SEQ ID NO: 101070 - RNA, 63 nt, Homo Sapiens
cuucauaaucuauggaaaccucuaaggugagaaaguuuugaacuuuuaacccuuucuacccag

SEQ ID NO: 101071 - RNA, 63 nt, Homo Sapiens
guuauauugugauacucaaauucacagcagaguaguuuugaguaacaguaauuaaauccuucu

SEQ ID NO: 101072 - RNA, 63 nt, Homo Sapiens
uuuagaaacauuagugccugccuggauccccuuaguuuugaaauauuugccauuguuguuuaa

SEQ ID NO: 101073 - RNA, 63 nt, Homo Sapiens
uacacccauagauuaccaagguuucaguguacuaguuuugaaucuguucugaauggaguuuuu

SEQ ID NO: 101074 - RNA, 63 nt, Homo Sapiens
augauauuugaaaaugcuaucccugcacucaaaaguuuugaaagaaacuaaucacagcacaga

SEQ ID NO: 101075 - RNA, 63 nt, Homo Sapiens
guuggguacuuagacccaaaccaauaaauggugaguuuugaacaagaacuaccaucaugcagg

SEQ ID NO: 101076 - RNA, 63 nt, Homo Sapiens
uggggauaauaauacugaccuaccucaaagggcaguuuugaggcaugacuaaugcuuuuuaga

SEQ ID NO: 101077 - RNA, 63 nt, Homo Sapiens
cacccacugacaucugaauuuauauaccuguugaguuuugagugcacccaaacacucgauaaa

SEQ ID NO: 101078 - RNA, 63 nt, Homo Sapiens
guucugcuuuuccuggcacucaaauucaugacuaguuuugaggucaaaccuauguucguaaug

SEQ ID NO: 101079 - RNA, 63 nt, Homo Sapiens
uguuacugaagcauuugaauauaaagcuauuuuaguuuugauggcuuaacuguucccugagga

SEQ ID NO: 101080 - RNA, 63 nt, Homo Sapiens
acaccuauaaucccaacacuuugggaggccaggaguuuugagaccagccugggaaacaucugu

SEQ ID NO: 101081 - RNA, 63 nt, Homo Sapiens
ccucaggaggaagguggacaacagagaaaugagaguuuugauauuuucugaaagaggaacaug

SEQ ID NO: 101082 - RNA, 63 nt, Homo Sapiens
uugggcaaacaaaauuggagggcaagugacugcaguuuugagaaucaguuuugaccuugauga

SEQ ID NO: 101083 - RNA, 63 nt, Homo Sapiens
auuggagggcaagugacugcaguuuugagaaucaguuuugaccuugaugauuuuuuguuucca

SEQ ID NO: 101084 - RNA, 63 nt, Homo Sapiens
gauuuacaucuuaggaaauaugcaucgcacucuaguuuugaaggaugcuugagauuuuccugc

SEQ ID NO: 101085 - RNA, 63 nt, Homo Sapiens
acaugaauacaaacaaaaaauguccauaaauaaaguuuugaaaauaugauauucaaauuucag

SEQ ID NO: 101086 - RNA, 63 nt, Homo Sapiens
auugagacacaauacuaauacuuuuuaaaaguuaguuuugagauccuuuagguuaaguuuaag

SEQ ID NO: 101087 - RNA, 63 nt, Homo Sapiens
augaucacuuaccuaaaacuuuuucuuaaagagaguuuugaaaugaaaacagccaugaauauc

SEQ ID NO: 101088 - RNA, 63 nt, Homo Sapiens
caaugaaaauggaagcacuuauccuugcuaaguaguuuugacaaaaguuuauuuuccucugcc

SEQ ID NO: 101089 - RNA, 63 nt, Homo Sapiens
aagcacaggguuauagguguauguaccuaaugaaguuuugagauuuaucaacguguugugaag

SEQ ID NO: 101090 - RNA, 63 nt, Homo Sapiens
ggcauuucauuaaggcaucuuaaacagugagguaguuuugaauuagcaccucaagguauaauu

SEQ ID NO: 101091 - RNA, 63 nt, Homo Sapiens
aauucaagccucuaaacagauuacaaguauaacaguuuugaguaugaucagaagaacaugauu

SEQ ID NO: 101092 - RNA, 63 nt, Homo Sapiens
acuuuguggcugguuuguccugauggcucggucaguuuugaggaaugccuuugacaccaacca

SEQ ID NO: 101093 - RNA, 63 nt, Homo Sapiens
gcuggcaucuugccaccccacccugcuuggcccaguuuugauugggggccuccaguguccugc

SEQ ID NO: 101094 - RNA, 63 nt, Homo Sapiens
aacaauaauggggaaaauaucaucuaugacaugaguuuugagaaaaaccaucaucuguaaaac

SEQ ID NO: 101095 - RNA, 63 nt, Homo Sapiens
uauuuguguuuaaaugcugcuuggggaaaaugaaguuuugauuauuuacaauauaugacuaau

SEQ ID NO: 101096 - RNA, 63 nt, Homo Sapiens
ccucugggguucagcuucugucucugcugucccaguuuugagguuugguuucuuguuucuguc

SEQ ID NO: 101097 - RNA, 63 nt, Homo Sapiens
aaauucagucuaguucugcugauaaagaucaucaguuuugaaagguuacugauuuuccucuuc

SEQ ID NO: 101098 - RNA, 63 nt, Homo Sapiens
aggcagagugguccccucuuugccaccuaggccaguuuugacccuggcauuaacuggccuuag

SEQ ID NO: 101099 - RNA, 63 nt, Homo Sapiens
agagugaaagggguaagggggugggaggguaagaguuuugacaaguuguggcaaaggaaacua

SEQ ID NO: 101100 - RNA, 63 nt, Homo Sapiens
auaaguaaaaauauuugagaaaaauaaaguacaaguuuugaacaacacaaaaggcaugaauuc

SEQ ID NO: 101101 - RNA, 63 nt, Homo Sapiens
aacacuacuaaauuuugguuccuccauagaauuaguuuugaaacacuugauguagugagaaau

SEQ ID NO: 101102 - RNA, 63 nt, Homo Sapiens
ccaugugggaaucagcauucuuaauuucguuaaaguuuugacuuguaaugaaauguucaagua

SEQ ID NO: 101103 - RNA, 63 nt, Homo Sapiens
gcuggggugccaaacaccagaaggggagauaauaguuuugacucugaacuuggccacaacccc

SEQ ID NO: 101104 - RNA, 63 nt, Homo Sapiens
uuucuagcuuaucuacuuccagcuauuuuuuucaguuuugauauaguagaacgcuaucuggga

SEQ ID NO: 101105 - RNA, 63 nt, Homo Sapiens
gaucguuaaugcccuugaagcacaaaacugaucaguuuugagaaaagaaacaugguuuacuug

SEQ ID NO: 101106 - RNA, 63 nt, Homo Sapiens
gauguagggagccuuaguugccuguggagucugaguuuugaagggaagaagcuggacauucag

SEQ ID NO: 101107 - RNA, 63 nt, Homo Sapiens
gagugaugugagaaacuucuaagcagucuuuucaguuuugacugacuaaacuaccuccaaagc

SEQ ID NO: 101108 - RNA, 63 nt, Homo Sapiens
ucuggagcuaguguuuugaccaccugauuucugaguuuugaguagcacuugggugaaucuggg

SEQ ID NO: 101109 - RNA, 63 nt, Homo Sapiens
ggaauuuuuagagaggacauuaaauucuuagaaaguuuugagaaacaccaaaauauuuuagaa

SEQ ID NO: 101110 - RNA, 63 nt, Homo Sapiens
uggccuaggaggaaacccagaccuuauuuuggaaguuuugaauugagccuauuguguuacuug

SEQ ID NO: 101111 - RNA, 63 nt, Homo Sapiens
caaagauggacuucaguggguaccuaucacucuaguuuugaagcugaaaaucugagaacuauu

SEQ ID NO: 101112 - RNA, 63 nt, Homo Sapiens
gucuuuagauagaaacaugagcagggaaaaacuaguuuugaguugcaguuaggaaagggaugg

SEQ ID NO: 101113 - RNA, 63 nt, Homo Sapiens
agcacugugguuuuccuuuuaucagccuagaaaaguuuugauuaacacuuucuugggaagcag

SEQ ID NO: 101114 - RNA, 63 nt, Homo Sapiens
gguaguuuggggcaaaaauccgaggugcuugggaguuuugaauguuaagaauugaccaucugc

SEQ ID NO: 101115 - RNA, 63 nt, Homo Sapiens
gggguuuggaaauguaaauguguaccuugcuuuaguuuugaggcuggggaauaugugugggug

SEQ ID NO: 101116 - RNA, 63 nt, Homo Sapiens
gacacuuguaacauauucaacguccuguacuccaguuuugacuacgagaucagauuuuggagg

SEQ ID NO: 101117 - RNA, 63 nt, Homo Sapiens
ugaaauuagugugcagagucauucuaccgauaaaguuuugaaauaaugugaaaacuggagcau

SEQ ID NO: 101118 - RNA, 63 nt, Homo Sapiens
guuuuacccuuucuaaacacuguccuuuuugaaaguuuugaauauauccacauucuauugaaa

SEQ ID NO: 101119 - RNA, 63 nt, Homo Sapiens
acuuugguacugcugucuuccaagguagcucuaaguuuugaugugugggcuucugaguuuaua

SEQ ID NO: 101120 - RNA, 63 nt, Homo Sapiens
augguaguucaguugggguacuuguuuuauggaaguuuugauugauuuacuugcccucccacc

SEQ ID NO: 101121 - RNA, 63 nt, Homo Sapiens
uaaguccucacccuuuacauuaucuaauucuucaguuuugaugcugauaccugcccccggccc

SEQ ID NO: 101122 - RNA, 63 nt, Homo Sapiens
uguucuucacuaugauuuacugugugccaaaggaguuuugacaggguacagaguauuuuacua

SEQ ID NO: 101123 - RNA, 63 nt, Homo Sapiens
uguaaaaauugguuaacuuuacaaaugucagcuaguuuugacuacuaauugggggaaauuuua

SEQ ID NO: 101124 - RNA, 63 nt, Homo Sapiens
cuuuccuucccuauuguuuuuguuuuuuuaaugaguuuugacgcauguuguuuugauugcuau

SEQ ID NO: 101125 - RNA, 63 nt, Homo Sapiens
auauagagccacuuccugaaaccaagaaucuguaguuuugauccaaaaucuaaaacuuaaagu

SEQ ID NO: 101126 - RNA, 63 nt, Homo Sapiens
uaucucagcugucuuuucuaacuguguagguugaguuuugaacacgugcuuguggacaucagg

SEQ ID NO: 101127 - RNA, 63 nt, Homo Sapiens
gaccucagaacugaaauugauaaugaaguugcaaguuuugauagcccgugaagugcauaagua

SEQ ID NO: 101128 - RNA, 63 nt, Homo Sapiens
caguaauaugucuccuugcuucuuugaugugauaguuuugagaugggugagaaucuaauagau

SEQ ID NO: 101129 - RNA, 63 nt, Homo Sapiens
ugugcaaaagcuccccguccagcuuugacagucaguuuugaugucagcuccucggcaggguag

SEQ ID NO: 101130 - RNA, 63 nt, Homo Sapiens
gaagggaagaccugcagugcguuccuugcuuuuaguuuugauaugggguuucaauugacuucu

SEQ ID NO: 101131 - RNA, 63 nt, Homo Sapiens
gcaacauuguccccuacuggcugcaauuggugcaguuuugaaucaggucuggccagggacgug

SEQ ID NO: 101132 - RNA, 63 nt, Homo Sapiens
guuuaugcugggcacugccacagucuuuuaucaaguuuugacgacagcaagauaaccccaaga

SEQ ID NO: 101133 - RNA, 63 nt, Homo Sapiens
gcaaaugcuguaaagauauacauuuaacuggccaguuuugauuaauucaaaagugaacgaaag

SEQ ID NO: 101134 - RNA, 63 nt, Homo Sapiens
ggguugauuucccccacucccaauuucuagaguaguuuugaauccugcuauucugccaaaaga

SEQ ID NO: 101135 - RNA, 63 nt, Homo Sapiens
aguaccuuuuauguucagaaagaugagcuaggaaguuuugagagauaaggcauacauuugcgc

SEQ ID NO: 101136 - RNA, 63 nt, Homo Sapiens
gacuucauauucuagaauaccuuuccacagccuaguuuugauugcccugcuucuaaucugguu

SEQ ID NO: 101137 - RNA, 63 nt, Homo Sapiens
guguguuuauguggaauguuagcauauccagugaguuuugacaaauuuaaguccuccaauucc

SEQ ID NO: 101138 - RNA, 63 nt, Homo Sapiens
cuacuccuguuugcccuccuaaccugccauggcaguuuugacagaucuguugaacugucuucc

SEQ ID NO: 101139 - RNA, 63 nt, Homo Sapiens
uuucuaaaggagauagaauguugaacuaagaucaguuuugaagacugaauaguaacuucuuuc

SEQ ID NO: 101140 - RNA, 63 nt, Homo Sapiens
aaagcagguaguagagcagcucaggaacuaacaaguuuugagagccacacccuagauccagcc

SEQ ID NO: 101141 - RNA, 63 nt, Homo Sapiens
caagaauuggugauuuguuucauaacagaugucaguuuugaacauaugugauaugguaauuuu

SEQ ID NO: 101142 - RNA, 63 nt, Homo Sapiens
aauaacuacauuuuauuucaucaucaguuggugaguuuugaagacugagaugaucaguuacau

SEQ ID NO: 101143 - RNA, 63 nt, Homo Sapiens
ucagugggaaaaaaggagguauauaaaacucaaaguuuugaagaaugacaaauugauauucug

SEQ ID NO: 101144 - RNA, 63 nt, Homo Sapiens
cuuugucucucuggaauaugacuuugcacuuguaguuuugagucuggcagcucucucuaccca

SEQ ID NO: 101145 - RNA, 63 nt, Homo Sapiens
ccaaaagcuuuuuuguuacacucuggguuauacaguuuugaucgauucugcucuaaaacauug

SEQ ID NO: 101146 - RNA, 63 nt, Homo Sapiens
cgccccagugcccuggagaaggcuggggcggccaguuuugacaccuggcgggugggaaggaau

SEQ ID NO: 101147 - RNA, 63 nt, Homo Sapiens
gcaaguaagucagguuucacaagaaaauuuucaaguuuugaagggaauuugagguugaucugg

SEQ ID NO: 101148 - RNA, 63 nt, Homo Sapiens
caguaauuaaauugcaucccaggagauuuauaaaguuuugauauuuuucccuacucuggaauu

SEQ ID NO: 101149 - RNA, 63 nt, Homo Sapiens
uuuguguagaaaaauaggugcaauaaugaucaaaguuuugaugucuugagucuccaucuuagg

SEQ ID NO: 101150 - RNA, 63 nt, Homo Sapiens
ccuuacgaaauacgucuuuuucagaacuguuaaaguuuugauguacaucgagcugaauucugu

SEQ ID NO: 101151 - RNA, 63 nt, Homo Sapiens
uuccaucccugucaugucuucaguuaucucucgaguuuugaagcugaacaguagcaaaucaga

SEQ ID NO: 101152 - RNA, 63 nt, Homo Sapiens
ugaaguacaggcaaacuugauguuugaaagauaaguuuugagaaaugucauuguauuuuggag

SEQ ID NO: 101153 - RNA, 63 nt, Homo Sapiens
uggaaauaaaaauauuuguuagugaauugguugaguuuugauuccucuaacuucucagaauga

SEQ ID NO: 101154 - RNA, 63 nt, Homo Sapiens
cugggacauuuucauugauauucuauacaccaaaguuuugacgguuuaccaucauuccauuuu

SEQ ID NO: 101155 - RNA, 63 nt, Homo Sapiens
auuuuggccacuuuacauuuagauucuggugagaguuuugacugaauguuccaaucucugaug

SEQ ID NO: 101156 - RNA, 63 nt, Homo Sapiens
aagcaaguaaugucaacuuugagcacuuuguugaguuuugaaaaaucuuauuuguugcugcac

SEQ ID NO: 101157 - RNA, 63 nt, Homo Sapiens
caaugaaagagacauugaaaucgucaccccaaaaguuuugaauuguuaauaagcuucucccuu

SEQ ID NO: 101158 - RNA, 63 nt, Homo Sapiens
auaaacaucuuuuucagaccccucuauuauauuaguuuugaauucaugcuacuuucuguuaca

SEQ ID NO: 101159 - RNA, 63 nt, Homo Sapiens
auaggaaagauuccgccugcaaccaaaaauuccaguuuugagaaagccagcugaucuaguagu

SEQ ID NO: 101160 - RNA, 63 nt, Homo Sapiens
aaagauuuuccuauuccuugaaguuuuauccguaguuuugauacauuguaucaaauuauuuuu

SEQ ID NO: 101161 - RNA, 63 nt, Homo Sapiens
uggaauugcaccauuucguauugugaccuuaccaguuuugaauaugcauuuccuugauucaau

SEQ ID NO: 101162 - RNA, 63 nt, Homo Sapiens
ucacaaauuuacuguaaggcauaggauuuaggaaguuuugaucaguggcuaguaccaucugca

SEQ ID NO: 101163 - RNA, 63 nt, Homo Sapiens
acugugaaauguuuaggaaccuuuuaugugaaaaguuuugagauaagcuuuaauaaucuuccc

SEQ ID NO: 101164 - RNA, 63 nt, Homo Sapiens
aguuacacguaaaguagaagacuaaacuaauaaaguuuugaaacccauggaggcaguucagua

SEQ ID NO: 101165 - RNA, 63 nt, Homo Sapiens
cuuuauaccaaaauucagugaaggcauucuacaaguuuugaguuagcauuacauuuuaauauu

SEQ ID NO: 101166 - RNA, 63 nt, Homo Sapiens
auauuuguuuaauaauaaccuauuucaagucugaguuuugaaaauuuacauuucccaaguauu

SEQ ID NO: 101167 - RNA, 63 nt, Homo Sapiens
gccaacuguggucaaagaauggcuuucaguuaaaguuuugacuucuuauuauaaauaauauaa

SEQ ID NO: 101168 - RNA, 63 nt, Homo Sapiens
gucaccuucccuugcagcuuaaggagcccaguaaguuuugaaaauguuugcgaaucaaacuaa

SEQ ID NO: 101169 - RNA, 63 nt, Homo Sapiens
cucaagagucagcuggcagguuuguugaaauacaguuuugaguuauuuugauguggcuuuuua

SEQ ID NO: 101170 - RNA, 63 nt, Homo Sapiens
augauauuuugaguaauuuuaugcaugaaacaaaguuuugacaggcuuuugaccgugauucau

SEQ ID NO: 101171 - RNA, 63 nt, Homo Sapiens
uacacccucccccuccagggaaugcugaguuccaguuuugagcagaggugaggcagaauccac

SEQ ID NO: 101172 - RNA, 63 nt, Homo Sapiens
aauaguguaucucguggaaucuguagcuguguaaguuuugacagacuauuuaucgucgauacu

SEQ ID NO: 101173 - RNA, 63 nt, Homo Sapiens
ccuuugccugccuggugugcaguuuuaauguauaguuuugaauaagacacaaaugcaugaaca

SEQ ID NO: 101174 - RNA, 63 nt, Homo Sapiens
aguuuuguaagguuuuuguuugaucaguuugcgaguuuugaugagucuuccgagaaacuuuuc

SEQ ID NO: 101175 - RNA, 63 nt, Homo Sapiens
uaaugaaugcauugaaaauaaaauauuccaguaaguuuugaaagcuugcagcaaguaaucuuc

SEQ ID NO: 101176 - RNA, 63 nt, Homo Sapiens
uucaacuucucuccccgugcuuauuccuguuacaguuuugacuuuuggaaagaauuuuuguau

SEQ ID NO: 101177 - RNA, 63 nt, Homo Sapiens
gaguuuuugugguuuugguuccuaaaaaauaccaguuuugaaugacauaugaaaauucaagaa

SEQ ID NO: 101178 - RNA, 63 nt, Homo Sapiens
agugaucacuuuguucugguuccaaaaugucugaguuuugaauucagguuacuaugcugaaau

SEQ ID NO: 101179 - RNA, 63 nt, Homo Sapiens
uuuuuggcccugcauaaguucuaagucaguguuaguuuugaaaggauccuccuucguggucuu

SEQ ID NO: 101180 - RNA, 63 nt, Homo Sapiens
cuagguuaauaacacuuuaugucauuucuagacaguuuugaauaagggcuucauuccuuuuau

SEQ ID NO: 101181 - RNA, 63 nt, Homo Sapiens
gacuuccucuuggcucccagaucuuucccuucuaguuuugagauggauugauacggggaaaac

SEQ ID NO: 101182 - RNA, 63 nt, Homo Sapiens
gguuuuuuauauauccuagacuuuuuacuauugaguuuugagauucuauuuaggucauuuguu

SEQ ID NO: 101183 - RNA, 63 nt, Homo Sapiens
aauugauauacccauguaacauacaauucagugaguuuugauaaaaauguuccuacuuuaaau

SEQ ID NO: 101184 - RNA, 63 nt, Homo Sapiens
ucaggaacagauccaaaguucuuuucuccuaguaguuuugaauguccuuuuuuauaaaggaca

SEQ ID NO: 101185 - RNA, 63 nt, Homo Sapiens
agcaggaagcucaugggggcuguuuugccuguuaguuuugagguugcuuucuaggagguuugu

SEQ ID NO: 101186 - RNA, 63 nt, Homo Sapiens
cccgauuaaugucuguacguuuuacacgacuugaguuuugaacggacccaacaacuaaccacg

SEQ ID NO: 101187 - RNA, 63 nt, Homo Sapiens
ugugccuaaggcugcuugaucuauuucuauaacaguuuugaucuuaaaagcuuugugauugca

SEQ ID NO: 101188 - RNA, 63 nt, Homo Sapiens
gacaaggcacaaauacuuucagaauuguauuucaguuuugaagauuuaaaaaaaaugugaaaa

SEQ ID NO: 101189 - RNA, 63 nt, Homo Sapiens
acugugugggauacuuagugguaugucucuuuaaguuuugauuaauguuucuuaaauggaauu

SEQ ID NO: 101190 - RNA, 63 nt, Homo Sapiens
uuccugaggccucaguauuagucgugagcacaaaguuuugagaccuuuggcguuguuucuuga

SEQ ID NO: 101191 - RNA, 63 nt, Homo Sapiens
uuccaaaccaguuuauucugugguucuauaauaaguuuugauauaaucuuggcuucuuaaaaa

SEQ ID NO: 101192 - RNA, 63 nt, Homo Sapiens
gggucuugagguggguacccacaagagcugggcaguuuugaauccacauuauucucugugggg

SEQ ID NO: 101193 - RNA, 63 nt, Homo Sapiens
uucaauaucugauagauacaguucccauccuuaaguuuugauaguaauuggauuucgcuauca

SEQ ID NO: 101194 - RNA, 63 nt, Homo Sapiens
aacauuucauucuugaacgccauuugauagaacaguuuugagguuuauguccaauagcuacua

SEQ ID NO: 101195 - RNA, 63 nt, Homo Sapiens
ugaaaaucaauuuaccuuucgcuuuacacaggcaguuuugaaagugguccaggauucuguaau

SEQ ID NO: 101196 - RNA, 63 nt, Homo Sapiens
augggcaaauccccucuuuuaguuuuucaauaaaguuuugauuuaaucuccuauuuugguguc

SEQ ID NO: 101197 - RNA, 63 nt, Homo Sapiens
ccauguguaaaguuuaaccaaaaauuguccuucaguuuugagggguauauugaagacgaaauu

SEQ ID NO: 101198 - RNA, 63 nt, Homo Sapiens
ucuaaaugucaauuuucuacauuuuguaauauaaguuuugaaagcuuaagacugcugcugaua

SEQ ID NO: 101199 - RNA, 63 nt, Homo Sapiens
uuuuaaagauaugucuguauugaagagaaagccaguuuugaguuuuuuacacuugcacaucau

SEQ ID NO: 101200 - RNA, 63 nt, Homo Sapiens
auuaaacuuuuuuuuuucaguuuauggaccaagaguuuugauuuauuuaggguggaguucagg

SEQ ID NO: 101201 - RNA, 63 nt, Homo Sapiens
agagagagugugugauuagaagcuaaauaggaaaguuuugagcuucaagucagugaggaguaa

SEQ ID NO: 101202 - RNA, 63 nt, Homo Sapiens
ucgaauauaguucuguguagagaaugucacuguaguuuugaguguauacaugugugggugcug

SEQ ID NO: 101203 - RNA, 63 nt, Homo Sapiens
ugcaucacuuaguuauugggauuagaucgagucaguuuugaucagaacugcuccuugguggcc

SEQ ID NO: 101204 - RNA, 63 nt, Homo Sapiens
uuuuggccauuuucucuuuauuucaacaaugguaguuuugagguuguguccuuuuaauauugu

SEQ ID NO: 101205 - RNA, 63 nt, Homo Sapiens
uuuagauuccugagagaugucucuggaagggaaaguuuugagaacuaauggcuauuuuugagg

SEQ ID NO: 101206 - RNA, 63 nt, Homo Sapiens
aaaucacagaaaauugucagauuucuucgggaaaguuuugauccgagugcuuuuuugguacca

SEQ ID NO: 101207 - RNA, 63 nt, Homo Sapiens
cuguaugcaucuaauuucauuugcguaauacauaguuuugagccauaagcagguucuuuaugu

SEQ ID NO: 101208 - RNA, 63 nt, Homo Sapiens
aucuauauguauauguauauuuaaucaaccagcaguuuugaaacuagucauccugguacaaaa

SEQ ID NO: 101209 - RNA, 63 nt, Homo Sapiens
aaagccuucuuggaaaaugggacauuagcauugaguuuugaaagaugaguaggaguuugcuaa

SEQ ID NO: 101210 - RNA, 63 nt, Homo Sapiens
uauuuuuauaacgugguucuuauuuaacugucuaguuuugauagaauuuaccaggucuggcug

SEQ ID NO: 101211 - RNA, 63 nt, Homo Sapiens
gcuaaauuuguauucucugugaauuucacuggcaguuuugaacuucccuuccuuaaaguacuc

SEQ ID NO: 101212 - RNA, 63 nt, Homo Sapiens
gugcccaagucauuucagaaagaaagacccuucaguuuugaugcauuuugcugaacacuuggg

SEQ ID NO: 101213 - RNA, 63 nt, Homo Sapiens
cuaacucaaucccugguacauuccuaauaaagcaguuuugaggaaaaucaacagacucuuuuu

SEQ ID NO: 101214 - RNA, 63 nt, Homo Sapiens
gcaacuauggguuugcaguuuucugaguaggugaguuuugaauauggguaaaucagaauaaug

SEQ ID NO: 101215 - RNA, 63 nt, Homo Sapiens
gccauuugaauguuaggaagcuucggggagacaaguuuugagagaagccccagagggagcuau

SEQ ID NO: 101216 - RNA, 63 nt, Homo Sapiens
gagcaucucuguuugguaaggaggacaauugucaguuuugagggggacauguguuaaaucaca

SEQ ID NO: 101217 - RNA, 63 nt, Homo Sapiens
gaaggagagaugaccccuacccccucaucccccaguuuugaaaaggucuaagcaagugagucu

SEQ ID NO: 101218 - RNA, 63 nt, Homo Sapiens
gugcuucauaucauguaccuauuuaauguauucaguuuugacuuaucauucgccucuauaaca

SEQ ID NO: 101219 - RNA, 63 nt, Homo Sapiens
gacuguaguauggauggguuccuagaaauguccaguuuugaguguaacuacuuuggcucuacc

SEQ ID NO: 101220 - RNA, 63 nt, Homo Sapiens
ggugaggggaccagagcagucugguccaucuggaguuuugaggggcagugccguuccggaggc

SEQ ID NO: 101221 - RNA, 63 nt, Homo Sapiens
uucugagguuugcuuugguugcuuuuuuauuuuaguuuugauguuuguuuugcuucauuuuau

SEQ ID NO: 101222 - RNA, 63 nt, Homo Sapiens
cuuaaccccauggacuccuugccagcccuggucaguuuugauuacaacaugccaucuauaguu

SEQ ID NO: 101223 - RNA, 63 nt, Homo Sapiens
gauuuugcaguaaagaccuguugcugccgugugaguuuugaauuuugcaauguauugaaggaa

SEQ ID NO: 101224 - RNA, 63 nt, Homo Sapiens
ucucugcuuaacacucaagaguaaauacuugguaguuuugacauuuugcuuucaggauuuggc

SEQ ID NO: 101225 - RNA, 63 nt, Homo Sapiens
guaaaaauuuuugguugugcaaaagugagagguaguuuugauauguuuucagucagauuucug

SEQ ID NO: 101226 - RNA, 63 nt, Homo Sapiens
cauugcauuuaaguucccuauugcaguccuauuaguuuugagcaccuuguuugaagcuguuau

SEQ ID NO: 101227 - RNA, 63 nt, Homo Sapiens
aaguaauucauacaaaguacuggcccauucuugaguuuugauacaggugugagccacagugcc

SEQ ID NO: 101228 - RNA, 63 nt, Homo Sapiens
uacguuuucuauuucaugugaucucauauauauaguuuugaaaagguagaaaaugugaaauaa

SEQ ID NO: 101229 - RNA, 63 nt, Homo Sapiens
ucagcauguuagacaacuacacaguauguuguuaguuuugaaagacauucacucaaggaaaac

SEQ ID NO: 101230 - RNA, 63 nt, Homo Sapiens
auuguuaagcugcaguugaguuguucaagugagaguuuugauaagccacuuaugggccgcguu

SEQ ID NO: 101231 - RNA, 63 nt, Homo Sapiens
uuccugaaauuaaaaaaguuacaguauauauggaguuuugaacggaaaccuauuguugauauu

SEQ ID NO: 101232 - RNA, 63 nt, Homo Sapiens
ggucagugucccagacauuuugagccaggggccaguuuugacauauauuugaugggaacccag

SEQ ID NO: 101233 - RNA, 63 nt, Homo Sapiens
uaaacacuuuucaguuucuuuuuacuagacugaaguuuugaaguuuaugauucauaauuucag

SEQ ID NO: 101234 - RNA, 63 nt, Homo Sapiens
aaaaagacauuuuuuaaaagggcacugugauacaguuuugaguuuaucuauuagauaaucaag

SEQ ID NO: 101235 - RNA, 63 nt, Homo Sapiens
caugagagucauacagagcguugaauaaaaaauaguuuugaagcuagggccauuguaagucac

SEQ ID NO: 101236 - RNA, 63 nt, Homo Sapiens
uauaguuugucauccugugauuugcuuuuuuucaguuuugaaacaggagugagauauaaacau

SEQ ID NO: 101237 - RNA, 63 nt, Homo Sapiens
uuuagaccucagccuuuuguaaacuguuauacuaguuuugagcugacagccaacuaauacagu

SEQ ID NO: 101238 - RNA, 63 nt, Homo Sapiens
uuuuuccccucauucaucucuaguuuugaaaggaguuuugacuuuuuucugaugcuuugaaua

SEQ ID NO: 101239 - RNA, 63 nt, Homo Sapiens
ggaguuuugacuuuuuucccaugcuuugaauauaguuuugaaaagaaaaaaaaauuuuuucug

SEQ ID NO: 101240 - RNA, 63 nt, Homo Sapiens
uuuggucauagagucuucauguuccuuaaaaucaguuuugaacuuccugucuugcuucacaca

SEQ ID NO: 101241 - RNA, 63 nt, Homo Sapiens
uuccuugcaacuuagccaugaauucuuuuucaaaguuuugaagcucucacuucucagggauga

SEQ ID NO: 101242 - RNA, 63 nt, Homo Sapiens
aaacagguuuguuuuuuauuucuuuacacugccaguuuugacaauacacuuccagugcugccu

SEQ ID NO: 101243 - RNA, 63 nt, Homo Sapiens
gugguucccgacuucuuugcagauuuuaaaaucaguuuugaaaaguaugucuucagcuugauc

SEQ ID NO: 101244 - RNA, 63 nt, Homo Sapiens
uccaucuuccaggagagacgcaccuccggaugcaguuuugauguuccuucugggugcagacug

SEQ ID NO: 101245 - RNA, 63 nt, Homo Sapiens
ggaccaggaugacaccuccauuucucuccaggaaguuuugaguuucucuccaccgugacacaa

SEQ ID NO: 101246 - RNA, 63 nt, Homo Sapiens
uuuaaguucuuuugucaccaaauauuaauaaacaguuuugacuucacaccaagguuggauaaa

SEQ ID NO: 101247 - RNA, 63 nt, Homo Sapiens
gaacugggcagacaccccuggagcucagccgacaguuuugaugagcagggaagucugaggccc

SEQ ID NO: 101248 - RNA, 63 nt, Homo Sapiens
cuggggguagaugagacccuacuacugaacuccaguuuugaucucgugacuuuuagaaaaaca

SEQ ID NO: 101249 - RNA, 63 nt, Homo Sapiens
uagauuugaugggugugaagauuaugagaguaaaguuuugaagacucagggauagcuguaaug

SEQ ID NO: 101250 - RNA, 63 nt, Homo Sapiens
ccgugugugcauauuuguugguucucugauuaaaguuuugagucuaaaagcauugguuccuuc

SEQ ID NO: 101251 - RNA, 63 nt, Homo Sapiens
uccgugggggaaugucauggucuugcuuuacuaaguuuugagacuggcagguagugaaacuca

SEQ ID NO: 101252 - RNA, 63 nt, Homo Sapiens
gcucuguugauuguguccuuugaugaaauuuuaaguuuugauguacuguugacucuuucuguc

SEQ ID NO: 101253 - RNA, 63 nt, Homo Sapiens
agcccuguauucuuggcuguacccgucgaauggaguuuugaucucgcugaguuuggaguuggg

SEQ ID NO: 101254 - RNA, 63 nt, Homo Sapiens
gacaguggguugagggagaacaguucuuaguccaguuuugauguuaacuuccauagcugacaa

SEQ ID NO: 101255 - RNA, 63 nt, Homo Sapiens
cucacaucacccacugugcaggucuggaggcguaguuuugaaagacagcugggaggguuucuc

SEQ ID NO: 101256 - RNA, 63 nt, Homo Sapiens
ugucugucccuccucccuggggccuucuguaauaguuuugagaaccccaccccucguccucuc

SEQ ID NO: 101257 - RNA, 63 nt, Homo Sapiens
uacauauaguuaaauauaugcaugcagacauuuaguuuugauuuuccugucugccugcaaaca

SEQ ID NO: 101258 - RNA, 63 nt, Homo Sapiens
guuguauuccaaaggccucagagcggcaagaugaguuuugagcaccuugugagcagaaggcaa

SEQ ID NO: 101259 - RNA, 63 nt, Homo Sapiens
uuacaguaaaaguugugaacuuaagucaguagaaguuuugaacaacuuguuuagcacccguuu

SEQ ID NO: 101260 - RNA, 63 nt, Homo Sapiens
ucccaggcucaagcgauccuuccggcucacugcaguuuugaccgcuggagugcaguguugcag

SEQ ID NO: 101261 - RNA, 63 nt, Homo Sapiens
cuaaccuguucagagccaggaaggagacugcacaguuuugaaagcacagcccgucagguccgg

SEQ ID NO: 101262 - RNA, 63 nt, Homo Sapiens
aagcaacuuaucagcuacuuaagagaaauggcaaguuuugauaugaguauacaauauauaaaa

SEQ ID NO: 101263 - RNA, 63 nt, Homo Sapiens
cuuuguucuugaacacuuuugcccugcagccucaguuuugaauucuuuuagcaacuuggauua

SEQ ID NO: 101264 - RNA, 63 nt, Homo Sapiens
aaugacugcuauggugggaacacaauaaacaccaguuuugacuuuuagugcauaguuguccuu

SEQ ID NO: 101265 - RNA, 63 nt, Homo Sapiens
cagauuggucacauaaaugccacggcauuccgaaguuuugauuuugauuaacauugacaggau

SEQ ID NO: 101266 - RNA, 63 nt, Homo Sapiens
uccucuugggguuuuguaccaucugaugcuggaaguuuugauuagugauauuuucuacuacua

SEQ ID NO: 101267 - RNA, 63 nt, Homo Sapiens
uuugcuuucuuauuucucuuucucugcguuguuaguuuugaagaguggaggagcuaggggcuc

SEQ ID NO: 101268 - RNA, 63 nt, Homo Sapiens
ucuucgaccgauuugugggacacauggucuugcaguuuugaacgcagauuuucucacugguau

SEQ ID NO: 101269 - RNA, 63 nt, Homo Sapiens
auuuauaguacuuugaugucuuuucuguacgauaguuuugauauuuugcaacgaauuuguaau

SEQ ID NO: 101270 - RNA, 63 nt, Homo Sapiens
agcuggcuuacacuggcaaucuguguuaauuuaaguuuugacaccguugcugacuuagaaucc

SEQ ID NO: 101271 - RNA, 63 nt, Homo Sapiens
uauagaugcuaugguucagauaauacucuugccaguuuugaaaagggccacaaggugcagggu

SEQ ID NO: 101272 - RNA, 63 nt, Homo Sapiens
ucaaauauauuucucuuucaaggauaugugcugaguuuugaugucacguguauauauagacca

SEQ ID NO: 101273 - RNA, 63 nt, Homo Sapiens
aaacuguauuuguaaaaaaagauguaugucccaaguuuugauguacugaaaagaaaugaaguu

SEQ ID NO: 101274 - RNA, 63 nt, Homo Sapiens
uucuagccacucgagcucauaaaaccugagcacaguuuugaaguuuuuauaacuuccaaaaca

SEQ ID NO: 101275 - RNA, 63 nt, Homo Sapiens
guagucggauuccggggaaaagaacaaguaucuaguuuugaugacaauguuuucuuguaagaa

SEQ ID NO: 101276 - RNA, 63 nt, Homo Sapiens
acuagguuuacagucccuuauuuuuaaugccuaaguuuugacagcaggaagaaaacaauuuuu

SEQ ID NO: 101277 - RNA, 63 nt, Homo Sapiens
guuuaauguccuguucuuaagcucguuagagccaguuuugaaacguuuggucuuaccgugaac

SEQ ID NO: 101278 - RNA, 63 nt, Homo Sapiens
gaggaaaaugugcucaauuauuuccucauauuuaguuuugaaugguuccguuuuacggagauu

SEQ ID NO: 101279 - RNA, 63 nt, Homo Sapiens
uuauauauguuauugaacaauuucauaccugccaguuuugaaucaaaaaacaaaguaaccuuu

SEQ ID NO: 101280 - RNA, 63 nt, Homo Sapiens
uacgguuauuuaaaaacuaauauaggaugugaaaguuuugaauugcuucuuggggaaaaauag

SEQ ID NO: 101281 - RNA, 63 nt, Homo Sapiens
uugauaagaaacugggauaaauugggacuuaggaguuuugauuguuuuaugguacuuguugga

SEQ ID NO: 101282 - RNA, 63 nt, Homo Sapiens
ggcauugcuuuaaaggaaaauuacagugaacagaguuuugaaauuaccaaagagcugccaagg

SEQ ID NO: 101283 - RNA, 63 nt, Homo Sapiens
uauuucucuuuggaugaauacauuguuaacuggaguuuugaugaaauaaggaaaaacccuucu

SEQ ID NO: 101284 - RNA, 63 nt, Homo Sapiens
uacagggccagucuacauuauggcuuuaaggacaguuuugaucagggcuucaucuucacuuga

SEQ ID NO: 101285 - RNA, 63 nt, Homo Sapiens
ccacgcagaccuugggugggguucuuauucuugaguuuugauaaugguggugguuuggcuucu

SEQ ID NO: 101286 - RNA, 63 nt, Homo Sapiens
uaacauaccguuuauaaugcauagaaacaacacaguuuugaccacugggaugaaacuaaagca

SEQ ID NO: 101287 - RNA, 63 nt, Homo Sapiens
gagcacuuuauuuucgucaaaaccugcugugagaguuuugacaaucuccuuguuccagcugaa

SEQ ID NO: 101288 - RNA, 63 nt, Homo Sapiens
cacaaaccuucuuuucaaugcaaugcaucugaaaguuuugauacuuguaacuuuuuuuuuuuu

SEQ ID NO: 101289 - RNA, 63 nt, Homo Sapiens
aaguugaaauggguauguaaguugaaaaccagaaguuuugagaaacauccuuuguuaacuuuc

SEQ ID NO: 101290 - RNA, 63 nt, Homo Sapiens
accuuccaaaacaaaaauaaagaccuguccaaaaguuuugacaaaaauacugauugcucccaa

SEQ ID NO: 101291 - RNA, 59 nt, Homo Sapiens
cgagccgagaacggucgugaguacuguggaguuuugagggauggcaccguccaggccgc

SEQ ID NO: 101292 - RNA, 63 nt, Homo Sapiens
aauaaacaugggaaagccauggccauuaugccuaguuuugauggcugaucagaagcucagcau

SEQ ID NO: 101293 - RNA, 63 nt, Homo Sapiens
ucuggaauuccucugcccccuccugcgccuuuuaguuuugaacuagaaugaaaugacuuugau

SEQ ID NO: 101294 - RNA, 63 nt, Homo Sapiens
augcugggaaaagugacugccuggcuucuuaagaguuuugaugcagagauuggguccuugggc

SEQ ID NO: 101295 - RNA, 63 nt, Homo Sapiens
ucaucuuaaauuucaaaccauuuaccaucugaaaguuuugauuugaauguaaaacaggaaauu

SEQ ID NO: 101296 - RNA, 63 nt, Homo Sapiens
uuaccuguggaguugcauauccaaaccuuagugaguuuugaagcuuuaagcaaauucuuuuaa

SEQ ID NO: 101297 - RNA, 63 nt, Homo Sapiens
acauuuauuggugcugccagcuuuaagcauaugaguuuugauauucuauauuuuucaaauccu

SEQ ID NO: 101298 - RNA, 63 nt, Homo Sapiens
cugcucuuuaccuugcauuuuagcuaauuuaggaguuuugagaauguauuggauacgcuccag

SEQ ID NO: 101299 - RNA, 63 nt, Homo Sapiens
uguuaaagggcaagaaaaaagggaggggguuggaguuuugaacguaguaagccuuaccuuaau

SEQ ID NO: 101300 - RNA, 63 nt, Homo Sapiens
uuggcagaaagacauuuuucuccucaguagcauaguuuugauguuagugaggaacauuguuga

SEQ ID NO: 101301 - RNA, 63 nt, Homo Sapiens
gaccacuugcugucucuguuguauuuugguaugaguuuugauagcucuauaaaauguuuugga

SEQ ID NO: 101302 - RNA, 63 nt, Homo Sapiens
uguuuauaugguaaaggaauccuuucagcugccaguuuugaauaaugaauaucauauuguauc

SEQ ID NO: 101303 - RNA, 63 nt, Homo Sapiens
caagguaacagaauugcugacaucugucuaaaaaguuuugacuauccaauuuagauguguaau

SEQ ID NO: 101304 - RNA, 63 nt, Homo Sapiens
caaaauguugauaucauaggugauguacaauuuaguuuugaaugaguuauuauguuaucacug

SEQ ID NO: 101305 - RNA, 63 nt, Homo Sapiens
cuacagccaguaagugauaaaucuagaaaauugaguuuugaguaccucuuuucccauauacaa

SEQ ID NO: 101306 - RNA, 63 nt, Homo Sapiens
gucuuuaaaacauagugauuacaauauuuagaaaguuuugagcacuugcuauaaguuuuuuaa

SEQ ID NO: 101307 - RNA, 63 nt, Homo Sapiens
uguugauaauuuuuagaagcaaauuuuccugaaaguuuugaguagaggugagacccccucccc

SEQ ID NO: 101308 - RNA, 63 nt, Homo Sapiens
uguauuucaguaguuguagaauuauugauauuuaguuuugauagcuaauguuuaauuguuugg

SEQ ID NO: 101309 - RNA, 63 nt, Homo Sapiens
guuauaagguggaaggaaaccauuuuucaggaaaguuuugagucauuuuuucauuucucuucu

SEQ ID NO: 101310 - RNA, 63 nt, Homo Sapiens
augcacaaaauaaacagcaguaguagaaacuuuaguuuugaugauaaacaccgaggcuuacug

SEQ ID NO: 101311 - RNA, 63 nt, Homo Sapiens
uuuauuuaugcuaauauuuuuauaagugugaccaguuuugauaaauauguuuuauucagcuuc

SEQ ID NO: 101312 - RNA, 63 nt, Homo Sapiens
auaugugaauacacaaauuuauuucagaagggcaguuuugauuuaaaauaaauacaaauguuu

SEQ ID NO: 101313 - RNA, 63 nt, Homo Sapiens
uuauuuuuuuaauaaaauuuagauuugcugaacaguuuugaugauuuugguuacauugaauac

SEQ ID NO: 101314 - RNA, 63 nt, Homo Sapiens
gguucuuaaauccucauaucuggaaacuugugaaguuuugacaccuuuccuauagauauagga

SEQ ID NO: 101315 - RNA, 63 nt, Homo Sapiens
aaaauguccaacauacaguuuuuaaaguguggcaguuuugaguaguaacuuagaauguauaag

SEQ ID NO: 101316 - RNA, 63 nt, Homo Sapiens
uccaggguuugggcuugauuccuguugaauaauaguuuugagcauucuuugugguuaaauaaa

SEQ ID NO: 101317 - RNA, 63 nt, Homo Sapiens
ucuuugugguuaaauaaauucuuaaaucugccuaguuuugaugaauucuuuugugaaacuuga

SEQ ID NO: 101318 - RNA, 64 nt, Homo Sapiens
gcgggacugaggcugccucacguguugcaagaacaguuuugagccauuguuaacaaugccuuuu

SEQ ID NO: 101319 - RNA, 64 nt, Homo Sapiens
cuuuccuaccagcccagagccuuguggcuuguacaguuuugaaacucccguucuauuuuaugau

SEQ ID NO: 101320 - RNA, 64 nt, Homo Sapiens
caaagugaaaauuuuuuuuuuucuuuugaaaucuaguuuugaauaagucugggugaccgcaccu

SEQ ID NO: 101321 - RNA, 64 nt, Homo Sapiens
cacguuucuacccagauccuuuuucauuuccuuaaguuuugaucuccgucuuccugaugaagca

SEQ ID NO: 101322 - RNA, 64 nt, Homo Sapiens
acaaugggugggggcuauucuuuugcuaucaggaaguuuugaggagcaggcagaguggagaaag

SEQ ID NO: 101323 - RNA, 64 nt, Homo Sapiens
cuggauugauguggagaaaacaccuuucccuucuaguuuugagagacuuccucuuggcucccag

SEQ ID NO: 101324 - RNA, 64 nt, Homo Sapiens
agcaacuuguacaguggcugagaaaauaggauauaguuuugauuuuuuuaauuguaaaauauuu

SEQ ID NO: 101325 - RNA, 64 nt, Homo Sapiens
gaaaguuaaugagguuuuuaaaauaagguuuucuaguuuugagagugugcacuucacacagggg

SEQ ID NO: 101326 - RNA, 64 nt, Homo Sapiens
agguucugaaguaaaggcuuguuaaguuucucuuaguuuugauuugaggcaucccguaaaguug

SEQ ID NO: 101327 - RNA, 64 nt, Homo Sapiens
aauauuuauagugagauugugaaagcaaccuuaaaguuuugaagaagacugaugagacuaggug

SEQ ID NO: 101328 - RNA, 64 nt, Homo Sapiens
caagugguaauaaacaugaaaacugguuuguagcaguuuugaaagaauagaaugcauucaaaug

SEQ ID NO: 101329 - RNA, 64 nt, Homo Sapiens
agacuuuggacaguggccucuugaguuccucugcaguuuugacauuuaggauuuugugucuuuu

SEQ ID NO: 101330 - RNA, 64 nt, Homo Sapiens
gcaaacuacuacuacuacuguucaguuuuuuaaaaguuuugaaaugcugcacuuacauuuaaaa

SEQ ID NO: 101331 - RNA, 64 nt, Homo Sapiens
uuggccauaugcuagggccccugugaaaauaaguaguuuugagaaguuuuucuauauacguaua

SEQ ID NO: 101332 - RNA, 64 nt, Homo Sapiens
uggucugauaccuaaggagccugguucaguagaaaguuuugaauuuaaaccagaaccuucuaaa

SEQ ID NO: 101333 - RNA, 64 nt, Homo Sapiens
agaguacagaaugacaacauugagcccacacugcaguuuugaagauaguaacugauggcuggug

SEQ ID NO: 101334 - RNA, 64 nt, Homo Sapiens
auuucuucuuuggguauaggguugaggggaaauaaguuuugagugagaaauaaacguuuuagcu

SEQ ID NO: 101335 - RNA, 64 nt, Homo Sapiens
auccauuugucccauuaguugcuguggauuaucaaguuuugaaggaacuguacaucccaacaga

SEQ ID NO: 101336 - RNA, 64 nt, Homo Sapiens
ugcucaugucauuuuucucauggucacauuuaacaguuuugacauguuauacuugcgcauagau

SEQ ID NO: 101337 - RNA, 64 nt, Homo Sapiens
aagucugucuagucauuguaaauauuuaucugucaguuuugacagauuggggccagcuugaugu

SEQ ID NO: 101338 - RNA, 64 nt, Homo Sapiens
uuuuuaaaucuugcaauuguaugugugauuauggaguuuugaaaacguuacauuuuuuaaaucu

SEQ ID NO: 101339 - RNA, 64 nt, Homo Sapiens
agggucacagaccucccucccaucugggugccugaguuuugacuccaaucagugauaccagacc

SEQ ID NO: 101340 - RNA, 64 nt, Homo Sapiens
gaaccaaugacuacuuaggauggguuguggaauaaguuuugauguggaauugcacaucuaccuu

SEQ ID NO: 101341 - RNA, 64 nt, Homo Sapiens
ugucuaauguaugugcacauauaaguaauacaaaaguuuugagcucuuccaaguauaccauuua

SEQ ID NO: 101342 - RNA, 64 nt, Homo Sapiens
aauuguguacagugguuauuuuccccaguuguauaguuuugagacauucaauuaucacugucuu

SEQ ID NO: 101343 - RNA, 64 nt, Homo Sapiens
aagucuagcauuuacuuuuaaauaauuauaaugaaguuuugaaauacuaaguuaauccagaccu

SEQ ID NO: 101344 - RNA, 64 nt, Homo Sapiens
gcaugacaaccagacauuuccaguugguuuuguaaguuuugagaaucuagauacuggguuuuau

SEQ ID NO: 101345 - RNA, 64 nt, Homo Sapiens
gcccggccgcgccccgcgcccagcgugcacgaggaguuuugagcaagcugguggacuacgcgcg

SEQ ID NO: 101346 - RNA, 64 nt, Homo Sapiens
auauuuucuauuaaaguggcaacucuuguaaucgaguuuugaucugguuuucuaugucuuuuug

SEQ ID NO: 101347 - RNA, 64 nt, Homo Sapiens
uuuaacuaaacgcaaaucugauuuccuaugcuggaguuuugauuaccggcuaugugaacugccu

SEQ ID NO: 101348 - RNA, 64 nt, Homo Sapiens
acguaaagaacuuuuucuuuucaugaaaguagacaguuuugagaaugguguggacugaauggga

SEQ ID NO: 101349 - RNA, 64 nt, Homo Sapiens
aaggaugguauagaaaacaauugugccacaugcaaguuuugaaucuuggugccaccaacccauu

SEQ ID NO: 101350 - RNA, 64 nt, Homo Sapiens
agcaaauaaacagcauucuuuaauuuuucccacaaguuuugauccucccaauauuuuuuuacuu

SEQ ID NO: 101351 - RNA, 64 nt, Homo Sapiens
ugaagcuguacuccccauuuggcuccuucaucccaguuuugagaugggcagggacuacagggaa

SEQ ID NO: 101352 - RNA, 64 nt, Homo Sapiens
gcacuuaaccggaggagggcguguuaggggcagaaguuuugaaucaaguaggacaugacuagga

SEQ ID NO: 101353 - RNA, 64 nt, Homo Sapiens
uauuucuaagccuuuuggguuugggccucuuucuaguuuugaaugccauagguagccuuacuac

SEQ ID NO: 101354 - RNA, 64 nt, Homo Sapiens
ccugcuaaaugaagagacuuuagaaaauaaggcaaguuuugaagcccagagaagcucauuuagu

SEQ ID NO: 101355 - RNA, 64 nt, Homo Sapiens
auacucugcacuuuucaauuaacaguaggaugacaguuuugaguauugcagggaagacugagaa

SEQ ID NO: 101356 - RNA, 64 nt, Homo Sapiens
aauuuuuuuuuccaguaaugcauucauuacuaaaaguuuugagaccaauugcugcuuguacacu

SEQ ID NO: 101357 - RNA, 64 nt, Homo Sapiens
ucuuuuuacuugaauuucaaaccagagagaaaugaguuuugacgguuuuuauucuguuuuauaa

SEQ ID NO: 101358 - RNA, 64 nt, Homo Sapiens
uuauuuaaguguggggaugaauaggugaccucuuaguuuugaacuaauggaaaacauaaguaga

SEQ ID NO: 101359 - RNA, 64 nt, Homo Sapiens
cuaguuucucauaaaauucuuucauauauuuuauaguuuugaaaacuugaaccaauguuuuuau

SEQ ID NO: 101360 - RNA, 64 nt, Homo Sapiens
uuggaaagauguuaagcauuaaguguucgucuuuaguuuugauuacacuuccacccuuuuuucu

SEQ ID NO: 101361 - RNA, 64 nt, Homo Sapiens
gauaggcaaaaaaaaaaaagaauacccagugcucaguuuugaaaaugacauggcuuauguuaaa

SEQ ID NO: 101362 - RNA, 64 nt, Homo Sapiens
auacuuauauuuucguaugaaaaugaguugugaaaguuuugaguagauauuacuuuaucacuuu

SEQ ID NO: 101363 - RNA, 64 nt, Homo Sapiens
guuuugugauuuuauuugugcaggucaugcacacaguuuugauaaagggcaguaacaaguauug

SEQ ID NO: 101364 - RNA, 64 nt, Homo Sapiens
acugaaaccugaauuggauacugccagaauagguaguuuugaaacaaguuaaggacaugguaua

SEQ ID NO: 101365 - RNA, 64 nt, Homo Sapiens
cugaaguagaaauagcaauuaagaaauuaauucaaguuuugacgguuaacauuuagcagaaaaa

SEQ ID NO: 101366 - RNA, 52 nt, Homo Sapiens; identical to SEQ ID NO: 100853

SEQ ID NO: 101367 - RNA, 64 nt, Homo Sapiens
ggcuguacaagugaagacaagggcuuuuuaugcaaguuuugaaagauagguauuuauuuuuucu

SEQ ID NO: 101368 - RNA, 64 nt, Homo Sapiens
gagcaggauaugugauacugugugguugguguggaguuuugaagaaggggcuguguuugggcca

SEQ ID NO: 101369 - RNA, 64 nt, Homo Sapiens
gcaugaaucaaggugguggcagcaaacuucuaguaguuuugauauguccuugauagaacaaaua

SEQ ID NO: 101370 - RNA, 64 nt, Homo Sapiens
cuucaaugaacaaagggauucuccaggauuccaaaguuuugaagucaucuuagcuuuccacagg

SEQ ID NO: 101371 - RNA, 64 nt, Homo Sapiens
agcagggaagggaagcagaucuagggaggaaggcaguuuugauuugaggagguuugcacaugua

SEQ ID NO: 101372 - RNA, 64 nt, Homo Sapiens
auauucuaacauugcacaaguugaugagauaucaaguuuugaauauuauucaggaagcacuuug

SEQ ID NO: 101373 - RNA, 64 nt, Homo Sapiens
gaugugaaaaagccuaagaaaaaggaaauuggacaguuuugauacaaacuuuguuugcuaaugc

SEQ ID NO: 101374 - RNA, 64 nt, Homo Sapiens
cuuagucccccuggucugaacuaguugagagaguaguuuugaacagucguaaccguggcuggug

SEQ ID NO: 101375 - RNA, 64 nt, Homo Sapiens
uguauuucaggcuggaaaugaauuauucuuuaccaguuuugaaacacuuugaaauauccuaagg

SEQ ID NO: 101376 - RNA, 64 nt, Homo Sapiens
gccuuuugaagauacacaaaacacugaggauuuuaguuuugaaaucaaagacuauuaaaggagc

SEQ ID NO: 101377 - RNA, 64 nt, Homo Sapiens
gaccaauaucaauagacuucuugaggcuacuauaaguuuugagaaauaagguucaaaaaauaag

SEQ ID NO: 101378 - RNA, 64 nt, Homo Sapiens
auccagggggaaaugcuggaagucaauaaaacugaguuuugagagcuuggugguguguuguguu

SEQ ID NO: 101379 - RNA, 64 nt, Homo Sapiens
cagaguguuguaguuuuaagguuagcgugacuucaguuuugacuaaggaugacacuaauuguua

SEQ ID NO: 101380 - RNA, 64 nt, Homo Sapiens
ugucuuuguaagaguaggguacuuaauuacugcuaguuuugaaaggauuuggggggaccaugua

SEQ ID NO: 101381 - RNA, 64 nt, Homo Sapiens
uuguuggaacauucaaaggacauucagaaaaugaaguuuugaauuaguucgcauuuauguaaaa

SEQ ID NO: 101382 - RNA, 64 nt, Homo Sapiens
ucaacuaucauaagugaaaacuuuggccucacaaaguuuugauugaauugaagauuauucauug

SEQ ID NO: 101383 - RNA, 64 nt, Homo Sapiens
guugugcucuuucauacagacugaauuuuguuguaguuuugaauauuagcuaaggaacucaugu

SEQ ID NO: 101384 - RNA, 64 nt, Homo Sapiens
cuagaacaaggucgcuucucuaacuuuggaaaacaguuuugacaacuguuaaauugaacguaaa

SEQ ID NO: 101385 - RNA, 64 nt, Homo Sapiens
augaggauucaccuagacuuuguuuucaauaugcaguuuugaaaacuugaauaaguaguuuuca

SEQ ID NO: 101386 - RNA, 64 nt, Homo Sapiens
uucaaauguucugcuucauggaaucuuguauuuaaguuuugauuuaaauugccauucacuuuua

SEQ ID NO: 101387 - RNA, 64 nt, Homo Sapiens
acagauuugguaucauucuacuauauuguauuacaguuuugaaaaauaguuugcaagcagauuu

SEQ ID NO: 101388 - RNA, 64 nt, Homo Sapiens
gacauuguaucgcagaggccgacuucuugcugcuaguuuugaaguuucuuuuauuuucucuagu

SEQ ID NO: 101389 - RNA, 64 nt, Homo Sapiens
auauauuuugaggagaaaaaucuucugaauucugaguuuugaaaggaauuucugaaaguaucag

SEQ ID NO: 101390 - RNA, 64 nt, Homo Sapiens
ccacaaagaauuaaaaacugggcccuucuacuucaguuuugaauccguguuguuugacucagaa

SEQ ID NO: 101391 - RNA, 64 nt, Homo Sapiens
gcagggaccccgcauucccauauucugucacuggaguuuugaauuagcagcugguuggggacua

SEQ ID NO: 101392 - RNA, 64 nt, Homo Sapiens
aaauagucucccuucaauuaucuguuuaauuuagaguuuugaagguaaacuuaauugauaaagc

SEQ ID NO: 101393 - RNA, 64 nt, Homo Sapiens
ccuagauuauagucuuaguaugguuaucacuuuaaguuuugacaauuaagaaaacauugcuuug

SEQ ID NO: 101394 - RNA, 64 nt, Homo Sapiens
uaacugcauucauuaggggcaaaagaaaggaguuaguuuugaggugugcaacagaaccauuaau

SEQ ID NO: 101395 - RNA, 64 nt, Homo Sapiens
cuaacuguugguaggagaaacauuuuacaauguaaguuuugaaauuguaccauuuauuuuauga

SEQ ID NO: 101396 - RNA, 64 nt, Homo Sapiens
auacuuugaaaaagagaaguaauuugaauagugaaguuuugaaaauuauuaaaauauccuauuu

SEQ ID NO: 101397 - RNA, 64 nt, Homo Sapiens
ggauuuuaaauucaggcaaacuuaagagcaaaaaaguuuugaugugcuauuuguuguauuuaug

SEQ ID NO: 101398 - RNA, 64 nt, Homo Sapiens
cuucccaguggaagauacagaccccaaggccaguaguuuugacaucucugguggucuuccuucu

SEQ ID NO: 101399 - RNA, 64 nt, Homo Sapiens
acuggcauuuuauagacacccacuguuuuuccauaguuuugaugcuuauuuuucuaaacguaag

SEQ ID NO: 101400 - RNA, 64 nt, Homo Sapiens
cuguauuugcugccagacacgaacacugccucugaguuuugauguacauguaccuauagaaaua

SEQ ID NO: 101401 - RNA, 64 nt, Homo Sapiens
uuauauuguuucaucccaugaacccuuaucuguaaguuuugaauaagaguugagugauagagcu

SEQ ID NO: 101402 - RNA, 64 nt, Homo Sapiens
uuauuucaguaaccuacauacuggauugacgcaaaguuuugagucauugcaguaugaguugcca

SEQ ID NO: 101403 - RNA, 64 nt, Homo Sapiens
uaaacgacuaaaggauuuguuggguuuuugcuuaaguuuugaaccaaauccuagagccagcuga

SEQ ID NO: 101404 - RNA, 64 nt, Homo Sapiens
agacugucaguaggcuggaagaaguggauauugaaguuuugacaucaaugaugaggcuccaguu

SEQ ID NO: 101405 - RNA, 64 nt, Homo Sapiens
uauagagaggcaaaggacacagaguagcuaaccuaguuuugaagaacaagaugggggguuuuau

SEQ ID NO: 101406 - RNA, 64 nt, Homo Sapiens
uuggagacuaauucuaauguggaccuuagaauacaguuuugaguagaguugaucaaaaucaauu

SEQ ID NO: 101407 - RNA, 64 nt, Homo Sapiens
aacacaccaaguuuggaaauacaauuguacauggaguuuugaucaacggacuuaucucagcucu

SEQ ID NO: 101408 - RNA, 64 nt, Homo Sapiens
uacaauaacccaguuacuuuuuuacacugauaaaaguuuugauauuuauuuuuugccauuuuau

SEQ ID NO: 101409 - RNA, 64 nt, Homo Sapiens
auuuuuuuuuuuaagaagaaagaaaaugcaagcuaguuuugagaaaggaaggccaaauuggguc

SEQ ID NO: 101410 - RNA, 64 nt, Homo Sapiens
gaaaaccaagaaauguaaagauaacaggaaaauaaguuuugauugcauuguuuuuaaaauaagc

SEQ ID NO: 101411 - RNA, 64 nt, Homo Sapiens
caaaaaaaaguaguuuuuccuucauaacauacucaguuuugaauuacauguagugucacaugaa

SEQ ID NO: 101412 - RNA, 64 nt, Homo Sapiens
acaaaaaauaaauagccaugcauuugauuuguuuaguuuugauuguuuuaacaguuaguaaugg

SEQ ID NO: 101413 - RNA, 64 nt, Homo Sapiens
uucuaaaauauuggagaugaggaaaauguacuugaguuuugaaauauuuugguaagccucucuu

SEQ ID NO: 101414 - RNA, 64 nt, Homo Sapiens
cauauauacuugagguguagagauguuauuaagaaguuuugauguuagaauaauugcuuuugga

SEQ ID NO: 101415 - RNA, 64 nt, Homo Sapiens
cugugucggcugcccccugauccuuccauuaucaaguuuugaaggguguuggggaaauuauggc

SEQ ID NO: 101416 - RNA, 64 nt, Homo Sapiens
ugggacucuaguguuaagauuauccuccuccuagaguuuugacuuucacagacuagaccuuucu

SEQ ID NO: 101417 - RNA, 64 nt, Homo Sapiens
ugccuaagaugaccuauuugagauccauuuaaggaguuuugaagauuagaggacaaauauuuuu

SEQ ID NO: 101418 - RNA, 64 nt, Homo Sapiens
uauucuguacaguacguuccguuuucuugguagcaguuuugaaagcuagguagaauuuguacuu

SEQ ID NO: 101419 - RNA, 64 nt, Homo Sapiens
acaaaaaaaaaaaaaaaaaauggucucuuggaccaguuuugacucagagguucagucugcuuca

SEQ ID NO: 101420 - RNA, 64 nt, Homo Sapiens
uaaaccauguccaucuucuaugguuucugguccaaguuuugaccagagcuguuucaaaggaagu

SEQ ID NO: 101421 - RNA, 64 nt, Homo Sapiens
uaacuauauauauauaaauauacuauguacuaucaguuuugauauuaguucuuucuuccaguua

SEQ ID NO: 101422 - RNA, 64 nt, Homo Sapiens
gagggauaaauagaaagcagaguauauauguuagaguuuugaauuuaagugguggaaaaaggaa

SEQ ID NO: 101423 - RNA, 64 nt, Homo Sapiens
uauauguauagcuugaaaagaugcuagcucaauuaguuuugaaucucaguaaagauuuaauucc

SEQ ID NO: 101424 - RNA, 64 nt, Homo Sapiens
aaaggagggaaaagcagauguuacuuuaaaaaucaguuuugaugcauuuugcuaaccuaguuug

SEQ ID NO: 101425 - RNA, 64 nt, Homo Sapiens
uguuggguuuccagagagagaagaugaaaugugcaguuuugaaacagaacuuuagugcuagggg

SEQ ID NO: 101426 - RNA, 64 nt, Homo Sapiens
accugaaauuguaaucacuggaugacccuucuugaguuuugaacauucugcuucagaguauaau

SEQ ID NO: 101427 - RNA, 64 nt, Homo Sapiens
uucacagccuucugcauugcuuucuuugucacauaguuuugaaugccugugguacgcacugaau

SEQ ID NO: 101428 - RNA, 64 nt, Homo Sapiens
uuaugcacacuaaauuaaauuggaauaauaccucaguuuugaggugcaagugguuuuuauaaau

SEQ ID NO: 101429 - RNA, 64 nt, Homo Sapiens
uaaagggggggaaacaaguuuuuuuuauaguuguaguuuugauuuuuuauuuucaguaacuauu

SEQ ID NO: 101430 - RNA, 64 nt, Homo Sapiens
ggucagauuuucauauguaugcuacugcaaaaccaguuuugacaccacauauaucucaaaucug

SEQ ID NO: 101431 - RNA, 64 nt, Homo Sapiens
uacuacacuaauuuccaacauaagaggcaggaagaguuuugauucuauccuuuuuuacuaaaca

SEQ ID NO: 101432 - RNA, 64 nt, Homo Sapiens
aucauuuucuuggcauguuaaaucaagcuuaaaaaguuuugagaaaauuuuacugcgcuguguu

SEQ ID NO: 101433 - RNA, 64 nt, Homo Sapiens
aagaaaaugaauuuuuuccugcagcaggaaacauaguuuugaguaguucuaccucuuauuugua

SEQ ID NO: 101434 - RNA, 64 nt, Homo Sapiens
uaaaagcaaaauuaacaaugaucugugcucugaaaguuuugaaaauauauuugaacaauuugaa

SEQ ID NO: 101435 - RNA, 64 nt, Homo Sapiens
uaggagaagucuucuauuuauuuauuuauucauuaguuuugaagauucuauguuaauauuuuag

SEQ ID NO: 101436 - RNA, 64 nt, Homo Sapiens
cagacacacucacacacaagagccaggaugguggaguuuugauuggguggguuguuugaggggg

SEQ ID NO: 101437 - RNA, 64 nt, Homo Sapiens
uuaaaauccauuuuaggugauaaaauuuuuuaaaaguuuugaaggaaaccucuggauaaaugga

SEQ ID NO: 101438 - RNA, 64 nt, Homo Sapiens
auguuuaucaaaucguguacuaaaauggaaagcuaguuuugagaaauuauucagaagccuuguu

SEQ ID NO: 101439 - RNA, 64 nt, Homo Sapiens
gauguuuguuuauucuaccucaaacagaggcuuaaguuuugaaguguaaccaguuuauacuuca

SEQ ID NO: 101440 - RNA, 64 nt, Homo Sapiens
acaauuauguucauuuuaagcaaaauuuuaagaaaguuuugaaauucauaaagcauuugguuuu

SEQ ID NO: 101441 - RNA, 64 nt, Homo Sapiens
uacuaauuaauuuuuagauucaauauuuauauggaguuuugaaaaauaauaguggcccugaagg

SEQ ID NO: 101442 - RNA, 64 nt, Homo Sapiens
gaaguuuuucuauuuagcaaaauaauuaguaauaaguuuugacuaggucuaaagaaugaacaca

SEQ ID NO: 101443 - RNA, 64 nt, Homo Sapiens
auagcagcugacugaaaaucagcacugccugaguaguuuugaucaguuuaacuugaaucacuaa

SEQ ID NO: 101444 - RNA, 64 nt, Homo Sapiens
uucuuaaccacuuuugucauuuguuuuuuggaguaguuuugaaaaguguuuuauauugagugca

SEQ ID NO: 101445 - RNA, 64 nt, Homo Sapiens
uucugucuguaaucacuaaagucaacuuuaauagaguuuugaaacaguacugugcaauccgaug

SEQ ID NO: 101446 - RNA, 64 nt, Homo Sapiens
auuucucuugcucaccaagaaguaacaaaaguauaguuuugacagaguugguguucauaauuuc

SEQ ID NO: 101447 - RNA, 64 nt, Homo Sapiens
gacuauuuuaagagauucagcaugcauggauauuaguuuugauuaauguguacaauaauuuaca

SEQ ID NO: 101448 - RNA, 64 nt, Homo Sapiens
ccacugaucuugacaucaagucuaacaaagaaaaaguuuugaguuuuguauuuucuuuuuucuu

SEQ ID NO: 101449 - RNA, 64 nt, Homo Sapiens
gaaaaaugguaaauggauuuuucuguaaguuaccaguuuugaauagagaaaaauacuauguggu

SEQ ID NO: 101450 - RNA, 64 nt, Homo Sapiens
cuagaagucaaaaaucuuuuucucuaucaacaguaguuuugaaaauuaagaaauguuuuuauuu

SEQ ID NO: 101451 - RNA, 64 nt, Homo Sapiens
uuaaacauuauguagcuaaguggauugucuggugaguuuugauauccaucaguuucuuuaaaau

SEQ ID NO: 101452 - RNA, 64 nt, Homo Sapiens
uugggacucuuucaaguguauacuaucaugagacaguuuugauuucauguuugaagcuauagcu

SEQ ID NO: 101453 - RNA, 64 nt, Homo Sapiens
uuaugaauucuagaaacuaaaaacuuaugugaacaguuuugaguuaaacaagaacaaauacucu

SEQ ID NO: 101454 - RNA, 64 nt, Homo Sapiens
uuuuaauguaacucagauugugucaauuaaaaaaaguuuugaucgccugguacaucacccauga

SEQ ID NO: 101455 - RNA, 64 nt, Homo Sapiens
ucuuuuuaaggagaggcacucuaccuggaaggugaguuuugaucugaaacuuacgcaguaauca

SEQ ID NO: 101456 - RNA, 64 nt, Homo Sapiens
gaaauauaaagcuuucuuuuacuuuguggguaugaguuuugauuuguaacagcaaccccugugg

SEQ ID NO: 101457 - RNA, 64 nt, Homo Sapiens
ccuuaguaccuuuuuaacagccgguuuccguagcaguuuugaaacaccaucuugaagucauugu

SEQ ID NO: 101458 - RNA, 64 nt, Homo Sapiens
gcauauuuuguuauaguucauuuagguggcugggaguuuugauuuaggauuugcacugcuuuau

SEQ ID NO: 101459 - RNA, 64 nt, Homo Sapiens
uuuuuuuuuuuucugaaaagugcuuauguuuauaaguuuugagaugguacaauguaaaaugcca

SEQ ID NO: 101460 - RNA, 64 nt, Homo Sapiens
uuuaaauuacuugaaucucauaaauauuuuuuaaaguuuugacaaaaguaucugauuuuuaaag

SEQ ID NO: 101461 - RNA, 64 nt, Homo Sapiens
ccuuuauuaauacuacuuuugaaaauuacuuuggaguuuugaagaguacuugaaauucuuacca

SEQ ID NO: 101462 - RNA, 64 nt, Homo Sapiens
uguguuuauggaguuuaagauuuugggacccagcaguuuugaaaccuagaguucauagauggac

SEQ ID NO: 101463 - RNA, 64 nt, Homo Sapiens
ucuugcucauuuucagaauagaugauaauaggcuaguuuugauuucuuggugccuaauuuucua

SEQ ID NO: 101464 - RNA, 64 nt, Homo Sapiens
uauaauaguuuguauauucaaaauaccaguguucaguuuugaacuuaguugaaguuuaugaggg

SEQ ID NO: 101465 - RNA, 64 nt, Homo Sapiens
aggugcaacugugacuugggcucacuuuaaagcuaguuuugaauuuuaugaaguuuaaaaauag

SEQ ID NO: 101466 - RNA, 64 nt, Homo Sapiens
guucgauaaaagccauuaaacgucacuuuucuauaguuuugagaucuugacuaauucauuguua

SEQ ID NO: 101467 - RNA, 64 nt, Homo Sapiens
agacaucuuugaagugcuuuggucuucuggaaauaguuuugaccacaaaaggugugggcuuugg

SEQ ID NO: 101468 - RNA, 64 nt, Homo Sapiens
gauguuugagcuuuuguauaacuucaauaguccaaguuuugaagaaauugaaauuuaauuguag

SEQ ID NO: 101469 - RNA, 64 nt, Homo Sapiens
ugcuacuauaauaaguuuuugucagacaaaauaaaguuuugaaggaaaauacauaugcagucua

SEQ ID NO: 101470 - RNA, 64 nt, Homo Sapiens
ucgguaacuaguuuaacuacuuuuuauacuuuuuaguuuugauuuguuuugaaaagaaaauagc

SEQ ID NO: 101471 - RNA, 64 nt, Homo Sapiens
uucaagucugugguuuugaugcagagaagaaaauaguuuugauuuuugaguuuuuaacagaagu

SEQ ID NO: 101472 - RNA, 64 nt, Homo Sapiens
uuauuuacacuuuauugucucccgcuucucagauaguuuugauguguuguacaguggaauaucu

SEQ ID NO: 101473 - RNA, 64 nt, Homo Sapiens
cucaccucugaaggcaaauauaagcugggaaaaaaguuuugaugaaauucuugaaguucauggu

SEQ ID NO: 101474 - RNA, 64 nt, Homo Sapiens
aagacugggaccuuagaaaucauuguagaaacacaguuuugaaagaaaaauaccaugucucuaa

SEQ ID NO: 101475 - RNA, 64 nt, Homo Sapiens
ugaauacauauugaaauagugugcuggcuuuuguaguuuugauaaagaccauugcaggcaaugg

SEQ ID NO: 101476 - RNA, 64 nt, Homo Sapiens
guagguacauggacuauaucgcacaacaggugcuaguuuugagaaggcccaacaggaguuugca

SEQ ID NO: 101477 - RNA, 64 nt, Homo Sapiens
gucugucaaauuguauuucaguggcacaaaaaccaguuuugaggucuuagacuuauaauucuuu

SEQ ID NO: 101478 - RNA, 64 nt, Homo Sapiens
cacuccgucgugguuuuauuuuuaauauagagagaguuuugaauucuacacuguugucuuuccu

SEQ ID NO: 101479 - RNA, 64 nt, Homo Sapiens
ccugucuugaugacacuugcagggcaggcugaaaaguuuugagauugagcagcuugggaguuug

SEQ ID NO: 101480 - RNA, 64 nt, Homo Sapiens
agagggaugcccauuccaugguccuccagagaauaguuuugacuuaacaugucuguuuagccca

SEQ ID NO: 101481 - RNA, 63 nt, Homo Sapiens
aaaaaucucauguuugaaucuauaugaguuuuucaguuuugaaugugggaguaaaauacugaa

SEQ ID NO: 101482 - RNA, 64 nt, Homo Sapiens
uagagacauuuacucuggagugauugccucuugaaguuuugacaauuauuugaaucugucuuuu

SEQ ID NO: 101483 - RNA, 64 nt, Homo Sapiens
acuuaauuuuuuguaaaacaguggacuucaaaagaguuuugaagugggggauguucugcaccca

SEQ ID NO: 101484 - RNA, 64 nt, Homo Sapiens
ucaucuauuuuuuauuuguuaauugguaaauguuaguuuugacuuaguuucaguuucucaugga

SEQ ID NO: 101485 - RNA, 64 nt, Homo Sapiens
cuuguggcaagagacuuaacagacagcucugaaaaguuuugauggaaauggauuuucacggaag

SEQ ID NO: 101486 - RNA, 64 nt, Homo Sapiens
uggauagugaaaaaguggagagacugacaaugacaguuuugaguuuuaaaaagaauucaaaaaa

SEQ ID NO: 101487 - RNA, 64 nt, Homo Sapiens
uuguucuuuuuauuuucaggcccuucuacuugugaguuuugaaaaaaaauaauuaccaaggccu

SEQ ID NO: 101488 - RNA, 64 nt, Homo Sapiens
cucuccaggugauuccaaugucacaggcauugguaguuuugaagucacaaucuuuggugacggg

SEQ ID NO: 101489 - RNA, 64 nt, Homo Sapiens
gugaaccacacuuuauccaaugaugucuggagcuaguuuugaggaguauacauucucuagucug

SEQ ID NO: 101490 - RNA, 64 nt, Homo Sapiens
uaugaagagcgaaaucaaauucuuauuuuuguacaguuuugaaguuuauacuuagaacugacca

SEQ ID NO: 101491 - RNA, 64 nt, Homo Sapiens
ugugcugagauauaccuguacuauuuaugguuuaaguuuugauucuuagguauuuucuccagcu

SEQ ID NO: 101492 - RNA, 64 nt, Homo Sapiens
gccaucagcauagacuugacuuccuuaaaccgagaguuuugauguggccuuggcaacccuaaaa

SEQ ID NO: 101493 - RNA, 64 nt, Homo Sapiens
cucuaagcaauagagagcuucaugacugaguaagaguuuugaagucagcagugaaucaagugcc

SEQ ID NO: 101494 - RNA, 64 nt, Homo Sapiens
guuguuuucugugaaaacagcagugaacagguucaguuuugaacuggcccugaggaaauggguc

SEQ ID NO: 101495 - RNA, 64 nt, Homo Sapiens
gacugggcuuucuccccacuaagggcaaggccccaguuuugaccaaucgcaugguucuccuggc

SEQ ID NO: 101496 - RNA, 64 nt, Homo Sapiens
acgugagacaagcaguuaauaguaugaucuuuaaaguuuugacaauauaaaauaaacuugguaa

SEQ ID NO: 101497 - RNA, 64 nt, Homo Sapiens
aauaaaggaaauucagauuguuuaaaugccuaaaaguuuugagauaaguuuuguuucaauuaga

SEQ ID NO: 101498 - RNA, 64 nt, Homo Sapiens
caaaaugaaagcaacagugauguauugaaaucuuaguuuugauauuuuaaagaaaugacuuucu

SEQ ID NO: 101499 - RNA, 64 nt, Homo Sapiens
gacgaaaguaggcgguacgaacccuaauggaggcaguuuugaggagguccucagcuccacggcc

SEQ ID NO: 101500 - RNA, 64 nt, Homo Sapiens
cagauuucaaaucuuuccaauuuacccuggaaucaguuuugagggagcugauaaagacuuuagc

SEQ ID NO: 101501 - RNA, 64 nt, Homo Sapiens
uuuuuuuuuuaccaaacuucagggacacucugcuaguuuugaauaaguaaccaucaaaguuacu

SEQ ID NO: 101502 - RNA, 64 nt, Homo Sapiens
augaccagguuggacuguuuugcccaacguauauaguuuugacaacaccuggucuucaguucug

SEQ ID NO: 101503 - RNA, 64 nt, Homo Sapiens
acauguuaauuuuuuucccuuacagaaagguuguaguuuugagcuaaacaaaaauuauuuugcc

SEQ ID NO: 101504 - RNA, 64 nt, Homo Sapiens
aaacucaguaugcaugugugaagcagaacagacuaguuuugagucaucccggaagaagaggaag

SEQ ID NO: 101505 - RNA, 64 nt, Homo Sapiens
acucuuaaagcaucauuugcauuauuuuuuaaaaaguuuugauauggaggcuccauauuaaugc

SEQ ID NO: 101506 - RNA, 64 nt, Homo Sapiens
uuuuaauuugaguagauuuaaaugcagaucacacaguuuugaaaauagucuguagguggacaag

SEQ ID NO: 101507 - RNA, 64 nt, Homo Sapiens
gaggugcauaauaaaacuacccaugaggagccucaguuuugaaaaaaaaaguuccaacacacag

SEQ ID NO: 101508 - RNA, 64 nt, Homo Sapiens
cacugcaaccuccgccuccugagugcaauggugcaguuuugacuugcucuuguugcccaggcug

SEQ ID NO: 101509 - RNA, 64 nt, Homo Sapiens
ggguaauguuucuguucuucuuuuguauuuuuacaguuuugauuaaaaaauauguuugaugcua

SEQ ID NO: 101510 - RNA, 64 nt, Homo Sapiens
aauccuauucaauuuucucaucacuuugcaucuuaguuuugaacauaucuugcaagcuccaccu

SEQ ID NO: 101511 - RNA, 64 nt, Homo Sapiens
auaugcaguacuguuuauauuguguuuauuuaaaaguuuugaaaauguauaccuauauauucuu

SEQ ID NO: 101512 - RNA, 64 nt, Homo Sapiens
aaauguuauuuuuacugaaaaaaucagauugaaaaguuuugagauaaaaaguacaagcuauuaa

SEQ ID NO: 101513 - RNA, 64 nt, Homo Sapiens
cucaaccgagguccagggcagagaucaagacccaaguuuugaauaagagagagagagcgcgaga

SEQ ID NO: 101514 - RNA, 64 nt, Homo Sapiens
uuuguuagccugacacucccuaaugucaaugcccaguuuugacuaaacaucaguaaacuaccau

SEQ ID NO: 101515 - RNA, 64 nt, Homo Sapiens
aacauuuaccuucagccuccaucagaauggaacgaguuuugaguaaucaggaaguauaucuaua

SEQ ID NO: 101516 - RNA, 64 nt, Homo Sapiens
auuauuucugucacaguaaaaauaaaauacuuugaguuuugagcuacuggauucuuauuaguuc

SEQ ID NO: 101517 - RNA, 64 nt, Homo Sapiens
uuuaagaaguaccacuugaaacauuuuauguauuaguuuugaaauaauaauggaaaguggcuau

SEQ ID NO: 101518 - RNA, 64 nt, Homo Sapiens
uguauuugaguucacacuauuucuguuuuacagcaguuuugaaaaacacauacuaugccaccaa

SEQ ID NO: 101519 - RNA, 64 nt, Homo Sapiens
uaagagcccucaauugccugccuguauuaauuuuaguuuugagucaggauuuguaauggagugg

SEQ ID NO: 101520 - RNA, 64 nt, Homo Sapiens
uguuagcccugccuuccaggaagguuggggugggaguuuugagugggaaagaggaugacaugug

SEQ ID NO: 101521 - RNA, 64 nt, Homo Sapiens
ggaggccgaggugagcggaucaccugaggucaggaguuuugagaccagccuggccaacauggua

SEQ ID NO: 101522 - RNA, 64 nt, Homo Sapiens
gauacuguucuggacugugccuguuaaguugcucaguuuugagcugucuucagacaagaagauu

SEQ ID NO: 101523 - RNA, 64 nt, Homo Sapiens
cccuuuguagaaauucuugccugaauucucaccaaguuuugaauuccuaagguagccccgaucu

SEQ ID NO: 101524 - RNA, 64 nt, Homo Sapiens
gcugccagucuuccugcccccacuggacuguuccaguuuugacaagcccgggccugcacauacu

SEQ ID NO: 101525 - RNA, 64 nt, Homo Sapiens
augaugaaacuauaucaugugaugggguccuacaaguuuugaguuacuuuuuacuuaggcuugg

SEQ ID NO: 101526 - RNA, 64 nt, Homo Sapiens
agucagaucuggccauuuguuucacaaugugaguaguuuugaaacuagauuuguuccugcuuuu

SEQ ID NO: 101527 - RNA, 64 nt, Homo Sapiens
agcuauuagccaggaucaugaagauuuuucucaaaguuuugaaaugacaugugaaaccuuuuuu

SEQ ID NO: 101528 - RNA, 64 nt, Homo Sapiens
caguauuguuacacucaaaccugucuuccauuucaguuuugaauuaaaguauucuagggagaaa

SEQ ID NO: 101529 - RNA, 64 nt, Homo Sapiens
gggcagauuucaaacugaauuauaauacagaaagaguuuugaauggauguggcguuucaacuca

SEQ ID NO: 101530 - RNA, 64 nt, Homo Sapiens
uaaaacaaugcccauucacccuguggauagacuuaguuuugacaucuuuguuacaggagaggac

SEQ ID NO: 101531 - RNA, 64 nt, Homo Sapiens
auaaauucuuuggaacuuuaugaaguuuuguuuuaguuuugauauuuauuacuuuauguacaac

SEQ ID NO: 101532 - RNA, 64 nt, Homo Sapiens
uaauguuuucagcccaucuccuuauuauauuauuaguuuugauuuguaacaaagaacugaagcu

SEQ ID NO: 101533 - RNA, 64 nt, Homo Sapiens
gcuuggaacuggaauccuuugccacuaacgguugaguuuugacuaucuaccaggucaaaauagu

SEQ ID NO: 101534 - RNA, 64 nt, Homo Sapiens
aauacgagucugucagagcggucuucugaauguaaguuuugagauucaaauaguggcagacagu

SEQ ID NO: 101535 - RNA, 64 nt, Homo Sapiens
uuuacuuucucagaauuaccuaaauguuuuguagaguuuugacuaguaaucaaucaaaauuaua

SEQ ID NO: 101536 - RNA, 64 nt, Homo Sapiens
uagcuggcuaucuuuaagaaagaugauauauccuaguuuugaaaguaauuuucuuuuuucuuuc

SEQ ID NO: 101537 - RNA, 64 nt, Homo Sapiens
uucuuucuguuucaggcuugaaaaacccuugcccaguuuugaucccuucaagacuuugucacag

SEQ ID NO: 101538 - RNA, 64 nt, Homo Sapiens
ugcacaauggcuuuuuguuaauaaagaacagauuaguuuugaagaaggcaaaaauuucaguuuu

SEQ ID NO: 101539 - RNA, 64 nt, Homo Sapiens
guuucuaauauguggccagggcguucagauuuccaguuuugaaaacaauuguauagauuucaca

SEQ ID NO: 101540 - RNA, 64 nt, Homo Sapiens
aucuuucaacacacuuccacugccugcguaaugaaguuuugauucauuuuuaaccacuggaauu

SEQ ID NO: 101541 - RNA, 64 nt, Homo Sapiens
gacuaagaagcuuaaauguugauaaaauaugacuaguuuugaauuuacaccaagaacuucucaa

SEQ ID NO: 101542 - RNA, 64 nt, Homo Sapiens
aaacacguuacaauuaccacauauccuugcuauaaguuuugaaguuucuuagcaauuaaaguuu

SEQ ID NO: 101543 - RNA, 64 nt, Homo Sapiens
gucauucuuuuuuucugaaagagguaauaauucuaguuuugauagacucugaggauuaugugaa

SEQ ID NO: 101544 - RNA, 64 nt, Homo Sapiens
uuccagcaaacuaggguaauuggugccuuuuuacaguuuugaauaaaagcauuuacaauuucua

SEQ ID NO: 101545 - RNA, 64 nt, Homo Sapiens
auuuuaggucucucaaauaauuaagaauagagccaguuuugaauaaagucuagcagaacuaugc

SEQ ID NO: 101546 - RNA, 64 nt, Homo Sapiens
uuuaagauaggauuauugggaggguucgacuuagaguuuugagccaugagcauauggacuuacg

SEQ ID NO: 101547 - RNA, 64 nt, Homo Sapiens
guacugugccugguuugauugguguugacacaccaguuuugagucaaacuaguaucauuuuagg

SEQ ID NO: 101548 - RNA, 64 nt, Homo Sapiens
agucacuuuuauuuuuaauuaucacagacuguagaguuuugaaacuggccaccucacgcauuug

SEQ ID NO: 101549 - RNA, 64 nt, Homo Sapiens
uuaccuugauuuuuuuaauuagacgcuuuuuagaaguuuugaaaaaugcugcagucugcacauu

SEQ ID NO: 101550 - RNA, 64 nt, Homo Sapiens
uuuuaugauagauuugcucuuuuuauucucuucuaguuuugacauucuagguuuuuuccuuuca

SEQ ID NO: 101551 - RNA, 64 nt, Homo Sapiens
uaaaaucucguuuguauacuuuuuuacaauaaacaguuuugauuaaaaaacaauuuucaaguuu

SEQ ID NO: 101552 - RNA, 64 nt, Homo Sapiens
aagaacagcauagagcuucagauaauaaaauaagaguuuugauuuuagaacuaguguaauucuu

SEQ ID NO: 101553 - RNA, 64 nt, Homo Sapiens
ucagccagcugcccuaaauaauuagcauucuggcaguuuugacaagagacucagccugcaguua

SEQ ID NO: 101554 - RNA, 64 nt, Homo Sapiens
uccguuaugugauucugcuugaugugaacuauuuaguuuugaugcauauuuaauuuaaacuaau

SEQ ID NO: 101555 - RNA, 64 nt, Homo Sapiens
uagauguguauauggacuguuagcuagcaaagguaguuuugaaauaaaacuuugggaaaggggc

SEQ ID NO: 101556 - RNA, 64 nt, Homo Sapiens
ugacaaggcaaaacaugacaaaacaagcuauuugaguuuugacuuuucuggaauaauuuuacca

SEQ ID NO: 101557 - RNA, 64 nt, Homo Sapiens
aauuacaugguggauucugaccuuuuaguuucccaguuuugaauuuuuaguugauuuuuuuuaa

SEQ ID NO: 101558 - RNA, 64 nt, Homo Sapiens
guaaagugguuaauucaggaaauugacagaauccaguuuugagaaaagaacacagauauuugcu

SEQ ID NO: 101559 - RNA, 64 nt, Homo Sapiens
uuuuagugucucaccagugguuuuacaucugcagaguuuugagggcugugcugaccuuugagag

SEQ ID NO: 101560 - RNA, 64 nt, Homo Sapiens
aaauuagaguuuaaauaaauaugcuuugaugcauaguuuugaacuaauguaacaugauuuuucu

SEQ ID NO: 101561 - RNA, 64 nt, Homo Sapiens
aucccuacauguauugcacauuguaaaaaguuuuaguuuugaugaguugugaguuuaccuugua

SEQ ID NO: 101562 - RNA, 64 nt, Homo Sapiens
gauuuuggugucaauuuuguggacauuuggcaggaguuuugacugggguaggagaaacccauga

SEQ ID NO: 101563 - RNA, 64 nt, Homo Sapiens
ggcacggauggcugguccgaagcacgugcauuucaguuuugaggcuccuguccucaggcagugu

SEQ ID NO: 101564 - RNA, 64 nt, Homo Sapiens
caaggcaauuuuaaauaggcagagagaaguuuauaguuuugaaaacagcugcugaagucaggaa

SEQ ID NO: 101565 - RNA, 64 nt, Homo Sapiens
aaaaccaccaagaacauuuccuggggcauguuccaguuuugaggggugauauaucugccagaua

SEQ ID NO: 101566 - RNA, 64 nt, Homo Sapiens
uaagaucagcuggcuuucuuguuaaaguuauuuaaguuuugaaugcucuacuacuucaagucuu

SEQ ID NO: 101567 - RNA, 64 nt, Homo Sapiens
acuaggauuaauuaucagaagacagcucaggccaaguuuugaucguuccauacaguaccuuguu

SEQ ID NO: 101568 - RNA, 64 nt, Homo Sapiens
ccuaacaagguauuugcaugagucacaauuacaaaguuuugagcgguuuuguaauuugacauuu

SEQ ID NO: 101569 - RNA, 64 nt, Homo Sapiens
caaccuuuuaaggaaauacaguccuugggaaaugaguuuugauggugaauugggguguuaagga

SEQ ID NO: 101570 - RNA, 64 nt, Homo Sapiens
agaaagagaaaggaaauuauaaggucaaguuaacaguuuugagguuuuguguuuuuuucuggaa

SEQ ID NO: 101571 - RNA, 64 nt, Homo Sapiens
uauuauguuauagccaucauaaaaccauuuugguaguuuugacugaacuggguguucacuuuuu

SEQ ID NO: 101572 - RNA, 64 nt, Homo Sapiens
ucuuaaugcuuguaauuuaaacauuuguuccuggaguuuugauuugguggaugugaugguuggu

SEQ ID NO: 101573 - RNA, 64 nt, Homo Sapiens
aguuguggagaggagacgccuccagacucucagaaguuuugaggacugaacugggucacucggg

SEQ ID NO: 101574 - RNA, 64 nt, Homo Sapiens
uacugcaguggaugugggaugcuguuacuaggagaguuuugagaauuuguggugaugggaggau

SEQ ID NO: 101575 - RNA, 64 nt, Homo Sapiens
guaaggaacaauaccugggauuuuccuuuuagcuaguuuugaaaguucauaaaccaugcuaaca

SEQ ID NO: 101576 - RNA, 64 nt, Homo Sapiens
gaauaauucuuggucuucccgugcaacuagccccaguuuugacacacacacacacacacacagu

SEQ ID NO: 101577 - RNA, 64 nt, Homo Sapiens
uuuggcuguuuauuuuugucucauuuuucauucuaguuuugauacuucacuauuugagguaacu

SEQ ID NO: 101578 - RNA, 64 nt, Homo Sapiens
ccaaaaaagaaaccuagaauuggauuguagacccaguuuugaaacuccauuaaugucauuuuua

SEQ ID NO: 101579 - RNA, 64 nt, Homo Sapiens
gggcacugucaacuuggguucauuauuuaugaaaaguuuugagauuuuuuaaaugaaauuaggu

SEQ ID NO: 101580 - RNA, 64 nt, Homo Sapiens
ucuucagcaccaggaaggaaccccuagaggagacaguuuugaccgagggacaguuuugaccuga

SEQ ID NO: 101581 - RNA, 64 nt, Homo Sapiens
ugaccccuagaggagacaguaccuauggagggacaguuuugaccgccauggaccccuggaggag

SEQ ID NO: 101582 - RNA, 64 nt, Homo Sapiens
gguaucuguacguuaauguuucuugcugaguuacaguuuugauaaagaggcucucauuuccugu

SEQ ID NO: 101583 - RNA, 64 nt, Homo Sapiens
ucuucauaaucuauggaaaccucuaaggugagaaaguuuugaacuuuuaacccuuucuacccag

SEQ ID NO: 101584 - RNA, 64 nt, Homo Sapiens
aguuauauugugauacucaaauucacagcagaguaguuuugaguaacaguaauuaaauccuucu

SEQ ID NO: 101585 - RNA, 64 nt, Homo Sapiens
cuuuagaaacauuagugccugccuggauccccuuaguuuugaaauauuugccauuguuguuuaa

SEQ ID NO: 101586 - RNA, 64 nt, Homo Sapiens
cuacacccauagauuaccaagguuucaguguacuaguuuugaaucuguucugaauggaguuuuu

SEQ ID NO: 101587 - RNA, 64 nt, Homo Sapiens
uaugauauuugaaaaugcuaucccugcacucaaaaguuuugaaagaaacuaaucacagcacaga

SEQ ID NO: 101588 - RNA, 64 nt, Homo Sapiens
uguuggguacuuagacccaaaccaauaaauggugaguuuugaacaagaacuaccaucaugcagg

SEQ ID NO: 101589 - RNA, 64 nt, Homo Sapiens
auggggauaauaauacugaccuaccucaaagggcaguuuugaggcaugacuaaugcuuuuuaga

SEQ ID NO: 101590 - RNA, 64 nt, Homo Sapiens
ccacccacugacaucugaauuuauauaccuguugaguuuugagugcacccaaacacucgauaaa

SEQ ID NO: 101591 - RNA, 64 nt, Homo Sapiens
uguucugcuuuuccuggcacucaaauucaugacuaguuuugaggucaaaccuauguucguaaug

SEQ ID NO: 101592 - RNA, 64 nt, Homo Sapiens
auguuacugaagcauuugaauauaaagcuauuuuaguuuugauggcuuaacuguucccugagga

SEQ ID NO: 101593 - RNA, 64 nt, Homo Sapiens
cacaccuauaaucccaacacuuugggaggccaggaguuuugagaccagccugggaaacaucugu

SEQ ID NO: 101594 - RNA, 64 nt, Homo Sapiens
cccucaggaggaagguggacaacagagaaaugagaguuuugauauuuucugaaagaggaacaug

SEQ ID NO: 101595 - RNA, 64 nt, Homo Sapiens
uuugggcaaacaaaauuggagggcaagugacugcaguuuugagaaucaguuuugaccuugauga

SEQ ID NO: 101596 - RNA, 64 nt, Homo Sapiens
aauuggagggcaagugacugcaguuuugagaaucaguuuugaccuugaugauuuuuuguuucca

SEQ ID NO: 101597 - RNA, 64 nt, Homo Sapiens
gauuuacaucuuaggaaauacugcaucgcacucuaguuuugaagagaugcuugagauuuuccug

SEQ ID NO: 101598 - RNA, 64 nt, Homo Sapiens
acaugaauacaaacaaaaaaguguccauaaauaaaguuuugaaauauaugauauucaaauuuca

SEQ ID NO: 101599 - RNA, 64 nt, Homo Sapiens
auugagacacaauacuaauagcuuuuuaaaaguuaguuuugagaauccuuuagguuaaguuuaa

SEQ ID NO: 101600 - RNA, 64 nt, Homo Sapiens
augaucacuuaccuaaaacucuuuucuuaaagagaguuuugaaaaugaaaacagccaugaauau

SEQ ID NO: 101601 - RNA, 64 nt, Homo Sapiens
caaugaaaauggaagcacuucauccuugcuaaguaguuuugacauaaaguuuauuuuccucugc

SEQ ID NO: 101602 - RNA, 64 nt, Homo Sapiens
aagcacaggguuauaggugugauguaccuaaugaaguuuugagaauuuaucaacguguugugaa

SEQ ID NO: 101603 - RNA, 64 nt, Homo Sapiens
ggcauuucauuaaggcaucuuuaaacagugagguaguuuugaauuuagcaccucaagguauaau

SEQ ID NO: 101604 - RNA, 64 nt, Homo Sapiens
aauucaagccucuaaacagauuuacaaguauaacaguuuugaguuaugaucagaagaacaugau

SEQ ID NO: 101605 - RNA, 64 nt, Homo Sapiens
acuuuguggcugguuuguccaugauggcucggucaguuuugaggcaaugccuuugacaccaacc

SEQ ID NO: 101606 - RNA, 64 nt, Homo Sapiens
gcuggcaucuugccaccccaccccugcuuggcccaguuuugauuugggggccuccaguguccug

SEQ ID NO: 101607 - RNA, 64 nt, Homo Sapiens
aacaauaauggggaaaauauccaucuaugacaugaguuuugagauaaaaccaucaucuguaaaa

SEQ ID NO: 101608 - RNA, 64 nt, Homo Sapiens
uauuuguguuuaaaugcugcuuuggggaaaaugaaguuuugauuuauuuacaauauaugacuaa

SEQ ID NO: 101609 - RNA, 64 nt, Homo Sapiens
accucugggguucagcuucugucucugcugucccaguuuugagguuugguuucuuguuucuguc

SEQ ID NO: 101610 - RNA, 64 nt, Homo Sapiens
gaaauucagucuaguucugcugauaaagaucaucaguuuugaaagguuacugauuuuccucuuc

SEQ ID NO: 101611 - RNA, 64 nt, Homo Sapiens
gaggcagagugguccccucuuugccaccuaggccaguuuugacccuggcauuaacuggccuuag

SEQ ID NO: 101612 - RNA, 64 nt, Homo Sapiens
uagagugaaagggguaagggggugggaggguaagaguuuugacaaguuguggcaaaggaaacua

SEQ ID NO: 101613 - RNA, 64 nt, Homo Sapiens
cauaaguaaaaauauuugagaaaaauaaaguacaaguuuugaacaacacaaaaggcaugaauuc

SEQ ID NO: 101614 - RNA, 64 nt, Homo Sapiens
uaacacuacuaaauuuugguuccuccauagaauuaguuuugaaacacuugauguagugagaaau

SEQ ID NO: 101615 - RNA, 64 nt, Homo Sapiens
accaugugggaaucagcauucuuaauuucguuaaaguuuugacuuguaaugaaauguucaagua

SEQ ID NO: 101616 - RNA, 64 nt, Homo Sapiens
ggcuggggugccaaacaccagaaggggagauaauaguuuugacucugaacuuggccacaacccc

SEQ ID NO: 101617 - RNA, 64 nt, Homo Sapiens
uuucuagcuuaucuacuuccaagcuauuuuuuucaguuuugauaauaguagaacgcuaucuggg

SEQ ID NO: 101618 - RNA, 64 nt, Homo Sapiens
gaucguuaaugcccuugaaggcacaaaacugaucaguuuugagaaaaagaaacaugguuuacuu

SEQ ID NO: 101619 - RNA, 64 nt, Homo Sapiens
gauguagggagccuuaguuggccuguggagucugaguuuugaagaggaagaagcuggacauuca

SEQ ID NO: 101620 - RNA, 64 nt, Homo Sapiens
gagugaugugagaaacuucucaagcagucuuuucaguuuugacuggacuaaacuaccuccaaag

SEQ ID NO: 101621 - RNA, 64 nt, Homo Sapiens
ucuggagcuaguguuuugacgcaccugauuucugaguuuugagugagcacuugggugaaucugg

SEQ ID NO: 101622 - RNA, 64 nt, Homo Sapiens
ggaauuuuuagagaggacauauaaauucuuagaaaguuuugagaaaacaccaaaauauuuuaga

SEQ ID NO: 101623 - RNA, 64 nt, Homo Sapiens
uggccuaggaggaaacccaggaccuuauuuuggaaguuuugaaugugagccuauuguguuacuu

SEQ ID NO: 101624 - RNA, 64 nt, Homo Sapiens
caaagauggacuucaguggguuaccuaucacucuaguuuugaagacugaaaaucugagaacuau

SEQ ID NO: 101625 - RNA, 64 nt, Homo Sapiens
gucuuuagauagaaacaugaggcagggaaaaacuaguuuugaguuugcaguuaggaaagggaug

SEQ ID NO: 101626 - RNA, 64 nt, Homo Sapiens
agcacugugguuuuccuuuugaucagccuagaaaaguuuugauuaaacacuuucuugggaagca

SEQ ID NO: 101627 - RNA, 64 nt, Homo Sapiens
agguaguuuggggcaaaaauccgaggugcuugggaguuuugaauguuaagaauugaccaucugc

SEQ ID NO: 101628 - RNA, 64 nt, Homo Sapiens
ugggguuuggaaauguaaauguguaccuugcuuuaguuuugaggcuggggaauaugugugggug

SEQ ID NO: 101629 - RNA, 64 nt, Homo Sapiens
agacacuuguaacauauucaacguccuguacuccaguuuugacuacgagaucagauuuuggagg

SEQ ID NO: 101630 - RNA, 64 nt, Homo Sapiens
gugaaauuagugugcagagucauucuaccgauaaaguuuugaaauaaugugaaaacuggagcau

SEQ ID NO: 101631 - RNA, 64 nt, Homo Sapiens
aguuuuacccuuucuaaacacuguccuuuuugaaaguuuugaauauauccacauucuauugaaa

SEQ ID NO: 101632 - RNA, 64 nt, Homo Sapiens
gacuuugguacugcugucuuccaagguagcucuaaguuuugaugugugggcuucugaguuuaua

SEQ ID NO: 101633 - RNA, 64 nt, Homo Sapiens
gaugguaguucaguugggguacuuguuuuauggaaguuuugauugauuuacuugcccucccacc

SEQ ID NO: 101634 - RNA, 64 nt, Homo Sapiens
uuaaguccucacccuuuacauuaucuaauucuucaguuuugaugcugauaccugcccccggccc

SEQ ID NO: 101635 - RNA, 64 nt, Homo Sapiens
uuguucuucacuaugauuuacugugugccaaaggaguuuugacaggguacagaguauuuuacua

SEQ ID NO: 101636 - RNA, 64 nt, Homo Sapiens
auguaaaaauugguuaacuuuacaaaugucagcuaguuuugacuacuaauugggggaaauuuua

SEQ ID NO: 101637 - RNA, 64 nt, Homo Sapiens
gcuuuccuucccuauuguuuuuguuuuuuuaaugaguuuugacgcauguuguuuugauugcuau

SEQ ID NO: 101638 - RNA, 64 nt, Homo Sapiens
aauauagagccacuuccugaaaccaagaaucuguaguuuugauccaaaaucuaaaacuuaaagu

SEQ ID NO: 101639 - RNA, 64 nt, Homo Sapiens
cuaucucagcugucuuuucuaacuguguagguugaguuuugaacacgugcuuguggacaucagg

SEQ ID NO: 101640 - RNA, 64 nt, Homo Sapiens
ugaccucagaacugaaauugauaaugaaguugcaaguuuugauagcccgugaagugcauaagua

SEQ ID NO: 101641 - RNA, 64 nt, Homo Sapiens
ccaguaauaugucuccuugcuucuuugaugugauaguuuugagaugggugagaaucuaauagau

SEQ ID NO: 101642 - RNA, 64 nt, Homo Sapiens
augugcaaaagcuccccguccagcuuugacagucaguuuugaugucagcuccucggcaggguag

SEQ ID NO: 101643 - RNA, 64 nt, Homo Sapiens
gaagggaagaccugcagugcuguuccuugcuuuuaguuuugauacugggguuucaauugacuuc

SEQ ID NO: 101644 - RNA, 64 nt, Homo Sapiens
gcaacauuguccccuacugggcugcaauuggugcaguuuugaauacaggucuggccagggacgu

SEQ ID NO: 101645 - RNA, 64 nt, Homo Sapiens
guuuaugcugggcacugccaacagucuuuuaucaaguuuugacggacagcaagauaaccccaag

SEQ ID NO: 101646 - RNA, 64 nt, Homo Sapiens
gcaaaugcuguaaagauauagcauuuaacuggccaguuuugauuaaauucaaaagugaacgaaa

SEQ ID NO: 101647 - RNA, 64 nt, Homo Sapiens
ggguugauuucccccacuccacaauuucuagaguaguuuugaauaccugcuauucugccaaaag

SEQ ID NO: 101648 - RNA, 64 nt, Homo Sapiens
aguaccuuuuauguucagaacagaugagcuaggaaguuuugagaugauaaggcauacauuugcg

SEQ ID NO: 101649 - RNA, 64 nt, Homo Sapiens
gacuucauauucuagaauacucuuuccacagccuaguuuugauuugcccugcuucuaaucuggu

SEQ ID NO: 101650 - RNA, 64 nt, Homo Sapiens
guguguuuauguggaauguucagcauauccagugaguuuugacaaaauuuaaguccuccaauuc

SEQ ID NO: 101651 - RNA, 64 nt, Homo Sapiens
cuacuccuguuugcccuccucaaccugccauggcaguuuugacaugaucuguugaacugucuuc

SEQ ID NO: 101652 - RNA, 64 nt, Homo Sapiens
uuucuaaaggagauagaaugcuugaacuaagaucaguuuugaagcacugaauaguaacuucuuu

SEQ ID NO: 101653 - RNA, 64 nt, Homo Sapiens
aaagcagguaguagagcagccucaggaacuaacaaguuuugagaugccacacccuagauccagc

SEQ ID NO: 101654 - RNA, 64 nt, Homo Sapiens
caagaauuggugauuuguuuucauaacagaugucaguuuugaacaauaugugauaugguaauuu

SEQ ID NO: 101655 - RNA, 64 nt, Homo Sapiens
aauaacuacauuuuauuucauucaucaguuggugaguuuugaagaacugagaugaucaguuaca

SEQ ID NO: 101656 - RNA, 64 nt, Homo Sapiens
ucagugggaaaaaaggaggugauauaaaacucaaaguuuugaagaaaugacaaauugauauucu

SEQ ID NO: 101657 - RNA, 64 nt, Homo Sapiens
cuuugucucucuggaauaugaacuuugcacuuguaguuuugaguucuggcagcucucucuaccc

SEQ ID NO: 101658 - RNA, 64 nt, Homo Sapiens
ccaaaagcuuuuuuguuacagcucuggguuauacaguuuugaucugauucugcucuaaaacauu

SEQ ID NO: 101659 - RNA, 64 nt, Homo Sapiens
cgccccagugcccuggagaauggcuggggcggccaguuuugacauccuggcgggugggaaggaa

SEQ ID NO: 101660 - RNA, 64 nt, Homo Sapiens
ugcaaguaagucagguuucacaagaaaauuuucaaguuuugaagggaauuugagguugaucugg

SEQ ID NO: 101661 - RNA, 64 nt, Homo Sapiens
gcaguaauuaaauugcaucccaggagauuuauaaaguuuugauauuuuucccuacucuggaauu

SEQ ID NO: 101662 - RNA, 64 nt, Homo Sapiens
uuuuguguagaaaaauaggugcaauaaugaucaaaguuuugaugucuugagucuccaucuuagg

SEQ ID NO: 101663 - RNA, 64 nt, Homo Sapiens
cccuuacgaaauacgucuuuuucagaacuguuaaaguuuugauguacaucgagcugaauucugu

SEQ ID NO: 101664 - RNA, 64 nt, Homo Sapiens
cuuccaucccugucaugucuucaguuaucucucgaguuuugaagcugaacaguagcaaaucaga

SEQ ID NO: 101665 - RNA, 64 nt, Homo Sapiens
cugaaguacaggcaaacuugauguuugaaagauaaguuuugagaaaugucauuguauuuuggag

SEQ ID NO: 101666 - RNA, 64 nt, Homo Sapiens
auggaaauaaaaauauuuguuagugaauugguugaguuuugauuccucuaacuucucagaauga

SEQ ID NO: 101667 - RNA, 64 nt, Homo Sapiens
acugggacauuuucauugauauucuauacaccaaaguuuugacgguuuaccaucauuccauuuu

SEQ ID NO: 101668 - RNA, 64 nt, Homo Sapiens
aauuuuggccacuuuacauuuagauucuggugagaguuuugacugaauguuccaaucucugaug

SEQ ID NO: 101669 - RNA, 64 nt, Homo Sapiens
gaagcaaguaaugucaacuuugagcacuuuguugaguuuugaaaaaucuuauuuguugcugcac

SEQ ID NO: 101670 - RNA, 64 nt, Homo Sapiens
caaugaaagagacauugaaauucgucaccccaaaaguuuugaauauguuaauaagcuucucccu

SEQ ID NO: 101671 - RNA, 64 nt, Homo Sapiens
auaaacaucuuuuucagaccaccucuauuauauuaguuuugaaucucaugcuacuuucuguuac

SEQ ID NO: 101672 - RNA, 64 nt, Homo Sapiens
auaggaaagauuccgccugcuaaccaaaaauuccaguuuugagauaagccagcugaucuaguag

SEQ ID NO: 101673 - RNA, 64 nt, Homo Sapiens
aaagauuuuccuauuccuuguaaguuuuauccguaguuuugauaucauuguaucaaauuauuuu

SEQ ID NO: 101674 - RNA, 64 nt, Homo Sapiens
uggaauugcaccauuucguauuugugaccuuaccaguuuugaauuaugcauuuccuugauucaa

SEQ ID NO: 101675 - RNA, 64 nt, Homo Sapiens
ucacaaauuuacuguaaggcaauaggauuuaggaaguuuugauccaguggcuaguaccaucugc

SEQ ID NO: 101676 - RNA, 64 nt, Homo Sapiens
acugugaaauguuuaggaacccuuuuaugugaaaaguuuugagaauaagcuuuaauaaucuucc

SEQ ID NO: 101677 - RNA, 64 nt, Homo Sapiens
aguuacacguaaaguagaagaacuaaacuaauaaaguuuugaaaccccauggaggcaguucagu

SEQ ID NO: 101678 - RNA, 64 nt, Homo Sapiens
ucuuuauaccaaaauucagugaaggcauucuacaaguuuugaguuagcauuacauuuuaauauu

SEQ ID NO: 101679 - RNA, 64 nt, Homo Sapiens
uauauuuguuuaauaauaaccuauuucaagucugaguuuugaaaauuuacauuucccaaguauu

SEQ ID NO: 101680 - RNA, 64 nt, Homo Sapiens
ggccaacuguggucaaagaauggcuuucaguuaaaguuuugacuucuuauuauaaauaauauaa

SEQ ID NO: 101681 - RNA, 64 nt, Homo Sapiens
ugucaccuucccuugcagcuuaaggagcccaguaaguuuugaaaauguuugcgaaucaaacuaa

SEQ ID NO: 101682 - RNA, 64 nt, Homo Sapiens
ccucaagagucagcuggcagguuuguugaaauacaguuuugaguuauuuugauguggcuuuuua

SEQ ID NO: 101683 - RNA, 64 nt, Homo Sapiens
uaugauauuuugaguaauuuuaugcaugaaacaaaguuuugacaggcuuuugaccgugauucau

SEQ ID NO: 101684 - RNA, 64 nt, Homo Sapiens
cuacacccucccccuccagggaaugcugaguuccaguuuugagcagaggugaggcagaauccac

SEQ ID NO: 101685 - RNA, 64 nt, Homo Sapiens
aauaguguaucucguggaauucuguagcuguguaaguuuugacaugacuauuuaucgucgauac

SEQ ID NO: 101686 - RNA, 64 nt, Homo Sapiens
ccuuugccugccuggugugcaaguuuuaauguauaguuuugaauuaagacacaaaugcaugaac

SEQ ID NO: 101687 - RNA, 64 nt, Homo Sapiens
aguuuuguaagguuuuuguucugaucaguuugcgaguuuugauguagucuuccgagaaacuuuu

SEQ ID NO: 101688 - RNA, 64 nt, Homo Sapiens
uaaugaaugcauugaaaauacaaauauuccaguaaguuuugaaaagcuugcagcaaguaaucuu

SEQ ID NO: 101689 - RNA, 64 nt, Homo Sapiens
uucaacuucucuccccgugcuuuauuccuguuacaguuuugacuguuuggaaagaauuuuugua

SEQ ID NO: 101690 - RNA, 64 nt, Homo Sapiens
gaguuuuugugguuuugguuaccuaaaaaauaccaguuuugaauggacauaugaaaauucaaga

SEQ ID NO: 101691 - RNA, 64 nt, Homo Sapiens
agugaucacuuuguucugguuuccaaaaugucugaguuuugaaucucagguuacuaugcugaaa

SEQ ID NO: 101692 - RNA, 64 nt, Homo Sapiens
uuuuuggcccugcauaaguuucuaagucaguguuaguuuugaaagggauccuccuucguggucu

SEQ ID NO: 101693 - RNA, 64 nt, Homo Sapiens
cuagguuaauaacacuuuauugucauuucuagacaguuuugaaucaagggcuucauuccuuuua

SEQ ID NO: 101694 - RNA, 64 nt, Homo Sapiens
gacuuccucuuggcucccagcaucuuucccuucuaguuuugagacuggauugauacggggaaaa

SEQ ID NO: 101695 - RNA, 64 nt, Homo Sapiens
gguuuuuuauauauccuagaucuuuuuacuauugaguuuugagauuucuauuuaggucauuugu

SEQ ID NO: 101696 - RNA, 64 nt, Homo Sapiens
aauugauauacccauguaacuauacaauucagugaguuuugauauaaaauguuccuacuuuaaa

SEQ ID NO: 101697 - RNA, 64 nt, Homo Sapiens
ucaggaacagauccaaaguuacuuuucuccuaguaguuuugaaugguccuuuuuuauaaaggac

SEQ ID NO: 101698 - RNA, 64 nt, Homo Sapiens
agcaggaagcucaugggggcuuguuuugccuguuaguuuugagguuugcuuucuaggagguuug

SEQ ID NO: 101699 - RNA, 64 nt, Homo Sapiens
cccgauuaaugucuguacguguuuacacgacuugaguuuugaacaggacccaacaacuaaccac

SEQ ID NO: 101700 - RNA, 64 nt, Homo Sapiens
cugugccuaaggcugcuugaucuauuucuauaacaguuuugaucuuaaaagcuuugugauugca

SEQ ID NO: 101701 - RNA, 64 nt, Homo Sapiens
ugacaaggcacaaauacuuucagaauuguauuucaguuuugaagauuuaaaaaaaaugugaaaa

SEQ ID NO: 101702 - RNA, 64 nt, Homo Sapiens
uacugugugggauacuuagugguaugucucuuuaaguuuugauuaauguuucuuaaauggaauu

SEQ ID NO: 101703 - RNA, 64 nt, Homo Sapiens
cuuccugaggccucaguauuagucgugagcacaaaguuuugagaccuuuggcguuguuucuuga

SEQ ID NO: 101704 - RNA, 64 nt, Homo Sapiens
guuccaaaccaguuuauucugugguucuauaauaaguuuugauauaaucuuggcuucuuaaaaa

SEQ ID NO: 101705 - RNA, 64 nt, Homo Sapiens
gggucuugagguggguacccgacaagagcugggcaguuuugaauuccacauuauucucuguggg

SEQ ID NO: 101706 - RNA, 64 nt, Homo Sapiens
uucaauaucugauagauacaaguucccauccuuaaguuuugauauguaauuggauuucgcuauc

SEQ ID NO: 101707 - RNA, 64 nt, Homo Sapiens
aacauuucauucuugaacgcacauuugauagaacaguuuugagguuuuauguccaauagcuacu

SEQ ID NO: 101708 - RNA, 64 nt, Homo Sapiens
ugaaaaucaauuuaccuuucugcuuuacacaggcaguuuugaaaagugguccaggauucuguaa

SEQ ID NO: 101709 - RNA, 64 nt, Homo Sapiens
augggcaaauccccucuuuucaguuuuucaauaaaguuuugauuguaaucuccuauuuuggugu

SEQ ID NO: 101710 - RNA, 64 nt, Homo Sapiens
ccauguguaaaguuuaaccauaaaauuguccuucaguuuugaggugguauauugaagacgaaau

SEQ ID NO: 101711 - RNA, 64 nt, Homo Sapiens
ucuaaaugucaauuuucuacaauuuuguaauauaaguuuugaaaugcuuaagacugcugcugau

SEQ ID NO: 101712 - RNA, 64 nt, Homo Sapiens
uuuuuaaagauaugucuguauugaagagaaagccaguuuugaguuuuuuacacuugcacaucau

SEQ ID NO: 101713 - RNA, 64 nt, Homo Sapiens
gauuaaacuuuuuuuuuucaguuuauggaccaagaguuuugauuuauuuaggguggaguucagg

SEQ ID NO: 101714 - RNA, 64 nt, Homo Sapiens
aagagagagugugugauuagaagcuaaauaggaaaguuuugagcuucaagucagugaggaguaa

SEQ ID NO: 101715 - RNA, 64 nt, Homo Sapiens
aucgaauauaguucuguguagagaaugucacuguaguuuugaguguauacaugugugggugcug

SEQ ID NO: 101716 - RNA, 64 nt, Homo Sapiens
ugcaucacuuaguuauugggcauuagaucgagucaguuuugaucuagaacugcuccuugguggc

SEQ ID NO: 101717 - RNA, 64 nt, Homo Sapiens
uuuuggccauuuucucuuuauuuucaacaaugguaguuuugaggauuguguccuuuuaauauug

SEQ ID NO: 101718 - RNA, 64 nt, Homo Sapiens
uuuuagauuccugagagaugucucuggaagggaaaguuuugagaacuaauggcuauuuuugagg

SEQ ID NO: 101719 - RNA, 64 nt, Homo Sapiens
aaaaucacagaaaauugucagauuucuucgggaaaguuuugauccgagugcuuuuuugguacca

SEQ ID NO: 101720 - RNA, 64 nt, Homo Sapiens
ucuguaugcaucuaauuucauuugcguaauacauaguuuugagccauaagcagguucuuuaugu

SEQ ID NO: 101721 - RNA, 64 nt, Homo Sapiens
uaucuauauguauauguauauuuaaucaaccagcaguuuugaaacuagucauccugguacaaaa

SEQ ID NO: 101722 - RNA, 64 nt, Homo Sapiens
aaaagccuucuuggaaaaugggacauuagcauugaguuuugaaagaugaguaggaguuugcuaa

SEQ ID NO: 101723 - RNA, 64 nt, Homo Sapiens
auauuuuuauaacgugguucuuauuuaacugucuaguuuugauagaauuuaccaggucuggcug

SEQ ID NO: 101724 - RNA, 64 nt, Homo Sapiens
ugcuaaauuuguauucucugugaauuucacuggcaguuuugaacuucccuuccuuaaaguacuc

SEQ ID NO: 101725 - RNA, 64 nt, Homo Sapiens
ugugcccaagucauuucagaaagaaagacccuucaguuuugaugcauuuugcugaacacuuggg

SEQ ID NO: 101726 - RNA, 64 nt, Homo Sapiens
ccuaacucaaucccugguacauuccuaauaaagcaguuuugaggaaaaucaacagacucuuuuu

SEQ ID NO: 101727 - RNA, 64 nt, Homo Sapiens
agcaacuauggguuugcaguuuucugaguaggugaguuuugaauauggguaaaucagaauaaug

SEQ ID NO: 101728 - RNA, 64 nt, Homo Sapiens
agccauuugaauguuaggaagcuucggggagacaaguuuugagagaagccccagagggagcuau

SEQ ID NO: 101729 - RNA, 64 nt, Homo Sapiens
ugagcaucucuguuugguaaggaggacaauugucaguuuugagggggacauguguuaaaucaca

SEQ ID NO: 101730 - RNA, 64 nt, Homo Sapiens
ggaaggagagaugaccccuacccccucaucccccaguuuugaaaaggucuaagcaagugagucu

SEQ ID NO: 101731 - RNA, 64 nt, Homo Sapiens
gugcuucauaucauguaccuaauuuaauguauucaguuuugacuauaucauucgccucuauaac

SEQ ID NO: 101732 - RNA, 64 nt, Homo Sapiens
gacuguaguauggauggguucccuagaaauguccaguuuugaguaguaacuacuuuggcucuac

SEQ ID NO: 101733 - RNA, 64 nt, Homo Sapiens
ggugaggggaccagagcaguccugguccaucuggaguuuugaggcggcagugccguuccggagg

SEQ ID NO: 101734 - RNA, 64 nt, Homo Sapiens
uucugagguuugcuuugguuugcuuuuuuauuuuaguuuugauguuuuguuuugcuucauuuua

SEQ ID NO: 101735 - RNA, 64 nt, Homo Sapiens
cuuaaccccauggacuccuuugccagcccuggucaguuuugauuuacaacaugccaucuauagu

SEQ ID NO: 101736 - RNA, 64 nt, Homo Sapiens
gauuuugcaguaaagaccugauugcugccgugugaguuuugaaucuuugcaauguauugaagga

SEQ ID NO: 101737 - RNA, 64 nt, Homo Sapiens
ucucugcuuaacacucaagacguaaauacuugguaguuuugacaguuuugcuuucaggauuugg

SEQ ID NO: 101738 - RNA, 64 nt, Homo Sapiens
guaaaaauuuuugguugugcgaaaagugagagguaguuuugauauuguuuucagucagauuucu

SEQ ID NO: 101739 - RNA, 64 nt, Homo Sapiens
cauugcauuuaaguucccuauuugcaguccuauuaguuuugagcaaccuuguuugaagcuguua

SEQ ID NO: 101740 - RNA, 64 nt, Homo Sapiens
aaguaauucauacaaaguaccuggcccauucuugaguuuugauaacaggugugagccacagugc

SEQ ID NO: 101741 - RNA, 64 nt, Homo Sapiens
uacguuuucuauuucaugugaaucucauauauauaguuuugaaauagguagaaaaugugaaaua

SEQ ID NO: 101742 - RNA, 64 nt, Homo Sapiens
aucagcauguuagacaacuacacaguauguuguuaguuuugaaagacauucacucaaggaaaac

SEQ ID NO: 101743 - RNA, 64 nt, Homo Sapiens
aauuguuaagcugcaguugaguuguucaagugagaguuuugauaagccacuuaugggccgcguu

SEQ ID NO: 101744 - RNA, 64 nt, Homo Sapiens
uuccugaaauuaaaaaaguuuacaguauauauggaguuuugaacuggaaaccuauuguugauau

SEQ ID NO: 101745 - RNA, 64 nt, Homo Sapiens
ggucagugucccagacauuugugagccaggggccaguuuugacacuauauuugaugggaaccca

SEQ ID NO: 101746 - RNA, 64 nt, Homo Sapiens
uaaacacuuuucaguuucuuguuuacuagacugaaguuuugaaguuuuaugauucauaauuuca

SEQ ID NO: 101747 - RNA, 64 nt, Homo Sapiens
aaaaagacauuuuuuaaaaggggcacugugauacaguuuugaguuuuaucuauuagauaaucaa

SEQ ID NO: 101748 - RNA, 64 nt, Homo Sapiens
caugagagucauacagagcgcuugaauaaaaaauaguuuugaagccuagggccauuguaaguca

SEQ ID NO: 101749 - RNA, 64 nt, Homo Sapiens
uauaguuugucauccugugauuuugcuuuuuuucaguuuugaaaucaggagugagauauaaaca

SEQ ID NO: 101750 - RNA, 64 nt, Homo Sapiens
uuuagaccucagccuuuuguuaaacuguuauacuaguuuugagcuugacagccaacuaauacag

SEQ ID NO: 101751 - RNA, 64 nt, Homo Sapiens
uuuuuccccucauucaucucauaguuuugaaaggaguuuugacuuuuuuucugaugcuuugaau

SEQ ID NO: 101752 - RNA, 64 nt, Homo Sapiens
ggaguuuugacuuuuuucccgaugcuuugaauauaguuuugaaaaagaaaaaaaaauuuuuucu

SEQ ID NO: 101753 - RNA, 64 nt, Homo Sapiens
uuuggucauagagucuucauaguuccuuaaaaucaguuuugaacuuuccugucuugcuucacac

SEQ ID NO: 101754 - RNA, 64 nt, Homo Sapiens
uuccuugcaacuuagccaugaaauucuuuuucaaaguuuugaagucucucacuucucagggaug

SEQ ID NO: 101755 - RNA, 64 nt, Homo Sapiens
aaacagguuuguuuuuuauuuucuuuacacugccaguuuugacacauacacuuccagugcugcc

SEQ ID NO: 101756 - RNA, 64 nt, Homo Sapiens
gugguucccgacuucuuugccagauuuuaaaaucaguuuugaaacaguaugucuucagcuugau

SEQ ID NO: 101757 - RNA, 64 nt, Homo Sapiens
uccaucuuccaggagagacggcaccuccggaugcaguuuugaugcuuccuucugggugcagacu

SEQ ID NO: 101758 - RNA, 64 nt, Homo Sapiens
gggaccaggaugacaccuccauuucucuccaggaaguuuugaguuucucuccaccgugacacaa

SEQ ID NO: 101759 - RNA, 64 nt, Homo Sapiens
auuuaaguucuuuugucaccaaauauuaauaaacaguuuugacuucacaccaagguuggauaaa

SEQ ID NO: 101760 - RNA, 64 nt, Homo Sapiens
agaacugggcagacaccccuggagcucagccgacaguuuugaugagcagggaagucugaggccc

SEQ ID NO: 101761 - RNA, 64 nt, Homo Sapiens
gcuggggguagaugagacccuacuacugaacuccaguuuugaucucgugacuuuuagaaaaaca

SEQ ID NO: 101762 - RNA, 64 nt, Homo Sapiens
cuagauuugaugggugugaagauuaugagaguaaaguuuugaagacucagggauagcuguaaug

SEQ ID NO: 101763 - RNA, 64 nt, Homo Sapiens
uccgugugugcauauuuguugguucucugauuaaaguuuugagucuaaaagcauugguuccuuc

SEQ ID NO: 101764 - RNA, 64 nt, Homo Sapiens
uuccgugggggaaugucauggucuugcuuuacuaaguuuugagacuggcagguagugaaacuca

SEQ ID NO: 101765 - RNA, 64 nt, Homo Sapiens
cgcucuguugauuguguccuuugaugaaauuuuaaguuuugauguacuguugacucuuucuguc

SEQ ID NO: 101766 - RNA, 64 nt, Homo Sapiens
gagcccuguauucuuggcuguacccgucgaauggaguuuugaucucgcugaguuuggaguuggg

SEQ ID NO: 101767 - RNA, 64 nt, Homo Sapiens
ggacaguggguugagggagaacaguucuuaguccaguuuugauguuaacuuccauagcugacaa

SEQ ID NO: 101768 - RNA, 64 nt, Homo Sapiens
cucacaucacccacugugcacggucuggaggcguaguuuugaaaugacagcugggaggguuucu

SEQ ID NO: 101769 - RNA, 64 nt, Homo Sapiens
ugucugucccuccucccuggcggccuucuguaauaguuuugagaaaccccaccccucguccucu

SEQ ID NO: 101770 - RNA, 64 nt, Homo Sapiens
uacauauaguuaaauauaugacaugcagacauuuaguuuugauuuuuccugucugccugcaaac

SEQ ID NO: 101771 - RNA, 64 nt, Homo Sapiens
guuguauuccaaaggccucaagagcggcaagaugaguuuugagcaaccuugugagcagaaggca

SEQ ID NO: 101772 - RNA, 64 nt, Homo Sapiens
uuacaguaaaaguugugaacuuuaagucaguagaaguuuugaacaaacuuguuuagcacccguu

SEQ ID NO: 101773 - RNA, 64 nt, Homo Sapiens
ucccaggcucaagcgauccuguccggcucacugcaguuuugaccggcuggagugcaguguugca

SEQ ID NO: 101774 - RNA, 64 nt, Homo Sapiens
gcuaaccuguucagagccaggaaggagacugcacaguuuugaaagcacagcccgucagguccgg

SEQ ID NO: 101775 - RNA, 64 nt, Homo Sapiens
aaagcaacuuaucagcuacuuaagagaaauggcaaguuuugauaugaguauacaauauauaaaa

SEQ ID NO: 101776 - RNA, 64 nt, Homo Sapiens
ccuuuguucuugaacacuuuugcccugcagccucaguuuugaauucuuuuagcaacuuggauua

SEQ ID NO: 101777 - RNA, 64 nt, Homo Sapiens
aaaugacugcuauggugggaacacaauaaacaccaguuuugacuuuuagugcauaguuguccuu

SEQ ID NO: 101778 - RNA, 64 nt, Homo Sapiens
ucagauuggucacauaaaugccacggcauuccgaaguuuugauuuugauuaacauugacaggau

SEQ ID NO: 101779 - RNA, 64 nt, Homo Sapiens
guccucuugggguuuuguaccaucugaugcuggaaguuuugauuagugauauuuucuacuacua

SEQ ID NO: 101780 - RNA, 64 nt, Homo Sapiens
cuuugcuuucuuauuucucuuucucugcguuguuaguuuugaagaguggaggagcuaggggcuc

SEQ ID NO: 101781 - RNA, 64 nt, Homo Sapiens
ucuucgaccgauuugugggaucacauggucuugcaguuuugaacagcagauuuucucacuggua

SEQ ID NO: 101782 - RNA, 64 nt, Homo Sapiens
auuuauaguacuuugaugucuuuuucuguacgauaguuuugauaauuuugcaacgaauuuguaa

SEQ ID NO: 101783 - RNA, 64 nt, Homo Sapiens
agcuggcuuacacuggcaauccuguguuaauuuaaguuuugacagccguugcugacuuagaauc

SEQ ID NO: 101784 - RNA, 64 nt, Homo Sapiens
uauagaugcuaugguucagauuaauacucuugccaguuuugaaaaagggccacaaggugcaggg

SEQ ID NO: 101785 - RNA, 64 nt, Homo Sapiens
ucaaauauauuucucuuucaaaggauaugugcugaguuuugauguucacguguauauauagacc

SEQ ID NO: 101786 - RNA, 64 nt, Homo Sapiens
aaacuguauuuguaaaaaaaugauguaugucccaaguuuugaugguacugaaaagaaaugaagu

SEQ ID NO: 101787 - RNA, 64 nt, Homo Sapiens
uucuagccacucgagcucauaaaaaccugagcacaguuuugaaguuuuuuauaacuuccaaaac

SEQ ID NO: 101788 - RNA, 64 nt, Homo Sapiens
aguagucggauuccggggaaaagaacaaguaucuaguuuugaugacaauguuuucuuguaagaa

SEQ ID NO: 101789 - RNA, 64 nt, Homo Sapiens
aacuagguuuacagucccuuauuuuuaaugccuaaguuuugacagcaggaagaaaacaauuuuu

SEQ ID NO: 101790 - RNA, 64 nt, Homo Sapiens
uguuuaauguccuguucuuaagcucguuagagccaguuuugaaacguuuggucuuaccgugaac

SEQ ID NO: 101791 - RNA, 64 nt, Homo Sapiens
gaggaaaaugugcucaauuauuuuccucauauuuaguuuugaauugguuccguuuuacggagau

SEQ ID NO: 101792 - RNA, 64 nt, Homo Sapiens
uuauauauguuauugaacaauuuucauaccugccaguuuugaaugcaaaaaacaaaguaaccuu

SEQ ID NO: 101793 - RNA, 64 nt, Homo Sapiens
uacgguuauuuaaaaacuaaguauaggaugugaaaguuuugaauaugcuucuuggggaaaaaua

SEQ ID NO: 101794 - RNA, 64 nt, Homo Sapiens
uugauaagaaacugggauaaaauugggacuuaggaguuuugauucguuuuaugguacuuguugg

SEQ ID NO: 101795 - RNA, 64 nt, Homo Sapiens
ggcauugcuuuaaaggaaaaguuacagugaacagaguuuugaaauuuaccaaagagcugccaag

SEQ ID NO: 101796 - RNA, 64 nt, Homo Sapiens
uauuucucuuuggaugaauaucauuguuaacuggaguuuugauggaaauaaggaaaaacccuuc

SEQ ID NO: 101797 - RNA, 64 nt, Homo Sapiens
uacagggccagucuacauuaauggcuuuaaggacaguuuugauccagggcuucaucuucacuug

SEQ ID NO: 101798 - RNA, 64 nt, Homo Sapiens
ccacgcagaccuuggguggguguucuuauucuugaguuuugauacaugguggugguuuggcuuc

SEQ ID NO: 101799 - RNA, 64 nt, Homo Sapiens
uaacauaccguuuauaaugcaauagaaacaacacaguuuugaccaacugggaugaaacuaaagc

SEQ ID NO: 101800 - RNA, 64 nt, Homo Sapiens
gagcacuuuauuuucgucaaaaaccugcugugagaguuuugacacaucuccuuguuccagcuga

SEQ ID NO: 101801 - RNA, 64 nt, Homo Sapiens
gcacaaaccuucuuuucaaugcaaugcaucugaaaguuuugauacuuguaacuuuuuuuuuuuu

SEQ ID NO: 101802 - RNA, 64 nt, Homo Sapiens
aaaguugaaauggguauguaaguugaaaaccagaaguuuugagaaacauccuuuguuaacuuuc

SEQ ID NO: 101803 - RNA, 64 nt, Homo Sapiens
aaccuuccaaaacaaaaauaaagaccuguccaaaaguuuugacaaaaauacugauugcucccaa

SEQ ID NO: 101804 - RNA, 59 nt, Homo Sapiens; identical to SEQ ID NO: 101291

SEQ ID NO: 101805 - RNA, 64 nt, Homo Sapiens
aauaaacaugggaaagccauuggccauuaugccuaguuuugaugagcugaucagaagcucagca

SEQ ID NO: 101806 - RNA, 64 nt, Homo Sapiens
ucuggaauuccucugcccccuuccugcgccuuuuaguuuugaacauagaaugaaaugacuuuga

SEQ ID NO: 101807 - RNA, 64 nt, Homo Sapiens
augcugggaaaagugacugcccuggcuucuuaagaguuuugaugccagagauuggguccuuggg

SEQ ID NO: 101808 - RNA, 64 nt, Homo Sapiens
gucaucuuaaauuucaaaccauuuaccaucugaaaguuuugauuugaauguaaaacaggaaauu

SEQ ID NO: 101809 - RNA, 64 nt, Homo Sapiens
auuaccuguggaguugcauauccaaaccuuagugaguuuugaagcuuuaagcaaauucuuuuaa

SEQ ID NO: 101810 - RNA, 64 nt, Homo Sapiens
cacauuuauuggugcugccagcuuuaagcauaugaguuuugauauucuauauuuuucaaauccu

SEQ ID NO: 101811 - RNA, 64 nt, Homo Sapiens
acugcucuuuaccuugcauuuuagcuaauuuaggaguuuugagaauguauuggauacgcuccag

SEQ ID NO: 101812 - RNA, 64 nt, Homo Sapiens
uuguuaaagggcaagaaaaaagggaggggguuggaguuuugaacguaguaagccuuaccuuaau

SEQ ID NO: 101813 - RNA, 64 nt, Homo Sapiens
cuuggcagaaagacauuuuucuccucaguagcauaguuuugauguuagugaggaacauuguuga

SEQ ID NO: 101814 - RNA, 64 nt, Homo Sapiens
ugaccacuugcugucucuguuguauuuugguaugaguuuugauagcucuauaaaauguuuugga

SEQ ID NO: 101815 - RNA, 64 nt, Homo Sapiens
uuguuuauaugguaaaggaauccuuucagcugccaguuuugaauaaugaauaucauauuguauc

SEQ ID NO: 101816 - RNA, 64 nt, Homo Sapiens
ccaagguaacagaauugcugacaucugucuaaaaaguuuugacuauccaauuuagauguguaau

SEQ ID NO: 101817 - RNA, 64 nt, Homo Sapiens
acaaaauguugauaucauaggugauguacaauuuaguuuugaaugaguuauuauguuaucacug

SEQ ID NO: 101818 - RNA, 64 nt, Homo Sapiens
ccuacagccaguaagugauaaaucuagaaaauugaguuuugaguaccucuuuucccauauacaa

SEQ ID NO: 101819 - RNA, 64 nt, Homo Sapiens
ugucuuuaaaacauagugauuacaauauuuagaaaguuuugagcacuugcuauaaguuuuuuaa

SEQ ID NO: 101820 - RNA, 64 nt, Homo Sapiens
uuguugauaauuuuuagaagcaaauuuuccugaaaguuuugaguagaggugagacccccucccc

SEQ ID NO: 101821 - RNA, 64 nt, Homo Sapiens
cuguauuucaguaguuguagaauuauugauauuuaguuuugauagcuaauguuuaauuguuugg

SEQ ID NO: 101822 - RNA, 64 nt, Homo Sapiens
guuauaagguggaaggaaacucauuuuucaggaaaguuuugaguucauuuuuucauuucucuuc

SEQ ID NO: 101823 - RNA, 64 nt, Homo Sapiens
augcacaaaauaaacagcagguaguagaaacuuuaguuuugaugaauaaacaccgaggcuuacu

SEQ ID NO: 101824 - RNA, 64 nt, Homo Sapiens
uuuauuuaugcuaauauuuucuauaagugugaccaguuuugauauaauauguuuuauucagcuu

SEQ ID NO: 101825 - RNA, 64 nt, Homo Sapiens
auaugugaauacacaaauuuuauuucagaagggcaguuuugauuuuaaaauaaauacaaauguu

SEQ ID NO: 101826 - RNA, 64 nt, Homo Sapiens
uuauuuuuuuaauaaaauuucagauuugcugaacaguuuugauguauuuugguuacauugaaua

SEQ ID NO: 101827 - RNA, 64 nt, Homo Sapiens
agguucuuaaauccucauaucuggaaacuugugaaguuuugacaccuuuccuauagauauagga

SEQ ID NO: 101828 - RNA, 64 nt, Homo Sapiens
aaaaauguccaacauacaguuuuuaaaguguggcaguuuugaguaguaacuuagaauguauaag

SEQ ID NO: 101829 - RNA, 64 nt, Homo Sapiens
cuccaggguuugggcuugauuccuguugaauaauaguuuugagcauucuuugugguuaaauaaa

SEQ ID NO: 101830 - RNA, 64 nt, Homo Sapiens
uucuuugugguuaaauaaauucuuaaaucugccuaguuuugaugaauucuuuugugaaacuuga

SEQ ID NO: 101831 - RNA, 64 nt, Homo Sapiens
ucaggaaaugaaagcuaaaacaacccauuugcuacccauccaaagcacuuacaguuuagcaaau

SEQ ID NO: 101832 - RNA, 64 nt, Homo Sapiens
gaacgagaugucacuaaaaacaguaaaaaugacucccauccauccucugacaaggaagaaggug

SEQ ID NO: 101833 - RNA, 64 nt, Homo Sapiens
gguugaauaugcaaaagcaguuccgcugggaacccccauccaaucaacugcuguacccaugggg

SEQ ID NO: 101834 - RNA, 64 nt, Homo Sapiens
cagcugaacuccuccaucuuccaaaucaaucaggcccauccaucccaugccucccuccucccca

SEQ ID NO: 101835 - RNA, 61 nt, Homo Sapiens
ucaauggaccuccucugugagacugugccuucccauccaggcuggaaggagcucucuguga

SEQ ID NO: 101836 - RNA, 64 nt, Homo Sapiens
cucuucuaacacccucagucagugacacacccaucccauccaccacuucccccguguggggucc

SEQ ID NO: 101837 - RNA, 64 nt, Homo Sapiens
ccagugcuaugccuggaggcucaacacaaaacuucccauccaaacauucagaugaacugagcgu

SEQ ID NO: 101838 - RNA, 64 nt, Homo Sapiens
aaucaagcuucucgcccacuccacggcucugagccccauccaagggcaagacuuggugcccagc

SEQ ID NO: 101839 - RNA, 64 nt, Homo Sapiens
gcuggugcucagcugcuugaagcugcgcugaggucccauccacaguggaaugggagguuggauu

SEQ ID NO: 101840 - RNA, 64 nt, Homo Sapiens
uccucucuacucugccaguccucccguucuuccucccauccaccucccaucuccccucuccccu

SEQ ID NO: 101841 - RNA, 64 nt, Homo Sapiens
cgcucaggcaugcaaccaugggcaccaggcaauacccauccaucacccaucucacucuccccag

SEQ ID NO: 101842 - RNA, 64 nt, Homo Sapiens
gcacuaagucucuagccucuuucucccuucugcucccauccaagaaagacaguguauaaggaac

SEQ ID NO: 101843 - RNA, 64 nt, Homo Sapiens
cccaacuccaauaaucccccagcccaguuccuuucccauccauccugaggagagcauuggcuga

SEQ ID NO: 101844 - RNA, 64 nt, Homo Sapiens
aacuuggccuaaaaauacucgccuuaagucaccucccauccaagcugagaucagagccagauca

SEQ ID NO: 101845 - RNA, 64 nt, Homo Sapiens
augggaccagguuggaccacguggcaucagaggucccauccagauccaacuauagguccaagag

SEQ ID NO: 101846 - RNA, 64 nt, Homo Sapiens
uugauccucccacccagucugccccuggucucugcccauccaaucagagcccacccuccuggaa

SEQ ID NO: 101847 - RNA, 64 nt, Homo Sapiens
uccucccucaucuccucugccugugucugcgacccccauccaugugccaaagugucccuugggu

SEQ ID NO: 101848 - RNA, 64 nt, Homo Sapiens
ggccaccuucccugcaaugggugcacacgcggcucccauccagcccucucagcguggggcugug

SEQ ID NO: 101849 - RNA, 64 nt, Homo Sapiens
gauugccagcacagugaguuucccagccugcucccccauccacacuuggaaauugagggagcau

SEQ ID NO: 101850 - RNA, 64 nt, Homo Sapiens
uaccuccacgggugucagcccagaugacuccucacccauccaccaccugcagcuugagauguua

SEQ ID NO: 101851 - RNA, 64 nt, Homo Sapiens
augcugauacacacuguuguuaggccugcaccugcccauccagaaagcagcagcugccuuguua

SEQ ID NO: 101852 - RNA, 64 nt, Homo Sapiens
uccuuccccuugaaguagggggacccugaauuugcccauccaccugggucacuuugagaguugu

SEQ ID NO: 101853 - RNA, 64 nt, Homo Sapiens
cucaggccuuaggucuggccgaucugucccugaucccauccaugucacccuucuugaagucucc

SEQ ID NO: 101854 - RNA, 64 nt, Homo Sapiens
ccuggacgcaggcccugccgccugccucaguuuccccauccacacuauacccuugacgcccaua

SEQ ID NO: 101855 - RNA, 63 nt, Homo Sapiens
ccucagagaguugaggaccgcagcauccccuccacuccagaguugggugguauggauuuucaa

SEQ ID NO: 101856 - RNA, 63 nt, Homo Sapiens
cagcacacaauuucaagccauuuucagaucagaacuccagaaguguugacaagaugccuauuc

SEQ ID NO: 101857 - RNA, 63 nt, Homo Sapiens
caguugcaguauuucaaagucccuauccaggucacuccagaaaaggguauugaaacguugaaa

SEQ ID NO: 101858 - RNA, 63 nt, Homo Sapiens
ucauaacauauaugagguauacaaaauuuucuaacuccagauuguagucauuuugagagguac

SEQ ID NO: 101859 - RNA, 63 nt, Homo Sapiens
cugcuguugccauagccccaaaaagacccugagacuccagaauccuguaacuuaucuagaaag

SEQ ID NO: 101860 - RNA, 63 nt, Homo Sapiens
cugagcccccggcuaguacccggaagccgucugacuccagaguuugucugaggccucaucccu

SEQ ID NO: 101861 - RNA, 63 nt, Homo Sapiens
ggacaauguccccuauucaguugugguucucuaacuccagaaaagagcacagaccccagaguc

SEQ ID NO: 101862 - RNA, 63 nt, Homo Sapiens
auguacaaaacacagccacuucauauaaagguuacuccagacccacacaccugggcagccacu

SEQ ID NO: 101863 - RNA, 63 nt, Homo Sapiens
augcuaccuuuugggaaacaaacugccccguuaacuccagaucauugcacuggaauguaauca

SEQ ID NO: 101864 - RNA, 63 nt, Homo Sapiens
aauuuacugugacuagauuugaagcaaauaaauacuccagauccaugcagcuagaacacacuu

SEQ ID NO: 101865 - RNA, 63 nt, Homo Sapiens
cugaccucaucaugguucuaguucucauacagaacuccagaauuuuuaaagaacucuauaauu

SEQ ID NO: 101866 - RNA, 63 nt, Homo Sapiens
cauguggcccaccagcagccuuuccaaaggggaacuccagagacauuucauaaugcaaacagc

SEQ ID NO: 101867 - RNA, 63 nt, Homo Sapiens
ucccuuccugcccaucccuucccuacaaugcccacuccagacgcaaagauacacuuuuuuccu

SEQ ID NO: 101868 - RNA, 63 nt, Homo Sapiens
uaaaaugcagcuguuguuagacaacuguugaaaacuccagaaauacaucacccaagguggcag

SEQ ID NO: 101869 - RNA, 63 nt, Homo Sapiens
agccuccgcaggaugccggacaauggugaagaaacuccagauaucaaggaauugggaaauccu

SEQ ID NO: 101870 - RNA, 63 nt, Homo Sapiens
cagcaaaucucaugauaaaggacaaggucaagaacuccagagcacugagcagagaggcuggug

SEQ ID NO: 101871 - RNA, 63 nt, Homo Sapiens
cuugggccguccccauuugcagcagggaacaaaacuccagacuuuacuggguaaaagcagggc

SEQ ID NO: 101872 - RNA, 63 nt, Homo Sapiens
caguaguuagguuugguuugcauguugcaaagaacuccagaguaaccuaaaaauguaggcuuu

SEQ ID NO: 101873 - RNA, 63 nt, Homo Sapiens
ucaugcucgcuucccuuggcaugcauguaguccacuccagaaaaguuuacugaacuccagacc

SEQ ID NO: 101874 - RNA, 63 nt, Homo Sapiens
augcauguaguccacuccaguccaguuuacugaacuccagaccaagacuugggggugaaacuu

SEQ ID NO: 101875 - RNA, 63 nt, Homo Sapiens
aacugcggcacgcgcuucggucccccugcucccacuccagaagcuccucuacccaaagcucug

SEQ ID NO: 101876 - RNA, 63 nt, Homo Sapiens
ccugcccaggcucaggcccagggggcuaugugcacuccagaccucacugcccucucccugccu

SEQ ID NO: 101877 - RNA, 63 nt, Homo Sapiens
uuguggggagaguggggaauguaaacacugggaacuccagaaguucuggauacagccuuuugg

SEQ ID NO: 101878 - RNA, 63 nt, Homo Sapiens
cgagggaagccagcuuccaaucccaaacccagcacuccagacugaaagacugcaauagaaaac

SEQ ID NO: 101879 - RNA, 63 nt, Homo Sapiens
guccugcucacccuuuccuuagccuccccaacuacuccagacugaaacucacccaaagccugu

SEQ ID NO: 101880 - RNA, 63 nt, Homo Sapiens
ugugaccuggcucugguucaugcagggcccaggacuccagagcgaaugccagaggagcaagga

SEQ ID NO: 101881 - RNA, 63 nt, Homo Sapiens
uggggcucugggagggauguguccuccauuucaacuccagaagaagguaacugagagcagaug

SEQ ID NO: 101882 - RNA, 63 nt, Homo Sapiens
ccacaaagccgugccuuucuuccaaguuccugcacuccagaaucacccccuccagcuccaguu

SEQ ID NO: 101883 - RNA, 63 nt, Homo Sapiens
uucguccaaggcaccggugugugugugucuugcacuccagagcugaccuccaccgcccagccu

SEQ ID NO: 101884 - RNA, 63 nt, Homo Sapiens
ugccacccagccacuuagggucuacagggugggacuccagaccuagagcguaaguauggaugu

SEQ ID NO: 101885 - RNA, 64 nt, Homo Sapiens; identical to SEQ ID NO: 24344

SEQ ID NO: 101886 - RNA, 64 nt, Homo Sapiens; identical to SEQ ID NO: 24345

SEQ ID NO: 101887 - RNA, 64 nt, Homo Sapiens; identical to SEQ ID NO: 24346

SEQ ID NO: 101888 - RNA, 64 nt, Homo Sapiens; identical to SEQ ID NO: 24347

SEQ ID NO: 101889 - RNA, 64 nt, Homo Sapiens; identical to SEQ ID NO: 24348

SEQ ID NO: 101890 - RNA, 64 nt, Homo Sapiens; identical to SEQ ID NO: 24349

SEQ ID NO: 101891 - RNA, 64 nt, Homo Sapiens; identical to SEQ ID NO: 24350

SEQ ID NO: 101892 - RNA, 64 nt, Homo Sapiens; identical to SEQ ID NO: 24351

SEQ ID NO: 101893 - RNA, 64 nt, Homo Sapiens; identical to SEQ ID NO: 24352

SEQ ID NO: 101894 - RNA, 64 nt, Homo Sapiens; identical to SEQ ID NO: 24353

SEQ ID NO: 101895 - RNA, 64 nt, Homo Sapiens; identical to SEQ ID NO: 24354

SEQ ID NO: 101896 - RNA, 64 nt, Homo Sapiens; identical to SEQ ID NO: 24355

SEQ ID NO: 101897 - RNA, 64 nt, Homo Sapiens
ugaaaacaacauuggccuuuuguaucucacaauucuggucuagauucaguuaugaauguaggca

SEQ ID NO: 101898 - RNA, 64 nt, Homo Sapiens
ggaauaugguuguggauuucugagcaugugcagacuggucuagcuaguucaggaacuggugcau

SEQ ID NO: 101899 - RNA, 64 nt, Homo Sapiens
ugaguucuagaacuucucucaauaaagcaauauacuggucuagcuaggauauugagccaauuua

SEQ ID NO: 101900 - RNA, 64 nt, Homo Sapiens
uuuagauaggauauugagccugcuuugaaaaccacuggucuagccugaugcaguccaggcucca

SEQ ID NO: 101901 - RNA, 64 nt, Homo Sapiens
gaguucaagggccugaggcaaggucucuguugaacuggucuaauggguaagagggaggccacug

SEQ ID NO: 101902 - RNA, 64 nt, Homo Sapiens
uguaucuaggcuuagggagcgcccauggucagcucuggucuagauuuucccuuccuuuuugcag

SEQ ID NO: 101903 - RNA, 64 nt, Homo Sapiens
uaugaaagaaaaacuugaaaugcuacuuaacuuacuauuucaaagggaaguauauuucuuuuua

SEQ ID NO: 101904 - RNA, 64 nt, Homo Sapiens
augcacacaaaaaauaacuuauaguuagacuuuucuauuucaaguaaagcuuugaguuacuugu

SEQ ID NO: 101905 - RNA, 64 nt, Homo Sapiens
cguuucuaggguuuuuuauuuuuagcuuucuuuucuauuucacuuguucucuaaucaauagugg

SEQ ID NO: 101906 - RNA, 64 nt, Homo Sapiens
gccacagcauaagaaugucaggauauuuauuaggcuauuucaaaauuacuugcucugggcaagu

SEQ ID NO: 101907 - RNA, 64 nt, Homo Sapiens
uucuaaauaccauuaaggcuugacugguuaauuccuauuucaaggauuuggauuuauucaggua

SEQ ID NO: 101908 - RNA, 64 nt, Homo Sapiens
uuugugagcaaaguaaccccauaaguuuauuucccuauuucaugguauuguuuaaacuuuaaaa

SEQ ID NO: 101909 - RNA, 64 nt, Homo Sapiens
uguauuauaugauugagcaaaaguaauaauaaaacuauuucagagggaccauugcauugugccc

SEQ ID NO: 101910 - RNA, 64 nt, Homo Sapiens
guaugaauauaucacaguuuuuuauuaccaaguacuauuucauugcagcuguaguuuguuucuu

SEQ ID NO: 101911 - RNA, 64 nt, Homo Sapiens
uguggaacaacccaguaauaucagacucgaauuacuauuucauucuauuucaaaugcuuauaaa

SEQ ID NO: 101912 - RNA, 64 nt, Homo Sapiens
cccaguaauaucagacucgaauuacuauuucauucuauuucaaaugcuuauaaagcuacuauug

SEQ ID NO: 101913 - RNA, 64 nt, Homo Sapiens
uuccccaguccaaaacacagucauuucaccuggacuauuucaaucauuacacagguguccaacc

SEQ ID NO: 101914 - RNA, 64 nt, Homo Sapiens
uuaacugaagaaagagaaauugaauaauauaguucuauuucaacauguggguucacagauuuau

SEQ ID NO: 101915 - RNA, 64 nt, Homo Sapiens
aauaagaaaggaggcauaguuuuccacagccacauuaccauagcuuggauguacaguaguuuua

SEQ ID NO: 101916 - RNA, 64 nt, Homo Sapiens
uugggcuuuaguauuguaaaagauguaaagcaauuuaccauaguuauaucaggugaccugguag

SEQ ID NO: 101917 - RNA, 64 nt, Homo Sapiens
cauuccugacauccuccccagcucaagucuauucuuaccauagaacccagggcagggagagaag

SEQ ID NO: 101918 - RNA, 64 nt, Homo Sapiens
uaagagagguuugguuuguggugguuugcuuucuuuaccauaagcaaucccuugccuuaacuca

SEQ ID NO: 101919 - RNA, 64 nt, Homo Sapiens
gugaaaaggucaagauuaagacuaaaacuuauuguuaccauauguauucaucuguuggaucuug

SEQ ID NO: 101920 - RNA, 64 nt, Homo Sapiens
cuguagugaauuaucugagcuagaguuaccuagcuuaccauacuauaucuuuggaaucaugaaa

SEQ ID NO: 101921 - RNA, 64 nt, Homo Sapiens
uuaaaaaacucacauagaggagacaaucagaaauuuaccauagucccaagaauucagcuacaug

SEQ ID NO: 101922 - RNA, 64 nt, Homo Sapiens
cagcacuugcuuucuucuucuuaaagagagcugcuuaccauacauagcacccacagugucuccc

SEQ ID NO: 101923 - RNA, 64 nt, Homo Sapiens
auaaaacuuguaauagagcaauaauuguaaaugguuaccauacuguaagauauuuugauaaaaa

SEQ ID NO: 101924 - RNA, 64 nt, Homo Sapiens
ugcaaaguguaucauguggaauauccucauauuuuuaccauauuuuaagaacuuuaagacgauu

SEQ ID NO: 101925 - RNA, 51 nt, Homo Sapiens
auuggaacauguuagaauaguuuaccauaauuaccaaggaaaagaaaagua

SEQ ID NO: 101926 - RNA, 64 nt, Homo Sapiens
guaaaauuaccuuagaagaaaacaacggguucaguuaccauaaugcagacauuuucuacuucag

SEQ ID NO: 101927 - RNA, 64 nt, Homo Sapiens
uaguaaaaaggaagagcguuuccuaaucccuccuuuaccauauccuacacagaaaaauacuuuu

SEQ ID NO: 101928 - RNA, 64 nt, Homo Sapiens
aaaauacuuuuagacuuauauugccaagccaaaguuaccauauuuugguguuuuuguguuuucu

SEQ ID NO: 101929 - RNA, 64 nt, Homo Sapiens
aagugcacaccucaccauccuucagucuaaggaagaagggcaagcccugggaccaagagcucuc

SEQ ID NO: 101930 - RNA, 64 nt, Homo Sapiens
caugcuguguguccugguauugggagguuucugggaagggcagaggauaaauguggcccugccu

SEQ ID NO: 101931 - RNA, 64 nt, Homo Sapiens
ggcccuucacagggggcagcgggacaggcaucuugaagggcauauguccucggaagcuccgagc

SEQ ID NO: 101932 - RNA, 64 nt, Homo Sapiens
aauuagaugucuucacccugcaccaaauuuaauugaagggcauuuagcuccauuucuuauuuuc

SEQ ID NO: 101933 - RNA, 64 nt, Homo Sapiens
ugaaggaacaauaucugggagauuuguuuuuccugaagggcauuaaaagucauauuuuaagugg

SEQ ID NO: 101934 - RNA, 64 nt, Homo Sapiens
cagcccauggguaguauggccuuagccauucagugaagggcaaaaagaccagcccaagugccgu

SEQ ID NO: 101935 - RNA, 64 nt, Homo Sapiens
uauuuauaugagagcaaaugucuuugauaugguagaagggcauugaugaguuccagaugucccu

SEQ ID NO: 101936 - RNA, 64 nt, Homo Sapiens
uggggagagggagugugccccucggggcaggagggaagggcaucuggggaagggcaggagggaa

SEQ ID NO: 101937 - RNA, 64 nt, Homo Sapiens
gugccccucggggcaggagggaagggcaucuggggaagggcaggagggaagagcuguccaugca

SEQ ID NO: 101938 - RNA, 64 nt, Homo Sapiens
gagggaaacaguguuaccagccauucugagccuugaagggcaagguaucagcaggaagccauug

SEQ ID NO: 101939 - RNA, 64 nt, Homo Sapiens
agccugaagauaacagugcaucguuuuuaucucugaagggcaguuguaacaugguauuggcuua

SEQ ID NO: 101940 - RNA, 64 nt, Homo Sapiens
gggccacugccagaaagagagucaagcaaaccuggaagggcaaaucugagagugggaaggccaa

SEQ ID NO: 101941 - RNA, 64 nt, Homo Sapiens
uggagucaggcagugcacuccuggagccaagagggaagggcaggguagagaggguauguccagu

SEQ ID NO: 101942 - RNA, 64 nt, Homo Sapiens
cucuuguccaguuucagggcaggaaaugacuuuggaagggcagggacugcaggcugcuaauugc

SEQ ID NO: 101943 - RNA, 64 nt, Homo Sapiens
agaggcagccccaagaaccuaaggcaauauuuaugaagggcagaugccagcaguguccuuggga

SEQ ID NO: 101944 - RNA, 64 nt, Homo Sapiens
uucaaaaauggaagcccacuucucagauuuuucugaagggcauacaaugaaaagugaaggggaa

SEQ ID NO: 101945 - RNA, 64 nt, Homo Sapiens
gaacaaaccccgaaacaguaagaaauuggagugagaagggcaugguauugggacuaggaucggc

SEQ ID NO: 101946 - RNA, 64 nt, Homo Sapiens
gcccucccucacccauauugcaggucugggaugagaagggcacugacagguuuuggggggggcu

SEQ ID NO: 101947 - RNA, 64 nt, Homo Sapiens
uguccggagcugucggggugcucuggcuggcggagaagggcaggcugugugagcucucugugag

SEQ ID NO: 101948 - RNA, 64 nt, Homo Sapiens
uguccccuggcugcacccaggacuucgggcuccugugucucaccauucccaagccccuggccac

SEQ ID NO: 101949 - RNA, 64 nt, Homo Sapiens
cacgcagccagaauccuuaagucuguguguuucugugucucaagacugggcucacauucuggcu

SEQ ID NO: 101950 - RNA, 64 nt, Homo Sapiens
acacauguggcagcugaacgaggugcuguugugggugucucagcucugagggucuuugugagcu

SEQ ID NO: 101951 - RNA, 64 nt, Homo Sapiens
cucugagggucuuugugagcucccacuguugugggugucucagcucugagggucuuugugagcu

SEQ ID NO: 101952 - RNA, 64 nt, Homo Sapiens
cucugagggucuuugugagcucccacuguugugggugucucagcucugagggucuuugugaguu

SEQ ID NO: 101953 - RNA, 64 nt, Homo Sapiens
aaagacaguuucuugcaagcuccaguagcuccgcgugucucauuugccaggaagauggguuccc

SEQ ID NO: 101954 - RNA, 64 nt, Homo Sapiens
augauaagguuuagaaugacaggaacccaucacugugucucauggucccacuuccccaucugug

SEQ ID NO: 101955 - RNA, 64 nt, Homo Sapiens
uuuucuuuuuucuuuauuuuuuuuuuuugaaaccgugucucacucugucgcccaggcuggagga

SEQ ID NO: 101956 - RNA, 64 nt, Homo Sapiens
ugugugcccauuaccuuuccucugccugaaagacgugucucaagaaaaauaaauucuauuuuag

SEQ ID NO: 101957 - RNA, 64 nt, Homo Sapiens
uagugaauuaucugugccuagacccaaacugaaagugucucaggcaggaaguuccaagggaugu

SEQ ID NO: 101958 - RNA, 64 nt, Homo Sapiens
cuacccugcuccagcuucagcccagguaguuggugugucucaauaugaauagggggugaguagc

SEQ ID NO: 101959 - RNA, 64 nt, Homo Sapiens
cccaggaccacauuuuaacaaucaauguuuucaggugucucaugaggaacacuacuuaaugcag

SEQ ID NO: 101960 - RNA, 64 nt, Homo Sapiens
auguugcccaagcuggucuuuuuuuguagagacagugucucacuauuaauuuuuuuuuuuuuuu

SEQ ID NO: 101961 - RNA, 64 nt, Homo Sapiens
ccuguauuugcagcacuuugaucagcuggacacagugucucauaugccuacuuuuaugaguacc

SEQ ID NO: 101962 - RNA, 64 nt, Homo Sapiens
gaaucaggaucugggacuggcaggguccccuccugugucucaucucuugcagcagcagcugcug

SEQ ID NO: 101963 - RNA, 64 nt, Homo Sapiens
guggguuuggccccaugucacuggccggaaggaugugucucagcccugcccuguggggugcccc

SEQ ID NO: 101964 - RNA, 64 nt, Homo Sapiens
uguagcugcccccuugcccugugugggauucgcagugucucauuuggugacgucuuacugguga

SEQ ID NO: 101965 - RNA, 64 nt, Homo Sapiens
cgagaguugcuucugguuuccagccugcugcuucgugucucacugggagcggugucuggugcgu

SEQ ID NO: 101966 - RNA, 64 nt, Homo Sapiens
ggcaaaauuugauuuggcuauuguggcuauuggugugucucacaaacauuuauauugagauucu

SEQ ID NO: 101967 - RNA, 64 nt, Homo Sapiens
ugugcuuaaccgaggugcuuuuuccuaugcaagagugucucacaauuccuuuaaaaacuacauc

SEQ ID NO: 101968 - RNA, 64 nt, Homo Sapiens
cccucuuaagccacucccccggaaagauuguucugugucucauuccuaggcagaugggggcugu

SEQ ID NO: 101969 - RNA, 64 nt, Homo Sapiens
ccugucaucccagcacuuuggaaggccaggugcagugucucaccuuuucagcauaguaaagcug

SEQ ID NO: 101970 - RNA, 64 nt, Homo Sapiens
aagacagugagaccgacucccuggagaucaaagugugucucaccaggaggacuaugagcagugg

SEQ ID NO: 101971 - RNA, 64 nt, Homo Sapiens
auguugccuaggcgggucucuuuuuguaaggacagugucucacccaccuggcuaauuuuaaaau

SEQ ID NO: 101972 - RNA, 64 nt, Homo Sapiens
uucuguuggcaagaagcucagcuauggcuuucuagugucucauauaaacaugaugaaaccgcau

SEQ ID NO: 101973 - RNA, 64 nt, Homo Sapiens
auacuggcacuguugcugggaagugcugggucaagugucucaucacagccaaagacaucaaccc

SEQ ID NO: 101974 - RNA, 64 nt, Homo Sapiens
gggcugauggcuuccuggucuugccugucugagagugucucaaaaucaacccagccuggcaccc

SEQ ID NO: 101975 - RNA, 64 nt, Homo Sapiens
aggaggagcaaggacaagaugcgcacagggugguuuuccucauggauuuugucaaauagaugau

SEQ ID NO: 101976 - RNA, 64 nt, Homo Sapiens
cuccuccccacaaaggcuuugaaaucauaaggauuuuccucaucucuuuauagcuuucccaaaa

SEQ ID NO: 101977 - RNA, 64 nt, Homo Sapiens
cuugggcaagucacuuaaccucucuuugccucaauuuccucaucuugaaaugaggauaauaaua

SEQ ID NO: 101978 - RNA, 64 nt, Homo Sapiens
cuaaaagaaugacagaacaaucaucuuagcacccuuuccucacaauaauauaaaaauauuaaaa

SEQ ID NO: 101979 - RNA, 64 nt, Homo Sapiens
ucucugguuaccccucuucccuuguuaucuaagcuuuccucaguugucaucucuucccagcucu

SEQ ID NO: 101980 - RNA, 64 nt, Homo Sapiens
ugcggugauuuugauccagggacugcaucuccucuuuccucaucacagccagugcugagaggcu

SEQ ID NO: 101981 - RNA, 64 nt, Homo Sapiens
cugucauccuuaaaguccauuguuucuugcuccauuuccucaugguaauuguauauaauuuuug

SEQ ID NO: 101982 - RNA, 64 nt, Homo Sapiens
uguaaaauagaguuaaauguucucuggauuucuauuuccucauccuugauuaagucauuuagcc

SEQ ID NO: 101983 - RNA, 64 nt, Homo Sapiens
caucuguggcaaaauuucagacuauuuuugcgucuuuccucaucacuuuuugugaugcaacucc

SEQ ID NO: 101984 - RNA, 64 nt, Homo Sapiens
cgugccagucuccugacuagagcacuuuacucuguuuccucagcccugcagccccugggagcac

SEQ ID NO: 101985 - RNA, 64 nt, Homo Sapiens
acuggaccuaacuuuaucauuaauuagguaauauuuuccucauuucuuuacugcugccauuuuc

SEQ ID NO: 101986 - RNA, 64 nt, Homo Sapiens
gguaauauuuuccucauuucuuuacugcugccauuuuccucaccaguauuccagagauggucau

SEQ ID NO: 101987 - RNA, 64 nt, Homo Sapiens
acauccuucuguuucuccuucagcucuauccugcuuuccucaucccuucugacaccacguccuc

SEQ ID NO: 101988 - RNA, 64 nt, Homo Sapiens
ggccuucacccacgggaugccggguucuccuuucuuuccucaccccaaccuuuacuccaccaga

SEQ ID NO: 101989 - RNA, 64 nt, Homo Sapiens
uuagaagccuugaagauuacaacugugauuuccuuuuccucagcaagcuccuauguguauauuu

SEQ ID NO: 101990 - RNA, 64 nt, Homo Sapiens
uagggugaugacccucuuuguccuagguguacccuuuccucaucucuauuaaauuguaaacagg

SEQ ID NO: 101991 - RNA, 64 nt, Homo Sapiens
agaacagcugaagucucaaaucauugucuggaauuuuccucaccuuggcuagcuccaccugcuc

SEQ ID NO: 101992 - RNA, 64 nt, Homo Sapiens
uaacauuucucaugaacccacugccccucugcauuuuccucacugguuagagauuaaguaaaua

SEQ ID NO: 101993 - RNA, 64 nt, Homo Sapiens
aauguaaguaggcauguugcauuaauuugcuuucuuuccucaaaguuauuuccucuaacuugau

SEQ ID NO: 101994 - RNA, 64 nt, Homo Sapiens
ccccauuugucaacuaaaagacagucacaacagguuuccucaagugaccuuugaaauaauguca

SEQ ID NO: 101995 - RNA, 64 nt, Homo Sapiens
gaaugggaugucuaauguaugaauaaacugucuuuuuccucaaugacuauuaaagaauguuuug

SEQ ID NO: 101996 - RNA, 64 nt, Homo Sapiens
auuaccaaacaaagcaaaaacauuuguuguuguuuuuccucaaaacuaaaguagaauuaucucu

SEQ ID NO: 101997 - RNA, 64 nt, Homo Sapiens
ucugaaguauggucuugguccugcccucuaaaaauuuccucagaucaaaguauuuauaaaaaca

SEQ ID NO: 101998 - RNA, 64 nt, Homo Sapiens
gacaguaccaucaugccuugccauuccuuaaguuuuuccucaccuagaguaaucuacaucugga

SEQ ID NO: 101999 - RNA, 64 nt, Homo Sapiens
agcauaaaaagaaaaucuuuuauuagaaauagcauuuccucauaaaaauaaaaauaagacaguu

SEQ ID NO: 102000 - RNA, 64 nt, Homo Sapiens
acugauaaaaaauaaugcaaauggguauucuugauuuccucagaugcauacuuuuucauucaaa

SEQ ID NO: 102001 - RNA, 64 nt, Homo Sapiens
cuguucuauuuuuguguuauaauuuaaacuucgauuuccucauaguccuuuaaguugacauuuc

SEQ ID NO: 102002 - RNA, 64 nt, Homo Sapiens
cuaauaaucggggcauggguaaaacuuaugaaaauuuccucaugcugaauuguaauuuucucuu

SEQ ID NO: 102003 - RNA, 64 nt, Homo Sapiens
gggcaggaggugggguggaaauagggugggcuccuuuccucagguagaguggggggccaaaacc

SEQ ID NO: 102004 - RNA, 64 nt, Homo Sapiens
caagaauguaauuuauuggggcccccccagcugcuuuccucaccugccccugcccuaccuuaca

SEQ ID NO: 102005 - RNA, 64 nt, Homo Sapiens
uguuugcuucaguuuuuuaucauggggagaucuuuuuccucagaauuguuuucuuuucacugua

SEQ ID NO: 102006 - RNA, 64 nt, Homo Sapiens
ucacuacaauaugauacauagaugguaccuuacuuuuccucauucuuaauaggugucuaagaau

SEQ ID NO: 102007 - RNA, 64 nt, Homo Sapiens
caaucauucacuccuuaugcaaagccaauauaauuuuccucauaccuuaugcuugaggauauug

SEQ ID NO: 102008 - RNA, 64 nt, Homo Sapiens
uuaucucaggcaggaggcguuuacauaacagauguuuccucagcugggugugagguauacucua

SEQ ID NO: 102009 - RNA, 64 nt, Homo Sapiens
gaaugcuggcugggagagccaugacuaccagacuuuuccucaggcuccuuggcauguuagucug

SEQ ID NO: 102010 - RNA, 64 nt, Homo Sapiens
gcccccugagauggccugucucacaccaacucuguuuccucauuucuggucucacugccuuauc

SEQ ID NO: 102011 - RNA, 64 nt, Homo Sapiens
gagacugggcggagguggggggcagacuccaucguuuccucagguagaauauugggggaaggag

SEQ ID NO: 102012 - RNA, 64 nt, Homo Sapiens
aguggccuuuccuccuucugggugcccagcccccuuuccucaccugauacccaagcccaccacu

SEQ ID NO: 102013 - RNA, 64 nt, Homo Sapiens
uguaggaucuuuggaaucucuugguuccuaagaguuuccucagagaucauaccuccccagaggg

SEQ ID NO: 102014 - RNA, 64 nt, Homo Sapiens
uuuaacucaacaauaccugcuucccaauuacucauuuccucagauaagaagaaaucaucucuac

SEQ ID NO: 102015 - RNA, 64 nt, Homo Sapiens
uuauuuuuauacccuuaaccaguuuaauuuuuuuuuuccucauuguuggggaugaugagaagaa

SEQ ID NO: 102016 - RNA, 64 nt, Homo Sapiens
uuuaaaaugagaagguuaaaagguccugguuuaauuuccucaucauaagccauuuuccuucauu

SEQ ID NO: 102017 - RNA, 64 nt, Homo Sapiens
auauuuuccuagaccaacucagaauuucauuuauuuuccucacaugucuauuugggcuaaccau

SEQ ID NO: 102018 - RNA, 64 nt, Homo Sapiens
ucaggccucaccccucaccuaguccuaaauagguuuuccucacuacuuucucuaguuagauguc

SEQ ID NO: 102019 - RNA, 64 nt, Homo Sapiens
uuuauuuugucuugccccauuuuuauuugcucuguuuccucagacagaugcuucccuccauacu

SEQ ID NO: 102020 - RNA, 64 nt, Homo Sapiens
gggaaaaaucuugagaccagccucucuacagcuguuuccucagaagcaaaguugaacugggcua

SEQ ID NO: 102021 - RNA, 64 nt, Homo Sapiens
uugaaaagcuuaugaggauuuaccuucucaggauuuuccucagagcuagguggugcuuacuaau

SEQ ID NO: 102022 - RNA, 64 nt, Homo Sapiens
acauuuaucuuuaguuuuaucacguuaaaugaaguuuccucauacaguaucuaacauuaccauu

SEQ ID NO: 102023 - RNA, 64 nt, Homo Sapiens
agcagaauuuauaacaguguaagauuggcauuauuuuccucauccaaauacaauuugcauuaaa

SEQ ID NO: 102024 - RNA, 64 nt, Homo Sapiens
uaccucccugucugcuuacucacccacucuguccuuuccucaccaacuaacaugugccagccag

SEQ ID NO: 102025 - RNA, 64 nt, Homo Sapiens
ucuuccucugggcaaagaagggcuuccaguggccuuuccucacucuguaguguuuguggggaua

SEQ ID NO: 102026 - RNA, 64 nt, Homo Sapiens
cccucaccugggcaaacaugaagcucuggccuccuuuccucagccccuuguucuucccuguccu

SEQ ID NO: 102027 - RNA, 64 nt, Homo Sapiens
ugcuagaguaucuggcuggcugcugugugccugguuuccucacauccugccucagcuucaccac

SEQ ID NO: 102028 - RNA, 64 nt, Homo Sapiens
aagaagcaccucacagcuccuuucuagguccuucuuuccucauuggaagcaaagaccuagccaa

SEQ ID NO: 102029 - RNA, 64 nt, Homo Sapiens
uguauuuuggaagacagguuuuuuaaagaaacauuuuccucagauuaaaagaugaugcuauuac

SEQ ID NO: 102030 - RNA, 64 nt, Homo Sapiens
accaucagcucugccuugcacuguggucgucaacuuuccucaaaucaaaaacaggcagguacag

SEQ ID NO: 102031 - RNA, 64 nt, Homo Sapiens
gaagagccuuuauacaauuggacgcauuuugguuuuuccucauugagaauucaaauccucuuuu

SEQ ID NO: 102032 - RNA, 64 nt, Homo Sapiens
ugucccccacccucauggcccaccuccaacccacuuuccucaguaucuggagagggaagggaag

SEQ ID NO: 102033 - RNA, 64 nt, Homo Sapiens
ucgaugcuuugguuuugaccccaccugauccuccuuuccucaugcagcacaagugcucaccggg

SEQ ID NO: 102034 - RNA, 64 nt, Homo Sapiens
cagguguucuucauuaccucagugagaagccagcuuuccucaucaggccauugucccugaagag

SEQ ID NO: 102035 - RNA, 64 nt, Homo Sapiens
uaugagcuggggaugucucucaugaccaaaugcuuuuccucaaagggagagagugcuauuguag

SEQ ID NO: 102036 - RNA, 64 nt, Homo Sapiens
aaauagucuuccuuuauggauuuucauuggacucuuuccucagcgauuguccuggcuguuuauu

SEQ ID NO: 102037 - RNA, 64 nt, Homo Sapiens
auuaacucauggccucagucaguucauucuuuaauuuccucaccaaauuauugacuuagagcau

SEQ ID NO: 102038 - RNA, 64 nt, Homo Sapiens
gauggugugucuuauagugaggaaauaguugucauuuccucaguucccauccagcacucucuau

SEQ ID NO: 102039 - RNA, 64 nt, Homo Sapiens
gacaccccuaaaggcucccaugcauuaguaacuuuuuccucagacaccagcuccugccaaauua

SEQ ID NO: 102040 - RNA, 64 nt, Homo Sapiens
uccaguuuuagaauauuuccaugacccuaagaaguuuccucaugucuauuaauauucccaaucc

SEQ ID NO: 102041 - RNA, 63 nt, Homo Sapiens
guccuuaauuuaucaaauauaugauacguggacauuuccucauagucugugguuucuuuuaau

SEQ ID NO: 102042 - RNA, 64 nt, Homo Sapiens
uggucuuaaacuucuaggcuggggucucacuauguuuccucaucaaaaaaauuuuuuuagagau

SEQ ID NO: 102043 - RNA, 64 nt, Homo Sapiens
ugaaucuaacccauuucugauaccaacuacaguuuuuccucauuauggaaauauaaacaaaauu

SEQ ID NO: 102044 - RNA, 64 nt, Homo Sapiens
ccaagcucuuuucuggagauuccacauuaacuaauuuccucacuuccauggguaacgucauuca

SEQ ID NO: 102045 - RNA, 64 nt, Homo Sapiens
guucucacauauggaaaggaguuccaaguuuguauuuccucagaauuaccuuacuauuucuuuu

SEQ ID NO: 102046 - RNA, 64 nt, Homo Sapiens
augauuuguaaauagcuacuccuaaaugguuauuuuuccucagauuccuaauaugaucuaaaac

SEQ ID NO: 102047 - RNA, 64 nt, Homo Sapiens
acaugagacuguaaaacaaaccaugacuuaugacuuuccucagaguguuucuuguguuugagaa

SEQ ID NO: 102048 - RNA, 64 nt, Homo Sapiens
uuuugaauuuaggugggauugguuucacugacguuuuccucaauacuuuuuagcgaacuuaaca

SEQ ID NO: 102049 - RNA, 64 nt, Homo Sapiens
ggaaaacuguacuuuaauccuuuaagaccuuagguuuccucagcacacuugaucccaaaacccc

SEQ ID NO: 102050 - RNA, 64 nt, Homo Sapiens
aggacacuugaucccaaaacuggugacaccuaguuuuccucaacaugcggggaagacuaaugca

SEQ ID NO: 102051 - RNA, 64 nt, Homo Sapiens
cuugauggccugaauauaugauuuagcaaauucauuuccucauuuauugauugauguugcauca

SEQ ID NO: 102052 - RNA, 64 nt, Homo Sapiens
gacugacucugugccacgucaaugucucuggaucuuuccucauuaauucuuuuugugaccucag

SEQ ID NO: 102053 - RNA, 64 nt, Homo Sapiens
caguugccacagauuauacaaccauuacccaaaccacucugacagucuccuccaguuccagcaa

SEQ ID NO: 102054 - RNA, 64 nt, Homo Sapiens
guucacccugagggcugucuugaagcccgcuacccacucugaggcuccuaggagguaccaugcu

SEQ ID NO: 102055 - RNA, 64 nt, Homo Sapiens
caguuuuagcuuauuaacagcuuuucuucccuuucacucugaagucccccucucccucccaucc

SEQ ID NO: 102056 - RNA, 64 nt, Homo Sapiens
augacaaaaguugccagaguuccccgccugcacccacucugaacucuuuaggcauuuccucuuu

SEQ ID NO: 102057 - RNA, 64 nt, Homo Sapiens
cgggugggggagagaaacccgauuccaggacaagcacucugaggaagaggggguuuuacacucu

SEQ ID NO: 102058 - RNA, 64 nt, Homo Sapiens
ccaggacaagcacucugaggaagaggggguuuuacacucugauuucaguuuuggugucugcuuc

SEQ ID NO: 102059 - RNA, 64 nt, Homo Sapiens
gcucagcccuuucugugagagucccucugcugcucacucugauccagaggcacccugaguuggu

SEQ ID NO: 102060 - RNA, 64 nt, Homo Sapiens
ggccuuaccucuuccucuacuggcauccuaauggcacucugacagcauccagggugacuacagg

SEQ ID NO: 102061 - RNA, 64 nt, Homo Sapiens
ccaagaccuucccauuuccuuggccagccaaaagcacucugaaaugcccuguuuggccacccuc

SEQ ID NO: 102062 - RNA, 64 nt, Homo Sapiens
gcuggcuuuucccagacagcgagcuugaggcuggcacucugacuccacaggagggggauaauca

SEQ ID NO: 102063 - RNA, 64 nt, Homo Sapiens
ccuucggccccuccucccucuuuuccucuggaugcacucugaugauaccaugguuaccccauug

SEQ ID NO: 102064 - RNA, 64 nt, Homo Sapiens
uuguacuguccauccuucaggcaucccuaaagcucacucugaagauguuagagacaaacacaaa

SEQ ID NO: 102065 - RNA, 52 nt, Homo Sapiens
cacuuccacugggaucaugagucacucugaagccacucugaaaucacucuga

SEQ ID NO: 102066 - RNA, 63 nt, Homo Sapiens
cacuuccacugggaucaugagucacucugaagccacucugaaaucacucugaagccaaagcug

SEQ ID NO: 102067 - RNA, 64 nt, Homo Sapiens
gggaucaugagucacucugaagccacucugaaaucacucugaagccaaagcugggcucaguggg

SEQ ID NO: 102068 - RNA, 64 nt, Homo Sapiens
ggguggagccccugagcugaguucugcagagacccacucugaccccacuaaaaugaccccugau

SEQ ID NO: 102069 - RNA, 64 nt, Homo Sapiens
uuauggacuggacguuaacucucuugcucaaggucacucugaguggaagaguggggauaaaucu

SEQ ID NO: 102070 - RNA, 64 nt, Homo Sapiens
auugaucaauuuuaacuacauaaaaauguuuauaggacaagaaaaaccccaccauaacccaagg

SEQ ID NO: 102071 - RNA, 64 nt, Homo Sapiens
gaugccuguaacuccagcuacucgggagacugaaggacaagaaucacuugaaccugggaagccg

SEQ ID NO: 102072 - RNA, 64 nt, Homo Sapiens
ggacauggccuggaccaggguaucacccagagagggacaagauacuuccugucucuguuuccau

SEQ ID NO: 102073 - RNA, 64 nt, Homo Sapiens
cgcccagcacuugcggcuggaagacuuggcccccggacaagacuagcugccucugcaguuggac

SEQ ID NO: 102074 - RNA, 64 nt, Homo Sapiens
uggcccccggacaagacucgcugccucugcaguuggacaagacuccaaacucaaccacaaccag

SEQ ID NO: 102075 - RNA, 64 nt, Homo Sapiens
aggaggagacagaguucccucuguauagccucugggacaagaaaaagaaaacacaagaauguau

SEQ ID NO: 102076 - RNA, 64 nt, Homo Sapiens
acacgugaccuuuuggugcacacuggagcuacuuggacaagaccagcaugccuugcugcacgug

SEQ ID NO: 102077 - RNA, 64 nt, Homo Sapiens
acgcauggcucauggcgggccacuuugacaugaaggacaagaaggaucagagcaggugagcauc

SEQ ID NO: 102078 - RNA, 64 nt, Homo Sapiens
aguugucugccaugagcaccgcuccaggucuccaggacaagagcgccagcgugcaacugcccaa

SEQ ID NO: 102079 - RNA, 64 nt, Homo Sapiens
aucccucuuccuccaugggagugacugcaaaaggggacaagaaauucuccagugacaguguccu

SEQ ID NO: 102080 - RNA, 64 nt, Homo Sapiens
gaacccaugacagcaccugcaggcuugacuggguggacaagaauccauauaggcccguccacac

SEQ ID NO: 102081 - RNA, 64 nt, Homo Sapiens
cucaugccaacagucuuuaugaugggauuaagguggacaagaucuccuaagaucugugaauggg

SEQ ID NO: 102082 - RNA, 64 nt, Homo Sapiens
aagaucuccuaagaucugugaaugggauuaagguggacaagaucuccuaagaucugaaaagaaa

SEQ ID NO: 102083 - RNA, 64 nt, Homo Sapiens
gagucggggcuccggccuccugccaaggcucuuguccccauacaccaucccacaagggcgcugg

SEQ ID NO: 102084 - RNA, 64 nt, Homo Sapiens
aguggcgagcccagcugcccagcccugcccccccuccccauagccagcacagcuaucccgcggg

SEQ ID NO: 102085 - RNA, 64 nt, Homo Sapiens
uuuaguggucagaaauguauguaauuaauuaguaucuacuuaaagaugaauuguuaauauggca

SEQ ID NO: 102086 - RNA, 64 nt, Homo Sapiens
uuugguagauauugaauggcuuuacugcuuuaauucuacuuaauagcuaaaaaaucacaauuuu

SEQ ID NO: 102087 - RNA, 64 nt, Homo Sapiens
uuuaacauauacuagcugagacuuagauuuggcaucuacuuagaagagaggagucagauuaucu

SEQ ID NO: 102088 - RNA, 64 nt, Homo Sapiens
uuuggcaucuacuuagauuugaggagucagauuaucuacuuagaaccgaguagggcuauguaga

SEQ ID NO: 102089 - RNA, 64 nt, Homo Sapiens
gauggucauguacacaaagaccauucgugaugcuuagaaccaagggaauuaaagcagagagaag

SEQ ID NO: 102090 - RNA, 64 nt, Homo Sapiens
uucaaacauuggggccuucuaucauagccaggauuagaaccacuugcagacauguuuacuaaug

SEQ ID NO: 102091 - RNA, 64 nt, Homo Sapiens
ggucuguaacaaaaguacuuucugggucuaggacuagaaccaguaguggcuacuguauugacau

SEQ ID NO: 102092 - RNA, 64 nt, Homo Sapiens
caagauucaccuguguuuuguugcuucacugucuuagaaccaagauauuuaaauacuggggaaa

SEQ ID NO: 102093 - RNA, 64 nt, Homo Sapiens
cuugaauuuccaaaauagucaguaaaggaucuaauagaaccagaauuauuugggugaauucugc

SEQ ID NO: 102094 - RNA, 64 nt, Homo Sapiens
ugguauuuugguguucacuuacgaagcauacaacuagaaccauauccaagcagacucuggguug

SEQ ID NO: 102095 - RNA, 64 nt, Homo Sapiens
acaccuguccuuuccauagcccuuuuuggaccuuuagaaccacagaugauaggaccagcccaau

SEQ ID NO: 102096 - RNA, 64 nt, Homo Sapiens
gcuuuucaguuacagaguccaguggaccauuuuguagaaccaugcagcucccugcggaaggugg

SEQ ID NO: 102097 - RNA, 64 nt, Homo Sapiens
gagagcuagcagcagggagggcuucugccauuucugagaucaaaacgguuuuacugcagcuuug

SEQ ID NO: 102098 - RNA, 64 nt, Homo Sapiens
gucgaggcaggaggaucacuugaguccagaaguuugagaucagccugggcaaugugauaaaacc

SEQ ID NO: 102099 - RNA, 64 nt, Homo Sapiens
ccauugcgcuucagccugggagguugcagugagcugagaucacacgcuugaaccugggaguuag

SEQ ID NO: 102100 - RNA, 64 nt, Homo Sapiens
ugucauuucccaaauuucuuaauugagaggaaaaugagaucaaaucauugauaucaugacuucc

SEQ ID NO: 102101 - RNA, 64 nt, Homo Sapiens
gccaagguggguggaccacaugaggucaggaguuugagaucagccuggccaacauggugaaacc

SEQ ID NO: 102102 - RNA, 64 nt, Homo Sapiens
uucuugaacccaggagacggaaguugcagugagcugagaucacaccacugcacuccagccuggu

SEQ ID NO: 102103 - RNA, 64 nt, Homo Sapiens
ccauuguacuccagccugggagguugcagugagcugagaucacgcaccugaaccccagaggcag

SEQ ID NO: 102104 - RNA, 64 nt, Homo Sapiens
aacacuacuucccugccggauugaauggagcuggugagaucaacucaaaaacuugaucacaugc

SEQ ID NO: 102105 - RNA, 64 nt, Homo Sapiens
ccacugcacuccagccugggaaguugcagugagcugagaucaugcacuugaacccaggaggcgg

SEQ ID NO: 102106 - RNA, 64 nt, Homo Sapiens
aguuugaaaccagccuggccgcaggcagaucauuugagaucaggcagcacuuugggaggccaag

SEQ ID NO: 102107 - RNA, 64 nt, Homo Sapiens
agagccacccuagaucagcucgaacaaauccaccugagaucagcccauccaacccuuagacuca

SEQ ID NO: 102108 - RNA, 64 nt, Homo Sapiens
gacacacuuuucaugaccucguggccaagccacaugagaucaaaaagggugccuuaaaaauguu

SEQ ID NO: 102109 - RNA, 64 nt, Homo Sapiens
gccuauggguuguuaauacugcacuugggaugucugagaucaguguacuauuaacaacccauag

SEQ ID NO: 102110 - RNA, 64 nt, Homo Sapiens
gccucuggguuguuaauacucuguuugggaugucugagaucagugaaucauuugcauuaucagc

SEQ ID NO: 102111 - RNA, 64 nt, Homo Sapiens
auucaugguuguuuagcacacaguucaggaccuuugagaucauguuuguauaagcacuccuuga

SEQ ID NO: 102112 - RNA, 64 nt, Homo Sapiens
uauucaugucugugaagcuuuuaaacauuacacuugagaucagucaugacuugauauucaggua

SEQ ID NO: 102113 - RNA, 64 nt, Homo Sapiens
ccacugcacuccagccugggagccugcagcgagcugagaucacacacuugggcccaggagguca

SEQ ID NO: 102114 - RNA, 64 nt, Homo Sapiens
ccauuguacuccagccugggagguugcagugagcugagaucacgcgcuugaaccggggaggugg

SEQ ID NO: 102115 - RNA, 64 nt, Homo Sapiens
uggucugacuaaaauuuauuucaggagacgguuuugagaucaacuugucauugauaacaucuua

SEQ ID NO: 102116 - RNA, 64 nt, Homo Sapiens
gugccagcauggucaaccucggaggcuggaagucugagaucagaauuuauauucucacauaucu

SEQ ID NO: 102117 - RNA, 64 nt, Homo Sapiens
aaggaucccugagagucucuguuucaucaggacauucugaaauuuacccacagugaggcugugg

SEQ ID NO: 102118 - RNA, 64 nt, Homo Sapiens
augcuaucaguaauagucccaguuccauccaacuuucugaaauuucauuuuuuuuuuugagaug

SEQ ID NO: 102119 - RNA, 64 nt, Homo Sapiens
gauuacaggugugagccaccgcacccggccaacuuucugaaauuucaaaacugaauugauccuu

SEQ ID NO: 102120 - RNA, 64 nt, Homo Sapiens
uuuuggaaacuuagaaaagaauuucuuugaacacuucugaaaguuauuaaaauuguucaagaaa

SEQ ID NO: 102121 - RNA, 64 nt, Homo Sapiens
ggguagagugguuggguguucaugccauuucacauucugaaacuauaauaugcccugcugaaua

SEQ ID NO: 102122 - RNA, 64 nt, Homo Sapiens
uuaaguagaagauuacauugaaggauuaauaaaauucugaaaugaagaaauagggugauuuuua

SEQ ID NO: 102123 - RNA, 64 nt, Homo Sapiens
ggcugauguaagaacaggcaugucucucccauuuuucugaaaguuccuguucaccagcaaaaaa

SEQ ID NO: 102124 - RNA, 64 nt, Homo Sapiens
ugggacacgagucugugaaugugagauuuucggguucugaaaccgcagcaaccuuugaucagga

SEQ ID NO: 102125 - RNA, 64 nt, Homo Sapiens
aaaauuccucauaaggcaugcuguggaaugauacuucugaaaucauaaauauaugaugcugagu

SEQ ID NO: 102126 - RNA, 64 nt, Homo Sapiens
auggucacacuauauacuauugcuaauucucuucuucugaaauucuagcuauccuuuuaaauua

SEQ ID NO: 102127 - RNA, 64 nt, Homo Sapiens
accuuucagccauaguuggacauucauugcugaauucugaaaugauagaauugucuuuauuuuu

SEQ ID NO: 102128 - RNA, 64 nt, Homo Sapiens
uuauuuuucucugugaggucaauuaaaugccuuguucugaaauuuauuuuuuacaagagagagu

SEQ ID NO: 102129 - RNA, 64 nt, Homo Sapiens
auaaauucagaaaugcucuaagcuaccaaaguuauucugaaaguaugggaacugcuacaacuaa

SEQ ID NO: 102130 - RNA, 64 nt, Homo Sapiens
gugaaucuaaucuuaaaacuacaaguuguaaguauucugaaauugggaaacauuuauuuuaaau

SEQ ID NO: 102131 - RNA, 64 nt, Homo Sapiens
ucuguaauaauuuaauguuacuuauuaucagaauuucugaaaccuuuacaaaaauucugauuua

SEQ ID NO: 102132 - RNA, 64 nt, Homo Sapiens
guaacuuuguggcaaaaauuuucaauauaauacauucugaaacaauaguugcugccuugcaaag

SEQ ID NO: 102133 - RNA, 64 nt, Homo Sapiens
gacuguuucccuuuccuucaaggccuagaguauauucugaaaauuuaggaaugaggaagaaauc

SEQ ID NO: 102134 - RNA, 64 nt, Homo Sapiens
gaggcuuuaaaauuuaaaacgaucaaguauaaaauucugaaacaacacauuuauuuuucuccuu

SEQ ID NO: 102135 - RNA, 64 nt, Homo Sapiens
uugccuuaagagagcuccagagaugcaacaucuuuucugaaagaacacaaaccaucaucacaga

SEQ ID NO: 102136 - RNA, 64 nt, Homo Sapiens
cuucauguguacuuuccuaccccaagaggaaguuuucugaaauaagauuuaaaaacaaaacaaa

SEQ ID NO: 102137 - RNA, 64 nt, Homo Sapiens
uuaaguauuugguagcugaauaaggggucagaacuucugaaaccagagaucuguaaucaucucu

SEQ ID NO: 102138 - RNA, 64 nt, Homo Sapiens
aagccucucucucuuucucuccuccccaacuuuuuucugaaagccuugauuucuguagacagaa

SEQ ID NO: 102139 - RNA, 64 nt, Homo Sapiens
aguggauguuucuauuuggcaaggaagguaggauuucugaaacucaggccuuaaccaauagguu

SEQ ID NO: 102140 - RNA, 64 nt, Homo Sapiens
auucauagguaggagggcuuagauuuuaaggcacuucugaaagucaaucccuggacaaggcagu

SEQ ID NO: 102141 - RNA, 64 nt, Homo Sapiens
ucuccauuuucccuaacuaaaugaaaaggacacauucugaaaucccuuuuguuggagaauaagu

SEQ ID NO: 102142 - RNA, 64 nt, Homo Sapiens
agggaggauagagaaacagagcacccccugugcuuucugaaaauagacuugcucuugucuugag

SEQ ID NO: 102143 - RNA, 64 nt, Homo Sapiens
gggagagcagcccaaccaauccccaauccuuuucuucugaaacugagcaggaaggguaaggaag

SEQ ID NO: 102144 - RNA, 64 nt, Homo Sapiens
ucaucguugggcagaaguuuagcauuaauaguuguucugaaacguguuuuaucagguuuagagc

SEQ ID NO: 102145 - RNA, 64 nt, Homo Sapiens
uguaacugugagagcaaaugaauaauuccugcuauucugaaauugccuacauguuucaauacca

SEQ ID NO: 102146 - RNA, 64 nt, Homo Sapiens
aagcauacaucaugauuaugaaaaguguuuucaauucugaaaaacuauagaugucuauacugug

SEQ ID NO: 102147 - RNA, 64 nt, Homo Sapiens
cuagagaauuacaacuuuggauuuuuacuucauuuucugaaaguaggggagacacaaaauaggg

SEQ ID NO: 102148 - RNA, 64 nt, Homo Sapiens
cuaucuuuauuagaggaaaaucuuauauugaagauucugaaaacuugccuuuauaauuuuaaca

SEQ ID NO: 102149 - RNA, 64 nt, Homo Sapiens
agaaaacguucagauuuugugguacacuagaauuuucugaaagcgaaauaucuaagcuguacau

SEQ ID NO: 102150 - RNA, 64 nt, Homo Sapiens
uaaaaauuuaguuguucuccuggaaaaccauggauucugaaaguauuuuacaaaauggcaagua

SEQ ID NO: 102151 - RNA, 64 nt, Homo Sapiens
uaauucuaagugaaauuuaacguacauguuaauuuucugaaagaugacagcuagugcuugggau

SEQ ID NO: 102152 - RNA, 64 nt, Homo Sapiens
ccacagagccucgggacaucaaaaacagcagaacuucugaaaccucugggucaucucucacaca

SEQ ID NO: 102153 - RNA, 64 nt, Homo Sapiens
ccugcggcaucagaugaauuguuaauuaucuaauuucugaaaugugcagcucccauuuggccuu

SEQ ID NO: 102154 - RNA, 64 nt, Homo Sapiens
uguugaaguaccaaguaaccuacaagccuccuaguucugaaaaguuggaagggcaucaugaccu

SEQ ID NO: 102155 - RNA, 64 nt, Homo Sapiens
uuuuuucuucgacaaaaaaauaauaaaacguuucuucugaaaagcugaacguuucuguauaagc

SEQ ID NO: 102156 - RNA, 64 nt, Homo Sapiens
auuucuguuuaaaaauauugauauucuagaaacuuucugaaauaggguuuuuuuucaacguuaa

SEQ ID NO: 102157 - RNA, 64 nt, Homo Sapiens
gaaggugccugaucuuccuaaucagucucggcucuucugaaauacucugccaucucgcuaaauc

SEQ ID NO: 102158 - RNA, 64 nt, Homo Sapiens
uuuucauuuacuaauuacaaauguugaggccuaauucugaaaguccucauauuuaaaggcuaga

SEQ ID NO: 102159 - RNA, 64 nt, Homo Sapiens
cuuuccauuuagugaucaagauauggaagcugauuucugaaaaugcucaguguguacucuaauu

SEQ ID NO: 102160 - RNA, 64 nt, Homo Sapiens
ccugccuaaagauagaauggcuucucuguuuuucuucugaaauacaaccagaaacaaugugucu

SEQ ID NO: 102161 - RNA, 64 nt, Homo Sapiens
ucuucugaaauacaaccagaaacaaugugucuauuucugaaagaauaggauuaaugaucauaca

SEQ ID NO: 102162 - RNA, 64 nt, Homo Sapiens
cauuaauagugaaaauauuguguauuagcuaagguucugaaauauucuauguauauaucauuua

SEQ ID NO: 102163 - RNA, 64 nt, Homo Sapiens
cacacacacacaccaggcguguuugaguccacaguucugaaacauguggcuaccuugucuuuca

SEQ ID NO: 102164 - RNA, 64 nt, Homo Sapiens
cagauccaacacaagcagucuccagauucgccauuucugaaauccuugauuuauguauuuuaug

SEQ ID NO: 102165 - RNA, 64 nt, Homo Sapiens
uauugcuaccauuguauaaccuaucucccggcacuucugaaauauggcaaaguauccaucuugu

SEQ ID NO: 102166 - RNA, 64 nt, Homo Sapiens
uguuggauuagcuuaaucaccaaguccugucaacuucugaaaugaaucucaaauuucuucccuu

SEQ ID NO: 102167 - RNA, 64 nt, Homo Sapiens
ugguucagucuuuauacugccucuugaguaaucuuucugaaauuuaaacuugauauuuuucgcc

SEQ ID NO: 102168 - RNA, 64 nt, Homo Sapiens
ccucagauagaaggaccuuuaugaucuggccauauucugaaauagcuucaauccucuccucauc

SEQ ID NO: 102169 - RNA, 64 nt, Homo Sapiens
ugacccccaaguccuauccuaagaauuauuugccuucugaaaugugacauguagcuucuucuga

SEQ ID NO: 102170 - RNA, 64 nt, Homo Sapiens
auuauuugccuucugaaaugugacauguagcuucuucugaaagaaauacuacccauagaaaacu

SEQ ID NO: 102171 - RNA, 64 nt, Homo Sapiens
uucuuuguggauuuauauagcuucuuccaucuauuucugaaaggagaacuuuagaaaaugccga

SEQ ID NO: 102172 - RNA, 64 nt, Homo Sapiens
aaagcuguauagggauccucacacuuuuaaaagguucugaaaacagcacaaggaacaguuugau

SEQ ID NO: 102173 - RNA, 64 nt, Homo Sapiens
acuuuugcaauaaaaaaaaaacauuuaaaaaguuuucugaaaaaauucaggugguuuauuaauu

SEQ ID NO: 102174 - RNA, 64 nt, Homo Sapiens
uaaagaccauuauugcuaccugcaaaacaguuauuucugaaaauauagugaaugguaagacuag

SEQ ID NO: 102175 - RNA, 64 nt, Homo Sapiens
aauauuuuauaaauccuguuagcauugugaugcuuucugaaagaaacauuauuugccuaaaauu

SEQ ID NO: 102176 - RNA, 64 nt, Homo Sapiens
aauaaaaaauuuuaggagaaugcaauaguauugcuucugaaaguuagugugguuguugauaccu

SEQ ID NO: 102177 - RNA, 64 nt, Homo Sapiens
uuuuuucccaaaaagaggaguaacaaaaugucauuucugaaagaggcuuacuuuauaccaacua

SEQ ID NO: 102178 - RNA, 64 nt, Homo Sapiens
cugcauauuuccaucuugaauuggugguucuaaauucugaaacuguaguugagauacagcuauu

SEQ ID NO: 102179 - RNA, 64 nt, Homo Sapiens
ugaacagaguuaccuuacaguaauuuuaaaauguuucugaaaagugaguuuaauucagauuacc

SEQ ID NO: 102180 - RNA, 64 nt, Homo Sapiens
auauaguaauaauggaauuguuuccauuaaaauauucugaaacaguacuuccauugaaauacuc

SEQ ID NO: 102181 - RNA, 64 nt, Homo Sapiens
ugaaaaaauuaaaauguaaauucaaaaaauuaaguucugaaaaucuuuuaaguguuagcaauag

SEQ ID NO: 102182 - RNA, 64 nt, Homo Sapiens
uaucaagauaacuaguaaaauauuuuugucccauuucugaaaauaagcagaaucaugagucuuc

SEQ ID NO: 102183 - RNA, 64 nt, Homo Sapiens
gucccuauuacaggauauguugcaguccccaucuuucugaaaauaacccuuaacguauccaaca

SEQ ID NO: 102184 - RNA, 64 nt, Homo Sapiens
aaacaaguguuuuaaaagaugaguuuuuccuacauucugaaaagcaaacaugaaaaacugaaca

SEQ ID NO: 102185 - RNA, 64 nt, Homo Sapiens
ucuaaguuuugaugugugggcuucugaguuuauauucugaaaggaaauacacuucuuuugaaca

SEQ ID NO: 102186 - RNA, 64 nt, Homo Sapiens
uaacagaaauuaauuuaacugacaugcauauugauucugaaauuuuuuuccuaaguuuuuuuca

SEQ ID NO: 102187 - RNA, 64 nt, Homo Sapiens
cucccaagagcucaaaagcagaaauggccaggccuucugaaaacuuaaguccagaauugucaca

SEQ ID NO: 102188 - RNA, 64 nt, Homo Sapiens
aguuguggccuccuuggauucuucugacuuuggcuucugaaaggaaggccuagauccagcccug

SEQ ID NO: 102189 - RNA, 64 nt, Homo Sapiens
aacuaaaaggcgcuucauguccaguguguggcccuucugaaacuuauggucaucucucccacug

SEQ ID NO: 102190 - RNA, 64 nt, Homo Sapiens
acagucuacaacugauaaaaaacagacucuuguauucugaaaguagcugaauaaaugugucuaa

SEQ ID NO: 102191 - RNA, 64 nt, Homo Sapiens
acugguuuauguuaagcuauguaaucaccagagauucugaaaugcucuaauggcauuugaacau

SEQ ID NO: 102192 - RNA, 64 nt, Homo Sapiens
gcaaagcuuccuguguuucacugaaaaugguaacuucugaaacaaggcugcaugagacaucuuu

SEQ ID NO: 102193 - RNA, 64 nt, Homo Sapiens
gguaacuucugaaacagcaaugcaugagacaucuuucugaaaaugauuugugacaagccaaggc

SEQ ID NO: 102194 - RNA, 64 nt, Homo Sapiens
auacaucacagcagugcauauuaagguuuuacuuuucugaaauuagugaucucccugaacauuu

SEQ ID NO: 102195 - RNA, 64 nt, Homo Sapiens
accaguguguggcaguucucuuauguuuucaguauucugaaaaucggacaagacuacccuuguu

SEQ ID NO: 102196 - RNA, 64 nt, Homo Sapiens
ucuuuucuuggggaaaugacguauuccaaagagauucugaaauuaaucuagaaacaugaaauua

SEQ ID NO: 102197 - RNA, 64 nt, Homo Sapiens
aaaccuuucuggacggcagaggaaaaggaagugcuucugaaaacuuuuuaguaaaagaaaguga

SEQ ID NO: 102198 - RNA, 64 nt, Homo Sapiens
ucauuuggggaaaaguggugguuauuagggcuuuuucugaaauguguaucuauguaacaucacu

SEQ ID NO: 102199 - RNA, 64 nt, Homo Sapiens
augcuuuagaacaaacccuuuuugaucuuaaugcuucugaaaacuaggucugacucuggggauu

SEQ ID NO: 102200 - RNA, 64 nt, Homo Sapiens
uuuguauaguuugcaaauuuugauauuuauuuucuucugaaacucuggaagaugagauuguagg

SEQ ID NO: 102201 - RNA, 64 nt, Homo Sapiens
gcaaacaaccuacauguuugcgugcaaaacauuuuucugaaauaaagggcuauucuuucuuuca

SEQ ID NO: 102202 - RNA, 64 nt, Homo Sapiens
guacuguuuuagaauguauuccuaauuucaucauuucugaaaaucaggcagggagaucuuaaua

SEQ ID NO: 102203 - RNA, 64 nt, Homo Sapiens
cauucagaaccuguuagauuuuccagugccaggguucugaaauugacuugugucuuguaucauu

SEQ ID NO: 102204 - RNA, 64 nt, Homo Sapiens
aacacuuacaaaauuucuuaucacuaucugauacuucugaaagaaauaauuaaaagagggauua

SEQ ID NO: 102205 - RNA, 64 nt, Homo Sapiens
uuugucugcuaaaaaguuucucccuugccuuuguuucugaaaauuuuauuuuuaugucaucacc

SEQ ID NO: 102206 - RNA, 64 nt, Homo Sapiens
cuugguuggaagacugugacuaaaagaaauucauuucugaaaugcuguaaucuuuuuugacucu

SEQ ID NO: 102207 - RNA, 64 nt, Homo Sapiens
uguuccuggccgggcauccccagcccuuucccuuuucugaaagcgaguuggaggaggcuguucu

SEQ ID NO: 102208 - RNA, 64 nt, Homo Sapiens
cgguuugcagagaauguuagccaugacuugggcuuucugaaaguuggcuauaauuucucuaucc

SEQ ID NO: 102209 - RNA, 64 nt, Homo Sapiens
cucaaagucuaacauauucaaugcaaguaagacuuucugaaaacacuugaugauguggaaaugc

SEQ ID NO: 102210 - RNA, 64 nt, Homo Sapiens
ugcacuugcagaagaaagaaaaaaauucaaaccacauguuuauuuuuuuuuugccuaccucauu

SEQ ID NO: 102211 - RNA, 64 nt, Homo Sapiens
aguuagaauuaaauuccugcuuguaauuuauauccauguuuaggcuuuucauaagaugaaacau

SEQ ID NO: 102212 - RNA, 64 nt, Homo Sapiens
uugugauguuuuguucaaaguuguaguucuugugcauguuuacuuuauuagaguaggaaggcua

SEQ ID NO: 102213 - RNA, 64 nt, Homo Sapiens
ugcuaucuauggcccugcaaaaauauaaccauuacauguuuaaauuguaaauuuuagagcauac

SEQ ID NO: 102214 - RNA, 64 nt, Homo Sapiens
ucuugccauauuuauaacaccuauugauauuggucauguuuauuuuauaguagccucaagaagu

SEQ ID NO: 102215 - RNA, 64 nt, Homo Sapiens
caacagaaguuauuuacagauguuguuguuuuaacauguuuaaccagaaguuuuuuguuguugu

SEQ ID NO: 102216 - RNA, 64 nt, Homo Sapiens
uuuuaggucuugcauaucaguuuuauuacugcaccauguuuacuucaaaaagacaaaacaaaaa

SEQ ID NO: 102217 - RNA, 64 nt, Homo Sapiens
agguuaucagcucuuuaagagcucuauuaauugccauguuuacaaacaaacacaaagagagaag

SEQ ID NO: 102218 - RNA, 64 nt, Homo Sapiens
uuugcuuuauucgaaaagaggcuuuuaaaaugugcauguuuagaaacaaaauuucuucauggaa

SEQ ID NO: 102219 - RNA, 64 nt, Homo Sapiens
gcacuagucuuaaauuguauaaaauauccccuaacauguuuaaauguccauuuuuauucauuau

SEQ ID NO: 102220 - RNA, 64 nt, Homo Sapiens
uccccaauucucaccacaacuguccuaggcauugcauguuuauaaucuucuacauccuaggcau

SEQ ID NO: 102221 - RNA, 64 nt, Homo Sapiens
gacguguuuuuaaaauuccaauaaaaucaaaagucauguuuaaaaaaauaauuaugagaagcaa

SEQ ID NO: 102222 - RNA, 64 nt, Homo Sapiens
ucuugacuugacuuuuuuauccagaggucaccaacauguuuauaaaacacucauuaaaagaacc

SEQ ID NO: 102223 - RNA, 64 nt, Homo Sapiens
acgcaggaacucccagcaacacaagcuggaagcacauguuuauuuauucugcauuuuauucugg

SEQ ID NO: 102224 - RNA, 64 nt, Homo Sapiens
ggggcccacagggaacccugcuugcacuuuguaacauguuuacuuuucagggcaucuuagcuuc

SEQ ID NO: 102225 - RNA, 64 nt, Homo Sapiens
ggaacccggguucuuagauucacaaguagguaaacauguuuaaacugguuccuguuggugucuc

SEQ ID NO: 102226 - RNA, 64 nt, Homo Sapiens
guauguuuuguuuugcagacucuaucuacuuaaacauguuuaaaaaauccagaauuucagauaa

SEQ ID NO: 102227 - RNA, 64 nt, Homo Sapiens
uugauguuuugcauuacuucauuuauguuuacaucauguuuagaaauguuuucauuuacugugg

SEQ ID NO: 102228 - RNA, 64 nt, Homo Sapiens
uuauaaaacuaguuacauuauaaacgguuucaaacauguuuaauuuacauuagguuuuuaugua

SEQ ID NO: 102229 - RNA, 64 nt, Homo Sapiens
gcaauuuaacauguguauucuuauguaauacguacauguuuauguuuuaugauuguuaugugua

SEQ ID NO: 102230 - RNA, 64 nt, Homo Sapiens
ucugcaaaaaaccuaauagcaucauuguacauagcauguuuauaaaaauaaaauaauuauaaau

SEQ ID NO: 102231 - RNA, 64 nt, Homo Sapiens
uauauauauauauauuuuuuguguuauucuucaccauguuuauaaaaauccuuaacaccucaug

SEQ ID NO: 102232 - RNA, 64 nt, Homo Sapiens
uggguaggaggaagccuugcuagagaaaagagaccauguuuauuugauggggcaugcugagaaa

SEQ ID NO: 102233 - RNA, 64 nt, Homo Sapiens
ugcaauuacuggcucucaaguuguuuuguucucccauguuuaguuaaguuaguguugcuuguuu

SEQ ID NO: 102234 - RNA, 64 nt, Homo Sapiens
uaaucagguugcugcaugcaacuauuucugacugcauguuuacugaaagcuucgguggaagguc

SEQ ID NO: 102235 - RNA, 64 nt, Homo Sapiens
caguguuuuccagccuuguacugagaugaagauucauguuuagcacccuagugacgucacagac

SEQ ID NO: 102236 - RNA, 64 nt, Homo Sapiens
uucaccuacuagcacgacuuuuccuuauuuaagacauguuuaaaaagguuucgaaauguaaaua

SEQ ID NO: 102237 - RNA, 64 nt, Homo Sapiens
ucuuugaaaaccagugugugacucacuguagagccauguuuacuguuugacuguguggcacagg

SEQ ID NO: 102238 - RNA, 64 nt, Homo Sapiens
ccagccagaagucccuuccaaauauaagaguacucauguuuauuuauuuccaacugagcagcaa

SEQ ID NO: 102239 - RNA, 64 nt, Homo Sapiens
ugaaucagcuacaaagguaauauuguauuaaaaucauguuuaagauagcugcuuuuauguguau

SEQ ID NO: 102240 - RNA, 64 nt, Homo Sapiens
augaauuugguugguuuugguguuguacagcucacauguuuacacacucagugcccuaauuucc

SEQ ID NO: 102241 - RNA, 64 nt, Homo Sapiens
guuuuuuaaagaauguuugguacuagaaggcguccauguuuauucacaaggacccuucaggugu

SEQ ID NO: 102242 - RNA, 64 nt, Homo Sapiens
uugaguccuaggacuuaaaaauuauucaaaaaaucauguuuauuuauuuuugauguauauaucu

SEQ ID NO: 102243 - RNA, 64 nt, Homo Sapiens
agggagaugagacagcucucgaugccuguucucccugucugaagaauuccaggguaaggaggaa

SEQ ID NO: 102244 - RNA, 64 nt, Homo Sapiens
auuaugguuuuacugcuacgccaaccccuuagcucugucugagaugacuuuagaggcaugggcu

SEQ ID NO: 102245 - RNA, 64 nt, Homo Sapiens
auggcuaugaagcgucauuuugaaguuguagucacugucugagagguuggaaaguaggggaaau

SEQ ID NO: 102246 - RNA, 64 nt, Homo Sapiens
uacuacacagagaaacuuuuaggugugccuuguacugucugauuagucuggauucggauguaua

SEQ ID NO: 102247 - RNA, 64 nt, Homo Sapiens
gaagcaacagagaaguggggaaugccugaauggucugucugaagucacucucaauucacuggca

SEQ ID NO: 102248 - RNA, 64 nt, Homo Sapiens
gucacucuggcacuaggaggugcccaguuuaugccugucugacuauacacuugugacugaacca

SEQ ID NO: 102249 - RNA, 64 nt, Homo Sapiens
ugaaauuuucaccucuugggguauuuuaauuguacugucugaacccagggaucacaaauucugu

SEQ ID NO: 102250 - RNA, 64 nt, Homo Sapiens
aaacaauuuagucugaaacacaauugugcugaaucugucugacuauaacucugaccacacagaa

SEQ ID NO: 102251 - RNA, 64 nt, Homo Sapiens
cauagaggcaggcaagccgucccaugauuuguuccugucugagguguauagaucccagauccau

SEQ ID NO: 102252 - RNA, 64 nt, Homo Sapiens
cuuuggucuuugcuaccaggauccaaggauuccucugucugaucgaaacugagcugagcccagu

SEQ ID NO: 102253 - RNA, 64 nt, Homo Sapiens
aacucaauaacuuucuauaauaucaugaauccuucugucugacuauaacaaaugacaaauuaua

SEQ ID NO: 102254 - RNA, 64 nt, Homo Sapiens
uagaucuuaggguugaagaacuuuacuauugaaucugucugauacuaaacuuuaggcuaauaau

SEQ ID NO: 102255 - RNA, 64 nt, Homo Sapiens
augagagagaagacuucggaacucuuaacaauugcugucugaaaaggucugggacgugugugug

SEQ ID NO: 102256 - RNA, 64 nt, Homo Sapiens
cugcacacaaaaguggguuuaggaugggaaaacacugucugauucccauuuggaauauagaauu

SEQ ID NO: 102257 - RNA, 64 nt, Homo Sapiens
gaugcucacaguuuuauuuuacuuuaaaauaaaccugucugacuguagcuuugugaaauaucuu

SEQ ID NO: 102258 - RNA, 64 nt, Homo Sapiens
ucgaaugcugcauuuuuauaaacaaaauuacagacugucugaaauugaagaagaaugaacuaau

SEQ ID NO: 102259 - RNA, 64 nt, Homo Sapiens
uuucagugguaguggggaaaccugaauuugucagcaugauuauuuguaacucagauuguucaaa

SEQ ID NO: 102260 - RNA, 64 nt, Homo Sapiens
aaccaugauaaauuuaaaaacaacagaaauguggcaugauuacuuauuuauuuguuccagguga

SEQ ID NO: 102261 - RNA, 64 nt, Homo Sapiens
gcauuugcguuuauugagagagaggaugugccaucaugauuaaugaaaacuaucuuuugaguuu

SEQ ID NO: 102262 - RNA, 64 nt, Homo Sapiens
gauuuuggucaccaaugaguacccgacccguugccaugauuaagagagaaugcuuucuauugga

SEQ ID NO: 102263 - RNA, 64 nt, Homo Sapiens
ugauagcuaagcaucugauuucuguuuccucucacaugauuacuguaugagguaaggaucuaau

SEQ ID NO: 102264 - RNA, 64 nt, Homo Sapiens
acaagaccacaugguauaaccacagaauggaaaccaugauuauaggacucauaaucugaagacu

SEQ ID NO: 102265 - RNA, 64 nt, Homo Sapiens
gugauccuuacuggguuuccaagcagaggagucacaugauuacaauugccaguagaguuguugu

SEQ ID NO: 102266 - RNA, 64 nt, Homo Sapiens
uuuuucucugagggcuggggguugggggagucagcaugauuauauuuuaauguagaaaauguga

SEQ ID NO: 102267 - RNA, 64 nt, Homo Sapiens
cuaaccaaaccuggaguaaaaggcuagacagucucaugauuauaagaauuuucucuagacuauu

SEQ ID NO: 102268 - RNA, 64 nt, Homo Sapiens
aauguuagaaucaauuugcuagcacauaaaagggcaugauuaugaagucaguauguccacuuaa

SEQ ID NO: 102269 - RNA, 64 nt, Homo Sapiens; identical to SEQ ID NO: 93680

SEQ ID NO: 102270 - RNA, 64 nt, Homo Sapiens; identical to SEQ ID NO: 93681

SEQ ID NO: 102271 - RNA, 64 nt, Homo Sapiens; identical to SEQ ID NO: 93682

SEQ ID NO: 102272 - RNA, 64 nt, Homo Sapiens; identical to SEQ ID NO: 93683

SEQ ID NO: 102273 - RNA, 64 nt, Homo Sapiens; identical to SEQ ID NO: 93684

SEQ ID NO: 102274 - RNA, 64 nt, Homo Sapiens; identical to SEQ ID NO: 93685

SEQ ID NO: 102275 - RNA, 64 nt, Homo Sapiens; identical to SEQ ID NO: 93686

SEQ ID NO: 102276 - RNA, 64 nt, Homo Sapiens; identical to SEQ ID NO: 93687

SEQ ID NO: 102277 - RNA, 64 nt, Homo Sapiens
ggaaggugagucuacuuucccugaggcuuuggggucagaguauauguuguuuggagaaagaggg

SEQ ID NO: 102278 - RNA, 64 nt, Homo Sapiens
ggcucuuccuacaaccuugagaaguagauaggcaucagaguaugguacuauaggaaucagaaaa

SEQ ID NO: 102279 - RNA, 64 nt, Homo Sapiens
cuuuucugaaacuccuugcuguaaggcagcuuucucagaguacuauauauuuucaacaguaaag

SEQ ID NO: 102280 - RNA, 64 nt, Homo Sapiens
cuggauaaagcaauuccccuuaggaaacauagccucagaguauuucauauaaauuuucucuauc

SEQ ID NO: 102281 - RNA, 56 nt, Homo Sapiens
cauuuuuuuccuccugguaguaaaugucagaguaagagaaacaaacuguuuagaau

SEQ ID NO: 102282 - RNA, 64 nt, Homo Sapiens
ucuuacaugggaucaaauacuugagauuaguacuucagaguacuggccuuguucaauuuaguac

SEQ ID NO: 102283 - RNA, 64 nt, Homo Sapiens
aguacaguugagauaguuaagauauaaccacaagucagaguacauugguuguauuuuguaaacu

SEQ ID NO: 102284 - RNA, 64 nt, Homo Sapiens
uagaauaaugcuaaaaaauaaugccuauaaaucuucagaguauaaagacauccauucagaaaca

SEQ ID NO: 102285 - RNA, 64 nt, Homo Sapiens
acacauuacccuaaccagccagcaguaacagauuucagaguaagauaaagcagauucugucuuc

SEQ ID NO: 102286 - RNA, 64 nt, Homo Sapiens
gaauuuugccauuuugauccaucaaaugauaugaucagaguaaagauagauaaaagugugauua

SEQ ID NO: 102287 - RNA, 64 nt, Homo Sapiens
auugacagacagcuuguggaugaauagguugccuucagaguauucagugggauucuggugcuga

SEQ ID NO: 102288 - RNA, 64 nt, Homo Sapiens
agugaacaaguuuuuggcagagguauauuuacauucagaguacacuuuucuuuggaaaaaauua

SEQ ID NO: 102289 - RNA, 64 nt, Homo Sapiens
acugauaauauugagugaugcaugagguagguguucagaguaauauucugcauuauagugaaaa

SEQ ID NO: 102290 - RNA, 64 nt, Homo Sapiens
guuagaaaaugugaucuggcaguuuaugcauucuucagaguaauguaauaauaccuaugugaug

SEQ ID NO: 102291 - RNA, 64 nt, Homo Sapiens
caauuugcucuuauaaagagacauuuucauagguucagaguaacucaccuccaugggcugacca

SEQ ID NO: 102292 - RNA, 64 nt, Homo Sapiens
auaguacacacuucagaguaagacaaaugcaaagcaucuuaaggagugaaaauagaguguaaau

SEQ ID NO: 102293 - RNA, 64 nt, Homo Sapiens
uccucugcuuuaugaaguuugaguuguauuugugcaucuuaaaguagguugaggcuugaggcug

SEQ ID NO: 102294 - RNA, 64 nt, Homo Sapiens
aacuguuaaauauaaaaaaauucaaaguauuugacaucuuaagcaaauauccagaauauuuuua

SEQ ID NO: 102295 - RNA, 64 nt, Homo Sapiens
aagcaaauauccagaauauuuuuaaguaaaaaaccaucuuaaguauucaaaauuuccuugguuu

SEQ ID NO: 102296 - RNA, 64 nt, Homo Sapiens
aauagcugagugcaguccuugcucauauuuccuucaucuuaaccccgcaaacaagaauuaagau

SEQ ID NO: 102297 - RNA, 64 nt, Homo Sapiens
uugcuuuuuaaaaugucagcaagaaggccugccucaucuuaacaaagcaaaaaaaaaugcuuua

SEQ ID NO: 102298 - RNA, 64 nt, Homo Sapiens
ccacgcuuuacgauauuauaauuuuuuaaaaacacaucuuaacuagcauauaaaaagccuguau

SEQ ID NO: 102299 - RNA, 64 nt, Homo Sapiens
acuuucgaggauuugcagugguguauugcucuuucaucuuaaacuaaacuuuugaagaucuuaa

SEQ ID NO: 102300 - RNA, 64 nt, Homo Sapiens
cagauccaagguaacuggguaggaaaucuuuugacaucuuaacucauguugaguuugugcugug

SEQ ID NO: 102301 - RNA, 64 nt, Homo Sapiens
aucagguaaacugucacuuaaauggagguguccacaucuuaauuguuucuccuugacacauuuc

SEQ ID NO: 102302 - RNA, 64 nt, Homo Sapiens
gagaacuaauggcuauuuuugaggacaaaaauuacaucuuaagcuaauuccuuaaauacauaca

SEQ ID NO: 102303 - RNA, 64 nt, Homo Sapiens
cuauuuugagaaauauaaauacauagaaauggugcaucuuaacauuuguuuguacauguauaaa

SEQ ID NO: 102304 - RNA, 64 nt, Homo Sapiens
aaaauaaauagaguguaaauuauuucugaagagguaagcugaucugcacauuuggggguauauc

SEQ ID NO: 102305 - RNA, 64 nt, Homo Sapiens
uaguguucugccauguaauguguacguuuccauguaagcugacauuuugaauacacccacauuu

SEQ ID NO: 102306 - RNA, 64 nt, Homo Sapiens
uuccugcagaggaguagugucagccaccuuguacuaagcugaaacaugucccucuggagcuucc

SEQ ID NO: 102307 - RNA, 64 nt, Homo Sapiens
aaaacaaaucuaagggaaaggaauauuaugggauuaagcugagcaagcaauucugguggaaagu

SEQ ID NO: 102308 - RNA, 64 nt, Homo Sapiens; identical to SEQ ID NO: 45025

SEQ ID NO: 102309 - RNA, 64 nt, Homo Sapiens; identical to SEQ ID NO: 45026

SEQ ID NO: 102310 - RNA, 64 nt, Homo Sapiens; identical to SEQ ID NO: 45027

SEQ ID NO: 102311 - RNA, 64 nt, Homo Sapiens; identical to SEQ ID NO: 45028

SEQ ID NO: 102312 - RNA, 64 nt, Homo Sapiens; identical to SEQ ID NO: 45029

SEQ ID NO: 102313 - RNA, 64 nt, Homo Sapiens; identical to SEQ ID NO: 45030

SEQ ID NO: 102314 - RNA, 64 nt, Homo Sapiens; identical to SEQ ID NO: 45031

SEQ ID NO: 102315 - RNA, 64 nt, Homo Sapiens; identical to SEQ ID NO: 45032

SEQ ID NO: 102316 - RNA, 64 nt, Homo Sapiens; identical to SEQ ID NO: 45033

SEQ ID NO: 102317 - RNA, 64 nt, Homo Sapiens; identical to SEQ ID NO: 45034

SEQ ID NO: 102318 - RNA, 64 nt, Homo Sapiens; identical to SEQ ID NO: 45035

SEQ ID NO: 102319 - RNA, 64 nt, Homo Sapiens; identical to SEQ ID NO: 45036

SEQ ID NO: 102320 - RNA, 64 nt, Homo Sapiens; identical to SEQ ID NO: 45037

SEQ ID NO: 102321 - RNA, 64 nt, Homo Sapiens; identical to SEQ ID NO: 45038

SEQ ID NO: 102322 - RNA, 64 nt, Homo Sapiens; identical to SEQ ID NO: 45039

SEQ ID NO: 102323 - RNA, 64 nt, Homo Sapiens; identical to SEQ ID NO: 45040

SEQ ID NO: 102324 - RNA, 64 nt, Homo Sapiens; identical to SEQ ID NO: 45041

SEQ ID NO: 102325 - RNA, 64 nt, Homo Sapiens; identical to SEQ ID NO: 45042

SEQ ID NO: 102326 - RNA, 64 nt, Homo Sapiens; identical to SEQ ID NO: 45043

SEQ ID NO: 102327 - RNA, 64 nt, Homo Sapiens; identical to SEQ ID NO: 45044

SEQ ID NO: 102328 - RNA, 64 nt, Homo Sapiens; identical to SEQ ID NO: 45045

SEQ ID NO: 102329 - RNA, 64 nt, Homo Sapiens; identical to SEQ ID NO: 45046

SEQ ID NO: 102330 - RNA, 64 nt, Homo Sapiens; identical to SEQ ID NO: 45047

SEQ ID NO: 102331 - RNA, 64 nt, Homo Sapiens; identical to SEQ ID NO: 45048

SEQ ID NO: 102332 - RNA, 64 nt, Homo Sapiens; identical to SEQ ID NO: 45049

SEQ ID NO: 102333 - RNA, 64 nt, Homo Sapiens; identical to SEQ ID NO: 45050

SEQ ID NO: 102334 - RNA, 64 nt, Homo Sapiens; identical to SEQ ID NO: 45051

SEQ ID NO: 102335 - RNA, 64 nt, Homo Sapiens; identical to SEQ ID NO: 45052

SEQ ID NO: 102336 - RNA, 64 nt, Homo Sapiens; identical to SEQ ID NO: 45053

SEQ ID NO: 102337 - RNA, 64 nt, Homo Sapiens; identical to SEQ ID NO: 45054

SEQ ID NO: 102338 - RNA, 64 nt, Homo Sapiens; identical to SEQ ID NO: 45055

SEQ ID NO: 102339 - RNA, 64 nt, Homo Sapiens; identical to SEQ ID NO: 45056

SEQ ID NO: 102340 - RNA, 64 nt, Homo Sapiens; identical to SEQ ID NO: 45057

SEQ ID NO: 102341 - RNA, 64 nt, Homo Sapiens; identical to SEQ ID NO: 45058

SEQ ID NO: 102342 - RNA, 64 nt, Homo Sapiens; identical to SEQ ID NO: 45059

SEQ ID NO: 102343 - RNA, 64 nt, Homo Sapiens; identical to SEQ ID NO: 45060

SEQ ID NO: 102344 - RNA, 64 nt, Homo Sapiens; identical to SEQ ID NO: 45061

SEQ ID NO: 102345 - RNA, 64 nt, Homo Sapiens; identical to SEQ ID NO: 45062

SEQ ID NO: 102346 - RNA, 64 nt, Homo Sapiens; identical to SEQ ID NO: 45063

SEQ ID NO: 102347 - RNA, 64 nt, Homo Sapiens; identical to SEQ ID NO: 45064

SEQ ID NO: 102348 - RNA, 64 nt, Homo Sapiens; identical to SEQ ID NO: 45065

SEQ ID NO: 102349 - RNA, 64 nt, Homo Sapiens; identical to SEQ ID NO: 45066

SEQ ID NO: 102350 - RNA, 64 nt, Homo Sapiens
ugaaucuucuuugacagacuggcucuuuuauguuaaaagagaggauuccugugauaacuuaaaa

SEQ ID NO: 102351 - RNA, 64 nt, Homo Sapiens
agaaaagaaaauuucuacuauucuacuagggccaaaaagagaaacacuguggaagcuaaaacac

SEQ ID NO: 102352 - RNA, 64 nt, Homo Sapiens
auguugacaugauacucuauaagauauuuuggguaaaagagauaagaauauaugcuaacuguug

SEQ ID NO: 102353 - RNA, 64 nt, Homo Sapiens
gcacagcacuuucugauccaucugguuucuuaacaaaagagaaacaaggaaauuucaguggcuc

SEQ ID NO: 102354 - RNA, 64 nt, Homo Sapiens
aacucaagucuauuacuuguaagaaagaagggaaaaaagagaaaaaaagccaaauuuaaauuau

SEQ ID NO: 102355 - RNA, 64 nt, Homo Sapiens
ucuucgauuucuuucaggccuagaguggggcaggaaaagagaucacuccacacagguguuucag

SEQ ID NO: 102356 - RNA, 64 nt, Homo Sapiens
aagaaaaauagaagacauauguaucacccccaaaaaaagagaaaaguguaugaauuugucacau

SEQ ID NO: 102357 - RNA, 64 nt, Homo Sapiens
caaauauaaaauuaaaaacuuugcaacauuagagaaaagagacaaugucauuagugacaaagau

SEQ ID NO: 102358 - RNA, 64 nt, Homo Sapiens
aaaaucuucacugaauaucauauguaucuaaaugaaaagagaauuacuuauauucaucuauuuu

SEQ ID NO: 102359 - RNA, 64 nt, Homo Sapiens
uaugggaguccacgauucucagguauugauugaaaaaagagaaaggggcaagaaauucauuaaa

SEQ ID NO: 102360 - RNA, 64 nt, Homo Sapiens
acuggaauuguugaaucacacugcauagcugcccaaaagagaguguuuggucuugaacuuucua

SEQ ID NO: 102361 - RNA, 64 nt, Homo Sapiens
aaccugcauugcacuaggaauucuguguuaguuuaaaagagaucucuaaaacuuccccaucccu

SEQ ID NO: 102362 - RNA, 64 nt, Homo Sapiens
aacaaaaaagugugacauuacuucaaaaaaaaaaaaaagagagauagugcaaauuauuuguaug

SEQ ID NO: 102363 - RNA, 64 nt, Homo Sapiens
gagagagaaaaagaccaugcuccguucugagagaaaaagagagaaacauguugcuguuuccagu

SEQ ID NO: 102364 - RNA, 64 nt, Homo Sapiens
gaacaaaccuccuugggaauagauggauguccucaaaagagaagacccccucccuccccuaaga

SEQ ID NO: 102365 - RNA, 64 nt, Homo Sapiens
gagagagagagagagagagacagaggggagggggaaaagagagaggggagagggaagugaauug

SEQ ID NO: 102366 - RNA, 64 nt, Homo Sapiens
uauuaaagagacugguagcucaucauccuaccauaaaagagaaaaaaauucggaaagugaucag

SEQ ID NO: 102367 - RNA, 64 nt, Homo Sapiens
agucaaguguucaggccacacagucagcccaggaaaaagagaagcagggccaaauggaaagaac

SEQ ID NO: 102368 - RNA, 64 nt, Homo Sapiens
acaaaagcacaaacaugggucaaaggaaaaucuuaaaagagaacacaccaaaaaagugaaagag

SEQ ID NO: 102369 - RNA, 64 nt, Homo Sapiens
aggagauugaugacaagcaaguuacucaggaaucaaaagagaaaaaaguuucugaaaacaauga

SEQ ID NO: 102370 - RNA, 64 nt, Homo Sapiens
uagugagauggccuggggaagcugugaaagaaccaaaagagaucacaauacucaaaagagagag

SEQ ID NO: 102371 - RNA, 64 nt, Homo Sapiens
agcugugaaagaaccaaaagagaucacaauacucaaaagagagagagagagaaaaaagagagau

SEQ ID NO: 102372 - RNA, 64 nt, Homo Sapiens
gagaucacaauacucaaaagagagagagagagaaaaaagagagaucuugauccacagaaauaca

SEQ ID NO: 102373 - RNA, 64 nt, Homo Sapiens
agaagguugacuuuuugcacuucuguauauagucaaaagagagaaaccuguauaauaguaagau

SEQ ID NO: 102374 - RNA, 64 nt, Homo Sapiens
uucaaaacuacugcauguuuaaaacuucaacaaaaaaagagagaaagaacuauacuaagaacau

SEQ ID NO: 102375 - RNA, 64 nt, Homo Sapiens
uuuuuagauuguaugccacuauaguauuucuagaaaaagagauauaauugaacuagauuacaua

SEQ ID NO: 102376 - RNA, 64 nt, Homo Sapiens
caaacucuaggaacaaugccaaugacagaaaaaaaaaagagagaguccugccagaaagagaaug

SEQ ID NO: 102377 - RNA, 64 nt, Homo Sapiens
uauugggaaaccauggugugugaaaaguccuccaaaaagagaacaaagcaguuuacucaucaau

SEQ ID NO: 102378 - RNA, 64 nt, Homo Sapiens
cccauugauuccucccccacgcuugucgccaaauaaaagagaggaaaugaacuuucuugcacuu

SEQ ID NO: 102379 - RNA, 64 nt, Homo Sapiens
guuucaggaaauaaaacuacauacaguauuuaguaaaagagaaagauaucaaaacaucucuaag

SEQ ID NO: 102380 - RNA, 64 nt, Homo Sapiens
aaaagaaauucaugcauagcaagaagggaacuguaaaagagaaaaggauuuuuuuuuuuuaagu

SEQ ID NO: 102381 - RNA, 64 nt, Homo Sapiens
uaaucauuggucuuuucaaaacuagguguuuaaaaaaagagacauauaugauauugcuguuaua

SEQ ID NO: 102382 - RNA, 64 nt, Homo Sapiens
cagucaauauuugacaauguggaauuaccaaauuaaaagagaauacuaugaauguauucauauu

SEQ ID NO: 102383 - RNA, 64 nt, Homo Sapiens
aacucauaaaacaaaagccuuguaagcauuuauuaaaagagauuauuaaaagagauugaaagac

SEQ ID NO: 102384 - RNA, 64 nt, Homo Sapiens
aaagccuuguaagcauuuauuaaaagagauuauuaaaagagauugaaagacaugcauucaauaa

SEQ ID NO: 102385 - RNA, 64 nt, Homo Sapiens
aaaacuucucgaaccgcugugucuccuacguaaaaaaagagauguacaaaucaauaauaauuac

SEQ ID NO: 102386 - RNA, 64 nt, Homo Sapiens
cagccuaggcaacagagugagacuuugucucaaaaaaagagaaauuuuccuuaauaagaaaagu

SEQ ID NO: 102387 - RNA, 64 nt, Homo Sapiens
uuagaauuacagcuacugacaagcagaguauuacaaaagagaagauucuauagguuaauuuuca

SEQ ID NO: 102388 - RNA, 64 nt, Homo Sapiens
ccaaugguuuacacuuuaacuacaguaaaaauuaaaaagagauauuuguuuguuuuagaaaagu

SEQ ID NO: 102389 - RNA, 64 nt, Homo Sapiens
uuaucauuacuguuacauuuucucuuucccuuggaaaagagaauaauguccauucugcagcguu

SEQ ID NO: 102390 - RNA, 64 nt, Homo Sapiens
agcagcuuucuagggacagcagagcugaaaaugaaaaagagaacggguggucccugcccuuacc

SEQ ID NO: 102391 - RNA, 64 nt, Homo Sapiens
uucaaauagaaaaacaacaaaacccaugaaauggaaaagagaguuccaaaaaagaagaccuguu

SEQ ID NO: 102392 - RNA, 64 nt, Homo Sapiens
gagaggaguaaaguguuuagauucugaaccugagaaaagagaacuuucucuuaagaaguuggaa

SEQ ID NO: 102393 - RNA, 64 nt, Homo Sapiens
uuucgcuguuuguuguuucauagauuuauuuaaaaaaagagaaagucuauagcuauaaaucuuu

SEQ ID NO: 102394 - RNA, 64 nt, Homo Sapiens
agaaauaugaauacaauuccccuaaacucuccucaaaagagaauucagucuacagccauuuaaa

SEQ ID NO: 102395 - RNA, 64 nt, Homo Sapiens
gagagagaggugugagggacgcauuuaauaaaaaaaaagagagauaaucuacuuuugcuaagau

SEQ ID NO: 102396 - RNA, 64 nt, Homo Sapiens
ugggugggcacacugaacugcccagcucucuucuaaaagagaagagugccuucauacacuguac

SEQ ID NO: 102397 - RNA, 64 nt, Homo Sapiens
ugaaugcagacagaaauaaauuaguguccuuaccaaaagagaucggcgggugcugcagccucac

SEQ ID NO: 102398 - RNA, 64 nt, Homo Sapiens
ccauuuguaaaauaaaauagagcagaaaaacacaaaaagagaacacugguucagacauucagug

SEQ ID NO: 102399 - RNA, 64 nt, Homo Sapiens
uguuucuguugauuucuuuuuuguaugcugugauaaaagagaaaugaaaagugccagucacugu

SEQ ID NO: 102400 - RNA, 64 nt, Homo Sapiens
cagaguugauuaagaaaaaugaagaaaaaacgcaaaaagagaacacauguagaaggugguggau

SEQ ID NO: 102401 - RNA, 64 nt, Homo Sapiens
aaaacugcacaaauuuuuaugggacaaagccuagaaaagagaaauguaguuugaaucauaaucu

SEQ ID NO: 102402 - RNA, 64 nt, Homo Sapiens
gaugaaaauaggaacaaauaagggaaaaagaagaaaaagagaaaagggagggaaacagggagaa

SEQ ID NO: 102403 - RNA, 64 nt, Homo Sapiens
cuugcaaagcaauggggaacuggcugugcuuuuaaaaagagaugacgugaccucccggggacag

SEQ ID NO: 102404 - RNA, 64 nt, Homo Sapiens
ccuuuuguguuuugaguaagugcauaagaaagagaaaagagaugcagcuauauacucugcuugg

SEQ ID NO: 102405 - RNA, 64 nt, Homo Sapiens
ggcugcucagggaaacauugcgacgaagaguaggaaaagagaagugaucuagaacugguccagc

SEQ ID NO: 102406 - RNA, 64 nt, Homo Sapiens
cuuccgggacagucauuaucugaaacugucucaaaaaagagagauuucagccugagcgacagag

SEQ ID NO: 102407 - RNA, 64 nt, Homo Sapiens
ucuggggccgagugugguggguuagugcuguuguaaaagagaccuauuggacuaaagucuguug

SEQ ID NO: 102408 - RNA, 64 nt, Homo Sapiens
uuugaaucuccuuucccaaacucaaacagaaaaaaaaagagaaugcagcagagcgagacuccgu

SEQ ID NO: 102409 - RNA, 64 nt, Homo Sapiens
guuguuggcaagguagcaaugggccuccucucauaaaagagacaaaaauugaaauaaagcuacu

SEQ ID NO: 102410 - RNA, 64 nt, Homo Sapiens
auacaugaagaauagaaacagaaaaaaagagugaaaaagagaaugguuaauuucauguaaaaca

SEQ ID NO: 102411 - RNA, 64 nt, Homo Sapiens
agauucccccaaacaacaauaauuaaagaucuaaaaaagagaggagccagacuugagaggugac

SEQ ID NO: 102412 - RNA, 64 nt, Homo Sapiens
gcaagagacagaaaucaggauauuaaaaaaagagaaaagagaaauuugcauuuuuuuguuugca

SEQ ID NO: 102413 - RNA, 64 nt, Homo Sapiens
agagaaagcaagagacagaaguuugcauauuaaaaaaagagaaauuucauuuuugcauuuuuuu

SEQ ID NO: 102414 - RNA, 64 nt, Homo Sapiens
cccguggcacuauguaaauaaaaaaagagaagaaaaaagagaaaguaccaucucccccgccaau

SEQ ID NO: 102415 - RNA, 64 nt, Homo Sapiens
aaaaaagagaaacccguggcucccccgccaauaaaaaagagaaguaacaaguuauaguaccauc

SEQ ID NO: 102416 - RNA, 64 nt, Homo Sapiens
caagagggaaggugauugguagugaguuaaaagaaaaagagaggaaaagagaguaguuuugucu

SEQ ID NO: 102417 - RNA, 64 nt, Homo Sapiens
ggugauugguagugaguuaaaagaaaaagagaggaaaagagaguaguuuugucuucaaguaaaa

SEQ ID NO: 102418 - RNA, 64 nt, Homo Sapiens
cucuccccugcgagcccuuuuuauuugagaaggaaaaagagaaaagagaaucguuuaagggaac

SEQ ID NO: 102419 - RNA, 64 nt, Homo Sapiens
cugcgagcccuuuuuauuugagaaggaaaaagagaaaagagaaucguuuaagggaacccggcgc

SEQ ID NO: 102420 - RNA, 64 nt, Homo Sapiens
guccuucaaaaaaauuauuuguuaauguuauauuaaaagagaggaauaaaugugcccccaaguu

SEQ ID NO: 102421 - RNA, 64 nt, Homo Sapiens
gcacugccucagggcuuacagauaacaaggagggaaaagagaggcagccacaaguacuggagua

SEQ ID NO: 102422 - RNA, 64 nt, Homo Sapiens
gaacaggaaugaaaggaaacaacuguucaaaagcaaaagagaaguagcuauuaguauauuuaaa

SEQ ID NO: 102423 - RNA, 64 nt, Homo Sapiens
gucugguuaaaacaccaugagcucagcaacaccaaaaagagaaaagaauuugcaaacuaccguc

SEQ ID NO: 102424 - RNA, 64 nt, Homo Sapiens
uacuucucgggaaaggaucaucgccguugaaaugaaaagagagacagagagaaaaaaaaaaaga

SEQ ID NO: 102425 - RNA, 64 nt, Homo Sapiens
cguugaaaugaaaagagagacagagagaaaaaaaaaaagagaacccacaugaagcucugaaacc

SEQ ID NO: 102426 - RNA, 64 nt, Homo Sapiens
ggagcugaggccauucccugacuuguuuaauucuaaaagagaagaaaguuaacucuuaguuuuu

SEQ ID NO: 102427 - RNA, 64 nt, Homo Sapiens
aaagaagcacucugcuggcgccuguaggaaacagaaaagagaaggguggguuccagggacugua

SEQ ID NO: 102428 - RNA, 64 nt, Homo Sapiens
ggggaagccugagguagucaacccaggagccaagaaaagagaacuacgaggaacaggugcccgg

SEQ ID NO: 102429 - RNA, 64 nt, Homo Sapiens
uaaaagggcaaaaaacaaucucaaaaagauuagaaaaagagaaggggggaagggaagagaaaau

SEQ ID NO: 102430 - RNA, 64 nt, Homo Sapiens
caacauagcgugacccugucucuacaaaaaauuaaaaagagaacauacaaaguugacauaugag

SEQ ID NO: 102431 - RNA, 64 nt, Homo Sapiens
accuaaagggaaccugcaauaaucuugaaaaagaaaaagagaaaaauuuuaaaauccugcuaua

SEQ ID NO: 102432 - RNA, 64 nt, Homo Sapiens
agagaaaaauuuuaaaauccugcuauaggagaaaaaaagagaaaaaaauaaaaaucaaaaaaaa

SEQ ID NO: 102433 - RNA, 64 nt, Homo Sapiens
uuucuucuucuucuuuuuuuuuuuuuauaaaagcaaaagagaaauacauaaaaaaguguuuacc

SEQ ID NO: 102434 - RNA, 64 nt, Homo Sapiens
gugcaauacauuuuuuucucuuuccuugaaaauaaaaagagaaacaaguauuuugcuauauaua

SEQ ID NO: 102435 - RNA, 64 nt, Homo Sapiens
cugcauuuuauugguuuuuauaauguuuccuaauaaaagagaaguuuuggguuuuuuuuuuuuu

SEQ ID NO: 102436 - RNA, 64 nt, Homo Sapiens
uucagagcguuggaccuucacccccuucuaaggaaaaagagaggggcagccccucaccccagac

SEQ ID NO: 102437 - RNA, 64 nt, Homo Sapiens
guaucuagaaaugccuuuaaacaggcccuugccuaaaagagaagguaacuccauuugcuacagg

SEQ ID NO: 102438 - RNA, 64 nt, Homo Sapiens
uuucccucucuugauaggaucaauuuguuuccagaaaagagacuauuuuucaucuuuuugcugu

SEQ ID NO: 102439 - RNA, 64 nt, Homo Sapiens
acacagugagaccccuucucaaaaaaaaaaaaaaaaaagagagagugugugauuagaagcuaaa

SEQ ID NO: 102440 - RNA, 64 nt, Homo Sapiens
aauauaagggaaaaauaugagaaaaauaaaaauaaaaagagaauaauaggccaggcacuguggc

SEQ ID NO: 102441 - RNA, 64 nt, Homo Sapiens
cucugauaaaacagaauuuaaaccaacaaagaucaaaagagacaaggccauuauauaaugguaa

SEQ ID NO: 102442 - RNA, 64 nt, Homo Sapiens
caaaauugauagaccgcuagcaagacuaaugaagaaaagagagaagaaucaaauagaugcaaua

SEQ ID NO: 102443 - RNA, 64 nt, Homo Sapiens
uccuguuaccaaagcugggcagagacaaaaccaaaaaagagaauuuuagaccaauauccuugau

SEQ ID NO: 102444 - RNA, 64 nt, Homo Sapiens
cuuuccuaaagcuccucugcacauagaggggagaaaaagagaauuuaggcaacuccacuccccc

SEQ ID NO: 102445 - RNA, 64 nt, Homo Sapiens
cccuucacccccaacccuguauucuacucucccgaaaagagaagagaaucgcaugaguagcaag

SEQ ID NO: 102446 - RNA, 64 nt, Homo Sapiens
cuccuaucccucugccccuacugcucagcaauguaaaagagacaaauaaggagaaagaaaaucu

SEQ ID NO: 102447 - RNA, 64 nt, Homo Sapiens
gcugugagcucaaacaaaaacugcagacaaacaaaaaagagaaaagcuuuuauuuguguuuuca

SEQ ID NO: 102448 - RNA, 64 nt, Homo Sapiens
ugggaggcugaggcaggagagguguggugguggguaccgcuacuaaaaauacaaaaauuagccg

SEQ ID NO: 102449 - RNA, 64 nt, Homo Sapiens
auuccaaaggaggauggcauuucuauuuuaauuauaccgcuaucaguauucuguguuaaaaaug

SEQ ID NO: 102450 - RNA, 64 nt, Homo Sapiens
uuuuuuuuucucuuuuuuuaguuuuuguuucaauuaccgcuagaagacacuuuuuaaaguuuuu

SEQ ID NO: 102451 - RNA, 64 nt, Homo Sapiens
uucuggggcugggccugagccuaacucccuccacuaccgcuauuucuccuuggauggcaccauc

SEQ ID NO: 102452 - RNA, 64 nt, Homo Sapiens
accacugcaauucacauuaucauagcacuguguauaccgcuacucccaccuuccucugugcccc

SEQ ID NO: 102453 - RNA, 64 nt, Homo Sapiens
cucaagggaaaauggaggcuccagcagcauauuguaccgcuaccccuuugaaaggcugaagaug

SEQ ID NO: 102454 - RNA, 64 nt, Homo Sapiens
cugacuagguggacagagcucaaagaggcccucuuaccgcuagcgaggugauaggacaucuggc

SEQ ID NO: 102455 - RNA, 64 nt, Homo Sapiens
ggaggaguuaacuuugcgccggccgucagggcauuaccgcuaacgucugcaggagcuuuauucc

SEQ ID NO: 102456 - RNA, 64 nt, Homo Sapiens
aggcugagcaagccaggaagcucuggggucuggcuaccgcuaggcugucuccagaagcuucuag

SEQ ID NO: 102457 - RNA, 64 nt, Homo Sapiens
caaacugaguugauuucuauuccuuuuaaguuuauaccgcuaaaacaagugauugaucuaaagu

SEQ ID NO: 102458 - RNA, 64 nt, Homo Sapiens
uuuuguuuucagauuuauuccccauguuuacagauaccgcuaauaaauugcaguaguccuuccc

SEQ ID NO: 102459 - RNA, 64 nt, Homo Sapiens
aauacuuagugcagaaggugcaaccagagcaaaagguuauuaaguuccagguuauuaaaugggu

SEQ ID NO: 102460 - RNA, 64 nt, Homo Sapiens
ugggucaaccagagcaaaagcuuuuuuucuuccagguuauuaaaagaccagacauggagcaaca

SEQ ID NO: 102461 - RNA, 64 nt, Homo Sapiens
auacucaacucaacuaggcucauacucaauugaugguuauuagacaauuccauuucuuucuggu

SEQ ID NO: 102462 - RNA, 64 nt, Homo Sapiens
aauugaugguuauuagacaauuccauuucuuucugguuauuauaaacagaaaaucuuuccucuu

SEQ ID NO: 102463 - RNA, 64 nt, Homo Sapiens
auaggcugggcgcgguggcuuguuuaaacauuaaaauuacuaaauuugaaaugaaaugaaaccu

SEQ ID NO: 102464 - RNA, 64 nt, Homo Sapiens
gagaaucccugucaaugucaccacaucaggcaauaauuacuaaaugggaagaccacaucuuguu

SEQ ID NO: 102465 - RNA, 64 nt, Homo Sapiens
uaaaacagaaagcacuaggauacaaaugaagcuuaauuacuaaaauguaauucuugacacucuu

SEQ ID NO: 102466 - RNA, 64 nt, Homo Sapiens
agaaauaugaagaaaaaauacaccaagauggucaaauuacuacacaaaucagcaccagcacagu

SEQ ID NO: 102467 - RNA, 64 nt, Homo Sapiens
uuauucucaauggaagaauggcaucugaucucauaauuacuaguuuauauuaauauaguuuuuu

SEQ ID NO: 102468 - RNA, 64 nt, Homo Sapiens
uuuaacuuccuucuguuuuaagauuguaauuaaaaauuacuauuuuguuauauggaaugguuaa

SEQ ID NO: 102469 - RNA, 64 nt, Homo Sapiens
aagacuccuaauagcuuuucuuucacauuagauaaauuacuauacuauuauaaggccauuuccu

SEQ ID NO: 102470 - RNA, 64 nt, Homo Sapiens
uucaguugagaccuucuaaucacauaaauggauuaauuacuaauuauucuguguuuuaucuagu

SEQ ID NO: 102471 - RNA, 64 nt, Homo Sapiens
uagucacugcaaauuugacugugacuuuaaucuaaauuacuauguaaacaaaaaguagauaguu

SEQ ID NO: 102472 - RNA, 64 nt, Homo Sapiens
aaaucugcauuuuaauucauguuggucaaagucgaauuacuaucuauuuaucuuauaucguaga

SEQ ID NO: 102473 - RNA, 64 nt, Homo Sapiens
ugaugauuuaaaacaaaauauagucuuaaacucaaauuacuauauuauucugaauggcugaagu

SEQ ID NO: 102474 - RNA, 64 nt, Homo Sapiens
caacagauuucaggaaguacuuucuuuuuacagaaauuacuaccccagcuucuggaauugcugc

SEQ ID NO: 102475 - RNA, 64 nt, Homo Sapiens
aaaauagcuuuauuuaugcugaauugugauuuuuuuaugccaaauuuuuuuuaguucuaaucau

SEQ ID NO: 102476 - RNA, 64 nt, Homo Sapiens
uucuaaucauugaugauagcuuggaaauaaauaauuaugccauggcauuugacaguucauuauu

SEQ ID NO: 102477 - RNA, 64 nt, Homo Sapiens
uaguuugucuagauuucuuuguuuccaaacuuaauuaugccauuaacaggcuauaucauaggca

SEQ ID NO: 102478 - RNA, 64 nt, Homo Sapiens
accuaggguaauguuuuguagcacaguuuuaagauuaugccaucugucauaccacacaguagcu

SEQ ID NO: 102479 - RNA, 64 nt, Homo Sapiens
cccacucagaauccacggugaccucuccgcuugccaaaauaaccgaaggaaagaccguucacca

SEQ ID NO: 102480 - RNA, 64 nt, Homo Sapiens
accgcaaauaucugugggguccuguugaaaagaacaaaauaaaggagcccaaggggucauucug

SEQ ID NO: 102481 - RNA, 64 nt, Homo Sapiens
auuuuuuuguagaguuuuuggaaagauauuuacucaaaauaacuaugcuuuagaacuuuuuuuu

SEQ ID NO: 102482 - RNA, 64 nt, Homo Sapiens
gcccauagaaacauucucguuuaaacaacaacaacaaaauaaauuuaucagcacuagauauuag

SEQ ID NO: 102483 - RNA, 64 nt, Homo Sapiens
aagcaauuagcuaugugauuggaugucaguuuuacaaaauaauguauucuaggugccaguguua

SEQ ID NO: 102484 - RNA, 64 nt, Homo Sapiens
uaguugaacucucugucuucaaucccuuagauugcaaaauaaaauugauugaagugcagagaaa

SEQ ID NO: 102485 - RNA, 64 nt, Homo Sapiens
aagguuugccaagcucagugaagcauuuuuaucacaaaauaaaauuaagaugaaauuuauauga

SEQ ID NO: 102486 - RNA, 64 nt, Homo Sapiens
ucugccugggcauuuuguaggcccaugacaccugcaaaauaagucuuccguccagugcugugau

SEQ ID NO: 102487 - RNA, 64 nt, Homo Sapiens
uauuggcaaacaauacagcaacagaugcaaaaugcaaaauaaaauuagaaggauuuuauucuca

SEQ ID NO: 102488 - RNA, 64 nt, Homo Sapiens
gggaaaugagaaguuauaccuauauuucuuaauacaaaauaaguuuagaaaugaagaaaaugaa

SEQ ID NO: 102489 - RNA, 64 nt, Homo Sapiens
cuauggggaaucaugguucuuuuaaagcaauuuucaaaauaaguaccaauuaaagcuuuagguu

SEQ ID NO: 102490 - RNA, 64 nt, Homo Sapiens
auauugcuagagcuauuuuccugaaauacauuugcaaaauaaggcugcuuuguaaucaaggaau

SEQ ID NO: 102491 - RNA, 64 nt, Homo Sapiens
caggugaauuggcucucauggaaauuuggaauuacaaaauaaacguccuggggguuacccagaa

SEQ ID NO: 102492 - RNA, 64 nt, Homo Sapiens
cccagaauacagauuuaaaaguuugccuguagagcaaaauaaaacagucaguuguagucauuaa

SEQ ID NO: 102493 - RNA, 64 nt, Homo Sapiens
uaguacuugauguugauguuuuuauuuugcugagcaaaauaaagccaaugggagaaagacuauu

SEQ ID NO: 102494 - RNA, 64 nt, Homo Sapiens
uuaccguaauauuauaucuugcccuacuuauuuacaaaauaauauguuucuguuaugguccuua

SEQ ID NO: 102495 - RNA, 64 nt, Homo Sapiens
aaccaguguugauauguuugauuaagacuuuucacaaaauaaucauauaaaacacuagucucuu

SEQ ID NO: 102496 - RNA, 64 nt, Homo Sapiens
uuuauguauguuccuaaugcuuauggaacuccuccaaaauaaaguuacucaaagagagcaaaua

SEQ ID NO: 102497 - RNA, 64 nt, Homo Sapiens
ggguuacagggcccaugcaaugggagaaauuggccaaaauaaaguuaaagacggcuguuccaaa

SEQ ID NO: 102498 - RNA, 64 nt, Homo Sapiens
cauuuccaacuacugcugcaacacuuuaguaaugcaaaauaacuacccgugauaaugugauuga

SEQ ID NO: 102499 - RNA, 64 nt, Homo Sapiens
uacgacgagagcuugaguuggaacuuuugcuuaacaaaauaacaagaguguuauuaaugauuau

SEQ ID NO: 102500 - RNA, 64 nt, Homo Sapiens
agcucuccauucugugguggugaacaggggcauccaaaauaagaggguuccccucucucaugca

SEQ ID NO: 102501 - RNA, 64 nt, Homo Sapiens
gucugaggcuaaggcccacgaaaggucacaaaagcaaaauaacuauuaaaucacaaaguauguu

SEQ ID NO: 102502 - RNA, 64 nt, Homo Sapiens
uaacuuguucugaaguuguccugcuuuuauucaucaaaauaaaauuuuuuucaauugccagcua

SEQ ID NO: 102503 - RNA, 64 nt, Homo Sapiens
uuacauugcuggucuuguaaaauucaaaaauguacaaaauaaaguaauuauuguuuauauuuuc

SEQ ID NO: 102504 - RNA, 64 nt, Homo Sapiens
ucuuguuaauauucuuucaaaagauuuaauuugccaaaauaaugccuguugaaaagccauguuu

SEQ ID NO: 102505 - RNA, 64 nt, Homo Sapiens
caagcuaucugcaccucaaaugagauaguaacaacaaaauaaaguuauaauuguuggaccuccu

SEQ ID NO: 102506 - RNA, 64 nt, Homo Sapiens
cuguuguuaaauuuuaaacaguaaagaacaacaacaaaauaaaggcaaugagccacagcaaaaa

SEQ ID NO: 102507 - RNA, 64 nt, Homo Sapiens
ucugaaguaguccaauaacauuauagucuaaaagcaaaauaaauuaauaaaauuuaguuucuca

SEQ ID NO: 102508 - RNA, 64 nt, Homo Sapiens
cucauuucuuuucaugacacaugcauuucacagccaaaauaaguauuagccaccacaccuuaag

SEQ ID NO: 102509 - RNA, 64 nt, Homo Sapiens
gacucuauuaucugaaaugaauuacuaaguauaccaaaauaauuauuuuaauacuugcaaaaac

SEQ ID NO: 102510 - RNA, 64 nt, Homo Sapiens
uacuuggagaaguauguaauuuuuaucaaaaugucaaaauaacaggcagucaaaugguguuugu

SEQ ID NO: 102511 - RNA, 64 nt, Homo Sapiens
gacacucccuaauuccauuauuuuuucauucauacaaaauaauguuggaggcuaaaauguaaug

SEQ ID NO: 102512 - RNA, 64 nt, Homo Sapiens
gcuaggaauaauucugucaaacugaaauuuaugucaaaauaacgagaguuugcgauauuuagau

SEQ ID NO: 102513 - RNA, 64 nt, Homo Sapiens
caugaauuuacugauucuucauuuaaaaccucagcaaaauaaucucugaaacagaggcuuuaaa

SEQ ID NO: 102514 - RNA, 64 nt, Homo Sapiens
uugugagcccagauaucauuuggaauucuguccacaaaauaauuauaaagaauucuuuugagga

SEQ ID NO: 102515 - RNA, 64 nt, Homo Sapiens
caaacucauccauagauaauucaagauuuguauucaaaauaaacauaguuuucacaguuacaaa

SEQ ID NO: 102516 - RNA, 64 nt, Homo Sapiens
uuuguauucaaaauaaacauaguuuucacaguuacaaaauaaaucaccuauuuuaucuuuuccu

SEQ ID NO: 102517 - RNA, 64 nt, Homo Sapiens
guggugucuacugcuagggagauuauaugaaggccaaaauaaugacuucagcaagagugacuga

SEQ ID NO: 102518 - RNA, 64 nt, Homo Sapiens
auauuuguauuacuugaauuuugcucuuguauggcaaaauaauuagugaguuuaaaaaaaaucu

SEQ ID NO: 102519 - RNA, 64 nt, Homo Sapiens
ucagcccugcacuuucuuuaacauauuccauuuacaaaauaaauugcaaaauaauuaaaccugu

SEQ ID NO: 102520 - RNA, 64 nt, Homo Sapiens
aaaccuguacauauuccauuuuuaccucaaggugcaaaauaauuuaguaguugcuauguacuga

SEQ ID NO: 102521 - RNA, 64 nt, Homo Sapiens
uuaauuuuguaaguaaauauuuuguugaguuuugcaaaauaaaaaaaccagaucugaacaugua

SEQ ID NO: 102522 - RNA, 64 nt, Homo Sapiens
uuaaguguaagaaacuaaaguaaguauuauaauacaaaauaauuguugauuuuagauaaccaag

SEQ ID NO: 102523 - RNA, 64 nt, Homo Sapiens
uuuguugcauuucaguaaaagcagaauaaccuuucaaaauaauaacaggcugggugcaauggcu

SEQ ID NO: 102524 - RNA, 64 nt, Homo Sapiens
agccuggccugggcaacagagcaagacccugucucaaaauaauaauaauauauaauuuuacacc

SEQ ID NO: 102525 - RNA, 64 nt, Homo Sapiens
cugaauucaccacagcuggaauagcuguggaaaacaaaauaaaacaacaaaauuaauaaugaaa

SEQ ID NO: 102526 - RNA, 64 nt, Homo Sapiens
uaguaaugcaaacaaauuauuuuuuacaaaaaaacaaaauaaauaaaauuagacuuccuucccu

SEQ ID NO: 102527 - RNA, 64 nt, Homo Sapiens
agaguaaccuguauuuuaauuguugaaacuuaaccaaaauaagauacugucucagcuagggcuu

SEQ ID NO: 102528 - RNA, 64 nt, Homo Sapiens
ugggaauauuuguuguuaaaaacuucuuuuugcccaaaauaacucauuuuguauuaucugaaaa

SEQ ID NO: 102529 - RNA, 64 nt, Homo Sapiens
ucuauauauuuaugauaaaucuuuuccauuuguacaaaauaaaauuccauuucauugugaccua

SEQ ID NO: 102530 - RNA, 64 nt, Homo Sapiens
accuauauuuauguaacuguauacugaauucugacaaaauaaaaaaagauaccuuauugacgaa

SEQ ID NO: 102531 - RNA, 64 nt, Homo Sapiens
guuguugaacguuauacuggaaauaaguuuuugucaaaauaacuuuuucacuguaggaaucaca

SEQ ID NO: 102532 - RNA, 64 nt, Homo Sapiens
uuuugucaaaauaacuguugcacuguaggaaucacaaaauaagugauaucaccaaaaauguuuu

SEQ ID NO: 102533 - RNA, 64 nt, Homo Sapiens
uuacuaaguacuaaagagccuuuuggucaugcaucaaaauaaaucauguuaaauuucccuuuua

SEQ ID NO: 102534 - RNA, 64 nt, Homo Sapiens
cagaguacauaugcaaucacgauccaaacauguccaaaauaaugugauuguuucuuuaacuuag

SEQ ID NO: 102535 - RNA, 64 nt, Homo Sapiens
aauguucuuuauuuuacaggauugcuagacucaccaaaauaauagaacuuacaacucagaaaag

SEQ ID NO: 102536 - RNA, 64 nt, Homo Sapiens
ucaaaauaguuuuggggaucaaauuacucaucgucaaaauaaugaaaagauuuugguugagacu

SEQ ID NO: 102537 - RNA, 64 nt, Homo Sapiens
uggcacaauuuaauuguuuuugaacaacuguagucaaaauaagggucaucguuauccucucuua

SEQ ID NO: 102538 - RNA, 64 nt, Homo Sapiens
gugacaauuguagcauugaccugagcuuccuuuucaaaauaaaacucuaagaguuuuuuuccuu

SEQ ID NO: 102539 - RNA, 64 nt, Homo Sapiens
uuuauagguaaagccaaugugugcuuagcauuaacaaaauaagguaugagcccauaaggguucu

SEQ ID NO: 102540 - RNA, 64 nt, Homo Sapiens
ugcaaauuuaaauguggcgcauugagcagcuagacaaaauaaucuuugagugguauuucucuug

SEQ ID NO: 102541 - RNA, 64 nt, Homo Sapiens
guauuuagaggacacugauuuugugggcuguugccaaaauaagagaauuuucuaaaaguuaacc

SEQ ID NO: 102542 - RNA, 64 nt, Homo Sapiens
aaagacaggaaaauaagucuacaaaauaaguagacaaaauaacagugauagaagauuauucaga

SEQ ID NO: 102543 - RNA, 64 nt, Homo Sapiens
agacaaaauaacaaaagacaaagauuauucagaacaaaauaaguuagaaggggaaaugugauag

SEQ ID NO: 102544 - RNA, 64 nt, Homo Sapiens
uggcucccaaacucuuguuguucuuaaggguuugcaaaauaauuuaaauuaguuuuaguuugug

SEQ ID NO: 102545 - RNA, 64 nt, Homo Sapiens
gugguuuuaaaguaaauucaagucuuaaguauuucaaaauaaaauauuuuuauaacuucuugug

SEQ ID NO: 102546 - RNA, 64 nt, Homo Sapiens
caaaugaaacuuuaaaauuuauuuugguuuaucccaaaauaauggaaaauguccaguuguguuu

SEQ ID NO: 102547 - RNA, 64 nt, Homo Sapiens
aauuuuaguacaaaauuucauaaaccguguuuuucaaaauaaguuuaugucaaauccagcuucc

SEQ ID NO: 102548 - RNA, 64 nt, Homo Sapiens
ucagacauucagugggcaaguaaauuauggacugcaaaauaaugauuuuuauucaagaaagcuu

SEQ ID NO: 102549 - RNA, 64 nt, Homo Sapiens
aaguuuuauauccagauauacaaccacaauaaagcaaaauaaccuacuaucaaaauagaaaugu

SEQ ID NO: 102550 - RNA, 64 nt, Homo Sapiens
cuuguaagcuuuaacuauaucucucuuuaaaaugcaaaauaaugucuuaagauucaaagucugu

SEQ ID NO: 102551 - RNA, 64 nt, Homo Sapiens
aagucuguauuuuuaaagcauggcuuuggcuuugcaaaauaaaaaauguguuuuguacaugaag

SEQ ID NO: 102552 - RNA, 64 nt, Homo Sapiens
aaauugggucuuagauuuugauuuacuagugugacaaaauaacuacauccuaaugaaaaucaag

SEQ ID NO: 102553 - RNA, 64 nt, Homo Sapiens
uaaacccauguuucugagaugccauuauuccaagcaaaauaagagauaaucccuucaaguuaaa

SEQ ID NO: 102554 - RNA, 64 nt, Homo Sapiens
ccuucauuaucaaacugguucauauguucaaaaccaaaauaauaguuuucaacacaucaacuca

SEQ ID NO: 102555 - RNA, 64 nt, Homo Sapiens
uugagggcauguugcauauucauuucccccaaaacaaaauaaaaaagcucuagguucuucagca

SEQ ID NO: 102556 - RNA, 64 nt, Homo Sapiens
agaaguuauuauucauacuguguugcucauuugacaaaauaagguaaggauuucauaaucaggu

SEQ ID NO: 102557 - RNA, 64 nt, Homo Sapiens
guuuacagaacccaaaugaugucuuccucucucucaaaauaaacuaaccuauucauauugcugu

SEQ ID NO: 102558 - RNA, 64 nt, Homo Sapiens
uuugugagcaguuugccauucagaaaccauugagcaaaauaagucuauagaugggacugaaacu

SEQ ID NO: 102559 - RNA, 64 nt, Homo Sapiens
aaguuuuguuuuucacaaagcucuuauuaugaagcaaaauaaaaauucuaguuucuuguaugau

SEQ ID NO: 102560 - RNA, 64 nt, Homo Sapiens
uuagugucucuauuuaugagaucacugaacuuuucaaaauaaagcuuuugcauagaauaaugaa

SEQ ID NO: 102561 - RNA, 64 nt, Homo Sapiens
ucacugcuguaaagcaaaauauuugugaaagugccaaaauaaagucugucaugccaaaaguaaa

SEQ ID NO: 102562 - RNA, 64 nt, Homo Sapiens
guauuauuugauacuaaauuuucaauuauuacuucaaaauaagagucugaggauuucuucuuac

SEQ ID NO: 102563 - RNA, 64 nt, Homo Sapiens
ugaaaacuaaucaaauauagugccuauuuagucucaaaauaagguaacuauuaacuugauuaua

SEQ ID NO: 102564 - RNA, 64 nt, Homo Sapiens
uucuaaagauaauacuaaacuaaauuaguguuggcaaaauaaagaacugcuuuguuugcaagau

SEQ ID NO: 102565 - RNA, 64 nt, Homo Sapiens
uaaaucuuuaaaaauauaaagauuagaacuuacucaaaauaaugacaucugcaucauuucauag

SEQ ID NO: 102566 - RNA, 64 nt, Homo Sapiens
ugacaugaaacugcaaaaauagauauggcuggaccaaaauaaaaguuuuuuuucuccuacaagg

SEQ ID NO: 102567 - RNA, 64 nt, Homo Sapiens
guuaaagagggcauaaaggauauagauguaaagacaaaauaaagaaacaaugacuguaacgugu

SEQ ID NO: 102568 - RNA, 64 nt, Homo Sapiens
aauguuaauaaggugauaaguccauaguuuuauucaaaauaauaugcaugauuuauccaaaguu

SEQ ID NO: 102569 - RNA, 64 nt, Homo Sapiens
caugaaauuggagcucuguauaaacugaaaaagacaaaauaaguaaagcacuuguugcuuugcu

SEQ ID NO: 102570 - RNA, 64 nt, Homo Sapiens
ugucucauuguagucugucuucaacuauuuuauccaaaauaaaccuccagaagaaaguaguuuu

SEQ ID NO: 102571 - RNA, 64 nt, Homo Sapiens
cucagccuaauugagcccuauuauuuuaacuuaacaaaauaaauacagaaguaccuauuucuaa

SEQ ID NO: 102572 - RNA, 64 nt, Homo Sapiens
cuccauauauugucauucaaaauauauuuuaacccaaaauaaguuaaauaauuugugcauguuu

SEQ ID NO: 102573 - RNA, 64 nt, Homo Sapiens
aaauggacgaaaaauucucucgccaucuuaauaacaaaauaaacuacaaauuccugacccaagg

SEQ ID NO: 102574 - RNA, 64 nt, Homo Sapiens
ccuggagauucugaagugccuuugcugugguuuucaaaauaauaaagauuuguauucaacucaa

SEQ ID NO: 102575 - RNA, 64 nt, Homo Sapiens
acaucucaauuucuaauaccuacucucaaauagucaaaauaaaauggaacauuaucuacaauuu

SEQ ID NO: 102576 - RNA, 64 nt, Homo Sapiens
ugaaaagguagauggaguugauuuguuuuggugucaaaauaacauguauucauucacuuucaag

SEQ ID NO: 102577 - RNA, 64 nt, Homo Sapiens
acugaggcccuaaaaauagauuuuuuucuuccagcaaaauaaacgcauacuuuucauguuuuaa

SEQ ID NO: 102578 - RNA, 64 nt, Homo Sapiens
acugcuauuuauaaaaaugcucagcaguugaaagcaaaauaauagggcauguuauuugaagugc

SEQ ID NO: 102579 - RNA, 64 nt, Homo Sapiens
aaacuaaaaacaaaaaguaauuuucauaaucagucaaaauaauauagaguaaacuuauugcaua

SEQ ID NO: 102580 - RNA, 64 nt, Homo Sapiens
cuuacuaaaggaagagugaguuugggucuugaaccaaaauaagauaauagagcagaugguugcc

SEQ ID NO: 102581 - RNA, 64 nt, Homo Sapiens
uuuuuuuuuuaaacucauauauugggauuuucaccaaaauaaugcuuuugaaaaaaagaaaaaa

SEQ ID NO: 102582 - RNA, 64 nt, Homo Sapiens
uauauugagaaucaaaguagaaguuuuaggaaugcaaaauaagucaucuugcauacagggagug

SEQ ID NO: 102583 - RNA, 64 nt, Homo Sapiens
auuuuuuuuucuuuuuaauauuuucuucuggucacaaaauaaagaaauuugggaugcaaaguac

SEQ ID NO: 102584 - RNA, 62 nt, Homo Sapiens
auuucucauuguuggaaucugaauaaaccaauuacaaaauaacauaugugcacauuguaagu

SEQ ID NO: 102585 - RNA, 64 nt, Homo Sapiens
gucaaucagcauuguuauuuuuucaaugauuuuucaaaauaaaaucucagaugauuauuccagu

SEQ ID NO: 102586 - RNA, 64 nt, Homo Sapiens
aggaacucauacuaaaauugucuguagauuccaucaaaauaaguaugugaaguauucaugagaa

SEQ ID NO: 102587 - RNA, 64 nt, Homo Sapiens
gcauaacgaccuugaauguaauuggaguaagugacaaaauaagaacuacccugggaaacccugc

SEQ ID NO: 102588 - RNA, 64 nt, Homo Sapiens
cuuaccacuucgaugguugugauuaauuuaaaaucaaaauaaaggaauuacugaguuuauuugc

SEQ ID NO: 102589 - RNA, 64 nt, Homo Sapiens
ucgagagcaaaucaaaaccucuauccagacaagacaaaauaaaacucaccaucuccugaagacc

SEQ ID NO: 102590 - RNA, 64 nt, Homo Sapiens
acuauaggccauaaagaaugggacugcauuggaccaaaauaaaugggaaaaucgugguuugaaa

SEQ ID NO: 102591 - RNA, 64 nt, Homo Sapiens
uacauggauauacuuccuuuuaaauucucagcugcaaaauaauuguagacaaaauaauggcauu

SEQ ID NO: 102592 - RNA, 64 nt, Homo Sapiens
ccuuuuaaauucucagcugcaaaauaauuguagacaaaauaauggcauuuaacuaaagauggag

SEQ ID NO: 102593 - RNA, 64 nt, Homo Sapiens
gaucacugaaauauuuaugacagugcauaauuugcaaaauaaaaaauguacacuagcauaauau

SEQ ID NO: 102594 - RNA, 64 nt, Homo Sapiens
aauaauuguuaauauggaauaagcucaaauaugucaaaauaaauguaaaaaaugaguguugccc

SEQ ID NO: 102595 - RNA, 64 nt, Homo Sapiens
aaucuacuguacacaaucuguuauuccaaaauaacaaaauaaauccuaagccauaaaauaaauu

SEQ ID NO: 102596 - RNA, 64 nt, Homo Sapiens
aaauaaauaaucuacuguacaauaaauuuuauuccaaaauaacaucauagauccuaagccauaa

SEQ ID NO: 102597 - RNA, 64 nt, Homo Sapiens
gcuaauaauucuguaaggacacaucaaagcuggccaaaauaaugaauuuuuuuuaaaaagcaau

SEQ ID NO: 102598 - RNA, 64 nt, Homo Sapiens
gucacaaucaucuuacuagcucucucucucucagcaaaauaaaacugugaugugucuucuuugu

SEQ ID NO: 102599 - RNA, 64 nt, Homo Sapiens
guuuaugcuuuuuagauuuugguugcuuucuugccaaaauaaguguuaacuguguuucaaacuu

SEQ ID NO: 102600 - RNA, 64 nt, Homo Sapiens
cauagguacuguuguaccaaggucacuuaucuaacaaaauaacccuucauguauuuuaaauuua

SEQ ID NO: 102601 - RNA, 64 nt, Homo Sapiens
aaguccuuauuaaaccaggaggaccuuuuuuccucaaaauaaacugugaacagccugauguuug

SEQ ID NO: 102602 - RNA, 64 nt, Homo Sapiens
ucuuguuaugcagggaguacuuaucaacugucuccaaaauaaucauaaaaaggauguaugguuu

SEQ ID NO: 102603 - RNA, 64 nt, Homo Sapiens
caggugugagaauuguguguacaauagagaacuucaaaauaaaagaaguagaucaaaauagaac

SEQ ID NO: 102604 - RNA, 64 nt, Homo Sapiens
acuauaaaaauguacuuuaguuauauuaaaaacacaaaauaaaaaagauugacuauaccaaaca

SEQ ID NO: 102605 - RNA, 64 nt, Homo Sapiens
cuuagacauaucacaccuaaggcuguugcucuaacaaaauaaacgcaaauaauuuugccuucua

SEQ ID NO: 102606 - RNA, 64 nt, Homo Sapiens
gacagguuuuguuuuuuuuuauuuagcaagugcucaaaauaauuaagagugcuuuaaugaugac

SEQ ID NO: 102607 - RNA, 64 nt, Homo Sapiens
auacaguguuuuacauucucuccuuuauagguaacaaaauaauguuuagcucaguaaguacuga

SEQ ID NO: 102608 - RNA, 64 nt, Homo Sapiens
caugcuuaaugauggaaaugaaauguuaaaucaacaaaauaagauccaguguuucauaacauuu

SEQ ID NO: 102609 - RNA, 64 nt, Homo Sapiens
cuaauuuuuaagaguaacucaaaagugaaacauacaaaauaagacaguuuuuacccuaaagugc

SEQ ID NO: 102610 - RNA, 64 nt, Homo Sapiens
aaguuauggcuucacauucaaauggguauuuguucaaaauaaugcuaauuuuucuuacacacua

SEQ ID NO: 102611 - RNA, 64 nt, Homo Sapiens
auuucaaauguaaauauugucucaagccaucucacaaaauaagaaaaccuguaugccgauuuuc

SEQ ID NO: 102612 - RNA, 64 nt, Homo Sapiens
caaaauggacagucauuuuagaauggcaccaaaacaaaauaaguuaaggcuuuuaauacauuuu

SEQ ID NO: 102613 - RNA, 64 nt, Homo Sapiens
ucgagacuaggaagaaacugcaugaacuaacgagcaaaauaaccagcuaacaucauaaugacag

SEQ ID NO: 102614 - RNA, 64 nt, Homo Sapiens
aaacccaucucacgugcagagacacacauaggcucaaaauaaaaggauggaggaagaucuacga

SEQ ID NO: 102615 - RNA, 64 nt, Homo Sapiens
aaauaacaaugugcucucggugacaucacuuguacaaaauaaacacaggcaaaauccuugcuua

SEQ ID NO: 102616 - RNA, 64 nt, Homo Sapiens
ccagcucuacuggucuugugugucacugguagaccaaaauaaaaaauugacugucacuguuccu

SEQ ID NO: 102617 - RNA, 64 nt, Homo Sapiens
uuaaacaaagguugagauguucagauucccagagcaaaauaauuugcuaauuuauccugaaauu

SEQ ID NO: 102618 - RNA, 64 nt, Homo Sapiens
aaaguguuuuacauaguaaguuuaaacauuuuuacaaaauaaauuuacaguauuuuuauucaua

SEQ ID NO: 102619 - RNA, 64 nt, Homo Sapiens
uaagacuuucuaugugguuuaaaagcaagucuaccaaaauaaacacuuuaaaccaaugccuaua

SEQ ID NO: 102620 - RNA, 64 nt, Homo Sapiens
acaaugcaacaaaauaguguaaaagguaacuguacaaaauaaguaacccauuuucgcuauaaau

SEQ ID NO: 102621 - RNA, 64 nt, Homo Sapiens
uccccuuucuugagguugucguugccuuuauauccaaaauaaacaccauuuggucaggauuccu

SEQ ID NO: 102622 - RNA, 64 nt, Homo Sapiens
ucaccuugauuuugagcuggaauguuucaaugagcaaaauaaauuagacaaaaguuuacuuucu

SEQ ID NO: 102623 - RNA, 64 nt, Homo Sapiens
aauuuuuaaaaagacuguuuuuaaaaaggugcuacaaaauaaagugcuaucuuuuucuguuucu

SEQ ID NO: 102624 - RNA, 64 nt, Homo Sapiens
uuagaauuacacagcuaaaaaggaaaaaaaacaccaaaauaagauaaaauaaaacaaauuuaaa

SEQ ID NO: 102625 - RNA, 64 nt, Homo Sapiens
ccaaaauaagauaaaauaaaacaaauuuaaacaccaaaauaagauauaauaaaacauuuguuuu

SEQ ID NO: 102626 - RNA, 64 nt, Homo Sapiens
accaaaauaagauauaauaaaacauuuguuuuugcaaaauaaggcccaauguuauggccuaaug

SEQ ID NO: 102627 - RNA, 64 nt, Homo Sapiens
uugucuguuuucaaccaaagcauaacuaucaaaacaaaauaaauuucuaauacauauuaaaaga

SEQ ID NO: 102628 - RNA, 64 nt, Homo Sapiens
aaggauauuggagaccuguuugugaguauguuugcaaaauaauauauguauccgcaugugugca

SEQ ID NO: 102629 - RNA, 64 nt, Homo Sapiens; identical to SEQ ID NO: 100468

SEQ ID NO: 102630 - RNA, 64 nt, Homo Sapiens; identical to SEQ ID NO: 100469

SEQ ID NO: 102631 - RNA, 64 nt, Homo Sapiens; identical to SEQ ID NO: 100470

SEQ ID NO: 102632 - RNA, 64 nt, Homo Sapiens; identical to SEQ ID NO: 100471

SEQ ID NO: 102633 - RNA, 64 nt, Homo Sapiens; identical to SEQ ID NO: 100472

SEQ ID NO: 102634 - RNA, 64 nt, Homo Sapiens; identical to SEQ ID NO: 100473

SEQ ID NO: 102635 - RNA, 64 nt, Homo Sapiens; identical to SEQ ID NO: 100474

SEQ ID NO: 102636 - RNA, 64 nt, Homo Sapiens; identical to SEQ ID NO: 100475

SEQ ID NO: 102637 - RNA, 64 nt, Homo Sapiens; identical to SEQ ID NO: 100476

SEQ ID NO: 102638 - RNA, 64 nt, Homo Sapiens; identical to SEQ ID NO: 100477

SEQ ID NO: 102639 - RNA, 64 nt, Homo Sapiens; identical to SEQ ID NO: 100478

SEQ ID NO: 102640 - RNA, 64 nt, Homo Sapiens; identical to SEQ ID NO: 100479

SEQ ID NO: 102641 - RNA, 64 nt, Homo Sapiens; identical to SEQ ID NO: 100480

SEQ ID NO: 102642 - RNA, 64 nt, Homo Sapiens; identical to SEQ ID NO: 100481

SEQ ID NO: 102643 - RNA, 64 nt, Homo Sapiens; identical to SEQ ID NO: 100482

SEQ ID NO: 102644 - RNA, 64 nt, Homo Sapiens; identical to SEQ ID NO: 100483

SEQ ID NO: 102645 - RNA, 64 nt, Homo Sapiens; identical to SEQ ID NO: 100484

SEQ ID NO: 102646 - RNA, 64 nt, Homo Sapiens; identical to SEQ ID NO: 100485

SEQ ID NO: 102647 - RNA, 64 nt, Homo Sapiens; identical to SEQ ID NO: 100486

SEQ ID NO: 102648 - RNA, 64 nt, Homo Sapiens; identical to SEQ ID NO: 100487

SEQ ID NO: 102649 - RNA, 64 nt, Homo Sapiens; identical to SEQ ID NO: 100488

SEQ ID NO: 102650 - RNA, 64 nt, Homo Sapiens; identical to SEQ ID NO: 100489

SEQ ID NO: 102651 - RNA, 64 nt, Homo Sapiens; identical to SEQ ID NO: 100490

SEQ ID NO: 102652 - RNA, 64 nt, Homo Sapiens; identical to SEQ ID NO: 100491

SEQ ID NO: 102653 - RNA, 64 nt, Homo Sapiens; identical to SEQ ID NO: 100492

SEQ ID NO: 102654 - RNA, 64 nt, Homo Sapiens; identical to SEQ ID NO: 100493

SEQ ID NO: 102655 - RNA, 64 nt, Homo Sapiens; identical to SEQ ID NO: 100494

SEQ ID NO: 102656 - RNA, 64 nt, Homo Sapiens; identical to SEQ ID NO: 100495

SEQ ID NO: 102657 - RNA, 64 nt, Homo Sapiens; identical to SEQ ID NO: 100496

SEQ ID NO: 102658 - RNA, 64 nt, Homo Sapiens; identical to SEQ ID NO: 100497

SEQ ID NO: 102659 - RNA, 64 nt, Homo Sapiens; identical to SEQ ID NO: 100498

SEQ ID NO: 102660 - RNA, 64 nt, Homo Sapiens; identical to SEQ ID NO: 100499

SEQ ID NO: 102661 - RNA, 64 nt, Homo Sapiens; identical to SEQ ID NO: 100500

SEQ ID NO: 102662 - RNA, 64 nt, Homo Sapiens; identical to SEQ ID NO: 100501

SEQ ID NO: 102663 - RNA, 64 nt, Homo Sapiens; identical to SEQ ID NO: 100502

SEQ ID NO: 102664 - RNA, 64 nt, Homo Sapiens; identical to SEQ ID NO: 100503

SEQ ID NO: 102665 - RNA, 64 nt, Homo Sapiens; identical to SEQ ID NO: 100504

SEQ ID NO: 102666 - RNA, 64 nt, Homo Sapiens; identical to SEQ ID NO: 100505

SEQ ID NO: 102667 - RNA, 64 nt, Homo Sapiens; identical to SEQ ID NO: 100506

SEQ ID NO: 102668 - RNA, 64 nt, Homo Sapiens; identical to SEQ ID NO: 100507

SEQ ID NO: 102669 - RNA, 64 nt, Homo Sapiens; identical to SEQ ID NO: 100508

SEQ ID NO: 102670 - RNA, 64 nt, Homo Sapiens; identical to SEQ ID NO: 100509

SEQ ID NO: 102671 - RNA, 64 nt, Homo Sapiens; identical to SEQ ID NO: 100510

SEQ ID NO: 102672 - RNA, 64 nt, Homo Sapiens; identical to SEQ ID NO: 100511

SEQ ID NO: 102673 - RNA, 64 nt, Homo Sapiens; identical to SEQ ID NO: 100512

SEQ ID NO: 102674 - RNA, 64 nt, Homo Sapiens; identical to SEQ ID NO: 100513

SEQ ID NO: 102675 - RNA, 64 nt, Homo Sapiens; identical to SEQ ID NO: 100514

SEQ ID NO: 102676 - RNA, 59 nt, Homo Sapiens; identical to SEQ ID NO: 100515

SEQ ID NO: 102677 - RNA, 64 nt, Homo Sapiens; identical to SEQ ID NO: 100516

SEQ ID NO: 102678 - RNA, 64 nt, Homo Sapiens; identical to SEQ ID NO: 100517

SEQ ID NO: 102679 - RNA, 64 nt, Homo Sapiens; identical to SEQ ID NO: 100518

SEQ ID NO: 102680 - RNA, 64 nt, Homo Sapiens; identical to SEQ ID NO: 100519

SEQ ID NO: 102681 - RNA, 64 nt, Homo Sapiens; identical to SEQ ID NO: 100520

SEQ ID NO: 102682 - RNA, 64 nt, Homo Sapiens; identical to SEQ ID NO: 100521

SEQ ID NO: 102683 - RNA, 64 nt, Homo Sapiens; identical to SEQ ID NO: 100522

SEQ ID NO: 102684 - RNA, 64 nt, Homo Sapiens; identical to SEQ ID NO: 100523

SEQ ID NO: 102685 - RNA, 64 nt, Homo Sapiens; identical to SEQ ID NO: 100524

SEQ ID NO: 102686 - RNA, 64 nt, Homo Sapiens; identical to SEQ ID NO: 100525

SEQ ID NO: 102687 - RNA, 64 nt, Homo Sapiens; identical to SEQ ID NO: 100526

SEQ ID NO: 102688 - RNA, 64 nt, Homo Sapiens; identical to SEQ ID NO: 100527

SEQ ID NO: 102689 - RNA, 64 nt, Homo Sapiens; identical to SEQ ID NO: 100528

SEQ ID NO: 102690 - RNA, 64 nt, Homo Sapiens; identical to SEQ ID NO: 100529

SEQ ID NO: 102691 - RNA, 64 nt, Homo Sapiens; identical to SEQ ID NO: 100530

SEQ ID NO: 102692 - RNA, 64 nt, Homo Sapiens; identical to SEQ ID NO: 100531

SEQ ID NO: 102693 - RNA, 64 nt, Homo Sapiens; identical to SEQ ID NO: 100532

SEQ ID NO: 102694 - RNA, 64 nt, Homo Sapiens; identical to SEQ ID NO: 100533

SEQ ID NO: 102695 - RNA, 64 nt, Homo Sapiens; identical to SEQ ID NO: 100534

SEQ ID NO: 102696 - RNA, 64 nt, Homo Sapiens; identical to SEQ ID NO: 100535

SEQ ID NO: 102697 - RNA, 64 nt, Homo Sapiens; identical to SEQ ID NO: 100536

SEQ ID NO: 102698 - RNA, 64 nt, Homo Sapiens; identical to SEQ ID NO: 100537

SEQ ID NO: 102699 - RNA, 64 nt, Homo Sapiens; identical to SEQ ID NO: 100538

SEQ ID NO: 102700 - RNA, 64 nt, Homo Sapiens; identical to SEQ ID NO: 100539

SEQ ID NO: 102701 - RNA, 64 nt, Homo Sapiens; identical to SEQ ID NO: 100540

SEQ ID NO: 102702 - RNA, 64 nt, Homo Sapiens; identical to SEQ ID NO: 100541

SEQ ID NO: 102703 - RNA, 64 nt, Homo Sapiens; identical to SEQ ID NO: 100542

SEQ ID NO: 102704 - RNA, 64 nt, Homo Sapiens; identical to SEQ ID NO: 100543

SEQ ID NO: 102705 - RNA, 64 nt, Homo Sapiens; identical to SEQ ID NO: 100544

SEQ ID NO: 102706 - RNA, 64 nt, Homo Sapiens; identical to SEQ ID NO: 100545

SEQ ID NO: 102707 - RNA, 64 nt, Homo Sapiens; identical to SEQ ID NO: 100546

SEQ ID NO: 102708 - RNA, 64 nt, Homo Sapiens; identical to SEQ ID NO: 100547

SEQ ID NO: 102709 - RNA, 64 nt, Homo Sapiens; identical to SEQ ID NO: 100548

SEQ ID NO: 102710 - RNA, 64 nt, Homo Sapiens; identical to SEQ ID NO: 100549

SEQ ID NO: 102711 - RNA, 64 nt, Homo Sapiens; identical to SEQ ID NO: 100550

SEQ ID NO: 102712 - RNA, 64 nt, Homo Sapiens; identical to SEQ ID NO: 100551

SEQ ID NO: 102713 - RNA, 64 nt, Homo Sapiens; identical to SEQ ID NO: 100552

SEQ ID NO: 102714 - RNA, 64 nt, Homo Sapiens; identical to SEQ ID NO: 100553

SEQ ID NO: 102715 - RNA, 64 nt, Homo Sapiens; identical to SEQ ID NO: 100554

SEQ ID NO: 102716 - RNA, 64 nt, Homo Sapiens; identical to SEQ ID NO: 100555

SEQ ID NO: 102717 - RNA, 64 nt, Homo Sapiens; identical to SEQ ID NO: 100556

SEQ ID NO: 102718 - RNA, 64 nt, Homo Sapiens; identical to SEQ ID NO: 100557

SEQ ID NO: 102719 - RNA, 64 nt, Homo Sapiens; identical to SEQ ID NO: 100558

SEQ ID NO: 102720 - RNA, 64 nt, Homo Sapiens; identical to SEQ ID NO: 100559

SEQ ID NO: 102721 - RNA, 64 nt, Homo Sapiens; identical to SEQ ID NO: 100560

SEQ ID NO: 102722 - RNA, 64 nt, Homo Sapiens; identical to SEQ ID NO: 100561

SEQ ID NO: 102723 - RNA, 64 nt, Homo Sapiens; identical to SEQ ID NO: 100562

SEQ ID NO: 102724 - RNA, 64 nt, Homo Sapiens; identical to SEQ ID NO: 100563

SEQ ID NO: 102725 - RNA, 64 nt, Homo Sapiens; identical to SEQ ID NO: 100564

SEQ ID NO: 102726 - RNA, 64 nt, Homo Sapiens; identical to SEQ ID NO: 100565

SEQ ID NO: 102727 - RNA, 64 nt, Homo Sapiens; identical to SEQ ID NO: 100566

SEQ ID NO: 102728 - RNA, 64 nt, Homo Sapiens; identical to SEQ ID NO: 100567

SEQ ID NO: 102729 - RNA, 64 nt, Homo Sapiens; identical to SEQ ID NO: 100568

SEQ ID NO: 102730 - RNA, 64 nt, Homo Sapiens; identical to SEQ ID NO: 100569

SEQ ID NO: 102731 - RNA, 64 nt, Homo Sapiens; identical to SEQ ID NO: 100570

SEQ ID NO: 102732 - RNA, 64 nt, Homo Sapiens; identical to SEQ ID NO: 100571

SEQ ID NO: 102733 - RNA, 64 nt, Homo Sapiens; identical to SEQ ID NO: 100572

SEQ ID NO: 102734 - RNA, 64 nt, Homo Sapiens; identical to SEQ ID NO: 100573

SEQ ID NO: 102735 - RNA, 64 nt, Homo Sapiens; identical to SEQ ID NO: 100574

SEQ ID NO: 102736 - RNA, 64 nt, Homo Sapiens; identical to SEQ ID NO: 100575

SEQ ID NO: 102737 - RNA, 60 nt, Homo Sapiens; identical to SEQ ID NO: 100576

SEQ ID NO: 102738 - RNA, 64 nt, Homo Sapiens; identical to SEQ ID NO: 100577

SEQ ID NO: 102739 - RNA, 64 nt, Homo Sapiens; identical to SEQ ID NO: 100578

SEQ ID NO: 102740 - RNA, 64 nt, Homo Sapiens; identical to SEQ ID NO: 100579

SEQ ID NO: 102741 - RNA, 64 nt, Homo Sapiens; identical to SEQ ID NO: 100580

SEQ ID NO: 102742 - RNA, 64 nt, Homo Sapiens; identical to SEQ ID NO: 100581

SEQ ID NO: 102743 - RNA, 64 nt, Homo Sapiens; identical to SEQ ID NO: 100582

SEQ ID NO: 102744 - RNA, 64 nt, Homo Sapiens; identical to SEQ ID NO: 100583

SEQ ID NO: 102745 - RNA, 64 nt, Homo Sapiens; identical to SEQ ID NO: 100584

SEQ ID NO: 102746 - RNA, 64 nt, Homo Sapiens; identical to SEQ ID NO: 100585

SEQ ID NO: 102747 - RNA, 64 nt, Homo Sapiens; identical to SEQ ID NO: 100586

SEQ ID NO: 102748 - RNA, 64 nt, Homo Sapiens; identical to SEQ ID NO: 100587

SEQ ID NO: 102749 - RNA, 64 nt, Homo Sapiens; identical to SEQ ID NO: 100588

SEQ ID NO: 102750 - RNA, 64 nt, Homo Sapiens; identical to SEQ ID NO: 100589

SEQ ID NO: 102751 - RNA, 64 nt, Homo Sapiens; identical to SEQ ID NO: 100590

SEQ ID NO: 102752 - RNA, 64 nt, Homo Sapiens; identical to SEQ ID NO: 100591

SEQ ID NO: 102753 - RNA, 64 nt, Homo Sapiens
ggccauuuaaagugagaggggcaccaacagacaauucggggaccuuaggccccuuccugaggca

SEQ ID NO: 102754 - RNA, 64 nt, Homo Sapiens
accagcacugagcccccucucccuccugcaauaauucggggagucucagccccauccaggugcc

SEQ ID NO: 102755 - RNA, 64 nt, Homo Sapiens
cuacuggaaaaacacuuaaggagcuaaacuuaccuucggggauuauuagcugauaagguucaca

SEQ ID NO: 102756 - RNA, 64 nt, Homo Sapiens
cuguugcauuggcaguuaaguuuccacguaaacuuucggggacacauucaaaccacaggagaaa

SEQ ID NO: 102757 - RNA, 64 nt, Homo Sapiens
uccuuuuccugguguggacucugaagggucagucuucggggaagagaggugggguggggcuacu

SEQ ID NO: 102758 - RNA, 64 nt, Homo Sapiens
ugaaggagagcccuucauuuggagauuauguucuuucggggagaggcugaggacuuaaaauauu

SEQ ID NO: 102759 - RNA, 64 nt, Homo Sapiens
aaaaaccauugcaacucacaguaagagacuggguuucggggaaggaggggcuagggacauuuug

SEQ ID NO: 102760 - RNA, 64 nt, Homo Sapiens
cucugggaggcauuauaauggagggucuucagaguucggggaccaagucuagcagauucucagc

SEQ ID NO: 102761 - RNA, 64 nt, Homo Sapiens
ucagccgccugguggggacaacccagacuacucuuucggggagcggcugugauuaaggcccaac

SEQ ID NO: 102762 - RNA, 64 nt, Homo Sapiens
gaggacucacagugaggaaggcucucuuugcacuuucggggaaggggccugcagguaucagcuu

SEQ ID NO: 102763 - RNA, 64 nt, Homo Sapiens
cccacaucaccaccuuggauagcccgccuggauguucggggaccugcuacauacaggcccccac

SEQ ID NO: 102764 - RNA, 64 nt, Homo Sapiens
ggaucuuguuauuguuuccuuuguuauauuuauuuucggggagaagcuaugguuacuaauaugu

SEQ ID NO: 102765 - RNA, 64 nt, Homo Sapiens
caaccucagauuaauccuauuuauuaucuaccuuuucggggaugcugaguucuuugugaugggu

SEQ ID NO: 102766 - RNA, 64 nt, Homo Sapiens
uacugaagauuucuuagucaguuuuuaggggauuuucggggaggggaaauagguaauguaugga

SEQ ID NO: 102767 - RNA, 64 nt, Homo Sapiens
cuagggcaacagccaaccuaggagccagcgggcuuucggggaaaaaaaagaaaaagacaucuaa

SEQ ID NO: 102768 - RNA, 64 nt, Homo Sapiens
gcugguuaccaucuuugcacuggcccuucggagauucggggacucaguucugguggggucaccc

SEQ ID NO: 102769 - RNA, 64 nt, Homo Sapiens
ugaguuucucugaauagcauaugccacaggagaauucggggauuuuaaaugucugauauaaaac

SEQ ID NO: 102770 - RNA, 64 nt, Homo Sapiens
auuaucucaaucaucaagaaagcugaugucauaauucggggacagggcaacaugauauuugggu

SEQ ID NO: 102771 - RNA, 64 nt, Homo Sapiens
uuugagauucuagaacacaugggagcuuuuuauuuucggggaaaaaccguauuuuuuucuuguc

SEQ ID NO: 102772 - RNA, 64 nt, Homo Sapiens
ccauugaaagacuugaagaauacauauacuuauauucggggauaugaaggauucaaugaaugau

SEQ ID NO: 102773 - RNA, 64 nt, Homo Sapiens
uggggccacugcagugcaguucaagaggcucugguucggggaagagcuggauggaguaugaauc

SEQ ID NO: 102774 - RNA, 64 nt, Homo Sapiens
gaagccccgccgagaccccaaccagggcccgggguucggggauacagcuggaagcuugaguggc

SEQ ID NO: 102775 - RNA, 64 nt, Homo Sapiens
ccugacccgagccuguugucggagggugccugauuucggggagugggaucucagcaguggggca

SEQ ID NO: 102776 - RNA, 64 nt, Homo Sapiens
cgagggacuguggcgaccguagaguuugccgccuuucggggaucaaacccacugggaaggacaa

SEQ ID NO: 102777 - RNA, 64 nt, Homo Sapiens
ggcgcaccugcuguccuggagcuuccgaucucuguucggggacccugugagccuucuggccggc

SEQ ID NO: 102778 - RNA, 64 nt, Homo Sapiens
uguagaugacaggcuuaauuuuuguccgugauucuucggggaacucccaggacuuuguggcugg

SEQ ID NO: 102779 - RNA, 64 nt, Homo Sapiens
gaagggcaggcaccaacaacucagaaugggggcuuucggggagggcgccuaguccccccagcuc

SEQ ID NO: 102780 - RNA, 64 nt, Homo Sapiens
gguuaaagacaggaucucacuucuuucuuuuuuuuucggggaggugaccuguuggacaguacuu

SEQ ID NO: 102781 - RNA, 64 nt, Homo Sapiens
gccaccgccuugagucuggcuuccagguguguuguucggggacacuccagcugcucucaauggc

SEQ ID NO: 102782 - RNA, 64 nt, Homo Sapiens
aauaagaauuagacaucuucauuuuuuacuuguuuucggggagaguagcccauguuaagcuucu

SEQ ID NO: 102783 - RNA, 64 nt, Homo Sapiens
uccguggcgcggaagacccgcggcuugggcgcucuucggggaccggguucgggccuuccggaug

SEQ ID NO: 102784 - RNA, 64 nt, Homo Sapiens
guguugccagugcuaagcugcccugaggguuuccuucggggaccagcccacagcacaccaaggu

SEQ ID NO: 102785 - RNA, 64 nt, Homo Sapiens
uuauaaaaaaucuauuuguaucuauccuaaccaguucggggauauauuaagauauuuuuguaca

SEQ ID NO: 102786 - RNA, 64 nt, Homo Sapiens
uggugugugugcauucuuuaaagagccaaguugcuucggggaaacagccaggaaaauggucaag

SEQ ID NO: 102787 - RNA, 64 nt, Homo Sapiens
gugaaguuuacaagaaggcugcuuaaaugccugcuucggggaaaucucugccucucucucucuc

SEQ ID NO: 102788 - RNA, 64 nt, Homo Sapiens
acuucauucacaaguauuccagugaugcaugcuuuucggggaaaguacuaucuuacugagccac

SEQ ID NO: 102789 - RNA, 64 nt, Homo Sapiens
uccuggaaauaucaguuacucuggcccugccuucuucggggaacccaccuucccagcucucccu

SEQ ID NO: 102790 - RNA, 64 nt, Homo Sapiens
agagcaccuucccuggcuuccuacucugcccccuuucggggagugcacaacacaauaguugcag

SEQ ID NO: 102791 - RNA, 64 nt, Homo Sapiens
cugcacaugugccacacagucaacaugugaggcauucggggaagguuccuggaagcaggugcua

SEQ ID NO: 102792 - RNA, 64 nt, Homo Sapiens
ggggaugagaaccuuccugcugugaugugacaccuucggggacauugaccacucaaaacucaga

SEQ ID NO: 102793 - RNA, 64 nt, Homo Sapiens
gauuacccugcccagcaggaacuggaauacaguguucggggagaaggccaaaugauauccuuga

SEQ ID NO: 102794 - RNA, 64 nt, Homo Sapiens
acgguuuuguuuuuuacugguuuguguuuauauuuucggggauacuuaauaaaucuauugcugu

SEQ ID NO: 102795 - RNA, 64 nt, Homo Sapiens
gggugguagcacagggcuuguguguguguguguguucggggagaugugugugugugugugugug

SEQ ID NO: 102796 - RNA, 64 nt, Homo Sapiens
guuuugccugacagccauuugaauguuaggaagcuucggggagacaaguuuugagagaagcccc

SEQ ID NO: 102797 - RNA, 64 nt, Homo Sapiens
aacagcagcugggcuggguucccagucggagccuuucggggaucugggggaugagggcggaagg

SEQ ID NO: 102798 - RNA, 64 nt, Homo Sapiens
aggagaccauccuuggagugcccuuccggaacccuucggggaaagggaaugcgcucuggaaaca

SEQ ID NO: 102799 - RNA, 64 nt, Homo Sapiens
ggcccugcuugggaacaucuuuuuaaccuggggguucggggagauuguugucuuuuacuuuugu

SEQ ID NO: 102800 - RNA, 64 nt, Homo Sapiens
uguggguuugcuggucucuccagacccuccaggcuucggggaaaauuguuuucaaagugauggu

SEQ ID NO: 102801 - RNA, 64 nt, Homo Sapiens
uaauaacaaaaacauuuuaagaugagguguuuuuuucggggagcuuugguagcaaggguccaga

SEQ ID NO: 102802 - RNA, 64 nt, Homo Sapiens
uuguguucaagaaugauuccaucuauguugacauuucggggauauuguagucuaccugcaugug

SEQ ID NO: 102803 - RNA, 64 nt, Homo Sapiens
auaccuggcaugaaacuguauucgggaaacaaaguucggggaaaauauccauuuuuuucuuaag

SEQ ID NO: 102804 - RNA, 64 nt, Homo Sapiens
gggcugucggccuuggcccccugcuggucgcuguuucggggacucggggcggccaguaccaccg

SEQ ID NO: 102805 - RNA, 64 nt, Homo Sapiens
ccuacccgccaaaccugcuggggagggcuggggcuucggggagccagcucucuacggcaggucc

SEQ ID NO: 102806 - RNA, 64 nt, Homo Sapiens
ccgcgccccccuccucacuugccaaacccgcuuuuucggggaucuacucgggaaauuugcuuuu

SEQ ID NO: 102807 - RNA, 64 nt, Homo Sapiens
agcgcccccacucccggccgcgagcaggcagggcuucggggacgcggggcgcuucucgggcggg

SEQ ID NO: 102808 - RNA, 64 nt, Homo Sapiens
gcuuuaaacaucucugguuccuaguuucugauuauucggggaugggggggaugggaggggacag

SEQ ID NO: 102809 - RNA, 64 nt, Homo Sapiens
ggguguggugguacgugccuguagucccagcuacuucggggacugaggugggaggaucacuuga

SEQ ID NO: 102810 - RNA, 64 nt, Homo Sapiens
aagcaguauagacuccaccuuccaggauguccauuucggggagaggagcaggugggacccucaa

SEQ ID NO: 102811 - RNA, 64 nt, Homo Sapiens
agacuugcugccaagggcuugggagguuccggccuucggggaccgaaagaaagggcgguggcuc

SEQ ID NO: 102812 - RNA, 64 nt, Homo Sapiens
uaggauuuacuagcaagcuaauggaaacaugauuuucggggaagaaaaacuacagaaaauguag

SEQ ID NO: 102813 - RNA, 64 nt, Homo Sapiens
aagauauacaccaaacuguuaaaugugguuucucuucggggagggggggauugggggaggggcc

SEQ ID NO: 102814 - RNA, 64 nt, Homo Sapiens
gcacuuggugauauaacuuuuuugagggagcgaauucggggaagggucagaacugugugguugg

SEQ ID NO: 102815 - RNA, 64 nt, Homo Sapiens
uggcccuucugaugaggggcguacauaugcauguuucggggacuucuucauuuuacagugauga

SEQ ID NO: 102816 - RNA, 64 nt, Homo Sapiens
gaaacuauucccccuaagacuguucaacuuguagauacaucaacuuugaaauuauuccauuuua

SEQ ID NO: 102817 - RNA, 64 nt, Homo Sapiens
uaccuugugccuuuggcacaaaugugcagaauagauacaucaguuggugcauaaucgaaaaaaa

SEQ ID NO: 102818 - RNA, 64 nt, Homo Sapiens
ucgacauagaaccucagcuguuaaccaaggggaaauacaucagaucugcaacacagaaaugcuc

SEQ ID NO: 102819 - RNA, 64 nt, Homo Sapiens
ggcuugggcuauggucuccaaagauccuucaaaaauacaucaagccagcuucauucacucacuu

SEQ ID NO: 102820 - RNA, 64 nt, Homo Sapiens
uaaaugauagguaugaaauagaauaagaaguaaaauacaucagcagauuuucauacuaguaugu

SEQ ID NO: 102821 - RNA, 64 nt, Homo Sapiens
ucagugaaauuauggaaaauuacuuaaaacgugaauacaucaucacaguagaauuuauuaugag

SEQ ID NO: 102822 - RNA, 64 nt, Homo Sapiens
uccauacuguuuaauauuuauagaguucauagaaauacaucaauaagcuccuaaauuauagagc

SEQ ID NO: 102823 - RNA, 64 nt, Homo Sapiens
auaugacuuugaauaaaauaaagcuaccauguuaauacaucauuuuuuguuucuuccuaauuaa

SEQ ID NO: 102824 - RNA, 59 nt, Homo Sapiens
ugccaagugccagcuguuacacauggagaggaaaugauuccuuauauuaaaccugacca

SEQ ID NO: 102825 - RNA, 59 nt, Homo Sapiens
gaaaaaaugaaaaagcagggacaacaggaggaaaugaaggcagagaaauauaguuuccu

SEQ ID NO: 102826 - RNA, 59 nt, Homo Sapiens
guuauccuaguuugaacaggauauguucaggaaaugaaaggugaauuaugccccuuauu

SEQ ID NO: 102827 - RNA, 59 nt, Homo Sapiens
auuugacauuucguagguguaagagaaauggaaaugaaugguuucaacaaagaucauuu

SEQ ID NO: 102828 - RNA, 59 nt, Homo Sapiens
auauuuccguaccccugaggaaacaaaaaggaaaugaggagagaaaguuacuguuaagg

SEQ ID NO: 102829 - RNA, 59 nt, Homo Sapiens
auucauucuacgggauauuauucaguaguggaaaugagugaacuacagcuauaccucac

SEQ ID NO: 102830 - RNA, 59 nt, Homo Sapiens
uguagcacaaucuuagccuauacuucuuuggaaaugaaaacaauaaagaccuccaaggg

SEQ ID NO: 102831 - RNA, 59 nt, Homo Sapiens
ggaguuagcucccaggcuccgggcaggaaggaaaugaacacaggacaagaaguggguaa

SEQ ID NO: 102832 - RNA, 59 nt, Homo Sapiens
gauuccaggaaauaccgauaugagaauggggaaaugaaaccaggaagggaagagagcua

SEQ ID NO: 102833 - RNA, 59 nt, Homo Sapiens
gcacaugcugcccagcacauguccaccugggaaaugagaugccaucgucacauucauuu

SEQ ID NO: 102834 - RNA, 59 nt, Homo Sapiens
aucuuacgugaccaagaaaccacguuaggggaaaugaaaaaagcaagccacaauaccau

SEQ ID NO: 102835 - RNA, 59 nt, Homo Sapiens
gauuccuuccauuuucaacaguagaugaaggaaaugauacugaaugagucacaguguuc

SEQ ID NO: 102836 - RNA, 59 nt, Homo Sapiens
aauuuugaguuugaaaucuccaaaaaauaggaaaugaguugauccucauuguguucagg

SEQ ID NO: 102837 - RNA, 59 nt, Homo Sapiens
guagaaacuuacugugggcaaugcgguuuggaaaugaauuugcugucuuuuuacacugu

SEQ ID NO: 102838 - RNA, 59 nt, Homo Sapiens
aaauuacauuaaguauuaaugaggggaaaggaaaugagcucuacgaggauuucacccug

SEQ ID NO: 102839 - RNA, 59 nt, Homo Sapiens
agugugcaugguucaaucccucacauccaggaaaugaauuuugcaauugggccagaugc

SEQ ID NO: 102840 - RNA, 59 nt, Homo Sapiens
gcauugugguaauuuagaauaagggaacaggaaaugaauugccacuagaguugaaagau

SEQ ID NO: 102841 - RNA, 59 nt, Homo Sapiens
uuguuuaugugucuaucccuuccuuauuuggaaaugacucuucucuggagauccagcau

SEQ ID NO: 102842 - RNA, 59 nt, Homo Sapiens
aaaaauggcuuaucugaaaucaguacuguggaaaugaacuauauuagcuauuaugaaua

SEQ ID NO: 102843 - RNA, 59 nt, Homo Sapiens
gaaaaucugcuggccagcuauguccucuaggaaaugacagacccaaccaccagcaauaa

SEQ ID NO: 102844 - RNA, 59 nt, Homo Sapiens
auuuaugaaauuuuguacuaaaaucauuuggaaaugauuguauuguaaacugaggcuaa

SEQ ID NO: 102845 - RNA, 59 nt, Homo Sapiens
caauuuuuauacagaaaaugagucauuuuggaaaugauucuuauguuuuuuuuuuuucu

SEQ ID NO: 102846 - RNA, 59 nt, Homo Sapiens
uucaugucuguacagauuauuuaaaucauggaaaugaaaaaaauguucucugcuugcua

SEQ ID NO: 102847 - RNA, 59 nt, Homo Sapiens
cucugcuugcuaccaaaggacaaacucuuggaaaugaacacuuucugcuuuccuuccuc

SEQ ID NO: 102848 - RNA, 59 nt, Homo Sapiens
aggacuugauauucauaauucagugcuguggaaaugaaaaaaaugauugaagaggugga

SEQ ID NO: 102849 - RNA, 59 nt, Homo Sapiens
aaugaaaaaaaugauugaagagguggaacggaaaugaccuuagggggaaaaaaaaggac

SEQ ID NO: 102850 - RNA, 59 nt, Homo Sapiens
guuucuuugacauauuuucuacuuuucugggaaaugacaauggacuuuucugggaaaug

SEQ ID NO: 102851 - RNA, 59 nt, Homo Sapiens
uuucugggaaaugacaguuuacuuuucugggaaaugacuaauccauguagaagucaugg

SEQ ID NO: 102852 - RNA, 59 nt, Homo Sapiens
uugaguuuaaaggaauugaaauuacuucaggaaaugaauauaaaauagguucacaguua

SEQ ID NO: 102853 - RNA, 59 nt, Homo Sapiens
uuuguuuuucuuuuguaccuagucucauuggaaaugacuaguauucugccucauuuuca

SEQ ID NO: 102854 - RNA, 59 nt, Homo Sapiens
uguucuaauucuagguucaccacgggaagggaaaugacuccaacuagaugcuuguuggc

SEQ ID NO: 102855 - RNA, 59 nt, Homo Sapiens
aaaucacgcagccuuuugguuucaacuagggaaaugaaguggcagcuguuuuauugcca

SEQ ID NO: 102856 - RNA, 59 nt, Homo Sapiens
uugaaggaucuguacgagaaaaacaaaaaggaaaugaauauucaacagcucaccaacua

SEQ ID NO: 102857 - RNA, 59 nt, Homo Sapiens
acagccugcacacaccugccugcagagcaggaaaugagagauagaggaugggcagcugg

SEQ ID NO: 102858 - RNA, 59 nt, Homo Sapiens
ucuguggauuugaaauugcacaccauucuggaaaugauuugcacauugucauguuauac

SEQ ID NO: 102859 - RNA, 59 nt, Homo Sapiens
cauuucucuuguuagguguuacagaaaauggaaaugauagauaagugugaauguuuuau

SEQ ID NO: 102860 - RNA, 59 nt, Homo Sapiens
gaauugauuuuuaaacacauauaacaguaggaaaugaauaaaugggcuucugcauuugg

SEQ ID NO: 102861 - RNA, 59 nt, Homo Sapiens
auuuuauuaugucugucuuaucaugcaauggaaaugaugcuuuuuguaaguaugcaucu

SEQ ID NO: 102862 - RNA, 59 nt, Homo Sapiens
uccuggccuuuccugguuuucaucaggaaggaaaugacaccaaauauguccgcagaaug

SEQ ID NO: 102863 - RNA, 59 nt, Homo Sapiens
aggguaacugugcugaaugcuuuagaugaggaaaugauccccaaguggugaaugacacg

SEQ ID NO: 102864 - RNA, 59 nt, Homo Sapiens
acagaagaagucguugaugugauuuuugaggaaaugacagaugugacuuuggaaccaaa

SEQ ID NO: 102865 - RNA, 59 nt, Homo Sapiens
uaaccacagguuguguucauucuuuuccuggaaaugaugacuuuauugcuuagaaaguu

SEQ ID NO: 102866 - RNA, 59 nt, Homo Sapiens
agcuaaaauggguuauuuauaggacugauggaaaugauuucaucucugccaucucuaaa

SEQ ID NO: 102867 - RNA, 59 nt, Homo Sapiens
uaggggaaggaaauuuacaagauuuaauaggaaaugaaacagcuugaauuucaaacuaa

SEQ ID NO: 102868 - RNA, 59 nt, Homo Sapiens
uauacuugguacuugcucuagaacauuugggaaaugacaaacucaggcuggcucuccuc

SEQ ID NO: 102869 - RNA, 59 nt, Homo Sapiens
gugcaaaaaaagaaaaagaauguucuaggggaaaugaauuuuuuuaaguucacuuuuuu

SEQ ID NO: 102870 - RNA, 59 nt, Homo Sapiens
gguuccacucaaauguccuggauuagaaaggaaaugaaucagauaaacagaaaugcucu

SEQ ID NO: 102871 - RNA, 59 nt, Homo Sapiens
cuucaauuagaauuauuuuuguaauuuuuggaaaugaggacauuaaaagaacuuaaaaa

SEQ ID NO: 102872 - RNA, 59 nt, Homo Sapiens
cauuaaaagaacuuaaaaagauauuuuuuggaaaugaaauaugaaaaaauacccaauau

SEQ ID NO: 102873 - RNA, 59 nt, Homo Sapiens
augggaaaauucagauauuuuuuuuacauggaaaugacaacguuuauugucaaggggag

SEQ ID NO: 102874 - RNA, 59 nt, Homo Sapiens
uaugacuccaaccguaugauaacggggagggaaaugauccggaagggggaggagugcuc

SEQ ID NO: 102875 - RNA, 59 nt, Homo Sapiens
agaccucagacaucuuuuccagagacaaaggaaaugaagcuuccaguugccuuagggac

SEQ ID NO: 102876 - RNA, 64 nt, Homo Sapiens
acacgccuguaguccaggccacucgagcacacaccuguaguaccagcuacucuggaggcugagg

SEQ ID NO: 102877 - RNA, 64 nt, Homo Sapiens
ggcaggaggaucacuugagcccaggagauuaagacuguaguauacuaugaucgugccuguggcu

SEQ ID NO: 102878 - RNA, 64 nt, Homo Sapiens
augcaaaacaaucuaucccagguucuguucugguuggcuacauuguucagcaacucacaaaacg

SEQ ID NO: 102879 - RNA, 64 nt, Homo Sapiens
cuguugaguaacuccuccuuuacuuuuuuccugcuggcuacagcauggggugcccuauaggcac

SEQ ID NO: 102880 - RNA, 64 nt, Homo Sapiens
cuguucagcagugagaugagaaaaucaacaugaguggcuacaucagaaggaaggcuccaaacgg

SEQ ID NO: 102881 - RNA, 64 nt, Homo Sapiens
aaaauuucuagaaaaagaagugaaacauuccaccuggcuacacguguugguuuuaccgaccaaa

SEQ ID NO: 102882 - RNA, 64 nt, Homo Sapiens
uguuuccagugcaagagaagggaaauacuaggaacuaagacauuucuaauuuauugcuuauuac

SEQ ID NO: 102883 - RNA, 64 nt, Homo Sapiens
aucuuuccagauaucuuaaggguaaaagcuuauucuaagacagucuguccauugagaauauuag

SEQ ID NO: 102884 - RNA, 64 nt, Homo Sapiens
aguuuuuuucaagaauugaacucauaucaaguagcuaagacaaacuuacaguugaaaacagauu

SEQ ID NO: 102885 - RNA, 64 nt, Homo Sapiens
guaacccucaacguuuuaucuaauuuccaguccccuaagacaaauggggaauuugcccuuuuaa

SEQ ID NO: 102886 - RNA, 64 nt, Homo Sapiens
aaauaaugcaacgcaggaggagaaaagaaaugcacuaagacaagaacauucucucauagaacau

SEQ ID NO: 102887 - RNA, 64 nt, Homo Sapiens
uguacauaauugcaugaaaauagcuauuuuuuuccuaagacauuuuucauucaugaauauuuuc

SEQ ID NO: 102888 - RNA, 64 nt, Homo Sapiens
ggaagcucaugccuguaauuauaaccuucagcuacuaagacaggugugguggcucacgccugug

SEQ ID NO: 102889 - RNA, 64 nt, Homo Sapiens
gguggcucacgccugugauuauaaucuucaguuacuaagacagaguccaugagaguguuaaugg

SEQ ID NO: 102890 - RNA, 64 nt, Homo Sapiens
aaaaaacucacacuggagagauuacaguucuugucuaagacaugguguucuaaagccuucccug

SEQ ID NO: 102891 - RNA, 64 nt, Homo Sapiens
aaagaacacguacuggggaguuuacaguucuuaucuaagacaugguguucuaaagccuuucauu

SEQ ID NO: 102892 - RNA, 64 nt, Homo Sapiens; identical to SEQ ID NO: 50174

SEQ ID NO: 102893 - RNA, 64 nt, Homo Sapiens; identical to SEQ ID NO: 50175

SEQ ID NO: 102894 - RNA, 64 nt, Homo Sapiens; identical to SEQ ID NO: 50176

SEQ ID NO: 102895 - RNA, 64 nt, Homo Sapiens; identical to SEQ ID NO: 50177

SEQ ID NO: 102896 - RNA, 64 nt, Homo Sapiens; identical to SEQ ID NO: 50178

SEQ ID NO: 102897 - RNA, 64 nt, Homo Sapiens; identical to SEQ ID NO: 50179

SEQ ID NO: 102898 - RNA, 64 nt, Homo Sapiens; identical to SEQ ID NO: 50180

SEQ ID NO: 102899 - RNA, 64 nt, Homo Sapiens; identical to SEQ ID NO: 50181

SEQ ID NO: 102900 - RNA, 64 nt, Homo Sapiens; identical to SEQ ID NO: 50182

SEQ ID NO: 102901 - RNA, 64 nt, Homo Sapiens; identical to SEQ ID NO: 50183

SEQ ID NO: 102902 - RNA, 64 nt, Homo Sapiens; identical to SEQ ID NO: 50184

SEQ ID NO: 102903 - RNA, 64 nt, Homo Sapiens; identical to SEQ ID NO: 50185

SEQ ID NO: 102904 - RNA, 64 nt, Homo Sapiens; identical to SEQ ID NO: 50186

SEQ ID NO: 102905 - RNA, 64 nt, Homo Sapiens; identical to SEQ ID NO: 50187

SEQ ID NO: 102906 - RNA, 64 nt, Homo Sapiens; identical to SEQ ID NO: 50188

SEQ ID NO: 102907 - RNA, 64 nt, Homo Sapiens; identical to SEQ ID NO: 50189

SEQ ID NO: 102908 - RNA, 64 nt, Homo Sapiens; identical to SEQ ID NO: 50190

SEQ ID NO: 102909 - RNA, 64 nt, Homo Sapiens; identical to SEQ ID NO: 50191

SEQ ID NO: 102910 - RNA, 64 nt, Homo Sapiens; identical to SEQ ID NO: 50192

SEQ ID NO: 102911 - RNA, 64 nt, Homo Sapiens; identical to SEQ ID NO: 50193

SEQ ID NO: 102912 - RNA, 64 nt, Homo Sapiens; identical to SEQ ID NO: 50194

SEQ ID NO: 102913 - RNA, 64 nt, Homo Sapiens; identical to SEQ ID NO: 50195

SEQ ID NO: 102914 - RNA, 64 nt, Homo Sapiens; identical to SEQ ID NO: 50196

SEQ ID NO: 102915 - RNA, 64 nt, Homo Sapiens; identical to SEQ ID NO: 50197

SEQ ID NO: 102916 - RNA, 64 nt, Homo Sapiens; identical to SEQ ID NO: 50198

SEQ ID NO: 102917 - RNA, 64 nt, Homo Sapiens; identical to SEQ ID NO: 50199

SEQ ID NO: 102918 - RNA, 64 nt, Homo Sapiens; identical to SEQ ID NO: 50200

SEQ ID NO: 102919 - RNA, 64 nt, Homo Sapiens; identical to SEQ ID NO: 50201

SEQ ID NO: 102920 - RNA, 64 nt, Homo Sapiens; identical to SEQ ID NO: 50202

SEQ ID NO: 102921 - RNA, 64 nt, Homo Sapiens; identical to SEQ ID NO: 50203

SEQ ID NO: 102922 - RNA, 64 nt, Homo Sapiens; identical to SEQ ID NO: 50204

SEQ ID NO: 102923 - RNA, 64 nt, Homo Sapiens; identical to SEQ ID NO: 50205

SEQ ID NO: 102924 - RNA, 64 nt, Homo Sapiens; identical to SEQ ID NO: 50206

SEQ ID NO: 102925 - RNA, 64 nt, Homo Sapiens; identical to SEQ ID NO: 50207

SEQ ID NO: 102926 - RNA, 64 nt, Homo Sapiens; identical to SEQ ID NO: 50208

SEQ ID NO: 102927 - RNA, 64 nt, Homo Sapiens; identical to SEQ ID NO: 50209

SEQ ID NO: 102928 - RNA, 64 nt, Homo Sapiens; identical to SEQ ID NO: 50210

SEQ ID NO: 102929 - RNA, 64 nt, Homo Sapiens; identical to SEQ ID NO: 50211

SEQ ID NO: 102930 - RNA, 64 nt, Homo Sapiens; identical to SEQ ID NO: 50212

SEQ ID NO: 102931 - RNA, 64 nt, Homo Sapiens; identical to SEQ ID NO: 50213

SEQ ID NO: 102932 - RNA, 64 nt, Homo Sapiens; identical to SEQ ID NO: 50214

SEQ ID NO: 102933 - RNA, 64 nt, Homo Sapiens; identical to SEQ ID NO: 50215

SEQ ID NO: 102934 - RNA, 64 nt, Homo Sapiens; identical to SEQ ID NO: 50216

SEQ ID NO: 102935 - RNA, 64 nt, Homo Sapiens; identical to SEQ ID NO: 50217

SEQ ID NO: 102936 - RNA, 64 nt, Homo Sapiens; identical to SEQ ID NO: 50218

SEQ ID NO: 102937 - RNA, 64 nt, Homo Sapiens; identical to SEQ ID NO: 50219

SEQ ID NO: 102938 - RNA, 64 nt, Homo Sapiens; identical to SEQ ID NO: 50220

SEQ ID NO: 102939 - RNA, 64 nt, Homo Sapiens; identical to SEQ ID NO: 50221

SEQ ID NO: 102940 - RNA, 64 nt, Homo Sapiens; identical to SEQ ID NO: 50222

SEQ ID NO: 102941 - RNA, 64 nt, Homo Sapiens; identical to SEQ ID NO: 50223

SEQ ID NO: 102942 - RNA, 64 nt, Homo Sapiens; identical to SEQ ID NO: 50224

SEQ ID NO: 102943 - RNA, 64 nt, Homo Sapiens; identical to SEQ ID NO: 50225

SEQ ID NO: 102944 - RNA, 64 nt, Homo Sapiens; identical to SEQ ID NO: 50226

SEQ ID NO: 102945 - RNA, 64 nt, Homo Sapiens; identical to SEQ ID NO: 50227

SEQ ID NO: 102946 - RNA, 64 nt, Homo Sapiens; identical to SEQ ID NO: 50228

SEQ ID NO: 102947 - RNA, 64 nt, Homo Sapiens; identical to SEQ ID NO: 50229

SEQ ID NO: 102948 - RNA, 64 nt, Homo Sapiens; identical to SEQ ID NO: 50230

SEQ ID NO: 102949 - RNA, 64 nt, Homo Sapiens; identical to SEQ ID NO: 50231

SEQ ID NO: 102950 - RNA, 64 nt, Homo Sapiens; identical to SEQ ID NO: 50232

SEQ ID NO: 102951 - RNA, 64 nt, Homo Sapiens; identical to SEQ ID NO: 50233

SEQ ID NO: 102952 - RNA, 64 nt, Homo Sapiens; identical to SEQ ID NO: 50234

SEQ ID NO: 102953 - RNA, 64 nt, Homo Sapiens; identical to SEQ ID NO: 50235

SEQ ID NO: 102954 - RNA, 64 nt, Homo Sapiens; identical to SEQ ID NO: 50236

SEQ ID NO: 102955 - RNA, 64 nt, Homo Sapiens; identical to SEQ ID NO: 50237

SEQ ID NO: 102956 - RNA, 64 nt, Homo Sapiens; identical to SEQ ID NO: 50238

SEQ ID NO: 102957 - RNA, 64 nt, Homo Sapiens; identical to SEQ ID NO: 50239

SEQ ID NO: 102958 - RNA, 64 nt, Homo Sapiens; identical to SEQ ID NO: 50240

SEQ ID NO: 102959 - RNA, 64 nt, Homo Sapiens; identical to SEQ ID NO: 50241

SEQ ID NO: 102960 - RNA, 64 nt, Homo Sapiens; identical to SEQ ID NO: 50242

SEQ ID NO: 102961 - RNA, 64 nt, Homo Sapiens; identical to SEQ ID NO: 50243

SEQ ID NO: 102962 - RNA, 64 nt, Homo Sapiens
ggcacuuaaaauaaauauaucugccagaacugauaugcaugaauaagugucauuaggauuguug

SEQ ID NO: 102963 - RNA, 64 nt, Homo Sapiens
uuuggucccuuucuuugaaauuguaugucuguguaugcaugacaggccugcuguuucuguuguc

SEQ ID NO: 102964 - RNA, 64 nt, Homo Sapiens
uugcucuuguuaaagauuuguuugaauauagaagaugcaugauuucuggguuuuuuuuuuuuuu

SEQ ID NO: 102965 - RNA, 64 nt, Homo Sapiens
auuacaggcauaagccacugcgcccagccagaagaugcaugauuucuuaggaucauaugcuguu

SEQ ID NO: 102966 - RNA, 54 nt, Homo Sapiens
agaaggacuauagaucauaaggcaaugcaugaaccacagaagcugcaugguuaa

SEQ ID NO: 102967 - RNA, 64 nt, Homo Sapiens
ugguucuauaaucauauuauaugcacuaaacuauaugcaugaaaguucuuugcauggauuaaug

SEQ ID NO: 102968 - RNA, 64 nt, Homo Sapiens
aucaguuuuccuccugcucccagaauguccugugaugcaugauucuaagaacuggaagaaccug

SEQ ID NO: 102969 - RNA, 64 nt, Homo Sapiens
uuuccagaugucagaaaagaaagcauacaugcuuaugcaugaaacaauucugcaaaaaaaggau

SEQ ID NO: 102970 - RNA, 64 nt, Homo Sapiens
uuucuguggaagaguaagaacauuaaaaugaaagaugcaugaugaaaaucuaaguagagaggcu

SEQ ID NO: 102971 - RNA, 64 nt, Homo Sapiens
agaggcucuugugguuaacugauaauauugagugaugcaugagguagguguucagaguaauauu

SEQ ID NO: 102972 - RNA, 64 nt, Homo Sapiens
gaaaaauaaaaaccuguaucaguuguaaguuugcaugcaugauguguucuuaaacaguauaaau

SEQ ID NO: 102973 - RNA, 64 nt, Homo Sapiens
uuaagggcaagaaacaguaucuugacugcugggcaugcaugaagugauguucugcagaauggca

SEQ ID NO: 102974 - RNA, 64 nt, Homo Sapiens
agcauaacuaugugggcaaaauagauagaauuaaaugcaugaauuuuccucagacuuauuuuau

SEQ ID NO: 102975 - RNA, 64 nt, Homo Sapiens
gcuaauacucugacagaaaaaaaucuuggauaauaugcaugagaaaaauccuucaauaaacaca

SEQ ID NO: 102976 - RNA, 64 nt, Homo Sapiens
ugaaucuucuuuuauuucuaggcuguacagucugaugcaugauuuuuuuauaaauauuucauac

SEQ ID NO: 102977 - RNA, 64 nt, Homo Sapiens
aucagaugcuuuuuuuuucuucuuaccaucauuuaugcaugacauagguaaugugacuaauuuc

SEQ ID NO: 102978 - RNA, 64 nt, Homo Sapiens
acaugaaggcaagaaacagcauauuggaaacaguaugcaugaaggaaguagaaggaauuuccag

SEQ ID NO: 102979 - RNA, 64 nt, Homo Sapiens
ucauucuccuuuugagaagucuaauuacccaaauaugcaugaauuuuuaaaaguuaaguccauu

SEQ ID NO: 102980 - RNA, 63 nt, Homo Sapiens
agaccguacucaguaacaggccggaaaauugugcucuagaagaauaaaacugaaaaacucuag

SEQ ID NO: 102981 - RNA, 63 nt, Homo Sapiens
cauaagguaaacauucuauauauucuaugccugcucuagaauugaaagacuucagcaguauua

SEQ ID NO: 102982 - RNA, 63 nt, Homo Sapiens
cuccacaucugccuuaaaaccaaagagggcuuccucuagaagccaagggaaaggggugcuuuu

SEQ ID NO: 102983 - RNA, 63 nt, Homo Sapiens
aggaacauuauggagagaaaggguacugaggcacucuagaaucugccacauucauuuucaaau

SEQ ID NO: 102984 - RNA, 63 nt, Homo Sapiens
aggcagcuggaauuggaacucagauuuguugaacucuagaacuaaagaucauaauguugucuu

SEQ ID NO: 102985 - RNA, 63 nt, Homo Sapiens
uucagaguucaaggaagaagcaaaauaucacaucucuagaaguguugggaaaaauauaauuuc

SEQ ID NO: 102986 - RNA, 63 nt, Homo Sapiens
acuccuaaguuauuucucauagaacccagccuacucuagaauuucagcagugacauuggagaa

SEQ ID NO: 102987 - RNA, 63 nt, Homo Sapiens
aaauacaccagcucauuuggcugcucagucuaacucuagaauggaugcuuuugaauucauuuc

SEQ ID NO: 102988 - RNA, 63 nt, Homo Sapiens
uagagaggaauuaacuuccuggucugugcccuucucuagaagaauauaagaugcuccuccucc

SEQ ID NO: 102989 - RNA, 63 nt, Homo Sapiens
gcugggaggaaagugcugggcaucuuacaguaacucuagaaguuccuuugacuaggcugcaau

SEQ ID NO: 102990 - RNA, 63 nt, Homo Sapiens
cugaagccauuggagagcugucuuccuguguaccucuagaaucccagcagcagagaaccauca

SEQ ID NO: 102991 - RNA, 58 nt, Homo Sapiens
gcccuuccuucgcccgcuaacaccacuccucuagaacucggugguaaugacugggagg

SEQ ID NO: 102992 - RNA, 63 nt, Homo Sapiens
acauucucccuugcuugaugucuuuuccugucccucuagaagaagaaguauguggacaucucu

SEQ ID NO: 102993 - RNA, 63 nt, Homo Sapiens
agguuucacaaccgagaugcgagcagggagaggcucuagaacauuaagauccucacagcacgg

SEQ ID NO: 102994 - RNA, 63 nt, Homo Sapiens
gccaucucaauugugcuuuguugaagcugcugucucuagaagucucauuacccuuuucugggu

SEQ ID NO: 102995 - RNA, 63 nt, Homo Sapiens
cccacuggccaguccuagagaaccccagcuggccucuagaacauguccagaccauugucuucc

SEQ ID NO: 102996 - RNA, 63 nt, Homo Sapiens
uccagaaagguggagggcuggugcuacaauuaucucuagaaucuguuaucaaggaauuguacu

SEQ ID NO: 102997 - RNA, 63 nt, Homo Sapiens
ucagguucccugccacacuagcucccuggaggacucuagaagcaguccugauccuaacccugg

SEQ ID NO: 102998 - RNA, 63 nt, Homo Sapiens
gcaguauucaaccuuuuagcccgcuuuuucuugcucuagaagaucuguuuugcccaggggcuc

SEQ ID NO: 102999 - RNA, 63 nt, Homo Sapiens
uccauauuuauuuuuauguuuaggccuucaggacucuagaaugcagacuauggauguguucuc

SEQ ID NO: 103000 - RNA, 63 nt, Homo Sapiens
uugacauucucugugggggauugcaguaacaaacucuagaauacaguaacaaacuccagucug

SEQ ID NO: 103001 - RNA, 63 nt, Homo Sapiens
cccacauuuccaccaacucauauuagggcaguucucuagaacgucccucuuagcuguagucua

SEQ ID NO: 103002 - RNA, 63 nt, Homo Sapiens
uggauaauaaagaugcuuaugcagagccauuuccucuagaauucuaguagguucugcuguuau

SEQ ID NO: 103003 - RNA, 63 nt, Homo Sapiens
gaaugaaggauugaagaauucgaugaagaaugucucuagaagaaugacaauguagcuugaaag

SEQ ID NO: 103004 - RNA, 63 nt, Homo Sapiens
uagauuuucacuucuuuugauuuugaagagagucucuagaauaugaauauauugguugcucau

SEQ ID NO: 103005 - RNA, 63 nt, Homo Sapiens
augauaugauaauccuaccaauuuucaagaagucucuagaaagagauaacacauggaaagacg

SEQ ID NO: 103006 - RNA, 63 nt, Homo Sapiens
gccagccauauuacucuagucccuaccaaacugcucuagaaggucauuuccauuuuguuugug

SEQ ID NO: 103007 - RNA, 63 nt, Homo Sapiens
auugaaaguaagaaaacggauuuaggaugaaaacucuagaacuacccuaugcuguuuauacug

SEQ ID NO: 103008 - RNA, 63 nt, Homo Sapiens
cuacagucagauuuauagccagccaucuaucaccucuagaagguuccagagacagugaaacug

SEQ ID NO: 103009 - RNA, 63 nt, Homo Sapiens
uccucuuuaaaaaaaaaaaaguuuuuguuauaucucuagaacauuucaagucuuuuccuuuuu

SEQ ID NO: 103010 - RNA, 63 nt, Homo Sapiens
cacagaacguauagaguuaaccaaagugcucuucucuagaaucuuuacaccuccugugugguu

SEQ ID NO: 103011 - RNA, 63 nt, Homo Sapiens
aguccccuaaauuucuguucuaguuuuaaauuucucuagaacuugcaauaguuggggguuuua

SEQ ID NO: 103012 - RNA, 63 nt, Homo Sapiens
gucucggccuccacauuaaccauaggauguugacucuagaaccuggacccacccagcgcgucc

SEQ ID NO: 103013 - RNA, 63 nt, Homo Sapiens
uuuaauuuucuugugagauaauauucuaagaggcucuagaaacaugaaauacucaguagugau

SEQ ID NO: 103014 - RNA, 53 nt, Homo Sapiens
ucauaagcuccccuuccuaaucacucuagaagcugauuccccaaagguaagac

SEQ ID NO: 103015 - RNA, 63 nt, Homo Sapiens
aggacaccauguacuauaaccaguuaaauggaacucuagaauaucaagggagcaagaggaagc

SEQ ID NO: 103016 - RNA, 63 nt, Homo Sapiens
aaucaaaaacaaagaagcccuauaagaccauuucucuagaacagauguucuuaauauuuuucu

SEQ ID NO: 103017 - RNA, 63 nt, Homo Sapiens
uggagcauguggucuuuuuaaaaaauuguaacccucuagaaaauaucaaagaaaugaaccaga

SEQ ID NO: 103018 - RNA, 63 nt, Homo Sapiens
aaagaacacuaccacugcaacuuugacaguuaacucuagaaagaguuacugagaauuguugug

SEQ ID NO: 103019 - RNA, 63 nt, Homo Sapiens
uaguggcgggucugggcugggagagacacccuccucuagaauuagaaaaaaguacugugaccu

SEQ ID NO: 103020 - RNA, 63 nt, Homo Sapiens
guuuuggagcucgagaucuuucaaaauggugggcucuagaaugcugaaacacauguguaacaa

SEQ ID NO: 103021 - RNA, 63 nt, Homo Sapiens
uuacauugauuaaaauguuauguuucagcaaaucucuagaaauggucuccauucaggcaagug

SEQ ID NO: 103022 - RNA, 63 nt, Homo Sapiens
uguaucuuuuuaugauuuaguggcagauaauuccucuagaauguuugauaauuguuauuuuuu

SEQ ID NO: 103023 - RNA, 63 nt, Homo Sapiens
ugggauggacuuacuauucuugagcuaccucaucucuagaagcugacccaacauuucuuagca

SEQ ID NO: 103024 - RNA, 63 nt, Homo Sapiens
gaauccugucuuaaaacugguguuguguaaugucucuagaaaggaaacaccuuaaguguauac

SEQ ID NO: 103025 - RNA, 63 nt, Homo Sapiens
uauuacuuuguucucccaugagaaauacuauugcucuagaaugcugcuaccuaaaggauauaa

SEQ ID NO: 103026 - RNA, 63 nt, Homo Sapiens
cuaguacacuggcaucaucuauuaugccuacaucucuagaagaggccuagaaccaguuuuaag

SEQ ID NO: 103027 - RNA, 63 nt, Homo Sapiens
gccugggcccaaggggugaugaggcauccuuuccucuagaagaccugagucuuccugaccgac

SEQ ID NO: 103028 - RNA, 63 nt, Homo Sapiens
cuagacaaaaaccauuguugaugaggcagaugccucuagaagagacguuuaaaagccaucaaa

SEQ ID NO: 103029 - RNA, 63 nt, Homo Sapiens
aaguuccacaucaucuuaucgaucaagaagcuacucuagaagucggagcagaggaugguacag

SEQ ID NO: 103030 - RNA, 63 nt, Homo Sapiens
uguccuguugccaaacaaaagccagucauguaacucuagaagcagugacugguggggcuuucu

SEQ ID NO: 103031 - RNA, 63 nt, Homo Sapiens
gugaugcuucuggggcacguugaccauaugcaccucuagaaccuaaccagggcuuccuucuac

SEQ ID NO: 103032 - RNA, 63 nt, Homo Sapiens
gagagcguuccuugaguccguacaccguccucccucuagaagcuggcaucacacucaugcugg

SEQ ID NO: 103033 - RNA, 63 nt, Homo Sapiens
uaugaaguuccccaaggaaacgaacaaaaugaacucuagaauaucuagcaaauaguuaaagaa

SEQ ID NO: 103034 - RNA, 63 nt, Homo Sapiens
ugcauggaagagaacaccucuuuauggcuuacccucuagaauuucuaauuuauguguucuguu

SEQ ID NO: 103035 - RNA, 63 nt, Homo Sapiens
agcaccugggucccagcaucuagagcauggagccucuagaagccaugcucacccgcccacauu

SEQ ID NO: 103036 - RNA, 63 nt, Homo Sapiens
caucaggaaagagagcaccacgugauggaguuucucuagaagcuccagugauaagagauguug

SEQ ID NO: 103037 - RNA, 63 nt, Homo Sapiens
aagugugacucaaucuugccugccuucugggagcucuagaauuguucccaacccaguccaugg

SEQ ID NO: 103038 - RNA, 63 nt, Homo Sapiens
ucccuuccccagagaccuucagugccauccugacucuagaaggccccccacagcagggcguag

SEQ ID NO: 103039 - RNA, 63 nt, Homo Sapiens
ccuugaaagaaccgaagucuuucccauucacuucucuagaaagcugccaagacagaggcagaa

SEQ ID NO: 103040 - RNA, 63 nt, Homo Sapiens
cgaagggaggaggagcacaacucugggaaguuacucuagaaaaggcaggcuccaggcaggguc

SEQ ID NO: 103041 - RNA, 63 nt, Homo Sapiens
gaauuugcaggcaaccauguuugcguuuacuuccucuagaaaaaaaacauaaccauauguguu

SEQ ID NO: 103042 - RNA, 63 nt, Homo Sapiens
auuucaaacaauuaaaauaaagagcuucuuuggcucuagaaaaggaagaaacaacuucuuuaa

SEQ ID NO: 103043 - RNA, 63 nt, Homo Sapiens
ggagaccgauuuacaauuuaagaaaauuguguacucuagaaaugaaauaauuuuuuucaaaua

SEQ ID NO: 103044 - RNA, 63 nt, Homo Sapiens
accaccaaacaugacuguucacugcugauguugcucuagaaaauacuccuccuccagauacca

SEQ ID NO: 103045 - RNA, 63 nt, Homo Sapiens
cugaggacaguuucuuuugaaaacccucuaggucucuagaacagauuaggauuugauuucuug

SEQ ID NO: 103046 - RNA, 63 nt, Homo Sapiens
aaauauuuaguaaagcuuuaucaauagauguuucucuagaacaggacuuuauuuucacauaag

SEQ ID NO: 103047 - RNA, 63 nt, Homo Sapiens
uuaagugcuuuguaaugggaaauauuccccuaucucuagaauuuuaaaaaauguccaugaugg

SEQ ID NO: 103048 - RNA, 63 nt, Homo Sapiens
guaauuuuacacaugcuggaaugacuguaauuacucuagaauuccaaguagaauacaauaacu

SEQ ID NO: 103049 - RNA, 63 nt, Homo Sapiens
gauaacucuuaaaaaaccgucgagauuacaaugcucuagaaucagcauauaagaaaauaaaug

SEQ ID NO: 103050 - RNA, 63 nt, Homo Sapiens
acaauauuacauuacagccuguauucauuuguucucuagaaguuuugucagaauuuugacuug

SEQ ID NO: 103051 - RNA, 63 nt, Homo Sapiens
auuguaacuacacugggcaucagaauaaaaggccucuagaaauugcugaacaaugguuaauua

SEQ ID NO: 103052 - RNA, 63 nt, Homo Sapiens
ucucuccuucauuaauuuaaauauuuuuaucggcucuagaaaaugcauaagguuaguacaaga

SEQ ID NO: 103053 - RNA, 63 nt, Homo Sapiens
augaacaaagguuaauuuaauaauuauuuaaaacucuagaaagcacucucugcacugacuuuu

SEQ ID NO: 103054 - RNA, 63 nt, Homo Sapiens
caucugucuguauugaucuuagaacauuucugucucuagaaguacuauucuguugugacuaug

SEQ ID NO: 103055 - RNA, 63 nt, Homo Sapiens
agaaagcaauuuuuaggcaguguccuauauacccucuagaaacauucuccuauuuaccagucc

SEQ ID NO: 103056 - RNA, 63 nt, Homo Sapiens
ugugcgagcacaacacacacugaaagauuuuuacucuagaaacagugucacauuucucuaaga

SEQ ID NO: 103057 - RNA, 63 nt, Homo Sapiens
agaaccagcucuacgagagucguuucccuuuuccucuagaagccagcuuugggaaagcugccu

SEQ ID NO: 103058 - RNA, 63 nt, Homo Sapiens
aaugcccugacucuaccagcgcccauaaaugaucucuagaaggacuguuaguaccaaucuguu

SEQ ID NO: 103059 - RNA, 63 nt, Homo Sapiens
aaaauauaccauaggcuaaaacuaaggcuuucacucuagaaugcaaagcuguuuugcagcugu

SEQ ID NO: 103060 - RNA, 63 nt, Homo Sapiens
uucccaucugcugcucuuuguagaaaagguuuccucuagaacugaauuccucuggaauugagu

SEQ ID NO: 103061 - RNA, 63 nt, Homo Sapiens
uguaaacauugagcucaccuuuuauauauuaaccucuagaauuaaugggccuaugugguuuuu

SEQ ID NO: 103062 - RNA, 63 nt, Homo Sapiens
uaauugugcuuuuuuuuuuuugguagguagcuucucuagaauuuaaaauauuuagcccuuccu

SEQ ID NO: 103063 - RNA, 63 nt, Homo Sapiens
gacauaaagguuuauggggacuuguaauauaugcucuagaaauuacuuugccaaagcugucau

SEQ ID NO: 103064 - RNA, 63 nt, Homo Sapiens
gcagaaauuaggaaggugauuuccuugaauuuucucuagaaaugaaccugaaauauuguuuuc

SEQ ID NO: 103065 - RNA, 63 nt, Homo Sapiens
uaaagcugaaaucugcaaaucuuuaaaauauaucucuagaacugugaaucuuguuuuuuuuau

SEQ ID NO: 103066 - RNA, 63 nt, Homo Sapiens
cuuagccugggcaccuggcuccugucucccugucucuagaagcaaccucaagggauuuagugc

SEQ ID NO: 103067 - RNA, 63 nt, Homo Sapiens
gauuacuuaagacugugucauuacuauauacuucucuagaagaugaaaugggaaucagugguc

SEQ ID NO: 103068 - RNA, 63 nt, Homo Sapiens
ggacuaaacuuauucucucagagaagguucuagcucuagaaagcauggugggaaacagccacc

SEQ ID NO: 103069 - RNA, 63 nt, Homo Sapiens
guucuuacccaguuaacaugaagaaaccacugucucuagaagaaagcuuguuuugcaguauua

SEQ ID NO: 103070 - RNA, 63 nt, Homo Sapiens
gaccaguugcacauguuuuccccuaaaagcuuacucuagaaaggauauuuuuuggagagggag

SEQ ID NO: 103071 - RNA, 63 nt, Homo Sapiens
ccuuaucucccucagacgcagaguuuuuaguuucucuagaaauuuuguuucauauuaggaaua

SEQ ID NO: 103072 - RNA, 63 nt, Homo Sapiens
gaucauuaagaugaagagaguaauucacauuuacucuagaaccuuuaacaagcacugaaagga

SEQ ID NO: 103073 - RNA, 63 nt, Homo Sapiens
ugucacaggauuaauuaauugccgguuuucauacucuagaaggcugaaacugauguuuaucuu

SEQ ID NO: 103074 - RNA, 63 nt, Homo Sapiens
uaauauauuucacaucuuuauuauugcaguuuucucuagaaagcucugagaagcuuucucugc

SEQ ID NO: 103075 - RNA, 63 nt, Homo Sapiens
cauugaggaacuguugauuggcaggcacugauucucuagaacacugggcaugaggauguugca

SEQ ID NO: 103076 - RNA, 63 nt, Homo Sapiens
uacuuuucagguaauuauggaaaauauuuuaaacucuagaagcuucaauaaugaugugugauu

SEQ ID NO: 103077 - RNA, 63 nt, Homo Sapiens
ucucugugugcuuugugguugcugucauauuugcucuagaagaaaaaaaaaaaaggaggggaa

SEQ ID NO: 103078 - RNA, 63 nt, Homo Sapiens
cacauuuuauacuuuucauaaaccacaaagucucucuagaauuuuuucugccuucacuaaaau

SEQ ID NO: 103079 - RNA, 63 nt, Homo Sapiens
gcuccugggcucaagugauccucuagacucagccucuagaauagcugggacuacaggcacaug

SEQ ID NO: 103080 - RNA, 63 nt, Homo Sapiens
ccaguccccuuucucggggucacaugauuugggcucuagaauucagccuuuugggaauaauag

SEQ ID NO: 103081 - RNA, 63 nt, Homo Sapiens
uuccuuggcacauauaaaaguuucucaaaaaugcucuagaacuuuguucuucaguauuuuguu

SEQ ID NO: 103082 - RNA, 63 nt, Homo Sapiens
auuuaguuuguguuaacuauauguaaucacauucucuagaaccuuccaauaauguuagaguuc

SEQ ID NO: 103083 - RNA, 63 nt, Homo Sapiens
ggcacaagaauggcuaaagcgaugaaacuaaaucucuagaagaaagaggucuugcagucuuca

SEQ ID NO: 103084 - RNA, 63 nt, Homo Sapiens
aucagaaucaaguuguggguuucuuaugaaugacucuagaaaaaaaggauccacuacuucuug

SEQ ID NO: 103085 - RNA, 63 nt, Homo Sapiens
ccaaaugccccgaguuaagauuuccaaaaggaacucuagaagacuucacuaaugaucacauuc

SEQ ID NO: 103086 - RNA, 63 nt, Homo Sapiens
acgugaaauauuuaaguauauaguauauuuauacucuagaacaugcacauuuauauauauaug

SEQ ID NO: 103087 - RNA, 63 nt, Homo Sapiens
aaaaccuaaacucuucaggcuaccuuugugugucucuagaagagaaaagcaucuaucuggaga

SEQ ID NO: 103088 - RNA, 63 nt, Homo Sapiens
ugaauaaacaucagaguauuuuaaaaaacaguucucuagaaagaacuguuauaauuaaaauga

SEQ ID NO: 103089 - RNA, 63 nt, Homo Sapiens
aaacuccugugcuuuugagcaaggacuuuugcccucuagaaagcaacugaggccaggugcggu

SEQ ID NO: 103090 - RNA, 63 nt, Homo Sapiens
acugugucaaaaugauaauuuuguuauguuagccucuagaaaauuuaaguucagaaaaaugca

SEQ ID NO: 103091 - RNA, 63 nt, Homo Sapiens
ugcuuauagaggcaaaccacaguaucauuuuaacucuagaauugggcuuguacagaaggauaa

SEQ ID NO: 103092 - RNA, 63 nt, Homo Sapiens
cuuauuguaauuuuccuacuaauuuauagagaucucuagaauuauuuugagucauaggucugu

SEQ ID NO: 103093 - RNA, 63 nt, Homo Sapiens
uaccgcagaaauugaugugucugucuggucuuccucuagaaggcuuucaacucuguugacccu

SEQ ID NO: 103094 - RNA, 63 nt, Homo Sapiens
cugaguaccaugggcuacagcuaggcuacccuccucuagaaggcacucagggcuucuccucug

SEQ ID NO: 103095 - RNA, 63 nt, Homo Sapiens
aucucgcaccaccaguuacauccuuuccccucucucuagaaucgaagaccaaaccccacaucc

SEQ ID NO: 103096 - RNA, 63 nt, Homo Sapiens
guagggaaaauaaugcuuguaccugugugcauacucuagaagaauugcauugcauucagagua

SEQ ID NO: 103097 - RNA, 63 nt, Homo Sapiens
aagggaacagaaagucugccacacuaauaagagcucuagaaaagggauuaaaaauaaggauaa

SEQ ID NO: 103098 - RNA, 60 nt, Homo Sapiens
cucaaacaaguagaaacuuggcugcauuaccucuagaaacgggcacccaggagugucuga

SEQ ID NO: 103099 - RNA, 63 nt, Homo Sapiens
caauuagggauguuuguuacuucccugcuuccucucuagaaucaugagccaccgcaccuggcc

SEQ ID NO: 103100 - RNA, 63 nt, Homo Sapiens
ucaaugucuuuguggacauuuuacuguaguauucucuagaacucguuuucauugucaagaaug

SEQ ID NO: 103101 - RNA, 63 nt, Homo Sapiens
uuuauccuaagcacuuguuucaauauuccauuucucuagaauguuaauuuuuaagcucuuugc

SEQ ID NO: 103102 - RNA, 63 nt, Homo Sapiens
ccagcuugcuaaauuaggcuauaccuagguaaucucuagaagacaacucugacagacucuuua

SEQ ID NO: 103103 - RNA, 63 nt, Homo Sapiens
uuuuucaucaugcacgaauuaauaaucaucauacucuagaaucuugucugucacucacuacau

SEQ ID NO: 103104 - RNA, 63 nt, Homo Sapiens
uuucuagguuuguaagugcagcaguuuuauuuccucuagaacucauccuguuucaagggaagu

SEQ ID NO: 103105 - RNA, 63 nt, Homo Sapiens
cuaagaauuuuccacuucuucaaaaugaacuuacucuagaaagcuuacccuuggauaaccagu

SEQ ID NO: 103106 - RNA, 63 nt, Homo Sapiens
ugcuggugaguauuaccuuucaucugugccaugcucuagaaccuugaccuugauaguucacca

SEQ ID NO: 103107 - RNA, 63 nt, Homo Sapiens
gcuuaaugaucaaguguuacuuaucuaauaauccucuagaaagaacccuguuagaucuugguu

SEQ ID NO: 103108 - RNA, 63 nt, Homo Sapiens
gcccuucacuuucuccugguggagggcacgaggcucuagaaauaggggaaacucuggugccgg

SEQ ID NO: 103109 - RNA, 63 nt, Homo Sapiens
gaacucucuuucuucucuugcacucccccugcucucuagaaagucuccaccugcccaccggga

SEQ ID NO: 103110 - RNA, 63 nt, Homo Sapiens
aaacgucuuuauuuaggaggugauagauuugcucucuagaaggcuucuaguuuugacauuuua

SEQ ID NO: 103111 - RNA, 63 nt, Homo Sapiens
aucauauugaugaaaucguaaacaucuuuaugacucuagaauaaugcagacucaaaccuuccc

SEQ ID NO: 103112 - RNA, 63 nt, Homo Sapiens
gcggaccaaacuacuucauuuuuacccagacaacucuagaaauuuuguuuuuugguuuuuuuu

SEQ ID NO: 103113 - RNA, 63 nt, Homo Sapiens
cucuaaagaccauguuggaagucacagucguaucucuagaaagagugcgugaagaccaacaaa

SEQ ID NO: 103114 - RNA, 63 nt, Homo Sapiens
uagucacaaguauuaauaauauaauaugugaugcucuagaaaaaauuccugcuuguuaauuac

SEQ ID NO: 103115 - RNA, 63 nt, Homo Sapiens
ucuguauuguguagaaugauuccuuuagaaaugcucuagaagauaagaccaaaaacuguaaua

SEQ ID NO: 103116 - RNA, 63 nt, Homo Sapiens
gucugaugaaaggccgggaagaaaaggagguuucucuagaagacaugauagccaauggugagg

SEQ ID NO: 103117 - RNA, 63 nt, Homo Sapiens
aagcuuugucagguuaauguagcauguuaaggacucuagaaaaaaauaaacuaaggagacgag

SEQ ID NO: 103118 - RNA, 63 nt, Homo Sapiens
auauucggggauaugaaggauucaaugaaugaucucuagaaagauuuaaagaagaauauucag

SEQ ID NO: 103119 - RNA, 63 nt, Homo Sapiens
gguuccacccuaacuuggggaaacaaaagccuucucuagaaucugaaggccaggcuuaccucu

SEQ ID NO: 103120 - RNA, 63 nt, Homo Sapiens
uaggaaucaauaguuaguagugacauuggugcucucuagaaaucucagcaugagcugcuauag

SEQ ID NO: 103121 - RNA, 63 nt, Homo Sapiens
acaggccugcuagcucagccgacgcucuggacacucuagaaaucacuccucagugugaccucc

SEQ ID NO: 103122 - RNA, 63 nt, Homo Sapiens
cuaguccugaguauaaauccugugcauagauuccucuagaaaggcaucaaaaggcucaacaga

SEQ ID NO: 103123 - RNA, 63 nt, Homo Sapiens
aaauggguucagggucuuguccuuagcuacuagcucuagaaaagucccaaaagcagcagaagg

SEQ ID NO: 103124 - RNA, 63 nt, Homo Sapiens
gacuuuggccuccccccaagagggugaagccaccucuagaaggacuggacuguuccugggaaa

SEQ ID NO: 103125 - RNA, 63 nt, Homo Sapiens
cuguugccacuuacgggggccaccacugcaugucucuagaauguuguguguaugguacuagca

SEQ ID NO: 103126 - RNA, 63 nt, Homo Sapiens
aauuaucuuuuucucuuaauaauacaguauucacucuagaaacgugucuucuaagagcuguuc

SEQ ID NO: 103127 - RNA, 63 nt, Homo Sapiens
aggccaucucacuagaauagcucaguuuccuaccucuagaaaguaauaguaaagguaaaaucu

SEQ ID NO: 103128 - RNA, 63 nt, Homo Sapiens
ggagccaggacuaagugagacaauaaagaggaacucuagaacuccccaaacuuucaccaaaag

SEQ ID NO: 103129 - RNA, 63 nt, Homo Sapiens
caguauaaacuuucagaggcaguccaaggaaagcucuagaaaaaauucaggagcuuugaagga

SEQ ID NO: 103130 - RNA, 63 nt, Homo Sapiens
aaucuucuagaagaaaaaucuccgaagagcucucucuagaaguccaaaauggcuagccauuau

SEQ ID NO: 103131 - RNA, 63 nt, Homo Sapiens
uagcugaugucagcuucauguggauuuuaagcacucuagaaacaaugaagcuucuuggcauau

SEQ ID NO: 103132 - RNA, 63 nt, Homo Sapiens
uccugccacuagguuucaccucccaaacccagccucuagaacagccagacccugcagaucccc

SEQ ID NO: 103133 - RNA, 63 nt, Homo Sapiens
gacagugucuaaauauaagacaauauugaucagcucuagaauaacuuuaaagaaagacguguu

SEQ ID NO: 103134 - RNA, 63 nt, Homo Sapiens
uucuuugcauuuggcucuacuuacuaacaaccccucuagaauacauuggugauuucauuuaaa

SEQ ID NO: 103135 - RNA, 63 nt, Homo Sapiens
cuuucuauuucuaaccuaugaauaauucuuguucucuagaaaguuguaguacauguuuuuacu

SEQ ID NO: 103136 - RNA, 63 nt, Homo Sapiens
guaacaaaucagccaauuggcauacaguucagccucuagaaugugaaugguaguugaggucuu

SEQ ID NO: 103137 - RNA, 63 nt, Homo Sapiens
acacuagacagaugucuccuccuccuaccccuacucuagaaacaggaauugagcgguucccca

SEQ ID NO: 103138 - RNA, 63 nt, Homo Sapiens
ugccuuuuucaaauaucccuucuuugucuuuuccucuagaaccgcaggguucaguuucaugua

SEQ ID NO: 103139 - RNA, 63 nt, Homo Sapiens
acaucuuuaaaccccuuacaucccucuacgucucucuagaaugcugccacugucccaacucuu

SEQ ID NO: 103140 - RNA, 63 nt, Homo Sapiens
ggagauuuaguuuuacugcuuugacuggugggucucuagaagcaaaacugagugauaacucau

SEQ ID NO: 103141 - RNA, 63 nt, Homo Sapiens
ccauaguuuuguuuugguuuauuuuuaacaacgcucuagaaacaaagucaaauuaaucacaaa

SEQ ID NO: 103142 - RNA, 63 nt, Homo Sapiens
ucucuuuagaacuugauggcugggcacugccaucucuagaauugccacgagucucucucuucc

SEQ ID NO: 103143 - RNA, 63 nt, Homo Sapiens
ggguguacuaguuacacaucuucaacagacccccucuagaaauuuuucagaugcuucugggag

SEQ ID NO: 103144 - RNA, 63 nt, Homo Sapiens
agcagcuguggucauuaaaccauuaguuuaccccucuagaacuggggucugcaaacucccacc

SEQ ID NO: 103145 - RNA, 63 nt, Homo Sapiens
cuacagcacuaagagaagccccugagaaaaacccucuagaaaaacagcuguuccucugugugg

SEQ ID NO: 103146 - RNA, 63 nt, Homo Sapiens
uucccucuguggccuccuggcuugcacugcucccucuagaaagauuccuucaggucuggaggc

SEQ ID NO: 103147 - RNA, 63 nt, Homo Sapiens
ucaguggacaguaugcacucagcugaccacucucucuagaaauagucaagauaugaacuaaga

SEQ ID NO: 103148 - RNA, 63 nt, Homo Sapiens
aacuccccuuaaaaugucuauucuauuaaaagccucuagaagugccuuguuaugcacaagaga

SEQ ID NO: 103149 - RNA, 63 nt, Homo Sapiens
uugaguucucauuuuuuuaaagaagaguuauugcucuagaaaggccuugugcuagugcccucg

SEQ ID NO: 103150 - RNA, 63 nt, Homo Sapiens
gcaaagccggauuucuggaaagaacacugaagacucuagaaaaaucccggcggcaaggagaac

SEQ ID NO: 103151 - RNA, 63 nt, Homo Sapiens
cuguccguggaugaguuuagcagcguccugcugcucuagaagacauacucugcuucucucugu

SEQ ID NO: 103152 - RNA, 63 nt, Homo Sapiens
caggauguuccuucuauugucagcaagagucaacucuagaauuaagcugaagguguacuucac

SEQ ID NO: 103153 - RNA, 63 nt, Homo Sapiens
aacacauaaaauuuagcaauaggucuggaacagcucuagaauguuuuccuuuuuuucuugauu

SEQ ID NO: 103154 - RNA, 63 nt, Homo Sapiens
gaauugcuaccucuuguaugauuuugagaccaucucuagaaaaagugauuuugauguauucua

SEQ ID NO: 103155 - RNA, 63 nt, Homo Sapiens
uguuacaagggggagggaagcuuuucacuaaaacucuagaagguucacuucaagacuuuccuu

SEQ ID NO: 103156 - RNA, 63 nt, Homo Sapiens
cuccacccucaucucucugcacuggcugucugccucuagaacuuccuaggcccuagggaucca

SEQ ID NO: 103157 - RNA, 63 nt, Homo Sapiens
gcugguaaaggggugcuggaggccauggaggagcucuagaaacauuagcaugggcugaucuga

SEQ ID NO: 103158 - RNA, 63 nt, Homo Sapiens
uuauggcauaugucuccgauuuagaugguuauucucuagaaaauaguauuuaaagacauuuua

SEQ ID NO: 103159 - RNA, 63 nt, Homo Sapiens
cucauccccaccccaccucaccccaacaaacuccucuagaagaagccaagaauuucucucuau

SEQ ID NO: 103160 - RNA, 63 nt, Homo Sapiens
cugaugcuuggaccccuuuuauugaucagagugcucuagaauaauggauggucuuggaugaug

SEQ ID NO: 103161 - RNA, 63 nt, Homo Sapiens
ucauuauuuuaaugaaugugagcucuugacuuacucuagaauucuaauacagauacuuucugc

SEQ ID NO: 103162 - RNA, 63 nt, Homo Sapiens
cuauuguuugaucuaguuauuuuaauaaaggaacucuagaaguuucaaguggccagugaagug

SEQ ID NO: 103163 - RNA, 63 nt, Homo Sapiens
aaauaaguaggacugaguauuuaugugaaaacucucuagaagguaaaaauaaagauaauucuu

SEQ ID NO: 103164 - RNA, 63 nt, Homo Sapiens
guuuucuguguaauuccagaugagucacuguaacucuagaagauuaaccuuccagccaaccua

SEQ ID NO: 103165 - RNA, 63 nt, Homo Sapiens
uccucgcccuuucuuaaagugcaguucuuagcccucuagaaacgaguuggugucuuucgucuc

SEQ ID NO: 103166 - RNA, 63 nt, Homo Sapiens
aaauguacucauuuagacaauacuccuuacagucucuagaauugccccaaagcauauaaucuc

SEQ ID NO: 103167 - RNA, 63 nt, Homo Sapiens
agaaauuauggagaaugauuacaaagaagaaagcucuagaaagacuaccuuacgugauagcau

SEQ ID NO: 103168 - RNA, 63 nt, Homo Sapiens
cauguuuguuuguuuguuuucugacaacacaagcucuagaauuacuuaccccacagcugguua

SEQ ID NO: 103169 - RNA, 63 nt, Homo Sapiens
uuggcaauguugacuaagaaucaaaccuuuauccucuagaauuagaaaaauguggauaaacag

SEQ ID NO: 103170 - RNA, 63 nt, Homo Sapiens
aaguagugaggccguuaauugguggagccaaaucucuagaaaucauccugaagaaaugguaag

SEQ ID NO: 103171 - RNA, 63 nt, Homo Sapiens
cuagcagccuaacugcugcugaacaaagaugaacucuagaacuaacccugacugugggcuuga

SEQ ID NO: 103172 - RNA, 63 nt, Homo Sapiens
cagaguugcuguuguuuuuuuugguguuuuccccucuagaaaauaccauuugaauauuuucau

SEQ ID NO: 103173 - RNA, 63 nt, Homo Sapiens
ucuugccucauugaguguuuuccuucuuuugggcucuagaaagccccagaucucuucccccau

SEQ ID NO: 103174 - RNA, 63 nt, Homo Sapiens
uuuuaucaagaugaagacauuuuacccuaccuacucuagaaauauacaacaauguuauauuuu

SEQ ID NO: 103175 - RNA, 63 nt, Homo Sapiens
gggcuaaugcugcauuuuucuacaacaucaugccucuagaagguuuaagcuagguaggcuuuc

SEQ ID NO: 103176 - RNA, 63 nt, Homo Sapiens
ugucugcguuuacucuuguuucaccagacuuuucucuagaagcaucuauuaucaacugcugcu

SEQ ID NO: 103177 - RNA, 63 nt, Homo Sapiens
auaaagcaaagcacuauuccaaauuacugcuuucucuagaaauaggaacacugaacuaguugg

SEQ ID NO: 103178 - RNA, 63 nt, Homo Sapiens
ugggcuuggaccagaucuaaccucugcuuuuaacucuagaauuuuuuucagccacuaagaacc

SEQ ID NO: 103179 - RNA, 63 nt, Homo Sapiens
cagcaggucacacugggggcgggcugaaguguucucuagaaucuggguuuucccuugccuuau

SEQ ID NO: 103180 - RNA, 63 nt, Homo Sapiens
agucugaggauguuaacuuuggaacucgcaguccucuagaacagcuucagauuauggcuuuuu

SEQ ID NO: 103181 - RNA, 63 nt, Homo Sapiens
gcugcucuccaaugcuaacuuucugacacagugcucuagaacccugccugugguccugagcac

SEQ ID NO: 103182 - RNA, 63 nt, Homo Sapiens
aguugaggaaaugguugggaaucgcuguuagaacucuagaaauucuaaucugacuuugccacu

SEQ ID NO: 103183 - RNA, 63 nt, Homo Sapiens
gccuggacagccaggggcuccucgggcccugugcucuagaaggcccauucuaugucugcuucg

SEQ ID NO: 103184 - RNA, 63 nt, Homo Sapiens
gaaaagaaucugaacauuuaagugcgaaguuuucucuagaaauauauucaagauauguuuauu

SEQ ID NO: 103185 - RNA, 63 nt, Homo Sapiens
uuuauuuugcucgugcuuagcuaaauaugucaucucuagaaaagaugugguuuguuuuggcac

SEQ ID NO: 103186 - RNA, 63 nt, Homo Sapiens
ccguucaaaugagcguagcccccugagucaucacucuagaagaaucuguacaucaucaggacu

SEQ ID NO: 103187 - RNA, 63 nt, Homo Sapiens
augguguucacucuacauaucagguuauggugucucuagaaucuguuguuuguuuccuauaag

SEQ ID NO: 103188 - RNA, 63 nt, Homo Sapiens
aaugaagaccuacuuucaacuccuuuuuccccccucuagaagaaucaaauugaaucuuuuacu

SEQ ID NO: 103189 - RNA, 63 nt, Homo Sapiens
aaggugauugguuuucuuuacagacuccuuguucucuagaagggcuuuuuacuugaauaaaac

SEQ ID NO: 103190 - RNA, 63 nt, Homo Sapiens
auaauuaguguuauagucuuugucaaaugcauccucuagaaaauuugugaaugagaguuggca

SEQ ID NO: 103191 - RNA, 63 nt, Homo Sapiens
ucagcacugcacuguuagcuuccuguuucuuggcucuagaagacacauagagccucucucuuu

SEQ ID NO: 103192 - RNA, 63 nt, Homo Sapiens
ggcugcugucauagugaacaaugacauuaauaccucuagaaaguggagaauuaucacaaccua

SEQ ID NO: 103193 - RNA, 63 nt, Homo Sapiens
auuuucuuacaguagauaaguauacauuccacccucuagaaguaacuugcagguccagguugg

SEQ ID NO: 103194 - RNA, 63 nt, Homo Sapiens
cugugaauuucaacauuauuuauaacuauaaaucucuagaauuaauuggugauacuucuaaac

SEQ ID NO: 103195 - RNA, 63 nt, Homo Sapiens
cauagcuucuuacugaacuuacucuagaauugucucuagaaaaacaaagucaauggaaauuga

SEQ ID NO: 103196 - RNA, 51 nt, Homo Sapiens
gucucuagaaaacauagcuuacucuagaauuacaaagucaauggaaauuga

SEQ ID NO: 103197 - RNA, 63 nt, Homo Sapiens
ccguaggucuauccuuagaguuaaugguuuuugcucuagaauagauuuccuguagaaguagcu

SEQ ID NO: 103198 - RNA, 63 nt, Homo Sapiens
guguaccauccaauucgccagacugggacccuacucuagaacuccugccuccugggguccagu

SEQ ID NO: 103199 - RNA, 63 nt, Homo Sapiens
agguuaaacugaagcaacuugcauguacuaguccucuagaaauucccuguaguugacaauucu

SEQ ID NO: 103200 - RNA, 63 nt, Homo Sapiens
cacgcacaugcgaccccgaggaaacgaaacccacucuagaaaacgcgaccuuggccgcaccua

SEQ ID NO: 103201 - RNA, 63 nt, Homo Sapiens
ugucugcucccacagcaccaucuaagaccccuccucuagaaguggggaaggccagauguguag

SEQ ID NO: 103202 - RNA, 63 nt, Homo Sapiens
acuauguauauuuaaauuuaguaauuuucuaaucucuagaaaucucugcuguucaaaaggugg

SEQ ID NO: 103203 - RNA, 63 nt, Homo Sapiens
auuucuaaaucccaucuugauauacuaugaauacucuagaaugauguaaagcagauaggaaug

SEQ ID NO: 103204 - RNA, 63 nt, Homo Sapiens
caaucauguacuuuaguuuaauguauaaagauccucuagaaaaugauaauauuguguauuaag

SEQ ID NO: 103205 - RNA, 63 nt, Homo Sapiens
cucugguggucucaagacaagaacaagagcugacucuagaaucuucugccuggcugaccucug

SEQ ID NO: 103206 - RNA, 63 nt, Homo Sapiens
ggucagugauggcaacaggauggccaaggauggcucuagaacacucuguccaugcgucacucc

SEQ ID NO: 103207 - RNA, 63 nt, Homo Sapiens
cuguccuguccaaugcgggggcacugcagaacucucuagaaaugucaugauugagcuucagag

SEQ ID NO: 103208 - RNA, 63 nt, Homo Sapiens
uccacuuuggagaauacucagagugacacuacacucuagaauuaacugaauaaucuuugccug

SEQ ID NO: 103209 - RNA, 63 nt, Homo Sapiens
uuguuuugaacauccuuguaucaauaaaguuuucucuagaauauuuuauuuuguuuucaacca

SEQ ID NO: 103210 - RNA, 63 nt, Homo Sapiens
guauggaaaugcacccucccuccugccgcuccucucuagaaccuucuagaaccugggcugugc

SEQ ID NO: 103211 - RNA, 63 nt, Homo Sapiens
ucuaagggugccaagagacugguuagucaaagccucuagaaggggauccucguugaaaggagc

SEQ ID NO: 103212 - RNA, 63 nt, Homo Sapiens
cauaucuauaaaacaaacauaguaucugucaaucucuagaaaccacaagaugauggagagguc

SEQ ID NO: 103213 - RNA, 63 nt, Homo Sapiens
guguagggacccugccaaguggcaccugauuuacucuagaaaauaaaaguagaaaauacugag

SEQ ID NO: 103214 - RNA, 63 nt, Homo Sapiens
gucccugaaguauuuaauaagaagcauuuugcacucuagaaaguauguuuguguugguuuuuu

SEQ ID NO: 103215 - RNA, 63 nt, Homo Sapiens
gguagauuacuuaucagaaaacauauaugucaucucuagaacgaagaaaaagcauaguaguuc

SEQ ID NO: 103216 - RNA, 63 nt, Homo Sapiens
gguaggguauaguaucacuccugaguuccacugcucuagaaucuaaccagaaauagaaaccua

SEQ ID NO: 103217 - RNA, 63 nt, Homo Sapiens
guggcguuggugaacggaccucagcucacugcucucuagaaaccccugcucaccauuggagaa

SEQ ID NO: 103218 - RNA, 63 nt, Homo Sapiens
acuucugaugcaugaaaaaucgugguucuggagcucuagaaacucaggacgugaugagguacu

SEQ ID NO: 103219 - RNA, 63 nt, Homo Sapiens
ggugcagacaucccgucugauuuaacacagagucucuagaagaaauguucagucggucguguu

SEQ ID NO: 103220 - RNA, 63 nt, Homo Sapiens
uggcaaguguccagaugccagaaccuucuuuuccucuagaagggauggugcuugguaaccuua

SEQ ID NO: 103221 - RNA, 63 nt, Homo Sapiens
auguaugucgauugauaucgcugcuacaucagacucuagaaaaaagggcugagaggaagcaag

SEQ ID NO: 103222 - RNA, 63 nt, Homo Sapiens
gauaauuccucaagcaugagaccuugcuaagcacucuagaauaaguuuuauguucugcucaca

SEQ ID NO: 103223 - RNA, 63 nt, Homo Sapiens
uacaaaagugcaaauuucucauuuccugugggucucuagaaacucucucaauauuuaaagcca

SEQ ID NO: 103224 - RNA, 63 nt, Homo Sapiens
ugggcuugguaagugaauuuaugagauuuacugcucuagaaaguauagauggccaaaggaccg

SEQ ID NO: 103225 - RNA, 63 nt, Homo Sapiens
uauacauugauauuuauucuuuguuuauuaucacucuagaaguccaucugagaugggguccug

SEQ ID NO: 103226 - RNA, 63 nt, Homo Sapiens
ccacugacuuuagugggucugacacuuagagcucucuagaaucauuuuuguaacuuuacgcag

SEQ ID NO: 103227 - RNA, 63 nt, Homo Sapiens
cuacuuacaguugaccaagccuuuuagccugcucucuagaaccuaugcccauuugauccuaac

SEQ ID NO: 103228 - RNA, 63 nt, Homo Sapiens
uccuucuguuggaggcccucggcuuuuccuccucucuagaaccaguacggcccccucuuugca

SEQ ID NO: 103229 - RNA, 63 nt, Homo Sapiens
cugcucccucugcagggggugcuuccaccucagcucuagaagccucaggcccccagcccugug

SEQ ID NO: 103230 - RNA, 63 nt, Homo Sapiens
uaaaucucuccugugucuuaaaaauauauaucacucuagaaaagaaaaaaagaaaaagaacaa

SEQ ID NO: 103231 - RNA, 63 nt, Homo Sapiens
aacgaguuauucacaccagcuuauuuauaagggcucuagaaaacaaacacuaacugggggauu

SEQ ID NO: 103232 - RNA, 63 nt, Homo Sapiens
ugcugcuacuagaaaugucuggcuacacgagcucucuagaaacaaaaaaaaaguuuguuaaaa

SEQ ID NO: 103233 - RNA, 63 nt, Homo Sapiens
cgagccgucacaccucaggcagacaccaggccacucuagaagcuggggccauuagaaugaggc

SEQ ID NO: 103234 - RNA, 63 nt, Homo Sapiens
uuccccuggcaugaaacuuucagauuccccugccucuagaaauuguccugcccuccucaccac

SEQ ID NO: 103235 - RNA, 63 nt, Homo Sapiens
aacccaugguucucagcuggggugacacugcuccucuagaagcagguuugaaauuauggguau

SEQ ID NO: 103236 - RNA, 63 nt, Homo Sapiens
uguaaaggcccugucccaauuaagcuguguucacucuagaaggccuggcuuuuuguugauuau

SEQ ID NO: 103237 - RNA, 63 nt, Homo Sapiens
caagguuuuguuuguuaauuuaacuuccauguucucuagaaauuacauucuccuugucuggua

SEQ ID NO: 103238 - RNA, 63 nt, Homo Sapiens
cguacguaugcacccacagaaugguaacuucuacucuagaauaguuucuggugugugaacuuu

SEQ ID NO: 103239 - RNA, 63 nt, Homo Sapiens
cagaacccagcccagaucggaggacaaguuccucucuagaacccaauccaauuuggagcccca

SEQ ID NO: 103240 - RNA, 63 nt, Homo Sapiens
ggagccccagcccaacuccagaacccaacccuucucuagaauccagcccagaucugaggccaa

SEQ ID NO: 103241 - RNA, 63 nt, Homo Sapiens
ugugguccaaaugcggaucacuggucagauggacucuagaagcacugagcucccugucucugg

SEQ ID NO: 103242 - RNA, 63 nt, Homo Sapiens
ucaaaaagccucaugcauagcgggucauguagucucuagaaaauacauaaccugauggaaaug

SEQ ID NO: 103243 - RNA, 63 nt, Homo Sapiens
guuauuuauauccuauuuuuucucaccccaucucucuagaaacaccuauaaaggcuauuauug

SEQ ID NO: 103244 - RNA, 63 nt, Homo Sapiens
uuguauaagauccuagauccuaagggucgaaagcucuagaaucugcaauucaaaaguuccaag

SEQ ID NO: 103245 - RNA, 63 nt, Homo Sapiens
gcugccgugauggauucuguuugacguauuguucucuagaaggccuggcucugauccagugac

SEQ ID NO: 103246 - RNA, 63 nt, Homo Sapiens
ugcugcugauggagaccaggagcccucuggcgucucuagaaacguccccacccucugcccccc

SEQ ID NO: 103247 - RNA, 63 nt, Homo Sapiens
ggagagagguccagauugcgaaagcagacaacacucuagaacucugacggaggaauuaacaca

SEQ ID NO: 103248 - RNA, 63 nt, Homo Sapiens
agaugguaucugaaguccuuuggucagcuacgucucuagaauaccagccccuccccuacuuuu

SEQ ID NO: 103249 - RNA, 63 nt, Homo Sapiens
aggauguuggggaaaaucccucaguuuccccaucucuagaaugguuguuucucucccugggcc

SEQ ID NO: 103250 - RNA, 63 nt, Homo Sapiens
uucucuaaaauuguacucagcauuuuuauuuaucucuagaaguugaaauucaguaauauuuga

SEQ ID NO: 103251 - RNA, 63 nt, Homo Sapiens
uaagcuuggugaaagaagggcuaaauccauguucucuagaaugaaguacagugaugagcaugc

SEQ ID NO: 103252 - RNA, 63 nt, Homo Sapiens
uaauacuugguaauuauacugagucacagaucacucuagaaucuagacuguucugggguagca

SEQ ID NO: 103253 - RNA, 63 nt, Homo Sapiens
gggguuacuucuccccugggucccucuggucuacucuagaagacccccaggaauggggaacuc

SEQ ID NO: 103254 - RNA, 63 nt, Homo Sapiens
uucaaaucucucccaacucuauucaagguccuccucuagaaguucccaucuccuuucagaaaa

SEQ ID NO: 103255 - RNA, 63 nt, Homo Sapiens
auauuggcugucaucaaaggguuggagaaaccccucuagaaacaaggcccuggguucaagaga

SEQ ID NO: 103256 - RNA, 63 nt, Homo Sapiens
gaaauuccuuaacugagcuauacuugguacuugcucuagaacauuugggaaaugacaaacuca

SEQ ID NO: 103257 - RNA, 63 nt, Homo Sapiens
aucucuuccagcaccaucaggguuuuaauggcccucuagaauuaccacugagauacacuauuu

SEQ ID NO: 103258 - RNA, 63 nt, Homo Sapiens
ccacaguaggccucucuuuggggguccuugggccucuagaaggugaagaaucugggccaacca

SEQ ID NO: 103259 - RNA, 63 nt, Homo Sapiens
guaagaaauaaauauuugcuuggacuucccagccucuagaacuaucugcuggugccuugaucu

SEQ ID NO: 103260 - RNA, 63 nt, Homo Sapiens
uaacccugggaaaagggcaucuuaguuuggauccucuagaaaccaagggcccaaggacagugc

SEQ ID NO: 103261 - RNA, 63 nt, Homo Sapiens
uaaauuuaugaaaauacaaauaucuucuucucccucuagaauauguauaacuuauuuucuuau

SEQ ID NO: 103262 - RNA, 63 nt, Homo Sapiens
ugcuuuguuuuguaagaacugacacagugaaaucucuagaaucugcguggaaggagcaaugca

SEQ ID NO: 103263 - RNA, 63 nt, Homo Sapiens
cauccaggugucggagcuaaucagccugucauucucuagaacaaguuaaaccaaacuacaguc

SEQ ID NO: 103264 - RNA, 63 nt, Homo Sapiens
agcugggcucucagcuauuugacacccccuucucucuagaaagagucagggacccccauaaag

SEQ ID NO: 103265 - RNA, 63 nt, Homo Sapiens
aagacgggggcugcuucuccucuucaguauggacucuagaaagucuggcuacaugaauagauu

SEQ ID NO: 103266 - RNA, 63 nt, Homo Sapiens
agugcuaacuugggccagcgggguuugggguaucucuagaaaacagcaacugaacagagcucc

SEQ ID NO: 103267 - RNA, 63 nt, Homo Sapiens
ggcgugacccaggccccuguagcccucagccuccucuagaagcuucuguacuccuuguaggau

SEQ ID NO: 103268 - RNA, 63 nt, Homo Sapiens
ugccguggccacccccgcugcccagugucugcccucuagaaguaggcuguguuuccagguguu

SEQ ID NO: 103269 - RNA, 63 nt, Homo Sapiens
cauggaaauuaaguguuucguuuucccauucuacucuagaaaguaaacaggaaagucgcauua

SEQ ID NO: 103270 - RNA, 63 nt, Homo Sapiens
auuuuuaagaaggagggaauaguuuuuuaguagcucuagaaacucaacuauuuuguaaaugca

SEQ ID NO: 103271 - RNA, 63 nt, Homo Sapiens
aacauucugugucaccagcagcuguccccugggcucuagaaagugaccagcucagaggauggg

SEQ ID NO: 103272 - RNA, 63 nt, Homo Sapiens
gaagaggcugggggacuagaaagaggcccugcccucuagaaagcucagaucuuggcuucuguu

SEQ ID NO: 103273 - RNA, 63 nt, Homo Sapiens
ucuuccaagaaugccucuguggugcuguuuggucucuagaaacagggucacuuuuuuaaugua

SEQ ID NO: 103274 - RNA, 63 nt, Homo Sapiens
cgacugcugcuguuaaaaaacaugcauuagaaucucuagaacacgaggaaaaacagggucuug

SEQ ID NO: 103275 - RNA, 63 nt, Homo Sapiens
uugugcaaugauuguuaaauuauacugaaguagcucuagaaagacacauguauacaaggcacu

SEQ ID NO: 103276 - RNA, 63 nt, Homo Sapiens
gccguaguagauguucuacuuuguucugcuguucucuagaaagaauauuugguuuuccuguau

SEQ ID NO: 103277 - RNA, 63 nt, Homo Sapiens
uacacaucagcauaugagaaucucugagagguccucuagaaaggagagaaaaagcaccucuuu

SEQ ID NO: 103278 - RNA, 63 nt, Homo Sapiens
ggauucauauauuacaucaacuucccuuuuuaacucuagaaauucucaguaugggguuucccu

SEQ ID NO: 103279 - RNA, 63 nt, Homo Sapiens
uggguuccuauggccuuguuggagggggccaggcucuagaacgucuaacacaguggagaaccg

SEQ ID NO: 103280 - RNA, 63 nt, Homo Sapiens
uugaucacgaucauauuguagucucucaaagugcucuagaaauugucagugguuuacaugaag

SEQ ID NO: 103281 - RNA, 63 nt, Homo Sapiens
aagaaaaguguuuuuagaaaguuugagagugaccucuagaaaaaacuauagugauauaucagu

SEQ ID NO: 103282 - RNA, 63 nt, Homo Sapiens
agcaagacugggccccacaugagcuuuagcucucucuagaauggccacccaguagcccagagu

SEQ ID NO: 103283 - RNA, 63 nt, Homo Sapiens
uuaagccuuuguugaacuguggugguuuucaaccucuagaauuaguugugcaggagguagccu

SEQ ID NO: 103284 - RNA, 63 nt, Homo Sapiens
cugucuaacauaccacaugaauauaccugauuccucuagaaggaguuuggaguaagggacuuc

SEQ ID NO: 103285 - RNA, 63 nt, Homo Sapiens
gauguugaaaucuuugccucuacuguggcuagucucuagaaugugauauauuacuacuuauaa

SEQ ID NO: 103286 - RNA, 63 nt, Homo Sapiens
caagccccaugagcagcaguuagauggugagggcucuagaaacagugaacugaggaaggugcu

SEQ ID NO: 103287 - RNA, 63 nt, Homo Sapiens
aacuauagugauauaucaguguuugggagugaccucuagaaaaaagaaaacuguuuuuagaaa

SEQ ID NO: 103288 - RNA, 63 nt, Homo Sapiens
ggggcgcauugcgauccaacuggccggggaaggcucuagaaaaagccgcauccugccuguaga

SEQ ID NO: 103289 - RNA, 62 nt, Homo Sapiens
guucuggcagcuccccgaggcagccgggguacccucuagauucagggaugcuugcucuccac

SEQ ID NO: 103290 - RNA, 62 nt, Homo Sapiens
acuuuguuucucccaaguaggccaccaggcagccucuagaguugcuuuacccaaauccuucu

SEQ ID NO: 103291 - RNA, 62 nt, Homo Sapiens
cuguaagugcuuuuuuuuucuucaccugggacccucuagagguuggaaagagaagagaggcu

SEQ ID NO: 103292 - RNA, 62 nt, Homo Sapiens
ucccaaaaaguguuaucuuuuccuuaaauaucccucuagagguauuuuuccuaagugguauu

SEQ ID NO: 103293 - RNA, 62 nt, Homo Sapiens
augcagccucaaaauguuucaaaugccuaccgccucuagaucgagccacguugacuucaggu

SEQ ID NO: 103294 - RNA, 62 nt, Homo Sapiens
gcagugguaauucaaaaugagaggguccccugccucuagagucaucaucuaauuggggacag

SEQ ID NO: 103295 - RNA, 62 nt, Homo Sapiens
cuccacaucugccuuaaaaccaaagagggcuuccucuagaagccaagggaaaggggugcuuu

SEQ ID NO: 103296 - RNA, 62 nt, Homo Sapiens
acacuauaguauucccuuauuguagccaugguccucuagaugcaguuaaccaaauaggguca

SEQ ID NO: 103297 - RNA, 62 nt, Homo Sapiens
gcuuuucuuaccugucacaucuuggccauccuccucuagacaaaaccagccuuuaaaauauc

SEQ ID NO: 103298 - RNA, 62 nt, Homo Sapiens
cugaagccauuggagagcugucuuccuguguaccucuagaaucccagcagcagagaaccauc

SEQ ID NO: 103299 - RNA, 62 nt, Homo Sapiens
aaacgcuuaacaucuuccaccgcaacagcuugccucuagagggggaauuguucauccauuug

SEQ ID NO: 103300 - RNA, 57 nt, Homo Sapiens
gcccuuccuucgcccgcuaacaccacuccucuagaacucggugguaaugacugggag

SEQ ID NO: 103301 - RNA, 62 nt, Homo Sapiens
ccuucaggcaacacagcccagcaccaccaccaccucuagauagugaguaugguguucaggau

SEQ ID NO: 103302 - RNA, 62 nt, Homo Sapiens
aacauucucccuugcuugauucuuuuccugucccucuagaagagaaguauguggacaucucu

SEQ ID NO: 103303 - RNA, 62 nt, Homo Sapiens
gcugcgacuuuaauuaaaaaguggacagugcuccucuagagaccuccuacuuuccucccuag

SEQ ID NO: 103304 - RNA, 62 nt, Homo Sapiens
agucacugucaggguguugcaugauauauucaccucuagagcgguauuuuaaucuccuguuu

SEQ ID NO: 103305 - RNA, 62 nt, Homo Sapiens
aauucaguccuguuggaaauacuaauuucagaccucuagagcgaaaagaaaagaaaauuucu

SEQ ID NO: 103306 - RNA, 62 nt, Homo Sapiens
uagauuaugagcccugaggaauucuguaauguccucuagauuaaaacucuuagaaaaaaaaa

SEQ ID NO: 103307 - RNA, 62 nt, Homo Sapiens
ggguuuauauuaaucugggaaaagaagugauaccucuagacuugaaaugaaguuaaguuugg

SEQ ID NO: 103308 - RNA, 62 nt, Homo Sapiens
cuuggaugaaacagugagaacccagacucaagccucuagacuccugcugucuauucuaagcc

SEQ ID NO: 103309 - RNA, 62 nt, Homo Sapiens
acccacuggccaguccuagaaaccccagcuggccucuagaacuguccagaccauugucuucc

SEQ ID NO: 103310 - RNA, 62 nt, Homo Sapiens
cuucuugcuuucauuuuccuaaccccaggcagccucuagagcuaccucagucacacaccccc

SEQ ID NO: 103311 - RNA, 62 nt, Homo Sapiens
gaacauaaaaagauaccaauugugcauuacauccucuagaggauguuccguggcaaugcuuu

SEQ ID NO: 103312 - RNA, 62 nt, Homo Sapiens
uuggauaauaaagaugcuuagcagagccauuuccucuagaaucuaguagguucugcuguuau

SEQ ID NO: 103313 - RNA, 62 nt, Homo Sapiens
uucugauucgguugaucuggcaugcagacucgccucuagagacaagccucuauuauacaaac

SEQ ID NO: 103314 - RNA, 62 nt, Homo Sapiens
cuacagucagauuuauagccagccaucuaucaccucuagaagguuccagagacagugaaacu

SEQ ID NO: 103315 - RNA, 62 nt, Homo Sapiens
uguuacaggggccucagagcaccuucguuucuccucuagaccagggacagguguagagauaa

SEQ ID NO: 103316 - RNA, 62 nt, Homo Sapiens
uagaagguggaaaagccaagggaacggauucuccucuagagucuccggaaggaacacagcuc

SEQ ID NO: 103317 - RNA, 62 nt, Homo Sapiens
guggcccuuggccgagcgccgaacucgcucgcccucuagauguccaagugccacgugaacua

SEQ ID NO: 103318 - RNA, 62 nt, Homo Sapiens
uggagcauguggucuuuuuaaaaaauuguaacccucuagaaaauaucaaagaaaugaaccag

SEQ ID NO: 103319 - RNA, 62 nt, Homo Sapiens
gucuggcagaagccacgcuuguuccccauguaccucuagagaagcagaaaccaaaguccccc

SEQ ID NO: 103320 - RNA, 62 nt, Homo Sapiens
cccuggcuucuggccacugccaucauuucucuccucuagaguuuucugaaccccacaucugc

SEQ ID NO: 103321 - RNA, 62 nt, Homo Sapiens
aguggcgauguuggcugauucauaaauuaucuccucuagauguucaggguagucaaaauaaa

SEQ ID NO: 103322 - RNA, 62 nt, Homo Sapiens
uuaguggcgggucugggcuggagagacacccuccucuagaauagaaaaaaguacugugaccu

SEQ ID NO: 103323 - RNA, 62 nt, Homo Sapiens
guguaucuuuuuaugauuuauggcagauaauuccucuagaauuuugauaauuguuauuuuuu

SEQ ID NO: 103324 - RNA, 62 nt, Homo Sapiens
ucagaugccuccugaagaauuacagacuucuuccucuagacuuggaggugagggacccucuc

SEQ ID NO: 103325 - RNA, 62 nt, Homo Sapiens
gccugggcccaaggggugaugaggcauccuuuccucuagaagaccugagucuuccugaccga

SEQ ID NO: 103326 - RNA, 62 nt, Homo Sapiens
cuagacaaaaaccauuguugaugaggcagaugccucuagaagagacguuuaaaagccaucaa

SEQ ID NO: 103327 - RNA, 62 nt, Homo Sapiens
gugaugcuucuggggcacguugaccauaugcaccucuagaaccuaaccagggcuuccuucua

SEQ ID NO: 103328 - RNA, 62 nt, Homo Sapiens
ucauaccuagagauuuguggggggauacugaaccucuagacugaaguacuuaccggggagca

SEQ ID NO: 103329 - RNA, 62 nt, Homo Sapiens
gagagcguuccuugaguccguacaccguccucccucuagaagcuggcaucacacucaugcug

SEQ ID NO: 103330 - RNA, 62 nt, Homo Sapiens
ugcauggaagagaacaccucuuuauggcuuacccucuagaauuucuaauuuauguguucugu

SEQ ID NO: 103331 - RNA, 62 nt, Homo Sapiens
ucaucggcaggcgcaugaguaucugugggaguccucuagagagaugagaagccaggaggccu

SEQ ID NO: 103332 - RNA, 62 nt, Homo Sapiens
caagcccauugcucucccacugcagaacauggccucuagauuaaugccaccgauucaggaac

SEQ ID NO: 103333 - RNA, 62 nt, Homo Sapiens
agcaccugggucccagcaucuagagcauggagccucuagaagccaugcucacccgcccacau

SEQ ID NO: 103334 - RNA, 62 nt, Homo Sapiens
uggacaugaguccugugaggacuggugucucuccucuagagcuuucaucuuugggaugccug

SEQ ID NO: 103335 - RNA, 62 nt, Homo Sapiens
aggugcccuuacuauccauucuucauugaugcccucuagauuugccacuucaucuaggaaac

SEQ ID NO: 103336 - RNA, 62 nt, Homo Sapiens
agaauuugcaggcaaccauguugcguuuacuuccucuagaaaaaaacauaaccauauguguu

SEQ ID NO: 103337 - RNA, 62 nt, Homo Sapiens
cauagccauacugcuaguuaucccaauaacugccucuagauaagcauccacgcaucucuugg

SEQ ID NO: 103338 - RNA, 62 nt, Homo Sapiens
cacuaauuuuaccugaugcuaaggcugccuuuccucuagagugagugccgccuguacucaca

SEQ ID NO: 103339 - RNA, 62 nt, Homo Sapiens
auuguaacuacacugggcaucagaauaaaaggccucuagaaauugcugaacaaugguuaauu

SEQ ID NO: 103340 - RNA, 62 nt, Homo Sapiens
uucuucugugcuucucucuauuugucauauugccucuagauugcugaaucuaaguaugguuu

SEQ ID NO: 103341 - RNA, 62 nt, Homo Sapiens
cuuugaauggagcguaaguagcagacauuuggccucuagauccgaggaacagagauggccca

SEQ ID NO: 103342 - RNA, 62 nt, Homo Sapiens
auuuguagcaguguuauucuccccugucuggcccucuagauguuauguaacugugggccuug

SEQ ID NO: 103343 - RNA, 62 nt, Homo Sapiens
cagaaagcaauuuuuaggcauguccuauauacccucuagaaaauucuccuauuuaccagucc

SEQ ID NO: 103344 - RNA, 62 nt, Homo Sapiens
cagaaccagcucuacgagagcguuucccuuuuccucuagaagcagcuuugggaaagcugccu

SEQ ID NO: 103345 - RNA, 62 nt, Homo Sapiens
ggcuaccaggucucuaggggccugagagaggcccucuagagaauccagggaaacugugagcc

SEQ ID NO: 103346 - RNA, 62 nt, Homo Sapiens
uucccaucugcugcucuuuguagaaaagguuuccucuagaacugaauuccucuggaauugag

SEQ ID NO: 103347 - RNA, 62 nt, Homo Sapiens
uguaaacauugagcucaccuuuuauauauuaaccucuagaauuaaugggccuaugugguuuu

SEQ ID NO: 103348 - RNA, 62 nt, Homo Sapiens
ucuaguaugcugaaaacuguauuuugaauuacccucuagacauuaaguacaggaagagacau

SEQ ID NO: 103349 - RNA, 62 nt, Homo Sapiens
aaccugggaacagucacaaggguggcaguguaccucuagaucaucaccugcucuuuggcuaa

SEQ ID NO: 103350 - RNA, 62 nt, Homo Sapiens
uuccgacuugggguucaggcaggcuguuuucaccucuagacaccccucuccaccccuccugc

SEQ ID NO: 103351 - RNA, 62 nt, Homo Sapiens
gauggggaccagcagccccacaccagggccagccucuagagcagacuacagcuggggugcag

SEQ ID NO: 103352 - RNA, 62 nt, Homo Sapiens
acccucaggacacccucucugcacccugugguccucuagaguagcuagcucugaggccccaa

SEQ ID NO: 103353 - RNA, 62 nt, Homo Sapiens
acuuguacaguuguagcugcgaguccagaaguccucuagagcauguguacuggcacugaguu

SEQ ID NO: 103354 - RNA, 62 nt, Homo Sapiens
caucgugaugcuucucugaaguucugcuacaaccucuagaucugcagcuugccacaucagcu

SEQ ID NO: 103355 - RNA, 62 nt, Homo Sapiens
acuguaaucuccagcuccugggcucaagugauccucuagacucagccucuagaauagcuggg

SEQ ID NO: 103356 - RNA, 62 nt, Homo Sapiens
gcuccugggcucaagugauccucuagacucagccucuagaauagcugggacuacaggcacau

SEQ ID NO: 103357 - RNA, 62 nt, Homo Sapiens
ggcugcaguccuauagaaugcauaccuuccucccucuagacaucccuccaccagaagagaca

SEQ ID NO: 103358 - RNA, 62 nt, Homo Sapiens
agcugauuggagucagcuggaacauaccacugccucuagacuaaggucagcagauuuagcaa

SEQ ID NO: 103359 - RNA, 62 nt, Homo Sapiens
auguuuuuagaagcaagagcaaaauuaugaaaccucuagagauuugggucauguuacuccau

SEQ ID NO: 103360 - RNA, 62 nt, Homo Sapiens
aaacuccugugcuuuugagcaaggacuuuugcccucuagaaagcaacugaggccaggugcgg

SEQ ID NO: 103361 - RNA, 62 nt, Homo Sapiens
guuuguuugguuuuuuuaauucuuaaaaacauccucuagaggaauagaaacaaauuuuuaug

SEQ ID NO: 103362 - RNA, 62 nt, Homo Sapiens
acugugucaaaaugauaauuuuguuauguuagccucuagaaaauuuaaguucagaaaaaugc

SEQ ID NO: 103363 - RNA, 62 nt, Homo Sapiens
gaaaugguucaugugauaaugugggcugguauccucuagaguaccuggguacauaaacagaa

SEQ ID NO: 103364 - RNA, 62 nt, Homo Sapiens
ucuuccucacacccauuuagugggggauggguccucuagacuugaggggcuacccugggaag

SEQ ID NO: 103365 - RNA, 62 nt, Homo Sapiens
aguucuguaauucuaaguguuguucuagauuuccucuagagaagguuauuagaaucuccauu

SEQ ID NO: 103366 - RNA, 62 nt, Homo Sapiens
guaccgcagaaauugaugugcugucuggucuuccucuagaagcuuucaacucuguugacccu

SEQ ID NO: 103367 - RNA, 62 nt, Homo Sapiens
gaaauaaaaguuugauguuuaucuguaugugaccucuagaugguugaaacaaacuuguaugu

SEQ ID NO: 103368 - RNA, 62 nt, Homo Sapiens
gcugaguaccaugggcuacacuaggcuacccuccucuagaagcacucagggcuucuccucug

SEQ ID NO: 103369 - RNA, 62 nt, Homo Sapiens
gacgugggccagccuccuugugaauggccucgccucuagauucuguuccacaaacagcaggc

SEQ ID NO: 103370 - RNA, 62 nt, Homo Sapiens
aguuggguuggaggcucauucccauccacucuccucuagagcuucccuggcuucuccuucag

SEQ ID NO: 103371 - RNA, 62 nt, Homo Sapiens
aaagauguuuguuuacauaaagugcccugagaccucuagagaguuacuuaaguuuguaagac

SEQ ID NO: 103372 - RNA, 59 nt, Homo Sapiens
ccucaaacaaguagaaacuugcugcauuaccucuagaaagggcacccaggagugucuga

SEQ ID NO: 103373 - RNA, 62 nt, Homo Sapiens
cauacauuuauauagcauugauauuuuuuucuccucuagauugagaaaccauuccaguaugc

SEQ ID NO: 103374 - RNA, 62 nt, Homo Sapiens
cagcuggcuccgagggcaacacaggggccuggccucuagagggcuggugauugaggggcccg

SEQ ID NO: 103375 - RNA, 62 nt, Homo Sapiens
ugaaaaagaccuaaaaacagaaccaaagacagccucuagauuucuuacccucaagucuccug

SEQ ID NO: 103376 - RNA, 62 nt, Homo Sapiens
uaagauuuguaaaucaugggcuugaccuuugaccucuagacacuaauuuuauccuuugaggc

SEQ ID NO: 103377 - RNA, 62 nt, Homo Sapiens
uuucuagguuuguaagugcagcaguuuuauuuccucuagaacucauccuguuucaagggaag

SEQ ID NO: 103378 - RNA, 62 nt, Homo Sapiens
gcuuaaugaucaaguguuacuuaucuaauaauccucuagaaagaacccuguuagaucuuggu

SEQ ID NO: 103379 - RNA, 62 nt, Homo Sapiens
aagugggugcccuugguagcagccuggggugaccucuagagcuggaggcugugggacuccag

SEQ ID NO: 103380 - RNA, 62 nt, Homo Sapiens
gauggaauuuuuccagccucauccuggccugcccucuagacuccaguccccaagcccucagc

SEQ ID NO: 103381 - RNA, 62 nt, Homo Sapiens
agggcuaguucuauacuuaagguuugugggccccucuagaggagcuuccuauuccauguuga

SEQ ID NO: 103382 - RNA, 62 nt, Homo Sapiens
uuuuuuugggggaaaaaggggagcuauuagcuccucuagauauuuuccaaagaauauucuaa

SEQ ID NO: 103383 - RNA, 62 nt, Homo Sapiens
ggauuguguuagaggaaucggcucuguauuugccucuagagaaacacaguguucucuuugua

SEQ ID NO: 103384 - RNA, 62 nt, Homo Sapiens
caaaaugccaagaucugggagccucuuucacuccucuagacacacugccugagauagaaguu

SEQ ID NO: 103385 - RNA, 62 nt, Homo Sapiens
cuaguccugaguauaaauccugugcauagauuccucuagaaaggcaucaaaaggcucaacag

SEQ ID NO: 103386 - RNA, 62 nt, Homo Sapiens
aagaugucaguaggaugacccaggacauuggaccucuagagcagcaagcuguagacggacag

SEQ ID NO: 103387 - RNA, 62 nt, Homo Sapiens
ggacuuuggccuccccccaaagggugaagccaccucuagaagacuggacuguuccugggaaa

SEQ ID NO: 103388 - RNA, 62 nt, Homo Sapiens
gaggccaucucacuagaauacucaguuuccuaccucuagaaauaauaguaaagguaaaaucu

SEQ ID NO: 103389 - RNA, 62 nt, Homo Sapiens
cccugauuuccccaggccugaggacccuacccccucuagauuuuucauuauaaaaugguuag

SEQ ID NO: 103390 - RNA, 62 nt, Homo Sapiens
uugacugcaagagaaucucuugagggucagcuccucuagacagacuuccucugagugaugcc

SEQ ID NO: 103391 - RNA, 62 nt, Homo Sapiens
uccugccacuagguuucaccucccaaacccagccucuagaacagccagacccugcagauccc

SEQ ID NO: 103392 - RNA, 62 nt, Homo Sapiens
uucuuugcauuuggcucuacuuacuaacaaccccucuagaauacauuggugauuucauuuaa

SEQ ID NO: 103393 - RNA, 60 nt, Homo Sapiens
aagccacuuuccucuucagauccuggucugcaccucuagaggcagguccuaagaaggaga

SEQ ID NO: 103394 - RNA, 62 nt, Homo Sapiens
gccucucuuuugggggaaucaagcauuugcuuccucuagacuacagcagggaaagggaggag

SEQ ID NO: 103395 - RNA, 62 nt, Homo Sapiens
agacugauugaaguagacagucuuuaagugcuccucuagacuagacguuuucuaacuuuuuc

SEQ ID NO: 103396 - RNA, 62 nt, Homo Sapiens
aauaagaucuuuuuugucaguacuuucccuacccucuagagacaugaaaauucagaauuuua

SEQ ID NO: 103397 - RNA, 62 nt, Homo Sapiens
gguaacaaaucagccaauugcauacaguucagccucuagaauugaaugguaguugaggucuu

SEQ ID NO: 103398 - RNA, 62 nt, Homo Sapiens
cugccuuuuucaaauaucccucuuugucuuuuccucuagaacgcaggguucaguuucaugua

SEQ ID NO: 103399 - RNA, 62 nt, Homo Sapiens
gcugugugaccacuuucccccacccuucccacccucuagacaacucucucccuuaccuguuu

SEQ ID NO: 103400 - RNA, 62 nt, Homo Sapiens
ggguguacuaguuacacaucuucaacagacccccucuagaaauuuuucagaugcuucuggga

SEQ ID NO: 103401 - RNA, 62 nt, Homo Sapiens
agcagcuguggucauuaaaccauuaguuuaccccucuagaacuggggucugcaaacucccac

SEQ ID NO: 103402 - RNA, 62 nt, Homo Sapiens
ugccuccccucuggucuccagaguuuuccuguccucuagaggcaagccaggccagggagcug

SEQ ID NO: 103403 - RNA, 62 nt, Homo Sapiens
cuacagcacuaagagaagccccugagaaaaacccucuagaaaaacagcuguuccucugugug

SEQ ID NO: 103404 - RNA, 62 nt, Homo Sapiens
aggcaggaaggacugucccagacgaggggcuuccucuagagucucacugcuggggaggagag

SEQ ID NO: 103405 - RNA, 62 nt, Homo Sapiens
cagggccccagccugauggggcugcccucaguccucuagaucaagaugcugacuauuagggg

SEQ ID NO: 103406 - RNA, 62 nt, Homo Sapiens
gacuggaaaccuacccauuuuccccugagcauccucuagaugcugccccaaggaguugcugc

SEQ ID NO: 103407 - RNA, 62 nt, Homo Sapiens
uucccucuguggccuccuggcuugcacugcucccucuagaaagauuccuucaggucuggagg

SEQ ID NO: 103408 - RNA, 62 nt, Homo Sapiens
gcuucccugccaaacucacaaggagacaucaaccucuagacagggaacagcuucaggauacu

SEQ ID NO: 103409 - RNA, 62 nt, Homo Sapiens
uaacuccccuuaaaaugucuuucuauuaaaagccucuagaaggccuuguuaugcacaagaga

SEQ ID NO: 103410 - RNA, 62 nt, Homo Sapiens
cacugauacacagaauauaaagucauuuuuaaccucuagagugaagaacugucuauuuucuc

SEQ ID NO: 103411 - RNA, 62 nt, Homo Sapiens
gaguaaaaaugaauuacacuagaugggagaaaccucuagagaauaaaagauuuguacuguuu

SEQ ID NO: 103412 - RNA, 62 nt, Homo Sapiens
ucuccacccucaucucucugacuggcugucugccucuagaacuccuaggcccuagggaucca

SEQ ID NO: 103413 - RNA, 62 nt, Homo Sapiens
agagcucaacucucucccaaaccugggccccuccucuagagacggagcccccucucagccuu

SEQ ID NO: 103414 - RNA, 62 nt, Homo Sapiens
guaagcuagaggauuguaaauaucuuuuauguccucuagauaaaacacccgauuaacagaug

SEQ ID NO: 103415 - RNA, 62 nt, Homo Sapiens
agcggcugucacacucauugaaaugaaauggaccucuagaccaccuugugucuguuuccucu

SEQ ID NO: 103416 - RNA, 62 nt, Homo Sapiens
cucauccccaccccaccucaccccaacaaacuccucuagaagaagccaagaauuucucucua

SEQ ID NO: 103417 - RNA, 62 nt, Homo Sapiens
ugugccuguacccuccccuggucuacauaggaccucuagauaguguuagagagagaacaugu

SEQ ID NO: 103418 - RNA, 62 nt, Homo Sapiens
caaaagagaugucauucaguuaaaaagacaaaccucuagauguguaauuacauggaaaauac

SEQ ID NO: 103419 - RNA, 62 nt, Homo Sapiens
uuagcuguggcacaacacauacagcauugguuccucuagaucugguuaaaugcagaaugcag

SEQ ID NO: 103420 - RNA, 62 nt, Homo Sapiens
uccucgcccuuucuuaaagugcaguucuuagcccucuagaaacgaguuggugucuuucgucu

SEQ ID NO: 103421 - RNA, 62 nt, Homo Sapiens
caaacaaccgugcucagccuguuucucucugcccucuagagcaaggcccaccagguccaucc

SEQ ID NO: 103422 - RNA, 62 nt, Homo Sapiens
ccucuccugcucugagccaggguggggcauucccucuagauucagguuugggcagggguccu

SEQ ID NO: 103423 - RNA, 62 nt, Homo Sapiens
aggccaaaugccaacucuguagcccuaacuugccucuagagucaaguuuccuaccagcaaau

SEQ ID NO: 103424 - RNA, 62 nt, Homo Sapiens
agaaucuucaagaaucaguugcagaaaauuuuccucuagaucaagccucuagcuucacuggu

SEQ ID NO: 103425 - RNA, 62 nt, Homo Sapiens
uuuggcaauguugacuaagaucaaaccuuuauccucuagaauagaaaaauguggauaaacag

SEQ ID NO: 103426 - RNA, 62 nt, Homo Sapiens
ccagauagaggcccauuccuuccuaugaucauccucuagauagccucuguccucauuuuguu

SEQ ID NO: 103427 - RNA, 62 nt, Homo Sapiens
acucucccuuucuguuuuuuuaauacuuuguaccucuagagcggauugccauuuucauuaua

SEQ ID NO: 103428 - RNA, 62 nt, Homo Sapiens
acagaguugcuguuguuuuuuugguguuuuccccucuagaaauaccauuugaauauuuucau

SEQ ID NO: 103429 - RNA, 62 nt, Homo Sapiens
gggcuaaugcugcauuuuucuacaacaucaugccucuagaagguuuaagcuagguaggcuuu

SEQ ID NO: 103430 - RNA, 62 nt, Homo Sapiens
cuucagccuuaauggaagguugaauacucugcccucuagagcuuggaccagaucuaacaucu

SEQ ID NO: 103431 - RNA, 62 nt, Homo Sapiens
agucugaggauguuaacuuuggaacucgcaguccucuagaacagcuucagauuauggcuuuu

SEQ ID NO: 103432 - RNA, 62 nt, Homo Sapiens
ucugauugagugcagaggagacuagacagucuccucuagacagguuguagacacacccuccc

SEQ ID NO: 103433 - RNA, 62 nt, Homo Sapiens
gccagucagcuccuacagugaucaguuggccaccucuagaucuguguuugccggucuagacg

SEQ ID NO: 103434 - RNA, 62 nt, Homo Sapiens
agagccugguagagacuagggaagggaggucuccucuagacugacucacauugccuugagcu

SEQ ID NO: 103435 - RNA, 62 nt, Homo Sapiens
aaugaagaccuacuuucaacuccuuuuuccccccucuagaagaaucaaauugaaucuuuuac

SEQ ID NO: 103436 - RNA, 62 nt, Homo Sapiens
acgaggagaucuaagcagcguucccacagcccccucuagauucuuggaguuccgcagagcuu

SEQ ID NO: 103437 - RNA, 62 nt, Homo Sapiens
aauaauuaguguuauagucuugucaaaugcauccucuagaaauuugugaaugagaguuggca

SEQ ID NO: 103438 - RNA, 62 nt, Homo Sapiens
gggcugcugucauagugaacaugacauuaauaccucuagaaauggagaauuaucacaaccua

SEQ ID NO: 103439 - RNA, 62 nt, Homo Sapiens
uauuuucuuacaguagauaauauacauuccacccucuagaagaacuugcagguccagguugg

SEQ ID NO: 103440 - RNA, 62 nt, Homo Sapiens
uagguuaaacugaagcaacugcauguacuaguccucuagaaaucccuguaguugacaauucu

SEQ ID NO: 103441 - RNA, 62 nt, Homo Sapiens
ugucugcucccacagcaccaucuaagaccccuccucuagaaguggggaaggccagaugugua

SEQ ID NO: 103442 - RNA, 62 nt, Homo Sapiens
caaucauguacuuuaguuuaauguauaaagauccucuagaaaaugauaauauuguguauuaa

SEQ ID NO: 103443 - RNA, 62 nt, Homo Sapiens
cacacuucaaccccagcuugcuggucggcuuuccucuagagagagccgguuuuggggccauu

SEQ ID NO: 103444 - RNA, 62 nt, Homo Sapiens
ucuaagggugccaagagacugguuagucaaagccucuagaaggggauccucguugaaaggag

SEQ ID NO: 103445 - RNA, 62 nt, Homo Sapiens
guguagggucacugggagagcagaggucacagccucuagagaagggagaggggcgugugcau

SEQ ID NO: 103446 - RNA, 62 nt, Homo Sapiens
gggcugacccucucugcaaaacucuccccuguccucuagaccccacccuggguguaugugag

SEQ ID NO: 103447 - RNA, 62 nt, Homo Sapiens
ggcugggaagggccguucugcccccaaccuacccucuagaggcugggccuggugagcuacug

SEQ ID NO: 103448 - RNA, 62 nt, Homo Sapiens
aaccugacauuuacaauggagccucucaccccccucuagagagagguguccgcugacgggug

SEQ ID NO: 103449 - RNA, 62 nt, Homo Sapiens
gaccagcugccuuugagacccuuaccuuucaaccucuagagacagcaccuuagggccagggg

SEQ ID NO: 103450 - RNA, 62 nt, Homo Sapiens
uaaaccuaggccugugauacuugggcugugauccucuagagccagcuuggacucacaucauu

SEQ ID NO: 103451 - RNA, 62 nt, Homo Sapiens
uggcaaguguccagaugccagaaccuucuuuuccucuagaagggauggugcuugguaaccuu

SEQ ID NO: 103452 - RNA, 62 nt, Homo Sapiens
cucagccgcucuuugcuccagaccugccccucccucuagaggcugccugggccuguucacgu

SEQ ID NO: 103453 - RNA, 62 nt, Homo Sapiens
ucaugauuccuguagguaaaaguacaagacgaccucuagaugucuuuucuuucuaugaaagg

SEQ ID NO: 103454 - RNA, 62 nt, Homo Sapiens
ggggcccagucguucuugggcccaggauggggccucuagacuugcaagggagaggaacaggg

SEQ ID NO: 103455 - RNA, 62 nt, Homo Sapiens
acccagcggcgacauuguacagacuccucucaccucuagauagcaaauagcucucagauggu

SEQ ID NO: 103456 - RNA, 62 nt, Homo Sapiens
caaggaggggaggaacacuggaagucagcaugccucuagaggagggcucugugaccaggaag

SEQ ID NO: 103457 - RNA, 62 nt, Homo Sapiens
agcugguggccagggaugaauggggcccagccccucuagagugugugagaggucuccugggu

SEQ ID NO: 103458 - RNA, 62 nt, Homo Sapiens
auguuauauucuauaucagauuuauggaguuuccucuagaucuugaaauauaaaaaccuaga

SEQ ID NO: 103459 - RNA, 62 nt, Homo Sapiens
ucgggagcccggagggucuucaggaccaccuuccucuagagcucucugcucccaaaccaugu

SEQ ID NO: 103460 - RNA, 62 nt, Homo Sapiens
uuccccuggcaugaaacuuucagauuccccugccucuagaaauuguccugcccuccucacca

SEQ ID NO: 103461 - RNA, 62 nt, Homo Sapiens
cacccuugacugguugggauuugcucguccagccucuagacacuucccaaagcaagacugga

SEQ ID NO: 103462 - RNA, 62 nt, Homo Sapiens
aacccaugguucucagcuggggugacacugcuccucuagaagcagguuugaaauuaugggua

SEQ ID NO: 103463 - RNA, 62 nt, Homo Sapiens
cuugacuuacgaucguuauucaccuucgggugccucuagacaagaauacuucuccucuuccu

SEQ ID NO: 103464 - RNA, 62 nt, Homo Sapiens
ugccacaggguccuccgaugcuggccuuugcgccucuagaggcagccacucauggauucaag

SEQ ID NO: 103465 - RNA, 62 nt, Homo Sapiens
uggccaucccaccuaucccuuacccuucccugccucuagagccacuguucucacuacuucua

SEQ ID NO: 103466 - RNA, 62 nt, Homo Sapiens
gaggggacugcuguacaaagaauauaggaaggccucuagacuacauccauuccuuccucaac

SEQ ID NO: 103467 - RNA, 62 nt, Homo Sapiens
gugcugagcaaacguggagacaccauuucccuccucuagaccucaucuuggagagagagaug

SEQ ID NO: 103468 - RNA, 62 nt, Homo Sapiens
aaggcaggcagccccgacauccccagccaucuccucuagacccuucacccugugggaagugg

SEQ ID NO: 103469 - RNA, 62 nt, Homo Sapiens
uauaaguucugguuuauguuaaucccauuuuaccucuagaccuuugaccucugccccccaug

SEQ ID NO: 103470 - RNA, 62 nt, Homo Sapiens
acuucagguuuuuuuccuuuauuuguguuccaccucuagauuguucucuaauauuuuaccuc

SEQ ID NO: 103471 - RNA, 62 nt, Homo Sapiens
gugaauauaugaaaggagucucuuccaacuguccucuagaguaaaaaauaaaagugggaaaa

SEQ ID NO: 103472 - RNA, 62 nt, Homo Sapiens
uuuugccauaauacaugccaauaucguagucuccucuagauauuaugaaauccuauuggugg

SEQ ID NO: 103473 - RNA, 62 nt, Homo Sapiens
gaauaauguagaaacauuuuuuguuaauaauuccucuagauaggcucaaaacagaauuuauc

SEQ ID NO: 103474 - RNA, 62 nt, Homo Sapiens
caccuguucucacgcccuguguuagaguuagaccucuagacuucaaaugcacgguggucccu

SEQ ID NO: 103475 - RNA, 62 nt, Homo Sapiens
uuucaaaucucucccaacucauucaagguccuccucuagaagucccaucuccuuucagaaaa

SEQ ID NO: 103476 - RNA, 62 nt, Homo Sapiens
cauauuggcugucaucaaagguuggagaaaccccucuagaaaaaggcccuggguucaagaga

SEQ ID NO: 103477 - RNA, 62 nt, Homo Sapiens
aggaguggaagugugggugaugcaaguagaacccucuagauguacccuguguggucugcagg

SEQ ID NO: 103478 - RNA, 62 nt, Homo Sapiens
cugggaugaccuucccuggguuaaucaauuucccucuagacaacacaaacugcaggcaugug

SEQ ID NO: 103479 - RNA, 62 nt, Homo Sapiens
cucuaggcuuuuaucuugcggggucagagcgcccucuagagggaaaagcuagaggcacaggg

SEQ ID NO: 103480 - RNA, 62 nt, Homo Sapiens
aucucuuccagcaccaucaggguuuuaauggcccucuagaauuaccacugagauacacuauu

SEQ ID NO: 103481 - RNA, 62 nt, Homo Sapiens
ccaagaugugaacagugcaccuuuguucuugaccucuagaccaguaacgucuugucugugau

SEQ ID NO: 103482 - RNA, 62 nt, Homo Sapiens
aauugcccaagaagcccacccaccuuggaugaccucuagagacuuggagacacagaggguuu

SEQ ID NO: 103483 - RNA, 62 nt, Homo Sapiens
caugaaggcccacauagucagagaagaaaaauccucuagacacucaagguaguuauaugcug

SEQ ID NO: 103484 - RNA, 62 nt, Homo Sapiens
gccacaguaggccucucuuugggguccuugggccucuagaagugaagaaucugggccaacca

SEQ ID NO: 103485 - RNA, 62 nt, Homo Sapiens
uguaagaaauaaauauuugcuggacuucccagccucuagaacaucugcuggugccuugaucu

SEQ ID NO: 103486 - RNA, 62 nt, Homo Sapiens
cuaacccugggaaaagggcacuuaguuuggauccucuagaaacaagggcccaaggacagugc

SEQ ID NO: 103487 - RNA, 62 nt, Homo Sapiens
auaaauuuaugaaaauacaauaucuucuucucccucuagaauuguauaacuuauuuucuuau

SEQ ID NO: 103488 - RNA, 62 nt, Homo Sapiens
guaguugucacguuaucuuuggugcacccuuuccucuagaugcucucggcuucucugcugag

SEQ ID NO: 103489 - RNA, 62 nt, Homo Sapiens
ggcgugacccaggccccuguagcccucagccuccucuagaagcuucuguacuccuuguagga

SEQ ID NO: 103490 - RNA, 62 nt, Homo Sapiens
ugccguggccacccccgcugcccagugucugcccucuagaaguaggcuguguuuccaggugu

SEQ ID NO: 103491 - RNA, 62 nt, Homo Sapiens
ugggcuccguccucggcguuagaggccccacgccucuagagccgcagggucccaggcccaga

SEQ ID NO: 103492 - RNA, 62 nt, Homo Sapiens
aaaaaaauacagagucauccccuacccccaccccucuagagacccuccagcuaaaaacagag

SEQ ID NO: 103493 - RNA, 62 nt, Homo Sapiens
gaagaggcugggggacuagaaagaggcccugcccucuagaaagcucagaucuuggcuucugu

SEQ ID NO: 103494 - RNA, 62 nt, Homo Sapiens
aguuggcugccaaucucccugcucuugguucuccucuagauugaaguuuguuuucugaugcu

SEQ ID NO: 103495 - RNA, 62 nt, Homo Sapiens
uuuguaguuaaaggguccaguucugacuggagccucuagagagcugggcuuguauguucuuu

SEQ ID NO: 103496 - RNA, 62 nt, Homo Sapiens
ccccucuuucuuggggacccaguauguccucuccucuagacccagacauacaguuauaaccg

SEQ ID NO: 103497 - RNA, 62 nt, Homo Sapiens
cuccccauguuucgguaaucuuaagccuuuuuccucuagauaugcaguuagcaaacuuuugc

SEQ ID NO: 103498 - RNA, 62 nt, Homo Sapiens
gcaaauccaguuuccuggagccuuugagcugcccucuagagauggauugugagugaaugggc

SEQ ID NO: 103499 - RNA, 62 nt, Homo Sapiens
acuccuaggcucaagcaguccuccugccuuagccucuagaguagcuggggcuacaggugcug

SEQ ID NO: 103500 - RNA, 62 nt, Homo Sapiens
uacacaucagcauaugagaaucucugagagguccucuagaaaggagagaaaaagcaccucuu

SEQ ID NO: 103501 - RNA, 62 nt, Homo Sapiens
augagacauguggauggcagugagagaucgugccucuagaucuugauggaggcuuggugaga

SEQ ID NO: 103502 - RNA, 62 nt, Homo Sapiens
cacuucaucgugaggagcuguugggugucuugccucuagaggcuuugagaagcucagcugcc

SEQ ID NO: 103503 - RNA, 62 nt, Homo Sapiens
aaagaaaaguguuuuuagaaguuugagagugaccucuagaaaaacuauagugauauaucagu

SEQ ID NO: 103504 - RNA, 62 nt, Homo Sapiens
ccuggggccucacccuguaugcaaacacuuucccucuagaucgcauugcagcaugaggcagg

SEQ ID NO: 103505 - RNA, 62 nt, Homo Sapiens
uuuaagccuuuguugaacugggugguuuucaaccucuagaauaguugugcaggagguagccu

SEQ ID NO: 103506 - RNA, 62 nt, Homo Sapiens
gcugucuaacauaccacaugauauaccugauuccucuagaagaguuuggaguaagggacuuc

SEQ ID NO: 103507 - RNA, 62 nt, Homo Sapiens
aacuauagugauauaucaguguuugggagugaccucuagaaaaaagaaaacuguuuuuagaa

SEQ ID NO: 103508 - RNA, 63 nt, Homo Sapiens
aguucuggcagcuccccgaggcagccgggguacccucuagauucagggaugcuugcucuccac

SEQ ID NO: 103509 - RNA, 63 nt, Homo Sapiens
cacuuuguuucucccaaguaggccaccaggcagccucuagaguugcuuuacccaaauccuucu

SEQ ID NO: 103510 - RNA, 63 nt, Homo Sapiens
ucuguaagugcuuuuuuuuucuucaccugggacccucuagagguuggaaagagaagagaggcu

SEQ ID NO: 103511 - RNA, 63 nt, Homo Sapiens
uucccaaaaaguguuaucuuuuccuuaaauaucccucuagagguauuuuuccuaagugguauu

SEQ ID NO: 103512 - RNA, 63 nt, Homo Sapiens
caugcagccucaaaauguuucaaaugccuaccgccucuagaucgagccacguugacuucaggu

SEQ ID NO: 103513 - RNA, 63 nt, Homo Sapiens
agcagugguaauucaaaaugagaggguccccugccucuagagucaucaucuaauuggggacag

SEQ ID NO: 103514 - RNA, 63 nt, Homo Sapiens
acuccacaucugccuuaaaaccaaagagggcuuccucuagaagccaagggaaaggggugcuuu

SEQ ID NO: 103515 - RNA, 63 nt, Homo Sapiens
cacacuauaguauucccuuauuguagccaugguccucuagaugcaguuaaccaaauaggguca

SEQ ID NO: 103516 - RNA, 63 nt, Homo Sapiens
ugcuuuucuuaccugucacaucuuggccauccuccucuagacaaaaccagccuuuaaaauauc

SEQ ID NO: 103517 - RNA, 63 nt, Homo Sapiens
ccugaagccauuggagagcugucuuccuguguaccucuagaaucccagcagcagagaaccauc

SEQ ID NO: 103518 - RNA, 63 nt, Homo Sapiens
uaaacgcuuaacaucuuccaccgcaacagcuugccucuagagggggaauuguucauccauuug

SEQ ID NO: 103519 - RNA, 57 nt, Homo Sapiens; identical to SEQ ID NO: 103300

SEQ ID NO: 103520 - RNA, 63 nt, Homo Sapiens
ccuucaggcaacacagcccaugcaccaccaccaccucuagauaggugaguaugguguucagga

SEQ ID NO: 103521 - RNA, 63 nt, Homo Sapiens
aacauucucccuugcuugauuucuuuuccugucccucuagaaggagaaguauguggacaucuc

SEQ ID NO: 103522 - RNA, 63 nt, Homo Sapiens
gcugcgacuuuaauuaaaaagguggacagugcuccucuagagagccuccuacuuuccucccua

SEQ ID NO: 103523 - RNA, 63 nt, Homo Sapiens
agucacugucaggguguugcuaugauauauucaccucuagagcggguauuuuaaucuccuguu

SEQ ID NO: 103524 - RNA, 63 nt, Homo Sapiens
aauucaguccuguuggaaauuacuaauuucagaccucuagagcagaaaagaaaagaaaauuuc

SEQ ID NO: 103525 - RNA, 63 nt, Homo Sapiens
uagauuaugagcccugaggaaauucuguaauguccucuagauugaaaacucuuagaaaaaaaa

SEQ ID NO: 103526 - RNA, 63 nt, Homo Sapiens
ggguuuauauuaaucugggagaaagaagugauaccucuagacucugaaaugaaguuaaguuug

SEQ ID NO: 103527 - RNA, 63 nt, Homo Sapiens
cuuggaugaaacagugagaaccccagacucaagccucuagacucccugcugucuauucuaagc

SEQ ID NO: 103528 - RNA, 63 nt, Homo Sapiens
acccacuggccaguccuagacaaccccagcuggccucuagaacguguccagaccauugucuuc

SEQ ID NO: 103529 - RNA, 63 nt, Homo Sapiens
cuucuugcuuucauuuuccucaaccccaggcagccucuagagcguaccucagucacacacccc

SEQ ID NO: 103530 - RNA, 63 nt, Homo Sapiens
gaacauaaaaagauaccaauuugugcauuacauccucuagagguauguuccguggcaaugcuu

SEQ ID NO: 103531 - RNA, 63 nt, Homo Sapiens
uuggauaauaaagaugcuuaugcagagccauuuccucuagaaugcuaguagguucugcuguua

SEQ ID NO: 103532 - RNA, 63 nt, Homo Sapiens
uucugauucgguugaucuggccaugcagacucgccucuagagaccaagccucuauuauacaaa

SEQ ID NO: 103533 - RNA, 63 nt, Homo Sapiens
acuacagucagauuuauagccagccaucuaucaccucuagaagguuccagagacagugaaacu

SEQ ID NO: 103534 - RNA, 63 nt, Homo Sapiens
cuguuacaggggccucagagcaccuucguuucuccucuagaccagggacagguguagagauaa

SEQ ID NO: 103535 - RNA, 63 nt, Homo Sapiens
uuagaagguggaaaagccaagggaacggauucuccucuagagucuccggaaggaacacagcuc

SEQ ID NO: 103536 - RNA, 63 nt, Homo Sapiens
aguggcccuuggccgagcgccgaacucgcucgcccucuagauguccaagugccacgugaacua

SEQ ID NO: 103537 - RNA, 63 nt, Homo Sapiens
uuggagcauguggucuuuuuaaaaaauuguaacccucuagaaaauaucaaagaaaugaaccag

SEQ ID NO: 103538 - RNA, 63 nt, Homo Sapiens
agucuggcagaagccacgcuuguuccccauguaccucuagagaagcagaaaccaaaguccccc

SEQ ID NO: 103539 - RNA, 63 nt, Homo Sapiens
cccuggcuucuggccacugcccaucauuucucuccucuagaguuuuucugaaccccacaucug

SEQ ID NO: 103540 - RNA, 63 nt, Homo Sapiens
aguggcgauguuggcugauuacauaaauuaucuccucuagauguuucaggguagucaaaauaa

SEQ ID NO: 103541 - RNA, 63 nt, Homo Sapiens
uuaguggcgggucugggcugugagagacacccuccucuagaauaagaaaaaaguacugugacc

SEQ ID NO: 103542 - RNA, 63 nt, Homo Sapiens
guguaucuuuuuaugauuuauuggcagauaauuccucuagaaucuuugauaauuguuauuuuu

SEQ ID NO: 103543 - RNA, 63 nt, Homo Sapiens
aucagaugccuccugaagaauuacagacuucuuccucuagacuuggaggugagggacccucuc

SEQ ID NO: 103544 - RNA, 63 nt, Homo Sapiens
ugccugggcccaaggggugaugaggcauccuuuccucuagaagaccugagucuuccugaccga

SEQ ID NO: 103545 - RNA, 63 nt, Homo Sapiens
ucuagacaaaaaccauuguugaugaggcagaugccucuagaagagacguuuaaaagccaucaa

SEQ ID NO: 103546 - RNA, 63 nt, Homo Sapiens
ugugaugcuucuggggcacguugaccauaugcaccucuagaaccuaaccagggcuuccuucua

SEQ ID NO: 103547 - RNA, 63 nt, Homo Sapiens
gucauaccuagagauuuguggggggauacugaaccucuagacugaaguacuuaccggggagca

SEQ ID NO: 103548 - RNA, 63 nt, Homo Sapiens
ugagagcguuccuugaguccguacaccguccucccucuagaagcuggcaucacacucaugcug

SEQ ID NO: 103549 - RNA, 63 nt, Homo Sapiens
uugcauggaagagaacaccucuuuauggcuuacccucuagaauuucuaauuuauguguucugu

SEQ ID NO: 103550 - RNA, 63 nt, Homo Sapiens
cucaucggcaggcgcaugaguaucugugggaguccucuagagagaugagaagccaggaggccu

SEQ ID NO: 103551 - RNA, 63 nt, Homo Sapiens
ucaagcccauugcucucccacugcagaacauggccucuagauuaaugccaccgauucaggaac

SEQ ID NO: 103552 - RNA, 63 nt, Homo Sapiens
uagcaccugggucccagcaucuagagcauggagccucuagaagccaugcucacccgcccacau

SEQ ID NO: 103553 - RNA, 63 nt, Homo Sapiens
auggacaugaguccugugaggacuggugucucuccucuagagcuuucaucuuugggaugccug

SEQ ID NO: 103554 - RNA, 63 nt, Homo Sapiens
aggugcccuuacuauccauuccuucauugaugcccucuagauuaugccacuucaucuaggaaa

SEQ ID NO: 103555 - RNA, 63 nt, Homo Sapiens
agaauuugcaggcaaccauguuugcguuuacuuccucuagaaacaaaacauaaccauaugugu

SEQ ID NO: 103556 - RNA, 63 nt, Homo Sapiens
cauagccauacugcuaguuagucccaauaacugccucuagauacagcauccacgcaucucuug

SEQ ID NO: 103557 - RNA, 63 nt, Homo Sapiens
cacuaauuuuaccugaugcuaaaggcugccuuuccucuagagucgagugccgccuguacucac

SEQ ID NO: 103558 - RNA, 63 nt, Homo Sapiens
uauuguaacuacacugggcaucagaauaaaaggccucuagaaauugcugaacaaugguuaauu

SEQ ID NO: 103559 - RNA, 63 nt, Homo Sapiens
uucuucugugcuucucucuauuuugucauauugccucuagauuagcugaaucuaaguaugguu

SEQ ID NO: 103560 - RNA, 63 nt, Homo Sapiens
cuuugaauggagcguaaguaagcagacauuuggccucuagaucacgaggaacagagauggccc

SEQ ID NO: 103561 - RNA, 63 nt, Homo Sapiens
auuuguagcaguguuauucugccccugucuggcccucuagaugauuauguaacugugggccuu

SEQ ID NO: 103562 - RNA, 63 nt, Homo Sapiens
cagaaagcaauuuuuaggcacuguccuauauacccucuagaaacauucuccuauuuaccaguc

SEQ ID NO: 103563 - RNA, 63 nt, Homo Sapiens
cagaaccagcucuacgagagucguuucccuuuuccucuagaaggcagcuuugggaaagcugcc

SEQ ID NO: 103564 - RNA, 63 nt, Homo Sapiens
aggcuaccaggucucuaggggccugagagaggcccucuagagaauccagggaaacugugagcc

SEQ ID NO: 103565 - RNA, 63 nt, Homo Sapiens
auucccaucugcugcucuuuguagaaaagguuuccucuagaacugaauuccucuggaauugag

SEQ ID NO: 103566 - RNA, 63 nt, Homo Sapiens
guguaaacauugagcucaccuuuuauauauuaaccucuagaauuaaugggccuaugugguuuu

SEQ ID NO: 103567 - RNA, 63 nt, Homo Sapiens
ucuaguaugcugaaaacuguuauuuugaauuacccucuagacaauuaaguacaggaagagaca

SEQ ID NO: 103568 - RNA, 63 nt, Homo Sapiens
aaccugggaacagucacaagagguggcaguguaccucuagauccaucaccugcucuuuggcua

SEQ ID NO: 103569 - RNA, 63 nt, Homo Sapiens
uuuccgacuugggguucaggcaggcuguuuucaccucuagacaccccucuccaccccuccugc

SEQ ID NO: 103570 - RNA, 63 nt, Homo Sapiens
agauggggaccagcagccccacaccagggccagccucuagagcagacuacagcuggggugcag

SEQ ID NO: 103571 - RNA, 63 nt, Homo Sapiens
gacccucaggacacccucucugcacccugugguccucuagaguagcuagcucugaggccccaa

SEQ ID NO: 103572 - RNA, 63 nt, Homo Sapiens
cacuuguacaguuguagcugcgaguccagaaguccucuagagcauguguacuggcacugaguu

SEQ ID NO: 103573 - RNA, 63 nt, Homo Sapiens
ucaucgugaugcuucucugaaguucugcuacaaccucuagaucugcagcuugccacaucagcu

SEQ ID NO: 103574 - RNA, 63 nt, Homo Sapiens
cacuguaaucuccagcuccugggcucaagugauccucuagacucagccucuagaauagcuggg

SEQ ID NO: 103575 - RNA, 63 nt, Homo Sapiens
agcuccugggcucaagugauccucuagacucagccucuagaauagcugggacuacaggcacau

SEQ ID NO: 103576 - RNA, 63 nt, Homo Sapiens
aggcugcaguccuauagaaugcauaccuuccucccucuagacaucccuccaccagaagagaca

SEQ ID NO: 103577 - RNA, 63 nt, Homo Sapiens
gagcugauuggagucagcuggaacauaccacugccucuagacuaaggucagcagauuuagcaa

SEQ ID NO: 103578 - RNA, 63 nt, Homo Sapiens
uauguuuuuagaagcaagagcaaaauuaugaaaccucuagagauuugggucauguuacuccau

SEQ ID NO: 103579 - RNA, 63 nt, Homo Sapiens
aaaacuccugugcuuuugagcaaggacuuuugcccucuagaaagcaacugaggccaggugcgg

SEQ ID NO: 103580 - RNA, 63 nt, Homo Sapiens
gguuuguuugguuuuuuuaauucuuaaaaacauccucuagaggaauagaaacaaauuuuuaug

SEQ ID NO: 103581 - RNA, 63 nt, Homo Sapiens
uacugugucaaaaugauaauuuuguuauguuagccucuagaaaauuuaaguucagaaaaaugc

SEQ ID NO: 103582 - RNA, 63 nt, Homo Sapiens
ggaaaugguucaugugauaaugugggcugguauccucuagaguaccuggguacauaaacagaa

SEQ ID NO: 103583 - RNA, 63 nt, Homo Sapiens
cucuuccucacacccauuuagugggggauggguccucuagacuugaggggcuacccugggaag

SEQ ID NO: 103584 - RNA, 63 nt, Homo Sapiens
aaguucuguaauucuaaguguuguucuagauuuccucuagagaagguuauuagaaucuccauu

SEQ ID NO: 103585 - RNA, 63 nt, Homo Sapiens
guaccgcagaaauugaugugucugucuggucuuccucuagaagccuuucaacucuguugaccc

SEQ ID NO: 103586 - RNA, 63 nt, Homo Sapiens
gaaauaaaaguuugauguuuuaucuguaugugaccucuagaugaguugaaacaaacuuguaug

SEQ ID NO: 103587 - RNA, 63 nt, Homo Sapiens
gcugaguaccaugggcuacagcuaggcuacccuccucuagaagccacucagggcuucuccucu

SEQ ID NO: 103588 - RNA, 63 nt, Homo Sapiens
gacgugggccagccuccuugcugaauggccucgccucuagauuacuguuccacaaacagcagg

SEQ ID NO: 103589 - RNA, 63 nt, Homo Sapiens
aguuggguuggaggcucauugcccauccacucuccucuagagccuucccuggcuucuccuuca

SEQ ID NO: 103590 - RNA, 63 nt, Homo Sapiens
aaagauguuuguuuacauaacagugcccugagaccucuagagauguuacuuaaguuuguaaga

SEQ ID NO: 103591 - RNA, 59 nt, Homo Sapiens; identical to SEQ ID NO: 103372

SEQ ID NO: 103592 - RNA, 63 nt, Homo Sapiens
cauacauuuauauagcauugcauauuuuuuucuccucuagauuggagaaaccauuccaguaug

SEQ ID NO: 103593 - RNA, 63 nt, Homo Sapiens
ccagcuggcuccgagggcaacacaggggccuggccucuagagggcuggugauugaggggcccg

SEQ ID NO: 103594 - RNA, 63 nt, Homo Sapiens
augaaaaagaccuaaaaacagaaccaaagacagccucuagauuucuuacccucaagucuccug

SEQ ID NO: 103595 - RNA, 63 nt, Homo Sapiens
auaagauuuguaaaucaugggcuugaccuuugaccucuagacacuaauuuuauccuuugaggc

SEQ ID NO: 103596 - RNA, 63 nt, Homo Sapiens
auuucuagguuuguaagugcagcaguuuuauuuccucuagaacucauccuguuucaagggaag

SEQ ID NO: 103597 - RNA, 63 nt, Homo Sapiens
ugcuuaaugaucaaguguuacuuaucuaauaauccucuagaaagaacccuguuagaucuuggu

SEQ ID NO: 103598 - RNA, 63 nt, Homo Sapiens
gaagugggugcccuugguagcagccuggggugaccucuagagcuggaggcugugggacuccag

SEQ ID NO: 103599 - RNA, 63 nt, Homo Sapiens
agauggaauuuuuccagccucauccuggccugcccucuagacuccaguccccaagcccucagc

SEQ ID NO: 103600 - RNA, 63 nt, Homo Sapiens
agggcuaguucuauacuuaaagguuugugggccccucuagagggagcuuccuauuccauguug

SEQ ID NO: 103601 - RNA, 63 nt, Homo Sapiens
uuuuuuugggggaaaaagggagagcuauuagcuccucuagauaauuuuccaaagaauauucua

SEQ ID NO: 103602 - RNA, 63 nt, Homo Sapiens
uggauuguguuagaggaaucggcucuguauuugccucuagagaaacacaguguucucuuugua

SEQ ID NO: 103603 - RNA, 63 nt, Homo Sapiens
ucaaaaugccaagaucugggagccucuuucacuccucuagacacacugccugagauagaaguu

SEQ ID NO: 103604 - RNA, 63 nt, Homo Sapiens
ccuaguccugaguauaaauccugugcauagauuccucuagaaaggcaucaaaaggcucaacag

SEQ ID NO: 103605 - RNA, 63 nt, Homo Sapiens
aagaugucaguaggaugaccgcaggacauuggaccucuagagcgagcaagcuguagacggaca

SEQ ID NO: 103606 - RNA, 63 nt, Homo Sapiens
ggacuuuggccuccccccaaaagggugaagccaccucuagaagaacuggacuguuccugggaa

SEQ ID NO: 103607 - RNA, 63 nt, Homo Sapiens
gaggccaucucacuagaauaucucaguuuccuaccucuagaaauuaauaguaaagguaaaauc

SEQ ID NO: 103608 - RNA, 63 nt, Homo Sapiens
cccugauuuccccaggccuggaggacccuacccccucuagauuuuuucauuauaaaaugguua

SEQ ID NO: 103609 - RNA, 63 nt, Homo Sapiens
uugacugcaagagaaucucucugagggucagcuccucuagacaggacuuccucugagugaugc

SEQ ID NO: 103610 - RNA, 63 nt, Homo Sapiens
cuccugccacuagguuucaccucccaaacccagccucuagaacagccagacccugcagauccc

SEQ ID NO: 103611 - RNA, 63 nt, Homo Sapiens
guucuuugcauuuggcucuacuuacuaacaaccccucuagaauacauuggugauuucauuuaa

SEQ ID NO: 103612 - RNA, 61 nt, Homo Sapiens
aaagccacuuuccucuucagauccuggucugcaccucuagaggcagguccuaagaaggaga

SEQ ID NO: 103613 - RNA, 63 nt, Homo Sapiens
agccucucuuuugggggaaucaagcauuugcuuccucuagacuacagcagggaaagggaggag

SEQ ID NO: 103614 - RNA, 63 nt, Homo Sapiens
agacugauugaaguagacagcucuuuaagugcuccucuagacuaagacguuuucuaacuuuuu

SEQ ID NO: 103615 - RNA, 63 nt, Homo Sapiens
aauaagaucuuuuuugucagauacuuucccuacccucuagagaacaugaaaauucagaauuuu

SEQ ID NO: 103616 - RNA, 63 nt, Homo Sapiens
gguaacaaaucagccaauugucauacaguucagccucuagaaugugaaugguaguugaggucu

SEQ ID NO: 103617 - RNA, 63 nt, Homo Sapiens
cugccuuuuucaaauaucccaucuuugucuuuuccucuagaacagcaggguucaguuucaugu

SEQ ID NO: 103618 - RNA, 63 nt, Homo Sapiens
ggcugugugaccacuuucccccacccuucccacccucuagacaacucucucccuuaccuguuu

SEQ ID NO: 103619 - RNA, 63 nt, Homo Sapiens
gggguguacuaguuacacaucuucaacagacccccucuagaaauuuuucagaugcuucuggga

SEQ ID NO: 103620 - RNA, 63 nt, Homo Sapiens
cagcagcuguggucauuaaaccauuaguuuaccccucuagaacuggggucugcaaacucccac

SEQ ID NO: 103621 - RNA, 63 nt, Homo Sapiens
cugccuccccucuggucuccagaguuuuccuguccucuagaggcaagccaggccagggagcug

SEQ ID NO: 103622 - RNA, 63 nt, Homo Sapiens
gcuacagcacuaagagaagccccugagaaaaacccucuagaaaaacagcuguuccucugugug

SEQ ID NO: 103623 - RNA, 63 nt, Homo Sapiens
uaggcaggaaggacugucccagacgaggggcuuccucuagagucucacugcuggggaggagag

SEQ ID NO: 103624 - RNA, 63 nt, Homo Sapiens
ccagggccccagccugauggggcugcccucaguccucuagaucaagaugcugacuauuagggg

SEQ ID NO: 103625 - RNA, 63 nt, Homo Sapiens
agacuggaaaccuacccauuuuccccugagcauccucuagaugcugccccaaggaguugcugc

SEQ ID NO: 103626 - RNA, 63 nt, Homo Sapiens
uuucccucuguggccuccuggcuugcacugcucccucuagaaagauuccuucaggucuggagg

SEQ ID NO: 103627 - RNA, 63 nt, Homo Sapiens
agcuucccugccaaacucacaaggagacaucaaccucuagacagggaacagcuucaggauacu

SEQ ID NO: 103628 - RNA, 63 nt, Homo Sapiens
uaacuccccuuaaaaugucuauucuauuaaaagccucuagaagcgccuuguuaugcacaagag

SEQ ID NO: 103629 - RNA, 63 nt, Homo Sapiens
cacugauacacagaauauaacagucauuuuuaaccucuagaguugaagaacugucuauuuucu

SEQ ID NO: 103630 - RNA, 63 nt, Homo Sapiens
gaguaaaaaugaauuacacuuagaugggagaaaccucuagagacauaaaagauuuguacuguu

SEQ ID NO: 103631 - RNA, 63 nt, Homo Sapiens
ucuccacccucaucucucugaacuggcugucugccucuagaacguccuaggcccuagggaucc

SEQ ID NO: 103632 - RNA, 63 nt, Homo Sapiens
agagcucaacucucucccaauaccugggccccuccucuagagaucggagcccccucucagccu

SEQ ID NO: 103633 - RNA, 63 nt, Homo Sapiens
gguaagcuagaggauuguaaauaucuuuuauguccucuagauaaaacacccgauuaacagaug

SEQ ID NO: 103634 - RNA, 63 nt, Homo Sapiens
gagcggcugucacacucauugaaaugaaauggaccucuagaccaccuugugucuguuuccucu

SEQ ID NO: 103635 - RNA, 63 nt, Homo Sapiens
ccucauccccaccccaccucaccccaacaaacuccucuagaagaagccaagaauuucucucua

SEQ ID NO: 103636 - RNA, 63 nt, Homo Sapiens
augugccuguacccuccccuggucuacauaggaccucuagauaguguuagagagagaacaugu

SEQ ID NO: 103637 - RNA, 63 nt, Homo Sapiens
gcaaaagagaugucauucaguuaaaaagacaaaccucuagauguguaauuacauggaaaauac

SEQ ID NO: 103638 - RNA, 63 nt, Homo Sapiens
auuagcuguggcacaacacauacagcauugguuccucuagaucugguuaaaugcagaaugcag

SEQ ID NO: 103639 - RNA, 63 nt, Homo Sapiens
cuccucgcccuuucuuaaagugcaguucuuagcccucuagaaacgaguuggugucuuucgucu

SEQ ID NO: 103640 - RNA, 63 nt, Homo Sapiens
ccaaacaaccgugcucagccuguuucucucugcccucuagagcaaggcccaccagguccaucc

SEQ ID NO: 103641 - RNA, 63 nt, Homo Sapiens
uccucuccugcucugagccaggguggggcauucccucuagauucagguuugggcagggguccu

SEQ ID NO: 103642 - RNA, 63 nt, Homo Sapiens
aggccaaaugccaacucuguuagcccuaacuugccucuagaguucaaguuuccuaccagcaaa

SEQ ID NO: 103643 - RNA, 63 nt, Homo Sapiens
agaaucuucaagaaucaguuugcagaaaauuuuccucuagaucaaagccucuagcuucacugg

SEQ ID NO: 103644 - RNA, 63 nt, Homo Sapiens
uuuggcaauguugacuaagagucaaaccuuuauccucuagaauuagaaaaauguggauaaaca

SEQ ID NO: 103645 - RNA, 63 nt, Homo Sapiens
ccagauagaggcccauuccuuuccuaugaucauccucuagauaugccucuguccucauuuugu

SEQ ID NO: 103646 - RNA, 63 nt, Homo Sapiens
acucucccuuucuguuuuuuauaauacuuuguaccucuagagcuggauugccauuuucauuau

SEQ ID NO: 103647 - RNA, 63 nt, Homo Sapiens
acagaguugcuguuguuuuuuuugguguuuuccccucuagaaacuaccauuugaauauuuuca

SEQ ID NO: 103648 - RNA, 63 nt, Homo Sapiens
agggcuaaugcugcauuuuucuacaacaucaugccucuagaagguuuaagcuagguaggcuuu

SEQ ID NO: 103649 - RNA, 63 nt, Homo Sapiens
cuucagccuuaauggaagguuugaauacucugcccucuagagccuuggaccagaucuaacauc

SEQ ID NO: 103650 - RNA, 63 nt, Homo Sapiens
gagucugaggauguuaacuuuggaacucgcaguccucuagaacagcuucagauuauggcuuuu

SEQ ID NO: 103651 - RNA, 63 nt, Homo Sapiens
uucugauugagugcagaggagacuagacagucuccucuagacagguuguagacacacccuccc

SEQ ID NO: 103652 - RNA, 63 nt, Homo Sapiens
ugccagucagcuccuacagugaucaguuggccaccucuagaucuguguuugccggucuagacg

SEQ ID NO: 103653 - RNA, 63 nt, Homo Sapiens
cagagccugguagagacuagggaagggaggucuccucuagacugacucacauugccuugagcu

SEQ ID NO: 103654 - RNA, 63 nt, Homo Sapiens
aaaugaagaccuacuuucaacuccuuuuuccccccucuagaagaaucaaauugaaucuuuuac

SEQ ID NO: 103655 - RNA, 63 nt, Homo Sapiens
gacgaggagaucuaagcagcguucccacagcccccucuagauucuuggaguuccgcagagcuu

SEQ ID NO: 103656 - RNA, 63 nt, Homo Sapiens
aauaauuaguguuauagucuaugucaaaugcauccucuagaaauuuugugaaugagaguuggc

SEQ ID NO: 103657 - RNA, 63 nt, Homo Sapiens
gggcugcugucauagugaacaaugacauuaauaccucuagaaacuggagaauuaucacaaccu

SEQ ID NO: 103658 - RNA, 63 nt, Homo Sapiens
uauuuucuuacaguagauaaguauacauuccacccucuagaaggaacuugcagguccagguug

SEQ ID NO: 103659 - RNA, 63 nt, Homo Sapiens
uagguuaaacugaagcaacuugcauguacuaguccucuagaaauucccuguaguugacaauuc

SEQ ID NO: 103660 - RNA, 63 nt, Homo Sapiens
uugucugcucccacagcaccaucuaagaccccuccucuagaaguggggaaggccagaugugua

SEQ ID NO: 103661 - RNA, 63 nt, Homo Sapiens
ucaaucauguacuuuaguuuaauguauaaagauccucuagaaaaugauaauauuguguauuaa

SEQ ID NO: 103662 - RNA, 63 nt, Homo Sapiens
gcacacuucaaccccagcuugcuggucggcuuuccucuagagagagccgguuuuggggccauu

SEQ ID NO: 103663 - RNA, 63 nt, Homo Sapiens
uucuaagggugccaagagacugguuagucaaagccucuagaaggggauccucguugaaaggag

SEQ ID NO: 103664 - RNA, 63 nt, Homo Sapiens
aguguagggucacugggagagcagaggucacagccucuagagaagggagaggggcgugugcau

SEQ ID NO: 103665 - RNA, 63 nt, Homo Sapiens
agggcugacccucucugcaaaacucuccccuguccucuagaccccacccuggguguaugugag

SEQ ID NO: 103666 - RNA, 63 nt, Homo Sapiens
ggcugggaagggccguucuggcccccaaccuacccucuagaggccugggccuggugagcuacu

SEQ ID NO: 103667 - RNA, 63 nt, Homo Sapiens
aaccugacauuuacaauggaggccucucaccccccucuagagaugagguguccgcugacgggu

SEQ ID NO: 103668 - RNA, 63 nt, Homo Sapiens
gaccagcugccuuugagaccgcuuaccuuucaaccucuagagaccagcaccuuagggccaggg

SEQ ID NO: 103669 - RNA, 63 nt, Homo Sapiens
uuaaaccuaggccugugauacuugggcugugauccucuagagccagcuuggacucacaucauu

SEQ ID NO: 103670 - RNA, 63 nt, Homo Sapiens
cuggcaaguguccagaugccagaaccuucuuuuccucuagaagggauggugcuugguaaccuu

SEQ ID NO: 103671 - RNA, 63 nt, Homo Sapiens
ccucagccgcucuuugcuccagaccugccccucccucuagaggcugccugggccuguucacgu

SEQ ID NO: 103672 - RNA, 63 nt, Homo Sapiens
aucaugauuccuguagguaaaaguacaagacgaccucuagaugucuuuucuuucuaugaaagg

SEQ ID NO: 103673 - RNA, 63 nt, Homo Sapiens
aggggcccagucguucuugggcccaggauggggccucuagacuugcaagggagaggaacaggg

SEQ ID NO: 103674 - RNA, 63 nt, Homo Sapiens
cacccagcggcgacauuguacagacuccucucaccucuagauagcaaauagcucucagauggu

SEQ ID NO: 103675 - RNA, 63 nt, Homo Sapiens
caaggaggggaggaacacugggaagucagcaugccucuagaggcagggcucugugaccaggaa

SEQ ID NO: 103676 - RNA, 63 nt, Homo Sapiens
agcugguggccagggaugaauuggggcccagccccucuagaguugugugagaggucuccuggg

SEQ ID NO: 103677 - RNA, 63 nt, Homo Sapiens
auguuauauucuauaucagaauuuauggaguuuccucuagaucauugaaauauaaaaaccuag

SEQ ID NO: 103678 - RNA, 63 nt, Homo Sapiens
ucgggagcccggagggucuuucaggaccaccuuccucuagagcuucucugcucccaaaccaug

SEQ ID NO: 103679 - RNA, 63 nt, Homo Sapiens
auuccccuggcaugaaacuuucagauuccccugccucuagaaauuguccugcccuccucacca

SEQ ID NO: 103680 - RNA, 63 nt, Homo Sapiens
ccacccuugacugguugggauuugcucguccagccucuagacacuucccaaagcaagacugga

SEQ ID NO: 103681 - RNA, 63 nt, Homo Sapiens
uaacccaugguucucagcuggggugacacugcuccucuagaagcagguuugaaauuaugggua

SEQ ID NO: 103682 - RNA, 63 nt, Homo Sapiens
cuugacuuacgaucguuauuucaccuucgggugccucuagacacagaauacuucuccucuucc

SEQ ID NO: 103683 - RNA, 63 nt, Homo Sapiens
cugccacaggguccuccgaugcuggccuuugcgccucuagaggcagccacucauggauucaag

SEQ ID NO: 103684 - RNA, 63 nt, Homo Sapiens
uuggccaucccaccuaucccuuacccuucccugccucuagagccacuguucucacuacuucua

SEQ ID NO: 103685 - RNA, 63 nt, Homo Sapiens
agaggggacugcuguacaaagaauauaggaaggccucuagacuacauccauuccuuccucaac

SEQ ID NO: 103686 - RNA, 63 nt, Homo Sapiens
ugugcugagcaaacguggagacaccauuucccuccucuagaccucaucuuggagagagagaug

SEQ ID NO: 103687 - RNA, 63 nt, Homo Sapiens
aaggcaggcagccccgacaugccccagccaucuccucuagaccacuucacccugugggaagug

SEQ ID NO: 103688 - RNA, 63 nt, Homo Sapiens
uauaaguucugguuuauguugaaucccauuuuaccucuagacccuuugaccucugccccccau

SEQ ID NO: 103689 - RNA, 63 nt, Homo Sapiens
acuucagguuuuuuuccuuucauuuguguuccaccucuagauuaguucucuaauauuuuaccu

SEQ ID NO: 103690 - RNA, 63 nt, Homo Sapiens
gugaauauaugaaaggagucaucuuccaacuguccucuagagugaaaaaauaaaagugggaaa

SEQ ID NO: 103691 - RNA, 63 nt, Homo Sapiens
uuuugccauaauacaugccagauaucguagucuccucuagauacuuaugaaauccuauuggug

SEQ ID NO: 103692 - RNA, 63 nt, Homo Sapiens
gaauaauguagaaacauuuucuuguuaauaauuccucuagauauggcucaaaacagaauuuau

SEQ ID NO: 103693 - RNA, 63 nt, Homo Sapiens
caccuguucucacgcccuguuguuagaguuagaccucuagacuuucaaaugcacggugguccc

SEQ ID NO: 103694 - RNA, 63 nt, Homo Sapiens
uuucaaaucucucccaacucaauucaagguccuccucuagaagcucccaucuccuuucagaaa

SEQ ID NO: 103695 - RNA, 63 nt, Homo Sapiens
cauauuggcugucaucaaagaguuggagaaaccccucuagaaauaaggcccuggguucaagag

SEQ ID NO: 103696 - RNA, 63 nt, Homo Sapiens
caggaguggaagugugggugaugcaaguagaacccucuagauguacccuguguggucugcagg

SEQ ID NO: 103697 - RNA, 63 nt, Homo Sapiens
gcugggaugaccuucccuggguuaaucaauuucccucuagacaacacaaacugcaggcaugug

SEQ ID NO: 103698 - RNA, 63 nt, Homo Sapiens
acucuaggcuuuuaucuugcggggucagagcgcccucuagagggaaaagcuagaggcacaggg

SEQ ID NO: 103699 - RNA, 63 nt, Homo Sapiens
caucucuuccagcaccaucaggguuuuaauggcccucuagaauuaccacugagauacacuauu

SEQ ID NO: 103700 - RNA, 63 nt, Homo Sapiens
ccaagaugugaacagugcacucuuuguucuugaccucuagaccuaguaacgucuugucuguga

SEQ ID NO: 103701 - RNA, 63 nt, Homo Sapiens
aauugcccaagaagcccaccucaccuuggaugaccucuagagaucuuggagacacagaggguu

SEQ ID NO: 103702 - RNA, 63 nt, Homo Sapiens
caugaaggcccacauagucaggagaagaaaaauccucuagacaucucaagguaguuauaugcu

SEQ ID NO: 103703 - RNA, 63 nt, Homo Sapiens
gccacaguaggccucucuuuagggguccuugggccucuagaaggugaagaaucugggccaacc

SEQ ID NO: 103704 - RNA, 63 nt, Homo Sapiens
uguaagaaauaaauauuugcuuggacuucccagccucuagaacaaucugcuggugccuugauc

SEQ ID NO: 103705 - RNA, 63 nt, Homo Sapiens
cuaacccugggaaaagggcaccuuaguuuggauccucuagaaagcaagggcccaaggacagug

SEQ ID NO: 103706 - RNA, 63 nt, Homo Sapiens
auaaauuuaugaaaauacaauuaucuucuucucccucuagaaucuguauaacuuauuuucuua

SEQ ID NO: 103707 - RNA, 63 nt, Homo Sapiens
guaguugucacguuaucuuugggugcacccuuuccucuagauggcucucggcuucucugcuga

SEQ ID NO: 103708 - RNA, 63 nt, Homo Sapiens
aggcgugacccaggccccuguagcccucagccuccucuagaagcuucuguacuccuuguagga

SEQ ID NO: 103709 - RNA, 63 nt, Homo Sapiens
cugccguggccacccccgcugcccagugucugcccucuagaaguaggcuguguuuccaggugu

SEQ ID NO: 103710 - RNA, 63 nt, Homo Sapiens
ugggcuccguccucggcguuaagaggccccacgccucuagagcucgcagggucccaggcccag

SEQ ID NO: 103711 - RNA, 63 nt, Homo Sapiens
caaaaaaauacagagucauccccuacccccaccccucuagagacccuccagcuaaaaacagag

SEQ ID NO: 103712 - RNA, 63 nt, Homo Sapiens
ggaagaggcugggggacuagaaagaggcccugcccucuagaaagcucagaucuuggcuucugu

SEQ ID NO: 103713 - RNA, 63 nt, Homo Sapiens
uaguuggcugccaaucucccugcucuugguucuccucuagauugaaguuuguuuucugaugcu

SEQ ID NO: 103714 - RNA, 63 nt, Homo Sapiens
cuuuguaguuaaaggguccaguucugacuggagccucuagagagcugggcuuguauguucuuu

SEQ ID NO: 103715 - RNA, 63 nt, Homo Sapiens
gccccucuuucuuggggacccaguauguccucuccucuagacccagacauacaguuauaaccg

SEQ ID NO: 103716 - RNA, 63 nt, Homo Sapiens
cuccccauguuucgguaauccuuaagccuuuuuccucuagauacugcaguuagcaaacuuuug

SEQ ID NO: 103717 - RNA, 63 nt, Homo Sapiens
gcaaauccaguuuccuggagcccuuugagcugcccucuagagaguggauugugagugaauggg

SEQ ID NO: 103718 - RNA, 63 nt, Homo Sapiens
aacuccuaggcucaagcaguccuccugccuuagccucuagaguagcuggggcuacaggugcug

SEQ ID NO: 103719 - RNA, 63 nt, Homo Sapiens
guacacaucagcauaugagaaucucugagagguccucuagaaaggagagaaaaagcaccucuu

SEQ ID NO: 103720 - RNA, 63 nt, Homo Sapiens
uaugagacauguggauggcagugagagaucgugccucuagaucuugauggaggcuuggugaga

SEQ ID NO: 103721 - RNA, 63 nt, Homo Sapiens
acacuucaucgugaggagcuguugggugucuugccucuagaggcuuugagaagcucagcugcc

SEQ ID NO: 103722 - RNA, 63 nt, Homo Sapiens
aaagaaaaguguuuuuagaauguuugagagugaccucuagaaaaaacuauagugauauaucag

SEQ ID NO: 103723 - RNA, 63 nt, Homo Sapiens
ccuggggccucacccuguauggcaaacacuuucccucuagaucugcauugcagcaugaggcag

SEQ ID NO: 103724 - RNA, 63 nt, Homo Sapiens
uuuaagccuuuguugaacuguggugguuuucaaccucuagaaucaguugugcaggagguagcc

SEQ ID NO: 103725 - RNA, 63 nt, Homo Sapiens
gcugucuaacauaccacaugcauauaccugauuccucuagaaguaguuuggaguaagggacuu

SEQ ID NO: 103726 - RNA, 63 nt, Homo Sapiens
aaacuauagugauauaucaguguuugggagugaccucuagaaaaaagaaaacuguuuuuagaa

SEQ ID NO: 103727 - RNA, 64 nt, Homo Sapiens
guagcugccuauaugcaguugaaauuagcagcccucugcauaauccuuccauuuuuuaaaauaa

SEQ ID NO: 103728 - RNA, 64 nt, Homo Sapiens
gacacucaucaagacugaagcacuaauaaugaagucugcauagugaucucagcauaauaaugcu

SEQ ID NO: 103729 - RNA, 64 nt, Homo Sapiens
aaggaaaagcacaagaaacuuuggaagcacuuuuucugcauacuuagaugaucuucaugggccc

SEQ ID NO: 103730 - RNA, 64 nt, Homo Sapiens
gaugacuuaaggugaagugaggacaaaaucacauucugcauacuaaccuauuuuuuucucccuu

SEQ ID NO: 103731 - RNA, 64 nt, Homo Sapiens
agggcacaccuagacaaacaagggagaagagugucagaaucagaaucauggagaaaaugggcgg

SEQ ID NO: 103732 - RNA, 64 nt, Homo Sapiens
caccuagacaaacaagggagaagagugucagaaucagaaucauggagaaaaugggcgggggugg

SEQ ID NO: 103733 - RNA, 64 nt, Homo Sapiens
cuaagccauguaugaggguaacagaauuuaguaacagaaucaaaauuugauuaaauaaugauuc

SEQ ID NO: 103734 - RNA, 64 nt, Homo Sapiens
gaaaaauccugccuaaggcauagucagacacaaucagaaucacaauuaagauaucuucagcuug

SEQ ID NO: 103735 - RNA, 64 nt, Homo Sapiens
ucaccaguuaagcacaugagaggaucuauuucuacagaaucauuaaaugagaugcagaaucaga

SEQ ID NO: 103736 - RNA, 64 nt, Homo Sapiens
aggaucuauuucuacagaauaaggaaaugagaugcagaaucagaccuccuguuguaguugccau

SEQ ID NO: 103737 - RNA, 64 nt, Homo Sapiens
gugggaggcaaaagacacuuggcuggggaggccucagaaucauguuggacuuaaaguuccacau

SEQ ID NO: 103738 - RNA, 64 nt, Homo Sapiens
gcgggaggugaaaggcacuuggcuggggaggccucagaaucauguuggacuuacaguuccacau

SEQ ID NO: 103739 - RNA, 64 nt, Homo Sapiens
agacauaggaacugagcacauuugaucagaaucacagaaucaucaucagagucacagaguagaa

SEQ ID NO: 103740 - RNA, 64 nt, Homo Sapiens
gaaucaucagacauaggaacgaguagaauuugaucagaaucacacaaauuugaucagagucaca

SEQ ID NO: 103741 - RNA, 64 nt, Homo Sapiens
ggggagaacauacagcccagagcauccuguuaaucagaaucauggagggagguuauaauaauag

SEQ ID NO: 103742 - RNA, 64 nt, Homo Sapiens
uggaaggcuuguuaaaacccaauuuagcuuacaucagaaucacuguguaucucaggggcuucca

SEQ ID NO: 103743 - RNA, 64 nt, Homo Sapiens
aaacaaauacauuuuaauuauaaacaaucuguaacagaaucaagaucaagaaacaaauuuuaau

SEQ ID NO: 103744 - RNA, 64 nt, Homo Sapiens
aaacaaauuuuaauuaaacacuccauguauauaacagaaucaagcaucccuuuucacaugguuu

SEQ ID NO: 103745 - RNA, 64 nt, Homo Sapiens
gugugucuuuucauaagguuuuugcuauauugcacagaaucaguuuacaguguuuucuuaucaa

SEQ ID NO: 103746 - RNA, 64 nt, Homo Sapiens
auccuugaaauuucugguagcauucucuaguggccagaaucauuaguauugccaaugcuguuuu

SEQ ID NO: 103747 - RNA, 64 nt, Homo Sapiens
aacaaacaaaaaaacaaaaacaaaaaaacaaaaccagaaucagguaaaacagcuaugugauuaa

SEQ ID NO: 103748 - RNA, 64 nt, Homo Sapiens
agugguaucaagagaacuuugguggugguuucuucagaaucaugaaguucuuuugccagauaaa

SEQ ID NO: 103749 - RNA, 64 nt, Homo Sapiens
uuggacuuacaguuccacaugacuggggaggccucagaaucauggugggaggcaaaaagcacuu

SEQ ID NO: 103750 - RNA, 64 nt, Homo Sapiens
uuggacuuacaguuccacauggccggggaggccucagaaucauggcgggaggugaaaagcacuu

SEQ ID NO: 103751 - RNA, 64 nt, Homo Sapiens
gcuucggccaccugugcaauuuuuuuacuuuugucagaaucaaggcaaaagugauguuauaguu

SEQ ID NO: 103752 - RNA, 64 nt, Homo Sapiens
ucaggagaaaaccaacuaaguguuuuuuaggaaucagaaucauuuuuugcuauagacucauuca

SEQ ID NO: 103753 - RNA, 64 nt, Homo Sapiens
ucuuggagagucuuggggauuguuggcaccuaaacagaaucagugacccgggugcuuuguggcc

SEQ ID NO: 103754 - RNA, 64 nt, Homo Sapiens
aaucagugacccgggugcuuuguggccagcagcacagaaucaaacccgcaucccagcauugggc

SEQ ID NO: 103755 - RNA, 64 nt, Homo Sapiens
acuguagccaccuaaguaggacauuauaugauuucagaaucaauauguggaacuucuuuaagca

SEQ ID NO: 103756 - RNA, 64 nt, Homo Sapiens
acucugccuggccuaccacuaacuugaauacauucagaaucaccuccucuccccaaaauuugua

SEQ ID NO: 103757 - RNA, 64 nt, Homo Sapiens
ucuugaaagacgaaaucaaagcccauuaaugauucagaaucagugcuugaccuccuguauucug

SEQ ID NO: 103758 - RNA, 64 nt, Homo Sapiens
aguucauugggggaaaaaaaauaagaagauucaacagaaucagcauuugaaguguaccauuggu

SEQ ID NO: 103759 - RNA, 64 nt, Homo Sapiens
ggcaugugugccuggcccagguuucuuaauaaaacagaaucaugaucuuccagguuccccccag

SEQ ID NO: 103760 - RNA, 64 nt, Homo Sapiens
uaaaacacuuuccaaauaucugcacuucugaugucagaaucaaaccagauaauucucuaauucu

SEQ ID NO: 103761 - RNA, 64 nt, Homo Sapiens
auugauauaaaaauaaaagaacuggaaccagauucagaaucaugaaaacaacauuuuuacaaca

SEQ ID NO: 103762 - RNA, 64 nt, Homo Sapiens
caguuuuauuuuucucugauuuuuuuuaauaccacagaaucaccugagugucaauugaaaguug

SEQ ID NO: 103763 - RNA, 64 nt, Homo Sapiens
gcugacucaggaucuccuggaaacaaaccagagacagaaucaguauggaacccuuucccguauu

SEQ ID NO: 103764 - RNA, 64 nt, Homo Sapiens
guaucuugcccuauaagauaauccuaagugaguucagaaucagggauacagcucaugccaaccc

SEQ ID NO: 103765 - RNA, 64 nt, Homo Sapiens
gcaagacagaccaccagccagaaaucucugauaucaaccucaugucccccaccccucaccccau

SEQ ID NO: 103766 - RNA, 64 nt, Homo Sapiens
gacuuccucauucauugagcuuuuuaaaagaucacaaccucaagaugguuaaaauccauugaca

SEQ ID NO: 103767 - RNA, 53 nt, Homo Sapiens
cuccugugacgcccuccuagagccaaccucaguugaugccuucccagagucaa

SEQ ID NO: 103768 - RNA, 64 nt, Homo Sapiens
ccagagccaaccucgggugacacccucccagagucaaccucaugugacaccuuaccggaguaaa

SEQ ID NO: 103769 - RNA, 64 nt, Homo Sapiens
uuuuuaaccacuccgcacaucagugcugugaaggcaaccucaccauguauuuucuucauaaucu

SEQ ID NO: 103770 - RNA, 64 nt, Homo Sapiens
uuacugaagccgacuccccuccccaucucccucucaaccucaacccaccugcaugcaucucccc

SEQ ID NO: 103771 - RNA, 53 nt, Homo Sapiens
aacugagauugaaucgguaaaaacaaccucagggguccauaaacaauaucugc

SEQ ID NO: 103772 - RNA, 64 nt, Homo Sapiens
uaacuauuucaaaaauuacugccuuuaaaaaaaacaaccucaagcuauauuuguauucauaauu

SEQ ID NO: 103773 - RNA, 64 nt, Homo Sapiens
uuuuuuuuucuuucuuucuuugguccuccaaccucaaccucaguucgaccucccgaagcucaga

SEQ ID NO: 103774 - RNA, 64 nt, Homo Sapiens
cucaguuuuuuuuuucuuuccucagaugguccuccaaccucaacgcaaccucgaccucccgaag

SEQ ID NO: 103775 - RNA, 64 nt, Homo Sapiens
acgaggccacagcugccaucgaccuggagacugacaaccucauccaggcuaccauccgcaccca

SEQ ID NO: 103776 - RNA, 64 nt, Homo Sapiens
acaaaggaguaguagcugaauuugauucuccagccaaccucauugcagcuagaggcaucuucua

SEQ ID NO: 103777 - RNA, 59 nt, Homo Sapiens
cuugcuucccccagggcagcacaggcuaagucaggaacaucggaugccagggagggagg

SEQ ID NO: 103778 - RNA, 59 nt, Homo Sapiens
cacacaguaggugcugagaguuaggacaggucaggaagucccccaggguccacaaaggu

SEQ ID NO: 103779 - RNA, 59 nt, Homo Sapiens
cuagaaaaacggguaguaaacuguggauagucaggaaaacacccagcaagggacacagc

SEQ ID NO: 103780 - RNA, 59 nt, Homo Sapiens
caggaaaacacccagcaagggacacagcugucaggaaaugaaucuuccccccaaccccc

SEQ ID NO: 103781 - RNA, 59 nt, Homo Sapiens
ggucuagaaguguacggucacggggccuagucaggaagcuugucaguauccguccugaa

SEQ ID NO: 103782 - RNA, 59 nt, Homo Sapiens
gggaaggggagugggggcacuuuucuucugucaggaauguauucagaagaucuuuugca

SEQ ID NO: 103783 - RNA, 59 nt, Homo Sapiens
uggcaagggacggagaggucccaacaggagucaggaagagguuugauuauaaccaagaa

SEQ ID NO: 103784 - RNA, 59 nt, Homo Sapiens
cuguuuucauggguccuguagauguuugagucaggaagguaaggcggggagugacugaa

SEQ ID NO: 103785 - RNA, 59 nt, Homo Sapiens
gaggugcuguuaugagcagcgccagcucugucaggaaagagcacauugauuuuucaaaa

SEQ ID NO: 103786 - RNA, 59 nt, Homo Sapiens
cagaaagggcuugaaauuuaagaauuguagucaggaaaauuuuuaaauuuuuuaugggu

SEQ ID NO: 103787 - RNA, 59 nt, Homo Sapiens
gcuguaggaggaggcagggauuccagggugucaggaaggcaggggugccaggucccacc

SEQ ID NO: 103788 - RNA, 59 nt, Homo Sapiens
gcucuaggaggaggcagggacuccagggugucaggaaggcaggggugccgggucccacc

SEQ ID NO: 103789 - RNA, 59 nt, Homo Sapiens
gaaaagaaacuuaguucuacauacaugaagucaggaaaacugaggugggucugaaauuc

SEQ ID NO: 103790 - RNA, 59 nt, Homo Sapiens
aacaaacuucaauuaaauguagacauacagucaggaaagauucugacuugcagaaaugc

SEQ ID NO: 103791 - RNA, 59 nt, Homo Sapiens
uaggaaggccuuuaggcagaccuuugaaugucaggaaugaauucacacuggugagaaac

SEQ ID NO: 103792 - RNA, 59 nt, Homo Sapiens
cagcaaggccuuuaagcagaccuaugaaugucaggaauggaacucauacuaaugagaaa

SEQ ID NO: 103793 - RNA, 59 nt, Homo Sapiens
ccgugggcuuccugcccucacgacuccaagucaggaauaccccuccguucugucucccu

SEQ ID NO: 103794 - RNA, 59 nt, Homo Sapiens
caguuuauucuacuccaagaugccccuuagucaggaauggcugaggcuucauucagucc

SEQ ID NO: 103795 - RNA, 64 nt, Homo Sapiens
guuuugcuaucauugcuaagagauucccgcugauugggcucagugccagcuguuauucugcuuc

SEQ ID NO: 103796 - RNA, 64 nt, Homo Sapiens
ugagugcccucuuaguuggugugugaggucuuggugggcucaggccagcuguuugcgagugugg

SEQ ID NO: 103797 - RNA, 64 nt, Homo Sapiens
ccuagcugcauggggugcagguggggugagucccugggcucagucugggcucagaccuagcagc

SEQ ID NO: 103798 - RNA, 64 nt, Homo Sapiens
ccuagcagcguggggugaguaugggcugagucccugggcucagagugaaugggucuacaccugc

SEQ ID NO: 103799 - RNA, 64 nt, Homo Sapiens
gguacagucacggcucacaaaagccuugaccuccugggcucaggugauccucccaccucagccu

SEQ ID NO: 103800 - RNA, 64 nt, Homo Sapiens
ggcaccaucuuggcucacugcagccucugccuccugggcucaaacaguccucccaccucagccu

SEQ ID NO: 103801 - RNA, 64 nt, Homo Sapiens
ccauucuccugccucagccucaagcucugccuccugggcucacaggcgcgaucuccgcucacug

SEQ ID NO: 103802 - RNA, 64 nt, Homo Sapiens
caauccacccaccucugccuuggucucaaacuccugggcucaaguuuucccauguugcucaugc

SEQ ID NO: 103803 - RNA, 64 nt, Homo Sapiens
cgcuuggcguguggaucucuggagagcaggaugcugggcucaaguggucucagcggcaggugga

SEQ ID NO: 103804 - RNA, 64 nt, Homo Sapiens
agaugcugucuuaauuugugugacaggcucagcaugggcucagcgguuucccaguuguugacug

SEQ ID NO: 103805 - RNA, 64 nt, Homo Sapiens
caauccuccugccucggccuuggucucaaccuccugggcucaaguuucaccauguugcccaggc

SEQ ID NO: 103806 - RNA, 64 nt, Homo Sapiens
caauucucccaccucagccucaaccucugccuccugggcucaagggcgcaaucucggcucacug

SEQ ID NO: 103807 - RNA, 64 nt, Homo Sapiens
gagggagcacuggugggugccuuccagguggugcugggcucaccagcgacccagcuucccucca

SEQ ID NO: 103808 - RNA, 64 nt, Homo Sapiens
ucuguaauucucccaggagcgcccagagaugcccugggcucagaagcaggaacccuuuccaaaa

SEQ ID NO: 103809 - RNA, 64 nt, Homo Sapiens
cauuucuccuaccucggccuuggucuugaacuccugggcucaaguguagaaacaaaguccaggc

SEQ ID NO: 103810 - RNA, 64 nt, Homo Sapiens
uaguggaauuaaauauaccuucauaauacuuuuuugggcucauguccuggcaagaucucugauu

SEQ ID NO: 103811 - RNA, 64 nt, Homo Sapiens
ggguugaucauggcucacugcauccuugacuuccugggcucaagugauccaccucagccugccu

SEQ ID NO: 103812 - RNA, 64 nt, Homo Sapiens
uucacuauguugaccaagcuggucuuggaacuccugggcucaagugauccuccugccuuggccu

SEQ ID NO: 103813 - RNA, 64 nt, Homo Sapiens
uugucuauuuuccuuucaaaauugguauuuuuguugggcucaauuuucauuauaauacuuuucu

SEQ ID NO: 103814 - RNA, 64 nt, Homo Sapiens
ggcacaaucuuggcucacugcaaccucugccuccugggcucaacggauccuuccaccucagccu

SEQ ID NO: 103815 - RNA, 64 nt, Homo Sapiens
uuuugccaaguugcccaggcugaucuugaacuccugggcucaagccauccucccuccucagccu

SEQ ID NO: 103816 - RNA, 64 nt, Homo Sapiens
guccugggugugaguguuccuguguaacaagaacugggcucaacgguccagcuguuucuaugga

SEQ ID NO: 103817 - RNA, 64 nt, Homo Sapiens
ggcaugaucaugguucacuucaaccccuaccuccugggcucaaguguuccucucaccuuauccu

SEQ ID NO: 103818 - RNA, 64 nt, Homo Sapiens
uuucucuguguugcccagucuugucucaaacuccugggcucaagcgauccacccaccuugggcu

SEQ ID NO: 103819 - RNA, 64 nt, Homo Sapiens
ucuaaggaugggaggggaacuugguuuaucugggugggcucagugaccccuuggaauggcugag

SEQ ID NO: 103820 - RNA, 64 nt, Homo Sapiens
gaggaagccgucgcggggaccaugcugccuucucugggcucacgacuguucuggaaaggacccc

SEQ ID NO: 103821 - RNA, 64 nt, Homo Sapiens
ugggcccaaggcacagccagacguagugcucucaugggcucaccacugcuccccccauuugcug

SEQ ID NO: 103822 - RNA, 64 nt, Homo Sapiens
uuccaagacucagcugccuaugccagguccagccugggcucaggcuccuaccacugagcgccuu

SEQ ID NO: 103823 - RNA, 64 nt, Homo Sapiens
cucuuucucccaggcagggcucugcagguccauaugggcucaaugucaccacccucugcauggc

SEQ ID NO: 103824 - RNA, 64 nt, Homo Sapiens
uggguggaacaggcaugugacagaguggggagccugggcucagcuccucccccugccguugguu

SEQ ID NO: 103825 - RNA, 64 nt, Homo Sapiens
cgaugcuccugcuucagccuuaguuucaaacuccugggcucaagucuugcuauguugcccaagc

SEQ ID NO: 103826 - RNA, 64 nt, Homo Sapiens
ccuuccucccgccucagccucagccccgaacuacugggcucaagggcacaaucauggcucacug

SEQ ID NO: 103827 - RNA, 64 nt, Homo Sapiens
gaugacaggacagacugguggugaggagucuaagugggcucaguuugaugucagugucugggcu

SEQ ID NO: 103828 - RNA, 64 nt, Homo Sapiens
ggagucuaagugggcucaguuugaugucagugucugggcucaugacuuguaaauggaagcugau

SEQ ID NO: 103829 - RNA, 64 nt, Homo Sapiens
gcacccuggaggagaagggcgcaaaggugccauaugggcucacaaggggugccuuuccuaauuu

SEQ ID NO: 103830 - RNA, 64 nt, Homo Sapiens
gauuccuggccagcuccugccaguaccugccccaugggcucaagcuggguucuuacuucucagc

SEQ ID NO: 103831 - RNA, 64 nt, Homo Sapiens
ugauccuuccacuucagccucauccucaacuuccugggcucaaguggugcaaucuggcucacug

SEQ ID NO: 103832 - RNA, 64 nt, Homo Sapiens
cacaggccuuccugguuggaaccugaucuguagcugggcucagccuccagggccugcgggcaua

SEQ ID NO: 103833 - RNA, 64 nt, Homo Sapiens
uuaaagaugguguauguuuguaaaaauauucuucugggcucaaaagcuagcuugagggggcaga

SEQ ID NO: 103834 - RNA, 64 nt, Homo Sapiens
aaagcucaagaaccugcacgagggccuaaaacagugggcucagcuuuggcugugcauuggaauc

SEQ ID NO: 103835 - RNA, 64 nt, Homo Sapiens
ugauccucccuccuuggccuuggucuugaacuucugggcucaagucucacuauguugcccaggc

SEQ ID NO: 103836 - RNA, 64 nt, Homo Sapiens
ugauucuuccaccuaaauuuuacccuguuccuccugggcucaaggguacaagcacaguucacug

SEQ ID NO: 103837 - RNA, 64 nt, Homo Sapiens
gggacuggugaugggacaaucaacuccuguucuuugggcucaagaggagcaaaugcuggaugag

SEQ ID NO: 103838 - RNA, 64 nt, Homo Sapiens
uucccaaggguaacucuuggauaucuggccacacugggcucacagcuucucuugaaaacuuggu

SEQ ID NO: 103839 - RNA, 64 nt, Homo Sapiens
gacacaaucauagcucacugcagccuuuaacuacugggcucaagacauccuccugcuucagccu

SEQ ID NO: 103840 - RNA, 64 nt, Homo Sapiens
ucuugcuauguugcccaggcuggucuugaacuccugggcucaugcaauccuccugccuuggccu

SEQ ID NO: 103841 - RNA, 64 nt, Homo Sapiens
acugcguguccucugaagcagugaagucugugccuaugccgagcgcgcuaagaagucucccuuc

SEQ ID NO: 103842 - RNA, 64 nt, Homo Sapiens
caaggcggaacaugggugaagagcagucuguccuuaugccgaaugaggacccaaggccccacug

SEQ ID NO: 103843 - RNA, 64 nt, Homo Sapiens
cugggacaauaaaguuguuugguuuuuauucccauaugccgauuauaggauugacuaguuuacu

SEQ ID NO: 103844 - RNA, 64 nt, Homo Sapiens
aaauaacuccauugaacagcaucuauucagaaacuaugccgaauaaaaagauugguggaagggc

SEQ ID NO: 103845 - RNA, 64 nt, Homo Sapiens
ccuugugucaggaaaaaaugugggguaugccaaguaugccgauagaauaagugcuaaugaugcc

SEQ ID NO: 103846 - RNA, 64 nt, Homo Sapiens
ccaagcacacagucuuucuauuaaugauauuaaauaugccgaagaggaugauucuauauauucu

SEQ ID NO: 103847 - RNA, 64 nt, Homo Sapiens
guuacuuauaacacacacacacacaucugaaauauaugccgaaaauugacgucuuugaccucag

SEQ ID NO: 103848 - RNA, 64 nt, Homo Sapiens
cuaacuacagaugacuuuuucaggaucucauuaauaugccgaacguccauaaaugcucagugcu

SEQ ID NO: 103849 - RNA, 64 nt, Homo Sapiens
uaaaguccaauuaaaauauggaaauguaaaaguguaugccgaauaccuuaaaguaacuaauuau

SEQ ID NO: 103850 - RNA, 64 nt, Homo Sapiens
ggcuacgagcaauacuauaguggagagcaaauccuaugccgaaagcuccucuucugccugugua

SEQ ID NO: 103851 - RNA, 64 nt, Homo Sapiens
aagaaaaguggaucucaggguuuggucacaucacuaugccgagcgauggguuauuucaaccugu

SEQ ID NO: 103852 - RNA, 64 nt, Homo Sapiens
gcagccaaaauuccuuuuuagauuguccguuugcuaugccgaaucugaggcugucgcucacuca

SEQ ID NO: 103853 - RNA, 64 nt, Homo Sapiens
aucucagaaagggcuguguaugcaucaccugcuguaugccgaucaaucugcugagugugcagcc

SEQ ID NO: 103854 - RNA, 64 nt, Homo Sapiens
gcccucaggggacuugaaucugucacugugguccuaugccgaaucuugcguaugucuguuacca

SEQ ID NO: 103855 - RNA, 64 nt, Homo Sapiens
gucagcagcugauccccgaccugccgucaugagcuaugccgacaaaaugaagacaggagaacug

SEQ ID NO: 103856 - RNA, 64 nt, Homo Sapiens
uauuugcgaugaguaaauauacauagcuggugcuuaugccgaguuaugugcuggccgcaccuga

SEQ ID NO: 103857 - RNA, 63 nt, Homo Sapiens
ugaaggagauaacuuauuaaucugucgaaggcuuaugccgagccagaagccgaagccacuugc

SEQ ID NO: 103858 - RNA, 64 nt, Homo Sapiens
uuccucaagccaucucacaacaugggaaaaccuguaugccgauuucaugagaaaugucuaaucc

SEQ ID NO: 103859 - RNA, 64 nt, Homo Sapiens
acaggcagcccucacuuuucauuuugaugaguauuaugccgaauuuaauuuuucuuuagcccuu

SEQ ID NO: 103860 - RNA, 64 nt, Homo Sapiens; identical to SEQ ID NO: 103795

SEQ ID NO: 103861 - RNA, 64 nt, Homo Sapiens; identical to SEQ ID NO: 103796

SEQ ID NO: 103862 - RNA, 64 nt, Homo Sapiens; identical to SEQ ID NO: 103797

SEQ ID NO: 103863 - RNA, 64 nt, Homo Sapiens; identical to SEQ ID NO: 103798

SEQ ID NO: 103864 - RNA, 64 nt, Homo Sapiens; identical to SEQ ID NO: 103799

SEQ ID NO: 103865 - RNA, 64 nt, Homo Sapiens; identical to SEQ ID NO: 103800

SEQ ID NO: 103866 - RNA, 64 nt, Homo Sapiens; identical to SEQ ID NO: 103801

SEQ ID NO: 103867 - RNA, 64 nt, Homo Sapiens; identical to SEQ ID NO: 103802

SEQ ID NO: 103868 - RNA, 64 nt, Homo Sapiens; identical to SEQ ID NO: 103803

SEQ ID NO: 103869 - RNA, 64 nt, Homo Sapiens; identical to SEQ ID NO: 103804

SEQ ID NO: 103870 - RNA, 64 nt, Homo Sapiens; identical to SEQ ID NO: 103805

SEQ ID NO: 103871 - RNA, 64 nt, Homo Sapiens; identical to SEQ ID NO: 103806

SEQ ID NO: 103872 - RNA, 64 nt, Homo Sapiens; identical to SEQ ID NO: 103807

SEQ ID NO: 103873 - RNA, 64 nt, Homo Sapiens; identical to SEQ ID NO: 103808

SEQ ID NO: 103874 - RNA, 64 nt, Homo Sapiens; identical to SEQ ID NO: 103809

SEQ ID NO: 103875 - RNA, 64 nt, Homo Sapiens; identical to SEQ ID NO: 103810

SEQ ID NO: 103876 - RNA, 64 nt, Homo Sapiens; identical to SEQ ID NO: 103811

SEQ ID NO: 103877 - RNA, 64 nt, Homo Sapiens; identical to SEQ ID NO: 103812

SEQ ID NO: 103878 - RNA, 64 nt, Homo Sapiens; identical to SEQ ID NO: 103813

SEQ ID NO: 103879 - RNA, 64 nt, Homo Sapiens; identical to SEQ ID NO: 103814

SEQ ID NO: 103880 - RNA, 64 nt, Homo Sapiens; identical to SEQ ID NO: 103815

SEQ ID NO: 103881 - RNA, 64 nt, Homo Sapiens; identical to SEQ ID NO: 103816

SEQ ID NO: 103882 - RNA, 64 nt, Homo Sapiens; identical to SEQ ID NO: 103817

SEQ ID NO: 103883 - RNA, 64 nt, Homo Sapiens; identical to SEQ ID NO: 103818

SEQ ID NO: 103884 - RNA, 64 nt, Homo Sapiens; identical to SEQ ID NO: 103819

SEQ ID NO: 103885 - RNA, 64 nt, Homo Sapiens; identical to SEQ ID NO: 103820

SEQ ID NO: 103886 - RNA, 64 nt, Homo Sapiens; identical to SEQ ID NO: 103821

SEQ ID NO: 103887 - RNA, 64 nt, Homo Sapiens; identical to SEQ ID NO: 103822

SEQ ID NO: 103888 - RNA, 64 nt, Homo Sapiens; identical to SEQ ID NO: 103823

SEQ ID NO: 103889 - RNA, 64 nt, Homo Sapiens; identical to SEQ ID NO: 103824

SEQ ID NO: 103890 - RNA, 64 nt, Homo Sapiens; identical to SEQ ID NO: 103825

SEQ ID NO: 103891 - RNA, 64 nt, Homo Sapiens; identical to SEQ ID NO: 103826

SEQ ID NO: 103892 - RNA, 64 nt, Homo Sapiens; identical to SEQ ID NO: 103827

SEQ ID NO: 103893 - RNA, 64 nt, Homo Sapiens; identical to SEQ ID NO: 103828

SEQ ID NO: 103894 - RNA, 64 nt, Homo Sapiens; identical to SEQ ID NO: 103829

SEQ ID NO: 103895 - RNA, 64 nt, Homo Sapiens; identical to SEQ ID NO: 103830

SEQ ID NO: 103896 - RNA, 64 nt, Homo Sapiens; identical to SEQ ID NO: 103831

SEQ ID NO: 103897 - RNA, 64 nt, Homo Sapiens; identical to SEQ ID NO: 103832

SEQ ID NO: 103898 - RNA, 64 nt, Homo Sapiens; identical to SEQ ID NO: 103833

SEQ ID NO: 103899 - RNA, 64 nt, Homo Sapiens; identical to SEQ ID NO: 103834

SEQ ID NO: 103900 - RNA, 64 nt, Homo Sapiens; identical to SEQ ID NO: 103835

SEQ ID NO: 103901 - RNA, 64 nt, Homo Sapiens; identical to SEQ ID NO: 103836

SEQ ID NO: 103902 - RNA, 64 nt, Homo Sapiens; identical to SEQ ID NO: 103837

SEQ ID NO: 103903 - RNA, 64 nt, Homo Sapiens; identical to SEQ ID NO: 103838

SEQ ID NO: 103904 - RNA, 64 nt, Homo Sapiens; identical to SEQ ID NO: 103839

SEQ ID NO: 103905 - RNA, 64 nt, Homo Sapiens; identical to SEQ ID NO: 103840

SEQ ID NO: 103906 - RNA, 64 nt, Homo Sapiens; identical to SEQ ID NO: 103841

SEQ ID NO: 103907 - RNA, 64 nt, Homo Sapiens; identical to SEQ ID NO: 103842

SEQ ID NO: 103908 - RNA, 64 nt, Homo Sapiens; identical to SEQ ID NO: 103843

SEQ ID NO: 103909 - RNA, 64 nt, Homo Sapiens; identical to SEQ ID NO: 103844

SEQ ID NO: 103910 - RNA, 64 nt, Homo Sapiens; identical to SEQ ID NO: 103845

SEQ ID NO: 103911 - RNA, 64 nt, Homo Sapiens; identical to SEQ ID NO: 103846

SEQ ID NO: 103912 - RNA, 64 nt, Homo Sapiens; identical to SEQ ID NO: 103847

SEQ ID NO: 103913 - RNA, 64 nt, Homo Sapiens; identical to SEQ ID NO: 103848

SEQ ID NO: 103914 - RNA, 64 nt, Homo Sapiens; identical to SEQ ID NO: 103849

SEQ ID NO: 103915 - RNA, 64 nt, Homo Sapiens; identical to SEQ ID NO: 103850

SEQ ID NO: 103916 - RNA, 64 nt, Homo Sapiens; identical to SEQ ID NO: 103851

SEQ ID NO: 103917 - RNA, 64 nt, Homo Sapiens; identical to SEQ ID NO: 103852

SEQ ID NO: 103918 - RNA, 64 nt, Homo Sapiens; identical to SEQ ID NO: 103853

SEQ ID NO: 103919 - RNA, 64 nt, Homo Sapiens; identical to SEQ ID NO: 103854

SEQ ID NO: 103920 - RNA, 64 nt, Homo Sapiens; identical to SEQ ID NO: 103855

SEQ ID NO: 103921 - RNA, 64 nt, Homo Sapiens; identical to SEQ ID NO: 103856

SEQ ID NO: 103922 - RNA, 63 nt, Homo Sapiens; identical to SEQ ID NO: 103857

SEQ ID NO: 103923 - RNA, 64 nt, Homo Sapiens; identical to SEQ ID NO: 103858

SEQ ID NO: 103924 - RNA, 64 nt, Homo Sapiens; identical to SEQ ID NO: 103859

SEQ ID NO: 103925 - RNA, 64 nt, Homo Sapiens
auucguagauuuaauaacuuaccugaagggguuuucuugauaauuuuccuuuaauaugaaauuu

SEQ ID NO: 103926 - RNA, 64 nt, Homo Sapiens
guugaugucaauaacaguauaaaacagcccuauuucuugauaaaaaaugacaaaugacugucuc

SEQ ID NO: 103927 - RNA, 64 nt, Homo Sapiens
gauauuaauguauccaaugaaauaaucgacuuguucuugauagccucauuaaagcauuugguuu

SEQ ID NO: 103928 - RNA, 64 nt, Homo Sapiens
acugcacuuaauuuucaguaaguucauuucuaguucuugauagauuaagugacacuacgcgugc

SEQ ID NO: 103929 - RNA, 64 nt, Homo Sapiens
cuuaucauagcucuauauugaaggauucagggucucuugauagaaaaucauauuacaaguacgu

SEQ ID NO: 103930 - RNA, 64 nt, Homo Sapiens
aaaucuaguuuuugacacaggaguuuagaaaaagucuugauaguauuagcuguuaaugcucugu

SEQ ID NO: 103931 - RNA, 64 nt, Homo Sapiens
aguucagauacaaaaggagcacacaaugaguaauucuugauaaagaaaaagcuuuguaaucaua

SEQ ID NO: 103932 - RNA, 64 nt, Homo Sapiens
augggugcugugugugugcagaaaaaauccugugucuugauagcuugccucucaugaggcaacu

SEQ ID NO: 103933 - RNA, 64 nt, Homo Sapiens
cagacaucugcagaaauguuuuuuagagauagguucuugauauuaacauuuccugauaaaugcc

SEQ ID NO: 103934 - RNA, 64 nt, Homo Sapiens
auaauuggggaaacagaauaaguuagcugucagcucuugauaauacuauaaacuugaaacaaag

SEQ ID NO: 103935 - RNA, 64 nt, Homo Sapiens
ugaagacuauaaacuugaaaccuuuuaauuuguuucuugauauacuuucacauuccuuguuugu

SEQ ID NO: 103936 - RNA, 64 nt, Homo Sapiens
uuuccaaauacuuagaguuaugaauagcauaauuucuugauaccauaacuuugccuguguuguu

SEQ ID NO: 103937 - RNA, 64 nt, Homo Sapiens
cuugauuaacccaagacuuuccugauauugacucucuugauacauacccaagcugaacaaucuu

SEQ ID NO: 103938 - RNA, 64 nt, Homo Sapiens
uuuuaacauuccacuuaugccuugaaacaucauuucuugauaacuuuuugauacuucuuucuug

SEQ ID NO: 103939 - RNA, 64 nt, Homo Sapiens
aacaucauuucuugauaacuuuuugauacuucuuucuugauaaggcacuuuuaccaggugugug

SEQ ID NO: 103940 - RNA, 64 nt, Homo Sapiens
aacggccuggaaucgcaaagagacaccacucugggcagagcagagcaggguaugggguggggag

SEQ ID NO: 103941 - RNA, 64 nt, Homo Sapiens
ccuggaaucgcaaagagacaccacucugggcagagcagagcaggguaugggguggggagagagg

SEQ ID NO: 103942 - RNA, 64 nt, Homo Sapiens
cacuggcucaagcagcagaguagggaagcagagagcagagcacagaugagaaggauggcggggc

SEQ ID NO: 103943 - RNA, 64 nt, Homo Sapiens
cagugauggaagaagcaggacagggaagcagagagcagagcaugaaacuuuuaggugguggaac

SEQ ID NO: 103944 - RNA, 64 nt, Homo Sapiens
caggccguuaaguuucacagucuccagaaacauggcagagcagaaguguugaaccagcaucaag

SEQ ID NO: 103945 - RNA, 64 nt, Homo Sapiens
acucugucucaaaaaaaagacuccagccuggagagcagagcaaggccgagauugcaccacugca

SEQ ID NO: 103946 - RNA, 64 nt, Homo Sapiens
caauugagugcgauuauuggcuucugagcgcugagcagagcagguggaagaggaacuuugagca

SEQ ID NO: 103947 - RNA, 64 nt, Homo Sapiens
aacagaccaucacagauuggaaacuugguagauagcagagcaugguauuagugaaaaagguuca

SEQ ID NO: 103948 - RNA, 64 nt, Homo Sapiens
ugaaaucuugccaucaagcagagagguagugugagcagagcagccugcguugugccaguugcug

SEQ ID NO: 103949 - RNA, 64 nt, Homo Sapiens
cugcgcagcaggcaccuccaugcuuagagcgagagcagagcaaaggggggacacgucuucccac

SEQ ID NO: 103950 - RNA, 64 nt, Homo Sapiens
gccacgguggcuccagccaggaccagccagaccagcagagcagggagccacuugccagggugga

SEQ ID NO: 103951 - RNA, 64 nt, Homo Sapiens
caggguuacagcaagagccacugagguguggcuggcagagcaacugaggagcucugcgagagug

SEQ ID NO: 103952 - RNA, 64 nt, Homo Sapiens
ugagcuccggagucccugcaggggauaggaagacgcagagcaaaacuacaguuuuagcggggag

SEQ ID NO: 103953 - RNA, 64 nt, Homo Sapiens
cuaaacagaguccgggagaaccauguuaguaauggcagagcaguagcugaugucaucacacucu

SEQ ID NO: 103954 - RNA, 64 nt, Homo Sapiens
gccagcagggacgcgccccaggugggcagcuguggcagagcagcgacccgcggcggggcggcau

SEQ ID NO: 103955 - RNA, 64 nt, Homo Sapiens
gccagcagggacgcgccccaggugggcagcuguggcagagcagucccgacaccuaaauaaaagu

SEQ ID NO: 103956 - RNA, 64 nt, Homo Sapiens
uauugcgaagcacaugccccaucgagccuacugggcagagcagcagagcaggguuggaggggcu

SEQ ID NO: 103957 - RNA, 64 nt, Homo Sapiens
agcacaugccccaucgagccuacugggcagagcagcagagcaggguuggaggggcuggggagac

SEQ ID NO: 103958 - RNA, 64 nt, Homo Sapiens
ucauuguuuuuguuuuuguuuuuguuuugacacugcagagcacaaggcuaaagguuacagcuga

SEQ ID NO: 103959 - RNA, 64 nt, Homo Sapiens
cuaaagguuacagcugagaucuuuggaaccaaaggcagagcaagcagagcccguugucugggcc

SEQ ID NO: 103960 - RNA, 64 nt, Homo Sapiens
guggugggaggcacaguguuuacaggcucugguggcagagcaguuggcacaccugugggugaau

SEQ ID NO: 103961 - RNA, 64 nt, Homo Sapiens
cagaccuacaggcgaggccgcagcagaggguggggcagagcagccucggggucugggggcugca

SEQ ID NO: 103962 - RNA, 64 nt, Homo Sapiens
ccagccccuggaugcagccucacaguccuuaccagcagagcaccuuagacagucccugccaaug

SEQ ID NO: 103963 - RNA, 64 nt, Homo Sapiens
agacccugcccugugggcccccaaauggaaaugggcagagcagagaccaucccugaaggccccg

SEQ ID NO: 103964 - RNA, 64 nt, Homo Sapiens
caggaugccggagagacagccccuugugcugugagcagagcaggcaguggcucuggaggcugcc

SEQ ID NO: 103965 - RNA, 64 nt, Homo Sapiens
ccaccaagguuuccucucuucccccaggaccugggcagagcaggcaugagcugggcuguggugc

SEQ ID NO: 103966 - RNA, 64 nt, Homo Sapiens
accugggcagagcaggcaugagcugggcuguggugcagagcaagcagacccagccacacugcuc

SEQ ID NO: 103967 - RNA, 64 nt, Homo Sapiens
acucaguauugauaaaaccuuuuuaauaagugaugcagagcagccaaggauauguugacccaga

SEQ ID NO: 103968 - RNA, 64 nt, Homo Sapiens
ucaaccaggcuauuuuuauacuuaaaacaugucagcagagcauaggcagaauaaaaugguuuaa

SEQ ID NO: 103969 - RNA, 62 nt, Homo Sapiens
aggagcaagaagaguauuaacagccuggaccagcagagcaacaucggaauucuucacuccaa

SEQ ID NO: 103970 - RNA, 64 nt, Homo Sapiens
ccaauaaguuugaguuaggagcuuuuaccuuguagcagagcaguauuaacaccuaguugguuca

SEQ ID NO: 103971 - RNA, 64 nt, Homo Sapiens
uccacccaguguccacuggccuguccuucagggagcagagcagagcaggugguggacgggccca

SEQ ID NO: 103972 - RNA, 64 nt, Homo Sapiens
ccaguguccacuggccuguccuucagggagcagagcagagcaggugguggacgggcccagugcu

SEQ ID NO: 103973 - RNA, 64 nt, Homo Sapiens; identical to SEQ ID NO: 95478

SEQ ID NO: 103974 - RNA, 64 nt, Homo Sapiens; identical to SEQ ID NO: 95479

SEQ ID NO: 103975 - RNA, 64 nt, Homo Sapiens; identical to SEQ ID NO: 95480

SEQ ID NO: 103976 - RNA, 64 nt, Homo Sapiens; identical to SEQ ID NO: 95481

SEQ ID NO: 103977 - RNA, 64 nt, Homo Sapiens; identical to SEQ ID NO: 95482

SEQ ID NO: 103978 - RNA, 64 nt, Homo Sapiens; identical to SEQ ID NO: 95483

SEQ ID NO: 103979 - RNA, 64 nt, Homo Sapiens; identical to SEQ ID NO: 95484

SEQ ID NO: 103980 - RNA, 64 nt, Homo Sapiens; identical to SEQ ID NO: 95485

SEQ ID NO: 103981 - RNA, 64 nt, Homo Sapiens; identical to SEQ ID NO: 95486

SEQ ID NO: 103982 - RNA, 64 nt, Homo Sapiens; identical to SEQ ID NO: 95487

SEQ ID NO: 103983 - RNA, 64 nt, Homo Sapiens; identical to SEQ ID NO: 95488

SEQ ID NO: 103984 - RNA, 64 nt, Homo Sapiens; identical to SEQ ID NO: 95489

SEQ ID NO: 103985 - RNA, 64 nt, Homo Sapiens; identical to SEQ ID NO: 95490

SEQ ID NO: 103986 - RNA, 64 nt, Homo Sapiens; identical to SEQ ID NO: 95491

SEQ ID NO: 103987 - RNA, 64 nt, Homo Sapiens; identical to SEQ ID NO: 95492

SEQ ID NO: 103988 - RNA, 64 nt, Homo Sapiens; identical to SEQ ID NO: 95493

SEQ ID NO: 103989 - RNA, 64 nt, Homo Sapiens; identical to SEQ ID NO: 95494

SEQ ID NO: 103990 - RNA, 64 nt, Homo Sapiens; identical to SEQ ID NO: 95495

SEQ ID NO: 103991 - RNA, 64 nt, Homo Sapiens; identical to SEQ ID NO: 95496

SEQ ID NO: 103992 - RNA, 64 nt, Homo Sapiens; identical to SEQ ID NO: 95497

SEQ ID NO: 103993 - RNA, 64 nt, Homo Sapiens; identical to SEQ ID NO: 95498

SEQ ID NO: 103994 - RNA, 64 nt, Homo Sapiens; identical to SEQ ID NO: 95499

SEQ ID NO: 103995 - RNA, 64 nt, Homo Sapiens; identical to SEQ ID NO: 95500

SEQ ID NO: 103996 - RNA, 64 nt, Homo Sapiens; identical to SEQ ID NO: 95501

SEQ ID NO: 103997 - RNA, 64 nt, Homo Sapiens; identical to SEQ ID NO: 95502

SEQ ID NO: 103998 - RNA, 64 nt, Homo Sapiens; identical to SEQ ID NO: 95503

SEQ ID NO: 103999 - RNA, 64 nt, Homo Sapiens; identical to SEQ ID NO: 95504

SEQ ID NO: 104000 - RNA, 64 nt, Homo Sapiens; identical to SEQ ID NO: 95505

SEQ ID NO: 104001 - RNA, 64 nt, Homo Sapiens; identical to SEQ ID NO: 95506

SEQ ID NO: 104002 - RNA, 64 nt, Homo Sapiens; identical to SEQ ID NO: 95507

SEQ ID NO: 104003 - RNA, 64 nt, Homo Sapiens; identical to SEQ ID NO: 95508

SEQ ID NO: 104004 - RNA, 64 nt, Homo Sapiens; identical to SEQ ID NO: 95509

SEQ ID NO: 104005 - RNA, 64 nt, Homo Sapiens; identical to SEQ ID NO: 95510

SEQ ID NO: 104006 - RNA, 64 nt, Homo Sapiens; identical to SEQ ID NO: 95511

SEQ ID NO: 104007 - RNA, 64 nt, Homo Sapiens; identical to SEQ ID NO: 95512

SEQ ID NO: 104008 - RNA, 64 nt, Homo Sapiens; identical to SEQ ID NO: 95513

SEQ ID NO: 104009 - RNA, 64 nt, Homo Sapiens; identical to SEQ ID NO: 95514

SEQ ID NO: 104010 - RNA, 64 nt, Homo Sapiens; identical to SEQ ID NO: 95515

SEQ ID NO: 104011 - RNA, 64 nt, Homo Sapiens; identical to SEQ ID NO: 95516

SEQ ID NO: 104012 - RNA, 64 nt, Homo Sapiens; identical to SEQ ID NO: 95517

SEQ ID NO: 104013 - RNA, 64 nt, Homo Sapiens; identical to SEQ ID NO: 95518

SEQ ID NO: 104014 - RNA, 64 nt, Homo Sapiens; identical to SEQ ID NO: 95519

SEQ ID NO: 104015 - RNA, 64 nt, Homo Sapiens; identical to SEQ ID NO: 95520

SEQ ID NO: 104016 - RNA, 64 nt, Homo Sapiens; identical to SEQ ID NO: 95521

SEQ ID NO: 104017 - RNA, 64 nt, Homo Sapiens; identical to SEQ ID NO: 95522

SEQ ID NO: 104018 - RNA, 64 nt, Homo Sapiens; identical to SEQ ID NO: 95523

SEQ ID NO: 104019 - RNA, 64 nt, Homo Sapiens; identical to SEQ ID NO: 95524

SEQ ID NO: 104020 - RNA, 64 nt, Homo Sapiens; identical to SEQ ID NO: 95525

SEQ ID NO: 104021 - RNA, 62 nt, Homo Sapiens
cagcagcccaggaagcagcacacgcggccguggggaggcaggcaccgggcaugucggcgccu

SEQ ID NO: 104022 - RNA, 62 nt, Homo Sapiens
uacgugugucaagccuagccaccucagcugcagggaggcagaaggcaaggcaggccccacgg

SEQ ID NO: 104023 - RNA, 62 nt, Homo Sapiens
gggaggcugaggcaggagaaucgcuugaacccgggaggcacagguuccagugagccaagguu

SEQ ID NO: 104024 - RNA, 62 nt, Homo Sapiens
gggaggcugaggcaggagaaucgcuugaaccugggaggcagagguugcaguaagccaagauc

SEQ ID NO: 104025 - RNA, 62 nt, Homo Sapiens
aguugcagugagccgagauuuugcuugaaccggggaggcagagggaggcugaggcaggagaa

SEQ ID NO: 104026 - RNA, 62 nt, Homo Sapiens
gcuugcagugagcugagauuuggcaugaaccugggaggcagagggaggcugaggcaggagaa

SEQ ID NO: 104027 - RNA, 62 nt, Homo Sapiens
uuuggaauggugcgaguaugggcagggugugagggaggcagggacggcaccucuucccccau

SEQ ID NO: 104028 - RNA, 62 nt, Homo Sapiens
ggaggaagacggcaccucuuagauccugggaagggaggcacuuggcugagcccagggugggg

SEQ ID NO: 104029 - RNA, 62 nt, Homo Sapiens
aguugcagugagcugagauuucgcuugaaccugggaggcagagggaggcugaggcaggagaa

SEQ ID NO: 104030 - RNA, 62 nt, Homo Sapiens
ggugggcggaucacaaggucuuccagcacuuugggaggcagaacaguggcucaugccuauaa

SEQ ID NO: 104031 - RNA, 62 nt, Homo Sapiens
gcgggcgcgacgugaucguggaccugugggaggggaggcacguggcgcgcgugggcccgcug

SEQ ID NO: 104032 - RNA, 62 nt, Homo Sapiens
caguccaggcuggagagguuggggccgggguagggaggcaggagccaugucaguucugaagg

SEQ ID NO: 104033 - RNA, 62 nt, Homo Sapiens
gaugauuuguguaaccugaggccaggauuaaggggaggcaaucaaugcaccuagggaaaaaa

SEQ ID NO: 104034 - RNA, 62 nt, Homo Sapiens
aggaggcugaggcaggagaagggugggaacccgggaggcagagcuugcagugagccgagauu

SEQ ID NO: 104035 - RNA, 62 nt, Homo Sapiens
ugaagggauguaucaagugggguggugggagggggaggcaagguuauaugcacuuucucaug

SEQ ID NO: 104036 - RNA, 62 nt, Homo Sapiens
cugguauguucaguaggaacuguacauguguugggaggcauaaagacuaauuagcaaccaua

SEQ ID NO: 104037 - RNA, 62 nt, Homo Sapiens
ggcgggaggauugcuugagguuccaacacuuugggaggcagagcaauggcucacaccuguaa

SEQ ID NO: 104038 - RNA, 62 nt, Homo Sapiens
gguugcagugagccaagauuucgcuugaaccugggaggcagaaagaggcugaggcaggagaa

SEQ ID NO: 104039 - RNA, 62 nt, Homo Sapiens
gcaggcugcagucagucccuccccagcagcuagggaggcaaauggugcccuauuuccagcca

SEQ ID NO: 104040 - RNA, 62 nt, Homo Sapiens
cagcggggcgugaugcagugggaagaggcagagggaggcagcugugagugugcgucuguacg

SEQ ID NO: 104041 - RNA, 62 nt, Homo Sapiens
cacaaacuaggaagacuagcuuuuuuuaauuugggaggcaaguuuuuggcacauaacaacuu

SEQ ID NO: 104042 - RNA, 62 nt, Homo Sapiens
auuaaugguaccagccugucagauauuggucugggaggcaacauuuauauuuuacaaaugcu

SEQ ID NO: 104043 - RNA, 62 nt, Homo Sapiens
uggacgcugcagaccccagguguggagcgagagggaggcaggcaggaaaggacggcugagca

SEQ ID NO: 104044 - RNA, 62 nt, Homo Sapiens
cacagggaagcucacacaucgacagcugugccgggaggcagcggcgcgaugucaaaggucgg

SEQ ID NO: 104045 - RNA, 62 nt, Homo Sapiens
cccucccccagcagaauggaggcaggggacaagggaggcaguggcuaguggggugaacagcu

SEQ ID NO: 104046 - RNA, 62 nt, Homo Sapiens
ucuuugcccccgacggcugugacgcagccggagggaggcacuagucaccgacagcggccuug

SEQ ID NO: 104047 - RNA, 62 nt, Homo Sapiens
ccuggggcggggggcgugccugucacugccuggggaggcauuugccucuguaccaucgccuu

SEQ ID NO: 104048 - RNA, 62 nt, Homo Sapiens
cccccgcucaggugagcccgaaggcaggagccgggaggcacuccucccaaacacuccacuca

SEQ ID NO: 104049 - RNA, 62 nt, Homo Sapiens
gcaugucagaaacggaccuuggaagggaggcagggaggcaaaugugccgguagaauaaggaa

SEQ ID NO: 104050 - RNA, 62 nt, Homo Sapiens
gaggcaaagcaugucagaaaauaaggaaggaagggaggcagggaucccuuugugccgguaga

SEQ ID NO: 104051 - RNA, 62 nt, Homo Sapiens
gacuggcagcugccacccccugcuggugggaagggaggcaggugcuggggaggcagcaagca

SEQ ID NO: 104052 - RNA, 62 nt, Homo Sapiens
aagcaugcuggugggaagggcuuuucuugcuggggaggcagccucaugaccuaaacucuggg

SEQ ID NO: 104053 - RNA, 62 nt, Homo Sapiens
ggugagaggauggaauugugugggccuggcgggggaggcaggcuuucuuuuaaggcuguucc

SEQ ID NO: 104054 - RNA, 62 nt, Homo Sapiens
gacggggggaggggaagccugcacgcccggccgggaggcagacggccccgcaccugccauuu

SEQ ID NO: 104055 - RNA, 62 nt, Homo Sapiens
gggaggcugaggcacaagaaucacuugaacccgggaggcagagguuguagugagcccagauu

SEQ ID NO: 104056 - RNA, 62 nt, Homo Sapiens
ugagcccagauugugccacugcucuccagccugggaggcacagcaaacugucccccaaaaaa

SEQ ID NO: 104057 - RNA, 62 nt, Homo Sapiens
cacgagucugggacucauucagaugggggcccgggaggcacaaguccucuucuggaagcugc

SEQ ID NO: 104058 - RNA, 62 nt, Homo Sapiens
auuucugguuucugguuccucagacaagagcugggaggcaagacucugagguuucuaucuuc

SEQ ID NO: 104059 - RNA, 62 nt, Homo Sapiens
ugggguugcaggaccgagacccgcguccaccugggaggcauugggagccaauccacccagac

SEQ ID NO: 104060 - RNA, 62 nt, Homo Sapiens
gggggccuuguuggcagcugagugggucuccagggaggcaguucugcugaagagggggauga

SEQ ID NO: 104061 - RNA, 62 nt, Homo Sapiens
ccacccuccccaccagugcaccccagaggaccgggaggcaccgcagcagccccgagggacgc

SEQ ID NO: 104062 - RNA, 62 nt, Homo Sapiens
agcagaaaacccaagggcagguggagaguccagggaggcaggauggaucaccagacaccuaa

SEQ ID NO: 104063 - RNA, 62 nt, Homo Sapiens
gcuuagcaucuacucuguauaacgcaugagaggggaggcaaagaagaaaaagacacacagaa

SEQ ID NO: 104064 - RNA, 62 nt, Homo Sapiens
uucuucagcccgacuggaggaacagcagcucugggaggcacagagugcaggucucaggggca

SEQ ID NO: 104065 - RNA, 62 nt, Homo Sapiens
gauucauggaugaaugaaagcuagaccugauggggaggcauuaugacuaaauaggcccagcc

SEQ ID NO: 104066 - RNA, 62 nt, Homo Sapiens
ucucuggauggaacgggcaugggccucucugggggaggcagggcuggaaugggagaccuguu

SEQ ID NO: 104067 - RNA, 62 nt, Homo Sapiens
gaauaucuuauauugggcgauuugggggcucggggaggcagagaaucucuugggagucuugg

SEQ ID NO: 104068 - RNA, 62 nt, Homo Sapiens
agcaucuuuagaccuagaucugucuaacucuggggaggcacauugacauuuccauuacacac

SEQ ID NO: 104069 - RNA, 62 nt, Homo Sapiens
gggagcagcugagccauuuguucuugaacucugggaggcagaaguccccgcacccaucaugc

SEQ ID NO: 104070 - RNA, 62 nt, Homo Sapiens
uagggcucauggcaugggcccccacugggggagggaggcaucuuguuucuugugguucccug

SEQ ID NO: 104071 - RNA, 62 nt, Homo Sapiens
gggaguggaaauggggaagggggccuggagaggggaggcaggggccccugugcucucugaac

SEQ ID NO: 104072 - RNA, 62 nt, Homo Sapiens
cuucagcccuggagugggcagagaguauuguggggaggcauggccagugggacuaguguucc

SEQ ID NO: 104073 - RNA, 62 nt, Homo Sapiens
ggcauggggcuacauuccagugccugacuauagggaggcacuccugauuccauggagcagcc

SEQ ID NO: 104074 - RNA, 62 nt, Homo Sapiens
gcacagggagaugcucagggguaguaaacugggggaggcaggagcagcagcaggauggugaa

SEQ ID NO: 104075 - RNA, 62 nt, Homo Sapiens
cucacuggccauuuucccuacuagguggcugggggaggcaggcuuucccucccaggaguccc

SEQ ID NO: 104076 - RNA, 62 nt, Homo Sapiens
cgccagagcuuuuccacugauuguacucagcggggaggcaggggaggcagaggggcagccuc

SEQ ID NO: 104077 - RNA, 62 nt, Homo Sapiens
uuuuccacugauuguacucagcggggaggcaggggaggcagaggggcagccucucuaaugcu

SEQ ID NO: 104078 - RNA, 62 nt, Homo Sapiens
gguugcagugagcugagaucuggcgggaacccgggaggcagagguaggcugaggcaggagaa

SEQ ID NO: 104079 - RNA, 62 nt, Homo Sapiens
ccagaucccugcucaugcguacacacagcagggggaggcagcgcccaaggagguugucaggg

SEQ ID NO: 104080 - RNA, 62 nt, Homo Sapiens
uaccccagggcagcaggcucugaccggcuuuggggaggcaggcucccugccacagguggagc

SEQ ID NO: 104081 - RNA, 62 nt, Homo Sapiens
ccugcugccugcccucgaucccaaaggggcuggggaggcaggggugggggcugaggcugagg

SEQ ID NO: 104082 - RNA, 62 nt, Homo Sapiens
uggagcccauaggccaccucaaaugcagggaggggaggcagagagaaguucuugauucagcc

SEQ ID NO: 104083 - RNA, 62 nt, Homo Sapiens
agacugggagccacuucuccacugauaacuuggggaggcaaggucugcuaggcgcuggggag

SEQ ID NO: 104084 - RNA, 62 nt, Homo Sapiens
cagaagccugccacucuuuagccaccuccccugggaggcacccuuuauagaagcacauuucu

SEQ ID NO: 104085 - RNA, 62 nt, Homo Sapiens
uagagccccccuauuuuagugccagggggcuggggaggcaaaucuacccacccugccuccag

SEQ ID NO: 104086 - RNA, 62 nt, Homo Sapiens
cuguaagcugggugagcuacugaagccaaggugggaggcagcugacaacaccacccacggcc

SEQ ID NO: 104087 - RNA, 62 nt, Homo Sapiens
gcugggagaccagguccucugugcaugggcccgggaggcagaccugccccaagggugaugca

SEQ ID NO: 104088 - RNA, 62 nt, Homo Sapiens
caagauuguuugaaaaaaaaaaaaggggagcagggaggcagaaaguccuggaaaaguaaauu

SEQ ID NO: 104089 - RNA, 62 nt, Homo Sapiens
acugcuguccacaugaccucgugguaggggcagggaggcaacggccaaauaggagggagacu

SEQ ID NO: 104090 - RNA, 62 nt, Homo Sapiens
uccaggcaggccaggcugccgccagcucugaggggaggcaccgccugaucccugaaccccug

SEQ ID NO: 104091 - RNA, 64 nt, Homo Sapiens; identical to SEQ ID NO: 79249

SEQ ID NO: 104092 - RNA, 64 nt, Homo Sapiens; identical to SEQ ID NO: 79250

SEQ ID NO: 104093 - RNA, 64 nt, Homo Sapiens; identical to SEQ ID NO: 79251

SEQ ID NO: 104094 - RNA, 64 nt, Homo Sapiens; identical to SEQ ID NO: 79252

SEQ ID NO: 104095 - RNA, 64 nt, Homo Sapiens; identical to SEQ ID NO: 79253

SEQ ID NO: 104096 - RNA, 64 nt, Homo Sapiens; identical to SEQ ID NO: 79254

SEQ ID NO: 104097 - RNA, 64 nt, Homo Sapiens; identical to SEQ ID NO: 79255

SEQ ID NO: 104098 - RNA, 64 nt, Homo Sapiens; identical to SEQ ID NO: 79256

SEQ ID NO: 104099 - RNA, 64 nt, Homo Sapiens; identical to SEQ ID NO: 79257

SEQ ID NO: 104100 - RNA, 64 nt, Homo Sapiens; identical to SEQ ID NO: 79258

SEQ ID NO: 104101 - RNA, 64 nt, Homo Sapiens; identical to SEQ ID NO: 79259

SEQ ID NO: 104102 - RNA, 64 nt, Homo Sapiens; identical to SEQ ID NO: 79260

SEQ ID NO: 104103 - RNA, 64 nt, Homo Sapiens; identical to SEQ ID NO: 79261

SEQ ID NO: 104104 - RNA, 64 nt, Homo Sapiens; identical to SEQ ID NO: 79262

SEQ ID NO: 104105 - RNA, 64 nt, Homo Sapiens; identical to SEQ ID NO: 79263

SEQ ID NO: 104106 - RNA, 64 nt, Homo Sapiens; identical to SEQ ID NO: 79264

SEQ ID NO: 104107 - RNA, 64 nt, Homo Sapiens; identical to SEQ ID NO: 79265

SEQ ID NO: 104108 - RNA, 64 nt, Homo Sapiens; identical to SEQ ID NO: 79266

SEQ ID NO: 104109 - RNA, 64 nt, Homo Sapiens; identical to SEQ ID NO: 79267

SEQ ID NO: 104110 - RNA, 64 nt, Homo Sapiens; identical to SEQ ID NO: 79268

SEQ ID NO: 104111 - RNA, 64 nt, Homo Sapiens; identical to SEQ ID NO: 79269

SEQ ID NO: 104112 - RNA, 64 nt, Homo Sapiens; identical to SEQ ID NO: 79270

SEQ ID NO: 104113 - RNA, 64 nt, Homo Sapiens; identical to SEQ ID NO: 79271

SEQ ID NO: 104114 - RNA, 64 nt, Homo Sapiens; identical to SEQ ID NO: 79272

SEQ ID NO: 104115 - RNA, 64 nt, Homo Sapiens; identical to SEQ ID NO: 79273

SEQ ID NO: 104116 - RNA, 64 nt, Homo Sapiens; identical to SEQ ID NO: 79274

SEQ ID NO: 104117 - RNA, 64 nt, Homo Sapiens; identical to SEQ ID NO: 79275

SEQ ID NO: 104118 - RNA, 64 nt, Homo Sapiens; identical to SEQ ID NO: 79276

SEQ ID NO: 104119 - RNA, 64 nt, Homo Sapiens; identical to SEQ ID NO: 79277

SEQ ID NO: 104120 - RNA, 64 nt, Homo Sapiens; identical to SEQ ID NO: 79278

SEQ ID NO: 104121 - RNA, 64 nt, Homo Sapiens; identical to SEQ ID NO: 79279

SEQ ID NO: 104122 - RNA, 64 nt, Homo Sapiens; identical to SEQ ID NO: 79280

SEQ ID NO: 104123 - RNA, 64 nt, Homo Sapiens; identical to SEQ ID NO: 79281

SEQ ID NO: 104124 - RNA, 64 nt, Homo Sapiens; identical to SEQ ID NO: 79282

SEQ ID NO: 104125 - RNA, 64 nt, Homo Sapiens; identical to SEQ ID NO: 79283

SEQ ID NO: 104126 - RNA, 64 nt, Homo Sapiens; identical to SEQ ID NO: 79284

SEQ ID NO: 104127 - RNA, 64 nt, Homo Sapiens; identical to SEQ ID NO: 79285

SEQ ID NO: 104128 - RNA, 64 nt, Homo Sapiens; identical to SEQ ID NO: 79286

SEQ ID NO: 104129 - RNA, 64 nt, Homo Sapiens; identical to SEQ ID NO: 79287

SEQ ID NO: 104130 - RNA, 64 nt, Homo Sapiens; identical to SEQ ID NO: 79288

SEQ ID NO: 104131 - RNA, 64 nt, Homo Sapiens; identical to SEQ ID NO: 79289

SEQ ID NO: 104132 - RNA, 64 nt, Homo Sapiens; identical to SEQ ID NO: 79290

SEQ ID NO: 104133 - RNA, 64 nt, Homo Sapiens; identical to SEQ ID NO: 94908

SEQ ID NO: 104134 - RNA, 64 nt, Homo Sapiens; identical to SEQ ID NO: 94909

SEQ ID NO: 104135 - RNA, 64 nt, Homo Sapiens; identical to SEQ ID NO: 94910

SEQ ID NO: 104136 - RNA, 64 nt, Homo Sapiens; identical to SEQ ID NO: 94911

SEQ ID NO: 104137 - RNA, 64 nt, Homo Sapiens; identical to SEQ ID NO: 94912

SEQ ID NO: 104138 - RNA, 64 nt, Homo Sapiens; identical to SEQ ID NO: 94913

SEQ ID NO: 104139 - RNA, 64 nt, Homo Sapiens; identical to SEQ ID NO: 94914

SEQ ID NO: 104140 - RNA, 64 nt, Homo Sapiens; identical to SEQ ID NO: 94915

SEQ ID NO: 104141 - RNA, 64 nt, Homo Sapiens; identical to SEQ ID NO: 94916

SEQ ID NO: 104142 - RNA, 64 nt, Homo Sapiens; identical to SEQ ID NO: 94917

SEQ ID NO: 104143 - RNA, 64 nt, Homo Sapiens; identical to SEQ ID NO: 94918

SEQ ID NO: 104144 - RNA, 64 nt, Homo Sapiens; identical to SEQ ID NO: 94919

SEQ ID NO: 104145 - RNA, 64 nt, Homo Sapiens; identical to SEQ ID NO: 94920

SEQ ID NO: 104146 - RNA, 64 nt, Homo Sapiens; identical to SEQ ID NO: 94921

SEQ ID NO: 104147 - RNA, 64 nt, Homo Sapiens; identical to SEQ ID NO: 94922

SEQ ID NO: 104148 - RNA, 64 nt, Homo Sapiens; identical to SEQ ID NO: 94923

SEQ ID NO: 104149 - RNA, 64 nt, Homo Sapiens; identical to SEQ ID NO: 94924

SEQ ID NO: 104150 - RNA, 64 nt, Homo Sapiens; identical to SEQ ID NO: 94925

SEQ ID NO: 104151 - RNA, 64 nt, Homo Sapiens; identical to SEQ ID NO: 94926

SEQ ID NO: 104152 - RNA, 64 nt, Homo Sapiens; identical to SEQ ID NO: 94927

SEQ ID NO: 104153 - RNA, 64 nt, Homo Sapiens; identical to SEQ ID NO: 94928

SEQ ID NO: 104154 - RNA, 64 nt, Homo Sapiens; identical to SEQ ID NO: 94929

SEQ ID NO: 104155 - RNA, 64 nt, Homo Sapiens; identical to SEQ ID NO: 94930

SEQ ID NO: 104156 - RNA, 64 nt, Homo Sapiens; identical to SEQ ID NO: 94931

SEQ ID NO: 104157 - RNA, 64 nt, Homo Sapiens
guccauuuccuauauaaauaccagcaagaucacucugagauacauaaacucgcauuuccuucug

SEQ ID NO: 104158 - RNA, 64 nt, Homo Sapiens
auagauguccacguagcagagacugacuuaggaucugagauaaagcaucggauugcaggaauaa

SEQ ID NO: 104159 - RNA, 64 nt, Homo Sapiens
uuuuuucuuuuggcuuuucaacauugaauauucucugagauacuuucacugcuuggcaguauug

SEQ ID NO: 104160 - RNA, 64 nt, Homo Sapiens
uacaacugggagaaaugucuuagaauuuuagcuccugagauauuacuucauuauuaaaaauuga

SEQ ID NO: 104161 - RNA, 64 nt, Homo Sapiens
agaaaaccgcccuguggcugccauucguucuauucugagauaggguguaaaaagcugaccauuc

SEQ ID NO: 104162 - RNA, 64 nt, Homo Sapiens
gccucaugggaagggaaagacccacugagacagccugagauaugguauuguccaagguuucccc

SEQ ID NO: 104163 - RNA, 64 nt, Homo Sapiens
cugggaugagcaauccuguuugcuuuccagacuucugagauagcgcccagcaaccuucuaggcc

SEQ ID NO: 104164 - RNA, 64 nt, Homo Sapiens
uuagaugcccccccaucuuacguucagggggucccugagauagugaccccucucuaccugugag

SEQ ID NO: 104165 - RNA, 64 nt, Homo Sapiens
guccguuuucaaauucaucaacagccuagagugccugagauauaagaugaaacacaaauccaca

SEQ ID NO: 104166 - RNA, 64 nt, Homo Sapiens
uggcauugacgaaaaucauuugaaucucuucuggcugagauaauuugccaaugcaaaauacagu

SEQ ID NO: 104167 - RNA, 62 nt, Homo Sapiens
caaaaguaacuuguuuaucucagucuguacaaaaacaguaaggaggcagaaagccaagcacu

SEQ ID NO: 104168 - RNA, 62 nt, Homo Sapiens
cuuaaccuggucugaggugagacuaaacacaaaaacaguagauaaaucucucccuaaaagau

SEQ ID NO: 104169 - RNA, 62 nt, Homo Sapiens
uguaaauggaacuaaugcuagaacuauuuuggaaacaguauuuuuaccagaccuugguaaaa

SEQ ID NO: 104170 - RNA, 62 nt, Homo Sapiens
caguacuccuguguucuaagaagaauaguagcaaacaguauguagacuaaaaauauccuuga

SEQ ID NO: 104171 - RNA, 62 nt, Homo Sapiens
cuuuuuucuccuuccccuaguuacuguauagcaaacaguaucagggucaguuaaugcuacag

SEQ ID NO: 104172 - RNA, 62 nt, Homo Sapiens
agccugcguuaauugagcacccuuuuagugauaaacaguagcaaauaaugucccaagccuuu

SEQ ID NO: 104173 - RNA, 62 nt, Homo Sapiens
uauuuuuucaaaaacagcuaauaucuaaauuuaaacaguauuuuuuuauaaggaauacuguu

SEQ ID NO: 104174 - RNA, 62 nt, Homo Sapiens
agauaggaggauuaaaauauucucauacuuauaaacaguauggagugaguuugucaaaagua

SEQ ID NO: 104175 - RNA, 62 nt, Homo Sapiens
agauacuuaugacaaacucguagccuuaugacaaacaguaugaaaucuagauacucauuaag

SEQ ID NO: 104176 - RNA, 62 nt, Homo Sapiens
cucauacaucugugaaaaagauaaugugaaauaaacaguaaaaaaaaaaaguauguugaugg

SEQ ID NO: 104177 - RNA, 62 nt, Homo Sapiens
aacuugaauuaugcauuuauuggcauuaauguaaacaguaaguccuaagcuuugauggaagg

SEQ ID NO: 104178 - RNA, 62 nt, Homo Sapiens
uuauagacuugcugaguuuguacaccauaauuaaacaguaagugcuauuguguucagauacu

SEQ ID NO: 104179 - RNA, 62 nt, Homo Sapiens
uucaguaguguaaaagaguuguaguacacagaaaacaguaguauuuuuucauaaaggcauuu

SEQ ID NO: 104180 - RNA, 62 nt, Homo Sapiens
cccauguuugccuggauaaaguuccucauuucaaacaguauacauacuucuuugcaguucau

SEQ ID NO: 104181 - RNA, 62 nt, Homo Sapiens
uuugcaguucauuauaguaaggcuuaaccuguaaacaguaucugauggcccaccuauaaaua

SEQ ID NO: 104182 - RNA, 62 nt, Homo Sapiens
guuuucuuauaugugcaaugaaguggaaugauaaacaguaugccuuuaauuuauauguguuc

SEQ ID NO: 104183 - RNA, 62 nt, Homo Sapiens
uguucacaguauaugaaaauauggaguaauuuaaacaguaaauaaacauucuguggaugcuu

SEQ ID NO: 104184 - RNA, 62 nt, Homo Sapiens
aauaguuguaaguuugcauguucuguguucuuaaacaguauaccuguuaauaacgcaauuau

SEQ ID NO: 104185 - RNA, 62 nt, Homo Sapiens
ccauguguucuguaccaucaguuaagggcaagaaacaguauggacugcugggcaugcaugaa

SEQ ID NO: 104186 - RNA, 62 nt, Homo Sapiens
uuucaacauacuucuaaggcacagcaaaucauaaacaguaguacuguuuaccuguuggucua

SEQ ID NO: 104187 - RNA, 62 nt, Homo Sapiens
agauuuuggucuccauaaucaucauaaaaaagaaacaguauuagauauaauaaaagguguuu

SEQ ID NO: 104188 - RNA, 62 nt, Homo Sapiens
ugauuuaaauccuuucugaauaaagaucagauaaacaguaacugaaggagcauguauagcuc

SEQ ID NO: 104189 - RNA, 62 nt, Homo Sapiens
cugccaaauacauaggaauuuucuuucuuaaaaaacaguaaugaagacuauaucuccuuucc

SEQ ID NO: 104190 - RNA, 62 nt, Homo Sapiens
cauuaguuuaacucuuaaaacauaguguuguuaaacaguauuuuuugggggcggguggauag

SEQ ID NO: 104191 - RNA, 62 nt, Homo Sapiens
gguggauagcuuuuuguucuaucuuguacagaaaacaguaauggaaucacucauguucagaa

SEQ ID NO: 104192 - RNA, 62 nt, Homo Sapiens
acuugaugauuuugcauaaacacuuuaaaagcaaacaguaccuauaauaaaaaguuacaggu

SEQ ID NO: 104193 - RNA, 62 nt, Homo Sapiens
cuucuauauacuguaaauaacaccuaaaaugaaaacaguaacuccuacugaucagacucuuc

SEQ ID NO: 104194 - RNA, 62 nt, Homo Sapiens
gaagggcuguuuuuuaagaaaaaauuuuugguaaacaguauuguguaaaauugcuuuuugua

SEQ ID NO: 104195 - RNA, 62 nt, Homo Sapiens
acuccuguugauguuaaauuacuauauaauauaaacaguauguguuuuuauauaucauugug

SEQ ID NO: 104196 - RNA, 62 nt, Homo Sapiens
uucauaaagcaagacaacauuaugacacuuuaaaacaguagcaaagaagucuauuuauuaac

SEQ ID NO: 104197 - RNA, 62 nt, Homo Sapiens
uuuucuaaauuuuaguaagagagaagcuuuuaaaacaguacauuccugaauaaaacaacaau

SEQ ID NO: 104198 - RNA, 62 nt, Homo Sapiens
aaguacugcagaauuuaucauuagcaauggcuaaacaguaucaguccacuuaauuagucaaa

SEQ ID NO: 104199 - RNA, 62 nt, Homo Sapiens
ggaacacaauuuuuuucauuucuaauuuuuuaaaacaguaauauagaccaaagaugguguac

SEQ ID NO: 104200 - RNA, 62 nt, Homo Sapiens
uuaaaaggaaaagccuguuaugaccagcuuuaaaacaguacuagaccugaggaacuuuacac

SEQ ID NO: 104201 - RNA, 62 nt, Homo Sapiens
gcaguauggcagucauaaaaauuuuggaaccaaaacaguaucuuuuuuuaagcuaaaaaaaa

SEQ ID NO: 104202 - RNA, 62 nt, Homo Sapiens
uggcugcaauuacaggcaaccagccugacuuaaaacaguaucuuaagguagauggugauuag

SEQ ID NO: 104203 - RNA, 62 nt, Homo Sapiens
auaugaaauaaaauauauucuucuaagcaaagaaacaguacuauucauagaaaacauuaguu

SEQ ID NO: 104204 - RNA, 62 nt, Homo Sapiens
uuuuuaaaagcaguucaaguugacaacagcagaaacaguaacaaaaaaaucugcucagaaaa

SEQ ID NO: 104205 - RNA, 62 nt, Homo Sapiens
ugucaguagaagugagauaagauccucagaggaaacaguaagaagggauaaucauuaagaua

SEQ ID NO: 104206 - RNA, 62 nt, Homo Sapiens
cuaacugcccucucccaagauucauuuaguucaaacaguauccguaaacuaggaauaaugcc

SEQ ID NO: 104207 - RNA, 62 nt, Homo Sapiens; identical to SEQ ID NO: 104203

SEQ ID NO: 104208 - RNA, 62 nt, Homo Sapiens; identical to SEQ ID NO: 104204

SEQ ID NO: 104209 - RNA, 64 nt, Homo Sapiens
ugugguccugagcugugugcccuucucagucugaggggccuaaccuagagcagguuuccauagu

SEQ ID NO: 104210 - RNA, 64 nt, Homo Sapiens
gaaaaggugucucugagccgagggcaugugagcuggggccuaaacaacuagaaggagagagcca

SEQ ID NO: 104211 - RNA, 64 nt, Homo Sapiens
uggggcagggggcuacccaggggcuuccuauccuggggccuaccccgggcaggcacccccaggg

SEQ ID NO: 104212 - RNA, 64 nt, Homo Sapiens
accuggagucuacccagggccacccagcggcccuggggccuacccaucuucuggacagccaagu

SEQ ID NO: 104213 - RNA, 64 nt, Homo Sapiens
gucauuuuauuauuucaggauuaguacccuuuaaaggagcuacauuuaugucauacuuauuuuu

SEQ ID NO: 104214 - RNA, 64 nt, Homo Sapiens
ucaucuuccagcucagcucccugguuagucugggaggagcuauuaagcagaaggugcuggaagg

SEQ ID NO: 104215 - RNA, 64 nt, Homo Sapiens
uuuccgcagcaauaagaaugcucaggaacaguucaggagcuaaauaacaggguuuuaagcccag

SEQ ID NO: 104216 - RNA, 64 nt, Homo Sapiens
ugaaaaagguuaugugaaagcuuaaauguuccccaggagcuauaaaugauuuuucaaaacguau

SEQ ID NO: 104217 - RNA, 64 nt, Homo Sapiens
uuccaacagucagcuauuuuauggcacacuuuuuuugacugaugacaucuccuuugcuauaccu

SEQ ID NO: 104218 - RNA, 64 nt, Homo Sapiens
uauauuaaguaauuuuuaaauauuuguaauauuguugacugacuaauaaacuauuaaguuauug

SEQ ID NO: 104219 - RNA, 64 nt, Homo Sapiens
uggauaacaguaaugaucccauuaccagauaagauugacugacggggaaaaaaaaaaaaaaaga

SEQ ID NO: 104220 - RNA, 64 nt, Homo Sapiens
uucaccauuaaaauuccaaacccaaagccuuuguuugacugaaggagaagagagggaaguaagc

SEQ ID NO: 104221 - RNA, 64 nt, Homo Sapiens
ugaccguaaguauguuacuuaauuuauguaauauuugacugacuuuuucccuuuccgcaugaua

SEQ ID NO: 104222 - RNA, 64 nt, Homo Sapiens
gaugugagaaacuucuuuuccagucuuuucaguuuugacugaguuaaacuaccuccaaagcaag

SEQ ID NO: 104223 - RNA, 64 nt, Homo Sapiens
auugcgggguauauggagagucaggaaacuuccuuugacugauguucaguguccaucacuuugu

SEQ ID NO: 104224 - RNA, 64 nt, Homo Sapiens
uaaggaguugguaaaaagcaguucaacucuuagcuugacugagcuaaaauucacaggacuacgu

SEQ ID NO: 104225 - RNA, 64 nt, Homo Sapiens
gggccugcagcucccuucucaaugcaguuucugcuugacugacucuucaaagaaagacccaccg

SEQ ID NO: 104226 - RNA, 64 nt, Homo Sapiens
gugagauguuauuuguggcaccuuugcguuuuucuugacugaaguucaaaugagccaucuuuuu

SEQ ID NO: 104227 - RNA, 64 nt, Homo Sapiens
auuuaauuuuuuaauuugagaauuuuuauuucuuuugacugaaaacacauuagaaccuaugagu

SEQ ID NO: 104228 - RNA, 64 nt, Homo Sapiens
ucaggcauuuucaucugcuguccacguauuucacuugacugaaagcucauaugaguuaaaaugu

SEQ ID NO: 104229 - RNA, 64 nt, Homo Sapiens
ggcagaauuuuucuuaucccuugugaggcaguuguugacugaguuuuucauccuuacaauccug

SEQ ID NO: 104230 - RNA, 64 nt, Homo Sapiens
caacaguuauaguuugaaaguccaacuguauuaauugacugauaauaugauaauauagagauua

SEQ ID NO: 104231 - RNA, 64 nt, Homo Sapiens
aucagacguacucgucauaagugagaggcguguguugacugauugacccagcgcuuuggaaaua

SEQ ID NO: 104232 - RNA, 64 nt, Homo Sapiens
agguuaggacuuggugaacauguuugugggccuuuugacugaguggcagaaggaaacugcucag

SEQ ID NO: 104233 - RNA, 64 nt, Homo Sapiens
gccuugguaugacuuaaaauaggcccagggagggaagugugagcaagccccagcagcccucaac

SEQ ID NO: 104234 - RNA, 64 nt, Homo Sapiens
ccacugccaaguggggaugggccccucaacagccaagugugaccgagaagcuggacuucugugg

SEQ ID NO: 104235 - RNA, 64 nt, Homo Sapiens
uguuuuuuggaggugcaguuaaacuuuuaagcuuaagugugacaggacugauaaauagaagauc

SEQ ID NO: 104236 - RNA, 64 nt, Homo Sapiens
cauuucauaccauguauauauagagauguucuauaagugugagaaaguauaugcuuuaauagau

SEQ ID NO: 104237 - RNA, 64 nt, Homo Sapiens
cucaucccgaucucuuccugucagaggaccggagaagugugagaaggugccccuucaggcaccu

SEQ ID NO: 104238 - RNA, 64 nt, Homo Sapiens
gaacuaguuguuacacagcucccagccaagaagaaagugugagaaguugaugggcagcaaaccu

SEQ ID NO: 104239 - RNA, 64 nt, Homo Sapiens
uuuuaaauauaguugaguagugacgauaacacuuaagugugaauuauuuagaaguaaaguguga

SEQ ID NO: 104240 - RNA, 64 nt, Homo Sapiens
acgauaacacuuaagugugauuuauuuagaaguaaagugugauguaaugauaacguauuuggag

SEQ ID NO: 104241 - RNA, 64 nt, Homo Sapiens
uguguuuacuuagaugugaaaagcagugaauuguaagugugagguauacaucaauuauuacaaa

SEQ ID NO: 104242 - RNA, 64 nt, Homo Sapiens
aggcuuguuuuauuggaaggaccagaaaacugguaagugugacccagaucaagugugaggagau

SEQ ID NO: 104243 - RNA, 64 nt, Homo Sapiens
aaggaccagaaaacugguaagugugacccagaucaagugugaggagaugaggcuggggauaguc

SEQ ID NO: 104244 - RNA, 64 nt, Homo Sapiens; identical to SEQ ID NO: 60581

SEQ ID NO: 104245 - RNA, 64 nt, Homo Sapiens; identical to SEQ ID NO: 60582

SEQ ID NO: 104246 - RNA, 64 nt, Homo Sapiens
ccucaaaagcaagggcuucacuuucauuaccaaauaauguaaaaggggaaggaagaaaaaacgg

SEQ ID NO: 104247 - RNA, 64 nt, Homo Sapiens
gguggaaaggccucaagcucucuugucuguaauguaauguaaagauuuaaagaaauauguuguu

SEQ ID NO: 104248 - RNA, 64 nt, Homo Sapiens
uaaaggguggaaaggccucauuguuucuugucuguaauguaaugauuuaauuuaaagaaauaug

SEQ ID NO: 104249 - RNA, 64 nt, Homo Sapiens
gggccaacuccaauauaggguggguaaggccuuauaauguaaagagcauauaauguaaagggcu

SEQ ID NO: 104250 - RNA, 64 nt, Homo Sapiens
aggguggguaaggccuuauaauguaaagagcauauaauguaaagggcuuuagagugagacagac

SEQ ID NO: 104251 - RNA, 64 nt, Homo Sapiens
ccugcaauaaguguacuaaacucuacgcucugguuaauguaauguacucuccuggacugaaugc

SEQ ID NO: 104252 - RNA, 64 nt, Homo Sapiens
ugguuaaaauaaauacgccauuggcaauacuucauaauguaauggaauuguuuggggaacacuu

SEQ ID NO: 104253 - RNA, 64 nt, Homo Sapiens
uccuccucuaagaccauauuaacuauuuauuaacuaauguaauggguguuuuaaauucauuaua

SEQ ID NO: 104254 - RNA, 64 nt, Homo Sapiens
aguuggugcuuacuuucauuauagaguaaauuguuaauguaaauaacauuuggaaaaguaacaa

SEQ ID NO: 104255 - RNA, 64 nt, Homo Sapiens
uauuauugaguagaggccuagauuuuguuaagaguaauguaaacgcuaucuguuuauguagaau

SEQ ID NO: 104256 - RNA, 64 nt, Homo Sapiens
aaacuccaguauuaaaaaucgaagcuuaaauauguaauguaaccaguguccaucauucugugua

SEQ ID NO: 104257 - RNA, 64 nt, Homo Sapiens
ccaguucuucaaacacucuuaaauuuuucuuaaguaauguaaaaauggaacugccaauuuuauu

SEQ ID NO: 104258 - RNA, 64 nt, Homo Sapiens
guuugaaaauuauuaguuuugcaagaucacacacuaauguaaccauuuuaugaagguugaagug

SEQ ID NO: 104259 - RNA, 64 nt, Homo Sapiens
uuuuccuauuaaaaauucaguuuccccugagacuuaauguaaccacuuaauguaaucacuaucu

SEQ ID NO: 104260 - RNA, 64 nt, Homo Sapiens
aauucaguuuccccugagacuuaauguaaccacuuaauguaaucacuaucucauuguuucaucu

SEQ ID NO: 104261 - RNA, 64 nt, Homo Sapiens
uaguuuugcauauucuugugauaaaaaguguguauaauguaaagagaauuuuguaucuccuuug

SEQ ID NO: 104262 - RNA, 64 nt, Homo Sapiens
aaaaucaauuuuuaaaaaaucaccagauuuuuauuaauguaaaauuugguuuuauaauguuugu

SEQ ID NO: 104263 - RNA, 64 nt, Homo Sapiens
ucagcucugacuuuuugugucacauugcucuaguuaauguaaggaguuuucaaauacuauugac

SEQ ID NO: 104264 - RNA, 64 nt, Homo Sapiens
cuaauuacuaauauuuaugucuauaauuguuuuguaauguaagaauauuuuguuuaaauauaau

SEQ ID NO: 104265 - RNA, 64 nt, Homo Sapiens
ucauuucauuuaucauucauguaaauaguggugguaauguaaaacuaaugguaggaauguuaau

SEQ ID NO: 104266 - RNA, 64 nt, Homo Sapiens
aguggugguaauguaaaaucaaugguaggaauguuaauguaaauuuuuuauuuuggagacggcu

SEQ ID NO: 104267 - RNA, 64 nt, Homo Sapiens
gaauguuuuaaaaacagaacaaaaaucugcaagauaauguaacuagagauaauguaaacugaaa

SEQ ID NO: 104268 - RNA, 64 nt, Homo Sapiens
ugaaaaaaaaucugcaagauaaucaauguagagauaauguaaacauaugaccaucuuuccauca

SEQ ID NO: 104269 - RNA, 64 nt, Homo Sapiens
caaugaaaacuguuggagaagccuaguguuuucauaauguaauuuuauuaguaccuggcuugaa

SEQ ID NO: 104270 - RNA, 64 nt, Homo Sapiens
cuugggacagguguguaauguuagugugcaugacuaauguaagaaauuguuauucuacuaauau

SEQ ID NO: 104271 - RNA, 64 nt, Homo Sapiens
ucuaaagaaaagaaucagaaaucaaucuuucuacuaauguaaauuugagauuauuuuuaaaaau

SEQ ID NO: 104272 - RNA, 64 nt, Homo Sapiens
gcuagauuguuguguguuuuguugaauuuuuucauaauguaaugccguauuuauuguuuuuaaa

SEQ ID NO: 104273 - RNA, 64 nt, Homo Sapiens
uuguaugcuaguuuaaaaaagaaaauauguaauauaauguaaaaaaaaacaaaaaaaagcuuuu

SEQ ID NO: 104274 - RNA, 64 nt, Homo Sapiens
cuaauaguacuuguaauuucagagguaacuuguuuaauguaaauagagaaucgagaaauuugau

SEQ ID NO: 104275 - RNA, 64 nt, Homo Sapiens
aggggggggcucuacagcaguugagugccacuauuaauguaaaaacagaucuuauuuuuuuauu

SEQ ID NO: 104276 - RNA, 64 nt, Homo Sapiens
auaaaaaguaaagagaaugaaguauuuauagaaauaauguaaaaggauuuugggguuuuuuuuu

SEQ ID NO: 104277 - RNA, 64 nt, Homo Sapiens
ugguuucaagauuggggauuuaaccucagaccucuaauguaaguauauuuuaaaaguuauaaac

SEQ ID NO: 104278 - RNA, 64 nt, Homo Sapiens
auuuaucuuaucuagcaagacugaaaagaaaugcuaauguaaucugaguuuaaaaaaauaacau

SEQ ID NO: 104279 - RNA, 64 nt, Homo Sapiens
uucauagcauccugauuauuacauaauuaaauuuuaauguaaaauaacaacucuauuuuuuacu

SEQ ID NO: 104280 - RNA, 64 nt, Homo Sapiens
uauaaacucaagccuuuuuacuuauauguuauaguaauguaacgaaacacacauuugauauucu

SEQ ID NO: 104281 - RNA, 64 nt, Homo Sapiens
acgagugugcuucaguuuguguuuucuuaccuuuuaauguaauggcuugcugucucucagaauu

SEQ ID NO: 104282 - RNA, 64 nt, Homo Sapiens
agcauucauuuaaggaauagacaggaagguauauuaauguaacacugaggacaauauuuaaaug

SEQ ID NO: 104283 - RNA, 64 nt, Homo Sapiens
cuuuaaaaauauaaauuagagaacuuacucaaaauaauguaaauugcaucauuucauaggauua

SEQ ID NO: 104284 - RNA, 64 nt, Homo Sapiens
aaaugcagucauuuuauucucaagugcuuaaaauuaauguaauuaaaagcuuagcugacuacag

SEQ ID NO: 104285 - RNA, 64 nt, Homo Sapiens
aaaauugguuaaaaaauuuuguuuuuuaauuacguaauguaaaagcccaacaaacacuuuaugc

SEQ ID NO: 104286 - RNA, 64 nt, Homo Sapiens
gacuaaauaucauuccuucucaaggaauucagaguaauguaaaaguaguuaauaauaauuccaa

SEQ ID NO: 104287 - RNA, 64 nt, Homo Sapiens
ugaaguguuucuuaaagcucaagacauuuugaaauaauguaaugguucuaaggaauagcugcau

SEQ ID NO: 104288 - RNA, 64 nt, Homo Sapiens
uuuguauauaaugaaauuuuaccuguacauuguguaauguaaugccauuuucuuaguguuuuua

SEQ ID NO: 104289 - RNA, 64 nt, Homo Sapiens
uuuaugaaaugugugcaguaaacaaaaauguaguuaauguaauugguacuguuugguauuugca

SEQ ID NO: 104290 - RNA, 64 nt, Homo Sapiens
ugcauauuuuuuaacaaugcccaaucuguaugaauaauguaaacuucgauuuuuuuuuaaaaaa

SEQ ID NO: 104291 - RNA, 64 nt, Homo Sapiens
uuaaaaaaauuagauuuuagcuggagcuuuugacuaauguaaaguaaaugccaaacuaccgacu

SEQ ID NO: 104292 - RNA, 64 nt, Homo Sapiens
cuaggguccagucauauccuucuucuugaaacuguaauguaaauauuauacaugguugguuguc

SEQ ID NO: 104293 - RNA, 64 nt, Homo Sapiens
guaggguuuguaaaagucaccaguuacuauuuacuaauguaaacaccacauagcuuuugcacug

SEQ ID NO: 104294 - RNA, 64 nt, Homo Sapiens
uaaaaacacaaucaguguucaggcuucaguuauauaauguaagcacaacuaaaaugaaacuugu

SEQ ID NO: 104295 - RNA, 64 nt, Homo Sapiens
uguuucuauacaaaguaaauggauuguuugugcuuaauguaaagccgcuuuauaaaacuguaaa

SEQ ID NO: 104296 - RNA, 64 nt, Homo Sapiens
aaaaggacuauuaauagaaccuuuugagaugaauuaauguaagaauauuuuuuaaauaggcuua

SEQ ID NO: 104297 - RNA, 64 nt, Homo Sapiens
gaucaaaugcucuuaaauguuccuguuaccauccuaauguaaauacuggauuuuucugucauuu

SEQ ID NO: 104298 - RNA, 64 nt, Homo Sapiens
augagauaaaacaacacaaugcauguugccuuuuuaauguaaauacccguagguaucauuaaua

SEQ ID NO: 104299 - RNA, 64 nt, Homo Sapiens
cuuguuuuuaaauguuagauggcacuauguauauuaauguaaaacaauguuaauuuacucaagu

SEQ ID NO: 104300 - RNA, 64 nt, Homo Sapiens
caagcuggucucgaacuccugagacaggguuucauaauguaagucuaauuuuuguauuuuagua

SEQ ID NO: 104301 - RNA, 64 nt, Homo Sapiens
caacucuuaaauuauuuccuugaaaagugaguaauaauguaauuuuugaaaaaauuagauuuuu

SEQ ID NO: 104302 - RNA, 64 nt, Homo Sapiens
aauggaguagcaacuaguuuuguagcacuacauuuaauguaaugagauaccuuuguucauuuuu

SEQ ID NO: 104303 - RNA, 64 nt, Homo Sapiens
aguaucacaucuagcucccuuacuuguccacagauaauguaaacaaaggagggaaaaacuuauu

SEQ ID NO: 104304 - RNA, 64 nt, Homo Sapiens
aagucgugugaaauccuguacacuguguauagaauaauguaauuuuauguuaauuguuauuacu

SEQ ID NO: 104305 - RNA, 64 nt, Homo Sapiens
guaccucauguugaauguuauuguacuguauuuuuaauguaacagugcagaucuuguuagacac

SEQ ID NO: 104306 - RNA, 64 nt, Homo Sapiens
uuuccuucuagcuuccuacuauauaaugaacucguaauguaacagucacaauuuuccagauauu

SEQ ID NO: 104307 - RNA, 64 nt, Homo Sapiens
auaagcgauuccccucaacagcauauuaaaaauguaauguaauuggaugucagagaaacuuuau

SEQ ID NO: 104308 - RNA, 64 nt, Homo Sapiens
gugcuuccaaguuggggggacuucacaaaaacgguaauguaaauaaagcuuugaaaauaaagga

SEQ ID NO: 104309 - RNA, 64 nt, Homo Sapiens
uacccccugcuuaaaaauggacaaaaagaaacuauaauguaaugguuuucccuuaaaggaaugu

SEQ ID NO: 104310 - RNA, 64 nt, Homo Sapiens
ucuuucuacagaagaauauuggauugauuggaguuaauguaauacucaucauuuaccacugugc

SEQ ID NO: 104311 - RNA, 64 nt, Homo Sapiens
uaguaaauguccauugaaaacuauaaguagaucuuaauguaaaaugggaauugucucuuuguuc

SEQ ID NO: 104312 - RNA, 64 nt, Homo Sapiens
acccaaaaauaaaugucauaagauagguugaucuuaauguaacaugagccaccgugcccggccc

SEQ ID NO: 104313 - RNA, 64 nt, Homo Sapiens
cacuccccuucacuguggcccuacccuguccuuuuaauguaaguugccaucccaaaaccagcug

SEQ ID NO: 104314 - RNA, 64 nt, Homo Sapiens
ccauuagacacucaccagauuuuuggccaguuuuuaauguaacaccaaacguuuucugggcauu

SEQ ID NO: 104315 - RNA, 64 nt, Homo Sapiens
auuagauuaugauguucaguaacuuaaucucaucuaauguaaaucucuuugugacuuguaauuu

SEQ ID NO: 104316 - RNA, 64 nt, Homo Sapiens
gagcuuauggguagaagaccccacuuuguucuuuuaauguaaugucuuaagugagauguuaagc

SEQ ID NO: 104317 - RNA, 64 nt, Homo Sapiens; identical to SEQ ID NO: 60066

SEQ ID NO: 104318 - RNA, 64 nt, Homo Sapiens; identical to SEQ ID NO: 60067

SEQ ID NO: 104319 - RNA, 64 nt, Homo Sapiens; identical to SEQ ID NO: 60068

SEQ ID NO: 104320 - RNA, 64 nt, Homo Sapiens; identical to SEQ ID NO: 60069

SEQ ID NO: 104321 - RNA, 64 nt, Homo Sapiens; identical to SEQ ID NO: 60070

SEQ ID NO: 104322 - RNA, 64 nt, Homo Sapiens; identical to SEQ ID NO: 60071

SEQ ID NO: 104323 - RNA, 64 nt, Homo Sapiens; identical to SEQ ID NO: 60072

SEQ ID NO: 104324 - RNA, 64 nt, Homo Sapiens; identical to SEQ ID NO: 60073

SEQ ID NO: 104325 - RNA, 64 nt, Homo Sapiens; identical to SEQ ID NO: 60074

SEQ ID NO: 104326 - RNA, 64 nt, Homo Sapiens; identical to SEQ ID NO: 60075

SEQ ID NO: 104327 - RNA, 64 nt, Homo Sapiens; identical to SEQ ID NO: 60076

SEQ ID NO: 104328 - RNA, 63 nt, Homo Sapiens
aauucccaugccagagugaaaugauuaaguauaagaccagauucauggagccaagccacuaca

SEQ ID NO: 104329 - RNA, 63 nt, Homo Sapiens
uucuuuuguauuccccuuccccuauuaccuauuagaccagaucuucuguccuaaaaacuuguc

SEQ ID NO: 104330 - RNA, 63 nt, Homo Sapiens
ucuuugaggucucugucucuaaauaaaaagagaagaccagaaggagagugggcucauuggccu

SEQ ID NO: 104331 - RNA, 63 nt, Homo Sapiens
uuugcacuauuucaucaagaauuuuguggcuaaagaccagaccuuuauuucucaugaauuccc

SEQ ID NO: 104332 - RNA, 63 nt, Homo Sapiens
gaucggaggcucaggcccccaccagaccagaccagaccagaggggauguggaggagugaccag

SEQ ID NO: 104333 - RNA, 63 nt, Homo Sapiens
agagggaucggaggcucaggaccagaccagaccagaccagaccgaaguggauguggaggagug

SEQ ID NO: 104334 - RNA, 63 nt, Homo Sapiens
agaccagagggaucggaggcgagugaccagaccagaccagaccggguggaaguggauguggag

SEQ ID NO: 104335 - RNA, 63 nt, Homo Sapiens
agaccagaccagagggaucguggaggagugaccagaccagaccugaagggguggaaguggaug

SEQ ID NO: 104336 - RNA, 63 nt, Homo Sapiens
cauauaaaucugcuucaaccuuaggauguuuucagaccagaggcaacuuauucaugaauuuuu

SEQ ID NO: 104337 - RNA, 63 nt, Homo Sapiens
uacaaaaaguuuagggcauguuuucuguuuuaaagaccagaaguuugaaggcacccaaauccu

SEQ ID NO: 104338 - RNA, 63 nt, Homo Sapiens
uuacauuuugaugaccuccauuuugauacuuguagaccagaucuaauccgaagauuaaucuuu

SEQ ID NO: 104339 - RNA, 63 nt, Homo Sapiens
gagaagucuuaagagaugacugcucagauggagagaccagagaagagaacaagcuguugauuc

SEQ ID NO: 104340 - RNA, 63 nt, Homo Sapiens
caggagucuccaaagcacaggcagggacagaccagaccagaccaaaauacugaaagcacaggg

SEQ ID NO: 104341 - RNA, 63 nt, Homo Sapiens
agacccaggagucuccaaagcaggggcagggacagaccagaccaagagaaaauacugaaagca

SEQ ID NO: 104342 - RNA, 63 nt, Homo Sapiens
guguuuaagguuucuccccaaaacaaagguuucagaccagaugccuagguucccucaucugua

SEQ ID NO: 104343 - RNA, 63 nt, Homo Sapiens
gaauagacuacacugauaaaaaauuaccguuuuagaccagaauauuuggggguuauucagcca

SEQ ID NO: 104344 - RNA, 63 nt, Homo Sapiens
uagccccacccucacuccaggagucgccucucuagaccagaucggagccagcaagagagcuug

SEQ ID NO: 104345 - RNA, 63 nt, Homo Sapiens
ggaccuuuuaaggaaagaagccuccggcagugcagaccagaggccagcaccccucuccuuugg

SEQ ID NO: 104346 - RNA, 64 nt, Homo Sapiens
cauuauuuauugcuguguaaugaccagaaaucaaaaagggaaugcuggggcuagaucgaugaua

SEQ ID NO: 104347 - RNA, 64 nt, Homo Sapiens
aggauauguggagaaucaucggguauaaaggcuaaaagggaaaauguccagcugaguuucucuu

SEQ ID NO: 104348 - RNA, 64 nt, Homo Sapiens
uaagauggauaaucacuuucugugguaucuaauaaaagggaagguuuuaagaacucuugaauug

SEQ ID NO: 104349 - RNA, 64 nt, Homo Sapiens
ugaaagcugucauuacagaccuuuggguuuggagaaagggaaugggacuacuuuaauuuggauc

SEQ ID NO: 104350 - RNA, 64 nt, Homo Sapiens
aaaagaagagguggcaccauaucagucccucaggaaagggaagagaauagcagagagcaaacca

SEQ ID NO: 104351 - RNA, 64 nt, Homo Sapiens
agaaggaggacgcugcaggagagaggguacaacuaaagggaaugaggaaaggucucagaugaaa

SEQ ID NO: 104352 - RNA, 64 nt, Homo Sapiens
uauccaugucaguuucuuucucauacaucucuugaaagggaaaaccucacaguggguaaauaua

SEQ ID NO: 104353 - RNA, 64 nt, Homo Sapiens
gucagggaaggggagaagaagucggggaugggagaaagggaaaacuuccauugugggguaggug

SEQ ID NO: 104354 - RNA, 64 nt, Homo Sapiens
gaaaaacuugaaaugcuacuuaacuuacuauuucaaagggaaguauauuucuuuuuaaagaauc

SEQ ID NO: 104355 - RNA, 64 nt, Homo Sapiens
uuuuucaauagauuauucugccauuuuuuaaaggaaagggaaaaugaaaacagcaugucuuuuu

SEQ ID NO: 104356 - RNA, 64 nt, Homo Sapiens
uauguuuuguuugaaaaauuauuaugaccaauaaaaagggaauguagcuugaaagaugcucuac

SEQ ID NO: 104357 - RNA, 64 nt, Homo Sapiens
augaacuagaaaccagcaagaucaucuuaaugacaaagggaauaacauuaauuugucuagcauu

SEQ ID NO: 104358 - RNA, 64 nt, Homo Sapiens
uccugccagcucaaccugucauuuacagacuaagaaagggaaguacacaccuggcuuguggcca

SEQ ID NO: 104359 - RNA, 64 nt, Homo Sapiens
gcaacauggcgagacccuguuucuacaaaaagaaaaagggaaaaaaaaagcagggacugucauu

SEQ ID NO: 104360 - RNA, 64 nt, Homo Sapiens
accaaugaaaaaaggucaguugauuccagugcuaaaagggaaaaaccugugguccgcccagaag

SEQ ID NO: 104361 - RNA, 64 nt, Homo Sapiens
acgcagaaaagaaaaaaagguuaagcauaaaaagaaagggaaaaagcagaaacacugcagaaga

SEQ ID NO: 104362 - RNA, 64 nt, Homo Sapiens
aagagaacacaccaaaaaagugaaagagaaauugaaagggaaaaaagacaaaaagcauaaggcu

SEQ ID NO: 104363 - RNA, 64 nt, Homo Sapiens
agaaaagguuuauauuauuagugaaaacaaaacuaaagggaaguucaaguucucauguaaugcc

SEQ ID NO: 104364 - RNA, 64 nt, Homo Sapiens
ccaguguagggcuaucuuuuuaaaaaaugucaacaaagggaaaauaaacuaucagcuuggaugg

SEQ ID NO: 104365 - RNA, 64 nt, Homo Sapiens
gugaauuagccagcuagaauccguuuucuugcucaaagggaacauaaguccuuuucucccugug

SEQ ID NO: 104366 - RNA, 64 nt, Homo Sapiens
uuuaauccaaagaaagauuaggugguuuuauuucaaagggaaacuuuagcagucagauuaggua

SEQ ID NO: 104367 - RNA, 64 nt, Homo Sapiens
aaguuugcuccuccauagauaaugaauuuucuauaaagggaaaagcccacuucauaucacacaa

SEQ ID NO: 104368 - RNA, 64 nt, Homo Sapiens
aaguuccggaauuuguucgcagggcaguccuuugaaagggaagcguuuacugcugcuuggggcc

SEQ ID NO: 104369 - RNA, 64 nt, Homo Sapiens
auuucuacaugugcauauagaaugcuucuauuuaaaagggaaauuauuuauauguguuauaaug

SEQ ID NO: 104370 - RNA, 64 nt, Homo Sapiens
cggcgucgcccucauuucaaaucgcgcuaagaauaaagggaaaauucauugagggccuaaagua

SEQ ID NO: 104371 - RNA, 64 nt, Homo Sapiens
guccuagguuuucuuugugcccaguuuaaaacaaaaagggaaaucuccaaggaguuagaauuuc

SEQ ID NO: 104372 - RNA, 64 nt, Homo Sapiens
aaaagucuuuugaagguagcgcauaaugaauguaaaagggaaauaaagaauagaagugaaauuu

SEQ ID NO: 104373 - RNA, 64 nt, Homo Sapiens
uucucuuuggaaaaaaacuaccacuguggucuuaaaagggaacaaaauauaccauaggcuaaaa

SEQ ID NO: 104374 - RNA, 64 nt, Homo Sapiens
cuuucucucugaaagcagaaaaaggcacugauauaaagggaagagaaggaggcucaccggaggg

SEQ ID NO: 104375 - RNA, 64 nt, Homo Sapiens
uuaaaagcacaucuauguucacugccacucugaaaaagggaauuauuucucagucuuucaaggc

SEQ ID NO: 104376 - RNA, 64 nt, Homo Sapiens
ccaagguuggagggugggaugaguacccucugaaaaagggaauuugcuggugaaaagaggcugg

SEQ ID NO: 104377 - RNA, 64 nt, Homo Sapiens
ccuggcauucugugguguuuccgccguucccuugaaagggaacauacuguaggcagcugaagaa

SEQ ID NO: 104378 - RNA, 64 nt, Homo Sapiens
ucacuuguuuuucuuuagauaacuauguaaacaaaaagggaaacaauauauggagaaaugaaca

SEQ ID NO: 104379 - RNA, 64 nt, Homo Sapiens
uaaacugacuuuuauaaugaaauacgaaacacagaaagggaaaaauuuacugacaaaaagggaa

SEQ ID NO: 104380 - RNA, 64 nt, Homo Sapiens
uacgaaacacagaaagggaaucauuuacugacaaaaagggaaaaauuuccaaucaguguauugc

SEQ ID NO: 104381 - RNA, 64 nt, Homo Sapiens
accuuuucuucuaguaagugacuagaauuagagaaaagggaaaguggaguuaccucagcagaag

SEQ ID NO: 104382 - RNA, 64 nt, Homo Sapiens
aacuaauacuacuguaccuguuauggaggacugcaaagggaagagaaaagcagaacacuguauu

SEQ ID NO: 104383 - RNA, 64 nt, Homo Sapiens
uauauuugcaguuggggacagguugaguagaggaaaagggaaagaagggaaagcagaaaacaaa

SEQ ID NO: 104384 - RNA, 64 nt, Homo Sapiens
auuagguuugaauugcuuuugugggaggaggaagaaagggaagauugagaagcaggcggguugg

SEQ ID NO: 104385 - RNA, 64 nt, Homo Sapiens
auuagguuugaauugcuuuugugggaggaggaagaaagggaagacugagaagcaggcggguugg

SEQ ID NO: 104386 - RNA, 64 nt, Homo Sapiens
ccauccaaauuugaaagcugcagauagcaaaagaaaagggaaagaaaaaugaaaggugaguaac

SEQ ID NO: 104387 - RNA, 64 nt, Homo Sapiens
aucuaaaaaugaaaggugagggcuggaagaagugaaagggaagccauuuaagaauugaacuagg

SEQ ID NO: 104388 - RNA, 64 nt, Homo Sapiens
aaggaggcagcauggagagacagcuuauaaaaauaaagggaagaaaaaacauuuuagaaacgga

SEQ ID NO: 104389 - RNA, 64 nt, Homo Sapiens
aaaucccaucagugaauccugugaacaaacuuagaaagggaaggccguuuuagaaaaggaaaac

SEQ ID NO: 104390 - RNA, 64 nt, Homo Sapiens
ggaggaaguggacucgaauccuggaggaggaaauaaagggaaagggaagucguggagaggcagg

SEQ ID NO: 104391 - RNA, 64 nt, Homo Sapiens
aguggacucgaauccuggaggaggaaauaaagggaaagggaagucguggagaggcagggaaaau

SEQ ID NO: 104392 - RNA, 64 nt, Homo Sapiens
gaagcagaagugggacaucguuucaaucuucuagaaagggaacggcaugugguuuugaccuuuu

SEQ ID NO: 104393 - RNA, 64 nt, Homo Sapiens
cacuuuaccuugcgguggugacagggguuccagaaaagggaaguaaaauugguacuccugugcc

SEQ ID NO: 104394 - RNA, 64 nt, Homo Sapiens
aaaaaauucuguagauagcaucuaauagagguuaaaagggaaaaauuccaccuccuuccugaac

SEQ ID NO: 104395 - RNA, 64 nt, Homo Sapiens
ggaagcaguagcacuaaugcauggcuaccacgggaaagggaaggagugcugugauugacuagua

SEQ ID NO: 104396 - RNA, 64 nt, Homo Sapiens
uuuugugccuugguguuccaaucucugugacuacaaagggaagugcacugggaauggaaacuua

SEQ ID NO: 104397 - RNA, 64 nt, Homo Sapiens
acagauaguuuagguugugcuuuggguaaauaaaaaagggaaguuuucaguuuacucaaaaacu

SEQ ID NO: 104398 - RNA, 64 nt, Homo Sapiens
agggcagugcaugacuggcccugcaauagagaagaaagggaagugccuacaggccauaguuaac

SEQ ID NO: 104399 - RNA, 64 nt, Homo Sapiens
gauuaaaauaaguauuauuauauaaagacauacuaaagggaacauauauacacgaggggaacug

SEQ ID NO: 104400 - RNA, 64 nt, Homo Sapiens
gcuucuuugacuuuuuuucauuaggacugaauucaaagggaaauauuauaaggcauucauauuu

SEQ ID NO: 104401 - RNA, 64 nt, Homo Sapiens
cuugcuuuaaucugugggauaaaacuuugcguauaaagggaaaaauacaauagcuuaccuggcu

SEQ ID NO: 104402 - RNA, 64 nt, Homo Sapiens
ugggcuaaagagaagacgacgagaguaaggaaauaaagggaauugccucuggcuagagaguagu

SEQ ID NO: 104403 - RNA, 64 nt, Homo Sapiens
ugcuaaggcagaauuuugagggugggagagaagaaaagggaaagaagcugaaaauguaaaacca

SEQ ID NO: 104404 - RNA, 64 nt, Homo Sapiens
aaaucucauuaauuaauuguagugggaauauaggaaagggaacccucuccugaaacuuaaaaac

SEQ ID NO: 104405 - RNA, 64 nt, Homo Sapiens
cagaccaggccuaaagcccaucagcucuuuauauaaagggaaacucagccgccugagauggggg

SEQ ID NO: 104406 - RNA, 64 nt, Homo Sapiens
uauugguaauguuuuugaucagaauaaagaggguaaagggaaaaaguuacuacacaugcuaggc

SEQ ID NO: 104407 - RNA, 64 nt, Homo Sapiens
acucagugaacauucuuaccuaagcaaggcuauaaaagggaauacuacaguuuuguccacacuu

SEQ ID NO: 104408 - RNA, 64 nt, Homo Sapiens
ccucugaacauaaauuuggucaaauaauuggaacaaagggaaacagauacuugauaugaaagcc

SEQ ID NO: 104409 - RNA, 64 nt, Homo Sapiens
cauaaggucauuuucucccucuacucacaauacuaaagggaaaaaauggauucaaagcuaggau

SEQ ID NO: 104410 - RNA, 64 nt, Homo Sapiens
aagggcagccagagagaaaggucggguuacccacaaagggaagcccaucagacucacagcugac

SEQ ID NO: 104411 - RNA, 64 nt, Homo Sapiens
agagaagaaucaaauagaugcaauaaaaaaugauaaagggaauaucaucacugaucccacagaa

SEQ ID NO: 104412 - RNA, 64 nt, Homo Sapiens
acgccaaaauguugacaaugaaaacaaaaauccuaaagggaaauuuucuuucuauauauggauu

SEQ ID NO: 104413 - RNA, 64 nt, Homo Sapiens
cuggguuuuuguacaaaaauuggggacggaggggaaagggaagcaauuacuuuucauguugggg

SEQ ID NO: 104414 - RNA, 64 nt, Homo Sapiens
uaguuuuguaaucaagauuuuauguaacauuuguaaagggaaaauuagcacuuuugugguucuu

SEQ ID NO: 104415 - RNA, 64 nt, Homo Sapiens
ugaaguugucaauuccucuuauucuuaaauaucuaaagggaaaggaaaccaacuuuaauuucag

SEQ ID NO: 104416 - RNA, 64 nt, Homo Sapiens
ggcugggauggucucugcugaguuagagacggagaaagggaagaaugagggcaccgcgcagcuc

SEQ ID NO: 104417 - RNA, 64 nt, Homo Sapiens
cccccagggccugcuguggcaugguguagguucaaaagggaaacucccaaaggccaaggaaggg

SEQ ID NO: 104418 - RNA, 64 nt, Homo Sapiens
cuccugccacgccacugugucaugaaggaaagugaaagggaacgaggaaguaggaaugcccacg

SEQ ID NO: 104419 - RNA, 64 nt, Homo Sapiens
ccaccaggguucuuuugaaauaguaccacauguaaaagggaauuuggcuuucacuucaucuaau

SEQ ID NO: 104420 - RNA, 64 nt, Homo Sapiens
cccauagaccccaguugaagauggaauuuucaggaaagggaaaauacuagauaauucuagaauu

SEQ ID NO: 104421 - RNA, 64 nt, Homo Sapiens
ggugaaauucacauaacauaaaguuaaccauuuuaaagggaacaauucaguggcauuugguacu

SEQ ID NO: 104422 - RNA, 64 nt, Homo Sapiens
gacaugucacauaucaaaugguaaaaaaaaaaaaaaagggaauuagugcagcauuucagcauau

SEQ ID NO: 104423 - RNA, 64 nt, Homo Sapiens
uuaguuaauuaagugauaagacaauuuuuuuuuaaaagggaacugccgcuucauucaugccuac

SEQ ID NO: 104424 - RNA, 64 nt, Homo Sapiens
aaacacuguuaucauuuuuuaguuuugggaaguuaaagggaagaacaggugauuaacuuggaug

SEQ ID NO: 104425 - RNA, 64 nt, Homo Sapiens
ugagcugcuuuuuuugaaaccuaguaauauauuuaaagggaaauuauacaacaccaaaaaauau

SEQ ID NO: 104426 - RNA, 63 nt, Homo Sapiens
ccaccugagaccugcuccacgacccuuccaggcagagccgagaguucgccccaacccuucccc

SEQ ID NO: 104427 - RNA, 63 nt, Homo Sapiens
acccggacagcucaguccugccagcagccgcaaagagccgaggcugccaggcccauuuauguc

SEQ ID NO: 104428 - RNA, 64 nt, Homo Sapiens
cucgaagcuuggcggacccccagggccacacuguacccuccagcgagucccaggagagugacuc

SEQ ID NO: 104429 - RNA, 64 nt, Homo Sapiens
ucucagcuucugcgaucagauuaucaucaccaccacccuccagagaauuuuuacgcaagaagag

SEQ ID NO: 104430 - RNA, 64 nt, Homo Sapiens
ucagguacugagcaaggcccaccccaccuagaccacccuccaugguggccccagggcuucuaaa

SEQ ID NO: 104431 - RNA, 64 nt, Homo Sapiens
cacugguuccccacugcccuagauagcagaggacacccuccaaacccccccauggaugcccuuc

SEQ ID NO: 104432 - RNA, 64 nt, Homo Sapiens
uuuccauuguggaucacagcacacacauacauacacccuccaccuccccauccccuguucuccc

SEQ ID NO: 104433 - RNA, 64 nt, Homo Sapiens
cuucuuugaucccagcaucucagucccccucccaacccuccauauggcucucaauggugcucac

SEQ ID NO: 104434 - RNA, 64 nt, Homo Sapiens
ucagcccuguacaccugaccgggcccugacccuaacccuccagcccagaccagaguuuccugag

SEQ ID NO: 104435 - RNA, 64 nt, Homo Sapiens
guaccuggcugagacugucauccuugugaccuggacccuccauucaugcucaccauagcccccu

SEQ ID NO: 104436 - RNA, 64 nt, Homo Sapiens
accagcucugggggaggcacgagcccucccagggacccuccacgccgagguccccagacccccu

SEQ ID NO: 104437 - RNA, 64 nt, Homo Sapiens
aaaugacagcagucagugccacauucuguucuacacccuccaggugaggaccgcgacaaggacg

SEQ ID NO: 104438 - RNA, 64 nt, Homo Sapiens
uaccccuuccagaagcaaaaccaaagcauuucccacccuccauccuguucaucccauguuagcu

SEQ ID NO: 104439 - RNA, 64 nt, Homo Sapiens
ccaaccagcuucccuacuccuucuggaucuugugacccuccaugucuuuuuccaucccuagcca

SEQ ID NO: 104440 - RNA, 64 nt, Homo Sapiens
gugggagguggugguggguggagcuuugggacgcacccuccacaccuacccucucacuuaacug

SEQ ID NO: 104441 - RNA, 64 nt, Homo Sapiens
caaggagcagcccugcccagugucuccccuucccacccuccagcuguucaaaagcugugauuuu

SEQ ID NO: 104442 - RNA, 64 nt, Homo Sapiens
aacaacagaugaaagccaguggagagcagacugcacccuccagcuacaugguacuguauguaug

SEQ ID NO: 104443 - RNA, 64 nt, Homo Sapiens
ccccugcauugcucuucuguuucaucagcagagcacccuccaucgggccacucccucccuagcc

SEQ ID NO: 104444 - RNA, 64 nt, Homo Sapiens
uuccauuuucccccacuacugcagcaaacacuccacccuccaccacccuccacucagcuguccu

SEQ ID NO: 104445 - RNA, 64 nt, Homo Sapiens
cagcuguccugcagcaaacauugcaccuguccccacccuccacugcucucuaggccucuccagu

SEQ ID NO: 104446 - RNA, 64 nt, Homo Sapiens
cucugggugccagguacgacgcuugccccggcccacccuccauccccacccuccauccccaccc

SEQ ID NO: 104447 - RNA, 64 nt, Homo Sapiens
guacgacgcuugccccggcccacccuccauccccacccuccauccccacccuagauggagcgag

SEQ ID NO: 104448 - RNA, 64 nt, Homo Sapiens
ccccuccuccacuggguucagaggguaagaaagcacccuccaauaaacccaggcuccaggccgu

SEQ ID NO: 104449 - RNA, 64 nt, Homo Sapiens
gagagguuuccugcguuuuauuucuauuugguauacccuccacuguuguccacugcccugugug

SEQ ID NO: 104450 - RNA, 64 nt, Homo Sapiens
uagcagcugcuucggaacaccgucccuccuaugcacccuccaagacgugcagcagaugcaaagg

SEQ ID NO: 104451 - RNA, 64 nt, Homo Sapiens
ggaugcugagagaggaggcccgagaggacaccccacccuccagcguggccuuugauccagacuu

SEQ ID NO: 104452 - RNA, 64 nt, Homo Sapiens
gcugcgaccagagacuggagacgucagccagcacugcacagacacacagacagcugcgaccagg

SEQ ID NO: 104453 - RNA, 64 nt, Homo Sapiens
gcugcgaccaggacgucagcacaucagccagcacugcacagacaugaggccgugguuagcgugg

SEQ ID NO: 104454 - RNA, 64 nt, Homo Sapiens
gggcaugaccuucagcucacagaaagacacaggaugcacagaauugacauccaaguuuaccagu

SEQ ID NO: 104455 - RNA, 64 nt, Homo Sapiens
cacuuggaugaaauaagaccaggacaauuuccagugcacagaauuaaugaaagggaggaacgga

SEQ ID NO: 104456 - RNA, 64 nt, Homo Sapiens
gcucccugaaggcacacguacgcacacacgcacaugcacagauaugccgccugggcacacagau

SEQ ID NO: 104457 - RNA, 64 nt, Homo Sapiens
acacacgugcagauaugguauccggacacacacgugcacagauaugcugccuggacacacagau

SEQ ID NO: 104458 - RNA, 64 nt, Homo Sapiens
acggauauugccuggacacacacacacacacgugugcacagauaugcugucuggacacgcacac

SEQ ID NO: 104459 - RNA, 64 nt, Homo Sapiens
acacgcagacaugcuguccggacacacacacgcaugcacagauaugcuguccggacacacacac

SEQ ID NO: 104460 - RNA, 64 nt, Homo Sapiens
acacacgugcagauauugccuggacacacacaugugcacagauaugcugucuggacaugcacac

SEQ ID NO: 104461 - RNA, 64 nt, Homo Sapiens
ggggggcucugguggucaaggaacagaggacagaugcacagacgccgguggccuuuccagagcu

SEQ ID NO: 104462 - RNA, 64 nt, Homo Sapiens
uacacuaaacacgaacauaccacacacgcaaguaugcacagacaagugaacaugugugcgugug

SEQ ID NO: 104463 - RNA, 64 nt, Homo Sapiens
ugcucuuaacaaacacugcugcagucagcauccuugcacagauuucuuuguauacuuguauuag

SEQ ID NO: 104464 - RNA, 64 nt, Homo Sapiens
uagggauguuggggugagucagugugaccccacgugcacagaaagugcugcgaguggugcaugg

SEQ ID NO: 104465 - RNA, 64 nt, Homo Sapiens
aggaaagcaaauguagguaaggggagagcaaggaugcacagaaaacacacugacugugggacug

SEQ ID NO: 104466 - RNA, 64 nt, Homo Sapiens
uuuaaggaaccugcuaucaggaaaucuacaugugugcacagagagagaaaaguagaacaguucu

SEQ ID NO: 104467 - RNA, 64 nt, Homo Sapiens
uucuaaauuugauuauauucucugaugaucccuuugcacagaacuaugcuuaucucauguuugu

SEQ ID NO: 104468 - RNA, 64 nt, Homo Sapiens
ucuguacauauuuuuguaccuuuuauguaaauuuugcacagaaauuuuuggcauaaguuuauuu

SEQ ID NO: 104469 - RNA, 64 nt, Homo Sapiens
agugggcaaaugcggacccucccugccugcagccugcacagauucugguuugagguuugacucu

SEQ ID NO: 104470 - RNA, 64 nt, Homo Sapiens
ucgccugccagcccagagcccuggaggagccggcugcacagagaggcuuuucuucccagcuggg

SEQ ID NO: 104471 - RNA, 64 nt, Homo Sapiens
cuagggggacauuuuucugagcaucaguuacuuuugcacagauuucgugucacauacugcaggu

SEQ ID NO: 104472 - RNA, 64 nt, Homo Sapiens
acuagaaaaggggcagaaccguggcauaaccuugugcacagagacucugacugccuuggaguag

SEQ ID NO: 104473 - RNA, 64 nt, Homo Sapiens
caugccaaugcacgcacacaucagugcacacggaugcacagagauaugcacacaccgaugugcg

SEQ ID NO: 104474 - RNA, 64 nt, Homo Sapiens
ccaaauguauuucucccuucgcugggugccgggcugcacagacuauuccccaccugcuucccag

SEQ ID NO: 104475 - RNA, 64 nt, Homo Sapiens
accuaccuucuuuccagagguuccagaugauccuugcacagacagagaguuccagauucccagc

SEQ ID NO: 104476 - RNA, 64 nt, Homo Sapiens
aguucuagggagauguauuuuuauguuuauuauuugcacagaaguaaauaaauguuaauauuau

SEQ ID NO: 104477 - RNA, 64 nt, Homo Sapiens
acacugcacacaugcacacaacagcacacacaagugcacagagccacacaggugcacagaccac

SEQ ID NO: 104478 - RNA, 64 nt, Homo Sapiens
acacagcacacacaagugcacacaugcacacaggugcacagaccaaagugcauaggccacacag

SEQ ID NO: 104479 - RNA, 64 nt, Homo Sapiens
acacacagcacuaacacauguacacauacacaagugcacagacccguguagcucacacacagua

SEQ ID NO: 104480 - RNA, 64 nt, Homo Sapiens
acacacaugcacacacgugucuuacauguacacgugcacagaucuacaggcauacacaugcacg

SEQ ID NO: 104481 - RNA, 64 nt, Homo Sapiens
agcucccuaaacucuuggaggaucaugauauguuugagcauagucuuuggcuauccugggcucu

SEQ ID NO: 104482 - RNA, 64 nt, Homo Sapiens
cagcagcucacugaagcgccaagaguugaaugacugagcauauugggaugacuccuggacagug

SEQ ID NO: 104483 - RNA, 64 nt, Homo Sapiens
cauccuuauacuucaugagggcauugaucuuacaugagcauaauucagugauagggaaauagcu

SEQ ID NO: 104484 - RNA, 64 nt, Homo Sapiens
uauauguuuagugacaaaucuuuuaaaagugcuuugagcauauguuaaaucacaacuuaaaagu

SEQ ID NO: 104485 - RNA, 64 nt, Homo Sapiens
agcagcacauucuuacagaggagauggagcguuaugagcauaguauguggauagguaucuucac

SEQ ID NO: 104486 - RNA, 64 nt, Homo Sapiens
cuaucagggucuucccauggugguucagaauagaugagcauagcaugguuuuguuuguuuuugc

SEQ ID NO: 104487 - RNA, 64 nt, Homo Sapiens
gguuauuugagcaaguaacauucuguaccuaacuugagcauaaggacuuucuuaaaaauauuuu

SEQ ID NO: 104488 - RNA, 64 nt, Homo Sapiens
uccauaaguaagaaauuucuuaaguauuguuuccugagcauaacgaguuuacaguuuaagauuu

SEQ ID NO: 104489 - RNA, 64 nt, Homo Sapiens
uuuggaaaaccuucaccucaugauccaggccccucaguccaagcucuuuccgucccucucuuuc

SEQ ID NO: 104490 - RNA, 64 nt, Homo Sapiens
aagcugaaagugcagcucgcggcgcugcuccccacaguccaaaugcggccaccaacugaccugg

SEQ ID NO: 104491 - RNA, 64 nt, Homo Sapiens
ggguagcaacuggccaaaugaaacguucuaugugcaguccaauauaacuuuuuugcaauaaugg

SEQ ID NO: 104492 - RNA, 64 nt, Homo Sapiens
acuuuuuugcaauaauggaagcucuagagucgggcaguccaauacaggacuccugagcagguag

SEQ ID NO: 104493 - RNA, 64 nt, Homo Sapiens
cauagcugguuuuagaaaccuccucauuuuggggcaguccaagagaacagccaccacucuauca

SEQ ID NO: 104494 - RNA, 64 nt, Homo Sapiens
augucuuucaccaacucccuggaacugagagaagcaguccaaagcuucagauugucugacagca

SEQ ID NO: 104495 - RNA, 64 nt, Homo Sapiens
agaaauauuaguguuacggaagugccuaauaucccaguccaaauuuuuuuuuuuuuuuuuuuuu

SEQ ID NO: 104496 - RNA, 64 nt, Homo Sapiens
ugggauuacaggugugagccaccacgccuggccccaguccaaaauauuuaaagauuguuuccuu

SEQ ID NO: 104497 - RNA, 64 nt, Homo Sapiens
aauaucaaaauucugguugucucuagcaggcaugcaguccaagggcugcuguucuuuaaucuuc

SEQ ID NO: 104498 - RNA, 64 nt, Homo Sapiens
aauaucaaaauucugauugucucuagcaggcaugcaguccaagggcugcugcucuuuaauuuuc

SEQ ID NO: 104499 - RNA, 64 nt, Homo Sapiens
cuucacagaaaauaaaagguguuaauuugcuuuuuaaaacaaauuuaauuaucacauuuuaaau

SEQ ID NO: 104500 - RNA, 64 nt, Homo Sapiens
uugaaaucuaugauuuacugcaguaguaugugcuuaaaacaacuguugaggucuuuuaagcagg

SEQ ID NO: 104501 - RNA, 64 nt, Homo Sapiens
uuugcuuccagcaaguauguuagacuagauauuauaaaacaacuagauccugaauaaaaucugc

SEQ ID NO: 104502 - RNA, 64 nt, Homo Sapiens
gauaaacauaaguaaauuuaaacuguuguuuguauaaaacaauuauaaugaaguguuuauaaga

SEQ ID NO: 104503 - RNA, 64 nt, Homo Sapiens
ucuaaucugagugaguuacugagcuuugguccacuaaaacaagcugagcuuugguccacuaaaa

SEQ ID NO: 104504 - RNA, 64 nt, Homo Sapiens
uugguccacuaaaacaagcugagcuuugguccacuaaaacaagaugaaaaauacaagagugacu

SEQ ID NO: 104505 - RNA, 64 nt, Homo Sapiens
acaaguuauugauucacucuauuaauuuaauuuuuaaaacaaauaaaagcaacucuuaucaagg

SEQ ID NO: 104506 - RNA, 64 nt, Homo Sapiens
agacuugaaaagaaaccauuuucucacuauacucuaaaacaacuuuaaaauugugucaagguau

SEQ ID NO: 104507 - RNA, 64 nt, Homo Sapiens
ggcacagcaucuguagucagauucuuuuccaaaauaaaacaaaggacaagaugguacaaccuuu

SEQ ID NO: 104508 - RNA, 64 nt, Homo Sapiens
caaaacaacauuuugagaacaaagaacauaaagguaaaacaaaaauagcaucuguacaaagggg

SEQ ID NO: 104509 - RNA, 64 nt, Homo Sapiens
acaaaaacagcaguuugugauggugggucuuuaauaaaacaacaaaccugaagaugaguaaaac

SEQ ID NO: 104510 - RNA, 64 nt, Homo Sapiens
caaaacaaacuuccaaacagucaguggcuggaauuaaaacaaaacaauaacuucuauguugguu

SEQ ID NO: 104511 - RNA, 64 nt, Homo Sapiens
aaagguugcuguuuucuauuugagaaguaggcuauaaaacaaaacacuaaucacacaacaauuu

SEQ ID NO: 104512 - RNA, 64 nt, Homo Sapiens
uacuauagaacauuuaaaugcauuuggggaugguuaaaacaaauuuugacauuggcacuaaaug

SEQ ID NO: 104513 - RNA, 64 nt, Homo Sapiens
uaacuaaagaaaugugagcuuucaaauuguuuaguaaaacaaaaaacaugaauauaaugcuuac

SEQ ID NO: 104514 - RNA, 64 nt, Homo Sapiens
ugccucauauauuucuccucgguacagugccguauaaaacaaccaaauguuagguuuccuaaag

SEQ ID NO: 104515 - RNA, 64 nt, Homo Sapiens
ugugggggcaaaauuuaauuuggauuugauuuuuuaaaacaauguuuacugcgauuucuauauu

SEQ ID NO: 104516 - RNA, 64 nt, Homo Sapiens
agcuaugaugaccuucauauaaucagcauaaacauaaaacaaauuuuuuacuuaacaugagugc

SEQ ID NO: 104517 - RNA, 64 nt, Homo Sapiens
cuuuagcacacuaggugguaugccuuuauuagcauaaaacaaaaaaaacuuuaacaggagcuuu

SEQ ID NO: 104518 - RNA, 64 nt, Homo Sapiens
aaauuauucuuuuauauaacugaccagugcuuaauaaaacaagcagguacuuacaaauaauuac

SEQ ID NO: 104519 - RNA, 64 nt, Homo Sapiens
ggaguagaaaacaacaaagaauggaauggacucuuaaaacaaugaaagagcauuuaucguuugu

SEQ ID NO: 104520 - RNA, 64 nt, Homo Sapiens
ggacugguacgguagucuguggaaaccaggaagauaaaacaacagccacaaaagagaaaaucaa

SEQ ID NO: 104521 - RNA, 64 nt, Homo Sapiens
acuuaugagaauuucacauuggaauucauaaugguaaaacaacauacaucugccaauauacguu

SEQ ID NO: 104522 - RNA, 64 nt, Homo Sapiens
gcccuuugcuucuuucauuacuuauaaucuccucuaaaacaaccucugcauguuuuuuuuaaau

SEQ ID NO: 104523 - RNA, 64 nt, Homo Sapiens
aacugaauaguuuacuauuucauucaagcauguuuaaaacaaauaauuuccuuucaccaguuuu

SEQ ID NO: 104524 - RNA, 64 nt, Homo Sapiens
gccuuuauguuuucagugcacaugauuugagcccuaaaacaacacccgcuaaccuuuuuucacc

SEQ ID NO: 104525 - RNA, 64 nt, Homo Sapiens
ucagagcagcuccuaaacaauggacuauuaggaauaaaacaauccucaucaacuuaugauaaau

SEQ ID NO: 104526 - RNA, 64 nt, Homo Sapiens
auucucucagacgguggaauauuuggaaaaauuuuaaaacaauuaaaauuuuaaagcaaucuug

SEQ ID NO: 104527 - RNA, 64 nt, Homo Sapiens
aaacaauuaaaauuuuaaagcaaucuuggcagacuaaaacaaguacaucuguacaugacuguau

SEQ ID NO: 104528 - RNA, 64 nt, Homo Sapiens
uuaaacugugaagaacuuuaucauacaggaaacuuaaaacaagaggugucaaaagacccaaauu

SEQ ID NO: 104529 - RNA, 64 nt, Homo Sapiens
ccuuuugcauaagccucuuuauaacauguaucuuuaaaacaauuaagucuuuaggaauguguaa

SEQ ID NO: 104530 - RNA, 64 nt, Homo Sapiens
ccagaaaugcccucccuagguccaggaccaaagauaaaacaaacacgaggaacauguagcgucu

SEQ ID NO: 104531 - RNA, 64 nt, Homo Sapiens
aauuaacuaauucuacuugaaaucaggaguuuuauaaaacaacauuuuuagacguggucaucuu

SEQ ID NO: 104532 - RNA, 64 nt, Homo Sapiens
uuauguauaauauauuuaaauggggaauuucaucuaaaacaaugauguaguauuuuuaauauuc

SEQ ID NO: 104533 - RNA, 64 nt, Homo Sapiens
gaacugaucaaaguagcuuacuauaucuaaacuguaaaacaauauaguuucuccugaacaccug

SEQ ID NO: 104534 - RNA, 64 nt, Homo Sapiens
uauuuguuucccuguuuuuuugguaggucuuauauaaaacaaacauuccuuuguucuaguguug

SEQ ID NO: 104535 - RNA, 64 nt, Homo Sapiens
uucauuacuaggaaguucuuuuuaaaaugacacuuaaaacaaucacugaaaacuugauccacau

SEQ ID NO: 104536 - RNA, 64 nt, Homo Sapiens
auuccaucugagugauugucaguguaaggccuuuuaaaacaaaagcaaguucuuuguuaggaau

SEQ ID NO: 104537 - RNA, 64 nt, Homo Sapiens
acugugaagaaguuuucacaacuauuuaugcugguaaaacaaaugcuguuaaaucaccuuaugc

SEQ ID NO: 104538 - RNA, 64 nt, Homo Sapiens
uaacagucucaauuuuaacuaaaacuugaagaacuaaaacaacaaugcaaaccuuucagcauug

SEQ ID NO: 104539 - RNA, 64 nt, Homo Sapiens
uugcauuugcaagaucugagcaaauaagauuaaguaaaacaaaucaauuguauauauaauugac

SEQ ID NO: 104540 - RNA, 64 nt, Homo Sapiens
agauccauguuaggacauuuaaaagcacaauuauuaaaacaaacuaguagaugauaagccuaaa

SEQ ID NO: 104541 - RNA, 64 nt, Homo Sapiens
acacauaaggaaucugaagccugcaaauugucuuuaaaacaacaucaguccuucucccaacccc

SEQ ID NO: 104542 - RNA, 64 nt, Homo Sapiens
agccagaauuuuguaucuccuucuuguauuugucuaaaacaacacuuugugucuaguuugaagc

SEQ ID NO: 104543 - RNA, 64 nt, Homo Sapiens
aaguguaucaaagguggaugguguacaugggauguaaaacaaaccuucgucuugauaggcugua

SEQ ID NO: 104544 - RNA, 64 nt, Homo Sapiens
uauauauuuaaaauaaauauauuauuacacaauuuaaaacaacaggguugaagcuuuucugaua

SEQ ID NO: 104545 - RNA, 64 nt, Homo Sapiens
agggaaauguccuagguuuuagaauuucccaguuuaaaacaaaauugucuuccuccaaggaguu

SEQ ID NO: 104546 - RNA, 64 nt, Homo Sapiens
agcaauugcuauaugaaaauugcagaauguguaauaaaacaaaaaaacaacugcuacauacaua

SEQ ID NO: 104547 - RNA, 64 nt, Homo Sapiens
gcuacauacauaugcagaauaagaucuuaaugaguaaaacaacuccccuccaaaucuucccuca

SEQ ID NO: 104548 - RNA, 64 nt, Homo Sapiens
uauuuuuauauggaauugcauaaugugugccuuuuaaaacaauaacaaaaaccagagaugugcc

SEQ ID NO: 104549 - RNA, 64 nt, Homo Sapiens
cuugacauuaaccucaucaaaagugugugaauuuuaaaacaaauucuaaaaaaacuauagugcu

SEQ ID NO: 104550 - RNA, 64 nt, Homo Sapiens
acuugagauuuugguuuaucgacuuaauuuuuuguaaaacaagugacuucaaaagaguuuugaa

SEQ ID NO: 104551 - RNA, 64 nt, Homo Sapiens
gaauaaauggacaaaugagucuggccucauuuuuuaaaacaaauacaggcaugagucaccaugc

SEQ ID NO: 104552 - RNA, 64 nt, Homo Sapiens
aaaaaccuuguguguuauccucaacugagaagccuaaaacaaacuccuuacucgauguuuucuu

SEQ ID NO: 104553 - RNA, 64 nt, Homo Sapiens
augaagaucugcagcuauucauguuuuacagcguuaaaacaacuagcgacuucaguauuguguu

SEQ ID NO: 104554 - RNA, 64 nt, Homo Sapiens
acaacaacaacaacaacaacuucuuggcaaaaauuaaaacaacaucagcauuguuuuucucagc

SEQ ID NO: 104555 - RNA, 64 nt, Homo Sapiens
uguuuccuuuuggccaccccuuaaaaaauaauaauaaaacaacuaaccggaugcuaacgguguu

SEQ ID NO: 104556 - RNA, 64 nt, Homo Sapiens
agaauauuuuuuuuuugagcauggcuaguggauuuaaaacaacacauaccugucacugcuggag

SEQ ID NO: 104557 - RNA, 64 nt, Homo Sapiens
cuggaauaguuuaacccagcaacuuuccuuuuuauaaaacaacaaaugguucaacucugucugc

SEQ ID NO: 104558 - RNA, 64 nt, Homo Sapiens
uuuuucugcacuauaugcaaacaggguaacuaacuaaaacaaagccacuuucaaucuucaaucc

SEQ ID NO: 104559 - RNA, 64 nt, Homo Sapiens
ccaucagaugacaagaaaggcugcuguacugaaguaaaacaaacaauaccugaaugcucuguag

SEQ ID NO: 104560 - RNA, 64 nt, Homo Sapiens
acacaacacaguguuugucuuccacagggaagcuuaaaacaaaagauauuuuuaacccacugac

SEQ ID NO: 104561 - RNA, 64 nt, Homo Sapiens
aauccugacuuggugacaguaucauguguauuuauaaaacaaggcuagccauauuuaggacaac

SEQ ID NO: 104562 - RNA, 64 nt, Homo Sapiens
gaugccacaaugacuauugaggcgcuaaagggauuaaaacaacuagaguguuuuugcacauuug

SEQ ID NO: 104563 - RNA, 64 nt, Homo Sapiens
uuucauggucugaauuguauuaaguaaauguauuuaaaacaaauauuuuuagagguacauguuu

SEQ ID NO: 104564 - RNA, 64 nt, Homo Sapiens
aaauguguugaaauuauuuuguaaauccaugacuuaaaacaagauacauacauaguauaacaca

SEQ ID NO: 104565 - RNA, 64 nt, Homo Sapiens
ugagacacccuaccuucaauuguucaucaguggguaaaacaaauucugauguacauucaggaca

SEQ ID NO: 104566 - RNA, 64 nt, Homo Sapiens
ucaaauugcuuauaaaguuuuagcuaacugcccauaaaacaaaccaauaaaaaaugcuuugaga

SEQ ID NO: 104567 - RNA, 64 nt, Homo Sapiens
acuuugcugaaauaggaaaaucuguuuagcuuuauaaaacaaaccugcauucucauuggaaaug

SEQ ID NO: 104568 - RNA, 57 nt, Homo Sapiens
uuauuauuuuuuuuaauuagauacuccuaaaacaaaguuuaaaggauuacuaucugu

SEQ ID NO: 104569 - RNA, 64 nt, Homo Sapiens
aauuuugaaaagaaauagaaauuaagcuacuauauaaaacaauuguuuacguguacuuuuaacu

SEQ ID NO: 104570 - RNA, 64 nt, Homo Sapiens
cuuaaaugauggaaguauaggacguugcuuauuuuaaaacaagggaaggacacaaaauggaaug

SEQ ID NO: 104571 - RNA, 64 nt, Homo Sapiens
uggaaugacugcuuaguccuuucucagauacucuuaaaacaauuuuuuauuguuaaauuugugg

SEQ ID NO: 104572 - RNA, 64 nt, Homo Sapiens
aucagacauuuuccuaugcaaaacaguaacacuuuaaaacaagaucaacaaaagaaaaaaaaua

SEQ ID NO: 104573 - RNA, 64 nt, Homo Sapiens
guguauucaacaaaagaaaaaucuggacugccaguaaaacaaauuuuccuuuauauacuuguuu

SEQ ID NO: 104574 - RNA, 64 nt, Homo Sapiens
gaaaauagugagucucaaauuguucucuuuuaacuaaaacaaaucugcaaugaaucuagaugca

SEQ ID NO: 104575 - RNA, 64 nt, Homo Sapiens
aaacuuggcuacguauuggaaucaccuaaaaaguuaaaacaaaacauggaugucugggucccgc

SEQ ID NO: 104576 - RNA, 64 nt, Homo Sapiens
auagucuauaaaaacaguuuuacuugcaauccauuaaaacaacaaacgaaaccuagugaagcau

SEQ ID NO: 104577 - RNA, 64 nt, Homo Sapiens
uacaugcauuuaugcaauauuaauguaagggcucuaaaacaauggaguagagccagagguauaa

SEQ ID NO: 104578 - RNA, 64 nt, Homo Sapiens
aaccucacacauaccuaaaaaagacccugucucuuaaaacaaaauccagccuaggcaacagagc

SEQ ID NO: 104579 - RNA, 64 nt, Homo Sapiens
gauaaaaauguuuauuuuuaaacaucaagacaacuaaaacaaaucaguaauacgcuauuucucc

SEQ ID NO: 104580 - RNA, 64 nt, Homo Sapiens
caugauacucagauuccucacccuugcuuaggaguaaaacaauauacuuuacagggugauaaua

SEQ ID NO: 104581 - RNA, 64 nt, Homo Sapiens
gaaaaguuuuuuuucaaucauuguaccuugauauuaaaacaaauauccuuuaaguauuucuaau

SEQ ID NO: 104582 - RNA, 64 nt, Homo Sapiens
aacaauauuuauuguauuuuuauuauucaccauguaaaacaaaauguucucucuaugguaaaga

SEQ ID NO: 104583 - RNA, 64 nt, Homo Sapiens
aaccccccaucacaaacuuauugagggacaaauuuaaaacaaaccaacuuuaugcagcuuccuu

SEQ ID NO: 104584 - RNA, 64 nt, Homo Sapiens
ucaaggugcuguugucauuggauagcguuggaauuaaaacaauguuuuacugcuuuuaacuucu

SEQ ID NO: 104585 - RNA, 64 nt, Homo Sapiens
accaaaauauuuuagaauaaugacauuuuuauacuaaaacaaacauuacucagauuuggggaaa

SEQ ID NO: 104586 - RNA, 64 nt, Homo Sapiens
uucucuuuuugaaaauaguaguuuauuaauaguuuaaaacaauaugcccuaucaauuaauuuug

SEQ ID NO: 104587 - RNA, 64 nt, Homo Sapiens
ugguggaaguauaaauaagccuaugaacuuauaauaaaacaaacuguagguagaaaaaaugaga

SEQ ID NO: 104588 - RNA, 64 nt, Homo Sapiens
aaaaaauacuuguucagguaauucuaauucuuaauaaaacaaaugaguaucauacagguagagg

SEQ ID NO: 104589 - RNA, 64 nt, Homo Sapiens
uuucaauuaauauuaucacaauuuuaaaauccuuuaaaacaacucuuaaauuacucaauuuaaa

SEQ ID NO: 104590 - RNA, 64 nt, Homo Sapiens
ugaaacauuugccaaaacaauggaccgaagucauuaaaacaaaaguauuucauuuucuuuauau

SEQ ID NO: 104591 - RNA, 64 nt, Homo Sapiens
acuccuuguucucuagaagggcuuuuuacuugaauaaaacaaugcaacuuagcaaaccaauuua

SEQ ID NO: 104592 - RNA, 64 nt, Homo Sapiens
caaaguuuacagacuuuugauauggaaaaccagauaaaacaauguuacaaaaggcaaauauaaa

SEQ ID NO: 104593 - RNA, 64 nt, Homo Sapiens
gggcuuuuuaaaauuaaaaaggaagugaaacuauuaaaacaauaaucgcauucauaaaacaauu

SEQ ID NO: 104594 - RNA, 64 nt, Homo Sapiens
ggaagugaaacuauuaaaacagaaaucgcauucauaaaacaauuuuaguuugaaagauaucugg

SEQ ID NO: 104595 - RNA, 64 nt, Homo Sapiens
aagagagaagcuuuuaaaacaguacauuccugaauaaaacaacaauauuguaucuuaaucaagg

SEQ ID NO: 104596 - RNA, 64 nt, Homo Sapiens
aguagcugaguguuccugaguugccuaguagcaauaaaacaagugaauaggaaaauaauuaaua

SEQ ID NO: 104597 - RNA, 64 nt, Homo Sapiens
cuaaaucuucagcauagaaggaaguguguuugccuaaaacaaucuaaaacaauucccuucuuuu

SEQ ID NO: 104598 - RNA, 64 nt, Homo Sapiens
agcauagaaggaaguguguuugccuaaaacaaucuaaaacaauucccuucuuuuucaucccaga

SEQ ID NO: 104599 - RNA, 64 nt, Homo Sapiens
guacggaccaugugcuauauguugucguuguuuuuaaaacaaaguguauuccuaacagucuuuu

SEQ ID NO: 104600 - RNA, 64 nt, Homo Sapiens
caacucugagaugaacaauaaucuaccacggcuuuaaaacaaaaaugcacauuuaaagagaagc

SEQ ID NO: 104601 - RNA, 64 nt, Homo Sapiens
ugguauuuugacauguuauaauacgcaaguaaaauaaaacaauaguuuacucagcucauguuac

SEQ ID NO: 104602 - RNA, 64 nt, Homo Sapiens
aaacauaaauuaaaacucaaaugccaggacaaaauaaaacaauauaccagauggagaggaugcc

SEQ ID NO: 104603 - RNA, 64 nt, Homo Sapiens
uuugaacaaagugugugcauaaccagucaugagauaaaacaacacaaugcauguugccuuuuua

SEQ ID NO: 104604 - RNA, 64 nt, Homo Sapiens
uuuuaaauguuagauggcacuauguauauuaauguaaaacaauguuaauuuacucaaguuuuca

SEQ ID NO: 104605 - RNA, 64 nt, Homo Sapiens
caauaaaaauaccaucugagggaaaaggggaauauaaaacaaacuucaaaacagaagggcaaau

SEQ ID NO: 104606 - RNA, 64 nt, Homo Sapiens
uuuugacaguuuaggcuucaacauucuuuugguauaaaacaauagaauacauucauaaguacau

SEQ ID NO: 104607 - RNA, 64 nt, Homo Sapiens
aaacuacagaaauguaaaccuacaaauuaagcucuaaaacaaacgguuuuaauagcuaaaaaac

SEQ ID NO: 104608 - RNA, 64 nt, Homo Sapiens
gagaaccagacugagucucuacuccgucucaauuuaaaacaagacagccuggcaauagggcgag

SEQ ID NO: 104609 - RNA, 64 nt, Homo Sapiens
cauuucccaagauugguuucccuugaguuuuugcuaaaacaaaucuuaguaguuuugcccguuu

SEQ ID NO: 104610 - RNA, 64 nt, Homo Sapiens
uuugcuaaaacaaaucuuaguaguuuugcccguuuaaaacaacucacaaucguaaaugcuacua

SEQ ID NO: 104611 - RNA, 64 nt, Homo Sapiens
uucccuuuauagauugauuccagcaaaggcggaauaaaacaaauuuccuaugaagagaauccug

SEQ ID NO: 104612 - RNA, 64 nt, Homo Sapiens
guuuacauuuuaaauaguccauauugaauuuaauuaaaacaagggaugcaugcagucaaauuga

SEQ ID NO: 104613 - RNA, 64 nt, Homo Sapiens; identical to SEQ ID NO: 38255

SEQ ID NO: 104614 - RNA, 64 nt, Homo Sapiens; identical to SEQ ID NO: 38256

SEQ ID NO: 104615 - RNA, 64 nt, Homo Sapiens; identical to SEQ ID NO: 38257

SEQ ID NO: 104616 - RNA, 64 nt, Homo Sapiens; identical to SEQ ID NO: 38258

SEQ ID NO: 104617 - RNA, 64 nt, Homo Sapiens; identical to SEQ ID NO: 38259

SEQ ID NO: 104618 - RNA, 64 nt, Homo Sapiens; identical to SEQ ID NO: 38260

SEQ ID NO: 104619 - RNA, 64 nt, Homo Sapiens; identical to SEQ ID NO: 38261

SEQ ID NO: 104620 - RNA, 64 nt, Homo Sapiens; identical to SEQ ID NO: 38262

SEQ ID NO: 104621 - RNA, 64 nt, Homo Sapiens; identical to SEQ ID NO: 38263

SEQ ID NO: 104622 - RNA, 64 nt, Homo Sapiens; identical to SEQ ID NO: 38264

SEQ ID NO: 104623 - RNA, 64 nt, Homo Sapiens; identical to SEQ ID NO: 38265

SEQ ID NO: 104624 - RNA, 64 nt, Homo Sapiens; identical to SEQ ID NO: 38266

SEQ ID NO: 104625 - RNA, 64 nt, Homo Sapiens; identical to SEQ ID NO: 38267

SEQ ID NO: 104626 - RNA, 64 nt, Homo Sapiens; identical to SEQ ID NO: 38268

SEQ ID NO: 104627 - RNA, 64 nt, Homo Sapiens; identical to SEQ ID NO: 38269

SEQ ID NO: 104628 - RNA, 64 nt, Homo Sapiens; identical to SEQ ID NO: 38270

SEQ ID NO: 104629 - RNA, 64 nt, Homo Sapiens; identical to SEQ ID NO: 38271

SEQ ID NO: 104630 - RNA, 64 nt, Homo Sapiens; identical to SEQ ID NO: 38272

SEQ ID NO: 104631 - RNA, 64 nt, Homo Sapiens; identical to SEQ ID NO: 38273

SEQ ID NO: 104632 - RNA, 64 nt, Homo Sapiens; identical to SEQ ID NO: 38274

SEQ ID NO: 104633 - RNA, 64 nt, Homo Sapiens; identical to SEQ ID NO: 38275

SEQ ID NO: 104634 - RNA, 64 nt, Homo Sapiens; identical to SEQ ID NO: 38276

SEQ ID NO: 104635 - RNA, 64 nt, Homo Sapiens; identical to SEQ ID NO: 38277

SEQ ID NO: 104636 - RNA, 64 nt, Homo Sapiens; identical to SEQ ID NO: 38278

SEQ ID NO: 104637 - RNA, 64 nt, Homo Sapiens; identical to SEQ ID NO: 38279

SEQ ID NO: 104638 - RNA, 64 nt, Homo Sapiens; identical to SEQ ID NO: 38280

SEQ ID NO: 104639 - RNA, 64 nt, Homo Sapiens; identical to SEQ ID NO: 38281

SEQ ID NO: 104640 - RNA, 64 nt, Homo Sapiens; identical to SEQ ID NO: 38282

SEQ ID NO: 104641 - RNA, 64 nt, Homo Sapiens; identical to SEQ ID NO: 38283

SEQ ID NO: 104642 - RNA, 64 nt, Homo Sapiens; identical to SEQ ID NO: 38284

SEQ ID NO: 104643 - RNA, 62 nt, Homo Sapiens; identical to SEQ ID NO: 38285

SEQ ID NO: 104644 - RNA, 64 nt, Homo Sapiens; identical to SEQ ID NO: 38286

SEQ ID NO: 104645 - RNA, 64 nt, Homo Sapiens; identical to SEQ ID NO: 38287

SEQ ID NO: 104646 - RNA, 64 nt, Homo Sapiens; identical to SEQ ID NO: 38288

SEQ ID NO: 104647 - RNA, 64 nt, Homo Sapiens; identical to SEQ ID NO: 38289

SEQ ID NO: 104648 - RNA, 64 nt, Homo Sapiens; identical to SEQ ID NO: 38290

SEQ ID NO: 104649 - RNA, 64 nt, Homo Sapiens; identical to SEQ ID NO: 38291

SEQ ID NO: 104650 - RNA, 64 nt, Homo Sapiens; identical to SEQ ID NO: 38292

SEQ ID NO: 104651 - RNA, 64 nt, Homo Sapiens; identical to SEQ ID NO: 38293

SEQ ID NO: 104652 - RNA, 64 nt, Homo Sapiens; identical to SEQ ID NO: 38294

SEQ ID NO: 104653 - RNA, 64 nt, Homo Sapiens; identical to SEQ ID NO: 38295

SEQ ID NO: 104654 - RNA, 64 nt, Homo Sapiens; identical to SEQ ID NO: 38296

SEQ ID NO: 104655 - RNA, 64 nt, Homo Sapiens; identical to SEQ ID NO: 38297

SEQ ID NO: 104656 - RNA, 64 nt, Homo Sapiens; identical to SEQ ID NO: 38298

SEQ ID NO: 104657 - RNA, 64 nt, Homo Sapiens; identical to SEQ ID NO: 38299

SEQ ID NO: 104658 - RNA, 64 nt, Homo Sapiens; identical to SEQ ID NO: 38300

SEQ ID NO: 104659 - RNA, 64 nt, Homo Sapiens; identical to SEQ ID NO: 38301

SEQ ID NO: 104660 - RNA, 64 nt, Homo Sapiens; identical to SEQ ID NO: 38302

SEQ ID NO: 104661 - RNA, 64 nt, Homo Sapiens; identical to SEQ ID NO: 38303

SEQ ID NO: 104662 - RNA, 64 nt, Homo Sapiens; identical to SEQ ID NO: 38304

SEQ ID NO: 104663 - RNA, 64 nt, Homo Sapiens; identical to SEQ ID NO: 38305

SEQ ID NO: 104664 - RNA, 64 nt, Homo Sapiens; identical to SEQ ID NO: 38306

SEQ ID NO: 104665 - RNA, 64 nt, Homo Sapiens; identical to SEQ ID NO: 38307

SEQ ID NO: 104666 - RNA, 64 nt, Homo Sapiens; identical to SEQ ID NO: 38308

SEQ ID NO: 104667 - RNA, 64 nt, Homo Sapiens; identical to SEQ ID NO: 38309

SEQ ID NO: 104668 - RNA, 64 nt, Homo Sapiens; identical to SEQ ID NO: 38310

SEQ ID NO: 104669 - RNA, 64 nt, Homo Sapiens; identical to SEQ ID NO: 38311

SEQ ID NO: 104670 - RNA, 64 nt, Homo Sapiens; identical to SEQ ID NO: 38312

SEQ ID NO: 104671 - RNA, 64 nt, Homo Sapiens; identical to SEQ ID NO: 38313

SEQ ID NO: 104672 - RNA, 64 nt, Homo Sapiens; identical to SEQ ID NO: 38314

SEQ ID NO: 104673 - RNA, 64 nt, Homo Sapiens; identical to SEQ ID NO: 38315

SEQ ID NO: 104674 - RNA, 64 nt, Homo Sapiens; identical to SEQ ID NO: 38316

SEQ ID NO: 104675 - RNA, 64 nt, Homo Sapiens; identical to SEQ ID NO: 38317

SEQ ID NO: 104676 - RNA, 64 nt, Homo Sapiens; identical to SEQ ID NO: 38318

SEQ ID NO: 104677 - RNA, 64 nt, Homo Sapiens
aaucauauugaugaaaucguccaacaucuuuaugacucuagaauaaaugcagacucaaaccuuc

SEQ ID NO: 104678 - RNA, 64 nt, Homo Sapiens
ugcggaccaaacuacuucauuuuuuacccagacaacucuagaaauuuuuguuuuuugguuuuuu

SEQ ID NO: 104679 - RNA, 64 nt, Homo Sapiens
aauuucaagacaggauacuagaugaaugagcauuacucuagauauuucaguuuuuccaucauga

SEQ ID NO: 104680 - RNA, 64 nt, Homo Sapiens
ccuccugagaccuccguccugcagacaccagugcacucuagauacgggauccuagcucuuguag

SEQ ID NO: 104681 - RNA, 64 nt, Homo Sapiens
uaucugaagcccucccagguguuaacauuccaagacucuagaguccaagguuuaaagagucuag

SEQ ID NO: 104682 - RNA, 64 nt, Homo Sapiens
aauaagauucuaacggucuguucuguuucaaggcacucuagauuccauugguccaagauuccgg

SEQ ID NO: 104683 - RNA, 64 nt, Homo Sapiens; identical to SEQ ID NO: 98813

SEQ ID NO: 104684 - RNA, 64 nt, Homo Sapiens; identical to SEQ ID NO: 98814

SEQ ID NO: 104685 - RNA, 64 nt, Homo Sapiens; identical to SEQ ID NO: 98815

SEQ ID NO: 104686 - RNA, 64 nt, Homo Sapiens; identical to SEQ ID NO: 98816

SEQ ID NO: 104687 - RNA, 64 nt, Homo Sapiens; identical to SEQ ID NO: 98817

SEQ ID NO: 104688 - RNA, 64 nt, Homo Sapiens; identical to SEQ ID NO: 98818

SEQ ID NO: 104689 - RNA, 64 nt, Homo Sapiens; identical to SEQ ID NO: 98819

SEQ ID NO: 104690 - RNA, 64 nt, Homo Sapiens; identical to SEQ ID NO: 98820

SEQ ID NO: 104691 - RNA, 64 nt, Homo Sapiens; identical to SEQ ID NO: 98821

SEQ ID NO: 104692 - RNA, 64 nt, Homo Sapiens; identical to SEQ ID NO: 98822

SEQ ID NO: 104693 - RNA, 64 nt, Homo Sapiens; identical to SEQ ID NO: 98823

SEQ ID NO: 104694 - RNA, 64 nt, Homo Sapiens; identical to SEQ ID NO: 98824

SEQ ID NO: 104695 - RNA, 64 nt, Homo Sapiens; identical to SEQ ID NO: 98825

SEQ ID NO: 104696 - RNA, 64 nt, Homo Sapiens; identical to SEQ ID NO: 98826

SEQ ID NO: 104697 - RNA, 64 nt, Homo Sapiens; identical to SEQ ID NO: 98827

SEQ ID NO: 104698 - RNA, 64 nt, Homo Sapiens; identical to SEQ ID NO: 98828

SEQ ID NO: 104699 - RNA, 64 nt, Homo Sapiens; identical to SEQ ID NO: 98829

SEQ ID NO: 104700 - RNA, 64 nt, Homo Sapiens; identical to SEQ ID NO: 98830

SEQ ID NO: 104701 - RNA, 64 nt, Homo Sapiens; identical to SEQ ID NO: 98831

SEQ ID NO: 104702 - RNA, 64 nt, Homo Sapiens; identical to SEQ ID NO: 98832

SEQ ID NO: 104703 - RNA, 64 nt, Homo Sapiens; identical to SEQ ID NO: 98833

SEQ ID NO: 104704 - RNA, 64 nt, Homo Sapiens; identical to SEQ ID NO: 98834

SEQ ID NO: 104705 - RNA, 64 nt, Homo Sapiens; identical to SEQ ID NO: 98835

SEQ ID NO: 104706 - RNA, 64 nt, Homo Sapiens; identical to SEQ ID NO: 98836

SEQ ID NO: 104707 - RNA, 64 nt, Homo Sapiens; identical to SEQ ID NO: 98837

SEQ ID NO: 104708 - RNA, 64 nt, Homo Sapiens; identical to SEQ ID NO: 98838

SEQ ID NO: 104709 - RNA, 64 nt, Homo Sapiens; identical to SEQ ID NO: 98839

SEQ ID NO: 104710 - RNA, 64 nt, Homo Sapiens; identical to SEQ ID NO: 98840

SEQ ID NO: 104711 - RNA, 64 nt, Homo Sapiens; identical to SEQ ID NO: 98841

SEQ ID NO: 104712 - RNA, 64 nt, Homo Sapiens; identical to SEQ ID NO: 98842

SEQ ID NO: 104713 - RNA, 64 nt, Homo Sapiens; identical to SEQ ID NO: 98843

SEQ ID NO: 104714 - RNA, 64 nt, Homo Sapiens; identical to SEQ ID NO: 98844

SEQ ID NO: 104715 - RNA, 64 nt, Homo Sapiens; identical to SEQ ID NO: 98845

SEQ ID NO: 104716 - RNA, 64 nt, Homo Sapiens; identical to SEQ ID NO: 98846

SEQ ID NO: 104717 - RNA, 64 nt, Homo Sapiens; identical to SEQ ID NO: 98847

SEQ ID NO: 104718 - RNA, 64 nt, Homo Sapiens; identical to SEQ ID NO: 98848

SEQ ID NO: 104719 - RNA, 64 nt, Homo Sapiens; identical to SEQ ID NO: 98849

SEQ ID NO: 104720 - RNA, 64 nt, Homo Sapiens; identical to SEQ ID NO: 98850

SEQ ID NO: 104721 - RNA, 64 nt, Homo Sapiens; identical to SEQ ID NO: 98851

SEQ ID NO: 104722 - RNA, 64 nt, Homo Sapiens; identical to SEQ ID NO: 98852

SEQ ID NO: 104723 - RNA, 64 nt, Homo Sapiens; identical to SEQ ID NO: 98853

SEQ ID NO: 104724 - RNA, 64 nt, Homo Sapiens; identical to SEQ ID NO: 98854

SEQ ID NO: 104725 - RNA, 64 nt, Homo Sapiens; identical to SEQ ID NO: 98855

SEQ ID NO: 104726 - RNA, 64 nt, Homo Sapiens; identical to SEQ ID NO: 98856

SEQ ID NO: 104727 - RNA, 64 nt, Homo Sapiens; identical to SEQ ID NO: 98857

SEQ ID NO: 104728 - RNA, 64 nt, Homo Sapiens; identical to SEQ ID NO: 98858

SEQ ID NO: 104729 - RNA, 64 nt, Homo Sapiens; identical to SEQ ID NO: 98859

SEQ ID NO: 104730 - RNA, 64 nt, Homo Sapiens; identical to SEQ ID NO: 98860

SEQ ID NO: 104731 - RNA, 64 nt, Homo Sapiens; identical to SEQ ID NO: 98861

SEQ ID NO: 104732 - RNA, 64 nt, Homo Sapiens; identical to SEQ ID NO: 98862

SEQ ID NO: 104733 - RNA, 64 nt, Homo Sapiens; identical to SEQ ID NO: 98863

SEQ ID NO: 104734 - RNA, 64 nt, Homo Sapiens; identical to SEQ ID NO: 98864

SEQ ID NO: 104735 - RNA, 64 nt, Homo Sapiens; identical to SEQ ID NO: 98865

SEQ ID NO: 104736 - RNA, 64 nt, Homo Sapiens; identical to SEQ ID NO: 98866

SEQ ID NO: 104737 - RNA, 64 nt, Homo Sapiens; identical to SEQ ID NO: 98867

SEQ ID NO: 104738 - RNA, 64 nt, Homo Sapiens; identical to SEQ ID NO: 98868

SEQ ID NO: 104739 - RNA, 64 nt, Homo Sapiens; identical to SEQ ID NO: 98869

SEQ ID NO: 104740 - RNA, 64 nt, Homo Sapiens; identical to SEQ ID NO: 98870

SEQ ID NO: 104741 - RNA, 64 nt, Homo Sapiens; identical to SEQ ID NO: 98871

SEQ ID NO: 104742 - RNA, 64 nt, Homo Sapiens; identical to SEQ ID NO: 98872

SEQ ID NO: 104743 - RNA, 64 nt, Homo Sapiens; identical to SEQ ID NO: 98873

SEQ ID NO: 104744 - RNA, 64 nt, Homo Sapiens; identical to SEQ ID NO: 98874

SEQ ID NO: 104745 - RNA, 64 nt, Homo Sapiens; identical to SEQ ID NO: 98875

SEQ ID NO: 104746 - RNA, 64 nt, Homo Sapiens; identical to SEQ ID NO: 98876

SEQ ID NO: 104747 - RNA, 64 nt, Homo Sapiens; identical to SEQ ID NO: 98877

SEQ ID NO: 104748 - RNA, 64 nt, Homo Sapiens; identical to SEQ ID NO: 98878

SEQ ID NO: 104749 - RNA, 64 nt, Homo Sapiens; identical to SEQ ID NO: 98879

SEQ ID NO: 104750 - RNA, 64 nt, Homo Sapiens; identical to SEQ ID NO: 98880

SEQ ID NO: 104751 - RNA, 64 nt, Homo Sapiens; identical to SEQ ID NO: 98881

SEQ ID NO: 104752 - RNA, 64 nt, Homo Sapiens; identical to SEQ ID NO: 98882

SEQ ID NO: 104753 - RNA, 64 nt, Homo Sapiens; identical to SEQ ID NO: 98883

SEQ ID NO: 104754 - RNA, 64 nt, Homo Sapiens; identical to SEQ ID NO: 98884

SEQ ID NO: 104755 - RNA, 64 nt, Homo Sapiens; identical to SEQ ID NO: 98885

SEQ ID NO: 104756 - RNA, 64 nt, Homo Sapiens; identical to SEQ ID NO: 98886

SEQ ID NO: 104757 - RNA, 64 nt, Homo Sapiens; identical to SEQ ID NO: 98887

SEQ ID NO: 104758 - RNA, 64 nt, Homo Sapiens; identical to SEQ ID NO: 98888

SEQ ID NO: 104759 - RNA, 64 nt, Homo Sapiens; identical to SEQ ID NO: 98889

SEQ ID NO: 104760 - RNA, 64 nt, Homo Sapiens; identical to SEQ ID NO: 98890

SEQ ID NO: 104761 - RNA, 64 nt, Homo Sapiens; identical to SEQ ID NO: 98891

SEQ ID NO: 104762 - RNA, 64 nt, Homo Sapiens; identical to SEQ ID NO: 98892

SEQ ID NO: 104763 - RNA, 64 nt, Homo Sapiens; identical to SEQ ID NO: 98893

SEQ ID NO: 104764 - RNA, 64 nt, Homo Sapiens; identical to SEQ ID NO: 98894

SEQ ID NO: 104765 - RNA, 64 nt, Homo Sapiens; identical to SEQ ID NO: 98895

SEQ ID NO: 104766 - RNA, 64 nt, Homo Sapiens; identical to SEQ ID NO: 98896

SEQ ID NO: 104767 - RNA, 64 nt, Homo Sapiens; identical to SEQ ID NO: 98897

SEQ ID NO: 104768 - RNA, 64 nt, Homo Sapiens; identical to SEQ ID NO: 98898

SEQ ID NO: 104769 - RNA, 64 nt, Homo Sapiens; identical to SEQ ID NO: 98899

SEQ ID NO: 104770 - RNA, 64 nt, Homo Sapiens; identical to SEQ ID NO: 98900

SEQ ID NO: 104771 - RNA, 64 nt, Homo Sapiens; identical to SEQ ID NO: 98901

SEQ ID NO: 104772 - RNA, 64 nt, Homo Sapiens; identical to SEQ ID NO: 98902

SEQ ID NO: 104773 - RNA, 64 nt, Homo Sapiens; identical to SEQ ID NO: 98903

SEQ ID NO: 104774 - RNA, 64 nt, Homo Sapiens; identical to SEQ ID NO: 98904

SEQ ID NO: 104775 - RNA, 64 nt, Homo Sapiens; identical to SEQ ID NO: 98905

SEQ ID NO: 104776 - RNA, 64 nt, Homo Sapiens; identical to SEQ ID NO: 98906

SEQ ID NO: 104777 - RNA, 64 nt, Homo Sapiens; identical to SEQ ID NO: 98907

SEQ ID NO: 104778 - RNA, 64 nt, Homo Sapiens; identical to SEQ ID NO: 98908

SEQ ID NO: 104779 - RNA, 64 nt, Homo Sapiens; identical to SEQ ID NO: 98909

SEQ ID NO: 104780 - RNA, 64 nt, Homo Sapiens; identical to SEQ ID NO: 98910

SEQ ID NO: 104781 - RNA, 64 nt, Homo Sapiens; identical to SEQ ID NO: 98911

SEQ ID NO: 104782 - RNA, 64 nt, Homo Sapiens; identical to SEQ ID NO: 98912

SEQ ID NO: 104783 - RNA, 64 nt, Homo Sapiens
cuacaugguuggaguguuuuuagaucagauaaauauagaaaaguaaaauggaaaaugauacuca

SEQ ID NO: 104784 - RNA, 64 nt, Homo Sapiens
auuaaaacauuucuaaagugagacugaaaauaauauagaaaaucucauugcuacuugugauuau

SEQ ID NO: 104785 - RNA, 64 nt, Homo Sapiens
agagaaauaaauuucccuccaaacaacuuguauaauagaaaagcuuuuaauuugcaguuucugu

SEQ ID NO: 104786 - RNA, 64 nt, Homo Sapiens
uuuucuguuuuaaucuuuucuacauguauuauuuauagaaaauacgggagcacuaaaaccaaaa

SEQ ID NO: 104787 - RNA, 64 nt, Homo Sapiens
acaaagauggcaauauacacggagagugguauagauagaaaauggugauucuuguuuucagaag

SEQ ID NO: 104788 - RNA, 64 nt, Homo Sapiens
aaauggccucaguuugaucuccucacagauuauaauagaaaaaguaaaacuuaaaaacucaaca

SEQ ID NO: 104789 - RNA, 64 nt, Homo Sapiens
auuaacagugcggcuacaugguaacuaaaaagugauagaaaacucuaucauuaaugagacauga

SEQ ID NO: 104790 - RNA, 64 nt, Homo Sapiens
uacaguaaaaauauggucuauuguguaucuaaauauagaaaaggagacaauuguaacacaauau

SEQ ID NO: 104791 - RNA, 64 nt, Homo Sapiens
ucucuuaaacauuuauuacaacaauuguuuuaaaauagaaaaaauaaaaugcuucuauuuuacc

SEQ ID NO: 104792 - RNA, 64 nt, Homo Sapiens
uuauucuguuuauuaacagugucccaucuacugaauagaaaacuuugagaauaauauauauaua

SEQ ID NO: 104793 - RNA, 64 nt, Homo Sapiens
ucuguggagaaaacuucaaaacuuaaaaaaggacauagaaaauguuuugaauaggccaggcgca

SEQ ID NO: 104794 - RNA, 64 nt, Homo Sapiens
ggaaagccuagaacagaaauaaaugaaauagagaauagaaaagcaauacagaaaaaaaauuaug

SEQ ID NO: 104795 - RNA, 64 nt, Homo Sapiens
acuaauaaucucuauuuauaacuaaaucauugagauagaaaaagauucccauugacuguagacu

SEQ ID NO: 104796 - RNA, 64 nt, Homo Sapiens
gauggauuaugauaaagaagaugcuaccaaugaaauagaaaaccaacgagaugagaagacugug

SEQ ID NO: 104797 - RNA, 64 nt, Homo Sapiens
uugcucuuacgaacuuuaauaaaauaguuagcuaauagaaaaacagguaagaauaaagcaaugu

SEQ ID NO: 104798 - RNA, 64 nt, Homo Sapiens
aauggaaauauucaauugagacuugaggggaauaauagaaaauuaagguagauccccaauauuu

SEQ ID NO: 104799 - RNA, 64 nt, Homo Sapiens
aggcuuagaugacuucugcaggauuuauauucagauagaaaacaucaaauauuuucaggggaga

SEQ ID NO: 104800 - RNA, 64 nt, Homo Sapiens
uauacaaaaaaaaaagaacauuuccaaaacuaaaauagaaaaugcuuguggcauuuauuuucuc

SEQ ID NO: 104801 - RNA, 64 nt, Homo Sapiens
ugcauaaagaauagcaaucucauaaauccuuaguauagaaaaauuguauacuuaugcaugcaua

SEQ ID NO: 104802 - RNA, 64 nt, Homo Sapiens
ucuaagggacaugguaauccuaucacuaauuuggauagaaaauuagauauuugaucugaguuuc

SEQ ID NO: 104803 - RNA, 64 nt, Homo Sapiens
uagaaauguaaaauacucuccagaucuaccauuaauagaaaauaaacuaaaccuuauauuuuau

SEQ ID NO: 104804 - RNA, 64 nt, Homo Sapiens
cuguuuugugcuguaccuuuucugauucagaauuauagaaaacuugauaaauacuugauuuuaa

SEQ ID NO: 104805 - RNA, 64 nt, Homo Sapiens
agugguauccuuacuagauucauaaugcaauuagauagaaaagguccaaaacuguacccuaugu

SEQ ID NO: 104806 - RNA, 64 nt, Homo Sapiens
uagcuaguauaacuuuacagauaaccuaaaaagaauagaaaagaagagagaguggcuuugucag

SEQ ID NO: 104807 - RNA, 64 nt, Homo Sapiens
augcacaguguccucaggauacuuugaauugcuaauagaaaauaguuccguaggcagagugcuc

SEQ ID NO: 104808 - RNA, 64 nt, Homo Sapiens
ccuggcacgaacagucuaucugaggccaucagaaauagaaaaugacuagaaaaccaaugaaaag

SEQ ID NO: 104809 - RNA, 64 nt, Homo Sapiens
ugcaucaaaucaguuuccaugcuaauuuuuggucauagaaaaucuccacaguugggcaaucaua

SEQ ID NO: 104810 - RNA, 64 nt, Homo Sapiens
uauguuggggcacauguccugaaauaugcccagaauagaaaagcagaauuugauacgcuuuuua

SEQ ID NO: 104811 - RNA, 64 nt, Homo Sapiens
guauagaugcuuggacagaccuguuaugcaacauauagaaaaauuuuacugaaagagagagcag

SEQ ID NO: 104812 - RNA, 64 nt, Homo Sapiens
ugugauaaauaugagcaaaugaaguguaauaucuauagaaaaguagagugagggugaauuuaua

SEQ ID NO: 104813 - RNA, 64 nt, Homo Sapiens
uuuaaaguuuuugcuuguguccuccucagucagaauagaaaaguaacugaaauacuuuuaccuu

SEQ ID NO: 104814 - RNA, 64 nt, Homo Sapiens
aagaacagguucacagaaggagauaccaaaggggauagaaaaaugggaaaaaugguaagugaaa

SEQ ID NO: 104815 - RNA, 64 nt, Homo Sapiens
uccagaaaauagguacgguuuuaaaauauuuuauauagaaaagcuacaaaguaaauugagcaau

SEQ ID NO: 104816 - RNA, 64 nt, Homo Sapiens
cccacagguuaaaaaacuuuaguaacuuguuuguauagaaaauaguaacaaggacuauuuucua

SEQ ID NO: 104817 - RNA, 64 nt, Homo Sapiens
aacauucuuuuaacaacauuuuucugaauccucaauagaaaaucacauuaaucuuauuuuaaaa

SEQ ID NO: 104818 - RNA, 64 nt, Homo Sapiens
uauuauccucauuuuacacaugagggaccgaaggauagaaaaguuauuuuucaaaggucuugca

SEQ ID NO: 104819 - RNA, 64 nt, Homo Sapiens
uccccccaccccaauuugcuauuuccuuauuaaaauagaaaauuauaggcaagauacaauuaua

SEQ ID NO: 104820 - RNA, 64 nt, Homo Sapiens
cacauucuuuucaguuggagagaauugggcuaagauagaaaauaacaugauuuguuccuuauua

SEQ ID NO: 104821 - RNA, 64 nt, Homo Sapiens
cuauucauauugcugugaaugcuuuaucuuggagauagaaaauauaaugauaaauucaucaugu

SEQ ID NO: 104822 - RNA, 64 nt, Homo Sapiens
cggccuuaacuccaccugauggcaggugacccggauagaaaauggcccugcguuuagccaggau

SEQ ID NO: 104823 - RNA, 64 nt, Homo Sapiens
acaucuucaguggcagcucaaucuccuuacacacauagaaaaugugcagaacgaaguuaccagc

SEQ ID NO: 104824 - RNA, 64 nt, Homo Sapiens
ugugcagaacgaaguuaccagcaggauggaccuaauagaaaaagaagucgaugguaauuuaaga

SEQ ID NO: 104825 - RNA, 64 nt, Homo Sapiens
aacaguugcauuuagcuucuaggauaauaauuuuauagaaaagguccuuuguagcuacuuuugc

SEQ ID NO: 104826 - RNA, 64 nt, Homo Sapiens
ugacauguagcuucuucugauauuaauacuacccauagaaaacucauaagcuaaaucauauuag

SEQ ID NO: 104827 - RNA, 64 nt, Homo Sapiens
cacucagcucaacugcugugcaccucagcguacuauagaaaaugauuugaaauagaauagguaa

SEQ ID NO: 104828 - RNA, 64 nt, Homo Sapiens
aaaaaaggcuggguuuacuaucuugccuuacuguauagaaaaaguuuugcauuacaggcugcau

SEQ ID NO: 104829 - RNA, 64 nt, Homo Sapiens
ggguaugcguuucauguagcacucacuguuaagaauagaaaacucugagaccacagaggcucag

SEQ ID NO: 104830 - RNA, 64 nt, Homo Sapiens
aacaaacccaaagguaggaaacacguggucaugaauagaaaaaauuauuaugggauuggaagaa

SEQ ID NO: 104831 - RNA, 64 nt, Homo Sapiens
aacucacauuaagcgguuacucagacaguuaaucauagaaaagauuauuugcuucaucaguuca

SEQ ID NO: 104832 - RNA, 64 nt, Homo Sapiens
uaaucauagaaaagauuauuugcuucaucaguucauagaaaagauuauuugcuucaucaguuaa

SEQ ID NO: 104833 - RNA, 64 nt, Homo Sapiens
agcucuuacagaguugacagucuaguuucagcacauagaaaaccagcagugaauaaaccaaggu

SEQ ID NO: 104834 - RNA, 64 nt, Homo Sapiens
auauugaggucauuguuuuuggcuuaaguuuauuauagaaaaucaacacuaauguuuuuagauu

SEQ ID NO: 104835 - RNA, 64 nt, Homo Sapiens
cauuuaauuuuagugacuauauuuaaaaacauuuauagaaaauugaaaaagaauugcaauuuua

SEQ ID NO: 104836 - RNA, 64 nt, Homo Sapiens
aauugcaauuuuaauuuaaaagagccucuucugcauagaaaaaggggagugcaauuguucuuaa

SEQ ID NO: 104837 - RNA, 64 nt, Homo Sapiens
gggagucugcccucauuaauagauuucuacggggauagaaaaucugaucugguucuuucuucag

SEQ ID NO: 104838 - RNA, 64 nt, Homo Sapiens
auuagaaauaacuucuaacccuuucuguacagaaauagaaaagcaccuguggucauuauuuuuu

SEQ ID NO: 104839 - RNA, 64 nt, Homo Sapiens
cacuuuuuaaguacuaagucuuagcacuuugaagauagaaaaaccuuuuugaauacuuguuucu

SEQ ID NO: 104840 - RNA, 64 nt, Homo Sapiens
augauccaaaauauggauauauaaucugaugaauauagaaaaaacuugcugugcauuuuaacca

SEQ ID NO: 104841 - RNA, 64 nt, Homo Sapiens
uaauuaaggaaguaacuuuuauguugguuacuaaauagaaaaccucauauuuucuguccaguca

SEQ ID NO: 104842 - RNA, 64 nt, Homo Sapiens
ggguguguauacuuguauaagcaaagcgugucccauagaaaauuuuggcccucuuuccucugug

SEQ ID NO: 104843 - RNA, 64 nt, Homo Sapiens
guguggaauaguucugaauuaugcuguucuacagauagaaaaaaaguccaaaugccuuuaaaaa

SEQ ID NO: 104844 - RNA, 64 nt, Homo Sapiens
uaacauuguauucguguuugcauuauuaauuugaauagaaaauaaucacauuuucaacccauuu

SEQ ID NO: 104845 - RNA, 64 nt, Homo Sapiens
cccuacuaagucccaacagggccaugaucuagagauagaaaaaugguuucuuggcuuuccgaag

SEQ ID NO: 104846 - RNA, 64 nt, Homo Sapiens
aaucuuuggggcacugcaucccugggcuauggggauagaaaagaaggguggccauuuagucuga

SEQ ID NO: 104847 - RNA, 64 nt, Homo Sapiens
aacauggaauuucaaauauaaauacaugcauauaauagaaaaaaucuguauuauauacaagugu

SEQ ID NO: 104848 - RNA, 64 nt, Homo Sapiens
uuguucauuuuccucagucuuguucaaucuguugauagaaaaaauguuugaaugcuuauauauu

SEQ ID NO: 104849 - RNA, 64 nt, Homo Sapiens
gugcuaucguucaacuucaauacucaaaaccaagauagaaaaagacaauuauaauuucuuuaca

SEQ ID NO: 104850 - RNA, 64 nt, Homo Sapiens
uugcuugacauggugcuuuuuuuguaaauagccaauagaaaaguuuacuaauuuuuguauuauu

SEQ ID NO: 104851 - RNA, 64 nt, Homo Sapiens
caguauuuuaugauaaucacuuaaaugagcuuaaauagaaaauuguccauccuaauucacagaa

SEQ ID NO: 104852 - RNA, 64 nt, Homo Sapiens
acauuuuggcaggaauaauuaaaaaacuucagaaauagaaaacuuuuguaagcuacuuaucucc

SEQ ID NO: 104853 - RNA, 64 nt, Homo Sapiens
ugauaagaaaauguaaugaaauauaauguaucugauagaaaauuaugggggcuauaauuauggu

SEQ ID NO: 104854 - RNA, 64 nt, Homo Sapiens
gucucaaaugcauucuacuggccccuuaucccagauagaaaaguaacaucuaucaagcaacaca

SEQ ID NO: 104855 - RNA, 64 nt, Homo Sapiens
cucuuaaaaagauuaaaccuauuggaaugauuauauagaaaauguuauauuguuucauccuuau

SEQ ID NO: 104856 - RNA, 64 nt, Homo Sapiens
agccacucccgccacacgcucacuccagguucguauagaaaaagcacagcucucacuggccagu

SEQ ID NO: 104857 - RNA, 64 nt, Homo Sapiens
aaagaacacccaucguauaaggaaauccagccccauagaaaacaaucugcccaccgacccccuu

SEQ ID NO: 104858 - RNA, 64 nt, Homo Sapiens
acugacaauguauuuuggaagacauauauuauauauagaaaagaggagaggaaaacuauuccau

SEQ ID NO: 104859 - RNA, 64 nt, Homo Sapiens
guagaauuguuagauggcaauagucauuaaaaacauagaaaaaugaugucuuuaaguggagaau

SEQ ID NO: 104860 - RNA, 64 nt, Homo Sapiens
ugauagaccagcacuucugaugaucuguaauguaauagaaaauccaucugaacuggaccagugu

SEQ ID NO: 104861 - RNA, 64 nt, Homo Sapiens
uaacacaaguacuaauaaaaucuuuauaugcaguauagaaaaguaagaaauuuuaugcggaaaa

SEQ ID NO: 104862 - RNA, 64 nt, Homo Sapiens
caauguuagaagguuauuuauuauuucagagaaaauagaaaaaauuuugcaaguuuaauuugau

SEQ ID NO: 104863 - RNA, 64 nt, Homo Sapiens
aacauagagcauacaagaacagucauuuaguagaauagaaaagcaaucucauuguaaagcuauc

SEQ ID NO: 104864 - RNA, 64 nt, Homo Sapiens
uuauuuuggaucuuagauccaaacacaguuucuaauagaaaacuauuauuuauauugggaaagg

SEQ ID NO: 104865 - RNA, 64 nt, Homo Sapiens
aucauaaaaaaccagauaauugaacuuugaaguuauagaaaaucagagagggguaaguuuauag

SEQ ID NO: 104866 - RNA, 64 nt, Homo Sapiens
uuugggagauuauaaucaguuuguuuucaagauaauagaaaauaagguccaugagaauagaagu

SEQ ID NO: 104867 - RNA, 64 nt, Homo Sapiens
agguuuguccuauucuucauuuauucauacuaggauagaaaauuuuggaaucagaaaauagauc

SEQ ID NO: 104868 - RNA, 64 nt, Homo Sapiens
ucacugaauuuuuucauauuauggggaaauaguuauagaaaaugaaaacuuagcagucagugac

SEQ ID NO: 104869 - RNA, 64 nt, Homo Sapiens
aaugccucuccugcugccaugauacaugugugauauagaaaaauaauuggucagucagguagaa

SEQ ID NO: 104870 - RNA, 64 nt, Homo Sapiens
auaugaacagacucagcuuuuuaguaagaaaaaaauagaaaaaaggcagggagaagagaaggca

SEQ ID NO: 104871 - RNA, 64 nt, Homo Sapiens
ccgcuugaccuuuggugcaccaccuuuucuuccaauagaaaauucagucucuuccccaaagucu

SEQ ID NO: 104872 - RNA, 64 nt, Homo Sapiens
ucaacugaauucacacacacacaaauauaguaccauagaaaaaguuuguuuucucgaaauaauu

SEQ ID NO: 104873 - RNA, 64 nt, Homo Sapiens
ugaucgcauauucauugaugaggguuugcuugagauagaaaaugguggcuccuuucugucuuau

SEQ ID NO: 104874 - RNA, 64 nt, Homo Sapiens
auaaaauguuuguugaaguauguauaguagguagauagaaaaguacuuuuguguauagaaaaua

SEQ ID NO: 104875 - RNA, 64 nt, Homo Sapiens
uguauaguagguagauagaaaaauacuuuuguguauagaaaauauuaaaacacaaauuucaauc

SEQ ID NO: 104876 - RNA, 64 nt, Homo Sapiens
ccagugucagcuuccaaucccuaguacauauauaauagaaaagggccaagaaaaauaugcaucu

SEQ ID NO: 104877 - RNA, 64 nt, Homo Sapiens
uuauacuucuuuaaaaagcucugaagcugcuacaauagaaaaaucaaaaaggguaacaguaucu

SEQ ID NO: 104878 - RNA, 61 nt, Homo Sapiens
uucgagaaauuaaaucuuaaaaucuguguaaauagaaaacuugaaccauuaguaauaacag

SEQ ID NO: 104879 - RNA, 64 nt, Homo Sapiens
uucuugaaaugucuauuuaagcugcuuuaaguuaauagaaaagauuaaagcaaaauauucauuu

SEQ ID NO: 104880 - RNA, 64 nt, Homo Sapiens
agucccccuccuaacgucuuccuuucccugcacuaacgccaaccugacugcuuuuccugucagu

SEQ ID NO: 104881 - RNA, 64 nt, Homo Sapiens
uuuagucucaggauuaaccuucuacgggagucugaacgccaagagggccuggacacagaugacc

SEQ ID NO: 104882 - RNA, 64 nt, Homo Sapiens
gcguuucugauggaaacaguuuggauuguauaauaacgccaagcccaguuguagucguuugagu

SEQ ID NO: 104883 - RNA, 64 nt, Homo Sapiens
uguucuuuccgagucuuaaucuucagaaacagugaacgccaaaaagaacucaagauauucuggg

SEQ ID NO: 104884 - RNA, 64 nt, Homo Sapiens
uguguguuuuuuaauagguuauuucugacagacaaacgccaaaaaaagaugaaagucuuguauc

SEQ ID NO: 104885 - RNA, 64 nt, Homo Sapiens
aaggaucccccgugacggcucugccccacuugugaacgccaacccucagugcuuagccugcuuu

SEQ ID NO: 104886 - RNA, 64 nt, Homo Sapiens
aguaguaauucuuguaacuauacuucuuucagcaaacgccaaacaagcauauaauauucucacg

SEQ ID NO: 104887 - RNA, 64 nt, Homo Sapiens
ccuaugagaagcuggcucuucugaguccagggccaacgccaacuggcaaccucuuuacucuuag

SEQ ID NO: 104888 - RNA, 64 nt, Homo Sapiens
acgaagagauucugaauucccucuccuguaggagaacgccaagacccggguucuagcugcccuu

SEQ ID NO: 104889 - RNA, 64 nt, Homo Sapiens
gaagcacauuugucuuccaguuuguaucuaacacaacgccaacauugaagccugucagggaugc

SEQ ID NO: 104890 - RNA, 64 nt, Homo Sapiens
uaaaguuuacagucuuucuuauuuuaacugugugaacgccaaacucuguagguuaaaugcaggu

SEQ ID NO: 104891 - RNA, 64 nt, Homo Sapiens
ggaaagguccccuuccccagaagaaagccaugggaacgccaacuaacagcucugcuggacaccc

SEQ ID NO: 104892 - RNA, 64 nt, Homo Sapiens
cugaucugcgugacagaaacaccagcauauuugcaacgccaaggauauuggucuuaagugcaag

SEQ ID NO: 104893 - RNA, 64 nt, Homo Sapiens
aaaaucagcagauguugaaguaacaaaaaagagaaacgccaacauuaaaguguggaaagcaaaa

SEQ ID NO: 104894 - RNA, 64 nt, Homo Sapiens
cuggcagcuccaagagguuuuucagcucuuugacaacgccaacugcccaagccuacagaacaaa

SEQ ID NO: 104895 - RNA, 64 nt, Homo Sapiens
cggaggcccgaggccagccgacaggggagcaaagaacgccaagccugcuggccuuagcagggag

SEQ ID NO: 104896 - RNA, 64 nt, Homo Sapiens
gcuuugguuauuagaguuuaaaguugagaaggaaaacgccaaauuccauguagcaaccaggacg

SEQ ID NO: 104897 - RNA, 64 nt, Homo Sapiens
aauguacguugagaaucacuagaggaguagcaugaacgccaaggucccaggccccaggggagaa

SEQ ID NO: 104898 - RNA, 64 nt, Homo Sapiens
agacuauuuaaaaacugguacaacaggucucuacaacgccaagaucuaacuaagcuuuaaaagg

SEQ ID NO: 104899 - RNA, 64 nt, Homo Sapiens
cuuggggccccagcggugggagugcaaaagacccaacgccaacaccuggugccuucugcagcca

SEQ ID NO: 104900 - RNA, 64 nt, Homo Sapiens
gcucaugagcaacauuaggcuugcguggaaugaaaacgccaaagcuggcucagaggggcccacc

SEQ ID NO: 104901 - RNA, 64 nt, Homo Sapiens
gcuuccuucucuggcauauuggagccgucuacucaacgccaaagcaaguugggacucauccaau

SEQ ID NO: 104902 - RNA, 64 nt, Homo Sapiens
caugcucuagagaaaauaauuuuauuuuuaaauaaacgccaaaaaaugucaaaaucucaagauu

SEQ ID NO: 104903 - RNA, 64 nt, Homo Sapiens
aaauguuuaauaaauaucugagcauguaucuaucaacgccaagaauuucaaagucuccuucaac

SEQ ID NO: 104904 - RNA, 64 nt, Homo Sapiens
aacauguugcuuaauaauaauaagucucugcaucaacgccaauacuuaaaaaagaagacuugug

SEQ ID NO: 104905 - RNA, 64 nt, Homo Sapiens
uguagauagccauuucauuucuuuaaacuguuucaacgccaauauguauucuacaaaagagaau

SEQ ID NO: 104906 - RNA, 64 nt, Homo Sapiens
uuuaaggucuagauaggguuaauucucaguuaucaacgccaaggcacugccuccagagucuuua

SEQ ID NO: 104907 - RNA, 64 nt, Homo Sapiens
gcagcaccaucucugccuucacagccucuacaccaacgccaaggcaacuaccccuccucagaca

SEQ ID NO: 104908 - RNA, 64 nt, Homo Sapiens
uuuuguuuugguuucuguauuauguauuuuugucaacgccaauaaauuucuuugauuuguauuu

SEQ ID NO: 104909 - RNA, 64 nt, Homo Sapiens
ccaugucccccagccauggcauggcugcacuguaaacgccaaucggggggucaccaggaucaac

SEQ ID NO: 104910 - RNA, 64 nt, Homo Sapiens
ucaaccuguucugcauugucaguccacugucuacaacgccaacggaccagagcuguguuugugg

SEQ ID NO: 104911 - RNA, 64 nt, Homo Sapiens
auaugaaaacucucaugaauaaacaucuccgugaaacgccaaggcccucgucaaacccugaguc

SEQ ID NO: 104912 - RNA, 64 nt, Homo Sapiens
ucuaaaacuaauuugacaaaucaugacacuagaaaacgccaauguuuuaugucuuugcccaucu

SEQ ID NO: 104913 - RNA, 64 nt, Homo Sapiens
gugagaucacaguucauugcagccuugacuucucaacgccaagucauccucccaccucagccuc

SEQ ID NO: 104914 - RNA, 64 nt, Homo Sapiens
uuuuguacaccuucuguuucuuugcuuauuuuuuaacgccaaagaaagacucucagagaauaga

SEQ ID NO: 104915 - RNA, 64 nt, Homo Sapiens
ugcucacuaaaacaacuuuuuccauuuuuaauaaaacgccaaaaauaucacaacccaccaaaaa

SEQ ID NO: 104916 - RNA, 64 nt, Homo Sapiens
uauuguguagccucuuaugcagguuucuuuucuucugcccuaacgucagcucuagccaacagug

SEQ ID NO: 104917 - RNA, 64 nt, Homo Sapiens
cagcagggugggccugccuugacugccucacccucugcccuaaugccgaaggguccaagggcca

SEQ ID NO: 104918 - RNA, 64 nt, Homo Sapiens
uauuagcuccacuucacaugcuuauucagguuuccugcccuagcugugggucguggauaaggag

SEQ ID NO: 104919 - RNA, 64 nt, Homo Sapiens
uaagaaaccccaaauguaguguaguuugccccaccugcccuaaacuagucagcuaaagucauuu

SEQ ID NO: 104920 - RNA, 64 nt, Homo Sapiens
gcuuagagcauggaccuccuugcuacugcggccccugcccuaggcagcacuuuugaccaagucc

SEQ ID NO: 104921 - RNA, 64 nt, Homo Sapiens
ggggcccaacacuguacccauccccccagcucaccugcccuacuccacaucugaaaccuguagg

SEQ ID NO: 104922 - RNA, 64 nt, Homo Sapiens
ugaccccgagaagugcucuuucccacccacacagcugcccuagcacagcuuccucacaccccug

SEQ ID NO: 104923 - RNA, 64 nt, Homo Sapiens
cccccagggccuccagggccacuccaccgaccaacugcccuaaggggucugauuuucucacuga

SEQ ID NO: 104924 - RNA, 64 nt, Homo Sapiens
uuccuaccacagaaguaauuuucaaaguaagucucugcccuaggcacaucagaucaccugggga

SEQ ID NO: 104925 - RNA, 64 nt, Homo Sapiens
uuucuauucuauuccauguuggaccaauaccacacugcccuagucacuguugcauuauaguaua

SEQ ID NO: 104926 - RNA, 64 nt, Homo Sapiens
aggcccccuggccugggcacccagcugcaggccccugcccuacgugcacuacaggaagggguga

SEQ ID NO: 104927 - RNA, 64 nt, Homo Sapiens
acggacaggaccccgggacagaaccccgggagcacugcccuaggagcccggaccccacgagcuc

SEQ ID NO: 104928 - RNA, 64 nt, Homo Sapiens
agcaccaggccccagcucccuccgggggcccuccaggaaccaccaagcucucucacgaccuucc

SEQ ID NO: 104929 - RNA, 64 nt, Homo Sapiens
ccccaaucugaaagccaugcgugucgguguauauaggaaccauguacagagcccagagaagccc

SEQ ID NO: 104930 - RNA, 64 nt, Homo Sapiens
acccucagagcccagcauccuggauguccuucgaaggaaccaggcccaucaucucagaggcccc

SEQ ID NO: 104931 - RNA, 64 nt, Homo Sapiens
gcccaucaucucagaggcccccaugcuacaggccaggaaccagagcaaagccuccugcuccuac

SEQ ID NO: 104932 - RNA, 64 nt, Homo Sapiens
gggcagaggccaaguuccaggugucuguguucccaggaaccaaauggggagucuggggcccguu

SEQ ID NO: 104933 - RNA, 64 nt, Homo Sapiens
cccacccacccccauccaggaaccgugacguccaaggaaccaaacccagacgcagaacaauaaa

SEQ ID NO: 104934 - RNA, 64 nt, Homo Sapiens
aucaauuuucuuuucuuucuaaacuuguaaauaaaggaaccauaauacagggaugguguucaaa

SEQ ID NO: 104935 - RNA, 64 nt, Homo Sapiens
gcgaauuuuaaaagaugcaaauauauuucccugaaggaaccaaaaaauauuauauuauauauau

SEQ ID NO: 104936 - RNA, 64 nt, Homo Sapiens
ugacaugcuggguugugacuccaaacagagcaugaggaaccaguggcacaugugaauuuccaca

SEQ ID NO: 104937 - RNA, 64 nt, Homo Sapiens
gacugccagaaaauauuagcgaaguucaaauuucaggaaccaagcaaaaguuuaaaacacauau

SEQ ID NO: 104938 - RNA, 64 nt, Homo Sapiens
gggucugaucgcaaauacacuaaauguggaguguaggaaccaaaaugaaaccugcuguauggaa

SEQ ID NO: 104939 - RNA, 64 nt, Homo Sapiens
uguuuuacuacuauggcacuuugauaaaauggucaggaaccaacuuuacuggcaaaagggucca

SEQ ID NO: 104940 - RNA, 64 nt, Homo Sapiens
aguaacugugcacccuccaacaucccaaccccagaggaaccagugggauugaaaaccagcagaa

SEQ ID NO: 104941 - RNA, 64 nt, Homo Sapiens
ugaggccuucccauggcuacagugugacccuuggaggaaccaaaggcugugcauuguuagaauu

SEQ ID NO: 104942 - RNA, 64 nt, Homo Sapiens
acuuauagacccaaucagaauacggugguugagaaggaaccaguguuuacaaguaauaucagaa

SEQ ID NO: 104943 - RNA, 64 nt, Homo Sapiens
gaaccaguguuuacaaguaauaucagaaaguugaaggaaccaguguuuacaaguaauaccagaa

SEQ ID NO: 104944 - RNA, 64 nt, Homo Sapiens
guucuuggugacuacauauauauuaguauuuuacaggaaccauauuuauauacuaguaucuggc

SEQ ID NO: 104945 - RNA, 64 nt, Homo Sapiens
auugacaacagucaagcuguccacuccaaaggcaaggaaccauguucucuguaccuuuauagua

SEQ ID NO: 104946 - RNA, 64 nt, Homo Sapiens
cccgaaaccaggccugggcccagaccugaaaccaaggaaccagaguagccuggcgccuaggaac

SEQ ID NO: 104947 - RNA, 64 nt, Homo Sapiens
ccugaaaccaaggaaccagaguagccuggcgccuaggaaccagaagaagcaaaacuaaaggcag

SEQ ID NO: 104948 - RNA, 64 nt, Homo Sapiens
cacucccuccuggagcucugugggucucuggaagaggaaccaggagaagggcuggggccggggc

SEQ ID NO: 104949 - RNA, 64 nt, Homo Sapiens
gggcuuggaacccggugcucccucugucauccucaggaaccaacaauucgucggaggcaucaug

SEQ ID NO: 104950 - RNA, 64 nt, Homo Sapiens
gaugagggugcccgggcuggacggcuaagggcacgaagacgauaucugguagagagggccagag

SEQ ID NO: 104951 - RNA, 64 nt, Homo Sapiens
cugggucagacgccagugacagaagcugugaguggaagacgagggauugccaucgccuaugagg

SEQ ID NO: 104952 - RNA, 63 nt, Homo Sapiens
aggacugacuggguucuuccucccuccccgaagcccagacaguucaguugggcuggggguugc

SEQ ID NO: 104953 - RNA, 63 nt, Homo Sapiens
gacauaacugagcugaaguaauuccauaaagggcccagacagccuccuccaccauucccuuca

SEQ ID NO: 104954 - RNA, 63 nt, Homo Sapiens
ccucuccuugccugcaggcuggcugccccaaaccccagacacuacccagagguaaggcugccu

SEQ ID NO: 104955 - RNA, 63 nt, Homo Sapiens
uuauaccacccaguguucagcuuuuuuccacugcccagacagcgcucauuauaccccaaagac

SEQ ID NO: 104956 - RNA, 63 nt, Homo Sapiens
cuucccagccacugacucacaguucucuggaugcccagacaccucucuucagggaagaugagu

SEQ ID NO: 104957 - RNA, 63 nt, Homo Sapiens
cuggaaaucaucacagcagugggauaucagagccccagacagcacugccucuuccuccccacc

SEQ ID NO: 104958 - RNA, 63 nt, Homo Sapiens
gcuucuugugaaaccacaggcccuugggguucccccagacagagccgcaaaucaaccccagac

SEQ ID NO: 104959 - RNA, 63 nt, Homo Sapiens
uuuaaauggugggaacccuccccaaaaccuuuccccagacacauucuccugugccccucagag

SEQ ID NO: 104960 - RNA, 63 nt, Homo Sapiens
cccgaaguuucgauuugauuagucugggguggacccagacauguuaaguauuuuuuaaguucc

SEQ ID NO: 104961 - RNA, 63 nt, Homo Sapiens
gucagacagugacuaauccagggccguggcauucccagacagcacaccacugugguccccucc

SEQ ID NO: 104962 - RNA, 63 nt, Homo Sapiens
gacuguagccaucaccagaacacuuaguuucuucccagacaugaauuuccugacaggcucuga

SEQ ID NO: 104963 - RNA, 63 nt, Homo Sapiens
acgguugaagaaucaagcucauaauaugauacacccagacagacccagaaaucuuuugauuuc

SEQ ID NO: 104964 - RNA, 63 nt, Homo Sapiens
caggguucucuauuucucuucuagacccaaaggcccagacacgauagaucauaguccaauccc

SEQ ID NO: 104965 - RNA, 63 nt, Homo Sapiens
uucagccagcgcugaggaaaggaggccccaguccccagacagucagagaaggagacaccuccu

SEQ ID NO: 104966 - RNA, 63 nt, Homo Sapiens
ugacacccuaaaagccauccuucccuccgucuccccagacaucaguaucuucgcagugcucug

SEQ ID NO: 104967 - RNA, 63 nt, Homo Sapiens
cuaucgccacaaugccauguaggaaaggccagccccagacaucggaggaagcgaugccgaggu

SEQ ID NO: 104968 - RNA, 63 nt, Homo Sapiens
cuggcuguguuccugagcccccgucgugccucucccagacagcagcugucuggcccuugcugg

SEQ ID NO: 104969 - RNA, 63 nt, Homo Sapiens
aaguggucacaaagaggguggcugugaggugaccccagacacugcagaacgaugugcacccuc

SEQ ID NO: 104970 - RNA, 63 nt, Homo Sapiens
gcaguccccccacgcccgagaaagccugggggacccagacaccuguccccacagucaaagccu

SEQ ID NO: 104971 - RNA, 63 nt, Homo Sapiens
cagacaccuguccccacagucaaagccuggggacccagacauccuguccccacagucagccuc

SEQ ID NO: 104972 - RNA, 63 nt, Homo Sapiens
agacccggacagacagacacagccugaaacagacccagacaaacagacagacagacacagccu

SEQ ID NO: 104973 - RNA, 63 nt, Homo Sapiens
acaaacagacagacagacacagccugaaacagacccagacagacagacagacagccugaaaca

SEQ ID NO: 104974 - RNA, 63 nt, Homo Sapiens
acccagacagacagacagacagccugaaacagacccagacacagccugaaacagauccggaca

SEQ ID NO: 104975 - RNA, 63 nt, Homo Sapiens
ccggacagacagacagaaacagccugaaacagacccagacagacagacagacacagccugaaa

SEQ ID NO: 104976 - RNA, 63 nt, Homo Sapiens
agaccuagacagacagacacagauugaaacagacccagacaaacagacagacacagccugaaa

SEQ ID NO: 104977 - RNA, 63 nt, Homo Sapiens
ccagacaaacagacagacacagccugaaacagacccagacacagccugaaacagacccggaca

SEQ ID NO: 104978 - RNA, 63 nt, Homo Sapiens
ccggacagacagacagacacagccugaaacagacccagacagacagacagacacagccugaaa

SEQ ID NO: 104979 - RNA, 63 nt, Homo Sapiens
ccagacagacagacagacacagccugaaacagacccagacagacagaccgacgcagccugaaa

SEQ ID NO: 104980 - RNA, 63 nt, Homo Sapiens
ccagacagacagaccgacgcagccugaaagagacccagacagagagacaggcagacacagccu

SEQ ID NO: 104981 - RNA, 63 nt, Homo Sapiens
cugauggcucugacaccguguugguggcgaugucccagacaaucccaccaggacggcccagac

SEQ ID NO: 104982 - RNA, 63 nt, Homo Sapiens
guggcgaugucccagacaaucccaccaggacggcccagacaucccuacuggcuucgcuggugg

SEQ ID NO: 104983 - RNA, 63 nt, Homo Sapiens
agcagagguuggccucccuggaggagcagguggcccagacagcccaagcccugcacuggaucg

SEQ ID NO: 104984 - RNA, 63 nt, Homo Sapiens
acugucaggauaaacuccguggggguacaggagcccagacaaagcccaggccugucaagagac

SEQ ID NO: 104985 - RNA, 63 nt, Homo Sapiens
uucuuggggacccaguauguccucuccucuagacccagacauacaguuauaaccgucuguccu

SEQ ID NO: 104986 - RNA, 63 nt, Homo Sapiens
aucaaccagggcagauccaccgugcccugguuccccagacauuccagaaugccccacaucauu

SEQ ID NO: 104987 - RNA, 63 nt, Homo Sapiens
gaauguuggagcaaaagcucgguugaugucagacccagacauaacacacaggaacagagaaau

SEQ ID NO: 104988 - RNA, 63 nt, Homo Sapiens
gaauguuugaacaaagacucggucgauuccagacccagacauaacccguagauacagagaagu

SEQ ID NO: 104989 - RNA, 64 nt, Homo Sapiens; identical to SEQ ID NO: 79907

SEQ ID NO: 104990 - RNA, 64 nt, Homo Sapiens; identical to SEQ ID NO: 79908

SEQ ID NO: 104991 - RNA, 64 nt, Homo Sapiens
uugguguugcagaagguuuacucuguggccaaaggagggucaggaaggaugagcauuuagggca

SEQ ID NO: 104992 - RNA, 64 nt, Homo Sapiens
gucagcagaacugggguggauuuggguuggaagugagggucagagaggagucagagagaauccc

SEQ ID NO: 104993 - RNA, 64 nt, Homo Sapiens
gagcagggauguuggaugccucuggaauccugcagagggucaaggaugacuucacugggagccu

SEQ ID NO: 104994 - RNA, 64 nt, Homo Sapiens
guccaugaucugaccaacuagcuaacacuucacagagggucacauucuuccucaaauauuuggg

SEQ ID NO: 104995 - RNA, 64 nt, Homo Sapiens
gagugcuggaauggggaccugggguggggaggcagagggucacuuuacauaggauuaaguucga

SEQ ID NO: 104996 - RNA, 64 nt, Homo Sapiens
cagaggugggaggccccugguggcauggaagagggagggucagugccaagucucaggaggaggg

SEQ ID NO: 104997 - RNA, 64 nt, Homo Sapiens
ugccagaccuggacuaaacuacccccagaguggggagggucaggggcucauauuuauaaauccc

SEQ ID NO: 104998 - RNA, 64 nt, Homo Sapiens
agagaaugggggaggaggcguaucgagauagccagagggucaggaagacucacaggugaccugc

SEQ ID NO: 104999 - RNA, 64 nt, Homo Sapiens
agugacaagaaucacauccgguuguguccugugggagggucagaggcagaaucuacuuacagug

SEQ ID NO: 105000 - RNA, 64 nt, Homo Sapiens
auggcuggaauguggagcccaggugccucugguggagggucaucugcuuuuccagacugugguu

SEQ ID NO: 105001 - RNA, 64 nt, Homo Sapiens
cccuuccucugcuguguuuuccacugugugcucagagggucagucuuuuacacaugugggucaa

SEQ ID NO: 105002 - RNA, 64 nt, Homo Sapiens
agugccaagucacuggccgugcagagugcacagggagggucagagggcagggccuggcacagcu

SEQ ID NO: 105003 - RNA, 64 nt, Homo Sapiens
uaguccauaucaccacaaaugacaacugaccugucuccuucacagaauguagaacacugagcag

SEQ ID NO: 105004 - RNA, 64 nt, Homo Sapiens
uuaucuugaacugccugacuuagauguuauucgacuccuucagggucuugcaggacucacugga

SEQ ID NO: 105005 - RNA, 64 nt, Homo Sapiens
uuaucuuggacugacugacuuagauguuauucaacuccuucagugucuugcaggacucacugga

SEQ ID NO: 105006 - RNA, 64 nt, Homo Sapiens
gugaagccucucugucaucuccccuucccagccccuccuucauccccugccuccuucaccagcc

SEQ ID NO: 105007 - RNA, 64 nt, Homo Sapiens
aucuccccuucccagccccuccuucauccccugccuccuucaccagccuggcuuuugccuggag

SEQ ID NO: 105008 - RNA, 54 nt, Homo Sapiens; identical to SEQ ID NO: 100148

SEQ ID NO: 105009 - RNA, 64 nt, Homo Sapiens
aucagggacuuugugcuaagccugaugaaaugugcuccuucaaucuccaugaaaccaucguaac

SEQ ID NO: 105010 - RNA, 64 nt, Homo Sapiens
cuugaaaacacuguucucugcccuccaagaccuucuccuucaccuuuguccccaccgcagacag

SEQ ID NO: 105011 - RNA, 64 nt, Homo Sapiens
uuaugggcuggguucuacccaggugcuaggaacacuccuucacagaugggugcuuggaggaagg

SEQ ID NO: 105012 - RNA, 64 nt, Homo Sapiens
ucaucuagaauuuauuuuccuagcacuucaccaccuccuucaucuucuccuucaacaauaaacc

SEQ ID NO: 105013 - RNA, 64 nt, Homo Sapiens
uauuuuccuagcacuucaccaccuccuucaucuucuccuucaacaauaaacccugagaucuuug

SEQ ID NO: 105014 - RNA, 64 nt, Homo Sapiens
uucucuuuauaaggcaaaaagaucuguauuuacacuccuucaccuagggauguguuuguugccc

SEQ ID NO: 105015 - RNA, 64 nt, Homo Sapiens
ccucagcaggacugacucugggcucuacaaccagcuccuucacauaaaggguuuagagacuccc

SEQ ID NO: 105016 - RNA, 64 nt, Homo Sapiens
uuuuuccuuaugcaaaucauuugugugguuuuuuguuugugauuucucucaaaagacuuuguug

SEQ ID NO: 105017 - RNA, 64 nt, Homo Sapiens
aucuuuacguucaggacucaaugauguuucauagguuugugauguuacgcuaucuuguuuggga

SEQ ID NO: 105018 - RNA, 64 nt, Homo Sapiens
cugaacccuuaaacagugcucggguaucuugaggguuugugaucucacauuugaggacuuuucu

SEQ ID NO: 105019 - RNA, 64 nt, Homo Sapiens
acugagcauuaaagguuuugauagacuugacuguguuugugaaagcuguaaaucuggaaauuug

SEQ ID NO: 105020 - RNA, 64 nt, Homo Sapiens
uuuauacaauugaaagucuuuuuauacuuuacugguuugugaauaaccauuucuccaugguguc

SEQ ID NO: 105021 - RNA, 64 nt, Homo Sapiens
uauugagaaauguaacauucccauauaauauauuguuugugaaucaauauuuaauauaaauaua

SEQ ID NO: 105022 - RNA, 64 nt, Homo Sapiens
auuuuauaauguggaaugauuuaaaaaacuacauguuugugaaucagcaugaccugguguagac

SEQ ID NO: 105023 - RNA, 64 nt, Homo Sapiens
acugugagucucagaugauugcuuuuuucugcauguuugugauccaggaagaauagaauuguau

SEQ ID NO: 105024 - RNA, 64 nt, Homo Sapiens
cuccucugacaugcggucagauaagucccgucuuguuugugaguaccacagaaacgccugagag

SEQ ID NO: 105025 - RNA, 64 nt, Homo Sapiens
cugacaugaggaaugcagguucacacuguaaagaguuugugaaagguuucagucuaacuggggu

SEQ ID NO: 105026 - RNA, 64 nt, Homo Sapiens
cagcggucacuauuuucucuugugaccugaaaggguuugugauagaggaauuuguaacgaucgg

SEQ ID NO: 105027 - RNA, 64 nt, Homo Sapiens
uuuuauccuguuugaauuuuacuccaaugaguguguuugugaguaaaaaaagcccacaucuuau

SEQ ID NO: 105028 - RNA, 64 nt, Homo Sapiens
aaucgcugucucucugucucuuugcuuuguaucuguuugugaguugauccuggcuucucucucu

SEQ ID NO: 105029 - RNA, 64 nt, Homo Sapiens
gcucaguuuuuacagacuguaaaggagauguguuguuugugaagauggagcagagucaaaucug

SEQ ID NO: 105030 - RNA, 64 nt, Homo Sapiens
aggcuuucgggaaugauucacauagaaauguaagguuugugacaaauucacacuggagaaaagc

SEQ ID NO: 105031 - RNA, 64 nt, Homo Sapiens
agguuuuugcauauaaugcacauacagagguaagguuugugacaaauucacauugaagagaaac

SEQ ID NO: 105032 - RNA, 64 nt, Homo Sapiens
acuccucacccccuugcuccccuggucuucuggaguuugugacauugauuugaaauggauggug

SEQ ID NO: 105033 - RNA, 64 nt, Homo Sapiens
aguuuucuaacauagcuauaagguccuuguugcuguuugugauaacugauagauaacucauugg

SEQ ID NO: 105034 - RNA, 64 nt, Homo Sapiens
cugggugggcaggggccucaugacaagcgacaaguguacccagaguagaaggccuuccccacuc

SEQ ID NO: 105035 - RNA, 64 nt, Homo Sapiens
agaaaauaccuuauuaucugcagggacucaaagcuguacccaaaucaagaaagacaaaauaaca

SEQ ID NO: 105036 - RNA, 64 nt, Homo Sapiens
uguuuacauauuggcuaugguauuggagcauagcuguacccauuuguuuucauaaauaacguuu

SEQ ID NO: 105037 - RNA, 64 nt, Homo Sapiens
aaaauuuaaaaagaaauggaauauacaccuaccauguacccauaaucucauguaucccauaaau

SEQ ID NO: 105038 - RNA, 64 nt, Homo Sapiens
agcuaacgugucucugguggaggcagcugacagcuguacccacugcgcaugcuugcccuauuaa

SEQ ID NO: 105039 - RNA, 64 nt, Homo Sapiens
ucacagagaaggagcagagaacugcugaccacauuguacccauuguacauguauuaguuccuuu

SEQ ID NO: 105040 - RNA, 64 nt, Homo Sapiens
uaugggaauuauuccucagaagagaauuuaaagguguacccauauauaucucuuucuggaguau

SEQ ID NO: 105041 - RNA, 64 nt, Homo Sapiens
uuggucuucuuucaaauuguuuguaugaagaugcuguacccacuugaacaguccucagguguuu

SEQ ID NO: 105042 - RNA, 64 nt, Homo Sapiens
aaacaggauucugauucauuaagucuuuauccaagucaccaaugagaacaaaguuaaaauuaaa

SEQ ID NO: 105043 - RNA, 64 nt, Homo Sapiens
aagguugcauuuuacuuuugcagaggaacuggacgucaccaaaccaagugguuuuuccuaauuc

SEQ ID NO: 105044 - RNA, 64 nt, Homo Sapiens
acucaccagaagggggcuuacuccacuugguggggucaccaacuuccaugguccccagucuccc

SEQ ID NO: 105045 - RNA, 64 nt, Homo Sapiens
aaauaaacaggaaggaaaucgcuuguaugaccaagucaccaagggagaggguuuugccauguuu

SEQ ID NO: 105046 - RNA, 64 nt, Homo Sapiens
caucaaaaaaccuuaaaaaauauauucuaguugugucaccaaauccaauuuucaucuaaaaggu

SEQ ID NO: 105047 - RNA, 64 nt, Homo Sapiens
uucaucuaaaagguuauauuuguguauuugcaaagucaccaauuuuuaauuuuggaauuuagaa

SEQ ID NO: 105048 - RNA, 64 nt, Homo Sapiens
caaccaguccugcugcuaccccuugggucccacugucaccaaggcuaguuaugcagagcaguug

SEQ ID NO: 105049 - RNA, 64 nt, Homo Sapiens
agaccaucuucccaggccugucccuuucccaacugucaccaaacacccacccuguccucugacg

SEQ ID NO: 105050 - RNA, 64 nt, Homo Sapiens
uuaauuugauguuuaccuaagccuuuaaggcugugucaccaagguauggccacaaggaagaaua

SEQ ID NO: 105051 - RNA, 64 nt, Homo Sapiens
aauuccaauaauuagggaaaauugauaaauaucugucaccaaaccacaagaaauccaaaaucau

SEQ ID NO: 105052 - RNA, 64 nt, Homo Sapiens
caucuaaguaacauuugcacaugauacagcaaaaggaguucauugcaauacugucuuuggauau

SEQ ID NO: 105053 - RNA, 64 nt, Homo Sapiens
uggacguaagacaaacacgugcucguccuuuaauggaguucaccagcacacuuguuaaccaguc

SEQ ID NO: 105054 - RNA, 64 nt, Homo Sapiens
accauccuggccaacacaguaucaccugaagucaggaguucaagugggaggccaaggcaggcag

SEQ ID NO: 105055 - RNA, 64 nt, Homo Sapiens
ugcugcacccccagggagggggaugcgccucucuggaguucacgccaccuccccaugggcccaa

SEQ ID NO: 105056 - RNA, 64 nt, Homo Sapiens
aucagucugggcaacacgauauugccugagcucaggaguucaaguaggaggccgaggcaggcgg

SEQ ID NO: 105057 - RNA, 64 nt, Homo Sapiens
accagccugaccaacacggagaucccugaguucgggaguucaaguugggaggccaaggcaggcg

SEQ ID NO: 105058 - RNA, 64 nt, Homo Sapiens
accagcccgggcaacgugguaucgcuugaggucaggaguucaagugggaggcugaggcgggcag

SEQ ID NO: 105059 - RNA, 64 nt, Homo Sapiens
accagccuggccaacauggcaucaccugaggucaggaguucaagugggaggccgagucaggugg

SEQ ID NO: 105060 - RNA, 64 nt, Homo Sapiens
ugggaggccaaagcaggaggaucgcuugagcccaggaguucaagaccaaccuggugaaaccccg

SEQ ID NO: 105061 - RNA, 64 nt, Homo Sapiens
auucuucauuuaccuaguauuaugaaagaaugaaggaguucaaacaaauguguuucccaguuaa

SEQ ID NO: 105062 - RNA, 64 nt, Homo Sapiens
ugggaggcugaggcaggaggaucacuugaggucaggaguucaauguggacaacacaguaagacc

SEQ ID NO: 105063 - RNA, 64 nt, Homo Sapiens
ugggagguugagguaggaggaucgcuugaacccaggaguucaagucugcagugagcuaugauug

SEQ ID NO: 105064 - RNA, 64 nt, Homo Sapiens
gcuggcuggugaaaaguggggagcugacagccuuggaguucagugcuuccccagggcuacgaag

SEQ ID NO: 105065 - RNA, 64 nt, Homo Sapiens
acggggagcgaggcugguuuccugugcagcagguggaguucauuuccaacccagagguccgugc

SEQ ID NO: 105066 - RNA, 64 nt, Homo Sapiens
acuagccuggccaacaugguaucaccugaggucaggaguucaagugggaggcaggggcgggugg

SEQ ID NO: 105067 - RNA, 64 nt, Homo Sapiens
accagccuguccaacaugguaucaccugaggucaggaguucaagugagaggcugaggugguagg

SEQ ID NO: 105068 - RNA, 64 nt, Homo Sapiens
augaaucaagauugaaccaucugcugggcuuaagggaguucaguuaccuuuuaagaaugagaaa

SEQ ID NO: 105069 - RNA, 64 nt, Homo Sapiens
aaauggaguauccugaguugauuuuguuagauuuggaguucaaugaaacacugcagcgaucuua

SEQ ID NO: 105070 - RNA, 64 nt, Homo Sapiens
ccucugacaugagaaugaaaccaggaauggacuuggaguucaacaggcugagaggaugccucca

SEQ ID NO: 105071 - RNA, 64 nt, Homo Sapiens
uucuugaccguucuugggcacuggaggcuggcuaggaguucaguaauaaacguggccuucgugc

SEQ ID NO: 105072 - RNA, 64 nt, Homo Sapiens
uaggaguccaaggcgggcggaucacuugaggucaggaguucaagaccagcuuggccaaggugau

SEQ ID NO: 105073 - RNA, 64 nt, Homo Sapiens
ugggaggcugaggcgggcagaucacuugaggccaggaguucaagaccagcccaaccaacauggu

SEQ ID NO: 105074 - RNA, 64 nt, Homo Sapiens
ugggaggcugaggugggaagauucuuugagcccaggaguucaaggcugcagugaauucugaucg

SEQ ID NO: 105075 - RNA, 64 nt, Homo Sapiens
aauuauaucaccuguguucugaacuaaaaugaugggaguucauuuuguauuuacuuugcaguaa

SEQ ID NO: 105076 - RNA, 64 nt, Homo Sapiens
accagccuggcaaacaugguaucacuugaggccaggaguucaagugggaggcuaaggcagcugg

SEQ ID NO: 105077 - RNA, 64 nt, Homo Sapiens
accagccaaggcaacauaguauaacuugaaacuaggaguucaagcgggaggccaaggugagagg

SEQ ID NO: 105078 - RNA, 64 nt, Homo Sapiens
accagccugggcaauauaguaucacuugagcccaggaguucaaaugagacgcugaggugggagg

SEQ ID NO: 105079 - RNA, 64 nt, Homo Sapiens
accagccuggccaacaugguaucaccugaugucaggaguucaagugggaggcuaaggugggcgg

SEQ ID NO: 105080 - RNA, 64 nt, Homo Sapiens
accagccuggccaacaugguaucacuugaggucaggaguucaagaucccagcacugagaggccg

SEQ ID NO: 105081 - RNA, 64 nt, Homo Sapiens
accagccuggccaacaugauaucacuugaggccaggaguucaagugggaggccaaggugggugg

SEQ ID NO: 105082 - RNA, 64 nt, Homo Sapiens
uaagaggccaaggcggauggaucacuugagcccaggaguucaacaccagccugagcaacauggu

SEQ ID NO: 105083 - RNA, 64 nt, Homo Sapiens
uggaaggccgaggugggcagaucaucugaggccaggaguucaagaccagccuggcuaacauggu

SEQ ID NO: 105084 - RNA, 64 nt, Homo Sapiens
ggggaggccaaggcaggaggcuugcuugaggcaaggaguucaaggcuacagugagcuaugauug

SEQ ID NO: 105085 - RNA, 64 nt, Homo Sapiens
uggcaggcugaggcgggcagaucaccugagaucaggaguucaagaucagccugaccaacaugga

SEQ ID NO: 105086 - RNA, 64 nt, Homo Sapiens
uuugugcuggguaaaagaggagagcugugcuuucuaccccaaaguuguugguaauggagccggu

SEQ ID NO: 105087 - RNA, 64 nt, Homo Sapiens
gaaaacauguuuaagauaaaauacaaacuuuaccuaccccaaauucauaaaguacauuuagugc

SEQ ID NO: 105088 - RNA, 64 nt, Homo Sapiens
ccacuacugaccaaggucucaguguucucuucucuaccccaaagcaggagguguaaaaauaaac

SEQ ID NO: 105089 - RNA, 64 nt, Homo Sapiens
gaccugcaugcccaggacacgucauuucacauuuuaccccaacuucugagaauggcuaugaagc

SEQ ID NO: 105090 - RNA, 64 nt, Homo Sapiens; identical to SEQ ID NO: 75208

SEQ ID NO: 105091 - RNA, 64 nt, Homo Sapiens; identical to SEQ ID NO: 75209

SEQ ID NO: 105092 - RNA, 64 nt, Homo Sapiens; identical to SEQ ID NO: 75210

SEQ ID NO: 105093 - RNA, 64 nt, Homo Sapiens; identical to SEQ ID NO: 75211

SEQ ID NO: 105094 - RNA, 64 nt, Homo Sapiens; identical to SEQ ID NO: 75212

SEQ ID NO: 105095 - RNA, 64 nt, Homo Sapiens; identical to SEQ ID NO: 75213

SEQ ID NO: 105096 - RNA, 64 nt, Homo Sapiens; identical to SEQ ID NO: 75214

SEQ ID NO: 105097 - RNA, 64 nt, Homo Sapiens; identical to SEQ ID NO: 75215

SEQ ID NO: 105098 - RNA, 64 nt, Homo Sapiens; identical to SEQ ID NO: 75216

SEQ ID NO: 105099 - RNA, 64 nt, Homo Sapiens; identical to SEQ ID NO: 75217

SEQ ID NO: 105100 - RNA, 64 nt, Homo Sapiens; identical to SEQ ID NO: 75218

SEQ ID NO: 105101 - RNA, 64 nt, Homo Sapiens; identical to SEQ ID NO: 75219

SEQ ID NO: 105102 - RNA, 64 nt, Homo Sapiens; identical to SEQ ID NO: 75220

SEQ ID NO: 105103 - RNA, 64 nt, Homo Sapiens; identical to SEQ ID NO: 75221

SEQ ID NO: 105104 - RNA, 64 nt, Homo Sapiens; identical to SEQ ID NO: 75222

SEQ ID NO: 105105 - RNA, 60 nt, Homo Sapiens; identical to SEQ ID NO: 75223

SEQ ID NO: 105106 - RNA, 64 nt, Homo Sapiens; identical to SEQ ID NO: 75224

SEQ ID NO: 105107 - RNA, 64 nt, Homo Sapiens; identical to SEQ ID NO: 75225

SEQ ID NO: 105108 - RNA, 64 nt, Homo Sapiens; identical to SEQ ID NO: 75226

SEQ ID NO: 105109 - RNA, 64 nt, Homo Sapiens; identical to SEQ ID NO: 75227

SEQ ID NO: 105110 - RNA, 64 nt, Homo Sapiens; identical to SEQ ID NO: 75228

SEQ ID NO: 105111 - RNA, 64 nt, Homo Sapiens; identical to SEQ ID NO: 75229

SEQ ID NO: 105112 - RNA, 64 nt, Homo Sapiens; identical to SEQ ID NO: 75230

SEQ ID NO: 105113 - RNA, 64 nt, Homo Sapiens; identical to SEQ ID NO: 75231

SEQ ID NO: 105114 - RNA, 64 nt, Homo Sapiens; identical to SEQ ID NO: 75232

SEQ ID NO: 105115 - RNA, 64 nt, Homo Sapiens; identical to SEQ ID NO: 75233

SEQ ID NO: 105116 - RNA, 64 nt, Homo Sapiens; identical to SEQ ID NO: 75234

SEQ ID NO: 105117 - RNA, 64 nt, Homo Sapiens; identical to SEQ ID NO: 75235

SEQ ID NO: 105118 - RNA, 64 nt, Homo Sapiens; identical to SEQ ID NO: 75236

SEQ ID NO: 105119 - RNA, 64 nt, Homo Sapiens; identical to SEQ ID NO: 75237

SEQ ID NO: 105120 - RNA, 64 nt, Homo Sapiens; identical to SEQ ID NO: 75238

SEQ ID NO: 105121 - RNA, 64 nt, Homo Sapiens; identical to SEQ ID NO: 75239

SEQ ID NO: 105122 - RNA, 64 nt, Homo Sapiens; identical to SEQ ID NO: 75240

SEQ ID NO: 105123 - RNA, 64 nt, Homo Sapiens; identical to SEQ ID NO: 75241

SEQ ID NO: 105124 - RNA, 64 nt, Homo Sapiens; identical to SEQ ID NO: 75242

SEQ ID NO: 105125 - RNA, 64 nt, Homo Sapiens; identical to SEQ ID NO: 75243

SEQ ID NO: 105126 - RNA, 64 nt, Homo Sapiens; identical to SEQ ID NO: 75244

SEQ ID NO: 105127 - RNA, 64 nt, Homo Sapiens; identical to SEQ ID NO: 75245

SEQ ID NO: 105128 - RNA, 64 nt, Homo Sapiens; identical to SEQ ID NO: 75246

SEQ ID NO: 105129 - RNA, 51 nt, Homo Sapiens; identical to SEQ ID NO: 45449

SEQ ID NO: 105130 - RNA, 64 nt, Homo Sapiens; identical to SEQ ID NO: 45450

SEQ ID NO: 105131 - RNA, 64 nt, Homo Sapiens; identical to SEQ ID NO: 45451

SEQ ID NO: 105132 - RNA, 64 nt, Homo Sapiens; identical to SEQ ID NO: 45452

SEQ ID NO: 105133 - RNA, 64 nt, Homo Sapiens; identical to SEQ ID NO: 45453

SEQ ID NO: 105134 - RNA, 64 nt, Homo Sapiens; identical to SEQ ID NO: 45454

SEQ ID NO: 105135 - RNA, 64 nt, Homo Sapiens; identical to SEQ ID NO: 45455

SEQ ID NO: 105136 - RNA, 64 nt, Homo Sapiens; identical to SEQ ID NO: 45456

SEQ ID NO: 105137 - RNA, 64 nt, Homo Sapiens; identical to SEQ ID NO: 45457

SEQ ID NO: 105138 - RNA, 64 nt, Homo Sapiens; identical to SEQ ID NO: 45458

SEQ ID NO: 105139 - RNA, 64 nt, Homo Sapiens; identical to SEQ ID NO: 45459

SEQ ID NO: 105140 - RNA, 64 nt, Homo Sapiens; identical to SEQ ID NO: 45460

SEQ ID NO: 105141 - RNA, 56 nt, Homo Sapiens
ccucccuguccaagaagugacuguugagaggcgaggagguagugggugaggcuacc

SEQ ID NO: 105142 - RNA, 64 nt, Homo Sapiens
guguguguguggauguguguuuugggguacggggagaggcgaugcuauuggccaucacuaccaa

SEQ ID NO: 105143 - RNA, 64 nt, Homo Sapiens
cgcagcuuuguccugggagagaugcgugugacccagaggcgagaacauacaccccagccgcaca

SEQ ID NO: 105144 - RNA, 64 nt, Homo Sapiens
gcuguggcuggggcucuuggcgccuggacccaagagaggcgacacuuucccggaacccuccucu

SEQ ID NO: 105145 - RNA, 64 nt, Homo Sapiens
aguaagaagcuggucuuaucaagacccuauacucagaggcgacaauguucagaguguugaugag

SEQ ID NO: 105146 - RNA, 64 nt, Homo Sapiens
cuccaauuccacagucucugggagacuuucccuaagaggcgacuuccucuccagccuucucucu

SEQ ID NO: 105147 - RNA, 64 nt, Homo Sapiens
ccagugaggucccaaaugacccagggcuuaagggagaggcgagagaaugaucuggccucagggg

SEQ ID NO: 105148 - RNA, 64 nt, Homo Sapiens
ggcccaucucugcugaccuggguguggcggagggagaggcgaugcugcaaaguguuuucugugu

SEQ ID NO: 105149 - RNA, 64 nt, Homo Sapiens
gcgugggggaggugagcgcacucagggguggggaagaggcgaaaccacugucugcuuagcccag

SEQ ID NO: 105150 - RNA, 64 nt, Homo Sapiens
cauaagaggaggccaaaaguuaaacguucuaaaaagaggcgaaaggaagcaagcaguucagaag

SEQ ID NO: 105151 - RNA, 64 nt, Homo Sapiens
gcucugggauggcaaggcggagcagcccacuggcagaggcgagauuacagcagcagggaggccc

SEQ ID NO: 105152 - RNA, 64 nt, Homo Sapiens
cugccuggcucccuuucucagauuggggggcgccagaggcgaggaggggagucugggugcauca

SEQ ID NO: 105153 - RNA, 64 nt, Homo Sapiens
agagcccgcagcccacgccuucuaaggcgccugcagaggcgagcacgggggaccucggagcugc

SEQ ID NO: 105154 - RNA, 64 nt, Homo Sapiens
ugagacgaggcaggggcucugcuuccucagcccuagaggcgagccaggcaagguuggcgacugu

SEQ ID NO: 105155 - RNA, 64 nt, Homo Sapiens
uccuuaacccuacacccuuuagcuggaugcugucagaggcgauggagaaacgcaaaggugcguu

SEQ ID NO: 105156 - RNA, 64 nt, Homo Sapiens
gacaccuuauagugacuuagagaagaagaugcaaagaggcgaacgcucgcccagagcaagaaau

SEQ ID NO: 105157 - RNA, 64 nt, Homo Sapiens
agauucuguaaacuuaaaauguuaaugacaauucagaggcgaggauaugauaguauaaaaaaug

SEQ ID NO: 105158 - RNA, 64 nt, Homo Sapiens
uccugccccgucucccgugguaguggaacacgacagaggcgaaaaggaccccuagacugcucgc

SEQ ID NO: 105159 - RNA, 64 nt, Homo Sapiens
uuaaaauucugcagauggccugugaaauauugcaagaggcgaguaaauaugguguagaaauucu

SEQ ID NO: 105160 - RNA, 64 nt, Homo Sapiens
agggcacaacaggcacaaagaugaucauaaaagaagaggcgaguacccuaauucaauaugacug

SEQ ID NO: 105161 - RNA, 64 nt, Homo Sapiens
acaccacggucgacgacggcuggagggacguuucagaggcgaguccuggguggcuccucgccuu

SEQ ID NO: 105162 - RNA, 64 nt, Homo Sapiens
ucauugcuauggaucuggagaagaaccugucccuagaggcgacuuuuuucuuaccacuuaauag

SEQ ID NO: 105163 - RNA, 64 nt, Homo Sapiens
caacacaccauuggaauuuugcuugucccuaggaagaggcgauuccuugcuagcucagcgggcg

SEQ ID NO: 105164 - RNA, 64 nt, Homo Sapiens
cgugaggaggucgaggcgcacagggcaagcaggaagaggcgagggcacuugggggucauuauuu

SEQ ID NO: 105165 - RNA, 64 nt, Homo Sapiens
cagggggcuccccggaccgccuguggccucuuggagaggcgagcgccuccccucugcccagccc

SEQ ID NO: 105166 - RNA, 64 nt, Homo Sapiens
acacgagugaauaaagugcagacgcauggacccgagaggcgacgccggcugagacgcucgcccc

SEQ ID NO: 105167 - RNA, 64 nt, Homo Sapiens
uggcugaggcuuggagcaucuccucagacagagcagaggcgacaccucuucaggggugugugga

SEQ ID NO: 105168 - RNA, 64 nt, Homo Sapiens
cgcccugucccucucuggucaaacaacauacuaaagaggcgaggcaaugacuguuggccaguuc

SEQ ID NO: 105169 - RNA, 64 nt, Homo Sapiens
ggugagcuacuuugugagccagcuugaagaguggagaggcgagagcugcggaaucuucuuacua

SEQ ID NO: 105170 - RNA, 64 nt, Homo Sapiens
guggauugucacagcugcggccugcagguuagaaagaggcgagccgggaaagccagggccccug

SEQ ID NO: 105171 - RNA, 64 nt, Homo Sapiens
acguccuaagcagaguuaauccuggcugcucaggagaggcgacacauuucaaaucuccacgaga

SEQ ID NO: 105172 - RNA, 64 nt, Homo Sapiens
ugccaccagccugcagcacaccccacagccaaguagaggcgaaagcaguggcucauccuaccug

SEQ ID NO: 105173 - RNA, 64 nt, Homo Sapiens
aacuaccuuuuacaaauguuacaaaauguauuuuagaggcgacaucucucaagaugaccugagu

SEQ ID NO: 105174 - RNA, 64 nt, Homo Sapiens
gcaagauagcacacagaaguuggcugcgucaaguagaggcgacauuuauuaagugaaaaucaug

SEQ ID NO: 105175 - RNA, 64 nt, Homo Sapiens
cucaccucacaggagggccaggcauguauuccucagaggcgaaacugccaaacucuuucuccug

SEQ ID NO: 105176 - RNA, 64 nt, Homo Sapiens
caguuagaugauucacuuuuugccccuagggaugagaggcgaaagccacuucucauacaagccc

SEQ ID NO: 105177 - RNA, 64 nt, Homo Sapiens
cgaaucucccggcagugcuuggcaggcaggucugagaggcgaaagacugcaugcugaugagcaa

SEQ ID NO: 105178 - RNA, 64 nt, Homo Sapiens
gcaguucccuccgcagaacaccccaugcgugcugagaggcgagcuccuugaagaaggggcuguu

SEQ ID NO: 105179 - RNA, 64 nt, Homo Sapiens
ccacuguggcaucuccguccugcccaccuucuuaagaggcgagauggagcaggcccaucugccu

SEQ ID NO: 105180 - RNA, 64 nt, Homo Sapiens
uacuucaugaucaugaauuccaguuaauuuauaaagaggcgauuuuugugugccauucacacug

SEQ ID NO: 105181 - RNA, 64 nt, Homo Sapiens
gccagugcuuugguaaaggugcuuccgccacugcagaggcgaaaaauccuuacagguaaguauu

SEQ ID NO: 105182 - RNA, 64 nt, Homo Sapiens
gaccaguggaggugccagggccugcuuuggccccagaggcgaggucugggguguccccccacac

SEQ ID NO: 105183 - RNA, 64 nt, Homo Sapiens
uugcucgaggggacaaaaaagucaaaacgaggcgagaggcgaagcccacuuuuguauaccggcc

SEQ ID NO: 105184 - RNA, 64 nt, Homo Sapiens
uugucaacaguauuugaaggggaggaaacacuugagaggcgauauauaagcagcagauuuugug

SEQ ID NO: 105185 - RNA, 64 nt, Homo Sapiens
cacccuccucacagaccucugacuguagaaggugagaggcgaguuggacucuaguccuuggcug

SEQ ID NO: 105186 - RNA, 64 nt, Homo Sapiens
ugggcaccaugggccaaaauuuuguguccagggaagaggcgagaagugcaaccugcauuucacu

SEQ ID NO: 105187 - RNA, 64 nt, Homo Sapiens
ccuccaagggcacagaccugaagcaccggacucuagaggcgaggaggcccugaggaccgcgcug

SEQ ID NO: 105188 - RNA, 64 nt, Homo Sapiens
cuuguuguaaaaggcgaucauugauggaggggcuagaggcgaccaauguuccaggaccaaagac

SEQ ID NO: 105189 - RNA, 64 nt, Homo Sapiens
gcaccaccacagcuggcuaauucuauuuuuuuauagaggcgaagucucacuaugucgccaggcu

SEQ ID NO: 105190 - RNA, 64 nt, Homo Sapiens
gggcuguggaggagcucgcaacucaggugugggaagaggcgagagcuggggagucgugaacggg

SEQ ID NO: 105191 - RNA, 64 nt, Homo Sapiens
guggaggcucuucuucugccggacccccggagguagaggcgagacugucccugcugcagcgcca

SEQ ID NO: 105192 - RNA, 64 nt, Homo Sapiens
gaggaauaaaauggauguaaaaaugauaagucuuagaggcgaguaaaaaaaaaaauuuaaaguu

SEQ ID NO: 105193 - RNA, 64 nt, Homo Sapiens
agcucaggcagcgcagguguggagggggucaggaagaggcgaacccaggcaacaguggccucug

SEQ ID NO: 105194 - RNA, 64 nt, Homo Sapiens
uuguugaaaagucccaaggggccauggguucugaagaggcgaauugagucagguggcacugaaa

SEQ ID NO: 105195 - RNA, 64 nt, Homo Sapiens
uuucugucccucgugaagucacgucacacaggggagaggcgaggucgauggaacuggccacgca

SEQ ID NO: 105196 - RNA, 64 nt, Homo Sapiens
ccuuuggcacagaggcugaguggacagucaggagagaggcgagaggcaaggcgaagccuguguc

SEQ ID NO: 105197 - RNA, 64 nt, Homo Sapiens
ggcaccuggguccaucagagaaggugcaggugacagaggcgaaggcagauggggcacugaccca

SEQ ID NO: 105198 - RNA, 64 nt, Homo Sapiens
cagguggacguagaguuggccuuuuuacaggcaaagaggcgaauuguagaauuguuagauggca

SEQ ID NO: 105199 - RNA, 64 nt, Homo Sapiens
aacuccaucgaguguuccauagagcacggcacucagaggcgagaagguagucugccacggaucc

SEQ ID NO: 105200 - RNA, 64 nt, Homo Sapiens
cuggcaggcagcacagacugaaguggucuggguuagaggcgagcguguggucccuggagccuac

SEQ ID NO: 105201 - RNA, 64 nt, Homo Sapiens
cuugcacuuuugcauuugccuaacagacuuuugcagaggcgauggcagagagcagcugcaggca

SEQ ID NO: 105202 - RNA, 64 nt, Homo Sapiens
ggguaaauuaggaagagguguuggguguucauccagaggcgacuuggauucuguauccauggga

SEQ ID NO: 105203 - RNA, 64 nt, Homo Sapiens
agucacuuugaggugucucaaucugaucugagugagaggcgacaggaguauuuuuuuuuuuuua

SEQ ID NO: 105204 - RNA, 64 nt, Homo Sapiens
caaccaaagugcaggacaucaaaaacaaccugaaagaggcgauugaaguacgugcuggcuccuu

SEQ ID NO: 105205 - RNA, 64 nt, Homo Sapiens
cugagcgaaagaaggaaggacgucccggcaggcgagaggcgaggggaaaggagagggacucugg

SEQ ID NO: 105206 - RNA, 64 nt, Homo Sapiens
aaagccuugucacuuuggacguuugcgucuuugaagaggcgaugggagcauaucaugacugccu

SEQ ID NO: 105207 - RNA, 64 nt, Homo Sapiens
gaaugauucaggguaaaucacauacuuuguuuagagaggcgagggguuuaaccgagucacccag

SEQ ID NO: 105208 - RNA, 64 nt, Homo Sapiens
uuccuucaccaggggaugggcagcuuuuccuaucagaggcgauuagggagagggagucuggccc

SEQ ID NO: 105209 - RNA, 64 nt, Homo Sapiens
uugggccgccucuccuccaucuucuggcaaggacagaggcgaggggacagcccagcgccauccu

SEQ ID NO: 105210 - RNA, 64 nt, Homo Sapiens
cgguggccagagccagccagcauggccacccucaagaggcgagaugagcccacagaggcauauc

SEQ ID NO: 105211 - RNA, 64 nt, Homo Sapiens
gcucagggcgggcagccuauggugaagaggagacagaggcgaugggcgugcuucguccuccgua

SEQ ID NO: 105212 - RNA, 64 nt, Homo Sapiens
cgccaccacaccagcuaauuuuuguauuuuuaguagaggcgaaguuuccccauguuggccaggc

SEQ ID NO: 105213 - RNA, 64 nt, Homo Sapiens
uuagauuuggaggggcuggggugggcagagagcaagaggcgaguaaagagaauggugguuucag

SEQ ID NO: 105214 - RNA, 64 nt, Homo Sapiens
gaaaaugcauucacaguuucauuuucucuuuugccucguaaaauauugcuaugcaaucuugaau

SEQ ID NO: 105215 - RNA, 64 nt, Homo Sapiens
guccacuguauucacgaguaugaaaaaugcaugccucguaaagauucacuuuggccuagauuua

SEQ ID NO: 105216 - RNA, 64 nt, Homo Sapiens
auuuuaauaugaaagauccucaugaauuaaauaguugaugcaauuuuuaacguuaauugauaua

SEQ ID NO: 105217 - RNA, 64 nt, Homo Sapiens
uggugguggggagggaaggccuccugaauugaguuugaugcagagcuuuuuagccaugaagaau

SEQ ID NO: 105218 - RNA, 64 nt, Homo Sapiens
gucacuucuuuacuauuuaaucacuaccuucagcuugaugcaugagcuagcucuugagcauuag

SEQ ID NO: 105219 - RNA, 64 nt, Homo Sapiens
acauuuaagaauucucuuuaauguauuaggaccauugaugcauuuagugguauucuguuuacag

SEQ ID NO: 105220 - RNA, 64 nt, Homo Sapiens
uuaaauauaacaggagacuuaacauaauuuaaauuugaugcaauggcaugccagucuuauaauu

SEQ ID NO: 105221 - RNA, 64 nt, Homo Sapiens
ggauguuuugaaaagaaaaauuagaaaguagcacuugaugcaagacagagaaucuuaagagcug

SEQ ID NO: 105222 - RNA, 64 nt, Homo Sapiens
cauuuggguugggguucacucuuaccaagaaucuuugaugcagcuuuaagaugguggggaggau

SEQ ID NO: 105223 - RNA, 64 nt, Homo Sapiens
uauaagaaguagaaagucauugaacugacaguguuugaugcaacuaaaagaggauuguaagaca

SEQ ID NO: 105224 - RNA, 64 nt, Homo Sapiens
ggcgcuuucaguauuuugccauuaagcauaguauuugaugcagguuuuuuuugauugaugcagg

SEQ ID NO: 105225 - RNA, 64 nt, Homo Sapiens
auuaagcauaguauuugaugcagguuuuuuuugauugaugcaggggaucaaauuuaggaaguuc

SEQ ID NO: 105226 - RNA, 64 nt, Homo Sapiens
ggcaugaaaaucugacuuugcccagcucuuuuccuugaugcaguuucccgguguggaaggaacc

SEQ ID NO: 105227 - RNA, 64 nt, Homo Sapiens
ucaucagauucaucuccacugauaaccgguuuccuugaugcagacauaguuuagcuuucuuuga

SEQ ID NO: 105228 - RNA, 64 nt, Homo Sapiens
uuuuuuuggucaagcuugaggcugaauaaagccuuugaugcacaaaaugggacugcugaagagu

SEQ ID NO: 105229 - RNA, 64 nt, Homo Sapiens
acaguguaaaguuaaucagaaagaaaaaauuuuauugaugcagugugucuuuauaaagcuguuc

SEQ ID NO: 105230 - RNA, 64 nt, Homo Sapiens
gagagaaaaugagugaauauucuucucacuuuuauugaugcauucagagaauaagcaaugaaau

SEQ ID NO: 105231 - RNA, 64 nt, Homo Sapiens
uuuuuaauauuucuauugcaaaagucuauccgauuugaugcacuuugaauauugagauauuuug

SEQ ID NO: 105232 - RNA, 64 nt, Homo Sapiens
cuuuccuuuuguaauaagaaagaagagagagaacuugaugcaaaguccacgaaaaaacaauuuu

SEQ ID NO: 105233 - RNA, 64 nt, Homo Sapiens
uugccagagauaccuguuuugaugaguaccuauuuugaugcaaaggaacggcccugggaccuca

SEQ ID NO: 105234 - RNA, 64 nt, Homo Sapiens
cccacgaccggagugcuggcucucacagugaauuuugaugcauuuaaaauaagauucugaugcc

SEQ ID NO: 105235 - RNA, 64 nt, Homo Sapiens
caggcgcugguucugaagcaccgauggaaacagauugaugcagauggaaggaggaagggagacu

SEQ ID NO: 105236 - RNA, 64 nt, Homo Sapiens
cucguagugguaacucaucccauagaacugauacuugaugcacauccucugggaagcagauaag

SEQ ID NO: 105237 - RNA, 64 nt, Homo Sapiens
ugauguucacacagugagagaccuguaggcauaauugaugcacaacuuccaccauaaugcaguu

SEQ ID NO: 105238 - RNA, 64 nt, Homo Sapiens
ucucuuuuugccauggcuaaucccugcauuuccauucagggaaaaggugguagugagcauagaa

SEQ ID NO: 105239 - RNA, 64 nt, Homo Sapiens
agagauggcugccuggacuggaaucaaaucuaauuucagggaaaugaagauggaauuugaaggu

SEQ ID NO: 105240 - RNA, 64 nt, Homo Sapiens
uggccuugucuuucuggggaggagggaauguacauucagggaguagccuuuugcggaaaaauuc

SEQ ID NO: 105241 - RNA, 64 nt, Homo Sapiens
cauucuggcuuuguccauaacaaugcucugggauuucagggaguucccucauuuguaaaaugag

SEQ ID NO: 105242 - RNA, 64 nt, Homo Sapiens
ucuagaaaccaguauggaagggagggguccugauuucagggaaauggaggguggggccggguga

SEQ ID NO: 105243 - RNA, 64 nt, Homo Sapiens
gcucagcaaggugugaaugaccuuaguccgcaaguucagggaagcaggcagagcggggaggugc

SEQ ID NO: 105244 - RNA, 64 nt, Homo Sapiens
aaguuuuaugacccagaggcgauacuccuguuaguucagggaccaccuagucauuaaugaguaa

SEQ ID NO: 105245 - RNA, 64 nt, Homo Sapiens
aaugcuaagauaaaauugcugcaguguuucauuuuucagggauaaacaguuugugacagaaaau

SEQ ID NO: 105246 - RNA, 64 nt, Homo Sapiens
guuuucuucacccucacucuuugguggaggugccuucagggaaagaaucuugaagaaaaaucuu

SEQ ID NO: 105247 - RNA, 64 nt, Homo Sapiens
ggaucucccuagcucagagaugagaacuccauucuucagggaaauagcagagccccucuuaucu

SEQ ID NO: 105248 - RNA, 64 nt, Homo Sapiens
gacguugugcccagccuuuuuagaaagaaccacguucagggaauuuggaagaaguaaacauggc

SEQ ID NO: 105249 - RNA, 64 nt, Homo Sapiens
cugcccaggaggaagacuggcacuccuggcucuguucagggaggaaccaguucuacuaaugcuu

SEQ ID NO: 105250 - RNA, 64 nt, Homo Sapiens
ccuaugaauagaaaugcugacaugacagaagugauucagggauucaacaugaauucgcaccuua

SEQ ID NO: 105251 - RNA, 64 nt, Homo Sapiens
auaaauuuauuuaauauuagcagggaggauagguuucagggaaugggccuccaacaggcaaauu

SEQ ID NO: 105252 - RNA, 64 nt, Homo Sapiens
auagguuucagggaauauaacuccaacaggcaaauucagggaggucagugggaaaacuaagggc

SEQ ID NO: 105253 - RNA, 64 nt, Homo Sapiens
guaccugaccaacagaacuugggcagggacuguguucagggaaaggagggggacauuuuuuggg

SEQ ID NO: 105254 - RNA, 64 nt, Homo Sapiens
gauuugcaagaaguugguuuccaggcuaucuguguucagggaaugcucuccaggagauuucaau

SEQ ID NO: 105255 - RNA, 64 nt, Homo Sapiens
uuuggggggggugguuagaguugccagccugggcuucagggaugccaugaguggggcuggcauc

SEQ ID NO: 105256 - RNA, 64 nt, Homo Sapiens
gucacuuggaccgcuguucacuggucccuugguguucagggaggucaagggcuucagccccaug

SEQ ID NO: 105257 - RNA, 64 nt, Homo Sapiens
ccacguguuuuuccauccaaucacacugcugugauucagggaucuuucuucuaagacggacaca

SEQ ID NO: 105258 - RNA, 64 nt, Homo Sapiens
aacaacaacgacaaaaaauagacuguuuuaaaguuucagggaaaguugguggcugauuuaaagu

SEQ ID NO: 105259 - RNA, 64 nt, Homo Sapiens
aaaaugcuuuguuugcccuuugcuucugcuuuuuuucagggaagcugccaaagaaugucgacgu

SEQ ID NO: 105260 - RNA, 64 nt, Homo Sapiens
aucuauguuucaucuuguuuuuauaauaaaaagcuucagggaacaagcccaaagcccucaccac

SEQ ID NO: 105261 - RNA, 64 nt, Homo Sapiens
cagugugucucucugauugguuuuaaggugccucuucagggacacuaccugccagguucaguuc

SEQ ID NO: 105262 - RNA, 64 nt, Homo Sapiens
cucugcuggugcuggugcaaccauaagucugcuuuucagggauuagcuaagcucgggaucauuu

SEQ ID NO: 105263 - RNA, 64 nt, Homo Sapiens
gagauuuucuuuggucauccauuguguguuugauuucagggagauauagagagaaagauaacuu

SEQ ID NO: 105264 - RNA, 64 nt, Homo Sapiens
ucauauuuuguuauguguaguagaucguuacagcuucagggaauuggccauuccguucaaaucc

SEQ ID NO: 105265 - RNA, 64 nt, Homo Sapiens
agucccaauugaguaguucacuagaaagguuuaauucagggauaauuuucuugugcuucagcua

SEQ ID NO: 105266 - RNA, 64 nt, Homo Sapiens
uguaaagaucauuuaaaugggacaggacagcaacuucagggaucauccaucacuuaaauacagu

SEQ ID NO: 105267 - RNA, 64 nt, Homo Sapiens
auuugaggagaguuuaugaauccaucccccuguuuucagggaccucugccuucucccacacccc

SEQ ID NO: 105268 - RNA, 64 nt, Homo Sapiens
cgucacuccccccaguuuuauuuuuagcuuuggcuucagggagugacagccaucacaaauagcc

SEQ ID NO: 105269 - RNA, 64 nt, Homo Sapiens
ugccuucccaggucugacuuugucacccugccguuucagggagcagaaguccuucuggacagug

SEQ ID NO: 105270 - RNA, 64 nt, Homo Sapiens
gcuugagaggguuucuuuuacuucaaaaucuuucuucagggagcaagacaugaacugacuaauu

SEQ ID NO: 105271 - RNA, 64 nt, Homo Sapiens
acuuucuccccauggcacuggggaaccauggaaguucagggaacuucagggaagaggcuugguc

SEQ ID NO: 105272 - RNA, 64 nt, Homo Sapiens
cauggcacuggggaaccauggaaguucagggaacuucagggaagaggcuuggucaauuccugag

SEQ ID NO: 105273 - RNA, 64 nt, Homo Sapiens
agucguaagaucuuaagaaacagguggcccagcauucagggaggcuuuuuggcuagggaaggug

SEQ ID NO: 105274 - RNA, 64 nt, Homo Sapiens
cuccaguauauuccagagucauggaccaaagaguuucagggaaaaagcccaggcaccaauggga

SEQ ID NO: 105275 - RNA, 64 nt, Homo Sapiens
ccuagcaugcugaaugcacgugacaccgacugacuucagggaucugggccaggaguguggugga

SEQ ID NO: 105276 - RNA, 64 nt, Homo Sapiens
ggacaugaauucaggccucuguacuaaaaucuauuucagggaauguucugucuagugauuugcu

SEQ ID NO: 105277 - RNA, 64 nt, Homo Sapiens
ucuagagacccuccagcuaaaaacagagccugaguucagggacccaaguggugagcggcgucuu

SEQ ID NO: 105278 - RNA, 64 nt, Homo Sapiens
ugacucgugaaaguaggugauuccuuugcagaacuucagggacugggagcagaggccccucacu

SEQ ID NO: 105279 - RNA, 64 nt, Homo Sapiens
gugucccucccaccaugggcgggggcucagcugcuucagggaaucccuuggugaagccgugcca

SEQ ID NO: 105280 - RNA, 64 nt, Homo Sapiens
acacgugaccugcacaggaugaaauggggaagaguucagggaggcagcugcaucuugcuuguga

SEQ ID NO: 105281 - RNA, 64 nt, Homo Sapiens
gcccaaugaaagaagaguuccauggucaacuaaguucagggaacccuguuacacuauuaaaggc

SEQ ID NO: 105282 - RNA, 64 nt, Homo Sapiens
aauaugggaaacacucuaaaggagaugcaggauguucagggagccuugcaguguuauacgcgug

SEQ ID NO: 105283 - RNA, 64 nt, Homo Sapiens
augcacauagcaaucuggcuuccauucauaaggauucagggaauauuccagaagccauagcuuc

SEQ ID NO: 105284 - RNA, 64 nt, Homo Sapiens
cuuuucaucaauucuuaaauuucuuaaccuaggcuucagggagcauaugaaaccaaaauuauau

SEQ ID NO: 105285 - RNA, 64 nt, Homo Sapiens
aaggugugcaauuuucuauaggugacuuuugcaauucagggaagauuugggcauauuaaaugaa

SEQ ID NO: 105286 - RNA, 64 nt, Homo Sapiens
uuuaauuuguuaucucaaacaucaauuuauuaagcaggucuaucuaucuaugucuauaucaucu

SEQ ID NO: 105287 - RNA, 64 nt, Homo Sapiens
uuacaaugaaguuaagguuagauaauuuuguugacaggucuaaaaucucuaaaauugcuauccu

SEQ ID NO: 105288 - RNA, 64 nt, Homo Sapiens
gguguaaauuaauauggauaauuuuauuuaccuccaggucuaaaagguagugugacccaaauuu

SEQ ID NO: 105289 - RNA, 64 nt, Homo Sapiens
uuuucaugugaaaggacugggguuuuagcaaacacaggucuaaucucuuuuguguuuuugugca

SEQ ID NO: 105290 - RNA, 64 nt, Homo Sapiens
aaauuuuuuguuuguuuguuuuuaagaaacaagaaaacagaacugccuuugcacuaaauuagug

SEQ ID NO: 105291 - RNA, 64 nt, Homo Sapiens
auucaccgggauguacaguuuacaguugaagagcaaacagaaagguuuucucuuggugggauau

SEQ ID NO: 105292 - RNA, 64 nt, Homo Sapiens
auauuucauaauuucuaaccucuguucucucaguaaacagaaugucugaucgaucaugcagaua

SEQ ID NO: 105293 - RNA, 64 nt, Homo Sapiens
auaaaucaguauuuaaccuaaaauuacauauuugaaacagaagauauuauguuaugcucaguaa

SEQ ID NO: 105294 - RNA, 64 nt, Homo Sapiens
caaaaaauagagaucagcaaaaagcaaaacagaaaaacagaagacuggugccuaccauacacgg

SEQ ID NO: 105295 - RNA, 64 nt, Homo Sapiens
acagaagacaaaaaauagagauacacggaaagcaaaacagaaaaugccuguacuggugccuacc

SEQ ID NO: 105296 - RNA, 64 nt, Homo Sapiens
cuaaguuauuuaccuuaucaguaauuaaaaugggaaacagaagcugucauuauuagagauuuca

SEQ ID NO: 105297 - RNA, 64 nt, Homo Sapiens
agggaaaaaccaaccuacucaagaaaauggagacaaacagaaggcuacauuuaugagcuguaag

SEQ ID NO: 105298 - RNA, 64 nt, Homo Sapiens
uuuugacugcugugacuuuguuuuguguugcaucaaacagaagaauaaggaaacagaaacaacu

SEQ ID NO: 105299 - RNA, 64 nt, Homo Sapiens
aacuuuuuguguugcaucaagcauuuuaauaaggaaacagaaacgaaaaauagacaaccaguuc

SEQ ID NO: 105300 - RNA, 64 nt, Homo Sapiens
uuaauggaucagacuuugccagauuugguuagggaaacagaaauuuagaauggugcauuauuuu

SEQ ID NO: 105301 - RNA, 64 nt, Homo Sapiens
gagaguaaauagcccuucagcaugcucauucaugaaacagaagaggcuguacaagugaagacaa

SEQ ID NO: 105302 - RNA, 64 nt, Homo Sapiens
cagugaccccaucuaaauaaaauacugcuuuugcaaacagaacacuguaauaggguaguucugg

SEQ ID NO: 105303 - RNA, 64 nt, Homo Sapiens
gauuauuaagcaaccuuaaagcaauaaguucauuaaacagaagguaauaggaagaacaguacau

SEQ ID NO: 105304 - RNA, 64 nt, Homo Sapiens
auaaucaguuuggaccaguuucuuaaggucauuaaaacagaagcaaauuaagacagguuugacu

SEQ ID NO: 105305 - RNA, 64 nt, Homo Sapiens
aaagcacuuucugucaaauaauggacuuuuuucuaaacagaaauuauuuucuauuaauuugcaa

SEQ ID NO: 105306 - RNA, 64 nt, Homo Sapiens
agguaguauauugaagacaggugagaaguugcauaaacagaauuccauaaaaaacaauuaccug

SEQ ID NO: 105307 - RNA, 64 nt, Homo Sapiens
auccauuuuguaguuauagcaaugaagauaacuuaaacagaaaugaaaacuugccucuauuuau

SEQ ID NO: 105308 - RNA, 64 nt, Homo Sapiens
cacuuaacauagaaaugaauagcgcugugaauggaaacagaauauacuuggacgcaacauugca

SEQ ID NO: 105309 - RNA, 64 nt, Homo Sapiens
aguuuauucuaucauuugguacaaauuaacagaaaaacagaacaagaaaaaaggccuugaauug

SEQ ID NO: 105310 - RNA, 64 nt, Homo Sapiens
aacgaagcuaagaauaugagacaaacaaacaaacaaacagaaguucuagucccaugugauuuaa

SEQ ID NO: 105311 - RNA, 64 nt, Homo Sapiens
agggcggaguuuguuguaaggcaaucaccugucaaaacagaaauugggugggaaaggagucuuu

SEQ ID NO: 105312 - RNA, 64 nt, Homo Sapiens
gucauauucuaguauuucucacaggggguaugagaaacagaaagcuauauguagcagcuggucu

SEQ ID NO: 105313 - RNA, 64 nt, Homo Sapiens
caaaaaaaccucuaugcaauaacaaacaaacagaaaacagaaaaguuucaaaaaaucugaccaa

SEQ ID NO: 105314 - RNA, 64 nt, Homo Sapiens
cagaaaacaaaaaaaccucuugaccaaaacaaacaaacagaaaaugaagauguuucaaaaaauc

SEQ ID NO: 105315 - RNA, 64 nt, Homo Sapiens
agauuuaagguaaauuucuucuuuucauacuaacaaacagaacauauuuuggaaaaaaaguuaa

SEQ ID NO: 105316 - RNA, 64 nt, Homo Sapiens
aucacaaauaggcuaagaaggaugggucagaggaaaacagaaaacacuuuuuuauagaaucaau

SEQ ID NO: 105317 - RNA, 64 nt, Homo Sapiens
gacuuuuuaguuuggguccuacuguuguuauuaaaaacagaacaaaaacaaaacacacacacac

SEQ ID NO: 105318 - RNA, 64 nt, Homo Sapiens
aaacagaacaaaaacaaaacacacacacacacaaaaacagaaacaaaaaaaaccagcauuaaaa

SEQ ID NO: 105319 - RNA, 64 nt, Homo Sapiens
gcucgaggcucccaccccgcugguuucauguuacaaacagaaaacuucuuacugucccacagcu

SEQ ID NO: 105320 - RNA, 64 nt, Homo Sapiens
auaaacuggcuugccuguggacaacaacaacaacaaacagaagguuaaaacaacaacaacaaca

SEQ ID NO: 105321 - RNA, 64 nt, Homo Sapiens
uucugugguccccucacucagucucucauuugguaaacagaaagcuguuuucccuacaaggugc

SEQ ID NO: 105322 - RNA, 64 nt, Homo Sapiens
caauucauauuuauggccuuuggaauccaaagaaaaacagaagaauaauucauggauuuguuca

SEQ ID NO: 105323 - RNA, 64 nt, Homo Sapiens
gaagaaagaguauuauaccaacuuuuauucuguuaaacagaauucauugcuuuaaccuuugguu

SEQ ID NO: 105324 - RNA, 64 nt, Homo Sapiens
aaaacuguaauccugggguuaacauccuaguuuuaaacagaagauagaaaccccauuucuacug

SEQ ID NO: 105325 - RNA, 64 nt, Homo Sapiens
cuugauggugacacuuggguuaaaaucuuaaauaaaacagaaaaucuuucuucagaauuaaaac

SEQ ID NO: 105326 - RNA, 64 nt, Homo Sapiens
cugguuauaaccugacgcuagacaggagaaaagaaaacagaaaccguuugugcaguauugaaaa

SEQ ID NO: 105327 - RNA, 64 nt, Homo Sapiens
uuucuggagcagauuguacagcugugacuuuggaaaacagaaaguaagacccucagaaaaccaa

SEQ ID NO: 105328 - RNA, 64 nt, Homo Sapiens
uauucauucuacaggaacagcaauaaguacuauuaaacagaagauggcuacacuaaguuccaau

SEQ ID NO: 105329 - RNA, 64 nt, Homo Sapiens
ucccuuuggagcugcucagacuuacuuuaagcucaaacagaagggaaugcuauuacugguggug

SEQ ID NO: 105330 - RNA, 64 nt, Homo Sapiens
acuagccaguuuagguaugacuuuggaagugcagaaacagaaggauacuguuagaaaauccuaa

SEQ ID NO: 105331 - RNA, 64 nt, Homo Sapiens
ucauggccaaaguagaccuauuaaauggaagaagaaacagaacuaguuuuaauuuggguauagg

SEQ ID NO: 105332 - RNA, 64 nt, Homo Sapiens
uauucacuguguuuuugaugaaugaaauacuuugaaacagaaguuaugccacacuuugcaccuu

SEQ ID NO: 105333 - RNA, 64 nt, Homo Sapiens
cccauccaguucuucagaaaauuuuugauaggaaaaacagaaaacucuuuuucucccaacucau

SEQ ID NO: 105334 - RNA, 64 nt, Homo Sapiens
caggcagcagaggcauuaaagaugugguaagcggaaacagaagacuacugugaaaaggggaggg

SEQ ID NO: 105335 - RNA, 64 nt, Homo Sapiens
aaggaaaaauauagaaagcaacuuagcccaguucaaacagaacaagcagggucuaacugugcuu

SEQ ID NO: 105336 - RNA, 64 nt, Homo Sapiens
ugcccugugccgccugguucguggggcgcuugacaaacagaaucugacaaucugggcaaggcuu

SEQ ID NO: 105337 - RNA, 64 nt, Homo Sapiens
ugagcuuugaaguagguggcuugagcuagagauaaaacagaaucuucuggguaguccccuguug

SEQ ID NO: 105338 - RNA, 64 nt, Homo Sapiens
gcagacaauaguauagaagucuggaaaaaaacaaaaacagaauuugagaaccuuggaccacucc

SEQ ID NO: 105339 - RNA, 64 nt, Homo Sapiens
ggucucuuugcagauauauaaaaggcaggugaggaaacagaaaaaccaaaaaaugguagacaug

SEQ ID NO: 105340 - RNA, 64 nt, Homo Sapiens
cagucaucagcuaauacaaaauguccauguuagaaaacagaauccguaguguugaauauguugc

SEQ ID NO: 105341 - RNA, 64 nt, Homo Sapiens
aagucauuugcugagucugccaaaauagagguggaaacagaagguggagaugaaauaaacaagg

SEQ ID NO: 105342 - RNA, 64 nt, Homo Sapiens
aaauuaaaguauuauuaauaauauuuuuuccuuaaaacagaaaaggucagagaaaugcauggga

SEQ ID NO: 105343 - RNA, 64 nt, Homo Sapiens
cauaacacuuggcacuuguuaaucaccaacuugcaaacagaauugcucugauuaacuaguauuc

SEQ ID NO: 105344 - RNA, 64 nt, Homo Sapiens
ccugaugcuggggacacagcagggagaagagggaaaacagaaaaaauggacaaggaaggaauaa

SEQ ID NO: 105345 - RNA, 64 nt, Homo Sapiens
agaagguugagggcaauggaaaccaggccagagcaaacagaaaauucauggauauguuauacug

SEQ ID NO: 105346 - RNA, 64 nt, Homo Sapiens
agaauacacuaagaaguuucuaguuugugugccaaaacagaagcuucuccaagcaugauggcca

SEQ ID NO: 105347 - RNA, 64 nt, Homo Sapiens
aaagucagcaaaagaaagaaugcauuucgaaagcaaacagaagaaaaaaguauauucucacagu

SEQ ID NO: 105348 - RNA, 64 nt, Homo Sapiens
agcaucuucgcuacaaccacuguuugcucaugguaaacagaaacgcuuaagacccaagaaaugc

SEQ ID NO: 105349 - RNA, 64 nt, Homo Sapiens
acucaugcugccagauagauaacccacgcagaagaaacagaagagaugccugaugcccaugguc

SEQ ID NO: 105350 - RNA, 64 nt, Homo Sapiens
acagcaguggccagguggagugggccuaagccagaaacagaaaggcucacgccaggcaggccag

SEQ ID NO: 105351 - RNA, 64 nt, Homo Sapiens
guauuggcucagagcucuggggguaaguuauaauaaacagaaaucuagcaagaucccugagacg

SEQ ID NO: 105352 - RNA, 64 nt, Homo Sapiens
uucuguaaaccuaaugucugauuuuggugauguaaaacagaauauuguuauucucggacuguga

SEQ ID NO: 105353 - RNA, 64 nt, Homo Sapiens
gagaagaaagaagcacucugacuguaccuguaggaaacagaaaauggcaagguggguuccaggg

SEQ ID NO: 105354 - RNA, 64 nt, Homo Sapiens
aaagguaagguguugugucaaacugugcuccacgaaacagaagagcgcauggcuguucugcugc

SEQ ID NO: 105355 - RNA, 64 nt, Homo Sapiens
gagaaagugucagugacacauaacacaacacugcaaacagaagguuaauuuucaagcacuugau

SEQ ID NO: 105356 - RNA, 64 nt, Homo Sapiens
gacguuaaaauaugcgaaaggacccaaauuccauaaacagaacuacuuccacaccaggaaaaca

SEQ ID NO: 105357 - RNA, 64 nt, Homo Sapiens
gggaauuauugcacagaaauuaugaaucuaauuaaaacagaaaucuuauccagggccauagaag

SEQ ID NO: 105358 - RNA, 64 nt, Homo Sapiens
agaacaaaugugauuguauucuagaagaucccuaaaacagaauaccacacucagaaacgaggac

SEQ ID NO: 105359 - RNA, 64 nt, Homo Sapiens
gauaccucucgcucccaugcagcgagagugacugaaacagaagcagauauggaccaccggaguc

SEQ ID NO: 105360 - RNA, 64 nt, Homo Sapiens
aaugagaaaagaaaaaaaacaacuaaaacauugaaaacagaacauguuaccauccuuuaaucau

SEQ ID NO: 105361 - RNA, 64 nt, Homo Sapiens
acuguguuuccuuuuacuugugcauguugggcgaaaacagaacaccauuuguuucaaagagguc

SEQ ID NO: 105362 - RNA, 64 nt, Homo Sapiens
aaagcaaaggaaaaugcuuugacaaacuaaaacaaaacagaacaccaaaaacuagacaaauaaa

SEQ ID NO: 105363 - RNA, 64 nt, Homo Sapiens
caguauacugcuaucgagacauguuuguucggaaaaacagaaagauccauaaagaugcagaguc

SEQ ID NO: 105364 - RNA, 64 nt, Homo Sapiens
auucaccuuaccaauauuaaucccagcguguguaaaacagaacaguaacucuaugugaccccag

SEQ ID NO: 105365 - RNA, 64 nt, Homo Sapiens
caacaucuauugauaaaacauguauuuaauuaaaaaacagaauuucuuucugaaaucuaagcuu

SEQ ID NO: 105366 - RNA, 64 nt, Homo Sapiens
gcagaauuucuggggcugcuccuuaagaauacaaaaacagaaauagguuuacgagauuuggcug

SEQ ID NO: 105367 - RNA, 64 nt, Homo Sapiens
aacgaaagcaaaaauugacaaaugggacaugauuaaacagaauuaccauuugacucagcaaucc

SEQ ID NO: 105368 - RNA, 64 nt, Homo Sapiens
gcuggaagccauuauccuaaaugaacucacucagaaacagaaaaccaaauaccacauguucuca

SEQ ID NO: 105369 - RNA, 64 nt, Homo Sapiens
augagaugggaugaaauccuaugacaguaagcaaaaacagaaccaugaaaaaugauuggacaua

SEQ ID NO: 105370 - RNA, 64 nt, Homo Sapiens
auccuuguucuuugacaauuugugaugucugaaaaaacagaacccgaaaagcuauggugauaug

SEQ ID NO: 105371 - RNA, 64 nt, Homo Sapiens
augcaagguccucagaguagccggguucuaccacaaacagaaacagaaugaaaguagcugucag

SEQ ID NO: 105372 - RNA, 64 nt, Homo Sapiens
gguccucagaguagccggguucuaccacaaacagaaacagaaugaaaguagcugucaguccuug

SEQ ID NO: 105373 - RNA, 64 nt, Homo Sapiens
caguggagguggggguugcuacucaaaccaaaccaaacagaaaggagcuagcccaaaaucccaa

SEQ ID NO: 105374 - RNA, 64 nt, Homo Sapiens
cagacaaagaaaaaagagcuaagggaggaagggaaaacagaaagggcucugagcguacauaggg

SEQ ID NO: 105375 - RNA, 64 nt, Homo Sapiens
acaugacauaugaaagccugaaaaaaaaaguuuuaaacagaagcguguaguuuuuaauuguuaa

SEQ ID NO: 105376 - RNA, 64 nt, Homo Sapiens
aaaaaaguaaagagucuauucaaagaugaaaaacaaacagaaaaugaugcucucuucugacagc

SEQ ID NO: 105377 - RNA, 64 nt, Homo Sapiens
aauaagaacagccacugcucagaugaagauauucaaacagaaagccagaagaacccauagauga

SEQ ID NO: 105378 - RNA, 64 nt, Homo Sapiens
gguacugauggccucucauaguagaugacuuugaaaacagaaauaucaaaauauacuuuuggaa

SEQ ID NO: 105379 - RNA, 64 nt, Homo Sapiens
caaagaaaagcuuguauauacgaugcuaaauuaaaaacagaaaauucauuacucaucacauccc

SEQ ID NO: 105380 - RNA, 56 nt, Homo Sapiens
gcaaggagcagaagacauagacguugaaacagaaacagaaggaugaaggacaguuu

SEQ ID NO: 105381 - RNA, 62 nt, Homo Sapiens
gcaaggagcagaagacauagacguugaaacagaaacagaaggaugaaggacaguuuuuuccu

SEQ ID NO: 105382 - RNA, 64 nt, Homo Sapiens
ccuaaggggauugacucuccgaccccugccuuagaaacagaauuaugcaugugauggugccuga

SEQ ID NO: 105383 - RNA, 64 nt, Homo Sapiens
ggaaaacugccugacuuaucucuuuuuaaacuggaaacagaauuaaaguagugccacugcagug

SEQ ID NO: 105384 - RNA, 64 nt, Homo Sapiens
gcagccacucauucugcauuaccucugauucuggaaacagaauacgaacuagaagcuaugcguu

SEQ ID NO: 105385 - RNA, 50 nt, Homo Sapiens
augacauaaaucaagggagaaaacagaacacugucaacaguaagcuguaa

SEQ ID NO: 105386 - RNA, 64 nt, Homo Sapiens
aaagaggcagggguugcaauccuagucucugauaaaacagaauuuaaaccaacaaagaucaaaa

SEQ ID NO: 105387 - RNA, 64 nt, Homo Sapiens
acauacgcaaaucaauaaauguaauccagcauauaaacagaaccaaagacagaaaccacaugau

SEQ ID NO: 105388 - RNA, 64 nt, Homo Sapiens
cacaccaucuuuccaucccaggcuuuugaaaaacaaacagaaacccguguaucugggauauuuc

SEQ ID NO: 105389 - RNA, 64 nt, Homo Sapiens
uauguaacuggaaucucaaaaguucuuugggacaaaacagaaguccauggaguuaucuaagcuc

SEQ ID NO: 105390 - RNA, 64 nt, Homo Sapiens
ccucucaauucacaaugaguuaacugauaaaacaaaacagaagucagacaauguuuuaaauuga

SEQ ID NO: 105391 - RNA, 64 nt, Homo Sapiens
auguguccuaugcccagcugcacagcuuacccucaaacagaaaauaaugaagccuucuuccucc

SEQ ID NO: 105392 - RNA, 64 nt, Homo Sapiens
uaucuuguuaauaauuccucuuaauuauggcucaaaacagaauuugaaauguguagggaggcuu

SEQ ID NO: 105393 - RNA, 52 nt, Homo Sapiens
uaugaaauguguagggaggcugaaacagaauaaucaaaauuuguacugguga

SEQ ID NO: 105394 - RNA, 64 nt, Homo Sapiens
uccccccuccuucugcuguguaucaugguguucaaaacagaaauguuuuuuggcauuccaccuc

SEQ ID NO: 105395 - RNA, 64 nt, Homo Sapiens
guucuuugauccagaggugggugcagcugaaaguaaacagaauggauugccaguuacauguaug

SEQ ID NO: 105396 - RNA, 64 nt, Homo Sapiens
uauauuaauuuuauuaagcaaggguucgccagagaaacagaaccaauaggauauauaagcccaa

SEQ ID NO: 105397 - RNA, 64 nt, Homo Sapiens
cugguagaugguaaaacauuauuuaaauguuauuaaacagaaauaauguuuuaccaucucuuca

SEQ ID NO: 105398 - RNA, 64 nt, Homo Sapiens
augaaugaauuucuaaauacaguaugugcuggguaaacagaaagugguuuagacauucuugauu

SEQ ID NO: 105399 - RNA, 64 nt, Homo Sapiens
uuuggcuaaguagaggacauggacuaguuguagcaaacagaacaugcuguuugcucuugccaaa

SEQ ID NO: 105400 - RNA, 64 nt, Homo Sapiens
acguuuuccaacauguagaaucagucauucagggaaacagaaaguggauuccugcgaguugcuu

SEQ ID NO: 105401 - RNA, 64 nt, Homo Sapiens
aaaaguguggaauguguuguacuuaacaaaaagcaaacagaaaaaugaguacaaaaaugcagac

SEQ ID NO: 105402 - RNA, 64 nt, Homo Sapiens
uguacuguauguggcagugacuucugccauacuucauaccuacuugaacaucagaggguccauc

SEQ ID NO: 105403 - RNA, 64 nt, Homo Sapiens
uuccuaguuuuaaguguuucaccagcaaguauuccauaccuacuugauguugcuggucuggugu

SEQ ID NO: 105404 - RNA, 64 nt, Homo Sapiens
cauaaacgggucuuaugacauggcuuucuacaccaacucuaauccauuuuucaacucaaggcaa

SEQ ID NO: 105405 - RNA, 64 nt, Homo Sapiens
auugacccuaucaacuggagugaagaacccuuucaacucuaaaaauaagggugguggacuaucu

SEQ ID NO: 105406 - RNA, 64 nt, Homo Sapiens
caucaucaggacugcauugcucaggcauuuucuaaacucuaaauuuacgagcuguacaaaaaaa

SEQ ID NO: 105407 - RNA, 64 nt, Homo Sapiens
uuuccuguauaauauaugaauguuucugagaagaaacucuaaauaguugaaaggcuaaccugcu

SEQ ID NO: 105408 - RNA, 64 nt, Homo Sapiens
uaggggugucccaugacacuauuucauauucuacagaaguaaaucagguuucaccaacugaaau

SEQ ID NO: 105409 - RNA, 64 nt, Homo Sapiens
aagaaggaauuaccuuugacaauauuuuucgguaagaaguaaaaccucuggagaccuaucuuua

SEQ ID NO: 105410 - RNA, 64 nt, Homo Sapiens
aaguugauauacauagucauuuuuccucuaugguagaaguaaaaaaaaaaaaaaaggacauagc

SEQ ID NO: 105411 - RNA, 64 nt, Homo Sapiens
agagacuucugcuuuucaacccccacccuccucaagaaguaauaauuuguuuacuuguaaauug

SEQ ID NO: 105412 - RNA, 64 nt, Homo Sapiens
ucuguauguguucaacauuuuugaauacauuaaaagaaguaaccaacugaacgacaaagcaugg

SEQ ID NO: 105413 - RNA, 64 nt, Homo Sapiens
ccugcaaacauagcuaugcuucaugaggcuuacaagaaguaacuuuagguaggagcuguuuuug

SEQ ID NO: 105414 - RNA, 64 nt, Homo Sapiens
cuugaaaauaacgaccuugucuuguaucaguggaagaaguaaguugcuuagaaagggaaaaguc

SEQ ID NO: 105415 - RNA, 64 nt, Homo Sapiens
aguacaucauauguauacaaucagauaaaagcauagaaguaaaucauucggaugugauuuuuau

SEQ ID NO: 105416 - RNA, 64 nt, Homo Sapiens
gcuguauuuguaaacaaagacaaauguugcuuuaagaaguaauuauaauuaggaauaggcuaug

SEQ ID NO: 105417 - RNA, 64 nt, Homo Sapiens
uuuuaaagcaagaauggaagacccuugaaaauaaagaaguaauuauugacacauuucuuuuuua

SEQ ID NO: 105418 - RNA, 64 nt, Homo Sapiens
uugauguuuuugaaacuuaguagaacaaauauucagaaguaacuugauaagauaugaauguuuc

SEQ ID NO: 105419 - RNA, 64 nt, Homo Sapiens
augaagaacguggacguuuucuccaagcugcuuuagaaguaacaaugcuccacgugguaagauc

SEQ ID NO: 105420 - RNA, 64 nt, Homo Sapiens
aaagaagugacaucuucagcguggggaacuauaaagaaguaacacauuaaaaaaaaaaucaaug

SEQ ID NO: 105421 - RNA, 64 nt, Homo Sapiens
guuucaggugggucacauucugaugaauguuucccuuguacagaucccagcuuauggccuugac

SEQ ID NO: 105422 - RNA, 64 nt, Homo Sapiens
cacccuucuuuccuaccagcccagagccuuguggcuuguacaguuuugaaacucccguucuauu

SEQ ID NO: 105423 - RNA, 64 nt, Homo Sapiens
aaacugucuucuguacuauuuaacgcacaacuugcuuguacaguguuugcuugguguuuguuuu

SEQ ID NO: 105424 - RNA, 64 nt, Homo Sapiens
ggcauagguuaccacccccaugugcagccacauccuuguacagaugggagccucuggcugcauc

SEQ ID NO: 105425 - RNA, 64 nt, Homo Sapiens
auuucuaagcuaauuauuuuaccguuuuguugaccuuguacacaagaaugagauuaaucuguau

SEQ ID NO: 105426 - RNA, 64 nt, Homo Sapiens
aaaaugacaaacuuggaccacaggcuuucuugaccuuguacaguauaguaaaaauacccuuuac

SEQ ID NO: 105427 - RNA, 64 nt, Homo Sapiens
auuguuuauuugccuuuucuaauguguuaaauuucuuguacaaaaaagugaagaccuuguacag

SEQ ID NO: 105428 - RNA, 54 nt, Homo Sapiens
auguguuaaauuucuuguacagaccuuguacagaaaaugaugacagcaaaguga

SEQ ID NO: 105429 - RNA, 64 nt, Homo Sapiens
uucauggauaauuuuuaacuucauuauuucuguacuuguacaaacucaacacuaacuuuuuuuu

SEQ ID NO: 105430 - RNA, 64 nt, Homo Sapiens
uucaacuuuugaaauacaaaaccaguguuuuuuacuuguacacuguuuuaaagucuauuaaaau

SEQ ID NO: 105431 - RNA, 64 nt, Homo Sapiens
cuacaguagguaacuuuaaggauuucuuccuauccuuguacaaugacaugaaugucuuucuuug

SEQ ID NO: 105432 - RNA, 64 nt, Homo Sapiens
uaacaguguacuaugguuuuauaucuugacuugccuuguacaucuuucaauucuggaauaucug

SEQ ID NO: 105433 - RNA, 64 nt, Homo Sapiens
aaguucuggcucugcagagaccaaaccuuacugacuuguacagacuuguacaaguaaagacuua

SEQ ID NO: 105434 - RNA, 64 nt, Homo Sapiens
ucugcagagaccaaaccuuacugacuuguacagacuuguacaaguaaagacuuauacagauaga

SEQ ID NO: 105435 - RNA, 64 nt, Homo Sapiens
ugagauagcuucuucugaacaaacugaauuacuucuuguacagcuuggagugagaaauguucug

SEQ ID NO: 105436 - RNA, 64 nt, Homo Sapiens
ugguuuccuaguagaagcuccucuucucaggucacuuguacacucucucucacucuuucuuacu

SEQ ID NO: 105437 - RNA, 64 nt, Homo Sapiens
ugcauuaaggugccgaugcacaaugagcuuaguccuuguacaucguuuguuguugccauucuag

SEQ ID NO: 105438 - RNA, 64 nt, Homo Sapiens
uauuuucucuguauugauuuggaauuuuuuugcacuuguacauuuauuucucuuuacaaaugau

SEQ ID NO: 105439 - RNA, 64 nt, Homo Sapiens
cugauucuuuuuaucuggggucccugugacacagcuuguacagugugcccaugucguucuucuc

SEQ ID NO: 105440 - RNA, 64 nt, Homo Sapiens
acacuccuccacgcgguuucaccuccacgucugucuuguacaugcucagacuucuuguggcgcc

SEQ ID NO: 105441 - RNA, 64 nt, Homo Sapiens
uauggugcuauuucaauuagucuagguuuaggcccuuguacauuuugcccauaacuuuuuacaa

SEQ ID NO: 105442 - RNA, 64 nt, Homo Sapiens
gugguuaucuuuguuguauuggcauaaucagugacuuguacauucagcaauagcauuugagcaa

SEQ ID NO: 105443 - RNA, 64 nt, Homo Sapiens
cccucacagaggcaucaugcggugcgaaaggaaaggccuucacauaggccuucacaccuucaca

SEQ ID NO: 105444 - RNA, 64 nt, Homo Sapiens
ccuucacaggugcgaaaggaaauggcccaagauaggccuucacauugaaaaauauagaaucauu

SEQ ID NO: 105445 - RNA, 64 nt, Homo Sapiens
agggccccucucuucccaucucccuuguccugguggccuucagugucucuuccaguuccaggag

SEQ ID NO: 105446 - RNA, 64 nt, Homo Sapiens
ugucucuuccaguuccaggagcugcugggaagcuggccuucauuguuggugacagggcaaccau

SEQ ID NO: 105447 - RNA, 64 nt, Homo Sapiens
accaaauauagcucuguguauaacaucguacugcggccuucaaaacuacguuauguuggagcau

SEQ ID NO: 105448 - RNA, 64 nt, Homo Sapiens
aaaguuuccccucuauuguaauacauuauuaaguggccuucagaacugaguuaauaagugaaaa

SEQ ID NO: 105449 - RNA, 64 nt, Homo Sapiens
cuucccucucucacuccccacaucccaucgucucggccuucacaaucugucaguucuaaccucc

SEQ ID NO: 105450 - RNA, 64 nt, Homo Sapiens
cacaaucugucaguucuaaccuccuaagcaacuaggccuucaguaaaugugauucaccucuucu

SEQ ID NO: 105451 - RNA, 64 nt, Homo Sapiens
cuggaaaaugacguuuguggcucuuucccaaguuggccuucaaagagccugccugcuguugagc

SEQ ID NO: 105452 - RNA, 64 nt, Homo Sapiens
cgugucagccugcaucgcaagcacacacccugcgggccuucaagucucacuguuccguaugagg

SEQ ID NO: 105453 - RNA, 64 nt, Homo Sapiens
cacaugcuauguucugucuugaauuccuucgaaaggccuucagauuuuuaaaaaauaugucgua

SEQ ID NO: 105454 - RNA, 64 nt, Homo Sapiens
uuauuuccacuauuuucaaauggugaauuuucaaggccuucagucuccccugauagaagauugu

SEQ ID NO: 105455 - RNA, 64 nt, Homo Sapiens
uaggggagcaccacgcgcugcaguucaccgaccuggccuucaagcaggcccgggacggcugccc

SEQ ID NO: 105456 - RNA, 64 nt, Homo Sapiens
gggccccacgcaccaccuaccuggcuuccugcaaggccuucacgccugccagggucagcugcag

SEQ ID NO: 105457 - RNA, 64 nt, Homo Sapiens
gcugcucugguggaguugggaagggauaggaccuggccuucacugucucccuugcccuuugacu

SEQ ID NO: 105458 - RNA, 64 nt, Homo Sapiens
guuuggagaugugggccuuugauagacccacuugggccuucaugccauggccuguggauggaga

SEQ ID NO: 105459 - RNA, 64 nt, Homo Sapiens
agagaucaggcucugggaccccugccugggggguggccuucaugcacuagccacuuccgcaggu

SEQ ID NO: 105460 - RNA, 64 nt, Homo Sapiens
ccaugcccagagccccgccugccucagcgggucaggccuucagaacacugccacccacccaguu

SEQ ID NO: 105461 - RNA, 64 nt, Homo Sapiens
cugaggauuuuaucaagaaaggagaccuacaucaggccuucaucaaauaaauuaaagcguaaaa

SEQ ID NO: 105462 - RNA, 64 nt, Homo Sapiens
guguccuuuauguaagaaugcaaccagaagaaagggccuucacauuuugcaugcugaaacuucu

SEQ ID NO: 105463 - RNA, 64 nt, Homo Sapiens
caaagcagggagaacagaaagguagaguuacuaaggccuucagugaacagaaaggagcagagag

SEQ ID NO: 105464 - RNA, 64 nt, Homo Sapiens
uucucuggguccagggugacucuccaaagaaauuggccuucagcuggagaaaacauugggugga

SEQ ID NO: 105465 - RNA, 64 nt, Homo Sapiens
ugauucugcuuucuguuagcuuaggcagacauugggccuucaccuacaaguuuuuccuuacccc

SEQ ID NO: 105466 - RNA, 64 nt, Homo Sapiens
cuggaaaggccacuuggcccugugcugagugagcggccuucauuagagcgaggcagcccuuggc

SEQ ID NO: 105467 - RNA, 64 nt, Homo Sapiens; identical to SEQ ID NO: 72506

SEQ ID NO: 105468 - RNA, 64 nt, Homo Sapiens; identical to SEQ ID NO: 72507

SEQ ID NO: 105469 - RNA, 64 nt, Homo Sapiens; identical to SEQ ID NO: 72508

SEQ ID NO: 105470 - RNA, 64 nt, Homo Sapiens; identical to SEQ ID NO: 72509

SEQ ID NO: 105471 - RNA, 64 nt, Homo Sapiens; identical to SEQ ID NO: 72510

SEQ ID NO: 105472 - RNA, 64 nt, Homo Sapiens; identical to SEQ ID NO: 72511

SEQ ID NO: 105473 - RNA, 64 nt, Homo Sapiens; identical to SEQ ID NO: 72512

SEQ ID NO: 105474 - RNA, 64 nt, Homo Sapiens; identical to SEQ ID NO: 72513

SEQ ID NO: 105475 - RNA, 64 nt, Homo Sapiens; identical to SEQ ID NO: 72514

SEQ ID NO: 105476 - RNA, 64 nt, Homo Sapiens; identical to SEQ ID NO: 72515

SEQ ID NO: 105477 - RNA, 64 nt, Homo Sapiens; identical to SEQ ID NO: 72516

SEQ ID NO: 105478 - RNA, 64 nt, Homo Sapiens; identical to SEQ ID NO: 72517

SEQ ID NO: 105479 - RNA, 64 nt, Homo Sapiens; identical to SEQ ID NO: 72518

SEQ ID NO: 105480 - RNA, 64 nt, Homo Sapiens; identical to SEQ ID NO: 72519

SEQ ID NO: 105481 - RNA, 64 nt, Homo Sapiens; identical to SEQ ID NO: 72520

SEQ ID NO: 105482 - RNA, 64 nt, Homo Sapiens; identical to SEQ ID NO: 72521

SEQ ID NO: 105483 - RNA, 64 nt, Homo Sapiens; identical to SEQ ID NO: 72522

SEQ ID NO: 105484 - RNA, 64 nt, Homo Sapiens; identical to SEQ ID NO: 72523

SEQ ID NO: 105485 - RNA, 64 nt, Homo Sapiens; identical to SEQ ID NO: 72524

SEQ ID NO: 105486 - RNA, 64 nt, Homo Sapiens; identical to SEQ ID NO: 72525

SEQ ID NO: 105487 - RNA, 64 nt, Homo Sapiens; identical to SEQ ID NO: 72526

SEQ ID NO: 105488 - RNA, 64 nt, Homo Sapiens; identical to SEQ ID NO: 72527

SEQ ID NO: 105489 - RNA, 64 nt, Homo Sapiens; identical to SEQ ID NO: 72528

SEQ ID NO: 105490 - RNA, 64 nt, Homo Sapiens; identical to SEQ ID NO: 72529

SEQ ID NO: 105491 - RNA, 64 nt, Homo Sapiens; identical to SEQ ID NO: 72530

SEQ ID NO: 105492 - RNA, 64 nt, Homo Sapiens; identical to SEQ ID NO: 72531

SEQ ID NO: 105493 - RNA, 64 nt, Homo Sapiens; identical to SEQ ID NO: 72532

SEQ ID NO: 105494 - RNA, 64 nt, Homo Sapiens; identical to SEQ ID NO: 72533

SEQ ID NO: 105495 - RNA, 64 nt, Homo Sapiens; identical to SEQ ID NO: 72534

SEQ ID NO: 105496 - RNA, 64 nt, Homo Sapiens; identical to SEQ ID NO: 72535

SEQ ID NO: 105497 - RNA, 64 nt, Homo Sapiens; identical to SEQ ID NO: 72536

SEQ ID NO: 105498 - RNA, 64 nt, Homo Sapiens; identical to SEQ ID NO: 72537

SEQ ID NO: 105499 - RNA, 64 nt, Homo Sapiens; identical to SEQ ID NO: 72538

SEQ ID NO: 105500 - RNA, 64 nt, Homo Sapiens; identical to SEQ ID NO: 72539

SEQ ID NO: 105501 - RNA, 64 nt, Homo Sapiens; identical to SEQ ID NO: 72540

SEQ ID NO: 105502 - RNA, 64 nt, Homo Sapiens; identical to SEQ ID NO: 72541

SEQ ID NO: 105503 - RNA, 64 nt, Homo Sapiens; identical to SEQ ID NO: 72542

SEQ ID NO: 105504 - RNA, 64 nt, Homo Sapiens; identical to SEQ ID NO: 72543

SEQ ID NO: 105505 - RNA, 64 nt, Homo Sapiens; identical to SEQ ID NO: 72544

SEQ ID NO: 105506 - RNA, 64 nt, Homo Sapiens; identical to SEQ ID NO: 72545

SEQ ID NO: 105507 - RNA, 64 nt, Homo Sapiens; identical to SEQ ID NO: 72546

SEQ ID NO: 105508 - RNA, 64 nt, Homo Sapiens; identical to SEQ ID NO: 72547

SEQ ID NO: 105509 - RNA, 64 nt, Homo Sapiens; identical to SEQ ID NO: 72548

SEQ ID NO: 105510 - RNA, 64 nt, Homo Sapiens; identical to SEQ ID NO: 72549

SEQ ID NO: 105511 - RNA, 64 nt, Homo Sapiens; identical to SEQ ID NO: 72550

SEQ ID NO: 105512 - RNA, 64 nt, Homo Sapiens; identical to SEQ ID NO: 72551

SEQ ID NO: 105513 - RNA, 64 nt, Homo Sapiens; identical to SEQ ID NO: 72552

SEQ ID NO: 105514 - RNA, 64 nt, Homo Sapiens; identical to SEQ ID NO: 72553

SEQ ID NO: 105515 - RNA, 64 nt, Homo Sapiens; identical to SEQ ID NO: 72554

SEQ ID NO: 105516 - RNA, 64 nt, Homo Sapiens; identical to SEQ ID NO: 72555

SEQ ID NO: 105517 - RNA, 64 nt, Homo Sapiens; identical to SEQ ID NO: 72556

SEQ ID NO: 105518 - RNA, 64 nt, Homo Sapiens; identical to SEQ ID NO: 72557

SEQ ID NO: 105519 - RNA, 64 nt, Homo Sapiens; identical to SEQ ID NO: 72558

SEQ ID NO: 105520 - RNA, 64 nt, Homo Sapiens; identical to SEQ ID NO: 72559

SEQ ID NO: 105521 - RNA, 64 nt, Homo Sapiens; identical to SEQ ID NO: 72560

SEQ ID NO: 105522 - RNA, 64 nt, Homo Sapiens; identical to SEQ ID NO: 72561

SEQ ID NO: 105523 - RNA, 64 nt, Homo Sapiens; identical to SEQ ID NO: 72562

SEQ ID NO: 105524 - RNA, 64 nt, Homo Sapiens; identical to SEQ ID NO: 72563

SEQ ID NO: 105525 - RNA, 64 nt, Homo Sapiens; identical to SEQ ID NO: 72564

SEQ ID NO: 105526 - RNA, 64 nt, Homo Sapiens; identical to SEQ ID NO: 72565

SEQ ID NO: 105527 - RNA, 64 nt, Homo Sapiens; identical to SEQ ID NO: 72566

SEQ ID NO: 105528 - RNA, 64 nt, Homo Sapiens; identical to SEQ ID NO: 72567

SEQ ID NO: 105529 - RNA, 64 nt, Homo Sapiens; identical to SEQ ID NO: 72568

SEQ ID NO: 105530 - RNA, 64 nt, Homo Sapiens; identical to SEQ ID NO: 72569

SEQ ID NO: 105531 - RNA, 64 nt, Homo Sapiens; identical to SEQ ID NO: 72570

SEQ ID NO: 105532 - RNA, 64 nt, Homo Sapiens; identical to SEQ ID NO: 72571

SEQ ID NO: 105533 - RNA, 64 nt, Homo Sapiens; identical to SEQ ID NO: 72572

SEQ ID NO: 105534 - RNA, 64 nt, Homo Sapiens; identical to SEQ ID NO: 72573

SEQ ID NO: 105535 - RNA, 64 nt, Homo Sapiens; identical to SEQ ID NO: 72574

SEQ ID NO: 105536 - RNA, 64 nt, Homo Sapiens; identical to SEQ ID NO: 72575

SEQ ID NO: 105537 - RNA, 64 nt, Homo Sapiens; identical to SEQ ID NO: 72576

SEQ ID NO: 105538 - RNA, 64 nt, Homo Sapiens; identical to SEQ ID NO: 72577

SEQ ID NO: 105539 - RNA, 64 nt, Homo Sapiens; identical to SEQ ID NO: 72578

SEQ ID NO: 105540 - RNA, 64 nt, Homo Sapiens; identical to SEQ ID NO: 72579

SEQ ID NO: 105541 - RNA, 64 nt, Homo Sapiens; identical to SEQ ID NO: 72580

SEQ ID NO: 105542 - RNA, 64 nt, Homo Sapiens; identical to SEQ ID NO: 72581

SEQ ID NO: 105543 - RNA, 64 nt, Homo Sapiens; identical to SEQ ID NO: 72582

SEQ ID NO: 105544 - RNA, 64 nt, Homo Sapiens; identical to SEQ ID NO: 72583

SEQ ID NO: 105545 - RNA, 64 nt, Homo Sapiens; identical to SEQ ID NO: 72584

SEQ ID NO: 105546 - RNA, 64 nt, Homo Sapiens; identical to SEQ ID NO: 72585

SEQ ID NO: 105547 - RNA, 64 nt, Homo Sapiens; identical to SEQ ID NO: 72586

SEQ ID NO: 105548 - RNA, 64 nt, Homo Sapiens; identical to SEQ ID NO: 72587

SEQ ID NO: 105549 - RNA, 64 nt, Homo Sapiens; identical to SEQ ID NO: 72588

SEQ ID NO: 105550 - RNA, 64 nt, Homo Sapiens; identical to SEQ ID NO: 72589

SEQ ID NO: 105551 - RNA, 64 nt, Homo Sapiens; identical to SEQ ID NO: 72590

SEQ ID NO: 105552 - RNA, 64 nt, Homo Sapiens; identical to SEQ ID NO: 72591

SEQ ID NO: 105553 - RNA, 64 nt, Homo Sapiens; identical to SEQ ID NO: 72592

SEQ ID NO: 105554 - RNA, 64 nt, Homo Sapiens; identical to SEQ ID NO: 72593

SEQ ID NO: 105555 - RNA, 64 nt, Homo Sapiens; identical to SEQ ID NO: 72594

SEQ ID NO: 105556 - RNA, 64 nt, Homo Sapiens; identical to SEQ ID NO: 72595

SEQ ID NO: 105557 - RNA, 64 nt, Homo Sapiens; identical to SEQ ID NO: 72596

SEQ ID NO: 105558 - RNA, 64 nt, Homo Sapiens; identical to SEQ ID NO: 72597

SEQ ID NO: 105559 - RNA, 64 nt, Homo Sapiens; identical to SEQ ID NO: 72598

SEQ ID NO: 105560 - RNA, 64 nt, Homo Sapiens; identical to SEQ ID NO: 72599

SEQ ID NO: 105561 - RNA, 64 nt, Homo Sapiens; identical to SEQ ID NO: 72600

SEQ ID NO: 105562 - RNA, 64 nt, Homo Sapiens; identical to SEQ ID NO: 72601

SEQ ID NO: 105563 - RNA, 64 nt, Homo Sapiens; identical to SEQ ID NO: 59936

SEQ ID NO: 105564 - RNA, 64 nt, Homo Sapiens; identical to SEQ ID NO: 59937

SEQ ID NO: 105565 - RNA, 64 nt, Homo Sapiens; identical to SEQ ID NO: 59938

SEQ ID NO: 105566 - RNA, 64 nt, Homo Sapiens; identical to SEQ ID NO: 59939

SEQ ID NO: 105567 - RNA, 64 nt, Homo Sapiens; identical to SEQ ID NO: 59940

SEQ ID NO: 105568 - RNA, 64 nt, Homo Sapiens; identical to SEQ ID NO: 59941

SEQ ID NO: 105569 - RNA, 64 nt, Homo Sapiens; identical to SEQ ID NO: 59942

SEQ ID NO: 105570 - RNA, 64 nt, Homo Sapiens; identical to SEQ ID NO: 59943

SEQ ID NO: 105571 - RNA, 64 nt, Homo Sapiens; identical to SEQ ID NO: 59944

SEQ ID NO: 105572 - RNA, 64 nt, Homo Sapiens; identical to SEQ ID NO: 59945

SEQ ID NO: 105573 - RNA, 64 nt, Homo Sapiens; identical to SEQ ID NO: 59946

SEQ ID NO: 105574 - RNA, 64 nt, Homo Sapiens; identical to SEQ ID NO: 59947

SEQ ID NO: 105575 - RNA, 64 nt, Homo Sapiens; identical to SEQ ID NO: 59948

SEQ ID NO: 105576 - RNA, 64 nt, Homo Sapiens; identical to SEQ ID NO: 59949

SEQ ID NO: 105577 - RNA, 64 nt, Homo Sapiens; identical to SEQ ID NO: 59950

SEQ ID NO: 105578 - RNA, 64 nt, Homo Sapiens; identical to SEQ ID NO: 59951

SEQ ID NO: 105579 - RNA, 64 nt, Homo Sapiens; identical to SEQ ID NO: 59952

SEQ ID NO: 105580 - RNA, 64 nt, Homo Sapiens; identical to SEQ ID NO: 59953

SEQ ID NO: 105581 - RNA, 64 nt, Homo Sapiens; identical to SEQ ID NO: 59954

SEQ ID NO: 105582 - RNA, 64 nt, Homo Sapiens; identical to SEQ ID NO: 59955

SEQ ID NO: 105583 - RNA, 64 nt, Homo Sapiens
augccaggaagacccauaacuuauccacguguggauuauccacccccauauagucaacucuuga

SEQ ID NO: 105584 - RNA, 64 nt, Homo Sapiens
uguggauuauccaccaugccauagucaacucuugauuauccacggaggggagggaggaacccau

SEQ ID NO: 105585 - RNA, 64 nt, Homo Sapiens
gaauuguuacccccuuuacucagagauaacauagauuauccaggcugagauggaaaacaagccc

SEQ ID NO: 105586 - RNA, 64 nt, Homo Sapiens
ccucacacugaaacaaaggaagugaugucccauuauuauccacccugagccaccauaauaugcu

SEQ ID NO: 105587 - RNA, 64 nt, Homo Sapiens
aauucucaagacuaaagacuugagauuauauaaaauuauccagaaucauucagcuaauacuauu

SEQ ID NO: 105588 - RNA, 64 nt, Homo Sapiens
aaaauagaaagauuggaaaucaccauuguuuccuauuauccacaguguggauggauacuuauuu

SEQ ID NO: 105589 - RNA, 64 nt, Homo Sapiens
guucuaauccacagggauuacugcucccggcccuauuauccauagggauugcaggcaugagcca

SEQ ID NO: 105590 - RNA, 64 nt, Homo Sapiens
guuuuugggggguuuuuugugucugucaugcuuuauuauccauaaaaucauuuggcaucuugag

SEQ ID NO: 105591 - RNA, 64 nt, Homo Sapiens
gauggaaaguuguauuucucuaaauuuauuauccauuauccaguaaauuaauaacuggagccuc

SEQ ID NO: 105592 - RNA, 64 nt, Homo Sapiens
auccagugauggaaaguugugagccucuaaauuuauuauccauuaaaaacuaaauuaauaacug

SEQ ID NO: 105593 - RNA, 64 nt, Homo Sapiens
uaacuucuccauaauuauuguguggaaaagcucuauuauccaauuucuguguuucuacuugaau

SEQ ID NO: 105594 - RNA, 64 nt, Homo Sapiens
uucuucuguguuucuacuuguuagaggacuuaaaauuauccaguuugcaccagcaugucuugag

SEQ ID NO: 105595 - RNA, 64 nt, Homo Sapiens
cuucugaacuugaucaagagaaaauuagcaauauauuauccaauuguuggcucucaaacuuagc

SEQ ID NO: 105596 - RNA, 64 nt, Homo Sapiens
auucagaucuuucuagucaccauuagaacaaugaauuauccagcucugcagaucaagauuuucu

SEQ ID NO: 105597 - RNA, 64 nt, Homo Sapiens
ugccugccgccgugacugcguuuuaguucucuaaauuauccaagccgauguugcucuguccuuc

SEQ ID NO: 105598 - RNA, 64 nt, Homo Sapiens
aaaaauaaucacucccuaugaucuaguuaauguaauuauccagucacuguaacuaaucucuuga

SEQ ID NO: 105599 - RNA, 64 nt, Homo Sapiens
ucaaaaauaaauuagaaaaacugauucacagcuuauuauccaaucaauaaaaaaaaaccuagug

SEQ ID NO: 105600 - RNA, 64 nt, Homo Sapiens
aaaaaaaaaccuagugcugacucuuuaaaggauaauuauccaauaagucuaaacuguuaaacaa

SEQ ID NO: 105601 - RNA, 64 nt, Homo Sapiens
guccucauucccaagauugaggaggcaguaguuaaucugggaaggcaguagaauggccagcauu

SEQ ID NO: 105602 - RNA, 64 nt, Homo Sapiens
cuacuugggaggcugaguugggaggauugcugcaaucugggagguggaaguugcagugagccga

SEQ ID NO: 105603 - RNA, 64 nt, Homo Sapiens
caaauauagccacagaaauaaaggagggaccaauaucugggacagguaauuuugcaaaacacau

SEQ ID NO: 105604 - RNA, 64 nt, Homo Sapiens
caaauauagccacagaaauaaagaagggacaacaaucugggacagguaauuuugcaaaacacau

SEQ ID NO: 105605 - RNA, 64 nt, Homo Sapiens
cgaauauagccacagaaauaaaggauggagaaaaaucugggacagguaauuuugcaaaacacau

SEQ ID NO: 105606 - RNA, 64 nt, Homo Sapiens
cgaacauagccacagaaauaaaggauggagaaaaaucugggacagguaauuuugcaaaagacau

SEQ ID NO: 105607 - RNA, 64 nt, Homo Sapiens
accaugcccaggucuccugccucacaucacaauaaucugggacccaggcuugugcccuuucagu

SEQ ID NO: 105608 - RNA, 64 nt, Homo Sapiens
gucuagugaaucagaaaggcuuagccaaggccacaucugggaagaguggagaaauuugccacuu

SEQ ID NO: 105609 - RNA, 64 nt, Homo Sapiens
gaagugaggagccccuccgcccggcagccaccccaucugggaagugaggagcgucuacgcccgg

SEQ ID NO: 105610 - RNA, 64 nt, Homo Sapiens
gaagugaggagccccucugccuggccaccaccccaucugggaggugugcccagcagcucauuga

SEQ ID NO: 105611 - RNA, 64 nt, Homo Sapiens
ggcaggcuccaacccuaagaaggucgaccucaucaucugggagaucgaggugccaaagguaggg

SEQ ID NO: 105612 - RNA, 64 nt, Homo Sapiens
acacuggacaggugacuguaugguagagacugugaucugggaacuuuuugcuguacaaaucugu

SEQ ID NO: 105613 - RNA, 64 nt, Homo Sapiens
cugauacugacagggagauggucagaagaagauuaucugggacaccaaauugggaaauguccca

SEQ ID NO: 105614 - RNA, 64 nt, Homo Sapiens
caucagaaugucugcucuccuaugagugcugucaaucugggaaauucauacuggagaaaggccu

SEQ ID NO: 105615 - RNA, 64 nt, Homo Sapiens
uaguuuucaacucucccaguuuauugauuauggaaccugucaagugaugaucugaaucucugac

SEQ ID NO: 105616 - RNA, 64 nt, Homo Sapiens
gcugccuuucacaggguuccguccaacagacaccaccugucaaagggccaggccagaagcuggu

SEQ ID NO: 105617 - RNA, 64 nt, Homo Sapiens
ugacucgagcccccugcuucagagauggauucucaccugucaccggggccugcuugcucacuag

SEQ ID NO: 105618 - RNA, 64 nt, Homo Sapiens
ccacauaggcuccuggcgugccgucuguccaccuaccugucaguaaggcugucuguccauccgu

SEQ ID NO: 105619 - RNA, 64 nt, Homo Sapiens
uuggaggucaaagucaaaagcaucaggguaguagaccugucagacuggaaagucucuuccaguu

SEQ ID NO: 105620 - RNA, 64 nt, Homo Sapiens
ugaguugauuuagacaacauauauauauuguguaaccugucaggguuuuguggcacauugucug

SEQ ID NO: 105621 - RNA, 64 nt, Homo Sapiens
ugggaggcccaaggagaagagggcuucgggcaggaccugucagcccacgcuauaccaucuaccu

SEQ ID NO: 105622 - RNA, 64 nt, Homo Sapiens
cuccccaagcgccugcaccgccaggcagagccguaccugucaccgcggccccagaguccccgca

SEQ ID NO: 105623 - RNA, 64 nt, Homo Sapiens
cagucugugucguguucagugucacaaagcuaccaccugucaccagagccuacugcugcucucc

SEQ ID NO: 105624 - RNA, 64 nt, Homo Sapiens
cauccucccuugcucacaaaguuacaggguaggcaccugucaggacagaacagcagcagcgcua

SEQ ID NO: 105625 - RNA, 64 nt, Homo Sapiens
aaauaucucaaguguugaugaucucaguccagguaggaauuaagcaguagugucaguuuuccua

SEQ ID NO: 105626 - RNA, 64 nt, Homo Sapiens
gaaccucgguaggaauguauuuggcuuagucagaaggaauuaaccuaugguaaugaagaacucu

SEQ ID NO: 105627 - RNA, 64 nt, Homo Sapiens
auuuauaaggcuuuuucauaaauguauagcaaauaggaauuauuaacuugagcauaagauauga

SEQ ID NO: 105628 - RNA, 64 nt, Homo Sapiens
aaaauaacuacucacaacauucacuauguuugcaaggaauuaacacaaauaaaagaugccuuuu

SEQ ID NO: 105629 - RNA, 64 nt, Homo Sapiens
ggcuauuguaauuuacccacauuaucacauuuucaggaauuauaagaauguguuuuauuguacu

SEQ ID NO: 105630 - RNA, 64 nt, Homo Sapiens
uccuuggagcugaaugcaaggaaugugaauucugaggaauuaagguagaauauauuugacuuuc

SEQ ID NO: 105631 - RNA, 64 nt, Homo Sapiens
gaaugacuuuugaguggcaaauccaaaauuugucaggaauuaaauuuguccucauugaguugac

SEQ ID NO: 105632 - RNA, 56 nt, Homo Sapiens
caaaggaacauaaagaccacaaaaaaaggaauuauacauccaagacuggacucuga

SEQ ID NO: 105633 - RNA, 64 nt, Homo Sapiens
uucuaucuaaauugugugucuaucuuuuaauuugaggaauuacaugacuguguacccuuuaaaa

SEQ ID NO: 105634 - RNA, 64 nt, Homo Sapiens
acuaagcaaugugucuugcaaaugccuuauggauaggaauuagucuaagagaagauauuuuuua

SEQ ID NO: 105635 - RNA, 64 nt, Homo Sapiens
aaauaauugguucuuucuaaucuauuucagguauaggaauuauaaucaucauaauuuuuguggu

SEQ ID NO: 105636 - RNA, 64 nt, Homo Sapiens
uuuugaagaugagcauauauuccagugugacaugaggaauuagaacuuuuuuuuuuuuucagau

SEQ ID NO: 105637 - RNA, 64 nt, Homo Sapiens
auuguuccuuuugucacaggguuagucuucuucaaggaauuacuaaagcaaaauguuuuuucca

SEQ ID NO: 105638 - RNA, 64 nt, Homo Sapiens
aaaaaaaagcuuugccaauagcaaaugcuuaagaaggaauuaaauaagcuaguuuaacacuuga

SEQ ID NO: 105639 - RNA, 64 nt, Homo Sapiens
uugaaaugugucauacuguuuuaggaucaagacuaggaauuaggagccagguugacaaggacuu

SEQ ID NO: 105640 - RNA, 64 nt, Homo Sapiens
guagcauucaugguaaacuuuuaagugcuaagcaaggaauuauuuacugauugguuuuaaagag

SEQ ID NO: 105641 - RNA, 64 nt, Homo Sapiens
auucacuucugaaggacuuauuaugguucucuuaaggaauuaaugaauuuuuuaaaaauacauu

SEQ ID NO: 105642 - RNA, 64 nt, Homo Sapiens
auacugagucaaagauuaaccauuuauucaccaaaggaauuaauuauaaagaaaugaccgguga

SEQ ID NO: 105643 - RNA, 64 nt, Homo Sapiens
gaauuuccuuuucccccuuuuuuguguugucuauaggaauuaacuugggauuguuuuguggguu

SEQ ID NO: 105644 - RNA, 64 nt, Homo Sapiens
auagaguaaguauaagagauaauucauuaguaauaggaauuaacugaccccuuuuggauggggg

SEQ ID NO: 105645 - RNA, 64 nt, Homo Sapiens
gguuaagcuuuguguuuaccacaaugacuuuaugaggaauuaaaacaaugaguuaaauauaaua

SEQ ID NO: 105646 - RNA, 64 nt, Homo Sapiens
uuaacuuauccaaaguuucgaauaaacagguuugaggaauuagugaaccauuuuacagauuuaa

SEQ ID NO: 105647 - RNA, 64 nt, Homo Sapiens
gguaaugaaaagggaggaaaaaaaaagaaggaaaaggaauuauagacccccagggucagccagu

SEQ ID NO: 105648 - RNA, 64 nt, Homo Sapiens
ugcucaggagcauuggaauccucuucuuccagggaggaauuagccugcaagguuaggacuugaa

SEQ ID NO: 105649 - RNA, 64 nt, Homo Sapiens
aacuugccauguugagugccauuguauugaacuuauucuaaaggcuuaugcuaacccauuuaua

SEQ ID NO: 105650 - RNA, 64 nt, Homo Sapiens
aaauuuccuauuuguuccaauacaaacucacuuuauucuaaaguauauuaaugaaaccaguucc

SEQ ID NO: 105651 - RNA, 64 nt, Homo Sapiens
uaguuaagaugaaauuuauauacuuuuccguuucauucuaaagggaaaaugcacacuuuguuuu

SEQ ID NO: 105652 - RNA, 64 nt, Homo Sapiens
gugacucucugcccuuggacgcaaacauuuuaucauucuaaauggucagccucuuucauagugu

SEQ ID NO: 105653 - RNA, 64 nt, Homo Sapiens
gaccuucugcuaccucucauagaauugcucuguaauucuaaauuuaaaauuagaaguagagaga

SEQ ID NO: 105654 - RNA, 64 nt, Homo Sapiens
uugaugacauaucuuuaaacuuucuugcaucaguauucuaaauugagcaaacugaaagauuuuc

SEQ ID NO: 105655 - RNA, 64 nt, Homo Sapiens
gcguguugauagcaauaauuuguuucuuuuaaagauucuaaaaggucugagaccuguagcauua

SEQ ID NO: 105656 - RNA, 64 nt, Homo Sapiens
gcaacuguaaacgaaccugugccucuaacaagcgauucuaaaccaccuaugaguauuucuuuua

SEQ ID NO: 105657 - RNA, 64 nt, Homo Sapiens
uagaaauaugcuucugccuaaaaauggaaaauuaauucuaaacugauaaaguccugaaccuuuc

SEQ ID NO: 105658 - RNA, 64 nt, Homo Sapiens
gcuacuucuaauuauuccaauaaaugauaucuauauucuaaagaauuaaaucuccagcuuacua

SEQ ID NO: 105659 - RNA, 64 nt, Homo Sapiens
uuggaacugucguacacauucuagaaauggauuuauucuaaaauguaucagauuuuguuagaug

SEQ ID NO: 105660 - RNA, 64 nt, Homo Sapiens
caaaaauugguuugaguuuuucaacaagaauuuaauucuaaaagguaguacaagauugaaaaac

SEQ ID NO: 105661 - RNA, 64 nt, Homo Sapiens
cacaugguagugcuuuggugaaaacaggcagagcauucuaaaacauuuuauucucaacaggugu

SEQ ID NO: 105662 - RNA, 64 nt, Homo Sapiens
aagaagcacuaaauggcagguggggccaguugcgauucuaaaggugcuccaaaccguuccaagg

SEQ ID NO: 105663 - RNA, 64 nt, Homo Sapiens
ugggccugaggucaaugggacccccuguagacccauucuaaaugcaggcauucucuauucuuuu

SEQ ID NO: 105664 - RNA, 64 nt, Homo Sapiens
ucaaaacugagaagagauuauuuuuaacauuauuauucuaaaggguuuuauuauccuuacuuuu

SEQ ID NO: 105665 - RNA, 64 nt, Homo Sapiens
ugaguaaauacaauuuuuuagaacuauaaauagcauucuaaauuauauuucaucuaacugcuua

SEQ ID NO: 105666 - RNA, 64 nt, Homo Sapiens
uuguaccaaagcaacuuuaggccaguuuugcuuuauucuaaauuaucacauuuguuguggugcu

SEQ ID NO: 105667 - RNA, 64 nt, Homo Sapiens
cccuugaccagaaauuuuucuucuaaagaauuuaauucuaaaaguuauagacauucccaaagau

SEQ ID NO: 105668 - RNA, 64 nt, Homo Sapiens
ugucuucauguaccuguauguaaaucccacuuuuauucuaaaauucuuugaauauuuuguuucu

SEQ ID NO: 105669 - RNA, 64 nt, Homo Sapiens
uuguuaaaauaaauaacauuuaauuugacggaaaauucuaaaaaucaacauuugguaacuuaaa

SEQ ID NO: 105670 - RNA, 64 nt, Homo Sapiens
uuuuguugaaugcuauggaauauuaauauaauuaauucuaaaauaucaccuaaaauaugucaac

SEQ ID NO: 105671 - RNA, 64 nt, Homo Sapiens
uuccccuguaaaauuggaauaguaugauuggauuauucuaaaaaggucuuauacucaagagugg

SEQ ID NO: 105672 - RNA, 64 nt, Homo Sapiens
uuuaaucuugucuuggaaagauaaaaugaccugcauucuaaauuagaauugggguucuguuuaa

SEQ ID NO: 105673 - RNA, 64 nt, Homo Sapiens
accuuuuuugggggagugacaggaugggguauggauucuaaaaugccuuuucccaaaauguuga

SEQ ID NO: 105674 - RNA, 64 nt, Homo Sapiens
aagcccuuuuauaccuccccagacuccuucaacaauucuaaaaugauuguaguaaucugcauua

SEQ ID NO: 105675 - RNA, 64 nt, Homo Sapiens
auagaauuuuuuuuugauaaaggaucacaaaacaauucuaaaaccuaacuguuuuuaccauuga

SEQ ID NO: 105676 - RNA, 64 nt, Homo Sapiens
uguaugucuuuuguuaacauauuuguuaugccuuauucuaaaauugagucucaaacuggaaugc

SEQ ID NO: 105677 - RNA, 64 nt, Homo Sapiens
uaaguaguaaauuuaacuccaucaacacugacagauucuaaaauuuaaaaauuuauagaaccau

SEQ ID NO: 105678 - RNA, 64 nt, Homo Sapiens
uuuuuucuugaaaguuuuaaagagucuuuaagucauucuaaauauuuagguaguuauuuauaca

SEQ ID NO: 105679 - RNA, 64 nt, Homo Sapiens
cuuucccaugagauaccauguucuaugccuucccauucuaaaaguguggacaacgcuugauuug

SEQ ID NO: 105680 - RNA, 64 nt, Homo Sapiens
ugagggaagugugauauauuaacaaauauaaccaauucuaaauuuguuuuagcucuaaccucau

SEQ ID NO: 105681 - RNA, 64 nt, Homo Sapiens
uagugauaugguaaugaaaucacaaccacuccugauucuaaauuagucuugucuaucagauucc

SEQ ID NO: 105682 - RNA, 64 nt, Homo Sapiens
caggguauguucuaaucuauaaaauguuaauuauauucuaaauacagauuaaaauguuuacaac

SEQ ID NO: 105683 - RNA, 64 nt, Homo Sapiens
ccaaaguucauuauuuucaugcaguaaaucaaauauucuaaaacggcagcagaggaacccaaag

SEQ ID NO: 105684 - RNA, 64 nt, Homo Sapiens
cuucugcuccuuccuucccacagacccauucuauauucuaaaaguaauauucaucucuugcugu

SEQ ID NO: 105685 - RNA, 64 nt, Homo Sapiens
gaggagacaauaguucagaaccuuuuuaagagccauucuaaaagugaccagcaggagggaucua

SEQ ID NO: 105686 - RNA, 64 nt, Homo Sapiens
gugauuucugugggagggaaucauugcaauguauauucuaaauaaagucaucuaacuauuaaaa

SEQ ID NO: 105687 - RNA, 64 nt, Homo Sapiens
auauaauuuccagauaguaauagguaauuggcagauucuaaauaacaauuguugaggggggauc

SEQ ID NO: 105688 - RNA, 64 nt, Homo Sapiens
ccaguuuaugauuuaggauuuuuuuaaguguguaauucuaaaagaacucuuguaguuuacuguu

SEQ ID NO: 105689 - RNA, 64 nt, Homo Sapiens
aguucagagauauagucauauaauaaacugaugaauucuaaauaaaacuacaguuuuuccaaac

SEQ ID NO: 105690 - RNA, 64 nt, Homo Sapiens
agggcauucacucucuggaagauuucagagacccauucuaaacaagaugccucuuaaaaaugaa

SEQ ID NO: 105691 - RNA, 64 nt, Homo Sapiens
uaaagauuuuggagacucuguaaaacaagguuggauucuaaagauccuucauuuuacuacuucu

SEQ ID NO: 105692 - RNA, 64 nt, Homo Sapiens
uauuauguaaauguuaaugucuggaaaccaugugauucuaaauagcaugacugaaaucuaauca

SEQ ID NO: 105693 - RNA, 64 nt, Homo Sapiens
uaccagcaaagaauauuuuuaauguggauaucuaauucuaaagucuguuccauuagaagcaauu

SEQ ID NO: 105694 - RNA, 64 nt, Homo Sapiens
uauuguauuuuaaaaaugcauauugaucacuauaauucuaaaacaauuuuuuaaauaaaccagc

SEQ ID NO: 105695 - RNA, 64 nt, Homo Sapiens
ucuaaauuuccuaacaaggcaaaauauuuuaggaauucuaaacacgugacuucucauuuuaaau

SEQ ID NO: 105696 - RNA, 64 nt, Homo Sapiens
aggucucaagccuguauuuucuuguuuugacuuaauucuaaaauagguacaauucaguuguugg

SEQ ID NO: 105697 - RNA, 64 nt, Homo Sapiens
uuguccuugucuagguugagauguucauuggaaaauucuaaaauagcaucauacauagugaaug

SEQ ID NO: 105698 - RNA, 64 nt, Homo Sapiens
aguccacucucuguggcuaaauaaauacuuuuacauucuaaacaguuugauuuuaguauuugag

SEQ ID NO: 105699 - RNA, 64 nt, Homo Sapiens
gugaguggagagaugcagugaggcaguugucauuauucuaaaaauuguacuacuuucacuuuuc

SEQ ID NO: 105700 - RNA, 64 nt, Homo Sapiens
gucuucggcuugggugaaaugacaguuccucuucauucuaaagguuuacuccauugaauuuaag

SEQ ID NO: 105701 - RNA, 64 nt, Homo Sapiens
uuucugagaguugaugagguuuaagaacaugaagauucuaaaaggucaguuuuuagagauagau

SEQ ID NO: 105702 - RNA, 64 nt, Homo Sapiens
acuauuguguuuguuucauaugaauauuuuuguaauucuaaaagagaucuuauuuaaauuuccu

SEQ ID NO: 105703 - RNA, 64 nt, Homo Sapiens
agaggauuauaaagaagugcuuuaacaauuuauaauucuaaaccuaaaugacaauuaucaaggu

SEQ ID NO: 105704 - RNA, 64 nt, Homo Sapiens
uuuucauuuucuguguucuacaaauguacaacuuauucuaaauaaauagugauuuauuugucau

SEQ ID NO: 105705 - RNA, 64 nt, Homo Sapiens
uagaguucagaguccuuaaaauguaagauuauagauucuaaagauucuauaguucuagacaugg

SEQ ID NO: 105706 - RNA, 64 nt, Homo Sapiens
uauaguucuagacauggagguucuaaggccuaggauucuaaaaugugauguucuaaggcucuga

SEQ ID NO: 105707 - RNA, 64 nt, Homo Sapiens
uaguucuaagacucaaauguucuaaguuucuaagauucuaaagguccacaggucuagacuauua

SEQ ID NO: 105708 - RNA, 64 nt, Homo Sapiens
ccugaagaaaguguaggauagaauuguuuuuagcauucuaaauuuaaaugcuuaaaacgucaau

SEQ ID NO: 105709 - RNA, 64 nt, Homo Sapiens
uaaaagaagcuuauuguaguauguuugcagaaaaauucuaaacaaaaauuauacagcuuauuag

SEQ ID NO: 105710 - RNA, 64 nt, Homo Sapiens
auuaaaucuccagauuucuguaaaugauaccuacauucuaaagaguuaauucuaauuauuccga

SEQ ID NO: 105711 - RNA, 64 nt, Homo Sapiens
gaagauauuaagucccuuucaaaauggaaaauuaauucuaaacugagaaaaauguuccuacuac

SEQ ID NO: 105712 - RNA, 64 nt, Homo Sapiens; identical to SEQ ID NO: 105710

SEQ ID NO: 105713 - RNA, 64 nt, Homo Sapiens; identical to SEQ ID NO: 105711

SEQ ID NO: 105714 - RNA, 64 nt, Homo Sapiens
ucugacccucagcuuugggacagagaugacaagccauuugaaauugggccacgauuuaaaccau

SEQ ID NO: 105715 - RNA, 64 nt, Homo Sapiens
uacaauuuuauuugauaucagcugagaaaugauucauuugaagaacuaagcuguaauuaugaug

SEQ ID NO: 105716 - RNA, 64 nt, Homo Sapiens
gcagguuuucauuuauaugucaaaggccucccugcauuugaagauuucauaugacaauguuagg

SEQ ID NO: 105717 - RNA, 64 nt, Homo Sapiens
cacugacuaauguuuguuaaccagauuguguuaccauuugaauaagucuuuccucuguugcuga

SEQ ID NO: 105718 - RNA, 64 nt, Homo Sapiens
auucuugaaagaaucaacuacagugaauccuuugcauuugaagccuuaacaugcauugcuuuaa

SEQ ID NO: 105719 - RNA, 64 nt, Homo Sapiens
caauuuugaucuguuaaauuggauuuuacauguacauuugaaugccagaauuucuaaauaaauc

SEQ ID NO: 105720 - RNA, 64 nt, Homo Sapiens
agguugcugcuguuuccagugaaucacauuucgucauuugaagcccaugaggaccauugugugg

SEQ ID NO: 105721 - RNA, 64 nt, Homo Sapiens
gcaacaaugcuuguuuuuugguguuuucuuuugacauuugaaaauuuaguacauuguuaaaaug

SEQ ID NO: 105722 - RNA, 64 nt, Homo Sapiens
uuaauggcuuuuuccauuaauaaugugaucccuucauuugaauaucuuauguauggguuuuuuu

SEQ ID NO: 105723 - RNA, 64 nt, Homo Sapiens
cacugcaacagugaacuuuuaguacuugauuggucauuugaaaauggccuuuuaaccaagaagu

SEQ ID NO: 105724 - RNA, 64 nt, Homo Sapiens
uaauaaaguaguugccguauaugcaaagaguuugcauuugaaaaauuguaaaauagcaaacuaa

SEQ ID NO: 105725 - RNA, 64 nt, Homo Sapiens
agaccuggaacaaaucguuuaaaugacugccggucauuugaaugugaaacuguggggcuuacag

SEQ ID NO: 105726 - RNA, 64 nt, Homo Sapiens
gagcuggggucucagggcucagaugagucuguugcauuugaauggggucauagcagguucuggu

SEQ ID NO: 105727 - RNA, 64 nt, Homo Sapiens
ccccacccagccccuauuuggaccuaaacugugccauuugaacagucacuuccaagcucagucu

SEQ ID NO: 105728 - RNA, 64 nt, Homo Sapiens
aaaacauugaagguugauauuuuauguggaagaacauuugaauugaauucagaauuuuucugaa

SEQ ID NO: 105729 - RNA, 64 nt, Homo Sapiens
aaaacuguacaguuuaaaugaaaauguuuuucuucauuugaagaaaauuuguugauaaaccaug

SEQ ID NO: 105730 - RNA, 64 nt, Homo Sapiens
aauugaaaaugagaaauuaaaccugcaagugaaacauuugaaacgauuauacuuucuacauaag

SEQ ID NO: 105731 - RNA, 64 nt, Homo Sapiens
uuuauaguccaaacagauuauaaaaaauguuuuccauuugaacuuuacaguuugcaaaagugcu

SEQ ID NO: 105732 - RNA, 64 nt, Homo Sapiens
augcccuaaugaugcugacuugucaugguugcagcauuugaacuuuugguguuaaaaaaaaaaa

SEQ ID NO: 105733 - RNA, 64 nt, Homo Sapiens
gcuggugucuggguagucauggauuucugcuggacauuugaaugugauaaacaauccagcauua

SEQ ID NO: 105734 - RNA, 64 nt, Homo Sapiens
ucuugaaaggcuuuuggugaaaaugaagggauuucauuugaaauuacagcaugaugaauuuugc

SEQ ID NO: 105735 - RNA, 64 nt, Homo Sapiens
cucaaaauaauggugauacauucuagccuuaagacauuugaauugccgguuguugaggugaauu

SEQ ID NO: 105736 - RNA, 64 nt, Homo Sapiens
ccguagacuacgaaugucucccuauggcugguagcauuugaagacuaaagacuugucaaauaua

SEQ ID NO: 105737 - RNA, 64 nt, Homo Sapiens
guuaaaauguaugugccaaguucuacuagaauuccauuugaaauagcaccuuccuuagguuuca

SEQ ID NO: 105738 - RNA, 64 nt, Homo Sapiens
aagcccugggaccaccucaacacgggcaaauuggcauuugaauaagauaacccuguggcaguga

SEQ ID NO: 105739 - RNA, 64 nt, Homo Sapiens
aaaaaccaaauuuuuagauucaaguaaccugguacauuugaaaucccugauacuauaagcucag

SEQ ID NO: 105740 - RNA, 64 nt, Homo Sapiens
caaagagauuguucugaagaccgugcucuaagggcauuugaaagacugccagguagugcgagcc

SEQ ID NO: 105741 - RNA, 64 nt, Homo Sapiens
ucaggggugggagaaacuccuuuccuucagcuggcauuugaauguuuccaaaucuauuuuaucu

SEQ ID NO: 105742 - RNA, 64 nt, Homo Sapiens
cuuggcccuugguaaaauuuugacaaucauaagucauuugaaaagaacagacuuacuaaaauca

SEQ ID NO: 105743 - RNA, 64 nt, Homo Sapiens
ucccacaacaaauaccaagcaucaaaagcacuuucauuugaaaauuauuauguuguaauuuuuc

SEQ ID NO: 105744 - RNA, 64 nt, Homo Sapiens
cuccuguuaguagcagaaauugaugaaaaggcagcauuugaauauguggggaaacaauuuuuug

SEQ ID NO: 105745 - RNA, 64 nt, Homo Sapiens
cauuugcugaccggaauggucacuuaaacuugcacauuugaauucaaagcugaaaauguguaua

SEQ ID NO: 105746 - RNA, 64 nt, Homo Sapiens
ggcauuucccaauauuugcuacaauucguuuuuucauuugaauuugauggacuuugguuugaac

SEQ ID NO: 105747 - RNA, 64 nt, Homo Sapiens
auauuuacugcuccaauaucagcauauuuuguggcauuugaacuauuuuuaauugcuuauaaca

SEQ ID NO: 105748 - RNA, 64 nt, Homo Sapiens
ucauuugaccuugccagcugaccuucaaacccugcauuugaaccgaccaacauuaaguccagag

SEQ ID NO: 105749 - RNA, 64 nt, Homo Sapiens
acuugaauggaauaacgacauuccagaaguuaaucauuugaauucugaacacuggagaaaaacc

SEQ ID NO: 105750 - RNA, 64 nt, Homo Sapiens
ggaggaguauacaugauucuuguguucauguugucauuugaaacucuucacauaaaauuuucua

SEQ ID NO: 105751 - RNA, 64 nt, Homo Sapiens
uuaacuugauuauacuauauaauauucucaauuacauuugaauuuaaaaauauugagcucuuga

SEQ ID NO: 105752 - RNA, 64 nt, Homo Sapiens
uauauuaggguguguugauuaaaagacaagucaucauuugaaaagauguuaccuuuggguuuuu

SEQ ID NO: 105753 - RNA, 64 nt, Homo Sapiens
uaaucaccuguguuaccacguuuauguuaaaugccauuugaauguauagggcaguuuggugcaa

SEQ ID NO: 105754 - RNA, 64 nt, Homo Sapiens
ugggcauuuuuaguaggauagacccuuuguucugcauuugaauguuucguauauuuuuguuuca

SEQ ID NO: 105755 - RNA, 64 nt, Homo Sapiens
cccuuggaaucugaacaaaggaauauaaaauugccauuugaaaacugaccagcuaaucuggacc

SEQ ID NO: 105756 - RNA, 64 nt, Homo Sapiens
gaaaucucaucguaaggcagcuaguucuaauuugcauuugaauguauaacaaauugcaucacuu

SEQ ID NO: 105757 - RNA, 64 nt, Homo Sapiens
uuugauucugccuuaagaggguauaaaacuaaaccauuugaaggcacagcccauaagacuauac

SEQ ID NO: 105758 - RNA, 64 nt, Homo Sapiens
cuaguauguuuuauuauuuuaugggucuugagugcauuugaagguguccuucaguucccacgua

SEQ ID NO: 105759 - RNA, 64 nt, Homo Sapiens
ccagugaauuaauuucagcuuauaugggugucuucauuugaacaugaggaauauuagguuauau

SEQ ID NO: 105760 - RNA, 64 nt, Homo Sapiens
uucaaggauccaggaugccaaaaauaugugugaacauuugaaacauuuuuauuugcugcuuuuu

SEQ ID NO: 105761 - RNA, 64 nt, Homo Sapiens
aaauuuugucugcacuugaguucacuugaguuuacauuugaaaugugcauguuuauuuauauag

SEQ ID NO: 105762 - RNA, 64 nt, Homo Sapiens
auuaaauaggugaguuguugagcgagaaccccuucauuugaaaagaaaugaguaugcuacuaua

SEQ ID NO: 105763 - RNA, 64 nt, Homo Sapiens
uucucuggauguuaggaccuaggggaacauugggcauuugaacauaucagggaggguccccauu

SEQ ID NO: 105764 - RNA, 64 nt, Homo Sapiens
gaugagccacagaacuucagaaaaugccaugaaacauuugaacuaauuuuucacuuaaagaaaa

SEQ ID NO: 105765 - RNA, 64 nt, Homo Sapiens
gcugauaauuuauguuuuuuagauguuuauagagcauuugaaguuaacauaggccaaauucuag

SEQ ID NO: 105766 - RNA, 64 nt, Homo Sapiens
guguuggacuugugugaaaggagagaaugucuuucauuugaagaaauguggcagguuagaaaga

SEQ ID NO: 105767 - RNA, 64 nt, Homo Sapiens
uauuuuuuucuaauaugugaaugguaauuagaaucauuugaauuauggagacauuaacaagcua

SEQ ID NO: 105768 - RNA, 64 nt, Homo Sapiens
uuuuuagugaagugggcaccuuucuaguccacggcauuugaagagagcgaggagaaccauucug

SEQ ID NO: 105769 - RNA, 64 nt, Homo Sapiens
aucaacuccaguuuaaaaaguguuauuuuuaaaacauuugaaaccaaguacuguuuaauuucaa

SEQ ID NO: 105770 - RNA, 64 nt, Homo Sapiens
auccuuuuuccuuaauuuauacaugauccaggcacauuugaaauuugguaggcauugcaaacac

SEQ ID NO: 105771 - RNA, 64 nt, Homo Sapiens
aggcacauuugaaauuugguaggcauugcaaacacauuugaauauuguguauuucauacuauuc

SEQ ID NO: 105772 - RNA, 64 nt, Homo Sapiens
auuauauuuuuccaaccacugguuguuuuaauuacauuugaauagucauguuuauuaccuauau

SEQ ID NO: 105773 - RNA, 64 nt, Homo Sapiens
cuguccuuccugcuuuaucuuuauauguaagugacauuugaauaugcuucguggaaugcugcau

SEQ ID NO: 105774 - RNA, 64 nt, Homo Sapiens
gauugcuuccuguucugcucccucugaauauuugcauuugaaagugggcaaugccuuguuuucu

SEQ ID NO: 105775 - RNA, 64 nt, Homo Sapiens
ugaaaaagccccaaagugagauguuuucaucauucauuugaaaaaguauuuauuuuaaaaaauu

SEQ ID NO: 105776 - RNA, 64 nt, Homo Sapiens
caacuuauuuauuuccucuaccuuuucucagcagcauuugaauucagaacuauaauauacauug

SEQ ID NO: 105777 - RNA, 64 nt, Homo Sapiens
caacuacaaguacaugggacucaccuguaccaaacauuugaaaugaauacuugaagucuuacag

SEQ ID NO: 105778 - RNA, 64 nt, Homo Sapiens
caacuuagcucacacucaguauccucccuaacuccauuugaacuaacaaaugacuuacagccuc

SEQ ID NO: 105779 - RNA, 64 nt, Homo Sapiens
cuaggagucaaauggaaagacaacuaggucauuucauuugaaauuuuuaugguaaauaguaaua

SEQ ID NO: 105780 - RNA, 64 nt, Homo Sapiens
aagauucucuccauugcaguaccccaaacuaagccauuugaaacuaaugauacauuuagacaaa

SEQ ID NO: 105781 - RNA, 64 nt, Homo Sapiens
uccacuaucauuguauccauccugacuuuucucacauuugaacucagggauuguucuugacaua

SEQ ID NO: 105782 - RNA, 64 nt, Homo Sapiens
aacuccaccuauuuugcaaaaaacaaucagaccacauuugaagauacucuugcugcacuuaugu

SEQ ID NO: 105783 - RNA, 64 nt, Homo Sapiens
cauugguuauauuaccaauguuuguaacaugacacauuugaaauuacaguaacaaucugcuuuc

SEQ ID NO: 105784 - RNA, 64 nt, Homo Sapiens
uuuagcuaaauauauacucuucucuaguuuaaaacauuugaacuugccuaguuagugugguugg

SEQ ID NO: 105785 - RNA, 64 nt, Homo Sapiens
uagaaaaaguccugcuuuaaguaauauguagccacauuugaauccucuaccacaagucuuuuuu

SEQ ID NO: 105786 - RNA, 64 nt, Homo Sapiens
guaaacugacaggggcuccuguccuguaaaauggcauuugaaucucguucuuuguguccuuacu

SEQ ID NO: 105787 - RNA, 64 nt, Homo Sapiens
uucaaauaacuaacacgaacuuccagaaaauuaacauuugaacuuagcuguaauucuaaacuga

SEQ ID NO: 105788 - RNA, 64 nt, Homo Sapiens
cacuguccauuaaaaaaaaucaaaaacaccaaaucauuugaaauagaaaaagcaaaaacaagaa

SEQ ID NO: 105789 - RNA, 64 nt, Homo Sapiens
gacacaagcuaccugguaaccacacacauuucagcauuugaaguugaaacccacuuuggaccau

SEQ ID NO: 105790 - RNA, 64 nt, Homo Sapiens
uuugcuuaacauuucuacauaauauuuauggucuggucaguauuggucuggucaguauugccug

SEQ ID NO: 105791 - RNA, 64 nt, Homo Sapiens
uacauaauauuuauggucuggucaguauuggucuggucaguauugccuggcugacgugaaaugu

SEQ ID NO: 105792 - RNA, 64 nt, Homo Sapiens
agugaccgcucuugcucuugguaaaauauagaguggucaguagccuuaugcaccuaauucaaaa

SEQ ID NO: 105793 - RNA, 64 nt, Homo Sapiens
uuuuucuacuuugcuuuucucuccauacuuaaauggucaguagcuacugaguggugcuuuaucu

SEQ ID NO: 105794 - RNA, 64 nt, Homo Sapiens
cacacugcccccugccaccccuuugggaccacauggucaguagguacagagaagagaaaagcug

SEQ ID NO: 105795 - RNA, 64 nt, Homo Sapiens
gagaagagaaaagcugcuuugucaccuccauaauggucaguacaaugcccaggaaugugucaga

SEQ ID NO: 105796 - RNA, 64 nt, Homo Sapiens
gacagaagcugugaguggaagacgagggauugccaucgccuaugaggaugagggaagcggcuga

SEQ ID NO: 105797 - RNA, 64 nt, Homo Sapiens
augccuacuucuuuuccaaauaagcaucagauuuaucgccuauuaugcaguaacagucaauaaa

SEQ ID NO: 105798 - RNA, 64 nt, Homo Sapiens
cugaaaucucagcagaugcccaccauuucucuagaucgccuagucucaacccauaaaaaggaag

SEQ ID NO: 105799 - RNA, 64 nt, Homo Sapiens
uacaaugccaaagccucacuugccugcacaccacaucgccuaccagcagagcuccugggccugc

SEQ ID NO: 105800 - RNA, 64 nt, Homo Sapiens
gcugugggauaaaugugugugggaauauugaaacaucgccuaggaauugugguuuguauauaac

SEQ ID NO: 105801 - RNA, 64 nt, Homo Sapiens
cuaggaaccucucugccaccaagggcugccauccaucgccuaguaaccacggcaacccaaccua

SEQ ID NO: 105802 - RNA, 64 nt, Homo Sapiens
gggaaucuccccaagcucacacucucucccgcuuaucgccuauucucacaccucuucucggucc

SEQ ID NO: 105803 - RNA, 64 nt, Homo Sapiens
auguucugugaacacaaauagagcgacugucgagaucgccuagugggguuggugggcugucacg

SEQ ID NO: 105804 - RNA, 64 nt, Homo Sapiens
uccaggcuguguuaggacaguguggucaaaggaaaucgccuagcgaguuagacuccagguacuu

SEQ ID NO: 105805 - RNA, 64 nt, Homo Sapiens
cauuucaaaauaauuuaugacucauggaauguugaucgccuaaaaaugaacaucgcauuuucuu

SEQ ID NO: 105806 - RNA, 64 nt, Homo Sapiens
uggaaauagucucaacgugcagugaaacagcguuaucgccuacuggauuuccugagaagauaac

SEQ ID NO: 105807 - RNA, 64 nt, Homo Sapiens
uccgccucacccaguacaucaggacgcagcgugcaucgccuacaacacguccacgugauugggg

SEQ ID NO: 105808 - RNA, 64 nt, Homo Sapiens
gaaguucucuaauagauguuacuuuugacaaaagaucgccuaugaguuacaagcaccaggggau

SEQ ID NO: 105809 - RNA, 64 nt, Homo Sapiens
aaacuuuccucuugcaaagcuugcaguuccccaaaucgccuaaucucugcugcuucuaccuuua

SEQ ID NO: 105810 - RNA, 64 nt, Homo Sapiens
cauggcagaggacugaacaccgucgccuugauguaucgccuauaccugccaucucugcaguggc

SEQ ID NO: 105811 - RNA, 64 nt, Homo Sapiens
cucacccuccccuccaucugcguugaugcucagaaucgccuaccugugccugcguguaaaccac

SEQ ID NO: 105812 - RNA, 64 nt, Homo Sapiens
cacacauuuacucugcauuguccccgucuuucccaucgccuagcguuuggggaggaacagggag

SEQ ID NO: 105813 - RNA, 64 nt, Homo Sapiens
gcaggggaggagggaggggcgccagcaccugaugaucgccuacugucugcggguucuuuuaccu

SEQ ID NO: 105814 - RNA, 64 nt, Homo Sapiens
caagccccuguaaaucagggaaaaugcgcaacugaucgccuaggagagggccucguaguggcac

SEQ ID NO: 105815 - RNA, 64 nt, Homo Sapiens
ccugaacguccucaaaugugacauuaacauucccaucgccuaccauuuucugcgcagauaugcu

SEQ ID NO: 105816 - RNA, 64 nt, Homo Sapiens
aagagaggugagaagugcucccaagcagacacaacagcagcacagaggucuggaggccacacaa

SEQ ID NO: 105817 - RNA, 64 nt, Homo Sapiens
ccgcccagauuccugcaguggagaggaggucuuccagcagcagcaggucuggagggcugagaau

SEQ ID NO: 105818 - RNA, 64 nt, Homo Sapiens
cccagauuccugcaguggagaggaggucuuccagcagcagcaggucuggagggcugagaaugaa

SEQ ID NO: 105819 - RNA, 64 nt, Homo Sapiens
ccccaaguccugguccucucagcccugggcccuucagcagcagcauggaggagggugcugaacc

SEQ ID NO: 105820 - RNA, 64 nt, Homo Sapiens
caaguccugguccucucagcccugggcccuucagcagcagcauggaggagggugcugaaccucg

SEQ ID NO: 105821 - RNA, 64 nt, Homo Sapiens
aaggaguaaaacauaguugcuccuaacuuuuuuccagcagcagcaagugguaauaaacaugaaa

SEQ ID NO: 105822 - RNA, 64 nt, Homo Sapiens
gaguaaaacauaguugcuccuaacuuuuuuccagcagcagcaagugguaauaaacaugaaaacu

SEQ ID NO: 105823 - RNA, 64 nt, Homo Sapiens
gccucagccagcaccacugccaccagggcaacugcagcagcaucucaugcauaacccuguggcu

SEQ ID NO: 105824 - RNA, 64 nt, Homo Sapiens
agccgaagcgaaaggggucagggugcugaggcaacagcagcaagggcuggucuggacaagaaaa

SEQ ID NO: 105825 - RNA, 64 nt, Homo Sapiens
cacgucgagcccccagacucugugcacuucagaccagcagcagcaggagggcucccgagggccu

SEQ ID NO: 105826 - RNA, 64 nt, Homo Sapiens
gucgagcccccagacucugugcacuucagaccagcagcagcaggagggcucccgagggccuuau

SEQ ID NO: 105827 - RNA, 64 nt, Homo Sapiens
ugggaccaagagcucucccgccuucucccucgagcagcagcaaggacccugacgcuguccccga

SEQ ID NO: 105828 - RNA, 64 nt, Homo Sapiens
aggccaaagcaagagcagauucccuaggcaagagcagcagcacaacuaggaaaccccaaagccc

SEQ ID NO: 105829 - RNA, 64 nt, Homo Sapiens
acucugugacaggguguccugggagguuucuaggcagcagcaaacuggccugguaaacccagcu

SEQ ID NO: 105830 - RNA, 64 nt, Homo Sapiens
cacccacccucucacugacuucccacccuccucccagcagcagagggggcccagcagagccugc

SEQ ID NO: 105831 - RNA, 64 nt, Homo Sapiens
caugaaccuugggucugggaugcccucugcacaccagcagcaggauccgcccagaccccucucc

SEQ ID NO: 105832 - RNA, 64 nt, Homo Sapiens
gaccucuccacuuucccuuaagcagcagcagcagcagcagcagagugguagcagcaacagcagc

SEQ ID NO: 105833 - RNA, 64 nt, Homo Sapiens
agagaccucuccacuuucccagcagcagcagcagcagcagcagcgcagugguagcagcaacagc

SEQ ID NO: 105834 - RNA, 64 nt, Homo Sapiens
agcagagaccucuccacuuuagcagcagcagcagcagcagcagcguggcagugguagcagcaac

SEQ ID NO: 105835 - RNA, 64 nt, Homo Sapiens
agcagcagagaccucuccacaacagcagcagcagcagcagcagcuugguggcagugguagcagc

SEQ ID NO: 105836 - RNA, 64 nt, Homo Sapiens
agcagcagcagagaccucucagcaacagcagcagcagcagcagccucuugguggcagugguagc

SEQ ID NO: 105837 - RNA, 64 nt, Homo Sapiens
agcagcagcagcagagaccuagcagcaacagcagcagcagcagccugcucuugguggcaguggu

SEQ ID NO: 105838 - RNA, 64 nt, Homo Sapiens
agcagcagcagcagcagagagguagcagcaacagcagcagcagcucccugcucuugguggcagu

SEQ ID NO: 105839 - RNA, 64 nt, Homo Sapiens
agcagcagcagcagcagcagagugguagcagcaacagcagcagcgucucccugcucuugguggc

SEQ ID NO: 105840 - RNA, 64 nt, Homo Sapiens
ccaagaaggaaagagcuggaguaagaggaagaggcagcagcauccacuggcucaagcagcagag

SEQ ID NO: 105841 - RNA, 64 nt, Homo Sapiens
aagaggaggaggacaucuuggcaagaagaaaagacagcagcaucugauggaagaagcaggaaaa

SEQ ID NO: 105842 - RNA, 64 nt, Homo Sapiens
cuuugaucaggagugagauuagcagcagcagcagcagcagcaaccacacacauauagcaguagc

SEQ ID NO: 105843 - RNA, 64 nt, Homo Sapiens
aaccuuugaucaggagugagagcagcagcagcagcagcagcagcacacacacacauauagcagu

SEQ ID NO: 105844 - RNA, 64 nt, Homo Sapiens
agcaaccuuugaucaggaguaguagcagcagcagcagcagcagccauacacacacacauauagc

SEQ ID NO: 105845 - RNA, 64 nt, Homo Sapiens
agcagcaaccuuugaucaggagcaguagcagcagcagcagcagcgcacauacacacacacauau

SEQ ID NO: 105846 - RNA, 64 nt, Homo Sapiens
agcagcagcaaccuuugaucuauagcaguagcagcagcagcagccacgcacauacacacacaca

SEQ ID NO: 105847 - RNA, 64 nt, Homo Sapiens
agcagcagcagcaaccuuugacauauagcaguagcagcagcagcgcgcacgcacauacacacac

SEQ ID NO: 105848 - RNA, 64 nt, Homo Sapiens
aggcgaacucaucucuacccagccacuucagcagcagcagcaaaaccagagcuuuaacauuuga

SEQ ID NO: 105849 - RNA, 64 nt, Homo Sapiens
aaaaggcgaacucaucucuaugaagccacuucagcagcagcagcggcaccagagcuuuaacauu

SEQ ID NO: 105850 - RNA, 64 nt, Homo Sapiens
agcaaaaggcgaacucaucuauuugaagccacuucagcagcagccugggcaccagagcuuuaac

SEQ ID NO: 105851 - RNA, 64 nt, Homo Sapiens
ugagcagcggcuggucucuucccuccaccuggggcagcagcaggaggccuggggaggaggaaaa

SEQ ID NO: 105852 - RNA, 64 nt, Homo Sapiens
cacugcugucuucccuaccucaccaggcuacuggcagcagcaucccgagagcacaucaucucca

SEQ ID NO: 105853 - RNA, 64 nt, Homo Sapiens
aaauacugucccacucagcucugcuggcgcaguacagcagcagcagccccagcacagcuguguu

SEQ ID NO: 105854 - RNA, 64 nt, Homo Sapiens
uacugucccacucagcucugcuggcgcaguacagcagcagcagccccagcacagcuguguuccu

SEQ ID NO: 105855 - RNA, 64 nt, Homo Sapiens
ccagaagcacccagcccugcccagcaaccggccccagcagcagguccuggugcuggcggagccc

SEQ ID NO: 105856 - RNA, 64 nt, Homo Sapiens
gggccuggcgagcuggcguggagcccacaggauucagcagcauggacagucacucuugcacuau

SEQ ID NO: 105857 - RNA, 64 nt, Homo Sapiens
aauaguaggauauagaucacuccaugcucagcagcagcagcagauguuucaaccccacauguau

SEQ ID NO: 105858 - RNA, 64 nt, Homo Sapiens
agaaauaguaggauauagauuauuccaugcucagcagcagcagccccuguuucaaccccacaug

SEQ ID NO: 105859 - RNA, 64 nt, Homo Sapiens
agcagaaauaguaggauauaauguauuccaugcucagcagcagccuccccuguuucaaccccac

SEQ ID NO: 105860 - RNA, 64 nt, Homo Sapiens
uaagccuugcaaacaaaaaacaacaaaaaagaagcagcagcagcagccugcuguguggcaucug

SEQ ID NO: 105861 - RNA, 64 nt, Homo Sapiens
gccuugcaaacaaaaaacaacaaaaaagaagcagcagcagcagccugcuguguggcaucugaac

SEQ ID NO: 105862 - RNA, 64 nt, Homo Sapiens
cuuuagggaguccccucuuaggacaggcacugcccagcagcaagggcagcagaguugggugcua

SEQ ID NO: 105863 - RNA, 64 nt, Homo Sapiens
caagaagggacuugccuaaagccacccagcaacucagcagcagaaccaagaugggccccaggcu

SEQ ID NO: 105864 - RNA, 64 nt, Homo Sapiens
gaagggagaacauaucuauccucucagacccucgcagcagcagcaacucauacuuggcuaauga

SEQ ID NO: 105865 - RNA, 64 nt, Homo Sapiens
gggagaacauaucuauccucucagacccucgcagcagcagcaacucauacuuggcuaaugauau

SEQ ID NO: 105866 - RNA, 64 nt, Homo Sapiens
ugaguccaugaaugcuauggugaguuguguguggcagcagcauuuagaaaaauauuccagcacu

SEQ ID NO: 105867 - RNA, 64 nt, Homo Sapiens
ccuguggugcaguuacugccaggacguguggagacagcagcaguuggacagcccagacccugaa

SEQ ID NO: 105868 - RNA, 64 nt, Homo Sapiens
uucuuauucugugagauguuuuguauuauuucaccagcagcauagaacaggaccucugcuuuug

SEQ ID NO: 105869 - RNA, 64 nt, Homo Sapiens
cugaggccacccacugacccaacugauccugcuccagcagcacaccucagccccacugacaccc

SEQ ID NO: 105870 - RNA, 64 nt, Homo Sapiens
cuccccacaucugaaacugccuccccccaaccaccagcagcagcagggcccuccucccccacca

SEQ ID NO: 105871 - RNA, 64 nt, Homo Sapiens
cccacaucugaaacugccuccccccaaccaccagcagcagcagggcccuccucccccaccagcu

SEQ ID NO: 105872 - RNA, 64 nt, Homo Sapiens
gaaagaucgcucugcucggggagccugggcagagcagcagcaacgugagggucgcugugguggu

SEQ ID NO: 105873 - RNA, 64 nt, Homo Sapiens
gauagaggcgcuguaggagccuggucaucucuaccagcagcagcagcagcgagguucuagccca

SEQ ID NO: 105874 - RNA, 64 nt, Homo Sapiens
agaggcgcuguaggagccuggucaucucuaccagcagcagcagcagcgagguucuagcccagga

SEQ ID NO: 105875 - RNA, 64 nt, Homo Sapiens
ggcgcuguaggagccuggucaucucuaccagcagcagcagcagcgagguucuagcccaggaggg

SEQ ID NO: 105876 - RNA, 64 nt, Homo Sapiens
gagagggccuugggaaagaccagcagcagcucagcagcagcaguggcugugcaccacugggacc

SEQ ID NO: 105877 - RNA, 64 nt, Homo Sapiens
agugagagggccuugggaaaacccagcagcagcucagcagcagcgaaggcugugcaccacuggg

SEQ ID NO: 105878 - RNA, 64 nt, Homo Sapiens
ucagcagcagcagugagagggcaccacugggacccagcagcagcaucacaacaaggaaggcugu

SEQ ID NO: 105879 - RNA, 64 nt, Homo Sapiens
ugggugcucacugccucugcaggugcagaggggucagcagcaggagaagcguguugaacacgug

SEQ ID NO: 105880 - RNA, 64 nt, Homo Sapiens
aacccguuacauuucaggacgauccuuuuuccuucagcagcauuucuuacuggcuguggcugga

SEQ ID NO: 105881 - RNA, 64 nt, Homo Sapiens
gcguccuaccaagaccccagcccaacucaagcuacagcagcagcacuucccaagccugcugacc

SEQ ID NO: 105882 - RNA, 64 nt, Homo Sapiens
uccuaccaagaccccagcccaacucaagcuacagcagcagcacuucccaagccugcugaccaca

SEQ ID NO: 105883 - RNA, 64 nt, Homo Sapiens
ugcuggccuuguuagacagcacuugggccuuugccagcagcaagaggugaagcgaagccacucu

SEQ ID NO: 105884 - RNA, 64 nt, Homo Sapiens
gccccucccagcgcugagagccuccccuggcugucagcagcacuguguccaggcucuugucuga

SEQ ID NO: 105885 - RNA, 64 nt, Homo Sapiens
ucuccacugacagccgccucuggguugaauuccgcagcagcagcaauuggguuggaaagggcuu

SEQ ID NO: 105886 - RNA, 64 nt, Homo Sapiens
ccacugacagccgccucuggguugaauuccgcagcagcagcaauuggguuggaaagggcuucuu

SEQ ID NO: 105887 - RNA, 64 nt, Homo Sapiens
aacauugcugccuuuguccccccagcagcagcagcagcagcacaccaagagcaauugcagcaga

SEQ ID NO: 105888 - RNA, 64 nt, Homo Sapiens
acaaacauugcugccuuuguagacccagcagcagcagcagcagcggaccaagagcaauugcagc

SEQ ID NO: 105889 - RNA, 64 nt, Homo Sapiens
agcacaaacauugcugccuuagcagacccagcagcagcagcagccaaggaccaagagcaauugc

SEQ ID NO: 105890 - RNA, 64 nt, Homo Sapiens
agcagcacaaacauugcugcugcagcagacccagcagcagcagcgcucaaggaccaagagcaau

SEQ ID NO: 105891 - RNA, 64 nt, Homo Sapiens
agcagcagcacaaacauugcaauugcagcagacccagcagcagcgcugcucaaggaccaagagc

SEQ ID NO: 105892 - RNA, 64 nt, Homo Sapiens
uugucucaaaccagucagggccgucaugacuacgcagcagcagcaguuuccaagacgggccaga

SEQ ID NO: 105893 - RNA, 64 nt, Homo Sapiens
ucucaaaccagucagggccgucaugacuacgcagcagcagcaguuuccaagacgggccagaaac

SEQ ID NO: 105894 - RNA, 64 nt, Homo Sapiens
gcucagccagucacagcuccaccuccaacuucuacagcagcaauuuuuagugggaaagaacagc

SEQ ID NO: 105895 - RNA, 64 nt, Homo Sapiens
cugaugcuaaagaagacagacuuucccuuccucccagcagcagcagugcagagcccaccuggag

SEQ ID NO: 105896 - RNA, 64 nt, Homo Sapiens
augcuaaagaagacagacuuucccuuccucccagcagcagcagugcagagcccaccuggaggga

SEQ ID NO: 105897 - RNA, 64 nt, Homo Sapiens
agacuacuccaaagguggcuccugacccaggggacagcagcagggccacgcuagguuaugacga

SEQ ID NO: 105898 - RNA, 64 nt, Homo Sapiens
agcagggccgcgcccuuggucccgcgagugcauccagcagcagugccucugucugggugggacc

SEQ ID NO: 105899 - RNA, 64 nt, Homo Sapiens
guggccaucuccaucccccaugcagggcuugcagcagcagcaguuguuucuccugucccuccua

SEQ ID NO: 105900 - RNA, 64 nt, Homo Sapiens
aguguggccaucuccauccccuaugcagggcuugcagcagcagcugcuguuucuccugucccuc

SEQ ID NO: 105901 - RNA, 64 nt, Homo Sapiens
ggcugacagcaggcuuacugcaggaugcagcaagcagcagcagguaccuggccaaaacacuggc

SEQ ID NO: 105902 - RNA, 64 nt, Homo Sapiens
uccucucaagcucacucucuccucgccuaaagugcagcagcagcuaaaggucaagucugcucuc

SEQ ID NO: 105903 - RNA, 64 nt, Homo Sapiens
gcauagccccggccccccgcacccccugcuccaccagcagcauggcaucgggagcacccagagc

SEQ ID NO: 105904 - RNA, 64 nt, Homo Sapiens
aaccacagcaucgggagcacgccuccucggagagcagcagcaccugguggcgguggcugccccg

SEQ ID NO: 105905 - RNA, 64 nt, Homo Sapiens
cagaaccgugucuguggucgcaggccucucacuccagcagcaggcaugcugcagccucagaaac

SEQ ID NO: 105906 - RNA, 64 nt, Homo Sapiens
cucugucaucccgucgccccugcccgccugagagcagcagcaguggcgccaucagggccucccu

SEQ ID NO: 105907 - RNA, 64 nt, Homo Sapiens
cugcaagccagccuggccagagggguagccccagcagcagcaccaagggcuagugagaccacac

SEQ ID NO: 105908 - RNA, 64 nt, Homo Sapiens
acccugcaagccagccuggccacagggguagccccagcagcagcgggaagggcuagugagacca

SEQ ID NO: 105909 - RNA, 64 nt, Homo Sapiens
ucuaccuucuccccagcuccgccuggaccucugacagcagcaucaccugccccacuuguccuua

SEQ ID NO: 105910 - RNA, 64 nt, Homo Sapiens
ugcccuaccugccccacuuguuuccauccauggccagcagcaccggucuuggaacuugccugcc

SEQ ID NO: 105911 - RNA, 64 nt, Homo Sapiens
ugcuacugcaacaaccgcuaacacacaacaacagcagcagcagcaccugcuuacucagauacuu

SEQ ID NO: 105912 - RNA, 64 nt, Homo Sapiens
agcugcuacugcaacaaccgcuuacacacaacaacagcagcagcgguaccugcuuacucagaua

SEQ ID NO: 105913 - RNA, 64 nt, Homo Sapiens
gguucuuugucucacugaauucuuaucauggaaacagcagcagcagccgcuaggaaaucuucaa

SEQ ID NO: 105914 - RNA, 64 nt, Homo Sapiens
ucuuugucucacugaauucuuaucauggaaacagcagcagcagccgcuaggaaaucuucaagug

SEQ ID NO: 105915 - RNA, 64 nt, Homo Sapiens
ccaagaagcccugcccuccagccacagcaguccacagcagcaggguuaagacucagcacagggc

SEQ ID NO: 105916 - RNA, 64 nt, Homo Sapiens
uccacagcagcaggguuaagacucagcacagggccagcagcagcacaaccuugaccagagcuug

SEQ ID NO: 105917 - RNA, 64 nt, Homo Sapiens
acagcagcaggguuaagacucagcacagggccagcagcagcacaaccuugaccagagcuugggu

SEQ ID NO: 105918 - RNA, 64 nt, Homo Sapiens
cuacgcuaauaggaccacugucccaggccagcagcagcagcagcaccacccagguaugggcagc

SEQ ID NO: 105919 - RNA, 64 nt, Homo Sapiens
agccuacgcuaauaggaccaagcucccaggccagcagcagcagccagaccacccagguaugggc

SEQ ID NO: 105920 - RNA, 64 nt, Homo Sapiens
agcagccuacgcuaauaggaggcagcucccaggccagcagcagcguccagaccacccagguaug

SEQ ID NO: 105921 - RNA, 64 nt, Homo Sapiens
ugauuggaccaggccauucuagccccacugccagcagcagcaggaccuagaacacuaacucacc

SEQ ID NO: 105922 - RNA, 64 nt, Homo Sapiens
aggugauuggaccaggccauaccagccccacugccagcagcagccccaccuagaacacuaacuc

SEQ ID NO: 105923 - RNA, 64 nt, Homo Sapiens
acugcccugaugacgcagcagucacccuacuuuucagcagcaaaaaguucuaccagagcagaca

SEQ ID NO: 105924 - RNA, 64 nt, Homo Sapiens
cagaagcagcugcaguguuguccggagagcaccccagcagcaucagugcgcuguucacacccgc

SEQ ID NO: 105925 - RNA, 64 nt, Homo Sapiens
cuaaacagaaucagugacccgggugcuuuguggccagcagcacagaaucaaacccgcaucccag

SEQ ID NO: 105926 - RNA, 64 nt, Homo Sapiens
aacucacagcuccuccgggauacauaugugcccucagcagcagcucccaggugaaguuaccaga

SEQ ID NO: 105927 - RNA, 64 nt, Homo Sapiens
uacaggaguuuaaaacguauagccuacaaaguaccagcagcaaauuagcaaagaagcagugaaa

SEQ ID NO: 105928 - RNA, 64 nt, Homo Sapiens
aacuuuuaguuacuaaauuauagcuaaguuuugucagcagcauacuccggaaagucucauacuu

SEQ ID NO: 105929 - RNA, 64 nt, Homo Sapiens
gccgcuccacaucuuugcucgaggccugggccagcagcagcauuacgacaccauccugacauga

SEQ ID NO: 105930 - RNA, 61 nt, Homo Sapiens
auugccgcuccacaucuuuggaggccugggccagcagcagcacgacaccauccugacauga

SEQ ID NO: 105931 - RNA, 64 nt, Homo Sapiens
uggaauuccaaggccaagucggcuuccuaaaaagcagcagcagcgcagauugaagaccagcagg

SEQ ID NO: 105932 - RNA, 64 nt, Homo Sapiens
ugcuccuuagccaaauaugggagaggcagcuucucagcagcaggccuuccagguuccuggcagu

SEQ ID NO: 105933 - RNA, 64 nt, Homo Sapiens
aaaaaaaaaaaagucuaccaaaggaauuugcauccagcagcagcacuuagaccugccagccacu

SEQ ID NO: 105934 - RNA, 64 nt, Homo Sapiens
aaaaaaaaagucuaccaaaggaauuugcauccagcagcagcacuuagaccugccagccacuguc

SEQ ID NO: 105935 - RNA, 64 nt, Homo Sapiens
gggaaaggggcuugccugaggucacguagauaaucagcagcacauugaacgcugcacuccuggg

SEQ ID NO: 105936 - RNA, 64 nt, Homo Sapiens
acugccauucaugcauugucagauauuuauuaaacagcagcaaagugccagccaauuuguccug

SEQ ID NO: 105937 - RNA, 64 nt, Homo Sapiens
ccaguguucgcugugggaucaccuucuggcccuccagcagcaugauggcacgcugucgcccaaa

SEQ ID NO: 105938 - RNA, 64 nt, Homo Sapiens
agccgauggggccccccaggcccaggcgaaagggcagcagcauguggcccauggcaccaccccc

SEQ ID NO: 105939 - RNA, 64 nt, Homo Sapiens
uugcagauugucugcagaaacucagacagcucaucagcagcagcagcuguauuguauuuuaccu

SEQ ID NO: 105940 - RNA, 64 nt, Homo Sapiens
cagauugucugcagaaacucagacagcucaucagcagcagcagcuguauuguauuuuaccucau

SEQ ID NO: 105941 - RNA, 64 nt, Homo Sapiens
ggaaaccagcacacgcaaaagaugacgcccagcacagcagcaggacacaccaugugccaggaaa

SEQ ID NO: 105942 - RNA, 64 nt, Homo Sapiens
aaaaccuauacaacaauaagaggagugcgcccuucagcagcauguauacaaaaauugcaacgau

SEQ ID NO: 105943 - RNA, 64 nt, Homo Sapiens
uaccagcacggcccugacugugagcagagagcagcagcagcaggggauguucacuguaugccuc

SEQ ID NO: 105944 - RNA, 64 nt, Homo Sapiens
agguaccagcacggcccugacucugagcagagagcagcagcagcaagggauguucacuguaugc

SEQ ID NO: 105945 - RNA, 64 nt, Homo Sapiens
ggugacucgugagugguaccaacaaacucaugagcagcagcaacaacugaauguccugguccug

SEQ ID NO: 105946 - RNA, 64 nt, Homo Sapiens
agcagcaacaacugaauguccugguccuggcuagcagcagcaccguggugaugcaggaugaguc

SEQ ID NO: 105947 - RNA, 64 nt, Homo Sapiens
gacaaauaagggaauaaaaucuggccaccccagccagcagcagcaaccuguucaggucgccugc

SEQ ID NO: 105948 - RNA, 64 nt, Homo Sapiens
aaauaagggaauaaaaucuggccaccccagccagcagcagcaaccuguucaggucgccugccgc

SEQ ID NO: 105949 - RNA, 64 nt, Homo Sapiens
uauagcaguuguauuguguaacaaguacugcucccagcagcaauuagggagaaaacuagucuaa

SEQ ID NO: 105950 - RNA, 64 nt, Homo Sapiens
ggcugcuuguaggacuguucaccaagggggauaccagcagcaagagagugcacccguuuagccc

SEQ ID NO: 105951 - RNA, 64 nt, Homo Sapiens
gcgguagccuccgcagaggcugggggccuccacccagcagcagaccaaccaggaagcagcuuga

SEQ ID NO: 105952 - RNA, 64 nt, Homo Sapiens
guucugcaccccaagcccuugccccagcccaguccagcagcagauguuacaaucugagugagga

SEQ ID NO: 105953 - RNA, 64 nt, Homo Sapiens
cggccccuguaggccaaggcgccaggcaggacgacagcagcagcagcgcgucuccuucaggugg

SEQ ID NO: 105954 - RNA, 64 nt, Homo Sapiens
ccccuguaggccaaggcgccaggcaggacgacagcagcagcagcgcgucuccuucaggugggag

SEQ ID NO: 105955 - RNA, 61 nt, Homo Sapiens
ccaacucggagcccgccugagcuccagugcccagcagcagcaugucagcugagccuccugc

SEQ ID NO: 105956 - RNA, 64 nt, Homo Sapiens
ccaacucggagcccgccugagcuccagugcccagcagcagcaugucagcugagccuccugcccu

SEQ ID NO: 105957 - RNA, 64 nt, Homo Sapiens
cgaugccgcccuuggcuacacagcuucagugagacagcagcagcuuuuggucccacagaggcau

SEQ ID NO: 105958 - RNA, 64 nt, Homo Sapiens
gaugucuaccagccaccucucgagcacgaagaaacagcagcaggcagaccccuaugccuuguuc

SEQ ID NO: 105959 - RNA, 64 nt, Homo Sapiens
augaaaggugugucuaaaaaacaauucagaauaccagcagcauuguacagcaagggguaaauaa

SEQ ID NO: 105960 - RNA, 64 nt, Homo Sapiens
gacgucggccauuuaguaauuuaaagcgaauuuccagcagcaagcaugcuuugauaucugguuc

SEQ ID NO: 105961 - RNA, 64 nt, Homo Sapiens
cuagaaaggagauggggcuuagaggaaucaaagccagcagcaucgaauguuaaggacagcaggu

SEQ ID NO: 105962 - RNA, 64 nt, Homo Sapiens
uguccagcgcggagcagcugcagaagagcugaaucagcagcaacaauggugucuguguuucaga

SEQ ID NO: 105963 - RNA, 64 nt, Homo Sapiens
gucaccuuguagccuaugcgaggacgagguaacucagcagcaauccugcaccagggaggagugg

SEQ ID NO: 105964 - RNA, 64 nt, Homo Sapiens
auggugaaguaguaaacuggcugaggaagagcagcagcagcagggcagcacagucucuauggug

SEQ ID NO: 105965 - RNA, 64 nt, Homo Sapiens
aggauggugaaguaguaaacgugcugaggaagagcagcagcagcccagcagcacagucucuaug

SEQ ID NO: 105966 - RNA, 64 nt, Homo Sapiens
gucucuauggugcugaggaagccagcagcccagccagcagcacauggccccaagguugccccgg

SEQ ID NO: 105967 - RNA, 64 nt, Homo Sapiens
gugcugggagcagagguuggcagcagcauguggccagcagcaguagccuugagcuaaguucagg

SEQ ID NO: 105968 - RNA, 64 nt, Homo Sapiens
uggccagcagcagugugcuggagcuaaguucaggcagcagcaugaggaagugauggagagccuu

SEQ ID NO: 105969 - RNA, 64 nt, Homo Sapiens
ccuccagcccggucucacccaugguccagucucccagcagcagcaacauccccacgcagccccc

SEQ ID NO: 105970 - RNA, 64 nt, Homo Sapiens
ccagcccggucucacccaugguccagucucccagcagcagcaacauccccacgcagccccccag

SEQ ID NO: 105971 - RNA, 64 nt, Homo Sapiens
aggcagacgggagcagguucuuggccagcguagacagcagcaaacagcagcagggaagccauuc

SEQ ID NO: 105972 - RNA, 64 nt, Homo Sapiens
gagcagguucuuggccagcguagacagcagcaaacagcagcagggaagccauucucacugcauc

SEQ ID NO: 105973 - RNA, 59 nt, Homo Sapiens
uuaucaucguccaaguuuagcaaucccaucagcagcaguaagaggaaugucucccuccu

SEQ ID NO: 105974 - RNA, 64 nt, Homo Sapiens
ggccugauuuuaagccuuuugccgcuccggggaccagcagcaauccugggcagccaguggcucu

SEQ ID NO: 105975 - RNA, 64 nt, Homo Sapiens
cgguggccaggccgggccggagcagcagcagcagcagcagcaggggggcccccgcagcagcagc

SEQ ID NO: 105976 - RNA, 64 nt, Homo Sapiens
agcagcaggcgguggccaggagcagcagcagcagcagcagcagccucggggcccccgcagcagc

SEQ ID NO: 105977 - RNA, 64 nt, Homo Sapiens
agcagcagcaggcgguggccagcagcagcagcagcagcagcagccggcucggggcccccgcagc

SEQ ID NO: 105978 - RNA, 64 nt, Homo Sapiens
agcagcagcagcaggcggugagcagcagcagcagcagcagcagccggcggcucggggcccccgc

SEQ ID NO: 105979 - RNA, 64 nt, Homo Sapiens
agcagcagcagcagcaggcgcgcagcagcagcagcagcagcagcggccggcggcucggggcccc

SEQ ID NO: 105980 - RNA, 64 nt, Homo Sapiens
agcagcagcagcagcagcagccccgcagcagcagcagcagcagcuaaggccggcggcucggggc

SEQ ID NO: 105981 - RNA, 64 nt, Homo Sapiens
agcagcagcagcagcagcagggcccccgcagcagcagcagcagcccguaaggccggcggcucgg

SEQ ID NO: 105982 - RNA, 64 nt, Homo Sapiens
agcagcagcagcagcagcagcggggcccccgcagcagcagcagcgauccguaaggccggcggcu

SEQ ID NO: 105983 - RNA, 64 nt, Homo Sapiens
agcagcagcagcagcagcaggcucggggcccccgcagcagcagcugugauccguaaggccggcg

SEQ ID NO: 105984 - RNA, 64 nt, Homo Sapiens
guuaagaugugacugccaucaucuucgugguggccagcagcagcuacaacauggucauccggga

SEQ ID NO: 105985 - RNA, 64 nt, Homo Sapiens
aguucccucucacuuucaguaaaaauaaauaaaacagcagcagcaaacaaauaaaaugaaauaa

SEQ ID NO: 105986 - RNA, 64 nt, Homo Sapiens
ucccucucacuuucaguaaaaauaaauaaaacagcagcagcaaacaaauaaaaugaaauaaaag

SEQ ID NO: 105987 - RNA, 64 nt, Homo Sapiens
uugugaucuguccuuccaacggcagcagcagcagcagcagcaguacucuaaaacuaucagcagc

SEQ ID NO: 105988 - RNA, 64 nt, Homo Sapiens
aguuugugaucuguccuuccagcggcagcagcagcagcagcagcuagacucuaaaacuaucagc

SEQ ID NO: 105989 - RNA, 64 nt, Homo Sapiens
agcaguuugugaucuguccuagcagcggcagcagcagcagcagcaccuagacucuaaaacuauc

SEQ ID NO: 105990 - RNA, 64 nt, Homo Sapiens
agcagcaguuugugaucuguaucagcagcggcagcagcagcagcgacaccuagacucuaaaacu

SEQ ID NO: 105991 - RNA, 64 nt, Homo Sapiens
agcagcagcaguuugugaucacuaucagcagcggcagcagcagcucagacaccuagacucuaaa

SEQ ID NO: 105992 - RNA, 64 nt, Homo Sapiens
uaagaucaaggaugcguuccuugggaaaguaggucagcagcaccgaauuuuaaaacauuuugcu

SEQ ID NO: 105993 - RNA, 64 nt, Homo Sapiens
aguugacugcucgugugccauguuuggccugccucagcagcaccagcuugaauuauaaaugugg

SEQ ID NO: 105994 - RNA, 64 nt, Homo Sapiens
uggcugugcugcaagcugacuccagccuugggcucagcagcacccggugaacagcagcaggagg

SEQ ID NO: 105995 - RNA, 64 nt, Homo Sapiens
cucuaccucgcagggcucagcagcacccggugaacagcagcaggaggagccgcuagagcagcug

SEQ ID NO: 105996 - RNA, 64 nt, Homo Sapiens
ugcaagcuugcuuuagggcugagcccuggacucccagcagcagcacaguucagcauuguguggc

SEQ ID NO: 105997 - RNA, 64 nt, Homo Sapiens
aagcuugcuuuagggcugagcccuggacucccagcagcagcacaguucagcauuguguggcugg

SEQ ID NO: 105998 - RNA, 64 nt, Homo Sapiens
uccaagaagcgggucccugaagcgacagcagcaacagcagcagauguucagagcuggcaauggc

SEQ ID NO: 105999 - RNA, 64 nt, Homo Sapiens
agcagcagauccaagaagcgggcaauggcagcgacagcagcaaccccaggggcuguucagagcu

SEQ ID NO: 106000 - RNA, 64 nt, Homo Sapiens
aucaagggaugacccuccucucaaguguacacagcagcagcaaaugaggaccucaaggacccca

SEQ ID NO: 106001 - RNA, 64 nt, Homo Sapiens
aaaaucaagggaugacccucccaucaaguguacacagcagcagcuggugaggaccucaaggacc

SEQ ID NO: 106002 - RNA, 64 nt, Homo Sapiens
gcagggggaggggugacagggcgagcccccaccccagcagcagcaauacccccacccuccugcc

SEQ ID NO: 106003 - RNA, 64 nt, Homo Sapiens
gggggaggggugacagggcgagcccccaccccagcagcagcaauacccccacccuccugcccug

SEQ ID NO: 106004 - RNA, 64 nt, Homo Sapiens
ugaccccacccauuccaaggcggggucacgguaccagcagcacuuggggugaggccuccaaagc

SEQ ID NO: 106005 - RNA, 64 nt, Homo Sapiens
agcgacuagaguuuuuccugggggaaagcagcagcagcagcagggccccuugccaagggaguug

SEQ ID NO: 106006 - RNA, 64 nt, Homo Sapiens
aggagcgacuagaguuuuucuugggggaaagcagcagcagcagccaagccccuugccaagggag

SEQ ID NO: 106007 - RNA, 64 nt, Homo Sapiens
agcaggagcgacuagaguuugaguugggggaaagcagcagcagcguccaagccccuugccaagg

SEQ ID NO: 106008 - RNA, 64 nt, Homo Sapiens
ggccggcucccccagacucagagggcagcaggagcagcagcagcagcagcagcagcaacaacaa

SEQ ID NO: 106009 - RNA, 64 nt, Homo Sapiens
cggcucccccagacucagagggcagcaggagcagcagcagcagcagcagcagcaacaacaacaa

SEQ ID NO: 106010 - RNA, 64 nt, Homo Sapiens
cucccccagacucagagggcagcaggagcagcagcagcagcagcagcagcaacaacaacaacua

SEQ ID NO: 106011 - RNA, 64 nt, Homo Sapiens
ccccagacucagagggcagcaggagcagcagcagcagcagcagcagcaacaacaacaacuacug

SEQ ID NO: 106012 - RNA, 64 nt, Homo Sapiens
cagacucagagggcagcaggagcagcagcagcagcagcagcagcaacaacaacaacuacugugc

SEQ ID NO: 106013 - RNA, 64 nt, Homo Sapiens
acucagagggcagcaggagcagcagcagcagcagcagcagcaacaacaacaacuacugugccuu

SEQ ID NO: 106014 - RNA, 64 nt, Homo Sapiens
uugcuuccuacaccacguccuugaguggaguucccugcugaagccccuagcacacacugcaugc

SEQ ID NO: 106015 - RNA, 64 nt, Homo Sapiens
gagcauuuacucugucucccuguggaugaaacugcugcugaaaugguuccaauuuuuaggaauc

SEQ ID NO: 106016 - RNA, 64 nt, Homo Sapiens
agggccucccccaggcccccgcuuccucacaucucugcugaagacuaggacgaggagcugggga

SEQ ID NO: 106017 - RNA, 64 nt, Homo Sapiens
gggagauggcgcaggguauggcaucucgcuggggcugcugaagcaagccccagcauccccguag

SEQ ID NO: 106018 - RNA, 64 nt, Homo Sapiens
uguagagaguauagccaaaagucucuuuaaaaugcugcugaaauucauuguacauagacacauu

SEQ ID NO: 106019 - RNA, 64 nt, Homo Sapiens
caaaguaagaacugaaugacauuuggcaguuaaucugcugaaacgccuggauacauucuucagc

SEQ ID NO: 106020 - RNA, 64 nt, Homo Sapiens
gugagugcaguauucuaaacauauaaucaaaguacugcugaacuuuugauuuuuugaaugagau

SEQ ID NO: 106021 - RNA, 64 nt, Homo Sapiens
ucuauaccucucugauuuacgaaauacaguuuagcugcugaauuagcagcagugcuauaggugg

SEQ ID NO: 106022 - RNA, 64 nt, Homo Sapiens
caggccccugcuguacagauguacauaggcuuuccugcugaaaaagaguaagagguucuuacuu

SEQ ID NO: 106023 - RNA, 64 nt, Homo Sapiens
uguggcagcaauuuuguguucuguauugugaaaacugcugaacacauuaaaaaguccagacaca

SEQ ID NO: 106024 - RNA, 64 nt, Homo Sapiens
cagacauuuuaauaccaugccagagaagaguauucugcugaaaccaacagguuuuacuggucaa

SEQ ID NO: 106025 - RNA, 64 nt, Homo Sapiens
ugcugaaaccaacagguuuuacuggucaaaaugacugcugaaaauaauuuucaaguugaaagau

SEQ ID NO: 106026 - RNA, 64 nt, Homo Sapiens
agaaaaaaaugauuguuuuauauuauauaacccacugcugaaaauauuuuuuaaauuuacagaa

SEQ ID NO: 106027 - RNA, 64 nt, Homo Sapiens
cagggcaugggauuaaagaggcuggggcugcaagcugcugaagcaaagaaucaacagccaaacu

SEQ ID NO: 106028 - RNA, 64 nt, Homo Sapiens
agcugggugcagugaaaugaccaaaggcaagaaacugcugaaaaaaagaaaaaggggcugcuuu

SEQ ID NO: 106029 - RNA, 64 nt, Homo Sapiens
cuaaacacucacauggcaagcuuacagcauuugccugcugaauagcaagcuugaagccccuugg

SEQ ID NO: 106030 - RNA, 64 nt, Homo Sapiens
cacacaugaaaagccaaauuauggcuuggauguucugcugaaacuggucuaugucauacugucu

SEQ ID NO: 106031 - RNA, 64 nt, Homo Sapiens
ccucgggauugguaucaaaggcuuccacugccuucugcugaaggcaugauguaugcggcuccac

SEQ ID NO: 106032 - RNA, 64 nt, Homo Sapiens
caguguauugacgcauauuuacugaauauggacccugcugaaaguccccccagguacgauaggg

SEQ ID NO: 106033 - RNA, 64 nt, Homo Sapiens
ugaccggcagaauguucugcgauguuaccuaaaacugcugaacuaguguguggcaguucucgca

SEQ ID NO: 106034 - RNA, 64 nt, Homo Sapiens
cuuauugucacaagaguacaguuaaugcugcgugcugcugaacucuguugggugaacugguauu

SEQ ID NO: 106035 - RNA, 64 nt, Homo Sapiens
ugguugucuucagcugacaguaugaaaaaugaaacugcugaaaaagcugagcaccuggucaccc

SEQ ID NO: 106036 - RNA, 64 nt, Homo Sapiens
auugguacuagcaacuuaaauuucauucauaucccugcugaaauaugagcuaaguuguuauuuc

SEQ ID NO: 106037 - RNA, 64 nt, Homo Sapiens
ugguacuuucugcacagccucugacuagaugccccugcugaaucuggggagcaaagagggcagc

SEQ ID NO: 106038 - RNA, 64 nt, Homo Sapiens
uguuuuuucucucacccuggcuuugucaagucuacugcugaacccauugaaggcauucuucaac

SEQ ID NO: 106039 - RNA, 64 nt, Homo Sapiens
auauuuccauuugauucuuacaauuuucauauaucugcugaaauuccccaucuuuucaugcaug

SEQ ID NO: 106040 - RNA, 64 nt, Homo Sapiens
uggugcuuuggauuugaaaagggucugauggggagaaggagaacguaucauccuagcuuccucu

SEQ ID NO: 106041 - RNA, 64 nt, Homo Sapiens
cugcuguucccuuugcucuugauuaggagagauggaaggagaugagcucccauaacugaauugg

SEQ ID NO: 106042 - RNA, 64 nt, Homo Sapiens
ccucacuccuuuuacucacugggcucaugacagugaaggagaugcuccaucugcuucucccccu

SEQ ID NO: 106043 - RNA, 64 nt, Homo Sapiens
cuaagcaaucauuuuuccccccagaaguuacuuagaaggagaacugggaacacuuggggucucu

SEQ ID NO: 106044 - RNA, 64 nt, Homo Sapiens
aauguaaaauaugcacugagccuggcuucucuuugaaggagaaacuguagcuccagcuugucuc

SEQ ID NO: 106045 - RNA, 64 nt, Homo Sapiens
ugagcaggaaaccaaggcucugaggcuuagcccagaaggagaaccuuugcagaggggcgggggg

SEQ ID NO: 106046 - RNA, 64 nt, Homo Sapiens
gauauuuuauuaauuuccuggaaggagaauagcugaaggagagagcccuuucugccguuaauaa

SEQ ID NO: 106047 - RNA, 64 nt, Homo Sapiens
agcugaaggagagagauauuucugccguuaauaagaaggagaaugcagcaaucaacaagcccuu

SEQ ID NO: 106048 - RNA, 64 nt, Homo Sapiens
uggagaagaggaagaauaacuccaucagcacaaugaaggagacucuggcccugccagcugguag

SEQ ID NO: 106049 - RNA, 64 nt, Homo Sapiens
agacugaggggcugugaccuuguugcaggcaggggaaggagaagggaaggcggggcaggcagcc

SEQ ID NO: 106050 - RNA, 64 nt, Homo Sapiens
uucuguagaauccaagcccaccaggggagccugcgaaggagaggaacuggaaagguccccuucc

SEQ ID NO: 106051 - RNA, 64 nt, Homo Sapiens
ccuuauuccaaagcacgauuaaucugggcuuagggaaggagagaugaggugucaaauacaaaua

SEQ ID NO: 106052 - RNA, 64 nt, Homo Sapiens
cagguuuucuguugcacaaggacgggucaggaaggaaggagaggcuuuuccagaaacaaaaaau

SEQ ID NO: 106053 - RNA, 64 nt, Homo Sapiens
uggguaagauuggccagagguaggaauguggggagaaggagaggcugaaaagaaagcagaggag

SEQ ID NO: 106054 - RNA, 64 nt, Homo Sapiens
cucugucucgaaagaaagaaagaaaaaaaggaaggaaggagaaggaaggaaggagaagaaaagg

SEQ ID NO: 106055 - RNA, 64 nt, Homo Sapiens
aaagaaagaaaaaaaggaaggaaggagaaggaaggaaggagaagaaaagguaccuguucuacgu

SEQ ID NO: 106056 - RNA, 64 nt, Homo Sapiens
aaaaagaaagaaagaaaagaagaagaaaagagaagaaggagaaggagaugaaggaggaggagga

SEQ ID NO: 106057 - RNA, 64 nt, Homo Sapiens
aaagaaagaaaagaagaagaaaagagaagaaggagaaggagaugaaggaggaggaggaggagaa

SEQ ID NO: 106058 - RNA, 64 nt, Homo Sapiens
agaaggagaaggagaugaaggaggaggaggaggagaaggagaagaagaagaagaagaagaccac

SEQ ID NO: 106059 - RNA, 64 nt, Homo Sapiens
auuacguccaccaaagacccguguuggggguacugaaggagaggcccugggggacccucugaag

SEQ ID NO: 106060 - RNA, 64 nt, Homo Sapiens
uuaugucaucugcuucuccccuguuggggcuaaggaaggagauagguggcuccuaaaagaggag

SEQ ID NO: 106061 - RNA, 64 nt, Homo Sapiens
ugggcugauggcugaguugugauuaguuuaguuugaaggagagguuuucugaaaaauacauuua

SEQ ID NO: 106062 - RNA, 64 nt, Homo Sapiens
uacucucagaugcauuauguucuuacuccaugcugaaggagaagauauucccucaaaucccucc

SEQ ID NO: 106063 - RNA, 64 nt, Homo Sapiens
ucucaaccaucccacuaaguuauagccaagaagggaaggagacacggggauuugggguucucug

SEQ ID NO: 106064 - RNA, 64 nt, Homo Sapiens
augcuuugggcuuucuccuucuguggccccggaggaaggagagacugaggcaaggcaaagugau

SEQ ID NO: 106065 - RNA, 64 nt, Homo Sapiens
aacccaguuagccaagauguuggaugcguugcuagaaggagaaauagaagaccuugaccugcug

SEQ ID NO: 106066 - RNA, 64 nt, Homo Sapiens
cauauuguuuggagacuuccagauggcucugcacgaaggagaaccacgcauuuaugaagacauc

SEQ ID NO: 106067 - RNA, 64 nt, Homo Sapiens
gugccccaaaaugcaagauuauaucauuauaacugaaggagaagaaauguaaaacuuuuaaggu

SEQ ID NO: 106068 - RNA, 64 nt, Homo Sapiens
caccucugccucaaugugaaaucagaaggagaaggaaggagacugcuuguaacuccaccaaccc

SEQ ID NO: 106069 - RNA, 64 nt, Homo Sapiens
gaaggagacucaccucugccccaccaacccaucagaaggagaaguccuucccuggcuuguaacu

SEQ ID NO: 106070 - RNA, 64 nt, Homo Sapiens
cccagccagccucuacccauugcaugagggugaggaaggagaagagccagaggggcagccaccu

SEQ ID NO: 106071 - RNA, 64 nt, Homo Sapiens
agggauggagaagcucugcugcauuucuggcagggaaggagaggucugggccacuugcuuaauu

SEQ ID NO: 106072 - RNA, 64 nt, Homo Sapiens
uugagcuccugggcaagaacaccuuugaguuccugaaggagaauaacuuccagccuuacccccu

SEQ ID NO: 106073 - RNA, 64 nt, Homo Sapiens
uuugggaugagaacagcucugacggccgguaugugaaggagaacugcaaaccucugaaggucag

SEQ ID NO: 106074 - RNA, 64 nt, Homo Sapiens
gguucuuucuggcugguuguagaguagcugucaggaaggagaaaaaacccaggagguagcuggc

SEQ ID NO: 106075 - RNA, 64 nt, Homo Sapiens
uugaucuucuggauguacagucuucaguacuauugaaggagacaccaguucugaggagaggagg

SEQ ID NO: 106076 - RNA, 64 nt, Homo Sapiens
cugaugugucugugauggugugucaaacacuguugaaggagaggugaccuggaaugggggccuu

SEQ ID NO: 106077 - RNA, 64 nt, Homo Sapiens
uugugcagcaggaaacgggugaaaagaugagagugaaggagacugcccugccugacgauguauc

SEQ ID NO: 106078 - RNA, 64 nt, Homo Sapiens
gugguuacuagccaggcauacuuggugaaguaaggaaggagaaacaggccacucucuucccuuu

SEQ ID NO: 106079 - RNA, 64 nt, Homo Sapiens
cuuaacaaaaaaaaauugaacagcucaucccagagaaggagauggccagacugugaccaggaaa

SEQ ID NO: 106080 - RNA, 64 nt, Homo Sapiens
aagaggcuggggguaaggccaggcuuugucugcagaaggagauccauaaaaccuagugagcuaa

SEQ ID NO: 106081 - RNA, 64 nt, Homo Sapiens
ugacccccaggggcugacauucuagggggagauagaaggagacaaacguagaagguagaauaag

SEQ ID NO: 106082 - RNA, 64 nt, Homo Sapiens
agggagugcugagugccacaggaagucagacaaggaaggagaguguggggcaggugccguuuaa

SEQ ID NO: 106083 - RNA, 64 nt, Homo Sapiens
accagcaaaggaagcucugccaggaggugacugggaaggagaaaaacuugcucugaacugcacc

SEQ ID NO: 106084 - RNA, 64 nt, Homo Sapiens
ggaugcuugucuggccaugauguccagauggcaggaaggagaacccacauccccugacgaagcu

SEQ ID NO: 106085 - RNA, 64 nt, Homo Sapiens
acugcaucauaacuuuacagaggugagaggagaggaaggagaaauugaaagcugugcucagagg

SEQ ID NO: 106086 - RNA, 64 nt, Homo Sapiens
uacuuucugucuuauuaaaaagacgaugagacuagaaggagaaaauauuuuuuccuuucaaauc

SEQ ID NO: 106087 - RNA, 64 nt, Homo Sapiens
ggaugaggucucgacccuguuugcccaggugagggaaggagacaugccccugugggacucaucc

SEQ ID NO: 106088 - RNA, 64 nt, Homo Sapiens
gcuggagaaggacaugagaugugcagguauuucagaaggagaaguuccccaaaggaaccgccca

SEQ ID NO: 106089 - RNA, 64 nt, Homo Sapiens; identical to SEQ ID NO: 82429

SEQ ID NO: 106090 - RNA, 64 nt, Homo Sapiens; identical to SEQ ID NO: 82430

SEQ ID NO: 106091 - RNA, 64 nt, Homo Sapiens; identical to SEQ ID NO: 82431

SEQ ID NO: 106092 - RNA, 64 nt, Homo Sapiens; identical to SEQ ID NO: 82432

SEQ ID NO: 106093 - RNA, 64 nt, Homo Sapiens; identical to SEQ ID NO: 82433

SEQ ID NO: 106094 - RNA, 64 nt, Homo Sapiens; identical to SEQ ID NO: 82434

SEQ ID NO: 106095 - RNA, 64 nt, Homo Sapiens; identical to SEQ ID NO: 82435

SEQ ID NO: 106096 - RNA, 64 nt, Homo Sapiens; identical to SEQ ID NO: 82436

SEQ ID NO: 106097 - RNA, 64 nt, Homo Sapiens; identical to SEQ ID NO: 82437

SEQ ID NO: 106098 - RNA, 64 nt, Homo Sapiens; identical to SEQ ID NO: 82438

SEQ ID NO: 106099 - RNA, 64 nt, Homo Sapiens; identical to SEQ ID NO: 82439

SEQ ID NO: 106100 - RNA, 64 nt, Homo Sapiens; identical to SEQ ID NO: 82440

SEQ ID NO: 106101 - RNA, 64 nt, Homo Sapiens; identical to SEQ ID NO: 82441

SEQ ID NO: 106102 - RNA, 64 nt, Homo Sapiens; identical to SEQ ID NO: 82442

SEQ ID NO: 106103 - RNA, 64 nt, Homo Sapiens; identical to SEQ ID NO: 82443

SEQ ID NO: 106104 - RNA, 64 nt, Homo Sapiens; identical to SEQ ID NO: 82444

SEQ ID NO: 106105 - RNA, 64 nt, Homo Sapiens; identical to SEQ ID NO: 82445

SEQ ID NO: 106106 - RNA, 64 nt, Homo Sapiens; identical to SEQ ID NO: 82446

SEQ ID NO: 106107 - RNA, 64 nt, Homo Sapiens; identical to SEQ ID NO: 82447

SEQ ID NO: 106108 - RNA, 64 nt, Homo Sapiens; identical to SEQ ID NO: 82448

SEQ ID NO: 106109 - RNA, 64 nt, Homo Sapiens; identical to SEQ ID NO: 82449

SEQ ID NO: 106110 - RNA, 64 nt, Homo Sapiens; identical to SEQ ID NO: 82450

SEQ ID NO: 106111 - RNA, 64 nt, Homo Sapiens; identical to SEQ ID NO: 82451

SEQ ID NO: 106112 - RNA, 64 nt, Homo Sapiens; identical to SEQ ID NO: 82452

SEQ ID NO: 106113 - RNA, 64 nt, Homo Sapiens; identical to SEQ ID NO: 82453

SEQ ID NO: 106114 - RNA, 64 nt, Homo Sapiens; identical to SEQ ID NO: 82454

SEQ ID NO: 106115 - RNA, 64 nt, Homo Sapiens; identical to SEQ ID NO: 82455

SEQ ID NO: 106116 - RNA, 64 nt, Homo Sapiens; identical to SEQ ID NO: 82456

SEQ ID NO: 106117 - RNA, 64 nt, Homo Sapiens; identical to SEQ ID NO: 82457

SEQ ID NO: 106118 - RNA, 64 nt, Homo Sapiens; identical to SEQ ID NO: 82458

SEQ ID NO: 106119 - RNA, 64 nt, Homo Sapiens; identical to SEQ ID NO: 82459

SEQ ID NO: 106120 - RNA, 64 nt, Homo Sapiens; identical to SEQ ID NO: 82460

SEQ ID NO: 106121 - RNA, 64 nt, Homo Sapiens; identical to SEQ ID NO: 82461

SEQ ID NO: 106122 - RNA, 64 nt, Homo Sapiens; identical to SEQ ID NO: 82462

SEQ ID NO: 106123 - RNA, 64 nt, Homo Sapiens; identical to SEQ ID NO: 82463

SEQ ID NO: 106124 - RNA, 64 nt, Homo Sapiens; identical to SEQ ID NO: 82464

SEQ ID NO: 106125 - RNA, 64 nt, Homo Sapiens
cagagaggaccccacuggacuggguuuugucucugcaucucauuguagagcuugguggcugagc

SEQ ID NO: 106126 - RNA, 64 nt, Homo Sapiens
ggaguugacgcauccugcaguugggccagcugucgcaucucagcggggcgcacauguuauccac

SEQ ID NO: 106127 - RNA, 64 nt, Homo Sapiens
ggcggggggcgucucagcacccuccccagggggugcaucucagcccccucuuuccguccuuccc

SEQ ID NO: 106128 - RNA, 64 nt, Homo Sapiens
ccccccugcugccagccucccccguccccaacaugcaucucacucugggugucuuggucuuuua

SEQ ID NO: 106129 - RNA, 64 nt, Homo Sapiens
aacaucaccuuagugaggaauaauauuggcaaaggcaucucaggaaaugacugcaguaaccagg

SEQ ID NO: 106130 - RNA, 64 nt, Homo Sapiens
uuuguucugagacaccugauugggaaguagucaugcaucucaggagauaacuuagaacagccua

SEQ ID NO: 106131 - RNA, 64 nt, Homo Sapiens
uaggagaacagagacccgagggcugcuuugggggaggggggaacucgagaauguauggauuuac

SEQ ID NO: 106132 - RNA, 64 nt, Homo Sapiens
aaaaaaggaacuaaguucagcgagggguggggggaggggggagauuuuucuuuugaaaaauaau

SEQ ID NO: 106133 - RNA, 64 nt, Homo Sapiens
gggaaagugaaaagcuccuuagcccuggggcuugaggggggaaagggguaggguggguaagagu

SEQ ID NO: 106134 - RNA, 64 nt, Homo Sapiens
cucuccaugacucuugacauccuagcuucuucuaaggggggagggaaaggggggagauuuuuau

SEQ ID NO: 106135 - RNA, 64 nt, Homo Sapiens
uugacauccuagcuucuucuaaggggggagggaaaggggggagauuuuuauauauauauacaua

SEQ ID NO: 106136 - RNA, 64 nt, Homo Sapiens
uggagggggccaccggggcagggagggggcggcaaggggggaaugggaguugucuccccuucuc

SEQ ID NO: 106137 - RNA, 64 nt, Homo Sapiens
uccuucucucuucuuggucucuacucccagggggaggggggaacuuacucuaggaaaagccaug

SEQ ID NO: 106138 - RNA, 64 nt, Homo Sapiens
ggagguugcuguacaggaaaaaccgagauaggggaggggggagggggaagcaaaggggggaggu

SEQ ID NO: 106139 - RNA, 64 nt, Homo Sapiens
aaaccgagauaggggaggggggagggggaagcaaaggggggaggucaaaucccaaaccauuacu

SEQ ID NO: 106140 - RNA, 64 nt, Homo Sapiens
gaggagaaggguuacuugcuauugaggaggggggaggggggaggaggauauccaaggccacuac

SEQ ID NO: 106141 - RNA, 64 nt, Homo Sapiens
ggggagggaggagaaggguuccacuacauugaggaggggggaggaacaaacaggauauccaagg

SEQ ID NO: 106142 - RNA, 64 nt, Homo Sapiens
caaaauaaaaacaauaauucaaguaacaaugcccggaauauacguccuaacuacaccccuuccu

SEQ ID NO: 106143 - RNA, 64 nt, Homo Sapiens
aaacaguggcagcagauuuuaaguuaaagaauauggaauauaguaaaauaaguaaauuucuuuu

SEQ ID NO: 106144 - RNA, 55 nt, Homo Sapiens
ggcuucaugcuggagaguaaaauuuggaauauaaugaguaugggaagauuuguau

SEQ ID NO: 106145 - RNA, 64 nt, Homo Sapiens
gauuaggagaaggcauaugacaguagagaggacuggaauauagaggagaauauaagcauguaga

SEQ ID NO: 106146 - RNA, 64 nt, Homo Sapiens
guuuguaaaaauauacugauuuugaaaaguaucaggaauauaaauauuugguaauucuguguaa

SEQ ID NO: 106147 - RNA, 64 nt, Homo Sapiens
ggcuuuuuccauggggcuauaguagagaguuaguggaauauagacaggacucugaaaacacaac

SEQ ID NO: 106148 - RNA, 64 nt, Homo Sapiens
uuauuuucauuaauucagugcaaaaaucugucguggaauauauuuaaaguuuucauuugugcca

SEQ ID NO: 106149 - RNA, 64 nt, Homo Sapiens
uaguauuauauguaucaggaaguauugagauaagggaauauaaaaauaggacauugaguuucca

SEQ ID NO: 106150 - RNA, 64 nt, Homo Sapiens
uauuuuauauauauauauauuauaaaauacauauggaauauauauggaauauauauauuauaua

SEQ ID NO: 106151 - RNA, 64 nt, Homo Sapiens
uauuauauauauaaaauacauauauaauauauauggaauauauaauauuauauauauuuuuaua

SEQ ID NO: 106152 - RNA, 64 nt, Homo Sapiens
cagaucacucaagaggcagcauagcaauguaaaaggaauauaaguagguguuggaugccuuuuu

SEQ ID NO: 106153 - RNA, 64 nt, Homo Sapiens
gguguuggaugccuuuuuccuagaccaggaauggggaauauauaacaccugugccaccgcucuu

SEQ ID NO: 106154 - RNA, 64 nt, Homo Sapiens
uauauuuucuuaaaaaauaccagcaguuacucauggaauauauucugcguuuauaaaacuaguu

SEQ ID NO: 106155 - RNA, 64 nt, Homo Sapiens
ucaauaauugaguaauuuuagaagcauuauuuuaggaauauauaguugucacaguaaauaucuu

SEQ ID NO: 106156 - RNA, 64 nt, Homo Sapiens
gccuauaauuauauauacauuccauagucaucaaggaauauauugugcagagagaguauccuug

SEQ ID NO: 106157 - RNA, 64 nt, Homo Sapiens
ugccuuuguuagguggagaagaaaugucucuagaggaauauaaauaccugauuucuugucaucg

SEQ ID NO: 106158 - RNA, 64 nt, Homo Sapiens
ccgaggggccucacuguuagaaggaaaacuaacaggaauauaaucaacaucaacaaaggacauc

SEQ ID NO: 106159 - RNA, 64 nt, Homo Sapiens
gauaaaacgaacaaaagaauuagaauuccugcggggaauauauacaagacuuuauuuagucaag

SEQ ID NO: 106160 - RNA, 64 nt, Homo Sapiens
ccacauguguauauauuccaacauguguguauguggaauauauuggaauauauacauauauucc

SEQ ID NO: 106161 - RNA, 64 nt, Homo Sapiens
ccacauguguguauguggaaacauguguguauguggaauauauucauauauauacauauauucc

SEQ ID NO: 106162 - RNA, 64 nt, Homo Sapiens
acaaaccaauaaaaauaccagcaaauggaaaaggggaauauaaaaagcacuucaaaacagaagg

SEQ ID NO: 106163 - RNA, 64 nt, Homo Sapiens
uauauuuuucuaugaaaagugucuuacaauucagggaauauauugcuguuaaaauuauuuuuuu

SEQ ID NO: 106164 - RNA, 64 nt, Homo Sapiens
aaggcuaaccaucgaaaagauagugguuaacagagcuaagaaauacuugaagcuaacguuagaa

SEQ ID NO: 106165 - RNA, 64 nt, Homo Sapiens
ucuauuuccaagaaccuauaugucauccauauuugcuaagaaugaaaauaaauuacaauugauc

SEQ ID NO: 106166 - RNA, 64 nt, Homo Sapiens
ugagcacauguagcuaauuuguaaggaggggcuugcuaagaauugugcuucucagugggaaggu

SEQ ID NO: 106167 - RNA, 64 nt, Homo Sapiens
gauuuggggaagguuauaauuuuuuccaguuaaugcuaagaaaacuaagcuuuuuuuuuuuuuu

SEQ ID NO: 106168 - RNA, 64 nt, Homo Sapiens
ccugacauugccauugagggcuuuguuaccacaagcuaagaaacugaguuuaacagcccaguua

SEQ ID NO: 106169 - RNA, 64 nt, Homo Sapiens
gacucugugacgacaaaaguacaaacagucugaggcuaagaaagguucaucucacaacaggaaa

SEQ ID NO: 106170 - RNA, 64 nt, Homo Sapiens
gcuaaaggagcauguucuaacccaaugcaaggaagcuaagaaccuugaaaaaagguuagaggaa

SEQ ID NO: 106171 - RNA, 64 nt, Homo Sapiens
cauacaauacacuaacauuaacaauagcugaugagcuaagaaaaaaaaaaagucugugcauagu

SEQ ID NO: 106172 - RNA, 64 nt, Homo Sapiens
uagaaauuugccuugcugcaugacaauggcagagucucuagaggaaaggcacuaaauccuuucc

SEQ ID NO: 106173 - RNA, 64 nt, Homo Sapiens
uggaagcugagauucagagaauuuucacuucuuuucucuagacucacaucccauggaggugagg

SEQ ID NO: 106174 - RNA, 64 nt, Homo Sapiens
agcauugaccccccugaaucuucuguguggcucuucucuagaggaugguuccuggaccccccag

SEQ ID NO: 106175 - RNA, 64 nt, Homo Sapiens
ugggaggauuguguguaaccaaucucaugauuugucucuagauguuccuagaauaagaggugag

SEQ ID NO: 106176 - RNA, 64 nt, Homo Sapiens
uucaaugucuuuguggacauuguuacuguaguauucucuagaacuccguuuucauugucaagaa

SEQ ID NO: 106177 - RNA, 64 nt, Homo Sapiens
guuuauccuaagcacuuguugccaauauuccauuucucuagaauguuuaauuuuuaagcucuuu

SEQ ID NO: 106178 - RNA, 64 nt, Homo Sapiens
uuggauucaaugagugggaaauacauugugccuuucucuagaugugauacguuauaccaaaauc

SEQ ID NO: 106179 - RNA, 64 nt, Homo Sapiens
aauaggaaucaauaguuaguagugacauuggugcucucuagaaaucucagcaugagcugcuaua

SEQ ID NO: 106180 - RNA, 64 nt, Homo Sapiens
cugucuccuuuccuacaagguuuaggaauagaugucucuagacuggccaugcaaccaggugauu

SEQ ID NO: 106181 - RNA, 64 nt, Homo Sapiens
aguuuuaugucauuuguaaacuuagaagccccuuucucuagagcugguuaggaaaacaaaacug

SEQ ID NO: 106182 - RNA, 64 nt, Homo Sapiens
agaauugcuaccucuuguauuaauuuugagaccaucucuagaaacaagugauuuugauguauuc

SEQ ID NO: 106183 - RNA, 64 nt, Homo Sapiens
ggagguuuucaaagugcauccagagcuguccucuucucuagaguugcugugggugcuaacaccu

SEQ ID NO: 106184 - RNA, 64 nt, Homo Sapiens
ccagcaggucacacugggggaugggcugaaguguucucuagaauguuggguuuucccuugccuu

SEQ ID NO: 106185 - RNA, 64 nt, Homo Sapiens
uuaguccuuacugucucacuaaggugugcaaagaucucuagaguacacggaccucgggcuaguu

SEQ ID NO: 106186 - RNA, 64 nt, Homo Sapiens
cccuggguucuguucugugugggccuguggggagucucuagacaagaucuuuuccaggcccuga

SEQ ID NO: 106187 - RNA, 64 nt, Homo Sapiens
ugggagaggaaucuaagaaccagauggcuucagcucucuagaggagcugagccuauucacagug

SEQ ID NO: 106188 - RNA, 64 nt, Homo Sapiens
uccagaacccagcccagaucggaggacaaguuccucucuagaacccaauccaauuuggagcccc

SEQ ID NO: 106189 - RNA, 64 nt, Homo Sapiens
uuggagccccagcccaacuccagaacccaacccuucucuagaauccagcccagaucugaggcca

SEQ ID NO: 106190 - RNA, 64 nt, Homo Sapiens
cccccagaucugucuggucugaauggacgcccagcucaucuaggguggacccagcugcugggga

SEQ ID NO: 106191 - RNA, 64 nt, Homo Sapiens
ccacuuuggcgagcguccugcuuccgcccucgcccucaucuacgcugcuccgcuuuccucagac

SEQ ID NO: 106192 - RNA, 64 nt, Homo Sapiens
guuuaacucacuaguuuauaaugguucacuggcucucaucuauucauucuggaauucucaucua

SEQ ID NO: 106193 - RNA, 64 nt, Homo Sapiens
gguucacuggcucucaucuaagcauucuggaauucucaucuaauccacccaagaaaauuuucuu

SEQ ID NO: 106194 - RNA, 64 nt, Homo Sapiens
uggaacccaagccucauauucaaaaaagaacaagcucaucuauuagaacugcacgguacaaacc

SEQ ID NO: 106195 - RNA, 64 nt, Homo Sapiens
accuuuggaguagguuuaccugcugccacacugucucaucuagugaaaucugggauguacuguu

SEQ ID NO: 106196 - RNA, 64 nt, Homo Sapiens
gcaccacugcacuccagccuucgaggcugcagucagucaugauggauugcuugagcccaggagu

SEQ ID NO: 106197 - RNA, 64 nt, Homo Sapiens
cccaagugaaaucaaagguggaacagacaacagaagucaugaagauuucuugguaagaagccgg

SEQ ID NO: 106198 - RNA, 64 nt, Homo Sapiens
uacucagcuauccauuauaguuuugcccuuaagaagucaugauuaacuuaugaaaaaauuauuu

SEQ ID NO: 106199 - RNA, 64 nt, Homo Sapiens
aaucaucugugaguuccuucagguucucacucauagucaugauccuucagagggaauaugcacu

SEQ ID NO: 106200 - RNA, 64 nt, Homo Sapiens
cugcguuagccgaucaggcuggaaaauguuccuaaaccaggaagugggggauugauacgaccgg

SEQ ID NO: 106201 - RNA, 64 nt, Homo Sapiens
cgcugggagagauggacucuuguaaguaaaggauaaccaggacucacugcccccgaggccagag

SEQ ID NO: 106202 - RNA, 64 nt, Homo Sapiens
auuuugagauacccugcuaucgauggucgcuacaaaccaggaaauacucaaguuauuaugugua

SEQ ID NO: 106203 - RNA, 64 nt, Homo Sapiens
uuucuguuguuuuaauuaguauuuguguaguucaaaccaggaaggauuugacuaucauuagauu

SEQ ID NO: 106204 - RNA, 64 nt, Homo Sapiens
gcagaggcugggggccuccacccagcagcagaccaaccaggaagcagcuugaacuggauggaga

SEQ ID NO: 106205 - RNA, 64 nt, Homo Sapiens
agguggggucacagugaauuucacauccccucucaaccaggaguggagggcuaggucccuuccc

SEQ ID NO: 106206 - RNA, 64 nt, Homo Sapiens
ggcaacaucuugcaaaacuacaauguagucucauaaccaggauauugacauugauacagugaag

SEQ ID NO: 106207 - RNA, 64 nt, Homo Sapiens
cccccacaccccagccgugucccuaaccccuggcaaccaggaauccacucuccauuucuauaau

SEQ ID NO: 106208 - RNA, 64 nt, Homo Sapiens
acucuacauuuucucugcacuuucaaugcccuguucuuccaaaccccuaucccaaguuuuauga

SEQ ID NO: 106209 - RNA, 64 nt, Homo Sapiens
ccauucucauuugauguucccuagaaccucccugucuuccaacugcaggauguguuuacuucuc

SEQ ID NO: 106210 - RNA, 64 nt, Homo Sapiens
aaaauaggagcuugguugaauucugagauuguggucuuccaaaauaggcuuccugcuaaaaagc

SEQ ID NO: 106211 - RNA, 64 nt, Homo Sapiens
gugcugguucugcuuuccaacagguaguucaacaucuuccaaguaccccaaaucuuagaucugc

SEQ ID NO: 106212 - RNA, 64 nt, Homo Sapiens
caagaggaaggaaugauaauccggcccaggcccaucuuccaaagacugcauuucuagacucucg

SEQ ID NO: 106213 - RNA, 64 nt, Homo Sapiens
uacagaucagacaugaaugggcuguuaaauaauaucuuccaauuacaaccaugauaagagcaag

SEQ ID NO: 106214 - RNA, 64 nt, Homo Sapiens
ucuguccauaccuacuucuaggauugcaaaggagucuuccaacuagagaaaaauuguccacuga

SEQ ID NO: 106215 - RNA, 64 nt, Homo Sapiens
aauuuaagagggaaauauaaccuauaaauuuguuucuuccaagcuuagcucuuaaauuuggaga

SEQ ID NO: 106216 - RNA, 64 nt, Homo Sapiens
gacagacuggacauuucccuguuucgagccaggcucuuccaaggggccagcuggguccccggag

SEQ ID NO: 106217 - RNA, 64 nt, Homo Sapiens
ccgaggcucccgguuccaagucccaucgugcuccucuuccaaugccacacugccucugagccca

SEQ ID NO: 106218 - RNA, 64 nt, Homo Sapiens
ucauguuucucacuguuccaggaaauugaucaacucuuccaaugggacauugaugaucacauuc

SEQ ID NO: 106219 - RNA, 64 nt, Homo Sapiens
ugugauacggaaacaauaaauuccugagauacauucuuccaaucugugguaauaauaagaauuc

SEQ ID NO: 106220 - RNA, 64 nt, Homo Sapiens
caacuacuaaaacuucccgccacccugcuauuucucuuccaauuacuguucaaacauuuuuggu

SEQ ID NO: 106221 - RNA, 64 nt, Homo Sapiens
auguauaaaauaagcuucugccuauuugcauuuaucuuccaaacccaaucuaguaggauguucu

SEQ ID NO: 106222 - RNA, 64 nt, Homo Sapiens
ccugccauuuaaaaaguuguagcagauuguuuccucuuccaaaguaaaauugcugugcuuuaug

SEQ ID NO: 106223 - RNA, 64 nt, Homo Sapiens
aacaugaacacccuuagaaaauguguccuaucuaucuuccaaaugcaauuugauugacugccca

SEQ ID NO: 106224 - RNA, 64 nt, Homo Sapiens
caguugagugauuuuaaggugaauuugcugauguucuuccaacucugaauccugaggccacugu

SEQ ID NO: 106225 - RNA, 64 nt, Homo Sapiens
gagggccucgcgcccauucgccuggguucuuuagucuuccaagguguagcuauuuauuaaaugc

SEQ ID NO: 106226 - RNA, 64 nt, Homo Sapiens
gccauccaucaucaguaggauucuuggaaauaugucuuccaaguccaauuucagccugccacga

SEQ ID NO: 106227 - RNA, 64 nt, Homo Sapiens
gaauuauuuugugugugugcauccuuccuaauuaucuuccaaagucugugaguauaggaauggu

SEQ ID NO: 106228 - RNA, 64 nt, Homo Sapiens
cccuuuggcaaagcccccauccacaccuggcacuccccucuaccaaucccuggcacaggguucc

SEQ ID NO: 106229 - RNA, 64 nt, Homo Sapiens
agccugacucccucggcccuuacccaccugucacccccucuacgcucuccuuccucgccagcac

SEQ ID NO: 106230 - RNA, 64 nt, Homo Sapiens
uugucugauguuagugaugcacauguguaacagcccccucuaaaagcgcaagccagucauaccc

SEQ ID NO: 106231 - RNA, 64 nt, Homo Sapiens
uccacaggggcuugggaugguuguggggggcuggccccucuagccuuuccgguccuuccugggc

SEQ ID NO: 106232 - RNA, 64 nt, Homo Sapiens
uauucuugcccucucuuuugaggcucucucauaaccccucuauuucuagagacaacaaaaaugc

SEQ ID NO: 106233 - RNA, 64 nt, Homo Sapiens
agaaguggggccugcaccauacaucuguguccgcccccucuaccccuuccccccacguagggca

SEQ ID NO: 106234 - RNA, 64 nt, Homo Sapiens
ggcuggcuguaagggagacucagucccagccucuccccucuacaacuccugccacuguuggcca

SEQ ID NO: 106235 - RNA, 64 nt, Homo Sapiens
cacacuugcccuuucucccucucuccagcacacuccccucuaagaaaguaaaagcaaagcuuuc

SEQ ID NO: 106236 - RNA, 64 nt, Homo Sapiens
agccuccaagccccacgccagugacgguaaacuuccccucuaccaaggccaagaggagacagcc

SEQ ID NO: 106237 - RNA, 64 nt, Homo Sapiens
gucccuuucacaccuugccucagcugccucugucccccucuacucuugugccccgugugcucag

SEQ ID NO: 106238 - RNA, 64 nt, Homo Sapiens
gaaugagaacugcaggaguuuccccagaguccugccccucuaauccaccugacccuaaauaggu

SEQ ID NO: 106239 - RNA, 64 nt, Homo Sapiens
gucauuuaacuaauagccaggagacaaaugaaccccccucuaaauuucaggauugggugagaca

SEQ ID NO: 106240 - RNA, 64 nt, Homo Sapiens
uagaguggggagcaugccagucuccauaccccagccccucuaacagcgcccggcugggacgguc

SEQ ID NO: 106241 - RNA, 64 nt, Homo Sapiens
gagggugugggggagcccugccucccccaagggcccccucuaagcccagccuuaaaacucacug

SEQ ID NO: 106242 - RNA, 64 nt, Homo Sapiens
cauagccccaucuauaauacaaauucuaaucuauccccucuaacucaccccacccugcuuuuaa

SEQ ID NO: 106243 - RNA, 64 nt, Homo Sapiens
uccccucuuucccuucugagguggauuacgcagaccccucuacuagggacugauaauuucauuu

SEQ ID NO: 106244 - RNA, 64 nt, Homo Sapiens
uggugccaggggcuggaggcgggugacucacuuuccccucuaggaagcccaggggcaaugguuu

SEQ ID NO: 106245 - RNA, 64 nt, Homo Sapiens
uauuucugaacuugguuaauauccagggagaucaccccucuaauucucacuuguuuuaguucug

SEQ ID NO: 106246 - RNA, 64 nt, Homo Sapiens
guugcacagccagaaggggccacagcuucuucugccccucuacuauuauuuagagccauuagag

SEQ ID NO: 106247 - RNA, 64 nt, Homo Sapiens
cucucuaggacugggcugaucccccacuuccacuccccucuacucucuuggcccagccugguuc

SEQ ID NO: 106248 - RNA, 64 nt, Homo Sapiens
auuugcagaguccugcacagugagcuccaugugcccccucuaccccuuguucucuaaguuccac

SEQ ID NO: 106249 - RNA, 64 nt, Homo Sapiens
gaguucuaaauaguuuaucuauuucauuaggagaccccucuauuuuuccuuuccagaaggcuug

SEQ ID NO: 106250 - RNA, 64 nt, Homo Sapiens
cuccgguggccuucaagguccuuuaugaguguuaccccucuacacguccacaccacucaccaca

SEQ ID NO: 106251 - RNA, 64 nt, Homo Sapiens
ucuucucugcucccaacccccaucucacagcaucccccucuauuuccaaugcuccucuccaacc

SEQ ID NO: 106252 - RNA, 64 nt, Homo Sapiens
cugcugggugggggccuguuucuguaacuuucucccccucuacugagaagugaccuggaaguga

SEQ ID NO: 106253 - RNA, 64 nt, Homo Sapiens
uguuaauaaucucacauauacaaguagcuucccuccccucuaguuuuuucuuccuuuucacugc

SEQ ID NO: 106254 - RNA, 64 nt, Homo Sapiens
uuccuuaacuggcaguugagcacauaguacauuuccccucuaccaaacggaacacuuggauucc

SEQ ID NO: 106255 - RNA, 64 nt, Homo Sapiens
caaacuacuaagcauuuaaagaaacuugcucugaccccucuaagaauuaaucuuuaagcuucaa

SEQ ID NO: 106256 - RNA, 64 nt, Homo Sapiens
caggacaugcacacacaagucccccugcagccuuccccucuacagguggguggcacagcagugc

SEQ ID NO: 106257 - RNA, 64 nt, Homo Sapiens
gguaugcuuguguaucauuuacuuacuuuuuuugccccucuaagguuauugcuuuuucgguggc

SEQ ID NO: 106258 - RNA, 64 nt, Homo Sapiens
gauaggaguuccccagcaaaaguagaggagacuuccccucuaggaaaugcacggcuugauaccc

SEQ ID NO: 106259 - RNA, 64 nt, Homo Sapiens
auugauucauugguacugccuuaaagauacaguaccccucuagcuuuguuuagucuuuauacug

SEQ ID NO: 106260 - RNA, 64 nt, Homo Sapiens
auacacagauuaggagaugaccuuacuggguacaccccucuaaccagugcuuacagguuaaugc

SEQ ID NO: 106261 - RNA, 64 nt, Homo Sapiens
gcaucccccugcccgacuccaaauggggcccuuuccccucuauuuccgaagacggagaggaggg

SEQ ID NO: 106262 - RNA, 64 nt, Homo Sapiens
cccugguaggcuuccucuucuaugcaagcuaaagccccucuauacuguucuggggcagggggaa

SEQ ID NO: 106263 - RNA, 64 nt, Homo Sapiens
cccuguaaauacuggaucaaugagcacagcuugaccccucuagcuguggcagcugccucugggc

SEQ ID NO: 106264 - RNA, 64 nt, Homo Sapiens
ugcucuccuuuuucuuucuuccucucuuaacuuuccccucuauuuucuuaagaaaguuaagcac

SEQ ID NO: 106265 - RNA, 64 nt, Homo Sapiens
cuugucuaaaaguucuguguuugcagaaccuuuuccccucuacugaguacuuuacugugaggaa

SEQ ID NO: 106266 - RNA, 64 nt, Homo Sapiens
gaugcuuauccuuucaucugugugauuguuuuuuccccucuacuaacaagauccucccagcuuu

SEQ ID NO: 106267 - RNA, 64 nt, Homo Sapiens
uccugcucacccacgcccacgcugugccuggaucccccucuagcaucuggcaaacagccccugg

SEQ ID NO: 106268 - RNA, 64 nt, Homo Sapiens
gaacgcuuuguaaauacaugaccuuaaagacagaccccucuaaauuuuucucgucacacaggua

SEQ ID NO: 106269 - RNA, 64 nt, Homo Sapiens
ugcccaugugcucauuuuucuaaacagguguauuccccucuacuaugaaaaucacauaguauga

SEQ ID NO: 106270 - RNA, 64 nt, Homo Sapiens
augugucacugagaaauuuuguaguuuguuugguccccucuaguaaauauguacuuaugcuuua

SEQ ID NO: 106271 - RNA, 64 nt, Homo Sapiens
uuacacuacacacuguguacugcaguugguaugaccccucuaaggaguguagcaacuacagucu

SEQ ID NO: 106272 - RNA, 64 nt, Homo Sapiens
cuagaggucuaagucccccaccccuuuccccacuccccucuaguggugaacuuuagaggaaaag

SEQ ID NO: 106273 - RNA, 64 nt, Homo Sapiens
ggauggcugguuuagucuggguccaugucccagaccccucuauucugcuccaggacagcaggac

SEQ ID NO: 106274 - RNA, 64 nt, Homo Sapiens
cccaccaaacagaaaaagugaaggcuggguuuuuccccucuaaucuggagacaagcugcugcuc

SEQ ID NO: 106275 - RNA, 64 nt, Homo Sapiens
gagagggcauggccugagucugguauuuuguuuuccccucuaauugugggguucuugcuuugug

SEQ ID NO: 106276 - RNA, 64 nt, Homo Sapiens
ucaguaccuggaaaauuuccaagcucucuuaagaccccucuaaguucucaccucccuuccccaa

SEQ ID NO: 106277 - RNA, 64 nt, Homo Sapiens
acuuccugagagaccgaacccccucaccugaaucccccucuaucaaacaaacaaaaaagcagca

SEQ ID NO: 106278 - RNA, 64 nt, Homo Sapiens
ggccaccaucccagcuuccggcucccucuucuccccccucuacccgccaccccaccccacccca

SEQ ID NO: 106279 - RNA, 64 nt, Homo Sapiens
ucauuaucaucauuauuauugcucuccacuguauccccucuaccuggcaugugcuugucaaguu

SEQ ID NO: 106280 - RNA, 64 nt, Homo Sapiens
ucauuaucaucacuauuauugcucaccacuguauccccucuacuuggcaagugguugucaaguu

SEQ ID NO: 106281 - RNA, 64 nt, Homo Sapiens
cugcugacccuuccguacuccuggacccccuugaccccucuauuucuguuggcuaaggccagcc

SEQ ID NO: 106282 - RNA, 64 nt, Homo Sapiens
gcugugacacuucuucaucucacccccccccgccccccucuaggagagcuggcucugcaguggg

SEQ ID NO: 106283 - RNA, 64 nt, Homo Sapiens
ucuacgcacaugggucauaacucgcaugucgagcccccucuagugaaggguaggagagcucagc

SEQ ID NO: 106284 - RNA, 64 nt, Homo Sapiens
guagguuuuaaauuaaaaguguuaucaaaaguuuccccucuauuguaauacauuauuaaguggc

SEQ ID NO: 106285 - RNA, 64 nt, Homo Sapiens
guuuaagaaugaaucucuuacaccucuacuuuugccccucuacuguauauuaagcccauaggcu

SEQ ID NO: 106286 - RNA, 64 nt, Homo Sapiens
guaccggagugaccccggcagccacugcccaccuccccucuacccaggggccugaaaagagggg

SEQ ID NO: 106287 - RNA, 64 nt, Homo Sapiens
uauacaucauacuuaacuuugagggugagcugguccccucuauaagccuucagcacuaaccuau

SEQ ID NO: 106288 - RNA, 64 nt, Homo Sapiens
uauccauauguuuucauaauuucaguguguuguuccccucuaugaccuccacccucaaguagga

SEQ ID NO: 106289 - RNA, 64 nt, Homo Sapiens
ccacauuggccaguggacucuguggucuucucuaccccucuacccccaguggagucucuuccua

SEQ ID NO: 106290 - RNA, 64 nt, Homo Sapiens
uauaugggaaccagaauagagaauacacaaauuuccccucuaauacagaaaagggagcuaaauu

SEQ ID NO: 106291 - RNA, 64 nt, Homo Sapiens
ccuguuucugagaguggaucauucuuuuucuuuuccccucuaaauccuccuugaagcucccagu

SEQ ID NO: 106292 - RNA, 64 nt, Homo Sapiens
ugcgcguugugccuggcugugcucucuuuuaugcccccucuauucuccucucucccccagggga

SEQ ID NO: 106293 - RNA, 64 nt, Homo Sapiens
gauucccauaucccuccucuucuuugcauauuucccccucuaauuagcauguugcauuagcaug

SEQ ID NO: 106294 - RNA, 64 nt, Homo Sapiens
cauauguguuguacacuguggugcccuguccaguccccucuaccaagcugagacccccaucccc

SEQ ID NO: 106295 - RNA, 64 nt, Homo Sapiens
gagaucucgacccuggggagcugagcuggugaagccccucuaaauuguugucugauauuugcca

SEQ ID NO: 106296 - RNA, 64 nt, Homo Sapiens
ccaugcacauaguaagucugugcauuaugaaguuccccucuacuuucacaggccagaaaacaua

SEQ ID NO: 106297 - RNA, 64 nt, Homo Sapiens
auuuaguuucuucugcgcaacucucccuccccuaccccucuauccugucauggccccaugugau

SEQ ID NO: 106298 - RNA, 64 nt, Homo Sapiens
ccuucucccaucucuuucaacuccuuccccuucuccccucuaaaguuugcccccugcccuccca

SEQ ID NO: 106299 - RNA, 64 nt, Homo Sapiens
ggagggcuaguucuauacuuuugagguuugugggccccucuagaucggagcuuccuauuccaug

SEQ ID NO: 106300 - RNA, 64 nt, Homo Sapiens
uuuagccuuccacccaaacucaagugagugaguuccccucuacuuucacuuaaauaucauuucu

SEQ ID NO: 106301 - RNA, 64 nt, Homo Sapiens
ccuuaccccaggacuuggucuucaaccaccauuaccccucuaacuuugcacaaauaaaccugug

SEQ ID NO: 106302 - RNA, 64 nt, Homo Sapiens
cuuggauaucacguccucugggaagucuucuuuuccccucuaaccuaggacccucauuaccggc

SEQ ID NO: 106303 - RNA, 64 nt, Homo Sapiens
ggaaggaugccuuuacucuucccugugaauucccccccucuaugcaucugauauaauuaguguu

SEQ ID NO: 106304 - RNA, 64 nt, Homo Sapiens
uucccugauuuccccaggccuuagaggacccuacccccucuagauuuuuuucauuauaaaaugg

SEQ ID NO: 106305 - RNA, 64 nt, Homo Sapiens
ucugagaggcugccacugcugucacccagggagcccccucuaugacaagggggucucuggagau

SEQ ID NO: 106306 - RNA, 64 nt, Homo Sapiens
ugggaggccaaaugggugagcagaacccacccugccccucuaccggggucuaguauguagcuuc

SEQ ID NO: 106307 - RNA, 64 nt, Homo Sapiens
ugucuccccuagucccccaggagcucuuuccuuuccccucuaguuuugggugugcauguuugga

SEQ ID NO: 106308 - RNA, 64 nt, Homo Sapiens
acaguucuuugcauuuggcucuacuuacuaacaaccccucuagaauacauuggugauuucauuu

SEQ ID NO: 106309 - RNA, 64 nt, Homo Sapiens
augagucgauaaauguuguccuacuuaaccuggcccccucuaacuuuuuauccuuaauguuaau

SEQ ID NO: 106310 - RNA, 64 nt, Homo Sapiens
ucaguagcccccaggccugauggccuggccccucccccucuaccgcccacaagggggauuagag

SEQ ID NO: 106311 - RNA, 64 nt, Homo Sapiens
aggugaugauaggguuucuauaagaaauucacuuccccucuaggacucuugcaacuaaaaaaau

SEQ ID NO: 106312 - RNA, 64 nt, Homo Sapiens
caggucaccuugucaggaucugggcagcggcuucccccucuagccccuccccugccuagagcuc

SEQ ID NO: 106313 - RNA, 64 nt, Homo Sapiens
guugggguguacuaguuacacaucuucaacagacccccucuagaaauuuuucagaugcuucugg

SEQ ID NO: 106314 - RNA, 64 nt, Homo Sapiens
gagcagcagcuguggucauuaaaccauuaguuuaccccucuagaacuggggucugcaaacuccc

SEQ ID NO: 106315 - RNA, 64 nt, Homo Sapiens
gcaaaucuugcuacuggcucuagaucugcgguuuccccucuacccugccucccgucuccccaga

SEQ ID NO: 106316 - RNA, 64 nt, Homo Sapiens
ugacugguucauagggcuuuaauuauacaauuuaccccucuaauuaguacuauauguaugugac

SEQ ID NO: 106317 - RNA, 55 nt, Homo Sapiens
agaagccacgggaucccggccagagccccucuaggagggggaagagacuaaauaa

SEQ ID NO: 106318 - RNA, 64 nt, Homo Sapiens
cacacgcgcacuuccaucuccaggccuuugcucuccccucuaggguugagagcguggagcccuc

SEQ ID NO: 106319 - RNA, 64 nt, Homo Sapiens
accauuccuccaccugaugagucccccacccuauccccucuaacgagaagccaagaacuugugu

SEQ ID NO: 106320 - RNA, 64 nt, Homo Sapiens
gugccugguagacaagugcuuuuuccucaucacuccccucuacaaccuccuaagcaguccuggc

SEQ ID NO: 106321 - RNA, 64 nt, Homo Sapiens
gccgccacacggucaccugcaaggacgucacgggccccucuaaaggauucguggugcucauccc

SEQ ID NO: 106322 - RNA, 64 nt, Homo Sapiens
cauguaccaagcuaaauagcaauucauuucuccuccccucuacccuuaccaaaacucccacuuu

SEQ ID NO: 106323 - RNA, 64 nt, Homo Sapiens
cagcaugucugccagcggaaacuucucgagcuccccccucuaccccgccccaccuugcagcuaa

SEQ ID NO: 106324 - RNA, 64 nt, Homo Sapiens
uccucacagagcccuaacaucacuuccacaucucccccucuauauuauccccgcccuucuuucu

SEQ ID NO: 106325 - RNA, 64 nt, Homo Sapiens
gaggcagcaacggagaguggugagcccuucccuuccccucuaagcaggggaugggagggguccc

SEQ ID NO: 106326 - RNA, 64 nt, Homo Sapiens
ccgcuguaucgcauauugcucucuguuuacaucuccccucuaccucagggugcuguccccuccc

SEQ ID NO: 106327 - RNA, 64 nt, Homo Sapiens
aaacagaguugcuguuguuuucauuugguguuuuccccucuagauuacuaccauuugaauauuu

SEQ ID NO: 106328 - RNA, 64 nt, Homo Sapiens
cuggagcuguuaacagaaucgcagcacacuccguccccucuaguaguagagaagagaauggaaa

SEQ ID NO: 106329 - RNA, 64 nt, Homo Sapiens
guuaaagucaauacaagaaaccagggacgacuguccccucuaaacaguaaaucuacuucuuuuu

SEQ ID NO: 106330 - RNA, 64 nt, Homo Sapiens
uagaacacagaaaauaaaaccaagacuggaagguccccucuaccccucccaggcccagagcuag

SEQ ID NO: 106331 - RNA, 64 nt, Homo Sapiens
agaacauuuacacauucucacaauuguaaaguuuccccucuauuuuggugaccaauacuacugu

SEQ ID NO: 106332 - RNA, 64 nt, Homo Sapiens
cucccagucuuuaucugaaggcccagccaaagcaccccucuaaaccggucaccuaggggaaaug

SEQ ID NO: 106333 - RNA, 64 nt, Homo Sapiens
aucuaguguugcugcgagugaccucacuucagagccccucuagcagaguggggcggaaguccug

SEQ ID NO: 106334 - RNA, 64 nt, Homo Sapiens
gcaaaaugaagaccuacuuucaacuccuuuuuccccccucuagaagaaucaaauugaaucuuuu

SEQ ID NO: 106335 - RNA, 64 nt, Homo Sapiens
cuuuagccuuuaguaggagcucaaauuguuggggccccucuaccucucucagggcuagaacugc

SEQ ID NO: 106336 - RNA, 64 nt, Homo Sapiens
ggcgacgaggagaucuaagcagcguucccacagcccccucuagauucuuggaguuccgcagagc

SEQ ID NO: 106337 - RNA, 64 nt, Homo Sapiens
ucucggaggggcgaucaugaucccagacacacaaccccucuagcaaagugucuuaauccuuugu

SEQ ID NO: 106338 - RNA, 64 nt, Homo Sapiens
aacccuucuaaacggugaccuuuagugccaacuuccccucuaacuggacagccucuucuguccc

SEQ ID NO: 106339 - RNA, 64 nt, Homo Sapiens
acccccacccggaaccuccccuugccuaacauuuccccucuaugguaacaucucugacuucucu

SEQ ID NO: 106340 - RNA, 64 nt, Homo Sapiens
uacaaaaaaaaacaaagcuccagggaauuuuuucccccucuaugucucccuggaacgggaggga

SEQ ID NO: 106341 - RNA, 64 nt, Homo Sapiens
ccucuuucccccuucugcgccuagcguuccucuuccccucuaguuuccuggagccccaacacau

SEQ ID NO: 106342 - RNA, 64 nt, Homo Sapiens
caccuccgugcugucacugccaucuccccccugaccccucuaacccauccucugccucccuccc

SEQ ID NO: 106343 - RNA, 64 nt, Homo Sapiens
aauaugggguuggguaguguggguggcaggccauccccucuaaucuuggaaccucugaauaugg

SEQ ID NO: 106344 - RNA, 64 nt, Homo Sapiens
cugucaucagaccuuuggcaccauaugcuuagguccccucuaugaugucucaucaauaaccuua

SEQ ID NO: 106345 - RNA, 64 nt, Homo Sapiens
gaaaccugacauuuacaauggguggccucucaccccccucuagagccugagguguccgcugacg

SEQ ID NO: 106346 - RNA, 64 nt, Homo Sapiens
cucacugcuugaauuuggugagaggauuggcuguccccucuaucggaaauccuuagcccucccu

SEQ ID NO: 106347 - RNA, 64 nt, Homo Sapiens
cuacauuagcauauuucucacccuaacaguccuaccccucuagcauuguccuuuucccuccugc

SEQ ID NO: 106348 - RNA, 64 nt, Homo Sapiens
cauccaacucccucuucacuggccagauuuaaggccccucuacuuucuccugggacuuagaggu

SEQ ID NO: 106349 - RNA, 64 nt, Homo Sapiens
uuuccagccgaaggaaaaucacuuccguuaugucccccucuaauuuagccgcucgacauuuuac

SEQ ID NO: 106350 - RNA, 64 nt, Homo Sapiens
gacagcgcuagauuucguguacaaaaccuguguaccccucuauauauauguuacauagaaugua

SEQ ID NO: 106351 - RNA, 64 nt, Homo Sapiens
uagaaaaaggaugucuuuuuuuuuuuuuuuacucccccucuaaacacugcugcugccuuaauuu

SEQ ID NO: 106352 - RNA, 64 nt, Homo Sapiens
aaauaacugacccucccuuccuguccgcccucuuccccucuaaugcucacgcucccaacacaag

SEQ ID NO: 106353 - RNA, 64 nt, Homo Sapiens
caccucccuucuccuccuguguuuaaguggauggccccucuauccauccaggucccaugccaag

SEQ ID NO: 106354 - RNA, 64 nt, Homo Sapiens
ccaacucuuccaggccccaccucccugcaccccuccccucuauagagcaggggagugaaggggu

SEQ ID NO: 106355 - RNA, 64 nt, Homo Sapiens
uucuguuuugccugaaguuggagugaguguggcuccccucuauuuagcaugacaagccccaggc

SEQ ID NO: 106356 - RNA, 64 nt, Homo Sapiens
ccuaagauagcuggaugaaucaggaaaaccauguccccucuagguauuauuaauauaagcagga

SEQ ID NO: 106357 - RNA, 64 nt, Homo Sapiens
gagauucagaaggcaccucuucggucaaacauggccccucuauaaccccacuauucuucuccua

SEQ ID NO: 106358 - RNA, 64 nt, Homo Sapiens
aaaucuuaguuccauggaauuuuaagcauuguucccccucuaaccugugucuaaagaauuaaaa

SEQ ID NO: 106359 - RNA, 64 nt, Homo Sapiens
uauuucccuuccacagugugucugcugcccuggaccccucuauuugcgcccugggggccugggc

SEQ ID NO: 106360 - RNA, 64 nt, Homo Sapiens
ccaguuugccucccuuacccuugccuccuccuagccccucuaguggcugcucugguccccagca

SEQ ID NO: 106361 - RNA, 64 nt, Homo Sapiens
ucugggcagccaugaccugccucaccugcugcugccccucuaggugccccaggaagcccacagc

SEQ ID NO: 106362 - RNA, 64 nt, Homo Sapiens
uccuggagcugaacugggguucgagagugggcagccccucuaccggccucccagcaucugggac

SEQ ID NO: 106363 - RNA, 64 nt, Homo Sapiens
gcuauguggcuucaaccagccacacacacacacgccccucuacucacacacacacacacacaca

SEQ ID NO: 106364 - RNA, 64 nt, Homo Sapiens
gcuguccugguacccgucccacuggcccaucccuccccucuaguuccugugcuguagcaccuuc

SEQ ID NO: 106365 - RNA, 64 nt, Homo Sapiens
guagcugguggccagggaugggguuggggcccagccccucuagacugugugugagaggucuccu

SEQ ID NO: 106366 - RNA, 64 nt, Homo Sapiens
gccgaagaaggguccuuccccaggguucuccucuccccucuaaggggacugggagggcccacuu

SEQ ID NO: 106367 - RNA, 64 nt, Homo Sapiens
gacaggggcgcugcugcagaccgugcgcuccucaccccucuacagucuugcccacccccgaucc

SEQ ID NO: 106368 - RNA, 64 nt, Homo Sapiens
accucgcccuccacaaauggcagccucccccuguccccucuaugaauacacagugcugaccaga

SEQ ID NO: 106369 - RNA, 64 nt, Homo Sapiens
ccacuuucaaaacuacauuuggcagaggagcuaaccccucuacugcccaacggggacacaagga

SEQ ID NO: 106370 - RNA, 64 nt, Homo Sapiens
uaagaucgccucccccuacgccgucuuggcuuuuccccucuacuuccaguccuuagguuagaug

SEQ ID NO: 106371 - RNA, 64 nt, Homo Sapiens
ggaaaaacagaaacaacccucccccccauuuuuuccccucuauucaucaaaccuuuauguaucu

SEQ ID NO: 106372 - RNA, 64 nt, Homo Sapiens
uucaggauauaauucuuaacagccuuauauuaggccccucuauuuauagucacacuuuaaauua

SEQ ID NO: 106373 - RNA, 64 nt, Homo Sapiens
aggcaccaaucaggagaaggguucugccucccauccccucuaccugcagacagggucggaggug

SEQ ID NO: 106374 - RNA, 64 nt, Homo Sapiens
ggacaagcugcucuggcaggacucacguuacagaccccucuaccccuucagccugcccuacagc

SEQ ID NO: 106375 - RNA, 64 nt, Homo Sapiens
agcuccagccccccucugguuugcugccuccucuccccucuaaaaaagucuuccgcuugauuuu

SEQ ID NO: 106376 - RNA, 61 nt, Homo Sapiens
acgaaccugugggacccuagccaggcgccccccccucuaaggguccucuggccccacggac

SEQ ID NO: 106377 - RNA, 64 nt, Homo Sapiens
uuccagucuacuugaguuagcauaauacagaaguccccucuacuuuaacuuuuacaaaaaagua

SEQ ID NO: 106378 - RNA, 64 nt, Homo Sapiens
cuuuguaaugugcugguucucuuuuuuuuucuuuccccucuauggcccuuaagacuuucauuuu

SEQ ID NO: 106379 - RNA, 64 nt, Homo Sapiens
gaugguguccugaggccuccaaggacgguccccaccccucuacguuuccccaauaaagccuuuu

SEQ ID NO: 106380 - RNA, 64 nt, Homo Sapiens
ccucacccugagagcaccccagggacaggcucuuccccucuauccucccagcccgcaguauuuc

SEQ ID NO: 106381 - RNA, 64 nt, Homo Sapiens
agugacccuagugacuucccccuugggucauuggccccucuagggguaccuccccuacagcagc

SEQ ID NO: 106382 - RNA, 64 nt, Homo Sapiens
uguauccuuuauaauaaacuccggcaccgccccgccccucuaguuuucgggcgcagccaucuug

SEQ ID NO: 106383 - RNA, 64 nt, Homo Sapiens
guaaaugugccuuagccuaacucggauuuccuggccccucuacuugcagcguuggaacgugagc

SEQ ID NO: 106384 - RNA, 64 nt, Homo Sapiens
uucaugggcgagcacccccagguaacagggcacaccccucuaguagaguccccugcaguuucug

SEQ ID NO: 106385 - RNA, 64 nt, Homo Sapiens
cauuccucccgccccagccaucucccucuccucaccccucuauccucuuuucugugucaguuuc

SEQ ID NO: 106386 - RNA, 64 nt, Homo Sapiens
aagccacuccaagagccagcaggggauggcccucccccucuaccacugcccaccccaagucccc

SEQ ID NO: 106387 - RNA, 64 nt, Homo Sapiens
aacauauuggcugucaucaagagaguuggagaaaccccucuagaaccuaaggcccuggguucaa

SEQ ID NO: 106388 - RNA, 64 nt, Homo Sapiens
gagaauagucaggccuaucagucucacagaaucaccccucuaccuuugauauuccacuuagcug

SEQ ID NO: 106389 - RNA, 64 nt, Homo Sapiens
aggccuuuugacucuuuuaucugaguuuuauugaccccucuaauucucuuacccagaauauuua

SEQ ID NO: 106390 - RNA, 64 nt, Homo Sapiens
ccccagugccacagagaagaauagccuguagugcccccucuaacgccccucuuuucccacauuc

SEQ ID NO: 106391 - RNA, 64 nt, Homo Sapiens
caugagaaguaaagcugagacaucgucaccacacccccucuauucacuuucaucauuauuuaua

SEQ ID NO: 106392 - RNA, 64 nt, Homo Sapiens
cuuggacaguggagagaaucuguaaaagugugacccccucuaagauuucguuuuaaaugaucag

SEQ ID NO: 106393 - RNA, 64 nt, Homo Sapiens
ucgcggccucuucucucagaccgucuuccuccaaccccucuauguagugccgcucuuggggaca

SEQ ID NO: 106394 - RNA, 64 nt, Homo Sapiens
cccccagcaggccugguuccacccugggcagcacccccucuaguucuaauaaagccgccucugu

SEQ ID NO: 106395 - RNA, 64 nt, Homo Sapiens
gaccaaaaaaauacagagucauccccuacccccaccccucuagagacccuccagcuaaaaacag

SEQ ID NO: 106396 - RNA, 64 nt, Homo Sapiens
ccuccgcaggccucuugccuugguccugaaccggccccucuauccccuuucccagagccccugg

SEQ ID NO: 106397 - RNA, 64 nt, Homo Sapiens
uuauuuuucuugaaaacauuuauaauugaaaaggccccucuauugcaaaggaagcucugccuuu

SEQ ID NO: 106398 - RNA, 64 nt, Homo Sapiens
uccuccaggcugggagacaggggagcugggcagaccccucuaccagaagugcacuuuaagaggu

SEQ ID NO: 106399 - RNA, 64 nt, Homo Sapiens
ccuugccccaccuccaucaacuuugggcaaaggcccccucuaggcuuacuaguguuuggcucac

SEQ ID NO: 106400 - RNA, 64 nt, Homo Sapiens
cacccauucccaccccccagucccacacugaaauccccucuaguugugaagaacagacccuggg

SEQ ID NO: 106401 - RNA, 64 nt, Homo Sapiens
ugcugcucugggccuccccaacagagugcccacuccccucuacugagccuaugggagucccggg

SEQ ID NO: 106402 - RNA, 64 nt, Homo Sapiens
uuuccuguucagcauguacuccccucauccgauuccccucuaucagucacugacaguuaauaaa

SEQ ID NO: 106403 - RNA, 64 nt, Homo Sapiens
uuuccuguucagcauguacuccccucauccgauuccccucuaucagucacugacaguuaacaaa

SEQ ID NO: 106404 - RNA, 64 nt, Homo Sapiens
gcuaacuguauuuauugugaugccuuggucagggccccucuacccacuucucccagucaguugu

SEQ ID NO: 106405 - RNA, 64 nt, Homo Sapiens
ggcuauccgaauucucugaaaaaauaauaaaaguccccucuauuauaugagccuguacagaaau

SEQ ID NO: 106406 - RNA, 64 nt, Homo Sapiens
uuuuuuccucuacugacuucucuccauacucuuuccccucuauuucuuuguaugacugucauag

SEQ ID NO: 106407 - RNA, 64 nt, Homo Sapiens
uucucaccuauccacacaacauauccguauauauccccucuacucuuacuucccccaaauuuaa

SEQ ID NO: 106408 - RNA, 64 nt, Homo Sapiens
agucacugccaguuaauaaaccccucauccgauuccccucuaucuuuccuguucagcauguacu

SEQ ID NO: 106409 - RNA, 64 nt, Homo Sapiens
cuuccuggaggucacauuuagagaagugggugauccccucuagggucauauguacuuugaauuu

SEQ ID NO: 106410 - RNA, 64 nt, Homo Sapiens
acauacagcccugucacauuagcacuacagcauaccccucuacauccagguuaggaaaggauuc

SEQ ID NO: 106411 - RNA, 64 nt, Homo Sapiens
guuccccuaucauaagagcuguugaggcuggguuccccucuauuaaaacuaccuucugacuugg

SEQ ID NO: 106412 - RNA, 64 nt, Homo Sapiens
agugcacacacacgcacacauaagaauaacugugccccucuaagaaauugaucagucaguagug

SEQ ID NO: 106413 - RNA, 64 nt, Homo Sapiens
agcugugugcuggauuauucccagaacaaaagggccccucuaguuucugguccaacuuguacau

SEQ ID NO: 106414 - RNA, 64 nt, Homo Sapiens
aagcugugacccucaauucagauucuccuuuuuaccccucuacccuccccuucgcguauuucag

SEQ ID NO: 106415 - RNA, 64 nt, Homo Sapiens
agcggagccuggacugacacuccagcagucguucccagcagaaccuaacagaggaaacaaaugg

SEQ ID NO: 106416 - RNA, 64 nt, Homo Sapiens
cugcucccacccuccucccauggagacugggggcccagcagagcucuccaccacagccaaggcc

SEQ ID NO: 106417 - RNA, 64 nt, Homo Sapiens
cuggcccagggacaggaggaagcagacccugacuccagcagauuaccuggacucgccucuaccc

SEQ ID NO: 106418 - RNA, 64 nt, Homo Sapiens
cugacuccagcagauucuggggacucgccucuacccagcagaccaaccacuacagucaguaccu

SEQ ID NO: 106419 - RNA, 64 nt, Homo Sapiens
aacuccauacuguucauuguugaagucuuaacugccagcagaaauguaagauugauucugauuc

SEQ ID NO: 106420 - RNA, 64 nt, Homo Sapiens
uguuguauaaccuugauuaacacucuacucagucccagcagagcagucaagauaucuggguucu

SEQ ID NO: 106421 - RNA, 64 nt, Homo Sapiens
gguggcaugcccaguggcuucuaauugcugucucccagcagacucuugguuuuaagcugucuac

SEQ ID NO: 106422 - RNA, 64 nt, Homo Sapiens
ccagauuggauguuccagcuuugcaguuaaagcuccagcagaaacuuccaugaacagaucguca

SEQ ID NO: 106423 - RNA, 64 nt, Homo Sapiens
accgcugggucugcggccuaagggaccucccucgccagcagagguccauuccguucccagcugc

SEQ ID NO: 106424 - RNA, 64 nt, Homo Sapiens
ugcuucugggcccagcuaaggaagccaucuguucccagcagaggagagcugcugcgcugaccug

SEQ ID NO: 106425 - RNA, 64 nt, Homo Sapiens
gagaugggcaggagagucaaagggcuugcuugccccagcagaguucccagcagacagccauggc

SEQ ID NO: 106426 - RNA, 64 nt, Homo Sapiens
agagucaaagggcuugcuugccccagcagaguucccagcagacagccauggcucuucccagcag

SEQ ID NO: 106427 - RNA, 64 nt, Homo Sapiens
gccauggcucuucccagcagccccagcagaguucccagcagacaagagucaaagggcuugcuug

SEQ ID NO: 106428 - RNA, 64 nt, Homo Sapiens
ucccagcagacagccauggcagggcuugcuugccccagcagagugagaugggcaggagagucaa

SEQ ID NO: 106429 - RNA, 64 nt, Homo Sapiens
ccggaagggaagggacaccaaggaucuccggccaccagcagaagccagcagagaggcaugggac

SEQ ID NO: 106430 - RNA, 64 nt, Homo Sapiens
agggacaccaaggaucuccggccaccagcagaagccagcagagaggcaugggacagguucccca

SEQ ID NO: 106431 - RNA, 64 nt, Homo Sapiens
ugaagugugcugugacaagcugcguuucauguagccagcagaacuaagaauagaaaacugggua

SEQ ID NO: 106432 - RNA, 64 nt, Homo Sapiens
accuguucaggcaggcuuucucacccuagcuauaccagcagaaacuagacaguuagagacucug

SEQ ID NO: 106433 - RNA, 64 nt, Homo Sapiens
acugagggaggaaaugagcgaguucccucugacaccagcagauccccaggggcugcugggcagu

SEQ ID NO: 106434 - RNA, 64 nt, Homo Sapiens
guccuggggggcugggacgcccaagaucaagaggccagcagauucggacuccgcugagggcugu

SEQ ID NO: 106435 - RNA, 64 nt, Homo Sapiens
aucuuuaagcuaaguuacuaaaacucugaggccaccagcagaucggcacucucuggcuaaaaac

SEQ ID NO: 106436 - RNA, 64 nt, Homo Sapiens
ccugggcucgccuggagacacaugugaagagucaccagcagauucggcaguucucaaacuuuag

SEQ ID NO: 106437 - RNA, 64 nt, Homo Sapiens
gcaaugcaaacugagcugcucucucccgcccuuaccagcagaaaguggcggucaccaccaccac

SEQ ID NO: 106438 - RNA, 64 nt, Homo Sapiens
cuauccuguuggugugcccugagguugugcaugaccagcagauaaaauggcccgacagcauucu

SEQ ID NO: 106439 - RNA, 64 nt, Homo Sapiens
aagucuggucgcaguggcaaagccagcaccauggccagcagagcggugagcagcacucccacca

SEQ ID NO: 106440 - RNA, 64 nt, Homo Sapiens
ggccccuguggucugcuuguccuucagcccaugcccagcagauaccucucugacuggagacggg

SEQ ID NO: 106441 - RNA, 64 nt, Homo Sapiens
gcaaacauccuagauagccaugucaguuucccagccagcagauugcaacaucacaucaguccuc

SEQ ID NO: 106442 - RNA, 64 nt, Homo Sapiens
uuguuacucgcuuugggggaucacuguggcuucuccagcagaauaauagauucucaacgagauu

SEQ ID NO: 106443 - RNA, 64 nt, Homo Sapiens
uggugugagagggacagcucgccauggagggugcccagcagacggguucacaaggcuuggaccu

SEQ ID NO: 106444 - RNA, 64 nt, Homo Sapiens
ugguaugagagggauggcucgccguggagggugcccagcagacgggcucaugaggcuuggaccu

SEQ ID NO: 106445 - RNA, 64 nt, Homo Sapiens
uggugugagagggacggcuccugguggagggugcccagcagacgacggcucacgagacuuggac

SEQ ID NO: 106446 - RNA, 64 nt, Homo Sapiens
uggugugagaggaacggcucgcuguggagggugcccagcagacgggcucacgaggcuuggaccu

SEQ ID NO: 106447 - RNA, 64 nt, Homo Sapiens
ucaccuguguaggccccuguagugacccacgcguccagcagacgcccacccaccgcuagccguu

SEQ ID NO: 106448 - RNA, 64 nt, Homo Sapiens
cuguccugugcgggccauagggcagggcccugucccagcagaugggcuugggagggggcucccu

SEQ ID NO: 106449 - RNA, 64 nt, Homo Sapiens; identical to SEQ ID NO: 81180

SEQ ID NO: 106450 - RNA, 64 nt, Homo Sapiens; identical to SEQ ID NO: 81181

SEQ ID NO: 106451 - RNA, 64 nt, Homo Sapiens; identical to SEQ ID NO: 81204

SEQ ID NO: 106452 - RNA, 64 nt, Homo Sapiens; identical to SEQ ID NO: 81205

SEQ ID NO: 106453 - RNA, 64 nt, Homo Sapiens; identical to SEQ ID NO: 81232

SEQ ID NO: 106454 - RNA, 64 nt, Homo Sapiens; identical to SEQ ID NO: 81233

SEQ ID NO: 106455 - RNA, 64 nt, Homo Sapiens; identical to SEQ ID NO: 81241

SEQ ID NO: 106456 - RNA, 64 nt, Homo Sapiens; identical to SEQ ID NO: 81242

SEQ ID NO: 106457 - RNA, 64 nt, Homo Sapiens; identical to SEQ ID NO: 81294

SEQ ID NO: 106458 - RNA, 64 nt, Homo Sapiens; identical to SEQ ID NO: 81295

SEQ ID NO: 106459 - RNA, 64 nt, Homo Sapiens; identical to SEQ ID NO: 81311

SEQ ID NO: 106460 - RNA, 64 nt, Homo Sapiens; identical to SEQ ID NO: 81312

SEQ ID NO: 106461 - RNA, 64 nt, Homo Sapiens; identical to SEQ ID NO: 81313

SEQ ID NO: 106462 - RNA, 64 nt, Homo Sapiens; identical to SEQ ID NO: 81314

SEQ ID NO: 106463 - RNA, 64 nt, Homo Sapiens; identical to SEQ ID NO: 81315

SEQ ID NO: 106464 - RNA, 64 nt, Homo Sapiens; identical to SEQ ID NO: 81413

SEQ ID NO: 106465 - RNA, 64 nt, Homo Sapiens; identical to SEQ ID NO: 81414

SEQ ID NO: 106466 - RNA, 64 nt, Homo Sapiens; identical to SEQ ID NO: 81424

SEQ ID NO: 106467 - RNA, 64 nt, Homo Sapiens; identical to SEQ ID NO: 81425

SEQ ID NO: 106468 - RNA, 64 nt, Homo Sapiens; identical to SEQ ID NO: 81444

SEQ ID NO: 106469 - RNA, 64 nt, Homo Sapiens; identical to SEQ ID NO: 81445

SEQ ID NO: 106470 - RNA, 64 nt, Homo Sapiens; identical to SEQ ID NO: 81449

SEQ ID NO: 106471 - RNA, 64 nt, Homo Sapiens; identical to SEQ ID NO: 81450

SEQ ID NO: 106472 - RNA, 64 nt, Homo Sapiens; identical to SEQ ID NO: 81554

SEQ ID NO: 106473 - RNA, 64 nt, Homo Sapiens; identical to SEQ ID NO: 81555

SEQ ID NO: 106474 - RNA, 64 nt, Homo Sapiens; identical to SEQ ID NO: 81577

SEQ ID NO: 106475 - RNA, 64 nt, Homo Sapiens; identical to SEQ ID NO: 81578

SEQ ID NO: 106476 - RNA, 64 nt, Homo Sapiens
ugggcgcucaaggacgucugcugcugcagcugaagcucaugaugacagcggcgucuucuccuuc

SEQ ID NO: 106477 - RNA, 64 nt, Homo Sapiens
cgcuccaucacggcaccgcucugacgcugcccgugcucaugaagcugugcagcugagcgaguug

SEQ ID NO: 106478 - RNA, 64 nt, Homo Sapiens
uaauaagugguggucccaggagggacuuuucaugaucacacagcaacugaggcacagagagguu

SEQ ID NO: 106479 - RNA, 64 nt, Homo Sapiens
gaaacccguaggcacggacaaaagcacaaccccaaucacacacaagagaggcagaugugugcaa

SEQ ID NO: 106480 - RNA, 64 nt, Homo Sapiens
agcguuuugaccagaugcgaccacagggguacccaucacacaccgugccagcagcagcugcccg

SEQ ID NO: 106481 - RNA, 64 nt, Homo Sapiens
ucuccgcggagcagaagcggccgagaaccggcguaucacacacacaacucucugcuccccgaga

SEQ ID NO: 106482 - RNA, 64 nt, Homo Sapiens
cagacuguugugucuguggaagaauugccugaagaucacacauugguuugggugggacaaaguu

SEQ ID NO: 106483 - RNA, 64 nt, Homo Sapiens
acaauagggucuaugucauaggcagauggguuagaucacacauauauggacaggcugggacaga

SEQ ID NO: 106484 - RNA, 64 nt, Homo Sapiens
cacccuccccgccacagagagacacagacacaaaaucacacacauacacagacacacacagaaa

SEQ ID NO: 106485 - RNA, 64 nt, Homo Sapiens
cacccuccccgccacagagacacacagacacaaaaucacacacacagacacacacagaaagaca

SEQ ID NO: 106486 - RNA, 64 nt, Homo Sapiens
cccccuccccaccacagagacguccccaccucaaaucacacacaaguaacugaagccuaggccc

SEQ ID NO: 106487 - RNA, 64 nt, Homo Sapiens
ccaggccuaccugggagagggugagguucagcacaucacacaccauccccacugucauucaggg

SEQ ID NO: 106488 - RNA, 64 nt, Homo Sapiens
cuccaucucacuggcucugagggcaggacaggguaucacacauuucucaccaggccuccuuucc

SEQ ID NO: 106489 - RNA, 64 nt, Homo Sapiens
caaacaaauauugccaacucuucuauuuauggauaucacacauaucagcaggaguaauaaauuu

SEQ ID NO: 106490 - RNA, 64 nt, Homo Sapiens
uucuuaaggauaauuuuccucaaucacacuacacaucacacaagauuugacuguaauauuuaaa

SEQ ID NO: 106491 - RNA, 64 nt, Homo Sapiens
gaacucagaacccaagucugaucaggagaaaaacaucacacaaauuccaauugagaagcauucu

SEQ ID NO: 106492 - RNA, 64 nt, Homo Sapiens
acaacaaaaaaagaaguuaaauaacuuguuuaagaucacacagcuagugcaguuacccccucuc

SEQ ID NO: 106493 - RNA, 64 nt, Homo Sapiens
ggacugaugauauuugaauguuuauuaaauuauuaucacacaaauguguugauauuguggcuau

SEQ ID NO: 106494 - RNA, 64 nt, Homo Sapiens
uacaaagagccucugccuucccaaacuaauauuuaucacacauggucauuaaaugggaaaaaaa

SEQ ID NO: 106495 - RNA, 64 nt, Homo Sapiens
uauagucugaaucuuaggaagaagguaaaagaaaggaggcaagagaauaguuaugaugaauaug

SEQ ID NO: 106496 - RNA, 64 nt, Homo Sapiens
uuaugaugaauauguguuaagugccugcucugaaggaggcaauguucuucucauuugaauccuu
